United States Patent 10,706,955 (BIOINFORMATIC PROCESSES FOR DETERMINATION OF PEPTIDE BINDING) - sequence listing, part 25

SEQ ID NO: 960648 - protein, 4 aa, Mycobacterium
GQVN

SEQ ID NO: 960649 - protein, 9 aa, Mycobacterium
GQVNGPKLA

SEQ ID NO: 960650 - protein, 4 aa, Mycobacterium
GRAA

SEQ ID NO: 960651 - protein, 6 aa, Mycobacterium
GRAASN

SEQ ID NO: 960652 - protein, 6 aa, Mycobacterium
GRADDN

SEQ ID NO: 960653 - protein, 11 aa, Mycobacterium
GRAPDPDAPAQ

SEQ ID NO: 960654 - protein, 12 aa, Mycobacterium
GRAPIQPSGELP

SEQ ID NO: 960655 - protein, 71 aa, Mycobacterium; identical to SEQ ID NO: 262682

SEQ ID NO: 960656 - protein, 7 aa, Mycobacterium
GRARSTG

SEQ ID NO: 960657 - protein, 7 aa, Mycobacterium
GRASNPH

SEQ ID NO: 960658 - protein, 5 aa, Mycobacterium
GRASQ

SEQ ID NO: 960659 - protein, 8 aa, Mycobacterium
GRATGSGH

SEQ ID NO: 960660 - protein, 4 aa, Mycobacterium
GRDK

SEQ ID NO: 960661 - protein, 4 aa, Mycobacterium
GRDV

SEQ ID NO: 960662 - protein, 4 aa, Mycobacterium
GREA

SEQ ID NO: 960663 - protein, 25 aa, Mycobacterium
GREGRTEVPTGPLADPVNGQPRSAA

SEQ ID NO: 960664 - protein, 6 aa, Mycobacterium
GREPEL

SEQ ID NO: 960665 - protein, 10 aa, Mycobacterium
GREPPPGLSA

SEQ ID NO: 960666 - protein, 6 aa, Mycobacterium
GRFDPR

SEQ ID NO: 960667 - protein, 8 aa, Mycobacterium
GRFPGGDR

SEQ ID NO: 960668 - protein, 4 aa, Mycobacterium
GRGA

SEQ ID NO: 960669 - protein, 9 aa, Mycobacterium
GRGDSDPRV

SEQ ID NO: 960670 - protein, 5 aa, Mycobacterium
GRGEC

SEQ ID NO: 960671 - protein, 4 aa, Mycobacterium
GRGG

SEQ ID NO: 960672 - protein, 7 aa, Mycobacterium
GRGGAPA

SEQ ID NO: 960673 - protein, 8 aa, Mycobacterium
GRGPDGTQ

SEQ ID NO: 960674 - protein, 16 aa, Mycobacterium
GRHKSELSSAKDRATL

SEQ ID NO: 960675 - protein, 5 aa, Mycobacterium
GRIPD

SEQ ID NO: 960676 - protein, 6 aa, Mycobacterium
GRIPGT

SEQ ID NO: 960677 - protein, 13 aa, Mycobacterium
GRITAEEAHSHPQ

SEQ ID NO: 960678 - protein, 9 aa, Mycobacterium
GRKAYDEEL

SEQ ID NO: 960679 - protein, 8 aa, Mycobacterium
GRKIQGSA

SEQ ID NO: 960680 - protein, 8 aa, Mycobacterium
GRKQDNPA

SEQ ID NO: 960681 - protein, 8 aa, Mycobacterium
GRNQRPVI

SEQ ID NO: 960682 - protein, 9 aa, Mycobacterium
GRNSLSAAA

SEQ ID NO: 960683 - protein, 10 aa, Mycobacterium
GRPDDGPSPR

SEQ ID NO: 960684 - protein, 10 aa, Mycobacterium
GRPNPHSHNP

SEQ ID NO: 960685 - protein, 9 aa, Mycobacterium
GRPPNRAVS

SEQ ID NO: 960686 - protein, 19 aa, Mycobacterium
GRPRPAPRRASSAERSRAI

SEQ ID NO: 960687 - protein, 13 aa, Mycobacterium
GRPSPEDIDPEAG

SEQ ID NO: 960688 - protein, 4 aa, Mycobacterium
GRPT

SEQ ID NO: 960689 - protein, 8 aa, Mycobacterium
GRPTNATL

SEQ ID NO: 960690 - protein, 5 aa, Mycobacterium
GRQDT

SEQ ID NO: 960691 - protein, 9 aa, Mycobacterium
GRQGRDGMS

SEQ ID NO: 960692 - protein, 11 aa, Mycobacterium
GRQPTPEDERN

SEQ ID NO: 960693 - protein, 6 aa, Mycobacterium
GRQRGE

SEQ ID NO: 960694 - protein, 7 aa, Mycobacterium
GRQRGIP

SEQ ID NO: 960695 - protein, 4 aa, Mycobacterium
GRRA

SEQ ID NO: 960696 - protein, 7 aa, Mycobacterium
GRREDGS

SEQ ID NO: 960697 - protein, 11 aa, Mycobacterium
GRRENAAARAR

SEQ ID NO: 960698 - protein, 11 aa, Mycobacterium
GRSAGVPAGDR

SEQ ID NO: 960699 - protein, 8 aa, Mycobacterium
GRSGAARR

SEQ ID NO: 960700 - protein, 9 aa, Mycobacterium
GRSGALSRS

SEQ ID NO: 960701 - protein, 5 aa, Mycobacterium
GRSGR

SEQ ID NO: 960702 - protein, 9 aa, Mycobacterium
GRSGSGKTT

SEQ ID NO: 960703 - protein, 10 aa, Mycobacterium
GRSGTEVAKD

SEQ ID NO: 960704 - protein, 7 aa, Mycobacterium
GRSPQRL

SEQ ID NO: 960705 - protein, 9 aa, Mycobacterium
GRSTETYLA

SEQ ID NO: 960706 - protein, 7 aa, Mycobacterium
GRSTQTV

SEQ ID NO: 960707 - protein, 12 aa, Mycobacterium
GRSTSTTPEDTV

SEQ ID NO: 960708 - protein, 8 aa, Mycobacterium
GRTAPTQL

SEQ ID NO: 960709 - protein, 7 aa, Mycobacterium
GRTASRS

SEQ ID NO: 960710 - protein, 4 aa, Mycobacterium
GRTE

SEQ ID NO: 960711 - protein, 6 aa, Mycobacterium
GRTGGH

SEQ ID NO: 960712 - protein, 5 aa, Mycobacterium
GRTGT

SEQ ID NO: 960713 - protein, 10 aa, Mycobacterium
GRTNYRNPAT

SEQ ID NO: 960714 - protein, 7 aa, Mycobacterium
GRTPPEK

SEQ ID NO: 960715 - protein, 6 aa, Mycobacterium
GRTPYR

SEQ ID NO: 960716 - protein, 5 aa, Mycobacterium
GRTRD

SEQ ID NO: 960717 - protein, 11 aa, Mycobacterium
GRTTGSGETQT

SEQ ID NO: 960718 - protein, 7 aa, Mycobacterium
GRTTTAT

SEQ ID NO: 960719 - protein, 6 aa, Mycobacterium
GRVGRS

SEQ ID NO: 960720 - protein, 14 aa, Mycobacterium
GRVPGDGPEQAARP

SEQ ID NO: 960721 - protein, 17 aa, Mycobacterium
GRYVSDNGGTPAAGDTT

SEQ ID NO: 960722 - protein, 5 aa, Mycobacterium
GSAAR

SEQ ID NO: 960723 - protein, 7 aa, Mycobacterium
GSAASAT

SEQ ID NO: 960724 - protein, 6 aa, Mycobacterium
GSAATI

SEQ ID NO: 960725 - protein, 13 aa, Mycobacterium
GSADEIAAAVENP

SEQ ID NO: 960726 - protein, 8 aa, Mycobacterium
GSADGDVA

SEQ ID NO: 960727 - protein, 10 aa, Mycobacterium
GSAPHNSPAP

SEQ ID NO: 960728 - protein, 20 aa, Mycobacterium
GSAPRALGAEPQQQAPPTAP

SEQ ID NO: 960729 - protein, 8 aa, Mycobacterium
GSAPSFTA

SEQ ID NO: 960730 - protein, 6 aa, Mycobacterium
GSAPTQ

SEQ ID NO: 960731 - protein, 14 aa, Mycobacterium
GSARPLTEDEPMPS

SEQ ID NO: 960732 - protein, 4 aa, Mycobacterium
GSAS

SEQ ID NO: 960733 - protein, 17 aa, Mycobacterium
GSASSPNSAPFADPGNP

SEQ ID NO: 960734 - protein, 12 aa, Mycobacterium
GSATGSRAPMDA

SEQ ID NO: 960735 - protein, 5 aa, Mycobacterium
GSATQ

SEQ ID NO: 960736 - protein, 7 aa, Mycobacterium
GSDPASV

SEQ ID NO: 960737 - protein, 7 aa, Mycobacterium
GSDPESV

SEQ ID NO: 960738 - protein, 5 aa, Mycobacterium
GSDSK

SEQ ID NO: 960739 - protein, 5 aa, Mycobacterium
GSESE

SEQ ID NO: 960740 - protein, 8 aa, Mycobacterium
GSETAPLQ

SEQ ID NO: 960741 - protein, 6 aa, Mycobacterium
GSFGGE

SEQ ID NO: 960742 - protein, 18 aa, Mycobacterium
GSFTPRHASSSAQTPTPH

SEQ ID NO: 960743 - protein, 8 aa, Mycobacterium
GSGASATV

SEQ ID NO: 960744 - protein, 7 aa, Mycobacterium
GSGATRV

SEQ ID NO: 960745 - protein, 5 aa, Mycobacterium
GSGDH

SEQ ID NO: 960746 - protein, 7 aa, Mycobacterium
GSGDPTR

SEQ ID NO: 960747 - protein, 21 aa, Mycobacterium
GSGDRFEKTTGTLAPRAAVPT

SEQ ID NO: 960748 - protein, 25 aa, Mycobacterium
GSGDWGPSLGPTVGGRSGAKAPAVT

SEQ ID NO: 960749 - protein, 7 aa, Mycobacterium
GSGKSQT

SEQ ID NO: 960750 - protein, 6 aa, Mycobacterium
GSGMNP

SEQ ID NO: 960751 - protein, 6 aa, Mycobacterium
GSGPGF

SEQ ID NO: 960752 - protein, 7 aa, Mycobacterium
GSGPIES

SEQ ID NO: 960753 - protein, 6 aa, Mycobacterium
GSGPLT

SEQ ID NO: 960754 - protein, 7 aa, Mycobacterium
GSGRTSG

SEQ ID NO: 960755 - protein, 6 aa, Mycobacterium
GSGTTL

SEQ ID NO: 960756 - protein, 6 aa, Mycobacterium
GSGTTP

SEQ ID NO: 960757 - protein, 10 aa, Mycobacterium
GSGVGKPGAE

SEQ ID NO: 960758 - protein, 4 aa, Mycobacterium
GSGW

SEQ ID NO: 960759 - protein, 5 aa, Mycobacterium
GSHNS

SEQ ID NO: 960760 - protein, 8 aa, Mycobacterium
GSIEERAA

SEQ ID NO: 960761 - protein, 10 aa, Mycobacterium
GSIEGKAAVP

SEQ ID NO: 960762 - protein, 10 aa, Mycobacterium
GSKSAALSPD

SEQ ID NO: 960763 - protein, 6 aa, Mycobacterium
GSKVTY

SEQ ID NO: 960764 - protein, 12 aa, Mycobacterium
GSLGTPPQSYNG

SEQ ID NO: 960765 - protein, 6 aa, Mycobacterium
GSLTGS

SEQ ID NO: 960766 - protein, 9 aa, Mycobacterium
GSMSPEDSH

SEQ ID NO: 960767 - protein, 6 aa, Mycobacterium
GSNDIA

SEQ ID NO: 960768 - protein, 4 aa, Mycobacterium
GSPE

SEQ ID NO: 960769 - protein, 14 aa, Mycobacterium
GSPEAEGHQHGHQC

SEQ ID NO: 960770 - protein, 10 aa, Mycobacterium
GSPENAAGTV

SEQ ID NO: 960771 - protein, 14 aa, Mycobacterium
GSPEPSGHRATALG

SEQ ID NO: 960772 - protein, 9 aa, Mycobacterium
GSPESPELR

SEQ ID NO: 960773 - protein, 7 aa, Mycobacterium
GSPFSTP

SEQ ID NO: 960774 - protein, 14 aa, Mycobacterium
GSPGLGNYAAANTA

SEQ ID NO: 960775 - protein, 8 aa, Mycobacterium
GSPMSNTT

SEQ ID NO: 960776 - protein, 5 aa, Mycobacterium
GSPPR

SEQ ID NO: 960777 - protein, 9 aa, Mycobacterium
GSPPYRADS

SEQ ID NO: 960778 - protein, 8 aa, Mycobacterium
GSPPYRGD

SEQ ID NO: 960779 - protein, 13 aa, Mycobacterium
GSPPYRSDSAGTL

SEQ ID NO: 960780 - protein, 4 aa, Mycobacterium
GSPS

SEQ ID NO: 960781 - protein, 10 aa, Mycobacterium
GSPTDAGTPI

SEQ ID NO: 960782 - protein, 7 aa, Mycobacterium
GSQAPAA

SEQ ID NO: 960783 - protein, 8 aa, Mycobacterium
GSRADAWG

SEQ ID NO: 960784 - protein, 5 aa, Mycobacterium
GSRAT

SEQ ID NO: 960785 - protein, 5 aa, Mycobacterium
GSRDL

SEQ ID NO: 960786 - protein, 13 aa, Mycobacterium
GSRIERNNTRIGQ

SEQ ID NO: 960787 - protein, 8 aa, Mycobacterium
GSRQGVTR

SEQ ID NO: 960788 - protein, 7 aa, Mycobacterium
GSRRRGA

SEQ ID NO: 960789 - protein, 6 aa, Mycobacterium
GSRSEM

SEQ ID NO: 960790 - protein, 5 aa, Mycobacterium
GSSAD

SEQ ID NO: 960791 - protein, 8 aa, Mycobacterium
GSSADPQA

SEQ ID NO: 960792 - protein, 5 aa, Mycobacterium
GSSAR

SEQ ID NO: 960793 - protein, 6 aa, Mycobacterium
GSSARA

SEQ ID NO: 960794 - protein, 17 aa, Mycobacterium
GSSCGPTDHIGASGLIF

SEQ ID NO: 960795 - protein, 8 aa, Mycobacterium
GSSGGPFA

SEQ ID NO: 960796 - protein, 9 aa, Mycobacterium
GSSKPYGYK

SEQ ID NO: 960797 - protein, 10 aa, Mycobacterium
GSSKPYGYKG

SEQ ID NO: 960798 - protein, 15 aa, Mycobacterium
GSSMPASGQTLVAPV

SEQ ID NO: 960799 - protein, 9 aa, Mycobacterium
GSSNSPISG

SEQ ID NO: 960800 - protein, 13 aa, Mycobacterium
GSSQFEEPTGSIA

SEQ ID NO: 960801 - protein, 6 aa, Mycobacterium
GSSVSG

SEQ ID NO: 960802 - protein, 13 aa, Mycobacterium
GSTDTGHEAADQP

SEQ ID NO: 960803 - protein, 6 aa, Mycobacterium
GSTEAG

SEQ ID NO: 960804 - protein, 19 aa, Mycobacterium
GSTESSEQQGPGYDDGEGQ

SEQ ID NO: 960805 - protein, 4 aa, Mycobacterium
GSTF

SEQ ID NO: 960806 - protein, 5 aa, Mycobacterium
GSTGA

SEQ ID NO: 960807 - protein, 8 aa, Mycobacterium
GSTGAPKG

SEQ ID NO: 960808 - protein, 9 aa, Mycobacterium
GSTGTPKGV

SEQ ID NO: 960809 - protein, 9 aa, Mycobacterium
GSVSEHPGM

SEQ ID NO: 960810 - protein, 4 aa, Mycobacterium
GSVT

SEQ ID NO: 960811 - protein, 10 aa, Mycobacterium
GSVTRGLDES

SEQ ID NO: 960812 - protein, 27 aa, Mycobacterium
GSYATPDATAATPKRISSPPDGPAERY

SEQ ID NO: 960813 - protein, 6 aa, Mycobacterium
GTAAAG

SEQ ID NO: 960814 - protein, 17 aa, Mycobacterium
GTAASPDQKDAVRSAAT

SEQ ID NO: 960815 - protein, 6 aa, Mycobacterium
GTAGEN

SEQ ID NO: 960816 - protein, 5 aa, Mycobacterium
GTANG

SEQ ID NO: 960817 - protein, 6 aa, Mycobacterium
GTAPGL

SEQ ID NO: 960818 - protein, 8 aa, Mycobacterium
GTASRRRR

SEQ ID NO: 960819 - protein, 4 aa, Mycobacterium
GTAT

SEQ ID NO: 960820 - protein, 7 aa, Mycobacterium
GTATTGR

SEQ ID NO: 960821 - protein, 11 aa, Mycobacterium
GTATTLGDPIE

SEQ ID NO: 960822 - protein, 8 aa, Mycobacterium
GTDETVQQ

SEQ ID NO: 960823 - protein, 9 aa, Mycobacterium
GTDLPTDEQ

SEQ ID NO: 960824 - protein, 5 aa, Mycobacterium
GTDNI

SEQ ID NO: 960825 - protein, 9 aa, Mycobacterium
GTDPDEANR

SEQ ID NO: 960826 - protein, 9 aa, Mycobacterium
GTDPDQATW

SEQ ID NO: 960827 - protein, 12 aa, Mycobacterium
GTDQEQAAATLG

SEQ ID NO: 960828 - protein, 6 aa, Mycobacterium
GTDRHN

SEQ ID NO: 960829 - protein, 9 aa, Mycobacterium
GTDSGQSRR

SEQ ID NO: 960830 - protein, 18 aa, Mycobacterium
GTEDLSASVGSTHPPGTP

SEQ ID NO: 960831 - protein, 4 aa, Mycobacterium
GTEP

SEQ ID NO: 960832 - protein, 7 aa, Mycobacterium
GTERTDH

SEQ ID NO: 960833 - protein, 11 aa, Mycobacterium
GTGANPKPVRE

SEQ ID NO: 960834 - protein, 8 aa, Mycobacterium
GTGDPEIH

SEQ ID NO: 960835 - protein, 30 aa, Mycobacterium
GTGDRKPGGPVNCPAEDDPERELEPEPAHG

SEQ ID NO: 960836 - protein, 4 aa, Mycobacterium
GTGG

SEQ ID NO: 960837 - protein, 5 aa, Mycobacterium
GTGGV

SEQ ID NO: 960838 - protein, 6 aa, Mycobacterium
GTGKVV

SEQ ID NO: 960839 - protein, 5 aa, Mycobacterium
GTGPA

SEQ ID NO: 960840 - protein, 6 aa, Mycobacterium
GTGPST

SEQ ID NO: 960841 - protein, 6 aa, Mycobacterium
GTGPTA

SEQ ID NO: 960842 - protein, 5 aa, Mycobacterium
GTGSG

SEQ ID NO: 960843 - protein, 9 aa, Mycobacterium
GTGSPASRA

SEQ ID NO: 960844 - protein, 4 aa, Mycobacterium
GTGT

SEQ ID NO: 960845 - protein, 5 aa, Mycobacterium
GTGTD

SEQ ID NO: 960846 - protein, 9 aa, Mycobacterium
GTGTKNPDA

SEQ ID NO: 960847 - protein, 8 aa, Mycobacterium
GTHGQTPS

SEQ ID NO: 960848 - protein, 6 aa, Mycobacterium
GTIDAS

SEQ ID NO: 960849 - protein, 15 aa, Mycobacterium
GTKAAAEDRRRGTGP

SEQ ID NO: 960850 - protein, 4 aa, Mycobacterium
GTKY

SEQ ID NO: 960851 - protein, 11 aa, Mycobacterium
GTLETQRRPLG

SEQ ID NO: 960852 - protein, 15 aa, Mycobacterium
GTLTVTGAGKSTTLR

SEQ ID NO: 960853 - protein, 11 aa, Mycobacterium
GTNPPANQTSA

SEQ ID NO: 960854 - protein, 7 aa, Mycobacterium
GTPDLTG

SEQ ID NO: 960855 - protein, 11 aa, Mycobacterium
GTPDYGAPARL

SEQ ID NO: 960856 - protein, 6 aa, Mycobacterium
GTPEAA

SEQ ID NO: 960857 - protein, 4 aa, Mycobacterium
GTPG

SEQ ID NO: 960858 - protein, 9 aa, Mycobacterium
GTPPYRADS

SEQ ID NO: 960859 - protein, 14 aa, Mycobacterium
GTPSYLPSAADYPE

SEQ ID NO: 960860 - protein, 9 aa, Mycobacterium
GTPTSADFD

SEQ ID NO: 960861 - protein, 8 aa, Mycobacterium
GTPTSSRV

SEQ ID NO: 960862 - protein, 8 aa, Mycobacterium
GTSEAELN

SEQ ID NO: 960863 - protein, 21 aa, Mycobacterium
GTSNNKPVNTTVPAPSPEPIT

SEQ ID NO: 960864 - protein, 14 aa, Mycobacterium
GTSQKLTEKYNQDL

SEQ ID NO: 960865 - protein, 14 aa, Mycobacterium
GTTARSARHYGAGD

SEQ ID NO: 960866 - protein, 6 aa, Mycobacterium
GTTASD

SEQ ID NO: 960867 - protein, 19 aa, Mycobacterium
GTTDGKSRSAISQLTIRAA

SEQ ID NO: 960868 - protein, 15 aa, Mycobacterium
GTTGESPTTTDDEKR

SEQ ID NO: 960869 - protein, 7 aa, Mycobacterium
GTTGIPK

SEQ ID NO: 960870 - protein, 6 aa, Mycobacterium
GTTGLP

SEQ ID NO: 960871 - protein, 8 aa, Mycobacterium
GTTGRTKL

SEQ ID NO: 960872 - protein, 18 aa, Mycobacterium
GTTGTPKGANRSTPPTLA

SEQ ID NO: 960873 - protein, 6 aa, Mycobacterium
GTTIAP

SEQ ID NO: 960874 - protein, 18 aa, Mycobacterium
GTTKGESRNAISDITLRA

SEQ ID NO: 960875 - protein, 32 aa, Mycobacterium
GTTKQHGRRELAEREGPRELRSPDGPRQLPPG

SEQ ID NO: 960876 - protein, 4 aa, Mycobacterium
GTVE

SEQ ID NO: 960877 - protein, 8 aa, Mycobacterium
GTVPQPAT

SEQ ID NO: 960878 - protein, 6 aa, Mycobacterium
GTVTSG

SEQ ID NO: 960879 - protein, 12 aa, Mycobacterium
GTVTSTNGDRIE

SEQ ID NO: 960880 - protein, 13 aa, Mycobacterium
GTVVSDGPAPLDQ

SEQ ID NO: 960881 - protein, 4 aa, Mycobacterium
GTYP

SEQ ID NO: 960882 - protein, 5 aa, Mycobacterium
GVAAG

SEQ ID NO: 960883 - protein, 13 aa, Mycobacterium
GVAAGTTGTARTA

SEQ ID NO: 960884 - protein, 6 aa, Mycobacterium
GVAAPP

SEQ ID NO: 960885 - protein, 10 aa, Mycobacterium
GVAAPRSARV

SEQ ID NO: 960886 - protein, 7 aa, Mycobacterium
GVADGPD

SEQ ID NO: 960887 - protein, 9 aa, Mycobacterium
GVAGNPTEY

SEQ ID NO: 960888 - protein, 7 aa, Mycobacterium
GVANTST

SEQ ID NO: 960889 - protein, 5 aa, Mycobacterium
GVARG

SEQ ID NO: 960890 - protein, 13 aa, Mycobacterium
GVEGDKPGQTADG

SEQ ID NO: 960891 - protein, 10 aa, Mycobacterium
GVEPTATGVE

SEQ ID NO: 960892 - protein, 14 aa, Mycobacterium
GVFSPSRAKIPQRT

SEQ ID NO: 960893 - protein, 8 aa, Mycobacterium
GVGDQPAV

SEQ ID NO: 960894 - protein, 10 aa, Mycobacterium
GVGGGNYSAS

SEQ ID NO: 960895 - protein, 4 aa, Mycobacterium
GVGH

SEQ ID NO: 960896 - protein, 10 aa, Mycobacterium
GVGKGPERIP

SEQ ID NO: 960897 - protein, 14 aa, Mycobacterium
GVGLSSAPKAVSAY

SEQ ID NO: 960898 - protein, 4 aa, Mycobacterium
GVGR

SEQ ID NO: 960899 - protein, 7 aa, Mycobacterium
GVGRGDR

SEQ ID NO: 960900 - protein, 8 aa, Mycobacterium
GVHPNDAG

SEQ ID NO: 960901 - protein, 6 aa, Mycobacterium
GVNDAA

SEQ ID NO: 960902 - protein, 7 aa, Mycobacterium
GVNDAAA

SEQ ID NO: 960903 - protein, 7 aa, Mycobacterium
GVNDAPA

SEQ ID NO: 960904 - protein, 8 aa, Mycobacterium
GVNKPSMP

SEQ ID NO: 960905 - protein, 6 aa, Mycobacterium
GVPAHD

SEQ ID NO: 960906 - protein, 18 aa, Mycobacterium
GVPAPPPPPPEAPPPAET

SEQ ID NO: 960907 - protein, 7 aa, Mycobacterium
GVPDHGP

SEQ ID NO: 960908 - protein, 11 aa, Mycobacterium
GVPEPESEPEA

SEQ ID NO: 960909 - protein, 13 aa, Mycobacterium
GVPGRGPETRTAN

SEQ ID NO: 960910 - protein, 5 aa, Mycobacterium
GVPGV

SEQ ID NO: 960911 - protein, 6 aa, Mycobacterium
GVPGVG

SEQ ID NO: 960912 - protein, 7 aa, Mycobacterium
GVPPSPL

SEQ ID NO: 960913 - protein, 11 aa, Mycobacterium
GVPRDDEPPLD

SEQ ID NO: 960914 - protein, 10 aa, Mycobacterium
GVQAQEPRHS

SEQ ID NO: 960915 - protein, 18 aa, Mycobacterium
GVQPGPRLPNVDAGGDFV

SEQ ID NO: 960916 - protein, 9 aa, Mycobacterium
GVRSYDDDG

SEQ ID NO: 960917 - protein, 9 aa, Mycobacterium
GVRTGPDRG

SEQ ID NO: 960918 - protein, 7 aa, Mycobacterium
GVSAGDG

SEQ ID NO: 960919 - protein, 4 aa, Mycobacterium
GVSE

SEQ ID NO: 960920 - protein, 7 aa, Mycobacterium
GVSEAAG

SEQ ID NO: 960921 - protein, 6 aa, Mycobacterium
GVSPTQ

SEQ ID NO: 960922 - protein, 5 aa, Mycobacterium
GVSPY

SEQ ID NO: 960923 - protein, 5 aa, Mycobacterium
GVSTG

SEQ ID NO: 960924 - protein, 7 aa, Mycobacterium
GVSTPRL

SEQ ID NO: 960925 - protein, 8 aa, Mycobacterium
GVTPGRPR

SEQ ID NO: 960926 - protein, 11 aa, Mycobacterium
GVTPPSSSVTS

SEQ ID NO: 960927 - protein, 14 aa, Mycobacterium
GWKPGSRAVAAPTL

SEQ ID NO: 960928 - protein, 6 aa, Mycobacterium
GWPTTA

SEQ ID NO: 960929 - protein, 9 aa, Mycobacterium
GWSSAGSDP

SEQ ID NO: 960930 - protein, 4 aa, Mycobacterium
GYAG

SEQ ID NO: 960931 - protein, 16 aa, Mycobacterium
GYDDSLDEEDEPSTPR

SEQ ID NO: 960932 - protein, 6 aa, Mycobacterium
GYDEDD

SEQ ID NO: 960933 - protein, 11 aa, Mycobacterium
GYEAPGGNGRS

SEQ ID NO: 960934 - protein, 5 aa, Mycobacterium
GYEPE

SEQ ID NO: 960935 - protein, 6 aa, Mycobacterium
GYGPTV

SEQ ID NO: 960936 - protein, 10 aa, Mycobacterium
GYGRPEASRE

SEQ ID NO: 960937 - protein, 5 aa, Mycobacterium
GYGYG

SEQ ID NO: 960938 - protein, 22 aa, Mycobacterium
GYKTSYDTRPYMPSSAAANVGY

SEQ ID NO: 960939 - protein, 39 aa, Mycobacterium; identical to SEQ ID NO: 264440

SEQ ID NO: 960940 - protein, 6 aa, Mycobacterium
GYNSEG

SEQ ID NO: 960941 - protein, 8 aa, Mycobacterium
GYPASTPI

SEQ ID NO: 960942 - protein, 5 aa, Mycobacterium
GYPDA

SEQ ID NO: 960943 - protein, 7 aa, Mycobacterium
GYSGNPW

SEQ ID NO: 960944 - protein, 20 aa, Mycobacterium
GYSPEQDTATQLSPSEQARS

SEQ ID NO: 960945 - protein, 8 aa, Mycobacterium
GYTGGGHK

SEQ ID NO: 960946 - protein, 11 aa, Mycobacterium
GYYGSDSAGTF

SEQ ID NO: 960947 - protein, 5 aa, Mycobacterium
HAAPG

SEQ ID NO: 960948 - protein, 6 aa, Mycobacterium
HADTRV

SEQ ID NO: 960949 - protein, 15 aa, Mycobacterium
HAEAESADDDEDNTL

SEQ ID NO: 960950 - protein, 28 aa, Mycobacterium
HAEATAPAGSGLSQPVNPPTALPPAVPG

SEQ ID NO: 960951 - protein, 6 aa, Mycobacterium
HAEDSL

SEQ ID NO: 960952 - protein, 16 aa, Mycobacterium
HAESAADDRDPDAEHA

SEQ ID NO: 960953 - protein, 8 aa, Mycobacterium
HAETAYTE

SEQ ID NO: 960954 - protein, 17 aa, Mycobacterium
HAGGPRPLDPPPAPDAF

SEQ ID NO: 960955 - protein, 10 aa, Mycobacterium
HAGQVTASGD

SEQ ID NO: 960956 - protein, 4 aa, Mycobacterium
HAHP

SEQ ID NO: 960957 - protein, 14 aa, Mycobacterium
HANDPHPGCSTPAT

SEQ ID NO: 960958 - protein, 12 aa, Mycobacterium
HAPTQDISERSL

SEQ ID NO: 960959 - protein, 6 aa, Mycobacterium
HASRPD

SEQ ID NO: 960960 - protein, 6 aa, Mycobacterium
HATGGR

SEQ ID NO: 960961 - protein, 5 aa, Mycobacterium
HATPN

SEQ ID NO: 960962 - protein, 22 aa, Mycobacterium
HDAEPAPPRAPDDDEVAPLSFA

SEQ ID NO: 960963 - protein, 8 aa, Mycobacterium
HDDNDTRI

SEQ ID NO: 960964 - protein, 13 aa, Mycobacterium
HDGSVTAESAAGQ

SEQ ID NO: 960965 - protein, 9 aa, Mycobacterium
HDKNAEPEK

SEQ ID NO: 960966 - protein, 6 aa, Mycobacterium
HDMRNS

SEQ ID NO: 960967 - protein, 5 aa, Mycobacterium
HDNNA

SEQ ID NO: 960968 - protein, 11 aa, Mycobacterium
HDPDRTDDDEY

SEQ ID NO: 960969 - protein, 5 aa, Mycobacterium
HDPGQ

SEQ ID NO: 960970 - protein, 10 aa, Mycobacterium
HDPNDGVGGN

SEQ ID NO: 960971 - protein, 62 aa, Mycobacterium
HDSAPAPAAEAEAEAPESEAAAPPASDVPLPPPPTNPAGPSPNGQSSSTPDLKGAADALNQE

SEQ ID NO: 960972 - protein, 6 aa, Mycobacterium
HDSGVS

SEQ ID NO: 960973 - protein, 7 aa, Mycobacterium
HDTGNAM

SEQ ID NO: 960974 - protein, 6 aa, Mycobacterium
HEGEER

SEQ ID NO: 960975 - protein, 6 aa, Mycobacterium
HEGLPA

SEQ ID NO: 960976 - protein, 5 aa, Mycobacterium
HEPPQ

SEQ ID NO: 960977 - protein, 4 aa, Mycobacterium
HEVD

SEQ ID NO: 960978 - protein, 5 aa, Mycobacterium
HEVDP

SEQ ID NO: 960979 - protein, 5 aa, Mycobacterium
HEVGT

SEQ ID NO: 960980 - protein, 6 aa, Mycobacterium
HFPPDD

SEQ ID NO: 960981 - protein, 6 aa, Mycobacterium
HFPTEQ

SEQ ID NO: 960982 - protein, 16 aa, Mycobacterium
HGAAASAGAGQSCGAG

SEQ ID NO: 960983 - protein, 5 aa, Mycobacterium
HGAAE

SEQ ID NO: 960984 - protein, 11 aa, Mycobacterium
HGARRGATDRR

SEQ ID NO: 960985 - protein, 9 aa, Mycobacterium
HGATNPIWG

SEQ ID NO: 960986 - protein, 12 aa, Mycobacterium
HGDEQAVGSPLN

SEQ ID NO: 960987 - protein, 10 aa, Mycobacterium
HGDHTPGPAT

SEQ ID NO: 960988 - protein, 5 aa, Mycobacterium
HGDSE

SEQ ID NO: 960989 - protein, 9 aa, Mycobacterium
HGEHPGYEL

SEQ ID NO: 960990 - protein, 6 aa, Mycobacterium
HGESPT

SEQ ID NO: 960991 - protein, 22 aa, Mycobacterium
HGFGDEPCSRRGTRPLPQRRRW

SEQ ID NO: 960992 - protein, 26 aa, Mycobacterium
HGGATVATTQTGVSTPDPKAARVQTR

SEQ ID NO: 960993 - protein, 5 aa, Mycobacterium
HGGDV

SEQ ID NO: 960994 - protein, 7 aa, Mycobacterium
HGGGTPS

SEQ ID NO: 960995 - protein, 4 aa, Mycobacterium
HGGI

SEQ ID NO: 960996 - protein, 6 aa, Mycobacterium
HGGSAA

SEQ ID NO: 960997 - protein, 9 aa, Mycobacterium
HGHTDRRDA

SEQ ID NO: 960998 - protein, 5 aa, Mycobacterium
HGKEG

SEQ ID NO: 960999 - protein, 7 aa, Mycobacterium
HGNPSAE

SEQ ID NO: 961000 - protein, 8 aa, Mycobacterium
HGPAPVAD

SEQ ID NO: 961001 - protein, 10 aa, Mycobacterium
HGPDFGKASP

SEQ ID NO: 961002 - protein, 7 aa, Mycobacterium
HGPQGGL

SEQ ID NO: 961003 - protein, 6 aa, Mycobacterium
HGPRTN

SEQ ID NO: 961004 - protein, 16 aa, Mycobacterium
HGRHAQDERRPGRHDR

SEQ ID NO: 961005 - protein, 12 aa, Mycobacterium
HGRPFRPRNPRP

SEQ ID NO: 961006 - protein, 8 aa, Mycobacterium
HGTAASEA

SEQ ID NO: 961007 - protein, 8 aa, Mycobacterium
HHAGRDES

SEQ ID NO: 961008 - protein, 8 aa, Mycobacterium
HHATGGKV

SEQ ID NO: 961009 - protein, 31 aa, Mycobacterium
HHDERSAPSAPAETTETVAPTSQAKPGNGRV

SEQ ID NO: 961010 - protein, 4 aa, Mycobacterium
HHGA

SEQ ID NO: 961011 - protein, 8 aa, Mycobacterium
HHSPATHV

SEQ ID NO: 961012 - protein, 7 aa, Mycobacterium
HHTSPHT

SEQ ID NO: 961013 - protein, 7 aa, Mycobacterium
HIAGPDQ

SEQ ID NO: 961014 - protein, 8 aa, Mycobacterium
HIQSPAAE

SEQ ID NO: 961015 - protein, 25 aa, Mycobacterium
HKGQTEVTTGQLADPVNGQPRSAAL

SEQ ID NO: 961016 - protein, 9 aa, Mycobacterium
HKLGDDAHQ

SEQ ID NO: 961017 - protein, 9 aa, Mycobacterium
HKQTAASSN

SEQ ID NO: 961018 - protein, 8 aa, Mycobacterium
HKSGDRSM

SEQ ID NO: 961019 - protein, 9 aa, Mycobacterium
HLDSRTGEQ

SEQ ID NO: 961020 - protein, 13 aa, Mycobacterium
HLSPQTQRALAPA

SEQ ID NO: 961021 - protein, 5 aa, Mycobacterium
HNDAT

SEQ ID NO: 961022 - protein, 12 aa, Mycobacterium
HNPAATQGAAKR

SEQ ID NO: 961023 - protein, 8 aa, Mycobacterium
HNSGKGQV

SEQ ID NO: 961024 - protein, 9 aa, Mycobacterium
HNTGAPAPG

SEQ ID NO: 961025 - protein, 6 aa, Mycobacterium
HPADGT

SEQ ID NO: 961026 - protein, 13 aa, Mycobacterium
HPARPGPEGAGIQ

SEQ ID NO: 961027 - protein, 11 aa, Mycobacterium
HPATSGTVRYD

SEQ ID NO: 961028 - protein, 5 aa, Mycobacterium
HPDLD

SEQ ID NO: 961029 - protein, 6 aa, Mycobacterium
HPEEPV

SEQ ID NO: 961030 - protein, 7 aa, Mycobacterium
HPGPGFS

SEQ ID NO: 961031 - protein, 8 aa, Mycobacterium
HPGTPTNF

SEQ ID NO: 961032 - protein, 6 aa, Mycobacterium
HPHTAP

SEQ ID NO: 961033 - protein, 5 aa, Mycobacterium
HPPIE

SEQ ID NO: 961034 - protein, 5 aa, Mycobacterium
HPPPW

SEQ ID NO: 961035 - protein, 4 aa, Mycobacterium
HPPT

SEQ ID NO: 961036 - protein, 5 aa, Mycobacterium
HPPTL

SEQ ID NO: 961037 - protein, 23 aa, Mycobacterium
HPQTADSAGGYPYPGWEQPGDTV

SEQ ID NO: 961038 - protein, 6 aa, Mycobacterium
HPSFGR

SEQ ID NO: 961039 - protein, 23 aa, Mycobacterium
HPSRRQSRPPNQPRRSRSRPELD

SEQ ID NO: 961040 - protein, 7 aa, Mycobacterium
HQAAQRE

SEQ ID NO: 961041 - protein, 19 aa, Mycobacterium
HQAPSDHGPVLEPACEPLG

SEQ ID NO: 961042 - protein, 4 aa, Mycobacterium
HQES

SEQ ID NO: 961043 - protein, 18 aa, Mycobacterium
HQKKGGGAAGPDDSVRVT

SEQ ID NO: 961044 - protein, 11 aa, Mycobacterium
HQKTQTAEEIA

SEQ ID NO: 961045 - protein, 6 aa, Mycobacterium
HQPTGG

SEQ ID NO: 961046 - protein, 4 aa, Mycobacterium
HQSS

SEQ ID NO: 961047 - protein, 4 aa, Mycobacterium
HQTT

SEQ ID NO: 961048 - protein, 8 aa, Mycobacterium
HRAHPSAN

SEQ ID NO: 961049 - protein, 9 aa, Mycobacterium
HRAHTGTGA

SEQ ID NO: 961050 - protein, 7 aa, Mycobacterium
HRDDLSG

SEQ ID NO: 961051 - protein, 5 aa, Mycobacterium
HREAT

SEQ ID NO: 961052 - protein, 6 aa, Mycobacterium
HRGAGY

SEQ ID NO: 961053 - protein, 21 aa, Mycobacterium
HRGKPRRHRSYQADGAEHQRV

SEQ ID NO: 961054 - protein, 6 aa, Mycobacterium
HRGQAG

SEQ ID NO: 961055 - protein, 11 aa, Mycobacterium
HRISPDRPGTG

SEQ ID NO: 961056 - protein, 4 aa, Mycobacterium
HRLT

SEQ ID NO: 961057 - protein, 5 aa, Mycobacterium
HRNAD

SEQ ID NO: 961058 - protein, 50 aa, Mycobacterium
HRPFEASDQVSASPHGRQPTRELPREPENHNEPHGSDFDDESDEYEYEPV

SEQ ID NO: 961059 - protein, 9 aa, Mycobacterium
HRPHTGNGA

SEQ ID NO: 961060 - protein, 6 aa, Mycobacterium
HRPPVA

SEQ ID NO: 961061 - protein, 20 aa, Mycobacterium
HRPTSLDETARADRLPPLPD

SEQ ID NO: 961062 - protein, 6 aa, Mycobacterium
HRQGAG

SEQ ID NO: 961063 - protein, 11 aa, Mycobacterium
HRRPAPSPIRP

SEQ ID NO: 961064 - protein, 16 aa, Mycobacterium
HRRPPPAPPVPNAEPP

SEQ ID NO: 961065 - protein, 4 aa, Mycobacterium
HRRS

SEQ ID NO: 961066 - protein, 20 aa, Mycobacterium
HRSVGKWQGGHRSDGGRRGV

SEQ ID NO: 961067 - protein, 4 aa, Mycobacterium
HRTG

SEQ ID NO: 961068 - protein, 8 aa, Mycobacterium
HSANGTYV

SEQ ID NO: 961069 - protein, 19 aa, Mycobacterium
HSAPESEPDPVPADAARDI

SEQ ID NO: 961070 - protein, 16 aa, Mycobacterium
HSASAPVQTASAQPMA

SEQ ID NO: 961071 - protein, 6 aa, Mycobacterium
HSDTDV

SEQ ID NO: 961072 - protein, 6 aa, Mycobacterium
HSDVSG

SEQ ID NO: 961073 - protein, 6 aa, Mycobacterium
HSGDRS

SEQ ID NO: 961074 - protein, 7 aa, Mycobacterium
HSGTETP

SEQ ID NO: 961075 - protein, 8 aa, Mycobacterium
HSKNSEEK

SEQ ID NO: 961076 - protein, 4 aa, Mycobacterium
HSLG

SEQ ID NO: 961077 - protein, 16 aa, Mycobacterium
HSNDDVEDPDTFASHG

SEQ ID NO: 961078 - protein, 20 aa, Mycobacterium
HSPSHGAGPANIKPDYHPRL

SEQ ID NO: 961079 - protein, 8 aa, Mycobacterium
HSQAPAPV

SEQ ID NO: 961080 - protein, 10 aa, Mycobacterium
HTEVKDNRRN

SEQ ID NO: 961081 - protein, 25 aa, Mycobacterium
HTGDQARCERNPGARTSEGLWQASE

SEQ ID NO: 961082 - protein, 4 aa, Mycobacterium
HTGH

SEQ ID NO: 961083 - protein, 5 aa, Mycobacterium
HTGPG

SEQ ID NO: 961084 - protein, 20 aa, Mycobacterium
HTGTTGAPPWGQPPPEPTVA

SEQ ID NO: 961085 - protein, 11 aa, Mycobacterium
HTIGTAQQSLG

SEQ ID NO: 961086 - protein, 5 aa, Mycobacterium
HTPAK

SEQ ID NO: 961087 - protein, 6 aa, Mycobacterium
HTSDNG

SEQ ID NO: 961088 - protein, 22 aa, Mycobacterium
HTTGSDTDATPIPDHTEDRPPQ

SEQ ID NO: 961089 - protein, 10 aa, Mycobacterium
HVGPRSRHHR

SEQ ID NO: 961090 - protein, 47 aa, Mycobacterium; identical to SEQ ID NO: 265507

SEQ ID NO: 961091 - protein, 7 aa, Mycobacterium
IAERGTH

SEQ ID NO: 961092 - protein, 11 aa, Mycobacterium
IAGAPGQGNYA

SEQ ID NO: 961093 - protein, 48 aa, Mycobacterium
IAGGAKRPGAKKSPDQAETPAPTESKSEAKPEPSDHADGNPAPPTAPV

SEQ ID NO: 961094 - protein, 7 aa, Mycobacterium
IAPEDQS

SEQ ID NO: 961095 - protein, 4 aa, Mycobacterium
IAPG

SEQ ID NO: 961096 - protein, 10 aa, Mycobacterium
IAPGDAQATM

SEQ ID NO: 961097 - protein, 5 aa, Mycobacterium
IAPSL

SEQ ID NO: 961098 - protein, 24 aa, Mycobacterium
IAPTPTAAPTTTTTIASTPEQDSA

SEQ ID NO: 961099 - protein, 5 aa, Mycobacterium
IASGQ

SEQ ID NO: 961100 - protein, 7 aa, Mycobacterium
IASGRSA

SEQ ID NO: 961101 - protein, 8 aa, Mycobacterium
IASQETNR

SEQ ID NO: 961102 - protein, 12 aa, Mycobacterium
IASRTQQTPTES

SEQ ID NO: 961103 - protein, 6 aa, Mycobacterium
IDAEPA

SEQ ID NO: 961104 - protein, 9 aa, Mycobacterium
IDASAQDGV

SEQ ID NO: 961105 - protein, 19 aa, Mycobacterium
IDDPAGGTFDRAADAPPGW

SEQ ID NO: 961106 - protein, 6 aa, Mycobacterium
IDGAGE

SEQ ID NO: 961107 - protein, 6 aa, Mycobacterium
IDGASR

SEQ ID NO: 961108 - protein, 12 aa, Mycobacterium
IDGDPNSAWPTD

SEQ ID NO: 961109 - protein, 4 aa, Mycobacterium
IDGS

SEQ ID NO: 961110 - protein, 5 aa, Mycobacterium
IDIPS

SEQ ID NO: 961111 - protein, 8 aa, Mycobacterium
IDKKPDLS

SEQ ID NO: 961112 - protein, 8 aa, Mycobacterium
IDNAGNAA

SEQ ID NO: 961113 - protein, 7 aa, Mycobacterium
IDPATGR

SEQ ID NO: 961114 - protein, 6 aa, Mycobacterium
IDPQRD

SEQ ID NO: 961115 - protein, 15 aa, Mycobacterium
IDPRKRDKILATYGV

SEQ ID NO: 961116 - protein, 8 aa, Mycobacterium
IDQLSGGQ

SEQ ID NO: 961117 - protein, 8 aa, Mycobacterium
IDRAQQRR

SEQ ID NO: 961118 - protein, 7 aa, Mycobacterium
IDRPQAT

SEQ ID NO: 961119 - protein, 4 aa, Mycobacterium
IDSS

SEQ ID NO: 961120 - protein, 12 aa, Mycobacterium
IDTAKGSMAGPV

SEQ ID NO: 961121 - protein, 18 aa, Mycobacterium
IDTTSAAPAASTTRHKAV

SEQ ID NO: 961122 - protein, 6 aa, Mycobacterium
IEDNPG

SEQ ID NO: 961123 - protein, 6 aa, Mycobacterium
IEESDA

SEQ ID NO: 961124 - protein, 5 aa, Mycobacterium
IEGAG

SEQ ID NO: 961125 - protein, 4 aa, Mycobacterium
IEGF

SEQ ID NO: 961126 - protein, 5 aa, Mycobacterium
IEGGN

SEQ ID NO: 961127 - protein, 6 aa, Mycobacterium
IEGSYT

SEQ ID NO: 961128 - protein, 7 aa, Mycobacterium
IEGSYTL

SEQ ID NO: 961129 - protein, 43 aa, Mycobacterium
IEPEPETPAPVAAEPVAPPVAPETPQAPEVPEAPEAPEAPEVA

SEQ ID NO: 961130 - protein, 4 aa, Mycobacterium
IEPG

SEQ ID NO: 961131 - protein, 5 aa, Mycobacterium
IEPPA

SEQ ID NO: 961132 - protein, 23 aa, Mycobacterium
IEPPAPPAPARSPAPTGATFGRR

SEQ ID NO: 961133 - protein, 7 aa, Mycobacterium
IEPPEGR

SEQ ID NO: 961134 - protein, 12 aa, Mycobacterium
IERTLGASRGWR

SEQ ID NO: 961135 - protein, 9 aa, Mycobacterium
IESGKEHKG

SEQ ID NO: 961136 - protein, 9 aa, Mycobacterium
IESPNSEDS

SEQ ID NO: 961137 - protein, 12 aa, Mycobacterium
IETDTSELAGSP

SEQ ID NO: 961138 - protein, 8 aa, Mycobacterium
IETTSRQE

SEQ ID NO: 961139 - protein, 23 aa, Mycobacterium
IGAATPSPAPAATSGTRSPGPNL

SEQ ID NO: 961140 - protein, 6 aa, Mycobacterium
IGATPG

SEQ ID NO: 961141 - protein, 8 aa, Mycobacterium
IGDPHERG

SEQ ID NO: 961142 - protein, 18 aa, Mycobacterium
IGEPGVAAGTTSGSPQMS

SEQ ID NO: 961143 - protein, 6 aa, Mycobacterium
IGESSS

SEQ ID NO: 961144 - protein, 4 aa, Mycobacterium
IGGA

SEQ ID NO: 961145 - protein, 4 aa, Mycobacterium
IGGG

SEQ ID NO: 961146 - protein, 6 aa, Mycobacterium
IGGGGK

SEQ ID NO: 961147 - protein, 4 aa, Mycobacterium
IGGI

SEQ ID NO: 961148 - protein, 8 aa, Mycobacterium
IGGPPEQV

SEQ ID NO: 961149 - protein, 6 aa, Mycobacterium
IGNGAR

SEQ ID NO: 961150 - protein, 6 aa, Mycobacterium
IGNGST

SEQ ID NO: 961151 - protein, 4 aa, Mycobacterium
IGPA

SEQ ID NO: 961152 - protein, 5 aa, Mycobacterium
IGPAD

SEQ ID NO: 961153 - protein, 5 aa, Mycobacterium
IGPND

SEQ ID NO: 961154 - protein, 15 aa, Mycobacterium
IGQGDPASQPQAQNV

SEQ ID NO: 961155 - protein, 4 aa, Mycobacterium
IGRK

SEQ ID NO: 961156 - protein, 5 aa, Mycobacterium
IGRQG

SEQ ID NO: 961157 - protein, 4 aa, Mycobacterium
IGSG

SEQ ID NO: 961158 - protein, 16 aa, Mycobacterium
IGSGGSGGREGPTAQI

SEQ ID NO: 961159 - protein, 10 aa, Mycobacterium
IGTGGSGGLF

SEQ ID NO: 961160 - protein, 34 aa, Mycobacterium
IGTGHSSVGDQDKARDPRCPRRPPGRLPAWRRIS

SEQ ID NO: 961161 - protein, 5 aa, Mycobacterium
IHDGP

SEQ ID NO: 961162 - protein, 5 aa, Mycobacterium
IHKQT

SEQ ID NO: 961163 - protein, 6 aa, Mycobacterium
IKPSSI

SEQ ID NO: 961164 - protein, 8 aa, Mycobacterium
IKSTSPDT

SEQ ID NO: 961165 - protein, 7 aa, Mycobacterium
INDAPAL

SEQ ID NO: 961166 - protein, 6 aa, Mycobacterium
IPAEGN

SEQ ID NO: 961167 - protein, 4 aa, Mycobacterium
IPAG

SEQ ID NO: 961168 - protein, 12 aa, Mycobacterium
IPAPSGAAIATS

SEQ ID NO: 961169 - protein, 23 aa, Mycobacterium
IPASFDSEHPELDQAADEGTELG

SEQ ID NO: 961170 - protein, 6 aa, Mycobacterium
IPASST

SEQ ID NO: 961171 - protein, 8 aa, Mycobacterium
IPDATKAA

SEQ ID NO: 961172 - protein, 7 aa, Mycobacterium
IPGDEHD

SEQ ID NO: 961173 - protein, 12 aa, Mycobacterium
IPGGAEDSIKRV

SEQ ID NO: 961174 - protein, 9 aa, Mycobacterium
IPGPEPTSV

SEQ ID NO: 961175 - protein, 4 aa, Mycobacterium
IPGQ

SEQ ID NO: 961176 - protein, 6 aa, Mycobacterium
IPGSGG

SEQ ID NO: 961177 - protein, 6 aa, Mycobacterium
IPKRRE

SEQ ID NO: 961178 - protein, 48 aa, Mycobacterium; identical to SEQ ID NO: 266158

SEQ ID NO: 961179 - protein, 5 aa, Mycobacterium
IPPGA

SEQ ID NO: 961180 - protein, 20 aa, Mycobacterium
IPPSDIPPLPNTPSPKPMPN

SEQ ID NO: 961181 - protein, 6 aa, Mycobacterium
IPPSGV

SEQ ID NO: 961182 - protein, 10 aa, Mycobacterium
IPPSSLRGGP

SEQ ID NO: 961183 - protein, 5 aa, Mycobacterium
IPPVP

SEQ ID NO: 961184 - protein, 11 aa, Mycobacterium
IPQPAAQPNAL

SEQ ID NO: 961185 - protein, 8 aa, Mycobacterium
IPQPTPSS

SEQ ID NO: 961186 - protein, 4 aa, Mycobacterium
IPRP

SEQ ID NO: 961187 - protein, 4 aa, Mycobacterium
IPRS

SEQ ID NO: 961188 - protein, 11 aa, Mycobacterium
IPSYSGGARVT

SEQ ID NO: 961189 - protein, 7 aa, Mycobacterium
IPTATSG

SEQ ID NO: 961190 - protein, 8 aa, Mycobacterium
IQAATPDH

SEQ ID NO: 961191 - protein, 5 aa, Mycobacterium
IQPDT

SEQ ID NO: 961192 - protein, 4 aa, Mycobacterium
IQPG

SEQ ID NO: 961193 - protein, 5 aa, Mycobacterium
IQPGE

SEQ ID NO: 961194 - protein, 13 aa, Mycobacterium
IQPSEVGKTFPDN

SEQ ID NO: 961195 - protein, 7 aa, Mycobacterium
IQSKSKS

SEQ ID NO: 961196 - protein, 9 aa, Mycobacterium
IRESVSGAL

SEQ ID NO: 961197 - protein, 5 aa, Mycobacterium
IRGTY

SEQ ID NO: 961198 - protein, 12 aa, Mycobacterium
IRNQAAEQRAAA

SEQ ID NO: 961199 - protein, 11 aa, Mycobacterium
IRPTPQPRERK

SEQ ID NO: 961200 - protein, 17 aa, Mycobacterium
IRQDSQLGAGQAGPELT

SEQ ID NO: 961201 - protein, 9 aa, Mycobacterium
ISGAEMEQT

SEQ ID NO: 961202 - protein, 8 aa, Mycobacterium
ISGGASAL

SEQ ID NO: 961203 - protein, 5 aa, Mycobacterium
ISGPE

SEQ ID NO: 961204 - protein, 4 aa, Mycobacterium
ISGR

SEQ ID NO: 961205 - protein, 7 aa, Mycobacterium
ISKDGEQ

SEQ ID NO: 961206 - protein, 4 aa, Mycobacterium
ISPE

SEQ ID NO: 961207 - protein, 25 aa, Mycobacterium
ISPPDGVPQPEVTESIGSTTTVNND

SEQ ID NO: 961208 - protein, 10 aa, Mycobacterium
ISPQIETTKA

SEQ ID NO: 961209 - protein, 6 aa, Mycobacterium
ISPVQQ

SEQ ID NO: 961210 - protein, 8 aa, Mycobacterium
ISRDHREP

SEQ ID NO: 961211 - protein, 6 aa, Mycobacterium
ISRPPT

SEQ ID NO: 961212 - protein, 4 aa, Mycobacterium
ISSE

SEQ ID NO: 961213 - protein, 32 aa, Mycobacterium; identical to SEQ ID NO: 266432

SEQ ID NO: 961214 - protein, 6 aa, Mycobacterium
ITAAGA

SEQ ID NO: 961215 - protein, 4 aa, Mycobacterium
ITAD

SEQ ID NO: 961216 - protein, 5 aa, Mycobacterium
ITDGS

SEQ ID NO: 961217 - protein, 14 aa, Mycobacterium
ITDTHSNKTREAWG

SEQ ID NO: 961218 - protein, 8 aa, Mycobacterium
ITGSSPVR

SEQ ID NO: 961219 - protein, 9 aa, Mycobacterium
ITGTSPLNT

SEQ ID NO: 961220 - protein, 14 aa, Mycobacterium
ITNYPDDPNGPYTE

SEQ ID NO: 961221 - protein, 15 aa, Mycobacterium
ITPAAPLPGAPRRAG

SEQ ID NO: 961222 - protein, 6 aa, Mycobacterium
ITPAPG

SEQ ID NO: 961223 - protein, 6 aa, Mycobacterium
ITPPKG

SEQ ID NO: 961224 - protein, 25 aa, Mycobacterium
ITPTAIQPRRRGRDTGSRPGPGGGG

SEQ ID NO: 961225 - protein, 9 aa, Mycobacterium
ITRDGKPAA

SEQ ID NO: 961226 - protein, 11 aa, Mycobacterium
ITRPDGKPIEH

SEQ ID NO: 961227 - protein, 4 aa, Mycobacterium
ITSA

SEQ ID NO: 961228 - protein, 4 aa, Mycobacterium
ITTA

SEQ ID NO: 961229 - protein, 7 aa, Mycobacterium
ITTPNSA

SEQ ID NO: 961230 - protein, 20 aa, Mycobacterium
ITTSDGTVLSSNSNDAPQTS

SEQ ID NO: 961231 - protein, 7 aa, Mycobacterium
IVTDRSS

SEQ ID NO: 961232 - protein, 15 aa, Mycobacterium
KAADSDADDPPTDPN

SEQ ID NO: 961233 - protein, 9 aa, Mycobacterium
KAAPLGNGL

SEQ ID NO: 961234 - protein, 10 aa, Mycobacterium
KAEDRLDSGI

SEQ ID NO: 961235 - protein, 4 aa, Mycobacterium
KAET

SEQ ID NO: 961236 - protein, 6 aa, Mycobacterium
KAGGAT

SEQ ID NO: 961237 - protein, 10 aa, Mycobacterium
KAGREPTLAE

SEQ ID NO: 961238 - protein, 8 aa, Mycobacterium
KAGTDYAD

SEQ ID NO: 961239 - protein, 24 aa, Mycobacterium
KAGVAGGGEDGPPALDVTIKSVFL

SEQ ID NO: 961240 - protein, 5 aa, Mycobacterium
KAGYA

SEQ ID NO: 961241 - protein, 14 aa, Mycobacterium
KALSAKDRAEQAFP

SEQ ID NO: 961242 - protein, 6 aa, Mycobacterium
KANGNH

SEQ ID NO: 961243 - protein, 9 aa, Mycobacterium
KAQAESLGN

SEQ ID NO: 961244 - protein, 36 aa, Mycobacterium
KAQAQLGSALPDNSWQGSASYAYASQNTALQNRGQA

SEQ ID NO: 961245 - protein, 5 aa, Mycobacterium
KAQQP

SEQ ID NO: 961246 - protein, 8 aa, Mycobacterium
KARRQRRG

SEQ ID NO: 961247 - protein, 8 aa, Mycobacterium
KATTVGTV

SEQ ID NO: 961248 - protein, 4 aa, Mycobacterium
KAYF

SEQ ID NO: 961249 - protein, 15 aa, Mycobacterium
KCNDGTDPTVKKGAT

SEQ ID NO: 961250 - protein, 8 aa, Mycobacterium
KDATTTFE

SEQ ID NO: 961251 - protein, 18 aa, Mycobacterium
KDAVDDDRHADPPSTRAA

SEQ ID NO: 961252 - protein, 6 aa, Mycobacterium
KDGSKV

SEQ ID NO: 961253 - protein, 9 aa, Mycobacterium
KDKRSDQAL

SEQ ID NO: 961254 - protein, 14 aa, Mycobacterium
KDLGGSASNLDKPQ

SEQ ID NO: 961255 - protein, 18 aa, Mycobacterium
KDPSGAPLRSGYPDPNLR

SEQ ID NO: 961256 - protein, 30 aa, Mycobacterium; identical to SEQ ID NO: 266899

SEQ ID NO: 961257 - protein, 6 aa, Mycobacterium
KDQLGT

SEQ ID NO: 961258 - protein, 4 aa, Mycobacterium
KDRL

SEQ ID NO: 961259 - protein, 6 aa, Mycobacterium
KDRPEV

SEQ ID NO: 961260 - protein, 10 aa, Mycobacterium
KDRSAKPARR

SEQ ID NO: 961261 - protein, 7 aa, Mycobacterium
KDSTATI

SEQ ID NO: 961262 - protein, 8 aa, Mycobacterium
KDTADEID

SEQ ID NO: 961263 - protein, 8 aa, Mycobacterium
KDTTPPEH

SEQ ID NO: 961264 - protein, 10 aa, Mycobacterium
KEAGLPPARG

SEQ ID NO: 961265 - protein, 4 aa, Mycobacterium
KEAI

SEQ ID NO: 961266 - protein, 7 aa, Mycobacterium
KEALASA

SEQ ID NO: 961267 - protein, 6 aa, Mycobacterium
KEDREN

SEQ ID NO: 961268 - protein, 92 aa, Mycobacterium
KEEEAKKQEALERRAANAPAPGPKPKRTPKAVAGSNGSPAESEDVSDTDATETSGEEAPSGDTKRDKPNSTARNSSPTNRTPRPGVRPKKRK

SEQ ID NO: 961269 - protein, 8 aa, Mycobacterium
KEEESAQT

SEQ ID NO: 961270 - protein, 8 aa, Mycobacterium
KEPKFERR

SEQ ID NO: 961271 - protein, 14 aa, Mycobacterium
KEPPPPLPAELPPN

SEQ ID NO: 961272 - protein, 5 aa, Mycobacterium
KERAV

SEQ ID NO: 961273 - protein, 4 aa, Mycobacterium
KERL

SEQ ID NO: 961274 - protein, 6 aa, Mycobacterium
KESRDR

SEQ ID NO: 961275 - protein, 28 aa, Mycobacterium
KETMPTNPDNPKGAYTAARTAKDQGVPI

SEQ ID NO: 961276 - protein, 6 aa, Mycobacterium
KEYEES

SEQ ID NO: 961277 - protein, 6 aa, Mycobacterium
KEYGSA

SEQ ID NO: 961278 - protein, 22 aa, Mycobacterium
KGAAEGIQRGLSTGSKSTPAAA

SEQ ID NO: 961279 - protein, 5 aa, Mycobacterium
KGAGS

SEQ ID NO: 961280 - protein, 4 aa, Mycobacterium
KGAP

SEQ ID NO: 961281 - protein, 5 aa, Mycobacterium
KGAPQ

SEQ ID NO: 961282 - protein, 8 aa, Mycobacterium
KGAPTQPA

SEQ ID NO: 961283 - protein, 10 aa, Mycobacterium
KGASVEAART

SEQ ID NO: 961284 - protein, 19 aa, Mycobacterium
KGATGKLGAPVADQTEVGD

SEQ ID NO: 961285 - protein, 8 aa, Mycobacterium
KGDDDDTI

SEQ ID NO: 961286 - protein, 8 aa, Mycobacterium
KGDEPLVT

SEQ ID NO: 961287 - protein, 6 aa, Mycobacterium
KGDRRT

SEQ ID NO: 961288 - protein, 8 aa, Mycobacterium
KGGPTQGA

SEQ ID NO: 961289 - protein, 9 aa, Mycobacterium
KGKPGRVGR

SEQ ID NO: 961290 - protein, 14 aa, Mycobacterium
KGKPIADGADLDGL

SEQ ID NO: 961291 - protein, 28 aa, Mycobacterium
KGLGSANPIASNDTAEGRIKNRRVEIVV

SEQ ID NO: 961292 - protein, 6 aa, Mycobacterium
KGLPDS

SEQ ID NO: 961293 - protein, 5 aa, Mycobacterium
KGNPD

SEQ ID NO: 961294 - protein, 8 aa, Mycobacterium
KGPHPATY

SEQ ID NO: 961295 - protein, 29 aa, Mycobacterium
KGPTSAGTMGPTAVTPSTKATLTDLGDST

SEQ ID NO: 961296 - protein, 19 aa, Mycobacterium
KGQPAGSTPPTGPAATGAC

SEQ ID NO: 961297 - protein, 15 aa, Mycobacterium
KGQPPQQPASGDGHW

SEQ ID NO: 961298 - protein, 67 aa, Mycobacterium
KGREDPASVRGTAAAADEVPEPEPAGEVATAAAPAGDTEGDEPTGPGRNGQGGRSRRTRNRWFGGRR

SEQ ID NO: 961299 - protein, 4 aa, Mycobacterium
KGRS

SEQ ID NO: 961300 - protein, 6 aa, Mycobacterium
KGSPEV

SEQ ID NO: 961301 - protein, 23 aa, Mycobacterium
KGTGGAARSIGRARDIEPGHRRD

SEQ ID NO: 961302 - protein, 6 aa, Mycobacterium
KGTPLA

SEQ ID NO: 961303 - protein, 7 aa, Mycobacterium
KGTPLEN

SEQ ID NO: 961304 - protein, 8 aa, Mycobacterium
KGTRSEKI

SEQ ID NO: 961305 - protein, 8 aa, Mycobacterium
KGVRPAHG

SEQ ID NO: 961306 - protein, 12 aa, Mycobacterium
KHAGSRVAGEPE

SEQ ID NO: 961307 - protein, 4 aa, Mycobacterium
KHDN

SEQ ID NO: 961308 - protein, 8 aa, Mycobacterium
KHGGSTRV

SEQ ID NO: 961309 - protein, 4 aa, Mycobacterium
KHPG

SEQ ID NO: 961310 - protein, 11 aa, Mycobacterium
KHPNVSQEDRV

SEQ ID NO: 961311 - protein, 12 aa, Mycobacterium
KIEPKLRDGDWA

SEQ ID NO: 961312 - protein, 8 aa, Mycobacterium
KIGKRKDV

SEQ ID NO: 961313 - protein, 6 aa, Mycobacterium
KIPAGS

SEQ ID NO: 961314 - protein, 8 aa, Mycobacterium
KISKDSHS

SEQ ID NO: 961315 - protein, 8 aa, Mycobacterium
KKAPDPTI

SEQ ID NO: 961316 - protein, 8 aa, Mycobacterium
KKDQLGEG

SEQ ID NO: 961317 - protein, 10 aa, Mycobacterium
KKGEVEQADD

SEQ ID NO: 961318 - protein, 5 aa, Mycobacterium
KKGLT

SEQ ID NO: 961319 - protein, 7 aa, Mycobacterium
KKLKRAD

SEQ ID NO: 961320 - protein, 23 aa, Mycobacterium
KKPPAVRRNPPPQPAEHPDTEVN

SEQ ID NO: 961321 - protein, 7 aa, Mycobacterium
KKQARMH

SEQ ID NO: 961322 - protein, 13 aa, Mycobacterium
KKSVTEVAEELKA

SEQ ID NO: 961323 - protein, 6 aa, Mycobacterium
KKTLED

SEQ ID NO: 961324 - protein, 8 aa, Mycobacterium
KKWRQSTN

SEQ ID NO: 961325 - protein, 8 aa, Mycobacterium
KKYGKDRQ

SEQ ID NO: 961326 - protein, 5 aa, Mycobacterium
KLDGV

SEQ ID NO: 961327 - protein, 8 aa, Mycobacterium
KLGSSGGV

SEQ ID NO: 961328 - protein, 19 aa, Mycobacterium
KLPEEGPPAPPKPAALPPE

SEQ ID NO: 961329 - protein, 16 aa, Mycobacterium
KLPPGGTINAEHTQPA

SEQ ID NO: 961330 - protein, 6 aa, Mycobacterium
KLPPSI

SEQ ID NO: 961331 - protein, 10 aa, Mycobacterium
KLSEDVGTLT

SEQ ID NO: 961332 - protein, 11 aa, Mycobacterium
KLSGGQRKRAS

SEQ ID NO: 961333 - protein, 8 aa, Mycobacterium
KLSPDGVY

SEQ ID NO: 961334 - protein, 10 aa, Mycobacterium
KLTPESGVAG

SEQ ID NO: 961335 - protein, 5 aa, Mycobacterium
KMPAD

SEQ ID NO: 961336 - protein, 6 aa, Mycobacterium
KNAATE

SEQ ID NO: 961337 - protein, 10 aa, Mycobacterium
KNDKKGASAV

SEQ ID NO: 961338 - protein, 10 aa, Mycobacterium
KNGYKGPRKK

SEQ ID NO: 961339 - protein, 5 aa, Mycobacterium
KNIKG

SEQ ID NO: 961340 - protein, 6 aa, Mycobacterium
KNLGEV

SEQ ID NO: 961341 - protein, 8 aa, Mycobacterium
KNNRGATP

SEQ ID NO: 961342 - protein, 6 aa, Mycobacterium
KNPADR

SEQ ID NO: 961343 - protein, 9 aa, Mycobacterium
KNPAERYPT

SEQ ID NO: 961344 - protein, 13 aa, Mycobacterium
KNPDGVAVDSDGN

SEQ ID NO: 961345 - protein, 5 aa, Mycobacterium
KNRDI

SEQ ID NO: 961346 - protein, 20 aa, Mycobacterium
KNSPVPPGTRAMYRPATILG

SEQ ID NO: 961347 - protein, 21 aa, Mycobacterium
KNTGQAKARAKARKAKAPKVV

SEQ ID NO: 961348 - protein, 11 aa, Mycobacterium
KNTKTSRENRQ

SEQ ID NO: 961349 - protein, 9 aa, Mycobacterium
KPADGTDAA

SEQ ID NO: 961350 - protein, 4 aa, Mycobacterium
KPAE

SEQ ID NO: 961351 - protein, 13 aa, Mycobacterium
KPAEADAATTFEP

SEQ ID NO: 961352 - protein, 11 aa, Mycobacterium
KPAHVSAGSQP

SEQ ID NO: 961353 - protein, 6 aa, Mycobacterium
KPAPAP

SEQ ID NO: 961354 - protein, 6 aa, Mycobacterium
KPDDGH

SEQ ID NO: 961355 - protein, 12 aa, Mycobacterium
KPDEDPGPEPLE

SEQ ID NO: 961356 - protein, 9 aa, Mycobacterium
KPDTDLDEE

SEQ ID NO: 961357 - protein, 7 aa, Mycobacterium
KPELGTP

SEQ ID NO: 961358 - protein, 9 aa, Mycobacterium
KPEQSDRTF

SEQ ID NO: 961359 - protein, 13 aa, Mycobacterium
KPESDDVRDSPAL

SEQ ID NO: 961360 - protein, 14 aa, Mycobacterium
KPETVEKDLTAAQD

SEQ ID NO: 961361 - protein, 15 aa, Mycobacterium
KPFDANYDSEEDVNG

SEQ ID NO: 961362 - protein, 8 aa, Mycobacterium
KPGDVATA

SEQ ID NO: 961363 - protein, 7 aa, Mycobacterium
KPMSPTA

SEQ ID NO: 961364 - protein, 4 aa, Mycobacterium
KPMT

SEQ ID NO: 961365 - protein, 12 aa, Mycobacterium
KPNAAQKESEYI

SEQ ID NO: 961366 - protein, 5 aa, Mycobacterium
KPPGL

SEQ ID NO: 961367 - protein, 12 aa, Mycobacterium
KPPQGMAAEASS

SEQ ID NO: 961368 - protein, 7 aa, Mycobacterium
KPRPARP

SEQ ID NO: 961369 - protein, 5 aa, Mycobacterium
KPRRD

SEQ ID NO: 961370 - protein, 7 aa, Mycobacterium
KPSANLG

SEQ ID NO: 961371 - protein, 8 aa, Mycobacterium
KPSGDKGN

SEQ ID NO: 961372 - protein, 10 aa, Mycobacterium
KPSGPGREEF

SEQ ID NO: 961373 - protein, 5 aa, Mycobacterium
KPSQA

SEQ ID NO: 961374 - protein, 7 aa, Mycobacterium
KPSSPMS

SEQ ID NO: 961375 - protein, 14 aa, Mycobacterium
KPSWIGSSSSDTAL

SEQ ID NO: 961376 - protein, 8 aa, Mycobacterium
KPSYQPPS

SEQ ID NO: 961377 - protein, 7 aa, Mycobacterium
KPTNQIQ

SEQ ID NO: 961378 - protein, 6 aa, Mycobacterium
KPTRPK

SEQ ID NO: 961379 - protein, 6 aa, Mycobacterium
KPVRPR

SEQ ID NO: 961380 - protein, 29 aa, Mycobacterium
KPWATTSPSTERPDRSPSKRTSRQSSRQV

SEQ ID NO: 961381 - protein, 6 aa, Mycobacterium
KPYAPT

SEQ ID NO: 961382 - protein, 6 aa, Mycobacterium
KQDEVE

SEQ ID NO: 961383 - protein, 14 aa, Mycobacterium
KQEAREAIKGTPLQ

SEQ ID NO: 961384 - protein, 11 aa, Mycobacterium
KQIKPTGSAAV

SEQ ID NO: 961385 - protein, 18 aa, Mycobacterium
KQRNRSRPSVSARDTAAN

SEQ ID NO: 961386 - protein, 7 aa, Mycobacterium
KQRPSAN

SEQ ID NO: 961387 - protein, 8 aa, Mycobacterium
KQTPTQRV

SEQ ID NO: 961388 - protein, 12 aa, Mycobacterium
KQVEPTPGADLA

SEQ ID NO: 961389 - protein, 7 aa, Mycobacterium
KQYREKA

SEQ ID NO: 961390 - protein, 10 aa, Mycobacterium
KQYSSNGGAV

SEQ ID NO: 961391 - protein, 7 aa, Mycobacterium
KRAANRG

SEQ ID NO: 961392 - protein, 6 aa, Mycobacterium
KRAELS

SEQ ID NO: 961393 - protein, 7 aa, Mycobacterium
KRARGKP

SEQ ID NO: 961394 - protein, 8 aa, Mycobacterium
KRATTTRR

SEQ ID NO: 961395 - protein, 5 aa, Mycobacterium
KRDPN

SEQ ID NO: 961396 - protein, 11 aa, Mycobacterium
KREKAARPNRS

SEQ ID NO: 961397 - protein, 19 aa, Mycobacterium
KRENTDQDEPAKGSGRPSL

SEQ ID NO: 961398 - protein, 4 aa, Mycobacterium
KRGA

SEQ ID NO: 961399 - protein, 18 aa, Mycobacterium
KRGGPAAGHRSDPDWKRQ

SEQ ID NO: 961400 - protein, 4 aa, Mycobacterium
KRGN

SEQ ID NO: 961401 - protein, 5 aa, Mycobacterium
KRGPR

SEQ ID NO: 961402 - protein, 37 aa, Mycobacterium
KRKAKREVLPADDEASSIEEPEPIPTPSAPGGSHDDI

SEQ ID NO: 961403 - protein, 7 aa, Mycobacterium
KRKLERQ

SEQ ID NO: 961404 - protein, 6 aa, Mycobacterium
KRLSRP

SEQ ID NO: 961405 - protein, 12 aa, Mycobacterium
KRNREQHNRRRR

SEQ ID NO: 961406 - protein, 5 aa, Mycobacterium
KRNSA

SEQ ID NO: 961407 - protein, 7 aa, Mycobacterium
KRPDLER

SEQ ID NO: 961408 - protein, 7 aa, Mycobacterium
KRPHDPA

SEQ ID NO: 961409 - protein, 9 aa, Mycobacterium
KRRAEPTGD

SEQ ID NO: 961410 - protein, 5 aa, Mycobacterium
KRRIN

SEQ ID NO: 961411 - protein, 10 aa, Mycobacterium
KRSKRRAGAA

SEQ ID NO: 961412 - protein, 19 aa, Mycobacterium
KRTEHSAGPDIDREADAIA

SEQ ID NO: 961413 - protein, 8 aa, Mycobacterium
KRTRNAGI

SEQ ID NO: 961414 - protein, 6 aa, Mycobacterium
KRVPPQ

SEQ ID NO: 961415 - protein, 10 aa, Mycobacterium
KSAEALSAQA

SEQ ID NO: 961416 - protein, 12 aa, Mycobacterium
KSASVDDANLLK

SEQ ID NO: 961417 - protein, 10 aa, Mycobacterium
KSDGKPATLT

SEQ ID NO: 961418 - protein, 7 aa, Mycobacterium
KSDPHRV

SEQ ID NO: 961419 - protein, 4 aa, Mycobacterium
KSHL

SEQ ID NO: 961420 - protein, 4 aa, Mycobacterium
KSHS

SEQ ID NO: 961421 - protein, 13 aa, Mycobacterium
KSLSGEYASAAAE

SEQ ID NO: 961422 - protein, 8 aa, Mycobacterium
KSMSTGGV

SEQ ID NO: 961423 - protein, 11 aa, Mycobacterium
KSPAEDGAAQD

SEQ ID NO: 961424 - protein, 14 aa, Mycobacterium
KSPQEPPERGEGAE

SEQ ID NO: 961425 - protein, 13 aa, Mycobacterium
KSPRLAKPAYNGL

SEQ ID NO: 961426 - protein, 4 aa, Mycobacterium
KSPV

SEQ ID NO: 961427 - protein, 5 aa, Mycobacterium
KSQGD

SEQ ID NO: 961428 - protein, 8 aa, Mycobacterium
KSRDELGD

SEQ ID NO: 961429 - protein, 8 aa, Mycobacterium
KSRGQRNS

SEQ ID NO: 961430 - protein, 12 aa, Mycobacterium
KSSSDTDGSDKV

SEQ ID NO: 961431 - protein, 6 aa, Mycobacterium
KSTMPA

SEQ ID NO: 961432 - protein, 11 aa, Mycobacterium
KSTPNSAGTLG

SEQ ID NO: 961433 - protein, 4 aa, Mycobacterium
KSYE

SEQ ID NO: 961434 - protein, 5 aa, Mycobacterium
KSYPY

SEQ ID NO: 961435 - protein, 15 aa, Mycobacterium
KTAAKEAIKGTPLEG

SEQ ID NO: 961436 - protein, 7 aa, Mycobacterium
KTAKYAR

SEQ ID NO: 961437 - protein, 13 aa, Mycobacterium
KTDGRWLASKVEL

SEQ ID NO: 961438 - protein, 28 aa, Mycobacterium
KTGADREYDYETSADTKNYTYTGSGGVS

SEQ ID NO: 961439 - protein, 8 aa, Mycobacterium
KTGARGTP

SEQ ID NO: 961440 - protein, 4 aa, Mycobacterium
KTGT

SEQ ID NO: 961441 - protein, 8 aa, Mycobacterium
KTGTLTEN

SEQ ID NO: 961442 - protein, 8 aa, Mycobacterium
KTGTLTET

SEQ ID NO: 961443 - protein, 7 aa, Mycobacterium
KTGTLTQ

SEQ ID NO: 961444 - protein, 7 aa, Mycobacterium
KTGTLTR

SEQ ID NO: 961445 - protein, 9 aa, Mycobacterium
KTGTPSDNR

SEQ ID NO: 961446 - protein, 9 aa, Mycobacterium
KTKRRDRYR

SEQ ID NO: 961447 - protein, 24 aa, Mycobacterium
KTKVATATTAENPARDVGETATVT

SEQ ID NO: 961448 - protein, 15 aa, Mycobacterium
KTLPEPAGQDAPDPS

SEQ ID NO: 961449 - protein, 7 aa, Mycobacterium
KTNFASR

SEQ ID NO: 961450 - protein, 7 aa, Mycobacterium
KTNRAAA

SEQ ID NO: 961451 - protein, 6 aa, Mycobacterium
KTPDGM

SEQ ID NO: 961452 - protein, 9 aa, Mycobacterium
KTPGINGST

SEQ ID NO: 961453 - protein, 5 aa, Mycobacterium
KTPLQ

SEQ ID NO: 961454 - protein, 5 aa, Mycobacterium
KTSDE

SEQ ID NO: 961455 - protein, 4 aa, Mycobacterium
KTSY

SEQ ID NO: 961456 - protein, 13 aa, Mycobacterium
KTTTAAAPEQRPR

SEQ ID NO: 961457 - protein, 42 aa, Mycobacterium
KTVARSGNRTSSLKATSRGVSQSRRPVPPRPRRNRPAERRNQ

SEQ ID NO: 961458 - protein, 5 aa, Mycobacterium
KTVGA

SEQ ID NO: 961459 - protein, 15 aa, Mycobacterium
KVAAVKAEKAEGSAA

SEQ ID NO: 961460 - protein, 12 aa, Mycobacterium
KVARDEQALAEA

SEQ ID NO: 961461 - protein, 4 aa, Mycobacterium
KVDE

SEQ ID NO: 961462 - protein, 15 aa, Mycobacterium
KVHSGDRSGAAARGR

SEQ ID NO: 961463 - protein, 6 aa, Mycobacterium
KVPANA

SEQ ID NO: 961464 - protein, 14 aa, Mycobacterium
KVRSGAITAPLGSQ

SEQ ID NO: 961465 - protein, 8 aa, Mycobacterium
KVSPPTAY

SEQ ID NO: 961466 - protein, 10 aa, Mycobacterium
KVTRSSKNQL

SEQ ID NO: 961467 - protein, 15 aa, Mycobacterium
KWEGNQWKISNLLQV

SEQ ID NO: 961468 - protein, 5 aa, Mycobacterium
KWNNS

SEQ ID NO: 961469 - protein, 8 aa, Mycobacterium
KWSPPGGR

SEQ ID NO: 961470 - protein, 13 aa, Mycobacterium
KYASSQDGQPAPS

SEQ ID NO: 961471 - protein, 6 aa, Mycobacterium
KYPDQV

SEQ ID NO: 961472 - protein, 4 aa, Mycobacterium
KYTP

SEQ ID NO: 961473 - protein, 8 aa, Mycobacterium
LAAASSPL

SEQ ID NO: 961474 - protein, 6 aa, Mycobacterium
LAAEAS

SEQ ID NO: 961475 - protein, 10 aa, Mycobacterium
LAAGPPPRRL

SEQ ID NO: 961476 - protein, 9 aa, Mycobacterium
LAAGPTVAT

SEQ ID NO: 961477 - protein, 7 aa, Mycobacterium
LAAKPST

SEQ ID NO: 961478 - protein, 14 aa, Mycobacterium
LAAPAIPDAGNPAA

SEQ ID NO: 961479 - protein, 6 aa, Mycobacterium
LAARSD

SEQ ID NO: 961480 - protein, 8 aa, Mycobacterium
LAATRPPV

SEQ ID NO: 961481 - protein, 19 aa, Mycobacterium
LAATSRGDGGHGSSGGHAS

SEQ ID NO: 961482 - protein, 46 aa, Mycobacterium
LADAARASELGSSQPAGESAYQNYQGYPGYQPPPGSVPPSPPPYGY

SEQ ID NO: 961483 - protein, 13 aa, Mycobacterium
LADDGEDAVEGRR

SEQ ID NO: 961484 - protein, 31 aa, Mycobacterium
LADEQDEAQDEAQDSETEAETTQVSAGPSAA

SEQ ID NO: 961485 - protein, 8 aa, Mycobacterium
LADRPGVL

SEQ ID NO: 961486 - protein, 6 aa, Mycobacterium
LADTGR

SEQ ID NO: 961487 - protein, 8 aa, Mycobacterium
LAEAGYGS

SEQ ID NO: 961488 - protein, 4 aa, Mycobacterium
LAEG

SEQ ID NO: 961489 - protein, 14 aa, Mycobacterium
LAEGKSNDIPERAT

SEQ ID NO: 961490 - protein, 24 aa, Mycobacterium
LAGAARAALSGQPLPQAPPGGPKT

SEQ ID NO: 961491 - protein, 7 aa, Mycobacterium
LAGDGSP

SEQ ID NO: 961492 - protein, 6 aa, Mycobacterium
LAGGDP

SEQ ID NO: 961493 - protein, 28 aa, Mycobacterium
LAGGTDTAGPGGGAEAKNGSKGQSAARK

SEQ ID NO: 961494 - protein, 9 aa, Mycobacterium
LAGGTREDV

SEQ ID NO: 961495 - protein, 9 aa, Mycobacterium
LAGKQGELL

SEQ ID NO: 961496 - protein, 9 aa, Mycobacterium
LAGNDDPKL

SEQ ID NO: 961497 - protein, 7 aa, Mycobacterium
LAGPQPV

SEQ ID NO: 961498 - protein, 9 aa, Mycobacterium
LAGSVTKPV

SEQ ID NO: 961499 - protein, 12 aa, Mycobacterium
LAGTDSHLESPT

SEQ ID NO: 961500 - protein, 9 aa, Mycobacterium
LAKDPDDRY

SEQ ID NO: 961501 - protein, 9 aa, Mycobacterium
LANADYGSA

SEQ ID NO: 961502 - protein, 5 aa, Mycobacterium
LAPDA

SEQ ID NO: 961503 - protein, 27 aa, Mycobacterium
LAPDSEPDPDAEADAETAAEAEQPSAG

SEQ ID NO: 961504 - protein, 17 aa, Mycobacterium
LAPDSKPGRPASAEGGP

SEQ ID NO: 961505 - protein, 6 aa, Mycobacterium
LAPGQR

SEQ ID NO: 961506 - protein, 8 aa, Mycobacterium
LAPMNPEQ

SEQ ID NO: 961507 - protein, 10 aa, Mycobacterium
LAPPNTRKGT

SEQ ID NO: 961508 - protein, 5 aa, Mycobacterium
LAPSG

SEQ ID NO: 961509 - protein, 9 aa, Mycobacterium
LAQNPNDPN

SEQ ID NO: 961510 - protein, 6 aa, Mycobacterium
LAQSQD

SEQ ID NO: 961511 - protein, 7 aa, Mycobacterium
LAQSRRS

SEQ ID NO: 961512 - protein, 9 aa, Mycobacterium
LARATPDVP

SEQ ID NO: 961513 - protein, 4 aa, Mycobacterium
LARR

SEQ ID NO: 961514 - protein, 6 aa, Mycobacterium
LASANA

SEQ ID NO: 961515 - protein, 4 aa, Mycobacterium
LASE

SEQ ID NO: 961516 - protein, 4 aa, Mycobacterium
LASG

SEQ ID NO: 961517 - protein, 12 aa, Mycobacterium
LASHPALNRPIN

SEQ ID NO: 961518 - protein, 4 aa, Mycobacterium
LASN

SEQ ID NO: 961519 - protein, 34 aa, Mycobacterium
LASPGTGSAGAPASGAGAGAPGTAPPGPGAPAPA

SEQ ID NO: 961520 - protein, 9 aa, Mycobacterium
LASPTRRGE

SEQ ID NO: 961521 - protein, 44 aa, Mycobacterium
LASRNAATAAPESPESPGSPESPVSPQPRPVEARKPTTSAEPEP

SEQ ID NO: 961522 - protein, 8 aa, Mycobacterium
LASTSVGA

SEQ ID NO: 961523 - protein, 8 aa, Mycobacterium
LATGAAAG

SEQ ID NO: 961524 - protein, 10 aa, Mycobacterium
LATGHDGHLS

SEQ ID NO: 961525 - protein, 5 aa, Mycobacterium
LATPR

SEQ ID NO: 961526 - protein, 11 aa, Mycobacterium
LATSGRSMRSK

SEQ ID NO: 961527 - protein, 8 aa, Mycobacterium
LATSPRPQ

SEQ ID NO: 961528 - protein, 14 aa, Mycobacterium
LATSRDVDPEGTVT

SEQ ID NO: 961529 - protein, 51 aa, Mycobacterium
LDAPPTRPIRSRRSGGGLPPDGGAPPPAGPAGPSGPTGRSRARSHRSTTQR

SEQ ID NO: 961530 - protein, 9 aa, Mycobacterium
LDASKNDDS

SEQ ID NO: 961531 - protein, 7 aa, Mycobacterium
LDATSQR

SEQ ID NO: 961532 - protein, 26 aa, Mycobacterium
LDDAASQAAIDNANAKDEQMKAICGG

SEQ ID NO: 961533 - protein, 16 aa, Mycobacterium
LDDDEPDDRIPSPPTA

SEQ ID NO: 961534 - protein, 6 aa, Mycobacterium
LDDEGQ

SEQ ID NO: 961535 - protein, 9 aa, Mycobacterium
LDDEREPAT

SEQ ID NO: 961536 - protein, 6 aa, Mycobacterium
LDDQPE

SEQ ID NO: 961537 - protein, 13 aa, Mycobacterium
LDDSTPETPAQRR

SEQ ID NO: 961538 - protein, 4 aa, Mycobacterium
LDEA

SEQ ID NO: 961539 - protein, 17 aa, Mycobacterium
LDEAPGQTLSGPRAATP

SEQ ID NO: 961540 - protein, 23 aa, Mycobacterium
LDEEPSDTDRNGPSLPPEPGADS

SEQ ID NO: 961541 - protein, 4 aa, Mycobacterium
LDER

SEQ ID NO: 961542 - protein, 14 aa, Mycobacterium
LDERADSGRVQSAA

SEQ ID NO: 961543 - protein, 5 aa, Mycobacterium
LDERD

SEQ ID NO: 961544 - protein, 7 aa, Mycobacterium
LDERDAQ

SEQ ID NO: 961545 - protein, 11 aa, Mycobacterium
LDGEREPVPSA

SEQ ID NO: 961546 - protein, 6 aa, Mycobacterium
LDGGTV

SEQ ID NO: 961547 - protein, 10 aa, Mycobacterium
LDGQDEATLQ

SEQ ID NO: 961548 - protein, 10 aa, Mycobacterium
LDKDKAAKMA

SEQ ID NO: 961549 - protein, 14 aa, Mycobacterium
LDNPRSPRRRASMP

SEQ ID NO: 961550 - protein, 12 aa, Mycobacterium
LDPADGRPRASA

SEQ ID NO: 961551 - protein, 6 aa, Mycobacterium
LDPATE

SEQ ID NO: 961552 - protein, 8 aa, Mycobacterium
LDPDSDHA

SEQ ID NO: 961553 - protein, 11 aa, Mycobacterium
LDPESSRSARP

SEQ ID NO: 961554 - protein, 6 aa, Mycobacterium
LDPGGR

SEQ ID NO: 961555 - protein, 5 aa, Mycobacterium
LDPGN

SEQ ID NO: 961556 - protein, 8 aa, Mycobacterium
LDPGNAEA

SEQ ID NO: 961557 - protein, 9 aa, Mycobacterium
LDPTGTGQK

SEQ ID NO: 961558 - protein, 14 aa, Mycobacterium
LDRAGRSGSIPRPS

SEQ ID NO: 961559 - protein, 6 aa, Mycobacterium
LDRDDT

SEQ ID NO: 961560 - protein, 7 aa, Mycobacterium
LDRRPKG

SEQ ID NO: 961561 - protein, 4 aa, Mycobacterium
LDRS

SEQ ID NO: 961562 - protein, 11 aa, Mycobacterium
LDSPPSTPLQR

SEQ ID NO: 961563 - protein, 7 aa, Mycobacterium
LDTTGPG

SEQ ID NO: 961564 - protein, 7 aa, Mycobacterium
LEAPPVG

SEQ ID NO: 961565 - protein, 11 aa, Mycobacterium
LEARAQAGGLP

SEQ ID NO: 961566 - protein, 8 aa, Mycobacterium
LEASTTLP

SEQ ID NO: 961567 - protein, 16 aa, Mycobacterium
LEDPAPRWDAQRFDER

SEQ ID NO: 961568 - protein, 22 aa, Mycobacterium
LEDPDDTGEASDADSPEASGKR

SEQ ID NO: 961569 - protein, 7 aa, Mycobacterium
LEEDPQN

SEQ ID NO: 961570 - protein, 5 aa, Mycobacterium
LEGLN

SEQ ID NO: 961571 - protein, 33 aa, Mycobacterium; identical to SEQ ID NO: 268975

SEQ ID NO: 961572 - protein, 8 aa, Mycobacterium
LEPDEHDR

SEQ ID NO: 961573 - protein, 5 aa, Mycobacterium
LEPTT

SEQ ID NO: 961574 - protein, 5 aa, Mycobacterium
LERDQ

SEQ ID NO: 961575 - protein, 9 aa, Mycobacterium
LESESDDAA

SEQ ID NO: 961576 - protein, 9 aa, Mycobacterium
LETGPPPRR

SEQ ID NO: 961577 - protein, 8 aa, Mycobacterium
LETKSDLS

SEQ ID NO: 961578 - protein, 9 aa, Mycobacterium
LGAASSSCS

SEQ ID NO: 961579 - protein, 5 aa, Mycobacterium
LGADT

SEQ ID NO: 961580 - protein, 10 aa, Mycobacterium
LGAESTAADL

SEQ ID NO: 961581 - protein, 13 aa, Mycobacterium
LGAPDSQPAESTL

SEQ ID NO: 961582 - protein, 7 aa, Mycobacterium
LGAPSIN

SEQ ID NO: 961583 - protein, 6 aa, Mycobacterium
LGARPS

SEQ ID NO: 961584 - protein, 6 aa, Mycobacterium
LGATAG

SEQ ID NO: 961585 - protein, 4 aa, Mycobacterium
LGDE

SEQ ID NO: 961586 - protein, 37 aa, Mycobacterium
LGDNATKYATPASRRSVARAQDAAIATEKASKSAELD

SEQ ID NO: 961587 - protein, 7 aa, Mycobacterium
LGDPADT

SEQ ID NO: 961588 - protein, 8 aa, Mycobacterium
LGDQNKQF

SEQ ID NO: 961589 - protein, 7 aa, Mycobacterium
LGDRYGR

SEQ ID NO: 961590 - protein, 4 aa, Mycobacterium
LGEE

SEQ ID NO: 961591 - protein, 4 aa, Mycobacterium
LGEL

SEQ ID NO: 961592 - protein, 22 aa, Mycobacterium
LGEPGTPDSAAAAAIRSSQVDV

SEQ ID NO: 961593 - protein, 10 aa, Mycobacterium
LGEQIDADTD

SEQ ID NO: 961594 - protein, 6 aa, Mycobacterium
LGERAA

SEQ ID NO: 961595 - protein, 13 aa, Mycobacterium
LGESEDDSTPAFD

SEQ ID NO: 961596 - protein, 36 aa, Mycobacterium
LGESGTSSGTATPGTATAGGGAGLPRHSEANGRDFG

SEQ ID NO: 961597 - protein, 6 aa, Mycobacterium
LGGAGF

SEQ ID NO: 961598 - protein, 4 aa, Mycobacterium
LGGE

SEQ ID NO: 961599 - protein, 9 aa, Mycobacterium
LGGGEPIPT

SEQ ID NO: 961600 - protein, 10 aa, Mycobacterium
LGGGNYSGSL

SEQ ID NO: 961601 - protein, 10 aa, Mycobacterium
LGGGQPTRRL

SEQ ID NO: 961602 - protein, 8 aa, Mycobacterium
LGGPEGQL

SEQ ID NO: 961603 - protein, 23 aa, Mycobacterium
LGGRDTRVATPSGLDGPGMSTSA

SEQ ID NO: 961604 - protein, 4 aa, Mycobacterium
LGLA

SEQ ID NO: 961605 - protein, 4 aa, Mycobacterium
LGLS

SEQ ID NO: 961606 - protein, 9 aa, Mycobacterium
LGMTESDRR

SEQ ID NO: 961607 - protein, 13 aa, Mycobacterium
LGNGQPDTVPAAS

SEQ ID NO: 961608 - protein, 9 aa, Mycobacterium
LGNPDNSND

SEQ ID NO: 961609 - protein, 9 aa, Mycobacterium
LGNSDKVRV

SEQ ID NO: 961610 - protein, 5 aa, Mycobacterium
LGPAG

SEQ ID NO: 961611 - protein, 11 aa, Mycobacterium
LGPDGGWRGNA

SEQ ID NO: 961612 - protein, 7 aa, Mycobacterium
LGPGDAD

SEQ ID NO: 961613 - protein, 13 aa, Mycobacterium
LGPGPVTTGAGAG

SEQ ID NO: 961614 - protein, 4 aa, Mycobacterium
LGPL

SEQ ID NO: 961615 - protein, 8 aa, Mycobacterium
LGPPPQVD

SEQ ID NO: 961616 - protein, 6 aa, Mycobacterium
LGPQDC

SEQ ID NO: 961617 - protein, 6 aa, Mycobacterium
LGPRGG

SEQ ID NO: 961618 - protein, 6 aa, Mycobacterium
LGPSGV

SEQ ID NO: 961619 - protein, 12 aa, Mycobacterium
LGPTKDQPTGPF

SEQ ID NO: 961620 - protein, 6 aa, Mycobacterium
LGQPAN

SEQ ID NO: 961621 - protein, 11 aa, Mycobacterium
LGRPGDDTADI

SEQ ID NO: 961622 - protein, 10 aa, Mycobacterium
LGRQSEEGSG

SEQ ID NO: 961623 - protein, 14 aa, Mycobacterium
LGRREPDVYGSTTH

SEQ ID NO: 961624 - protein, 9 aa, Mycobacterium
LGRSSTADF

SEQ ID NO: 961625 - protein, 8 aa, Mycobacterium
LGSAAESS

SEQ ID NO: 961626 - protein, 12 aa, Mycobacterium
LGSAGSPGSGSF

SEQ ID NO: 961627 - protein, 10 aa, Mycobacterium
LGSARANDSV

SEQ ID NO: 961628 - protein, 10 aa, Mycobacterium
LGSPRRPPRA

SEQ ID NO: 961629 - protein, 8 aa, Mycobacterium
LGSPSSLA

SEQ ID NO: 961630 - protein, 30 aa, Mycobacterium
LGSRAGAGALPKGPLPNAGKMRGVQRSVRR

SEQ ID NO: 961631 - protein, 13 aa, Mycobacterium
LGSSLTTHTAANG

SEQ ID NO: 961632 - protein, 8 aa, Mycobacterium
LGSSTPTA

SEQ ID NO: 961633 - protein, 9 aa, Mycobacterium
LGTGSDGHS

SEQ ID NO: 961634 - protein, 7 aa, Mycobacterium
LGTPGVP

SEQ ID NO: 961635 - protein, 5 aa, Mycobacterium
LGVSG

SEQ ID NO: 961636 - protein, 5 aa, Mycobacterium
LHPGS

SEQ ID NO: 961637 - protein, 5 aa, Mycobacterium
LHSPR

SEQ ID NO: 961638 - protein, 5 aa, Mycobacterium
LHSPS

SEQ ID NO: 961639 - protein, 7 aa, Mycobacterium
LKEPRES

SEQ ID NO: 961640 - protein, 11 aa, Mycobacterium
LKKGGEVSEPR

SEQ ID NO: 961641 - protein, 7 aa, Mycobacterium
LKPGART

SEQ ID NO: 961642 - protein, 13 aa, Mycobacterium
LKPREGGDFGTTE

SEQ ID NO: 961643 - protein, 6 aa, Mycobacterium
LKPTEA

SEQ ID NO: 961644 - protein, 7 aa, Mycobacterium
LKQGKSQ

SEQ ID NO: 961645 - protein, 4 aa, Mycobacterium
LKQL

SEQ ID NO: 961646 - protein, 9 aa, Mycobacterium
LKSAEPTVS

SEQ ID NO: 961647 - protein, 7 aa, Mycobacterium
LKSDQGR

SEQ ID NO: 961648 - protein, 8 aa, Mycobacterium
LKSSTGLT

SEQ ID NO: 961649 - protein, 5 aa, Mycobacterium
LLGPS

SEQ ID NO: 961650 - protein, 5 aa, Mycobacterium
LLPSE

SEQ ID NO: 961651 - protein, 9 aa, Mycobacterium
LNAQTGNLS

SEQ ID NO: 961652 - protein, 4 aa, Mycobacterium
LNDA

SEQ ID NO: 961653 - protein, 8 aa, Mycobacterium
LNDPDDDA

SEQ ID NO: 961654 - protein, 10 aa, Mycobacterium
LNDPDPLAES

SEQ ID NO: 961655 - protein, 4 aa, Mycobacterium
LNEP

SEQ ID NO: 961656 - protein, 4 aa, Mycobacterium
LNPD

SEQ ID NO: 961657 - protein, 6 aa, Mycobacterium
LNPDEY

SEQ ID NO: 961658 - protein, 6 aa, Mycobacterium
LNPDNT

SEQ ID NO: 961659 - protein, 7 aa, Mycobacterium
LNPNGVT

SEQ ID NO: 961660 - protein, 9 aa, Mycobacterium
LNPTPAISA

SEQ ID NO: 961661 - protein, 4 aa, Mycobacterium
LNRD

SEQ ID NO: 961662 - protein, 34 aa, Mycobacterium
LNRRSGDGAVDHAPQDRAAGQPDDALPGSKPAQW

SEQ ID NO: 961663 - protein, 8 aa, Mycobacterium
LNSHTTPL

SEQ ID NO: 961664 - protein, 8 aa, Mycobacterium
LNSPDGKF

SEQ ID NO: 961665 - protein, 11 aa, Mycobacterium
LPAASAATAAT

SEQ ID NO: 961666 - protein, 5 aa, Mycobacterium
LPADM

SEQ ID NO: 961667 - protein, 4 aa, Mycobacterium
LPAG

SEQ ID NO: 961668 - protein, 10 aa, Mycobacterium
LPAGPAAGVR

SEQ ID NO: 961669 - protein, 11 aa, Mycobacterium
LPANEGYSAAE

SEQ ID NO: 961670 - protein, 5 aa, Mycobacterium
LPANG

SEQ ID NO: 961671 - protein, 9 aa, Mycobacterium
LPARGTIGD

SEQ ID NO: 961672 - protein, 7 aa, Mycobacterium
LPASPKR

SEQ ID NO: 961673 - protein, 10 aa, Mycobacterium
LPASRNADLT

SEQ ID NO: 961674 - protein, 16 aa, Mycobacterium
LPASSAFSGAPTVTQQ

SEQ ID NO: 961675 - protein, 17 aa, Mycobacterium
LPDDDGTSHTEPATSRP

SEQ ID NO: 961676 - protein, 8 aa, Mycobacterium
LPDDQRKE

SEQ ID NO: 961677 - protein, 14 aa, Mycobacterium
LPDSGGPRTSRTRA

SEQ ID NO: 961678 - protein, 12 aa, Mycobacterium
LPDSMEDDLPDP

SEQ ID NO: 961679 - protein, 13 aa, Mycobacterium
LPEPHGNEDRREA

SEQ ID NO: 961680 - protein, 4 aa, Mycobacterium
LPEQ

SEQ ID NO: 961681 - protein, 9 aa, Mycobacterium
LPESGGLLP

SEQ ID NO: 961682 - protein, 4 aa, Mycobacterium
LPET

SEQ ID NO: 961683 - protein, 5 aa, Mycobacterium
LPGKQ

SEQ ID NO: 961684 - protein, 7 aa, Mycobacterium
LPGNGKS

SEQ ID NO: 961685 - protein, 7 aa, Mycobacterium
LPGRGVR

SEQ ID NO: 961686 - protein, 11 aa, Mycobacterium
LPGRRGGVPQF

SEQ ID NO: 961687 - protein, 8 aa, Mycobacterium
LPGSAPKP

SEQ ID NO: 961688 - protein, 15 aa, Mycobacterium
LPGTASPATQEVPAG

SEQ ID NO: 961689 - protein, 13 aa, Mycobacterium
LPHREQYSDPEKP

SEQ ID NO: 961690 - protein, 8 aa, Mycobacterium
LPKPPAER

SEQ ID NO: 961691 - protein, 10 aa, Mycobacterium
LPKPPSPAAV

SEQ ID NO: 961692 - protein, 21 aa, Mycobacterium
LPPAPPPGAPRESGPTPGSEP

SEQ ID NO: 961693 - protein, 16 aa, Mycobacterium
LPPDGTPGPPAPMKQN

SEQ ID NO: 961694 - protein, 12 aa, Mycobacterium
LPPDTSADNRRR

SEQ ID NO: 961695 - protein, 12 aa, Mycobacterium
LPPDTSKEGRAQ

SEQ ID NO: 961696 - protein, 11 aa, Mycobacterium
LPPDTTKEDRE

SEQ ID NO: 961697 - protein, 8 aa, Mycobacterium
LPPGAPGS

SEQ ID NO: 961698 - protein, 7 aa, Mycobacterium
LPPGGVP

SEQ ID NO: 961699 - protein, 5 aa, Mycobacterium
LPPGP

SEQ ID NO: 961700 - protein, 6 aa, Mycobacterium
LPPGSQ

SEQ ID NO: 961701 - protein, 5 aa, Mycobacterium
LPPGV

SEQ ID NO: 961702 - protein, 45 aa, Mycobacterium
LPPIAGPSSTIAPPTTRTSPTPSSSPAPTTTSGSATPTTTPTAGA

SEQ ID NO: 961703 - protein, 131 aa, Mycobacterium
LPPPPPKPIKVKEPKQRRRRKKGGEGDDVDETDETEDAEDAEDVDEADEADEAEETDEAEEADEASDGEESVESEEAEPTEEAEVAEAAEETAEPEAQGQDATAHGGLRNRRPTGKTSHRRRRVRRGVTVE

SEQ ID NO: 961704 - protein, 6 aa, Mycobacterium
LPPPPT

SEQ ID NO: 961705 - protein, 6 aa, Mycobacterium
LPPQND

SEQ ID NO: 961706 - protein, 17 aa, Mycobacterium
LPPTDTSPQPGAPHSTL

SEQ ID NO: 961707 - protein, 41 aa, Mycobacterium; identical to SEQ ID NO: 269977

SEQ ID NO: 961708 - protein, 20 aa, Mycobacterium
LPQPGTTAPPIPADVKPKGV

SEQ ID NO: 961709 - protein, 5 aa, Mycobacterium
LPQRL

SEQ ID NO: 961710 - protein, 11 aa, Mycobacterium
LPQSPSGSHAS

SEQ ID NO: 961711 - protein, 29 aa, Mycobacterium
LPREPEIGASTHAAGESRLGDDGRPDAHP

SEQ ID NO: 961712 - protein, 6 aa, Mycobacterium
LPRRAS

SEQ ID NO: 961713 - protein, 38 aa, Mycobacterium
LPRRPDRSGARSGQQGAGQRYAGQRHSGRVRALEGQRY

SEQ ID NO: 961714 - protein, 19 aa, Mycobacterium
LPSASAEPNAEANSGAQEC

SEQ ID NO: 961715 - protein, 5 aa, Mycobacterium
LPSTQ

SEQ ID NO: 961716 - protein, 8 aa, Mycobacterium
LPTAVGPA

SEQ ID NO: 961717 - protein, 11 aa, Mycobacterium
LPTPPRVSPDR

SEQ ID NO: 961718 - protein, 11 aa, Mycobacterium
LPTRTSGKVDR

SEQ ID NO: 961719 - protein, 5 aa, Mycobacterium
LPTTG

SEQ ID NO: 961720 - protein, 12 aa, Mycobacterium
LPVEPSSRTAVA

SEQ ID NO: 961721 - protein, 4 aa, Mycobacterium
LPVP

SEQ ID NO: 961722 - protein, 6 aa, Mycobacterium
LPVPAG

SEQ ID NO: 961723 - protein, 7 aa, Mycobacterium
LPVPSTR

SEQ ID NO: 961724 - protein, 13 aa, Mycobacterium
LQAAGGALAGADT

SEQ ID NO: 961725 - protein, 7 aa, Mycobacterium
LQDGRRK

SEQ ID NO: 961726 - protein, 9 aa, Mycobacterium
LQGGSTITQ

SEQ ID NO: 961727 - protein, 5 aa, Mycobacterium
LQGQT

SEQ ID NO: 961728 - protein, 7 aa, Mycobacterium
LQGVGGG

SEQ ID NO: 961729 - protein, 11 aa, Mycobacterium
LQNGESPATDW

SEQ ID NO: 961730 - protein, 7 aa, Mycobacterium
LQPGGPV

SEQ ID NO: 961731 - protein, 5 aa, Mycobacterium
LQPGS

SEQ ID NO: 961732 - protein, 20 aa, Mycobacterium
LQPPRVGAGPGELAAQGAVG

SEQ ID NO: 961733 - protein, 12 aa, Mycobacterium
LQPSRQSRRRVS

SEQ ID NO: 961734 - protein, 7 aa, Mycobacterium
LQRTGGL

SEQ ID NO: 961735 - protein, 4 aa, Mycobacterium
LQSA

SEQ ID NO: 961736 - protein, 10 aa, Mycobacterium
LQSAHDSASI

SEQ ID NO: 961737 - protein, 7 aa, Mycobacterium
LQSSAQG

SEQ ID NO: 961738 - protein, 21 aa, Mycobacterium
LQTAQRREAVAGREGVPSPAA

SEQ ID NO: 961739 - protein, 12 aa, Mycobacterium
LQTPPGPPNAYD

SEQ ID NO: 961740 - protein, 11 aa, Mycobacterium
LQTVNDGSRRQ

SEQ ID NO: 961741 - protein, 5 aa, Mycobacterium
LRAES

SEQ ID NO: 961742 - protein, 6 aa, Mycobacterium
LRAGGD

SEQ ID NO: 961743 - protein, 6 aa, Mycobacterium
LRATSS

SEQ ID NO: 961744 - protein, 4 aa, Mycobacterium
LRDA

SEQ ID NO: 961745 - protein, 6 aa, Mycobacterium
LRDNPK

SEQ ID NO: 961746 - protein, 8 aa, Mycobacterium
LRDQESGI

SEQ ID NO: 961747 - protein, 7 aa, Mycobacterium
LREERGS

SEQ ID NO: 961748 - protein, 15 aa, Mycobacterium
LREGSGSAGHTGAPV

SEQ ID NO: 961749 - protein, 11 aa, Mycobacterium
LREREAARRAY

SEQ ID NO: 961750 - protein, 8 aa, Mycobacterium
LRETNRER

SEQ ID NO: 961751 - protein, 5 aa, Mycobacterium
LRGDH

SEQ ID NO: 961752 - protein, 24 aa, Mycobacterium
LRGPPSAPTAMAAGSAYPDRGEHR

SEQ ID NO: 961753 - protein, 9 aa, Mycobacterium
LRGQRSASR

SEQ ID NO: 961754 - protein, 8 aa, Mycobacterium
LRGRSDNP

SEQ ID NO: 961755 - protein, 7 aa, Mycobacterium
LRGSSTG

SEQ ID NO: 961756 - protein, 15 aa, Mycobacterium
LRGTRKAEEAAESAR

SEQ ID NO: 961757 - protein, 6 aa, Mycobacterium
LRNGEA

SEQ ID NO: 961758 - protein, 4 aa, Mycobacterium
LRNP

SEQ ID NO: 961759 - protein, 6 aa, Mycobacterium
LRNPPE

SEQ ID NO: 961760 - protein, 5 aa, Mycobacterium
LRPDE

SEQ ID NO: 961761 - protein, 4 aa, Mycobacterium
LRPE

SEQ ID NO: 961762 - protein, 4 aa, Mycobacterium
LRPG

SEQ ID NO: 961763 - protein, 14 aa, Mycobacterium
LRPGGGSQAAASGI

SEQ ID NO: 961764 - protein, 8 aa, Mycobacterium
LRPPERAQ

SEQ ID NO: 961765 - protein, 4 aa, Mycobacterium
LRPS

SEQ ID NO: 961766 - protein, 6 aa, Mycobacterium
LRPTEV

SEQ ID NO: 961767 - protein, 5 aa, Mycobacterium
LRRGQ

SEQ ID NO: 961768 - protein, 6 aa, Mycobacterium
LRRPAQ

SEQ ID NO: 961769 - protein, 4 aa, Mycobacterium
LRSG

SEQ ID NO: 961770 - protein, 10 aa, Mycobacterium
LRSGKAGTDA

SEQ ID NO: 961771 - protein, 14 aa, Mycobacterium
LRSGVSSPTVFATG

SEQ ID NO: 961772 - protein, 10 aa, Mycobacterium
LRSPDAPVLS

SEQ ID NO: 961773 - protein, 6 aa, Mycobacterium
LRSSGI

SEQ ID NO: 961774 - protein, 14 aa, Mycobacterium
LRSSTQACADRRSM

SEQ ID NO: 961775 - protein, 5 aa, Mycobacterium
LRTGS

SEQ ID NO: 961776 - protein, 8 aa, Mycobacterium
LRTNRGGD

SEQ ID NO: 961777 - protein, 24 aa, Mycobacterium
LRTRPGETPADEPAAPLDMGTKDP

SEQ ID NO: 961778 - protein, 12 aa, Mycobacterium
LRYGKSDATDEE

SEQ ID NO: 961779 - protein, 12 aa, Mycobacterium
LSAAAAANTKHD

SEQ ID NO: 961780 - protein, 9 aa, Mycobacterium
LSAAGSRGI

SEQ ID NO: 961781 - protein, 7 aa, Mycobacterium
LSAARAA

SEQ ID NO: 961782 - protein, 8 aa, Mycobacterium
LSAGERQD

SEQ ID NO: 961783 - protein, 7 aa, Mycobacterium
LSAGQAE

SEQ ID NO: 961784 - protein, 6 aa, Mycobacterium
LSAGSA

SEQ ID NO: 961785 - protein, 6 aa, Mycobacterium
LSDAGR

SEQ ID NO: 961786 - protein, 8 aa, Mycobacterium
LSDAKKKL

SEQ ID NO: 961787 - protein, 9 aa, Mycobacterium
LSDEDGRTA

SEQ ID NO: 961788 - protein, 6 aa, Mycobacterium
LSDGQL

SEQ ID NO: 961789 - protein, 5 aa, Mycobacterium
LSDPI

SEQ ID NO: 961790 - protein, 9 aa, Mycobacterium
LSDPVSDET

SEQ ID NO: 961791 - protein, 6 aa, Mycobacterium
LSDSTD

SEQ ID NO: 961792 - protein, 7 aa, Mycobacterium
LSEAGAN

SEQ ID NO: 961793 - protein, 7 aa, Mycobacterium
LSEENGS

SEQ ID NO: 961794 - protein, 9 aa, Mycobacterium
LSEGSGGVS

SEQ ID NO: 961795 - protein, 12 aa, Mycobacterium
LSERAEGSITTE

SEQ ID NO: 961796 - protein, 9 aa, Mycobacterium
LSGDDAAAI

SEQ ID NO: 961797 - protein, 10 aa, Mycobacterium
LSGEGSDTDT

SEQ ID NO: 961798 - protein, 10 aa, Mycobacterium
LSGGQRKRAS

SEQ ID NO: 961799 - protein, 8 aa, Mycobacterium
LSGGQRQR

SEQ ID NO: 961800 - protein, 25 aa, Mycobacterium
LSGGSYQNLATSTGPNLAAAVDTFL

SEQ ID NO: 961801 - protein, 19 aa, Mycobacterium
LSGNPASADQITQAAAGVG

SEQ ID NO: 961802 - protein, 13 aa, Mycobacterium
LSGSGTNGSAQPA

SEQ ID NO: 961803 - protein, 10 aa, Mycobacterium
LSHPDDPRNW

SEQ ID NO: 961804 - protein, 8 aa, Mycobacterium
LSHRNTQP

SEQ ID NO: 961805 - protein, 12 aa, Mycobacterium
LSPAAADEQPNR

SEQ ID NO: 961806 - protein, 6 aa, Mycobacterium
LSPAGE

SEQ ID NO: 961807 - protein, 12 aa, Mycobacterium
LSPDQEPAGRRS

SEQ ID NO: 961808 - protein, 15 aa, Mycobacterium
LSPEAGATGASQDRE

SEQ ID NO: 961809 - protein, 16 aa, Mycobacterium
LSPEQARGDSVDARSD

SEQ ID NO: 961810 - protein, 6 aa, Mycobacterium
LSPETV

SEQ ID NO: 961811 - protein, 5 aa, Mycobacterium
LSPEV

SEQ ID NO: 961812 - protein, 4 aa, Mycobacterium
LSPG

SEQ ID NO: 961813 - protein, 6 aa, Mycobacterium
LSPGDR

SEQ ID NO: 961814 - protein, 25 aa, Mycobacterium
LSPGQTITKGTVPSEIGPALDTANR

SEQ ID NO: 961815 - protein, 5 aa, Mycobacterium
LSPID

SEQ ID NO: 961816 - protein, 4 aa, Mycobacterium
LSPS

SEQ ID NO: 961817 - protein, 5 aa, Mycobacterium
LSPSA

SEQ ID NO: 961818 - protein, 9 aa, Mycobacterium
LSPSPRSCR

SEQ ID NO: 961819 - protein, 12 aa, Mycobacterium
LSPTAAAAEAAT

SEQ ID NO: 961820 - protein, 5 aa, Mycobacterium
LSPTR

SEQ ID NO: 961821 - protein, 5 aa, Mycobacterium
LSQDE

SEQ ID NO: 961822 - protein, 46 aa, Mycobacterium; identical to SEQ ID NO: 270636

SEQ ID NO: 961823 - protein, 8 aa, Mycobacterium
LSRGGDAL

SEQ ID NO: 961824 - protein, 15 aa, Mycobacterium
LSRGGFQDPNAESAR

SEQ ID NO: 961825 - protein, 9 aa, Mycobacterium
LSRPGGSHK

SEQ ID NO: 961826 - protein, 10 aa, Mycobacterium
LSSATADSNE

SEQ ID NO: 961827 - protein, 17 aa, Mycobacterium
LSSATTAGSDEDVQTTA

SEQ ID NO: 961828 - protein, 14 aa, Mycobacterium
LSSDGTTVLSAGST

SEQ ID NO: 961829 - protein, 6 aa, Mycobacterium
LSSGPT

SEQ ID NO: 961830 - protein, 4 aa, Mycobacterium
LSSQ

SEQ ID NO: 961831 - protein, 11 aa, Mycobacterium
LSTDDGGKTRL

SEQ ID NO: 961832 - protein, 9 aa, Mycobacterium
LSTDKPESV

SEQ ID NO: 961833 - protein, 8 aa, Mycobacterium
LSTGTDTS

SEQ ID NO: 961834 - protein, 7 aa, Mycobacterium
LSTPSLN

SEQ ID NO: 961835 - protein, 6 aa, Mycobacterium
LSTSGI

SEQ ID NO: 961836 - protein, 15 aa, Mycobacterium
LSTSSVPQPPQPSIP

SEQ ID NO: 961837 - protein, 14 aa, Mycobacterium
LSTTSTTITGHSTQ

SEQ ID NO: 961838 - protein, 22 aa, Mycobacterium
LSYPTTRPPGISGGAISPAGFA

SEQ ID NO: 961839 - protein, 14 aa, Mycobacterium
LTASGSQSADDKAA

SEQ ID NO: 961840 - protein, 10 aa, Mycobacterium
LTDPSSGDLA

SEQ ID NO: 961841 - protein, 5 aa, Mycobacterium
LTEAR

SEQ ID NO: 961842 - protein, 12 aa, Mycobacterium
LTEETHDAERTI

SEQ ID NO: 961843 - protein, 13 aa, Mycobacterium
LTEGSAQSLDGKA

SEQ ID NO: 961844 - protein, 7 aa, Mycobacterium
LTEHGSG

SEQ ID NO: 961845 - protein, 10 aa, Mycobacterium
LTETGTRIND

SEQ ID NO: 961846 - protein, 6 aa, Mycobacterium
LTETTV

SEQ ID NO: 961847 - protein, 15 aa, Mycobacterium
LTGESEAGGVASGEP

SEQ ID NO: 961848 - protein, 4 aa, Mycobacterium
LTGG

SEQ ID NO: 961849 - protein, 9 aa, Mycobacterium
LTGHQDDDY

SEQ ID NO: 961850 - protein, 10 aa, Mycobacterium
LTGQPGPNQT

SEQ ID NO: 961851 - protein, 10 aa, Mycobacterium
LTGSPVSVAS

SEQ ID NO: 961852 - protein, 6 aa, Mycobacterium
LTHTPD

SEQ ID NO: 961853 - protein, 7 aa, Mycobacterium
LTKATGD

SEQ ID NO: 961854 - protein, 7 aa, Mycobacterium
LTKGTNR

SEQ ID NO: 961855 - protein, 7 aa, Mycobacterium
LTKTTGD

SEQ ID NO: 961856 - protein, 5 aa, Mycobacterium
LTNAP

SEQ ID NO: 961857 - protein, 6 aa, Mycobacterium
LTPDER

SEQ ID NO: 961858 - protein, 25 aa, Mycobacterium
LTPDPAQRPAHPAAARTTKPVAQQS

SEQ ID NO: 961859 - protein, 6 aa, Mycobacterium
LTPDRV

SEQ ID NO: 961860 - protein, 5 aa, Mycobacterium
LTPER

SEQ ID NO: 961861 - protein, 7 aa, Mycobacterium
LTPGNTA

SEQ ID NO: 961862 - protein, 12 aa, Mycobacterium
LTPGRGFRNGPF

SEQ ID NO: 961863 - protein, 12 aa, Mycobacterium
LTPNDPQFQPGF

SEQ ID NO: 961864 - protein, 6 aa, Mycobacterium
LTPPDD

SEQ ID NO: 961865 - protein, 7 aa, Mycobacterium
LTPPGTF

SEQ ID NO: 961866 - protein, 17 aa, Mycobacterium
LTPPTRISDKENPKVPK

SEQ ID NO: 961867 - protein, 8 aa, Mycobacterium
LTPSGALT

SEQ ID NO: 961868 - protein, 13 aa, Mycobacterium
LTPSRKSGSDAVE

SEQ ID NO: 961869 - protein, 11 aa, Mycobacterium
LTQATQGGGGA

SEQ ID NO: 961870 - protein, 11 aa, Mycobacterium
LTQSKDQPELA

SEQ ID NO: 961871 - protein, 10 aa, Mycobacterium
LTREDRGYHK

SEQ ID NO: 961872 - protein, 7 aa, Mycobacterium
LTRETPA

SEQ ID NO: 961873 - protein, 14 aa, Mycobacterium
LTRQDSSDLPPTTE

SEQ ID NO: 961874 - protein, 5 aa, Mycobacterium
LTRRS

SEQ ID NO: 961875 - protein, 7 aa, Mycobacterium
LTSAQEY

SEQ ID NO: 961876 - protein, 5 aa, Mycobacterium
LTSGA

SEQ ID NO: 961877 - protein, 10 aa, Mycobacterium
LTSRRQPSAT

SEQ ID NO: 961878 - protein, 24 aa, Mycobacterium
LTTAGETGVTEEPKVSAPEPPPRR

SEQ ID NO: 961879 - protein, 8 aa, Mycobacterium
LTTAPATE

SEQ ID NO: 961880 - protein, 7 aa, Mycobacterium
LTTAPGE

SEQ ID NO: 961881 - protein, 5 aa, Mycobacterium
LTTGE

SEQ ID NO: 961882 - protein, 6 aa, Mycobacterium
LTTKDE

SEQ ID NO: 961883 - protein, 10 aa, Mycobacterium
LTTPEQRQEA

SEQ ID NO: 961884 - protein, 7 aa, Mycobacterium
LTTPTAR

SEQ ID NO: 961885 - protein, 8 aa, Mycobacterium
LTVSGPAN

SEQ ID NO: 961886 - protein, 9 aa, Mycobacterium
LVTTGTPVA

SEQ ID NO: 961887 - protein, 10 aa, Mycobacterium
MAAGATAPGW

SEQ ID NO: 961888 - protein, 11 aa, Mycobacterium
MAEETRNPRRT

SEQ ID NO: 961889 - protein, 5 aa, Mycobacterium
MAEKA

SEQ ID NO: 961890 - protein, 8 aa, Mycobacterium
MAGQDEDD

SEQ ID NO: 961891 - protein, 10 aa, Mycobacterium
MAKNPDERYM

SEQ ID NO: 961892 - protein, 8 aa, Mycobacterium
MAPQPPAT

SEQ ID NO: 961893 - protein, 43 aa, Mycobacterium
MAQQGKGTAPAEDTAQTEATTVEDVEGAGADSAGAAAGRAPIE

SEQ ID NO: 961894 - protein, 7 aa, Mycobacterium
MATDDKK

SEQ ID NO: 961895 - protein, 11 aa, Mycobacterium
MDADDQASVSV

SEQ ID NO: 961896 - protein, 18 aa, Mycobacterium
MDEDDERIRAASRRGTQN

SEQ ID NO: 961897 - protein, 7 aa, Mycobacterium
MEGPTPV

SEQ ID NO: 961898 - protein, 9 aa, Mycobacterium
MERTSTQDI

SEQ ID NO: 961899 - protein, 5 aa, Mycobacterium
MGDDR

SEQ ID NO: 961900 - protein, 9 aa, Mycobacterium
MGGANATNS

SEQ ID NO: 961901 - protein, 9 aa, Mycobacterium
MGGHAAGEV

SEQ ID NO: 961902 - protein, 14 aa, Mycobacterium
MGGPPARRCSTNGR

SEQ ID NO: 961903 - protein, 9 aa, Mycobacterium
MGNAPNEPG

SEQ ID NO: 961904 - protein, 4 aa, Mycobacterium
MGRP

SEQ ID NO: 961905 - protein, 5 aa, Mycobacterium
MGSGV

SEQ ID NO: 961906 - protein, 4 aa, Mycobacterium
MGTA

SEQ ID NO: 961907 - protein, 9 aa, Mycobacterium
MGTQSDYSH

SEQ ID NO: 961908 - protein, 9 aa, Mycobacterium
MHSGPTTEL

SEQ ID NO: 961909 - protein, 8 aa, Mycobacterium
MNGNSDAT

SEQ ID NO: 961910 - protein, 16 aa, Mycobacterium
MNGTAEGVLPPDASAR

SEQ ID NO: 961911 - protein, 7 aa, Mycobacterium
MNPDAAG

SEQ ID NO: 961912 - protein, 7 aa, Mycobacterium
MPAEPSI

SEQ ID NO: 961913 - protein, 114 aa, Mycobacterium
MPAQPAAQEPQQEPQQPGGTAPAPGGPAPNAGQPPESSAPASPQSGAPAAPQSGTPGRPGAQPRPYPQDPPPSPAPAPSPAPTGSPAPPATGAQQPADLPPGEEPALPDPRKDL

SEQ ID NO: 961914 - protein, 12 aa, Mycobacterium
MPASAESTISSF

SEQ ID NO: 961915 - protein, 10 aa, Mycobacterium
MPAVTGADGR

SEQ ID NO: 961916 - protein, 14 aa, Mycobacterium
MPDPPSSRPLTRAE

SEQ ID NO: 961917 - protein, 10 aa, Mycobacterium
MPEGEGDTAG

SEQ ID NO: 961918 - protein, 6 aa, Mycobacterium
MPGENV

SEQ ID NO: 961919 - protein, 12 aa, Mycobacterium
MPGGGTADATTE

SEQ ID NO: 961920 - protein, 6 aa, Mycobacterium
MPGPDG

SEQ ID NO: 961921 - protein, 9 aa, Mycobacterium
MPNPTTLPA

SEQ ID NO: 961922 - protein, 6 aa, Mycobacterium
MPPGFD

SEQ ID NO: 961923 - protein, 10 aa, Mycobacterium
MPSPPKSMTT

SEQ ID NO: 961924 - protein, 11 aa, Mycobacterium
MPTDEGGKTRL

SEQ ID NO: 961925 - protein, 8 aa, Mycobacterium
MQGQQVGP

SEQ ID NO: 961926 - protein, 6 aa, Mycobacterium
MQQDTE

SEQ ID NO: 961927 - protein, 7 aa, Mycobacterium
MQTSELG

SEQ ID NO: 961928 - protein, 7 aa, Mycobacterium
MRARGQD

SEQ ID NO: 961929 - protein, 9 aa, Mycobacterium
MRATDVEPN

SEQ ID NO: 961930 - protein, 12 aa, Mycobacterium
MREANGGALDDP

SEQ ID NO: 961931 - protein, 13 aa, Mycobacterium
MRSGADDPDGASG

SEQ ID NO: 961932 - protein, 10 aa, Mycobacterium
MSANEATAAL

SEQ ID NO: 961933 - protein, 4 aa, Mycobacterium
MSAY

SEQ ID NO: 961934 - protein, 6 aa, Mycobacterium
MSGPDS

SEQ ID NO: 961935 - protein, 10 aa, Mycobacterium
MSGPFAGQRP

SEQ ID NO: 961936 - protein, 5 aa, Mycobacterium
MSPAR

SEQ ID NO: 961937 - protein, 8 aa, Mycobacterium
MSPDAAPS

SEQ ID NO: 961938 - protein, 5 aa, Mycobacterium
MSPTQ

SEQ ID NO: 961939 - protein, 15 aa, Mycobacterium
MTGEAKPTRVRPGGQ

SEQ ID NO: 961940 - protein, 6 aa, Mycobacterium
MTQRGG

SEQ ID NO: 961941 - protein, 4 aa, Mycobacterium
MTSQ

SEQ ID NO: 961942 - protein, 17 aa, Mycobacterium
MTTDDRTGLTGAQYTAP

SEQ ID NO: 961943 - protein, 7 aa, Mycobacterium
NAAASSI

SEQ ID NO: 961944 - protein, 5 aa, Mycobacterium
NAAGT

SEQ ID NO: 961945 - protein, 15 aa, Mycobacterium
NADNAKSAQIDDREQ

SEQ ID NO: 961946 - protein, 9 aa, Mycobacterium
NADRGAGSL

SEQ ID NO: 961947 - protein, 9 aa, Mycobacterium
NADVAPGSG

SEQ ID NO: 961948 - protein, 6 aa, Mycobacterium
NADYPQ

SEQ ID NO: 961949 - protein, 4 aa, Mycobacterium
NAET

SEQ ID NO: 961950 - protein, 7 aa, Mycobacterium
NAFGSNA

SEQ ID NO: 961951 - protein, 8 aa, Mycobacterium
NAFSGGPR

SEQ ID NO: 961952 - protein, 12 aa, Mycobacterium
NAGDGSAWSAAN

SEQ ID NO: 961953 - protein, 8 aa, Mycobacterium
NAGEGQPR

SEQ ID NO: 961954 - protein, 7 aa, Mycobacterium
NAGGGLG

SEQ ID NO: 961955 - protein, 21 aa, Mycobacterium
NAGKGPHELTQGRPTADGTTV

SEQ ID NO: 961956 - protein, 6 aa, Mycobacterium
NAGLAA

SEQ ID NO: 961957 - protein, 9 aa, Mycobacterium
NAGPDTNSS

SEQ ID NO: 961958 - protein, 4 aa, Mycobacterium
NAGQ

SEQ ID NO: 961959 - protein, 17 aa, Mycobacterium
NAGRPGNTKPVTVQPSS

SEQ ID NO: 961960 - protein, 6 aa, Mycobacterium
NAGRTG

SEQ ID NO: 961961 - protein, 14 aa, Mycobacterium
NAGTSNAAMLAAGM

SEQ ID NO: 961962 - protein, 8 aa, Mycobacterium
NAGVDGSV

SEQ ID NO: 961963 - protein, 9 aa, Mycobacterium
NAIASGAQV

SEQ ID NO: 961964 - protein, 7 aa, Mycobacterium
NAKAALS

SEQ ID NO: 961965 - protein, 11 aa, Mycobacterium
NALKSNSAALP

SEQ ID NO: 961966 - protein, 6 aa, Mycobacterium
NAMPPT

SEQ ID NO: 961967 - protein, 4 aa, Mycobacterium
NANA

SEQ ID NO: 961968 - protein, 4 aa, Mycobacterium
NAPG

SEQ ID NO: 961969 - protein, 25 aa, Mycobacterium
NAPTASTSAAASSASAGSVVKPTKA

SEQ ID NO: 961970 - protein, 8 aa, Mycobacterium
NARESAGV

SEQ ID NO: 961971 - protein, 9 aa, Mycobacterium
NARRGLAGA

SEQ ID NO: 961972 - protein, 8 aa, Mycobacterium
NARTRGGY

SEQ ID NO: 961973 - protein, 13 aa, Mycobacterium
NASAPGRPRQPSD

SEQ ID NO: 961974 - protein, 9 aa, Mycobacterium
NASGASKAE

SEQ ID NO: 961975 - protein, 8 aa, Mycobacterium
NASGGSVG

SEQ ID NO: 961976 - protein, 7 aa, Mycobacterium
NASRGRR

SEQ ID NO: 961977 - protein, 8 aa, Mycobacterium
NASSPTSN

SEQ ID NO: 961978 - protein, 5 aa, Mycobacterium
NASVS

SEQ ID NO: 961979 - protein, 4 aa, Mycobacterium
NASW

SEQ ID NO: 961980 - protein, 11 aa, Mycobacterium
NATGQRDKARR

SEQ ID NO: 961981 - protein, 15 aa, Mycobacterium
NATIPTGSQNPCFAN

SEQ ID NO: 961982 - protein, 9 aa, Mycobacterium
NATSPPLKD

SEQ ID NO: 961983 - protein, 5 aa, Mycobacterium
NDADR

SEQ ID NO: 961984 - protein, 16 aa, Mycobacterium
NDAGGVATYAQAGQNY

SEQ ID NO: 961985 - protein, 4 aa, Mycobacterium
NDAK

SEQ ID NO: 961986 - protein, 8 aa, Mycobacterium
NDATIGSR

SEQ ID NO: 961987 - protein, 8 aa, Mycobacterium
NDDRTGAA

SEQ ID NO: 961988 - protein, 7 aa, Mycobacterium
NDEAGAY

SEQ ID NO: 961989 - protein, 12 aa, Mycobacterium
NDETDDPGRTLG

SEQ ID NO: 961990 - protein, 4 aa, Mycobacterium
NDEV

SEQ ID NO: 961991 - protein, 12 aa, Mycobacterium
NDGEIGDGSGQL

SEQ ID NO: 961992 - protein, 9 aa, Mycobacterium
NDGGERTRG

SEQ ID NO: 961993 - protein, 7 aa, Mycobacterium
NDKPRTL

SEQ ID NO: 961994 - protein, 4 aa, Mycobacterium
NDLA

SEQ ID NO: 961995 - protein, 7 aa, Mycobacterium
NDLQDHA

SEQ ID NO: 961996 - protein, 13 aa, Mycobacterium
NDNQPLTAKDQRN

SEQ ID NO: 961997 - protein, 6 aa, Mycobacterium
NDPDAA

SEQ ID NO: 961998 - protein, 6 aa, Mycobacterium
NDPPPC

SEQ ID NO: 961999 - protein, 5 aa, Mycobacterium
NDPRL

SEQ ID NO: 962000 - protein, 4 aa, Mycobacterium
NDRI

SEQ ID NO: 962001 - protein, 29 aa, Mycobacterium
NDRNAEPALPADNDVGSDPTTLPSVNGSN

SEQ ID NO: 962002 - protein, 8 aa, Mycobacterium
NDSNTAAT

SEQ ID NO: 962003 - protein, 18 aa, Mycobacterium
NDYSDGIRGTDDDRTGPM

SEQ ID NO: 962004 - protein, 20 aa, Mycobacterium
NEADSADRTVDLSESPDNAE

SEQ ID NO: 962005 - protein, 5 aa, Mycobacterium
NEEAY

SEQ ID NO: 962006 - protein, 7 aa, Mycobacterium
NEGPDLG

SEQ ID NO: 962007 - protein, 4 aa, Mycobacterium
NEGR

SEQ ID NO: 962008 - protein, 7 aa, Mycobacterium
NELGPQG

SEQ ID NO: 962009 - protein, 5 aa, Mycobacterium
NEPVP

SEQ ID NO: 962010 - protein, 9 aa, Mycobacterium
NESATRRGI

SEQ ID NO: 962011 - protein, 6 aa, Mycobacterium
NESPCT

SEQ ID NO: 962012 - protein, 7 aa, Mycobacterium
NESQRDR

SEQ ID NO: 962013 - protein, 11 aa, Mycobacterium
NFTSQGPASLE

SEQ ID NO: 962014 - protein, 6 aa, Mycobacterium
NGAPVD

SEQ ID NO: 962015 - protein, 8 aa, Mycobacterium
NGASDVDR

SEQ ID NO: 962016 - protein, 7 aa, Mycobacterium
NGDGEIP

SEQ ID NO: 962017 - protein, 7 aa, Mycobacterium
NGDTSAQ

SEQ ID NO: 962018 - protein, 10 aa, Mycobacterium
NGEAPEAPKV

SEQ ID NO: 962019 - protein, 9 aa, Mycobacterium
NGEEYEWST

SEQ ID NO: 962020 - protein, 7 aa, Mycobacterium
NGGASSR

SEQ ID NO: 962021 - protein, 13 aa, Mycobacterium
NGGGTHLSKNPTF

SEQ ID NO: 962022 - protein, 4 aa, Mycobacterium
NGGS

SEQ ID NO: 962023 - protein, 13 aa, Mycobacterium
NGITVKDSDGTIR

SEQ ID NO: 962024 - protein, 8 aa, Mycobacterium
NGLSGAPG

SEQ ID NO: 962025 - protein, 8 aa, Mycobacterium
NGMPRETA

SEQ ID NO: 962026 - protein, 5 aa, Mycobacterium
NGNFT

SEQ ID NO: 962027 - protein, 6 aa, Mycobacterium
NGNITD

SEQ ID NO: 962028 - protein, 23 aa, Mycobacterium
NGNVGAPAVTRRRRRRRGDTDSI

SEQ ID NO: 962029 - protein, 6 aa, Mycobacterium
NGPAGS

SEQ ID NO: 962030 - protein, 8 aa, Mycobacterium
NGPGIPEA

SEQ ID NO: 962031 - protein, 5 aa, Mycobacterium
NGPGL

SEQ ID NO: 962032 - protein, 6 aa, Mycobacterium
NGPIPT

SEQ ID NO: 962033 - protein, 7 aa, Mycobacterium
NGQVGSN

SEQ ID NO: 962034 - protein, 29 aa, Mycobacterium
NGQYWKGSPAAKSGRVNHPWPDQRPPRRG

SEQ ID NO: 962035 - protein, 7 aa, Mycobacterium
NGRGGQP

SEQ ID NO: 962036 - protein, 8 aa, Mycobacterium
NGRSAANR

SEQ ID NO: 962037 - protein, 10 aa, Mycobacterium
NGSEPVSPAS

SEQ ID NO: 962038 - protein, 18 aa, Mycobacterium
NGSGPKFTAPMSKNGVPY

SEQ ID NO: 962039 - protein, 6 aa, Mycobacterium
NGSTTL

SEQ ID NO: 962040 - protein, 10 aa, Mycobacterium
NGTGKTTTVG

SEQ ID NO: 962041 - protein, 4 aa, Mycobacterium
NGTL

SEQ ID NO: 962042 - protein, 5 aa, Mycobacterium
NGTMT

SEQ ID NO: 962043 - protein, 11 aa, Mycobacterium
NGVEEDEGLQP

SEQ ID NO: 962044 - protein, 22 aa, Mycobacterium
NGVTGPAATDDAARASERGAGQ

SEQ ID NO: 962045 - protein, 4 aa, Mycobacterium
NGYS

SEQ ID NO: 962046 - protein, 9 aa, Mycobacterium
NHEHAEDDY

SEQ ID NO: 962047 - protein, 8 aa, Mycobacterium
NHGAGGRM

SEQ ID NO: 962048 - protein, 11 aa, Mycobacterium
NHGEPLGNESV

SEQ ID NO: 962049 - protein, 5 aa, Mycobacterium
NHNGR

SEQ ID NO: 962050 - protein, 17 aa, Mycobacterium
NHPRQDPTYPEEGRDRV

SEQ ID NO: 962051 - protein, 6 aa, Mycobacterium
NHQPGT

SEQ ID NO: 962052 - protein, 21 aa, Mycobacterium
NHRKPTPHGGLSDSLDAGGRP

SEQ ID NO: 962053 - protein, 6 aa, Mycobacterium
NHYPDD

SEQ ID NO: 962054 - protein, 5 aa, Mycobacterium
NHYPQ

SEQ ID NO: 962055 - protein, 5 aa, Mycobacterium
NIDSS

SEQ ID NO: 962056 - protein, 8 aa, Mycobacterium
NIEPAGDK

SEQ ID NO: 962057 - protein, 10 aa, Mycobacterium
NIGNPDGPAL

SEQ ID NO: 962058 - protein, 11 aa, Mycobacterium
NIKAGAKTRAS

SEQ ID NO: 962059 - protein, 8 aa, Mycobacterium
NITGDGNA

SEQ ID NO: 962060 - protein, 13 aa, Mycobacterium
NITKSTGVQQEPR

SEQ ID NO: 962061 - protein, 8 aa, Mycobacterium
NKAEPDCG

SEQ ID NO: 962062 - protein, 5 aa, Mycobacterium
NKAIA

SEQ ID NO: 962063 - protein, 6 aa, Mycobacterium
NKDGRR

SEQ ID NO: 962064 - protein, 6 aa, Mycobacterium
NKPRRA

SEQ ID NO: 962065 - protein, 7 aa, Mycobacterium
NKPSAFS

SEQ ID NO: 962066 - protein, 6 aa, Mycobacterium
NKQNQD

SEQ ID NO: 962067 - protein, 28 aa, Mycobacterium
NKSARANRSDARSAAQLGASSEPRVSKT

SEQ ID NO: 962068 - protein, 10 aa, Mycobacterium
NKTAKTVGQI

SEQ ID NO: 962069 - protein, 18 aa, Mycobacterium
NKTSSNASSLRAATQRAT

SEQ ID NO: 962070 - protein, 25 aa, Mycobacterium
NLAGGRPSASKTGTVQLGDTSANRD

SEQ ID NO: 962071 - protein, 8 aa, Mycobacterium
NLATPNET

SEQ ID NO: 962072 - protein, 5 aa, Mycobacterium
NLATT

SEQ ID NO: 962073 - protein, 9 aa, Mycobacterium
NLETKSDLS

SEQ ID NO: 962074 - protein, 6 aa, Mycobacterium
NLGPTA

SEQ ID NO: 962075 - protein, 4 aa, Mycobacterium
NLMR

SEQ ID NO: 962076 - protein, 24 aa, Mycobacterium
NLPAGETAVNPQTGQHLTKDTSGA

SEQ ID NO: 962077 - protein, 7 aa, Mycobacterium
NLPGTSQ

SEQ ID NO: 962078 - protein, 7 aa, Mycobacterium
NLTPDSD

SEQ ID NO: 962079 - protein, 10 aa, Mycobacterium
NMGHTQAAAG

SEQ ID NO: 962080 - protein, 12 aa, Mycobacterium
NNAITTDPAVSQ

SEQ ID NO: 962081 - protein, 6 aa, Mycobacterium
NNDESR

SEQ ID NO: 962082 - protein, 8 aa, Mycobacterium
NNDNDPVA

SEQ ID NO: 962083 - protein, 13 aa, Mycobacterium
NNEDSQARSEGAA

SEQ ID NO: 962084 - protein, 4 aa, Mycobacterium
NNGR

SEQ ID NO: 962085 - protein, 5 aa, Mycobacterium
NNNVE

SEQ ID NO: 962086 - protein, 8 aa, Mycobacterium
NNPTSSPY

SEQ ID NO: 962087 - protein, 20 aa, Mycobacterium
NNPVPSTGTKSNAAFNRATT

SEQ ID NO: 962088 - protein, 7 aa, Mycobacterium
NNRSARK

SEQ ID NO: 962089 - protein, 9 aa, Mycobacterium
NNSPRGSFQ

SEQ ID NO: 962090 - protein, 6 aa, Mycobacterium
NNTGRT

SEQ ID NO: 962091 - protein, 16 aa, Mycobacterium
NPAPGRTANELANDAG

SEQ ID NO: 962092 - protein, 10 aa, Mycobacterium
NPAPGTPEGP

SEQ ID NO: 962093 - protein, 5 aa, Mycobacterium
NPASD

SEQ ID NO: 962094 - protein, 6 aa, Mycobacterium
NPCAAQ

SEQ ID NO: 962095 - protein, 6 aa, Mycobacterium
NPDETI

SEQ ID NO: 962096 - protein, 4 aa, Mycobacterium
NPDF

SEQ ID NO: 962097 - protein, 6 aa, Mycobacterium
NPDLAD

SEQ ID NO: 962098 - protein, 7 aa, Mycobacterium
NPEQHKD

SEQ ID NO: 962099 - protein, 5 aa, Mycobacterium
NPESA

SEQ ID NO: 962100 - protein, 11 aa, Mycobacterium
NPEVMGSDTNH

SEQ ID NO: 962101 - protein, 9 aa, Mycobacterium
NPGDAPTKL

SEQ ID NO: 962102 - protein, 7 aa, Mycobacterium
NPGGSYT

SEQ ID NO: 962103 - protein, 7 aa, Mycobacterium
NPIGPGD

SEQ ID NO: 962104 - protein, 6 aa, Mycobacterium
NPKATL

SEQ ID NO: 962105 - protein, 9 aa, Mycobacterium
NPNPDGKEV

SEQ ID NO: 962106 - protein, 8 aa, Mycobacterium
NPPNDTPL

SEQ ID NO: 962107 - protein, 7 aa, Mycobacterium
NPPPGGA

SEQ ID NO: 962108 - protein, 13 aa, Mycobacterium
NPPPQPADATATV

SEQ ID NO: 962109 - protein, 6 aa, Mycobacterium
NPPVSA

SEQ ID NO: 962110 - protein, 4 aa, Mycobacterium
NPQA

SEQ ID NO: 962111 - protein, 10 aa, Mycobacterium
NPQAYARPAA

SEQ ID NO: 962112 - protein, 6 aa, Mycobacterium
NPRDGY

SEQ ID NO: 962113 - protein, 6 aa, Mycobacterium
NPREIG

SEQ ID NO: 962114 - protein, 11 aa, Mycobacterium
NPRPTNPEGKM

SEQ ID NO: 962115 - protein, 14 aa, Mycobacterium
NPSPNLTDPNPPLP

SEQ ID NO: 962116 - protein, 7 aa, Mycobacterium
NPSRSLQ

SEQ ID NO: 962117 - protein, 6 aa, Mycobacterium
NPSRYQ

SEQ ID NO: 962118 - protein, 6 aa, Mycobacterium
NPSWRP

SEQ ID NO: 962119 - protein, 31 aa, Mycobacterium; identical to SEQ ID NO: 272517

SEQ ID NO: 962120 - protein, 6 aa, Mycobacterium
NPTSRM

SEQ ID NO: 962121 - protein, 5 aa, Mycobacterium
NPVGG

SEQ ID NO: 962122 - protein, 5 aa, Mycobacterium
NPVPT

SEQ ID NO: 962123 - protein, 15 aa, Mycobacterium
NPWRGPPVPYDTPVT

SEQ ID NO: 962124 - protein, 14 aa, Mycobacterium
NQGESGAVKVAFDQ

SEQ ID NO: 962125 - protein, 22 aa, Mycobacterium
NQNKAVPGTNDDSAAEGTKVGV

SEQ ID NO: 962126 - protein, 6 aa, Mycobacterium
NQPAAL

SEQ ID NO: 962127 - protein, 11 aa, Mycobacterium
NQQLTSEQARP

SEQ ID NO: 962128 - protein, 6 aa, Mycobacterium
NQQTEK

SEQ ID NO: 962129 - protein, 7 aa, Mycobacterium
NQQTNIS

SEQ ID NO: 962130 - protein, 8 aa, Mycobacterium
NQRPNRAT

SEQ ID NO: 962131 - protein, 4 aa, Mycobacterium
NQRY

SEQ ID NO: 962132 - protein, 6 aa, Mycobacterium
NQSQHP

SEQ ID NO: 962133 - protein, 6 aa, Mycobacterium
NQTALE

SEQ ID NO: 962134 - protein, 7 aa, Mycobacterium
NRAADLD

SEQ ID NO: 962135 - protein, 6 aa, Mycobacterium
NRAGGR

SEQ ID NO: 962136 - protein, 12 aa, Mycobacterium
NRDAAGAGRRAR

SEQ ID NO: 962137 - protein, 10 aa, Mycobacterium
NRDGSDAMST

SEQ ID NO: 962138 - protein, 10 aa, Mycobacterium
NRDGSDATSV

SEQ ID NO: 962139 - protein, 17 aa, Mycobacterium
NRETAEAERAARAADRG

SEQ ID NO: 962140 - protein, 7 aa, Mycobacterium
NRKEFGR

SEQ ID NO: 962141 - protein, 4 aa, Mycobacterium
NRPR

SEQ ID NO: 962142 - protein, 12 aa, Mycobacterium
NRQAHPSTRDRL

SEQ ID NO: 962143 - protein, 8 aa, Mycobacterium
NRSQTAAA

SEQ ID NO: 962144 - protein, 4 aa, Mycobacterium
NRTA

SEQ ID NO: 962145 - protein, 7 aa, Mycobacterium
NRTTGDI

SEQ ID NO: 962146 - protein, 23 aa, Mycobacterium
NSAAGQAPQSVPADVESAKVESE

SEQ ID NO: 962147 - protein, 6 aa, Mycobacterium
NSAANG

SEQ ID NO: 962148 - protein, 4 aa, Mycobacterium
NSDS

SEQ ID NO: 962149 - protein, 7 aa, Mycobacterium
NSELGIP

SEQ ID NO: 962150 - protein, 8 aa, Mycobacterium
NSEQLPGP

SEQ ID NO: 962151 - protein, 7 aa, Mycobacterium
NSGEDRA

SEQ ID NO: 962152 - protein, 6 aa, Mycobacterium
NSGEPQ

SEQ ID NO: 962153 - protein, 10 aa, Mycobacterium
NSGGPAATTY

SEQ ID NO: 962154 - protein, 6 aa, Mycobacterium
NSGGVQ

SEQ ID NO: 962155 - protein, 12 aa, Mycobacterium
NSHWRAGGVVGV

SEQ ID NO: 962156 - protein, 4 aa, Mycobacterium
NSLA

SEQ ID NO: 962157 - protein, 5 aa, Mycobacterium
NSLAP

SEQ ID NO: 962158 - protein, 9 aa, Mycobacterium
NSLASGGRL

SEQ ID NO: 962159 - protein, 7 aa, Mycobacterium
NSLQNHS

SEQ ID NO: 962160 - protein, 8 aa, Mycobacterium
NSPDRLPE

SEQ ID NO: 962161 - protein, 11 aa, Mycobacterium
NSPGMGDDATH

SEQ ID NO: 962162 - protein, 12 aa, Mycobacterium
NSPGTIDAGYRG

SEQ ID NO: 962163 - protein, 6 aa, Mycobacterium
NSSAGN

SEQ ID NO: 962164 - protein, 7 aa, Mycobacterium
NSSRDYA

SEQ ID NO: 962165 - protein, 5 aa, Mycobacterium
NSTDR

SEQ ID NO: 962166 - protein, 7 aa, Mycobacterium
NSTGSFK

SEQ ID NO: 962167 - protein, 4 aa, Mycobacterium
NSVA

SEQ ID NO: 962168 - protein, 7 aa, Mycobacterium
NSWGETL

SEQ ID NO: 962169 - protein, 7 aa, Mycobacterium
NTAADQL

SEQ ID NO: 962170 - protein, 19 aa, Mycobacterium
NTGAVQTEDRADPVPDGAT

SEQ ID NO: 962171 - protein, 6 aa, Mycobacterium
NTNQLS

SEQ ID NO: 962172 - protein, 8 aa, Mycobacterium
NTPAAAAS

SEQ ID NO: 962173 - protein, 13 aa, Mycobacterium
NTPADWARAGNAV

SEQ ID NO: 962174 - protein, 15 aa, Mycobacterium
NTPDESDGTAAEKDQ

SEQ ID NO: 962175 - protein, 10 aa, Mycobacterium
NTPQPANARG

SEQ ID NO: 962176 - protein, 7 aa, Mycobacterium
NTRSPLD

SEQ ID NO: 962177 - protein, 6 aa, Mycobacterium
NTSDDG

SEQ ID NO: 962178 - protein, 8 aa, Mycobacterium
NTTQPIRS

SEQ ID NO: 962179 - protein, 11 aa, Mycobacterium
NTTTTSPLTKN

SEQ ID NO: 962180 - protein, 7 aa, Mycobacterium
NTVGARG

SEQ ID NO: 962181 - protein, 11 aa, Mycobacterium
NTYTENADLPD

SEQ ID NO: 962182 - protein, 5 aa, Mycobacterium
NVAPP

SEQ ID NO: 962183 - protein, 10 aa, Mycobacterium
NVDPGGPSRG

SEQ ID NO: 962184 - protein, 6 aa, Mycobacterium
NVGANE

SEQ ID NO: 962185 - protein, 5 aa, Mycobacterium
NVGGK

SEQ ID NO: 962186 - protein, 9 aa, Mycobacterium
NVPGCGPQS

SEQ ID NO: 962187 - protein, 4 aa, Mycobacterium
NVPS

SEQ ID NO: 962188 - protein, 15 aa, Mycobacterium
NVTRQRSAQEITDEQ

SEQ ID NO: 962189 - protein, 6 aa, Mycobacterium
NWPQGR

SEQ ID NO: 962190 - protein, 21 aa, Mycobacterium
NYPTDGPGNRRTRRPPPMPSA

SEQ ID NO: 962191 - protein, 21 aa, Mycobacterium
NYQPPKDLAPPPGTAVGPDGN

SEQ ID NO: 962192 - protein, 20 aa, Mycobacterium
NYQPPPNLAPPPGTVVGPDG

SEQ ID NO: 962193 - protein, 8 aa, Mycobacterium
NYSTGGGY

SEQ ID NO: 962194 - protein, 7 aa, Mycobacterium
PAAAAPL

SEQ ID NO: 962195 - protein, 12 aa, Mycobacterium
PAAAPRDFDTPT

SEQ ID NO: 962196 - protein, 11 aa, Mycobacterium
PAAASVSATGE

SEQ ID NO: 962197 - protein, 15 aa, Mycobacterium
PAAATDDSCGHGRVE

SEQ ID NO: 962198 - protein, 15 aa, Mycobacterium
PAAATDDSRGHDRVK

SEQ ID NO: 962199 - protein, 27 aa, Mycobacterium
PAAATDDSRGHGRVERPAAARRNPISN

SEQ ID NO: 962200 - protein, 7 aa, Mycobacterium
PAAATVS

SEQ ID NO: 962201 - protein, 7 aa, Mycobacterium
PAADAGG

SEQ ID NO: 962202 - protein, 6 aa, Mycobacterium
PAADQS

SEQ ID NO: 962203 - protein, 11 aa, Mycobacterium
PAAGSASQDYT

SEQ ID NO: 962204 - protein, 12 aa, Mycobacterium
PAAKQKALKTSA

SEQ ID NO: 962205 - protein, 10 aa, Mycobacterium
PAAKRKSVRT

SEQ ID NO: 962206 - protein, 15 aa, Mycobacterium
PAAKTGGTAASAADY

SEQ ID NO: 962207 - protein, 12 aa, Mycobacterium
PAALNNPQHPRF

SEQ ID NO: 962208 - protein, 15 aa, Mycobacterium
PAAPRASAGEPGATP

SEQ ID NO: 962209 - protein, 6 aa, Mycobacterium
PAARAA

SEQ ID NO: 962210 - protein, 7 aa, Mycobacterium
PAARGMG

SEQ ID NO: 962211 - protein, 20 aa, Mycobacterium
PAASGPSQHEAAASRDLPRA

SEQ ID NO: 962212 - protein, 10 aa, Mycobacterium
PAASRNTART

SEQ ID NO: 962213 - protein, 7 aa, Mycobacterium
PADAGSV

SEQ ID NO: 962214 - protein, 13 aa, Mycobacterium
PADATDDSRGHGR

SEQ ID NO: 962215 - protein, 6 aa, Mycobacterium
PADLDS

SEQ ID NO: 962216 - protein, 20 aa, Mycobacterium
PADRAGVGSAVNDTTRELGG

SEQ ID NO: 962217 - protein, 22 aa, Mycobacterium
PAEATEPPQAAEEPAAGQAGRA

SEQ ID NO: 962218 - protein, 11 aa, Mycobacterium
PAEKPSASAAA

SEQ ID NO: 962219 - protein, 5 aa, Mycobacterium
PAESY

SEQ ID NO: 962220 - protein, 10 aa, Mycobacterium
PAGAATPRPR

SEQ ID NO: 962221 - protein, 6 aa, Mycobacterium
PAGARK

SEQ ID NO: 962222 - protein, 22 aa, Mycobacterium
PAGDLGRRQHDAAGGHPPRPQV

SEQ ID NO: 962223 - protein, 7 aa, Mycobacterium
PAGGLSN

SEQ ID NO: 962224 - protein, 10 aa, Mycobacterium
PAGGVDTGKN

SEQ ID NO: 962225 - protein, 5 aa, Mycobacterium
PAGKA

SEQ ID NO: 962226 - protein, 8 aa, Mycobacterium
PAGPASQW

SEQ ID NO: 962227 - protein, 10 aa, Mycobacterium
PAGPGAPRDV

SEQ ID NO: 962228 - protein, 13 aa, Mycobacterium
PAGPGTAKAPGPL

SEQ ID NO: 962229 - protein, 7 aa, Mycobacterium
PAGRGSR

SEQ ID NO: 962230 - protein, 10 aa, Mycobacterium
PAGSGPTPIQ

SEQ ID NO: 962231 - protein, 11 aa, Mycobacterium
PAGSNTPSAFP

SEQ ID NO: 962232 - protein, 11 aa, Mycobacterium
PAGSSTPSELG

SEQ ID NO: 962233 - protein, 10 aa, Mycobacterium
PAGSSTPTVK

SEQ ID NO: 962234 - protein, 6 aa, Mycobacterium
PAGSTS

SEQ ID NO: 962235 - protein, 34 aa, Mycobacterium
PAGTLPAGGPYTQAGDKTRRVVPGTTPQVGQGTG

SEQ ID NO: 962236 - protein, 5 aa, Mycobacterium
PAHAG

SEQ ID NO: 962237 - protein, 5 aa, Mycobacterium
PAIPE

SEQ ID NO: 962238 - protein, 5 aa, Mycobacterium
PALSR

SEQ ID NO: 962239 - protein, 16 aa, Mycobacterium
PAMLPTADPATLAETR

SEQ ID NO: 962240 - protein, 5 aa, Mycobacterium
PANPD

SEQ ID NO: 962241 - protein, 8 aa, Mycobacterium
PAPAAGPA

SEQ ID NO: 962242 - protein, 15 aa, Mycobacterium
PAPDQDDAAGSGHSF

SEQ ID NO: 962243 - protein, 7 aa, Mycobacterium
PAPGTGV

SEQ ID NO: 962244 - protein, 4 aa, Mycobacterium
PAPH

SEQ ID NO: 962245 - protein, 40 aa, Mycobacterium
PAPHDPPRVRGASQNAVSTRRAEGSARGDSEAKRSKARTV

SEQ ID NO: 962246 - protein, 12 aa, Mycobacterium
PAPHGLKPTALN

SEQ ID NO: 962247 - protein, 5 aa, Mycobacterium
PAPLS

SEQ ID NO: 962248 - protein, 9 aa, Mycobacterium
PAPQATTAA

SEQ ID NO: 962249 - protein, 12 aa, Mycobacterium
PAPRNSAQHRSA

SEQ ID NO: 962250 - protein, 7 aa, Mycobacterium
PAPRPIA

SEQ ID NO: 962251 - protein, 20 aa, Mycobacterium
PAPSEPARSQRRRRTKVGQL

SEQ ID NO: 962252 - protein, 4 aa, Mycobacterium
PAPV

SEQ ID NO: 962253 - protein, 4 aa, Mycobacterium
PAQA

SEQ ID NO: 962254 - protein, 11 aa, Mycobacterium
PAQLAGTGAGV

SEQ ID NO: 962255 - protein, 5 aa, Mycobacterium
PAQRV

SEQ ID NO: 962256 - protein, 24 aa, Mycobacterium
PAQSGGSYGGATPSFAQADDAASK

SEQ ID NO: 962257 - protein, 4 aa, Mycobacterium
PAQV

SEQ ID NO: 962258 - protein, 22 aa, Mycobacterium
PARAALAGDTGIGDSLPRSRPT

SEQ ID NO: 962259 - protein, 16 aa, Mycobacterium
PARASSVNKWVSPAGS

SEQ ID NO: 962260 - protein, 7 aa, Mycobacterium
PARIDTP

SEQ ID NO: 962261 - protein, 10 aa, Mycobacterium
PASDPTTPGA

SEQ ID NO: 962262 - protein, 5 aa, Mycobacterium
PASGF

SEQ ID NO: 962263 - protein, 7 aa, Mycobacterium
PASGLGA

SEQ ID NO: 962264 - protein, 4 aa, Mycobacterium
PASN

SEQ ID NO: 962265 - protein, 11 aa, Mycobacterium
PASPWATPPPT

SEQ ID NO: 962266 - protein, 9 aa, Mycobacterium
PASQEDRSR

SEQ ID NO: 962267 - protein, 9 aa, Mycobacterium
PASTSNEYD

SEQ ID NO: 962268 - protein, 5 aa, Mycobacterium
PASVA

SEQ ID NO: 962269 - protein, 4 aa, Mycobacterium
PATA

SEQ ID NO: 962270 - protein, 12 aa, Mycobacterium
PATASSHQVGDE

SEQ ID NO: 962271 - protein, 6 aa, Mycobacterium
PATDPL

SEQ ID NO: 962272 - protein, 9 aa, Mycobacterium
PATGANAVE

SEQ ID NO: 962273 - protein, 12 aa, Mycobacterium
PATGGPPNGQVQ

SEQ ID NO: 962274 - protein, 13 aa, Mycobacterium
PATPPRTPPPLQF

SEQ ID NO: 962275 - protein, 30 aa, Mycobacterium
PATQPRRTPAPQAPAPTPVQAPAPEVPPPV

SEQ ID NO: 962276 - protein, 6 aa, Mycobacterium
PATSGA

SEQ ID NO: 962277 - protein, 15 aa, Mycobacterium
PATTTSKSSTAWAPR

SEQ ID NO: 962278 - protein, 15 aa, Mycobacterium
PAVATAAPPPPPPVE

SEQ ID NO: 962279 - protein, 4 aa, Mycobacterium
PAVE

SEQ ID NO: 962280 - protein, 5 aa, Mycobacterium
PAVGT

SEQ ID NO: 962281 - protein, 9 aa, Mycobacterium
PAYAGSAAD

SEQ ID NO: 962282 - protein, 99 aa, Mycobacterium
PCPAPRATSPPEPSAPSTASETPGQPSVTSSPASTTTPTPSASTTPTTTSGSTAATSTPPAGTSPAAPTSPTPTSTTSSPNVTALPPPPPQPGIDCRAV

SEQ ID NO: 962283 - protein, 8 aa, Mycobacterium
PDAGGPRD

SEQ ID NO: 962284 - protein, 5 aa, Mycobacterium
PDAHH

SEQ ID NO: 962285 - protein, 5 aa, Mycobacterium
PDAIN

SEQ ID NO: 962286 - protein, 16 aa, Mycobacterium
PDAPAAQIQAAAGQAQ

SEQ ID NO: 962287 - protein, 5 aa, Mycobacterium
PDAQT

SEQ ID NO: 962288 - protein, 8 aa, Mycobacterium
PDARDSNV

SEQ ID NO: 962289 - protein, 77 aa, Mycobacterium
PDATPGQPAKKPPADKAAKTPAKKTPAKKTPAKKAPAQKAPAKKAPAKKAPAKKAPATKPPAQSPEPAEPAPQPTAL

SEQ ID NO: 962290 - protein, 9 aa, Mycobacterium
PDDASSFGD

SEQ ID NO: 962291 - protein, 5 aa, Mycobacterium
PDDGR

SEQ ID NO: 962292 - protein, 6 aa, Mycobacterium
PDDLAD

SEQ ID NO: 962293 - protein, 13 aa, Mycobacterium
PDDSPGPIPGRPV

SEQ ID NO: 962294 - protein, 5 aa, Mycobacterium
PDDTT

SEQ ID NO: 962295 - protein, 19 aa, Mycobacterium
PDEPPQLHPRRDTRLRAGD

SEQ ID NO: 962296 - protein, 18 aa, Mycobacterium
PDERKRPANNGSARPPVK

SEQ ID NO: 962297 - protein, 13 aa, Mycobacterium
PDETGAVPAGALA

SEQ ID NO: 962298 - protein, 6 aa, Mycobacterium
PDEYRR

SEQ ID NO: 962299 - protein, 5 aa, Mycobacterium
PDEYS

SEQ ID NO: 962300 - protein, 22 aa, Mycobacterium
PDGADTVVGEAGSALSGGERQR

SEQ ID NO: 962301 - protein, 7 aa, Mycobacterium
PDGANGE

SEQ ID NO: 962302 - protein, 6 aa, Mycobacterium
PDGASA

SEQ ID NO: 962303 - protein, 9 aa, Mycobacterium
PDGENPPDE

SEQ ID NO: 962304 - protein, 4 aa, Mycobacterium
PDGK

SEQ ID NO: 962305 - protein, 5 aa, Mycobacterium
PDGKA

SEQ ID NO: 962306 - protein, 5 aa, Mycobacterium
PDGKS

SEQ ID NO: 962307 - protein, 34 aa, Mycobacterium
PDGMDTATSATSPTAGPRSCRRRAGPPRKPSGYD

SEQ ID NO: 962308 - protein, 7 aa, Mycobacterium
PDGPLTS

SEQ ID NO: 962309 - protein, 15 aa, Mycobacterium
PDGRYSDEDRARRRG

SEQ ID NO: 962310 - protein, 6 aa, Mycobacterium
PDGSVA

SEQ ID NO: 962311 - protein, 8 aa, Mycobacterium
PDGSVAQT

SEQ ID NO: 962312 - protein, 7 aa, Mycobacterium
PDGSYSE

SEQ ID NO: 962313 - protein, 5 aa, Mycobacterium
PDGTA

SEQ ID NO: 962314 - protein, 7 aa, Mycobacterium
PDGTLPE

SEQ ID NO: 962315 - protein, 4 aa, Mycobacterium
PDGV

SEQ ID NO: 962316 - protein, 4 aa, Mycobacterium
PDHR

SEQ ID NO: 962317 - protein, 7 aa, Mycobacterium
PDHRDTY

SEQ ID NO: 962318 - protein, 6 aa, Mycobacterium
PDIEPV

SEQ ID NO: 962319 - protein, 8 aa, Mycobacterium
PDKARAAV

SEQ ID NO: 962320 - protein, 8 aa, Mycobacterium
PDKFPADT

SEQ ID NO: 962321 - protein, 5 aa, Mycobacterium
PDKPI

SEQ ID NO: 962322 - protein, 5 aa, Mycobacterium
PDLPT

SEQ ID NO: 962323 - protein, 4 aa, Mycobacterium
PDMD

SEQ ID NO: 962324 - protein, 14 aa, Mycobacterium
PDNDPQDSGYQARQ

SEQ ID NO: 962325 - protein, 7 aa, Mycobacterium
PDNEYTA

SEQ ID NO: 962326 - protein, 11 aa, Mycobacterium
PDNPPGEPRAD

SEQ ID NO: 962327 - protein, 8 aa, Mycobacterium
PDPDTPAL

SEQ ID NO: 962328 - protein, 6 aa, Mycobacterium
PDPEPA

SEQ ID NO: 962329 - protein, 6 aa, Mycobacterium
PDPKRA

SEQ ID NO: 962330 - protein, 6 aa, Mycobacterium
PDPLNG

SEQ ID NO: 962331 - protein, 5 aa, Mycobacterium
PDPSL

SEQ ID NO: 962332 - protein, 5 aa, Mycobacterium
PDPST

SEQ ID NO: 962333 - protein, 7 aa, Mycobacterium
PDQGRKI

SEQ ID NO: 962334 - protein, 6 aa, Mycobacterium
PDQIST

SEQ ID NO: 962335 - protein, 5 aa, Mycobacterium
PDQLA

SEQ ID NO: 962336 - protein, 32 aa, Mycobacterium
PDRAETDSASASDSDSDSGSSTGTGELPSTNR

SEQ ID NO: 962337 - protein, 22 aa, Mycobacterium
PDREVDAQAAGAAVSAASDGAI

SEQ ID NO: 962338 - protein, 10 aa, Mycobacterium
PDRTSAQPVG

SEQ ID NO: 962339 - protein, 29 aa, Mycobacterium
PDSAAAQGISPLNDAQEHRPVRRPKRPAL

SEQ ID NO: 962340 - protein, 19 aa, Mycobacterium
PDSDESPDPDESQLAGSDL

SEQ ID NO: 962341 - protein, 9 aa, Mycobacterium
PDSEASQEL

SEQ ID NO: 962342 - protein, 6 aa, Mycobacterium
PDSGDM

SEQ ID NO: 962343 - protein, 7 aa, Mycobacterium
PDSGTHS

SEQ ID NO: 962344 - protein, 6 aa, Mycobacterium
PDSPQV

SEQ ID NO: 962345 - protein, 8 aa, Mycobacterium
PDSTIPPD

SEQ ID NO: 962346 - protein, 8 aa, Mycobacterium
PDTDRATA

SEQ ID NO: 962347 - protein, 5 aa, Mycobacterium
PDTID

SEQ ID NO: 962348 - protein, 12 aa, Mycobacterium
PDTLGPADQSYY

SEQ ID NO: 962349 - protein, 11 aa, Mycobacterium
PDTPPVPGDVS

SEQ ID NO: 962350 - protein, 5 aa, Mycobacterium
PDTRQ

SEQ ID NO: 962351 - protein, 8 aa, Mycobacterium
PDTVRSDL

SEQ ID NO: 962352 - protein, 8 aa, Mycobacterium
PDVGVSRG

SEQ ID NO: 962353 - protein, 4 aa, Mycobacterium
PDYD

SEQ ID NO: 962354 - protein, 6 aa, Mycobacterium
PDYGAA

SEQ ID NO: 962355 - protein, 17 aa, Mycobacterium
PDYNAKKLDTDTWEDGV

SEQ ID NO: 962356 - protein, 14 aa, Mycobacterium
PDYPAERKALIPGV

SEQ ID NO: 962357 - protein, 13 aa, Mycobacterium
PDYPPQAPQIPYP

SEQ ID NO: 962358 - protein, 5 aa, Mycobacterium
PDYSP

SEQ ID NO: 962359 - protein, 25 aa, Mycobacterium
PEAGADSGFAPAERDASGNPVEPAA

SEQ ID NO: 962360 - protein, 16 aa, Mycobacterium
PEAPPPPRTPADGTYK

SEQ ID NO: 962361 - protein, 12 aa, Mycobacterium
PEAQWTDNAPIA

SEQ ID NO: 962362 - protein, 11 aa, Mycobacterium
PEATGHGTDEA

SEQ ID NO: 962363 - protein, 5 aa, Mycobacterium
PEDAT

SEQ ID NO: 962364 - protein, 5 aa, Mycobacterium
PEDPT

SEQ ID NO: 962365 - protein, 5 aa, Mycobacterium
PEEPD

SEQ ID NO: 962366 - protein, 7 aa, Mycobacterium
PEGGRTH

SEQ ID NO: 962367 - protein, 4 aa, Mycobacterium
PEGL

SEQ ID NO: 962368 - protein, 13 aa, Mycobacterium
PEGPELSGASASV

SEQ ID NO: 962369 - protein, 7 aa, Mycobacterium
PEGPERK

SEQ ID NO: 962370 - protein, 4 aa, Mycobacterium
PEGV

SEQ ID NO: 962371 - protein, 51 aa, Mycobacterium
PEGVGEDLKSDPVVSKPGLVNSDASPNKPNAAISDSAGTAGGKAPAGINGS

SEQ ID NO: 962372 - protein, 8 aa, Mycobacterium
PEHGAAAD

SEQ ID NO: 962373 - protein, 5 aa, Mycobacterium
PEHQP

SEQ ID NO: 962374 - protein, 5 aa, Mycobacterium
PELNA

SEQ ID NO: 962375 - protein, 5 aa, Mycobacterium
PELSD

SEQ ID NO: 962376 - protein, 26 aa, Mycobacterium
PENKSPEGHRLPEPGAPGTPNSSDVT

SEQ ID NO: 962377 - protein, 12 aa, Mycobacterium
PENMDGLPDRAA

SEQ ID NO: 962378 - protein, 10 aa, Mycobacterium
PEPAPAPQRC

SEQ ID NO: 962379 - protein, 9 aa, Mycobacterium
PEPDSPRRM

SEQ ID NO: 962380 - protein, 14 aa, Mycobacterium
PEPEAGPEGRGADQ

SEQ ID NO: 962381 - protein, 8 aa, Mycobacterium
PEPSRRAK

SEQ ID NO: 962382 - protein, 10 aa, Mycobacterium
PEQQDDPGLE

SEQ ID NO: 962383 - protein, 9 aa, Mycobacterium
PEQVTQARP

SEQ ID NO: 962384 - protein, 8 aa, Mycobacterium
PERASTPD

SEQ ID NO: 962385 - protein, 7 aa, Mycobacterium
PERDKRV

SEQ ID NO: 962386 - protein, 19 aa, Mycobacterium
PERKARELKKAGERPSSPK

SEQ ID NO: 962387 - protein, 6 aa, Mycobacterium
PERPWA

SEQ ID NO: 962388 - protein, 10 aa, Mycobacterium
PESDTGPYLS

SEQ ID NO: 962389 - protein, 7 aa, Mycobacterium
PESPAIN

SEQ ID NO: 962390 - protein, 8 aa, Mycobacterium
PESPDDAA

SEQ ID NO: 962391 - protein, 5 aa, Mycobacterium
PESRS

SEQ ID NO: 962392 - protein, 14 aa, Mycobacterium
PETAAPEAAVPETA

SEQ ID NO: 962393 - protein, 5 aa, Mycobacterium
PEVAA

SEQ ID NO: 962394 - protein, 5 aa, Mycobacterium
PEVPK

SEQ ID NO: 962395 - protein, 29 aa, Mycobacterium
PEWQSQQPGWQPPQPGWPAQQPGYAPEPD

SEQ ID NO: 962396 - protein, 6 aa, Mycobacterium
PFASRT

SEQ ID NO: 962397 - protein, 4 aa, Mycobacterium
PFDH

SEQ ID NO: 962398 - protein, 9 aa, Mycobacterium
PFGNRSDNG

SEQ ID NO: 962399 - protein, 9 aa, Mycobacterium
PFPDTPPRY

SEQ ID NO: 962400 - protein, 9 aa, Mycobacterium
PFSSSSESM

SEQ ID NO: 962401 - protein, 27 aa, Mycobacterium
PFSTPNAVTKARRRGKQPAAGPDEQGA

SEQ ID NO: 962402 - protein, 10 aa, Mycobacterium
PFTSDQDSMR

SEQ ID NO: 962403 - protein, 5 aa, Mycobacterium
PGAAP

SEQ ID NO: 962404 - protein, 8 aa, Mycobacterium
PGADAAAQ

SEQ ID NO: 962405 - protein, 10 aa, Mycobacterium
PGAETGRSRR

SEQ ID NO: 962406 - protein, 4 aa, Mycobacterium
PGAG

SEQ ID NO: 962407 - protein, 8 aa, Mycobacterium
PGAGRTGR

SEQ ID NO: 962408 - protein, 15 aa, Mycobacterium
PGALTTDNKNLSPPY

SEQ ID NO: 962409 - protein, 15 aa, Mycobacterium
PGAPSDFNPASPATS

SEQ ID NO: 962410 - protein, 5 aa, Mycobacterium
PGARD

SEQ ID NO: 962411 - protein, 12 aa, Mycobacterium
PGARSAQEQPMA

SEQ ID NO: 962412 - protein, 5 aa, Mycobacterium
PGART

SEQ ID NO: 962413 - protein, 5 aa, Mycobacterium
PGATL

SEQ ID NO: 962414 - protein, 9 aa, Mycobacterium
PGCAPAPDT

SEQ ID NO: 962415 - protein, 4 aa, Mycobacterium
PGDA

SEQ ID NO: 962416 - protein, 19 aa, Mycobacterium
PGDPRGPNLEELYSWWKKH

SEQ ID NO: 962417 - protein, 8 aa, Mycobacterium
PGDRPRGQ

SEQ ID NO: 962418 - protein, 10 aa, Mycobacterium
PGDSTTAVGE

SEQ ID NO: 962419 - protein, 7 aa, Mycobacterium
PGDTTTL

SEQ ID NO: 962420 - protein, 7 aa, Mycobacterium
PGEKIPV

SEQ ID NO: 962421 - protein, 10 aa, Mycobacterium
PGEKKSPTAW

SEQ ID NO: 962422 - protein, 10 aa, Mycobacterium
PGEMNSPEET

SEQ ID NO: 962423 - protein, 7 aa, Mycobacterium
PGEPDEE

SEQ ID NO: 962424 - protein, 4 aa, Mycobacterium
PGFP

SEQ ID NO: 962425 - protein, 9 aa, Mycobacterium
PGGADGPEG

SEQ ID NO: 962426 - protein, 11 aa, Mycobacterium
PGGGALGAEGA

SEQ ID NO: 962427 - protein, 8 aa, Mycobacterium
PGGGELGV

SEQ ID NO: 962428 - protein, 13 aa, Mycobacterium
PGGGNFTATPARI

SEQ ID NO: 962429 - protein, 5 aa, Mycobacterium
PGGGQ

SEQ ID NO: 962430 - protein, 7 aa, Mycobacterium
PGGKTAF

SEQ ID NO: 962431 - protein, 4 aa, Mycobacterium
PGGL

SEQ ID NO: 962432 - protein, 4 aa, Mycobacterium
PGGP

SEQ ID NO: 962433 - protein, 21 aa, Mycobacterium
PGGRTQISGGEPPFSASTARQ

SEQ ID NO: 962434 - protein, 14 aa, Mycobacterium
PGGSGGPGGPGGPG

SEQ ID NO: 962435 - protein, 13 aa, Mycobacterium
PGGVGTERARAVG

SEQ ID NO: 962436 - protein, 21 aa, Mycobacterium
PGHAPGATAAQPLGRSASRDN

SEQ ID NO: 962437 - protein, 4 aa, Mycobacterium
PGHN

SEQ ID NO: 962438 - protein, 11 aa, Mycobacterium
PGHTATPAGSI

SEQ ID NO: 962439 - protein, 16 aa, Mycobacterium
PGIDSAEVSGTATSMG

SEQ ID NO: 962440 - protein, 4 aa, Mycobacterium
PGIG

SEQ ID NO: 962441 - protein, 9 aa, Mycobacterium
PGINDPTTA

SEQ ID NO: 962442 - protein, 7 aa, Mycobacterium
PGKAAAV

SEQ ID NO: 962443 - protein, 6 aa, Mycobacterium
PGKAGL

SEQ ID NO: 962444 - protein, 7 aa, Mycobacterium
PGKRAPT

SEQ ID NO: 962445 - protein, 26 aa, Mycobacterium
PGKSSDAGSALLSPDSTASAASSRIG

SEQ ID NO: 962446 - protein, 8 aa, Mycobacterium
PGKTPQAT

SEQ ID NO: 962447 - protein, 17 aa, Mycobacterium
PGLAGPDSRVSTFSASD

SEQ ID NO: 962448 - protein, 8 aa, Mycobacterium
PGLGGNRP

SEQ ID NO: 962449 - protein, 15 aa, Mycobacterium
PGLPPAPGGYRNRRP

SEQ ID NO: 962450 - protein, 11 aa, Mycobacterium
PGLQSDPNSMA

SEQ ID NO: 962451 - protein, 11 aa, Mycobacterium
PGLQTNPNSLA

SEQ ID NO: 962452 - protein, 9 aa, Mycobacterium
PGLTDSSDD

SEQ ID NO: 962453 - protein, 4 aa, Mycobacterium
PGMA

SEQ ID NO: 962454 - protein, 9 aa, Mycobacterium
PGMPTPSTV

SEQ ID NO: 962455 - protein, 13 aa, Mycobacterium
PGNDGNEARNLGQ

SEQ ID NO: 962456 - protein, 14 aa, Mycobacterium
PGNQAEAAIRPGDP

SEQ ID NO: 962457 - protein, 13 aa, Mycobacterium
PGNVAANVSSGAQ

SEQ ID NO: 962458 - protein, 14 aa, Mycobacterium
PGPDDPALLPRTGP

SEQ ID NO: 962459 - protein, 4 aa, Mycobacterium
PGPI

SEQ ID NO: 962460 - protein, 18 aa, Mycobacterium
PGPIADSTARQAAGEELT

SEQ ID NO: 962461 - protein, 11 aa, Mycobacterium
PGPNNQQTAFK

SEQ ID NO: 962462 - protein, 37 aa, Mycobacterium
PGPPPEEGAPQGESGPGPVPPPAPGQPPASNHGGGTV

SEQ ID NO: 962463 - protein, 8 aa, Mycobacterium
PGPPPGAE

SEQ ID NO: 962464 - protein, 13 aa, Mycobacterium
PGPTDPKNQHWDQ

SEQ ID NO: 962465 - protein, 11 aa, Mycobacterium
PGPTDTPLAQA

SEQ ID NO: 962466 - protein, 7 aa, Mycobacterium
PGPTLSR

SEQ ID NO: 962467 - protein, 5 aa, Mycobacterium
PGPVD

SEQ ID NO: 962468 - protein, 10 aa, Mycobacterium
PGQADGVGPA

SEQ ID NO: 962469 - protein, 8 aa, Mycobacterium
PGQGSQRI

SEQ ID NO: 962470 - protein, 13 aa, Mycobacterium
PGQTFGPGGPLGG

SEQ ID NO: 962471 - protein, 28 aa, Mycobacterium
PGQYPQSGSPGQYGPPGQYGPPGQYSQQ

SEQ ID NO: 962472 - protein, 58 aa, Mycobacterium
PGQYPQSGSPGQYGSPGQYGPPGQYGPPGQYGPPGQYGPPGQYGPPGQYGPPGQYSQQ

SEQ ID NO: 962473 - protein, 12 aa, Mycobacterium
PGRAAGELPPGA

SEQ ID NO: 962474 - protein, 4 aa, Mycobacterium
PGRF

SEQ ID NO: 962475 - protein, 15 aa, Mycobacterium
PGRGVSGTVSGRSVR

SEQ ID NO: 962476 - protein, 16 aa, Mycobacterium
PGRHSTWQEQTQASTA

SEQ ID NO: 962477 - protein, 26 aa, Mycobacterium
PGRSAVGESDDRATTDPTDPKGRAVP

SEQ ID NO: 962478 - protein, 15 aa, Mycobacterium
PGSAPGIPASEKPQH

SEQ ID NO: 962479 - protein, 6 aa, Mycobacterium
PGSDPF

SEQ ID NO: 962480 - protein, 8 aa, Mycobacterium
PGSEDSVA

SEQ ID NO: 962481 - protein, 17 aa, Mycobacterium
PGSEYGPDASPPSPARI

SEQ ID NO: 962482 - protein, 4 aa, Mycobacterium
PGSL

SEQ ID NO: 962483 - protein, 8 aa, Mycobacterium
PGSPPAGA

SEQ ID NO: 962484 - protein, 16 aa, Mycobacterium
PGSSFPDADSLSEGVA

SEQ ID NO: 962485 - protein, 5 aa, Mycobacterium
PGTEH

SEQ ID NO: 962486 - protein, 5 aa, Mycobacterium
PGTGD

SEQ ID NO: 962487 - protein, 5 aa, Mycobacterium
PGTGY

SEQ ID NO: 962488 - protein, 4 aa, Mycobacterium
PGTR

SEQ ID NO: 962489 - protein, 6 aa, Mycobacterium
PGTTTA

SEQ ID NO: 962490 - protein, 11 aa, Mycobacterium
PGVGGHGQPHL

SEQ ID NO: 962491 - protein, 6 aa, Mycobacterium
PGVGPV

SEQ ID NO: 962492 - protein, 4 aa, Mycobacterium
PGVP

SEQ ID NO: 962493 - protein, 19 aa, Mycobacterium
PGVPSDSLSAALPGNTSGL

SEQ ID NO: 962494 - protein, 4 aa, Mycobacterium
PGVT

SEQ ID NO: 962495 - protein, 4 aa, Mycobacterium
PGWD

SEQ ID NO: 962496 - protein, 22 aa, Mycobacterium
PGYVQSSPTLGPTKKSSTTVDG

SEQ ID NO: 962497 - protein, 13 aa, Mycobacterium
PHAAPGDTRRGIF

SEQ ID NO: 962498 - protein, 17 aa, Mycobacterium
PHDGAGSDGVPASGTYL

SEQ ID NO: 962499 - protein, 9 aa, Mycobacterium
PHGANSAYP

SEQ ID NO: 962500 - protein, 5 aa, Mycobacterium
PHHSS

SEQ ID NO: 962501 - protein, 33 aa, Mycobacterium; identical to SEQ ID NO: 275050

SEQ ID NO: 962502 - protein, 4 aa, Mycobacterium
PHPD

SEQ ID NO: 962503 - protein, 5 aa, Mycobacterium
PHPDH

SEQ ID NO: 962504 - protein, 17 aa, Mycobacterium
PHPDTTTDTDTDTDTDA

SEQ ID NO: 962505 - protein, 8 aa, Mycobacterium
PHQRSGGA

SEQ ID NO: 962506 - protein, 10 aa, Mycobacterium
PHRPGTQTPF

SEQ ID NO: 962507 - protein, 7 aa, Mycobacterium
PHSTEIR

SEQ ID NO: 962508 - protein, 4 aa, Mycobacterium
PHTS

SEQ ID NO: 962509 - protein, 9 aa, Mycobacterium
PHTTPAPPV

SEQ ID NO: 962510 - protein, 11 aa, Mycobacterium
PIGDAASAATI

SEQ ID NO: 962511 - protein, 9 aa, Mycobacterium
PIPQPSTVR

SEQ ID NO: 962512 - protein, 12 aa, Mycobacterium
PIQPPPPGPEVI

SEQ ID NO: 962513 - protein, 10 aa, Mycobacterium
PISQSDVGSV

SEQ ID NO: 962514 - protein, 11 aa, Mycobacterium
PISQSDVGSVE

SEQ ID NO: 962515 - protein, 8 aa, Mycobacterium
PIYPKSSL

SEQ ID NO: 962516 - protein, 6 aa, Mycobacterium
PKAKRV

SEQ ID NO: 962517 - protein, 7 aa, Mycobacterium
PKALDNA

SEQ ID NO: 962518 - protein, 32 aa, Mycobacterium; identical to SEQ ID NO: 275172

SEQ ID NO: 962519 - protein, 4 aa, Mycobacterium
PKDV

SEQ ID NO: 962520 - protein, 26 aa, Mycobacterium
PKGADGKPSKKAISDAAVSETWGGQI

SEQ ID NO: 962521 - protein, 9 aa, Mycobacterium
PKGSNTEYQ

SEQ ID NO: 962522 - protein, 9 aa, Mycobacterium
PKGSTEPRG

SEQ ID NO: 962523 - protein, 4 aa, Mycobacterium
PKGT

SEQ ID NO: 962524 - protein, 9 aa, Mycobacterium
PKKSRKSPG

SEQ ID NO: 962525 - protein, 10 aa, Mycobacterium
PKLADGSLSE

SEQ ID NO: 962526 - protein, 16 aa, Mycobacterium
PKLPAAPGSEEAPELA

SEQ ID NO: 962527 - protein, 4 aa, Mycobacterium
PKPL

SEQ ID NO: 962528 - protein, 9 aa, Mycobacterium
PKPTSTVKD

SEQ ID NO: 962529 - protein, 8 aa, Mycobacterium
PKQAPNAV

SEQ ID NO: 962530 - protein, 22 aa, Mycobacterium
PKQRGGYAQFGTGAGAGYAGDP

SEQ ID NO: 962531 - protein, 25 aa, Mycobacterium
PKSESASTSPSTASPSAPSPASADA

SEQ ID NO: 962532 - protein, 6 aa, Mycobacterium
PKTPEF

SEQ ID NO: 962533 - protein, 10 aa, Mycobacterium
PKTVPGRRRA

SEQ ID NO: 962534 - protein, 4 aa, Mycobacterium
PKYR

SEQ ID NO: 962535 - protein, 8 aa, Mycobacterium
PLAGPAGL

SEQ ID NO: 962536 - protein, 9 aa, Mycobacterium
PLAKGNERI

SEQ ID NO: 962537 - protein, 10 aa, Mycobacterium
PLAPPIAPNP

SEQ ID NO: 962538 - protein, 7 aa, Mycobacterium
PLAQKGP

SEQ ID NO: 962539 - protein, 9 aa, Mycobacterium
PLASTTTDL

SEQ ID NO: 962540 - protein, 17 aa, Mycobacterium
PLDDQRREKVPAKRLRP

SEQ ID NO: 962541 - protein, 4 aa, Mycobacterium
PLER

SEQ ID NO: 962542 - protein, 12 aa, Mycobacterium
PLGSRSPTEPAH

SEQ ID NO: 962543 - protein, 5 aa, Mycobacterium
PLHTP

SEQ ID NO: 962544 - protein, 4 aa, Mycobacterium
PLND

SEQ ID NO: 962545 - protein, 22 aa, Mycobacterium
PLPAPPPGGPPPGPPAPAPPEL

SEQ ID NO: 962546 - protein, 6 aa, Mycobacterium
PLPESP

SEQ ID NO: 962547 - protein, 11 aa, Mycobacterium
PLPGETADNEE

SEQ ID NO: 962548 - protein, 9 aa, Mycobacterium
PLPPEPQLA

SEQ ID NO: 962549 - protein, 12 aa, Mycobacterium
PLPPPHRSDPVT

SEQ ID NO: 962550 - protein, 38 aa, Mycobacterium
PLPPPSATSTAVPPSSVVPPPPTTPTTTVTTLTGPRQV

SEQ ID NO: 962551 - protein, 24 aa, Mycobacterium
PLPSQRPTTTRRLPPMGSAARPAM

SEQ ID NO: 962552 - protein, 7 aa, Mycobacterium
PLPTTKD

SEQ ID NO: 962553 - protein, 14 aa, Mycobacterium
PLRATQSLTEQDVY

SEQ ID NO: 962554 - protein, 22 aa, Mycobacterium
PLSGASGNGPAVAGRGQQPHSA

SEQ ID NO: 962555 - protein, 7 aa, Mycobacterium
PLTPPQT

SEQ ID NO: 962556 - protein, 13 aa, Mycobacterium
PLTRPHRSKPGIA

SEQ ID NO: 962557 - protein, 4 aa, Mycobacterium
PLYS

SEQ ID NO: 962558 - protein, 4 aa, Mycobacterium
PMDE

SEQ ID NO: 962559 - protein, 15 aa, Mycobacterium
PMQPPNSHSPEPGTL

SEQ ID NO: 962560 - protein, 4 aa, Mycobacterium
PNAG

SEQ ID NO: 962561 - protein, 6 aa, Mycobacterium
PNAPPF

SEQ ID NO: 962562 - protein, 10 aa, Mycobacterium
PNATAGAPLV

SEQ ID NO: 962563 - protein, 4 aa, Mycobacterium
PNCP

SEQ ID NO: 962564 - protein, 8 aa, Mycobacterium
PNDERAYP

SEQ ID NO: 962565 - protein, 4 aa, Mycobacterium
PNEP

SEQ ID NO: 962566 - protein, 12 aa, Mycobacterium
PNEQGNQLEPAT

SEQ ID NO: 962567 - protein, 10 aa, Mycobacterium
PNGEANTQTT

SEQ ID NO: 962568 - protein, 6 aa, Mycobacterium
PNGESV

SEQ ID NO: 962569 - protein, 4 aa, Mycobacterium
PNGF

SEQ ID NO: 962570 - protein, 4 aa, Mycobacterium
PNGT

SEQ ID NO: 962571 - protein, 5 aa, Mycobacterium
PNGTF

SEQ ID NO: 962572 - protein, 14 aa, Mycobacterium
PNKQAKITNNTEVT

SEQ ID NO: 962573 - protein, 4 aa, Mycobacterium
PNLE

SEQ ID NO: 962574 - protein, 5 aa, Mycobacterium
PNLSP

SEQ ID NO: 962575 - protein, 4 aa, Mycobacterium
PNNT

SEQ ID NO: 962576 - protein, 7 aa, Mycobacterium
PNNTEGR

SEQ ID NO: 962577 - protein, 9 aa, Mycobacterium
PNPAANNSV

SEQ ID NO: 962578 - protein, 8 aa, Mycobacterium
PNPAGEDV

SEQ ID NO: 962579 - protein, 4 aa, Mycobacterium
PNPG

SEQ ID NO: 962580 - protein, 5 aa, Mycobacterium
PNPGI

SEQ ID NO: 962581 - protein, 9 aa, Mycobacterium
PNPTGDPNV

SEQ ID NO: 962582 - protein, 9 aa, Mycobacterium
PNQPGTDYD

SEQ ID NO: 962583 - protein, 10 aa, Mycobacterium
PNSIETSAEA

SEQ ID NO: 962584 - protein, 4 aa, Mycobacterium
PNSW

SEQ ID NO: 962585 - protein, 5 aa, Mycobacterium
PNTDR

SEQ ID NO: 962586 - protein, 16 aa, Mycobacterium
PNTPGSGLLSSPTAEL

SEQ ID NO: 962587 - protein, 16 aa, Mycobacterium
PNVPPTPPAPAPVDAS

SEQ ID NO: 962588 - protein, 80 aa, Mycobacterium
PPAAPAPRQTQTAPPSNQHLPNQQPVVTPSRAPAAPATTTQATQPPPATQSQPPPADGGAPPPAQAPEPEAPAPAEPAPG

SEQ ID NO: 962589 - protein, 6 aa, Mycobacterium
PPADPL

SEQ ID NO: 962590 - protein, 9 aa, Mycobacterium
PPADQRKKT

SEQ ID NO: 962591 - protein, 4 aa, Mycobacterium
PPAP

SEQ ID NO: 962592 - protein, 4 aa, Mycobacterium
PPAS

SEQ ID NO: 962593 - protein, 11 aa, Mycobacterium
PPDDPSAGRLH

SEQ ID NO: 962594 - protein, 6 aa, Mycobacterium
PPDERR

SEQ ID NO: 962595 - protein, 5 aa, Mycobacterium
PPDNW

SEQ ID NO: 962596 - protein, 11 aa, Mycobacterium
PPDPVVPTRDT

SEQ ID NO: 962597 - protein, 4 aa, Mycobacterium
PPDV

SEQ ID NO: 962598 - protein, 8 aa, Mycobacterium
PPDVSADT

SEQ ID NO: 962599 - protein, 11 aa, Mycobacterium
PPEGAESVDIS

SEQ ID NO: 962600 - protein, 5 aa, Mycobacterium
PPEHT

SEQ ID NO: 962601 - protein, 7 aa, Mycobacterium
PPEHTRY

SEQ ID NO: 962602 - protein, 11 aa, Mycobacterium
PPERRAQPGAR

SEQ ID NO: 962603 - protein, 8 aa, Mycobacterium
PPERRGAA

SEQ ID NO: 962604 - protein, 4 aa, Mycobacterium
PPEV

SEQ ID NO: 962605 - protein, 5 aa, Mycobacterium
PPGQP

SEQ ID NO: 962606 - protein, 7 aa, Mycobacterium
PPGRSAY

SEQ ID NO: 962607 - protein, 13 aa, Mycobacterium
PPGRVADRRPRAG

SEQ ID NO: 962608 - protein, 6 aa, Mycobacterium
PPGSAI

SEQ ID NO: 962609 - protein, 6 aa, Mycobacterium
PPGTKI

SEQ ID NO: 962610 - protein, 11 aa, Mycobacterium
PPHYPHGGGRV

SEQ ID NO: 962611 - protein, 4 aa, Mycobacterium
PPKQ

SEQ ID NO: 962612 - protein, 7 aa, Mycobacterium
PPLPTGY

SEQ ID NO: 962613 - protein, 5 aa, Mycobacterium
PPNDR

SEQ ID NO: 962614 - protein, 14 aa, Mycobacterium
PPNPPAVGQADTIG

SEQ ID NO: 962615 - protein, 7 aa, Mycobacterium
PPPADDH

SEQ ID NO: 962616 - protein, 5 aa, Mycobacterium
PPPAL

SEQ ID NO: 962617 - protein, 18 aa, Mycobacterium
PPPARPGAHTTASHYPDR

SEQ ID NO: 962618 - protein, 5 aa, Mycobacterium
PPPCS

SEQ ID NO: 962619 - protein, 5 aa, Mycobacterium
PPPCT

SEQ ID NO: 962620 - protein, 8 aa, Mycobacterium
PPPETMPG

SEQ ID NO: 962621 - protein, 6 aa, Mycobacterium
PPPGEN

SEQ ID NO: 962622 - protein, 74 aa, Mycobacterium
PPPMPSGPWPSQAPPQTGSHRPVPPQPAPPTTRMPAQPPSGPQHVQPSDQQPQYPSGPQTSRSQTGAQPAPQIY

SEQ ID NO: 962623 - protein, 7 aa, Mycobacterium
PPPPPPM

SEQ ID NO: 962624 - protein, 81 aa, Mycobacterium
PPPPPPPGSSGGSEPPAGGYQAPPPPSAPSGGGYPPPPPPPPPSTSGYPPPPPPPPLEGGYPPPPPPSAGGYAPPPPGPAI

SEQ ID NO: 962625 - protein, 8 aa, Mycobacterium
PPPRISKR

SEQ ID NO: 962626 - protein, 35 aa, Mycobacterium; identical to SEQ ID NO: 275869

SEQ ID NO: 962627 - protein, 14 aa, Mycobacterium
PPRNLAKAKPASIL

SEQ ID NO: 962628 - protein, 10 aa, Mycobacterium
PPRSTRGATA

SEQ ID NO: 962629 - protein, 9 aa, Mycobacterium
PPSAPSVAA

SEQ ID NO: 962630 - protein, 10 aa, Mycobacterium
PPSHAGRATT

SEQ ID NO: 962631 - protein, 14 aa, Mycobacterium
PPSSAPFKASKDPV

SEQ ID NO: 962632 - protein, 4 aa, Mycobacterium
PPTC

SEQ ID NO: 962633 - protein, 4 aa, Mycobacterium
PPTF

SEQ ID NO: 962634 - protein, 4 aa, Mycobacterium
PPTN

SEQ ID NO: 962635 - protein, 25 aa, Mycobacterium
PPVPAPGPATECPGGQCPQQPHQAD

SEQ ID NO: 962636 - protein, 5 aa, Mycobacterium
PPVSR

SEQ ID NO: 962637 - protein, 14 aa, Mycobacterium
PPYDPTNSGAVPSG

SEQ ID NO: 962638 - protein, 7 aa, Mycobacterium
PQADAAR

SEQ ID NO: 962639 - protein, 15 aa, Mycobacterium
PQAPAPAPEAPVPAP

SEQ ID NO: 962640 - protein, 5 aa, Mycobacterium
PQDNP

SEQ ID NO: 962641 - protein, 9 aa, Mycobacterium
PQGGGSETY

SEQ ID NO: 962642 - protein, 11 aa, Mycobacterium
PQGPAAQSVLS

SEQ ID NO: 962643 - protein, 21 aa, Mycobacterium
PQHRQQPAAAATTDTHGVDPE

SEQ ID NO: 962644 - protein, 20 aa, Mycobacterium
PQKYRDRSEFRPDDQPADPV

SEQ ID NO: 962645 - protein, 7 aa, Mycobacterium
PQLPGST

SEQ ID NO: 962646 - protein, 7 aa, Mycobacterium
PQMPQAR

SEQ ID NO: 962647 - protein, 6 aa, Mycobacterium
PQPGRH

SEQ ID NO: 962648 - protein, 6 aa, Mycobacterium
PQPPDV

SEQ ID NO: 962649 - protein, 14 aa, Mycobacterium
PQPPIPPQSEPSQV

SEQ ID NO: 962650 - protein, 11 aa, Mycobacterium
PQQDSSAPEAQ

SEQ ID NO: 962651 - protein, 5 aa, Mycobacterium
PQRKR

SEQ ID NO: 962652 - protein, 12 aa, Mycobacterium
PQSARADISADG

SEQ ID NO: 962653 - protein, 25 aa, Mycobacterium
PQSRTSVGPQRVASTARRAAPRLPP

SEQ ID NO: 962654 - protein, 5 aa, Mycobacterium
PQTGT

SEQ ID NO: 962655 - protein, 16 aa, Mycobacterium
PQTPLAAPVPGTAGLP

SEQ ID NO: 962656 - protein, 4 aa, Mycobacterium
PQTS

SEQ ID NO: 962657 - protein, 6 aa, Mycobacterium
PQVAGG

SEQ ID NO: 962658 - protein, 69 aa, Mycobacterium
PQVPPGNSLTPLAPETVSPVPPNESGAPESAPAPSASPTTTGAKPSASLPPAGATATSPAPTSVPTPPV

SEQ ID NO: 962659 - protein, 6 aa, Mycobacterium
PQWGPP

SEQ ID NO: 962660 - protein, 7 aa, Mycobacterium
PRAEPGL

SEQ ID NO: 962661 - protein, 7 aa, Mycobacterium
PRATPQD

SEQ ID NO: 962662 - protein, 10 aa, Mycobacterium
PRAVAPSAGD

SEQ ID NO: 962663 - protein, 4 aa, Mycobacterium
PRDR

SEQ ID NO: 962664 - protein, 20 aa, Mycobacterium
PRDRAGTFEPKTVEKRQRRL

SEQ ID NO: 962665 - protein, 5 aa, Mycobacterium
PREQH

SEQ ID NO: 962666 - protein, 14 aa, Mycobacterium
PRGDNARPRVAAPT

SEQ ID NO: 962667 - protein, 6 aa, Mycobacterium
PRGPLP

SEQ ID NO: 962668 - protein, 12 aa, Mycobacterium
PRGPPAGAPTSI

SEQ ID NO: 962669 - protein, 9 aa, Mycobacterium
PRGSGEGRL

SEQ ID NO: 962670 - protein, 14 aa, Mycobacterium
PRGSHSLGAPQLAA

SEQ ID NO: 962671 - protein, 29 aa, Mycobacterium
PRGSPYSRGRSNGGDRSGSRAPAGGHSTR

SEQ ID NO: 962672 - protein, 5 aa, Mycobacterium
PRGWP

SEQ ID NO: 962673 - protein, 8 aa, Mycobacterium
PRIPPRRP

SEQ ID NO: 962674 - protein, 7 aa, Mycobacterium
PRKSREI

SEQ ID NO: 962675 - protein, 11 aa, Mycobacterium
PRLAPGVPGGT

SEQ ID NO: 962676 - protein, 7 aa, Mycobacterium
PRLGAGA

SEQ ID NO: 962677 - protein, 5 aa, Mycobacterium
PRLSG

SEQ ID NO: 962678 - protein, 9 aa, Mycobacterium
PRNLGRQNA

SEQ ID NO: 962679 - protein, 4 aa, Mycobacterium
PRPA

SEQ ID NO: 962680 - protein, 19 aa, Mycobacterium
PRPDTPDRRRETPPTPPAE

SEQ ID NO: 962681 - protein, 14 aa, Mycobacterium
PRPGRADDGGAPCC

SEQ ID NO: 962682 - protein, 6 aa, Mycobacterium
PRPGSD

SEQ ID NO: 962683 - protein, 18 aa, Mycobacterium
PRPIGTTAPIAGAPPARV

SEQ ID NO: 962684 - protein, 4 aa, Mycobacterium
PRPM

SEQ ID NO: 962685 - protein, 7 aa, Mycobacterium
PRPRPTG

SEQ ID NO: 962686 - protein, 11 aa, Mycobacterium
PRPSQLRPDIP

SEQ ID NO: 962687 - protein, 6 aa, Mycobacterium
PRPTEV

SEQ ID NO: 962688 - protein, 10 aa, Mycobacterium
PRQPGRLGTS

SEQ ID NO: 962689 - protein, 4 aa, Mycobacterium
PRQR

SEQ ID NO: 962690 - protein, 7 aa, Mycobacterium
PRRAVRN

SEQ ID NO: 962691 - protein, 6 aa, Mycobacterium
PRREWG

SEQ ID NO: 962692 - protein, 8 aa, Mycobacterium
PRRPLDER

SEQ ID NO: 962693 - protein, 5 aa, Mycobacterium
PRRPR

SEQ ID NO: 962694 - protein, 7 aa, Mycobacterium
PRRPRDI

SEQ ID NO: 962695 - protein, 5 aa, Mycobacterium
PRRRE

SEQ ID NO: 962696 - protein, 21 aa, Mycobacterium
PRRRQIEDTGDAAQSKSALAE

SEQ ID NO: 962697 - protein, 5 aa, Mycobacterium
PRSAS

SEQ ID NO: 962698 - protein, 22 aa, Mycobacterium
PRSPVASAPRKPNEDPQLSGAA

SEQ ID NO: 962699 - protein, 7 aa, Mycobacterium
PRTKNST

SEQ ID NO: 962700 - protein, 7 aa, Mycobacterium
PRTLGRQ

SEQ ID NO: 962701 - protein, 25 aa, Mycobacterium
PRTPDGSSTLGADTNHLPGQPPIEI

SEQ ID NO: 962702 - protein, 8 aa, Mycobacterium
PRTPKNSR

SEQ ID NO: 962703 - protein, 7 aa, Mycobacterium
PRTPPAP

SEQ ID NO: 962704 - protein, 6 aa, Mycobacterium
PRTSMS

SEQ ID NO: 962705 - protein, 21 aa, Mycobacterium
PRVPRRCSPASSIEATWRWCC

SEQ ID NO: 962706 - protein, 4 aa, Mycobacterium
PRYG

SEQ ID NO: 962707 - protein, 8 aa, Mycobacterium
PSAAKASS

SEQ ID NO: 962708 - protein, 7 aa, Mycobacterium
PSADEKI

SEQ ID NO: 962709 - protein, 7 aa, Mycobacterium
PSAGATV

SEQ ID NO: 962710 - protein, 8 aa, Mycobacterium
PSAGLNPA

SEQ ID NO: 962711 - protein, 7 aa, Mycobacterium
PSAGSAY

SEQ ID NO: 962712 - protein, 8 aa, Mycobacterium
PSAPVAPR

SEQ ID NO: 962713 - protein, 5 aa, Mycobacterium
PSCPL

SEQ ID NO: 962714 - protein, 9 aa, Mycobacterium
PSDADQLQP

SEQ ID NO: 962715 - protein, 7 aa, Mycobacterium
PSDPQWS

SEQ ID NO: 962716 - protein, 4 aa, Mycobacterium
PSDR

SEQ ID NO: 962717 - protein, 4 aa, Mycobacterium
PSEG

SEQ ID NO: 962718 - protein, 8 aa, Mycobacterium
PSFPTSEA

SEQ ID NO: 962719 - protein, 8 aa, Mycobacterium
PSGAQPPF

SEQ ID NO: 962720 - protein, 6 aa, Mycobacterium
PSGDDS

SEQ ID NO: 962721 - protein, 5 aa, Mycobacterium
PSGQA

SEQ ID NO: 962722 - protein, 8 aa, Mycobacterium
PSGQINDS

SEQ ID NO: 962723 - protein, 17 aa, Mycobacterium
PSGRLPRRRSGNRARAV

SEQ ID NO: 962724 - protein, 11 aa, Mycobacterium
PSGSGPTPIQE

SEQ ID NO: 962725 - protein, 11 aa, Mycobacterium
PSGVSAGRPAV

SEQ ID NO: 962726 - protein, 7 aa, Mycobacterium
PSHSYTR

SEQ ID NO: 962727 - protein, 5 aa, Mycobacterium
PSIAD

SEQ ID NO: 962728 - protein, 6 aa, Mycobacterium
PSPASS

SEQ ID NO: 962729 - protein, 5 aa, Mycobacterium
PSPCA

SEQ ID NO: 962730 - protein, 5 aa, Mycobacterium
PSPDT

SEQ ID NO: 962731 - protein, 5 aa, Mycobacterium
PSPQP

SEQ ID NO: 962732 - protein, 44 aa, Mycobacterium
PSPRVPGTGDPDDAPPAPPAPPGAAAPSAFGGNVGPVGSRQEGD

SEQ ID NO: 962733 - protein, 18 aa, Mycobacterium
PSPSCAPRREQSVPQQEL

SEQ ID NO: 962734 - protein, 7 aa, Mycobacterium
PSPSMGR

SEQ ID NO: 962735 - protein, 9 aa, Mycobacterium
PSPSVAESD

SEQ ID NO: 962736 - protein, 5 aa, Mycobacterium
PSPVL

SEQ ID NO: 962737 - protein, 12 aa, Mycobacterium
PSQIPPRTLNPD

SEQ ID NO: 962738 - protein, 7 aa, Mycobacterium
PSQSSAR

SEQ ID NO: 962739 - protein, 9 aa, Mycobacterium
PSRARNSSL

SEQ ID NO: 962740 - protein, 6 aa, Mycobacterium
PSRPRI

SEQ ID NO: 962741 - protein, 12 aa, Mycobacterium
PSRVRRSGGTGL

SEQ ID NO: 962742 - protein, 8 aa, Mycobacterium
PSSTSPLD

SEQ ID NO: 962743 - protein, 4 aa, Mycobacterium
PSTF

SEQ ID NO: 962744 - protein, 5 aa, Mycobacterium
PSTLA

SEQ ID NO: 962745 - protein, 13 aa, Mycobacterium
PSTLDPAVDPDGA

SEQ ID NO: 962746 - protein, 12 aa, Mycobacterium
PSTVSVGDDGMR

SEQ ID NO: 962747 - protein, 7 aa, Mycobacterium
PSVPSPR

SEQ ID NO: 962748 - protein, 5 aa, Mycobacterium
PSVQN

SEQ ID NO: 962749 - protein, 4 aa, Mycobacterium
PSVV

SEQ ID NO: 962750 - protein, 13 aa, Mycobacterium
PSYADPSQSMLSP

SEQ ID NO: 962751 - protein, 4 aa, Mycobacterium
PSYT

SEQ ID NO: 962752 - protein, 5 aa, Mycobacterium
PTAAI

SEQ ID NO: 962753 - protein, 18 aa, Mycobacterium
PTAASEPVEGHQNAQPGK

SEQ ID NO: 962754 - protein, 7 aa, Mycobacterium
PTAESTP

SEQ ID NO: 962755 - protein, 13 aa, Mycobacterium
PTAFSPSAAPVGT

SEQ ID NO: 962756 - protein, 11 aa, Mycobacterium
PTAGDGTGVTP

SEQ ID NO: 962757 - protein, 5 aa, Mycobacterium
PTALS

SEQ ID NO: 962758 - protein, 6 aa, Mycobacterium
PTANGD

SEQ ID NO: 962759 - protein, 9 aa, Mycobacterium
PTATPQEPL

SEQ ID NO: 962760 - protein, 69 aa, Mycobacterium
PTDADDSLRTEATAEDSSESEAAPDSTEQPEPEAAAGSHDAAQEQAEDTEQSGDGQAVEPGVERRPSRL

SEQ ID NO: 962761 - protein, 4 aa, Mycobacterium
PTDP

SEQ ID NO: 962762 - protein, 6 aa, Mycobacterium
PTEPAV

SEQ ID NO: 962763 - protein, 9 aa, Mycobacterium
PTESGRSER

SEQ ID NO: 962764 - protein, 11 aa, Mycobacterium
PTETAAGAAGR

SEQ ID NO: 962765 - protein, 4 aa, Mycobacterium
PTEV

SEQ ID NO: 962766 - protein, 17 aa, Mycobacterium
PTKNAQSTNTRGQQSRS

SEQ ID NO: 962767 - protein, 6 aa, Mycobacterium
PTLPRS

SEQ ID NO: 962768 - protein, 18 aa, Mycobacterium
PTNRSSDTGGDPADPTAA

SEQ ID NO: 962769 - protein, 4 aa, Mycobacterium
PTPA

SEQ ID NO: 962770 - protein, 20 aa, Mycobacterium
PTPPHTPGPDDPAGSEPAPG

SEQ ID NO: 962771 - protein, 80 aa, Mycobacterium
PTPPSTTTTSPSATTTTTQPTTTTTTTTTTTTTPPTTTTTQPTTTRTTTTQPTTTAPPTTTQQPSTTTAAPITPTTEAPG

SEQ ID NO: 962772 - protein, 15 aa, Mycobacterium
PTPQGTEIRDNRSIN

SEQ ID NO: 962773 - protein, 5 aa, Mycobacterium
PTPTA

SEQ ID NO: 962774 - protein, 14 aa, Mycobacterium
PTPYGGPVLPIEPP

SEQ ID NO: 962775 - protein, 7 aa, Mycobacterium
PTRPPSP

SEQ ID NO: 962776 - protein, 4 aa, Mycobacterium
PTSA

SEQ ID NO: 962777 - protein, 18 aa, Mycobacterium
PTSGCGVGRRSGRPSIVS

SEQ ID NO: 962778 - protein, 7 aa, Mycobacterium
PTSGLDP

SEQ ID NO: 962779 - protein, 8 aa, Mycobacterium
PTSGLDPA

SEQ ID NO: 962780 - protein, 10 aa, Mycobacterium
PTSGLDPGYE

SEQ ID NO: 962781 - protein, 7 aa, Mycobacterium
PTSPAQK

SEQ ID NO: 962782 - protein, 6 aa, Mycobacterium
PTTDLA

SEQ ID NO: 962783 - protein, 14 aa, Mycobacterium
PTTGAVSDIEQATK

SEQ ID NO: 962784 - protein, 11 aa, Mycobacterium
PTTGPGDRHDK

SEQ ID NO: 962785 - protein, 4 aa, Mycobacterium
PTTN

SEQ ID NO: 962786 - protein, 11 aa, Mycobacterium
PTTNREATKAA

SEQ ID NO: 962787 - protein, 5 aa, Mycobacterium
PTTVG

SEQ ID NO: 962788 - protein, 21 aa, Mycobacterium
PTTVNPTTVAPTTVAPTTQQT

SEQ ID NO: 962789 - protein, 8 aa, Mycobacterium
PTVQPKNC

SEQ ID NO: 962790 - protein, 5 aa, Mycobacterium
PVAGG

SEQ ID NO: 962791 - protein, 16 aa, Mycobacterium
PVARPPVDAASREAFG

SEQ ID NO: 962792 - protein, 10 aa, Mycobacterium
PVEGDATSTF

SEQ ID NO: 962793 - protein, 8 aa, Mycobacterium
PVGATTSS

SEQ ID NO: 962794 - protein, 9 aa, Mycobacterium
PVGEPPTHT

SEQ ID NO: 962795 - protein, 8 aa, Mycobacterium
PVGSEAAL

SEQ ID NO: 962796 - protein, 7 aa, Mycobacterium
PVKPGRG

SEQ ID NO: 962797 - protein, 13 aa, Mycobacterium
PVLDTQTDTAGAI

SEQ ID NO: 962798 - protein, 5 aa, Mycobacterium
PVNEA

SEQ ID NO: 962799 - protein, 4 aa, Mycobacterium
PVPP

SEQ ID NO: 962800 - protein, 6 aa, Mycobacterium
PVPPQT

SEQ ID NO: 962801 - protein, 4 aa, Mycobacterium
PVPR

SEQ ID NO: 962802 - protein, 11 aa, Mycobacterium
PVPRQQPKVPA

SEQ ID NO: 962803 - protein, 12 aa, Mycobacterium
PVPVPQAPAPVP

SEQ ID NO: 962804 - protein, 9 aa, Mycobacterium
PVRAGRGGA

SEQ ID NO: 962805 - protein, 7 aa, Mycobacterium
PVRGTPL

SEQ ID NO: 962806 - protein, 17 aa, Mycobacterium
PVRPGGGVVSPHNAWPG

SEQ ID NO: 962807 - protein, 5 aa, Mycobacterium
PVRSR

SEQ ID NO: 962808 - protein, 6 aa, Mycobacterium
PVRTPG

SEQ ID NO: 962809 - protein, 5 aa, Mycobacterium
PVSAG

SEQ ID NO: 962810 - protein, 4 aa, Mycobacterium
PVSG

SEQ ID NO: 962811 - protein, 8 aa, Mycobacterium
PVTELTGD

SEQ ID NO: 962812 - protein, 4 aa, Mycobacterium
PVTG

SEQ ID NO: 962813 - protein, 5 aa, Mycobacterium
PVTGG

SEQ ID NO: 962814 - protein, 11 aa, Mycobacterium
PWDTPQPPPDM

SEQ ID NO: 962815 - protein, 19 aa, Mycobacterium
PWEHDTADDDDTDADAVDA

SEQ ID NO: 962816 - protein, 6 aa, Mycobacterium
PWKPGP

SEQ ID NO: 962817 - protein, 20 aa, Mycobacterium
PWPPPGSSDTEETPDLAGTT

SEQ ID NO: 962818 - protein, 4 aa, Mycobacterium
PWPS

SEQ ID NO: 962819 - protein, 6 aa, Mycobacterium
PWPTPD

SEQ ID NO: 962820 - protein, 23 aa, Mycobacterium
PWTGPSADPKSAPDLVSKDGKSG

SEQ ID NO: 962821 - protein, 16 aa, Mycobacterium
PYAAPPQRRQSDGGRL

SEQ ID NO: 962822 - protein, 4 aa, Mycobacterium
PYPG

SEQ ID NO: 962823 - protein, 11 aa, Mycobacterium
PYQAPEGYPVK

SEQ ID NO: 962824 - protein, 4 aa, Mycobacterium
PYRE

SEQ ID NO: 962825 - protein, 7 aa, Mycobacterium
QAADTGA

SEQ ID NO: 962826 - protein, 9 aa, Mycobacterium
QAAEEGGTN

SEQ ID NO: 962827 - protein, 8 aa, Mycobacterium
QAAPTADQ

SEQ ID NO: 962828 - protein, 5 aa, Mycobacterium
QAAQD

SEQ ID NO: 962829 - protein, 7 aa, Mycobacterium
QAATSIG

SEQ ID NO: 962830 - protein, 6 aa, Mycobacterium
QAATVS

SEQ ID NO: 962831 - protein, 14 aa, Mycobacterium
QADDQESTAAARAP

SEQ ID NO: 962832 - protein, 7 aa, Mycobacterium
QADPGLR

SEQ ID NO: 962833 - protein, 9 aa, Mycobacterium
QADQRPNET

SEQ ID NO: 962834 - protein, 6 aa, Mycobacterium
QADYEK

SEQ ID NO: 962835 - protein, 10 aa, Mycobacterium
QAEADQARAR

SEQ ID NO: 962836 - protein, 8 aa, Mycobacterium
QAEDIDTR

SEQ ID NO: 962837 - protein, 6 aa, Mycobacterium
QAEHPG

SEQ ID NO: 962838 - protein, 6 aa, Mycobacterium
QAEHRS

SEQ ID NO: 962839 - protein, 11 aa, Mycobacterium
QAERSRDAERR

SEQ ID NO: 962840 - protein, 24 aa, Mycobacterium
QAETPEPVAQSPVAATPRGSWRAQ

SEQ ID NO: 962841 - protein, 9 aa, Mycobacterium
QAFPGTGTN

SEQ ID NO: 962842 - protein, 8 aa, Mycobacterium
QAIDSSKS

SEQ ID NO: 962843 - protein, 13 aa, Mycobacterium
QAKLTSGAISTAA

SEQ ID NO: 962844 - protein, 7 aa, Mycobacterium
QALTGKS

SEQ ID NO: 962845 - protein, 5 aa, Mycobacterium
QANAG

SEQ ID NO: 962846 - protein, 12 aa, Mycobacterium
QANTALASTALR

SEQ ID NO: 962847 - protein, 5 aa, Mycobacterium
QAPAI

SEQ ID NO: 962848 - protein, 29 aa, Mycobacterium
QAPEAQPGRNVAAAPDPLDGTTVARAPTT

SEQ ID NO: 962849 - protein, 33 aa, Mycobacterium; identical to SEQ ID NO: 277451

SEQ ID NO: 962850 - protein, 6 aa, Mycobacterium
QAPPGV

SEQ ID NO: 962851 - protein, 17 aa, Mycobacterium
QAPPPPPSTAPPPVSGA

SEQ ID NO: 962852 - protein, 16 aa, Mycobacterium
QAPRSERRSSPEAAPE

SEQ ID NO: 962853 - protein, 4 aa, Mycobacterium
QAQA

SEQ ID NO: 962854 - protein, 9 aa, Mycobacterium
QAQARQGQA

SEQ ID NO: 962855 - protein, 22 aa, Mycobacterium
QAQHHAKERARDRDSTESSSEE

SEQ ID NO: 962856 - protein, 7 aa, Mycobacterium
QAQPGLS

SEQ ID NO: 962857 - protein, 8 aa, Mycobacterium
QARARSAN

SEQ ID NO: 962858 - protein, 6 aa, Mycobacterium
QARDPE

SEQ ID NO: 962859 - protein, 8 aa, Mycobacterium
QARPPLAK

SEQ ID NO: 962860 - protein, 5 aa, Mycobacterium
QASNA

SEQ ID NO: 962861 - protein, 16 aa, Mycobacterium
QASSYRHNARAEGRKV

SEQ ID NO: 962862 - protein, 13 aa, Mycobacterium
QASVDSPKPAGSV

SEQ ID NO: 962863 - protein, 40 aa, Mycobacterium
QATQAAQSASEGTGRGPNGSRGADANPGSHPDYGAPAGWR

SEQ ID NO: 962864 - protein, 21 aa, Mycobacterium
QATRAERLSRRHPPAQLCQQA

SEQ ID NO: 962865 - protein, 11 aa, Mycobacterium
QAVAGNVGANE

SEQ ID NO: 962866 - protein, 44 aa, Mycobacterium; identical to SEQ ID NO: 277581

SEQ ID NO: 962867 - protein, 12 aa, Mycobacterium
QDDGAPVSRTQQ

SEQ ID NO: 962868 - protein, 6 aa, Mycobacterium
QDDPKV

SEQ ID NO: 962869 - protein, 9 aa, Mycobacterium
QDDSPPPPR

SEQ ID NO: 962870 - protein, 7 aa, Mycobacterium
QDENEAA

SEQ ID NO: 962871 - protein, 6 aa, Mycobacterium
QDEQDP

SEQ ID NO: 962872 - protein, 8 aa, Mycobacterium
QDGVSSQV

SEQ ID NO: 962873 - protein, 8 aa, Mycobacterium
QDNDADSM

SEQ ID NO: 962874 - protein, 12 aa, Mycobacterium
QDNKGTYEVGRP

SEQ ID NO: 962875 - protein, 4 aa, Mycobacterium
QDPE

SEQ ID NO: 962876 - protein, 9 aa, Mycobacterium
QDPPARRRL

SEQ ID NO: 962877 - protein, 10 aa, Mycobacterium
QDPPTSTASS

SEQ ID NO: 962878 - protein, 17 aa, Mycobacterium
QDQSSAGAPTGAGPAVD

SEQ ID NO: 962879 - protein, 7 aa, Mycobacterium
QDRAEDL

SEQ ID NO: 962880 - protein, 17 aa, Mycobacterium
QDSAERHGRLSGQFGAE

SEQ ID NO: 962881 - protein, 13 aa, Mycobacterium
QDSLNETSNGEGD

SEQ ID NO: 962882 - protein, 7 aa, Mycobacterium
QDSPLNV

SEQ ID NO: 962883 - protein, 4 aa, Mycobacterium
QDVQ

SEQ ID NO: 962884 - protein, 12 aa, Mycobacterium
QEARSAGEERDT

SEQ ID NO: 962885 - protein, 10 aa, Mycobacterium
QEDSSAMGEA

SEQ ID NO: 962886 - protein, 5 aa, Mycobacterium
QEEAG

SEQ ID NO: 962887 - protein, 10 aa, Mycobacterium
QEETGQRAEP

SEQ ID NO: 962888 - protein, 7 aa, Mycobacterium
QEGAEGW

SEQ ID NO: 962889 - protein, 20 aa, Mycobacterium
QEGRGRLRRGPDADSGQPYG

SEQ ID NO: 962890 - protein, 107 aa, Mycobacterium
QEGSWQPPSYPAADYQQYQQPVEPAYPQQYPAAPGYGQSDFGSQPTRFGAPPQFGQPGQYGQPGQYGQPGQYGQPGQPGQPGQYGQPGQYPGQFSPYDQSGQGSKRS

SEQ ID NO: 962891 - protein, 5 aa, Mycobacterium
QELQT

SEQ ID NO: 962892 - protein, 6 aa, Mycobacterium
QEPLGA

SEQ ID NO: 962893 - protein, 9 aa, Mycobacterium
QEQAAAASE

SEQ ID NO: 962894 - protein, 10 aa, Mycobacterium
QEQPDPSTMA

SEQ ID NO: 962895 - protein, 8 aa, Mycobacterium
QEQTTAAS

SEQ ID NO: 962896 - protein, 4 aa, Mycobacterium
QERS

SEQ ID NO: 962897 - protein, 6 aa, Mycobacterium
QESYGS

SEQ ID NO: 962898 - protein, 7 aa, Mycobacterium
QETVAKG

SEQ ID NO: 962899 - protein, 6 aa, Mycobacterium
QEVPDA

SEQ ID NO: 962900 - protein, 12 aa, Mycobacterium
QFGGGDATVTDA

SEQ ID NO: 962901 - protein, 8 aa, Mycobacterium
QFGGSDTR

SEQ ID NO: 962902 - protein, 10 aa, Mycobacterium
QFPGPGRTEH

SEQ ID NO: 962903 - protein, 9 aa, Mycobacterium
QGAAELGGA

SEQ ID NO: 962904 - protein, 5 aa, Mycobacterium
QGAAR

SEQ ID NO: 962905 - protein, 6 aa, Mycobacterium
QGAIQG

SEQ ID NO: 962906 - protein, 15 aa, Mycobacterium
QGAPGATGNALAAPQ

SEQ ID NO: 962907 - protein, 11 aa, Mycobacterium
QGAPLDGRADQ

SEQ ID NO: 962908 - protein, 7 aa, Mycobacterium
QGASNVV

SEQ ID NO: 962909 - protein, 4 aa, Mycobacterium
QGDG

SEQ ID NO: 962910 - protein, 4 aa, Mycobacterium
QGEL

SEQ ID NO: 962911 - protein, 4 aa, Mycobacterium
QGGA

SEQ ID NO: 962912 - protein, 6 aa, Mycobacterium
QGGGGG

SEQ ID NO: 962913 - protein, 13 aa, Mycobacterium
QGGHRSADGRRGV

SEQ ID NO: 962914 - protein, 6 aa, Mycobacterium
QGGTAG

SEQ ID NO: 962915 - protein, 5 aa, Mycobacterium
QGGTT

SEQ ID NO: 962916 - protein, 4 aa, Mycobacterium
QGLG

SEQ ID NO: 962917 - protein, 20 aa, Mycobacterium
QGPNAEHPGEPLRGERSGYD

SEQ ID NO: 962918 - protein, 7 aa, Mycobacterium
QGQSASW

SEQ ID NO: 962919 - protein, 7 aa, Mycobacterium
QGQSGST

SEQ ID NO: 962920 - protein, 8 aa, Mycobacterium
QGRARSGA

SEQ ID NO: 962921 - protein, 17 aa, Mycobacterium
QGRDAVTEFPNDRGWDT

SEQ ID NO: 962922 - protein, 11 aa, Mycobacterium
QGREDTASIEG

SEQ ID NO: 962923 - protein, 10 aa, Mycobacterium
QGSANASPGC

SEQ ID NO: 962924 - protein, 13 aa, Mycobacterium
QGSIRAGGQDIRS

SEQ ID NO: 962925 - protein, 4 aa, Mycobacterium
QGSP

SEQ ID NO: 962926 - protein, 12 aa, Mycobacterium
QGVGSAIASPTG

SEQ ID NO: 962927 - protein, 6 aa, Mycobacterium
QHADGS

SEQ ID NO: 962928 - protein, 5 aa, Mycobacterium
QHAEA

SEQ ID NO: 962929 - protein, 10 aa, Mycobacterium
QHAGSGAPAV

SEQ ID NO: 962930 - protein, 12 aa, Mycobacterium
QHDPSTIARADT

SEQ ID NO: 962931 - protein, 15 aa, Mycobacterium
QHGGESGEAASPIGA

SEQ ID NO: 962932 - protein, 4 aa, Mycobacterium
QHGV

SEQ ID NO: 962933 - protein, 10 aa, Mycobacterium
QHPSHHDEVG

SEQ ID NO: 962934 - protein, 12 aa, Mycobacterium
QHRHEQARDKVG

SEQ ID NO: 962935 - protein, 11 aa, Mycobacterium
QHSAPMTPMDA

SEQ ID NO: 962936 - protein, 8 aa, Mycobacterium
QHTPDSAD

SEQ ID NO: 962937 - protein, 6 aa, Mycobacterium
QIAGDR

SEQ ID NO: 962938 - protein, 26 aa, Mycobacterium
QIPDSQATQAEEEKLPESDGEMVSVT

SEQ ID NO: 962939 - protein, 6 aa, Mycobacterium
QIPDTA

SEQ ID NO: 962940 - protein, 20 aa, Mycobacterium
QIRSTARQYGRSTTAGGQRS

SEQ ID NO: 962941 - protein, 26 aa, Mycobacterium
QISGGSYQNLSTSASLDLATAINTFL

SEQ ID NO: 962942 - protein, 18 aa, Mycobacterium
QISRDGLDPYRVGPASGL

SEQ ID NO: 962943 - protein, 7 aa, Mycobacterium
QKALGQR

SEQ ID NO: 962944 - protein, 32 aa, Mycobacterium
QKESLERDVREAESAPALAEAARKQGMIPTRD

SEQ ID NO: 962945 - protein, 16 aa, Mycobacterium
QKESSQRTEIAWPVLF

SEQ ID NO: 962946 - protein, 15 aa, Mycobacterium
QKGLSTKGGPTGVAN

SEQ ID NO: 962947 - protein, 11 aa, Mycobacterium
QKRPAGPEQDE

SEQ ID NO: 962948 - protein, 9 aa, Mycobacterium
QKTKTREEV

SEQ ID NO: 962949 - protein, 6 aa, Mycobacterium
QLAGDR

SEQ ID NO: 962950 - protein, 20 aa, Mycobacterium
QLASSAGQQQEDPAARGQYR

SEQ ID NO: 962951 - protein, 9 aa, Mycobacterium
QLDDTTDMK

SEQ ID NO: 962952 - protein, 15 aa, Mycobacterium
QLDEQAEELRRSNAE

SEQ ID NO: 962953 - protein, 6 aa, Mycobacterium
QLDGRS

SEQ ID NO: 962954 - protein, 9 aa, Mycobacterium
QLGADEASH

SEQ ID NO: 962955 - protein, 18 aa, Mycobacterium
QLGAGMSDTAKSLTTADQ

SEQ ID NO: 962956 - protein, 7 aa, Mycobacterium
QLGDNTA

SEQ ID NO: 962957 - protein, 8 aa, Mycobacterium
QLPPGFDS

SEQ ID NO: 962958 - protein, 12 aa, Mycobacterium
QLPPLPRATTST

SEQ ID NO: 962959 - protein, 5 aa, Mycobacterium
QLPPQ

SEQ ID NO: 962960 - protein, 7 aa, Mycobacterium
QLPPVAG

SEQ ID NO: 962961 - protein, 7 aa, Mycobacterium
QLPSPYH

SEQ ID NO: 962962 - protein, 5 aa, Mycobacterium
QLPTG

SEQ ID NO: 962963 - protein, 9 aa, Mycobacterium
QLQRQDSSL

SEQ ID NO: 962964 - protein, 25 aa, Mycobacterium
QLRGDSGRSRRRDPRDQAGRPLSRD

SEQ ID NO: 962965 - protein, 16 aa, Mycobacterium
QLRPEQATAAAADPDL

SEQ ID NO: 962966 - protein, 11 aa, Mycobacterium
QLSGGNSYNAA

SEQ ID NO: 962967 - protein, 7 aa, Mycobacterium
QLSTGGS

SEQ ID NO: 962968 - protein, 8 aa, Mycobacterium
QLSTSAST

SEQ ID NO: 962969 - protein, 17 aa, Mycobacterium
QLTDTTDTTERGQPAIA

SEQ ID NO: 962970 - protein, 14 aa, Mycobacterium
QLTGAEADGRSDQY

SEQ ID NO: 962971 - protein, 13 aa, Mycobacterium
QLTPPAAGELPGA

SEQ ID NO: 962972 - protein, 6 aa, Mycobacterium
QMGADG

SEQ ID NO: 962973 - protein, 9 aa, Mycobacterium
QMQANTDQL

SEQ ID NO: 962974 - protein, 11 aa, Mycobacterium
QNDATTVRGAR

SEQ ID NO: 962975 - protein, 5 aa, Mycobacterium
QNDRE

SEQ ID NO: 962976 - protein, 9 aa, Mycobacterium
QNGGANSPA

SEQ ID NO: 962977 - protein, 28 aa, Mycobacterium
QNGGTPHDAAAATVNNTGITPAQASAGI

SEQ ID NO: 962978 - protein, 6 aa, Mycobacterium
QNGQLN

SEQ ID NO: 962979 - protein, 7 aa, Mycobacterium
QNGSGTF

SEQ ID NO: 962980 - protein, 9 aa, Mycobacterium
QNGVDESPK

SEQ ID NO: 962981 - protein, 5 aa, Mycobacterium
QNNCD

SEQ ID NO: 962982 - protein, 9 aa, Mycobacterium
QNPGQPGEV

SEQ ID NO: 962983 - protein, 20 aa, Mycobacterium
QNPPAGAGVNRDGIVTLKFG

SEQ ID NO: 962984 - protein, 8 aa, Mycobacterium
QNSARGKA

SEQ ID NO: 962985 - protein, 14 aa, Mycobacterium
QNSPGQPPSQAAPA

SEQ ID NO: 962986 - protein, 11 aa, Mycobacterium
QNTNDGGPSRA

SEQ ID NO: 962987 - protein, 9 aa, Mycobacterium
QNTSTAGVG

SEQ ID NO: 962988 - protein, 12 aa, Mycobacterium
QPADGGGQLRHR

SEQ ID NO: 962989 - protein, 17 aa, Mycobacterium
QPAPQGTGAWSSAAADE

SEQ ID NO: 962990 - protein, 8 aa, Mycobacterium
QPDDPRDW

SEQ ID NO: 962991 - protein, 19 aa, Mycobacterium
QPDEPDEGTEAEAGADQTR

SEQ ID NO: 962992 - protein, 5 aa, Mycobacterium
QPDGS

SEQ ID NO: 962993 - protein, 32 aa, Mycobacterium
QPDIPAGPDRGRGASLRPSDLSNGDSVGYTRG

SEQ ID NO: 962994 - protein, 6 aa, Mycobacterium
QPDQPA

SEQ ID NO: 962995 - protein, 14 aa, Mycobacterium
QPDTTRARGDSDGL

SEQ ID NO: 962996 - protein, 31 aa, Mycobacterium; identical to SEQ ID NO: 278398

SEQ ID NO: 962997 - protein, 6 aa, Mycobacterium
QPEVDA

SEQ ID NO: 962998 - protein, 9 aa, Mycobacterium
QPGQGKERH

SEQ ID NO: 962999 - protein, 16 aa, Mycobacterium
QPGRTYDVSSPDLPTV

SEQ ID NO: 963000 - protein, 8 aa, Mycobacterium
QPGVVDPA

SEQ ID NO: 963001 - protein, 5 aa, Mycobacterium
QPIAP

SEQ ID NO: 963002 - protein, 15 aa, Mycobacterium
QPIPRPSAARPGIPA

SEQ ID NO: 963003 - protein, 8 aa, Mycobacterium
QPIQTQRQ

SEQ ID NO: 963004 - protein, 7 aa, Mycobacterium
QPKKAAA

SEQ ID NO: 963005 - protein, 9 aa, Mycobacterium
QPKLADSTW

SEQ ID NO: 963006 - protein, 6 aa, Mycobacterium
QPLSPA

SEQ ID NO: 963007 - protein, 4 aa, Mycobacterium
QPPF

SEQ ID NO: 963008 - protein, 7 aa, Mycobacterium
QPPGNPL

SEQ ID NO: 963009 - protein, 15 aa, Mycobacterium
QPPKPSPPPKPIAED

SEQ ID NO: 963010 - protein, 4 aa, Mycobacterium
QPPP

SEQ ID NO: 963011 - protein, 13 aa, Mycobacterium
QPPPPAPPGPEHP

SEQ ID NO: 963012 - protein, 5 aa, Mycobacterium
QPPSR

SEQ ID NO: 963013 - protein, 5 aa, Mycobacterium
QPPST

SEQ ID NO: 963014 - protein, 5 aa, Mycobacterium
QPPTE

SEQ ID NO: 963015 - protein, 22 aa, Mycobacterium
QPPTPNPTQTPEDCSPAQSPCA

SEQ ID NO: 963016 - protein, 11 aa, Mycobacterium
QPPVPPPDIPE

SEQ ID NO: 963017 - protein, 9 aa, Mycobacterium
QPQLASQPA

SEQ ID NO: 963018 - protein, 12 aa, Mycobacterium
QPQPATDDRSGV

SEQ ID NO: 963019 - protein, 13 aa, Mycobacterium
QPQPGARHIPATP

SEQ ID NO: 963020 - protein, 4 aa, Mycobacterium
QPQT

SEQ ID NO: 963021 - protein, 7 aa, Mycobacterium
QPRPNEN

SEQ ID NO: 963022 - protein, 29 aa, Mycobacterium
QPSPASEPSSAKERTPTRDRAQGSAVGRP

SEQ ID NO: 963023 - protein, 6 aa, Mycobacterium
QPSSGV

SEQ ID NO: 963024 - protein, 6 aa, Mycobacterium
QPTAEA

SEQ ID NO: 963025 - protein, 7 aa, Mycobacterium
QPTDEDQ

SEQ ID NO: 963026 - protein, 11 aa, Mycobacterium
QPTNSASGFGR

SEQ ID NO: 963027 - protein, 15 aa, Mycobacterium
QPTRLATPIETAELD

SEQ ID NO: 963028 - protein, 7 aa, Mycobacterium
QPVGPSR

SEQ ID NO: 963029 - protein, 7 aa, Mycobacterium
QPVPAPA

SEQ ID NO: 963030 - protein, 24 aa, Mycobacterium
QPVPEDTAADGGPGEAGLAPTTRQ

SEQ ID NO: 963031 - protein, 52 aa, Mycobacterium; identical to SEQ ID NO: 278563

SEQ ID NO: 963032 - protein, 5 aa, Mycobacterium
QQAET

SEQ ID NO: 963033 - protein, 6 aa, Mycobacterium
QQASAR

SEQ ID NO: 963034 - protein, 7 aa, Mycobacterium
QQELTQQ

SEQ ID NO: 963035 - protein, 10 aa, Mycobacterium
QQESNAQDFP

SEQ ID NO: 963036 - protein, 7 aa, Mycobacterium
QQGGAQV

SEQ ID NO: 963037 - protein, 5 aa, Mycobacterium
QQGRE

SEQ ID NO: 963038 - protein, 7 aa, Mycobacterium
QQPMDDR

SEQ ID NO: 963039 - protein, 10 aa, Mycobacterium
QQPPAGQQPD

SEQ ID NO: 963040 - protein, 10 aa, Mycobacterium
QQPYGDDPDD

SEQ ID NO: 963041 - protein, 25 aa, Mycobacterium
QQQAPVPPPPPDAPTAGFQGGTIPT

SEQ ID NO: 963042 - protein, 6 aa, Mycobacterium
QQRGQA

SEQ ID NO: 963043 - protein, 4 aa, Mycobacterium
QQRR

SEQ ID NO: 963044 - protein, 10 aa, Mycobacterium
QQRRQNPGSD

SEQ ID NO: 963045 - protein, 4 aa, Mycobacterium
QQRV

SEQ ID NO: 963046 - protein, 9 aa, Mycobacterium
QQVTPEGTT

SEQ ID NO: 963047 - protein, 7 aa, Mycobacterium
QQYQASG

SEQ ID NO: 963048 - protein, 5 aa, Mycobacterium
QRAQT

SEQ ID NO: 963049 - protein, 10 aa, Mycobacterium
QRATADGDDC

SEQ ID NO: 963050 - protein, 22 aa, Mycobacterium
QRDPLGQAAGRARVDRDRPRQW

SEQ ID NO: 963051 - protein, 6 aa, Mycobacterium
QRDRAN

SEQ ID NO: 963052 - protein, 10 aa, Mycobacterium
QREADEATSG

SEQ ID NO: 963053 - protein, 7 aa, Mycobacterium
QREGTLN

SEQ ID NO: 963054 - protein, 14 aa, Mycobacterium
QREPGEPVPPSQAG

SEQ ID NO: 963055 - protein, 9 aa, Mycobacterium
QRFGPNDYR

SEQ ID NO: 963056 - protein, 7 aa, Mycobacterium
QRFGTGA

SEQ ID NO: 963057 - protein, 8 aa, Mycobacterium
QRGNHGPT

SEQ ID NO: 963058 - protein, 5 aa, Mycobacterium
QRGNY

SEQ ID NO: 963059 - protein, 5 aa, Mycobacterium
QRGVP

SEQ ID NO: 963060 - protein, 11 aa, Mycobacterium
QRHADSAYKMP

SEQ ID NO: 963061 - protein, 13 aa, Mycobacterium
QRISSNRTHPEPD

SEQ ID NO: 963062 - protein, 6 aa, Mycobacterium
QRITDP

SEQ ID NO: 963063 - protein, 12 aa, Mycobacterium
QRKRRSYSADEV

SEQ ID NO: 963064 - protein, 5 aa, Mycobacterium
QRNDG

SEQ ID NO: 963065 - protein, 21 aa, Mycobacterium
QRPAPQPWPTPAPTPPPATTS

SEQ ID NO: 963066 - protein, 53 aa, Mycobacterium; identical to SEQ ID NO: 278798

SEQ ID NO: 963067 - protein, 52 aa, Mycobacterium; identical to SEQ ID NO: 278799

SEQ ID NO: 963068 - protein, 6 aa, Mycobacterium
QRPHPY

SEQ ID NO: 963069 - protein, 9 aa, Mycobacterium
QRPHTGNGA

SEQ ID NO: 963070 - protein, 7 aa, Mycobacterium
QRPLHGT

SEQ ID NO: 963071 - protein, 11 aa, Mycobacterium
QRQPVPVDDET

SEQ ID NO: 963072 - protein, 5 aa, Mycobacterium
QRRDR

SEQ ID NO: 963073 - protein, 23 aa, Mycobacterium
QRRGGADAQAADTDAALAPAGTP

SEQ ID NO: 963074 - protein, 6 aa, Mycobacterium
QRRPQY

SEQ ID NO: 963075 - protein, 7 aa, Mycobacterium
QRSAQFS

SEQ ID NO: 963076 - protein, 7 aa, Mycobacterium
QRSGADA

SEQ ID NO: 963077 - protein, 6 aa, Mycobacterium
QRTAGL

SEQ ID NO: 963078 - protein, 15 aa, Mycobacterium
QRTTPDQAAPDDPAL

SEQ ID NO: 963079 - protein, 8 aa, Mycobacterium
QRTVRDVP

SEQ ID NO: 963080 - protein, 10 aa, Mycobacterium
QRYSQAARRS

SEQ ID NO: 963081 - protein, 6 aa, Mycobacterium
QSANQI

SEQ ID NO: 963082 - protein, 6 aa, Mycobacterium
QSDSEA

SEQ ID NO: 963083 - protein, 4 aa, Mycobacterium
QSDV

SEQ ID NO: 963084 - protein, 10 aa, Mycobacterium
QSESAPAEVP

SEQ ID NO: 963085 - protein, 4 aa, Mycobacterium
QSGD

SEQ ID NO: 963086 - protein, 5 aa, Mycobacterium
QSGVE

SEQ ID NO: 963087 - protein, 11 aa, Mycobacterium
QSHTKTYSTRA

SEQ ID NO: 963088 - protein, 6 aa, Mycobacterium
QSLAPA

SEQ ID NO: 963089 - protein, 10 aa, Mycobacterium
QSNPGRARGR

SEQ ID NO: 963090 - protein, 11 aa, Mycobacterium
QSPGRVSPDTK

SEQ ID NO: 963091 - protein, 15 aa, Mycobacterium
QSPVPGETLAGTAER

SEQ ID NO: 963092 - protein, 6 aa, Mycobacterium
QSQTIT

SEQ ID NO: 963093 - protein, 9 aa, Mycobacterium
QSRTGAAEA

SEQ ID NO: 963094 - protein, 6 aa, Mycobacterium
QSSGTY

SEQ ID NO: 963095 - protein, 20 aa, Mycobacterium
QSVPGPNDAVAGSDQDSVRH

SEQ ID NO: 963096 - protein, 12 aa, Mycobacterium
QSVPPDTRNGLA

SEQ ID NO: 963097 - protein, 11 aa, Mycobacterium
QSVSEGLNGEA

SEQ ID NO: 963098 - protein, 7 aa, Mycobacterium
QTAADAA

SEQ ID NO: 963099 - protein, 13 aa, Mycobacterium
QTAGGGPAAPPTG

SEQ ID NO: 963100 - protein, 4 aa, Mycobacterium
QTAT

SEQ ID NO: 963101 - protein, 7 aa, Mycobacterium
QTDNKGL

SEQ ID NO: 963102 - protein, 9 aa, Mycobacterium
QTETDGAGP

SEQ ID NO: 963103 - protein, 4 aa, Mycobacterium
QTGD

SEQ ID NO: 963104 - protein, 24 aa, Mycobacterium
QTGPPPPAPPVERPGELGGDPSHT

SEQ ID NO: 963105 - protein, 5 aa, Mycobacterium
QTGSK

SEQ ID NO: 963106 - protein, 4 aa, Mycobacterium
QTHD

SEQ ID NO: 963107 - protein, 8 aa, Mycobacterium
QTHSSGRI

SEQ ID NO: 963108 - protein, 10 aa, Mycobacterium
QTKGASHTQQ

SEQ ID NO: 963109 - protein, 10 aa, Mycobacterium
QTKLTGAGLT

SEQ ID NO: 963110 - protein, 28 aa, Mycobacterium
QTNSNSSGRHEAPGTAGTPPPNYGPRAD

SEQ ID NO: 963111 - protein, 5 aa, Mycobacterium
QTPDF

SEQ ID NO: 963112 - protein, 4 aa, Mycobacterium
QTPN

SEQ ID NO: 963113 - protein, 7 aa, Mycobacterium
QTPQDQI

SEQ ID NO: 963114 - protein, 4 aa, Mycobacterium
QTPV

SEQ ID NO: 963115 - protein, 4 aa, Mycobacterium
QTQA

SEQ ID NO: 963116 - protein, 8 aa, Mycobacterium
QTQPEVDS

SEQ ID NO: 963117 - protein, 15 aa, Mycobacterium
QTRISGDGSNISAGE

SEQ ID NO: 963118 - protein, 16 aa, Mycobacterium
QTSDPNKCDTFSATNL

SEQ ID NO: 963119 - protein, 11 aa, Mycobacterium
QTSNGGEPDPM

SEQ ID NO: 963120 - protein, 12 aa, Mycobacterium
QTTGTGPGDERV

SEQ ID NO: 963121 - protein, 4 aa, Mycobacterium
QTVG

SEQ ID NO: 963122 - protein, 6 aa, Mycobacterium
QVADTD

SEQ ID NO: 963123 - protein, 10 aa, Mycobacterium
QVATDVRGSL

SEQ ID NO: 963124 - protein, 7 aa, Mycobacterium
QVDGAGA

SEQ ID NO: 963125 - protein, 5 aa, Mycobacterium
QVDGR

SEQ ID NO: 963126 - protein, 5 aa, Mycobacterium
QVDQA

SEQ ID NO: 963127 - protein, 6 aa, Mycobacterium
QVGGSI

SEQ ID NO: 963128 - protein, 13 aa, Mycobacterium
QVGYDQDDVLHHI

SEQ ID NO: 963129 - protein, 8 aa, Mycobacterium
QVNSGDAI

SEQ ID NO: 963130 - protein, 8 aa, Mycobacterium
QVPAGEGT

SEQ ID NO: 963131 - protein, 17 aa, Mycobacterium
QVPGAPGPVPLPGQLPG

SEQ ID NO: 963132 - protein, 4 aa, Mycobacterium
QVQR

SEQ ID NO: 963133 - protein, 11 aa, Mycobacterium
QVRTDADTAIQ

SEQ ID NO: 963134 - protein, 10 aa, Mycobacterium
QVSSSNAGAR

SEQ ID NO: 963135 - protein, 8 aa, Mycobacterium
QVTGTDKA

SEQ ID NO: 963136 - protein, 5 aa, Mycobacterium
QVTTT

SEQ ID NO: 963137 - protein, 8 aa, Mycobacterium
QWRSRPDT

SEQ ID NO: 963138 - protein, 27 aa, Mycobacterium
QWSHPEPTALAGVPGSRRQWERDPHDS

SEQ ID NO: 963139 - protein, 9 aa, Mycobacterium
QWSRPANSD

SEQ ID NO: 963140 - protein, 8 aa, Mycobacterium
QYAKSSAD

SEQ ID NO: 963141 - protein, 9 aa, Mycobacterium
QYPDQGASS

SEQ ID NO: 963142 - protein, 6 aa, Mycobacterium
QYPNNS

SEQ ID NO: 963143 - protein, 5 aa, Mycobacterium
QYRDY

SEQ ID NO: 963144 - protein, 6 aa, Mycobacterium
QYTTGL

SEQ ID NO: 963145 - protein, 4 aa, Mycobacterium
RAAA

SEQ ID NO: 963146 - protein, 12 aa, Mycobacterium
RAAADRGYNTGG

SEQ ID NO: 963147 - protein, 14 aa, Mycobacterium
RAAARAAARRDREM

SEQ ID NO: 963148 - protein, 10 aa, Mycobacterium
RAAGGDQDPL

SEQ ID NO: 963149 - protein, 11 aa, Mycobacterium
RAAGGGGFGGL

SEQ ID NO: 963150 - protein, 6 aa, Mycobacterium
RAAGTH

SEQ ID NO: 963151 - protein, 4 aa, Mycobacterium
RAAQ

SEQ ID NO: 963152 - protein, 19 aa, Mycobacterium
RAASPQLPAPAAPAQRAPE

SEQ ID NO: 963153 - protein, 12 aa, Mycobacterium
RAASPVADPVAD

SEQ ID NO: 963154 - protein, 11 aa, Mycobacterium
RAATAANGGAR

SEQ ID NO: 963155 - protein, 9 aa, Mycobacterium
RADAAPSVA

SEQ ID NO: 963156 - protein, 10 aa, Mycobacterium
RADEETGRAE

SEQ ID NO: 963157 - protein, 7 aa, Mycobacterium
RADGPRI

SEQ ID NO: 963158 - protein, 14 aa, Mycobacterium
RADNALTGEDESAI

SEQ ID NO: 963159 - protein, 5 aa, Mycobacterium
RADNP

SEQ ID NO: 963160 - protein, 8 aa, Mycobacterium
RADPGRAG

SEQ ID NO: 963161 - protein, 7 aa, Mycobacterium
RADRAAD

SEQ ID NO: 963162 - protein, 30 aa, Mycobacterium
RADSQQQSPPPTVTQTTTAHQTPTGQGPRL

SEQ ID NO: 963163 - protein, 4 aa, Mycobacterium
RADY

SEQ ID NO: 963164 - protein, 12 aa, Mycobacterium
RAEASGLRGDGG

SEQ ID NO: 963165 - protein, 5 aa, Mycobacterium
RAEQR

SEQ ID NO: 963166 - protein, 10 aa, Mycobacterium
RAERAEAAAE

SEQ ID NO: 963167 - protein, 9 aa, Mycobacterium
RAERTQSEL

SEQ ID NO: 963168 - protein, 13 aa, Mycobacterium
RAESLAETTGADQ

SEQ ID NO: 963169 - protein, 9 aa, Mycobacterium
RAGAGAAAP

SEQ ID NO: 963170 - protein, 9 aa, Mycobacterium
RAGATAAEL

SEQ ID NO: 963171 - protein, 15 aa, Mycobacterium
RAGEHGRARRQRPLG

SEQ ID NO: 963172 - protein, 7 aa, Mycobacterium
RAGGDIK

SEQ ID NO: 963173 - protein, 7 aa, Mycobacterium
RAGGGQA

SEQ ID NO: 963174 - protein, 5 aa, Mycobacterium
RAGNP

SEQ ID NO: 963175 - protein, 5 aa, Mycobacterium
RAGPG

SEQ ID NO: 963176 - protein, 16 aa, Mycobacterium
RAGQPTPAQTEPALAQ

SEQ ID NO: 963177 - protein, 13 aa, Mycobacterium
RAGQRAAAEVAAL

SEQ ID NO: 963178 - protein, 8 aa, Mycobacterium
RAGRDDRV

SEQ ID NO: 963179 - protein, 13 aa, Mycobacterium
RAGSTRSGRIRRR

SEQ ID NO: 963180 - protein, 4 aa, Mycobacterium
RAGT

SEQ ID NO: 963181 - protein, 9 aa, Mycobacterium
RAGTGGAGV

SEQ ID NO: 963182 - protein, 5 aa, Mycobacterium
RAGTP

SEQ ID NO: 963183 - protein, 13 aa, Mycobacterium
RAGTTAIYGQGSG

SEQ ID NO: 963184 - protein, 8 aa, Mycobacterium
RAHAEQEV

SEQ ID NO: 963185 - protein, 8 aa, Mycobacterium
RAHDGDAG

SEQ ID NO: 963186 - protein, 15 aa, Mycobacterium
RAHPEPDQAADEGTD

SEQ ID NO: 963187 - protein, 7 aa, Mycobacterium
RAIRQQD

SEQ ID NO: 963188 - protein, 10 aa, Mycobacterium
RAKSKAGAAL

SEQ ID NO: 963189 - protein, 10 aa, Mycobacterium
RAKSKAGGAL

SEQ ID NO: 963190 - protein, 6 aa, Mycobacterium
RAKTTT

SEQ ID NO: 963191 - protein, 4 aa, Mycobacterium
RALE

SEQ ID NO: 963192 - protein, 20 aa, Mycobacterium
RALSSGAHAAKRGAPLGAEP

SEQ ID NO: 963193 - protein, 15 aa, Mycobacterium
RAMRRGGPLPHHPTP

SEQ ID NO: 963194 - protein, 8 aa, Mycobacterium
RANPRRLA

SEQ ID NO: 963195 - protein, 12 aa, Mycobacterium
RAPEAAADPFTK

SEQ ID NO: 963196 - protein, 9 aa, Mycobacterium
RAPGETGNI

SEQ ID NO: 963197 - protein, 12 aa, Mycobacterium
RAPGLSQTIEAQ

SEQ ID NO: 963198 - protein, 9 aa, Mycobacterium
RAPQTTPAP

SEQ ID NO: 963199 - protein, 11 aa, Mycobacterium
RAPSGTAAAVK

SEQ ID NO: 963200 - protein, 7 aa, Mycobacterium
RAPYEDL

SEQ ID NO: 963201 - protein, 9 aa, Mycobacterium
RAQAATPEM

SEQ ID NO: 963202 - protein, 9 aa, Mycobacterium
RAQPHRRSV

SEQ ID NO: 963203 - protein, 7 aa, Mycobacterium
RARGGCS

SEQ ID NO: 963204 - protein, 4 aa, Mycobacterium
RARN

SEQ ID NO: 963205 - protein, 6 aa, Mycobacterium
RARNTV

SEQ ID NO: 963206 - protein, 9 aa, Mycobacterium
RARPQAERA

SEQ ID NO: 963207 - protein, 7 aa, Mycobacterium
RARRASG

SEQ ID NO: 963208 - protein, 6 aa, Mycobacterium
RARRGA

SEQ ID NO: 963209 - protein, 9 aa, Mycobacterium
RASGPEQRI

SEQ ID NO: 963210 - protein, 7 aa, Mycobacterium
RASGSAH

SEQ ID NO: 963211 - protein, 33 aa, Mycobacterium
RASHADDDHVDRGDYGYGGYGEQDDFGEQDDYD

SEQ ID NO: 963212 - protein, 6 aa, Mycobacterium
RASSVS

SEQ ID NO: 963213 - protein, 4 aa, Mycobacterium
RAST

SEQ ID NO: 963214 - protein, 13 aa, Mycobacterium
RATAGPAAQAEQP

SEQ ID NO: 963215 - protein, 7 aa, Mycobacterium
RATDEAD

SEQ ID NO: 963216 - protein, 42 aa, Mycobacterium
RATKATVKKAEPKKGGRTSAAKTTAKKTATKATAAKTANTAV

SEQ ID NO: 963217 - protein, 7 aa, Mycobacterium
RATPRAD

SEQ ID NO: 963218 - protein, 8 aa, Mycobacterium
RATPVAAP

SEQ ID NO: 963219 - protein, 6 aa, Mycobacterium
RATRDG

SEQ ID NO: 963220 - protein, 6 aa, Mycobacterium
RATRPD

SEQ ID NO: 963221 - protein, 23 aa, Mycobacterium
RATTTPSTAATGRHRRSAGQARS

SEQ ID NO: 963222 - protein, 23 aa, Mycobacterium
RATVSRPAAAPAPNPSPAREVPG

SEQ ID NO: 963223 - protein, 11 aa, Mycobacterium
RCSTGYAEEVD

SEQ ID NO: 963224 - protein, 12 aa, Mycobacterium
RDATPRNIHPKH

SEQ ID NO: 963225 - protein, 5 aa, Mycobacterium
RDEGT

SEQ ID NO: 963226 - protein, 12 aa, Mycobacterium
RDERGEGRSHED

SEQ ID NO: 963227 - protein, 7 aa, Mycobacterium
RDETSLA

SEQ ID NO: 963228 - protein, 7 aa, Mycobacterium
RDFPSRT

SEQ ID NO: 963229 - protein, 12 aa, Mycobacterium
RDGAAAAEDQSF

SEQ ID NO: 963230 - protein, 5 aa, Mycobacterium
RDGAD

SEQ ID NO: 963231 - protein, 9 aa, Mycobacterium
RDGDGVASR

SEQ ID NO: 963232 - protein, 14 aa, Mycobacterium
RDGDQLKMSKVEFV

SEQ ID NO: 963233 - protein, 11 aa, Mycobacterium
RDGKATTLGAA

SEQ ID NO: 963234 - protein, 10 aa, Mycobacterium
RDGKPTTFGA

SEQ ID NO: 963235 - protein, 12 aa, Mycobacterium
RDGLDTQAGYVP

SEQ ID NO: 963236 - protein, 6 aa, Mycobacterium
RDGPAR

SEQ ID NO: 963237 - protein, 13 aa, Mycobacterium
RDGPPPPEGPKTP

SEQ ID NO: 963238 - protein, 7 aa, Mycobacterium
RDGQRTM

SEQ ID NO: 963239 - protein, 7 aa, Mycobacterium
RDGSQTR

SEQ ID NO: 963240 - protein, 8 aa, Mycobacterium
RDKRDEVE

SEQ ID NO: 963241 - protein, 7 aa, Mycobacterium
RDLESSD

SEQ ID NO: 963242 - protein, 7 aa, Mycobacterium
RDLPASV

SEQ ID NO: 963243 - protein, 9 aa, Mycobacterium
RDNALPDHE

SEQ ID NO: 963244 - protein, 10 aa, Mycobacterium
RDNEIAGRQA

SEQ ID NO: 963245 - protein, 6 aa, Mycobacterium
RDNGQL

SEQ ID NO: 963246 - protein, 8 aa, Mycobacterium
RDNKASAH

SEQ ID NO: 963247 - protein, 6 aa, Mycobacterium
RDNQNR

SEQ ID NO: 963248 - protein, 10 aa, Mycobacterium
RDNTDQFNTR

SEQ ID NO: 963249 - protein, 11 aa, Mycobacterium
RDNTDQFNTRN

SEQ ID NO: 963250 - protein, 5 aa, Mycobacterium
RDPAQ

SEQ ID NO: 963251 - protein, 7 aa, Mycobacterium
RDPNAVR

SEQ ID NO: 963252 - protein, 7 aa, Mycobacterium
RDPPAAA

SEQ ID NO: 963253 - protein, 10 aa, Mycobacterium
RDPQPRQQQQ

SEQ ID NO: 963254 - protein, 6 aa, Mycobacterium
RDPSQT

SEQ ID NO: 963255 - protein, 12 aa, Mycobacterium
RDPVSDTGSAQH

SEQ ID NO: 963256 - protein, 18 aa, Mycobacterium
RDQATDQTRAEIAAQGPK

SEQ ID NO: 963257 - protein, 6 aa, Mycobacterium
RDQGPV

SEQ ID NO: 963258 - protein, 8 aa, Mycobacterium
RDREARRD

SEQ ID NO: 963259 - protein, 13 aa, Mycobacterium
RDRGRQRRSWPEE

SEQ ID NO: 963260 - protein, 11 aa, Mycobacterium
RDRQYADSLTR

SEQ ID NO: 963261 - protein, 10 aa, Mycobacterium
RDRVGGRSFT

SEQ ID NO: 963262 - protein, 7 aa, Mycobacterium
RDSPTWS

SEQ ID NO: 963263 - protein, 8 aa, Mycobacterium
RDSYGGTG

SEQ ID NO: 963264 - protein, 9 aa, Mycobacterium
RDTATDSRP

SEQ ID NO: 963265 - protein, 4 aa, Mycobacterium
RDTS

SEQ ID NO: 963266 - protein, 8 aa, Mycobacterium
RDVAQRQR

SEQ ID NO: 963267 - protein, 4 aa, Mycobacterium
RDVQ

SEQ ID NO: 963268 - protein, 6 aa, Mycobacterium
RDVTGR

SEQ ID NO: 963269 - protein, 6 aa, Mycobacterium
RDYAPA

SEQ ID NO: 963270 - protein, 4 aa, Mycobacterium
REAA

SEQ ID NO: 963271 - protein, 14 aa, Mycobacterium
REAAANPSNQTAAA

SEQ ID NO: 963272 - protein, 8 aa, Mycobacterium
REAGHAAE

SEQ ID NO: 963273 - protein, 12 aa, Mycobacterium
REAGVGLTGPGG

SEQ ID NO: 963274 - protein, 5 aa, Mycobacterium
REAIS

SEQ ID NO: 963275 - protein, 11 aa, Mycobacterium
REAKRKPRNGI

SEQ ID NO: 963276 - protein, 6 aa, Mycobacterium
REAPAS

SEQ ID NO: 963277 - protein, 14 aa, Mycobacterium
REAPPPAVHTTSPG

SEQ ID NO: 963278 - protein, 10 aa, Mycobacterium
REARTAGRLQ

SEQ ID NO: 963279 - protein, 10 aa, Mycobacterium
REASDRTVHS

SEQ ID NO: 963280 - protein, 4 aa, Mycobacterium
REAT

SEQ ID NO: 963281 - protein, 7 aa, Mycobacterium
REATSVT

SEQ ID NO: 963282 - protein, 13 aa, Mycobacterium
RECSAEPSTPQDD

SEQ ID NO: 963283 - protein, 18 aa, Mycobacterium
REDGPPSHHSKRGTPSMG

SEQ ID NO: 963284 - protein, 5 aa, Mycobacterium
REEDL

SEQ ID NO: 963285 - protein, 23 aa, Mycobacterium
REEERGRAGYTTEGTTGLPAGGD

SEQ ID NO: 963286 - protein, 8 aa, Mycobacterium
REEETRIS

SEQ ID NO: 963287 - protein, 6 aa, Mycobacterium
REEEVS

SEQ ID NO: 963288 - protein, 19 aa, Mycobacterium
REEKSAAGVNPQTFCLVKS

SEQ ID NO: 963289 - protein, 11 aa, Mycobacterium
REESARNGARA

SEQ ID NO: 963290 - protein, 5 aa, Mycobacterium
REETD

SEQ ID NO: 963291 - protein, 10 aa, Mycobacterium
REGAEPIPEP

SEQ ID NO: 963292 - protein, 7 aa, Mycobacterium
REGAIEG

SEQ ID NO: 963293 - protein, 9 aa, Mycobacterium
REGDGRASK

SEQ ID NO: 963294 - protein, 8 aa, Mycobacterium
REGDSDSA

SEQ ID NO: 963295 - protein, 4 aa, Mycobacterium
REGY

SEQ ID NO: 963296 - protein, 9 aa, Mycobacterium
REHRPTKAS

SEQ ID NO: 963297 - protein, 97 aa, Mycobacterium
REKATLPEKGTAAKEAEKRAKTAPKAAAPAAPAPAPAEAPAKAAEASAAATAASPAAPAKGLGMAGGAKRPGAKKAAPAPAAETAAAEAPAAPAKGL

SEQ ID NO: 963298 - protein, 4 aa, Mycobacterium
RELA

SEQ ID NO: 963299 - protein, 12 aa, Mycobacterium
RELEEQAAAHGN

SEQ ID NO: 963300 - protein, 8 aa, Mycobacterium
RENGMSTQ

SEQ ID NO: 963301 - protein, 4 aa, Mycobacterium
RENL

SEQ ID NO: 963302 - protein, 8 aa, Mycobacterium
REPAAPEA

SEQ ID NO: 963303 - protein, 7 aa, Mycobacterium
REPDEAA

SEQ ID NO: 963304 - protein, 10 aa, Mycobacterium
REPGSPTWGP

SEQ ID NO: 963305 - protein, 10 aa, Mycobacterium
REPSPTDQRN

SEQ ID NO: 963306 - protein, 14 aa, Mycobacterium
REPTSGTVERPGAV

SEQ ID NO: 963307 - protein, 5 aa, Mycobacterium
REQGA

SEQ ID NO: 963308 - protein, 40 aa, Mycobacterium
REQSAPDFSGAESDTGTDRITSHPLDSDSATTDDSVDANP

SEQ ID NO: 963309 - protein, 10 aa, Mycobacterium
RERASGTSER

SEQ ID NO: 963310 - protein, 15 aa, Mycobacterium
RERIRDGQEREHGAL

SEQ ID NO: 963311 - protein, 4 aa, Mycobacterium
RERP

SEQ ID NO: 963312 - protein, 4 aa, Mycobacterium
RERR

SEQ ID NO: 963313 - protein, 19 aa, Mycobacterium
RERRASDSRTRSGIAKTGR

SEQ ID NO: 963314 - protein, 9 aa, Mycobacterium
RERSGKGQV

SEQ ID NO: 963315 - protein, 6 aa, Mycobacterium
RETAGR

SEQ ID NO: 963316 - protein, 6 aa, Mycobacterium
RETARF

SEQ ID NO: 963317 - protein, 13 aa, Mycobacterium
RETEEAAASLGAT

SEQ ID NO: 963318 - protein, 4 aa, Mycobacterium
RETT

SEQ ID NO: 963319 - protein, 6 aa, Mycobacterium
REVPRQ

SEQ ID NO: 963320 - protein, 15 aa, Mycobacterium
RFRPGGHPTPLPNPG

SEQ ID NO: 963321 - protein, 6 aa, Mycobacterium
RFSPRQ

SEQ ID NO: 963322 - protein, 7 aa, Mycobacterium
RGAAADE

SEQ ID NO: 963323 - protein, 5 aa, Mycobacterium
RGAAG

SEQ ID NO: 963324 - protein, 20 aa, Mycobacterium
RGAAGQHAAGECGGPAQGVR

SEQ ID NO: 963325 - protein, 37 aa, Mycobacterium
RGAAPRDEGRDQYRDEPRPSPRTAPAPGRIPGVRRLT

SEQ ID NO: 963326 - protein, 6 aa, Mycobacterium
RGADNN

SEQ ID NO: 963327 - protein, 8 aa, Mycobacterium
RGANRPAA

SEQ ID NO: 963328 - protein, 10 aa, Mycobacterium
RGAPRPAPDV

SEQ ID NO: 963329 - protein, 8 aa, Mycobacterium
RGAPRRTR

SEQ ID NO: 963330 - protein, 4 aa, Mycobacterium
RGAT

SEQ ID NO: 963331 - protein, 9 aa, Mycobacterium
RGATEAGAD

SEQ ID NO: 963332 - protein, 9 aa, Mycobacterium
RGDDLGRGG

SEQ ID NO: 963333 - protein, 4 aa, Mycobacterium
RGDP

SEQ ID NO: 963334 - protein, 11 aa, Mycobacterium
RGDPASAEGIS

SEQ ID NO: 963335 - protein, 6 aa, Mycobacterium
RGDREA

SEQ ID NO: 963336 - protein, 15 aa, Mycobacterium
RGDTSRSRKGGSTGL

SEQ ID NO: 963337 - protein, 16 aa, Mycobacterium
RGEAAPDEGAGSETGA

SEQ ID NO: 963338 - protein, 16 aa, Mycobacterium
RGEAEKVAEEAVESGH

SEQ ID NO: 963339 - protein, 5 aa, Mycobacterium
RGEDD

SEQ ID NO: 963340 - protein, 4 aa, Mycobacterium
RGEG

SEQ ID NO: 963341 - protein, 11 aa, Mycobacterium
RGEGDGSDRIM

SEQ ID NO: 963342 - protein, 7 aa, Mycobacterium
RGESLSR

SEQ ID NO: 963343 - protein, 7 aa, Mycobacterium
RGETDDG

SEQ ID NO: 963344 - protein, 7 aa, Mycobacterium
RGFYSNP

SEQ ID NO: 963345 - protein, 10 aa, Mycobacterium
RGGPEGTGTT

SEQ ID NO: 963346 - protein, 14 aa, Mycobacterium
RGGQHDAIDGSAVQ

SEQ ID NO: 963347 - protein, 6 aa, Mycobacterium
RGGRRP

SEQ ID NO: 963348 - protein, 11 aa, Mycobacterium
RGGSKGLGTAV

SEQ ID NO: 963349 - protein, 15 aa, Mycobacterium
RGGTAPIPAVPADAP

SEQ ID NO: 963350 - protein, 14 aa, Mycobacterium
RGHGQSGEADPQTY

SEQ ID NO: 963351 - protein, 6 aa, Mycobacterium
RGIEPP

SEQ ID NO: 963352 - protein, 17 aa, Mycobacterium
RGIGSHSAPAATSNRSC

SEQ ID NO: 963353 - protein, 7 aa, Mycobacterium
RGLAADG

SEQ ID NO: 963354 - protein, 9 aa, Mycobacterium
RGLQASAPE

SEQ ID NO: 963355 - protein, 9 aa, Mycobacterium
RGLSQSAPE

SEQ ID NO: 963356 - protein, 8 aa, Mycobacterium
RGLTGGGT

SEQ ID NO: 963357 - protein, 6 aa, Mycobacterium
RGNEMA

SEQ ID NO: 963358 - protein, 16 aa, Mycobacterium
RGNGSQARRPKDEQQV

SEQ ID NO: 963359 - protein, 4 aa, Mycobacterium
RGPA

SEQ ID NO: 963360 - protein, 5 aa, Mycobacterium
RGPAH

SEQ ID NO: 963361 - protein, 7 aa, Mycobacterium
RGPMPPH

SEQ ID NO: 963362 - protein, 12 aa, Mycobacterium
RGPNDPPEVEVD

SEQ ID NO: 963363 - protein, 8 aa, Mycobacterium
RGPRGDEY

SEQ ID NO: 963364 - protein, 7 aa, Mycobacterium
RGPRQTI

SEQ ID NO: 963365 - protein, 7 aa, Mycobacterium
RGPRRSP

SEQ ID NO: 963366 - protein, 14 aa, Mycobacterium
RGPSTGEAGGGTTA

SEQ ID NO: 963367 - protein, 4 aa, Mycobacterium
RGQS

SEQ ID NO: 963368 - protein, 15 aa, Mycobacterium
RGQSGITKDTDYLGN

SEQ ID NO: 963369 - protein, 4 aa, Mycobacterium
RGRA

SEQ ID NO: 963370 - protein, 9 aa, Mycobacterium
RGRAGADYS

SEQ ID NO: 963371 - protein, 13 aa, Mycobacterium
RGRARSKGAYGRD

SEQ ID NO: 963372 - protein, 8 aa, Mycobacterium
RGRARSVT

SEQ ID NO: 963373 - protein, 17 aa, Mycobacterium
RGRDRPTRLAIPASSPR

SEQ ID NO: 963374 - protein, 9 aa, Mycobacterium
RGRPAATGM

SEQ ID NO: 963375 - protein, 11 aa, Mycobacterium
RGRPAQGNREF

SEQ ID NO: 963376 - protein, 12 aa, Mycobacterium
RGRRRGAGLDQD

SEQ ID NO: 963377 - protein, 24 aa, Mycobacterium
RGRRRLDPEDPPPGVVSSTIGEEM

SEQ ID NO: 963378 - protein, 6 aa, Mycobacterium
RGRTSL

SEQ ID NO: 963379 - protein, 4 aa, Mycobacterium
RGRY

SEQ ID NO: 963380 - protein, 11 aa, Mycobacterium
RGSDRAKIAAA

SEQ ID NO: 963381 - protein, 6 aa, Mycobacterium
RGSGSI

SEQ ID NO: 963382 - protein, 7 aa, Mycobacterium
RGSSDLG

SEQ ID NO: 963383 - protein, 16 aa, Mycobacterium
RGSTGGPNNANPKHHP

SEQ ID NO: 963384 - protein, 17 aa, Mycobacterium
RGSTRPPSRRAKELTGA

SEQ ID NO: 963385 - protein, 4 aa, Mycobacterium
RGSY

SEQ ID NO: 963386 - protein, 15 aa, Mycobacterium
RGSYDEANPTQQLPP

SEQ ID NO: 963387 - protein, 7 aa, Mycobacterium
RGTDGRT

SEQ ID NO: 963388 - protein, 5 aa, Mycobacterium
RGTGF

SEQ ID NO: 963389 - protein, 8 aa, Mycobacterium
RGTGGNTA

SEQ ID NO: 963390 - protein, 9 aa, Mycobacterium
RGTPEPPSI

SEQ ID NO: 963391 - protein, 6 aa, Mycobacterium
RGTPLR

SEQ ID NO: 963392 - protein, 10 aa, Mycobacterium
RGTTTAAAAT

SEQ ID NO: 963393 - protein, 6 aa, Mycobacterium
RGVPEP

SEQ ID NO: 963394 - protein, 4 aa, Mycobacterium
RGWP

SEQ ID NO: 963395 - protein, 5 aa, Mycobacterium
RGYAY

SEQ ID NO: 963396 - protein, 4 aa, Mycobacterium
RGYR

SEQ ID NO: 963397 - protein, 11 aa, Mycobacterium
RHATRTATVSA

SEQ ID NO: 963398 - protein, 20 aa, Mycobacterium
RHDRAGYGSGNSRNRTRSKT

SEQ ID NO: 963399 - protein, 4 aa, Mycobacterium
RHFP

SEQ ID NO: 963400 - protein, 15 aa, Mycobacterium
RHKPVGPAAPKSALA

SEQ ID NO: 963401 - protein, 23 aa, Mycobacterium
RHPAPDDGNTTVDVGTTTAAEPA

SEQ ID NO: 963402 - protein, 7 aa, Mycobacterium
RHPGGAS

SEQ ID NO: 963403 - protein, 12 aa, Mycobacterium
RHPGVGSGGGCW

SEQ ID NO: 963404 - protein, 7 aa, Mycobacterium
RHPPPGV

SEQ ID NO: 963405 - protein, 8 aa, Mycobacterium
RHPPPRSG

SEQ ID NO: 963406 - protein, 8 aa, Mycobacterium
RHRPEPVT

SEQ ID NO: 963407 - protein, 6 aa, Mycobacterium
RHRTAS

SEQ ID NO: 963408 - protein, 45 aa, Mycobacterium; identical to SEQ ID NO: 281211

SEQ ID NO: 963409 - protein, 17 aa, Mycobacterium
RIDPPAGSYPTAAERRQ

SEQ ID NO: 963410 - protein, 4 aa, Mycobacterium
RIDT

SEQ ID NO: 963411 - protein, 26 aa, Mycobacterium
RIEPSEPVNGKRNQADGALEGFSARA

SEQ ID NO: 963412 - protein, 12 aa, Mycobacterium
RIPGTAAGPSRR

SEQ ID NO: 963413 - protein, 4 aa, Mycobacterium
RIQG

SEQ ID NO: 963414 - protein, 5 aa, Mycobacterium
RIQRG

SEQ ID NO: 963415 - protein, 11 aa, Mycobacterium
RITGQQTGHGA

SEQ ID NO: 963416 - protein, 9 aa, Mycobacterium
RKAGDPSTA

SEQ ID NO: 963417 - protein, 7 aa, Mycobacterium
RKAPPTL

SEQ ID NO: 963418 - protein, 8 aa, Mycobacterium
RKDPADER

SEQ ID NO: 963419 - protein, 5 aa, Mycobacterium
RKEDK

SEQ ID NO: 963420 - protein, 4 aa, Mycobacterium
RKEG

SEQ ID NO: 963421 - protein, 12 aa, Mycobacterium
RKEGQSGQAKMT

SEQ ID NO: 963422 - protein, 19 aa, Mycobacterium
RKEHAEEPEISEEPAVAPR

SEQ ID NO: 963423 - protein, 8 aa, Mycobacterium
RKGRGTPT

SEQ ID NO: 963424 - protein, 7 aa, Mycobacterium
RKHQAAA

SEQ ID NO: 963425 - protein, 8 aa, Mycobacterium
RKKAAAAE

SEQ ID NO: 963426 - protein, 10 aa, Mycobacterium
RKKKTDTDFP

SEQ ID NO: 963427 - protein, 98 aa, Mycobacterium
RKKSYGQDIETSDDNVGSEASLPDTLSRGSSTTAPKGRPTRKRDDADRRHTKKGPITPAPMTASEARARRKSLAPPKCHRAERRAKRAASKAQITDRR

SEQ ID NO: 963428 - protein, 5 aa, Mycobacterium
RKPAP

SEQ ID NO: 963429 - protein, 8 aa, Mycobacterium
RKPDGKDL

SEQ ID NO: 963430 - protein, 12 aa, Mycobacterium
RKPGETGGTFSA

SEQ ID NO: 963431 - protein, 4 aa, Mycobacterium
RKPP

SEQ ID NO: 963432 - protein, 8 aa, Mycobacterium
RKRARGQC

SEQ ID NO: 963433 - protein, 7 aa, Mycobacterium
RKRFGDT

SEQ ID NO: 963434 - protein, 15 aa, Mycobacterium
RKSQAQRENAREETR

SEQ ID NO: 963435 - protein, 9 aa, Mycobacterium
RKTSGGPGV

SEQ ID NO: 963436 - protein, 7 aa, Mycobacterium
RKTSPQS

SEQ ID NO: 963437 - protein, 5 aa, Mycobacterium
RLDEP

SEQ ID NO: 963438 - protein, 6 aa, Mycobacterium
RLEEGR

SEQ ID NO: 963439 - protein, 9 aa, Mycobacterium
RLEQPEDQA

SEQ ID NO: 963440 - protein, 5 aa, Mycobacterium
RLGAH

SEQ ID NO: 963441 - protein, 9 aa, Mycobacterium
RLGKPGPRS

SEQ ID NO: 963442 - protein, 7 aa, Mycobacterium
RLGPARE

SEQ ID NO: 963443 - protein, 7 aa, Mycobacterium
RLGPEGT

SEQ ID NO: 963444 - protein, 8 aa, Mycobacterium
RLGQGRAA

SEQ ID NO: 963445 - protein, 11 aa, Mycobacterium
RLGSGATVGPA

SEQ ID NO: 963446 - protein, 4 aa, Mycobacterium
RLPA

SEQ ID NO: 963447 - protein, 5 aa, Mycobacterium
RLPNQ

SEQ ID NO: 963448 - protein, 4 aa, Mycobacterium
RLPR

SEQ ID NO: 963449 - protein, 5 aa, Mycobacterium
RLPRR

SEQ ID NO: 963450 - protein, 4 aa, Mycobacterium
RLPS

SEQ ID NO: 963451 - protein, 4 aa, Mycobacterium
RLTG

SEQ ID NO: 963452 - protein, 7 aa, Mycobacterium
RMAGQDR

SEQ ID NO: 963453 - protein, 7 aa, Mycobacterium
RMSRGEL

SEQ ID NO: 963454 - protein, 6 aa, Mycobacterium
RNAAAE

SEQ ID NO: 963455 - protein, 19 aa, Mycobacterium
RNAPPVPTHDGTGGRADTD

SEQ ID NO: 963456 - protein, 27 aa, Mycobacterium
RNAQTAPAVAAASESLRQSRTARRSLD

SEQ ID NO: 963457 - protein, 6 aa, Mycobacterium
RNATAM

SEQ ID NO: 963458 - protein, 6 aa, Mycobacterium
RNDQGV

SEQ ID NO: 963459 - protein, 6 aa, Mycobacterium
RNEGAG

SEQ ID NO: 963460 - protein, 17 aa, Mycobacterium
RNESFNHAGNATAAAIT

SEQ ID NO: 963461 - protein, 5 aa, Mycobacterium
RNGDR

SEQ ID NO: 963462 - protein, 17 aa, Mycobacterium
RNGDSADGPEDTNTERL

SEQ ID NO: 963463 - protein, 16 aa, Mycobacterium
RNGEHTSIHTGTPPLS

SEQ ID NO: 963464 - protein, 7 aa, Mycobacterium
RNGPAER

SEQ ID NO: 963465 - protein, 9 aa, Mycobacterium
RNKRGEGAE

SEQ ID NO: 963466 - protein, 11 aa, Mycobacterium
RNNSGCKSGHV

SEQ ID NO: 963467 - protein, 10 aa, Mycobacterium
RNPGPDGRIS

SEQ ID NO: 963468 - protein, 11 aa, Mycobacterium
RNPVTSSASDQ

SEQ ID NO: 963469 - protein, 4 aa, Mycobacterium
RNQR

SEQ ID NO: 963470 - protein, 5 aa, Mycobacterium
RNRAV

SEQ ID NO: 963471 - protein, 7 aa, Mycobacterium
RNSMTDD

SEQ ID NO: 963472 - protein, 9 aa, Mycobacterium
RNSNTINPG

SEQ ID NO: 963473 - protein, 8 aa, Mycobacterium
RNTGAQSA

SEQ ID NO: 963474 - protein, 7 aa, Mycobacterium
RNTIQDY

SEQ ID NO: 963475 - protein, 13 aa, Mycobacterium
RPAEEDRRDAENR

SEQ ID NO: 963476 - protein, 13 aa, Mycobacterium
RPAEPDRTPAPAA

SEQ ID NO: 963477 - protein, 14 aa, Mycobacterium
RPAEPGAEADTSTT

SEQ ID NO: 963478 - protein, 14 aa, Mycobacterium
RPAESVPHDHPGRG

SEQ ID NO: 963479 - protein, 18 aa, Mycobacterium
RPAGAGAPPGWPPQTPPA

SEQ ID NO: 963480 - protein, 9 aa, Mycobacterium
RPAGGGRLE

SEQ ID NO: 963481 - protein, 6 aa, Mycobacterium
RPAGLS

SEQ ID NO: 963482 - protein, 7 aa, Mycobacterium
RPAGRPW

SEQ ID NO: 963483 - protein, 10 aa, Mycobacterium
RPAGRRPSTN

SEQ ID NO: 963484 - protein, 6 aa, Mycobacterium
RPAMSP

SEQ ID NO: 963485 - protein, 7 aa, Mycobacterium
RPAQQSV

SEQ ID NO: 963486 - protein, 11 aa, Mycobacterium
RPARFGSGPVG

SEQ ID NO: 963487 - protein, 4 aa, Mycobacterium
RPAS

SEQ ID NO: 963488 - protein, 5 aa, Mycobacterium
RPATV

SEQ ID NO: 963489 - protein, 6 aa, Mycobacterium
RPCRDG

SEQ ID NO: 963490 - protein, 13 aa, Mycobacterium
RPDAVDKPDLQGA

SEQ ID NO: 963491 - protein, 11 aa, Mycobacterium
RPDAYTAADKL

SEQ ID NO: 963492 - protein, 8 aa, Mycobacterium
RPDFATAT

SEQ ID NO: 963493 - protein, 4 aa, Mycobacterium
RPDL

SEQ ID NO: 963494 - protein, 16 aa, Mycobacterium
RPDNEDPLYRGPKVPA

SEQ ID NO: 963495 - protein, 8 aa, Mycobacterium
RPDNPQTL

SEQ ID NO: 963496 - protein, 11 aa, Mycobacterium
RPDPDSTGGAA

SEQ ID NO: 963497 - protein, 17 aa, Mycobacterium
RPDPRQTTAAPAEAPQW

SEQ ID NO: 963498 - protein, 5 aa, Mycobacterium
RPDQK

SEQ ID NO: 963499 - protein, 10 aa, Mycobacterium
RPDQQVDPAV

SEQ ID NO: 963500 - protein, 16 aa, Mycobacterium
RPDRTPGRPNLVRNAD

SEQ ID NO: 963501 - protein, 4 aa, Mycobacterium
RPDV

SEQ ID NO: 963502 - protein, 9 aa, Mycobacterium
RPEDLDAGG

SEQ ID NO: 963503 - protein, 11 aa, Mycobacterium
RPEDTDPDNEV

SEQ ID NO: 963504 - protein, 9 aa, Mycobacterium
RPEPPPRPV

SEQ ID NO: 963505 - protein, 7 aa, Mycobacterium
RPESTQS

SEQ ID NO: 963506 - protein, 19 aa, Mycobacterium
RPEVESKDRSGGYTASSGI

SEQ ID NO: 963507 - protein, 5 aa, Mycobacterium
RPFGS

SEQ ID NO: 963508 - protein, 6 aa, Mycobacterium
RPFPEN

SEQ ID NO: 963509 - protein, 20 aa, Mycobacterium
RPGATQPPDPTLIAKIHASS

SEQ ID NO: 963510 - protein, 8 aa, Mycobacterium
RPGDIRTN

SEQ ID NO: 963511 - protein, 4 aa, Mycobacterium
RPGG

SEQ ID NO: 963512 - protein, 7 aa, Mycobacterium
RPGGAGP

SEQ ID NO: 963513 - protein, 9 aa, Mycobacterium
RPGLAPRTL

SEQ ID NO: 963514 - protein, 22 aa, Mycobacterium
RPGNAGSAAAPTTTASPTYTAE

SEQ ID NO: 963515 - protein, 16 aa, Mycobacterium
RPGPNRVGPKGSLQSL

SEQ ID NO: 963516 - protein, 7 aa, Mycobacterium
RPGQTIA

SEQ ID NO: 963517 - protein, 7 aa, Mycobacterium
RPGRGPS

SEQ ID NO: 963518 - protein, 9 aa, Mycobacterium
RPGRGSTAT

SEQ ID NO: 963519 - protein, 7 aa, Mycobacterium
RPGRPTA

SEQ ID NO: 963520 - protein, 4 aa, Mycobacterium
RPGT

SEQ ID NO: 963521 - protein, 8 aa, Mycobacterium
RPKPQHKP

SEQ ID NO: 963522 - protein, 14 aa, Mycobacterium
RPKTPARPGQRQDP

SEQ ID NO: 963523 - protein, 21 aa, Mycobacterium
RPLATELDNRKDEVNNDVEQL

SEQ ID NO: 963524 - protein, 5 aa, Mycobacterium
RPLEP

SEQ ID NO: 963525 - protein, 5 aa, Mycobacterium
RPLES

SEQ ID NO: 963526 - protein, 5 aa, Mycobacterium
RPLGG

SEQ ID NO: 963527 - protein, 8 aa, Mycobacterium
RPLGSPLD

SEQ ID NO: 963528 - protein, 8 aa, Mycobacterium
RPLGTPLD

SEQ ID NO: 963529 - protein, 6 aa, Mycobacterium
RPLPPL

SEQ ID NO: 963530 - protein, 35 aa, Mycobacterium; identical to SEQ ID NO: 281987

SEQ ID NO: 963531 - protein, 8 aa, Mycobacterium
RPMPLPPG

SEQ ID NO: 963532 - protein, 18 aa, Mycobacterium
RPNAGSVDDATSEQRSGS

SEQ ID NO: 963533 - protein, 12 aa, Mycobacterium
RPPAASPAPPAP

SEQ ID NO: 963534 - protein, 6 aa, Mycobacterium
RPPDIT

SEQ ID NO: 963535 - protein, 15 aa, Mycobacterium
RPPGLEPRERPQSAR

SEQ ID NO: 963536 - protein, 15 aa, Mycobacterium
RPPGVPADHGIAHSR

SEQ ID NO: 963537 - protein, 29 aa, Mycobacterium
RPPSSEPAPAPDAAGSAPTGDSTAVPPLP

SEQ ID NO: 963538 - protein, 49 aa, Mycobacterium
RPPVVSRSTTTKVVSRSDTSSAWAAGGSVRSVPGKAMSAKAAGSSPVRL

SEQ ID NO: 963539 - protein, 7 aa, Mycobacterium
RPQSTGD

SEQ ID NO: 963540 - protein, 8 aa, Mycobacterium
RPRDAPVR

SEQ ID NO: 963541 - protein, 6 aa, Mycobacterium
RPRPAS

SEQ ID NO: 963542 - protein, 9 aa, Mycobacterium
RPRPEGSSK

SEQ ID NO: 963543 - protein, 15 aa, Mycobacterium
RPRSGSAERAREPPA

SEQ ID NO: 963544 - protein, 6 aa, Mycobacterium
RPRSRR

SEQ ID NO: 963545 - protein, 11 aa, Mycobacterium
RPRTGPPSASA

SEQ ID NO: 963546 - protein, 6 aa, Mycobacterium
RPRTLP

SEQ ID NO: 963547 - protein, 9 aa, Mycobacterium
RPSASPTVA

SEQ ID NO: 963548 - protein, 7 aa, Mycobacterium
RPSGPRS

SEQ ID NO: 963549 - protein, 14 aa, Mycobacterium
RPSPTNTQKQTVPT

SEQ ID NO: 963550 - protein, 8 aa, Mycobacterium
RPSQATGV

SEQ ID NO: 963551 - protein, 11 aa, Mycobacterium
RPTETASPRRR

SEQ ID NO: 963552 - protein, 6 aa, Mycobacterium
RPTHEQ

SEQ ID NO: 963553 - protein, 8 aa, Mycobacterium
RPTPGFPA

SEQ ID NO: 963554 - protein, 53 aa, Mycobacterium
RPTRRRSGPAGEADQSDAPQDEADDSGATSRNESEDDLQTATGTPPEAGGHHS

SEQ ID NO: 963555 - protein, 4 aa, Mycobacterium
RPVG

SEQ ID NO: 963556 - protein, 9 aa, Mycobacterium
RPVGGADSL

SEQ ID NO: 963557 - protein, 14 aa, Mycobacterium
RPVSTTGESGNQNT

SEQ ID NO: 963558 - protein, 4 aa, Mycobacterium
RPVT

SEQ ID NO: 963559 - protein, 6 aa, Mycobacterium
RPYSGT

SEQ ID NO: 963560 - protein, 4 aa, Mycobacterium
RQAA

SEQ ID NO: 963561 - protein, 21 aa, Mycobacterium
RQATPTVPGPVAPAPAAAPGV

SEQ ID NO: 963562 - protein, 23 aa, Mycobacterium
RQDRQVAARKDRHADSSYADDDL

SEQ ID NO: 963563 - protein, 6 aa, Mycobacterium
RQEAPT

SEQ ID NO: 963564 - protein, 10 aa, Mycobacterium
RQETAVPETA

SEQ ID NO: 963565 - protein, 5 aa, Mycobacterium
RQGGT

SEQ ID NO: 963566 - protein, 5 aa, Mycobacterium
RQGPK

SEQ ID NO: 963567 - protein, 7 aa, Mycobacterium
RQGQESF

SEQ ID NO: 963568 - protein, 11 aa, Mycobacterium
RQGTTGSSIGK

SEQ ID NO: 963569 - protein, 10 aa, Mycobacterium
RQLPSEQPEL

SEQ ID NO: 963570 - protein, 8 aa, Mycobacterium
RQPDGGWG

SEQ ID NO: 963571 - protein, 6 aa, Mycobacterium
RQPGEA

SEQ ID NO: 963572 - protein, 12 aa, Mycobacterium
RQPKPHQYAQPV

SEQ ID NO: 963573 - protein, 7 aa, Mycobacterium
RQPLGAD

SEQ ID NO: 963574 - protein, 6 aa, Mycobacterium
RQPNLA

SEQ ID NO: 963575 - protein, 6 aa, Mycobacterium
RQPNTS

SEQ ID NO: 963576 - protein, 17 aa, Mycobacterium
RQPPGPASEATERVARG

SEQ ID NO: 963577 - protein, 13 aa, Mycobacterium
RQPPPRPPQSTIP

SEQ ID NO: 963578 - protein, 7 aa, Mycobacterium
RQPRQSR

SEQ ID NO: 963579 - protein, 22 aa, Mycobacterium
RQPTGVHGGPSRARPSGRRATQ

SEQ ID NO: 963580 - protein, 8 aa, Mycobacterium
RQQDRWSS

SEQ ID NO: 963581 - protein, 7 aa, Mycobacterium
RQQPAQL

SEQ ID NO: 963582 - protein, 10 aa, Mycobacterium
RQRPHTGNGA

SEQ ID NO: 963583 - protein, 6 aa, Mycobacterium
RQRRGI

SEQ ID NO: 963584 - protein, 7 aa, Mycobacterium
RQSRTRG

SEQ ID NO: 963585 - protein, 14 aa, Mycobacterium
RQTESGDSLETARP

SEQ ID NO: 963586 - protein, 15 aa, Mycobacterium
RQTLADKIMTTVCLP

SEQ ID NO: 963587 - protein, 6 aa, Mycobacterium
RQTPGV

SEQ ID NO: 963588 - protein, 5 aa, Mycobacterium
RQYPG

SEQ ID NO: 963589 - protein, 10 aa, Mycobacterium
RRAAQSQEAL

SEQ ID NO: 963590 - protein, 16 aa, Mycobacterium
RRAESSKPIRQLTAEA

SEQ ID NO: 963591 - protein, 4 aa, Mycobacterium
RRAG

SEQ ID NO: 963592 - protein, 24 aa, Mycobacterium
RRAGQETHGYEPAEHDAESGYDAI

SEQ ID NO: 963593 - protein, 11 aa, Mycobacterium
RRAGRYEPYEP

SEQ ID NO: 963594 - protein, 14 aa, Mycobacterium
RRAMPAADEPEAAE

SEQ ID NO: 963595 - protein, 10 aa, Mycobacterium
RRAPQAGGRE

SEQ ID NO: 963596 - protein, 8 aa, Mycobacterium
RRAQVRSA

SEQ ID NO: 963597 - protein, 13 aa, Mycobacterium
RRARDRAADALRT

SEQ ID NO: 963598 - protein, 15 aa, Mycobacterium
RRASNPAAQSLPDPT

SEQ ID NO: 963599 - protein, 21 aa, Mycobacterium
RRDPVPVAGQRSRTSSGMGDQ

SEQ ID NO: 963600 - protein, 6 aa, Mycobacterium
RREGIE

SEQ ID NO: 963601 - protein, 13 aa, Mycobacterium
RREQGHPESHTSR

SEQ ID NO: 963602 - protein, 19 aa, Mycobacterium
RRGARGAQAGLETYLDQQI

SEQ ID NO: 963603 - protein, 8 aa, Mycobacterium
RRGASAEE

SEQ ID NO: 963604 - protein, 11 aa, Mycobacterium
RRGDRAEGAAE

SEQ ID NO: 963605 - protein, 6 aa, Mycobacterium
RRGEDM

SEQ ID NO: 963606 - protein, 8 aa, Mycobacterium
RRGGAGRL

SEQ ID NO: 963607 - protein, 8 aa, Mycobacterium
RRGKALSS

SEQ ID NO: 963608 - protein, 13 aa, Mycobacterium
RRGPDDPPARPWT

SEQ ID NO: 963609 - protein, 7 aa, Mycobacterium
RRGPGKS

SEQ ID NO: 963610 - protein, 31 aa, Mycobacterium
RRGPRPDRRQGGLSARRQGRGDGNHAGQPSR

SEQ ID NO: 963611 - protein, 6 aa, Mycobacterium
RRGQDL

SEQ ID NO: 963612 - protein, 6 aa, Mycobacterium
RRGRSL

SEQ ID NO: 963613 - protein, 8 aa, Mycobacterium
RRGSPPEI

SEQ ID NO: 963614 - protein, 11 aa, Mycobacterium
RRGSSSPNRTY

SEQ ID NO: 963615 - protein, 6 aa, Mycobacterium
RRGTDG

SEQ ID NO: 963616 - protein, 15 aa, Mycobacterium
RRGVRPPTSDPNASS

SEQ ID NO: 963617 - protein, 14 aa, Mycobacterium
RRHGGDAVPDRPVV

SEQ ID NO: 963618 - protein, 7 aa, Mycobacterium
RRHPGTD

SEQ ID NO: 963619 - protein, 4 aa, Mycobacterium
RRIT

SEQ ID NO: 963620 - protein, 12 aa, Mycobacterium
RRKDAEGRTARE

SEQ ID NO: 963621 - protein, 19 aa, Mycobacterium
RRKKSSGTKQSEGGAKDTA

SEQ ID NO: 963622 - protein, 9 aa, Mycobacterium
RRKRGRSKR

SEQ ID NO: 963623 - protein, 7 aa, Mycobacterium
RRLEPDP

SEQ ID NO: 963624 - protein, 9 aa, Mycobacterium
RRNAREQRD

SEQ ID NO: 963625 - protein, 5 aa, Mycobacterium
RRNGS

SEQ ID NO: 963626 - protein, 10 aa, Mycobacterium
RRNPDHELRR

SEQ ID NO: 963627 - protein, 27 aa, Mycobacterium
RRNPGSSGIADVPGQQPEQQQPPRRRR

SEQ ID NO: 963628 - protein, 5 aa, Mycobacterium
RRPAD

SEQ ID NO: 963629 - protein, 16 aa, Mycobacterium
RRPADAVPHDQPGRGL

SEQ ID NO: 963630 - protein, 59 aa, Mycobacterium
RRPAEPSGAPPRQPTSAPPPPKPATGPVGPRRRRRTPTPAPPPRPAAPKARRKKTERRW

SEQ ID NO: 963631 - protein, 6 aa, Mycobacterium
RRPDRA

SEQ ID NO: 963632 - protein, 7 aa, Mycobacterium
RRPDTGI

SEQ ID NO: 963633 - protein, 5 aa, Mycobacterium
RRPGA

SEQ ID NO: 963634 - protein, 23 aa, Mycobacterium
RRPGGDADIGGAEGQPHDPYGAG

SEQ ID NO: 963635 - protein, 16 aa, Mycobacterium
RRPGGQIRAGKDQGQR

SEQ ID NO: 963636 - protein, 7 aa, Mycobacterium
RRPPVGL

SEQ ID NO: 963637 - protein, 57 aa, Mycobacterium
RRPRPPGDSDLRATPPRQPRRDPHTRRNPYESYERPAPRTSRFDPYSGYEPPEAAES

SEQ ID NO: 963638 - protein, 9 aa, Mycobacterium
RRPTSVAPT

SEQ ID NO: 963639 - protein, 9 aa, Mycobacterium
RRQDRTGRT

SEQ ID NO: 963640 - protein, 17 aa, Mycobacterium
RRQGRSRWNPKTYPSND

SEQ ID NO: 963641 - protein, 9 aa, Mycobacterium
RRQHPETQE

SEQ ID NO: 963642 - protein, 7 aa, Mycobacterium
RRQPSSA

SEQ ID NO: 963643 - protein, 14 aa, Mycobacterium
RRQQGSVGRPPPTA

SEQ ID NO: 963644 - protein, 35 aa, Mycobacterium
RRQRRDREMRAPASPTRGRSPHDRPAANRRPSYSL

SEQ ID NO: 963645 - protein, 6 aa, Mycobacterium
RRQSPV

SEQ ID NO: 963646 - protein, 8 aa, Mycobacterium
RRRARAGS

SEQ ID NO: 963647 - protein, 26 aa, Mycobacterium
RRRASRAAGPAKSESGESDAGETTVG

SEQ ID NO: 963648 - protein, 12 aa, Mycobacterium
RRRGRSRRRKSW

SEQ ID NO: 963649 - protein, 7 aa, Mycobacterium
RRRPAQS

SEQ ID NO: 963650 - protein, 10 aa, Mycobacterium
RRRPDSWPSQ

SEQ ID NO: 963651 - protein, 23 aa, Mycobacterium
RRRPRRPKPRPVPPAEADVDEPI

SEQ ID NO: 963652 - protein, 6 aa, Mycobacterium
RRRQAI

SEQ ID NO: 963653 - protein, 5 aa, Mycobacterium
RRRRA

SEQ ID NO: 963654 - protein, 28 aa, Mycobacterium
RRRSDRRDAEAISQSLGGGLDPGEVDEI

SEQ ID NO: 963655 - protein, 7 aa, Mycobacterium
RRSARSR

SEQ ID NO: 963656 - protein, 44 aa, Mycobacterium
RRSATQTKQPGRPRRRQRRTGQPGPARGGAAVPSEAETTQFRSP

SEQ ID NO: 963657 - protein, 9 aa, Mycobacterium
RRSATSPEV

SEQ ID NO: 963658 - protein, 7 aa, Mycobacterium
RRSDAPY

SEQ ID NO: 963659 - protein, 18 aa, Mycobacterium
RRSFTSRTPVNDNPDKVE

SEQ ID NO: 963660 - protein, 11 aa, Mycobacterium
RRSGPPSAQAR

SEQ ID NO: 963661 - protein, 13 aa, Mycobacterium
RRSGTTVEVSAEK

SEQ ID NO: 963662 - protein, 9 aa, Mycobacterium
RRSRIDATD

SEQ ID NO: 963663 - protein, 4 aa, Mycobacterium
RRST

SEQ ID NO: 963664 - protein, 6 aa, Mycobacterium
RRSTGG

SEQ ID NO: 963665 - protein, 5 aa, Mycobacterium
RRTFA

SEQ ID NO: 963666 - protein, 6 aa, Mycobacterium
RRTFAE

SEQ ID NO: 963667 - protein, 11 aa, Mycobacterium
RRTGGQPLRTA

SEQ ID NO: 963668 - protein, 8 aa, Mycobacterium
RRTGREPT

SEQ ID NO: 963669 - protein, 75 aa, Mycobacterium; identical to SEQ ID NO: 282893

SEQ ID NO: 963670 - protein, 8 aa, Mycobacterium
RRTPGSPN

SEQ ID NO: 963671 - protein, 39 aa, Mycobacterium
RRTRDTGAPQECGSTCGPTGASVAARPASTTGPTAGAVA

SEQ ID NO: 963672 - protein, 34 aa, Mycobacterium
RRTSTMDSQEPTPTTTPKNCSATAQPTKAKRGVD

SEQ ID NO: 963673 - protein, 9 aa, Mycobacterium
RRVDPTDAR

SEQ ID NO: 963674 - protein, 12 aa, Mycobacterium
RRVPERDPRTEV

SEQ ID NO: 963675 - protein, 6 aa, Mycobacterium
RRYPQG

SEQ ID NO: 963676 - protein, 8 aa, Mycobacterium
RRYTPAGG

SEQ ID NO: 963677 - protein, 5 aa, Mycobacterium
RSADD

SEQ ID NO: 963678 - protein, 10 aa, Mycobacterium
RSAFGAPPTR

SEQ ID NO: 963679 - protein, 30 aa, Mycobacterium
RSAGSDAIPGSAGMTAPDVGTPPSGARPRL

SEQ ID NO: 963680 - protein, 9 aa, Mycobacterium
RSAPALANQ

SEQ ID NO: 963681 - protein, 10 aa, Mycobacterium
RSARHADPIE

SEQ ID NO: 963682 - protein, 21 aa, Mycobacterium
RSATSGGPTAAHAARPRPNSN

SEQ ID NO: 963683 - protein, 8 aa, Mycobacterium
RSAVPIES

SEQ ID NO: 963684 - protein, 5 aa, Mycobacterium
RSEND

SEQ ID NO: 963685 - protein, 13 aa, Mycobacterium
RSEPGTRPDPGQS

SEQ ID NO: 963686 - protein, 13 aa, Mycobacterium
RSFSASVSDTELS

SEQ ID NO: 963687 - protein, 39 aa, Mycobacterium
RSGADRFAGQTGPSDGAVGGNSSKFDSNRRVDDHVDRSP

SEQ ID NO: 963688 - protein, 10 aa, Mycobacterium
RSGAPNGIDE

SEQ ID NO: 963689 - protein, 14 aa, Mycobacterium
RSGARPVGWQPHRP

SEQ ID NO: 963690 - protein, 7 aa, Mycobacterium
RSGGATR

SEQ ID NO: 963691 - protein, 12 aa, Mycobacterium
RSGPSQRSFAAG

SEQ ID NO: 963692 - protein, 24 aa, Mycobacterium
RSGQGPSLKDGDVIPSSRTRVPTD

SEQ ID NO: 963693 - protein, 17 aa, Mycobacterium
RSGRQPQEAADAAMATS

SEQ ID NO: 963694 - protein, 5 aa, Mycobacterium
RSGSL

SEQ ID NO: 963695 - protein, 5 aa, Mycobacterium
RSGTT

SEQ ID NO: 963696 - protein, 6 aa, Mycobacterium
RSGVPR

SEQ ID NO: 963697 - protein, 7 aa, Mycobacterium
RSHAEGV

SEQ ID NO: 963698 - protein, 4 aa, Mycobacterium
RSHL

SEQ ID NO: 963699 - protein, 10 aa, Mycobacterium
RSKAPGDKVS

SEQ ID NO: 963700 - protein, 9 aa, Mycobacterium
RSKGASAGS

SEQ ID NO: 963701 - protein, 8 aa, Mycobacterium
RSLNAGKV

SEQ ID NO: 963702 - protein, 7 aa, Mycobacterium
RSLTGAE

SEQ ID NO: 963703 - protein, 9 aa, Mycobacterium
RSLTTDKYR

SEQ ID NO: 963704 - protein, 32 aa, Mycobacterium
RSPAAGAGPDEPAPSVKPGPPSVPADPVRDDS

SEQ ID NO: 963705 - protein, 10 aa, Mycobacterium
RSPAEESAAR

SEQ ID NO: 963706 - protein, 18 aa, Mycobacterium
RSPGPPTASAPPPPPPDA

SEQ ID NO: 963707 - protein, 6 aa, Mycobacterium
RSPPAW

SEQ ID NO: 963708 - protein, 7 aa, Mycobacterium
RSPPPDG

SEQ ID NO: 963709 - protein, 14 aa, Mycobacterium
RSPPPSKQPGNSSS

SEQ ID NO: 963710 - protein, 8 aa, Mycobacterium
RSPRPPQA

SEQ ID NO: 963711 - protein, 6 aa, Mycobacterium
RSPRSL

SEQ ID NO: 963712 - protein, 6 aa, Mycobacterium
RSPRSR

SEQ ID NO: 963713 - protein, 6 aa, Mycobacterium
RSPRTG

SEQ ID NO: 963714 - protein, 6 aa, Mycobacterium
RSPSTA

SEQ ID NO: 963715 - protein, 14 aa, Mycobacterium
RSQAGGKWPPPPTE

SEQ ID NO: 963716 - protein, 5 aa, Mycobacterium
RSQLS

SEQ ID NO: 963717 - protein, 5 aa, Mycobacterium
RSREM

SEQ ID NO: 963718 - protein, 4 aa, Mycobacterium
RSRG

SEQ ID NO: 963719 - protein, 6 aa, Mycobacterium
RSRGGT

SEQ ID NO: 963720 - protein, 4 aa, Mycobacterium
RSRM

SEQ ID NO: 963721 - protein, 4 aa, Mycobacterium
RSRP

SEQ ID NO: 963722 - protein, 17 aa, Mycobacterium
RSRPAQDPVRSRTQDRQ

SEQ ID NO: 963723 - protein, 20 aa, Mycobacterium
RSRRRSPNNESDSSDPVVLP

SEQ ID NO: 963724 - protein, 14 aa, Mycobacterium
RSRRRTGTGDQLQG

SEQ ID NO: 963725 - protein, 4 aa, Mycobacterium
RSRS

SEQ ID NO: 963726 - protein, 22 aa, Mycobacterium
RSRSTASPSVGRPAPSDSWAQV

SEQ ID NO: 963727 - protein, 4 aa, Mycobacterium
RSRV

SEQ ID NO: 963728 - protein, 8 aa, Mycobacterium
RSSDGEVY

SEQ ID NO: 963729 - protein, 8 aa, Mycobacterium
RSSGGLSD

SEQ ID NO: 963730 - protein, 15 aa, Mycobacterium
RSSPTPNPSKLDDTT

SEQ ID NO: 963731 - protein, 6 aa, Mycobacterium
RSSSPH

SEQ ID NO: 963732 - protein, 7 aa, Mycobacterium
RSSTRAG

SEQ ID NO: 963733 - protein, 20 aa, Mycobacterium
RSTQAAAAELAQRRSALSAK

SEQ ID NO: 963734 - protein, 6 aa, Mycobacterium
RSTQPA

SEQ ID NO: 963735 - protein, 8 aa, Mycobacterium
RSTSAARG

SEQ ID NO: 963736 - protein, 6 aa, Mycobacterium
RSTTLT

SEQ ID NO: 963737 - protein, 7 aa, Mycobacterium
RSVADSD

SEQ ID NO: 963738 - protein, 5 aa, Mycobacterium
RSWDE

SEQ ID NO: 963739 - protein, 7 aa, Mycobacterium
RSWPPLG

SEQ ID NO: 963740 - protein, 6 aa, Mycobacterium
RSYPRD

SEQ ID NO: 963741 - protein, 4 aa, Mycobacterium
RTAA

SEQ ID NO: 963742 - protein, 5 aa, Mycobacterium
RTAAN

SEQ ID NO: 963743 - protein, 9 aa, Mycobacterium
RTADADRRA

SEQ ID NO: 963744 - protein, 13 aa, Mycobacterium
RTAGAAQAAGVPN

SEQ ID NO: 963745 - protein, 8 aa, Mycobacterium
RTASGRYE

SEQ ID NO: 963746 - protein, 10 aa, Mycobacterium
RTASSDPEAY

SEQ ID NO: 963747 - protein, 7 aa, Mycobacterium
RTDEGPS

SEQ ID NO: 963748 - protein, 9 aa, Mycobacterium
RTDPEAAAT

SEQ ID NO: 963749 - protein, 6 aa, Mycobacterium
RTDPGP

SEQ ID NO: 963750 - protein, 8 aa, Mycobacterium
RTDSMGRS

SEQ ID NO: 963751 - protein, 52 aa, Mycobacterium
RTDSTKLANPATTSSVPPVQDEITTTKPPPPPPPPPPPPSTEIPTATETQTV

SEQ ID NO: 963752 - protein, 6 aa, Mycobacterium
RTERGI

SEQ ID NO: 963753 - protein, 5 aa, Mycobacterium
RTERY

SEQ ID NO: 963754 - protein, 9 aa, Mycobacterium
RTGAGAQLT

SEQ ID NO: 963755 - protein, 5 aa, Mycobacterium
RTGER

SEQ ID NO: 963756 - protein, 15 aa, Mycobacterium
RTGNAPANAATDSTA

SEQ ID NO: 963757 - protein, 12 aa, Mycobacterium
RTGQGGEPHRKL

SEQ ID NO: 963758 - protein, 8 aa, Mycobacterium
RTGSDTEP

SEQ ID NO: 963759 - protein, 7 aa, Mycobacterium
RTGTGFG

SEQ ID NO: 963760 - protein, 6 aa, Mycobacterium
RTKEST

SEQ ID NO: 963761 - protein, 7 aa, Mycobacterium
RTKTAAQ

SEQ ID NO: 963762 - protein, 14 aa, Mycobacterium
RTLSETAERRAQRG

SEQ ID NO: 963763 - protein, 15 aa, Mycobacterium
RTNGTDHAARTGKKI

SEQ ID NO: 963764 - protein, 15 aa, Mycobacterium
RTNNRAGNPVGSSYL

SEQ ID NO: 963765 - protein, 28 aa, Mycobacterium
RTNSKPGQELEPEPAAAARAAPTTTEPA

SEQ ID NO: 963766 - protein, 6 aa, Mycobacterium
RTPDVT

SEQ ID NO: 963767 - protein, 5 aa, Mycobacterium
RTPRR

SEQ ID NO: 963768 - protein, 5 aa, Mycobacterium
RTPTA

SEQ ID NO: 963769 - protein, 5 aa, Mycobacterium
RTPTV

SEQ ID NO: 963770 - protein, 16 aa, Mycobacterium
RTPTVAEYENASDSYA

SEQ ID NO: 963771 - protein, 6 aa, Mycobacterium
RTPVDA

SEQ ID NO: 963772 - protein, 44 aa, Mycobacterium
RTQQGADVAGAPESGVARAPARPQPVTPRPAAAPARPPQTTADG

SEQ ID NO: 963773 - protein, 6 aa, Mycobacterium
RTRPAS

SEQ ID NO: 963774 - protein, 8 aa, Mycobacterium
RTRSPYQL

SEQ ID NO: 963775 - protein, 6 aa, Mycobacterium
RTRSTN

SEQ ID NO: 963776 - protein, 5 aa, Mycobacterium
RTRTA

SEQ ID NO: 963777 - protein, 24 aa, Mycobacterium
RTSGPAKSDGTQAALDTARTTATT

SEQ ID NO: 963778 - protein, 6 aa, Mycobacterium
RTSPAL

SEQ ID NO: 963779 - protein, 4 aa, Mycobacterium
RTSQ

SEQ ID NO: 963780 - protein, 17 aa, Mycobacterium
RTSTTYTDAYGNTSETV

SEQ ID NO: 963781 - protein, 7 aa, Mycobacterium
RTTDEDL

SEQ ID NO: 963782 - protein, 8 aa, Mycobacterium
RTTGGFGQ

SEQ ID NO: 963783 - protein, 8 aa, Mycobacterium
RTTTPYTL

SEQ ID NO: 963784 - protein, 19 aa, Mycobacterium
RTVPPDQARAANQTTGPNG

SEQ ID NO: 963785 - protein, 13 aa, Mycobacterium
RTVPSRPRPPAAP

SEQ ID NO: 963786 - protein, 29 aa, Mycobacterium
RVAGGNGAGPVTGPAASVPAANMPSGSVE

SEQ ID NO: 963787 - protein, 7 aa, Mycobacterium
RVDAAGG

SEQ ID NO: 963788 - protein, 5 aa, Mycobacterium
RVDRQ

SEQ ID NO: 963789 - protein, 6 aa, Mycobacterium
RVEPAR

SEQ ID NO: 963790 - protein, 6 aa, Mycobacterium
RVESGD

SEQ ID NO: 963791 - protein, 7 aa, Mycobacterium
RVETGGV

SEQ ID NO: 963792 - protein, 6 aa, Mycobacterium
RVGDSR

SEQ ID NO: 963793 - protein, 6 aa, Mycobacterium
RVGGAR

SEQ ID NO: 963794 - protein, 14 aa, Mycobacterium
RVGRPSPSDDRPIP

SEQ ID NO: 963795 - protein, 4 aa, Mycobacterium
RVNE

SEQ ID NO: 963796 - protein, 13 aa, Mycobacterium
RVPESHAEGAPDD

SEQ ID NO: 963797 - protein, 26 aa, Mycobacterium
RVQPPAARPPAKQAAARKAPKAATRL

SEQ ID NO: 963798 - protein, 17 aa, Mycobacterium
RVRSRRRRAGIPPNGLS

SEQ ID NO: 963799 - protein, 6 aa, Mycobacterium
RVSATE

SEQ ID NO: 963800 - protein, 7 aa, Mycobacterium
RVSKTRA

SEQ ID NO: 963801 - protein, 9 aa, Mycobacterium
RVSRTEMTD

SEQ ID NO: 963802 - protein, 5 aa, Mycobacterium
RVTPD

SEQ ID NO: 963803 - protein, 9 aa, Mycobacterium
RVTTSATSQ

SEQ ID NO: 963804 - protein, 8 aa, Mycobacterium
RWNDDGSA

SEQ ID NO: 963805 - protein, 16 aa, Mycobacterium
RWPVEGTKAEKRAERG

SEQ ID NO: 963806 - protein, 5 aa, Mycobacterium
RYAGD

SEQ ID NO: 963807 - protein, 6 aa, Mycobacterium
RYEPRA

SEQ ID NO: 963808 - protein, 17 aa, Mycobacterium
RYGANIDDTDVDASPGG

SEQ ID NO: 963809 - protein, 10 aa, Mycobacterium
RYGKPDATNA

SEQ ID NO: 963810 - protein, 6 aa, Mycobacterium
RYGPQA

SEQ ID NO: 963811 - protein, 17 aa, Mycobacterium
RYGPRPEEAHWQSNSSP

SEQ ID NO: 963812 - protein, 4 aa, Mycobacterium
RYGR

SEQ ID NO: 963813 - protein, 6 aa, Mycobacterium
RYPGAP

SEQ ID NO: 963814 - protein, 4 aa, Mycobacterium
RYPP

SEQ ID NO: 963815 - protein, 4 aa, Mycobacterium
RYSH

SEQ ID NO: 963816 - protein, 9 aa, Mycobacterium
SAAAATPPL

SEQ ID NO: 963817 - protein, 7 aa, Mycobacterium
SAAAGET

SEQ ID NO: 963818 - protein, 8 aa, Mycobacterium
SAAASGGG

SEQ ID NO: 963819 - protein, 9 aa, Mycobacterium
SAAASSSAV

SEQ ID NO: 963820 - protein, 11 aa, Mycobacterium
SAAEGVTRSPL

SEQ ID NO: 963821 - protein, 13 aa, Mycobacterium
SAAEQRALPGEGA

SEQ ID NO: 963822 - protein, 4 aa, Mycobacterium
SAAG

SEQ ID NO: 963823 - protein, 5 aa, Mycobacterium
SAAGT

SEQ ID NO: 963824 - protein, 10 aa, Mycobacterium
SAALNTDQNI

SEQ ID NO: 963825 - protein, 68 aa, Mycobacterium
SAARPQRPTGKRSRQRATAAEDADDEQSSTEPQASEEGAKKDAKKQTSKAAKDKKPKTASKPAARAAS

SEQ ID NO: 963826 - protein, 7 aa, Mycobacterium
SAATAAK

SEQ ID NO: 963827 - protein, 11 aa, Mycobacterium
SAATDEKLTQI

SEQ ID NO: 963828 - protein, 11 aa, Mycobacterium
SAATDPRARQL

SEQ ID NO: 963829 - protein, 8 aa, Mycobacterium
SAATRGAS

SEQ ID NO: 963830 - protein, 6 aa, Mycobacterium
SAATTT

SEQ ID NO: 963831 - protein, 9 aa, Mycobacterium
SAAVSAVPG

SEQ ID NO: 963832 - protein, 13 aa, Mycobacterium
SADADGYTRSEGA

SEQ ID NO: 963833 - protein, 6 aa, Mycobacterium
SADAKI

SEQ ID NO: 963834 - protein, 9 aa, Mycobacterium
SADDLDGET

SEQ ID NO: 963835 - protein, 38 aa, Mycobacterium
SADEPSDDHDAENQDWDDELTGQPGGGADSAAADPGAF

SEQ ID NO: 963836 - protein, 13 aa, Mycobacterium
SADGAGKAAEHEA

SEQ ID NO: 963837 - protein, 6 aa, Mycobacterium
SADGKS

SEQ ID NO: 963838 - protein, 7 aa, Mycobacterium
SADGSVT

SEQ ID NO: 963839 - protein, 4 aa, Mycobacterium
SADP

SEQ ID NO: 963840 - protein, 11 aa, Mycobacterium
SADPAEPTVSR

SEQ ID NO: 963841 - protein, 8 aa, Mycobacterium
SADPAKPI

SEQ ID NO: 963842 - protein, 8 aa, Mycobacterium
SADPRSTE

SEQ ID NO: 963843 - protein, 10 aa, Mycobacterium
SADPVGGWRR

SEQ ID NO: 963844 - protein, 8 aa, Mycobacterium
SADQRRDR

SEQ ID NO: 963845 - protein, 20 aa, Mycobacterium
SADSAATAAAHQAAATAYTG

SEQ ID NO: 963846 - protein, 14 aa, Mycobacterium
SADSAPSSGAISDA

SEQ ID NO: 963847 - protein, 12 aa, Mycobacterium
SADSGEVLLQRS

SEQ ID NO: 963848 - protein, 9 aa, Mycobacterium
SAEALTAQA

SEQ ID NO: 963849 - protein, 24 aa, Mycobacterium
SAEGSSSGDVGTGDEDAASDEDFD

SEQ ID NO: 963850 - protein, 14 aa, Mycobacterium
SAEPAPGPHDDDAE

SEQ ID NO: 963851 - protein, 7 aa, Mycobacterium
SAESIDD

SEQ ID NO: 963852 - protein, 12 aa, Mycobacterium
SAESLKETLRGQ

SEQ ID NO: 963853 - protein, 4 aa, Mycobacterium
SAGA

SEQ ID NO: 963854 - protein, 7 aa, Mycobacterium
SAGGRPR

SEQ ID NO: 963855 - protein, 9 aa, Mycobacterium
SAGGSEALG

SEQ ID NO: 963856 - protein, 6 aa, Mycobacterium
SAGKVG

SEQ ID NO: 963857 - protein, 8 aa, Mycobacterium
SAGPGGPI

SEQ ID NO: 963858 - protein, 10 aa, Mycobacterium
SAGPGPGPLY

SEQ ID NO: 963859 - protein, 9 aa, Mycobacterium
SAGPGPGSL

SEQ ID NO: 963860 - protein, 7 aa, Mycobacterium
SAGPPPV

SEQ ID NO: 963861 - protein, 7 aa, Mycobacterium
SAGPRRS

SEQ ID NO: 963862 - protein, 9 aa, Mycobacterium
SAGSFGADA

SEQ ID NO: 963863 - protein, 13 aa, Mycobacterium
SAGVDDAKEYNSV

SEQ ID NO: 963864 - protein, 18 aa, Mycobacterium
SAGVQARNPKYSSYLPSK

SEQ ID NO: 963865 - protein, 6 aa, Mycobacterium
SAHPPV

SEQ ID NO: 963866 - protein, 5 aa, Mycobacterium
SAHQP

SEQ ID NO: 963867 - protein, 14 aa, Mycobacterium
SAHRPEPGNLATVL

SEQ ID NO: 963868 - protein, 6 aa, Mycobacterium
SAHSSA

SEQ ID NO: 963869 - protein, 8 aa, Mycobacterium
SAIAPGTG

SEQ ID NO: 963870 - protein, 9 aa, Mycobacterium
SAIDPGRRE

SEQ ID NO: 963871 - protein, 4 aa, Mycobacterium
SAIS

SEQ ID NO: 963872 - protein, 4 aa, Mycobacterium
SAIT

SEQ ID NO: 963873 - protein, 7 aa, Mycobacterium
SALAANG

SEQ ID NO: 963874 - protein, 7 aa, Mycobacterium
SALASGT

SEQ ID NO: 963875 - protein, 10 aa, Mycobacterium
SALGNAPTGA

SEQ ID NO: 963876 - protein, 7 aa, Mycobacterium
SALTGES

SEQ ID NO: 963877 - protein, 8 aa, Mycobacterium
SAMQGQPG

SEQ ID NO: 963878 - protein, 7 aa, Mycobacterium
SANDTGW

SEQ ID NO: 963879 - protein, 7 aa, Mycobacterium
SANPEVP

SEQ ID NO: 963880 - protein, 6 aa, Mycobacterium
SANPHA

SEQ ID NO: 963881 - protein, 14 aa, Mycobacterium
SANVQAGAKSRAST

SEQ ID NO: 963882 - protein, 7 aa, Mycobacterium
SAPAAVR

SEQ ID NO: 963883 - protein, 6 aa, Mycobacterium
SAPADL

SEQ ID NO: 963884 - protein, 12 aa, Mycobacterium
SAPAEAFSRPGL

SEQ ID NO: 963885 - protein, 8 aa, Mycobacterium
SAPAHKRG

SEQ ID NO: 963886 - protein, 9 aa, Mycobacterium
SAPAPPHRS

SEQ ID NO: 963887 - protein, 141 aa, Mycobacterium
SAPAPRPKFDPYGQYGQYGQYGGQPGGYYGQPGAQQSAPNPQQSPQQPSGYGSQYGGFTSSQGSNPSSGGFSAPQAQSAPQPMHQTPSTPPTGFPSFSPPPSVSAGTGSQGGSAPVNYANPSGAQQNYGQGQQSSSPGSAP

SEQ ID NO: 963888 - protein, 14 aa, Mycobacterium
SAPASAARLTERSK

SEQ ID NO: 963889 - protein, 6 aa, Mycobacterium
SAPHQA

SEQ ID NO: 963890 - protein, 9 aa, Mycobacterium
SAPKCPLPR

SEQ ID NO: 963891 - protein, 8 aa, Mycobacterium
SAPKRWNA

SEQ ID NO: 963892 - protein, 7 aa, Mycobacterium
SAPPEAL

SEQ ID NO: 963893 - protein, 8 aa, Mycobacterium
SAPPGATT

SEQ ID NO: 963894 - protein, 7 aa, Mycobacterium
SAPQDSW

SEQ ID NO: 963895 - protein, 8 aa, Mycobacterium
SAPSTGLT

SEQ ID NO: 963896 - protein, 9 aa, Mycobacterium
SAPVGGNAL

SEQ ID NO: 963897 - protein, 7 aa, Mycobacterium
SAQAADQ

SEQ ID NO: 963898 - protein, 21 aa, Mycobacterium
SAQAQPTPLPPAPLPQEVAPS

SEQ ID NO: 963899 - protein, 7 aa, Mycobacterium
SAQATQV

SEQ ID NO: 963900 - protein, 4 aa, Mycobacterium
SAQH

SEQ ID NO: 963901 - protein, 9 aa, Mycobacterium
SAQQPELSD

SEQ ID NO: 963902 - protein, 5 aa, Mycobacterium
SAQQV

SEQ ID NO: 963903 - protein, 9 aa, Mycobacterium
SAQSTASEL

SEQ ID NO: 963904 - protein, 4 aa, Mycobacterium
SAQV

SEQ ID NO: 963905 - protein, 7 aa, Mycobacterium
SARDESL

SEQ ID NO: 963906 - protein, 6 aa, Mycobacterium
SARPHS

SEQ ID NO: 963907 - protein, 11 aa, Mycobacterium
SARRSLAERGS

SEQ ID NO: 963908 - protein, 5 aa, Mycobacterium
SARWP

SEQ ID NO: 963909 - protein, 4 aa, Mycobacterium
SASA

SEQ ID NO: 963910 - protein, 11 aa, Mycobacterium
SASASPAAPVR

SEQ ID NO: 963911 - protein, 9 aa, Mycobacterium
SASASTQTT

SEQ ID NO: 963912 - protein, 17 aa, Mycobacterium
SASEQVTRRDKEGRQVT

SEQ ID NO: 963913 - protein, 9 aa, Mycobacterium
SASPDGVSD

SEQ ID NO: 963914 - protein, 6 aa, Mycobacterium
SASPSD

SEQ ID NO: 963915 - protein, 18 aa, Mycobacterium
SASQASPSALVGGPDAQA

SEQ ID NO: 963916 - protein, 13 aa, Mycobacterium
SASSAIAKASLDA

SEQ ID NO: 963917 - protein, 8 aa, Mycobacterium
SASSAPTV

SEQ ID NO: 963918 - protein, 7 aa, Mycobacterium
SASSGQA

SEQ ID NO: 963919 - protein, 4 aa, Mycobacterium
SAST

SEQ ID NO: 963920 - protein, 5 aa, Mycobacterium
SASVS

SEQ ID NO: 963921 - protein, 6 aa, Mycobacterium
SATASG

SEQ ID NO: 963922 - protein, 6 aa, Mycobacterium
SATDDE

SEQ ID NO: 963923 - protein, 10 aa, Mycobacterium
SATGDEKLTQ

SEQ ID NO: 963924 - protein, 5 aa, Mycobacterium
SATHG

SEQ ID NO: 963925 - protein, 8 aa, Mycobacterium
SATNGASV

SEQ ID NO: 963926 - protein, 6 aa, Mycobacterium
SATPGL

SEQ ID NO: 963927 - protein, 15 aa, Mycobacterium
SATRREVRAPASQTP

SEQ ID NO: 963928 - protein, 13 aa, Mycobacterium
SATSDEKLTQLGS

SEQ ID NO: 963929 - protein, 7 aa, Mycobacterium
SATTAQL

SEQ ID NO: 963930 - protein, 10 aa, Mycobacterium
SATTDEKLTQ

SEQ ID NO: 963931 - protein, 8 aa, Mycobacterium
SATTEPVL

SEQ ID NO: 963932 - protein, 9 aa, Mycobacterium
SATTSPPGA

SEQ ID NO: 963933 - protein, 12 aa, Mycobacterium
SAVAASAGSAQA

SEQ ID NO: 963934 - protein, 7 aa, Mycobacterium
SCAPGAS

SEQ ID NO: 963935 - protein, 8 aa, Mycobacterium
SCNSAGGR

SEQ ID NO: 963936 - protein, 7 aa, Mycobacterium
SDAQQSV

SEQ ID NO: 963937 - protein, 12 aa, Mycobacterium
SDASKQRVSGSQ

SEQ ID NO: 963938 - protein, 6 aa, Mycobacterium
SDATTL

SEQ ID NO: 963939 - protein, 9 aa, Mycobacterium
SDDDDTAVG

SEQ ID NO: 963940 - protein, 7 aa, Mycobacterium
SDDEVPE

SEQ ID NO: 963941 - protein, 9 aa, Mycobacterium
SDDGGPERF

SEQ ID NO: 963942 - protein, 12 aa, Mycobacterium
SDEAANARAAAQ

SEQ ID NO: 963943 - protein, 7 aa, Mycobacterium
SDERAPA

SEQ ID NO: 963944 - protein, 12 aa, Mycobacterium
SDETQKALRGSG

SEQ ID NO: 963945 - protein, 10 aa, Mycobacterium
SDFGSNSASR

SEQ ID NO: 963946 - protein, 12 aa, Mycobacterium
SDFSREGQQRLA

SEQ ID NO: 963947 - protein, 5 aa, Mycobacterium
SDGKA

SEQ ID NO: 963948 - protein, 7 aa, Mycobacterium
SDGLSGD

SEQ ID NO: 963949 - protein, 10 aa, Mycobacterium
SDGNRQRRDI

SEQ ID NO: 963950 - protein, 5 aa, Mycobacterium
SDGNT

SEQ ID NO: 963951 - protein, 6 aa, Mycobacterium
SDGSEI

SEQ ID NO: 963952 - protein, 21 aa, Mycobacterium
SDGTTLDAADRRAAQQAAQRM

SEQ ID NO: 963953 - protein, 17 aa, Mycobacterium
SDGTVLSSNSNDAPQTS

SEQ ID NO: 963954 - protein, 5 aa, Mycobacterium
SDIPE

SEQ ID NO: 963955 - protein, 10 aa, Mycobacterium
SDLEKAATLD

SEQ ID NO: 963956 - protein, 10 aa, Mycobacterium
SDPASASGIA

SEQ ID NO: 963957 - protein, 9 aa, Mycobacterium
SDPATPKGI

SEQ ID NO: 963958 - protein, 10 aa, Mycobacterium
SDPKTTAHQP

SEQ ID NO: 963959 - protein, 6 aa, Mycobacterium
SDPSNL

SEQ ID NO: 963960 - protein, 8 aa, Mycobacterium
SDPTLPGR

SEQ ID NO: 963961 - protein, 5 aa, Mycobacterium
SDQHL

SEQ ID NO: 963962 - protein, 5 aa, Mycobacterium
SDQPG

SEQ ID NO: 963963 - protein, 5 aa, Mycobacterium
SDRFG

SEQ ID NO: 963964 - protein, 6 aa, Mycobacterium
SDRFGG

SEQ ID NO: 963965 - protein, 7 aa, Mycobacterium
SDRGVQD

SEQ ID NO: 963966 - protein, 5 aa, Mycobacterium
SDSGS

SEQ ID NO: 963967 - protein, 23 aa, Mycobacterium
SDSPDGPAQLPGTPTHPGTGQAA

SEQ ID NO: 963968 - protein, 39 aa, Mycobacterium; identical to SEQ ID NO: 284971

SEQ ID NO: 963969 - protein, 6 aa, Mycobacterium
SDSVDG

SEQ ID NO: 963970 - protein, 7 aa, Mycobacterium
SDTADEI

SEQ ID NO: 963971 - protein, 13 aa, Mycobacterium
SDTPIPADAFDGP

SEQ ID NO: 963972 - protein, 4 aa, Mycobacterium
SDVD

SEQ ID NO: 963973 - protein, 6 aa, Mycobacterium
SDWADG

SEQ ID NO: 963974 - protein, 9 aa, Mycobacterium
SEADAASGR

SEQ ID NO: 963975 - protein, 15 aa, Mycobacterium
SEAHHRPANIPRTAL

SEQ ID NO: 963976 - protein, 4 aa, Mycobacterium
SEAR

SEQ ID NO: 963977 - protein, 7 aa, Mycobacterium
SEARDSD

SEQ ID NO: 963978 - protein, 10 aa, Mycobacterium
SEASATKAKT

SEQ ID NO: 963979 - protein, 13 aa, Mycobacterium
SECATADTASPTT

SEQ ID NO: 963980 - protein, 7 aa, Mycobacterium
SEDAGYH

SEQ ID NO: 963981 - protein, 12 aa, Mycobacterium
SEDEDESVAPPR

SEQ ID NO: 963982 - protein, 12 aa, Mycobacterium
SEDGGNLSAGEK

SEQ ID NO: 963983 - protein, 5 aa, Mycobacterium
SEDIG

SEQ ID NO: 963984 - protein, 7 aa, Mycobacterium
SEEQCET

SEQ ID NO: 963985 - protein, 7 aa, Mycobacterium
SEGISDQ

SEQ ID NO: 963986 - protein, 13 aa, Mycobacterium
SEGKGSALDSASL

SEQ ID NO: 963987 - protein, 5 aa, Mycobacterium
SEGTR

SEQ ID NO: 963988 - protein, 5 aa, Mycobacterium
SEHTT

SEQ ID NO: 963989 - protein, 6 aa, Mycobacterium
SELGAQ

SEQ ID NO: 963990 - protein, 8 aa, Mycobacterium
SELGGDSL

SEQ ID NO: 963991 - protein, 5 aa, Mycobacterium
SELRD

SEQ ID NO: 963992 - protein, 5 aa, Mycobacterium
SELSL

SEQ ID NO: 963993 - protein, 7 aa, Mycobacterium
SENANAM

SEQ ID NO: 963994 - protein, 6 aa, Mycobacterium
SENEYA

SEQ ID NO: 963995 - protein, 7 aa, Mycobacterium
SENPGRR

SEQ ID NO: 963996 - protein, 6 aa, Mycobacterium
SEQEVT

SEQ ID NO: 963997 - protein, 4 aa, Mycobacterium
SEQY

SEQ ID NO: 963998 - protein, 4 aa, Mycobacterium
SERQ

SEQ ID NO: 963999 - protein, 5 aa, Mycobacterium
SESAK

SEQ ID NO: 964000 - protein, 16 aa, Mycobacterium
SETDANPDTEVGQLGS

SEQ ID NO: 964001 - protein, 8 aa, Mycobacterium
SETTGEPL

SEQ ID NO: 964002 - protein, 27 aa, Mycobacterium
SETTPDSMTGSERITTASGLAGSAGTF

SEQ ID NO: 964003 - protein, 12 aa, Mycobacterium
SETVAGATETER

SEQ ID NO: 964004 - protein, 16 aa, Mycobacterium
SEVPDPTQRPPQPDRP

SEQ ID NO: 964005 - protein, 9 aa, Mycobacterium
SEVTGSDRR

SEQ ID NO: 964006 - protein, 7 aa, Mycobacterium
SFAAERQ

SEQ ID NO: 964007 - protein, 5 aa, Mycobacterium
SFADA

SEQ ID NO: 964008 - protein, 5 aa, Mycobacterium
SFPGV

SEQ ID NO: 964009 - protein, 4 aa, Mycobacterium
SFPT

SEQ ID NO: 964010 - protein, 7 aa, Mycobacterium
SFTGGRG

SEQ ID NO: 964011 - protein, 7 aa, Mycobacterium
SGAADRV

SEQ ID NO: 964012 - protein, 8 aa, Mycobacterium
SGAAVGAA

SEQ ID NO: 964013 - protein, 11 aa, Mycobacterium
SGAEGADPASV

SEQ ID NO: 964014 - protein, 4 aa, Mycobacterium
SGAG

SEQ ID NO: 964015 - protein, 5 aa, Mycobacterium
SGAHR

SEQ ID NO: 964016 - protein, 45 aa, Mycobacterium
SGAKRPGAKKAAPPAAAAPEAAATAPAPEAAAAPAEPAAPAAPVK

SEQ ID NO: 964017 - protein, 19 aa, Mycobacterium
SGALNAQEYASRRAQIISE

SEQ ID NO: 964018 - protein, 7 aa, Mycobacterium
SGAPFPD

SEQ ID NO: 964019 - protein, 8 aa, Mycobacterium
SGAPQGSW

SEQ ID NO: 964020 - protein, 9 aa, Mycobacterium
SGAPSARNP

SEQ ID NO: 964021 - protein, 8 aa, Mycobacterium
SGAPVDAS

SEQ ID NO: 964022 - protein, 10 aa, Mycobacterium
SGAQAEGTSE

SEQ ID NO: 964023 - protein, 7 aa, Mycobacterium
SGASSAE

SEQ ID NO: 964024 - protein, 7 aa, Mycobacterium
SGAYRAT

SEQ ID NO: 964025 - protein, 15 aa, Mycobacterium
SGDEIPEQYRRTLVD

SEQ ID NO: 964026 - protein, 13 aa, Mycobacterium
SGDGGGDSGEDLP

SEQ ID NO: 964027 - protein, 4 aa, Mycobacterium
SGDN

SEQ ID NO: 964028 - protein, 4 aa, Mycobacterium
SGDQ

SEQ ID NO: 964029 - protein, 7 aa, Mycobacterium
SGDVATA

SEQ ID NO: 964030 - protein, 17 aa, Mycobacterium
SGDVGVRDSQYTAVAAA

SEQ ID NO: 964031 - protein, 5 aa, Mycobacterium
SGEEI

SEQ ID NO: 964032 - protein, 4 aa, Mycobacterium
SGEP

SEQ ID NO: 964033 - protein, 5 aa, Mycobacterium
SGESP

SEQ ID NO: 964034 - protein, 19 aa, Mycobacterium
SGESTGPLPPKIYRRLDDP

SEQ ID NO: 964035 - protein, 6 aa, Mycobacterium
SGEWSK

SEQ ID NO: 964036 - protein, 6 aa, Mycobacterium
SGFGPA

SEQ ID NO: 964037 - protein, 14 aa, Mycobacterium
SGGAAAVRRTATGT

SEQ ID NO: 964038 - protein, 5 aa, Mycobacterium
SGGAQ

SEQ ID NO: 964039 - protein, 7 aa, Mycobacterium
SGGLGSP

SEQ ID NO: 964040 - protein, 7 aa, Mycobacterium
SGGLYTS

SEQ ID NO: 964041 - protein, 4 aa, Mycobacterium
SGGM

SEQ ID NO: 964042 - protein, 8 aa, Mycobacterium
SGGPEGVG

SEQ ID NO: 964043 - protein, 9 aa, Mycobacterium
SGGTSVPVA

SEQ ID NO: 964044 - protein, 15 aa, Mycobacterium
SGGTVNVPGGVGPGG

SEQ ID NO: 964045 - protein, 7 aa, Mycobacterium
SGHAQRV

SEQ ID NO: 964046 - protein, 6 aa, Mycobacterium
SGHPPG

SEQ ID NO: 964047 - protein, 7 aa, Mycobacterium
SGHSPID

SEQ ID NO: 964048 - protein, 11 aa, Mycobacterium
SGHSRAHATRT

SEQ ID NO: 964049 - protein, 7 aa, Mycobacterium
SGIGGEY

SEQ ID NO: 964050 - protein, 4 aa, Mycobacterium
SGIP

SEQ ID NO: 964051 - protein, 12 aa, Mycobacterium
SGITGGRRSGLL

SEQ ID NO: 964052 - protein, 13 aa, Mycobacterium
SGITQPGRRVPDD

SEQ ID NO: 964053 - protein, 5 aa, Mycobacterium
SGLAS

SEQ ID NO: 964054 - protein, 6 aa, Mycobacterium
SGLDAA

SEQ ID NO: 964055 - protein, 8 aa, Mycobacterium
SGLELPEG

SEQ ID NO: 964056 - protein, 5 aa, Mycobacterium
SGLND

SEQ ID NO: 964057 - protein, 7 aa, Mycobacterium
SGLNNDK

SEQ ID NO: 964058 - protein, 8 aa, Mycobacterium
SGLNNDKL

SEQ ID NO: 964059 - protein, 8 aa, Mycobacterium
SGLSAGVK

SEQ ID NO: 964060 - protein, 8 aa, Mycobacterium
SGNLTGGG

SEQ ID NO: 964061 - protein, 5 aa, Mycobacterium
SGNQI

SEQ ID NO: 964062 - protein, 26 aa, Mycobacterium
SGPAGQTTGRAIDRSARALRTDARRP

SEQ ID NO: 964063 - protein, 9 aa, Mycobacterium
SGPAGSTAN

SEQ ID NO: 964064 - protein, 5 aa, Mycobacterium
SGPAP

SEQ ID NO: 964065 - protein, 6 aa, Mycobacterium
SGPARH

SEQ ID NO: 964066 - protein, 21 aa, Mycobacterium
SGPATKQIPDVAGQSVEEAQQ

SEQ ID NO: 964067 - protein, 5 aa, Mycobacterium
SGPDM

SEQ ID NO: 964068 - protein, 8 aa, Mycobacterium
SGPEGAVG

SEQ ID NO: 964069 - protein, 4 aa, Mycobacterium
SGPI

SEQ ID NO: 964070 - protein, 6 aa, Mycobacterium
SGPIPD

SEQ ID NO: 964071 - protein, 4 aa, Mycobacterium
SGPT

SEQ ID NO: 964072 - protein, 19 aa, Mycobacterium
SGQAPSGFDAGLLQAAFER

SEQ ID NO: 964073 - protein, 6 aa, Mycobacterium
SGQAPV

SEQ ID NO: 964074 - protein, 7 aa, Mycobacterium
SGQATSF

SEQ ID NO: 964075 - protein, 9 aa, Mycobacterium
SGQDSNVPG

SEQ ID NO: 964076 - protein, 5 aa, Mycobacterium
SGQRS

SEQ ID NO: 964077 - protein, 8 aa, Mycobacterium
SGQSATNW

SEQ ID NO: 964078 - protein, 7 aa, Mycobacterium
SGRAPLG

SEQ ID NO: 964079 - protein, 8 aa, Mycobacterium
SGRDQGWR

SEQ ID NO: 964080 - protein, 13 aa, Mycobacterium
SGRDTAPAAGPEL

SEQ ID NO: 964081 - protein, 12 aa, Mycobacterium
SGREESPTDLAA

SEQ ID NO: 964082 - protein, 16 aa, Mycobacterium
SGRGNRRVVDSDDEFE

SEQ ID NO: 964083 - protein, 6 aa, Mycobacterium
SGRGNS

SEQ ID NO: 964084 - protein, 9 aa, Mycobacterium
SGRPLEREP

SEQ ID NO: 964085 - protein, 11 aa, Mycobacterium
SGRPSGRAGYH

SEQ ID NO: 964086 - protein, 7 aa, Mycobacterium
SGRPSVG

SEQ ID NO: 964087 - protein, 5 aa, Mycobacterium
SGRST

SEQ ID NO: 964088 - protein, 15 aa, Mycobacterium
SGSDYPQVQPRDDTQ

SEQ ID NO: 964089 - protein, 7 aa, Mycobacterium
SGSGGVG

SEQ ID NO: 964090 - protein, 8 aa, Mycobacterium
SGSGPGPL

SEQ ID NO: 964091 - protein, 8 aa, Mycobacterium
SGSGTADV

SEQ ID NO: 964092 - protein, 4 aa, Mycobacterium
SGSL

SEQ ID NO: 964093 - protein, 6 aa, Mycobacterium
SGSLTA

SEQ ID NO: 964094 - protein, 8 aa, Mycobacterium
SGSMVGRT

SEQ ID NO: 964095 - protein, 12 aa, Mycobacterium
SGSPPPGYPSGY

SEQ ID NO: 964096 - protein, 10 aa, Mycobacterium
SGSVRGEPSG

SEQ ID NO: 964097 - protein, 5 aa, Mycobacterium
SGSVV

SEQ ID NO: 964098 - protein, 4 aa, Mycobacterium
SGSY

SEQ ID NO: 964099 - protein, 10 aa, Mycobacterium
SGTAIPSNVT

SEQ ID NO: 964100 - protein, 6 aa, Mycobacterium
SGTDRA

SEQ ID NO: 964101 - protein, 8 aa, Mycobacterium
SGTEIDTG

SEQ ID NO: 964102 - protein, 6 aa, Mycobacterium
SGTPRA

SEQ ID NO: 964103 - protein, 10 aa, Mycobacterium
SGTTGSGKST

SEQ ID NO: 964104 - protein, 7 aa, Mycobacterium
SGTTPKM

SEQ ID NO: 964105 - protein, 6 aa, Mycobacterium
SGVASA

SEQ ID NO: 964106 - protein, 5 aa, Mycobacterium
SGVAV

SEQ ID NO: 964107 - protein, 6 aa, Mycobacterium
SGVEGF

SEQ ID NO: 964108 - protein, 14 aa, Mycobacterium
SGVGHGTDADLETE

SEQ ID NO: 964109 - protein, 10 aa, Mycobacterium
SGVPENLRSP

SEQ ID NO: 964110 - protein, 13 aa, Mycobacterium
SGVPKARAAALTG

SEQ ID NO: 964111 - protein, 8 aa, Mycobacterium
SGVPRPSL

SEQ ID NO: 964112 - protein, 4 aa, Mycobacterium
SGYA

SEQ ID NO: 964113 - protein, 7 aa, Mycobacterium
SHARNPQ

SEQ ID NO: 964114 - protein, 11 aa, Mycobacterium
SHGPRVAGGGS

SEQ ID NO: 964115 - protein, 7 aa, Mycobacterium
SHGTSTA

SEQ ID NO: 964116 - protein, 9 aa, Mycobacterium
SHNGRPRAG

SEQ ID NO: 964117 - protein, 18 aa, Mycobacterium
SHPSDPPRTAYEPSDDGI

SEQ ID NO: 964118 - protein, 13 aa, Mycobacterium
SHPTTPFVAVDYD

SEQ ID NO: 964119 - protein, 8 aa, Mycobacterium
SHQADQQR

SEQ ID NO: 964120 - protein, 7 aa, Mycobacterium
SHTPVGP

SEQ ID NO: 964121 - protein, 4 aa, Mycobacterium
SIAD

SEQ ID NO: 964122 - protein, 6 aa, Mycobacterium
SIATRR

SEQ ID NO: 964123 - protein, 9 aa, Mycobacterium
SIDSNNVDA

SEQ ID NO: 964124 - protein, 9 aa, Mycobacterium
SIGQAGSTI

SEQ ID NO: 964125 - protein, 10 aa, Mycobacterium
SIGTTATALQ

SEQ ID NO: 964126 - protein, 10 aa, Mycobacterium
SIPITTSGKI

SEQ ID NO: 964127 - protein, 4 aa, Mycobacterium
SISA

SEQ ID NO: 964128 - protein, 9 aa, Mycobacterium
SISAGGTGF

SEQ ID NO: 964129 - protein, 8 aa, Mycobacterium
SITGRDHP

SEQ ID NO: 964130 - protein, 6 aa, Mycobacterium
SITPGG

SEQ ID NO: 964131 - protein, 10 aa, Mycobacterium
SKAEGQTGAA

SEQ ID NO: 964132 - protein, 8 aa, Mycobacterium
SKAESALE

SEQ ID NO: 964133 - protein, 7 aa, Mycobacterium
SKANAGV

SEQ ID NO: 964134 - protein, 7 aa, Mycobacterium
SKDTVSR

SEQ ID NO: 964135 - protein, 7 aa, Mycobacterium
SKESPRT

SEQ ID NO: 964136 - protein, 8 aa, Mycobacterium
SKETRPDV

SEQ ID NO: 964137 - protein, 13 aa, Mycobacterium
SKGIVAQPSGLTT

SEQ ID NO: 964138 - protein, 4 aa, Mycobacterium
SKGP

SEQ ID NO: 964139 - protein, 8 aa, Mycobacterium
SKGTRAQR

SEQ ID NO: 964140 - protein, 6 aa, Mycobacterium
SKHRQA

SEQ ID NO: 964141 - protein, 15 aa, Mycobacterium
SKKNPELAYDLGIIR

SEQ ID NO: 964142 - protein, 10 aa, Mycobacterium
SKKSDQGRAE

SEQ ID NO: 964143 - protein, 9 aa, Mycobacterium
SKPIAAAAD

SEQ ID NO: 964144 - protein, 17 aa, Mycobacterium
SKPRGQTDPNARGPDQQ

SEQ ID NO: 964145 - protein, 6 aa, Mycobacterium
SLAGDA

SEQ ID NO: 964146 - protein, 4 aa, Mycobacterium
SLAP

SEQ ID NO: 964147 - protein, 12 aa, Mycobacterium
SLASSKAAQGAS

SEQ ID NO: 964148 - protein, 6 aa, Mycobacterium
SLDEAG

SEQ ID NO: 964149 - protein, 6 aa, Mycobacterium
SLDGGG

SEQ ID NO: 964150 - protein, 6 aa, Mycobacterium
SLDGPN

SEQ ID NO: 964151 - protein, 7 aa, Mycobacterium
SLDKATY

SEQ ID NO: 964152 - protein, 16 aa, Mycobacterium
SLDKGPDVDGGGSQHN

SEQ ID NO: 964153 - protein, 12 aa, Mycobacterium
SLDPSIGNQPNQ

SEQ ID NO: 964154 - protein, 7 aa, Mycobacterium
SLEATRS

SEQ ID NO: 964155 - protein, 7 aa, Mycobacterium
SLEGGKQ

SEQ ID NO: 964156 - protein, 10 aa, Mycobacterium
SLGDSGRFGD

SEQ ID NO: 964157 - protein, 6 aa, Mycobacterium
SLGEAA

SEQ ID NO: 964158 - protein, 4 aa, Mycobacterium
SLGG

SEQ ID NO: 964159 - protein, 8 aa, Mycobacterium
SLGGPVSS

SEQ ID NO: 964160 - protein, 6 aa, Mycobacterium
SLGGTA

SEQ ID NO: 964161 - protein, 13 aa, Mycobacterium
SLPKTPAAAPASF

SEQ ID NO: 964162 - protein, 9 aa, Mycobacterium
SLPRVDGGP

SEQ ID NO: 964163 - protein, 8 aa, Mycobacterium
SLQPLPKG

SEQ ID NO: 964164 - protein, 21 aa, Mycobacterium
SLQRGGAFGEATLQGNQVGAS

SEQ ID NO: 964165 - protein, 10 aa, Mycobacterium
SLRDDGELRD

SEQ ID NO: 964166 - protein, 6 aa, Mycobacterium
SLRDER

SEQ ID NO: 964167 - protein, 6 aa, Mycobacterium
SLRRRR

SEQ ID NO: 964168 - protein, 8 aa, Mycobacterium
SLSDRYGR

SEQ ID NO: 964169 - protein, 11 aa, Mycobacterium
SLSPDGGPQTV

SEQ ID NO: 964170 - protein, 9 aa, Mycobacterium
SLTERTPHT

SEQ ID NO: 964171 - protein, 4 aa, Mycobacterium
SMEG

SEQ ID NO: 964172 - protein, 13 aa, Mycobacterium
SMRGEDTKVSDGV

SEQ ID NO: 964173 - protein, 12 aa, Mycobacterium
SMRSSSASTATL

SEQ ID NO: 964174 - protein, 30 aa, Mycobacterium
SNADGGGLANGLPNQRQQLTPLSGTSYAAG

SEQ ID NO: 964175 - protein, 10 aa, Mycobacterium
SNAKLGDEAH

SEQ ID NO: 964176 - protein, 9 aa, Mycobacterium
SNDGPDIDP

SEQ ID NO: 964177 - protein, 8 aa, Mycobacterium
SNDNLQDL

SEQ ID NO: 964178 - protein, 8 aa, Mycobacterium
SNDPTSVA

SEQ ID NO: 964179 - protein, 12 aa, Mycobacterium
SNDQDQNQETGY

SEQ ID NO: 964180 - protein, 8 aa, Mycobacterium
SNGAPEQL

SEQ ID NO: 964181 - protein, 8 aa, Mycobacterium
SNGATDAA

SEQ ID NO: 964182 - protein, 4 aa, Mycobacterium
SNHQ

SEQ ID NO: 964183 - protein, 7 aa, Mycobacterium
SNIGGTA

SEQ ID NO: 964184 - protein, 12 aa, Mycobacterium
SNIQPGKPITSM

SEQ ID NO: 964185 - protein, 11 aa, Mycobacterium
SNISYGEYGSA

SEQ ID NO: 964186 - protein, 5 aa, Mycobacterium
SNLGG

SEQ ID NO: 964187 - protein, 15 aa, Mycobacterium
SNLPEAKDNPAMTHG

SEQ ID NO: 964188 - protein, 12 aa, Mycobacterium
SNNATFNKTMSE

SEQ ID NO: 964189 - protein, 8 aa, Mycobacterium
SNQKYQPQ

SEQ ID NO: 964190 - protein, 6 aa, Mycobacterium
SNQLGE

SEQ ID NO: 964191 - protein, 5 aa, Mycobacterium
SNRIS

SEQ ID NO: 964192 - protein, 4 aa, Mycobacterium
SNRP

SEQ ID NO: 964193 - protein, 7 aa, Mycobacterium
SNRPATD

SEQ ID NO: 964194 - protein, 6 aa, Mycobacterium
SNTPAD

SEQ ID NO: 964195 - protein, 10 aa, Mycobacterium
SNYDGDGYVG

SEQ ID NO: 964196 - protein, 4 aa, Mycobacterium
SPAA

SEQ ID NO: 964197 - protein, 5 aa, Mycobacterium
SPAAF

SEQ ID NO: 964198 - protein, 8 aa, Mycobacterium
SPADETLR

SEQ ID NO: 964199 - protein, 6 aa, Mycobacterium
SPAGAA

SEQ ID NO: 964200 - protein, 4 aa, Mycobacterium
SPAN

SEQ ID NO: 964201 - protein, 8 aa, Mycobacterium
SPANTVRG

SEQ ID NO: 964202 - protein, 8 aa, Mycobacterium
SPATPSSI

SEQ ID NO: 964203 - protein, 5 aa, Mycobacterium
SPDGH

SEQ ID NO: 964204 - protein, 6 aa, Mycobacterium
SPDGRA

SEQ ID NO: 964205 - protein, 9 aa, Mycobacterium
SPDGSAHDP

SEQ ID NO: 964206 - protein, 8 aa, Mycobacterium
SPDTLDDD

SEQ ID NO: 964207 - protein, 5 aa, Mycobacterium
SPEDK

SEQ ID NO: 964208 - protein, 13 aa, Mycobacterium
SPEGQASSLESIG

SEQ ID NO: 964209 - protein, 5 aa, Mycobacterium
SPELS

SEQ ID NO: 964210 - protein, 6 aa, Mycobacterium
SPEPLA

SEQ ID NO: 964211 - protein, 4 aa, Mycobacterium
SPEQ

SEQ ID NO: 964212 - protein, 9 aa, Mycobacterium
SPEQRSREP

SEQ ID NO: 964213 - protein, 16 aa, Mycobacterium
SPEQVRDGNAGPRSDV

SEQ ID NO: 964214 - protein, 8 aa, Mycobacterium
SPERTQAP

SEQ ID NO: 964215 - protein, 4 aa, Mycobacterium
SPEV

SEQ ID NO: 964216 - protein, 7 aa, Mycobacterium
SPGAAPI

SEQ ID NO: 964217 - protein, 5 aa, Mycobacterium
SPGAT

SEQ ID NO: 964218 - protein, 5 aa, Mycobacterium
SPGDR

SEQ ID NO: 964219 - protein, 8 aa, Mycobacterium
SPGEQQRA

SEQ ID NO: 964220 - protein, 5 aa, Mycobacterium
SPGQP

SEQ ID NO: 964221 - protein, 5 aa, Mycobacterium
SPGVA

SEQ ID NO: 964222 - protein, 7 aa, Mycobacterium
SPHDDAP

SEQ ID NO: 964223 - protein, 7 aa, Mycobacterium
SPHPAPV

SEQ ID NO: 964224 - protein, 9 aa, Mycobacterium
SPKGARNDR

SEQ ID NO: 964225 - protein, 8 aa, Mycobacterium
SPKKSWEG

SEQ ID NO: 964226 - protein, 11 aa, Mycobacterium
SPNPDAAGAAA

SEQ ID NO: 964227 - protein, 7 aa, Mycobacterium
SPPPRQR

SEQ ID NO: 964228 - protein, 11 aa, Mycobacterium
SPQQAAAQVSG

SEQ ID NO: 964229 - protein, 6 aa, Mycobacterium
SPRDDG

SEQ ID NO: 964230 - protein, 13 aa, Mycobacterium
SPRNQNYSARAAA

SEQ ID NO: 964231 - protein, 6 aa, Mycobacterium
SPRNTW

SEQ ID NO: 964232 - protein, 4 aa, Mycobacterium
SPRT

SEQ ID NO: 964233 - protein, 8 aa, Mycobacterium
SPSDPNAK

SEQ ID NO: 964234 - protein, 11 aa, Mycobacterium
SPTAAGVGSAV

SEQ ID NO: 964235 - protein, 27 aa, Mycobacterium
SPTAWANQAGSAAASESASDNAKSATY

SEQ ID NO: 964236 - protein, 7 aa, Mycobacterium
SPTDAAA

SEQ ID NO: 964237 - protein, 5 aa, Mycobacterium
SPTGC

SEQ ID NO: 964238 - protein, 9 aa, Mycobacterium
SPTQHTPYG

SEQ ID NO: 964239 - protein, 5 aa, Mycobacterium
SPTRL

SEQ ID NO: 964240 - protein, 14 aa, Mycobacterium
SPTSPELSASDSAR

SEQ ID NO: 964241 - protein, 11 aa, Mycobacterium
SPTSSSGGGGF

SEQ ID NO: 964242 - protein, 4 aa, Mycobacterium
SPTV

SEQ ID NO: 964243 - protein, 8 aa, Mycobacterium
SPYDIPDE

SEQ ID NO: 964244 - protein, 8 aa, Mycobacterium
SQAANTWA

SEQ ID NO: 964245 - protein, 7 aa, Mycobacterium
SQAGPKK

SEQ ID NO: 964246 - protein, 12 aa, Mycobacterium
SQAPAGSGKPLQ

SEQ ID NO: 964247 - protein, 7 aa, Mycobacterium
SQDKTNI

SEQ ID NO: 964248 - protein, 12 aa, Mycobacterium
SQDPVYSGTGYT

SEQ ID NO: 964249 - protein, 7 aa, Mycobacterium
SQDYGIE

SEQ ID NO: 964250 - protein, 49 aa, Mycobacterium
SQEATLPGPPDPAAPPTMPATAATPPSRPGPAATPPRPASTPQQPPYYP

SEQ ID NO: 964251 - protein, 6 aa, Mycobacterium
SQEFTE

SEQ ID NO: 964252 - protein, 36 aa, Mycobacterium
SQEPQKAADQAEDQDEFEGPRRRARRERAERRAAEA

SEQ ID NO: 964253 - protein, 4 aa, Mycobacterium
SQFG

SEQ ID NO: 964254 - protein, 6 aa, Mycobacterium
SQGRVA

SEQ ID NO: 964255 - protein, 8 aa, Mycobacterium
SQGTSRPR

SEQ ID NO: 964256 - protein, 7 aa, Mycobacterium
SQGTTRF

SEQ ID NO: 964257 - protein, 4 aa, Mycobacterium
SQNE

SEQ ID NO: 964258 - protein, 10 aa, Mycobacterium
SQNHEDEAGA

SEQ ID NO: 964259 - protein, 6 aa, Mycobacterium
SQNYNG

SEQ ID NO: 964260 - protein, 23 aa, Mycobacterium
SQPGPPAGLPPGPPPGAPPGPQF

SEQ ID NO: 964261 - protein, 6 aa, Mycobacterium
SQPPGL

SEQ ID NO: 964262 - protein, 13 aa, Mycobacterium
SQPQAAAGDAQGA

SEQ ID NO: 964263 - protein, 4 aa, Mycobacterium
SQPV

SEQ ID NO: 964264 - protein, 8 aa, Mycobacterium
SQQRYRPN

SEQ ID NO: 964265 - protein, 4 aa, Mycobacterium
SQRL

SEQ ID NO: 964266 - protein, 7 aa, Mycobacterium
SQRQQHA

SEQ ID NO: 964267 - protein, 17 aa, Mycobacterium
SQRTDPPIGQPGTPPLP

SEQ ID NO: 964268 - protein, 6 aa, Mycobacterium
SQTPSE

SEQ ID NO: 964269 - protein, 36 aa, Mycobacterium; identical to SEQ ID NO: 287017

SEQ ID NO: 964270 - protein, 25 aa, Mycobacterium
SQYDDPEDDSDLSDEEIEEARRRRQ

SEQ ID NO: 964271 - protein, 5 aa, Mycobacterium
SQYTP

SEQ ID NO: 964272 - protein, 13 aa, Mycobacterium
SRAAGRRRKPDLR

SEQ ID NO: 964273 - protein, 4 aa, Mycobacterium
SRAE

SEQ ID NO: 964274 - protein, 6 aa, Mycobacterium
SRAGAA

SEQ ID NO: 964275 - protein, 8 aa, Mycobacterium
SRAGTLGA

SEQ ID NO: 964276 - protein, 4 aa, Mycobacterium
SRAI

SEQ ID NO: 964277 - protein, 14 aa, Mycobacterium
SRAKQLSKDMPKTT

SEQ ID NO: 964278 - protein, 6 aa, Mycobacterium
SRAQWD

SEQ ID NO: 964279 - protein, 7 aa, Mycobacterium
SRARNAS

SEQ ID NO: 964280 - protein, 7 aa, Mycobacterium
SRDEIGD

SEQ ID NO: 964281 - protein, 9 aa, Mycobacterium
SRDPAAPRV

SEQ ID NO: 964282 - protein, 5 aa, Mycobacterium
SREGL

SEQ ID NO: 964283 - protein, 14 aa, Mycobacterium
SRELPSNPRPPDPP

SEQ ID NO: 964284 - protein, 7 aa, Mycobacterium
SREMPAR

SEQ ID NO: 964285 - protein, 36 aa, Mycobacterium
SREQDVSDVRDPGPDLPDVPDIPDGRGEELAAEPAS

SEQ ID NO: 964286 - protein, 67 aa, Mycobacterium
SRESTLPGTAAITPQPPTMPAVTPPPAMPYADPASSGPLPQSAPTGQPGWAPASGPIPAAHQPAQVP

SEQ ID NO: 964287 - protein, 8 aa, Mycobacterium
SRETDRVR

SEQ ID NO: 964288 - protein, 13 aa, Mycobacterium
SREYQADESGAVL

SEQ ID NO: 964289 - protein, 8 aa, Mycobacterium
SRGDKSED

SEQ ID NO: 964290 - protein, 23 aa, Mycobacterium
SRGEASRRLGEAADLGPRRALTG

SEQ ID NO: 964291 - protein, 7 aa, Mycobacterium
SRGGVGI

SEQ ID NO: 964292 - protein, 5 aa, Mycobacterium
SRGTP

SEQ ID NO: 964293 - protein, 6 aa, Mycobacterium
SRGVPA

SEQ ID NO: 964294 - protein, 28 aa, Mycobacterium
SRHRRPEEERPDVAGSHDSDSQSGGQSV

SEQ ID NO: 964295 - protein, 9 aa, Mycobacterium
SRHTSSTAR

SEQ ID NO: 964296 - protein, 9 aa, Mycobacterium
SRKDQERAV

SEQ ID NO: 964297 - protein, 6 aa, Mycobacterium
SRKDST

SEQ ID NO: 964298 - protein, 8 aa, Mycobacterium
SRLKAGQK

SEQ ID NO: 964299 - protein, 5 aa, Mycobacterium
SRMGA

SEQ ID NO: 964300 - protein, 10 aa, Mycobacterium
SRNARAGQLD

SEQ ID NO: 964301 - protein, 8 aa, Mycobacterium
SRNDDGVA

SEQ ID NO: 964302 - protein, 6 aa, Mycobacterium
SRNGSF

SEQ ID NO: 964303 - protein, 10 aa, Mycobacterium
SRNPDRPPLD

SEQ ID NO: 964304 - protein, 7 aa, Mycobacterium
SRPAAAA

SEQ ID NO: 964305 - protein, 13 aa, Mycobacterium
SRPAASASPASPY

SEQ ID NO: 964306 - protein, 6 aa, Mycobacterium
SRPAGA

SEQ ID NO: 964307 - protein, 29 aa, Mycobacterium
SRPDRGAIQRAAQSDTEPAPVESAPATAG

SEQ ID NO: 964308 - protein, 10 aa, Mycobacterium
SRPPRDPDQP

SEQ ID NO: 964309 - protein, 7 aa, Mycobacterium
SRPPRLT

SEQ ID NO: 964310 - protein, 8 aa, Mycobacterium
SRQAREQG

SEQ ID NO: 964311 - protein, 5 aa, Mycobacterium
SRQER

SEQ ID NO: 964312 - protein, 16 aa, Mycobacterium
SRQEVSPKVTPARHEL

SEQ ID NO: 964313 - protein, 5 aa, Mycobacterium
SRRGD

SEQ ID NO: 964314 - protein, 5 aa, Mycobacterium
SRRIA

SEQ ID NO: 964315 - protein, 8 aa, Mycobacterium
SRRNHGRS

SEQ ID NO: 964316 - protein, 5 aa, Mycobacterium
SRRNR

SEQ ID NO: 964317 - protein, 5 aa, Mycobacterium
SRRPL

SEQ ID NO: 964318 - protein, 9 aa, Mycobacterium
SRRPPTGMS

SEQ ID NO: 964319 - protein, 5 aa, Mycobacterium
SRRPR

SEQ ID NO: 964320 - protein, 7 aa, Mycobacterium
SRRRTNA

SEQ ID NO: 964321 - protein, 9 aa, Mycobacterium
SRRYDAAGN

SEQ ID NO: 964322 - protein, 9 aa, Mycobacterium
SRSAKKRPR

SEQ ID NO: 964323 - protein, 9 aa, Mycobacterium
SRSANHPAS

SEQ ID NO: 964324 - protein, 10 aa, Mycobacterium
SRSGDIPPGI

SEQ ID NO: 964325 - protein, 6 aa, Mycobacterium
SRSGNT

SEQ ID NO: 964326 - protein, 8 aa, Mycobacterium
SRSHPTPL

SEQ ID NO: 964327 - protein, 7 aa, Mycobacterium
SRSLSGN

SEQ ID NO: 964328 - protein, 6 aa, Mycobacterium
SRTEQP

SEQ ID NO: 964329 - protein, 13 aa, Mycobacterium
SRTESGSAALSGF

SEQ ID NO: 964330 - protein, 8 aa, Mycobacterium
SRTGGAQT

SEQ ID NO: 964331 - protein, 5 aa, Mycobacterium
SRTRD

SEQ ID NO: 964332 - protein, 15 aa, Mycobacterium
SRVGPPAGATGFSDG

SEQ ID NO: 964333 - protein, 14 aa, Mycobacterium
SRVTNGGDGKQEPR

SEQ ID NO: 964334 - protein, 5 aa, Mycobacterium
SSAGS

SEQ ID NO: 964335 - protein, 9 aa, Mycobacterium
SSANGATVA

SEQ ID NO: 964336 - protein, 4 aa, Mycobacterium
SSDA

SEQ ID NO: 964337 - protein, 7 aa, Mycobacterium
SSDDGYN

SEQ ID NO: 964338 - protein, 6 aa, Mycobacterium
SSDPLV

SEQ ID NO: 964339 - protein, 8 aa, Mycobacterium
SSEAATDV

SEQ ID NO: 964340 - protein, 8 aa, Mycobacterium
SSEAQTVS

SEQ ID NO: 964341 - protein, 8 aa, Mycobacterium
SSGGSTGS

SEQ ID NO: 964342 - protein, 9 aa, Mycobacterium
SSGPGAGPM

SEQ ID NO: 964343 - protein, 9 aa, Mycobacterium
SSGPGPASL

SEQ ID NO: 964344 - protein, 12 aa, Mycobacterium
SSGPLPDQADPA

SEQ ID NO: 964345 - protein, 14 aa, Mycobacterium
SSGSQGGSAAHSTG

SEQ ID NO: 964346 - protein, 7 aa, Mycobacterium
SSGVRTY

SEQ ID NO: 964347 - protein, 5 aa, Mycobacterium
SSGVY

SEQ ID NO: 964348 - protein, 9 aa, Mycobacterium
SSKPTVAPG

SEQ ID NO: 964349 - protein, 12 aa, Mycobacterium
SSKSRSSAPGHG

SEQ ID NO: 964350 - protein, 52 aa, Mycobacterium
SSLAAGPPPAPPGATLAPPPPSAPPATLGTELTPAAATAPGAPAAAFAPQPV

SEQ ID NO: 964351 - protein, 5 aa, Mycobacterium
SSLTD

SEQ ID NO: 964352 - protein, 9 aa, Mycobacterium
SSNPALSNH

SEQ ID NO: 964353 - protein, 6 aa, Mycobacterium
SSPAVP

SEQ ID NO: 964354 - protein, 9 aa, Mycobacterium
SSPGAADPV

SEQ ID NO: 964355 - protein, 5 aa, Mycobacterium
SSPTG

SEQ ID NO: 964356 - protein, 12 aa, Mycobacterium
SSQADAVKQARE

SEQ ID NO: 964357 - protein, 5 aa, Mycobacterium
SSQAF

SEQ ID NO: 964358 - protein, 18 aa, Mycobacterium
SSQPEPSPRPPSVNVQPR

SEQ ID NO: 964359 - protein, 12 aa, Mycobacterium
SSRFDVPKEQPA

SEQ ID NO: 964360 - protein, 11 aa, Mycobacterium
SSRKSASERYP

SEQ ID NO: 964361 - protein, 8 aa, Mycobacterium
SSRTSHRV

SEQ ID NO: 964362 - protein, 6 aa, Mycobacterium
SSRWPG

SEQ ID NO: 964363 - protein, 8 aa, Mycobacterium
SSSGSMTA

SEQ ID NO: 964364 - protein, 8 aa, Mycobacterium
SSSSQRRG

SEQ ID NO: 964365 - protein, 15 aa, Mycobacterium
SSTAAQAWAQDPGSG

SEQ ID NO: 964366 - protein, 12 aa, Mycobacterium
SSTAPAPKAGKH

SEQ ID NO: 964367 - protein, 7 aa, Mycobacterium
SSTGEFK

SEQ ID NO: 964368 - protein, 23 aa, Mycobacterium
SSTGRDVEGPKKNFAARKNELQT

SEQ ID NO: 964369 - protein, 4 aa, Mycobacterium
SSTR

SEQ ID NO: 964370 - protein, 4 aa, Mycobacterium
SSTS

SEQ ID NO: 964371 - protein, 11 aa, Mycobacterium
SSTSSFQGSWT

SEQ ID NO: 964372 - protein, 5 aa, Mycobacterium
SSVAA

SEQ ID NO: 964373 - protein, 9 aa, Mycobacterium
SSVSSYRQV

SEQ ID NO: 964374 - protein, 16 aa, Mycobacterium
SSVVNGDGVLQAVADD

SEQ ID NO: 964375 - protein, 7 aa, Mycobacterium
SSWDGPA

SEQ ID NO: 964376 - protein, 9 aa, Mycobacterium
STAADQPAQ

SEQ ID NO: 964377 - protein, 6 aa, Mycobacterium
STAAQA

SEQ ID NO: 964378 - protein, 10 aa, Mycobacterium
STADATTPYT

SEQ ID NO: 964379 - protein, 6 aa, Mycobacterium
STADGD

SEQ ID NO: 964380 - protein, 10 aa, Mycobacterium
STAEPEPQGL

SEQ ID NO: 964381 - protein, 8 aa, Mycobacterium
STAGDITG

SEQ ID NO: 964382 - protein, 15 aa, Mycobacterium
STAGEEVRNPQQSVP

SEQ ID NO: 964383 - protein, 14 aa, Mycobacterium
STAPTTSPTPAGSP

SEQ ID NO: 964384 - protein, 5 aa, Mycobacterium
STATE

SEQ ID NO: 964385 - protein, 5 aa, Mycobacterium
STATI

SEQ ID NO: 964386 - protein, 4 aa, Mycobacterium
STDA

SEQ ID NO: 964387 - protein, 13 aa, Mycobacterium
STEDNTGDQRIPK

SEQ ID NO: 964388 - protein, 6 aa, Mycobacterium
STEERR

SEQ ID NO: 964389 - protein, 4 aa, Mycobacterium
STEG

SEQ ID NO: 964390 - protein, 15 aa, Mycobacterium
STEPGANASVGAGDE

SEQ ID NO: 964391 - protein, 16 aa, Mycobacterium
STEPGANASVGAGDEI

SEQ ID NO: 964392 - protein, 8 aa, Mycobacterium
STEQVTNT

SEQ ID NO: 964393 - protein, 9 aa, Mycobacterium
STESLDTHE

SEQ ID NO: 964394 - protein, 10 aa, Mycobacterium
STESSDAGFA

SEQ ID NO: 964395 - protein, 16 aa, Mycobacterium
STESSPGKASKPRSVT

SEQ ID NO: 964396 - protein, 16 aa, Mycobacterium
STETGERVGPGEVGEI

SEQ ID NO: 964397 - protein, 5 aa, Mycobacterium
STGAG

SEQ ID NO: 964398 - protein, 11 aa, Mycobacterium
STGCGPASSEV

SEQ ID NO: 964399 - protein, 9 aa, Mycobacterium
STGKATHAS

SEQ ID NO: 964400 - protein, 10 aa, Mycobacterium
STGPEQRELP

SEQ ID NO: 964401 - protein, 4 aa, Mycobacterium
STGR

SEQ ID NO: 964402 - protein, 8 aa, Mycobacterium
STGSGKST

SEQ ID NO: 964403 - protein, 5 aa, Mycobacterium
STHAG

SEQ ID NO: 964404 - protein, 5 aa, Mycobacterium
STHKS

SEQ ID NO: 964405 - protein, 6 aa, Mycobacterium
STLDNP

SEQ ID NO: 964406 - protein, 4 aa, Mycobacterium
STLQ

SEQ ID NO: 964407 - protein, 8 aa, Mycobacterium
STNGTASA

SEQ ID NO: 964408 - protein, 11 aa, Mycobacterium
STPEDPASARF

SEQ ID NO: 964409 - protein, 4 aa, Mycobacterium
STPF

SEQ ID NO: 964410 - protein, 16 aa, Mycobacterium
STPPAPQSTETPRSSL

SEQ ID NO: 964411 - protein, 13 aa, Mycobacterium
STPPPALAQTRPE

SEQ ID NO: 964412 - protein, 6 aa, Mycobacterium
STPPPV

SEQ ID NO: 964413 - protein, 7 aa, Mycobacterium
STPQPLH

SEQ ID NO: 964414 - protein, 5 aa, Mycobacterium
STPQQ

SEQ ID NO: 964415 - protein, 7 aa, Mycobacterium
STPRSYL

SEQ ID NO: 964416 - protein, 6 aa, Mycobacterium
STPTAI

SEQ ID NO: 964417 - protein, 8 aa, Mycobacterium
STPTTASR

SEQ ID NO: 964418 - protein, 6 aa, Mycobacterium
STPVGG

SEQ ID NO: 964419 - protein, 13 aa, Mycobacterium
STRALDGYADAPE

SEQ ID NO: 964420 - protein, 9 aa, Mycobacterium
STRQASETR

SEQ ID NO: 964421 - protein, 10 aa, Mycobacterium
STRSADVAQA

SEQ ID NO: 964422 - protein, 4 aa, Mycobacterium
STSA

SEQ ID NO: 964423 - protein, 7 aa, Mycobacterium
STSALDT

SEQ ID NO: 964424 - protein, 8 aa, Mycobacterium
STSARTIT

SEQ ID NO: 964425 - protein, 7 aa, Mycobacterium
STSGSFQ

SEQ ID NO: 964426 - protein, 6 aa, Mycobacterium
STSSRT

SEQ ID NO: 964427 - protein, 7 aa, Mycobacterium
STSSWGD

SEQ ID NO: 964428 - protein, 4 aa, Mycobacterium
STTA

SEQ ID NO: 964429 - protein, 10 aa, Mycobacterium
STTPRPGRET

SEQ ID NO: 964430 - protein, 10 aa, Mycobacterium
STTRAAAESR

SEQ ID NO: 964431 - protein, 7 aa, Mycobacterium
STTRTRQ

SEQ ID NO: 964432 - protein, 11 aa, Mycobacterium
STTSKDHPDPT

SEQ ID NO: 964433 - protein, 6 aa, Mycobacterium
STTYSR

SEQ ID NO: 964434 - protein, 7 aa, Mycobacterium
STVSGAF

SEQ ID NO: 964435 - protein, 4 aa, Mycobacterium
SVAA

SEQ ID NO: 964436 - protein, 11 aa, Mycobacterium
SVAPDAESHAD

SEQ ID NO: 964437 - protein, 16 aa, Mycobacterium
SVARQSPEAAANPQTA

SEQ ID NO: 964438 - protein, 7 aa, Mycobacterium
SVDNPAT

SEQ ID NO: 964439 - protein, 8 aa, Mycobacterium
SVDPGQLE

SEQ ID NO: 964440 - protein, 13 aa, Mycobacterium
SVEGPDPARPPSK

SEQ ID NO: 964441 - protein, 20 aa, Mycobacterium
SVENSTKTGDDGWKEMLAPA

SEQ ID NO: 964442 - protein, 17 aa, Mycobacterium
SVGENRSVSSTPRDAPA

SEQ ID NO: 964443 - protein, 13 aa, Mycobacterium
SVGGSNLATRTMK

SEQ ID NO: 964444 - protein, 5 aa, Mycobacterium
SVGTI

SEQ ID NO: 964445 - protein, 44 aa, Mycobacterium
SVKETRTALTPGHDKAQARPRKLTGSGTNPENNPDRRTPADPSG

SEQ ID NO: 964446 - protein, 11 aa, Mycobacterium
SVPAPQAASPA

SEQ ID NO: 964447 - protein, 7 aa, Mycobacterium
SVPGTGR

SEQ ID NO: 964448 - protein, 11 aa, Mycobacterium
SVPNPATSRWN

SEQ ID NO: 964449 - protein, 6 aa, Mycobacterium
SVPPDI

SEQ ID NO: 964450 - protein, 6 aa, Mycobacterium
SVPRAK

SEQ ID NO: 964451 - protein, 7 aa, Mycobacterium
SVPTGTP

SEQ ID NO: 964452 - protein, 10 aa, Mycobacterium
SVQVSGPAAG

SEQ ID NO: 964453 - protein, 15 aa, Mycobacterium
SVRGSQQQIWQVSER

SEQ ID NO: 964454 - protein, 12 aa, Mycobacterium
SVRRTDKQKDTG

SEQ ID NO: 964455 - protein, 10 aa, Mycobacterium
SVSPTPPSVL

SEQ ID NO: 964456 - protein, 8 aa, Mycobacterium
SVTDADAE

SEQ ID NO: 964457 - protein, 5 aa, Mycobacterium
SVTGD

SEQ ID NO: 964458 - protein, 11 aa, Mycobacterium
SVTGTKAPGDI

SEQ ID NO: 964459 - protein, 8 aa, Mycobacterium
SVTPTKRT

SEQ ID NO: 964460 - protein, 29 aa, Mycobacterium
SWASTPPGTPPQQPVGPTPWNQPPPKRNP

SEQ ID NO: 964461 - protein, 5 aa, Mycobacterium
SWPLG

SEQ ID NO: 964462 - protein, 5 aa, Mycobacterium
SWRNT

SEQ ID NO: 964463 - protein, 8 aa, Mycobacterium
SWSAGSRE

SEQ ID NO: 964464 - protein, 12 aa, Mycobacterium
SYAPGGSKDPSV

SEQ ID NO: 964465 - protein, 15 aa, Mycobacterium
SYGATNSDDAEGYAM

SEQ ID NO: 964466 - protein, 22 aa, Mycobacterium
SYGATNSDDAEGYAMTGGATSV

SEQ ID NO: 964467 - protein, 23 aa, Mycobacterium
SYGATNSDGAEGYAMTGGSTSVM

SEQ ID NO: 964468 - protein, 14 aa, Mycobacterium
SYGENSLAATTTSS

SEQ ID NO: 964469 - protein, 9 aa, Mycobacterium
SYGGKDVGA

SEQ ID NO: 964470 - protein, 5 aa, Mycobacterium
SYGSS

SEQ ID NO: 964471 - protein, 10 aa, Mycobacterium
SYNASARPVG

SEQ ID NO: 964472 - protein, 5 aa, Mycobacterium
SYNRT

SEQ ID NO: 964473 - protein, 7 aa, Mycobacterium
SYRGAPL

SEQ ID NO: 964474 - protein, 6 aa, Mycobacterium
SYSPDT

SEQ ID NO: 964475 - protein, 9 aa, Mycobacterium
SYSPSAVSQ

SEQ ID NO: 964476 - protein, 6 aa, Mycobacterium
SYTEGT

SEQ ID NO: 964477 - protein, 16 aa, Mycobacterium
SYTTGTDEGGRGPNAW

SEQ ID NO: 964478 - protein, 4 aa, Mycobacterium
SYVG

SEQ ID NO: 964479 - protein, 10 aa, Mycobacterium
SYVKPGSDPI

SEQ ID NO: 964480 - protein, 4 aa, Mycobacterium
TAAA

SEQ ID NO: 964481 - protein, 17 aa, Mycobacterium
TAAAGKLSDELDRGAGS

SEQ ID NO: 964482 - protein, 22 aa, Mycobacterium
TAAATGSADSESPQSNTAVDPP

SEQ ID NO: 964483 - protein, 17 aa, Mycobacterium
TAAATSGSTSPRSSRPM

SEQ ID NO: 964484 - protein, 6 aa, Mycobacterium
TAADEV

SEQ ID NO: 964485 - protein, 11 aa, Mycobacterium
TAADRRGRYPS

SEQ ID NO: 964486 - protein, 13 aa, Mycobacterium
TAAEESLKGTPLE

SEQ ID NO: 964487 - protein, 13 aa, Mycobacterium
TAAGAQSNDGMAD

SEQ ID NO: 964488 - protein, 12 aa, Mycobacterium
TAAGEGHHVPES

SEQ ID NO: 964489 - protein, 12 aa, Mycobacterium
TAAGSQSVDGKA

SEQ ID NO: 964490 - protein, 13 aa, Mycobacterium
TAAHTGHSGDAAW

SEQ ID NO: 964491 - protein, 7 aa, Mycobacterium
TAAPGSV

SEQ ID NO: 964492 - protein, 15 aa, Mycobacterium
TAAPNAFATGRNPRN

SEQ ID NO: 964493 - protein, 20 aa, Mycobacterium
TAAPSTAKRPAKPAKPARSL

SEQ ID NO: 964494 - protein, 4 aa, Mycobacterium
TAAR

SEQ ID NO: 964495 - protein, 4 aa, Mycobacterium
TAAS

SEQ ID NO: 964496 - protein, 16 aa, Mycobacterium
TAASRIAKDTAAESLK

SEQ ID NO: 964497 - protein, 6 aa, Mycobacterium
TAATGG

SEQ ID NO: 964498 - protein, 11 aa, Mycobacterium
TAATKSTPATL

SEQ ID NO: 964499 - protein, 9 aa, Mycobacterium
TAATPLKST

SEQ ID NO: 964500 - protein, 9 aa, Mycobacterium
TADDSGNRA

SEQ ID NO: 964501 - protein, 10 aa, Mycobacterium
TADEGRARDH

SEQ ID NO: 964502 - protein, 9 aa, Mycobacterium
TADGSVSEV

SEQ ID NO: 964503 - protein, 8 aa, Mycobacterium
TADPQSRT

SEQ ID NO: 964504 - protein, 12 aa, Mycobacterium
TADRSQGAPAAA

SEQ ID NO: 964505 - protein, 8 aa, Mycobacterium
TADTATRA

SEQ ID NO: 964506 - protein, 5 aa, Mycobacterium
TAENP

SEQ ID NO: 964507 - protein, 7 aa, Mycobacterium
TAEPAGW

SEQ ID NO: 964508 - protein, 6 aa, Mycobacterium
TAESGA

SEQ ID NO: 964509 - protein, 9 aa, Mycobacterium
TAETSTITD

SEQ ID NO: 964510 - protein, 4 aa, Mycobacterium
TAGA

SEQ ID NO: 964511 - protein, 25 aa, Mycobacterium
TAGAALASAPRTGPPPKVVNPGGGQ

SEQ ID NO: 964512 - protein, 5 aa, Mycobacterium
TAGAS

SEQ ID NO: 964513 - protein, 7 aa, Mycobacterium
TAGATAV

SEQ ID NO: 964514 - protein, 6 aa, Mycobacterium
TAGDAR

SEQ ID NO: 964515 - protein, 6 aa, Mycobacterium
TAGGGA

SEQ ID NO: 964516 - protein, 9 aa, Mycobacterium
TAGGQPSKF

SEQ ID NO: 964517 - protein, 12 aa, Mycobacterium
TAGKSLSDSASG

SEQ ID NO: 964518 - protein, 5 aa, Mycobacterium
TAGLA

SEQ ID NO: 964519 - protein, 10 aa, Mycobacterium
TAGNQVRDAK

SEQ ID NO: 964520 - protein, 6 aa, Mycobacterium
TAGPGV

SEQ ID NO: 964521 - protein, 8 aa, Mycobacterium
TAGPTREE

SEQ ID NO: 964522 - protein, 9 aa, Mycobacterium
TAGQGNYAA

SEQ ID NO: 964523 - protein, 7 aa, Mycobacterium
TAGRGAG

SEQ ID NO: 964524 - protein, 9 aa, Mycobacterium
TAGRGSDYS

SEQ ID NO: 964525 - protein, 7 aa, Mycobacterium
TAGRRAS

SEQ ID NO: 964526 - protein, 11 aa, Mycobacterium
TAGSAATAAAL

SEQ ID NO: 964527 - protein, 5 aa, Mycobacterium
TAGVG

SEQ ID NO: 964528 - protein, 5 aa, Mycobacterium
TAHPG

SEQ ID NO: 964529 - protein, 4 aa, Mycobacterium
TAKA

SEQ ID NO: 964530 - protein, 10 aa, Mycobacterium
TALKPGSNTI

SEQ ID NO: 964531 - protein, 4 aa, Mycobacterium
TALT

SEQ ID NO: 964532 - protein, 11 aa, Mycobacterium
TANGDTAQQPH

SEQ ID NO: 964533 - protein, 15 aa, Mycobacterium
TANQPGQTLPVGAPE

SEQ ID NO: 964534 - protein, 12 aa, Mycobacterium
TAPATDHGYEGA

SEQ ID NO: 964535 - protein, 8 aa, Mycobacterium
TAPEPATE

SEQ ID NO: 964536 - protein, 6 aa, Mycobacterium
TAPGEF

SEQ ID NO: 964537 - protein, 13 aa, Mycobacterium
TAPGPTPNGPPTA

SEQ ID NO: 964538 - protein, 5 aa, Mycobacterium
TAPGV

SEQ ID NO: 964539 - protein, 6 aa, Mycobacterium
TAPLGR

SEQ ID NO: 964540 - protein, 4 aa, Mycobacterium
TAPP

SEQ ID NO: 964541 - protein, 15 aa, Mycobacterium
TAPPPALGDRRSELA

SEQ ID NO: 964542 - protein, 14 aa, Mycobacterium
TAPPPTVDRPASPE

SEQ ID NO: 964543 - protein, 4 aa, Mycobacterium
TAPT

SEQ ID NO: 964544 - protein, 12 aa, Mycobacterium
TAQDATNEETPT

SEQ ID NO: 964545 - protein, 11 aa, Mycobacterium
TAQESADSMDS

SEQ ID NO: 964546 - protein, 5 aa, Mycobacterium
TAQFS

SEQ ID NO: 964547 - protein, 7 aa, Mycobacterium
TAQGTQI

SEQ ID NO: 964548 - protein, 4 aa, Mycobacterium
TAQP

SEQ ID NO: 964549 - protein, 5 aa, Mycobacterium
TAQSV

SEQ ID NO: 964550 - protein, 6 aa, Mycobacterium
TAQTPV

SEQ ID NO: 964551 - protein, 5 aa, Mycobacterium
TARAE

SEQ ID NO: 964552 - protein, 11 aa, Mycobacterium
TARAQGESRGE

SEQ ID NO: 964553 - protein, 12 aa, Mycobacterium
TARGGPAGVGEA

SEQ ID NO: 964554 - protein, 18 aa, Mycobacterium
TARGGTGQLSANPTRPKL

SEQ ID NO: 964555 - protein, 7 aa, Mycobacterium
TARPGTL

SEQ ID NO: 964556 - protein, 6 aa, Mycobacterium
TARRPL

SEQ ID NO: 964557 - protein, 14 aa, Mycobacterium
TARRSSDGLPRPDS

SEQ ID NO: 964558 - protein, 4 aa, Mycobacterium
TART

SEQ ID NO: 964559 - protein, 6 aa, Mycobacterium
TASAST

SEQ ID NO: 964560 - protein, 7 aa, Mycobacterium
TASEGST

SEQ ID NO: 964561 - protein, 13 aa, Mycobacterium
TASGGDPTQLASA

SEQ ID NO: 964562 - protein, 4 aa, Mycobacterium
TAST

SEQ ID NO: 964563 - protein, 9 aa, Mycobacterium
TASTAPAYS

SEQ ID NO: 964564 - protein, 6 aa, Mycobacterium
TASTKD

SEQ ID NO: 964565 - protein, 5 aa, Mycobacterium
TATAE

SEQ ID NO: 964566 - protein, 8 aa, Mycobacterium
TATAGASG

SEQ ID NO: 964567 - protein, 9 aa, Mycobacterium
TATATDQRS

SEQ ID NO: 964568 - protein, 7 aa, Mycobacterium
TATDQRS

SEQ ID NO: 964569 - protein, 13 aa, Mycobacterium
TATGAQSGDGKAA

SEQ ID NO: 964570 - protein, 7 aa, Mycobacterium
TATGGEV

SEQ ID NO: 964571 - protein, 7 aa, Mycobacterium
TATGGNT

SEQ ID NO: 964572 - protein, 5 aa, Mycobacterium
TATGL

SEQ ID NO: 964573 - protein, 16 aa, Mycobacterium
TATHSGLWSPGKIRIG

SEQ ID NO: 964574 - protein, 8 aa, Mycobacterium
TATRQAYG

SEQ ID NO: 964575 - protein, 10 aa, Mycobacterium
TATTPKPNSV

SEQ ID NO: 964576 - protein, 16 aa, Mycobacterium
TAVPRRAEPERTAEEV

SEQ ID NO: 964577 - protein, 4 aa, Mycobacterium
TAVS

SEQ ID NO: 964578 - protein, 4 aa, Mycobacterium
TAVT

SEQ ID NO: 964579 - protein, 4 aa, Mycobacterium
TAWG

SEQ ID NO: 964580 - protein, 9 aa, Mycobacterium
TAYADPESE

SEQ ID NO: 964581 - protein, 8 aa, Mycobacterium
TCRAGGPA

SEQ ID NO: 964582 - protein, 6 aa, Mycobacterium
TDADRR

SEQ ID NO: 964583 - protein, 6 aa, Mycobacterium
TDAGTG

SEQ ID NO: 964584 - protein, 5 aa, Mycobacterium
TDALG

SEQ ID NO: 964585 - protein, 84 aa, Mycobacterium
TDAVSDGETEAAAAASDDEAQPDEAVQTPAAGAEPAEGAADDEATTDSVEDTGEASADSTDPDTDAEADGAKGKAAARPKRLTG

SEQ ID NO: 964586 - protein, 12 aa, Mycobacterium
TDDNDDDPPPEI

SEQ ID NO: 964587 - protein, 8 aa, Mycobacterium
TDDSGMST

SEQ ID NO: 964588 - protein, 14 aa, Mycobacterium
TDELESPSTAAGPC

SEQ ID NO: 964589 - protein, 31 aa, Mycobacterium
TDENPPARENPVTPAEGTTSPGSTPRKRDTT

SEQ ID NO: 964590 - protein, 9 aa, Mycobacterium
TDEPSRVET

SEQ ID NO: 964591 - protein, 14 aa, Mycobacterium
TDEQAAAGKHGGSM

SEQ ID NO: 964592 - protein, 8 aa, Mycobacterium
TDEQPAVA

SEQ ID NO: 964593 - protein, 9 aa, Mycobacterium
TDESTSAAV

SEQ ID NO: 964594 - protein, 6 aa, Mycobacterium
TDFPSE

SEQ ID NO: 964595 - protein, 5 aa, Mycobacterium
TDGAL

SEQ ID NO: 964596 - protein, 9 aa, Mycobacterium
TDGVSRELS

SEQ ID NO: 964597 - protein, 4 aa, Mycobacterium
TDHK

SEQ ID NO: 964598 - protein, 6 aa, Mycobacterium
TDIRDA

SEQ ID NO: 964599 - protein, 12 aa, Mycobacterium
TDKQAEHVLSAH

SEQ ID NO: 964600 - protein, 6 aa, Mycobacterium
TDLPEG

SEQ ID NO: 964601 - protein, 9 aa, Mycobacterium
TDMNEAPDK

SEQ ID NO: 964602 - protein, 17 aa, Mycobacterium
TDNADALTSSGRAKVTT

SEQ ID NO: 964603 - protein, 4 aa, Mycobacterium
TDND

SEQ ID NO: 964604 - protein, 14 aa, Mycobacterium
TDPAANASVSAGDQ

SEQ ID NO: 964605 - protein, 11 aa, Mycobacterium
TDPATAAATGR

SEQ ID NO: 964606 - protein, 8 aa, Mycobacterium
TDPGSRAA

SEQ ID NO: 964607 - protein, 5 aa, Mycobacterium
TDPGV

SEQ ID NO: 964608 - protein, 9 aa, Mycobacterium
TDPHATQRL

SEQ ID NO: 964609 - protein, 5 aa, Mycobacterium
TDPQF

SEQ ID NO: 964610 - protein, 5 aa, Mycobacterium
TDQAQ

SEQ ID NO: 964611 - protein, 4 aa, Mycobacterium
TDQR

SEQ ID NO: 964612 - protein, 5 aa, Mycobacterium
TDQRT

SEQ ID NO: 964613 - protein, 6 aa, Mycobacterium
TDQYRS

SEQ ID NO: 964614 - protein, 10 aa, Mycobacterium
TDRAEEKAEK

SEQ ID NO: 964615 - protein, 7 aa, Mycobacterium
TDRGRGW

SEQ ID NO: 964616 - protein, 7 aa, Mycobacterium
TDRPAFT

SEQ ID NO: 964617 - protein, 6 aa, Mycobacterium
TDRTSV

SEQ ID NO: 964618 - protein, 5 aa, Mycobacterium
TDSAR

SEQ ID NO: 964619 - protein, 14 aa, Mycobacterium
TDSSRARASGGTGL

SEQ ID NO: 964620 - protein, 8 aa, Mycobacterium
TDTASAMG

SEQ ID NO: 964621 - protein, 7 aa, Mycobacterium
TDTDNNR

SEQ ID NO: 964622 - protein, 12 aa, Mycobacterium
TDTGPGIPDDER

SEQ ID NO: 964623 - protein, 4 aa, Mycobacterium
TDTI

SEQ ID NO: 964624 - protein, 21 aa, Mycobacterium
TDTSKLSTPTTGRSTPPVQDE

SEQ ID NO: 964625 - protein, 4 aa, Mycobacterium
TDVA

SEQ ID NO: 964626 - protein, 6 aa, Mycobacterium
TDWPRY

SEQ ID NO: 964627 - protein, 5 aa, Mycobacterium
TEAAI

SEQ ID NO: 964628 - protein, 10 aa, Mycobacterium
TEADNIDPQQ

SEQ ID NO: 964629 - protein, 22 aa, Mycobacterium
TEASEGSAELSGSGSEKATGLP

SEQ ID NO: 964630 - protein, 5 aa, Mycobacterium
TEDIG

SEQ ID NO: 964631 - protein, 9 aa, Mycobacterium
TEDSSPTRV

SEQ ID NO: 964632 - protein, 8 aa, Mycobacterium
TEDTGPIE

SEQ ID NO: 964633 - protein, 6 aa, Mycobacterium
TEDTTK

SEQ ID NO: 964634 - protein, 15 aa, Mycobacterium
TEEDGQYKMSKVEFV

SEQ ID NO: 964635 - protein, 10 aa, Mycobacterium
TEEMPDTPAR

SEQ ID NO: 964636 - protein, 5 aa, Mycobacterium
TEHRS

SEQ ID NO: 964637 - protein, 14 aa, Mycobacterium
TELPTNSKNIGRTE

SEQ ID NO: 964638 - protein, 12 aa, Mycobacterium
TENSEDVAAGRR

SEQ ID NO: 964639 - protein, 12 aa, Mycobacterium
TEPDSGSDAFGG

SEQ ID NO: 964640 - protein, 4 aa, Mycobacterium
TEPF

SEQ ID NO: 964641 - protein, 8 aa, Mycobacterium
TEQRSQNE

SEQ ID NO: 964642 - protein, 7 aa, Mycobacterium
TERDGVE

SEQ ID NO: 964643 - protein, 5 aa, Mycobacterium
TERQV

SEQ ID NO: 964644 - protein, 11 aa, Mycobacterium
TESGRSGKFGA

SEQ ID NO: 964645 - protein, 7 aa, Mycobacterium
TESGSPA

SEQ ID NO: 964646 - protein, 9 aa, Mycobacterium
TESKKSSVE

SEQ ID NO: 964647 - protein, 10 aa, Mycobacterium
TESSKDEARA

SEQ ID NO: 964648 - protein, 11 aa, Mycobacterium
TESVEQRSDQR

SEQ ID NO: 964649 - protein, 7 aa, Mycobacterium
TETADEW

SEQ ID NO: 964650 - protein, 5 aa, Mycobacterium
TETAV

SEQ ID NO: 964651 - protein, 10 aa, Mycobacterium
TETETETETA

SEQ ID NO: 964652 - protein, 15 aa, Mycobacterium
TETRDAAAGEAGTES

SEQ ID NO: 964653 - protein, 17 aa, Mycobacterium
TEVASSPEALHRQSPAV

SEQ ID NO: 964654 - protein, 13 aa, Mycobacterium
TEVSTSNTPTASF

SEQ ID NO: 964655 - protein, 4 aa, Mycobacterium
TGAA

SEQ ID NO: 964656 - protein, 10 aa, Mycobacterium
TGAAGQPGAD

SEQ ID NO: 964657 - protein, 41 aa, Mycobacterium
TGAERRSLTTSSPSSPAAPRTDPLPRQTLDDTDRDRSTPSV

SEQ ID NO: 964658 - protein, 7 aa, Mycobacterium
TGAETEL

SEQ ID NO: 964659 - protein, 4 aa, Mycobacterium
TGAH

SEQ ID NO: 964660 - protein, 55 aa, Mycobacterium
TGAKRPGAKKAPARAEAPSAAAPAQPEPEATPEPEPASKQDGEPTPPAAPAAPVK

SEQ ID NO: 964661 - protein, 7 aa, Mycobacterium
TGAPAKF

SEQ ID NO: 964662 - protein, 9 aa, Mycobacterium
TGAPPPSLR

SEQ ID NO: 964663 - protein, 7 aa, Mycobacterium
TGDEPAS

SEQ ID NO: 964664 - protein, 39 aa, Mycobacterium
TGDFAADDAQNQPVGSDSGVFKGSEGSTASDDCVDPGRP

SEQ ID NO: 964665 - protein, 5 aa, Mycobacterium
TGDGL

SEQ ID NO: 964666 - protein, 4 aa, Mycobacterium
TGDT

SEQ ID NO: 964667 - protein, 6 aa, Mycobacterium
TGEADS

SEQ ID NO: 964668 - protein, 11 aa, Mycobacterium
TGEAETPSGPL

SEQ ID NO: 964669 - protein, 6 aa, Mycobacterium
TGEGRA

SEQ ID NO: 964670 - protein, 14 aa, Mycobacterium
TGENRQYKDTRVEV

SEQ ID NO: 964671 - protein, 15 aa, Mycobacterium
TGESKPVRATADAPV

SEQ ID NO: 964672 - protein, 9 aa, Mycobacterium
TGETAERAR

SEQ ID NO: 964673 - protein, 12 aa, Mycobacterium
TGETSPGVDGGT

SEQ ID NO: 964674 - protein, 7 aa, Mycobacterium
TGFDGED

SEQ ID NO: 964675 - protein, 7 aa, Mycobacterium
TGFSGKL

SEQ ID NO: 964676 - protein, 11 aa, Mycobacterium
TGGAANRGNSL

SEQ ID NO: 964677 - protein, 4 aa, Mycobacterium
TGGG

SEQ ID NO: 964678 - protein, 7 aa, Mycobacterium
TGGGHGV

SEQ ID NO: 964679 - protein, 10 aa, Mycobacterium
TGGGPEGSTE

SEQ ID NO: 964680 - protein, 7 aa, Mycobacterium
TGGPAFG

SEQ ID NO: 964681 - protein, 6 aa, Mycobacterium
TGGPAM

SEQ ID NO: 964682 - protein, 7 aa, Mycobacterium
TGGRTAQ

SEQ ID NO: 964683 - protein, 5 aa, Mycobacterium
TGGSV

SEQ ID NO: 964684 - protein, 5 aa, Mycobacterium
TGGVV

SEQ ID NO: 964685 - protein, 4 aa, Mycobacterium
TGGW

SEQ ID NO: 964686 - protein, 9 aa, Mycobacterium
TGHHSEGMA

SEQ ID NO: 964687 - protein, 8 aa, Mycobacterium
TGHSSGVA

SEQ ID NO: 964688 - protein, 4 aa, Mycobacterium
TGKA

SEQ ID NO: 964689 - protein, 22 aa, Mycobacterium
TGKGGALSSGKFAPDLGPANEQ

SEQ ID NO: 964690 - protein, 11 aa, Mycobacterium
TGLGDGPPYAK

SEQ ID NO: 964691 - protein, 14 aa, Mycobacterium
TGMGAAAAKSAAEL

SEQ ID NO: 964692 - protein, 7 aa, Mycobacterium
TGNYERA

SEQ ID NO: 964693 - protein, 6 aa, Mycobacterium
TGPAAL

SEQ ID NO: 964694 - protein, 5 aa, Mycobacterium
TGPAP

SEQ ID NO: 964695 - protein, 8 aa, Mycobacterium
TGPAPDGL

SEQ ID NO: 964696 - protein, 8 aa, Mycobacterium
TGPDANSA

SEQ ID NO: 964697 - protein, 14 aa, Mycobacterium
TGPDTADQTVPDDK

SEQ ID NO: 964698 - protein, 19 aa, Mycobacterium
TGPGALGADQDTSGNSSLQ

SEQ ID NO: 964699 - protein, 5 aa, Mycobacterium
TGPLP

SEQ ID NO: 964700 - protein, 8 aa, Mycobacterium
TGPTPPGL

SEQ ID NO: 964701 - protein, 23 aa, Mycobacterium
TGPVAADGQPGPGALSTDRGSLP

SEQ ID NO: 964702 - protein, 9 aa, Mycobacterium
TGQANDDNI

SEQ ID NO: 964703 - protein, 8 aa, Mycobacterium
TGQFGTPL

SEQ ID NO: 964704 - protein, 7 aa, Mycobacterium
TGRAECG

SEQ ID NO: 964705 - protein, 6 aa, Mycobacterium
TGRGAD

SEQ ID NO: 964706 - protein, 4 aa, Mycobacterium
TGRL

SEQ ID NO: 964707 - protein, 5 aa, Mycobacterium
TGRPN

SEQ ID NO: 964708 - protein, 5 aa, Mycobacterium
TGSAA

SEQ ID NO: 964709 - protein, 8 aa, Mycobacterium
TGSGKSQT

SEQ ID NO: 964710 - protein, 4 aa, Mycobacterium
TGSP

SEQ ID NO: 964711 - protein, 24 aa, Mycobacterium
TGSPAAPQADPEAAQPVEPAKPPA

SEQ ID NO: 964712 - protein, 7 aa, Mycobacterium
TGSPLDP

SEQ ID NO: 964713 - protein, 6 aa, Mycobacterium
TGSPRL

SEQ ID NO: 964714 - protein, 7 aa, Mycobacterium
TGSSEQQ

SEQ ID NO: 964715 - protein, 8 aa, Mycobacterium
TGSTLATG

SEQ ID NO: 964716 - protein, 5 aa, Mycobacterium
TGTGE

SEQ ID NO: 964717 - protein, 9 aa, Mycobacterium
TGTGYAPDG

SEQ ID NO: 964718 - protein, 6 aa, Mycobacterium
TGTLTR

SEQ ID NO: 964719 - protein, 8 aa, Mycobacterium
TGTLTSGQ

SEQ ID NO: 964720 - protein, 7 aa, Mycobacterium
TGTVTTG

SEQ ID NO: 964721 - protein, 13 aa, Mycobacterium
TGVAKGGSYATTS

SEQ ID NO: 964722 - protein, 12 aa, Mycobacterium
TGVGSAKGAALL

SEQ ID NO: 964723 - protein, 4 aa, Mycobacterium
TGWP

SEQ ID NO: 964724 - protein, 12 aa, Mycobacterium
TGYGGPPGHPGR

SEQ ID NO: 964725 - protein, 13 aa, Mycobacterium
TGYPDTVSEPLDA

SEQ ID NO: 964726 - protein, 21 aa, Mycobacterium
THAASPPAVTASPGAAATSVL

SEQ ID NO: 964727 - protein, 13 aa, Mycobacterium
THASSQRTDEPVE

SEQ ID NO: 964728 - protein, 4 aa, Mycobacterium
THDP

SEQ ID NO: 964729 - protein, 6 aa, Mycobacterium
THEPAG

SEQ ID NO: 964730 - protein, 4 aa, Mycobacterium
THEQ

SEQ ID NO: 964731 - protein, 6 aa, Mycobacterium
THGNNQ

SEQ ID NO: 964732 - protein, 8 aa, Mycobacterium
THIPEDSR

SEQ ID NO: 964733 - protein, 8 aa, Mycobacterium
THPTNGTV

SEQ ID NO: 964734 - protein, 7 aa, Mycobacterium
TIAETNN

SEQ ID NO: 964735 - protein, 9 aa, Mycobacterium
TIDGSTGEF

SEQ ID NO: 964736 - protein, 20 aa, Mycobacterium
TIDGSTGRRGPARSSYADPK

SEQ ID NO: 964737 - protein, 10 aa, Mycobacterium
TIDNGGPALD

SEQ ID NO: 964738 - protein, 19 aa, Mycobacterium
TIPDEASCSGSCAGCTLSC

SEQ ID NO: 964739 - protein, 6 aa, Mycobacterium
TIPPGA

SEQ ID NO: 964740 - protein, 13 aa, Mycobacterium
TIPRTSSGKIGRR

SEQ ID NO: 964741 - protein, 5 aa, Mycobacterium
TIPSG

SEQ ID NO: 964742 - protein, 14 aa, Mycobacterium
TIPTTEKPPPPQTV

SEQ ID NO: 964743 - protein, 10 aa, Mycobacterium
TISAAANRTL

SEQ ID NO: 964744 - protein, 10 aa, Mycobacterium
TISASASRTV

SEQ ID NO: 964745 - protein, 7 aa, Mycobacterium
TISTSPW

SEQ ID NO: 964746 - protein, 4 aa, Mycobacterium
TKAK

SEQ ID NO: 964747 - protein, 7 aa, Mycobacterium
TKASITA

SEQ ID NO: 964748 - protein, 5 aa, Mycobacterium
TKATA

SEQ ID NO: 964749 - protein, 8 aa, Mycobacterium
TKEFTTTP

SEQ ID NO: 964750 - protein, 8 aa, Mycobacterium
TKHTADSV

SEQ ID NO: 964751 - protein, 9 aa, Mycobacterium
TKIDRAQTP

SEQ ID NO: 964752 - protein, 8 aa, Mycobacterium
TKKQSIAS

SEQ ID NO: 964753 - protein, 15 aa, Mycobacterium
TKPFTQPVTAGPGGA

SEQ ID NO: 964754 - protein, 7 aa, Mycobacterium
TKPSLSI

SEQ ID NO: 964755 - protein, 10 aa, Mycobacterium
TKPSSDESVE

SEQ ID NO: 964756 - protein, 6 aa, Mycobacterium
TKQAYH

SEQ ID NO: 964757 - protein, 9 aa, Mycobacterium
TKSAVPKRI

SEQ ID NO: 964758 - protein, 9 aa, Mycobacterium
TKTGPAAAT

SEQ ID NO: 964759 - protein, 7 aa, Mycobacterium
TKTLESA

SEQ ID NO: 964760 - protein, 25 aa, Mycobacterium
TKVEKRDPNATLPAGGPPQSGPTGV

SEQ ID NO: 964761 - protein, 8 aa, Mycobacterium
TLAGGDLP

SEQ ID NO: 964762 - protein, 6 aa, Mycobacterium
TLAPGQ

SEQ ID NO: 964763 - protein, 9 aa, Mycobacterium
TLAPSTPTM

SEQ ID NO: 964764 - protein, 13 aa, Mycobacterium
TLAPYQPQSMTGT

SEQ ID NO: 964765 - protein, 4 aa, Mycobacterium
TLAQ

SEQ ID NO: 964766 - protein, 9 aa, Mycobacterium
TLDQESRTR

SEQ ID NO: 964767 - protein, 10 aa, Mycobacterium
TLDSAVDDDE

SEQ ID NO: 964768 - protein, 26 aa, Mycobacterium
TLEQNAAARGVTVDPSGLPPQALTPD

SEQ ID NO: 964769 - protein, 14 aa, Mycobacterium
TLGADSGDAQSGSI

SEQ ID NO: 964770 - protein, 11 aa, Mycobacterium
TLGDGGQPTVD

SEQ ID NO: 964771 - protein, 11 aa, Mycobacterium
TLGGEAKTPKA

SEQ ID NO: 964772 - protein, 6 aa, Mycobacterium
TLGGPL

SEQ ID NO: 964773 - protein, 7 aa, Mycobacterium
TLGTTSE

SEQ ID NO: 964774 - protein, 8 aa, Mycobacterium
TLNTRDEA

SEQ ID NO: 964775 - protein, 5 aa, Mycobacterium
TLPDG

SEQ ID NO: 964776 - protein, 9 aa, Mycobacterium
TLPETAKGY

SEQ ID NO: 964777 - protein, 30 aa, Mycobacterium
TLPPPPPPVGVGPEPGPQPQASGPAYTTYD

SEQ ID NO: 964778 - protein, 5 aa, Mycobacterium
TLPSV

SEQ ID NO: 964779 - protein, 10 aa, Mycobacterium
TLSDAPPNTC

SEQ ID NO: 964780 - protein, 6 aa, Mycobacterium
TLSNGG

SEQ ID NO: 964781 - protein, 7 aa, Mycobacterium
TLSPARA

SEQ ID NO: 964782 - protein, 8 aa, Mycobacterium
TLSPGTTV

SEQ ID NO: 964783 - protein, 10 aa, Mycobacterium
TLSRPDGAND

SEQ ID NO: 964784 - protein, 13 aa, Mycobacterium
TLSTNGNAQEPAG

SEQ ID NO: 964785 - protein, 7 aa, Mycobacterium
TLTGQPE

SEQ ID NO: 964786 - protein, 11 aa, Mycobacterium
TLTRPADTTQE

SEQ ID NO: 964787 - protein, 17 aa, Mycobacterium
TLTSKTDPASGAGQAGA

SEQ ID NO: 964788 - protein, 8 aa, Mycobacterium
TMAPGTSM

SEQ ID NO: 964789 - protein, 5 aa, Mycobacterium
TMGSS

SEQ ID NO: 964790 - protein, 12 aa, Mycobacterium
TMPDANPQDDIR

SEQ ID NO: 964791 - protein, 26 aa, Mycobacterium
TMRAADRSARRDHANGRSEGTEWSSE

SEQ ID NO: 964792 - protein, 9 aa, Mycobacterium
TMSPQDAPA

SEQ ID NO: 964793 - protein, 10 aa, Mycobacterium
TNAARPDPLV

SEQ ID NO: 964794 - protein, 7 aa, Mycobacterium
TNAGVTA

SEQ ID NO: 964795 - protein, 6 aa, Mycobacterium
TNALPA

SEQ ID NO: 964796 - protein, 8 aa, Mycobacterium
TNATSEAV

SEQ ID NO: 964797 - protein, 6 aa, Mycobacterium
TNCSSR

SEQ ID NO: 964798 - protein, 8 aa, Mycobacterium
TNDDSAAF

SEQ ID NO: 964799 - protein, 5 aa, Mycobacterium
TNDPD

SEQ ID NO: 964800 - protein, 7 aa, Mycobacterium
TNECGQQ

SEQ ID NO: 964801 - protein, 4 aa, Mycobacterium
TNFS

SEQ ID NO: 964802 - protein, 8 aa, Mycobacterium
TNGRSARY

SEQ ID NO: 964803 - protein, 8 aa, Mycobacterium
TNGSGPEL

SEQ ID NO: 964804 - protein, 20 aa, Mycobacterium
TNGTNSSGTLSEGAAKTAIQ

SEQ ID NO: 964805 - protein, 4 aa, Mycobacterium
TNGV

SEQ ID NO: 964806 - protein, 9 aa, Mycobacterium
TNNQPVTDQ

SEQ ID NO: 964807 - protein, 6 aa, Mycobacterium
TNPAAL

SEQ ID NO: 964808 - protein, 7 aa, Mycobacterium
TNPDLAG

SEQ ID NO: 964809 - protein, 5 aa, Mycobacterium
TNPEH

SEQ ID NO: 964810 - protein, 10 aa, Mycobacterium
TNPPAGTTVP

SEQ ID NO: 964811 - protein, 7 aa, Mycobacterium
TNPRSIR

SEQ ID NO: 964812 - protein, 7 aa, Mycobacterium
TNRPAAK

SEQ ID NO: 964813 - protein, 10 aa, Mycobacterium
TNSAGNHHPW

SEQ ID NO: 964814 - protein, 11 aa, Mycobacterium
TNSFSTDPANL

SEQ ID NO: 964815 - protein, 14 aa, Mycobacterium
TNSYGLQQPPRIGA

SEQ ID NO: 964816 - protein, 9 aa, Mycobacterium
TPAADSLDA

SEQ ID NO: 964817 - protein, 7 aa, Mycobacterium
TPADAQA

SEQ ID NO: 964818 - protein, 5 aa, Mycobacterium
TPAEY

SEQ ID NO: 964819 - protein, 7 aa, Mycobacterium
TPALEQD

SEQ ID NO: 964820 - protein, 6 aa, Mycobacterium
TPAPYG

SEQ ID NO: 964821 - protein, 8 aa, Mycobacterium
TPAQLGET

SEQ ID NO: 964822 - protein, 49 aa, Mycobacterium
TPASPAAPPKTATPVPAKAPAQVPAPGPAPAASPVPVAAPPSVVQPPPV

SEQ ID NO: 964823 - protein, 5 aa, Mycobacterium
TPEAT

SEQ ID NO: 964824 - protein, 10 aa, Mycobacterium
TPEDPASARF

SEQ ID NO: 964825 - protein, 10 aa, Mycobacterium
TPENDAPGTV

SEQ ID NO: 964826 - protein, 5 aa, Mycobacterium
TPEPK

SEQ ID NO: 964827 - protein, 8 aa, Mycobacterium
TPEQAEAF

SEQ ID NO: 964828 - protein, 8 aa, Mycobacterium
TPGDGASN

SEQ ID NO: 964829 - protein, 5 aa, Mycobacterium
TPGPI

SEQ ID NO: 964830 - protein, 15 aa, Mycobacterium
TPGPLPKPDVGTTDD

SEQ ID NO: 964831 - protein, 22 aa, Mycobacterium
TPGPPTAVYSPQSGKLVGPDGV

SEQ ID NO: 964832 - protein, 10 aa, Mycobacterium
TPGSYPRGGS

SEQ ID NO: 964833 - protein, 16 aa, Mycobacterium
TPHPQQALPQPASGSA

SEQ ID NO: 964834 - protein, 8 aa, Mycobacterium
TPIAGRAG

SEQ ID NO: 964835 - protein, 5 aa, Mycobacterium
TPITA

SEQ ID NO: 964836 - protein, 15 aa, Mycobacterium
TPKPADGVPPPPLNS

SEQ ID NO: 964837 - protein, 13 aa, Mycobacterium
TPLSNAAHSPGVG

SEQ ID NO: 964838 - protein, 5 aa, Mycobacterium
TPMQG

SEQ ID NO: 964839 - protein, 6 aa, Mycobacterium
TPMTES

SEQ ID NO: 964840 - protein, 11 aa, Mycobacterium
TPNDLADHADA

SEQ ID NO: 964841 - protein, 13 aa, Mycobacterium
TPPAAAPTAHGRR

SEQ ID NO: 964842 - protein, 19 aa, Mycobacterium
TPPAVDSSEVPQAGEPPLP

SEQ ID NO: 964843 - protein, 7 aa, Mycobacterium
TPPDPLG

SEQ ID NO: 964844 - protein, 6 aa, Mycobacterium
TPPGVT

SEQ ID NO: 964845 - protein, 6 aa, Mycobacterium
TPPPDA

SEQ ID NO: 964846 - protein, 5 aa, Mycobacterium
TPPPN

SEQ ID NO: 964847 - protein, 10 aa, Mycobacterium
TPPQPTAIPQ

SEQ ID NO: 964848 - protein, 5 aa, Mycobacterium
TPPVL

SEQ ID NO: 964849 - protein, 14 aa, Mycobacterium
TPQHRAALARFEMQ

SEQ ID NO: 964850 - protein, 4 aa, Mycobacterium
TPQR

SEQ ID NO: 964851 - protein, 5 aa, Mycobacterium
TPQYG

SEQ ID NO: 964852 - protein, 6 aa, Mycobacterium
TPRHRD

SEQ ID NO: 964853 - protein, 11 aa, Mycobacterium
TPRPDASYQDI

SEQ ID NO: 964854 - protein, 6 aa, Mycobacterium
TPRRAG

SEQ ID NO: 964855 - protein, 4 aa, Mycobacterium
TPSA

SEQ ID NO: 964856 - protein, 7 aa, Mycobacterium
TPSDAVG

SEQ ID NO: 964857 - protein, 8 aa, Mycobacterium
TPSGFGPR

SEQ ID NO: 964858 - protein, 7 aa, Mycobacterium
TPSNRSL

SEQ ID NO: 964859 - protein, 6 aa, Mycobacterium
TPSPTP

SEQ ID NO: 964860 - protein, 6 aa, Mycobacterium
TPTARG

SEQ ID NO: 964861 - protein, 16 aa, Mycobacterium
TPTEGQYKISKLDQVA

SEQ ID NO: 964862 - protein, 37 aa, Mycobacterium
TPTHTAATSATTSQITRPDPPRTPGCDDGGVVSMLSD

SEQ ID NO: 964863 - protein, 6 aa, Mycobacterium
TPTPRM

SEQ ID NO: 964864 - protein, 21 aa, Mycobacterium
TPTPRTHAGSGTRARTDARKG

SEQ ID NO: 964865 - protein, 5 aa, Mycobacterium
TPTQS

SEQ ID NO: 964866 - protein, 4 aa, Mycobacterium
TPTR

SEQ ID NO: 964867 - protein, 16 aa, Mycobacterium
TPTSEISPTLEGGRGV

SEQ ID NO: 964868 - protein, 9 aa, Mycobacterium
TPTTTAPIT

SEQ ID NO: 964869 - protein, 6 aa, Mycobacterium
TPTYRD

SEQ ID NO: 964870 - protein, 13 aa, Mycobacterium
TPVGEGGSHGSSG

SEQ ID NO: 964871 - protein, 21 aa, Mycobacterium
TPWERSSRGRRRFRSPIVGGA

SEQ ID NO: 964872 - protein, 19 aa, Mycobacterium
TQADQRIDSLSGGQRKRTS

SEQ ID NO: 964873 - protein, 7 aa, Mycobacterium
TQAPPGI

SEQ ID NO: 964874 - protein, 4 aa, Mycobacterium
TQAR

SEQ ID NO: 964875 - protein, 5 aa, Mycobacterium
TQCGK

SEQ ID NO: 964876 - protein, 14 aa, Mycobacterium
TQGEALANESVTAV

SEQ ID NO: 964877 - protein, 5 aa, Mycobacterium
TQGEL

SEQ ID NO: 964878 - protein, 5 aa, Mycobacterium
TQITK

SEQ ID NO: 964879 - protein, 11 aa, Mycobacterium
TQNIDTPTQLG

SEQ ID NO: 964880 - protein, 4 aa, Mycobacterium
TQPL

SEQ ID NO: 964881 - protein, 6 aa, Mycobacterium
TQPMPG

SEQ ID NO: 964882 - protein, 6 aa, Mycobacterium
TQQGLQ

SEQ ID NO: 964883 - protein, 9 aa, Mycobacterium
TQRADASLP

SEQ ID NO: 964884 - protein, 9 aa, Mycobacterium
TQTAERDQN

SEQ ID NO: 964885 - protein, 8 aa, Mycobacterium
TQVATGSV

SEQ ID NO: 964886 - protein, 10 aa, Mycobacterium
TRADARTAVG

SEQ ID NO: 964887 - protein, 9 aa, Mycobacterium
TRAGGAPLR

SEQ ID NO: 964888 - protein, 11 aa, Mycobacterium
TRAGRSAFSPD

SEQ ID NO: 964889 - protein, 4 aa, Mycobacterium
TRAR

SEQ ID NO: 964890 - protein, 6 aa, Mycobacterium
TRARRA

SEQ ID NO: 964891 - protein, 6 aa, Mycobacterium
TRASAS

SEQ ID NO: 964892 - protein, 10 aa, Mycobacterium
TRASSGLTDE

SEQ ID NO: 964893 - protein, 4 aa, Mycobacterium
TRDL

SEQ ID NO: 964894 - protein, 4 aa, Mycobacterium
TRDS

SEQ ID NO: 964895 - protein, 10 aa, Mycobacterium
TRDTAVDEPD

SEQ ID NO: 964896 - protein, 9 aa, Mycobacterium
TREGAADAG

SEQ ID NO: 964897 - protein, 19 aa, Mycobacterium
TRGADGLQTPSPEAITGGA

SEQ ID NO: 964898 - protein, 7 aa, Mycobacterium
TRGDGGF

SEQ ID NO: 964899 - protein, 5 aa, Mycobacterium
TRGEL

SEQ ID NO: 964900 - protein, 12 aa, Mycobacterium
TRGGKPFTGAGY

SEQ ID NO: 964901 - protein, 15 aa, Mycobacterium
TRGTASALTRRWPSI

SEQ ID NO: 964902 - protein, 12 aa, Mycobacterium
TRGVPDQPLERA

SEQ ID NO: 964903 - protein, 4 aa, Mycobacterium
TRIS

SEQ ID NO: 964904 - protein, 7 aa, Mycobacterium
TRLSGPD

SEQ ID NO: 964905 - protein, 19 aa, Mycobacterium
TRNSTQMGQALDGSKNDDS

SEQ ID NO: 964906 - protein, 12 aa, Mycobacterium
TRPARARPVRPQ

SEQ ID NO: 964907 - protein, 25 aa, Mycobacterium
TRPARTPSSPTAHPEPDRALAMSGE

SEQ ID NO: 964908 - protein, 9 aa, Mycobacterium
TRPDGAPIQ

SEQ ID NO: 964909 - protein, 6 aa, Mycobacterium
TRPDGL

SEQ ID NO: 964910 - protein, 10 aa, Mycobacterium
TRPDGTAQPL

SEQ ID NO: 964911 - protein, 17 aa, Mycobacterium
TRPEINQESPAINLESR

SEQ ID NO: 964912 - protein, 6 aa, Mycobacterium
TRPLAG

SEQ ID NO: 964913 - protein, 5 aa, Mycobacterium
TRPLS

SEQ ID NO: 964914 - protein, 9 aa, Mycobacterium
TRPSGTTMD

SEQ ID NO: 964915 - protein, 5 aa, Mycobacterium
TRPWN

SEQ ID NO: 964916 - protein, 4 aa, Mycobacterium
TRQL

SEQ ID NO: 964917 - protein, 9 aa, Mycobacterium
TRQPNPGGA

SEQ ID NO: 964918 - protein, 13 aa, Mycobacterium
TRQPPDLAGAAER

SEQ ID NO: 964919 - protein, 8 aa, Mycobacterium
TRRGETEY

SEQ ID NO: 964920 - protein, 5 aa, Mycobacterium
TRRHR

SEQ ID NO: 964921 - protein, 12 aa, Mycobacterium
TRRKNEEAMNSA

SEQ ID NO: 964922 - protein, 23 aa, Mycobacterium
TRRPCGERSGYAAPPPRPAPCWR

SEQ ID NO: 964923 - protein, 6 aa, Mycobacterium
TRRQTL

SEQ ID NO: 964924 - protein, 4 aa, Mycobacterium
TRRR

SEQ ID NO: 964925 - protein, 5 aa, Mycobacterium
TRRRA

SEQ ID NO: 964926 - protein, 15 aa, Mycobacterium
TRSAATLPDGPQTDV

SEQ ID NO: 964927 - protein, 5 aa, Mycobacterium
TRSFA

SEQ ID NO: 964928 - protein, 7 aa, Mycobacterium
TRSRGRT

SEQ ID NO: 964929 - protein, 6 aa, Mycobacterium
TRSTND

SEQ ID NO: 964930 - protein, 5 aa, Mycobacterium
TRTGL

SEQ ID NO: 964931 - protein, 6 aa, Mycobacterium
TRTQVT

SEQ ID NO: 964932 - protein, 10 aa, Mycobacterium
TRTTTDVQTI

SEQ ID NO: 964933 - protein, 14 aa, Mycobacterium
TRVANSPRITPPRT

SEQ ID NO: 964934 - protein, 6 aa, Mycobacterium
TRYPAT

SEQ ID NO: 964935 - protein, 4 aa, Mycobacterium
TSAD

SEQ ID NO: 964936 - protein, 9 aa, Mycobacterium
TSADPAKPI

SEQ ID NO: 964937 - protein, 6 aa, Mycobacterium
TSADPL

SEQ ID NO: 964938 - protein, 4 aa, Mycobacterium
TSAF

SEQ ID NO: 964939 - protein, 13 aa, Mycobacterium
TSAGYAATAAEHE

SEQ ID NO: 964940 - protein, 18 aa, Mycobacterium
TSALATGDDGEPTTAART

SEQ ID NO: 964941 - protein, 9 aa, Mycobacterium
TSALDTENE

SEQ ID NO: 964942 - protein, 5 aa, Mycobacterium
TSAPP

SEQ ID NO: 964943 - protein, 8 aa, Mycobacterium
TSAQETNI

SEQ ID NO: 964944 - protein, 10 aa, Mycobacterium
TSARAMPGSG

SEQ ID NO: 964945 - protein, 4 aa, Mycobacterium
TSDD

SEQ ID NO: 964946 - protein, 18 aa, Mycobacterium
TSDGGATEDDRASGGRTA

SEQ ID NO: 964947 - protein, 6 aa, Mycobacterium
TSDGKH

SEQ ID NO: 964948 - protein, 6 aa, Mycobacterium
TSDIDD

SEQ ID NO: 964949 - protein, 10 aa, Mycobacterium
TSDPHELANS

SEQ ID NO: 964950 - protein, 4 aa, Mycobacterium
TSDT

SEQ ID NO: 964951 - protein, 4 aa, Mycobacterium
TSEP

SEQ ID NO: 964952 - protein, 8 aa, Mycobacterium
TSEPGPVV

SEQ ID NO: 964953 - protein, 11 aa, Mycobacterium
TSEQDGQPPLA

SEQ ID NO: 964954 - protein, 6 aa, Mycobacterium
TSERPL

SEQ ID NO: 964955 - protein, 5 aa, Mycobacterium
TSERS

SEQ ID NO: 964956 - protein, 16 aa, Mycobacterium
TSEVTNAAGAKKDPRK

SEQ ID NO: 964957 - protein, 4 aa, Mycobacterium
TSGA

SEQ ID NO: 964958 - protein, 7 aa, Mycobacterium
TSGPDEL

SEQ ID NO: 964959 - protein, 5 aa, Mycobacterium
TSGSL

SEQ ID NO: 964960 - protein, 9 aa, Mycobacterium
TSGSTRTPA

SEQ ID NO: 964961 - protein, 10 aa, Mycobacterium
TSGSTRVPSG

SEQ ID NO: 964962 - protein, 7 aa, Mycobacterium
TSGTARV

SEQ ID NO: 964963 - protein, 10 aa, Mycobacterium
TSHATGSAGD

SEQ ID NO: 964964 - protein, 10 aa, Mycobacterium
TSHEPQPPVD

SEQ ID NO: 964965 - protein, 7 aa, Mycobacterium
TSHGDAS

SEQ ID NO: 964966 - protein, 13 aa, Mycobacterium
TSITGQLANGDAV

SEQ ID NO: 964967 - protein, 4 aa, Mycobacterium
TSKL

SEQ ID NO: 964968 - protein, 7 aa, Mycobacterium
TSPADPE

SEQ ID NO: 964969 - protein, 9 aa, Mycobacterium
TSPDGDRAA

SEQ ID NO: 964970 - protein, 7 aa, Mycobacterium
TSPDPEC

SEQ ID NO: 964971 - protein, 11 aa, Mycobacterium
TSPDRDFNRDS

SEQ ID NO: 964972 - protein, 22 aa, Mycobacterium
TSPQSRGEDHSHDDDISSASES

SEQ ID NO: 964973 - protein, 19 aa, Mycobacterium
TSPRTRATFGTTAEEAETT

SEQ ID NO: 964974 - protein, 4 aa, Mycobacterium
TSPY

SEQ ID NO: 964975 - protein, 13 aa, Mycobacterium
TSQQSIPDYSRSN

SEQ ID NO: 964976 - protein, 8 aa, Mycobacterium
TSQSGDVE

SEQ ID NO: 964977 - protein, 6 aa, Mycobacterium
TSRADA

SEQ ID NO: 964978 - protein, 4 aa, Mycobacterium
TSRC

SEQ ID NO: 964979 - protein, 13 aa, Mycobacterium
TSRGLSGSGAPLG

SEQ ID NO: 964980 - protein, 15 aa, Mycobacterium
TSRHSKRPGATPART

SEQ ID NO: 964981 - protein, 6 aa, Mycobacterium
TSRTAH

SEQ ID NO: 964982 - protein, 4 aa, Mycobacterium
TSSA

SEQ ID NO: 964983 - protein, 9 aa, Mycobacterium
TSSAAPSVL

SEQ ID NO: 964984 - protein, 8 aa, Mycobacterium
TSSADSAR

SEQ ID NO: 964985 - protein, 5 aa, Mycobacterium
TSSAG

SEQ ID NO: 964986 - protein, 7 aa, Mycobacterium
TSSPDDL

SEQ ID NO: 964987 - protein, 36 aa, Mycobacterium; identical to SEQ ID NO: 291776

SEQ ID NO: 964988 - protein, 29 aa, Mycobacterium
TSSTSESPAGPEDSDAPGSQPAVSNGADS

SEQ ID NO: 964989 - protein, 9 aa, Mycobacterium
TSSVDPGTE

SEQ ID NO: 964990 - protein, 6 aa, Mycobacterium
TSSVPL

SEQ ID NO: 964991 - protein, 7 aa, Mycobacterium
TSTAVPG

SEQ ID NO: 964992 - protein, 9 aa, Mycobacterium
TSTDSAEGV

SEQ ID NO: 964993 - protein, 5 aa, Mycobacterium
TSTHQ

SEQ ID NO: 964994 - protein, 13 aa, Mycobacterium
TSTLGARKGDVYP

SEQ ID NO: 964995 - protein, 8 aa, Mycobacterium
TSTRASGG

SEQ ID NO: 964996 - protein, 6 aa, Mycobacterium
TSTTEA

SEQ ID NO: 964997 - protein, 12 aa, Mycobacterium
TSTVSTETGRAF

SEQ ID NO: 964998 - protein, 41 aa, Mycobacterium; identical to SEQ ID NO: 291838

SEQ ID NO: 964999 - protein, 4 aa, Mycobacterium
TSWQ

SEQ ID NO: 965000 - protein, 9 aa, Mycobacterium
TTAANRDPR

SEQ ID NO: 965001 - protein, 10 aa, Mycobacterium
TTALATSPYS

SEQ ID NO: 965002 - protein, 8 aa, Mycobacterium
TTANEQID

SEQ ID NO: 965003 - protein, 6 aa, Mycobacterium
TTDETD

SEQ ID NO: 965004 - protein, 12 aa, Mycobacterium
TTDHGAGLSSAT

SEQ ID NO: 965005 - protein, 11 aa, Mycobacterium
TTDPGAKPDGV

SEQ ID NO: 965006 - protein, 6 aa, Mycobacterium
TTDQRS

SEQ ID NO: 965007 - protein, 17 aa, Mycobacterium
TTDSVPEPPSDADQLQP

SEQ ID NO: 965008 - protein, 5 aa, Mycobacterium
TTDTA

SEQ ID NO: 965009 - protein, 7 aa, Mycobacterium
TTEPITT

SEQ ID NO: 965010 - protein, 9 aa, Mycobacterium
TTEQESPTE

SEQ ID NO: 965011 - protein, 7 aa, Mycobacterium
TTETDAV

SEQ ID NO: 965012 - protein, 6 aa, Mycobacterium
TTETTV

SEQ ID NO: 965013 - protein, 21 aa, Mycobacterium
TTHDRHAAARAQRERAELDAD

SEQ ID NO: 965014 - protein, 5 aa, Mycobacterium
TTHGH

SEQ ID NO: 965015 - protein, 7 aa, Mycobacterium
TTIPGSA

SEQ ID NO: 965016 - protein, 6 aa, Mycobacterium
TTLSDE

SEQ ID NO: 965017 - protein, 4 aa, Mycobacterium
TTNT

SEQ ID NO: 965018 - protein, 4 aa, Mycobacterium
TTPE

SEQ ID NO: 965019 - protein, 12 aa, Mycobacterium
TTPEHPSNKKLS

SEQ ID NO: 965020 - protein, 15 aa, Mycobacterium
TTPPHREQYSDPDQP

SEQ ID NO: 965021 - protein, 7 aa, Mycobacterium
TTPSNGR

SEQ ID NO: 965022 - protein, 7 aa, Mycobacterium
TTQPPAE

SEQ ID NO: 965023 - protein, 14 aa, Mycobacterium
TTQSADRPEPALTS

SEQ ID NO: 965024 - protein, 8 aa, Mycobacterium
TTQTTQVT

SEQ ID NO: 965025 - protein, 15 aa, Mycobacterium
TTRASIERGIAGEID

SEQ ID NO: 965026 - protein, 4 aa, Mycobacterium
TTRG

SEQ ID NO: 965027 - protein, 7 aa, Mycobacterium
TTRGCDN

SEQ ID NO: 965028 - protein, 4 aa, Mycobacterium
TTRP

SEQ ID NO: 965029 - protein, 5 aa, Mycobacterium
TTRPG

SEQ ID NO: 965030 - protein, 21 aa, Mycobacterium
TTSAPAADDSRNAPGAHFGPD

SEQ ID NO: 965031 - protein, 5 aa, Mycobacterium
TTSPT

SEQ ID NO: 965032 - protein, 9 aa, Mycobacterium
TTSQAPPVR

SEQ ID NO: 965033 - protein, 12 aa, Mycobacterium
TTSQPGPEFSPG

SEQ ID NO: 965034 - protein, 5 aa, Mycobacterium
TTSRI

SEQ ID NO: 965035 - protein, 13 aa, Mycobacterium
TTSTTKPDTPLTR

SEQ ID NO: 965036 - protein, 5 aa, Mycobacterium
TTTEA

SEQ ID NO: 965037 - protein, 6 aa, Mycobacterium
TTTGTG

SEQ ID NO: 965038 - protein, 5 aa, Mycobacterium
TTTTF

SEQ ID NO: 965039 - protein, 6 aa, Mycobacterium
TTTTRG

SEQ ID NO: 965040 - protein, 8 aa, Mycobacterium
TTVAGDGH

SEQ ID NO: 965041 - protein, 9 aa, Mycobacterium
TTVAGDGHD

SEQ ID NO: 965042 - protein, 4 aa, Mycobacterium
TTVG

SEQ ID NO: 965043 - protein, 6 aa, Mycobacterium
TTVSPA

SEQ ID NO: 965044 - protein, 8 aa, Mycobacterium
TVAPGDKA

SEQ ID NO: 965045 - protein, 7 aa, Mycobacterium
TVATGAG

SEQ ID NO: 965046 - protein, 6 aa, Mycobacterium
TVCGES

SEQ ID NO: 965047 - protein, 6 aa, Mycobacterium
TVDPVQ

SEQ ID NO: 965048 - protein, 8 aa, Mycobacterium
TVDRDSLR

SEQ ID NO: 965049 - protein, 6 aa, Mycobacterium
TVEPER

SEQ ID NO: 965050 - protein, 8 aa, Mycobacterium
TVESPANA

SEQ ID NO: 965051 - protein, 17 aa, Mycobacterium
TVGGPAGSGAGPGSPAG

SEQ ID NO: 965052 - protein, 4 aa, Mycobacterium
TVGQ

SEQ ID NO: 965053 - protein, 13 aa, Mycobacterium
TVGSPGQGNYSAA

SEQ ID NO: 965054 - protein, 11 aa, Mycobacterium
TVGTDDEAPGL

SEQ ID NO: 965055 - protein, 12 aa, Mycobacterium
TVGTVTASGRSR

SEQ ID NO: 965056 - protein, 8 aa, Mycobacterium
TVKDDAAD

SEQ ID NO: 965057 - protein, 11 aa, Mycobacterium
TVKPKGDISPE

SEQ ID NO: 965058 - protein, 20 aa, Mycobacterium
TVKPPPPSTETSTATETQTV

SEQ ID NO: 965059 - protein, 4 aa, Mycobacterium
TVNP

SEQ ID NO: 965060 - protein, 5 aa, Mycobacterium
TVNTD

SEQ ID NO: 965061 - protein, 28 aa, Mycobacterium
TVNTESSDDHREQPAPQSAGADAPAPVN

SEQ ID NO: 965062 - protein, 10 aa, Mycobacterium
TVPGGQPPGT

SEQ ID NO: 965063 - protein, 5 aa, Mycobacterium
TVPPD

SEQ ID NO: 965064 - protein, 6 aa, Mycobacterium
TVPVGT

SEQ ID NO: 965065 - protein, 8 aa, Mycobacterium
TVQETDRA

SEQ ID NO: 965066 - protein, 6 aa, Mycobacterium
TVQPGA

SEQ ID NO: 965067 - protein, 9 aa, Mycobacterium
TVRAGGSAM

SEQ ID NO: 965068 - protein, 5 aa, Mycobacterium
TVSDQ

SEQ ID NO: 965069 - protein, 15 aa, Mycobacterium
TVSGAADAPAGAEQQ

SEQ ID NO: 965070 - protein, 18 aa, Mycobacterium
TVSPETTAAGGQLDAAAD

SEQ ID NO: 965071 - protein, 6 aa, Mycobacterium
TVTNRT

SEQ ID NO: 965072 - protein, 11 aa, Mycobacterium
TVTPSESALSL

SEQ ID NO: 965073 - protein, 52 aa, Mycobacterium
TVTPTTPTTTAPSTLTPTTPTTTAPSTLTPSTPTTTAPSTLTPTTPTTTVPS

SEQ ID NO: 965074 - protein, 9 aa, Mycobacterium
TVTTTGGRV

SEQ ID NO: 965075 - protein, 5 aa, Mycobacterium
TWSRP

SEQ ID NO: 965076 - protein, 7 aa, Mycobacterium
TYGPTET

SEQ ID NO: 965077 - protein, 8 aa, Mycobacterium
TYGPTETT

SEQ ID NO: 965078 - protein, 20 aa, Mycobacterium
TYQDQSGSSRTVQVTLGKAE

SEQ ID NO: 965079 - protein, 4 aa, Mycobacterium
VAAA

SEQ ID NO: 965080 - protein, 5 aa, Mycobacterium
VAAAN

SEQ ID NO: 965081 - protein, 13 aa, Mycobacterium
VAAAPQPAPAPPI

SEQ ID NO: 965082 - protein, 9 aa, Mycobacterium
VAAEPESMR

SEQ ID NO: 965083 - protein, 9 aa, Mycobacterium
VAAPAERSV

SEQ ID NO: 965084 - protein, 8 aa, Mycobacterium
VAASTPVR

SEQ ID NO: 965085 - protein, 11 aa, Mycobacterium
VAATADGPAGY

SEQ ID NO: 965086 - protein, 7 aa, Mycobacterium
VADAAQA

SEQ ID NO: 965087 - protein, 6 aa, Mycobacterium
VADSHG

SEQ ID NO: 965088 - protein, 9 aa, Mycobacterium
VAENTSDAQ

SEQ ID NO: 965089 - protein, 12 aa, Mycobacterium
VAEQEPAELVSA

SEQ ID NO: 965090 - protein, 8 aa, Mycobacterium
VAGKDSFP

SEQ ID NO: 965091 - protein, 11 aa, Mycobacterium
VAGKSGDRTAA

SEQ ID NO: 965092 - protein, 6 aa, Mycobacterium
VAGPLR

SEQ ID NO: 965093 - protein, 18 aa, Mycobacterium
VAGPVTGPGQLPGPAAGA

SEQ ID NO: 965094 - protein, 11 aa, Mycobacterium
VAGQPKRFGSS

SEQ ID NO: 965095 - protein, 19 aa, Mycobacterium
VAGRSNPETSTHGSSAQRQ

SEQ ID NO: 965096 - protein, 7 aa, Mycobacterium
VAGTESV

SEQ ID NO: 965097 - protein, 8 aa, Mycobacterium
VAKGDTNT

SEQ ID NO: 965098 - protein, 6 aa, Mycobacterium
VAKQDG

SEQ ID NO: 965099 - protein, 4 aa, Mycobacterium
VANA

SEQ ID NO: 965100 - protein, 8 aa, Mycobacterium
VANPSYTR

SEQ ID NO: 965101 - protein, 47 aa, Mycobacterium; identical to SEQ ID NO: 292580

SEQ ID NO: 965102 - protein, 6 aa, Mycobacterium
VAPDAP

SEQ ID NO: 965103 - protein, 6 aa, Mycobacterium
VAPGVA

SEQ ID NO: 965104 - protein, 11 aa, Mycobacterium
VAPKETPEARR

SEQ ID NO: 965105 - protein, 11 aa, Mycobacterium
VAPPPQRPAET

SEQ ID NO: 965106 - protein, 10 aa, Mycobacterium
VAPSDQGAGP

SEQ ID NO: 965107 - protein, 8 aa, Mycobacterium
VAQPGPLP

SEQ ID NO: 965108 - protein, 10 aa, Mycobacterium
VARETDPGAR

SEQ ID NO: 965109 - protein, 31 aa, Mycobacterium
VARRRGESSPSTFDEEEAEADEEQAARPLSG

SEQ ID NO: 965110 - protein, 4 aa, Mycobacterium
VARS

SEQ ID NO: 965111 - protein, 5 aa, Mycobacterium
VASAA

SEQ ID NO: 965112 - protein, 9 aa, Mycobacterium
VASDATTPG

SEQ ID NO: 965113 - protein, 6 aa, Mycobacterium
VASETV

SEQ ID NO: 965114 - protein, 9 aa, Mycobacterium
VASGLGPPV

SEQ ID NO: 965115 - protein, 18 aa, Mycobacterium
VASPQGAAAAVSPSDPTL

SEQ ID NO: 965116 - protein, 15 aa, Mycobacterium
VATASVPAGAPAIQG

SEQ ID NO: 965117 - protein, 7 aa, Mycobacterium
VATATQA

SEQ ID NO: 965118 - protein, 9 aa, Mycobacterium
VATGPGRLG

SEQ ID NO: 965119 - protein, 8 aa, Mycobacterium
VATNASTI

SEQ ID NO: 965120 - protein, 45 aa, Mycobacterium
VATTAEAVEAEQTEQTEQTEQTEQTEQTEQAEEPDPAASHQTEVA

SEQ ID NO: 965121 - protein, 14 aa, Mycobacterium
VATTGRGAPTGSRR

SEQ ID NO: 965122 - protein, 5 aa, Mycobacterium
VDASR

SEQ ID NO: 965123 - protein, 6 aa, Mycobacterium
VDDPDA

SEQ ID NO: 965124 - protein, 7 aa, Mycobacterium
VDDPDTG

SEQ ID NO: 965125 - protein, 17 aa, Mycobacterium
VDDPDTQLTGAPDGYQQ

SEQ ID NO: 965126 - protein, 7 aa, Mycobacterium
VDDPSSV

SEQ ID NO: 965127 - protein, 9 aa, Mycobacterium
VDESTQDRL

SEQ ID NO: 965128 - protein, 6 aa, Mycobacterium
VDGEEA

SEQ ID NO: 965129 - protein, 10 aa, Mycobacterium
VDGGSRPNHA

SEQ ID NO: 965130 - protein, 7 aa, Mycobacterium
VDGHSTG

SEQ ID NO: 965131 - protein, 12 aa, Mycobacterium
VDGSGDGRAAGV

SEQ ID NO: 965132 - protein, 5 aa, Mycobacterium
VDLSA

SEQ ID NO: 965133 - protein, 4 aa, Mycobacterium
VDNL

SEQ ID NO: 965134 - protein, 8 aa, Mycobacterium
VDNRGDAV

SEQ ID NO: 965135 - protein, 10 aa, Mycobacterium
VDPADSAALP

SEQ ID NO: 965136 - protein, 64 aa, Mycobacterium
VDPGAGGSSTNYSGSGAQPPAPQPVAPPPQYPTGDETVARPVPASTTGWRSRPDVSDQRTQAAP

SEQ ID NO: 965137 - protein, 19 aa, Mycobacterium
VDPGRVDRAGLERAEASAD

SEQ ID NO: 965138 - protein, 8 aa, Mycobacterium
VDPGTPTW

SEQ ID NO: 965139 - protein, 7 aa, Mycobacterium
VDQPTDV

SEQ ID NO: 965140 - protein, 10 aa, Mycobacterium
VDRESRTARA

SEQ ID NO: 965141 - protein, 5 aa, Mycobacterium
VDSGH

SEQ ID NO: 965142 - protein, 13 aa, Mycobacterium
VDSGTCSVHPDTG

SEQ ID NO: 965143 - protein, 5 aa, Mycobacterium
VDSQG

SEQ ID NO: 965144 - protein, 8 aa, Mycobacterium
VDSYDGDV

SEQ ID NO: 965145 - protein, 5 aa, Mycobacterium
VDTNT

SEQ ID NO: 965146 - protein, 5 aa, Mycobacterium
VDTSG

SEQ ID NO: 965147 - protein, 7 aa, Mycobacterium
VDTSQRG

SEQ ID NO: 965148 - protein, 10 aa, Mycobacterium
VEADREHPTK

SEQ ID NO: 965149 - protein, 6 aa, Mycobacterium
VEANTS

SEQ ID NO: 965150 - protein, 7 aa, Mycobacterium
VEAPEAQ

SEQ ID NO: 965151 - protein, 5 aa, Mycobacterium
VEDGS

SEQ ID NO: 965152 - protein, 10 aa, Mycobacterium
VEDTKEAREA

SEQ ID NO: 965153 - protein, 15 aa, Mycobacterium
VEEAEAEAEAEEEGI

SEQ ID NO: 965154 - protein, 6 aa, Mycobacterium
VEEGRG

SEQ ID NO: 965155 - protein, 10 aa, Mycobacterium
VEETQNESRG

SEQ ID NO: 965156 - protein, 6 aa, Mycobacterium
VEETQV

SEQ ID NO: 965157 - protein, 12 aa, Mycobacterium
VEEVASQGSGVV

SEQ ID NO: 965158 - protein, 5 aa, Mycobacterium
VEGAQ

SEQ ID NO: 965159 - protein, 8 aa, Mycobacterium
VEGEPATI

SEQ ID NO: 965160 - protein, 7 aa, Mycobacterium
VEGESCG

SEQ ID NO: 965161 - protein, 26 aa, Mycobacterium
VEGGLKEGEASAPARPPGSKSRKGRA

SEQ ID NO: 965162 - protein, 9 aa, Mycobacterium
VEGQPPGPR

SEQ ID NO: 965163 - protein, 7 aa, Mycobacterium
VEGTDAA

SEQ ID NO: 965164 - protein, 7 aa, Mycobacterium
VENAARA

SEQ ID NO: 965165 - protein, 9 aa, Mycobacterium
VENSKKADV

SEQ ID NO: 965166 - protein, 5 aa, Mycobacterium
VEPDN

SEQ ID NO: 965167 - protein, 60 aa, Mycobacterium
VEPEGESGQAGVPEAQPRDEDQDETADETQEDADADPEAGEDDAQASDGEQESPKPAPSK

SEQ ID NO: 965168 - protein, 23 aa, Mycobacterium
VEPPDDLPGCREPADADEEATAE

SEQ ID NO: 965169 - protein, 10 aa, Mycobacterium
VEQGDSGGPL

SEQ ID NO: 965170 - protein, 16 aa, Mycobacterium
VEQGRGISASDDGLAR

SEQ ID NO: 965171 - protein, 6 aa, Mycobacterium
VEQGTH

SEQ ID NO: 965172 - protein, 9 aa, Mycobacterium
VESGSEHPI

SEQ ID NO: 965173 - protein, 55 aa, Mycobacterium
VESPPPAEVTQPAEASQQAEPNQQGESNQPETADPAAKPPATRRPTSTTDAYADS

SEQ ID NO: 965174 - protein, 16 aa, Mycobacterium
VESSPTVERHEQDRAA

SEQ ID NO: 965175 - protein, 7 aa, Mycobacterium
VESTPAT

SEQ ID NO: 965176 - protein, 8 aa, Mycobacterium
VESTRDPK

SEQ ID NO: 965177 - protein, 7 aa, Mycobacterium
VETSAGV

SEQ ID NO: 965178 - protein, 18 aa, Mycobacterium
VEVGPGDTVTGATTNAGG

SEQ ID NO: 965179 - protein, 7 aa, Mycobacterium
VFEPGDS

SEQ ID NO: 965180 - protein, 15 aa, Mycobacterium
VFSPDGEADNPGQAD

SEQ ID NO: 965181 - protein, 8 aa, Mycobacterium
VGAGATAE

SEQ ID NO: 965182 - protein, 8 aa, Mycobacterium
VGAGATAQ

SEQ ID NO: 965183 - protein, 8 aa, Mycobacterium
VGAGGGRV

SEQ ID NO: 965184 - protein, 6 aa, Mycobacterium
VGAGTH

SEQ ID NO: 965185 - protein, 9 aa, Mycobacterium
VGANGTATS

SEQ ID NO: 965186 - protein, 6 aa, Mycobacterium
VGARGQ

SEQ ID NO: 965187 - protein, 9 aa, Mycobacterium
VGASPGSVV

SEQ ID NO: 965188 - protein, 11 aa, Mycobacterium
VGATSLAGAAS

SEQ ID NO: 965189 - protein, 6 aa, Mycobacterium
VGDAEY

SEQ ID NO: 965190 - protein, 12 aa, Mycobacterium
VGDASQTSDRPD

SEQ ID NO: 965191 - protein, 13 aa, Mycobacterium
VGDEAKVANVEFV

SEQ ID NO: 965192 - protein, 7 aa, Mycobacterium
VGDEGIR

SEQ ID NO: 965193 - protein, 11 aa, Mycobacterium
VGDGLPKRSDV

SEQ ID NO: 965194 - protein, 7 aa, Mycobacterium
VGDQPAV

SEQ ID NO: 965195 - protein, 19 aa, Mycobacterium
VGDSGAQAAWGSIASALGP

SEQ ID NO: 965196 - protein, 5 aa, Mycobacterium
VGEHT

SEQ ID NO: 965197 - protein, 6 aa, Mycobacterium
VGGAPF

SEQ ID NO: 965198 - protein, 4 aa, Mycobacterium
VGGG

SEQ ID NO: 965199 - protein, 6 aa, Mycobacterium
VGGGGW

SEQ ID NO: 965200 - protein, 12 aa, Mycobacterium
VGGGPAGVGNAV

SEQ ID NO: 965201 - protein, 11 aa, Mycobacterium
VGGGPAGVGRA

SEQ ID NO: 965202 - protein, 8 aa, Mycobacterium
VGGGSAAS

SEQ ID NO: 965203 - protein, 5 aa, Mycobacterium
VGGND

SEQ ID NO: 965204 - protein, 7 aa, Mycobacterium
VGGNGDA

SEQ ID NO: 965205 - protein, 5 aa, Mycobacterium
VGGVP

SEQ ID NO: 965206 - protein, 10 aa, Mycobacterium
VGKGEDPRYT

SEQ ID NO: 965207 - protein, 10 aa, Mycobacterium
VGKSPAQVAT

SEQ ID NO: 965208 - protein, 11 aa, Mycobacterium
VGKSPDSIDES

SEQ ID NO: 965209 - protein, 6 aa, Mycobacterium
VGLGGD

SEQ ID NO: 965210 - protein, 5 aa, Mycobacterium
VGNAV

SEQ ID NO: 965211 - protein, 14 aa, Mycobacterium
VGNPYPDATVGNPY

SEQ ID NO: 965212 - protein, 6 aa, Mycobacterium
VGNQTT

SEQ ID NO: 965213 - protein, 12 aa, Mycobacterium
VGPALSPGTAFG

SEQ ID NO: 965214 - protein, 8 aa, Mycobacterium
VGPAPLTA

SEQ ID NO: 965215 - protein, 6 aa, Mycobacterium
VGPPTT

SEQ ID NO: 965216 - protein, 4 aa, Mycobacterium
VGPS

SEQ ID NO: 965217 - protein, 10 aa, Mycobacterium
VGPSEGSKAR

SEQ ID NO: 965218 - protein, 10 aa, Mycobacterium
VGPSGSGKST

SEQ ID NO: 965219 - protein, 5 aa, Mycobacterium
VGPSQ

SEQ ID NO: 965220 - protein, 6 aa, Mycobacterium
VGPTPR

SEQ ID NO: 965221 - protein, 17 aa, Mycobacterium
VGPTQVDRDAGDDAETA

SEQ ID NO: 965222 - protein, 8 aa, Mycobacterium
VGQPDEGV

SEQ ID NO: 965223 - protein, 7 aa, Mycobacterium
VGQTATA

SEQ ID NO: 965224 - protein, 7 aa, Mycobacterium
VGRGTEI

SEQ ID NO: 965225 - protein, 6 aa, Mycobacterium
VGRPRK

SEQ ID NO: 965226 - protein, 19 aa, Mycobacterium
VGRQRGAGLGGGHDEREQT

SEQ ID NO: 965227 - protein, 8 aa, Mycobacterium
VGSETERI

SEQ ID NO: 965228 - protein, 10 aa, Mycobacterium
VGSKGTAKVT

SEQ ID NO: 965229 - protein, 9 aa, Mycobacterium
VGSPDAKTL

SEQ ID NO: 965230 - protein, 5 aa, Mycobacterium
VGSPE

SEQ ID NO: 965231 - protein, 10 aa, Mycobacterium
VGSTGSGKST

SEQ ID NO: 965232 - protein, 10 aa, Mycobacterium
VGTAEQGGVI

SEQ ID NO: 965233 - protein, 9 aa, Mycobacterium
VGTATGPTL

SEQ ID NO: 965234 - protein, 7 aa, Mycobacterium
VGTDNEQ

SEQ ID NO: 965235 - protein, 19 aa, Mycobacterium
VGTPSKLSFPSAHATSTAA

SEQ ID NO: 965236 - protein, 5 aa, Mycobacterium
VGTPT

SEQ ID NO: 965237 - protein, 13 aa, Mycobacterium
VGVDESALTGESL

SEQ ID NO: 965238 - protein, 6 aa, Mycobacterium
VGYGSP

SEQ ID NO: 965239 - protein, 10 aa, Mycobacterium
VHEPADEQLD

SEQ ID NO: 965240 - protein, 11 aa, Mycobacterium
VHRTGPGPMGR

SEQ ID NO: 965241 - protein, 8 aa, Mycobacterium
VHSQTAIG

SEQ ID NO: 965242 - protein, 11 aa, Mycobacterium
VKAGSPAQKAG

SEQ ID NO: 965243 - protein, 6 aa, Mycobacterium
VKAPAG

SEQ ID NO: 965244 - protein, 8 aa, Mycobacterium
VKDSAADA

SEQ ID NO: 965245 - protein, 20 aa, Mycobacterium
VKGGAEGQPTAPTTPGRPSF

SEQ ID NO: 965246 - protein, 12 aa, Mycobacterium
VKGGPKGVGNAV

SEQ ID NO: 965247 - protein, 7 aa, Mycobacterium
VKPPPQY

SEQ ID NO: 965248 - protein, 10 aa, Mycobacterium
VKPPSSPVTS

SEQ ID NO: 965249 - protein, 8 aa, Mycobacterium
VKPTSAAA

SEQ ID NO: 965250 - protein, 6 aa, Mycobacterium
VKRDGA

SEQ ID NO: 965251 - protein, 8 aa, Mycobacterium
VKSNSDIT

SEQ ID NO: 965252 - protein, 10 aa, Mycobacterium
VKVSKKASEW

SEQ ID NO: 965253 - protein, 8 aa, Mycobacterium
VLPPSASA

SEQ ID NO: 965254 - protein, 5 aa, Mycobacterium
VLPRP

SEQ ID NO: 965255 - protein, 10 aa, Mycobacterium
VMERPGDRSF

SEQ ID NO: 965256 - protein, 7 aa, Mycobacterium
VNDAPAM

SEQ ID NO: 965257 - protein, 13 aa, Mycobacterium
VNDRQEEAGRSGV

SEQ ID NO: 965258 - protein, 8 aa, Mycobacterium
VNDRRTSS

SEQ ID NO: 965259 - protein, 6 aa, Mycobacterium
VNEQSD

SEQ ID NO: 965260 - protein, 6 aa, Mycobacterium
VNGPDS

SEQ ID NO: 965261 - protein, 7 aa, Mycobacterium
VNGPTAA

SEQ ID NO: 965262 - protein, 4 aa, Mycobacterium
VNGS

SEQ ID NO: 965263 - protein, 13 aa, Mycobacterium
VNGYTDNSGSEGL

SEQ ID NO: 965264 - protein, 9 aa, Mycobacterium
VNHDGRSNG

SEQ ID NO: 965265 - protein, 9 aa, Mycobacterium
VNLSGGQRQ

SEQ ID NO: 965266 - protein, 9 aa, Mycobacterium
VNPDRGLRK

SEQ ID NO: 965267 - protein, 15 aa, Mycobacterium
VNPDSEEDSGSTDET

SEQ ID NO: 965268 - protein, 6 aa, Mycobacterium
VNPPLD

SEQ ID NO: 965269 - protein, 7 aa, Mycobacterium
VNPQTID

SEQ ID NO: 965270 - protein, 10 aa, Mycobacterium
VNPTTVKSTE

SEQ ID NO: 965271 - protein, 9 aa, Mycobacterium
VNRDSVDAV

SEQ ID NO: 965272 - protein, 9 aa, Mycobacterium
VNSSPGRTE

SEQ ID NO: 965273 - protein, 4 aa, Mycobacterium
VNVT

SEQ ID NO: 965274 - protein, 18 aa, Mycobacterium
VPAAAGSSLGSRVAGTQP

SEQ ID NO: 965275 - protein, 14 aa, Mycobacterium
VPAFQKPKSRNAAT

SEQ ID NO: 965276 - protein, 7 aa, Mycobacterium
VPAGPAG

SEQ ID NO: 965277 - protein, 5 aa, Mycobacterium
VPAQV

SEQ ID NO: 965278 - protein, 18 aa, Mycobacterium
VPDDGAAATFPGAPGPVG

SEQ ID NO: 965279 - protein, 6 aa, Mycobacterium
VPDSAT

SEQ ID NO: 965280 - protein, 11 aa, Mycobacterium
VPDSRDPRGRR

SEQ ID NO: 965281 - protein, 6 aa, Mycobacterium
VPEAGP

SEQ ID NO: 965282 - protein, 5 aa, Mycobacterium
VPEAQ

SEQ ID NO: 965283 - protein, 9 aa, Mycobacterium
VPEEQHERR

SEQ ID NO: 965284 - protein, 11 aa, Mycobacterium
VPEPAPAPPVP

SEQ ID NO: 965285 - protein, 26 aa, Mycobacterium
VPEPARGGDTFGASAGSDRRDCSNDT

SEQ ID NO: 965286 - protein, 8 aa, Mycobacterium
VPEPEAGH

SEQ ID NO: 965287 - protein, 4 aa, Mycobacterium
VPES

SEQ ID NO: 965288 - protein, 36 aa, Mycobacterium
VPGAADSDEPTQDEADRPPASDRGLPPDQPAQHTAA

SEQ ID NO: 965289 - protein, 5 aa, Mycobacterium
VPGAT

SEQ ID NO: 965290 - protein, 7 aa, Mycobacterium
VPGDTGF

SEQ ID NO: 965291 - protein, 8 aa, Mycobacterium
VPGETEVS

SEQ ID NO: 965292 - protein, 61 aa, Mycobacterium
VPGETPADTSVVAPGSPAAAGVAAPGPAKLAAPGDATNPGSPVVQTSGQPEPVEPAPAGPV

SEQ ID NO: 965293 - protein, 5 aa, Mycobacterium
VPGGF

SEQ ID NO: 965294 - protein, 4 aa, Mycobacterium
VPGH

SEQ ID NO: 965295 - protein, 8 aa, Mycobacterium
VPGKRAPT

SEQ ID NO: 965296 - protein, 7 aa, Mycobacterium
VPGKRSS

SEQ ID NO: 965297 - protein, 5 aa, Mycobacterium
VPGPV

SEQ ID NO: 965298 - protein, 19 aa, Mycobacterium
VPGQHASAADTTESEVHER

SEQ ID NO: 965299 - protein, 9 aa, Mycobacterium
VPGRGSASV

SEQ ID NO: 965300 - protein, 4 aa, Mycobacterium
VPGV

SEQ ID NO: 965301 - protein, 9 aa, Mycobacterium
VPGVPEAPV

SEQ ID NO: 965302 - protein, 13 aa, Mycobacterium
VPNGQARQAAEEL

SEQ ID NO: 965303 - protein, 9 aa, Mycobacterium
VPPDRDADF

SEQ ID NO: 965304 - protein, 7 aa, Mycobacterium
VPPDSTI

SEQ ID NO: 965305 - protein, 7 aa, Mycobacterium
VPPEGNR

SEQ ID NO: 965306 - protein, 15 aa, Mycobacterium
VPPLDERDVQPGRGP

SEQ ID NO: 965307 - protein, 82 aa, Mycobacterium; identical to SEQ ID NO: 293944

SEQ ID NO: 965308 - protein, 8 aa, Mycobacterium
VPPPGPAI

SEQ ID NO: 965309 - protein, 7 aa, Mycobacterium
VPPPPGI

SEQ ID NO: 965310 - protein, 8 aa, Mycobacterium
VPPPSPGT

SEQ ID NO: 965311 - protein, 82 aa, Mycobacterium
VPQPTQETVAPPPTQQTVAPQPTIAPQPTQQALEPPSGGSSGGSSGGGSSSGGGSSSGGGSSSGRGSSSGGSSSGGHSSGGG

SEQ ID NO: 965312 - protein, 5 aa, Mycobacterium
VPSAG

SEQ ID NO: 965313 - protein, 7 aa, Mycobacterium
VPSGSGL

SEQ ID NO: 965314 - protein, 8 aa, Mycobacterium
VPSSRDVD

SEQ ID NO: 965315 - protein, 8 aa, Mycobacterium
VPSTGTEV

SEQ ID NO: 965316 - protein, 8 aa, Mycobacterium
VPSTGTNV

SEQ ID NO: 965317 - protein, 8 aa, Mycobacterium
VPTADGKK

SEQ ID NO: 965318 - protein, 7 aa, Mycobacterium
VPTARTI

SEQ ID NO: 965319 - protein, 15 aa, Mycobacterium
VPTEGSAADPQPPID

SEQ ID NO: 965320 - protein, 6 aa, Mycobacterium
VPTGAD

SEQ ID NO: 965321 - protein, 10 aa, Mycobacterium
VPTGPAAPGI

SEQ ID NO: 965322 - protein, 9 aa, Mycobacterium
VPVSGSSYS

SEQ ID NO: 965323 - protein, 11 aa, Mycobacterium
VPVSPSRPLPR

SEQ ID NO: 965324 - protein, 4 aa, Mycobacterium
VQAD

SEQ ID NO: 965325 - protein, 5 aa, Mycobacterium
VQAQP

SEQ ID NO: 965326 - protein, 12 aa, Mycobacterium
VQARASARRDAA

SEQ ID NO: 965327 - protein, 10 aa, Mycobacterium
VQEDGGIRSA

SEQ ID NO: 965328 - protein, 5 aa, Mycobacterium
VQGTG

SEQ ID NO: 965329 - protein, 5 aa, Mycobacterium
VQNTT

SEQ ID NO: 965330 - protein, 9 aa, Mycobacterium
VQPGSTDRP

SEQ ID NO: 965331 - protein, 29 aa, Mycobacterium
VQPPTRPPTTAAGRNQHRQRHQRAGRSNQ

SEQ ID NO: 965332 - protein, 13 aa, Mycobacterium
VQPSGGGRRRRRD

SEQ ID NO: 965333 - protein, 6 aa, Mycobacterium
VQQGPG

SEQ ID NO: 965334 - protein, 7 aa, Mycobacterium
VQQSDRV

SEQ ID NO: 965335 - protein, 7 aa, Mycobacterium
VQRQDAS

SEQ ID NO: 965336 - protein, 6 aa, Mycobacterium
VQRQYP

SEQ ID NO: 965337 - protein, 6 aa, Mycobacterium
VQSGSR

SEQ ID NO: 965338 - protein, 7 aa, Mycobacterium
VQSNPST

SEQ ID NO: 965339 - protein, 5 aa, Mycobacterium
VQSPT

SEQ ID NO: 965340 - protein, 10 aa, Mycobacterium
VQSSLSGSTV

SEQ ID NO: 965341 - protein, 7 aa, Mycobacterium
VQSSNTV

SEQ ID NO: 965342 - protein, 12 aa, Mycobacterium
VQTRDEQPSNAA

SEQ ID NO: 965343 - protein, 6 aa, Mycobacterium
VQVPPA

SEQ ID NO: 965344 - protein, 6 aa, Mycobacterium
VRAAGG

SEQ ID NO: 965345 - protein, 5 aa, Mycobacterium
VRAES

SEQ ID NO: 965346 - protein, 8 aa, Mycobacterium
VRDARDSL

SEQ ID NO: 965347 - protein, 26 aa, Mycobacterium
VRDDLGGYPPVEPRPAAPAKAPEAPV

SEQ ID NO: 965348 - protein, 8 aa, Mycobacterium
VREQTRDL

SEQ ID NO: 965349 - protein, 7 aa, Mycobacterium
VRGEVGG

SEQ ID NO: 965350 - protein, 9 aa, Mycobacterium
VRGQASADA

SEQ ID NO: 965351 - protein, 6 aa, Mycobacterium
VRGSEG

SEQ ID NO: 965352 - protein, 11 aa, Mycobacterium
VRGTTDNPLND

SEQ ID NO: 965353 - protein, 10 aa, Mycobacterium
VRPAPGFTPG

SEQ ID NO: 965354 - protein, 7 aa, Mycobacterium
VRPDARE

SEQ ID NO: 965355 - protein, 20 aa, Mycobacterium
VRPEPGSHVPPIPRAPDQTL

SEQ ID NO: 965356 - protein, 10 aa, Mycobacterium
VRPPPRRPAH

SEQ ID NO: 965357 - protein, 7 aa, Mycobacterium
VRQESTG

SEQ ID NO: 965358 - protein, 10 aa, Mycobacterium
VRRETASANA

SEQ ID NO: 965359 - protein, 5 aa, Mycobacterium
VRRGD

SEQ ID NO: 965360 - protein, 13 aa, Mycobacterium
VRRQSGTRTMSPS

SEQ ID NO: 965361 - protein, 7 aa, Mycobacterium
VRTPAGD

SEQ ID NO: 965362 - protein, 13 aa, Mycobacterium
VRTSTRHRSAPGA

SEQ ID NO: 965363 - protein, 8 aa, Mycobacterium
VSAASDGT

SEQ ID NO: 965364 - protein, 9 aa, Mycobacterium
VSAEERRQR

SEQ ID NO: 965365 - protein, 6 aa, Mycobacterium
VSAGQR

SEQ ID NO: 965366 - protein, 14 aa, Mycobacterium
VSANDPNCDSDPCK

SEQ ID NO: 965367 - protein, 11 aa, Mycobacterium
VSARTRRRGEA

SEQ ID NO: 965368 - protein, 7 aa, Mycobacterium
VSASQPR

SEQ ID NO: 965369 - protein, 22 aa, Mycobacterium
VSDAGGRVDSRSERSGASSPTV

SEQ ID NO: 965370 - protein, 15 aa, Mycobacterium
VSDQTSSAGTAGGGG

SEQ ID NO: 965371 - protein, 6 aa, Mycobacterium
VSDRDA

SEQ ID NO: 965372 - protein, 6 aa, Mycobacterium
VSEEQE

SEQ ID NO: 965373 - protein, 11 aa, Mycobacterium
VSEKDTERGFR

SEQ ID NO: 965374 - protein, 6 aa, Mycobacterium
VSEQAS

SEQ ID NO: 965375 - protein, 18 aa, Mycobacterium
VSESERRSLSVSHLLQLL

SEQ ID NO: 965376 - protein, 25 aa, Mycobacterium
VSGDDDQLTLPNTAAGRASAITARK

SEQ ID NO: 965377 - protein, 8 aa, Mycobacterium
VSGGGHAN

SEQ ID NO: 965378 - protein, 17 aa, Mycobacterium
VSGQNQPSTSAAPPHSK

SEQ ID NO: 965379 - protein, 24 aa, Mycobacterium
VSGSSGASPGSSASPAAAAGPDRP

SEQ ID NO: 965380 - protein, 14 aa, Mycobacterium
VSGTATLMRRSRKR

SEQ ID NO: 965381 - protein, 16 aa, Mycobacterium
VSKRTEAAIEDSDGRR

SEQ ID NO: 965382 - protein, 7 aa, Mycobacterium
VSLAGGG

SEQ ID NO: 965383 - protein, 10 aa, Mycobacterium
VSLSPSDAPS

SEQ ID NO: 965384 - protein, 10 aa, Mycobacterium
VSLSPTDAPS

SEQ ID NO: 965385 - protein, 9 aa, Mycobacterium
VSLTPDSNK

SEQ ID NO: 965386 - protein, 13 aa, Mycobacterium
VSNARAPEPRLDR

SEQ ID NO: 965387 - protein, 7 aa, Mycobacterium
VSNSAHE

SEQ ID NO: 965388 - protein, 7 aa, Mycobacterium
VSPEPSN

SEQ ID NO: 965389 - protein, 5 aa, Mycobacterium
VSPPA

SEQ ID NO: 965390 - protein, 23 aa, Mycobacterium
VSPSPPEPAAPGPAAAPRDPNRP

SEQ ID NO: 965391 - protein, 7 aa, Mycobacterium
VSQDRPD

SEQ ID NO: 965392 - protein, 37 aa, Mycobacterium; identical to SEQ ID NO: 294574

SEQ ID NO: 965393 - protein, 6 aa, Mycobacterium
VSRGQG

SEQ ID NO: 965394 - protein, 5 aa, Mycobacterium
VSRTP

SEQ ID NO: 965395 - protein, 11 aa, Mycobacterium
VSSAKDGANQW

SEQ ID NO: 965396 - protein, 5 aa, Mycobacterium
VSSNA

SEQ ID NO: 965397 - protein, 6 aa, Mycobacterium
VSSRAG

SEQ ID NO: 965398 - protein, 31 aa, Mycobacterium; identical to SEQ ID NO: 294636

SEQ ID NO: 965399 - protein, 12 aa, Mycobacterium
VSTGQPGDNENY

SEQ ID NO: 965400 - protein, 7 aa, Mycobacterium
VSTGTET

SEQ ID NO: 965401 - protein, 5 aa, Mycobacterium
VSTQP

SEQ ID NO: 965402 - protein, 18 aa, Mycobacterium
VSTTAAGGLGGRTGAGGK

SEQ ID NO: 965403 - protein, 12 aa, Mycobacterium
VTAAAAAAPGQG

SEQ ID NO: 965404 - protein, 8 aa, Mycobacterium
VTAGQPVT

SEQ ID NO: 965405 - protein, 8 aa, Mycobacterium
VTAPSGTF

SEQ ID NO: 965406 - protein, 11 aa, Mycobacterium
VTDKSRQPLYD

SEQ ID NO: 965407 - protein, 8 aa, Mycobacterium
VTDPPREY

SEQ ID NO: 965408 - protein, 16 aa, Mycobacterium
VTDQSAVLTPAERVVI

SEQ ID NO: 965409 - protein, 23 aa, Mycobacterium
VTDQSWSDPARSGSPPPGYPSGY

SEQ ID NO: 965410 - protein, 12 aa, Mycobacterium
VTDSPTERAREL

SEQ ID NO: 965411 - protein, 5 aa, Mycobacterium
VTEGT

SEQ ID NO: 965412 - protein, 5 aa, Mycobacterium
VTGAG

SEQ ID NO: 965413 - protein, 7 aa, Mycobacterium
VTGKPRD

SEQ ID NO: 965414 - protein, 14 aa, Mycobacterium
VTGNAGQGPDHDFA

SEQ ID NO: 965415 - protein, 8 aa, Mycobacterium
VTGPAGRT

SEQ ID NO: 965416 - protein, 10 aa, Mycobacterium
VTGPSGSGKT

SEQ ID NO: 965417 - protein, 8 aa, Mycobacterium
VTGPTPKP

SEQ ID NO: 965418 - protein, 10 aa, Mycobacterium
VTGQDGQPGY

SEQ ID NO: 965419 - protein, 12 aa, Mycobacterium
VTGRDGRSPHNL

SEQ ID NO: 965420 - protein, 23 aa, Mycobacterium
VTGTEAGTEGGTTAAPGINGSRA

SEQ ID NO: 965421 - protein, 9 aa, Mycobacterium
VTGTKAPGD

SEQ ID NO: 965422 - protein, 24 aa, Mycobacterium
VTGTTSPKPAAAEAVHDTPNIGSV

SEQ ID NO: 965423 - protein, 7 aa, Mycobacterium
VTNQNPF

SEQ ID NO: 965424 - protein, 14 aa, Mycobacterium
VTNTRPEPPDASGL

SEQ ID NO: 965425 - protein, 13 aa, Mycobacterium
VTPAGSGNATTIP

SEQ ID NO: 965426 - protein, 9 aa, Mycobacterium
VTPGAPANR

SEQ ID NO: 965427 - protein, 7 aa, Mycobacterium
VTPGPGL

SEQ ID NO: 965428 - protein, 7 aa, Mycobacterium
VTPGQGV

SEQ ID NO: 965429 - protein, 5 aa, Mycobacterium
VTPHP

SEQ ID NO: 965430 - protein, 18 aa, Mycobacterium
VTPKPGTGPSQKSRERGH

SEQ ID NO: 965431 - protein, 44 aa, Mycobacterium; identical to SEQ ID NO: 294847

SEQ ID NO: 965432 - protein, 6 aa, Mycobacterium
VTQPGD

SEQ ID NO: 965433 - protein, 10 aa, Mycobacterium
VTQPGTQDPK

SEQ ID NO: 965434 - protein, 18 aa, Mycobacterium
VTQRQERAEAFTDGAKTG

SEQ ID NO: 965435 - protein, 8 aa, Mycobacterium
VTRADDQS

SEQ ID NO: 965436 - protein, 6 aa, Mycobacterium
VTSEAN

SEQ ID NO: 965437 - protein, 11 aa, Mycobacterium
VTSKSPDGKQV

SEQ ID NO: 965438 - protein, 4 aa, Mycobacterium
VTSL

SEQ ID NO: 965439 - protein, 20 aa, Mycobacterium
VTSNEDTVETQVNTARDERD

SEQ ID NO: 965440 - protein, 6 aa, Mycobacterium
VTSTGE

SEQ ID NO: 965441 - protein, 9 aa, Mycobacterium
VTTDGEVGG

SEQ ID NO: 965442 - protein, 7 aa, Mycobacterium
VTTPDGV

SEQ ID NO: 965443 - protein, 6 aa, Mycobacterium
VTTSPL

SEQ ID NO: 965444 - protein, 7 aa, Mycobacterium
VTTTSDP

SEQ ID NO: 965445 - protein, 21 aa, Mycobacterium
VTYQSGSPKISKSGSGNVIEQ

SEQ ID NO: 965446 - protein, 10 aa, Mycobacterium
VTYRGSEVGR

SEQ ID NO: 965447 - protein, 10 aa, Mycobacterium
VVPGPAASPL

SEQ ID NO: 965448 - protein, 11 aa, Mycobacterium
VVPPAEHPPRP

SEQ ID NO: 965449 - protein, 5 aa, Mycobacterium
VYSGD

SEQ ID NO: 965450 - protein, 11 aa, Mycobacterium
VYSRDGHSDYG

SEQ ID NO: 965451 - protein, 5 aa, Mycobacterium
WAPLG

SEQ ID NO: 965452 - protein, 10 aa, Mycobacterium
WASGGSVATY

SEQ ID NO: 965453 - protein, 16 aa, Mycobacterium
WATPSPRYLAPLRRFS

SEQ ID NO: 965454 - protein, 10 aa, Mycobacterium
WDQAESQLAE

SEQ ID NO: 965455 - protein, 19 aa, Mycobacterium
WDSNPTHAGLRSAATRGAS

SEQ ID NO: 965456 - protein, 14 aa, Mycobacterium
WDSPQEGREDGLQS

SEQ ID NO: 965457 - protein, 17 aa, Mycobacterium
WEPSTASAAALTAEGTL

SEQ ID NO: 965458 - protein, 9 aa, Mycobacterium
WGESATGAA

SEQ ID NO: 965459 - protein, 4 aa, Mycobacterium
WGHG

SEQ ID NO: 965460 - protein, 5 aa, Mycobacterium
WGPLA

SEQ ID NO: 965461 - protein, 17 aa, Mycobacterium
WGPSTDPAWKRNDPTVN

SEQ ID NO: 965462 - protein, 7 aa, Mycobacterium
WHGPSAA

SEQ ID NO: 965463 - protein, 38 aa, Mycobacterium
WKGDPNSTLSGQDIPQLPPGPPPPAAAGPGEAPPPPIA

SEQ ID NO: 965464 - protein, 38 aa, Mycobacterium; identical to SEQ ID NO: 295094

SEQ ID NO: 965465 - protein, 4 aa, Mycobacterium
WNGR

SEQ ID NO: 965466 - protein, 8 aa, Mycobacterium
WPANLGDK

SEQ ID NO: 965467 - protein, 6 aa, Mycobacterium
WPAPAT

SEQ ID NO: 965468 - protein, 6 aa, Mycobacterium
WPGDTH

SEQ ID NO: 965469 - protein, 8 aa, Mycobacterium
WPKGPAVG

SEQ ID NO: 965470 - protein, 9 aa, Mycobacterium
WPQNGTFSS

SEQ ID NO: 965471 - protein, 11 aa, Mycobacterium
WPQPDDKADWE

SEQ ID NO: 965472 - protein, 16 aa, Mycobacterium
WPRGGGGGPAYGEEMP

SEQ ID NO: 965473 - protein, 45 aa, Mycobacterium; identical to SEQ ID NO: 295160

SEQ ID NO: 965474 - protein, 7 aa, Mycobacterium
WPTESSG

SEQ ID NO: 965475 - protein, 5 aa, Mycobacterium
WPVPG

SEQ ID NO: 965476 - protein, 7 aa, Mycobacterium
WQGPGAE

SEQ ID NO: 965477 - protein, 9 aa, Mycobacterium
WQQPEANEL

SEQ ID NO: 965478 - protein, 8 aa, Mycobacterium
WQSPRSSD

SEQ ID NO: 965479 - protein, 11 aa, Mycobacterium
WRAPSAKNRQP

SEQ ID NO: 965480 - protein, 5 aa, Mycobacterium
WRQAG

SEQ ID NO: 965481 - protein, 20 aa, Mycobacterium
WSDGPDRQDGPDTSHPPEHL

SEQ ID NO: 965482 - protein, 8 aa, Mycobacterium
WSHPDPDA

SEQ ID NO: 965483 - protein, 7 aa, Mycobacterium
WSPDGRP

SEQ ID NO: 965484 - protein, 6 aa, Mycobacterium
WSSDDA

SEQ ID NO: 965485 - protein, 6 aa, Mycobacterium
WTDPTD

SEQ ID NO: 965486 - protein, 11 aa, Mycobacterium
WTHEDKGKLSG

SEQ ID NO: 965487 - protein, 9 aa, Mycobacterium
WTPDTGETI

SEQ ID NO: 965488 - protein, 11 aa, Mycobacterium
YAAGSQQQSKL

SEQ ID NO: 965489 - protein, 14 aa, Mycobacterium
YAATDGDRATSWTA

SEQ ID NO: 965490 - protein, 4 aa, Mycobacterium
YAAY

SEQ ID NO: 965491 - protein, 5 aa, Mycobacterium
YADNP

SEQ ID NO: 965492 - protein, 4 aa, Mycobacterium
YADR

SEQ ID NO: 965493 - protein, 12 aa, Mycobacterium
YAEAQAAADSAK

SEQ ID NO: 965494 - protein, 12 aa, Mycobacterium
YAEAQAASASAK

SEQ ID NO: 965495 - protein, 10 aa, Mycobacterium
YAGDRRRARE

SEQ ID NO: 965496 - protein, 7 aa, Mycobacterium
YDESDRE

SEQ ID NO: 965497 - protein, 4 aa, Mycobacterium
YDPM

SEQ ID NO: 965498 - protein, 14 aa, Mycobacterium
YEGDDGGPQPMPAP

SEQ ID NO: 965499 - protein, 9 aa, Mycobacterium
YEPPQQTKT

SEQ ID NO: 965500 - protein, 8 aa, Mycobacterium
YEPPRSTK

SEQ ID NO: 965501 - protein, 6 aa, Mycobacterium
YEREST

SEQ ID NO: 965502 - protein, 7 aa, Mycobacterium
YESENQR

SEQ ID NO: 965503 - protein, 4 aa, Mycobacterium
YETP

SEQ ID NO: 965504 - protein, 9 aa, Mycobacterium
YGATSGQAL

SEQ ID NO: 965505 - protein, 9 aa, Mycobacterium
YGERPGTEA

SEQ ID NO: 965506 - protein, 12 aa, Mycobacterium
YGESQMNGEGRT

SEQ ID NO: 965507 - protein, 8 aa, Mycobacterium
YGETKAPE

SEQ ID NO: 965508 - protein, 9 aa, Mycobacterium
YGGDNANGF

SEQ ID NO: 965509 - protein, 6 aa, Mycobacterium
YGGQSL

SEQ ID NO: 965510 - protein, 6 aa, Mycobacterium
YGPDKV

SEQ ID NO: 965511 - protein, 6 aa, Mycobacterium
YGPPQR

SEQ ID NO: 965512 - protein, 4 aa, Mycobacterium
YGPR

SEQ ID NO: 965513 - protein, 6 aa, Mycobacterium
YGPRTA

SEQ ID NO: 965514 - protein, 6 aa, Mycobacterium
YGPTEA

SEQ ID NO: 965515 - protein, 9 aa, Mycobacterium
YGQGRPTDQ

SEQ ID NO: 965516 - protein, 6 aa, Mycobacterium
YGRDRT

SEQ ID NO: 965517 - protein, 17 aa, Mycobacterium
YGRPDATDAQVERAARE

SEQ ID NO: 965518 - protein, 11 aa, Mycobacterium
YGRPEASPDDI

SEQ ID NO: 965519 - protein, 8 aa, Mycobacterium
YGSPDPSA

SEQ ID NO: 965520 - protein, 7 aa, Mycobacterium
YGSPRGD

SEQ ID NO: 965521 - protein, 8 aa, Mycobacterium
YGTEHGDP

SEQ ID NO: 965522 - protein, 7 aa, Mycobacterium
YKAGESP

SEQ ID NO: 965523 - protein, 8 aa, Mycobacterium
YKTNYNDR

SEQ ID NO: 965524 - protein, 8 aa, Mycobacterium
YLSTDPDE

SEQ ID NO: 965525 - protein, 12 aa, Mycobacterium
YNGRPSPQPPNV

SEQ ID NO: 965526 - protein, 4 aa, Mycobacterium
YNPA

SEQ ID NO: 965527 - protein, 8 aa, Mycobacterium
YNPETHRA

SEQ ID NO: 965528 - protein, 10 aa, Mycobacterium
YNPSYGPDRQ

SEQ ID NO: 965529 - protein, 27 aa, Mycobacterium
YPASPDKAAKPAKPPRSGKVPTEPAQV

SEQ ID NO: 965530 - protein, 8 aa, Mycobacterium
YPEAEPAR

SEQ ID NO: 965531 - protein, 4 aa, Mycobacterium
YPEL

SEQ ID NO: 965532 - protein, 9 aa, Mycobacterium
YPGAGQDAL

SEQ ID NO: 965533 - protein, 11 aa, Mycobacterium
YPNAGNKAETI

SEQ ID NO: 965534 - protein, 7 aa, Mycobacterium
YPNQPNV

SEQ ID NO: 965535 - protein, 7 aa, Mycobacterium
YPNRAPG

SEQ ID NO: 965536 - protein, 7 aa, Mycobacterium
YPNRPAG

SEQ ID NO: 965537 - protein, 6 aa, Mycobacterium
YPPPRL

SEQ ID NO: 965538 - protein, 5 aa, Mycobacterium
YPTGM

SEQ ID NO: 965539 - protein, 9 aa, Mycobacterium
YPTRDAPAL

SEQ ID NO: 965540 - protein, 20 aa, Mycobacterium
YQAEVQPDDGQGAGDSDAEH

SEQ ID NO: 965541 - protein, 16 aa, Mycobacterium
YQPDPYAATPYQETRA

SEQ ID NO: 965542 - protein, 17 aa, Mycobacterium
YQPDPYAATPYQETRAY

SEQ ID NO: 965543 - protein, 7 aa, Mycobacterium
YQPGRPV

SEQ ID NO: 965544 - protein, 5 aa, Mycobacterium
YQPTA

SEQ ID NO: 965545 - protein, 6 aa, Mycobacterium
YQQSGE

SEQ ID NO: 965546 - protein, 29 aa, Mycobacterium
YQRPTSVNGPTGELPTVTASSAKPDRPEL

SEQ ID NO: 965547 - protein, 11 aa, Mycobacterium
YQTGNDLSANT

SEQ ID NO: 965548 - protein, 5 aa, Mycobacterium
YQTLA

SEQ ID NO: 965549 - protein, 6 aa, Mycobacterium
YQTNYN

SEQ ID NO: 965550 - protein, 14 aa, Mycobacterium
YRDETGSKVHTPEQ

SEQ ID NO: 965551 - protein, 9 aa, Mycobacterium
YRDPEQRPA

SEQ ID NO: 965552 - protein, 26 aa, Mycobacterium
YRENAANRSDGSARGQLHSKGSEGKK

SEQ ID NO: 965553 - protein, 18 aa, Mycobacterium
YRGNDNKMSTEEVDAERA

SEQ ID NO: 965554 - protein, 10 aa, Mycobacterium
YRGSAPGSLT

SEQ ID NO: 965555 - protein, 8 aa, Mycobacterium
YRPSYNDR

SEQ ID NO: 965556 - protein, 5 aa, Mycobacterium
YRQLG

SEQ ID NO: 965557 - protein, 4 aa, Mycobacterium
YRSD

SEQ ID NO: 965558 - protein, 7 aa, Mycobacterium
YRTSSGA

SEQ ID NO: 965559 - protein, 7 aa, Mycobacterium
YSDHPAT

SEQ ID NO: 965560 - protein, 17 aa, Mycobacterium
YSEPRLQPPNGYKDTTV

SEQ ID NO: 965561 - protein, 4 aa, Mycobacterium
YSGD

SEQ ID NO: 965562 - protein, 7 aa, Mycobacterium
YSGGEQR

SEQ ID NO: 965563 - protein, 8 aa, Mycobacterium
YSKPPQSG

SEQ ID NO: 965564 - protein, 8 aa, Mycobacterium
YSPIPPSM

SEQ ID NO: 965565 - protein, 8 aa, Mycobacterium
YSPPTAPV

SEQ ID NO: 965566 - protein, 7 aa, Mycobacterium
YSPQPSA

SEQ ID NO: 965567 - protein, 7 aa, Mycobacterium
YSQAGEN

SEQ ID NO: 965568 - protein, 21 aa, Mycobacterium
YSRGGEKPDGRLYPEDQPDRV

SEQ ID NO: 965569 - protein, 5 aa, Mycobacterium
YSTSD

SEQ ID NO: 965570 - protein, 9 aa, Mycobacterium
YTAQESTKA

SEQ ID NO: 965571 - protein, 10 aa, Mycobacterium
YTEEPGQARG

SEQ ID NO: 965572 - protein, 12 aa, Mycobacterium
YTERPVAPLRRS

SEQ ID NO: 965573 - protein, 13 aa, Mycobacterium
YTGAVSKAEPPLG

SEQ ID NO: 965574 - protein, 21 aa, Mycobacterium
YTGDGEATAQQVAADRATTSN

SEQ ID NO: 965575 - protein, 18 aa, Mycobacterium
YTLTTDRSAEPDLGPQPD

SEQ ID NO: 965576 - protein, 5 aa, Mycobacterium
YTPGQ

SEQ ID NO: 965577 - protein, 10 aa, Mycobacterium
YTSPSSGTVT

SEQ ID NO: 965578 - protein, 5 aa, Mycobacterium
YTSSK

SEQ ID NO: 965579 - protein, 8 aa, Mycobacterium
YTTTTTGA

SEQ ID NO: 965580 - protein, 9 aa, Mycobacterium
YWGPPAKPG

SEQ ID NO: 965581 - protein, 24 aa, Mycobacterium
KATATHLVSVFAHRARLVLGQLAV

SEQ ID NO: 965582 - protein, 22 aa, Mycobacterium
SDPSGLVPIALDGKMLRGALRA

SEQ ID NO: 965583 - protein, 18 aa, Mycobacterium
GERSELIGSEFLDVLASV

SEQ ID NO: 965584 - protein, 18 aa, Mycobacterium
DLNARMGSYFTAHVASSD

SEQ ID NO: 965585 - protein, 19 aa, Mycobacterium
ELIGSEFLDVLASVPDPRD

SEQ ID NO: 965586 - protein, 21 aa, Mycobacterium
LLPDNLRWLVTVDAMHTQVVT

SEQ ID NO: 965587 - protein, 29 aa, Mycobacterium
AICSLPFEHARPTAIMTWMRQHCGIENSL

SEQ ID NO: 965588 - protein, 20 aa, Mycobacterium
EIPCVRALLTLLPDNLRWLV

SEQ ID NO: 965589 - protein, 19 aa, Mycobacterium
ADLNARMGSYFTAHVASSD

SEQ ID NO: 965590 - protein, 18 aa, Mycobacterium
LIGSEFLDVLASVPDPRD

SEQ ID NO: 965591 - protein, 23 aa, Mycobacterium
GERSELIGSEFLDVLASVPDPRD

SEQ ID NO: 965592 - protein, 30 aa, Mycobacterium
YAICSLPFEHARPTAIMTWMRQHCGIENSL

SEQ ID NO: 965593 - protein, 21 aa, Mycobacterium
DPSGLVPIALDGKMLRGALRA

SEQ ID NO: 965594 - protein, 20 aa, Mycobacterium
EIPCVCALLTLLPDNLRWLV

SEQ ID NO: 965595 - protein, 17 aa, Mycobacterium
ERSELIGSEFLDVLASV

SEQ ID NO: 965596 - protein, 23 aa, Mycobacterium
EIPCVRALLTLLPGSLRWLVTVD

SEQ ID NO: 965597 - protein, 30 aa, Mycobacterium
AICSLPFEHARPTAIMTWMRQHWGIENSLH

SEQ ID NO: 965598 - protein, 19 aa, Mycobacterium
EIPCVRALLTLLPDNLRWL

SEQ ID NO: 965599 - protein, 21 aa, Mycobacterium
LLPGSLRWLVTVDAMHTQVVT

SEQ ID NO: 965600 - protein, 18 aa, Mycobacterium
LLTLLPDNLRWLVTVDAM

SEQ ID NO: 965601 - protein, 20 aa, Mycobacterium
LPDNLRWLVTVDAMHTQVVT

SEQ ID NO: 965602 - protein, 17 aa, Mycobacterium
RQHWGIENSLHWIRDVT

SEQ ID NO: 965603 - protein, 20 aa, Mycobacterium
PSGLVPIALDGKMLRGALRA

SEQ ID NO: 965604 - protein, 20 aa, Mycobacterium
ARMRGYAGFATWAATASDDV

SEQ ID NO: 965605 - protein, 23 aa, Mycobacterium
ATATHLVSVFAHRARLVLGQLAV

SEQ ID NO: 965606 - protein, 31 aa, Mycobacterium
EIPCVCALLTLLPGSLRWLVTVDAMHTQVVT

SEQ ID NO: 965607 - protein, 20 aa, Mycobacterium
SELIGSEFLDVLASVPDPRD

SEQ ID NO: 965608 - protein, 22 aa, Mycobacterium
DRGRLGWLTRVLWVLVGQVTRA

SEQ ID NO: 965609 - protein, 19 aa, Mycobacterium
PSGLVPIALDGKMLRGALR

SEQ ID NO: 965610 - protein, 28 aa, Mycobacterium
AICSLPFEHARPTAIMTWMRQHCGIENS

SEQ ID NO: 965611 - protein, 32 aa, Mycobacterium
NEIPCVCALLTLLPGSLRWLVTVDAMHTQVVT

SEQ ID NO: 965612 - protein, 22 aa, Mycobacterium
NEIPCVCALLTLLPDNLRWLVT

SEQ ID NO: 965613 - protein, 18 aa, Mycobacterium
AFAAALGQLHCHGISPSW

SEQ ID NO: 965614 - protein, 19 aa, Mycobacterium
AGFDAGFFGISPREARAMD

SEQ ID NO: 965615 - protein, 25 aa, Mycobacterium
AGFFGISPREARAMDPQQRLLLEVC

SEQ ID NO: 965616 - protein, 21 aa, Mycobacterium
CSSSLVAIHLACQSLRNNESQ

SEQ ID NO: 965617 - protein, 19 aa, Mycobacterium
DEQPEWVLHASAVLTAQTT

SEQ ID NO: 965618 - protein, 24 aa, Mycobacterium
DQVLAPKIDAAWQLHQLTYEHNLS

SEQ ID NO: 965619 - protein, 18 aa, Mycobacterium
LAHAAVWGLIRSAQNEHP

SEQ ID NO: 965620 - protein, 23 aa, Mycobacterium
LFAEHLVSAHGVRHLLLTSRRGP

SEQ ID NO: 965621 - protein, 18 aa, Mycobacterium
LIVHTPLLLAGHDTADLQ

SEQ ID NO: 965622 - protein, 22 aa, Mycobacterium
LQQRLTDLGAHVTITACDISDP

SEQ ID NO: 965623 - protein, 18 aa, Mycobacterium
PSEKIFRAVLSRLDPADL

SEQ ID NO: 965624 - protein, 19 aa, Mycobacterium
RPDAVAFAAALGQLHCHGI

SEQ ID NO: 965625 - protein, 23 aa, Mycobacterium
TGDQVRLPYAFTGISLHATHATR

SEQ ID NO: 965626 - protein, 18 aa, Mycobacterium
THATRLRVRLTRTGADAI

SEQ ID NO: 965627 - protein, 23 aa, Mycobacterium
TYAFQHQRYWLLPTAGDFSGANT

SEQ ID NO: 965628 - protein, 41 aa, Mycobacterium
ALGQLHCHGISPSWNVLYCQARPLTLPTYAFQHQRYWLLPT

SEQ ID NO: 965629 - protein, 17 aa, Mycobacterium
ATSHGLALFDAALATGQ

SEQ ID NO: 965630 - protein, 25 aa, Mycobacterium
EEPVAVVGMACRFPGGVASADQLWD

SEQ ID NO: 965631 - protein, 17 aa, Mycobacterium
ENSLHWIRDVTFDEDRQ

SEQ ID NO: 965632 - protein, 21 aa, Mycobacterium
LLPDNLRWLVTVDAIHTQVVT

SEQ ID NO: 965633 - protein, 25 aa, Mycobacterium
MDPQQRLLLEVCWEALETAGIPAHT

SEQ ID NO: 965634 - protein, 21 aa, Mycobacterium
SDPAVGVLVWPLSARSAPGLS

SEQ ID NO: 965635 - protein, 17 aa, Mycobacterium
TYTRYGAFLDDAAGFDA

SEQ ID NO: 965636 - protein, 25 aa, Mycobacterium
VVGNFPADRGWDVEGLFDPDPDAVG

SEQ ID NO: 965637 - protein, 24 aa, Mycobacterium
YEHNLSAFIMFSSMAGMIGSPGQG

SEQ ID NO: 965638 - protein, 17 aa, Mycobacterium
ENSLHWIRDVTFDEDRH

SEQ ID NO: 965639 - protein, 20 aa, Mycobacterium
APDGRCKAFAATADGTGFGE

SEQ ID NO: 965640 - protein, 25 aa, Mycobacterium
DALADYRHRLGLPATSLAWGYWQTH

SEQ ID NO: 965641 - protein, 18 aa, Mycobacterium
IENSLHWIRDVTFDEDRQ

SEQ ID NO: 965642 - protein, 20 aa, Mycobacterium
LPILLCAQALARHYTRRSQL

SEQ ID NO: 965643 - protein, 18 aa, Mycobacterium
TRRSQLRSRQGDTADVYR

SEQ ID NO: 965644 - protein, 19 aa, Mycobacterium
AAAVVALRSRVLTDLAGAG

SEQ ID NO: 965645 - protein, 24 aa, Mycobacterium
ACDAALQPFTGWSVLAVLHDEPEA

SEQ ID NO: 965646 - protein, 29 aa, Mycobacterium
AICSLPFEHARPTAIMTWMRQHGGIENSL

SEQ ID NO: 965647 - protein, 19 aa, Mycobacterium
ALLTLLPDNLRWLVTVDAM

SEQ ID NO: 965648 - protein, 27 aa, Mycobacterium
DELPELTPRPSTIAMYSTVDGEPHDTA

SEQ ID NO: 965649 - protein, 18 aa, Mycobacterium
DTIHIPRLTRHSSDGALT

SEQ ID NO: 965650 - protein, 25 aa, Mycobacterium
DYWYRNIRNTVRFHDTVAALLGAGE

SEQ ID NO: 965651 - protein, 28 aa, Mycobacterium
FSVMVSLAALWRWAGITPDAVIGHSQGE

SEQ ID NO: 965652 - protein, 24 aa, Mycobacterium
KATATHLVSVFAHRARLVPGQLAV

SEQ ID NO: 965653 - protein, 26 aa, Mycobacterium
LNEHAVESAVLFPGTGFVELALHVAD

SEQ ID NO: 965654 - protein, 20 aa, Mycobacterium
TATHLVSVFTHRARLVLGQL

SEQ ID NO: 965655 - protein, 18 aa, Mycobacterium
TQLLARWDGKITVAAVNG

SEQ ID NO: 965656 - protein, 28 aa, Mycobacterium
YPGMGADLYRQFPVFAHALDACDAALQP

SEQ ID NO: 965657 - protein, 17 aa, Mycobacterium
AGLNFHDVVVALGLIPD

SEQ ID NO: 965658 - protein, 19 aa, Mycobacterium
ARHTGKIVLTAPVVVDPEG

SEQ ID NO: 965659 - protein, 22 aa, Mycobacterium
ATATHLVSVFAHRARLVLGQLA

SEQ ID NO: 965660 - protein, 23 aa, Mycobacterium
ATYLHRWTIFTALPQWTLALLAL

SEQ ID NO: 965661 - protein, 25 aa, Mycobacterium
DTIHIPRLTRTAVLTPPDSGPWRLD

SEQ ID NO: 965662 - protein, 17 aa, Mycobacterium
DVVLNCLSGEFVEASLA

SEQ ID NO: 965663 - protein, 30 aa, Mycobacterium
EIPCVCALLTLLPGSLRWLVTVDAMHTQVV

SEQ ID NO: 965664 - protein, 34 aa, Mycobacterium
EWFGELEFWAALIKVCALMAFLVVGTIFLGGRYP

SEQ ID NO: 965665 - protein, 18 aa, Mycobacterium
FHSPHMDPILEQFRQIAA

SEQ ID NO: 965666 - protein, 19 aa, Mycobacterium
GELTAAYAAGVLSLQDAAT

SEQ ID NO: 965667 - protein, 35 aa, Mycobacterium
HRMVMTIPARWSFPQAASIPVVFLTAYIALAEISG

SEQ ID NO: 965668 - protein, 18 aa, Mycobacterium
IENSLHWIRDVTFDEDRH

SEQ ID NO: 965669 - protein, 22 aa, Mycobacterium
LLPDSLRWLVTVDAMHTQVVTA

SEQ ID NO: 965670 - protein, 20 aa, Mycobacterium
LLPGSLRWLVTVDAMHTQVV

SEQ ID NO: 965671 - protein, 17 aa, Mycobacterium
LMQSCTPGGTMLALQAS

SEQ ID NO: 965672 - protein, 19 aa, Mycobacterium
LRNTVRFHDTVAALLGAGE

SEQ ID NO: 965673 - protein, 20 aa, Mycobacterium
MPLAPYSGYLTLAFLFAVLV

SEQ ID NO: 965674 - protein, 18 aa, Mycobacterium
MRQHWGIENSLHWIRDVT

SEQ ID NO: 965675 - protein, 18 aa, Mycobacterium
NCLSGEFVEASLALLPRG

SEQ ID NO: 965676 - protein, 21 aa, Mycobacterium
RLQVSHAFHSPHMDPILEQFR

SEQ ID NO: 965677 - protein, 27 aa, Mycobacterium
VEASLALLPRGGHFVEIGKTDIRDTEV

SEQ ID NO: 965678 - protein, 30 aa, Mycobacterium
YAICSLPFEHARPTAIMTWMRQHCGIENNL

SEQ ID NO: 965679 - protein, 18 aa, Mycobacterium
YLLGHSIGELTAAYAAGV

SEQ ID NO: 965680 - protein, 18 aa, Mycobacterium
AAIAVLVIACPCALGLAT

SEQ ID NO: 965681 - protein, 27 aa, Mycobacterium
AALAPIIAAVACGRLAGAGRIGVKVGK

SEQ ID NO: 965682 - protein, 21 aa, Mycobacterium
AAYTRRTEIGIMRLVGASRWY

SEQ ID NO: 965683 - protein, 20 aa, Mycobacterium
AEKLAALLTQPGRTYDVSSP

SEQ ID NO: 965684 - protein, 22 aa, Mycobacterium
AMGGRAAEELVFREPTTGAVSD

SEQ ID NO: 965685 - protein, 20 aa, Mycobacterium
APDGRCKAFAATADGTGWGE

SEQ ID NO: 965686 - protein, 20 aa, Mycobacterium
AVTGCTRGPTVTRYEVELGP

SEQ ID NO: 965687 - protein, 17 aa, Mycobacterium
CKAFAATADGTGWGEGA

SEQ ID NO: 965688 - protein, 25 aa, Mycobacterium
DALADYRHRLGLPATSLAWGYWQTR

SEQ ID NO: 965689 - protein, 37 aa, Mycobacterium
DDRVKAHILIAMLACYLVWHLRKAWAPMTYTDENPPA

SEQ ID NO: 965690 - protein, 19 aa, Mycobacterium
DKPVIFWTPDHGAFVVRGA

SEQ ID NO: 965691 - protein, 24 aa, Mycobacterium
DSFDGYEYLFWVGCAGAYDDKAKK

SEQ ID NO: 965692 - protein, 26 aa, Mycobacterium
EEDKGLRTRSEMIAQLVFAMGGRAAE

SEQ ID NO: 965693 - protein, 22 aa, Mycobacterium
EIPCVRALLTLLPDSLRWLVTV

SEQ ID NO: 965694 - protein, 17 aa, Mycobacterium
ESAVLFPNTGFVELALH

SEQ ID NO: 965695 - protein, 18 aa, Mycobacterium
FLDVLAWVPDPRDPRGRR

SEQ ID NO: 965696 - protein, 17 aa, Mycobacterium
FLEKRFTGDYAHHNLLQ

SEQ ID NO: 965697 - protein, 19 aa, Mycobacterium
FLTRLRVGEKLVDAKAVAT

SEQ ID NO: 965698 - protein, 23 aa, Mycobacterium
FVWNVFKSWRYGEVVTVDDPWGY

SEQ ID NO: 965699 - protein, 21 aa, Mycobacterium
GDSRGYLLRDGELTQITKDDT

SEQ ID NO: 965700 - protein, 17 aa, Mycobacterium
GERSELIGSEFLDVLAW

SEQ ID NO: 965701 - protein, 25 aa, Mycobacterium
GLDRELAARFGFLLAIPAVFASGLF

SEQ ID NO: 965702 - protein, 20 aa, Mycobacterium
GLLACSPRALILDEPLAGLD

SEQ ID NO: 965703 - protein, 29 aa, Mycobacterium
GTALHRLFTHAGIHPDYLLGHSIGELTAA

SEQ ID NO: 965704 - protein, 25 aa, Mycobacterium
HARLIFERFGKFWGAFSVGDLLILN

SEQ ID NO: 965705 - protein, 17 aa, Mycobacterium
ILLNSEFSGPQIKEVSE

SEQ ID NO: 965706 - protein, 18 aa, Mycobacterium
IPCVRALLTLLPDNLRWL

SEQ ID NO: 965707 - protein, 19 aa, Mycobacterium
IPVLVLPAGKRIEFQLNSA

SEQ ID NO: 965708 - protein, 26 aa, Mycobacterium
ISVMSGRIAYTLGLEGPAITVDTACS

SEQ ID NO: 965709 - protein, 28 aa, Mycobacterium
KATATHLVSVFAYRARLVLGQLAVAEKS

SEQ ID NO: 965710 - protein, 25 aa, Mycobacterium
LFVPAALPWYYSWPLAVAAPLAQSR

SEQ ID NO: 965711 - protein, 22 aa, Mycobacterium
LLHRAKGGGLSTLFGGGVQSSL

SEQ ID NO: 965712 - protein, 17 aa, Mycobacterium
LLTLLPDNLRWLVTVDA

SEQ ID NO: 965713 - protein, 18 aa, Mycobacterium
LLTLLPDNLRWLVTVDAI

SEQ ID NO: 965714 - protein, 28 aa, Mycobacterium
LLVYVLPLLLLVGLFVMFSRMQGGARMG

SEQ ID NO: 965715 - protein, 18 aa, Mycobacterium
LMENMGYRLVLKARTAGA

SEQ ID NO: 965716 - protein, 17 aa, Mycobacterium
LNARMGSYFTAHVASSD

SEQ ID NO: 965717 - protein, 23 aa, Mycobacterium
LNVDKAKSVIVLKRSMNSGFAGI

SEQ ID NO: 965718 - protein, 20 aa, Mycobacterium
LPDNLRWLVTVDAIHTQVVT

SEQ ID NO: 965719 - protein, 20 aa, Mycobacterium
LRQLRWALSEVQRGNYNAHM

SEQ ID NO: 965720 - protein, 17 aa, Mycobacterium
LRQQRIWGASTVVASWQ

SEQ ID NO: 965721 - protein, 21 aa, Mycobacterium
LSAVSSRAGVEIAVDDNGSGV

SEQ ID NO: 965722 - protein, 17 aa, Mycobacterium
LTFGGLMLLGGRLGDTI

SEQ ID NO: 965723 - protein, 17 aa, Mycobacterium
LVTSILVLIAFPLLTAA

SEQ ID NO: 965724 - protein, 17 aa, Mycobacterium
LWVAFWFFLAQLNLILG

SEQ ID NO: 965725 - protein, 17 aa, Mycobacterium
MIAQLVFAMGGRAAEEL

SEQ ID NO: 965726 - protein, 33 aa, Mycobacterium
NEIPCVCALLTLLPDSLRWLVTVDAMHTQVVTA

SEQ ID NO: 965727 - protein, 21 aa, Mycobacterium
PDTATGFGWITALRAPAIAKL

SEQ ID NO: 965728 - protein, 27 aa, Mycobacterium
PGQGACFRLTLPLVRGHKVTTSPLPMK

SEQ ID NO: 965729 - protein, 24 aa, Mycobacterium
PHEECEVLVGLGMRTWADGRTLLL

SEQ ID NO: 965730 - protein, 21 aa, Mycobacterium
PSNFFAWALSVMFLVFTLRAL

SEQ ID NO: 965731 - protein, 23 aa, Mycobacterium
QGGARMGFGFGKSRAKQLSKDMP

SEQ ID NO: 965732 - protein, 24 aa, Mycobacterium
QQQMSRPKLDAMRAQFMLMLDMLR

SEQ ID NO: 965733 - protein, 22 aa, Mycobacterium
QRRMEVLALPLVAVVLFLVFGG

SEQ ID NO: 965734 - protein, 19 aa, Mycobacterium
RALLYKPFVRQIRTTRQMQ

SEQ ID NO: 965735 - protein, 20 aa, Mycobacterium
RQAKFALAHGGIFGDGLGQG

SEQ ID NO: 965736 - protein, 19 aa, Mycobacterium
RQGRAYWIHLMMASQTIES

SEQ ID NO: 965737 - protein, 17 aa, Mycobacterium
RQHWGIENSLHWIHDVT

SEQ ID NO: 965738 - protein, 18 aa, Mycobacterium
SATFLLRQQRIWGASTVV

SEQ ID NO: 965739 - protein, 22 aa, Mycobacterium
SELIGSEFLDVLAWVPDPRDPR

SEQ ID NO: 965740 - protein, 25 aa, Mycobacterium
SVMSGRIAYTLGLEGPAITVDTACS

SEQ ID NO: 965741 - protein, 17 aa, Mycobacterium
TGRRVFRMAPFHHHFEL

SEQ ID NO: 965742 - protein, 26 aa, Mycobacterium
TSVMSGRIAYTLGLEGPAITVDTACS

SEQ ID NO: 965743 - protein, 25 aa, Mycobacterium
VAESAYRLIELALRGGGPDNVTVVV

SEQ ID NO: 965744 - protein, 21 aa, Mycobacterium
VDYSLFILMRFREELRSGRQP

SEQ ID NO: 965745 - protein, 23 aa, Mycobacterium
VPTGIKFFNWVGTMWKGQLTFET

SEQ ID NO: 965746 - protein, 17 aa, Mycobacterium
VRAAGLNFHDVVVALGL

SEQ ID NO: 965747 - protein, 17 aa, Mycobacterium
VRASVNFATRVATIDAV

SEQ ID NO: 965748 - protein, 19 aa, Mycobacterium
WLNEHAVESAVLFPNTGFV

SEQ ID NO: 965749 - protein, 22 aa, Mycobacterium
WYTENLRYYYLILPTVDGSLSR

SEQ ID NO: 965750 - protein, 20 aa, Mycobacterium
YLAFGLMAALLLDATVVRMF

SEQ ID NO: 965751 - protein, 25 aa, Mycobacterium
YQRLKSWRRGLIFAMFVFAAVFTPG

SEQ ID NO: 965752 - protein, 22 aa, Mycobacterium
AAANLNRYGGAAARGIDDIGQM

SEQ ID NO: 965753 - protein, 18 aa, Mycobacterium
AAARFGLGPLRRVRPDVV

SEQ ID NO: 965754 - protein, 17 aa, Mycobacterium
AAEAVAFYRGEEAERKQ

SEQ ID NO: 965755 - protein, 25 aa, Mycobacterium
AAERWMERFSWIALIITVVVGIIAA

SEQ ID NO: 965756 - protein, 20 aa, Mycobacterium
AAEVHYLRSIFESGALGFEP

SEQ ID NO: 965757 - protein, 19 aa, Mycobacterium
AAGCMPVMIGWSAITDTIG

SEQ ID NO: 965758 - protein, 24 aa, Mycobacterium
AAGMRGHAGFATWAATASDDVLAQ

SEQ ID NO: 965759 - protein, 30 aa, Mycobacterium
AAGQFMWLATSWRLAEYVCSTGYFWMPISE

SEQ ID NO: 965760 - protein, 27 aa, Mycobacterium
AAGTAPRPAICSMHVGPPVGIDSGAAA

SEQ ID NO: 965761 - protein, 26 aa, Mycobacterium
AAGVLTWKMYVCRPLPGNLHDEAANA

SEQ ID NO: 965762 - protein, 19 aa, Mycobacterium
AAIELRTTTLTLIYPTLSL

SEQ ID NO: 965763 - protein, 28 aa, Mycobacterium
AAISGWRSGALGSLLSLIGVLFGAMAGV

SEQ ID NO: 965764 - protein, 20 aa, Mycobacterium
AAKLYPLLFLVPLFVLGVRT

SEQ ID NO: 965765 - protein, 23 aa, Mycobacterium
AALEAHPAVLLFSHRSYIDGAVV

SEQ ID NO: 965766 - protein, 25 aa, Mycobacterium
AALFSPWSLYFGWGLGHTRQQSTVI

SEQ ID NO: 965767 - protein, 25 aa, Mycobacterium
AALRGDHRAVLLARGNTPGWDDDRV

SEQ ID NO: 965768 - protein, 27 aa, Mycobacterium
AALSLRYALRHQQRWRNGLTVGLSAGG

SEQ ID NO: 965769 - protein, 18 aa, Mycobacterium
AALVMPVVLAFAYGTALV

SEQ ID NO: 965770 - protein, 19 aa, Mycobacterium
AAMLPATLVIIFVETGLLF

SEQ ID NO: 965771 - protein, 17 aa, Mycobacterium
AAMPAWSKLPSRLSGGP

SEQ ID NO: 965772 - protein, 40 aa, Mycobacterium
AAPIVTWAAWPFHRVALRNARYRAASMETLISAGILAATG

SEQ ID NO: 965773 - protein, 20 aa, Mycobacterium
AAPPTCAYSNWVRDGQSKPV

SEQ ID NO: 965774 - protein, 22 aa, Mycobacterium
AARRACPNRHAVPRLGLLKPGS

SEQ ID NO: 965775 - protein, 28 aa, Mycobacterium
AASFGAPRLWTALSDGRILPTRLSSKNR

SEQ ID NO: 965776 - protein, 19 aa, Mycobacterium
AASVPLPWMAVLIANDRPL

SEQ ID NO: 965777 - protein, 20 aa, Mycobacterium
AATILIVLAGRRLWHRFRIQ

SEQ ID NO: 965778 - protein, 24 aa, Mycobacterium
AAVCLAALVIIVGVVFVEQGQRRI

SEQ ID NO: 965779 - protein, 17 aa, Mycobacterium
AAVKRSVLMHWSQRSEC

SEQ ID NO: 965780 - protein, 19 aa, Mycobacterium
AAVLLFAMVAGGSFRRWEQ

SEQ ID NO: 965781 - protein, 19 aa, Mycobacterium
AAVPPRNALVLGLALTAGS

SEQ ID NO: 965782 - protein, 20 aa, Mycobacterium
AAVRRTVMTAGRTVTFSAVL

SEQ ID NO: 965783 - protein, 23 aa, Mycobacterium
AAVSLTSILGFVFGVLGIVIAAC

SEQ ID NO: 965784 - protein, 19 aa, Mycobacterium
AAVSWWLIEQPIRHWRPVR

SEQ ID NO: 965785 - protein, 21 aa, Mycobacterium
AAWAGLCWMSHFRAALTKMWW

SEQ ID NO: 965786 - protein, 25 aa, Mycobacterium
ACITDRLDGLLARRYGMATEFGAFV

SEQ ID NO: 965787 - protein, 25 aa, Mycobacterium
ADEPRATSFVRVRIDKVTPDVVTTS

SEQ ID NO: 965788 - protein, 21 aa, Mycobacterium
ADGKLVAPITYPSLYASDEDG

SEQ ID NO: 965789 - protein, 23 aa, Mycobacterium
ADHSGYMANYFRWFGSPEDPFGW

SEQ ID NO: 965790 - protein, 29 aa, Mycobacterium
ADLEPTWSYPGWRHIKYVNGFATSFWVTP

SEQ ID NO: 965791 - protein, 17 aa, Mycobacterium
ADLKGGSAVKPFAGVPH

SEQ ID NO: 965792 - protein, 24 aa, Mycobacterium
ADRSCLLSSGAGNFGVPRTDALSR

SEQ ID NO: 965793 - protein, 25 aa, Mycobacterium
ADSELRPWYPAVEIYRVAVSDGTNP

SEQ ID NO: 965794 - protein, 18 aa, Mycobacterium
AEALKLSLNTSYYRLMLK

SEQ ID NO: 965795 - protein, 21 aa, Mycobacterium
AEERVSIGWLAFALTMVVVQA

SEQ ID NO: 965796 - protein, 18 aa, Mycobacterium
AEIRGEFLSIFLSPTETL

SEQ ID NO: 965797 - protein, 25 aa, Mycobacterium
AELTANRATRGFLIATNFFGINTIP

SEQ ID NO: 965798 - protein, 17 aa, Mycobacterium
AEQFIGIELSAIMLFNH

SEQ ID NO: 965799 - protein, 17 aa, Mycobacterium
AEYLLSVNVRNAANLGS

SEQ ID NO: 965800 - protein, 35 aa, Mycobacterium
AFETNWLYPFIEFRLPRLGTSVFHGVEIELRNAIE

SEQ ID NO: 965801 - protein, 27 aa, Mycobacterium
AFFEKHGRWTIILARFLPFMRTFTPVI

SEQ ID NO: 965802 - protein, 18 aa, Mycobacterium
AFGTYLMRQFFRTLPSDL

SEQ ID NO: 965803 - protein, 17 aa, Mycobacterium
AFKSLRRPPPKPTSLAT

SEQ ID NO: 965804 - protein, 18 aa, Mycobacterium
AFLARPQLLILDEATSSI

SEQ ID NO: 965805 - protein, 26 aa, Mycobacterium
AFLLLVAGCAYLFRRPLGTQLRIMFV

SEQ ID NO: 965806 - protein, 17 aa, Mycobacterium
AFLPGFFGLLAVVVGPL

SEQ ID NO: 965807 - protein, 23 aa, Mycobacterium
AFPGKRLLVGTTLLVTMFPAISL

SEQ ID NO: 965808 - protein, 22 aa, Mycobacterium
AFPVTFRLALIVLTVESALSYW

SEQ ID NO: 965809 - protein, 26 aa, Mycobacterium
AFSMVLRHRIEWLSDPSLALPVVSAV

SEQ ID NO: 965810 - protein, 19 aa, Mycobacterium
AGAAMAFSSFFVVSNSLRL

SEQ ID NO: 965811 - protein, 20 aa, Mycobacterium
AGAAMAFSSFFVVSNSLRLS

SEQ ID NO: 965812 - protein, 25 aa, Mycobacterium
AGAFVRASGMALPFADDAVDICLSS

SEQ ID NO: 965813 - protein, 24 aa, Mycobacterium
AGAIVGYYLLRRALLPTGGHLFGV

SEQ ID NO: 965814 - protein, 25 aa, Mycobacterium
AGARRYSLSPIPVYLMAGLSLGKGG

SEQ ID NO: 965815 - protein, 51 aa, Mycobacterium
AGCLPAVIWWACHRPNRLWWRYTGWWLLALCLATLWWVVALVLLHGVSPPF

SEQ ID NO: 965816 - protein, 17 aa, Mycobacterium
AGDLKARVVEFGRRPAV

SEQ ID NO: 965817 - protein, 20 aa, Mycobacterium
AGEYRIGFGMLVFGVAMGAL

SEQ ID NO: 965818 - protein, 21 aa, Mycobacterium
AGGRYRLLAFHGGAPSLQFWQ

SEQ ID NO: 965819 - protein, 18 aa, Mycobacterium
AGGWDCVVARAFCMTLIV

SEQ ID NO: 965820 - protein, 25 aa, Mycobacterium
AGHHVAWCVGVGITVVVMVLVLVSY

SEQ ID NO: 965821 - protein, 24 aa, Mycobacterium
AGIMRRPRFRMPLAPYSGYLTLAF

SEQ ID NO: 965822 - protein, 25 aa, Mycobacterium
AGIMRRPRFRMPLAPYSGYLTLAFL

SEQ ID NO: 965823 - protein, 25 aa, Mycobacterium
AGKDSFPASFIIKLANPVQHKEFDA

SEQ ID NO: 965824 - protein, 28 aa, Mycobacterium
AGLQTGSSFKVFALIAALEQGIGLGYRV

SEQ ID NO: 965825 - protein, 19 aa, Mycobacterium
AGLVGCYRGLIVRGGSNGL

SEQ ID NO: 965826 - protein, 25 aa, Mycobacterium
AGLVGGIVWNLLTWLLGIPSSSSHA

SEQ ID NO: 965827 - protein, 22 aa, Mycobacterium
AGNLVTWWTGDTLMVFNQSNLT

SEQ ID NO: 965828 - protein, 26 aa, Mycobacterium
AGNTWPVGRLVAWLTGCVALVFTSSS

SEQ ID NO: 965829 - protein, 18 aa, Mycobacterium
AGNYHWLTTPGTWLEALV

SEQ ID NO: 965830 - protein, 22 aa, Mycobacterium
AGPLPYIVMEYVDGATLRDIVH

SEQ ID NO: 965831 - protein, 25 aa, Mycobacterium
AGSLLRLTVLTSIMLPTMAVVMLRG

SEQ ID NO: 965832 - protein, 19 aa, Mycobacterium
AGTVVRFDGAVPFVNLQVS

SEQ ID NO: 965833 - protein, 18 aa, Mycobacterium
AHDLELVGYIGLADTARP

SEQ ID NO: 965834 - protein, 18 aa, Mycobacterium
AHLNRQLWIGAVVASLVV

SEQ ID NO: 965835 - protein, 22 aa, Mycobacterium
AHLRARHDLVLEAFTAVHAAFP

SEQ ID NO: 965836 - protein, 17 aa, Mycobacterium
AHWRPAEAYEEIGQRVA

SEQ ID NO: 965837 - protein, 17 aa, Mycobacterium
AIAILALGFDPTRALVL

SEQ ID NO: 965838 - protein, 29 aa, Mycobacterium
AICSLPFEHARPTVIMTWMRQHCGIENSL

SEQ ID NO: 965839 - protein, 19 aa, Mycobacterium
AIGFLQDFFALAVLTSTVT

SEQ ID NO: 965840 - protein, 19 aa, Mycobacterium
AIILGAIGVMLGWRPALIC

SEQ ID NO: 965841 - protein, 19 aa, Mycobacterium
AIILYWFSNNIWTFGQQHY

SEQ ID NO: 965842 - protein, 22 aa, Mycobacterium
AILIVWCFPPLLSVVYAGSHDG

SEQ ID NO: 965843 - protein, 19 aa, Mycobacterium
AILSLVPWGTTGVSLDVMR

SEQ ID NO: 965844 - protein, 22 aa, Mycobacterium
AINIFGNLVIRWANGISALGKI

SEQ ID NO: 965845 - protein, 22 aa, Mycobacterium
AIPVLIVGTVVWVGITNDRKER

SEQ ID NO: 965846 - protein, 28 aa, Mycobacterium
AIRLRWLREEYYRRIYLALNQTSHIEAL

SEQ ID NO: 965847 - protein, 35 aa, Mycobacterium
AISAMLIYRLISWLLIAAIGWVVFFFMFRTENVTD

SEQ ID NO: 965848 - protein, 18 aa, Mycobacterium
AITLRDFRIPAIGLVLLM

SEQ ID NO: 965849 - protein, 20 aa, Mycobacterium
AIYGSGLPSDIWKSTMDGAL

SEQ ID NO: 965850 - protein, 26 aa, Mycobacterium
AIYNYTWLVLMLPFGIIGVTVLTVVM

SEQ ID NO: 965851 - protein, 21 aa, Mycobacterium
AKGSLLFDLGICLVLVSLPTL

SEQ ID NO: 965852 - protein, 21 aa, Mycobacterium
AKHLPKARHTRQMSKRRGRPI

SEQ ID NO: 965853 - protein, 27 aa, Mycobacterium
AKKSTGHWWWLVAAVAVLLVIVMFVLL

SEQ ID NO: 965854 - protein, 18 aa, Mycobacterium
AKLLYGPVLGKYESLGGP

SEQ ID NO: 965855 - protein, 18 aa, Mycobacterium
AKPAVGVLAVLTWVNVWN

SEQ ID NO: 965856 - protein, 17 aa, Mycobacterium
AKSGLATHLEAFAGNTI

SEQ ID NO: 965857 - protein, 17 aa, Mycobacterium
ALARADLGMAIGRGTDV

SEQ ID NO: 965858 - protein, 18 aa, Mycobacterium
ALCALVIRQIYRPDEDPV

SEQ ID NO: 965859 - protein, 20 aa, Mycobacterium
ALCASLVRFNYDDRKQIPAS

SEQ ID NO: 965860 - protein, 18 aa, Mycobacterium
ALCAVTAIVSVVVPFAAG

SEQ ID NO: 965861 - protein, 24 aa, Mycobacterium
ALEASNSPVALVIALAIGLLALLL

SEQ ID NO: 965862 - protein, 21 aa, Mycobacterium
ALEHISRQALLEVAEREDQID

SEQ ID NO: 965863 - protein, 18 aa, Mycobacterium
ALEMSYRRIRIHKDPSRP

SEQ ID NO: 965864 - protein, 19 aa, Mycobacterium
ALEQGIGLGYRVDSSPLTV

SEQ ID NO: 965865 - protein, 19 aa, Mycobacterium
ALEYLKITYGWSLLLIVVS

SEQ ID NO: 965866 - protein, 21 aa, Mycobacterium
ALFCDAVRNAYGWGAHDTILQ

SEQ ID NO: 965867 - protein, 26 aa, Mycobacterium
ALHECGHLWVACATGMKVRRYFVGFG

SEQ ID NO: 965868 - protein, 24 aa, Mycobacterium
ALICAAAVFSAITLRDFRIPAIGL

SEQ ID NO: 965869 - protein, 20 aa, Mycobacterium
ALIGGLWAWIAPPIHAVVGL

SEQ ID NO: 965870 - protein, 25 aa, Mycobacterium
ALLGARSVSSPMLLAGPTISMTVVI

SEQ ID NO: 965871 - protein, 19 aa, Mycobacterium
ALLGGLSIVVGDEVIDGTL

SEQ ID NO: 965872 - protein, 25 aa, Mycobacterium
ALLGPRCRSRDLVLGLIISRVLRPA

SEQ ID NO: 965873 - protein, 25 aa, Mycobacterium
ALLPLLALLALWGRRNERAADAAAQ

SEQ ID NO: 965874 - protein, 19 aa, Mycobacterium
ALLTLLPDNLRWLVTVDAI

SEQ ID NO: 965875 - protein, 26 aa, Mycobacterium
ALLTLLPDNLRWLVTVDAIHTQVVTA

SEQ ID NO: 965876 - protein, 29 aa, Mycobacterium
ALMVAVACLPDWLSGFLTGGLIAGSSARR

SEQ ID NO: 965877 - protein, 35 aa, Mycobacterium
ALPILVAVVPWLVLRFWFFRHKWTVTTLAATPAGK

SEQ ID NO: 965878 - protein, 26 aa, Mycobacterium
ALRSRIGMVLQDAWLFDGTIAENIAY

SEQ ID NO: 965879 - protein, 25 aa, Mycobacterium
ALSDIKAYMIGGAVPAGADQSTAGE

SEQ ID NO: 965880 - protein, 18 aa, Mycobacterium
ALTAPAPHHTRPVRFVWL

SEQ ID NO: 965881 - protein, 18 aa, Mycobacterium
ALTAVGWLIAGSGPDRVF

SEQ ID NO: 965882 - protein, 18 aa, Mycobacterium
ALTLAGVSTWLITRAWQM

SEQ ID NO: 965883 - protein, 18 aa, Mycobacterium
ALTLLGVRRYVFARPLLL

SEQ ID NO: 965884 - protein, 17 aa, Mycobacterium
ALVLAIGAALSFAADLL

SEQ ID NO: 965885 - protein, 18 aa, Mycobacterium
ALVSCAVLTVIVVVRKVK

SEQ ID NO: 965886 - protein, 23 aa, Mycobacterium
AMAICIFSVGLLRDHDGDVLFYP

SEQ ID NO: 965887 - protein, 43 aa, Mycobacterium
AMGAMPWILIVCLFVTILAGILFQFTMFGRWVKAIGGNERVAT

SEQ ID NO: 965888 - protein, 25 aa, Mycobacterium
AMLRCVTSIAVLRRLLRWVLGPTDP

SEQ ID NO: 965889 - protein, 24 aa, Mycobacterium
AMSLRKGRIPGLAAGPSRRIIGIT

SEQ ID NO: 965890 - protein, 23 aa, Mycobacterium
AMVFPVLGAFPFTGRMLMVLMLT

SEQ ID NO: 965891 - protein, 18 aa, Mycobacterium
AMVGELAALLASREPPPD

SEQ ID NO: 965892 - protein, 26 aa, Mycobacterium
ANGMKAMLWTSGWTPRYHGETIYLAR

SEQ ID NO: 965893 - protein, 17 aa, Mycobacterium
ANSKVARVVTCEIKDQA

SEQ ID NO: 965894 - protein, 26 aa, Mycobacterium
ANSLYRPGLAAGLALLPLLALLALWG

SEQ ID NO: 965895 - protein, 26 aa, Mycobacterium
ANYGCARVGARIILLNSEFSGPQIKE

SEQ ID NO: 965896 - protein, 24 aa, Mycobacterium
APDAICVADPLAFTGCGRNNKRSD

SEQ ID NO: 965897 - protein, 18 aa, Mycobacterium
APEAPRLPDQEMADLRAD

SEQ ID NO: 965898 - protein, 17 aa, Mycobacterium
APEKAAWGIALGLTVTL

SEQ ID NO: 965899 - protein, 24 aa, Mycobacterium
APEKILPRCRFADPEADVAHAESL

SEQ ID NO: 965900 - protein, 25 aa, Mycobacterium
APFGWYYDLLALWAHVTTTSAWMRV

SEQ ID NO: 965901 - protein, 18 aa, Mycobacterium
APIIVFVWIFQRRIVAGL

SEQ ID NO: 965902 - protein, 25 aa, Mycobacterium
APPGKYWWVRWVVLSLVAIVLVVEL

SEQ ID NO: 965903 - protein, 18 aa, Mycobacterium
APVAMVFAYGFYLRMDSF

SEQ ID NO: 965904 - protein, 25 aa, Mycobacterium
APWPAIPGPRRGAVSSFGLSGTNAH

SEQ ID NO: 965905 - protein, 19 aa, Mycobacterium
AQAFARTLIGFGYHGPDGQ

SEQ ID NO: 965906 - protein, 28 aa, Mycobacterium
AQAVAGLRWLRQYGRAIQVFGGMLLIAI

SEQ ID NO: 965907 - protein, 19 aa, Mycobacterium
AQLTRQLRLKFGHESVRQA

SEQ ID NO: 965908 - protein, 17 aa, Mycobacterium
ARADAWRDTEFERGFSM

SEQ ID NO: 965909 - protein, 21 aa, Mycobacterium
ARADLGMAIGRGTDVAIGAAD

SEQ ID NO: 965910 - protein, 23 aa, Mycobacterium
ARAGRLTIQIAQLLLVVAAGALW

SEQ ID NO: 965911 - protein, 17 aa, Mycobacterium
ARDLRDPAALIAIDQVS

SEQ ID NO: 965912 - protein, 28 aa, Mycobacterium
ARDSDLCGVSWVYHYAVAVYRDDRGCGQ

SEQ ID NO: 965913 - protein, 23 aa, Mycobacterium
AREQPWTPIVIIVVITAVRIIVS

SEQ ID NO: 965914 - protein, 24 aa, Mycobacterium
ARLDQPRVYFGPVISNTSADYAIV

SEQ ID NO: 965915 - protein, 19 aa, Mycobacterium
ARLIPRVGVASVIAEGFLV

SEQ ID NO: 965916 - protein, 21 aa, Mycobacterium
ARLNLLWSVLTVHLGYSVWTL

SEQ ID NO: 965917 - protein, 18 aa, Mycobacterium
ARLQEVWMGRQIAEVKSK

SEQ ID NO: 965918 - protein, 19 aa, Mycobacterium
ARLQFRGRDALFVLYLGTL

SEQ ID NO: 965919 - protein, 23 aa, Mycobacterium
ARLRADKALVAFPEMRSISYFTW

SEQ ID NO: 965920 - protein, 23 aa, Mycobacterium
ARLRSGWYRLPARDKAGPLLVVS

SEQ ID NO: 965921 - protein, 21 aa, Mycobacterium
ARMRGYAGFATWAATASDDVL

SEQ ID NO: 965922 - protein, 18 aa, Mycobacterium
ARRRCRYATLGAVRLAVF

SEQ ID NO: 965923 - protein, 23 aa, Mycobacterium
ARTAEDWPGLAVLSAGLVAVLTL

SEQ ID NO: 965924 - protein, 26 aa, Mycobacterium
ARTGNPWVVEAVRVFNIRYILTTSPT

SEQ ID NO: 965925 - protein, 20 aa, Mycobacterium
ARTLIGFGYHGPDGQIVADH

SEQ ID NO: 965926 - protein, 17 aa, Mycobacterium
ARVQSSFLRDNARVDGR

SEQ ID NO: 965927 - protein, 21 aa, Mycobacterium
ARYGYISGLTGLVFLAIPAPL

SEQ ID NO: 965928 - protein, 18 aa, Mycobacterium
ASAIVPRKEIAKSMAPQV

SEQ ID NO: 965929 - protein, 36 aa, Mycobacterium
ASALGVLLLVLVLWRCFRVAMISALMVAVACLPDWL

SEQ ID NO: 965930 - protein, 18 aa, Mycobacterium
ASARLVGPLASYLVVNVS

SEQ ID NO: 965931 - protein, 19 aa, Mycobacterium
ASATVFLAAWVPLFASFAA

SEQ ID NO: 965932 - protein, 28 aa, Mycobacterium
ASLFAAIIGSISFWGSIIAFGKLQETIS

SEQ ID NO: 965933 - protein, 18 aa, Mycobacterium
ASLREMLIPLVPAAVIAL

SEQ ID NO: 965934 - protein, 20 aa, Mycobacterium
ASPQTAPWVIVRLLVEGPVL

SEQ ID NO: 965935 - protein, 24 aa, Mycobacterium
ASRPELIEGIGRRVLSWVNSVRGK

SEQ ID NO: 965936 - protein, 25 aa, Mycobacterium
ASRVAAMAGMLADWVEGPGAEVALA

SEQ ID NO: 965937 - protein, 17 aa, Mycobacterium
ASVSWAVVYSHDRAIDQ

SEQ ID NO: 965938 - protein, 19 aa, Mycobacterium
ASWLIKPDAKLPVDRLESR

SEQ ID NO: 965939 - protein, 18 aa, Mycobacterium
ASYSDLRVSRGLDAFSQR

SEQ ID NO: 965940 - protein, 17 aa, Mycobacterium
ATALKPGHNVIEVNSGS

SEQ ID NO: 965941 - protein, 18 aa, Mycobacterium
ATATCTRPTELVIDGIDV

SEQ ID NO: 965942 - protein, 17 aa, Mycobacterium
ATELSLKVRSAPAMNGK

SEQ ID NO: 965943 - protein, 19 aa, Mycobacterium
ATESVRMLAPIPGKSAVGI

SEQ ID NO: 965944 - protein, 25 aa, Mycobacterium
ATFDPLRRLAGIVVIAAAIGAITWL

SEQ ID NO: 965945 - protein, 26 aa, Mycobacterium
ATGARLRWVPLQGPSATPVQGREHAD

SEQ ID NO: 965946 - protein, 18 aa, Mycobacterium
ATLKILLFSTLAGAALPG

SEQ ID NO: 965947 - protein, 26 aa, Mycobacterium
ATMRTIKFNMVWAFGYNIAAIPIAAA

SEQ ID NO: 965948 - protein, 26 aa, Mycobacterium
ATMRTIRINMIWAFGYNVAAIPIASS

SEQ ID NO: 965949 - protein, 19 aa, Mycobacterium
ATNGDCLMWPDSTPHTAVI

SEQ ID NO: 965950 - protein, 26 aa, Mycobacterium
ATQPTGIGMLAFWFAWLMATAYLVWN

SEQ ID NO: 965951 - protein, 23 aa, Mycobacterium
ATRECSKVLFGVVTFNTGSRGWV

SEQ ID NO: 965952 - protein, 18 aa, Mycobacterium
ATRIARKLAGWSITGTIL

SEQ ID NO: 965953 - protein, 20 aa, Mycobacterium
ATVIGLLTILGFSLYDTVIV

SEQ ID NO: 965954 - protein, 31 aa, Mycobacterium
AVAAVCLVFRWFSPMICVCRPTLSKSGSSRG

SEQ ID NO: 965955 - protein, 19 aa, Mycobacterium
AVAELLAIAGVKYLVLGTG

SEQ ID NO: 965956 - protein, 24 aa, Mycobacterium
AVALPLRIFAWLSLVFGVGFSMLA

SEQ ID NO: 965957 - protein, 19 aa, Mycobacterium
AVAMRKWGDLAMLPAMPAR

SEQ ID NO: 965958 - protein, 18 aa, Mycobacterium
AVASRIGIDEVIADILPE

SEQ ID NO: 965959 - protein, 25 aa, Mycobacterium
AVATSNLLMAWVCIGASVLGVLLLI

SEQ ID NO: 965960 - protein, 25 aa, Mycobacterium
AVDAWLELCQTYGWAPGVMGASSQG

SEQ ID NO: 965961 - protein, 25 aa, Mycobacterium
AVEALRWAMMRGEPLVVLADALAEA

SEQ ID NO: 965962 - protein, 24 aa, Mycobacterium
AVEIAEAMRGMLQRIWNEQNRTKE

SEQ ID NO: 965963 - protein, 17 aa, Mycobacterium
AVFGDSIGWTWMHYLPP

SEQ ID NO: 965964 - protein, 25 aa, Mycobacterium
AVGQQCTRHPLPLLAALAKLLVAAA

SEQ ID NO: 965965 - protein, 17 aa, Mycobacterium
AVGRWTASRPEIPAPTI

SEQ ID NO: 965966 - protein, 18 aa, Mycobacterium
AVLGTFGVFFGMLVVYKT

SEQ ID NO: 965967 - protein, 17 aa, Mycobacterium
AVLIPYSIVTVVASYSW

SEQ ID NO: 965968 - protein, 24 aa, Mycobacterium
AVLVWAARLWTRSPWLVALPLWVW

SEQ ID NO: 965969 - protein, 21 aa, Mycobacterium
AVPGFAWWAAALNSLPMLAAL

SEQ ID NO: 965970 - protein, 21 aa, Mycobacterium
AVPYIRWPAWLRTVVATVALA

SEQ ID NO: 965971 - protein, 27 aa, Mycobacterium
AVTLMPALLVLAGTRGWVAPRRDRAGA

SEQ ID NO: 965972 - protein, 32 aa, Mycobacterium
AVYFGSRTGMSFGRDLRSAMFDHITTFSERET

SEQ ID NO: 965973 - protein, 20 aa, Mycobacterium
AWIVVTICALLVTLTLRVII

SEQ ID NO: 965974 - protein, 27 aa, Mycobacterium
AWLHSAVWWKALLALVVAVALVIGVNY

SEQ ID NO: 965975 - protein, 20 aa, Mycobacterium
AWRNLRFARSQMPFDAVAVR

SEQ ID NO: 965976 - protein, 17 aa, Mycobacterium
AWTAAGMFLAVWLPLDN

SEQ ID NO: 965977 - protein, 17 aa, Mycobacterium
AWVKVGYIAFVLGGVYA

SEQ ID NO: 965978 - protein, 18 aa, Mycobacterium
AYCIGRFCVELLRDDAAT

SEQ ID NO: 965979 - protein, 20 aa, Mycobacterium
AYFDKPVEQLTCSEGALLAA

SEQ ID NO: 965980 - protein, 31 aa, Mycobacterium; identical to SEQ ID NO: 10665

SEQ ID NO: 965981 - protein, 20 aa, Mycobacterium
AYIPRNVHFTQWNPAIDAST

SEQ ID NO: 965982 - protein, 20 aa, Mycobacterium
CAAVISAVFGTWALIHNQTV

SEQ ID NO: 965983 - protein, 20 aa, Mycobacterium
CAIAMVGLLALPGYRTNYKD

SEQ ID NO: 965984 - protein, 33 aa, Mycobacterium
CASFPSLNWWWAAVVAFALLAWVLTHPTTTPVG

SEQ ID NO: 965985 - protein, 21 aa, Mycobacterium
CATGMKVRRYFVGFGPTLWST

SEQ ID NO: 965986 - protein, 17 aa, Mycobacterium
CDITLKINGLQPGGPVR

SEQ ID NO: 965987 - protein, 17 aa, Mycobacterium
CGIPGQYPQSGSPGQYG

SEQ ID NO: 965988 - protein, 20 aa, Mycobacterium
CIEQLNWRDALVVGVAQTLA

SEQ ID NO: 965989 - protein, 19 aa, Mycobacterium
CIVSVWRSVPFATVVLLAA

SEQ ID NO: 965990 - protein, 24 aa, Mycobacterium
CKSIKRPVHRWVVVHLGGSVVHPS

SEQ ID NO: 965991 - protein, 19 aa, Mycobacterium
CLLAPVVVIPVVISEGADF

SEQ ID NO: 965992 - protein, 20 aa, Mycobacterium
CLPMLAQIPVFLGLYHALRS

SEQ ID NO: 965993 - protein, 19 aa, Mycobacterium
CLTGLLAVGGVWQAGRFRR

SEQ ID NO: 965994 - protein, 19 aa, Mycobacterium
CMGLGIPFVLLASGSAQAV

SEQ ID NO: 965995 - protein, 26 aa, Mycobacterium
CPHIPRGKVTGVVRLDGVTFTYPGTN

SEQ ID NO: 965996 - protein, 17 aa, Mycobacterium
CSMLSPKAKHIGDIFPG

SEQ ID NO: 965997 - protein, 33 aa, Mycobacterium
CSRWSTATPSCWWCTRLSRWAWLKESGSASIRS

SEQ ID NO: 965998 - protein, 18 aa, Mycobacterium
CTAQRRRTLTIALLLVAM

SEQ ID NO: 965999 - protein, 17 aa, Mycobacterium
CTECGRCQSQCPAWNTG

SEQ ID NO: 966000 - protein, 33 aa, Mycobacterium
CVKAEMLVGTPAMWWLAVPVLVYATWRTVIQRD

SEQ ID NO: 966001 - protein, 18 aa, Mycobacterium
CWAPMAWILMAVGKRASC

SEQ ID NO: 966002 - protein, 18 aa, Mycobacterium
CYDRRVLLMLGLVWVVVL

SEQ ID NO: 966003 - protein, 21 aa, Mycobacterium
CYHLAGIWRRGIVGHPVAVLK

SEQ ID NO: 966004 - protein, 24 aa, Mycobacterium
DAFIDFSRPAVILVGIPMMVLAGV

SEQ ID NO: 966005 - protein, 19 aa, Mycobacterium
DAISALQNRGFKTRTLQKP

SEQ ID NO: 966006 - protein, 18 aa, Mycobacterium
DAKGMKIAIDIQNVQIRD

SEQ ID NO: 966007 - protein, 25 aa, Mycobacterium
DAMYCLCFTRLPYFRTLGLLCSVGM

SEQ ID NO: 966008 - protein, 22 aa, Mycobacterium
DAPADVLAGFDFSAQGVWTFAR

SEQ ID NO: 966009 - protein, 18 aa, Mycobacterium
DCLMWPDSTPHTAVIVNC

SEQ ID NO: 966010 - protein, 23 aa, Mycobacterium
DDAYRFASWLSFPVTGFVADFGL

SEQ ID NO: 966011 - protein, 27 aa, Mycobacterium
DDLVRARFPPLFTRGCTAQRRRTLTIA

SEQ ID NO: 966012 - protein, 19 aa, Mycobacterium
DDMARLAVSFNDMAESLSR

SEQ ID NO: 966013 - protein, 25 aa, Mycobacterium
DDPEGYRLSVDYAVRISSRGLYIHS

SEQ ID NO: 966014 - protein, 22 aa, Mycobacterium
DDPNWSWLKWLPHIQHPTETDA

SEQ ID NO: 966015 - protein, 32 aa, Mycobacterium
DERDRLALWSRVLPITFTAVGLITLLSGGFLA

SEQ ID NO: 966016 - protein, 24 aa, Mycobacterium
DEWRAEVMPEDKLKVVRDLQNEGY

SEQ ID NO: 966017 - protein, 17 aa, Mycobacterium
DEYRASAVSSYRQVRQG

SEQ ID NO: 966018 - protein, 17 aa, Mycobacterium
DFDALWNSRTDAMGKSR

SEQ ID NO: 966019 - protein, 20 aa, Mycobacterium
DFLQNPCRYQTLGAKIPKGV

SEQ ID NO: 966020 - protein, 25 aa, Mycobacterium
DFLWYPYYASYGMLLLPFFAPALSV

SEQ ID NO: 966021 - protein, 19 aa, Mycobacterium
DFTIVPLLWLLAIDAVLIT

SEQ ID NO: 966022 - protein, 19 aa, Mycobacterium
DGAQLPWSLLMTTTLAAVM

SEQ ID NO: 966023 - protein, 24 aa, Mycobacterium
DGITAWRLLEKGGILIFDDFLWPG

SEQ ID NO: 966024 - protein, 20 aa, Mycobacterium
DGLQPISPVLAAILRNINSY

SEQ ID NO: 966025 - protein, 18 aa, Mycobacterium
DGLTAWIAAPLLFIGALF

SEQ ID NO: 966026 - protein, 21 aa, Mycobacterium
DGMQKRVTVTFQDDKGTYEVG

SEQ ID NO: 966027 - protein, 20 aa, Mycobacterium
DGVRIPPRIIKATNAADGTR

SEQ ID NO: 966028 - protein, 17 aa, Mycobacterium
DHRTRLTALAMMAVTAA

SEQ ID NO: 966029 - protein, 18 aa, Mycobacterium
DHVVAILSLVPWGTTGVS

SEQ ID NO: 966030 - protein, 18 aa, Mycobacterium
DIGRHALCRARLTNLDGG

SEQ ID NO: 966031 - protein, 25 aa, Mycobacterium
DITPSEAFTAWEYVDAYDVAQAVVL

SEQ ID NO: 966032 - protein, 20 aa, Mycobacterium
DIYLTQRFIIAWRMWLTNHL

SEQ ID NO: 966033 - protein, 32 aa, Mycobacterium
DKHGRPFRRRNARPAIFVVVFLVIVAGVSWTI

SEQ ID NO: 966034 - protein, 26 aa, Mycobacterium
DKRITPRWMRYGRADLVVGIVGVMAG

SEQ ID NO: 966035 - protein, 20 aa, Mycobacterium
DLAQPGWCDPHYLSSAWSGQ

SEQ ID NO: 966036 - protein, 20 aa, Mycobacterium
DLDVPFTRIHEFRHFHRERH

SEQ ID NO: 966037 - protein, 19 aa, Mycobacterium
DLFLRIAPELYLKRLCIGG

SEQ ID NO: 966038 - protein, 24 aa, Mycobacterium
DLLQDRTSFIIAHHLPTIRDADHI

SEQ ID NO: 966039 - protein, 20 aa, Mycobacterium
DLLTGTALTRFAVILASAKI

SEQ ID NO: 966040 - protein, 18 aa, Mycobacterium
DLPTAVWHLLCDHSDAID

SEQ ID NO: 966041 - protein, 26 aa, Mycobacterium
DLTARLKAAWAPQGLIHFRQGQWYTG

SEQ ID NO: 966042 - protein, 21 aa, Mycobacterium
DMDVGMDFGYKAAVDGQCTYD

SEQ ID NO: 966043 - protein, 18 aa, Mycobacterium
DMGMPRRYADYLPTDGFQ

SEQ ID NO: 966044 - protein, 27 aa, Mycobacterium
DNGLRPEPIIALGILLTWCSVERAVAT

SEQ ID NO: 966045 - protein, 19 aa, Mycobacterium
DNLRGKWRVSPGVAANGHF

SEQ ID NO: 966046 - protein, 29 aa, Mycobacterium
DPAELPAAVISRLPVRYTFDNRYFSDIYE

SEQ ID NO: 966047 - protein, 22 aa, Mycobacterium
DPAGRPVAIRVFAGNTADPAAF

SEQ ID NO: 966048 - protein, 20 aa, Mycobacterium
DPKETVSFVAWVVYAAYLHA

SEQ ID NO: 966049 - protein, 26 aa, Mycobacterium
DPNSKYTISMLWSGDRAWRQSGERRM

SEQ ID NO: 966050 - protein, 22 aa, Mycobacterium
DPSRPVDCIVRVRAKDGSETGR

SEQ ID NO: 966051 - protein, 25 aa, Mycobacterium
DPVKFSSLYTGIPFVPAIATETNGD

SEQ ID NO: 966052 - protein, 26 aa, Mycobacterium
DQGALVVGVFFWFAVVGWVTVVVACG

SEQ ID NO: 966053 - protein, 36 aa, Mycobacterium
DQSDWAKRNPRRWSVIDAWFTLGMMFEMRSYAEYPT

SEQ ID NO: 966054 - protein, 24 aa, Mycobacterium
DRDRLKIPFGHEFKTGNIMYLDIK

SEQ ID NO: 966055 - protein, 23 aa, Mycobacterium
DRIAAVFVPMVFVIAGLAGASWL

SEQ ID NO: 966056 - protein, 18 aa, Mycobacterium
DRLWIRFIADTERRSQVI

SEQ ID NO: 966057 - protein, 18 aa, Mycobacterium
DRMKVFWAQAMRLRDLLK

SEQ ID NO: 966058 - protein, 20 aa, Mycobacterium
DRPLIHLSRLVTTLRSIYKG

SEQ ID NO: 966059 - protein, 22 aa, Mycobacterium
DRSVVPVRVFWMPPAERSKLAK

SEQ ID NO: 966060 - protein, 24 aa, Mycobacterium
DRYELGDILGFGGMSEVHLARDIR

SEQ ID NO: 966061 - protein, 17 aa, Mycobacterium
DSAAWMYHAAVSISFTV

SEQ ID NO: 966062 - protein, 23 aa, Mycobacterium
DSFYLPPEVFKNTDFKRAMKSFL

SEQ ID NO: 966063 - protein, 23 aa, Mycobacterium
DSGAKIFVLIAVLVFMLLGSFIL

SEQ ID NO: 966064 - protein, 17 aa, Mycobacterium
DSIELWLSGLAFVLQAA

SEQ ID NO: 966065 - protein, 25 aa, Mycobacterium
DSLTKYLISKGFEFTELEAAGLSRQ

SEQ ID NO: 966066 - protein, 21 aa, Mycobacterium
DSMDANYRWFHPAPTTLAAAV

SEQ ID NO: 966067 - protein, 30 aa, Mycobacterium
DTELPRQFGYNMPLELVLTVTPFLIISMLF

SEQ ID NO: 966068 - protein, 23 aa, Mycobacterium
DTGMPDFRISLVSPLTIRAGCGY

SEQ ID NO: 966069 - protein, 23 aa, Mycobacterium
DTLARQGISYVVLRNDLDPDTSR

SEQ ID NO: 966070 - protein, 21 aa, Mycobacterium
DTLHGTRCISIGTLQRDADDT

SEQ ID NO: 966071 - protein, 17 aa, Mycobacterium
DTLKPEVTLADYKVTST

SEQ ID NO: 966072 - protein, 22 aa, Mycobacterium
DTLPVRIGVAVVGTLIVFGLIM

SEQ ID NO: 966073 - protein, 23 aa, Mycobacterium
DTPPEEFDRVLAVNLGGVVNCCR

SEQ ID NO: 966074 - protein, 17 aa, Mycobacterium
DTRMFDDPLQFYSRSIA

SEQ ID NO: 966075 - protein, 19 aa, Mycobacterium
DTRRHLGRHLSLLDLISAD

SEQ ID NO: 966076 - protein, 25 aa, Mycobacterium
DVGASPAWRNLRLPLSAIPSMATQI

SEQ ID NO: 966077 - protein, 24 aa, Mycobacterium
DVGPKLSATLPRYRSSHHTVGVRN

SEQ ID NO: 966078 - protein, 18 aa, Mycobacterium
DWLADRGARRLVLMGRTP

SEQ ID NO: 966079 - protein, 20 aa, Mycobacterium
EAEGGMGPHGLMIGMTGSGK

SEQ ID NO: 966080 - protein, 17 aa, Mycobacterium
EAFPPGSVDFFYLTSSA

SEQ ID NO: 966081 - protein, 21 aa, Mycobacterium
EAGFWGKLVNFVMKRPLVFAI

SEQ ID NO: 966082 - protein, 24 aa, Mycobacterium
EAGRAATLRIVRSLTGVSIDYFAE

SEQ ID NO: 966083 - protein, 17 aa, Mycobacterium
EAIFGYNGVGWRFTGAL

SEQ ID NO: 966084 - protein, 20 aa, Mycobacterium
EALRCGAHVVLPADADGHAP

SEQ ID NO: 966085 - protein, 19 aa, Mycobacterium
EALTGDMFLLMLGGGALAS

SEQ ID NO: 966086 - protein, 17 aa, Mycobacterium
EAVGTPLPAKIPLPKAA

SEQ ID NO: 966087 - protein, 22 aa, Mycobacterium
ECYTLVRWSIRGQGGRAISKLG

SEQ ID NO: 966088 - protein, 17 aa, Mycobacterium
EDARLIPRVGVASVIAE

SEQ ID NO: 966089 - protein, 18 aa, Mycobacterium
EDFGDALLRAWRNRSRRL

SEQ ID NO: 966090 - protein, 24 aa, Mycobacterium
EDFLCPGCGDFERNFGPTVSKLID

SEQ ID NO: 966091 - protein, 21 aa, Mycobacterium
EDFTWKAMLDFATCTECGRCQ

SEQ ID NO: 966092 - protein, 31 aa, Mycobacterium
EDQVFRFSRILDVAPRLAILLDDYAVPADSR

SEQ ID NO: 966093 - protein, 17 aa, Mycobacterium
EFEGPRRRARRERAERR

SEQ ID NO: 966094 - protein, 21 aa, Mycobacterium
EFERGFSMALGRLGDPADSDC

SEQ ID NO: 966095 - protein, 20 aa, Mycobacterium
EGRTAYLVMELVNGEPLNSV

SEQ ID NO: 966096 - protein, 20 aa, Mycobacterium
EGRWWTACRRSLPFMNVVEI

SEQ ID NO: 966097 - protein, 19 aa, Mycobacterium
EGSLGRLVIELDKNADSDV

SEQ ID NO: 966098 - protein, 17 aa, Mycobacterium
EHISLHPLWGLDQRLKR

SEQ ID NO: 966099 - protein, 17 aa, Mycobacterium
EHLRLGSYAVMHAISDY

SEQ ID NO: 966100 - protein, 24 aa, Mycobacterium
EIDTWRWVGVLIFLCTGKALLQKI

SEQ ID NO: 966101 - protein, 25 aa, Mycobacterium
EIELMGNEGFVWIGLHEPEASHMHN

SEQ ID NO: 966102 - protein, 20 aa, Mycobacterium
EIIRLVRRLLPALVVVLTGC

SEQ ID NO: 966103 - protein, 32 aa, Mycobacterium
EIPCVCALLTLLPDSLRWLVTVDAMHTQVVTA

SEQ ID NO: 966104 - protein, 18 aa, Mycobacterium
EITAPLGSQRVYRPYPYI

SEQ ID NO: 966105 - protein, 20 aa, Mycobacterium
EIVLAVANLMWFVFAGLGAL

SEQ ID NO: 966106 - protein, 21 aa, Mycobacterium
EKGLELTIIFGLSGIVLASVF

SEQ ID NO: 966107 - protein, 20 aa, Mycobacterium
ELEPVFVVHAGFSLHDVLAN

SEQ ID NO: 966108 - protein, 20 aa, Mycobacterium
ELGVTLLRLAVIHRGVIPAS

SEQ ID NO: 966109 - protein, 29 aa, Mycobacterium
ELICMSWLRFGHGLVLSSILLWTGVSLML

SEQ ID NO: 966110 - protein, 19 aa, Mycobacterium
ELIGSEFLDVLASVPGPRD

SEQ ID NO: 966111 - protein, 24 aa, Mycobacterium
ELNRAASELAAFAAFGSVASATEW

SEQ ID NO: 966112 - protein, 25 aa, Mycobacterium
ELPADWEPLGAIAIGYAHEPTDLRE

SEQ ID NO: 966113 - protein, 32 aa, Mycobacterium
ELSDAALVSRSWAMAFATLISRITGFARVVLL

SEQ ID NO: 966114 - protein, 19 aa, Mycobacterium
ELTELALGVGRQYVAQGRV

SEQ ID NO: 966115 - protein, 19 aa, Mycobacterium
EMFFRGVLYTPLGRHRPVP

SEQ ID NO: 966116 - protein, 23 aa, Mycobacterium
ENLRRSCLRLHTYGFTGTDLAYV

SEQ ID NO: 966117 - protein, 24 aa, Mycobacterium
ENRLPPVHVFAGINLSFGLMGPLL

SEQ ID NO: 966118 - protein, 20 aa, Mycobacterium
ENWAETWPATARSGPTFTYP

SEQ ID NO: 966119 - protein, 21 aa, Mycobacterium
EPGKPVALWIVTRGVYESVAS

SEQ ID NO: 966120 - protein, 24 aa, Mycobacterium
EPIAVIGMGCRFPGGISGPEALWQ

SEQ ID NO: 966121 - protein, 20 aa, Mycobacterium
EPMLAVICVALFGLVVSPVS

SEQ ID NO: 966122 - protein, 22 aa, Mycobacterium
EPTRRTCIVFALRVILLALFPV

SEQ ID NO: 966123 - protein, 25 aa, Mycobacterium
EPVPDRFAGIAISEFIWARQHARRM

SEQ ID NO: 966124 - protein, 28 aa, Mycobacterium
EQGLRVIATRSRLMARLSGQGAMALLEL

SEQ ID NO: 966125 - protein, 18 aa, Mycobacterium
ERAITYGRMTPVALATLT

SEQ ID NO: 966126 - protein, 21 aa, Mycobacterium
EREVRIVIVVAVMEFGVYLLR

SEQ ID NO: 966127 - protein, 20 aa, Mycobacterium
ERGEPWPQPVPEPAFKAAIA

SEQ ID NO: 966128 - protein, 20 aa, Mycobacterium
ERGGSTWLLWDGKRSEIDLA

SEQ ID NO: 966129 - protein, 20 aa, Mycobacterium
ERIKLQGARQVELLRAQLTR

SEQ ID NO: 966130 - protein, 20 aa, Mycobacterium
ERLPELPLCVGYRFDPIRLP

SEQ ID NO: 966131 - protein, 18 aa, Mycobacterium
ERNFDANAARHFGCGFAP

SEQ ID NO: 966132 - protein, 19 aa, Mycobacterium
ERRVVPLPLAQKIFDAEWI

SEQ ID NO: 966133 - protein, 21 aa, Mycobacterium
ERWNLPIILIVLLAVFGSLAA

SEQ ID NO: 966134 - protein, 27 aa, Mycobacterium
ERYMAISALTTMCFDLTVTAGVYSLVG

SEQ ID NO: 966135 - protein, 21 aa, Mycobacterium
ERYRTKMIWWDRRTLANHAEP

SEQ ID NO: 966136 - protein, 22 aa, Mycobacterium
ESEFPSELSTLFKNLETKGNPW

SEQ ID NO: 966137 - protein, 21 aa, Mycobacterium
ESGRSDCRWLLRAVLGRNSIQ

SEQ ID NO: 966138 - protein, 18 aa, Mycobacterium
ESQLRKLLADSLLPTCPP

SEQ ID NO: 966139 - protein, 42 aa, Mycobacterium
ESVIRTPFALGIAGLLGRIPLPGSAPVLVWLSSFAHPERDKR

SEQ ID NO: 966140 - protein, 29 aa, Mycobacterium
ETESDGSIGRWVAVVAVLAVLTIAIVAAF

SEQ ID NO: 966141 - protein, 25 aa, Mycobacterium
ETGYRLRVKMALAEGQYKISKLDQV

SEQ ID NO: 966142 - protein, 23 aa, Mycobacterium
ETPEVRRGAAGFLGFAIGGPLSD

SEQ ID NO: 966143 - protein, 20 aa, Mycobacterium
ETPQHRWTRHVTAQLSSASA

SEQ ID NO: 966144 - protein, 18 aa, Mycobacterium
ETQYGIKAVPLGGFCDIV

SEQ ID NO: 966145 - protein, 18 aa, Mycobacterium
ETVNRCSVYMPFDDVDVS

SEQ ID NO: 966146 - protein, 23 aa, Mycobacterium
ETVVLCVVALYAVNVVLTTIGVR

SEQ ID NO: 966147 - protein, 23 aa, Mycobacterium
EVATSDADRGLWTPWNTYVSPGL

SEQ ID NO: 966148 - protein, 19 aa, Mycobacterium
EVHAALGAVRGQIMSRNWI

SEQ ID NO: 966149 - protein, 18 aa, Mycobacterium
EVHSVLLSAGQGAESLLV

SEQ ID NO: 966150 - protein, 17 aa, Mycobacterium
EVLALRAELAALRTNLE

SEQ ID NO: 966151 - protein, 24 aa, Mycobacterium
EVPAPRPIGAGLFNAIPEAPPLKA

SEQ ID NO: 966152 - protein, 20 aa, Mycobacterium
EVPDVSSLNYTDAVKKLTSS

SEQ ID NO: 966153 - protein, 18 aa, Mycobacterium
EVPPDRWDADAFYDPDPS

SEQ ID NO: 966154 - protein, 25 aa, Mycobacterium
EVPRHPGYRLHPVVLDAALQSVGAA

SEQ ID NO: 966155 - protein, 17 aa, Mycobacterium
EWNEAWRSDQFVLDPTR

SEQ ID NO: 966156 - protein, 20 aa, Mycobacterium
EYGTCWPVIMATSMLIILPL

SEQ ID NO: 966157 - protein, 18 aa, Mycobacterium
FAAGRLYTTLSVADAAAA

SEQ ID NO: 966158 - protein, 25 aa, Mycobacterium
FAGLSWRARPKLAINPDGLAVQGWF

SEQ ID NO: 966159 - protein, 32 aa, Mycobacterium
FAHGQVWQVDWIFRVSWHYVFDITQRQYFDHS

SEQ ID NO: 966160 - protein, 17 aa, Mycobacterium
FALSGFLLWRGHAATAR

SEQ ID NO: 966161 - protein, 19 aa, Mycobacterium
FANLFPLGGCAAATSVLIS

SEQ ID NO: 966162 - protein, 20 aa, Mycobacterium
FANLPRLIQVVVDNQLISLA

SEQ ID NO: 966163 - protein, 27 aa, Mycobacterium
FARLRFPGRDTLFWAYIMTLMVPATVT

SEQ ID NO: 966164 - protein, 17 aa, Mycobacterium
FAVAALTAVGWLIAGSG

SEQ ID NO: 966165 - protein, 21 aa, Mycobacterium
FCALLALPIVPLFAYLHAAVI

SEQ ID NO: 966166 - protein, 17 aa, Mycobacterium
FCGGLRLMHDLLHGDLA

SEQ ID NO: 966167 - protein, 29 aa, Mycobacterium
FDANAARHFGCGFAPSGWDSLTKYLISKG

SEQ ID NO: 966168 - protein, 19 aa, Mycobacterium
FDLSSSWMTGQCCDLAARG

SEQ ID NO: 966169 - protein, 20 aa, Mycobacterium
FDRKAPVRILEIGSWEGRST

SEQ ID NO: 966170 - protein, 23 aa, Mycobacterium
FDVVLCWLALGVLVAVVITGHII

SEQ ID NO: 966171 - protein, 26 aa, Mycobacterium
FDVVPSRLRRPGAVVLEIDDEDPIFE

SEQ ID NO: 966172 - protein, 25 aa, Mycobacterium
FEFEIPRAMFWIVIVYVLLATIITF

SEQ ID NO: 966173 - protein, 26 aa, Mycobacterium
FELPFYRLVLSYVFVAVFLAFVVNLL

SEQ ID NO: 966174 - protein, 17 aa, Mycobacterium
FEVLAPFVVDDGPTVLV

SEQ ID NO: 966175 - protein, 19 aa, Mycobacterium
FFAEIPWDLEKAAKMDGAT

SEQ ID NO: 966176 - protein, 22 aa, Mycobacterium
FFALACWIALAGLTPTGLMLAA

SEQ ID NO: 966177 - protein, 19 aa, Mycobacterium
FFHTQYWWAGIALVVLVVI

SEQ ID NO: 966178 - protein, 31 aa, Mycobacterium
FFMSCVRCSWKRIYALIRLIALFGVDWLTTL

SEQ ID NO: 966179 - protein, 18 aa, Mycobacterium
FFSPHSWWPVLVALSGSV

SEQ ID NO: 966180 - protein, 18 aa, Mycobacterium
FFVLYALIMAFSFTTLSI

SEQ ID NO: 966181 - protein, 20 aa, Mycobacterium
FGAASLLFGRGERLPPLPRG

SEQ ID NO: 966182 - protein, 21 aa, Mycobacterium
FGDSIGWTWMHYLPPTPGFAF

SEQ ID NO: 966183 - protein, 17 aa, Mycobacterium
FGGDFPGTILIPRLYAL

SEQ ID NO: 966184 - protein, 17 aa, Mycobacterium
FGGLMLLGGRLGDTIGR

SEQ ID NO: 966185 - protein, 26 aa, Mycobacterium
FGICLGCQLYPVVVWFRRTAAPRNRN

SEQ ID NO: 966186 - protein, 18 aa, Mycobacterium
FGIDFKGGTTVSMPVSPG

SEQ ID NO: 966187 - protein, 19 aa, Mycobacterium
FGKDLGFYAFELPFYRLVL

SEQ ID NO: 966188 - protein, 25 aa, Mycobacterium
FGLAAKFPARLTIAVIGTALLAGLV

SEQ ID NO: 966189 - protein, 25 aa, Mycobacterium
FGPAPEGMAIWIIGMVTAIGLALWI

SEQ ID NO: 966190 - protein, 18 aa, Mycobacterium
FGRDIVRILHAWCRGLTV

SEQ ID NO: 966191 - protein, 26 aa, Mycobacterium
FGTVVARDRIQAVAGLRALAAGKQAP

SEQ ID NO: 966192 - protein, 21 aa, Mycobacterium
FGVAAIADWLGVIASLAAIAA

SEQ ID NO: 966193 - protein, 18 aa, Mycobacterium
FGVIILTAWGTLAALAAL

SEQ ID NO: 966194 - protein, 30 aa, Mycobacterium
FGVPWSNSFPKLRWSLTTALLELTVIVLLL

SEQ ID NO: 966195 - protein, 24 aa, Mycobacterium
FIFRHRGGNVVIFALMLVAATQLF

SEQ ID NO: 966196 - protein, 20 aa, Mycobacterium
FIPRIALHIFVDCSAGNVGY

SEQ ID NO: 966197 - protein, 24 aa, Mycobacterium
FITALPFGFAFTVFFAHPDLLTGT

SEQ ID NO: 966198 - protein, 20 aa, Mycobacterium
FKDLELRYACLARVVALEGA

SEQ ID NO: 966199 - protein, 17 aa, Mycobacterium
FKGFPALTNFVAEERFL

SEQ ID NO: 966200 - protein, 21 aa, Mycobacterium
FKSAAADVWADFTAAHIGTQT

SEQ ID NO: 966201 - protein, 23 aa, Mycobacterium
FKSSRFESMTSYDIGLLILRLVL

SEQ ID NO: 966202 - protein, 18 aa, Mycobacterium
FLEHGIASMEVFRRRKFG

SEQ ID NO: 966203 - protein, 32 aa, Mycobacterium
FLFLAELLDTWLWRWVALLIVFAIMVMVTAAL

SEQ ID NO: 966204 - protein, 30 aa, Mycobacterium
FLIALVPLVWLLSVVVARGFYAVTRFDWWT

SEQ ID NO: 966205 - protein, 24 aa, Mycobacterium
FLITALCLFTAVLITLRRKQIPGV

SEQ ID NO: 966206 - protein, 21 aa, Mycobacterium
FLLTVVCTFRSRLYAERWCAW

SEQ ID NO: 966207 - protein, 25 aa, Mycobacterium
FLLVGIPVLVGWVVLRRRLGQSVLP

SEQ ID NO: 966208 - protein, 17 aa, Mycobacterium
FLLWTAALFSALALSLI

SEQ ID NO: 966209 - protein, 22 aa, Mycobacterium
FLMCMLPDLFIVLPDVGDVDKP

SEQ ID NO: 966210 - protein, 18 aa, Mycobacterium
FLPVLGLAGLAAATHYAT

SEQ ID NO: 966211 - protein, 19 aa, Mycobacterium
FLSHPVTNFILFVGSPYIV

SEQ ID NO: 966212 - protein, 17 aa, Mycobacterium
FLSTRRGQLTITEQQAF

SEQ ID NO: 966213 - protein, 17 aa, Mycobacterium
FLTFFVVATFGALIVDR

SEQ ID NO: 966214 - protein, 18 aa, Mycobacterium
FMMRATIGFWLTPLLLSV

SEQ ID NO: 966215 - protein, 17 aa, Mycobacterium
FNANSLIFPYLSLTPCI

SEQ ID NO: 966216 - protein, 33 aa, Mycobacterium
FNNGLRPEPLIALGVLFTWVLVERAIALRRLAS

SEQ ID NO: 966217 - protein, 19 aa, Mycobacterium
FNRLPRRVVERVTPKSGTG

SEQ ID NO: 966218 - protein, 17 aa, Mycobacterium
FPEMRSISYFTWVVEQL

SEQ ID NO: 966219 - protein, 21 aa, Mycobacterium
FPGTILIPRLYALHILLIPGV

SEQ ID NO: 966220 - protein, 19 aa, Mycobacterium
FPLADPIIGIVIIVAILTV

SEQ ID NO: 966221 - protein, 19 aa, Mycobacterium
FPLGSHWARIDLPDDEYIP

SEQ ID NO: 966222 - protein, 21 aa, Mycobacterium
FPMGLGLVSQFFGRYFTPDEA

SEQ ID NO: 966223 - protein, 22 aa, Mycobacterium
FPPDGRAGVTVITLGNHRSSTY

SEQ ID NO: 966224 - protein, 17 aa, Mycobacterium
FQAGHGIAEFMGSVIKK

SEQ ID NO: 966225 - protein, 21 aa, Mycobacterium
FQDGEQFWELLFINPTAAFQF

SEQ ID NO: 966226 - protein, 18 aa, Mycobacterium
FQKWDMFTPPVFVGLANF

SEQ ID NO: 966227 - protein, 20 aa, Mycobacterium
FQQVSFAYRTGTPVIDDLSM

SEQ ID NO: 966228 - protein, 23 aa, Mycobacterium
FRAHEVTLLPAPMFHALGYLHAT

SEQ ID NO: 966229 - protein, 25 aa, Mycobacterium
FRDRNRLVTFIAIFLAGGVIFSLTV

SEQ ID NO: 966230 - protein, 17 aa, Mycobacterium
FRHGLLIGVAIAAVIVI

SEQ ID NO: 966231 - protein, 17 aa, Mycobacterium
FRIPAIGLVLLMLSSLI

SEQ ID NO: 966232 - protein, 19 aa, Mycobacterium
FRIVERWQFHYSQVIKSTR

SEQ ID NO: 966233 - protein, 23 aa, Mycobacterium
FRLNCASCHNFTGKGGALSSGKY

SEQ ID NO: 966234 - protein, 18 aa, Mycobacterium
FRMRRRPPILIGPQIASI

SEQ ID NO: 966235 - protein, 17 aa, Mycobacterium
FRPIAAGVVTEWLAYTL

SEQ ID NO: 966236 - protein, 29 aa, Mycobacterium
FRSRLYAERWCAWALLAAAVVIPTGLTVK

SEQ ID NO: 966237 - protein, 18 aa, Mycobacterium
FRTLPVVRYDNINGQAVN

SEQ ID NO: 966238 - protein, 23 aa, Mycobacterium
FSAASVVVLLAWNERKSSARLQI

SEQ ID NO: 966239 - protein, 18 aa, Mycobacterium
FSALDNWGSEEWGLVCAC

SEQ ID NO: 966240 - protein, 19 aa, Mycobacterium
FSAYCRYGQHVSKQQARST

SEQ ID NO: 966241 - protein, 18 aa, Mycobacterium
FSDCLRAELDAVGVGLTT

SEQ ID NO: 966242 - protein, 20 aa, Mycobacterium
FSGPSARLSARIARSEQSVL

SEQ ID NO: 966243 - protein, 17 aa, Mycobacterium
FSIFVDGFGVVRAGLGG

SEQ ID NO: 966244 - protein, 22 aa, Mycobacterium
FSIPVLVPMVLWIALSSATIRR

SEQ ID NO: 966245 - protein, 18 aa, Mycobacterium
FSMGRALLVTALVPPCII

SEQ ID NO: 966246 - protein, 18 aa, Mycobacterium
FSSFFVVSNSLRLRNFGA

SEQ ID NO: 966247 - protein, 18 aa, Mycobacterium
FSSFFVVSNSLRLSNFGL

SEQ ID NO: 966248 - protein, 18 aa, Mycobacterium
FSSPARLTAVVLATCALP

SEQ ID NO: 966249 - protein, 18 aa, Mycobacterium
FSVPCSWVGFPAQPLISW

SEQ ID NO: 966250 - protein, 26 aa, Mycobacterium
FTACGIIGLGAAFLIAALLLATYTSS

SEQ ID NO: 966251 - protein, 26 aa, Mycobacterium
FTFFGWHWSLPLGVAIMLSAVGGGLL

SEQ ID NO: 966252 - protein, 24 aa, Mycobacterium
FTGEARMALGLLVRISMASIAAVE

SEQ ID NO: 966253 - protein, 24 aa, Mycobacterium
FTISSVLCAVAWDEVTLVIARLLQ

SEQ ID NO: 966254 - protein, 20 aa, Mycobacterium
FTNISGLRTGQFVRASGVEV

SEQ ID NO: 966255 - protein, 25 aa, Mycobacterium
FTPTKWTHHFGVFAGLAGSLGALAA

SEQ ID NO: 966256 - protein, 17 aa, Mycobacterium
FTQNVGYDADGKLVAPI

SEQ ID NO: 966257 - protein, 17 aa, Mycobacterium
FTVLVGFHSINILLREI

SEQ ID NO: 966258 - protein, 18 aa, Mycobacterium
FVAPCLMLGLLTVLAVTA

SEQ ID NO: 966259 - protein, 17 aa, Mycobacterium
FVDGHLSKWLNFTPTPL

SEQ ID NO: 966260 - protein, 18 aa, Mycobacterium
FVMTLCFATTNGWWYVSS

SEQ ID NO: 966261 - protein, 20 aa, Mycobacterium
FVNFYSCDITLKINGLQPGG

SEQ ID NO: 966262 - protein, 21 aa, Mycobacterium
FVRGEGAGVVVLKRLTDAQRD

SEQ ID NO: 966263 - protein, 25 aa, Mycobacterium
FVVALSFASVNGWWYVSNFGVPWSN

SEQ ID NO: 966264 - protein, 19 aa, Mycobacterium
FVVGLALALFGWISKLEYT

SEQ ID NO: 966265 - protein, 21 aa, Mycobacterium
FVVPYPPGFPVLVPGQVVSKE

SEQ ID NO: 966266 - protein, 23 aa, Mycobacterium
FVVRGAMKAAWDKLKGPNGKLGV

SEQ ID NO: 966267 - protein, 18 aa, Mycobacterium
FWFAWLMATAYLVWNYGY

SEQ ID NO: 966268 - protein, 19 aa, Mycobacterium
FWSLVPLVVGCILLAGMAG

SEQ ID NO: 966269 - protein, 21 aa, Mycobacterium
FYFVLPRWPELIGETTHTLGT

SEQ ID NO: 966270 - protein, 22 aa, Mycobacterium
FYGVLRMTRFIGIVIIAVSLPL

SEQ ID NO: 966271 - protein, 18 aa, Mycobacterium
FYLALPILALLTRRISVR

SEQ ID NO: 966272 - protein, 19 aa, Mycobacterium
FYNIPRLRQMYALLYHEVF

SEQ ID NO: 966273 - protein, 18 aa, Mycobacterium
FYVPASIKQVWLGDTATG

SEQ ID NO: 966274 - protein, 21 aa, Mycobacterium
GAALPGLFALGIRLQVNDAGD

SEQ ID NO: 966275 - protein, 18 aa, Mycobacterium
GAALSRQPWRSVDGYSGH

SEQ ID NO: 966276 - protein, 18 aa, Mycobacterium
GAANLAAFRGYLATMATV

SEQ ID NO: 966277 - protein, 28 aa, Mycobacterium
GAANRNGRRLMAVLLHGTRQPIAPWEQA

SEQ ID NO: 966278 - protein, 22 aa, Mycobacterium
GAFAGLPPAYAISPPKIDPGAV

SEQ ID NO: 966279 - protein, 17 aa, Mycobacterium
GAFFAAIVGVLGLMGGF

SEQ ID NO: 966280 - protein, 19 aa, Mycobacterium
GAGSFGFAGTVSKEAVVEV

SEQ ID NO: 966281 - protein, 21 aa, Mycobacterium
GAGSIFPLFMIGGVAMMMFSG

SEQ ID NO: 966282 - protein, 25 aa, Mycobacterium
GAILVPCRRRYWLVAGAGVFAAHVA

SEQ ID NO: 966283 - protein, 19 aa, Mycobacterium
GAKALARLVRRFPDAQTLD

SEQ ID NO: 966284 - protein, 20 aa, Mycobacterium
GAKIPKGVLLYGPPGTGKTL

SEQ ID NO: 966285 - protein, 18 aa, Mycobacterium
GALIRLAPLVWTGPAISL

SEQ ID NO: 966286 - protein, 29 aa, Mycobacterium
GALYVRVGDRLYPALNLASARLITGRPDN

SEQ ID NO: 966287 - protein, 23 aa, Mycobacterium
GANFWRRGALLIGIGVGVATVLR

SEQ ID NO: 966288 - protein, 17 aa, Mycobacterium
GAPPEDFSGCYDGSLVG

SEQ ID NO: 966289 - protein, 23 aa, Mycobacterium
GAPSGLRLSATIDTRFSSTPTTL

SEQ ID NO: 966290 - protein, 18 aa, Mycobacterium
GAQSCVKAEMLVGTPAMW

SEQ ID NO: 966291 - protein, 24 aa, Mycobacterium
GARGEVVSLGFLISLWAGSSAISA

SEQ ID NO: 966292 - protein, 24 aa, Mycobacterium
GARLWLPTYLAWFLGGMILAVLQV

SEQ ID NO: 966293 - protein, 19 aa, Mycobacterium
GATCIAGAWLYTGSSKPYG

SEQ ID NO: 966294 - protein, 18 aa, Mycobacterium
GAYIAAGFALFFLTFVVN

SEQ ID NO: 966295 - protein, 25 aa, Mycobacterium
GCSPTRSAYRWQPHHILRRQRRPTA

SEQ ID NO: 966296 - protein, 21 aa, Mycobacterium
GDASAGWLRLGVLVLALAALT

SEQ ID NO: 966297 - protein, 21 aa, Mycobacterium
GDKNLAFGIRDLFMVTVLSSI

SEQ ID NO: 966298 - protein, 24 aa, Mycobacterium
GDPEHPPIGVVIFVGGAATGLDDG

SEQ ID NO: 966299 - protein, 27 aa, Mycobacterium
GDVIQTEFNVVLPWSKQVSLSKSAVHP

SEQ ID NO: 966300 - protein, 23 aa, Mycobacterium
GEAGEIYSLINLFSGGALLKLTV

SEQ ID NO: 966301 - protein, 20 aa, Mycobacterium
GEAVRPCAVDKWIDSGASQG

SEQ ID NO: 966302 - protein, 20 aa, Mycobacterium
GECSACRAWFDQVADQARDL

SEQ ID NO: 966303 - protein, 22 aa, Mycobacterium
GEIYEAMDWLLARQDAIEKQLA

SEQ ID NO: 966304 - protein, 20 aa, Mycobacterium
GELQRLALAAALAREPSLLI

SEQ ID NO: 966305 - protein, 24 aa, Mycobacterium
GENFSRCFVPTSFVVSAITLAITK

SEQ ID NO: 966306 - protein, 20 aa, Mycobacterium
GEPLPQWQITLYWRTKGQPL

SEQ ID NO: 966307 - protein, 37 aa, Mycobacterium
GFAMPLYLQMVIVRWLLVRSLVAWFWEEPLRASVIRH

SEQ ID NO: 966308 - protein, 29 aa, Mycobacterium
GFAVNLKLLMPVFRWQRRDNRLAEADPAA

SEQ ID NO: 966309 - protein, 20 aa, Mycobacterium
GFDKDGMGLLAWGALGFGYA

SEQ ID NO: 966310 - protein, 17 aa, Mycobacterium
GFFFGGKILRAALNPVP

SEQ ID NO: 966311 - protein, 18 aa, Mycobacterium
GFLVLPFSRRGRVHTGHH

SEQ ID NO: 966312 - protein, 25 aa, Mycobacterium
GFPPARLTKVTAMPQLVAFFNGVGG

SEQ ID NO: 966313 - protein, 26 aa, Mycobacterium
GFQLVRLVYDMALVFRHRVRKDRLIS

SEQ ID NO: 966314 - protein, 18 aa, Mycobacterium
GFWTGGFVQAQFNTRIVR

SEQ ID NO: 966315 - protein, 20 aa, Mycobacterium
GGAGDFRHGLLIGVAIAAVI

SEQ ID NO: 966316 - protein, 26 aa, Mycobacterium
GGALTEVSWRLAFLVNVPIGLVMIYL

SEQ ID NO: 966317 - protein, 19 aa, Mycobacterium
GGILLGLACATKWSGLYFV

SEQ ID NO: 966318 - protein, 24 aa, Mycobacterium
GGIRLSGRTGALSRLARLQLVSLV

SEQ ID NO: 966319 - protein, 17 aa, Mycobacterium
GGLIAAVGFELFKQVGS

SEQ ID NO: 966320 - protein, 17 aa, Mycobacterium
GGLVPIALDGKMLRGAL

SEQ ID NO: 966321 - protein, 18 aa, Mycobacterium
GGPFLFLQALLRTSTIST

SEQ ID NO: 966322 - protein, 21 aa, Mycobacterium
GGPRRKGRIISEQEKKITAYH

SEQ ID NO: 966323 - protein, 30 aa, Mycobacterium; identical to SEQ ID NO: 10389

SEQ ID NO: 966324 - protein, 20 aa, Mycobacterium
GGTFLLMLFLDFVFQDRDIK

SEQ ID NO: 966325 - protein, 18 aa, Mycobacterium
GGVEVCLNHAVYDSYSGA

SEQ ID NO: 966326 - protein, 26 aa, Mycobacterium
GGVIAAEHPEMWGGLVDLAASALGAD

SEQ ID NO: 966327 - protein, 17 aa, Mycobacterium
GGVLTIVMGLVFVGLLP

SEQ ID NO: 966328 - protein, 20 aa, Mycobacterium
GGVVNCCRAFGQRLVERGTG

SEQ ID NO: 966329 - protein, 29 aa, Mycobacterium
GGYSSLWMSIRFIRRIAFFSYVITIILLV

SEQ ID NO: 966330 - protein, 25 aa, Mycobacterium
GHLRRAAVSSFGFGGTNAHVVIEQG

SEQ ID NO: 966331 - protein, 18 aa, Mycobacterium
GHVPEVHAALGAVRGQIM

SEQ ID NO: 966332 - protein, 17 aa, Mycobacterium
GIAEFMGSVIKKRRKRM

SEQ ID NO: 966333 - protein, 18 aa, Mycobacterium
GIDPIHRLVVPRVLAATL

SEQ ID NO: 966334 - protein, 19 aa, Mycobacterium
GIFIKGYRALETINAIDTV

SEQ ID NO: 966335 - protein, 22 aa, Mycobacterium
GIIGVACGRWRVDRRSPPVPEH

SEQ ID NO: 966336 - protein, 23 aa, Mycobacterium
GILLSLGLVELFPGSLARQDRLP

SEQ ID NO: 966337 - protein, 26 aa, Mycobacterium
GIRTVLAFRGYFYWDDLILIGKTGTQ

SEQ ID NO: 966338 - protein, 29 aa, Mycobacterium
GISIFKLLSRIWIPLVILVVLVVGGFVVY

SEQ ID NO: 966339 - protein, 17 aa, Mycobacterium
GITLFSVFVLLVLKSLL

SEQ ID NO: 966340 - protein, 25 aa, Mycobacterium
GIYPAPACFARHPRWVAPVRRVGLL

SEQ ID NO: 966341 - protein, 24 aa, Mycobacterium
GKFDWLDSKVVQWVPDRYWPEHST

SEQ ID NO: 966342 - protein, 18 aa, Mycobacterium
GKILRAALNPVPSLSPVA

SEQ ID NO: 966343 - protein, 22 aa, Mycobacterium
GKPKTPCGFYRLHGAQQPALLG

SEQ ID NO: 966344 - protein, 24 aa, Mycobacterium
GKPLKEPYLRPVTMNADLSFSPCL

SEQ ID NO: 966345 - protein, 22 aa, Mycobacterium
GKPTTVHWSLRLDVSDVDGKLM

SEQ ID NO: 966346 - protein, 20 aa, Mycobacterium
GKSTLAWIMAGLMVPTTGAC

SEQ ID NO: 966347 - protein, 20 aa, Mycobacterium
GLACYSDWAFTSAVVALVVA

SEQ ID NO: 966348 - protein, 30 aa, Mycobacterium
GLAGGPWHWDRWAPASPWAAPPPLVMALGW

SEQ ID NO: 966349 - protein, 47 aa, Mycobacterium
GLFEPKRLIKVRGWRRIGTVVVRWPLPILITTCAIAMVGLLALPGYR

SEQ ID NO: 966350 - protein, 19 aa, Mycobacterium
GLFGVLRWTAVGLVATLVA

SEQ ID NO: 966351 - protein, 18 aa, Mycobacterium
GLFLGAVSFLFANFQVST

SEQ ID NO: 966352 - protein, 18 aa, Mycobacterium
GLFLPMGASKPVRLQGAF

SEQ ID NO: 966353 - protein, 17 aa, Mycobacterium
GLGEIHLPDERRRPTVS

SEQ ID NO: 966354 - protein, 17 aa, Mycobacterium
GLGKPGGEVRWGVAGRM

SEQ ID NO: 966355 - protein, 25 aa, Mycobacterium
GLGLRSGGPVAILFSLACIGIAAFG

SEQ ID NO: 966356 - protein, 21 aa, Mycobacterium
GLGVLRDGQKWVALAVPGYSL

SEQ ID NO: 966357 - protein, 22 aa, Mycobacterium
GLIERPERLIIVLVGAGLSDFP

SEQ ID NO: 966358 - protein, 20 aa, Mycobacterium
GLIGCFVFSFIRPNGAAGNN

SEQ ID NO: 966359 - protein, 19 aa, Mycobacterium
GLLCGGSGHLRAERTHHIV

SEQ ID NO: 966360 - protein, 18 aa, Mycobacterium
GLLVWFLIALPIGAVLGG

SEQ ID NO: 966361 - protein, 20 aa, Mycobacterium
GLPSDIWKSTMDGALEGTPN

SEQ ID NO: 966362 - protein, 23 aa, Mycobacterium
GLRPGEEKLVFSRFWRSDPSRVR

SEQ ID NO: 966363 - protein, 22 aa, Mycobacterium
GLSRFIWVTAMVWIFGGSATWL

SEQ ID NO: 966364 - protein, 20 aa, Mycobacterium
GLSYRFPFHTEKKTYPYFDP

SEQ ID NO: 966365 - protein, 22 aa, Mycobacterium
GLTKRHPIALVHITHYNNEADT

SEQ ID NO: 966366 - protein, 22 aa, Mycobacterium
GLTSLRAGLIAGAIGLSLVLLY

SEQ ID NO: 966367 - protein, 21 aa, Mycobacterium
GLTTYRFTQNVGYDADGKLVA

SEQ ID NO: 966368 - protein, 17 aa, Mycobacterium
GLVCCIGSILAIVLGAI

SEQ ID NO: 966369 - protein, 24 aa, Mycobacterium
GLVTAGSLVVHWATMQEFYGITDS

SEQ ID NO: 966370 - protein, 21 aa, Mycobacterium
GLVYELCLRLGFCQSDTQIIY

SEQ ID NO: 966371 - protein, 20 aa, Mycobacterium
GMGLLAWGALGFGYAEVGTV

SEQ ID NO: 966372 - protein, 20 aa, Mycobacterium
GMPRRLRWLSPLVPLVAGPL

SEQ ID NO: 966373 - protein, 27 aa, Mycobacterium
GMTLPRPRDLAPLLAAWVISVSVMVFE

SEQ ID NO: 966374 - protein, 20 aa, Mycobacterium
GMVTRAGLRPVGRLTEAAER

SEQ ID NO: 966375 - protein, 26 aa, Mycobacterium
GNARRYEAVLVRRSYRDGKKVRHQTL

SEQ ID NO: 966376 - protein, 17 aa, Mycobacterium
GNAVSCGIKRSNVLADR

SEQ ID NO: 966377 - protein, 19 aa, Mycobacterium
GNTWTRRLLVPNFSSPARL

SEQ ID NO: 966378 - protein, 18 aa, Mycobacterium
GNYIKWDLVPMIQLSPSS

SEQ ID NO: 966379 - protein, 25 aa, Mycobacterium
GPALACADLGLAMGRGTDVAIGAAD

SEQ ID NO: 966380 - protein, 25 aa, Mycobacterium
GPERFYDMVRKFGLGQLTGVGLPGE

SEQ ID NO: 966381 - protein, 17 aa, Mycobacterium
GPGRVLRTLDIRDIKAV

SEQ ID NO: 966382 - protein, 30 aa, Mycobacterium
GPIARLWRGLLLFFSRWWQLETLYRSNIKY

SEQ ID NO: 966383 - protein, 19 aa, Mycobacterium
GPQQYSLVLADGVETVSPL

SEQ ID NO: 966384 - protein, 25 aa, Mycobacterium
GPRLGVRWWRFLGGILLGLACATKW

SEQ ID NO: 966385 - protein, 25 aa, Mycobacterium
GPSPAMPPSLAWWASSLQLSGLNTR

SEQ ID NO: 966386 - protein, 25 aa, Mycobacterium
GQAEILWDVIPFDWTNDSDTVATRC

SEQ ID NO: 966387 - protein, 23 aa, Mycobacterium
GQRRIPVQYAKRMVGRRMYGGTS

SEQ ID NO: 966388 - protein, 22 aa, Mycobacterium
GRALLVTALVPPCIILFFHTQY

SEQ ID NO: 966389 - protein, 17 aa, Mycobacterium
GREPVWYITPGNEHAAA

SEQ ID NO: 966390 - protein, 26 aa, Mycobacterium
GRFRRLAQLGGLVFVSAFTVVTLGMP

SEQ ID NO: 966391 - protein, 25 aa, Mycobacterium
GRFSLDWLIFGKNWFDSCDGLLISV

SEQ ID NO: 966392 - protein, 21 aa, Mycobacterium
GRGSQWAGMGRQLLADEPAFT

SEQ ID NO: 966393 - protein, 19 aa, Mycobacterium
GRMATAWLVTLPLAGSVGA

SEQ ID NO: 966394 - protein, 18 aa, Mycobacterium
GRPMPVSAYSTLADQDMG

SEQ ID NO: 966395 - protein, 18 aa, Mycobacterium
GRRYALWRGARLPPDRVD

SEQ ID NO: 966396 - protein, 21 aa, Mycobacterium
GRRYSLMVLLAIAVLATAAGM

SEQ ID NO: 966397 - protein, 25 aa, Mycobacterium
GRTCICLRFRWLVQPGYLRVTPGSP

SEQ ID NO: 966398 - protein, 18 aa, Mycobacterium
GRYLFPHFVSHDMAAIAT

SEQ ID NO: 966399 - protein, 17 aa, Mycobacterium
GSEKYYWAIDEAVLHIT

SEQ ID NO: 966400 - protein, 18 aa, Mycobacterium
GSFFWLWWTTNLLSGLLA

SEQ ID NO: 966401 - protein, 19 aa, Mycobacterium
GSGVPLALMRSLRYRALDL

SEQ ID NO: 966402 - protein, 20 aa, Mycobacterium
GSIAVVCWLAATVVLVALAV

SEQ ID NO: 966403 - protein, 18 aa, Mycobacterium
GSISDWFLSATIPLAVMN

SEQ ID NO: 966404 - protein, 23 aa, Mycobacterium
GSMTRRFPVLVLLLCMFGVLVVL

SEQ ID NO: 966405 - protein, 22 aa, Mycobacterium
GSPHAVMGFGVFAIAAMLALRF

SEQ ID NO: 966406 - protein, 24 aa, Mycobacterium
GSRGWVPGRCRLAVVENLRRSCLR

SEQ ID NO: 966407 - protein, 25 aa, Mycobacterium
GSVLLIGLVRWFFQLMYRTTASSNS

SEQ ID NO: 966408 - protein, 21 aa, Mycobacterium
GSVLLLCWRDIGHPQGGGSET

SEQ ID NO: 966409 - protein, 37 aa, Mycobacterium
GTGQDAAVIWLNRLRALAHRMCVASLPYAQADLDALQ

SEQ ID NO: 966410 - protein, 20 aa, Mycobacterium
GTPNLAPWVALRLLSQGPTL

SEQ ID NO: 966411 - protein, 24 aa, Mycobacterium
GTRVRVKFNVDRSVPLYQSTTAQI

SEQ ID NO: 966412 - protein, 17 aa, Mycobacterium
GTVRPKGDITPELAEHL

SEQ ID NO: 966413 - protein, 28 aa, Mycobacterium
GVFTRILALILKFTIGFWLGADKEVVSI

SEQ ID NO: 966414 - protein, 19 aa, Mycobacterium
GVIAACLPVMVGGLSIAGA

SEQ ID NO: 966415 - protein, 18 aa, Mycobacterium
GVIARLLADLRRLGNRET

SEQ ID NO: 966416 - protein, 18 aa, Mycobacterium
GVILALIGLHLALVWFQK

SEQ ID NO: 966417 - protein, 23 aa, Mycobacterium
GVLALVICYSWLTIFIGRCYSRR

SEQ ID NO: 966418 - protein, 25 aa, Mycobacterium
GVLVITILIAWRWVPARVARIPGPL

SEQ ID NO: 966419 - protein, 18 aa, Mycobacterium
GVMMASYFAGFITLFILS

SEQ ID NO: 966420 - protein, 20 aa, Mycobacterium
GVMVYCGGLLFFEKAAVIPF

SEQ ID NO: 966421 - protein, 24 aa, Mycobacterium
GVNLLLSPAVFRGFDQVGALSPTG

SEQ ID NO: 966422 - protein, 20 aa, Mycobacterium
GVPYFPNLLAPIVVGGIGIG

SEQ ID NO: 966423 - protein, 17 aa, Mycobacterium
GVSTWLITRAWQMPPAL

SEQ ID NO: 966424 - protein, 31 aa, Mycobacterium
GVTVPRMLFRPSPTLRPTIHLPLDDPYQVPD

SEQ ID NO: 966425 - protein, 18 aa, Mycobacterium
GVVPLLAKRFRIVRYDNR

SEQ ID NO: 966426 - protein, 23 aa, Mycobacterium
GVVTALLAAWGWFTLLLQITGSI

SEQ ID NO: 966427 - protein, 17 aa, Mycobacterium
GVVTEWLAYTLAVVLGV

SEQ ID NO: 966428 - protein, 17 aa, Mycobacterium
GWCDPHYLSSAWSGQLV

SEQ ID NO: 966429 - protein, 21 aa, Mycobacterium
GWDTRRVTFEWQPNSEVANKP

SEQ ID NO: 966430 - protein, 18 aa, Mycobacterium
GWGTIVLCQLRLHKMAKA

SEQ ID NO: 966431 - protein, 20 aa, Mycobacterium
GWGTIVLCQLRLHKMAKAGI

SEQ ID NO: 966432 - protein, 20 aa, Mycobacterium
GWLAERRGAGGIAQQPSCSG

SEQ ID NO: 966433 - protein, 32 aa, Mycobacterium
GWLRSRPGWPAFRPVWRSCLKGGQVLQFVVEM

SEQ ID NO: 966434 - protein, 21 aa, Mycobacterium
GWRFVMRRIASGIALHDTRML

SEQ ID NO: 966435 - protein, 22 aa, Mycobacterium
GWSGVPLFASRCSATVAVAAVS

SEQ ID NO: 966436 - protein, 34 aa, Mycobacterium
GWVAPRRDRAGAFWRRTGVRIVRRPVAYLSASMV

SEQ ID NO: 966437 - protein, 21 aa, Mycobacterium
GYLDPAAPWGRYPVTGQLLFG

SEQ ID NO: 966438 - protein, 19 aa, Mycobacterium
GYLIGRRIGPALFKKENSR

SEQ ID NO: 966439 - protein, 25 aa, Mycobacterium
GYLREFGNLVFHFSLLGLLVAVAVD

SEQ ID NO: 966440 - protein, 18 aa, Mycobacterium
GYTAEFTNISGLRTGQFV

SEQ ID NO: 966441 - protein, 19 aa, Mycobacterium
GYVFRSVCCDVMNTAIVAL

SEQ ID NO: 966442 - protein, 23 aa, Mycobacterium
HAALRTVWRDGLRLWITSLTLTV

SEQ ID NO: 966443 - protein, 24 aa, Mycobacterium
HADYLMWIDGCRELIQNAAEAANG

SEQ ID NO: 966444 - protein, 32 aa, Mycobacterium
HAGRSRRRLLRVTRLDVILAMTIAGIVNTAML

SEQ ID NO: 966445 - protein, 24 aa, Mycobacterium
HASLPPSRRRAWAGRMFIAPNLAS

SEQ ID NO: 966446 - protein, 22 aa, Mycobacterium
HCFGCSEGGDVYAFIQKIEHVS

SEQ ID NO: 966447 - protein, 24 aa, Mycobacterium
HDERSRLAAVLLLDLDDFKVINDS

SEQ ID NO: 966448 - protein, 17 aa, Mycobacterium
HDLPLRSRDRVPLMNTL

SEQ ID NO: 966449 - protein, 19 aa, Mycobacterium
HDLRTPRALADMAELAQRV

SEQ ID NO: 966450 - protein, 19 aa, Mycobacterium
HDRGFRTALLTGDNPASAA

SEQ ID NO: 966451 - protein, 20 aa, Mycobacterium
HELIKFAIVGGTTFIIDSAI

SEQ ID NO: 966452 - protein, 23 aa, Mycobacterium
HETGIDWEVIFLLLSMMIIVSVL

SEQ ID NO: 966453 - protein, 30 aa, Mycobacterium
HEVLRWSRNRMAFLAALLFVMTLCFATTNG

SEQ ID NO: 966454 - protein, 23 aa, Mycobacterium
HGDSGRYYFGLSVSAVLAHAFPV

SEQ ID NO: 966455 - protein, 19 aa, Mycobacterium
HGFLARFYTGLSRLYTGTG

SEQ ID NO: 966456 - protein, 17 aa, Mycobacterium
HGRRVALATSFVLRTGL

SEQ ID NO: 966457 - protein, 19 aa, Mycobacterium
HGTVPIVFERDGTAITSYV

SEQ ID NO: 966458 - protein, 18 aa, Mycobacterium
HGVIWSGVISKVIIPAII

SEQ ID NO: 966459 - protein, 22 aa, Mycobacterium
HKLFGWWGGQGLTGFKNSLTQV

SEQ ID NO: 966460 - protein, 18 aa, Mycobacterium
HLEAFAGNTIEFIKSESP

SEQ ID NO: 966461 - protein, 22 aa, Mycobacterium
HLNDFPIQYGLVVLAAIGMAIL

SEQ ID NO: 966462 - protein, 23 aa, Mycobacterium
HLTELRTRLLISLAAIVVTTIFG

SEQ ID NO: 966463 - protein, 17 aa, Mycobacterium
HNLGWLFLFKQGNVSLA

SEQ ID NO: 966464 - protein, 19 aa, Mycobacterium
HPYGRVFAALVAPRLGPVK

SEQ ID NO: 966465 - protein, 19 aa, Mycobacterium
HQTETPLLFAVDGTLVGLI

SEQ ID NO: 966466 - protein, 24 aa, Mycobacterium
HREQWPVAGPVIGRLGWYVESTLS

SEQ ID NO: 966467 - protein, 17 aa, Mycobacterium
HRIPGAVGMAIAEWHQA

SEQ ID NO: 966468 - protein, 17 aa, Mycobacterium
HRPALAVLDLFSAQRLD

SEQ ID NO: 966469 - protein, 20 aa, Mycobacterium
HRTVKRWRCPPPTRLRSTAC

SEQ ID NO: 966470 - protein, 26 aa, Mycobacterium
HSLHWKITEAPLFYGSYTALLGISAV

SEQ ID NO: 966471 - protein, 30 aa, Mycobacterium
HTGGAWLILFMIFNVIWTYAVFRGASVDAL

SEQ ID NO: 966472 - protein, 34 aa, Mycobacterium
HTKPPFVARMIHRFAVPIILVWLAIAVTVSVFIP

SEQ ID NO: 966473 - protein, 21 aa, Mycobacterium
HTMMFQEMVNRVGADVPGMPR

SEQ ID NO: 966474 - protein, 23 aa, Mycobacterium
HTMSIDWVAWRGLGFAANAQIVS

SEQ ID NO: 966475 - protein, 19 aa, Mycobacterium
HTRMLRYAAKRCTVRRGAL

SEQ ID NO: 966476 - protein, 20 aa, Mycobacterium
HVPNRLAVVRVEAGESLQDV

SEQ ID NO: 966477 - protein, 18 aa, Mycobacterium
HWGHHVGRLVAHPDSEQL

SEQ ID NO: 966478 - protein, 17 aa, Mycobacterium
HYFARDTLKPEVTLADY

SEQ ID NO: 966479 - protein, 26 aa, Mycobacterium
HYGGDAWVIRQGRRSRIDAMNRSVLL

SEQ ID NO: 966480 - protein, 17 aa, Mycobacterium
IAAVGGHGVIWSGVISK

SEQ ID NO: 966481 - protein, 23 aa, Mycobacterium
IACYQDFLRYYFLTVESNADGSM

SEQ ID NO: 966482 - protein, 24 aa, Mycobacterium
IADIASQVGRLWGLTSALTADGRT

SEQ ID NO: 966483 - protein, 38 aa, Mycobacterium
IADPYKYFLRFFQRLGFRPAIAVVLAIIALQLYDFLWY

SEQ ID NO: 966484 - protein, 31 aa, Mycobacterium
IAFATGGLLAWSRCRPISAGVLIGLGAAAKL

SEQ ID NO: 966485 - protein, 27 aa, Mycobacterium
IAGALGILRFIALFGPVHFFAQPVVSL

SEQ ID NO: 966486 - protein, 27 aa, Mycobacterium
IAHGLGMPIPLGWQLWLYGVFAISAVG

SEQ ID NO: 966487 - protein, 17 aa, Mycobacterium
IAIPAWYTPLVLTVGGI

SEQ ID NO: 966488 - protein, 17 aa, Mycobacterium
IAKSMAPQVDKVHQQRW

SEQ ID NO: 966489 - protein, 17 aa, Mycobacterium
IALGIVVAVALLIGAVL

SEQ ID NO: 966490 - protein, 20 aa, Mycobacterium
IALIAHWKPLMVELANQVMS

SEQ ID NO: 966491 - protein, 17 aa, Mycobacterium
IALQLGIRTVLAFRGYF

SEQ ID NO: 966492 - protein, 20 aa, Mycobacterium
IAPELYLKRLCIGGVERVFE

SEQ ID NO: 966493 - protein, 17 aa, Mycobacterium
IARWRSPMRRVYTANLH

SEQ ID NO: 966494 - protein, 23 aa, Mycobacterium
IATLRITFLSALVLELLVTLGVA

SEQ ID NO: 966495 - protein, 22 aa, Mycobacterium
IAVSLPLLWWRYRRDDRSALTG

SEQ ID NO: 966496 - protein, 26 aa, Mycobacterium
IAVVMWTTFWVLVGIAVYNTISTIAD

SEQ ID NO: 966497 - protein, 27 aa, Mycobacterium
ICFLWDEAWYAFATAVPWARQRTAMVS

SEQ ID NO: 966498 - protein, 30 aa, Mycobacterium
IDAINFWIRRACRLLPALVLMVLTVGIARE

SEQ ID NO: 966499 - protein, 26 aa, Mycobacterium
IDDALELRGRILSAFEQAERSNDPER

SEQ ID NO: 966500 - protein, 24 aa, Mycobacterium
IDEFYEWFRIVPTAVDVLDSIGRQ

SEQ ID NO: 966501 - protein, 19 aa, Mycobacterium
IDFRPKHKLAVLMVSVILL

SEQ ID NO: 966502 - protein, 18 aa, Mycobacterium
IDLNGRVLGVVFGAAVDD

SEQ ID NO: 966503 - protein, 23 aa, Mycobacterium
IDTRTEALIARATHDLLQDRTSF

SEQ ID NO: 966504 - protein, 19 aa, Mycobacterium
IDYFAEVNLAGFYDLTHTL

SEQ ID NO: 966505 - protein, 18 aa, Mycobacterium
IEALGRVDTICFDKTGTL

SEQ ID NO: 966506 - protein, 21 aa, Mycobacterium
IEARALGAVLGRGRAEDSPLL

SEQ ID NO: 966507 - protein, 25 aa, Mycobacterium
IEILPVAGLPEFRPGDDLSAALAAA

SEQ ID NO: 966508 - protein, 24 aa, Mycobacterium
IELMVARQGIIFQLIITPLDYHNL

SEQ ID NO: 966509 - protein, 18 aa, Mycobacterium
IEPLRSAFDYGQINVLPM

SEQ ID NO: 966510 - protein, 17 aa, Mycobacterium
IERRVISMAHSFFSPSV

SEQ ID NO: 966511 - protein, 18 aa, Mycobacterium
IFDPKVFVISFVFNVSMA

SEQ ID NO: 966512 - protein, 24 aa, Mycobacterium
IFGCVALIAVIFIKVFGVVAPGGD

SEQ ID NO: 966513 - protein, 20 aa, Mycobacterium
IGAGVLYFYFVLPRWPELIG

SEQ ID NO: 966514 - protein, 17 aa, Mycobacterium
IGAVAFALSPRVLTTLG

SEQ ID NO: 966515 - protein, 24 aa, Mycobacterium
IGFKTKITTLLSWTVTFLSTRRGQ

SEQ ID NO: 966516 - protein, 19 aa, Mycobacterium
IGGIAGWIAGKIVQGGGSG

SEQ ID NO: 966517 - protein, 25 aa, Mycobacterium
IGGRELSIMPLLPVLLMVWATAHST

SEQ ID NO: 966518 - protein, 17 aa, Mycobacterium
IGIAVAFLAAVTLMPAL

SEQ ID NO: 966519 - protein, 17 aa, Mycobacterium
IGIMRLVGASRWYTQLP

SEQ ID NO: 966520 - protein, 18 aa, Mycobacterium
IGKLFAGTLVVWFFVLFD

SEQ ID NO: 966521 - protein, 26 aa, Mycobacterium
IGLGMLVCGVAFKATMIGSFPILSVF

SEQ ID NO: 966522 - protein, 18 aa, Mycobacterium
IGLYYVMLTFVARPYLIP

SEQ ID NO: 966523 - protein, 19 aa, Mycobacterium
IGMGGEWGLGAALAMEKVL

SEQ ID NO: 966524 - protein, 19 aa, Mycobacterium
IGPAQAWYTENLRYYYLIL

SEQ ID NO: 966525 - protein, 36 aa, Mycobacterium
IGPLEFSGFIAWLMWLVLHLMYLIGFKTKITTLLSW

SEQ ID NO: 966526 - protein, 17 aa, Mycobacterium
IGPWRLLLRDLTHLLDT

SEQ ID NO: 966527 - protein, 17 aa, Mycobacterium
IGSYGDFVNFYSCDITL

SEQ ID NO: 966528 - protein, 27 aa, Mycobacterium
IGVMLGWRPALICLALGAAIIALGTAG

SEQ ID NO: 966529 - protein, 19 aa, Mycobacterium
IHRLVVPRVLAATLVATLL

SEQ ID NO: 966530 - protein, 24 aa, Mycobacterium
IIGGRPAPTDGFIGVAPDVRLLSL

SEQ ID NO: 966531 - protein, 18 aa, Mycobacterium
IIPLAAWATRTGFRVAAI

SEQ ID NO: 966532 - protein, 23 aa, Mycobacterium
IIVEVWKTTPFMSLLLLVGLALV

SEQ ID NO: 966533 - protein, 21 aa, Mycobacterium
IKGIMLAAAVFVFLQRRKIGI

SEQ ID NO: 966534 - protein, 18 aa, Mycobacterium
IKIAGPFAPIAYTLAGIF

SEQ ID NO: 966535 - protein, 23 aa, Mycobacterium
IKKYAAAVLAVFVVPMLIRVLLS

SEQ ID NO: 966536 - protein, 24 aa, Mycobacterium
ILAKPLVRYTVRTDKNGFVARLDV

SEQ ID NO: 966537 - protein, 18 aa, Mycobacterium
ILASTRFRAGLEKISGAT

SEQ ID NO: 966538 - protein, 24 aa, Mycobacterium
ILESRLAALGSRAGASLIPKGPLP

SEQ ID NO: 966539 - protein, 26 aa, Mycobacterium
ILFLLRARQAIRIVVIMLLTADFSLA

SEQ ID NO: 966540 - protein, 27 aa, Mycobacterium
ILIAAFGMRLIFPAVIVWATAKLDPVR

SEQ ID NO: 966541 - protein, 19 aa, Mycobacterium
ILIAWYLILRLFKYTLSSV

SEQ ID NO: 966542 - protein, 18 aa, Mycobacterium
ILLEEVYLSTAIPMLVFS

SEQ ID NO: 966543 - protein, 26 aa, Mycobacterium
ILLYQKIWWPSIAWLVLTVATVYSAA

SEQ ID NO: 966544 - protein, 22 aa, Mycobacterium
ILPESANIIWLLLGTTLAVDWI

SEQ ID NO: 966545 - protein, 18 aa, Mycobacterium
ILPIHLWQARLAPQAKPY

SEQ ID NO: 966546 - protein, 26 aa, Mycobacterium
ILRRTRPDLQWGFRVPLLPIALICAS

SEQ ID NO: 966547 - protein, 22 aa, Mycobacterium
ILRSAARSGNWSLFDGGYTFAS

SEQ ID NO: 966548 - protein, 23 aa, Mycobacterium
ILTDPYWWTALAVTLAITVVSVS

SEQ ID NO: 966549 - protein, 24 aa, Mycobacterium
ILTLYLVERWRPRPMAVSLLSIMV

SEQ ID NO: 966550 - protein, 17 aa, Mycobacterium
ILVRGLMNYTFWMPNGS

SEQ ID NO: 966551 - protein, 22 aa, Mycobacterium
IMLLEVLFLWWLINGSEPKTVS

SEQ ID NO: 966552 - protein, 21 aa, Mycobacterium
INGRVEFQQVSFAYRTGTPVI

SEQ ID NO: 966553 - protein, 25 aa, Mycobacterium
INGVKEFPGPWALVPVGAAMLLILA

SEQ ID NO: 966554 - protein, 17 aa, Mycobacterium
INLFLKYHAGEYKILNV

SEQ ID NO: 966555 - protein, 18 aa, Mycobacterium
INQQRWSFDLSMTGQLLL

SEQ ID NO: 966556 - protein, 27 aa, Mycobacterium
IPHLDAGPFLSYGIQWISFGIIAPIGL

SEQ ID NO: 966557 - protein, 24 aa, Mycobacterium
IPNVLRPDLTIAYTDTDGHGQRGD

SEQ ID NO: 966558 - protein, 23 aa, Mycobacterium
IPPPEGKPWWVIVIGVVVIGLVG

SEQ ID NO: 966559 - protein, 18 aa, Mycobacterium
IPSLSIVIIVEVWKTTPF

SEQ ID NO: 966560 - protein, 25 aa, Mycobacterium
IPVDEWAVAVALALRAFPMLINEFQ

SEQ ID NO: 966561 - protein, 27 aa, Mycobacterium
IPVVTWAAWPFHRVAIHNARYHGASME

SEQ ID NO: 966562 - protein, 24 aa, Mycobacterium
IPYWPHWDTGAVVLKLYEHLVENR

SEQ ID NO: 966563 - protein, 22 aa, Mycobacterium
IQLALTELWRSYGVTPDAVIGH

SEQ ID NO: 966564 - protein, 18 aa, Mycobacterium
IRFEIEFYQVYLVFVLGF

SEQ ID NO: 966565 - protein, 25 aa, Mycobacterium
IRFKDLELRYACLARVVALEGARAP

SEQ ID NO: 966566 - protein, 20 aa, Mycobacterium
IRGAISFVVVISFIHAFQTF

SEQ ID NO: 966567 - protein, 29 aa, Mycobacterium
IRGKMKGGPLPRGRGLLMAEDTGVLVQVA

SEQ ID NO: 966568 - protein, 20 aa, Mycobacterium
IRHTEQWVLIIAALVVGIVL

SEQ ID NO: 966569 - protein, 18 aa, Mycobacterium
IRKFPQYRDVAGKDSFPA

SEQ ID NO: 966570 - protein, 27 aa, Mycobacterium
IRLPDLICGVACWLLLSREVLPRLGPA

SEQ ID NO: 966571 - protein, 18 aa, Mycobacterium
IRQFISITVPFIRGAISF

SEQ ID NO: 966572 - protein, 24 aa, Mycobacterium
IRSLARAVVHAANLGASVINISET

SEQ ID NO: 966573 - protein, 21 aa, Mycobacterium
IRVPREFINNYLFNFPDTSIA

SEQ ID NO: 966574 - protein, 20 aa, Mycobacterium
IRVRMQVWWDPFTNLDVGGY

SEQ ID NO: 966575 - protein, 20 aa, Mycobacterium
IRVTPKFTRMLVAGTFGVLA

SEQ ID NO: 966576 - protein, 17 aa, Mycobacterium
ISAEFYRSVNLPWLASI

SEQ ID NO: 966577 - protein, 38 aa, Mycobacterium
ISEMINMPAGFSIGWAMWFILVCSVLQAIAAVAALLLE

SEQ ID NO: 966578 - protein, 24 aa, Mycobacterium
ISFEVRGGLFVRQIHHWAALMFTA

SEQ ID NO: 966579 - protein, 17 aa, Mycobacterium
ISLNFTMFRAAFEQGAQ

SEQ ID NO: 966580 - protein, 17 aa, Mycobacterium
ISNPELVAGYLGMANGL

SEQ ID NO: 966581 - protein, 23 aa, Mycobacterium
ISTISFGTVYGFVEINGQRQPVP

SEQ ID NO: 966582 - protein, 18 aa, Mycobacterium
ISWPRPHVSFYLDPMTFW

SEQ ID NO: 966583 - protein, 23 aa, Mycobacterium
ISWTHHWVWLVPLMIWLIHGPLG

SEQ ID NO: 966584 - protein, 24 aa, Mycobacterium
ITGFARVVLLAAILGAALSSAFSV

SEQ ID NO: 966585 - protein, 25 aa, Mycobacterium
ITLILLTFHWARVVWSSTIVQLATE

SEQ ID NO: 966586 - protein, 24 aa, Mycobacterium
ITLMSGLATWVWDCFADPRAALAA

SEQ ID NO: 966587 - protein, 24 aa, Mycobacterium
ITLVLWWQMIRFEYALLVTIATAA

SEQ ID NO: 966588 - protein, 25 aa, Mycobacterium
ITRVIEIPYGLPFLANSQFSNVTLH

SEQ ID NO: 966589 - protein, 25 aa, Mycobacterium
ITTLGLRIYLKWITGTGYTYGALTT

SEQ ID NO: 966590 - protein, 28 aa, Mycobacterium
ITVATGRTPTLWRPAGGLSNEAVRQVAG

SEQ ID NO: 966591 - protein, 24 aa, Mycobacterium
ITVVMAAMVSLIWWTSDAQATHSR

SEQ ID NO: 966592 - protein, 25 aa, Mycobacterium
IVAAVLCHRLMMLIGVGLVVWATPQ

SEQ ID NO: 966593 - protein, 24 aa, Mycobacterium
IVALVVVVLFGWWRGLYLTTILRR

SEQ ID NO: 966594 - protein, 17 aa, Mycobacterium
IVAWLLIVILLAWLFAP

SEQ ID NO: 966595 - protein, 17 aa, Mycobacterium
IVFVWIFQRRIVAGLTS

SEQ ID NO: 966596 - protein, 25 aa, Mycobacterium
IVGGAIAFHILFRVSLLLGGVITGT

SEQ ID NO: 966597 - protein, 18 aa, Mycobacterium
IVGGILWGGGVTVAGYFL

SEQ ID NO: 966598 - protein, 18 aa, Mycobacterium
IVGLFAIGLLLAMLRGNH

SEQ ID NO: 966599 - protein, 17 aa, Mycobacterium
IVGRIAAFVIFTVACIT

SEQ ID NO: 966600 - protein, 17 aa, Mycobacterium
IVNAVPLQVMIFYVGAF

SEQ ID NO: 966601 - protein, 17 aa, Mycobacterium
IVSEIFPVFSRKPIFGY

SEQ ID NO: 966602 - protein, 24 aa, Mycobacterium
IVTVVASYSWYYAWTPGTGYLASL

SEQ ID NO: 966603 - protein, 17 aa, Mycobacterium
IVVAALFALIIAMPLGI

SEQ ID NO: 966604 - protein, 22 aa, Mycobacterium
IWTQPRPAPLVRRRVLTDTLNY

SEQ ID NO: 966605 - protein, 24 aa, Mycobacterium
IYQEAALTWLLLVSVPILAVTNYW

SEQ ID NO: 966606 - protein, 18 aa, Mycobacterium
KAGSALRALAARGAKNVE

SEQ ID NO: 966607 - protein, 24 aa, Mycobacterium
KALARPAFTVMALLGVQFIMATAA

SEQ ID NO: 966608 - protein, 18 aa, Mycobacterium
KANQRRIRRRKGRKDNEA

SEQ ID NO: 966609 - protein, 27 aa, Mycobacterium
KARVVEFGRRPAVIAALVSCAVLTVIV

SEQ ID NO: 966610 - protein, 26 aa, Mycobacterium
KASAWVGALVLGWWVGVLVYFLPRWP

SEQ ID NO: 966611 - protein, 24 aa, Mycobacterium
KASGLPSAVINWGPWSDVGVAQAL

SEQ ID NO: 966612 - protein, 24 aa, Mycobacterium
KATATHLVSVFAHRARLVLGRLAV

SEQ ID NO: 966613 - protein, 23 aa, Mycobacterium
KATATHLVSVFAHRARLVPGQLA

SEQ ID NO: 966614 - protein, 19 aa, Mycobacterium
KDKEPFSRDGVQQVYSINI

SEQ ID NO: 966615 - protein, 17 aa, Mycobacterium
KEARVQSSFLRDNARVD

SEQ ID NO: 966616 - protein, 30 aa, Mycobacterium
KEVPRGQVGRIFVGNAFPFEGYTGGGGKQI

SEQ ID NO: 966617 - protein, 18 aa, Mycobacterium
KFTPLIAVLWLTAVAAVC

SEQ ID NO: 966618 - protein, 23 aa, Mycobacterium
KGHADSGMSQALFMTALGMAIGL

SEQ ID NO: 966619 - protein, 18 aa, Mycobacterium
KGLGIAGGAKRPGAKKSP

SEQ ID NO: 966620 - protein, 18 aa, Mycobacterium
KGPPSWNTMYKSIRSNNI

SEQ ID NO: 966621 - protein, 21 aa, Mycobacterium
KGVTARWNWVLDGMVDINALS

SEQ ID NO: 966622 - protein, 20 aa, Mycobacterium
KIMPAGGLIPLSRTSPALDL

SEQ ID NO: 966623 - protein, 18 aa, Mycobacterium
KIWIRFPGFSIQPAEFSK

SEQ ID NO: 966624 - protein, 22 aa, Mycobacterium
KKLALIDVREPVEWDIVHIDGA

SEQ ID NO: 966625 - protein, 19 aa, Mycobacterium
KKVATEWHQLVGANTVEEV

SEQ ID NO: 966626 - protein, 20 aa, Mycobacterium
KLAEVIWLVIGLLGLSVPEI

SEQ ID NO: 966627 - protein, 17 aa, Mycobacterium
KLFGLAAKFPARLTIAV

SEQ ID NO: 966628 - protein, 27 aa, Mycobacterium
KLIPHSWANMLHLGYYPAVIVSLLVAV

SEQ ID NO: 966629 - protein, 24 aa, Mycobacterium
KLKSGRISIEWRLVMVAVLLFSRS

SEQ ID NO: 966630 - protein, 19 aa, Mycobacterium
KLLQMRTFPTIAVGGDTAG

SEQ ID NO: 966631 - protein, 18 aa, Mycobacterium
KLLSPTRIRRVLTVSRLL

SEQ ID NO: 966632 - protein, 19 aa, Mycobacterium
KLLVVFGVEVLLTFYPGWV

SEQ ID NO: 966633 - protein, 20 aa, Mycobacterium
KLRILLSFGDIAEFIALGKS

SEQ ID NO: 966634 - protein, 20 aa, Mycobacterium
KLTPAVFLLYFVLRRDNRAA

SEQ ID NO: 966635 - protein, 24 aa, Mycobacterium
KLVSCAYGLGGLCSVVKNIGTTYG

SEQ ID NO: 966636 - protein, 19 aa, Mycobacterium
KPFVRQIRTTRQMQELQPR

SEQ ID NO: 966637 - protein, 19 aa, Mycobacterium
KPSEVDWVLDRLGRELEAL

SEQ ID NO: 966638 - protein, 24 aa, Mycobacterium
KRFGATPLPVWGIIAGKSLAVVTV

SEQ ID NO: 966639 - protein, 21 aa, Mycobacterium
KRFGKRWGPQVRMVFYDHCGH

SEQ ID NO: 966640 - protein, 17 aa, Mycobacterium
KRNPVLRAFSARMSDQR

SEQ ID NO: 966641 - protein, 18 aa, Mycobacterium
KRTARLVGDVPIYDIIVG

SEQ ID NO: 966642 - protein, 29 aa, Mycobacterium
KRYFADGLQHWPWMLLGYFVITILVVSLI

SEQ ID NO: 966643 - protein, 28 aa, Mycobacterium
KSAGTPISFWEFTRKGIAVTVISIALAG

SEQ ID NO: 966644 - protein, 24 aa, Mycobacterium
KSALVLGLWLAGWGAARLVVTALP

SEQ ID NO: 966645 - protein, 19 aa, Mycobacterium
KSEFIRAGKYMGVSSRRMI

SEQ ID NO: 966646 - protein, 22 aa, Mycobacterium
KSGLTALTWPVVTNFAVDSAMA

SEQ ID NO: 966647 - protein, 18 aa, Mycobacterium
KSTLVALICRLYDVTAGA

SEQ ID NO: 966648 - protein, 28 aa, Mycobacterium
KTASTPPLWVIVCCAIAIAAGTYLGGWR

SEQ ID NO: 966649 - protein, 19 aa, Mycobacterium
KTDARRALVIAGDSAKVSE

SEQ ID NO: 966650 - protein, 23 aa, Mycobacterium
KTPEGVAWLYSFIKAQGERNYGK

SEQ ID NO: 966651 - protein, 25 aa, Mycobacterium
KTPGVTLRLMLTWVPSTGVPVLAIV

SEQ ID NO: 966652 - protein, 23 aa, Mycobacterium
KTVPKRLSALLNTSGLPAVLEPF

SEQ ID NO: 966653 - protein, 22 aa, Mycobacterium
KVGEPDGGIAYERVIRPLCALT

SEQ ID NO: 966654 - protein, 17 aa, Mycobacterium
KVLPDLSIPGYRNVFVV

SEQ ID NO: 966655 - protein, 24 aa, Mycobacterium
KVNQAGVIPVIFASSLIYIPHLIT

SEQ ID NO: 966656 - protein, 22 aa, Mycobacterium
KVRHNMRMRKVLTSVIATVVTM

SEQ ID NO: 966657 - protein, 27 aa, Mycobacterium
KVVAWKLKPGVVSTMSARARYTDPDTR

SEQ ID NO: 966658 - protein, 21 aa, Mycobacterium
KVVYRRGFVTRHQVTGWRFVM

SEQ ID NO: 966659 - protein, 23 aa, Mycobacterium
KWGDLAMLPAMPARRSPHRAALI

SEQ ID NO: 966660 - protein, 22 aa, Mycobacterium
LAALLMLYTIVIVRGLRTAIAT

SEQ ID NO: 966661 - protein, 18 aa, Mycobacterium
LAALLRQRFPDLTPAQII

SEQ ID NO: 966662 - protein, 19 aa, Mycobacterium
LAASLSLITLVVFHSQTLA

SEQ ID NO: 966663 - protein, 20 aa, Mycobacterium
LAAWATRTGFRVAAITVTIV

SEQ ID NO: 966664 - protein, 20 aa, Mycobacterium
LACATKWSGLYFVLFFGVMS

SEQ ID NO: 966665 - protein, 21 aa, Mycobacterium
LACGLKFRLGFDDSLDMVGVH

SEQ ID NO: 966666 - protein, 25 aa, Mycobacterium
LAEQGLRVLAVAQCSWGHDTTDDND

SEQ ID NO: 966667 - protein, 33 aa, Mycobacterium
LAFLLVFGLFVRRGWDIIGCMVLFAYGGVLLGV

SEQ ID NO: 966668 - protein, 24 aa, Mycobacterium
LAGCGIGTGGYCMLRYHQDSQAMA

SEQ ID NO: 966669 - protein, 23 aa, Mycobacterium
LAGIACWLIINHWVLRRLGPGTG

SEQ ID NO: 966670 - protein, 17 aa, Mycobacterium
LAIGIAVAFLAAVTLMP

SEQ ID NO: 966671 - protein, 19 aa, Mycobacterium
LALGWWQWTRFQSASGTFQ

SEQ ID NO: 966672 - protein, 21 aa, Mycobacterium
LALLRRASLRQAVADGVAIAV

SEQ ID NO: 966673 - protein, 17 aa, Mycobacterium
LALPPFRVPAPRNTAQY

SEQ ID NO: 966674 - protein, 26 aa, Mycobacterium
LALQKMSFEVAWRILCATPVTATALV

SEQ ID NO: 966675 - protein, 22 aa, Mycobacterium
LALSLYLVYTLLTWAQARLLNV

SEQ ID NO: 966676 - protein, 17 aa, Mycobacterium
LALSWSRVTTVFVVAIV

SEQ ID NO: 966677 - protein, 17 aa, Mycobacterium
LAMMVLSKSFSVLRSAV

SEQ ID NO: 966678 - protein, 21 aa, Mycobacterium
LAQDARLGPAFGSELPSESEE

SEQ ID NO: 966679 - protein, 18 aa, Mycobacterium
LARRTRRRINLGLVAGAL

SEQ ID NO: 966680 - protein, 21 aa, Mycobacterium
LARSRALRMPFYHTIISLVTW

SEQ ID NO: 966681 - protein, 20 aa, Mycobacterium
LATGCLRVTASITISPDNLV

SEQ ID NO: 966682 - protein, 17 aa, Mycobacterium
LAVDGWNAHIATARKIL

SEQ ID NO: 966683 - protein, 20 aa, Mycobacterium
LAVELRLAGIVATNTTVSRD

SEQ ID NO: 966684 - protein, 35 aa, Mycobacterium
LAVMPALMAYPWWFTRSYWLLGIVALVVVVLFGWW

SEQ ID NO: 966685 - protein, 24 aa, Mycobacterium
LAWMTIDALVWVPRMYYLYGNPSR

SEQ ID NO: 966686 - protein, 18 aa, Mycobacterium
LCGISVIMRDGVAIGPWR

SEQ ID NO: 966687 - protein, 18 aa, Mycobacterium
LCLIFIIMLIITRAFVAA

SEQ ID NO: 966688 - protein, 25 aa, Mycobacterium
LCQRRWQPRLVLVVLAGMLLISPGW

SEQ ID NO: 966689 - protein, 18 aa, Mycobacterium
LCRQRNATEFSVKQTRNS

SEQ ID NO: 966690 - protein, 26 aa, Mycobacterium
LDATVVRMFLVPSVMKLLGDDCWWAP

SEQ ID NO: 966691 - protein, 24 aa, Mycobacterium
LDDEGFPVFSGRKDAVVKISGKRV

SEQ ID NO: 966692 - protein, 20 aa, Mycobacterium
LDERRRLLGQPALGPALMTA

SEQ ID NO: 966693 - protein, 26 aa, Mycobacterium
LDLRAKAGAMSLILASRILGVDITAS

SEQ ID NO: 966694 - protein, 23 aa, Mycobacterium
LDPLPRWVRDDVLTTGDLIISGV

SEQ ID NO: 966695 - protein, 18 aa, Mycobacterium
LDPMTFWRAWSAEPNTAA

SEQ ID NO: 966696 - protein, 17 aa, Mycobacterium
LDRIAYRTTIFAFPVFG

SEQ ID NO: 966697 - protein, 25 aa, Mycobacterium
LDRKLDEAAGFAIPFVPRGLDEIPR

SEQ ID NO: 966698 - protein, 22 aa, Mycobacterium
LDTLPWPPPTVFVMRHGAGNTY

SEQ ID NO: 966699 - protein, 25 aa, Mycobacterium
LDTRPRLILGATLIALSFLGLRHLW

SEQ ID NO: 966700 - protein, 20 aa, Mycobacterium
LEAVPPFFRWLSEFEPLHQL

SEQ ID NO: 966701 - protein, 17 aa, Mycobacterium
LEGCAFVVCCTRSPVRS

SEQ ID NO: 966702 - protein, 19 aa, Mycobacterium
LEIGVPIFFALSGFLLFSP

SEQ ID NO: 966703 - protein, 17 aa, Mycobacterium
LELLGATSMLLKRYSHS

SEQ ID NO: 966704 - protein, 18 aa, Mycobacterium
LETSCYNPSFGPDRQARV

SEQ ID NO: 966705 - protein, 21 aa, Mycobacterium
LFAFFGGFAIMLGAEFNASIQ

SEQ ID NO: 966706 - protein, 20 aa, Mycobacterium
LFATYVAAYCIGRFCVELLR

SEQ ID NO: 966707 - protein, 18 aa, Mycobacterium
LFGSAFGTYLMRQFFRTL

SEQ ID NO: 966708 - protein, 20 aa, Mycobacterium
LFIGAALTWSVFRNHREVKA

SEQ ID NO: 966709 - protein, 18 aa, Mycobacterium
LFLSNLNRPVVRRLHVRL

SEQ ID NO: 966710 - protein, 19 aa, Mycobacterium
LFSPLRRRATAALAVVGER

SEQ ID NO: 966711 - protein, 18 aa, Mycobacterium
LFVPLAHLSVMFAVLPST

SEQ ID NO: 966712 - protein, 17 aa, Mycobacterium
LGALLWSFISPSGQLNE

SEQ ID NO: 966713 - protein, 27 aa, Mycobacterium
LGDRWSRLRWQIPMSLTGAALGAFLLL

SEQ ID NO: 966714 - protein, 22 aa, Mycobacterium
LGEALIKVGFYAAIATLAVAPL

SEQ ID NO: 966715 - protein, 18 aa, Mycobacterium
LGFVGVLFAGLWALIVYF

SEQ ID NO: 966716 - protein, 18 aa, Mycobacterium
LGGCAAATSVLISALRAH

SEQ ID NO: 966717 - protein, 30 aa, Mycobacterium
LGLKLPAVPIPWSILSLFAVGPTLSRADAL

SEQ ID NO: 966718 - protein, 22 aa, Mycobacterium
LGLMRSIICQLTFSHGPDHVQM

SEQ ID NO: 966719 - protein, 27 aa, Mycobacterium
LGLVAGALCILVMVMWVGTALTISTTA

SEQ ID NO: 966720 - protein, 22 aa, Mycobacterium
LGMAIGLLLGGVVTRIYDRGGC

SEQ ID NO: 966721 - protein, 25 aa, Mycobacterium
LGQTARLYIRPVLNSLPVQRGQDPK

SEQ ID NO: 966722 - protein, 17 aa, Mycobacterium
LGRPWYLAWGGLVYIVV

SEQ ID NO: 966723 - protein, 23 aa, Mycobacterium
LGSDPFVAILAFPFIPQAMRDHY

SEQ ID NO: 966724 - protein, 24 aa, Mycobacterium
LGSTLVLRRRFKPATVLEDIEKHQ

SEQ ID NO: 966725 - protein, 18 aa, Mycobacterium
LGVIVLLLAGPRLVDAYV

SEQ ID NO: 966726 - protein, 19 aa, Mycobacterium
LGYQRFGIRAGMGDAHDTV

SEQ ID NO: 966727 - protein, 17 aa, Mycobacterium
LHIFLAPINVTFKRLPD

SEQ ID NO: 966728 - protein, 24 aa, Mycobacterium
LHQLFLGVRSLLYLKGHADSGMSQ

SEQ ID NO: 966729 - protein, 28 aa, Mycobacterium
LHRHPHWKRLIWPAVVLILATGLVSFGS

SEQ ID NO: 966730 - protein, 24 aa, Mycobacterium
LHRTADYWLGWYVIIGTIPICILG

SEQ ID NO: 966731 - protein, 18 aa, Mycobacterium
LHSMPVPFILNQPPPPPG

SEQ ID NO: 966732 - protein, 23 aa, Mycobacterium
LIAALCFAMLAYLVLLGRMAVAM

SEQ ID NO: 966733 - protein, 22 aa, Mycobacterium
LIEQPIRHWRPVRVPLLPLAAA

SEQ ID NO: 966734 - protein, 19 aa, Mycobacterium
LIFGWLAFLLVFGLFVRRG

SEQ ID NO: 966735 - protein, 29 aa, Mycobacterium
LIGLSMLGDLPWWVTVLIMTRELGVTLLR

SEQ ID NO: 966736 - protein, 31 aa, Mycobacterium
LIGRSWLMTPLRVMFLIGLVFLALGWSTKAA

SEQ ID NO: 966737 - protein, 17 aa, Mycobacterium
LIGSEFLDVLASVPDPR

SEQ ID NO: 966738 - protein, 25 aa, Mycobacterium
LILSALRVNWAFGIQLFDYTGETSP

SEQ ID NO: 966739 - protein, 23 aa, Mycobacterium
LILTDGRAVIWGSTDRAEEKAEK

SEQ ID NO: 966740 - protein, 19 aa, Mycobacterium
LIMLVRFTISLSFGSISDW

SEQ ID NO: 966741 - protein, 22 aa, Mycobacterium
LINRRPNAVVTISTIASGVSQL

SEQ ID NO: 966742 - protein, 17 aa, Mycobacterium
LIPAFVYVLLVMHADGW

SEQ ID NO: 966743 - protein, 32 aa, Mycobacterium
LIRTLTVSFWAPIPFAAGLMTLVFIGSMVAGI

SEQ ID NO: 966744 - protein, 20 aa, Mycobacterium
LISDFGWGVTCFITVAAGVL

SEQ ID NO: 966745 - protein, 23 aa, Mycobacterium
LISRAGGRYSVYLWALLAMAAAR

SEQ ID NO: 966746 - protein, 27 aa, Mycobacterium
LIVRNWRLIGKCLRPLPNKWKGLTDPE

SEQ ID NO: 966747 - protein, 19 aa, Mycobacterium
LKANGYRLVTVTELLGPRA

SEQ ID NO: 966748 - protein, 19 aa, Mycobacterium
LKGGSAVKPFAGVPHVSRI

SEQ ID NO: 966749 - protein, 18 aa, Mycobacterium
LKGLCPFHNEKSPSFHVR

SEQ ID NO: 966750 - protein, 19 aa, Mycobacterium
LKITYGWSLLLIVVSTVLC

SEQ ID NO: 966751 - protein, 20 aa, Mycobacterium
LKTSWYLLGPAFVAAIAYVD

SEQ ID NO: 966752 - protein, 17 aa, Mycobacterium
LKVLNRHSVTVVGCGVD

SEQ ID NO: 966753 - protein, 23 aa, Mycobacterium
LLAAWPHSPLFSFFLPDGNEHQI

SEQ ID NO: 966754 - protein, 28 aa, Mycobacterium
LLAGPRLVDAYVEWLWFGELGYRSVFST

SEQ ID NO: 966755 - protein, 20 aa, Mycobacterium
LLAKRFRIVRYDNRGVGQSS

SEQ ID NO: 966756 - protein, 30 aa, Mycobacterium
LLALCGVDGLPFEWSVKSWAKKTQQSTSRT

SEQ ID NO: 966757 - protein, 20 aa, Mycobacterium
LLDRMADKWRLDLASDALPA

SEQ ID NO: 966758 - protein, 21 aa, Mycobacterium
LLEDLRCERGLTVVVTSHDFV

SEQ ID NO: 966759 - protein, 34 aa, Mycobacterium
LLESVAPNRPVQWRHVPAILLMLALLLFTIAMAG

SEQ ID NO: 966760 - protein, 22 aa, Mycobacterium
LLFPVVQPWYLLWAIIPLAAWA

SEQ ID NO: 966761 - protein, 26 aa, Mycobacterium
LLGDDCWWAPRWARLLQNRIGLGEIH

SEQ ID NO: 966762 - protein, 22 aa, Mycobacterium
LLGRLMIYNALEMSYRRIRIHK

SEQ ID NO: 966763 - protein, 18 aa, Mycobacterium
LLGRSFVAYQHCQMPIGS

SEQ ID NO: 966764 - protein, 17 aa, Mycobacterium
LLILRLVLGLTLAAHGY

SEQ ID NO: 966765 - protein, 23 aa, Mycobacterium
LLLNELVCNIGLLEGYVSALLQG

SEQ ID NO: 966766 - protein, 22 aa, Mycobacterium
LLPDNLRWLVTVDAIHTQVVTA

SEQ ID NO: 966767 - protein, 21 aa, Mycobacterium
LLPGSLRWLVTVDAIHTQVVT

SEQ ID NO: 966768 - protein, 22 aa, Mycobacterium
LLPSGRFPSGRFIAAVIVIGGM

SEQ ID NO: 966769 - protein, 28 aa, Mycobacterium
LLQGHWSLLVGYGCLPWVAEAMLMLRSS

SEQ ID NO: 966770 - protein, 20 aa, Mycobacterium
LLSMRIPRWVEVTAGEIPAT

SEQ ID NO: 966771 - protein, 24 aa, Mycobacterium
LLTDFKGGSTFLGMEKLPHTAAVV

SEQ ID NO: 966772 - protein, 23 aa, Mycobacterium
LLTDMFPALSIAVTSQYEEPGED

SEQ ID NO: 966773 - protein, 23 aa, Mycobacterium
LLTGAGYWVAHRALEDITVSQAL

SEQ ID NO: 966774 - protein, 18 aa, Mycobacterium
LLTILGFSLYDTVIVFDK

SEQ ID NO: 966775 - protein, 19 aa, Mycobacterium
LLVEPWYALIGDREQTLGL

SEQ ID NO: 966776 - protein, 18 aa, Mycobacterium
LLVYRSFITVILLLFTVG

SEQ ID NO: 966777 - protein, 19 aa, Mycobacterium
LLYSLLYYRVLGLLTAFSL

SEQ ID NO: 966778 - protein, 25 aa, Mycobacterium
LMALGRKNFFPQFATWYTVVPFAIV

SEQ ID NO: 966779 - protein, 26 aa, Mycobacterium
LMGPLLRRSGVIFIRRNIGDNPLYKY

SEQ ID NO: 966780 - protein, 25 aa, Mycobacterium
LMGRTPLPPRRDWELDTLDAGLRQK

SEQ ID NO: 966781 - protein, 24 aa, Mycobacterium
LMIANPFRVGDRIGSLFSTHPPIE

SEQ ID NO: 966782 - protein, 18 aa, Mycobacterium
LMLVPVFLVALFAGNGHE

SEQ ID NO: 966783 - protein, 18 aa, Mycobacterium
LMLYALIMAFSFTTLSIY

SEQ ID NO: 966784 - protein, 18 aa, Mycobacterium
LMSLGCYLGAYPLQRRSA

SEQ ID NO: 966785 - protein, 18 aa, Mycobacterium
LMVGFPFVLLGTWDTLWS

SEQ ID NO: 966786 - protein, 26 aa, Mycobacterium
LNAAFRYALVRLRDAAEAVAFYRGEE

SEQ ID NO: 966787 - protein, 17 aa, Mycobacterium
LNAGNWQALMLPTTALT

SEQ ID NO: 966788 - protein, 24 aa, Mycobacterium
LNERELRAVLGHELSHVYNRDILI

SEQ ID NO: 966789 - protein, 17 aa, Mycobacterium
LNFGVAAIADWLGVIAS

SEQ ID NO: 966790 - protein, 32 aa, Mycobacterium
LNSLPMLAALGWVCADAILLVCTGNHRYAATG

SEQ ID NO: 966791 - protein, 24 aa, Mycobacterium
LNTRNVFGPPAWAPVINNIVAIAA

SEQ ID NO: 966792 - protein, 17 aa, Mycobacterium
LPAVKRLVVPAASDNDS

SEQ ID NO: 966793 - protein, 17 aa, Mycobacterium
LPKHASFQVIGDDKTLA

SEQ ID NO: 966794 - protein, 21 aa, Mycobacterium
LPMVAGMAFLLSRGSICLGVG

SEQ ID NO: 966795 - protein, 25 aa, Mycobacterium
LPNIPGVPWWAALLIATTASAIGYA

SEQ ID NO: 966796 - protein, 21 aa, Mycobacterium
LPPFYPPGWFWIGGRVAALTG

SEQ ID NO: 966797 - protein, 17 aa, Mycobacterium
LPPRPDRPYGVSLRLDD

SEQ ID NO: 966798 - protein, 23 aa, Mycobacterium
LPPTPWQHSRFWVADRSAMSELA

SEQ ID NO: 966799 - protein, 17 aa, Mycobacterium
LPTDGFQGLNVVSTIGS

SEQ ID NO: 966800 - protein, 32 aa, Mycobacterium
LPTHIVQLGTWLAEYPQLLLVALGGTIANLGA

SEQ ID NO: 966801 - protein, 18 aa, Mycobacterium
LPTPLSVHVYRLVWRQTI

SEQ ID NO: 966802 - protein, 26 aa, Mycobacterium
LPVLALMVVAVWLLGVGTLKDLALVQ

SEQ ID NO: 966803 - protein, 18 aa, Mycobacterium
LPVRIGYQGPNARLAATV

SEQ ID NO: 966804 - protein, 18 aa, Mycobacterium
LQFGAGWWTSTWFLCIWV

SEQ ID NO: 966805 - protein, 24 aa, Mycobacterium
LQKPIFMWWIVWVFSYVISVVAVV

SEQ ID NO: 966806 - protein, 25 aa, Mycobacterium
LQLARAGFLMLLWVFIWSVLQILKT

SEQ ID NO: 966807 - protein, 17 aa, Mycobacterium
LQLRVVALTFGLSLAVI

SEQ ID NO: 966808 - protein, 34 aa, Mycobacterium
LQLVSLVGVLVLLKAVAYWLDRYELLSRTRSSKP

SEQ ID NO: 966809 - protein, 18 aa, Mycobacterium
LQYLRYLGGILHGDSGRY

SEQ ID NO: 966810 - protein, 20 aa, Mycobacterium
LRAAQIQQWSRLTTASELIH

SEQ ID NO: 966811 - protein, 28 aa, Mycobacterium
LRAHVMSTYLARDWGRDWGSLRKFDPLV

SEQ ID NO: 966812 - protein, 21 aa, Mycobacterium
LRASGVRRIVMLTGDHPDIAK

SEQ ID NO: 966813 - protein, 17 aa, Mycobacterium
LREILPAVKRLVVPAAS

SEQ ID NO: 966814 - protein, 31 aa, Mycobacterium
LRENVVALAVLWLLNIGEYLQDLTLRRTRRA

SEQ ID NO: 966815 - protein, 22 aa, Mycobacterium
LRGHFLLTYTAAMYWRTSAKKE

SEQ ID NO: 966816 - protein, 18 aa, Mycobacterium
LRHTGRIDAINFWIRRAC

SEQ ID NO: 966817 - protein, 19 aa, Mycobacterium
LRLGSYAVMHAISDYVVDR

SEQ ID NO: 966818 - protein, 17 aa, Mycobacterium
LRLRSREGVRAAVDALS

SEQ ID NO: 966819 - protein, 20 aa, Mycobacterium
LRNALFDAFGPKGADAKPSK

SEQ ID NO: 966820 - protein, 21 aa, Mycobacterium
LRPASKLATLAWWADTTLGED

SEQ ID NO: 966821 - protein, 20 aa, Mycobacterium
LRPLFTMSPCSRWSTATPSC

SEQ ID NO: 966822 - protein, 18 aa, Mycobacterium
LRPLPNKWKGLTDPEARV

SEQ ID NO: 966823 - protein, 29 aa, Mycobacterium
LRPTEAVMTKLRWVLLIVGSLGVAVAAVA

SEQ ID NO: 966824 - protein, 20 aa, Mycobacterium
LRQMYALLYHEVFDTLGSEE

SEQ ID NO: 966825 - protein, 23 aa, Mycobacterium
LRQRLRIPGLHLDIVGGGWWRQR

SEQ ID NO: 966826 - protein, 25 aa, Mycobacterium
LRQRRKHAWGAFTFGLPVFPVVLTL

SEQ ID NO: 966827 - protein, 19 aa, Mycobacterium
LRRLLRWVLGPTDPVLAST

SEQ ID NO: 966828 - protein, 25 aa, Mycobacterium
LRSLAELWPYASGTLSRPDGKNETM

SEQ ID NO: 966829 - protein, 18 aa, Mycobacterium
LRSLVIICTAWIVIPTTL

SEQ ID NO: 966830 - protein, 17 aa, Mycobacterium
LRSTACSPVDASPLRPV

SEQ ID NO: 966831 - protein, 18 aa, Mycobacterium
LRTGQFVRASGVEVGKVN

SEQ ID NO: 966832 - protein, 18 aa, Mycobacterium
LRVPFTAGMCLLDNIGGL

SEQ ID NO: 966833 - protein, 26 aa, Mycobacterium
LSAAAVVFGVVIWRAHHDNSAERAYL

SEQ ID NO: 966834 - protein, 21 aa, Mycobacterium
LSAAVTGWVTRLPAVPQTIRA

SEQ ID NO: 966835 - protein, 20 aa, Mycobacterium
LSALLPRLFRGAFAVDPERV

SEQ ID NO: 966836 - protein, 23 aa, Mycobacterium
LSEAAAHQRVWRDREPQLASPKR

SEQ ID NO: 966837 - protein, 21 aa, Mycobacterium
LSERQRLRDLFGRYVGEDVAR

SEQ ID NO: 966838 - protein, 22 aa, Mycobacterium
LSFITRWGRQYWRITRGYFIGP

SEQ ID NO: 966839 - protein, 20 aa, Mycobacterium
LSIPGYRNVFVVGDMAAIDG

SEQ ID NO: 966840 - protein, 17 aa, Mycobacterium
LSLAVILALGFVLTSQL

SEQ ID NO: 966841 - protein, 20 aa, Mycobacterium
LSLFRWDLLGPLHYVGLANW

SEQ ID NO: 966842 - protein, 18 aa, Mycobacterium
LSLITLVVFHSQTLATVG

SEQ ID NO: 966843 - protein, 24 aa, Mycobacterium
LSLNTSYYRLMLKLKNGPQAVADA

SEQ ID NO: 966844 - protein, 18 aa, Mycobacterium
LSPACQRLTFAAYFDKIT

SEQ ID NO: 966845 - protein, 23 aa, Mycobacterium
LSPYMLMMPIMMVMMMAGGSGGG

SEQ ID NO: 966846 - protein, 17 aa, Mycobacterium
LSRQPWRSVDGYSGHSA

SEQ ID NO: 966847 - protein, 25 aa, Mycobacterium
LSTMLPVWRKFRFGEADGGVLKGSE

SEQ ID NO: 966848 - protein, 24 aa, Mycobacterium
LSTNFKTGPAILGIADISNHTFTV

SEQ ID NO: 966849 - protein, 25 aa, Mycobacterium
LSTVIRSGLAVARPLPTVIADALAR

SEQ ID NO: 966850 - protein, 17 aa, Mycobacterium
LSVDWFGVIILTAWGTL

SEQ ID NO: 966851 - protein, 19 aa, Mycobacterium
LSVEASFYLALPILALLTR

SEQ ID NO: 966852 - protein, 17 aa, Mycobacterium
LTAKGALVRSPRTIEAL

SEQ ID NO: 966853 - protein, 17 aa, Mycobacterium
LTATLPLLWSRGLLSLP

SEQ ID NO: 966854 - protein, 18 aa, Mycobacterium
LTGARSAPKVAPFADPGN

SEQ ID NO: 966855 - protein, 24 aa, Mycobacterium
LTGDKRVVPRLGIDLQGGTRVTLT

SEQ ID NO: 966856 - protein, 21 aa, Mycobacterium
LTGPDIYRGLAPVTRDVYTIR

SEQ ID NO: 966857 - protein, 20 aa, Mycobacterium
LTIGCGLILAALLVTVEAAQ

SEQ ID NO: 966858 - protein, 29 aa, Mycobacterium
LTIGGGWLLMVAMLYGWAFMNRGVPYFPN

SEQ ID NO: 966859 - protein, 21 aa, Mycobacterium
LTLLLIFLFWPWEYKPKEASG

SEQ ID NO: 966860 - protein, 20 aa, Mycobacterium
LTQEMPSWLQANKNVLPTGN

SEQ ID NO: 966861 - protein, 27 aa, Mycobacterium
LTTILRRRLAMMWRRGRPVSASGSATR

SEQ ID NO: 966862 - protein, 24 aa, Mycobacterium
LTTRKRIAWLLLLGNMVLAAVLNA

SEQ ID NO: 966863 - protein, 20 aa, Mycobacterium
LTVKLCIWYTQIAWLLLTSY

SEQ ID NO: 966864 - protein, 24 aa, Mycobacterium
LTVLRFLARRSFWRSLNVFHTRYY

SEQ ID NO: 966865 - protein, 17 aa, Mycobacterium
LVAAAGFYCYVLTHVLY

SEQ ID NO: 966866 - protein, 17 aa, Mycobacterium
LVAAAGRAGGQLRGIVH

SEQ ID NO: 966867 - protein, 22 aa, Mycobacterium
LVAALVCGAAWIARIPRDVLPS

SEQ ID NO: 966868 - protein, 24 aa, Mycobacterium
LVAGACTFLALPRLTRVLASVPPC

SEQ ID NO: 966869 - protein, 19 aa, Mycobacterium
LVALICRLYDVTAGAVLVD

SEQ ID NO: 966870 - protein, 24 aa, Mycobacterium
LVALWRLDQLDGRRMRRLIPARWS

SEQ ID NO: 966871 - protein, 17 aa, Mycobacterium
LVANNTRIWVYCGNGAP

SEQ ID NO: 966872 - protein, 22 aa, Mycobacterium
LVCFSDCWALVMGRPHSDHRTR

SEQ ID NO: 966873 - protein, 18 aa, Mycobacterium
LVFAALMIVVRLMQGTMI

SEQ ID NO: 966874 - protein, 27 aa, Mycobacterium
LVFAPRIWVVLCAGAIFVASHEVVRRL

SEQ ID NO: 966875 - protein, 24 aa, Mycobacterium
LVGACLRVPYSLATALFGGRNWAI

SEQ ID NO: 966876 - protein, 19 aa, Mycobacterium
LVGASRWYTQLPFLLEAMV

SEQ ID NO: 966877 - protein, 22 aa, Mycobacterium
LVGKRWGRGLAVFTQLLLLPVA

SEQ ID NO: 966878 - protein, 19 aa, Mycobacterium
LVHHCHREQWPVAGPVIGR

SEQ ID NO: 966879 - protein, 19 aa, Mycobacterium
LVISCWAPMAWILMAVGKR

SEQ ID NO: 966880 - protein, 26 aa, Mycobacterium
LVIVMFVLLALGWRRRRTAHDIVADS

SEQ ID NO: 966881 - protein, 28 aa, Mycobacterium
LVLAGVAIGRWVIRDNYYIAEYSGKVSI

SEQ ID NO: 966882 - protein, 17 aa, Mycobacterium
LVLAMTFGLSMDYEIFL

SEQ ID NO: 966883 - protein, 17 aa, Mycobacterium
LVLVGVVAVALTFAQSP

SEQ ID NO: 966884 - protein, 24 aa, Mycobacterium
LVPDELREACYALGIPKWKTIVRI

SEQ ID NO: 966885 - protein, 23 aa, Mycobacterium
LVPQRCYLFSGTVADNLRYGATP

SEQ ID NO: 966886 - protein, 17 aa, Mycobacterium
LVSAKFFGVNAIPIALN

SEQ ID NO: 966887 - protein, 18 aa, Mycobacterium
LVSCKRDVGAAVLAAYVY

SEQ ID NO: 966888 - protein, 17 aa, Mycobacterium
LVSCLAIGCDVVVGSDA

SEQ ID NO: 966889 - protein, 17 aa, Mycobacterium
LVTLLPDNLRWLVTVDA

SEQ ID NO: 966890 - protein, 19 aa, Mycobacterium
LVVAFLLTVVCTFRSRLYA

SEQ ID NO: 966891 - protein, 18 aa, Mycobacterium
LVVSEWIRGGSLHEVADT

SEQ ID NO: 966892 - protein, 29 aa, Mycobacterium
LVYTVLAVIWCWLLKRYVTEGSQEHDAEP

SEQ ID NO: 966893 - protein, 24 aa, Mycobacterium
LWIYQDIYEFLKNLIAKTVAIIEA

SEQ ID NO: 966894 - protein, 18 aa, Mycobacterium
LWLHLGWQDIKQRYRRSV

SEQ ID NO: 966895 - protein, 26 aa, Mycobacterium
LWMAARLPWVVIRSFDGLGPPKEVAL

SEQ ID NO: 966896 - protein, 17 aa, Mycobacterium
LWRSYGVTPDAVIGHSM

SEQ ID NO: 966897 - protein, 32 aa, Mycobacterium
LYGIFIVWLFSDWRYVFWINIPLTAIAMLMIQ

SEQ ID NO: 966898 - protein, 18 aa, Mycobacterium
LYLGFDIVGGILWGGGVT

SEQ ID NO: 966899 - protein, 24 aa, Mycobacterium
LYLWHWPLLIFWLSYTGHHHANFV

SEQ ID NO: 966900 - protein, 17 aa, Mycobacterium
LYRFEGQVSVFWEDAPD

SEQ ID NO: 966901 - protein, 19 aa, Mycobacterium
LYTGTGVFEVVGRRRLWYS

SEQ ID NO: 966902 - protein, 32 aa, Mycobacterium
LYVFPFGVVVGGPFLPLAIILYWFSNNIWTFG

SEQ ID NO: 966903 - protein, 24 aa, Mycobacterium
LYVILGWRRVLLIPLTFGLFTPLA

SEQ ID NO: 966904 - protein, 20 aa, Mycobacterium
LYYRVLGLLTAFSLFCSGTI

SEQ ID NO: 966905 - protein, 17 aa, Mycobacterium
MAAVLWPGVAAGLAGVL

SEQ ID NO: 966906 - protein, 31 aa, Mycobacterium
MACWLLLAVFRGRLHPIGGLGVALGVTVLLF

SEQ ID NO: 966907 - protein, 22 aa, Mycobacterium
MAMAIRREAEQFIGIELSAIML

SEQ ID NO: 966908 - protein, 26 aa, Mycobacterium
MDPQQRLLLEVAWEALEHAGISSNSL

SEQ ID NO: 966909 - protein, 21 aa, Mycobacterium
MEEVLAIKPDICFLWDEAWYA

SEQ ID NO: 966910 - protein, 18 aa, Mycobacterium
MFRDVTIIVVTQRISTAA

SEQ ID NO: 966911 - protein, 20 aa, Mycobacterium
MGILTWIFVDGHLSKWLNFT

SEQ ID NO: 966912 - protein, 25 aa, Mycobacterium
MGIVGWASGLGFGWIYTLGTANVVR

SEQ ID NO: 966913 - protein, 20 aa, Mycobacterium
MGKSRLRVPFGNRSDNGELL

SEQ ID NO: 966914 - protein, 22 aa, Mycobacterium
MHYRYAELLTEVSLAFVVFSLA

SEQ ID NO: 966915 - protein, 23 aa, Mycobacterium
MIFSTARLQSWGPTHIRRGALAA

SEQ ID NO: 966916 - protein, 17 aa, Mycobacterium
MIIVVFGQMRFGRTNGY

SEQ ID NO: 966917 - protein, 17 aa, Mycobacterium
MITVPGWIRRGPIRALP

SEQ ID NO: 966918 - protein, 19 aa, Mycobacterium
MKKMHTVSVPPHYAAVFVA

SEQ ID NO: 966919 - protein, 20 aa, Mycobacterium
MKQARWVPLITHLESRASSI

SEQ ID NO: 966920 - protein, 27 aa, Mycobacterium
MKRPLVFAIPIVIGMILLVIPLGNLSF

SEQ ID NO: 966921 - protein, 18 aa, Mycobacterium
MKVFPGTVRPKGDITPEL

SEQ ID NO: 966922 - protein, 20 aa, Mycobacterium
MLDLLLAIVRRIRAGRSAFS

SEQ ID NO: 966923 - protein, 17 aa, Mycobacterium
MLRIKVGMAAGIVLASP

SEQ ID NO: 966924 - protein, 26 aa, Mycobacterium
MLSSLIVGTGWPLIVEQLIAKPDAVR

SEQ ID NO: 966925 - protein, 26 aa, Mycobacterium
MMPSIAALLGRWFWWPQQGRTRPLLT

SEQ ID NO: 966926 - protein, 27 aa, Mycobacterium
MMPSIAALLGRWFWWPQQGRTRPLLTV

SEQ ID NO: 966927 - protein, 18 aa, Mycobacterium
MMYSDIFMITAIVCVIGA

SEQ ID NO: 966928 - protein, 23 aa, Mycobacterium
MPARGRLVTMLVIGVVLLSAGYS

SEQ ID NO: 966929 - protein, 22 aa, Mycobacterium
MPDDLLSGIGLRAALSSITLGI

SEQ ID NO: 966930 - protein, 20 aa, Mycobacterium
MPLGIWLFSPLRRRATAALA

SEQ ID NO: 966931 - protein, 24 aa, Mycobacterium
MPLLSRASDRFGRKLLLQVSLAGF

SEQ ID NO: 966932 - protein, 19 aa, Mycobacterium
MPPPARIVLFSDGKETMPT

SEQ ID NO: 966933 - protein, 25 aa, Mycobacterium
MQLTLTELWRSYGVQPDLVIGHSLG

SEQ ID NO: 966934 - protein, 19 aa, Mycobacterium
MQTAFDWTGVLINMNTSNV

SEQ ID NO: 966935 - protein, 19 aa, Mycobacterium
MRAAIRGVLVVIGIAATVI

SEQ ID NO: 966936 - protein, 18 aa, Mycobacterium
MRGYAGFATWAATASDDV

SEQ ID NO: 966937 - protein, 29 aa, Mycobacterium
MRKTKELVIAIKMSDAWSKDDVLQSYLNI

SEQ ID NO: 966938 - protein, 18 aa, Mycobacterium
MRSAFYAGYEESDREYVH

SEQ ID NO: 966939 - protein, 19 aa, Mycobacterium
MRSISYFTWVVEQLAAAGD

SEQ ID NO: 966940 - protein, 21 aa, Mycobacterium
MRTEIPAAAAAARLADPENRV

SEQ ID NO: 966941 - protein, 18 aa, Mycobacterium
MSEVHLARDIRLHRDVAV

SEQ ID NO: 966942 - protein, 23 aa, Mycobacterium
MSHFRAALTKMWWEHHIDPSSLL

SEQ ID NO: 966943 - protein, 23 aa, Mycobacterium
MSLSGFEHSWFFLFIFIVFGLAA

SEQ ID NO: 966944 - protein, 18 aa, Mycobacterium
MTALGMAIGLLLGGVVTR

SEQ ID NO: 966945 - protein, 22 aa, Mycobacterium
MTGGAALVMWMGELITERGIGN

SEQ ID NO: 966946 - protein, 30 aa, Mycobacterium
MTLSGPLAFWVCGLVLCLFIGPSQSSSRAL

SEQ ID NO: 966947 - protein, 18 aa, Mycobacterium
MTRYYAAQRTFWVDPVSG

SEQ ID NO: 966948 - protein, 25 aa, Mycobacterium
MTWVTEIFAPLTLAYQGWTYLIFRQ

SEQ ID NO: 966949 - protein, 18 aa, Mycobacterium
MVAAIYGMNFRFMPELNW

SEQ ID NO: 966950 - protein, 26 aa, Mycobacterium
MVARDDYPTLCWAWERKASDQAPKRT

SEQ ID NO: 966951 - protein, 17 aa, Mycobacterium
MVFQWGWLENLGFTHIN

SEQ ID NO: 966952 - protein, 20 aa, Mycobacterium
MVQIPRLVANNTRIWVYCGN

SEQ ID NO: 966953 - protein, 24 aa, Mycobacterium
MVTLGRWSYGMFVWHLAALAMVFP

SEQ ID NO: 966954 - protein, 20 aa, Mycobacterium
MVVGAFYIKAANYSPFIPSP

SEQ ID NO: 966955 - protein, 20 aa, Mycobacterium
MYKQATWKRVAVLFAGPAMN

SEQ ID NO: 966956 - protein, 22 aa, Mycobacterium
MYRVVRRLLFLTPPERIHTLVF

SEQ ID NO: 966957 - protein, 22 aa, Mycobacterium
NAFGTAPSRWPATLILLPTVHN

SEQ ID NO: 966958 - protein, 19 aa, Mycobacterium
NAPCDVVLESARREGESRG

SEQ ID NO: 966959 - protein, 24 aa, Mycobacterium
NASRPGLLGFFALACWIALAGLTP

SEQ ID NO: 966960 - protein, 28 aa, Mycobacterium
NDAVPFPGFKNGVGLMLHLPKPTVVSAV

SEQ ID NO: 966961 - protein, 17 aa, Mycobacterium
NDLPWSILKQLHAGDSN

SEQ ID NO: 966962 - protein, 22 aa, Mycobacterium
NDPRRLSAVVTMLLTPMAGIAL

SEQ ID NO: 966963 - protein, 17 aa, Mycobacterium
NDPRWILPDTDPLGRHP

SEQ ID NO: 966964 - protein, 20 aa, Mycobacterium
NEFQVLYAARRLRPKQILNS

SEQ ID NO: 966965 - protein, 22 aa, Mycobacterium
NEIPCVCALVTLLPDNLRWLVT

SEQ ID NO: 966966 - protein, 19 aa, Mycobacterium
NGTRSLIVRNWRLIGKCLR

SEQ ID NO: 966967 - protein, 19 aa, Mycobacterium
NKTIARLNLLWSVLTVHLG

SEQ ID NO: 966968 - protein, 19 aa, Mycobacterium
NLALAMLMIMLIRLYYDPA

SEQ ID NO: 966969 - protein, 24 aa, Mycobacterium
NLGHLEAAAGIAGFIKTVLAVQRG

SEQ ID NO: 966970 - protein, 28 aa, Mycobacterium
NLHIPFAELRMKVVDKHMEWPDTGHLRR

SEQ ID NO: 966971 - protein, 17 aa, Mycobacterium
NLIMARSCVLRSVREML

SEQ ID NO: 966972 - protein, 31 aa, Mycobacterium
NLLQMAFRFWAFRRWVFPDAFARNPEKTLES

SEQ ID NO: 966973 - protein, 25 aa, Mycobacterium
NNDFKCALFSATVLRVQRIAKHHRR

SEQ ID NO: 966974 - protein, 22 aa, Mycobacterium
NPACRCYFDDVYWITFAGMATV

SEQ ID NO: 966975 - protein, 19 aa, Mycobacterium
NPGQLCVLEAPSTEGDYPD

SEQ ID NO: 966976 - protein, 17 aa, Mycobacterium
NPMRRRSIGFGLITNLK

SEQ ID NO: 966977 - protein, 20 aa, Mycobacterium
NPTAAFQFLLYIVVLDLPTH

SEQ ID NO: 966978 - protein, 23 aa, Mycobacterium
NQNRIRWGNLLTLPVAQGGLLYV

SEQ ID NO: 966979 - protein, 19 aa, Mycobacterium
NRFATPFFDALRAYAAAPV

SEQ ID NO: 966980 - protein, 20 aa, Mycobacterium
NRLLLPTIIGWSLGRALCGI

SEQ ID NO: 966981 - protein, 17 aa, Mycobacterium
NRLRVVCAVPNTRMPHD

SEQ ID NO: 966982 - protein, 22 aa, Mycobacterium
NRTASVSLMLLVLLFVACYLLP

SEQ ID NO: 966983 - protein, 17 aa, Mycobacterium
NRVDLPQGKSCTRVAKR

SEQ ID NO: 966984 - protein, 28 aa, Mycobacterium
NRVELLKLAVILALWAAVAGAFVSVFYR

SEQ ID NO: 966985 - protein, 24 aa, Mycobacterium
NSASRLAIITVFGLIIAYAFPLAG

SEQ ID NO: 966986 - protein, 22 aa, Mycobacterium
NSGELSGYWGRLTIDTGEQSAV

SEQ ID NO: 966987 - protein, 18 aa, Mycobacterium
NSGSPMSNLLVWISTLGS

SEQ ID NO: 966988 - protein, 26 aa, Mycobacterium
NTTHWGLQIDHFWWTAIWAAIVLSIV

SEQ ID NO: 966989 - protein, 18 aa, Mycobacterium
NVDIKLIARTTHHLFQPL

SEQ ID NO: 966990 - protein, 19 aa, Mycobacterium
NVKDVKCNNGADPTVKKGD

SEQ ID NO: 966991 - protein, 17 aa, Mycobacterium
NVLHVLRQFPVGMRSPG

SEQ ID NO: 966992 - protein, 19 aa, Mycobacterium
NVRVARWVAAIAGLIGFVS

SEQ ID NO: 966993 - protein, 21 aa, Mycobacterium
NVSSVALIWFGGLRIDSGQMQ

SEQ ID NO: 966994 - protein, 24 aa, Mycobacterium
NYNAERLWSVIGLVPQRCYLFSGT

SEQ ID NO: 966995 - protein, 20 aa, Mycobacterium
NYVLALAFFVFVCYHLAGIW

SEQ ID NO: 966996 - protein, 27 aa, Mycobacterium
PAAIFVCLFCAFYIYDGNLQPDARCMG

SEQ ID NO: 966997 - protein, 21 aa, Mycobacterium
PADGAELAFPMLQFSLLGMIC

SEQ ID NO: 966998 - protein, 21 aa, Mycobacterium
PADQVIMRWQDGFLVSVVELI

SEQ ID NO: 966999 - protein, 19 aa, Mycobacterium
PAHSAWTPTIANINNILVI

SEQ ID NO: 967000 - protein, 22 aa, Mycobacterium
PAIALASIWLTGPLILGLGATQ

SEQ ID NO: 967001 - protein, 27 aa, Mycobacterium
PAIVGFKPALWAAGLVLLAAWMPFNNG

SEQ ID NO: 967002 - protein, 17 aa, Mycobacterium
PANADFYAATRIGVGDQ

SEQ ID NO: 967003 - protein, 17 aa, Mycobacterium
PARETWTALEIACPDSS

SEQ ID NO: 967004 - protein, 19 aa, Mycobacterium
PASIIKVLLAMASINTLNL

SEQ ID NO: 967005 - protein, 19 aa, Mycobacterium
PATIPAPNPTPAREVPTAF

SEQ ID NO: 967006 - protein, 19 aa, Mycobacterium
PAVAFRPVRLFIINIVLTG

SEQ ID NO: 967007 - protein, 18 aa, Mycobacterium
PAVLSVLVLEDFAMAAYL

SEQ ID NO: 967008 - protein, 18 aa, Mycobacterium
PAVLVVRCTIAVTVLALA

SEQ ID NO: 967009 - protein, 21 aa, Mycobacterium
PAYPARRPIRFEVSRERGGEQ

SEQ ID NO: 967010 - protein, 28 aa, Mycobacterium
PDASAAVLRIGLRAMLGVNVAVVITDTM

SEQ ID NO: 967011 - protein, 21 aa, Mycobacterium
PDDVFWSFLEAVIITAVVMIT

SEQ ID NO: 967012 - protein, 17 aa, Mycobacterium
PDERRRPTVSGRPVRPP

SEQ ID NO: 967013 - protein, 28 aa, Mycobacterium
PDFIGLFDRICRVGRSLRVHLLLATQSL

SEQ ID NO: 967014 - protein, 23 aa, Mycobacterium
PDGSHGMYSWLHFSLATTCALIA

SEQ ID NO: 967015 - protein, 26 aa, Mycobacterium
PDGYPIKASPRFGLYYTPASELYHDT

SEQ ID NO: 967016 - protein, 22 aa, Mycobacterium
PDIKATVITIRLASRSCQTRLS

SEQ ID NO: 967017 - protein, 25 aa, Mycobacterium
PDILDPALLRPGRFDRQIPVSNPDL

SEQ ID NO: 967018 - protein, 18 aa, Mycobacterium
PDLEAVVVSAGYRVGHVA

SEQ ID NO: 967019 - protein, 20 aa, Mycobacterium
PDNWRCWYRLARAYDYAGDR

SEQ ID NO: 967020 - protein, 22 aa, Mycobacterium
PDPNLRPQIVGVFTDLTGGAPS

SEQ ID NO: 967021 - protein, 22 aa, Mycobacterium
PDRRRDLAMTWLLTGILVGVLS

SEQ ID NO: 967022 - protein, 19 aa, Mycobacterium
PDRVFSAAIAVLVIACPCA

SEQ ID NO: 967023 - protein, 20 aa, Mycobacterium
PDTSIAWSFVLALLAAALTT

SEQ ID NO: 967024 - protein, 24 aa, Mycobacterium
PDVSAQHFLVFWPQMYYLLMALLG

SEQ ID NO: 967025 - protein, 22 aa, Mycobacterium
PEELPDPMLALPPPHGQVPRIN

SEQ ID NO: 967026 - protein, 20 aa, Mycobacterium
PEHFRQALFRVLASVVEIWM

SEQ ID NO: 967027 - protein, 27 aa, Mycobacterium
PELGIYRCCWWRFAFLHSKLIQSRAYA

SEQ ID NO: 967028 - protein, 19 aa, Mycobacterium
PEVIIPFMVPDGAHAYPDA

SEQ ID NO: 967029 - protein, 24 aa, Mycobacterium
PEVLRGMFDTGLFQRDYDDQYDAE

SEQ ID NO: 967030 - protein, 23 aa, Mycobacterium
PFADPGNPLAILMPLTAAVMDLV

SEQ ID NO: 967031 - protein, 25 aa, Mycobacterium
PFAELGLNSLMAMAIRREAEQFIGI

SEQ ID NO: 967032 - protein, 32 aa, Mycobacterium
PFMFGSPYAIFLLREHFRIIPNDLINAARLDG

SEQ ID NO: 967033 - protein, 26 aa, Mycobacterium
PFNNGLRPEGQIALGALITYVLIERA

SEQ ID NO: 967034 - protein, 18 aa, Mycobacterium
PGDIVLIDRNCHKSHHYG

SEQ ID NO: 967035 - protein, 18 aa, Mycobacterium
PGGLVPIALDGKRLRGAL

SEQ ID NO: 967036 - protein, 19 aa, Mycobacterium
PGLPLWPYLACAALTGLGG

SEQ ID NO: 967037 - protein, 25 aa, Mycobacterium
PGLTHLFTMWGFFILLTVYIEAYGV

SEQ ID NO: 967038 - protein, 20 aa, Mycobacterium
PGQAWVFVFAIAMMVGLVVS

SEQ ID NO: 967039 - protein, 29 aa, Mycobacterium
PGRIGAFVRWGIRTPWPLFSLSMLQSDII

SEQ ID NO: 967040 - protein, 21 aa, Mycobacterium
PGSPPGWAVAGWDLGSELLGR

SEQ ID NO: 967041 - protein, 19 aa, Mycobacterium
PGTPLLKLVRELRTDRGPV

SEQ ID NO: 967042 - protein, 23 aa, Mycobacterium
PHCPLPRPAIGPGTYNLVVQLGN

SEQ ID NO: 967043 - protein, 23 aa, Mycobacterium
PHHTRPVRFVWLQTPAVRTRLLD

SEQ ID NO: 967044 - protein, 20 aa, Mycobacterium
PHKLLPMFPTALILATVTAV

SEQ ID NO: 967045 - protein, 19 aa, Mycobacterium
PHVSFYLDPMTFWRAWSAE

SEQ ID NO: 967046 - protein, 31 aa, Mycobacterium
PIIKPAVMVALLFRTLDAFRIFDNIYVLTRG

SEQ ID NO: 967047 - protein, 29 aa, Mycobacterium
PISELCSIATQWCPARVLGRSDLPGPYTK

SEQ ID NO: 967048 - protein, 23 aa, Mycobacterium
PKCPSPVRAKSGWTRSRGCSPTR

SEQ ID NO: 967049 - protein, 17 aa, Mycobacterium
PKLASGHIRVIVDTNYS

SEQ ID NO: 967050 - protein, 56 aa, Mycobacterium
PKQPGRATGPGWRVPGSRLNRTWLLHLNRQVNWRWVRYSLYLAVVVLLLLPIVTFT

SEQ ID NO: 967051 - protein, 17 aa, Mycobacterium
PKVVMSFYEDFLCPGCG

SEQ ID NO: 967052 - protein, 20 aa, Mycobacterium
PLFPYHIVVRVSLWASVLLV

SEQ ID NO: 967053 - protein, 17 aa, Mycobacterium
PLISDAMLRVFFEAYDI

SEQ ID NO: 967054 - protein, 27 aa, Mycobacterium
PLNLPKLPAHRDMVPVWVAAGGLTTAV

SEQ ID NO: 967055 - protein, 26 aa, Mycobacterium
PLPTEIYWRRRGLAVGITVIVIVIAA

SEQ ID NO: 967056 - protein, 18 aa, Mycobacterium
PLRFLARATNLWNSDLPF

SEQ ID NO: 967057 - protein, 20 aa, Mycobacterium
PLRVLAGLLAVASFLVGYLG

SEQ ID NO: 967058 - protein, 19 aa, Mycobacterium
PLSLRFDSLNLTGLAVIAR

SEQ ID NO: 967059 - protein, 19 aa, Mycobacterium
PLTIRAGCGYEFRLETSCY

SEQ ID NO: 967060 - protein, 19 aa, Mycobacterium
PLTWPPAFFSWFAAGMLLA

SEQ ID NO: 967061 - protein, 25 aa, Mycobacterium
PLVAEIGVACAVAIAVDVTAVRLVL

SEQ ID NO: 967062 - protein, 18 aa, Mycobacterium
PMAKSMIAEGRRKVANRI

SEQ ID NO: 967063 - protein, 18 aa, Mycobacterium
PMLYILVRRHRAVGAWPL

SEQ ID NO: 967064 - protein, 24 aa, Mycobacterium
PNAIWKSFDLFVGAIQAFIFSILT

SEQ ID NO: 967065 - protein, 17 aa, Mycobacterium
PNTRHWLGTNALGQDLL

SEQ ID NO: 967066 - protein, 17 aa, Mycobacterium
PNTVWWWVTLSLLSGMA

SEQ ID NO: 967067 - protein, 20 aa, Mycobacterium
PPEELQFVLADLKGGSAVKP

SEQ ID NO: 967068 - protein, 17 aa, Mycobacterium
PPGSEKYYWAIDEAVLH

SEQ ID NO: 967069 - protein, 28 aa, Mycobacterium
PPHEPKSPHWFLWVVAGASVVLVVGLVM

SEQ ID NO: 967070 - protein, 27 aa, Mycobacterium
PPPPRGRELGKARPIRAAATHLRTANP

SEQ ID NO: 967071 - protein, 23 aa, Mycobacterium
PPRATSPPGPFTMPTDSGTPQPT

SEQ ID NO: 967072 - protein, 19 aa, Mycobacterium
PPRGVWHLGPLPIRAYALL

SEQ ID NO: 967073 - protein, 27 aa, Mycobacterium
PPRRRRPLMTWQRWALLCVGIAQIVLA

SEQ ID NO: 967074 - protein, 26 aa, Mycobacterium
PPSTRARVIMRWGRIAVLIVTGLITL

SEQ ID NO: 967075 - protein, 17 aa, Mycobacterium
PQGKSCTRVAKRIAAAL

SEQ ID NO: 967076 - protein, 20 aa, Mycobacterium
PQPPNIVRFFTVWRFDSLIG

SEQ ID NO: 967077 - protein, 26 aa, Mycobacterium
PRDPRGRRCSLMALLAIAVLATAAGM

SEQ ID NO: 967078 - protein, 17 aa, Mycobacterium
PRDVPVRTSIGAMAITF

SEQ ID NO: 967079 - protein, 18 aa, Mycobacterium
PREWLTWLMHSSVTAFLS

SEQ ID NO: 967080 - protein, 27 aa, Mycobacterium
PRFLTHRFTAWDVFLGYELPQPPNIVR

SEQ ID NO: 967081 - protein, 20 aa, Mycobacterium
PRHRPPRSAPLQELLQPHMK

SEQ ID NO: 967082 - protein, 18 aa, Mycobacterium
PRHVLRFIVTGSLATAVD

SEQ ID NO: 967083 - protein, 21 aa, Mycobacterium
PRKRSVNSIGLAPQVGTLLGQ

SEQ ID NO: 967084 - protein, 21 aa, Mycobacterium
PRLVKPEILASTRFRAGLEKI

SEQ ID NO: 967085 - protein, 22 aa, Mycobacterium
PRMLMVLWLQWISNVMLVSYAL

SEQ ID NO: 967086 - protein, 22 aa, Mycobacterium
PRPRWLCAAATLGSALGAALPW

SEQ ID NO: 967087 - protein, 19 aa, Mycobacterium
PRYSESLYYVDPEGVRYGL

SEQ ID NO: 967088 - protein, 25 aa, Mycobacterium
PSASGRMTTKWGGFVPDVDAFDAEF

SEQ ID NO: 967089 - protein, 17 aa, Mycobacterium
PSATSRWVFEARPDLPN

SEQ ID NO: 967090 - protein, 22 aa, Mycobacterium
PSCSGRCWYLLTLLFATSLVLL

SEQ ID NO: 967091 - protein, 19 aa, Mycobacterium
PSDPVPRHRSADLLTDGVK

SEQ ID NO: 967092 - protein, 23 aa, Mycobacterium
PSEGWWPTMIGLAMNDSGGYNAN

SEQ ID NO: 967093 - protein, 20 aa, Mycobacterium
PSELPRPVAGNSQPYISANL

SEQ ID NO: 967094 - protein, 20 aa, Mycobacterium
PSGRRRRSRHSSLDEAAASS

SEQ ID NO: 967095 - protein, 21 aa, Mycobacterium
PSIICGVWGWYVLAPQLCPIT

SEQ ID NO: 967096 - protein, 26 aa, Mycobacterium
PSIVAALFIFCLWIATLGFQQSAFAV

SEQ ID NO: 967097 - protein, 25 aa, Mycobacterium
PSNTESHWRLGLYAAGRASQMRRLR

SEQ ID NO: 967098 - protein, 23 aa, Mycobacterium
PSPTCIIVGLPAGLRLAVDNAVA

SEQ ID NO: 967099 - protein, 22 aa, Mycobacterium
PSQRARSGLASRPQIKRPQELP

SEQ ID NO: 967100 - protein, 17 aa, Mycobacterium
PSTCWWWERTAGESRSR

SEQ ID NO: 967101 - protein, 21 aa, Mycobacterium
PSTPWQHTRHWIPRKRSVNSI

SEQ ID NO: 967102 - protein, 23 aa, Mycobacterium
PSWLPDWLHPAGMRRVVTLAASS

SEQ ID NO: 967103 - protein, 18 aa, Mycobacterium
PTALVFAGLATGCLGVAE

SEQ ID NO: 967104 - protein, 28 aa, Mycobacterium
PTAQPTRAKRCWTSLTLSTQVQEDPHIT

SEQ ID NO: 967105 - protein, 28 aa, Mycobacterium
PTGRGRWALCLIDGTPLWPTQSLTEQDV

SEQ ID NO: 967106 - protein, 25 aa, Mycobacterium
PTQRPELRDSSILSVSAHRRRSSES

SEQ ID NO: 967107 - protein, 24 aa, Mycobacterium
PTTLKRFAMMLAIITTVGALVALW

SEQ ID NO: 967108 - protein, 19 aa, Mycobacterium
PVEQLTCSEGALLAALIRR

SEQ ID NO: 967109 - protein, 21 aa, Mycobacterium
PVGYMVFALLGARSVSSPMLL

SEQ ID NO: 967110 - protein, 20 aa, Mycobacterium
PVIFSTFLMCMLPDLFIVLP

SEQ ID NO: 967111 - protein, 19 aa, Mycobacterium
PVIGTWLHWALFGGDFPGT

SEQ ID NO: 967112 - protein, 24 aa, Mycobacterium
PVKQRLFALFLYIAMLAFVVATAP

SEQ ID NO: 967113 - protein, 35 aa, Mycobacterium
PVLGTKLRSARHFHWGWVVALLMMVLALAAIAILG

SEQ ID NO: 967114 - protein, 21 aa, Mycobacterium
PVLLWARRVARVEPPIRPAGV

SEQ ID NO: 967115 - protein, 25 aa, Mycobacterium
PVSWIWQLPQARWNAYMNLSLWIYQ

SEQ ID NO: 967116 - protein, 19 aa, Mycobacterium
PVSWSHHWVWMLPAVLVTG

SEQ ID NO: 967117 - protein, 27 aa, Mycobacterium
PYGYKGFGEVAVFVFFGLVAVLGTEYT

SEQ ID NO: 967118 - protein, 19 aa, Mycobacterium
PYLVDGRGPGVGFGSGRQS

SEQ ID NO: 967119 - protein, 23 aa, Mycobacterium
PYRTEYLPTLLLAAILTPGTVTV

SEQ ID NO: 967120 - protein, 30 aa, Mycobacterium
QAAYACASAWLDALVMWRKASGLPSAVINW

SEQ ID NO: 967121 - protein, 23 aa, Mycobacterium
QAHLAEPHGYPFALTGTIVSVLL

SEQ ID NO: 967122 - protein, 28 aa, Mycobacterium
QAMRLRDLLKFDFYFADSAAFRANIAEE

SEQ ID NO: 967123 - protein, 20 aa, Mycobacterium
QAPVMYRIVRELATGAHQPM

SEQ ID NO: 967124 - protein, 17 aa, Mycobacterium
QARELIDLLAAAITVTL

SEQ ID NO: 967125 - protein, 22 aa, Mycobacterium
QATLQLHRGCIVLIEDASLAGL

SEQ ID NO: 967126 - protein, 26 aa, Mycobacterium
QDPVFLDWLVGLAFPCQRPFDHQYGV

SEQ ID NO: 967127 - protein, 25 aa, Mycobacterium
QDRMSVLYCKTGVRSAETLATVKKA

SEQ ID NO: 967128 - protein, 19 aa, Mycobacterium
QEFADPLTPILAVGAAASA

SEQ ID NO: 967129 - protein, 24 aa, Mycobacterium
QEPRSGERLLVFLVIEYYVAAVSV

SEQ ID NO: 967130 - protein, 20 aa, Mycobacterium
QEPWAIPIAFVIAQGLATVI

SEQ ID NO: 967131 - protein, 18 aa, Mycobacterium
QFATQHFTNISVETAGNQ

SEQ ID NO: 967132 - protein, 23 aa, Mycobacterium
QFFGCTPLGPIAWSGVITATAGA

SEQ ID NO: 967133 - protein, 17 aa, Mycobacterium
QFQGGGQHAVYLLDGLR

SEQ ID NO: 967134 - protein, 24 aa, Mycobacterium
QFTVWLTWPYRTVGALAGFGATVV

SEQ ID NO: 967135 - protein, 24 aa, Mycobacterium
QFVMPDLSGMFWADAEPRLRALGW

SEQ ID NO: 967136 - protein, 24 aa, Mycobacterium
QGGRAISKLGFWSVVMLGINSIIG

SEQ ID NO: 967137 - protein, 17 aa, Mycobacterium
QGLHKLFGWWGGQGLTG

SEQ ID NO: 967138 - protein, 24 aa, Mycobacterium
QGSTLPVVIRWARMPENVAHAEKL

SEQ ID NO: 967139 - protein, 24 aa, Mycobacterium
QIELPPGYLPLRVPIEVNFTQRVA

SEQ ID NO: 967140 - protein, 19 aa, Mycobacterium
QILDSRGGVIFAAVCLAAL

SEQ ID NO: 967141 - protein, 19 aa, Mycobacterium
QIVYEVFGPPGTVADISYF

SEQ ID NO: 967142 - protein, 20 aa, Mycobacterium
QKFSGGAVFWNKKSSEFTTE

SEQ ID NO: 967143 - protein, 17 aa, Mycobacterium
QKNLNVYGFTKFSQASV

SEQ ID NO: 967144 - protein, 23 aa, Mycobacterium
QLGKLHFWLTFIGFHTTFLVQHW

SEQ ID NO: 967145 - protein, 31 aa, Mycobacterium
QLLGSPGWITQRLWWALLLTAGFWGLLRVAE

SEQ ID NO: 967146 - protein, 30 aa, Mycobacterium
QLLRLPLPVPYLPPRVETFRDRKQVRPQPG

SEQ ID NO: 967147 - protein, 21 aa, Mycobacterium
QLQAFNVFSSVWFTAIYTLLF

SEQ ID NO: 967148 - protein, 24 aa, Mycobacterium
QLTFSVLAGYAFARLRFPGRDTLF

SEQ ID NO: 967149 - protein, 29 aa, Mycobacterium
QMDGAGAWRRLTKIILPIIKPAVMVALLF

SEQ ID NO: 967150 - protein, 26 aa, Mycobacterium
QMSRFWRKMFLTIGILIAAFGMRLIF

SEQ ID NO: 967151 - protein, 28 aa, Mycobacterium
QPFLEPVSHMWVVKFLRTHGLVHDCPKL

SEQ ID NO: 967152 - protein, 18 aa, Mycobacterium
QPHMKDWQPDAADEQWLP

SEQ ID NO: 967153 - protein, 19 aa, Mycobacterium
QPIGFGMSVVRQLAHFVDA

SEQ ID NO: 967154 - protein, 20 aa, Mycobacterium
QPKVSICGLDMPAEVSETAA

SEQ ID NO: 967155 - protein, 17 aa, Mycobacterium
QPSELAMLFHAKKSTGH

SEQ ID NO: 967156 - protein, 17 aa, Mycobacterium
QQLRLTLKKGNNDTDGS

SEQ ID NO: 967157 - protein, 28 aa, Mycobacterium
QRFWRITLPMLRPTMFFVLVTGIVSTAQ

SEQ ID NO: 967158 - protein, 18 aa, Mycobacterium
QRGINWRTIHLLREDIYT

SEQ ID NO: 967159 - protein, 17 aa, Mycobacterium
QRKRFGKRWGPQVRMVF

SEQ ID NO: 967160 - protein, 17 aa, Mycobacterium
QRLTFAAYFDKITAEFV

SEQ ID NO: 967161 - protein, 25 aa, Mycobacterium
QRNRPRLWLCYALTLMLSILLNLTL

SEQ ID NO: 967162 - protein, 25 aa, Mycobacterium
QRSACSRPLPHLGDVRHPVAPDSIA

SEQ ID NO: 967163 - protein, 17 aa, Mycobacterium
QRSLIMRALTGHEVDPT

SEQ ID NO: 967164 - protein, 22 aa, Mycobacterium
QRTIRWWASVALLTAAGVSLGG

SEQ ID NO: 967165 - protein, 25 aa, Mycobacterium
QRTRLTEVLSRIYGHPVTVQMQIDA

SEQ ID NO: 967166 - protein, 25 aa, Mycobacterium
QSGERRMLCGLQLPGVNNQQVAFKG

SEQ ID NO: 967167 - protein, 23 aa, Mycobacterium
QSHTDILWWALALGADFGGNLTA

SEQ ID NO: 967168 - protein, 17 aa, Mycobacterium
QSLGATVHPCARITKLS

SEQ ID NO: 967169 - protein, 20 aa, Mycobacterium
QSLKLQWGVTRPDGIIQPLA

SEQ ID NO: 967170 - protein, 33 aa, Mycobacterium
QSMLNLPAAWQFSRGEGQLVAIVDTGVRPGPRL

SEQ ID NO: 967171 - protein, 19 aa, Mycobacterium
QSTKQSIQFLALQFESTHC

SEQ ID NO: 967172 - protein, 23 aa, Mycobacterium
QTLRYLPDLVIVLALLTAIAFHA

SEQ ID NO: 967173 - protein, 22 aa, Mycobacterium
QTPAPPGITAWVTGASALIADM

SEQ ID NO: 967174 - protein, 25 aa, Mycobacterium
QVFFCSLAGYAFARLQFRGRDALFV

SEQ ID NO: 967175 - protein, 29 aa, Mycobacterium
QVSGWRFLLRRVEHAIVRRDTRMFDDPLQ

SEQ ID NO: 967176 - protein, 18 aa, Mycobacterium
QVTGWRFVMRRIASGIAL

SEQ ID NO: 967177 - protein, 19 aa, Mycobacterium
QWNNFMWPLVITSGNKWRV

SEQ ID NO: 967178 - protein, 19 aa, Mycobacterium
RAALARELVRTGTAFPTDI

SEQ ID NO: 967179 - protein, 21 aa, Mycobacterium
RAGDIMLLSGIAPVTAAAAAA

SEQ ID NO: 967180 - protein, 22 aa, Mycobacterium
RAQFMLMLDMLREAANESADSM

SEQ ID NO: 967181 - protein, 18 aa, Mycobacterium
RASSIMHGIWILLFTIPF

SEQ ID NO: 967182 - protein, 22 aa, Mycobacterium
RAVLNFRHGWDIYNEHFDYVDP

SEQ ID NO: 967183 - protein, 28 aa, Mycobacterium
RAVSQLFRLTYMVLFSIPVLVPMVLWIA

SEQ ID NO: 967184 - protein, 19 aa, Mycobacterium
RCTLPRIVNAVPLQVMIFY

SEQ ID NO: 967185 - protein, 24 aa, Mycobacterium
RCTVRRGALMFGKILPIGIGAAVG

SEQ ID NO: 967186 - protein, 22 aa, Mycobacterium
RDEVIRYSRHLIIPDIGVDGQM

SEQ ID NO: 967187 - protein, 25 aa, Mycobacterium
RDEYARRLAGWTGWSDEGQVLARVR

SEQ ID NO: 967188 - protein, 21 aa, Mycobacterium
RDGQSKPVDWVPSNRVTSVRQ

SEQ ID NO: 967189 - protein, 21 aa, Mycobacterium
RDLAMAFSWSLFNWIADVACL

SEQ ID NO: 967190 - protein, 17 aa, Mycobacterium
RDLFGRYVGEDVARRAL

SEQ ID NO: 967191 - protein, 17 aa, Mycobacterium
RDPSFYLRFRREAQNAA

SEQ ID NO: 967192 - protein, 18 aa, Mycobacterium
RDQLAGIRVIRAFTRESF

SEQ ID NO: 967193 - protein, 20 aa, Mycobacterium
RDRHSGSWFAVSMVPFTIAI

SEQ ID NO: 967194 - protein, 18 aa, Mycobacterium
RDRIPVAILALVGTFSVH

SEQ ID NO: 967195 - protein, 21 aa, Mycobacterium
RDRTSIELVIAVLLLTILMII

SEQ ID NO: 967196 - protein, 19 aa, Mycobacterium
RDSWVLALLYLASFGSFIG

SEQ ID NO: 967197 - protein, 17 aa, Mycobacterium
RDVAGKDSFPASFIIKL

SEQ ID NO: 967198 - protein, 23 aa, Mycobacterium
RDVERGPTVSWLRGAQDATGLAQ

SEQ ID NO: 967199 - protein, 28 aa, Mycobacterium
RDVLPSMPRWLWIVVVLGGFTAALAGGS

SEQ ID NO: 967200 - protein, 17 aa, Mycobacterium
REAKSGLATHLEAFAGN

SEQ ID NO: 967201 - protein, 26 aa, Mycobacterium
REALKSVLQYPVLAGPVFDTLTVESF

SEQ ID NO: 967202 - protein, 18 aa, Mycobacterium
REGVAFGLYTMTGRAASF

SEQ ID NO: 967203 - protein, 23 aa, Mycobacterium
RENLERVWAPKATGALRMHQASV

SEQ ID NO: 967204 - protein, 19 aa, Mycobacterium
RETARFGAPTLLTRTTNDV

SEQ ID NO: 967205 - protein, 20 aa, Mycobacterium
RETTMPWGLEVFYRRDPAGY

SEQ ID NO: 967206 - protein, 22 aa, Mycobacterium
REVIELRRCVAPLSAALQRMQT

SEQ ID NO: 967207 - protein, 22 aa, Mycobacterium
REVLPRLGPAIVGFKPALWAAG

SEQ ID NO: 967208 - protein, 21 aa, Mycobacterium
REYKGRLVTVIAVDDGEDDPV

SEQ ID NO: 967209 - protein, 20 aa, Mycobacterium
RFEALWRGSLIVLQSILAVV

SEQ ID NO: 967210 - protein, 23 aa, Mycobacterium
RFGDPYLDVATCLVNSVAHSIRF

SEQ ID NO: 967211 - protein, 20 aa, Mycobacterium
RFGSNWEPLGMLLAGSILIV

SEQ ID NO: 967212 - protein, 25 aa, Mycobacterium
RFLLWAAGCLLVLAATAWAMLRVLR

SEQ ID NO: 967213 - protein, 20 aa, Mycobacterium
RFPRGNLIGIPGAPERMVQN

SEQ ID NO: 967214 - protein, 24 aa, Mycobacterium
RGARRRSHCGGYWLGHRRGVDTDR

SEQ ID NO: 967215 - protein, 26 aa, Mycobacterium
RGDVFGLRRWYVITLLMGLFFVLGQG

SEQ ID NO: 967216 - protein, 19 aa, Mycobacterium
RGEFSLIIIGLVGTSTPAV

SEQ ID NO: 967217 - protein, 19 aa, Mycobacterium
RGESSCALGSVKTNIGHLE

SEQ ID NO: 967218 - protein, 17 aa, Mycobacterium
RGGVIFAAVCLAALVII

SEQ ID NO: 967219 - protein, 26 aa, Mycobacterium
RGPMDRFHRRLLWPILTLAGEVIGFG

SEQ ID NO: 967220 - protein, 24 aa, Mycobacterium
RGPMPPHAVVAVLRPVLGGLAAAH

SEQ ID NO: 967221 - protein, 25 aa, Mycobacterium
RGQENFNFGEFFAFTKVCSHLGCPS

SEQ ID NO: 967222 - protein, 24 aa, Mycobacterium
RGQPAKEAILFLAEVAVARRGEVV

SEQ ID NO: 967223 - protein, 17 aa, Mycobacterium
RGSAGVVLYGHRVARRN

SEQ ID NO: 967224 - protein, 19 aa, Mycobacterium
RGSDGVVIPGSYRNRHRAV

SEQ ID NO: 967225 - protein, 21 aa, Mycobacterium
RGVLMATNFFGVNTIPIALNE

SEQ ID NO: 967226 - protein, 24 aa, Mycobacterium
RGVVASFLYFLVVVAILATNFVTV

SEQ ID NO: 967227 - protein, 21 aa, Mycobacterium
RHALVWNFRFSVLLTGLIIII

SEQ ID NO: 967228 - protein, 22 aa, Mycobacterium
RHFPQARMKPEILMIESDHDMR

SEQ ID NO: 967229 - protein, 25 aa, Mycobacterium
RHPDLLVSLLTCWQRHPSRSYRFAG

SEQ ID NO: 967230 - protein, 36 aa, Mycobacterium
RHRAIHKPSRIRIALTRSFMTLTSFVAVLLTGAGYW

SEQ ID NO: 967231 - protein, 18 aa, Mycobacterium
RIDGGPEVLLRLDERRRL

SEQ ID NO: 967232 - protein, 19 aa, Mycobacterium
RIDGITFSTIFFILFAIVA

SEQ ID NO: 967233 - protein, 34 aa, Mycobacterium
RIKDEIREGRSFRSAVPRGWVRARKTIVSGNAVT

SEQ ID NO: 967234 - protein, 23 aa, Mycobacterium
RIKYKVGPTIACYQDFLRYYFLT

SEQ ID NO: 967235 - protein, 18 aa, Mycobacterium
RILAPRSGYDEIVSAIEE

SEQ ID NO: 967236 - protein, 19 aa, Mycobacterium
RILHAWCRGLTVTLHRTAD

SEQ ID NO: 967237 - protein, 17 aa, Mycobacterium
RIMPAYVITVLFAYALY

SEQ ID NO: 967238 - protein, 17 aa, Mycobacterium
RIRLVWLTAAGYTVTCQ

SEQ ID NO: 967239 - protein, 20 aa, Mycobacterium
RIRQAIKLTGPDIYRGLAPV

SEQ ID NO: 967240 - protein, 29 aa, Mycobacterium
RISDGAVFCGLLWWMAFGLHSKHLVVATL

SEQ ID NO: 967241 - protein, 18 aa, Mycobacterium
RKAVDRFIGVAIPVLSLP

SEQ ID NO: 967242 - protein, 18 aa, Mycobacterium
RKEIAKSMAPQVDKVHQQ

SEQ ID NO: 967243 - protein, 21 aa, Mycobacterium
RKEYLRYLAGLRARVTSSAAS

SEQ ID NO: 967244 - protein, 20 aa, Mycobacterium
RKPLKWSGCAGQHVRSGKVF

SEQ ID NO: 967245 - protein, 18 aa, Mycobacterium
RKPWPIAGVLVLFAVAAF

SEQ ID NO: 967246 - protein, 27 aa, Mycobacterium
RKQTRLGRFVSVFGWRAYALPFLMALT

SEQ ID NO: 967247 - protein, 19 aa, Mycobacterium
RKWFVIAGFSMQPSELAKI

SEQ ID NO: 967248 - protein, 27 aa, Mycobacterium
RLAGAGRIGVKVGKVLAKFKMAKHFHL

SEQ ID NO: 967249 - protein, 23 aa, Mycobacterium
RLELWRSDMVRMLAYGEIDARVK

SEQ ID NO: 967250 - protein, 26 aa, Mycobacterium
RLFNRWGVRAVFFGRFIALLRILAGP

SEQ ID NO: 967251 - protein, 18 aa, Mycobacterium
RLGDRPLIHLSRLVTTLR

SEQ ID NO: 967252 - protein, 20 aa, Mycobacterium
RLGWPLWAAYVAAFALTVLV

SEQ ID NO: 967253 - protein, 22 aa, Mycobacterium
RLKTFVLLVGMSTLIVVVGAIF

SEQ ID NO: 967254 - protein, 24 aa, Mycobacterium
RLLKTDVLWGISFAPVLHANWQHL

SEQ ID NO: 967255 - protein, 22 aa, Mycobacterium
RLLRRICPGDIVVLDVLDLDRI

SEQ ID NO: 967256 - protein, 26 aa, Mycobacterium
RLPYLARIGLLFAVMPFHAFFGIALM

SEQ ID NO: 967257 - protein, 18 aa, Mycobacterium
RLQLGRPAVLVVRCTIAV

SEQ ID NO: 967258 - protein, 24 aa, Mycobacterium
RLRDCSAPRRPARPDIDSPEEYEY

SEQ ID NO: 967259 - protein, 17 aa, Mycobacterium
RLSWVIIGLVLFTAGST

SEQ ID NO: 967260 - protein, 20 aa, Mycobacterium
RLSYFLDLRGPSVAVDTACS

SEQ ID NO: 967261 - protein, 17 aa, Mycobacterium
RLTHLTKRQLFWVSLYY

SEQ ID NO: 967262 - protein, 23 aa, Mycobacterium
RLVGSRLAFPRSVLTAAVVGLTV

SEQ ID NO: 967263 - protein, 17 aa, Mycobacterium
RLVMLLVALGIIAIVVV

SEQ ID NO: 967264 - protein, 19 aa, Mycobacterium
RLYALHILLIPGVILALIG

SEQ ID NO: 967265 - protein, 17 aa, Mycobacterium
RMAPFHHHFELAGWAET

SEQ ID NO: 967266 - protein, 17 aa, Mycobacterium
RMLAPIPGKSAVGIEVP

SEQ ID NO: 967267 - protein, 17 aa, Mycobacterium
RMLLYRIALLDVIILIG

SEQ ID NO: 967268 - protein, 27 aa, Mycobacterium
RMVTAIAVVVLLGWSFFYFSDDTRGYK

SEQ ID NO: 967269 - protein, 22 aa, Mycobacterium
RNDRRIPPQLALFCTNAANKAE

SEQ ID NO: 967270 - protein, 22 aa, Mycobacterium
RNFYSNPGFDFRASVRAVQNNL

SEQ ID NO: 967271 - protein, 20 aa, Mycobacterium
RNLLRRLIVAALLFVPLADL

SEQ ID NO: 967272 - protein, 27 aa, Mycobacterium
RNPVTGESRWSYARDSDLCGVSWVYHY

SEQ ID NO: 967273 - protein, 18 aa, Mycobacterium
RNTFWALVLPFMFGSPYA

SEQ ID NO: 967274 - protein, 21 aa, Mycobacterium
RNVRSRAWVKVGYIAFVLGGV

SEQ ID NO: 967275 - protein, 27 aa, Mycobacterium
RPGCAPAPDNVRCAASMTLAPEEPVNF

SEQ ID NO: 967276 - protein, 19 aa, Mycobacterium
RPKLADWVTLAITITTSST

SEQ ID NO: 967277 - protein, 20 aa, Mycobacterium
RPQVRSGFGSRVELRLAAVE

SEQ ID NO: 967278 - protein, 24 aa, Mycobacterium
RPVAPEAYALYGISRVLPQVLRST

SEQ ID NO: 967279 - protein, 17 aa, Mycobacterium
RPWYLAWGGLVYIVVAL

SEQ ID NO: 967280 - protein, 19 aa, Mycobacterium
RPYRLEVNHPLRVAGNRVY

SEQ ID NO: 967281 - protein, 18 aa, Mycobacterium
RQLARYGYISGLTGLVFL

SEQ ID NO: 967282 - protein, 24 aa, Mycobacterium
RQLDRVRMLLLTNCTFDGVVCNPQ

SEQ ID NO: 967283 - protein, 19 aa, Mycobacterium
RQLFWVSLYYPLTMRVLCN

SEQ ID NO: 967284 - protein, 21 aa, Mycobacterium
RQLRLKFGHESVRQAAELVRN

SEQ ID NO: 967285 - protein, 20 aa, Mycobacterium
RQQLHWSVPGLAFVVLVAVG

SEQ ID NO: 967286 - protein, 25 aa, Mycobacterium
RQRLDASEALAFVRQRHGLDNGDLD

SEQ ID NO: 967287 - protein, 24 aa, Mycobacterium
RQVVKELFELFNIDRQTLNTQGLQ

SEQ ID NO: 967288 - protein, 23 aa, Mycobacterium
RRECGRTTVLATIMSEIGRLYAP

SEQ ID NO: 967289 - protein, 25 aa, Mycobacterium
RREWCLRCRGALIAPQAEMPTAVKQ

SEQ ID NO: 967290 - protein, 19 aa, Mycobacterium
RRFGFLITALCLFTAVLIT

SEQ ID NO: 967291 - protein, 23 aa, Mycobacterium
RRFKEAPYIPGMPIVVAALAGLV

SEQ ID NO: 967292 - protein, 24 aa, Mycobacterium
RRFRWLVFTGWLLALVPAIYLAMT

SEQ ID NO: 967293 - protein, 18 aa, Mycobacterium
RRGAGGIAQQPSCSGSEQ

SEQ ID NO: 967294 - protein, 19 aa, Mycobacterium
RRGQLLFERVITGLLFVIV

SEQ ID NO: 967295 - protein, 20 aa, Mycobacterium
RRGTQHLGLLVLRVGLGVVL

SEQ ID NO: 967296 - protein, 20 aa, Mycobacterium
RRHLPSAGVDIILNATPGAV

SEQ ID NO: 967297 - protein, 18 aa, Mycobacterium
RRHRIPLPAFGDALAPGI

SEQ ID NO: 967298 - protein, 17 aa, Mycobacterium
RRIEGLIAPGTFNVDPS

SEQ ID NO: 967299 - protein, 23 aa, Mycobacterium
RRIESACKVWSAGVSASRLGRDL

SEQ ID NO: 967300 - protein, 19 aa, Mycobacterium
RRINLGLVAGALCILVMVM

SEQ ID NO: 967301 - protein, 31 aa, Mycobacterium
RRLAKSGYRCRRFADKIVFGLLVVVVVLATF

SEQ ID NO: 967302 - protein, 26 aa, Mycobacterium
RRLLPSRWWSIGCLDGLVITILAWWH

SEQ ID NO: 967303 - protein, 20 aa, Mycobacterium
RRLLVPNFSSPARLTAVVLA

SEQ ID NO: 967304 - protein, 20 aa, Mycobacterium
RRLVAVLMVLQLVSTLASLY

SEQ ID NO: 967305 - protein, 22 aa, Mycobacterium
RRPGECPEPIPGRPASASLVDP

SEQ ID NO: 967306 - protein, 21 aa, Mycobacterium
RRQVDIEGFQLVRLVYDMALV

SEQ ID NO: 967307 - protein, 25 aa, Mycobacterium
RRRALRWGLIFGFGCLFWGVVTALL

SEQ ID NO: 967308 - protein, 18 aa, Mycobacterium
RRRIRFQIILAVQMVTVN

SEQ ID NO: 967309 - protein, 19 aa, Mycobacterium
RRRQYRPLWVFLLVSVLIL

SEQ ID NO: 967310 - protein, 27 aa, Mycobacterium
RRSDLPTGRGLVGLVIVECVLVVRRML

SEQ ID NO: 967311 - protein, 27 aa, Mycobacterium
RRSSIGQVPNERWELFDDGSPEVKALL

SEQ ID NO: 967312 - protein, 25 aa, Mycobacterium
RRTQHNVYIPWSMTVTPISQSDVGS

SEQ ID NO: 967313 - protein, 20 aa, Mycobacterium
RRVALATSFVLRTGLATLLI

SEQ ID NO: 967314 - protein, 32 aa, Mycobacterium
RRVLLICGFAIAAAAVFAWLLAAFAVRPFKQL

SEQ ID NO: 967315 - protein, 18 aa, Mycobacterium
RRYADYLPTDGFQGLNVV

SEQ ID NO: 967316 - protein, 23 aa, Mycobacterium
RRYVFARPLLLPTTSRLVASGVT

SEQ ID NO: 967317 - protein, 18 aa, Mycobacterium
RRYVHPWIAWLVRGSVVP

SEQ ID NO: 967318 - protein, 20 aa, Mycobacterium
RSARLMWHICKIDGQPSRYR

SEQ ID NO: 967319 - protein, 18 aa, Mycobacterium
RSASRIAERFAEGHLSER

SEQ ID NO: 967320 - protein, 31 aa, Mycobacterium
RSECTQSLFWTRWVGWVMHRPWISASAASTI

SEQ ID NO: 967321 - protein, 23 aa, Mycobacterium
RSELPDCIIVSVSHRRAVELLHA

SEQ ID NO: 967322 - protein, 21 aa, Mycobacterium
RSFTGAAVWLGIASFSAASVV

SEQ ID NO: 967323 - protein, 20 aa, Mycobacterium
RSGYDFRPQIVGVFTDLSGP

SEQ ID NO: 967324 - protein, 18 aa, Mycobacterium
RSLEFSWRQSAGAMRTVL

SEQ ID NO: 967325 - protein, 19 aa, Mycobacterium
RSLTLRNTLLLSRQRRHAA

SEQ ID NO: 967326 - protein, 26 aa, Mycobacterium
RSMSWSRPSYALGMALLVVGPLMRPG

SEQ ID NO: 967327 - protein, 25 aa, Mycobacterium
RSRAARTGLVLSIAALVPIGAVFAL

SEQ ID NO: 967328 - protein, 20 aa, Mycobacterium
RSRTGKMLPPKLGLLTYVAD

SEQ ID NO: 967329 - protein, 24 aa, Mycobacterium
RSSWELRAGCLLPLVNLLWAPVYV

SEQ ID NO: 967330 - protein, 19 aa, Mycobacterium
RSTVFLNVGGFDYVVAHFS

SEQ ID NO: 967331 - protein, 23 aa, Mycobacterium
RSVREMLFAKGFVEVETPILQQI

SEQ ID NO: 967332 - protein, 24 aa, Mycobacterium
RSVVKELFALLAYGFIVAAFYVFT

SEQ ID NO: 967333 - protein, 21 aa, Mycobacterium
RSYRFAGQFVGPISQAPQVDE

SEQ ID NO: 967334 - protein, 23 aa, Mycobacterium
RTDDLRPIPVFGSDELARLTEAF

SEQ ID NO: 967335 - protein, 18 aa, Mycobacterium
RTEVFTSLMVLFSTSVVV

SEQ ID NO: 967336 - protein, 23 aa, Mycobacterium
RTFADILLRTEVRCVQAVERQRT

SEQ ID NO: 967337 - protein, 27 aa, Mycobacterium
RTGISSCRDSAWLLVSILWQMRLTAWV

SEQ ID NO: 967338 - protein, 19 aa, Mycobacterium
RTHHIVVVMVIWWLFFAGL

SEQ ID NO: 967339 - protein, 17 aa, Mycobacterium
RTKVCYISLMILGNNVI

SEQ ID NO: 967340 - protein, 23 aa, Mycobacterium
RTLRLSRIDMPGVAQVLDVIHTG

SEQ ID NO: 967341 - protein, 24 aa, Mycobacterium
RTQSRSVLVGALLVITGLIGCFVF

SEQ ID NO: 967342 - protein, 18 aa, Mycobacterium
RTRLEQLAELTAESQSTA

SEQ ID NO: 967343 - protein, 18 aa, Mycobacterium
RVAAALGVVGLDPALAKR

SEQ ID NO: 967344 - protein, 17 aa, Mycobacterium
RVAKRIAAALELMAAAW

SEQ ID NO: 967345 - protein, 20 aa, Mycobacterium
RVALPIPLPTHRLVFGAILA

SEQ ID NO: 967346 - protein, 19 aa, Mycobacterium
RVCPIRGVMMASYFAGFIT

SEQ ID NO: 967347 - protein, 19 aa, Mycobacterium
RVGVASVIAEGFLVLPFSR

SEQ ID NO: 967348 - protein, 21 aa, Mycobacterium
RVISMAHSFFSPSVVNEIIEP

SEQ ID NO: 967349 - protein, 27 aa, Mycobacterium
RVLEVAQPLAYCLPGVRSRVVVSEGAL

SEQ ID NO: 967350 - protein, 20 aa, Mycobacterium
RVLLPHAKPAVGVLAVLTWV

SEQ ID NO: 967351 - protein, 26 aa, Mycobacterium
RVLTVSRLLAPIVVPLIYRAAIATRA

SEQ ID NO: 967352 - protein, 31 aa, Mycobacterium
RVMPWSDRPVHPFTLWRSRFSVAIDALEAHI

SEQ ID NO: 967353 - protein, 30 aa, Mycobacterium
RVPTLAMALTCWWLISREVIPRLGHAAKAS

SEQ ID NO: 967354 - protein, 24 aa, Mycobacterium
RVRHPKLATVIARDHADAVAGLRA

SEQ ID NO: 967355 - protein, 18 aa, Mycobacterium
RVVRGVLMATNFFGVNTI

SEQ ID NO: 967356 - protein, 25 aa, Mycobacterium
RVWDSVACKAWLLAQPYLVASVLLG

SEQ ID NO: 967357 - protein, 17 aa, Mycobacterium
RWALLCVGIAQIVLATV

SEQ ID NO: 967358 - protein, 25 aa, Mycobacterium
RWLLIKCGVVLLLVFVAFIAHPVLH

SEQ ID NO: 967359 - protein, 20 aa, Mycobacterium
RWRSPMRRVYTANLHDESAM

SEQ ID NO: 967360 - protein, 37 aa, Mycobacterium
RWWQLETLYRSNIKYLPDWVPRYACYEDARLIPRVGV

SEQ ID NO: 967361 - protein, 20 aa, Mycobacterium
RYRFDRVPLYELVRCGLPVP

SEQ ID NO: 967362 - protein, 23 aa, Mycobacterium
SAAPLFHNVAGWLMQRENVPLSP

SEQ ID NO: 967363 - protein, 28 aa, Mycobacterium
SADVVHSFWVPKFLFKRDVMPNPVANNS

SEQ ID NO: 967364 - protein, 19 aa, Mycobacterium
SAGASLWWMIGLLVAAGVL

SEQ ID NO: 967365 - protein, 23 aa, Mycobacterium
SAKTRFGVRIDRIVQSPIAIATW

SEQ ID NO: 967366 - protein, 18 aa, Mycobacterium
SALCSRGLHTILLTGDNQ

SEQ ID NO: 967367 - protein, 31 aa, Mycobacterium
SALIMLMIAARTCWLRALIVVAGGSLPVAYQ

SEQ ID NO: 967368 - protein, 17 aa, Mycobacterium
SALWEFAILAVIAIGLY

SEQ ID NO: 967369 - protein, 18 aa, Mycobacterium
SAMDRVFADILRNVSGGR

SEQ ID NO: 967370 - protein, 31 aa, Mycobacterium
SASEFGGDDVIAWRGQHRFVERLCKATLDAG

SEQ ID NO: 967371 - protein, 25 aa, Mycobacterium
SATELPVIIVIVALMAQWARQDHRV

SEQ ID NO: 967372 - protein, 23 aa, Mycobacterium
SATTFPWVFLFPAGVLVVILVCA

SEQ ID NO: 967373 - protein, 30 aa, Mycobacterium
SAVAPDITKPVWITMLWPLADRPRLSPGAP

SEQ ID NO: 967374 - protein, 25 aa, Mycobacterium
SAYDIGLFYRYAWQNPSFSNIVATR

SEQ ID NO: 967375 - protein, 19 aa, Mycobacterium
SCAEGGVLGIVCASIASVM

SEQ ID NO: 967376 - protein, 19 aa, Mycobacterium
SCQKVLEGTGFVVSLDRVM

SEQ ID NO: 967377 - protein, 17 aa, Mycobacterium
SDCDAHGTLTASIIGGR

SEQ ID NO: 967378 - protein, 23 aa, Mycobacterium
SDFGRLGLVAGVLVTLVCFSDCW

SEQ ID NO: 967379 - protein, 20 aa, Mycobacterium
SDILLSIVDACIALRAYPSA

SEQ ID NO: 967380 - protein, 21 aa, Mycobacterium
SDLDSAYRYGIEVALAESLVA

SEQ ID NO: 967381 - protein, 25 aa, Mycobacterium
SDLEQWDWVKWLPHFGDPRRQDAAG

SEQ ID NO: 967382 - protein, 17 aa, Mycobacterium
SDMPRVVKRRGQENFNF

SEQ ID NO: 967383 - protein, 24 aa, Mycobacterium
SDPSRVRRSGGTGLGLAISIEDAR

SEQ ID NO: 967384 - protein, 18 aa, Mycobacterium
SEFEPLHQLFLGVRSLLY

SEQ ID NO: 967385 - protein, 29 aa, Mycobacterium
SEFIWARQHARRMVLIWVGVVVAIAGLVA

SEQ ID NO: 967386 - protein, 19 aa, Mycobacterium
SEGALLAALIRRPSVLDPA

SEQ ID NO: 967387 - protein, 21 aa, Mycobacterium
SEGEIAPPTRVVLRKQRNIQV

SEQ ID NO: 967388 - protein, 24 aa, Mycobacterium
SEPVAVVGIGCRFPGNVTGPDSFW

SEQ ID NO: 967389 - protein, 18 aa, Mycobacterium
SFEAKKDIIGYVRTVIEE

SEQ ID NO: 967390 - protein, 19 aa, Mycobacterium
SFGDMRSAFYAGYEESDRE

SEQ ID NO: 967391 - protein, 17 aa, Mycobacterium
SFSQRWVSGGSVAAYSE

SEQ ID NO: 967392 - protein, 22 aa, Mycobacterium
SFTGFSAMVIWWLFFAGLVWVV

SEQ ID NO: 967393 - protein, 21 aa, Mycobacterium
SFYLPPEVFKNTDFKRAMKSF

SEQ ID NO: 967394 - protein, 23 aa, Mycobacterium
SGCSWSDALAIGWPEGITPEAHL

SEQ ID NO: 967395 - protein, 25 aa, Mycobacterium
SGDSYRLASRLGMPPWRVQKAQQQA

SEQ ID NO: 967396 - protein, 26 aa, Mycobacterium
SGEGAAGLAEIWSRHLGRAILPDSSL

SEQ ID NO: 967397 - protein, 18 aa, Mycobacterium
SGGRLVWDPLNGTLNGLD

SEQ ID NO: 967398 - protein, 25 aa, Mycobacterium
SGGVPIGSWLSRSVFAAKFAERNFL

SEQ ID NO: 967399 - protein, 21 aa, Mycobacterium
SGHLYPVYNLTSARLALGKPA

SEQ ID NO: 967400 - protein, 20 aa, Mycobacterium
SGIALFATIGVFFSGDHQVK

SEQ ID NO: 967401 - protein, 29 aa, Mycobacterium
SGIVGRLFGRFDLAVAVFFALSGFLLWRG

SEQ ID NO: 967402 - protein, 23 aa, Mycobacterium
SGKSEFLRTLILSLVAMTHPNQV

SEQ ID NO: 967403 - protein, 18 aa, Mycobacterium
SGLVPIALDGKMLRGALR

SEQ ID NO: 967404 - protein, 18 aa, Mycobacterium
SGLYSGRRYALWRGARLP

SEQ ID NO: 967405 - protein, 17 aa, Mycobacterium
SGPTWRLIGTTATSLLL

SEQ ID NO: 967406 - protein, 19 aa, Mycobacterium
SGQAFEVLAPFVVDDGPTV

SEQ ID NO: 967407 - protein, 24 aa, Mycobacterium
SGRPSKFTMAGPWVGIAAPGENIV

SEQ ID NO: 967408 - protein, 24 aa, Mycobacterium
SGTGELRGLLQLPTHDGIYVRAAM

SEQ ID NO: 967409 - protein, 18 aa, Mycobacterium
SGVSKFLLGTAFNVTQCQ

SEQ ID NO: 967410 - protein, 23 aa, Mycobacterium
SHELRTPLTTVRMAADLIYDHSS

SEQ ID NO: 967411 - protein, 24 aa, Mycobacterium
SHGSPLRILLLLVLVMALGSALLD

SEQ ID NO: 967412 - protein, 19 aa, Mycobacterium
SHHYGLVLAGAYPMYLDAY

SEQ ID NO: 967413 - protein, 21 aa, Mycobacterium
SHPFRLGFWLQAELVAMATDV

SEQ ID NO: 967414 - protein, 23 aa, Mycobacterium
SHRRVVLLIYLWVGIVAFGAAST

SEQ ID NO: 967415 - protein, 19 aa, Mycobacterium
SHSCVRKNVRIEFPENTAS

SEQ ID NO: 967416 - protein, 24 aa, Mycobacterium
SHWWPMCAGTAWWCTARVSMSVSR

SEQ ID NO: 967417 - protein, 17 aa, Mycobacterium
SILGELLVYVLPLLLLV

SEQ ID NO: 967418 - protein, 28 aa, Mycobacterium
SIPMLIRRLITLCPAIAILALGFDPTRA

SEQ ID NO: 967419 - protein, 21 aa, Mycobacterium
SIPYLRAVGRWTASRPEIPAP

SEQ ID NO: 967420 - protein, 23 aa, Mycobacterium
SKDGKAWILPIVLAGELGTSASY

SEQ ID NO: 967421 - protein, 21 aa, Mycobacterium
SKSLREMFRDVTIIVVTQRIS

SEQ ID NO: 967422 - protein, 17 aa, Mycobacterium
SKVALYLLITIAPFAVI

SEQ ID NO: 967423 - protein, 28 aa, Mycobacterium
SLAANIVGGIDWDGHGLLGLEDSLDSVL

SEQ ID NO: 967424 - protein, 20 aa, Mycobacterium
SLCLIFIIMLIITRAFVAAA

SEQ ID NO: 967425 - protein, 18 aa, Mycobacterium
SLDIVYYPVSWIMWVWYK

SEQ ID NO: 967426 - protein, 32 aa, Mycobacterium
SLEDVIRFQAEFLWRDYFRGVTLDGEEQPVLV

SEQ ID NO: 967427 - protein, 24 aa, Mycobacterium
SLEVTRLSRAIVHAADLGARVINI

SEQ ID NO: 967428 - protein, 25 aa, Mycobacterium
SLFCSGTIIFAILVLLGRYINYTLD

SEQ ID NO: 967429 - protein, 19 aa, Mycobacterium
SLGRRDLAMAFSWSLFNWI

SEQ ID NO: 967430 - protein, 27 aa, Mycobacterium
SLIRNWPAWLGIYGFLTLDRWLLFNWM

SEQ ID NO: 967431 - protein, 34 aa, Mycobacterium
SLKDLLINCGYPLIERFPLMLGTAGSVLLIGLVR

SEQ ID NO: 967432 - protein, 26 aa, Mycobacterium
SLLGMICMLGTLWLIVRTSSSVRASA

SEQ ID NO: 967433 - protein, 26 aa, Mycobacterium
SLPITAVAVWAWWVTGRSPFWSLAIG

SEQ ID NO: 967434 - protein, 18 aa, Mycobacterium
SLQSWRPVALAGLVVGLF

SEQ ID NO: 967435 - protein, 21 aa, Mycobacterium
SLSSLAHWLGWRRRSLRPRLP

SEQ ID NO: 967436 - protein, 18 aa, Mycobacterium
SLTGWRGFDTKLGFCELP

SEQ ID NO: 967437 - protein, 18 aa, Mycobacterium
SLVLSFTCLVLYSTLVQA

SEQ ID NO: 967438 - protein, 25 aa, Mycobacterium
SLWWVTRTGARFGVEDTKDVRDALG

SEQ ID NO: 967439 - protein, 25 aa, Mycobacterium
SLYRIGALCAYCMVIWAVSVSLLVV

SEQ ID NO: 967440 - protein, 19 aa, Mycobacterium
SMFPFVWNVFKSWRYGEVV

SEQ ID NO: 967441 - protein, 20 aa, Mycobacterium
SMIICGKAFDNIIALSETKQ

SEQ ID NO: 967442 - protein, 17 aa, Mycobacterium
SNWLSVLPLQYTNADGH

SEQ ID NO: 967443 - protein, 32 aa, Mycobacterium
SNYTEVFDLIPFWRMFFNTVLYAGYVTVGQVF

SEQ ID NO: 967444 - protein, 31 aa, Mycobacterium
SPDRPVHVLAHDWGSVGVWEYLSRSGASDRV

SEQ ID NO: 967445 - protein, 19 aa, Mycobacterium
SPEFNRKAVDRFIGVAIPV

SEQ ID NO: 967446 - protein, 27 aa, Mycobacterium
SPEVKALLARTTRWGSFLEDIDAFDSE

SEQ ID NO: 967447 - protein, 18 aa, Mycobacterium
SPIPWLRTVAVIGATVTL

SEQ ID NO: 967448 - protein, 17 aa, Mycobacterium
SPRVLTIGGGWLLMVAM

SEQ ID NO: 967449 - protein, 20 aa, Mycobacterium
SPRVPAEPGGDFVDQAGNGL

SEQ ID NO: 967450 - protein, 26 aa, Mycobacterium
SPYRGLLIAAHLTWLVILVMAVVGMQ

SEQ ID NO: 967451 - protein, 24 aa, Mycobacterium
SQSRRFIGALAFVAGCSVLVRPEL

SEQ ID NO: 967452 - protein, 19 aa, Mycobacterium
SQVKLPSLLALGFVAMALA

SEQ ID NO: 967453 - protein, 21 aa, Mycobacterium
SRALVDAAIIAPVTTLTRDEP

SEQ ID NO: 967454 - protein, 23 aa, Mycobacterium
SRGELDRTLLLWTLPLLIAPPMY

SEQ ID NO: 967455 - protein, 19 aa, Mycobacterium
SRIAERFAEGHLSERMPVR

SEQ ID NO: 967456 - protein, 21 aa, Mycobacterium
SRITLPGSIYLGAIAVLPNLF

SEQ ID NO: 967457 - protein, 19 aa, Mycobacterium
SRKEGWGLAVVEAAQHNVP

SEQ ID NO: 967458 - protein, 17 aa, Mycobacterium
SRLPDWVGDSVHAATAG

SEQ ID NO: 967459 - protein, 17 aa, Mycobacterium
SRLTVFGLLGGTIAGGA

SEQ ID NO: 967460 - protein, 18 aa, Mycobacterium
SRVVVLVHHCHREQWPVA

SEQ ID NO: 967461 - protein, 24 aa, Mycobacterium
SSFFRLRLRRACRISHWDPEDQAA

SEQ ID NO: 967462 - protein, 27 aa, Mycobacterium
SSFFVVGVPCIPRKPNGKIDRDNLLVM

SEQ ID NO: 967463 - protein, 20 aa, Mycobacterium
SSFHDPPWSNIYIGVSEAHK

SEQ ID NO: 967464 - protein, 19 aa, Mycobacterium
SSFSFPLAYYFATIGRQRR

SEQ ID NO: 967465 - protein, 19 aa, Mycobacterium
SSHELRTPLTAMRTNLEVL

SEQ ID NO: 967466 - protein, 24 aa, Mycobacterium
SSLAKRLLIGYVISGTLILCSGAI

SEQ ID NO: 967467 - protein, 19 aa, Mycobacterium
SSLVEMLRGTDSWTPFVAQ

SEQ ID NO: 967468 - protein, 19 aa, Mycobacterium
SSQAFGFKDLYTGDADPQT

SEQ ID NO: 967469 - protein, 20 aa, Mycobacterium
SSSLVAIHLACQSLRLRESD

SEQ ID NO: 967470 - protein, 19 aa, Mycobacterium
SSSLVAIHLACQSLRTADA

SEQ ID NO: 967471 - protein, 25 aa, Mycobacterium
SSWFDAARPIGAWVDAVLRTFIGSA

SEQ ID NO: 967472 - protein, 24 aa, Mycobacterium
SSYPRLIRVAMMYNDKIGYGPTVG

SEQ ID NO: 967473 - protein, 25 aa, Mycobacterium
STGGWCSGEVLALASAVEAASEHSV

SEQ ID NO: 967474 - protein, 23 aa, Mycobacterium
STGVPCGMQLFWEAITVQMRTQI

SEQ ID NO: 967475 - protein, 26 aa, Mycobacterium
STHFPGWEWMLTALAIPVVTWAAWPF

SEQ ID NO: 967476 - protein, 23 aa, Mycobacterium
STLQARATRRGLLLTALGGLLIG

SEQ ID NO: 967477 - protein, 19 aa, Mycobacterium
STLVSWLLFTWMIAWLPRK

SEQ ID NO: 967478 - protein, 19 aa, Mycobacterium
STPYALKIMTWVTEIFAPL

SEQ ID NO: 967479 - protein, 17 aa, Mycobacterium
STTAIALEVVKWWRSSG

SEQ ID NO: 967480 - protein, 27 aa, Mycobacterium
SVASSALRQSFLWGFGGVIAAEHPEMW

SEQ ID NO: 967481 - protein, 25 aa, Mycobacterium
SVEKRPRLTMFDDFGGRIPSDKPPI

SEQ ID NO: 967482 - protein, 20 aa, Mycobacterium
SVGCYVWYHAAGVVLVQAVG

SEQ ID NO: 967483 - protein, 20 aa, Mycobacterium
SVGVWLMLAVLLFSVVISVR

SEQ ID NO: 967484 - protein, 22 aa, Mycobacterium
SVPEITAAAGLVLFSVGAVVAH

SEQ ID NO: 967485 - protein, 25 aa, Mycobacterium
SVSCELDWWLGFSSVASLLGSPGQA

SEQ ID NO: 967486 - protein, 18 aa, Mycobacterium
SVVDYEQLFAATSMMPSH

SEQ ID NO: 967487 - protein, 22 aa, Mycobacterium
SWIMWVWYKLFAAVLGPSNFFA

SEQ ID NO: 967488 - protein, 24 aa, Mycobacterium
SWVGFPAQPLISWTQPDRGEHRSR

SEQ ID NO: 967489 - protein, 17 aa, Mycobacterium
SWVGGPMRFEYVALAAA

SEQ ID NO: 967490 - protein, 19 aa, Mycobacterium
SYSLPLRRLLGMVASGLDA

SEQ ID NO: 967491 - protein, 25 aa, Mycobacterium
TAAGATTAWAIGRWTPGTERRTATM

SEQ ID NO: 967492 - protein, 18 aa, Mycobacterium
TAALCAAVLIGYMHWTSP

SEQ ID NO: 967493 - protein, 25 aa, Mycobacterium
TAAVFAGWLWPLWDSRRRTFADILL

SEQ ID NO: 967494 - protein, 22 aa, Mycobacterium
TAFQWNWKFGYQRVDFKDGTLT

SEQ ID NO: 967495 - protein, 18 aa, Mycobacterium
TAGINGWFGVSNYGVPWF

SEQ ID NO: 967496 - protein, 18 aa, Mycobacterium
TAIAVAFSKPGLPVEYLQ

SEQ ID NO: 967497 - protein, 23 aa, Mycobacterium
TAIGIIVPWVLGHTTDLLFNGVI

SEQ ID NO: 967498 - protein, 26 aa, Mycobacterium
TAKFGVTPLLLWQFATQHFTNISVET

SEQ ID NO: 967499 - protein, 19 aa, Mycobacterium
TALALARRGAEVVVSDIDE

SEQ ID NO: 967500 - protein, 20 aa, Mycobacterium
TALCRRAGFRATFDPLRRLA

SEQ ID NO: 967501 - protein, 19 aa, Mycobacterium
TALLDGFLTFFVVATFGAL

SEQ ID NO: 967502 - protein, 20 aa, Mycobacterium
TALPRPVWTTATVVLLVAAT

SEQ ID NO: 967503 - protein, 24 aa, Mycobacterium
TAPAPRLSYDPYLQYGQYGAQSYY

SEQ ID NO: 967504 - protein, 19 aa, Mycobacterium
TARASWLVLTDWDPSIKSL

SEQ ID NO: 967505 - protein, 18 aa, Mycobacterium
TASIAWGVLASSFVSTLL

SEQ ID NO: 967506 - protein, 17 aa, Mycobacterium
TAVPWARQRTAMVSAEQ

SEQ ID NO: 967507 - protein, 24 aa, Mycobacterium
TAVSGNLIAAVGMTIAVAATLVKI

SEQ ID NO: 967508 - protein, 22 aa, Mycobacterium
TCALAVLCYAHLASMPPLAGSG

SEQ ID NO: 967509 - protein, 25 aa, Mycobacterium
TCLVNSVAHSIRFPPFASVQDVVRT

SEQ ID NO: 967510 - protein, 20 aa, Mycobacterium
TCSSLMRFSASESRAHSRFE

SEQ ID NO: 967511 - protein, 24 aa, Mycobacterium
TCSTGVLLLWSWLVLPLAQGYYSM

SEQ ID NO: 967512 - protein, 19 aa, Mycobacterium
TCTRPTELVIDGIDVTQAE

SEQ ID NO: 967513 - protein, 23 aa, Mycobacterium
TDGSCRRAFATADCVILDDEGFP

SEQ ID NO: 967514 - protein, 24 aa, Mycobacterium
TDKSDLFEAIGIRLRDMLWAAIFP

SEQ ID NO: 967515 - protein, 23 aa, Mycobacterium
TDTRLVELLGRINAELAVYTGLI

SEQ ID NO: 967516 - protein, 18 aa, Mycobacterium
TDVCPWLADHKVFGQPIM

SEQ ID NO: 967517 - protein, 17 aa, Mycobacterium
TEAFNLMLRALAESRER

SEQ ID NO: 967518 - protein, 17 aa, Mycobacterium
TEFMMRATIGFWLTPLL

SEQ ID NO: 967519 - protein, 25 aa, Mycobacterium
TEGFTRLVPTLACLAGYAVTFTLLA

SEQ ID NO: 967520 - protein, 19 aa, Mycobacterium
TEHRGVWRALLGSDAIYFE

SEQ ID NO: 967521 - protein, 17 aa, Mycobacterium
TEIPVLVLPAGKRIEFQ

SEQ ID NO: 967522 - protein, 21 aa, Mycobacterium
TERGIGNGMSLLIFVGIAARI

SEQ ID NO: 967523 - protein, 19 aa, Mycobacterium
TERMVTFWLLLGGVLGLTL

SEQ ID NO: 967524 - protein, 34 aa, Mycobacterium
TETRYGRSRLPGRSRHRGVIALTVLAVAASTGIA

SEQ ID NO: 967525 - protein, 21 aa, Mycobacterium
TEVGVSWSWLPTLEAVKLAEV

SEQ ID NO: 967526 - protein, 19 aa, Mycobacterium
TEVNGLRLAPSRSALPARP

SEQ ID NO: 967527 - protein, 35 aa, Mycobacterium
TFSSGQRALLWAAGMLGALAIIIAVLIVINSYAGN

SEQ ID NO: 967528 - protein, 19 aa, Mycobacterium
TFVGLRLWHTLFGSADGYT

SEQ ID NO: 967529 - protein, 20 aa, Mycobacterium
TFWIGRPLIGLNFANEKLNA

SEQ ID NO: 967530 - protein, 26 aa, Mycobacterium
TGAETLRLVSYLIMCRNSIRDYAELA

SEQ ID NO: 967531 - protein, 17 aa, Mycobacterium
TGARYMATFAHNVDAYK

SEQ ID NO: 967532 - protein, 30 aa, Mycobacterium
TGGLGGLGLVVARWLVDRGAGRVVLGSRSD

SEQ ID NO: 967533 - protein, 27 aa, Mycobacterium
TGTMLLRLCMLPGLALLIWATPRLAQH

SEQ ID NO: 967534 - protein, 32 aa, Mycobacterium
TGVLASSVLLVWWRWHHGFWLSVIYATVIALL

SEQ ID NO: 967535 - protein, 25 aa, Mycobacterium
THGRLSLLELRGFAMPLYLQMVIVR

SEQ ID NO: 967536 - protein, 17 aa, Mycobacterium
TIAMLFAIGLLASSLAS

SEQ ID NO: 967537 - protein, 20 aa, Mycobacterium
TIATPAWYAPLVLTVGGIAQ

SEQ ID NO: 967538 - protein, 21 aa, Mycobacterium
TIRRRKLIGLSLGVGLGAFGL

SEQ ID NO: 967539 - protein, 17 aa, Mycobacterium
TISLSFGSISDWFLSAT

SEQ ID NO: 967540 - protein, 18 aa, Mycobacterium
TITVVGGVPLVLDYQIAD

SEQ ID NO: 967541 - protein, 18 aa, Mycobacterium
TIVARFAALTWPIAIAVS

SEQ ID NO: 967542 - protein, 17 aa, Mycobacterium
TIVLCQLRLHKMAKAGI

SEQ ID NO: 967543 - protein, 21 aa, Mycobacterium
TIVPLPWILQAPRLFAGKINL

SEQ ID NO: 967544 - protein, 19 aa, Mycobacterium
TIYSPLFRKLVEWIEYLCL

SEQ ID NO: 967545 - protein, 18 aa, Mycobacterium
TKIARSMVTEFGMSSKLG

SEQ ID NO: 967546 - protein, 17 aa, Mycobacterium
TKIPLDIDATLVSEGNG

SEQ ID NO: 967547 - protein, 21 aa, Mycobacterium
TKVCSHLGCPSSLYEQQSYRI

SEQ ID NO: 967548 - protein, 21 aa, Mycobacterium
TKWVHHFGLFAALGAAVAALT

SEQ ID NO: 967549 - protein, 17 aa, Mycobacterium
TLGRPLRIFRIPVDEWA

SEQ ID NO: 967550 - protein, 24 aa, Mycobacterium
TLIALSFLGLRHLWSGSPETPEVR

SEQ ID NO: 967551 - protein, 19 aa, Mycobacterium
TLLPACLAILAKHVDALGV

SEQ ID NO: 967552 - protein, 18 aa, Mycobacterium
TLLRALYVILGWRRVLLI

SEQ ID NO: 967553 - protein, 19 aa, Mycobacterium
TLLVCERLTINAAPFLMAE

SEQ ID NO: 967554 - protein, 23 aa, Mycobacterium
TLLYKKSSVMFGIDLAKRDIVKG

SEQ ID NO: 967555 - protein, 30 aa, Mycobacterium
TLMAMFAQWNWWLPRWLSRALPAVDFDKPF

SEQ ID NO: 967556 - protein, 20 aa, Mycobacterium
TLPLLWSRGLLSLPVTYIGK

SEQ ID NO: 967557 - protein, 25 aa, Mycobacterium
TLPLYRQQRMLLMSKTMYAVTRNPT

SEQ ID NO: 967558 - protein, 17 aa, Mycobacterium
TLSIHWNVNIYNASSTP

SEQ ID NO: 967559 - protein, 27 aa, Mycobacterium
TLVEFSGRWLSGWLMALYSFFRRSSKP

SEQ ID NO: 967560 - protein, 20 aa, Mycobacterium
TLYVLPWICAPLAIAVLWRW

SEQ ID NO: 967561 - protein, 22 aa, Mycobacterium
TMGWHHHVVFILSLILIWTQPR

SEQ ID NO: 967562 - protein, 19 aa, Mycobacterium
TMNDINWVGAVVIALDSSV

SEQ ID NO: 967563 - protein, 25 aa, Mycobacterium
TMREARAGDRYLLCSDGLSDPVSDE

SEQ ID NO: 967564 - protein, 19 aa, Mycobacterium
TMRRFSWSGTAPVLDPLPR

SEQ ID NO: 967565 - protein, 27 aa, Mycobacterium
TMTGRAASFVAPWSFSIFVDGFGVVRA

SEQ ID NO: 967566 - protein, 24 aa, Mycobacterium
TNLDKLRSLMAVARKDVVLSAGWN

SEQ ID NO: 967567 - protein, 17 aa, Mycobacterium
TNLHGRYLFPHFVSHDM

SEQ ID NO: 967568 - protein, 19 aa, Mycobacterium
TNMLYPFAGCSVVALFGGQ

SEQ ID NO: 967569 - protein, 20 aa, Mycobacterium
TPALIRLFTRHGFGQEIRED

SEQ ID NO: 967570 - protein, 19 aa, Mycobacterium
TPAPYGPLFLWIGRGISAL

SEQ ID NO: 967571 - protein, 26 aa, Mycobacterium
TPARLDNARFLLPVAGVPPAKSDAMD

SEQ ID NO: 967572 - protein, 23 aa, Mycobacterium
TPDWRRRLDDLSYTRALSPLRKP

SEQ ID NO: 967573 - protein, 22 aa, Mycobacterium
TPFLIISMLFYFTVIVQDKMLY

SEQ ID NO: 967574 - protein, 27 aa, Mycobacterium
TPHCAAVGRISYLLGLRGPAMAVDTAC

SEQ ID NO: 967575 - protein, 21 aa, Mycobacterium
TPLLDLACRGLQLSEAAAHQR

SEQ ID NO: 967576 - protein, 17 aa, Mycobacterium
TPLLFAVDGTLVGLISL

SEQ ID NO: 967577 - protein, 19 aa, Mycobacterium
TPPPLPSPHHRPHWGEEGV

SEQ ID NO: 967578 - protein, 28 aa, Mycobacterium
TPRMIEHARSLRAMPVIAPRNLARLPKH

SEQ ID NO: 967579 - protein, 21 aa, Mycobacterium
TPRYAVMPRWGLADRVDQDST

SEQ ID NO: 967580 - protein, 17 aa, Mycobacterium
TPWPRGLMLGLGIALKL

SEQ ID NO: 967581 - protein, 23 aa, Mycobacterium
TQIPLPVILIVSTTVVFGALSHR

SEQ ID NO: 967582 - protein, 19 aa, Mycobacterium
TQLRIMFVVLLGALMIASF

SEQ ID NO: 967583 - protein, 24 aa, Mycobacterium
TQPDYGAPPGWHAPGWPPQQPPDY

SEQ ID NO: 967584 - protein, 24 aa, Mycobacterium
TQPKKAAAALVWLVEEMEQRYQDM

SEQ ID NO: 967585 - protein, 19 aa, Mycobacterium
TRCRAKAAVNRAEHTTPAQ

SEQ ID NO: 967586 - protein, 21 aa, Mycobacterium
TRGISGWPAVTVAVGVLLGAL

SEQ ID NO: 967587 - protein, 20 aa, Mycobacterium
TRHWIPRKRSVNSIGLAPQV

SEQ ID NO: 967588 - protein, 18 aa, Mycobacterium
TRRAELTSISVLLSNNTA

SEQ ID NO: 967589 - protein, 20 aa, Mycobacterium
TRREAAAVGLSWWRSQARRG

SEQ ID NO: 967590 - protein, 19 aa, Mycobacterium
TRTAVMMGLSSWDYTIVNI

SEQ ID NO: 967591 - protein, 25 aa, Mycobacterium
TRVASAAAVLADWMSGPGAAAPLAD

SEQ ID NO: 967592 - protein, 17 aa, Mycobacterium
TRVDSGREPVWYITPGN

SEQ ID NO: 967593 - protein, 30 aa, Mycobacterium
TRVRKYMTLMAFRIPALMLTTVAYSAWHNG

SEQ ID NO: 967594 - protein, 17 aa, Mycobacterium
TRVTVNISVNYLDHAAH

SEQ ID NO: 967595 - protein, 18 aa, Mycobacterium
TRYARRLSPNVLRATIVA

SEQ ID NO: 967596 - protein, 27 aa, Mycobacterium
TSAIARGIYQWRWSIATLWFITVFLLI

SEQ ID NO: 967597 - protein, 27 aa, Mycobacterium
TSATRFVAAHGAYLVWLEQTSINNAIT

SEQ ID NO: 967598 - protein, 24 aa, Mycobacterium
TSAYSSWLVIRWVVASALGGPLLI

SEQ ID NO: 967599 - protein, 19 aa, Mycobacterium
TSIYAEYLLSVNVRNAANL

SEQ ID NO: 967600 - protein, 17 aa, Mycobacterium
TSLARASAFLMEMGQDA

SEQ ID NO: 967601 - protein, 19 aa, Mycobacterium
TSLGGWVVGVSRELYHRSM

SEQ ID NO: 967602 - protein, 30 aa, Mycobacterium
TSLWGNCTIKVMVGFLFLYPAFVAKEHQAN

SEQ ID NO: 967603 - protein, 26 aa, Mycobacterium
TSMLQRKLRVGFAKAGRLMDLMETRS

SEQ ID NO: 967604 - protein, 25 aa, Mycobacterium
TSPDSRSAIALIWLQGEAGTTRARA

SEQ ID NO: 967605 - protein, 24 aa, Mycobacterium
TTARFDSRLSRRWTVQHGLSSGSA

SEQ ID NO: 967606 - protein, 18 aa, Mycobacterium
TTFSAFTALIVFLTGIIG

SEQ ID NO: 967607 - protein, 26 aa, Mycobacterium
TTIATACPFCRVMVTDGVNDRQEEAG

SEQ ID NO: 967608 - protein, 24 aa, Mycobacterium
TTLVNLLMRFYDVDSGQILIDGVD

SEQ ID NO: 967609 - protein, 19 aa, Mycobacterium
TTMLLMFLAFGSFVLPIKA

SEQ ID NO: 967610 - protein, 26 aa, Mycobacterium
TTVIIRFWLLTAIACGLGVVLFYGEW

SEQ ID NO: 967611 - protein, 20 aa, Mycobacterium
TTVVCLRAPGMTMFRMPIFT

SEQ ID NO: 967612 - protein, 22 aa, Mycobacterium
TTWDLKPAVDLRRFPSSGPYKI

SEQ ID NO: 967613 - protein, 21 aa, Mycobacterium
TVAGLLQLLGLIGILDIGRIY

SEQ ID NO: 967614 - protein, 25 aa, Mycobacterium
TVALCLCGGVFGLSLGKHVTQSGFY

SEQ ID NO: 967615 - protein, 31 aa, Mycobacterium
TVARVPATWAMLVPRLPRLVVAVVAGLLFCA

SEQ ID NO: 967616 - protein, 28 aa, Mycobacterium
TVEAAQLSALWARFPLPVIPAPGDPTPS

SEQ ID NO: 967617 - protein, 26 aa, Mycobacterium
TVESDARLRLGWPIVPNTVFIAFGEL

SEQ ID NO: 967618 - protein, 25 aa, Mycobacterium
TVHAFAVSIILDWLAICVVLTVFVP

SEQ ID NO: 967619 - protein, 18 aa, Mycobacterium
TVHLGYSVWTLWPVMELF

SEQ ID NO: 967620 - protein, 17 aa, Mycobacterium
TVHPCARITKLSERTDF

SEQ ID NO: 967621 - protein, 19 aa, Mycobacterium
TVIMREYSRFAGYDDEPYY

SEQ ID NO: 967622 - protein, 26 aa, Mycobacterium
TVLVILRLLHGIGMGGEWGLGAALAM

SEQ ID NO: 967623 - protein, 23 aa, Mycobacterium
TVPWRPGPIRALLAARPAAFRSL

SEQ ID NO: 967624 - protein, 22 aa, Mycobacterium
TVQLTAIWLLTAVKVQLLNLAR

SEQ ID NO: 967625 - protein, 24 aa, Mycobacterium
TVSAKSLRAGDVIDLAAPEVVPAD

SEQ ID NO: 967626 - protein, 24 aa, Mycobacterium
TVVFGALSHRWLARRTRRRINLGL

SEQ ID NO: 967627 - protein, 17 aa, Mycobacterium
TVVMPRLSRNAAANDTP

SEQ ID NO: 967628 - protein, 19 aa, Mycobacterium
TWHPPAYASPECYNYPQLT

SEQ ID NO: 967629 - protein, 22 aa, Mycobacterium
TWPATARSGPTFTYPEALAEDL

SEQ ID NO: 967630 - protein, 25 aa, Mycobacterium
TYLGGWRIIRTLGKGMVEIKPPQGM

SEQ ID NO: 967631 - protein, 18 aa, Mycobacterium
TYLRDDWYRDWGSVEQYY

SEQ ID NO: 967632 - protein, 24 aa, Mycobacterium
TYTRLPWRPLQMVPAKRSELDQQL

SEQ ID NO: 967633 - protein, 19 aa, Mycobacterium
VAACARTGTDYADLTGELM

SEQ ID NO: 967634 - protein, 26 aa, Mycobacterium
VAAFPRYHPRWAWWLTSVPVLREFVV

SEQ ID NO: 967635 - protein, 35 aa, Mycobacterium
VAAKISWTLRCLVFLLRFGFAFLFYSGIVNPIIIW

SEQ ID NO: 967636 - protein, 17 aa, Mycobacterium
VAALRAGLIALALLAVL

SEQ ID NO: 967637 - protein, 18 aa, Mycobacterium
VAALTAWGLYRFNQILAG

SEQ ID NO: 967638 - protein, 29 aa, Mycobacterium
VAALTGTPAWEIFKPWAITSITIAVAITL

SEQ ID NO: 967639 - protein, 17 aa, Mycobacterium
VAATVAVLTALLVSTSS

SEQ ID NO: 967640 - protein, 22 aa, Mycobacterium
VACRKPMFEFAIRSLIPDGMVL

SEQ ID NO: 967641 - protein, 17 aa, Mycobacterium
VAEFAWPVVQSVAKSTG

SEQ ID NO: 967642 - protein, 28 aa, Mycobacterium
VAFDQLWRWNSIVALVLSVLVILGLVVG

SEQ ID NO: 967643 - protein, 19 aa, Mycobacterium
VAFSIPRDDWVPFSDVPGY

SEQ ID NO: 967644 - protein, 20 aa, Mycobacterium
VAGGVSATWGYRAELGDRWS

SEQ ID NO: 967645 - protein, 23 aa, Mycobacterium
VAGRMPGHMNVLLAEAEVDYDAM

SEQ ID NO: 967646 - protein, 26 aa, Mycobacterium
VAHRVGEPFGSLVLAAAVTVIEVALI

SEQ ID NO: 967647 - protein, 22 aa, Mycobacterium
VAIALTGWRVIRARVEAQPVGD

SEQ ID NO: 967648 - protein, 19 aa, Mycobacterium
VAIGAVLAIAVWRHSSTPR

SEQ ID NO: 967649 - protein, 24 aa, Mycobacterium
VAKTEPLMLVFVALIAFVMLLISI

SEQ ID NO: 967650 - protein, 23 aa, Mycobacterium
VALIAVGIGLRLVFGDIGLNVKL

SEQ ID NO: 967651 - protein, 21 aa, Mycobacterium
VALTCGMSFIRDQPSYLWAGL

SEQ ID NO: 967652 - protein, 29 aa, Mycobacterium
VAQRWSSPFWRFWDLALLWLAQVHGGNGL

SEQ ID NO: 967653 - protein, 17 aa, Mycobacterium
VARIPGPLVAIVVTTLV

SEQ ID NO: 967654 - protein, 25 aa, Mycobacterium
VARRAVEVLRRLYGRVGDRLVLISV

SEQ ID NO: 967655 - protein, 28 aa, Mycobacterium
VARRGQLRAGTALVARGEFSLIIIGLVG

SEQ ID NO: 967656 - protein, 30 aa, Mycobacterium
VARVKRLLDRIGAYERYWLYPGAANLAAFR

SEQ ID NO: 967657 - protein, 25 aa, Mycobacterium
VATDPTTAISMAWRAAGGVSGPLGP

SEQ ID NO: 967658 - protein, 20 aa, Mycobacterium
VAVIFGFLLWHVIGANSSDD

SEQ ID NO: 967659 - protein, 25 aa, Mycobacterium
VCAHLFKLPGALFVVAAITISGALL

SEQ ID NO: 967660 - protein, 19 aa, Mycobacterium
VCVVFLNLLHGVMIGLAVA

SEQ ID NO: 967661 - protein, 24 aa, Mycobacterium
VDALRRSVPLVARIRDYALRDEYA

SEQ ID NO: 967662 - protein, 26 aa, Mycobacterium
VDAVICCIGFLFPLWDSKRQTLADKI

SEQ ID NO: 967663 - protein, 18 aa, Mycobacterium
VDEMKSVVQTLIKDGKIV

SEQ ID NO: 967664 - protein, 25 aa, Mycobacterium
VDHRIRFQLYYCRADHSLIDVRLFK

SEQ ID NO: 967665 - protein, 17 aa, Mycobacterium
VDIVASFAVLLVAPTAT

SEQ ID NO: 967666 - protein, 19 aa, Mycobacterium
VDKHMEWPDTGHLRRAAVS

SEQ ID NO: 967667 - protein, 24 aa, Mycobacterium
VEPRFEILEAVTALVGVLFIGAAL

SEQ ID NO: 967668 - protein, 21 aa, Mycobacterium
VFAGSCLSEYGAIASTDLSQV

SEQ ID NO: 967669 - protein, 20 aa, Mycobacterium
VFGFGVIFGAIWAEQAWGRY

SEQ ID NO: 967670 - protein, 18 aa, Mycobacterium
VFGPPGTVADISYFDANS

SEQ ID NO: 967671 - protein, 25 aa, Mycobacterium
VFGQMRFGRTNGYTAEFTNISGLRT

SEQ ID NO: 967672 - protein, 19 aa, Mycobacterium
VFLGYELPQPPNIVRFFTV

SEQ ID NO: 967673 - protein, 18 aa, Mycobacterium
VFMLFPLGFSLYMSFQKW

SEQ ID NO: 967674 - protein, 26 aa, Mycobacterium
VFNFPPNGTHSWPYWNQQLVAMKPDI

SEQ ID NO: 967675 - protein, 29 aa, Mycobacterium
VFTVPLRSAWWWLCMAVGGIVILSMLVNR

SEQ ID NO: 967676 - protein, 24 aa, Mycobacterium
VGAFGRIGWDVTHASRSRWQQLRL

SEQ ID NO: 967677 - protein, 25 aa, Mycobacterium
VGAIFGRTALFFATLVAVGINVYTY

SEQ ID NO: 967678 - protein, 20 aa, Mycobacterium
VGALSPTGCCRAFDAAADGF

SEQ ID NO: 967679 - protein, 25 aa, Mycobacterium
VGAMARTLGLPALLGPRCRSRDLVL

SEQ ID NO: 967680 - protein, 24 aa, Mycobacterium
VGDELHPVLNLTSARLIVGRSVNP

SEQ ID NO: 967681 - protein, 25 aa, Mycobacterium
VGFAAIVYLVWWYVVPPVCRLMRAR

SEQ ID NO: 967682 - protein, 22 aa, Mycobacterium
VGFDRIGPVSAIALMLQSLGGP

SEQ ID NO: 967683 - protein, 25 aa, Mycobacterium
VGFSMLALMTRRWVLAWIALAGAAM

SEQ ID NO: 967684 - protein, 18 aa, Mycobacterium
VGFVHWLIFQSLYRIGAL

SEQ ID NO: 967685 - protein, 17 aa, Mycobacterium
VGGGWWRQRLVDHAHRL

SEQ ID NO: 967686 - protein, 23 aa, Mycobacterium
VGIALWLPWLIVAGVVFVLASAA

SEQ ID NO: 967687 - protein, 24 aa, Mycobacterium
VGIARELFPYQALTNLRNDAIATF

SEQ ID NO: 967688 - protein, 34 aa, Mycobacterium
VGILFPKPWSWADLSVFPALALVILNSVWVSLCF

SEQ ID NO: 967689 - protein, 18 aa, Mycobacterium
VGIVLGFPPARLTKVTAM

SEQ ID NO: 967690 - protein, 23 aa, Mycobacterium
VGLFDTWAGLILPYITFALPLAI

SEQ ID NO: 967691 - protein, 28 aa, Mycobacterium
VGLMPVKLFPRWIHPFVLNQPVSQFVVA

SEQ ID NO: 967692 - protein, 21 aa, Mycobacterium
VGPLMRPGYLLLRDAVSTPRS

SEQ ID NO: 967693 - protein, 24 aa, Mycobacterium
VGRCGICALSMALLNIIWYRLPAL

SEQ ID NO: 967694 - protein, 22 aa, Mycobacterium
VGRRRLWYSVGGVIVAVAVLSI

SEQ ID NO: 967695 - protein, 29 aa, Mycobacterium
VGSSQPVLLDWEVGLAFPCQQPMLHANGV

SEQ ID NO: 967696 - protein, 20 aa, Mycobacterium
VGSVLDWWSDPLTAPLGTSP

SEQ ID NO: 967697 - protein, 19 aa, Mycobacterium
VGVCAAVWLVLIGVSVAAA

SEQ ID NO: 967698 - protein, 24 aa, Mycobacterium
VGVRVMPVFAFKSGAFFAAIVGVL

SEQ ID NO: 967699 - protein, 23 aa, Mycobacterium
VGVSLRLLIIGSLTGTVLGVTAG

SEQ ID NO: 967700 - protein, 30 aa, Mycobacterium
VGYLLVLVLYRWFPPITVWTGLSLLAVAIP

SEQ ID NO: 967701 - protein, 24 aa, Mycobacterium
VHLARIFFTGAFRRPRETNWVIGS

SEQ ID NO: 967702 - protein, 30 aa, Mycobacterium
VHLDLDPLLPFPRWHEYAAVVEEPVRRIPG

SEQ ID NO: 967703 - protein, 22 aa, Mycobacterium
VHTEGFSGPALIIGTPTSSQVT

SEQ ID NO: 967704 - protein, 26 aa, Mycobacterium
VHVYRLVWRQTILFTHNIIIYLVVGI

SEQ ID NO: 967705 - protein, 18 aa, Mycobacterium
VIAYCMGLGIPFVLLASG

SEQ ID NO: 967706 - protein, 23 aa, Mycobacterium
VIGDARAGFGLLLKEAGYTLAAP

SEQ ID NO: 967707 - protein, 33 aa, Mycobacterium
VILCGPGRYGLDAGRRWAYRPFIGSFIVLIAGI

SEQ ID NO: 967708 - protein, 19 aa, Mycobacterium
VIQRDWRYAAVLVGYCAGW

SEQ ID NO: 967709 - protein, 17 aa, Mycobacterium
VKPADQVIMRWQDGFLV

SEQ ID NO: 967710 - protein, 24 aa, Mycobacterium
VKSARPPVMADIYGCGTDVPGYLR

SEQ ID NO: 967711 - protein, 18 aa, Mycobacterium
VKTYPANYFRAFSGRRRG

SEQ ID NO: 967712 - protein, 19 aa, Mycobacterium
VLAAPLLVRLMLGRNPQVN

SEQ ID NO: 967713 - protein, 18 aa, Mycobacterium
VLAGPVFDTLTVESFTHP

SEQ ID NO: 967714 - protein, 24 aa, Mycobacterium
VLAGRRLWHRFRIQTEGADSNRPD

SEQ ID NO: 967715 - protein, 23 aa, Mycobacterium
VLATCALPVIGMRLGLAEDHTAQ

SEQ ID NO: 967716 - protein, 21 aa, Mycobacterium
VLAWRDSWEYWTHTVHNTERI

SEQ ID NO: 967717 - protein, 21 aa, Mycobacterium
VLDAIITWSSDGIRQSVQNSI

SEQ ID NO: 967718 - protein, 19 aa, Mycobacterium
VLFAGLWALIVYFRAEVSR

SEQ ID NO: 967719 - protein, 25 aa, Mycobacterium
VLKRTGRLSLRHALDMLEQTGRALQ

SEQ ID NO: 967720 - protein, 23 aa, Mycobacterium
VLLGALLIGWAAYRGLLHWQSIP

SEQ ID NO: 967721 - protein, 23 aa, Mycobacterium
VLLSGIALLVSRQVVVPVRSASR

SEQ ID NO: 967722 - protein, 20 aa, Mycobacterium
VLLTFYPGWVTIGLVAALVC

SEQ ID NO: 967723 - protein, 25 aa, Mycobacterium
VLLWQHLFWFFGHPEVYIIALPFFG

SEQ ID NO: 967724 - protein, 23 aa, Mycobacterium
VLPLLRPIILAALLFTRSLVAVV

SEQ ID NO: 967725 - protein, 22 aa, Mycobacterium
VLPRASVCAQRITEVLSTRPAV

SEQ ID NO: 967726 - protein, 18 aa, Mycobacterium
VLTGLLWWTVAIHLLTSM

SEQ ID NO: 967727 - protein, 25 aa, Mycobacterium
VLVLLLCMFGVLVVLLRRSRVPGLA

SEQ ID NO: 967728 - protein, 25 aa, Mycobacterium
VLYGGRFAVGVSIMATVLKLVAVAI

SEQ ID NO: 967729 - protein, 18 aa, Mycobacterium
VMALGWLLLIGVLALSLV

SEQ ID NO: 967730 - protein, 18 aa, Mycobacterium
VMGIMRAAIRGVLVVIGI

SEQ ID NO: 967731 - protein, 32 aa, Mycobacterium
VMIGVVLDWPRWWVSACSVLVLLIVEGVGVNF

SEQ ID NO: 967732 - protein, 19 aa, Mycobacterium
VMPFHAFFGIALMTMTSAI

SEQ ID NO: 967733 - protein, 33 aa, Mycobacterium
VMPIDIGPQPAWRNLRFPLTWAPPEANVARVVA

SEQ ID NO: 967734 - protein, 32 aa, Mycobacterium
VMSPVRRIGLLMLRGYLVLACVLVVVKVVQVG

SEQ ID NO: 967735 - protein, 26 aa, Mycobacterium
VNDCPRSRSATWSWALAVNQQGWDTR

SEQ ID NO: 967736 - protein, 19 aa, Mycobacterium
VNFVMKRPLVFAIPIVIGM

SEQ ID NO: 967737 - protein, 18 aa, Mycobacterium
VNHPLRVAGNRVYLQGHG

SEQ ID NO: 967738 - protein, 17 aa, Mycobacterium
VNTLSLVIVLGFVVVPA

SEQ ID NO: 967739 - protein, 18 aa, Mycobacterium
VPAAPRKPVPIPTTEKSP

SEQ ID NO: 967740 - protein, 25 aa, Mycobacterium
VPCGDLRMVLKLAAKLKNLAPDAIC

SEQ ID NO: 967741 - protein, 22 aa, Mycobacterium
VPLADLSTMFAIVPTNRFPGWG

SEQ ID NO: 967742 - protein, 24 aa, Mycobacterium
VPLEGRTAVFTIFYRHDLDGLRGI

SEQ ID NO: 967743 - protein, 19 aa, Mycobacterium
VPPCTRVTVNISVNYLDHA

SEQ ID NO: 967744 - protein, 24 aa, Mycobacterium
VPPLKFAQLLGFVFVVCGVTGFAA

SEQ ID NO: 967745 - protein, 22 aa, Mycobacterium
VPTGLCLLSLLSSCSVVLAPRV

SEQ ID NO: 967746 - protein, 18 aa, Mycobacterium
VPVLKWLDVQGLHRGIVV

SEQ ID NO: 967747 - protein, 29 aa, Mycobacterium
VPVSPSTMLWPTFALNFTSNVLYDLSQAY

SEQ ID NO: 967748 - protein, 26 aa, Mycobacterium
VPVTRFYKSVLWCAAHSICLVHATAG

SEQ ID NO: 967749 - protein, 19 aa, Mycobacterium
VPYRELRLANVELVSAIVD

SEQ ID NO: 967750 - protein, 22 aa, Mycobacterium
VQMGLNHLCLFLFHYQEPWAIP

SEQ ID NO: 967751 - protein, 17 aa, Mycobacterium
VQPEQRLAFLLVTPAAM

SEQ ID NO: 967752 - protein, 28 aa, Mycobacterium
VQPFGEYLPMPWLFKRLSKYADRVSHIV

SEQ ID NO: 967753 - protein, 17 aa, Mycobacterium
VRFDRRSPILPWLTGVV

SEQ ID NO: 967754 - protein, 21 aa, Mycobacterium
VRFFTVWRFDSLIGATAIVLG

SEQ ID NO: 967755 - protein, 19 aa, Mycobacterium
VRFLCTFSPNFTVLVILRL

SEQ ID NO: 967756 - protein, 25 aa, Mycobacterium
VRGLKTLFATVMFSIAGFGLGLALY

SEQ ID NO: 967757 - protein, 18 aa, Mycobacterium
VRGWPLRVLAGLLAVASF

SEQ ID NO: 967758 - protein, 23 aa, Mycobacterium
VRIPRNRAVVMLVIDVSQSMRAT

SEQ ID NO: 967759 - protein, 24 aa, Mycobacterium
VRLLADSAPVLWADMPTLPLYRQQ

SEQ ID NO: 967760 - protein, 21 aa, Mycobacterium
VRQIHHWAALMFTAAIMVHLA

SEQ ID NO: 967761 - protein, 17 aa, Mycobacterium
VRQRHGLDNGDLDRTHR

SEQ ID NO: 967762 - protein, 33 aa, Mycobacterium
VRTLFRVPLLRNWRMSHACLNWLADRLQKTKTR

SEQ ID NO: 967763 - protein, 21 aa, Mycobacterium
VSCYVALVITNFVWLYPVLTG

SEQ ID NO: 967764 - protein, 19 aa, Mycobacterium
VSFVTARTALLDGFLTFFV

SEQ ID NO: 967765 - protein, 18 aa, Mycobacterium
VSGAICWAGGTTALVYFA

SEQ ID NO: 967766 - protein, 32 aa, Mycobacterium
VSGIATRLRFMWSLRVLHTLAMIDLAITALYR

SEQ ID NO: 967767 - protein, 28 aa, Mycobacterium
VSHISAPRAKLFAALFLILALVVIGEVV

SEQ ID NO: 967768 - protein, 17 aa, Mycobacterium
VSIPFTVLVGFHSINIL

SEQ ID NO: 967769 - protein, 25 aa, Mycobacterium
VSLMLIAWLRLGRRVLAGQATEFMM

SEQ ID NO: 967770 - protein, 21 aa, Mycobacterium
VSNSLRLRNFGAILSCGTSRH

SEQ ID NO: 967771 - protein, 19 aa, Mycobacterium
VSQIPGIALVRGVTRPTGK

SEQ ID NO: 967772 - protein, 17 aa, Mycobacterium
VSRVWLNVLHVLRQFPV

SEQ ID NO: 967773 - protein, 21 aa, Mycobacterium
VSWLLRFLVQHNLYWFVGYRI

SEQ ID NO: 967774 - protein, 26 aa, Mycobacterium
VTAGEIPATLSYRLHRKPLRQSWPEE

SEQ ID NO: 967775 - protein, 17 aa, Mycobacterium
VTERMCALIAAVMGYAD

SEQ ID NO: 967776 - protein, 21 aa, Mycobacterium
VTFLAAAVLHFLAIGQVKGFA

SEQ ID NO: 967777 - protein, 20 aa, Mycobacterium
VTGGLIAFIFLLARTTMSKF

SEQ ID NO: 967778 - protein, 17 aa, Mycobacterium
VTGKALQEFGRYQSIVY

SEQ ID NO: 967779 - protein, 17 aa, Mycobacterium
VTGVLFGLAALPVVFTL

SEQ ID NO: 967780 - protein, 21 aa, Mycobacterium
VTMGVAWSVLYIPLGGVGTIV

SEQ ID NO: 967781 - protein, 23 aa, Mycobacterium
VTNLELYLIFPLKNEQATVTLVR

SEQ ID NO: 967782 - protein, 23 aa, Mycobacterium
VTPAELRTGAALFNAITTSETSR

SEQ ID NO: 967783 - protein, 21 aa, Mycobacterium
VTPPIMCIGGIVMAIYQEAAL

SEQ ID NO: 967784 - protein, 17 aa, Mycobacterium
VTRFDWWTHSLRGVMPE

SEQ ID NO: 967785 - protein, 23 aa, Mycobacterium
VTSLLWLGVAGWSLWAANSPGMG

SEQ ID NO: 967786 - protein, 21 aa, Mycobacterium
VVAFGLALAWLATIWATAGLA

SEQ ID NO: 967787 - protein, 19 aa, Mycobacterium
VVCMIWRLVMHDNSKQHES

SEQ ID NO: 967788 - protein, 17 aa, Mycobacterium
VVDPEWEYVISVEGIDG

SEQ ID NO: 967789 - protein, 20 aa, Mycobacterium
VVFAQRRRNLLIGIGAAVVI

SEQ ID NO: 967790 - protein, 17 aa, Mycobacterium
VVFLVTWPLVYLASKSP

SEQ ID NO: 967791 - protein, 28 aa, Mycobacterium
VVFQATLLRGCPWALAISPPVVDPGVPP

SEQ ID NO: 967792 - protein, 22 aa, Mycobacterium
VVGCVAMVFNLFFVNLVTVGLH

SEQ ID NO: 967793 - protein, 21 aa, Mycobacterium
VVGEMRKVIWPNRKQMLTYTS

SEQ ID NO: 967794 - protein, 20 aa, Mycobacterium
VVGGVPLVLDYQIADNAVYS

SEQ ID NO: 967795 - protein, 19 aa, Mycobacterium
VVGTCWDLGAISAIPQLLR

SEQ ID NO: 967796 - protein, 18 aa, Mycobacterium
VVIPGSYRNRHRAVNGST

SEQ ID NO: 967797 - protein, 21 aa, Mycobacterium
VVISVRLNVLFSYQSKDLYNA

SEQ ID NO: 967798 - protein, 26 aa, Mycobacterium
VVLALSGIVPWWFVVALLARDVLLTA

SEQ ID NO: 967799 - protein, 19 aa, Mycobacterium
VVMVIWWLFFAGLVWVVVL

SEQ ID NO: 967800 - protein, 18 aa, Mycobacterium
VVNLRFSSYGFIMFGATA

SEQ ID NO: 967801 - protein, 17 aa, Mycobacterium
VVQAVAIGLFLLPLTQL

SEQ ID NO: 967802 - protein, 19 aa, Mycobacterium
VVRVSLWASVLLVAALFGW

SEQ ID NO: 967803 - protein, 17 aa, Mycobacterium
VVSAGYRVGHVASLDVV

SEQ ID NO: 967804 - protein, 17 aa, Mycobacterium
VVSCREAQQLLDSAGVY

SEQ ID NO: 967805 - protein, 24 aa, Mycobacterium
VVSLIGWWVLSRVLERIRDIPDVH

SEQ ID NO: 967806 - protein, 17 aa, Mycobacterium
VVTRAVLFLLLLTSVAC

SEQ ID NO: 967807 - protein, 20 aa, Mycobacterium
VVVACGIKRFPRHLKPPPAL

SEQ ID NO: 967808 - protein, 27 aa, Mycobacterium
VVVGPLPGWPIWFAVVWAAQEWLKSVV

SEQ ID NO: 967809 - protein, 17 aa, Mycobacterium
VWGPRLGVRWWRFLGGI

SEQ ID NO: 967810 - protein, 18 aa, Mycobacterium
VWHLGPLPIRAYALLIIL

SEQ ID NO: 967811 - protein, 17 aa, Mycobacterium
VWHLLCDHSDAIDEINR

SEQ ID NO: 967812 - protein, 18 aa, Mycobacterium
VWLGEISYEIFLIHLVTM

SEQ ID NO: 967813 - protein, 18 aa, Mycobacterium
VWVSLCFGILATRYRDIG

SEQ ID NO: 967814 - protein, 24 aa, Mycobacterium
VYFITYRWCIGLQRSDRAVLEHGI

SEQ ID NO: 967815 - protein, 27 aa, Mycobacterium
VYGGAWAHVIDRLRHLILPTLTLALVG

SEQ ID NO: 967816 - protein, 19 aa, Mycobacterium
VYINIYFGLIIFFTYFYVS

SEQ ID NO: 967817 - protein, 21 aa, Mycobacterium
VYRYRFIVIGITVALCLCGGV

SEQ ID NO: 967818 - protein, 23 aa, Mycobacterium
VYSLPWALSVAMWLLVVASLITC

SEQ ID NO: 967819 - protein, 19 aa, Mycobacterium
VYTTRNWLSGLLVGVAGGI

SEQ ID NO: 967820 - protein, 19 aa, Mycobacterium
VYYPVSWIMWVWYKLFAAV

SEQ ID NO: 967821 - protein, 26 aa, Mycobacterium
WAAQEWLKSVVPFGGFPWGSVAFGQA

SEQ ID NO: 967822 - protein, 26 aa, Mycobacterium
WADAEPRLRALGWTGVLDKGPDVDAG

SEQ ID NO: 967823 - protein, 18 aa, Mycobacterium
WAGTKLLVVFGVEVLLTF

SEQ ID NO: 967824 - protein, 33 aa, Mycobacterium
WAMSRAVPGPAWLRRLWLAVIIVSPAAIWLEPI

SEQ ID NO: 967825 - protein, 27 aa, Mycobacterium
WASVLLVAALFGWGAWQRRWIADDGLI

SEQ ID NO: 967826 - protein, 29 aa, Mycobacterium
WASVTSVSIPSWWQPYVLSVASLTPSGRP

SEQ ID NO: 967827 - protein, 17 aa, Mycobacterium
WATAGINGWFGVSNYGV

SEQ ID NO: 967828 - protein, 19 aa, Mycobacterium
WCALFPIVWALSGSLKKEG

SEQ ID NO: 967829 - protein, 17 aa, Mycobacterium
WCRGLTVTLHRTADYWL

SEQ ID NO: 967830 - protein, 17 aa, Mycobacterium
WFLCIWVTGTSMLLISR

SEQ ID NO: 967831 - protein, 25 aa, Mycobacterium
WGLDQRLKRFGAMATAMVLYVLISQ

SEQ ID NO: 967832 - protein, 17 aa, Mycobacterium
WGVAGRMATAWLVTLPL

SEQ ID NO: 967833 - protein, 17 aa, Mycobacterium
WGVTCFITVAAGVLQVL

SEQ ID NO: 967834 - protein, 22 aa, Mycobacterium
WHGRSPRLWLIAGGGLSVQDDE

SEQ ID NO: 967835 - protein, 18 aa, Mycobacterium
WHHTIPAPVWVAVIMALV

SEQ ID NO: 967836 - protein, 20 aa, Mycobacterium
WHYLFRHLVLFGDKYDSVMV

SEQ ID NO: 967837 - protein, 26 aa, Mycobacterium
WIAHSRWLRWLTQIYIDVFRGLLEEV

SEQ ID NO: 967838 - protein, 18 aa, Mycobacterium
WIALTLVVTAFTYLCFMV

SEQ ID NO: 967839 - protein, 27 aa, Mycobacterium
WICAPLAIAVLWRWLLAPTDGAFSMVL

SEQ ID NO: 967840 - protein, 24 aa, Mycobacterium
WIEYLCLVPIFPLALWLMDVYTAI

SEQ ID NO: 967841 - protein, 18 aa, Mycobacterium
WIGPEGFFAAAMLPATLV

SEQ ID NO: 967842 - protein, 17 aa, Mycobacterium
WILQAPRLFAGKINLGD

SEQ ID NO: 967843 - protein, 23 aa, Mycobacterium
WIRELRPHIDLYLLTDESIAAGN

SEQ ID NO: 967844 - protein, 38 aa, Mycobacterium
WKRVAVLFAGPAMNFVICLVLIYGIALVWGLPNLHMPT

SEQ ID NO: 967845 - protein, 18 aa, Mycobacterium
WLDIAVLAVAFIAAISGW

SEQ ID NO: 967846 - protein, 22 aa, Mycobacterium
WLLEGMASLPLSTWSQLHTRML

SEQ ID NO: 967847 - protein, 19 aa, Mycobacterium
WLLFTWMIAWLPRKSVNLV

SEQ ID NO: 967848 - protein, 20 aa, Mycobacterium
WLRRPYCSLPQSARADISPD

SEQ ID NO: 967849 - protein, 26 aa, Mycobacterium
WLSSDTAVQCLFGIYGAAAASAVLGF

SEQ ID NO: 967850 - protein, 25 aa, Mycobacterium
WLSSELMFFAGLFAMYFTARAQAGG

SEQ ID NO: 967851 - protein, 25 aa, Mycobacterium
WLTELPRRWRAVLLAVVAACVTCGI

SEQ ID NO: 967852 - protein, 17 aa, Mycobacterium
WLVAFFATIVLISVWIP

SEQ ID NO: 967853 - protein, 28 aa, Mycobacterium
WLVIVGWLTLWPFLNWLTTHFVVTNRRV

SEQ ID NO: 967854 - protein, 27 aa, Mycobacterium
WLWFGELGYRSVFSTVLVTRVVVFLVA

SEQ ID NO: 967855 - protein, 28 aa, Mycobacterium
WPGYLRARANPAWAINLFLKYHAGEYKI

SEQ ID NO: 967856 - protein, 20 aa, Mycobacterium
WPQPVPEPAFKAAIARASQA

SEQ ID NO: 967857 - protein, 36 aa, Mycobacterium
WPSLNRGWCLIRTRWGQLIARFLPVLGLAGLAAATH

SEQ ID NO: 967858 - protein, 21 aa, Mycobacterium
WPVMELFMPKDVYGFSAGDKF

SEQ ID NO: 967859 - protein, 17 aa, Mycobacterium
WPVVTNFAVDSAMAVAL

SEQ ID NO: 967860 - protein, 19 aa, Mycobacterium
WQFLCDRRSSIGQVPNERW

SEQ ID NO: 967861 - protein, 17 aa, Mycobacterium
WQHILGIELHYLVLAMS

SEQ ID NO: 967862 - protein, 18 aa, Mycobacterium
WQHILGIELHYLVLAMSV

SEQ ID NO: 967863 - protein, 20 aa, Mycobacterium
WRCPPPTRLRSTACSPVDAS

SEQ ID NO: 967864 - protein, 17 aa, Mycobacterium
WRLVMVAVLLFSRSRLT

SEQ ID NO: 967865 - protein, 36 aa, Mycobacterium
WRPIRSYFYWERHCFNIPICWSFRSIFDALDGVDQI

SEQ ID NO: 967866 - protein, 20 aa, Mycobacterium
WRVSPGVAANGHFDAVHRVI

SEQ ID NO: 967867 - protein, 29 aa, Mycobacterium
WSAPEPRWPKSPPLTHLRTGLQRSACSRP

SEQ ID NO: 967868 - protein, 18 aa, Mycobacterium
WSFDLSMTGQLLLRSITH

SEQ ID NO: 967869 - protein, 17 aa, Mycobacterium
WSIATLWFITVFLLIMV

SEQ ID NO: 967870 - protein, 20 aa, Mycobacterium
WSLGRALCGISVIMRDGVAI

SEQ ID NO: 967871 - protein, 25 aa, Mycobacterium
WSMLKVSLLLSVALFFVWMIAVAFL

SEQ ID NO: 967872 - protein, 17 aa, Mycobacterium
WSNLDCAPSNETLVKTF

SEQ ID NO: 967873 - protein, 17 aa, Mycobacterium
WSPEQVLAYAASSEIHS

SEQ ID NO: 967874 - protein, 20 aa, Mycobacterium
WSPSGGRVVVTMRQFDPSHV

SEQ ID NO: 967875 - protein, 19 aa, Mycobacterium
WSRHLGRAILPDSSLLDEG

SEQ ID NO: 967876 - protein, 17 aa, Mycobacterium
WTHSLRGVMPEEFAGGV

SEQ ID NO: 967877 - protein, 17 aa, Mycobacterium
WTPCLGPTLSGVITVAA

SEQ ID NO: 967878 - protein, 23 aa, Mycobacterium
WVANWRFVVHKADYFTQGTPPSP

SEQ ID NO: 967879 - protein, 18 aa, Mycobacterium
WVIGSLLLILAMFEGYFG

SEQ ID NO: 967880 - protein, 21 aa, Mycobacterium
WWEYGCWVLTGVIRLVRITRR

SEQ ID NO: 967881 - protein, 23 aa, Mycobacterium
WWRQLAGMSYVWWALAVIVATGL

SEQ ID NO: 967882 - protein, 28 aa, Mycobacterium
WWVGVLVYFLPRWPWLRVADKDTSGTVV

SEQ ID NO: 967883 - protein, 19 aa, Mycobacterium
WWVTGRSPFWSLAIGILSI

SEQ ID NO: 967884 - protein, 27 aa, Mycobacterium
WWYVVPPVCRLMRARRDAVRQQLTEAA

SEQ ID NO: 967885 - protein, 18 aa, Mycobacterium
WYLLWAIIPLAAWATRTG

SEQ ID NO: 967886 - protein, 21 aa, Mycobacterium
WYQLPLHWKESIADRPLVVVS

SEQ ID NO: 967887 - protein, 19 aa, Mycobacterium
WYTQLPFLLEAMVAATVGA

SEQ ID NO: 967888 - protein, 17 aa, Mycobacterium
YAAAGVLTWKMYVCRPL

SEQ ID NO: 967889 - protein, 20 aa, Mycobacterium
YAAGRLGWRTLDFEVEVLPI

SEQ ID NO: 967890 - protein, 17 aa, Mycobacterium
YAAKRCTVRRGALMFGK

SEQ ID NO: 967891 - protein, 27 aa, Mycobacterium
YAAVLVGYCAGWLPWFADIDRQMYLFY

SEQ ID NO: 967892 - protein, 24 aa, Mycobacterium
YADPRPVADFVAFAGCGVSGVVAE

SEQ ID NO: 967893 - protein, 29 aa, Mycobacterium
YAICSLPFEHARPTAIMTWMRQHCGIENS

SEQ ID NO: 967894 - protein, 31 aa, Mycobacterium
YAICSLPFEHARPTAIMTWMRQHWGIENSLH

SEQ ID NO: 967895 - protein, 26 aa, Mycobacterium
YALLPVLWILSLSLKPASTVKDGKLI

SEQ ID NO: 967896 - protein, 29 aa, Mycobacterium
YALLVNRWPLPEAGMHSGLAPAQQDTTGQ

SEQ ID NO: 967897 - protein, 27 aa, Mycobacterium
YALQWPLFAGFCLYTYHNFVRYEESPP

SEQ ID NO: 967898 - protein, 17 aa, Mycobacterium
YASPECYNYPQLTEPVY

SEQ ID NO: 967899 - protein, 18 aa, Mycobacterium
YATKNALDKLQFADRTAT

SEQ ID NO: 967900 - protein, 17 aa, Mycobacterium
YATVFSTLYLPLLTILF

SEQ ID NO: 967901 - protein, 17 aa, Mycobacterium
YAVTRFDWWTHSLRGVM

SEQ ID NO: 967902 - protein, 19 aa, Mycobacterium
YDIGLLILRLVLGLTLAAH

SEQ ID NO: 967903 - protein, 23 aa, Mycobacterium
YEGLPVDGYTAWCTKMADDDRIE

SEQ ID NO: 967904 - protein, 18 aa, Mycobacterium
YEHYFRTFLRPDDVFWSF

SEQ ID NO: 967905 - protein, 27 aa, Mycobacterium
YFQTLGVPCAVGMLIAVAVALTLGPAV

SEQ ID NO: 967906 - protein, 18 aa, Mycobacterium
YGAELVYLLSPGAAMIDS

SEQ ID NO: 967907 - protein, 26 aa, Mycobacterium
YGIYLWHWPIFLALNGERTGWSGVPL

SEQ ID NO: 967908 - protein, 29 aa, Mycobacterium
YGMNFRFMPELNWTWSYPLVMAGMTIVCL

SEQ ID NO: 967909 - protein, 22 aa, Mycobacterium
YGRDRSGHIVAIFHAPDGKTVN

SEQ ID NO: 967910 - protein, 18 aa, Mycobacterium
YGSLVMVFQWGWLENLGF

SEQ ID NO: 967911 - protein, 21 aa, Mycobacterium
YITGCVAAVLAVRQSGLFTAV

SEQ ID NO: 967912 - protein, 25 aa, Mycobacterium
YIVEKRFNLSWSIEGTRSRTGKMLP

SEQ ID NO: 967913 - protein, 17 aa, Mycobacterium
YKEQRWPIEGTKAEKRT

SEQ ID NO: 967914 - protein, 22 aa, Mycobacterium
YKLSGPDMRGVRQAVTRARRAG

SEQ ID NO: 967915 - protein, 18 aa, Mycobacterium
YKSPRLVKPEILASTRFR

SEQ ID NO: 967916 - protein, 18 aa, Mycobacterium
YLERGAAEVHYLRSIFES

SEQ ID NO: 967917 - protein, 25 aa, Mycobacterium
YLGLLWWMMVCWAQPLRNRSQSRRF

SEQ ID NO: 967918 - protein, 25 aa, Mycobacterium
YLLIRLAVAAALFVPLAHLSVMFAV

SEQ ID NO: 967919 - protein, 20 aa, Mycobacterium
YLRFRREAQNAAALNHPSIV

SEQ ID NO: 967920 - protein, 19 aa, Mycobacterium
YLSALGLCVLVFQVLLRQQ

SEQ ID NO: 967921 - protein, 20 aa, Mycobacterium
YLSLTPCILCVLFSYPIYLR

SEQ ID NO: 967922 - protein, 32 aa, Mycobacterium
YMMWTEGLARIWPAWEFYFWHHTIPAPVWVAV

SEQ ID NO: 967923 - protein, 24 aa, Mycobacterium
YNHIKIKEAYGLTKQYVTQKLIDQ

SEQ ID NO: 967924 - protein, 22 aa, Mycobacterium
YPDLVPRLQFGDIVRVRSDEQP

SEQ ID NO: 967925 - protein, 20 aa, Mycobacterium
YPEDLFKVQRMLLAKYHVND

SEQ ID NO: 967926 - protein, 22 aa, Mycobacterium
YPELKVSLVPSPTCIIVGLPAG

SEQ ID NO: 967927 - protein, 26 aa, Mycobacterium
YPGMGADLYRQFPVFAHALDEVAAAL

SEQ ID NO: 967928 - protein, 32 aa, Mycobacterium
YPISVTAMLWVRPRQGPKLADLIAEPKTTRAY

SEQ ID NO: 967929 - protein, 17 aa, Mycobacterium
YPPCPSYPPPGQSAPDA

SEQ ID NO: 967930 - protein, 25 aa, Mycobacterium
YPSERLIACRNPLLATQRARKRAEL

SEQ ID NO: 967931 - protein, 21 aa, Mycobacterium
YPVCVVLRLARFNALLDDGTQ

SEQ ID NO: 967932 - protein, 22 aa, Mycobacterium
YQLGNLLAAFKLPIQAHLAEPH

SEQ ID NO: 967933 - protein, 30 aa, Mycobacterium
YRAMALSRLRLIGVGIPAAIGLLAGIIAQS

SEQ ID NO: 967934 - protein, 17 aa, Mycobacterium
YRASAVSSYRQVRQGAL

SEQ ID NO: 967935 - protein, 22 aa, Mycobacterium
YRKETLRLIAQIGMGTGAMAVV

SEQ ID NO: 967936 - protein, 24 aa, Mycobacterium
YRNWCASMAEIPRSQWVDQRLLPD

SEQ ID NO: 967937 - protein, 21 aa, Mycobacterium
YRPDEDPVRLGGRVDDPAGGP

SEQ ID NO: 967938 - protein, 20 aa, Mycobacterium
YRPELGVLYLSELSTGMRIY

SEQ ID NO: 967939 - protein, 18 aa, Mycobacterium
YRTVGALAGFGATVVVCM

SEQ ID NO: 967940 - protein, 30 aa, Mycobacterium
YSALRAGIGFIPFVIAMGIGLGVSSQLVSR

SEQ ID NO: 967941 - protein, 19 aa, Mycobacterium
YSCQLPMRQWMATQLVRRL

SEQ ID NO: 967942 - protein, 25 aa, Mycobacterium
YSGRMPVALVWLIFALVLACAEALT

SEQ ID NO: 967943 - protein, 20 aa, Mycobacterium
YSVWTLWPVMELFMPKDVYG

SEQ ID NO: 967944 - protein, 18 aa, Mycobacterium
YTGLSRLYTGTGVFEVVG

SEQ ID NO: 967945 - protein, 23 aa, Mycobacterium
YTKERRFTVAFVVPAAVLFAGGT

SEQ ID NO: 967946 - protein, 17 aa, Mycobacterium
YTLCIGPGRVLRTLDIR

SEQ ID NO: 967947 - protein, 18 aa, Mycobacterium
YVIVLGLGYVLGAKAGRR

SEQ ID NO: 967948 - protein, 17 aa, Mycobacterium
YVLWLVVMSIGYNITTV

SEQ ID NO: 967949 - protein, 25 aa, Mycobacterium
YVVRLGFGASWAFVVMPFMGTYDSV

SEQ ID NO: 967950 - protein, 28 aa, Mycobacterium
YVYPGQPIWWLARGLEFFQDGEQFWELL

SEQ ID NO: 967951 - protein, 24 aa, Mycobacterium
YVYSLDNKRLWSNLDCAPSNETLV

SEQ ID NO: 967952 - protein, 20 aa, Mycobacterium
AAACACALLLTAIPVPVGHG

SEQ ID NO: 967953 - protein, 23 aa, Mycobacterium
AAAEALTGLGNRFGEAIANGNEI

SEQ ID NO: 967954 - protein, 22 aa, Mycobacterium
AAAEIFAGLGAEPWTQRARNEL

SEQ ID NO: 967955 - protein, 24 aa, Mycobacterium
AAAERWNLPIILIVLLAVFGSLTA

SEQ ID NO: 967956 - protein, 22 aa, Mycobacterium
AAAHQPYVAWLMRNGAEAEAMA

SEQ ID NO: 967957 - protein, 17 aa, Mycobacterium
AAAIAVPIALPIALPLG

SEQ ID NO: 967958 - protein, 25 aa, Mycobacterium
AAAKRSALLHWSRRPESTQSRFWTR

SEQ ID NO: 967959 - protein, 18 aa, Mycobacterium
AAAKSHLSGDFLAYYEQF

SEQ ID NO: 967960 - protein, 35 aa, Mycobacterium; identical to SEQ ID NO: 297247

SEQ ID NO: 967961 - protein, 19 aa, Mycobacterium
AAANGALALAARGKELDFR

SEQ ID NO: 967962 - protein, 23 aa, Mycobacterium
AAARRARRGRTFSRTACATCTSA

SEQ ID NO: 967963 - protein, 23 aa, Mycobacterium
AAASRLGALMLAYGRRTHPLQWA

SEQ ID NO: 967964 - protein, 19 aa, Mycobacterium
AAAVFSAIVLRDLRIPAIG

SEQ ID NO: 967965 - protein, 18 aa, Mycobacterium
AAAVWLVAPCTELFNDGR

SEQ ID NO: 967966 - protein, 18 aa, Mycobacterium
AAAWEPLGMLAGGAILIA

SEQ ID NO: 967967 - protein, 19 aa, Mycobacterium
AACKAWLLTQPYLVGGTLL

SEQ ID NO: 967968 - protein, 18 aa, Mycobacterium
AACRRFTEGNFGERIVAP

SEQ ID NO: 967969 - protein, 27 aa, Mycobacterium
AADAGLRLSSIGVTWTDPVQAAALRDA

SEQ ID NO: 967970 - protein, 17 aa, Mycobacterium
AADGERWVVDLAPMLND

SEQ ID NO: 967971 - protein, 21 aa, Mycobacterium
AADILRRSRESTLPGTAAITP

SEQ ID NO: 967972 - protein, 30 aa, Mycobacterium
AADIRKAGMFHLLIAVAFTMMGMVADAFTT

SEQ ID NO: 967973 - protein, 18 aa, Mycobacterium
AAEAVGFYRGERVEGAQL

SEQ ID NO: 967974 - protein, 24 aa, Mycobacterium
AAEHDRALLIPAILAVILVVLYAL

SEQ ID NO: 967975 - protein, 22 aa, Mycobacterium
AAEPASLVQSWRTTLARAAALL

SEQ ID NO: 967976 - protein, 22 aa, Mycobacterium
AAFCYAAAVVTELGGPMSHAAV

SEQ ID NO: 967977 - protein, 17 aa, Mycobacterium
AAFEPGELVVVWVESQA

SEQ ID NO: 967978 - protein, 18 aa, Mycobacterium
AAFFARRSPAAGAGPDEP

SEQ ID NO: 967979 - protein, 19 aa, Mycobacterium
AAGARARALQLRRRAERAE

SEQ ID NO: 967980 - protein, 18 aa, Mycobacterium
AAGAVAALAWVSRDRSPR

SEQ ID NO: 967981 - protein, 19 aa, Mycobacterium
AAGCMPVMIGWSAVTGTLA

SEQ ID NO: 967982 - protein, 19 aa, Mycobacterium
AAGELPPGAVTIGRADDND

SEQ ID NO: 967983 - protein, 17 aa, Mycobacterium
AAGETVMVFPGQGSQRL

SEQ ID NO: 967984 - protein, 24 aa, Mycobacterium
AAGGTKRALPWQPLPDVVMLEAKH

SEQ ID NO: 967985 - protein, 28 aa, Mycobacterium
AAGIVLACPIWFYELWAFITPGLYQKER

SEQ ID NO: 967986 - protein, 24 aa, Mycobacterium
AAGMRGHAGFATWAATASDDVLAP

SEQ ID NO: 967987 - protein, 19 aa, Mycobacterium
AAGSWLPAILWGVAFAILV

SEQ ID NO: 967988 - protein, 24 aa, Mycobacterium
AAGYIRRHPLAALTTVGEQFVLGV

SEQ ID NO: 967989 - protein, 18 aa, Mycobacterium
AAHAPRYGAVPWVGVAAA

SEQ ID NO: 967990 - protein, 24 aa, Mycobacterium
AAHDLELLGYVGLADTARPSARPL

SEQ ID NO: 967991 - protein, 27 aa, Mycobacterium
AAHQKLCEVYKLAAREVQIQTHGNNQA

SEQ ID NO: 967992 - protein, 24 aa, Mycobacterium
AAHQVCGRFAAAARRVLPADQAAM

SEQ ID NO: 967993 - protein, 18 aa, Mycobacterium
AAIGFLYLLWLTRGLTRQ

SEQ ID NO: 967994 - protein, 20 aa, Mycobacterium
AAILMLYTIVIIRGLRTAIA

SEQ ID NO: 967995 - protein, 33 aa, Mycobacterium
AAIPAGPAITARKAGRAELGRSTLSAGPAGAAV

SEQ ID NO: 967996 - protein, 18 aa, Mycobacterium
AAISALVLPSAFRPATDP

SEQ ID NO: 967997 - protein, 24 aa, Mycobacterium
AAIVAIRLVAQWGSAVVAGTAGEK

SEQ ID NO: 967998 - protein, 25 aa, Mycobacterium
AAIWTRTSPPWAFFSLPTRAWELAV

SEQ ID NO: 967999 - protein, 19 aa, Mycobacterium
AAKCIAMSVVLGVPIPLVL

SEQ ID NO: 968000 - protein, 23 aa, Mycobacterium
AAKSFKRQLPWLSLAVLAIYLLA

SEQ ID NO: 968001 - protein, 24 aa, Mycobacterium
AAKVDWPNFWSLITSTSSRTALVL

SEQ ID NO: 968002 - protein, 25 aa, Mycobacterium
AALAARKRIAWLLLLTNVVLAAFLN

SEQ ID NO: 968003 - protein, 20 aa, Mycobacterium
AALAELKAGGATVALLTTSA

SEQ ID NO: 968004 - protein, 19 aa, Mycobacterium
AALAPMLAAPLVPLAAGAV

SEQ ID NO: 968005 - protein, 27 aa, Mycobacterium
AALCCLGVFCAFILYFALYSRHQLVAN

SEQ ID NO: 968006 - protein, 19 aa, Mycobacterium
AALCIGYLCGRRAGSTRSG

SEQ ID NO: 968007 - protein, 27 aa, Mycobacterium
AALDPYVREGWAFVAMRLTSTVPIVGG

SEQ ID NO: 968008 - protein, 17 aa, Mycobacterium
AALFADPRFTVETIGPF

SEQ ID NO: 968009 - protein, 17 aa, Mycobacterium
AALIAVGLIFTFAVYPL

SEQ ID NO: 968010 - protein, 20 aa, Mycobacterium
AALLELARRPQLRQLLRENH

SEQ ID NO: 968011 - protein, 17 aa, Mycobacterium
AALMASIALAAMLSSRR

SEQ ID NO: 968012 - protein, 30 aa, Mycobacterium
AALMGEWRDDLRWPPASALVSQNEAVDALI

SEQ ID NO: 968013 - protein, 18 aa, Mycobacterium
AALPHFLGSSGVRLLLVT

SEQ ID NO: 968014 - protein, 20 aa, Mycobacterium
AALQRCGRVTAMVGDGANDA

SEQ ID NO: 968015 - protein, 17 aa, Mycobacterium
AALRRESWYRRYLAVQL

SEQ ID NO: 968016 - protein, 28 aa, Mycobacterium
AALTGSPAWEMFKPWAITSIAVAVAVAL

SEQ ID NO: 968017 - protein, 18 aa, Mycobacterium
AALVTALMTTVILLGQMT

SEQ ID NO: 968018 - protein, 18 aa, Mycobacterium
AAMWLLFANRMGYPVSTT

SEQ ID NO: 968019 - protein, 18 aa, Mycobacterium
AANPFPIVAASALCFLVG

SEQ ID NO: 968020 - protein, 20 aa, Mycobacterium
AAPAYWSGAQLGALRGALLT

SEQ ID NO: 968021 - protein, 21 aa, Mycobacterium
AAPYRVCAIYLVLLTIGGIGA

SEQ ID NO: 968022 - protein, 27 aa, Mycobacterium
AAQDTFLRWVWYAARREGLALDGAGDS

SEQ ID NO: 968023 - protein, 18 aa, Mycobacterium
AARARRHALEYLDLHHPA

SEQ ID NO: 968024 - protein, 27 aa, Mycobacterium
AARASASLDEWGPEEWGMVGESPAANR

SEQ ID NO: 968025 - protein, 22 aa, Mycobacterium
AARDGILAIRWRLPSGTEIDTG

SEQ ID NO: 968026 - protein, 21 aa, Mycobacterium
AARELLPYQALTGLRNDALAA

SEQ ID NO: 968027 - protein, 21 aa, Mycobacterium
AARGEHYWLKLLRVLLPVHRS

SEQ ID NO: 968028 - protein, 20 aa, Mycobacterium
AARGIGWCGLSPARASSVNK

SEQ ID NO: 968029 - protein, 19 aa, Mycobacterium
AARGMGPHGLCIGATGSGK

SEQ ID NO: 968030 - protein, 28 aa, Mycobacterium
AARGRRLRFRPGRAVTGVALLVVSLLML

SEQ ID NO: 968031 - protein, 18 aa, Mycobacterium
AARLSTSGIPVDWQSVFD

SEQ ID NO: 968032 - protein, 17 aa, Mycobacterium
AARPKRRLISDADAGDN

SEQ ID NO: 968033 - protein, 17 aa, Mycobacterium
AASDRFGRKRLLMTGLV

SEQ ID NO: 968034 - protein, 25 aa, Mycobacterium
AASFYWGHHFGRLFAHPDSEQLLLR

SEQ ID NO: 968035 - protein, 24 aa, Mycobacterium
AASGPELVGLVVYLLTPLVSAVLL

SEQ ID NO: 968036 - protein, 20 aa, Mycobacterium
AASLILAVLAFRHFGNAVLL

SEQ ID NO: 968037 - protein, 17 aa, Mycobacterium
AASPAIWAAQEQPDPST

SEQ ID NO: 968038 - protein, 23 aa, Mycobacterium
AASPRPVLFISPSARLARVPWGL

SEQ ID NO: 968039 - protein, 24 aa, Mycobacterium
AATDIRLSQWFLLTAAFGSLFMVA

SEQ ID NO: 968040 - protein, 26 aa, Mycobacterium
AATDWPRYGGYALAGVSSFGFGGANA

SEQ ID NO: 968041 - protein, 24 aa, Mycobacterium
AATELPIIIVILIQIILVLLEILY

SEQ ID NO: 968042 - protein, 31 aa, Mycobacterium
AATPPPSLFRVAGHRGLRGWQGGHRSADGRR

SEQ ID NO: 968043 - protein, 26 aa, Mycobacterium
AATRSFAEGVGWLAQIGLFVLLGLLV

SEQ ID NO: 968044 - protein, 19 aa, Mycobacterium
AAVAAFGFIFTFRDIPTPP

SEQ ID NO: 968045 - protein, 24 aa, Mycobacterium
AAVFCVLAVLPLIVLTQLGIIVGL

SEQ ID NO: 968046 - protein, 17 aa, Mycobacterium
AAVGAAITALLFVGSAA

SEQ ID NO: 968047 - protein, 19 aa, Mycobacterium
AAVGHFRLANLVDITPSDA

SEQ ID NO: 968048 - protein, 24 aa, Mycobacterium
AAVLVALAGRRLWHRFRGQPDRAD

SEQ ID NO: 968049 - protein, 28 aa, Mycobacterium
AAVPIWQWREHRGPALVAAFAAGLVGAA

SEQ ID NO: 968050 - protein, 24 aa, Mycobacterium
AAVPTRSALIFGLALTVISFFWLW

SEQ ID NO: 968051 - protein, 21 aa, Mycobacterium
AAVQLPAVWLLAAVAVGLFGL

SEQ ID NO: 968052 - protein, 26 aa, Mycobacterium
AAVSGWRSGALGSMLSFAGVLLGAIA

SEQ ID NO: 968053 - protein, 29 aa, Mycobacterium
AAVSWFLRFLLRHSMYWFVGYRVVVGVVV

SEQ ID NO: 968054 - protein, 26 aa, Mycobacterium
AAVTAVLAAWGWFALLLQITGAIAVV

SEQ ID NO: 968055 - protein, 19 aa, Mycobacterium
AAVYLGSLVSMGFGRALRR

SEQ ID NO: 968056 - protein, 22 aa, Mycobacterium
AAWATRTGFRVATIIITLIVGI

SEQ ID NO: 968057 - protein, 24 aa, Mycobacterium
AAWRMFVRRDWRYAVVLVGYCAGW

SEQ ID NO: 968058 - protein, 19 aa, Mycobacterium
AAWWVVVLALTAATMMAAA

SEQ ID NO: 968059 - protein, 17 aa, Mycobacterium
ACAGGFDAGTPYWLIAA

SEQ ID NO: 968060 - protein, 17 aa, Mycobacterium
ACAVARLDFPGKRLLVG

SEQ ID NO: 968061 - protein, 26 aa, Mycobacterium
ACERADAVLILTEWQEFVDLDPDDLA

SEQ ID NO: 968062 - protein, 20 aa, Mycobacterium
ACLAGAIAGFARLRPGVLHA

SEQ ID NO: 968063 - protein, 23 aa, Mycobacterium
ACSERRLDLWADRAVVGQSLRAV

SEQ ID NO: 968064 - protein, 18 aa, Mycobacterium
ACVALCGVAAGLFMLGFS

SEQ ID NO: 968065 - protein, 18 aa, Mycobacterium
ADAAGLPVLTVGALVTRA

SEQ ID NO: 968066 - protein, 20 aa, Mycobacterium
ADAASGRFAVDVVLHEPAGP

SEQ ID NO: 968067 - protein, 17 aa, Mycobacterium
ADADYIRRVIKAQRALE

SEQ ID NO: 968068 - protein, 28 aa, Mycobacterium
ADANKYVQCRVVATGNSLDAVWTQLMPD

SEQ ID NO: 968069 - protein, 18 aa, Mycobacterium
ADAPPFFVLHGRNDSLVP

SEQ ID NO: 968070 - protein, 23 aa, Mycobacterium
ADASLPTVALWALALLITGAGIG

SEQ ID NO: 968071 - protein, 19 aa, Mycobacterium
ADAVITGFIGKWPSELGAQ

SEQ ID NO: 968072 - protein, 18 aa, Mycobacterium
ADETLSLIRHGDDESRRR

SEQ ID NO: 968073 - protein, 18 aa, Mycobacterium
ADETLSLIRRGDQEVRKQ

SEQ ID NO: 968074 - protein, 20 aa, Mycobacterium
ADFCRIRIGLGTQPLATRLV

SEQ ID NO: 968075 - protein, 17 aa, Mycobacterium
ADFNAAIDLGDLVEMTG

SEQ ID NO: 968076 - protein, 18 aa, Mycobacterium
ADGPRITFEVGHHQGVIG

SEQ ID NO: 968077 - protein, 17 aa, Mycobacterium
ADGRCKAFAAAADGTGW

SEQ ID NO: 968078 - protein, 22 aa, Mycobacterium
ADIRFSRNEFEQLITQPLDRFI

SEQ ID NO: 968079 - protein, 23 aa, Mycobacterium
ADLDRPDPPAARHAASDHRVDEE

SEQ ID NO: 968080 - protein, 23 aa, Mycobacterium
ADLLGRRRTFTFGVVIFTIASGL

SEQ ID NO: 968081 - protein, 19 aa, Mycobacterium
ADLNARMGGYFTAHVASSD

SEQ ID NO: 968082 - protein, 26 aa, Mycobacterium
ADLRVAHPLIDRAHLLLRFEQGSWVP

SEQ ID NO: 968083 - protein, 17 aa, Mycobacterium
ADLVVGIVGVMAGAIAL

SEQ ID NO: 968084 - protein, 17 aa, Mycobacterium
ADMAVAVDVPDGMDTAT

SEQ ID NO: 968085 - protein, 25 aa, Mycobacterium
ADMDQRLVGMIARIVETYGKYNSSQ

SEQ ID NO: 968086 - protein, 17 aa, Mycobacterium
ADMGGSFVGPSQDAVLA

SEQ ID NO: 968087 - protein, 19 aa, Mycobacterium
ADPGRAGAIALAVVAALAV

SEQ ID NO: 968088 - protein, 22 aa, Mycobacterium
ADPRGLPVLSVKQLVVRAVSGE

SEQ ID NO: 968089 - protein, 29 aa, Mycobacterium
ADPSRRTSCLSGLGYPASTPILGAQPVDI

SEQ ID NO: 968090 - protein, 23 aa, Mycobacterium
ADPSRVRRSGGTGLGLAISVEDA

SEQ ID NO: 968091 - protein, 36 aa, Mycobacterium
ADPYKYFLEFFQRMGFSPAVAVILAIIALQLYDFLW

SEQ ID NO: 968092 - protein, 18 aa, Mycobacterium
ADQALRIILFAQTPATAV

SEQ ID NO: 968093 - protein, 23 aa, Mycobacterium
ADQPAQIKLHFHLTDPDGVALDS

SEQ ID NO: 968094 - protein, 18 aa, Mycobacterium
ADRSRPDRGPRETQDSTG

SEQ ID NO: 968095 - protein, 17 aa, Mycobacterium
ADSLTRRRRVVAIVACT

SEQ ID NO: 968096 - protein, 25 aa, Mycobacterium
ADSRHIGSVLDWWSDPLTVPLGTGS

SEQ ID NO: 968097 - protein, 17 aa, Mycobacterium
ADTGARIVLACGFDSIP

SEQ ID NO: 968098 - protein, 24 aa, Mycobacterium
ADTRVQAAVPFYGVYDFTRFDDAM

SEQ ID NO: 968099 - protein, 23 aa, Mycobacterium
ADTVGWRGIFLINVPIGLAVLAG

SEQ ID NO: 968100 - protein, 18 aa, Mycobacterium
ADVDAVKFTQVLRGYKTS

SEQ ID NO: 968101 - protein, 20 aa, Mycobacterium
ADVHMVWWMVAVVGFNSLLG

SEQ ID NO: 968102 - protein, 18 aa, Mycobacterium
ADVKPVWQSLRHVDTWIL

SEQ ID NO: 968103 - protein, 18 aa, Mycobacterium
ADVLLPDLGAAWRIMHAI

SEQ ID NO: 968104 - protein, 32 aa, Mycobacterium; identical to SEQ ID NO: 298308

SEQ ID NO: 968105 - protein, 18 aa, Mycobacterium
ADYARMWVQAATVMSVYQ

SEQ ID NO: 968106 - protein, 17 aa, Mycobacterium
ADYLRGLIQERWTIRPK

SEQ ID NO: 968107 - protein, 21 aa, Mycobacterium
AEAAFLGYIVYFGRRAAKAGE

SEQ ID NO: 968108 - protein, 19 aa, Mycobacterium
AEAEALAAAARARARAAQL

SEQ ID NO: 968109 - protein, 18 aa, Mycobacterium
AEAHLARLAGQFRPDQLA

SEQ ID NO: 968110 - protein, 22 aa, Mycobacterium
AEALCWDVAEVVELRGRTAPTQ

SEQ ID NO: 968111 - protein, 17 aa, Mycobacterium
AECFRLCCCSATLATSG

SEQ ID NO: 968112 - protein, 19 aa, Mycobacterium
AEDAARVFERFYRTDSSRA

SEQ ID NO: 968113 - protein, 18 aa, Mycobacterium
AEDLKRYFAEGLHYWPWV

SEQ ID NO: 968114 - protein, 17 aa, Mycobacterium
AEEPLRPALPRRPDRSG

SEQ ID NO: 968115 - protein, 17 aa, Mycobacterium
AEEYPDFGTHPDGPEPS

SEQ ID NO: 968116 - protein, 23 aa, Mycobacterium
AEFARLYPFQVFLDLYGLPLQDR

SEQ ID NO: 968117 - protein, 26 aa, Mycobacterium
AEGLRSRLWPTPALGVVMAIAVGLAL

SEQ ID NO: 968118 - protein, 19 aa, Mycobacterium
AEGLSVIVHAIRQAREIFA

SEQ ID NO: 968119 - protein, 24 aa, Mycobacterium
AEGSLHLWLNLTLLAGVALVVVGA

SEQ ID NO: 968120 - protein, 25 aa, Mycobacterium
AEHGKVVGIALVFLVARSFSSGCAA

SEQ ID NO: 968121 - protein, 37 aa, Mycobacterium; identical to SEQ ID NO: 298407

SEQ ID NO: 968122 - protein, 20 aa, Mycobacterium
AEILITAGFFFGRDISDNGP

SEQ ID NO: 968123 - protein, 21 aa, Mycobacterium
AEIVLAIANLMWFVFAGFGAL

SEQ ID NO: 968124 - protein, 27 aa, Mycobacterium
AELAPTWSRPGWRHLKHFNGYATSFWV

SEQ ID NO: 968125 - protein, 23 aa, Mycobacterium
AELDVKFAALVKDQAEWATHGRL

SEQ ID NO: 968126 - protein, 23 aa, Mycobacterium
AELMPAHDSMLFPVPGPISDEAA

SEQ ID NO: 968127 - protein, 21 aa, Mycobacterium
AELPLREILPAVQRLVIPVAE

SEQ ID NO: 968128 - protein, 18 aa, Mycobacterium
AELSAPLIEVHISNVHAR

SEQ ID NO: 968129 - protein, 22 aa, Mycobacterium
AEPDCGTTFTWASRAFGPVTGW

SEQ ID NO: 968130 - protein, 19 aa, Mycobacterium
AEQAFPRTVPPDQARAANQ

SEQ ID NO: 968131 - protein, 18 aa, Mycobacterium
AEQLRPGDVIEVRTHEVV

SEQ ID NO: 968132 - protein, 18 aa, Mycobacterium
AEQWRSFADTSLQPLPKG

SEQ ID NO: 968133 - protein, 20 aa, Mycobacterium
AEREIGSWLLLSVIVAVVLM

SEQ ID NO: 968134 - protein, 17 aa, Mycobacterium
AERPVHPVTVWRGRLSI

SEQ ID NO: 968135 - protein, 18 aa, Mycobacterium
AEVRELFDTAVLHRLPVT

SEQ ID NO: 968136 - protein, 17 aa, Mycobacterium
AEYGLYVGIGSAVCAVA

SEQ ID NO: 968137 - protein, 26 aa, Mycobacterium
AEYRFEKAWPLLWFVVIGVVAAAIGY

SEQ ID NO: 968138 - protein, 25 aa, Mycobacterium
AFALAGGWRRATAVLTVLSAVAVLG

SEQ ID NO: 968139 - protein, 17 aa, Mycobacterium
AFAPAVVALVIIAAVTL

SEQ ID NO: 968140 - protein, 17 aa, Mycobacterium
AFCSFPQVMGHEVVADV

SEQ ID NO: 968141 - protein, 19 aa, Mycobacterium
AFDNPDFQRGLTLFLSPDG

SEQ ID NO: 968142 - protein, 19 aa, Mycobacterium
AFDNPDFQTGLRMFLSPDG

SEQ ID NO: 968143 - protein, 26 aa, Mycobacterium
AFELPFYRLLLSYLFVAIFLAFVANV

SEQ ID NO: 968144 - protein, 25 aa, Mycobacterium
AFEPQRAGVWLARRSGLARLINLYG

SEQ ID NO: 968145 - protein, 21 aa, Mycobacterium
AFGGFLVPLAYAWSKAQFGNI

SEQ ID NO: 968146 - protein, 24 aa, Mycobacterium
AFGWYFNIRFVREYSHGATNPIWG

SEQ ID NO: 968147 - protein, 20 aa, Mycobacterium
AFLFGCFVFGVLSVRHTGQG

SEQ ID NO: 968148 - protein, 22 aa, Mycobacterium
AFPPERRGAAATVWAAGAGFGN

SEQ ID NO: 968149 - protein, 25 aa, Mycobacterium
AFPYDPWVRISLWIGVAIIALLFGW

SEQ ID NO: 968150 - protein, 19 aa, Mycobacterium
AFQNPDFQRGLTLFLSPDG

SEQ ID NO: 968151 - protein, 18 aa, Mycobacterium
AFSLLGLRQLYFLIDNLL

SEQ ID NO: 968152 - protein, 19 aa, Mycobacterium
AFSSFFVVSNSLRLRNFGP

SEQ ID NO: 968153 - protein, 17 aa, Mycobacterium
AFTAWRFGDHDVAVRGY

SEQ ID NO: 968154 - protein, 17 aa, Mycobacterium
AGAAILLFGGRRTDAWG

SEQ ID NO: 968155 - protein, 20 aa, Mycobacterium
AGAAMAFSSFFVVSNSLRLR

SEQ ID NO: 968156 - protein, 28 aa, Mycobacterium
AGAARTALAAATGRIGQTIAAVATLAAD

SEQ ID NO: 968157 - protein, 19 aa, Mycobacterium
AGACLGALFFGHLTDRFGR

SEQ ID NO: 968158 - protein, 23 aa, Mycobacterium
AGAGLVLRGFVERVGDQSPLIAA

SEQ ID NO: 968159 - protein, 24 aa, Mycobacterium
AGANFWRRGSLLIGIGVGVAAALR

SEQ ID NO: 968160 - protein, 20 aa, Mycobacterium
AGARTARAATRAGAGAGATP

SEQ ID NO: 968161 - protein, 19 aa, Mycobacterium
AGAVFAILPRVTWAGIEAR

SEQ ID NO: 968162 - protein, 24 aa, Mycobacterium
AGDQPWRWFLIGFMVIFHLNILSN

SEQ ID NO: 968163 - protein, 23 aa, Mycobacterium
AGELLQALMFVIRTVAFVVWALA

SEQ ID NO: 968164 - protein, 17 aa, Mycobacterium
AGFEPDVRFDGVDLLVH

SEQ ID NO: 968165 - protein, 20 aa, Mycobacterium
AGFHHGFFIFAIVLTAMSII

SEQ ID NO: 968166 - protein, 17 aa, Mycobacterium
AGFVELALRAGDEVGCP

SEQ ID NO: 968167 - protein, 32 aa, Mycobacterium; identical to SEQ ID NO: 298812

SEQ ID NO: 968168 - protein, 18 aa, Mycobacterium
AGGAGRVRARLTMSGPDS

SEQ ID NO: 968169 - protein, 24 aa, Mycobacterium
AGGAIGILVSWGLVDLFPGSLAPH

SEQ ID NO: 968170 - protein, 19 aa, Mycobacterium
AGGFCDIAGMTPVEDLEPD

SEQ ID NO: 968171 - protein, 17 aa, Mycobacterium
AGGTYLGGWRIIRTLGK

SEQ ID NO: 968172 - protein, 18 aa, Mycobacterium
AGGVLTIIMGLVFVGLIP

SEQ ID NO: 968173 - protein, 27 aa, Mycobacterium
AGISHQRWLRWPARVYTDIFRGLPEVV

SEQ ID NO: 968174 - protein, 23 aa, Mycobacterium
AGKDSFPASFIVKLENPEQHKDF

SEQ ID NO: 968175 - protein, 27 aa, Mycobacterium
AGKLSFPISAAPGWSVFGDDQSPNLIG

SEQ ID NO: 968176 - protein, 24 aa, Mycobacterium
AGLAIGICSHWWPELPGNGKSILT

SEQ ID NO: 968177 - protein, 22 aa, Mycobacterium
AGLGLPIARALARAHGGELVCL

SEQ ID NO: 968178 - protein, 25 aa, Mycobacterium
AGLGWLRRHTRAIQIFGGVLLIVVG

SEQ ID NO: 968179 - protein, 19 aa, Mycobacterium
AGLIAIYVVLQLARQKRML

SEQ ID NO: 968180 - protein, 37 aa, Mycobacterium; identical to SEQ ID NO: 298932

SEQ ID NO: 968181 - protein, 23 aa, Mycobacterium
AGLMAAIGFELFKQVASIYLRTV

SEQ ID NO: 968182 - protein, 26 aa, Mycobacterium
AGLQTGSSFKVFALVAALEQGIGLGY

SEQ ID NO: 968183 - protein, 21 aa, Mycobacterium
AGLTLGPAVVFVGSRFHPFES

SEQ ID NO: 968184 - protein, 18 aa, Mycobacterium
AGLVERQRLQAAFGTYVD

SEQ ID NO: 968185 - protein, 19 aa, Mycobacterium
AGMRGHAGFATWAATASDD

SEQ ID NO: 968186 - protein, 21 aa, Mycobacterium
AGPDRPVVVSVVGLVHTSGLF

SEQ ID NO: 968187 - protein, 26 aa, Mycobacterium
AGPLVMSGCRFFDVMLGAAPHYRRAL

SEQ ID NO: 968188 - protein, 32 aa, Mycobacterium; identical to SEQ ID NO: 299028

SEQ ID NO: 968189 - protein, 21 aa, Mycobacterium
AGQLHKVRMLLLTNCTFDGVV

SEQ ID NO: 968190 - protein, 18 aa, Mycobacterium
AGRFRTCHELADALRDEV

SEQ ID NO: 968191 - protein, 18 aa, Mycobacterium
AGRLSWSLTVLAAVALIA

SEQ ID NO: 968192 - protein, 21 aa, Mycobacterium
AGRRKALAFIEGRSVDELLNL

SEQ ID NO: 968193 - protein, 18 aa, Mycobacterium
AGSLSIALVVDIVASFAV

SEQ ID NO: 968194 - protein, 23 aa, Mycobacterium
AGSRRAIPHAVVLSAVLAVVVEC

SEQ ID NO: 968195 - protein, 29 aa, Mycobacterium
AGSSADRLRCWLITIVIWVWTVRLTANWV

SEQ ID NO: 968196 - protein, 17 aa, Mycobacterium
AGTKLLVVFAISVLLTF

SEQ ID NO: 968197 - protein, 25 aa, Mycobacterium
AGVDPRVGLFASFTMAVTIAVVGGR

SEQ ID NO: 968198 - protein, 20 aa, Mycobacterium
AGVEACAGTGLVAPAADDIA

SEQ ID NO: 968199 - protein, 27 aa, Mycobacterium
AGVKSAWDLLWRYGGQYVATALAQVAS

SEQ ID NO: 968200 - protein, 19 aa, Mycobacterium
AGVLAFLAAMVLKLNAKAQ

SEQ ID NO: 968201 - protein, 17 aa, Mycobacterium
AGVLYFFFVVPRWPELM

SEQ ID NO: 968202 - protein, 24 aa, Mycobacterium
AGVPWPRHKLFAVIAGLVTVVLVG

SEQ ID NO: 968203 - protein, 26 aa, Mycobacterium
AGVTSVSIPSLWQPYVLSVASLTAGG

SEQ ID NO: 968204 - protein, 24 aa, Mycobacterium
AGVVPEWLAYTLAVALGVTSLGLA

SEQ ID NO: 968205 - protein, 19 aa, Mycobacterium
AGWPDSVFVFSLYAFCAPP

SEQ ID NO: 968206 - protein, 18 aa, Mycobacterium
AHAEVVRFGKAVVLTASK

SEQ ID NO: 968207 - protein, 19 aa, Mycobacterium
AHAGSAVLLVGEETASLSV

SEQ ID NO: 968208 - protein, 23 aa, Mycobacterium
AHFEFTRAPLLLVIAVPIALARL

SEQ ID NO: 968209 - protein, 23 aa, Mycobacterium
AHGEVYAPLTLVFLCSGSDIVVG

SEQ ID NO: 968210 - protein, 25 aa, Mycobacterium
AHGRRIKPATLIAGLVAVALVAVAA

SEQ ID NO: 968211 - protein, 24 aa, Mycobacterium
AHGSCSGVTPAVYFSDAVTLADQL

SEQ ID NO: 968212 - protein, 19 aa, Mycobacterium
AHIQIAWRTGNFAIYVITI

SEQ ID NO: 968213 - protein, 28 aa, Mycobacterium
AHLLDTLPLLIGWLWPLWDSRRRTFADL

SEQ ID NO: 968214 - protein, 17 aa, Mycobacterium
AHLNMCDRLLILAPGGR

SEQ ID NO: 968215 - protein, 25 aa, Mycobacterium
AHLQRARVPMPIIPVSSLLRSHAVT

SEQ ID NO: 968216 - protein, 17 aa, Mycobacterium
AHLRARHDLVLEAFTAF

SEQ ID NO: 968217 - protein, 17 aa, Mycobacterium
AHPEEPVRSLAVVSTLM

SEQ ID NO: 968218 - protein, 18 aa, Mycobacterium
AHQLCPAGVVVATKTDLY

SEQ ID NO: 968219 - protein, 26 aa, Mycobacterium
AHRLFPRAMLHFEDFGPTNARMILRT

SEQ ID NO: 968220 - protein, 25 aa, Mycobacterium
AHRVGEPFGSLVLAVAVTVIEVALI

SEQ ID NO: 968221 - protein, 17 aa, Mycobacterium
AHTLAGTSTGVFVGAWA

SEQ ID NO: 968222 - protein, 20 aa, Mycobacterium
AHVAGGLFLKVGSSGMIFQT

SEQ ID NO: 968223 - protein, 20 aa, Mycobacterium
AIAACAAGVYLVDVRPKLLE

SEQ ID NO: 968224 - protein, 18 aa, Mycobacterium
AIAFIAVEVLLGMIGGLS

SEQ ID NO: 968225 - protein, 17 aa, Mycobacterium
AIAFRWLKRAHYRNFPR

SEQ ID NO: 968226 - protein, 27 aa, Mycobacterium
AIARIPLGVAVTIEFAGPLMLAAAFSR

SEQ ID NO: 968227 - protein, 30 aa, Mycobacterium
AICSLPFEHARPTAIMAWMRQHWGIENSLH

SEQ ID NO: 968228 - protein, 29 aa, Mycobacterium
AICSLPFEHARPTAIMTWMRQHCGIENNL

SEQ ID NO: 968229 - protein, 29 aa, Mycobacterium
AICSLPFEHARPTAIMTWMRQHCGIGQHW

SEQ ID NO: 968230 - protein, 29 aa, Mycobacterium
AICSLPFEHARPTAIMTWMRQHCRIENSL

SEQ ID NO: 968231 - protein, 29 aa, Mycobacterium
AICSLPFEHARPTAIMTWMRQHWGIENGL

SEQ ID NO: 968232 - protein, 30 aa, Mycobacterium
AICSLPFEHARPTAIMTWMRQHWGIENGLH

SEQ ID NO: 968233 - protein, 30 aa, Mycobacterium
AICSLPFEHARPTAIMTWMRQHWGIGQHWG

SEQ ID NO: 968234 - protein, 28 aa, Mycobacterium
AICSLPFEHARPTAVMTWMRQHCGIENS

SEQ ID NO: 968235 - protein, 26 aa, Mycobacterium
AIDLGWSLIATRSMFEHRAVVVGADR

SEQ ID NO: 968236 - protein, 19 aa, Mycobacterium
AIDLNIVLSAAINFLLIAL

SEQ ID NO: 968237 - protein, 19 aa, Mycobacterium
AIGALMLIPSVPGRGSASV

SEQ ID NO: 968238 - protein, 22 aa, Mycobacterium
AIGLCGFALVLALDAVRNTSIA

SEQ ID NO: 968239 - protein, 19 aa, Mycobacterium
AIHAVCFALDPILFGSLRR

SEQ ID NO: 968240 - protein, 18 aa, Mycobacterium
AIHLLASMTMVWLSVLLY

SEQ ID NO: 968241 - protein, 17 aa, Mycobacterium
AIIEELVAWGGGRLRQA

SEQ ID NO: 968242 - protein, 19 aa, Mycobacterium
AILALPFVILIGLIVSRQW

SEQ ID NO: 968243 - protein, 23 aa, Mycobacterium
AILVTGFLWPAWLVTTKLDVNKA

SEQ ID NO: 968244 - protein, 19 aa, Mycobacterium
AINAVPLRVAIFYIGALLA

SEQ ID NO: 968245 - protein, 18 aa, Mycobacterium
AINSVVFRIGLFYLGSTV

SEQ ID NO: 968246 - protein, 20 aa, Mycobacterium
AIPIVLGMILLVIPLFNLSL

SEQ ID NO: 968247 - protein, 19 aa, Mycobacterium
AIPQLRTAWVSYRRGAPRR

SEQ ID NO: 968248 - protein, 24 aa, Mycobacterium
AIRALRESHDWSLADLAAATGVSI

SEQ ID NO: 968249 - protein, 25 aa, Mycobacterium
AIREFKRLGLTPVLLTGDNPTVARH

SEQ ID NO: 968250 - protein, 39 aa, Mycobacterium; identical to SEQ ID NO: 299447

SEQ ID NO: 968251 - protein, 22 aa, Mycobacterium
AISVLLTFYPGWVTIGLMAALV

SEQ ID NO: 968252 - protein, 18 aa, Mycobacterium
AITAAWPGGWWIDPGIGL

SEQ ID NO: 968253 - protein, 19 aa, Mycobacterium
AITALLFVGSAAFAGAAVQ

SEQ ID NO: 968254 - protein, 23 aa, Mycobacterium
AITGGLAFFFGPVVVFWVLATMA

SEQ ID NO: 968255 - protein, 19 aa, Mycobacterium
AITRRSQRLFVAHWTSTGR

SEQ ID NO: 968256 - protein, 24 aa, Mycobacterium
AIVGCALFLWLEGRSADPMMDLTL

SEQ ID NO: 968257 - protein, 26 aa, Mycobacterium
AIVLRDLRIPAIGLVLLLLSSLIVGA

SEQ ID NO: 968258 - protein, 27 aa, Mycobacterium
AIYNYTWLVLMLPFGMIGVTVLTVVMP

SEQ ID NO: 968259 - protein, 17 aa, Mycobacterium
AKAPKVVRPKLTERMAV

SEQ ID NO: 968260 - protein, 17 aa, Mycobacterium
AKAPVLFQIPGGAWTTG

SEQ ID NO: 968261 - protein, 26 aa, Mycobacterium
AKELVIATKMSGEWSKDDVLQAYLNI

SEQ ID NO: 968262 - protein, 24 aa, Mycobacterium
AKGLSRPRVVTVHILRNSLIPVVT

SEQ ID NO: 968263 - protein, 26 aa, Mycobacterium
AKIAIGWFAASAWLRRNGTLGQFKMI

SEQ ID NO: 968264 - protein, 20 aa, Mycobacterium
AKIANYRFSDLVADANPIAS

SEQ ID NO: 968265 - protein, 25 aa, Mycobacterium
AKIGFEMFRILPAAVIVIGLLALLD

SEQ ID NO: 968266 - protein, 26 aa, Mycobacterium
AKLDAWRFGWIVSIGRAITGGVGGLL

SEQ ID NO: 968267 - protein, 17 aa, Mycobacterium
AKLTGAFLSDYTSLTRD

SEQ ID NO: 968268 - protein, 21 aa, Mycobacterium
AKNRARLGVGASDRVGLVDAI

SEQ ID NO: 968269 - protein, 24 aa, Mycobacterium
AKPDRPELSLSLLSVSRSGNTLTL

SEQ ID NO: 968270 - protein, 23 aa, Mycobacterium
AKPEAMVGIALFLAFAALPASLH

SEQ ID NO: 968271 - protein, 29 aa, Mycobacterium
AKPPFSVGEAISWAWNRFTQNAMALVVPI

SEQ ID NO: 968272 - protein, 20 aa, Mycobacterium
AKPPRSGKVPTEPAQVSASM

SEQ ID NO: 968273 - protein, 20 aa, Mycobacterium
AKQAKRRRILMIVGSAVAAV

SEQ ID NO: 968274 - protein, 22 aa, Mycobacterium
AKSFKRQLPWLSLAVLAIYLLA

SEQ ID NO: 968275 - protein, 25 aa, Mycobacterium
AKTDPVIGCAAALEAHGALVTIITI

SEQ ID NO: 968276 - protein, 20 aa, Mycobacterium
AKTPKAAFRIAFAGPATSLA

SEQ ID NO: 968277 - protein, 18 aa, Mycobacterium
AKVLMYWIHAPLWLLSLC

SEQ ID NO: 968278 - protein, 35 aa, Mycobacterium
AKVPAGFDFEAQGVWTFARPGFPPLKLDQSLDEAG

SEQ ID NO: 968279 - protein, 22 aa, Mycobacterium
AKVVRPGWMAQLVMVVLVAPVG

SEQ ID NO: 968280 - protein, 18 aa, Mycobacterium
ALAADRWQALPAPVATLV

SEQ ID NO: 968281 - protein, 21 aa, Mycobacterium
ALADRLGRPVVYAFGLVLFAV

SEQ ID NO: 968282 - protein, 23 aa, Mycobacterium
ALAGFLPLTWLSLVYGWGLAGIW

SEQ ID NO: 968283 - protein, 19 aa, Mycobacterium
ALAGLPPAYAINPPTIDLG

SEQ ID NO: 968284 - protein, 27 aa, Mycobacterium
ALAIALTAWRVMWFRIHAEPSGDEWHV

SEQ ID NO: 968285 - protein, 19 aa, Mycobacterium
ALAIDIRPTVALQPRPNEN

SEQ ID NO: 968286 - protein, 23 aa, Mycobacterium
ALALGAIGGVIGRKTAEIVDAFT

SEQ ID NO: 968287 - protein, 26 aa, Mycobacterium
ALARAHGGELVCLPHQGGARFRLTLP

SEQ ID NO: 968288 - protein, 17 aa, Mycobacterium
ALARLLSTLPLGYAPGT

SEQ ID NO: 968289 - protein, 17 aa, Mycobacterium
ALASIWLSGSLLLGLGA

SEQ ID NO: 968290 - protein, 18 aa, Mycobacterium
ALATLRIAFLSAPVLELL

SEQ ID NO: 968291 - protein, 25 aa, Mycobacterium
ALAWLFGPRVMRLPFSRRLATYAIS

SEQ ID NO: 968292 - protein, 17 aa, Mycobacterium
ALCGITVVRRDSHDGDD

SEQ ID NO: 968293 - protein, 19 aa, Mycobacterium
ALDDPRAATPWTADIITGT

SEQ ID NO: 968294 - protein, 17 aa, Mycobacterium
ALDDQRLAPGWHHLADI

SEQ ID NO: 968295 - protein, 27 aa, Mycobacterium
ALDQYLRLPLRQVMWGDDEGLLNSTEF

SEQ ID NO: 968296 - protein, 18 aa, Mycobacterium
ALERGWQSLIATVDGLVL

SEQ ID NO: 968297 - protein, 27 aa, Mycobacterium
ALFALRAVVLPWLLARALGAEKHEQRE

SEQ ID NO: 968298 - protein, 19 aa, Mycobacterium
ALFGSIWALQGFGVLGGSP

SEQ ID NO: 968299 - protein, 19 aa, Mycobacterium
ALFPDYRGSVLDALASAFH

SEQ ID NO: 968300 - protein, 17 aa, Mycobacterium
ALFYKSIYVGGLINEVT

SEQ ID NO: 968301 - protein, 19 aa, Mycobacterium
ALGAHVARWLAHKYESVDL

SEQ ID NO: 968302 - protein, 20 aa, Mycobacterium
ALGALLMVPGVRGLGPGPVT

SEQ ID NO: 968303 - protein, 20 aa, Mycobacterium
ALGAMLFPSRRREWVVAGAG

SEQ ID NO: 968304 - protein, 18 aa, Mycobacterium
ALGFLQDFFATAVFLGIA

SEQ ID NO: 968305 - protein, 18 aa, Mycobacterium
ALGGLMVETLGWRSVFAV

SEQ ID NO: 968306 - protein, 20 aa, Mycobacterium
ALGIPSALGLLVVIAGALTA

SEQ ID NO: 968307 - protein, 22 aa, Mycobacterium
ALGLLAALFVFSYRPDREVDAQ

SEQ ID NO: 968308 - protein, 42 aa, Mycobacterium
ALGQLHCHGISPSWNVLYCQARPLTLPTYAFQHQRYWLLPTA

SEQ ID NO: 968309 - protein, 20 aa, Mycobacterium
ALGVCYALRRRERLRDRLTI

SEQ ID NO: 968310 - protein, 18 aa, Mycobacterium
ALGYRIARRRLPARLGGD

SEQ ID NO: 968311 - protein, 28 aa, Mycobacterium
ALGYVAWRLFGHIPYRIDIDIYQMGGQA

SEQ ID NO: 968312 - protein, 18 aa, Mycobacterium
ALHAWGFATATDQLMLPF

SEQ ID NO: 968313 - protein, 20 aa, Mycobacterium
ALHCTWMSCAFVAAAAVIRR

SEQ ID NO: 968314 - protein, 20 aa, Mycobacterium
ALHECGHMWVARATGMKVRR

SEQ ID NO: 968315 - protein, 22 aa, Mycobacterium
ALIEAMWWLRARALGLRPRVWR

SEQ ID NO: 968316 - protein, 18 aa, Mycobacterium
ALIFLGYEGFELIANAAE

SEQ ID NO: 968317 - protein, 21 aa, Mycobacterium
ALIGLVALVFAVVTSNQLVAW

SEQ ID NO: 968318 - protein, 17 aa, Mycobacterium
ALIGVDSDELWDIRNRG

SEQ ID NO: 968319 - protein, 25 aa, Mycobacterium
ALIIAIGVFLAWRAIPALARNKENF

SEQ ID NO: 968320 - protein, 25 aa, Mycobacterium
ALIMIGWWSGFPYWTTVAVCGFGGL

SEQ ID NO: 968321 - protein, 17 aa, Mycobacterium
ALISLIIRYRVKESEVW

SEQ ID NO: 968322 - protein, 19 aa, Mycobacterium
ALLAILSVVPWRRFASGES

SEQ ID NO: 968323 - protein, 18 aa, Mycobacterium
ALLDGFLTFFVVAAFGAL

SEQ ID NO: 968324 - protein, 19 aa, Mycobacterium
ALLELWRWAFGAVAMMIVL

SEQ ID NO: 968325 - protein, 24 aa, Mycobacterium
ALLGFPLVLLVGLLVAYLYTVLMF

SEQ ID NO: 968326 - protein, 26 aa, Mycobacterium
ALLGLCGVAMGWGWADGVAGLAVTGF

SEQ ID NO: 968327 - protein, 19 aa, Mycobacterium
ALLLPGGHRARGMRSYIDS

SEQ ID NO: 968328 - protein, 22 aa, Mycobacterium
ALLPHWRERRFGHVVNVSSAGV

SEQ ID NO: 968329 - protein, 23 aa, Mycobacterium
ALLPRTGPQLLPRTPDGSSTLGA

SEQ ID NO: 968330 - protein, 21 aa, Mycobacterium
ALLVPVVDWLDARGLPRGAAV

SEQ ID NO: 968331 - protein, 18 aa, Mycobacterium
ALMAIPLWIIIVLPVAKI

SEQ ID NO: 968332 - protein, 23 aa, Mycobacterium
ALMFPVALCTIAAVASLVGVVDP

SEQ ID NO: 968333 - protein, 18 aa, Mycobacterium
ALNALFPDYRGSVLDALA

SEQ ID NO: 968334 - protein, 32 aa, Mycobacterium; identical to SEQ ID NO: 300013

SEQ ID NO: 968335 - protein, 33 aa, Mycobacterium
ALPVVTWAAWPFHRIALRNARHHGASMETLISV

SEQ ID NO: 968336 - protein, 27 aa, Mycobacterium
ALQWPMFAWFCVYAYRKFVRYEETPPQ

SEQ ID NO: 968337 - protein, 18 aa, Mycobacterium
ALRLEGRTPYRVSRSLLS

SEQ ID NO: 968338 - protein, 25 aa, Mycobacterium
ALRNGLRTHVGFVRSGMAPRLVPDA

SEQ ID NO: 968339 - protein, 19 aa, Mycobacterium
ALRRRERLRDRLTIATSAG

SEQ ID NO: 968340 - protein, 30 aa, Mycobacterium; identical to SEQ ID NO: 300095

SEQ ID NO: 968341 - protein, 18 aa, Mycobacterium
ALSPAGEQFLDFEPESDT

SEQ ID NO: 968342 - protein, 19 aa, Mycobacterium
ALTGCGRANYAASMTNTNA

SEQ ID NO: 968343 - protein, 26 aa, Mycobacterium
ALTLWLHVVDARFARGLRARLLGKMS

SEQ ID NO: 968344 - protein, 24 aa, Mycobacterium
ALTSPRIWALALVYFGIAYGLYAL

SEQ ID NO: 968345 - protein, 23 aa, Mycobacterium
ALTWIRFGVWLLVGTVIYVGYGR

SEQ ID NO: 968346 - protein, 19 aa, Mycobacterium
ALVFPILFMLVLKIVLGNL

SEQ ID NO: 968347 - protein, 26 aa, Mycobacterium
ALVGDRPVQVWSLWSTTLRRLAEGHR

SEQ ID NO: 968348 - protein, 18 aa, Mycobacterium
ALVGKLGDMFGRKRVFQV

SEQ ID NO: 968349 - protein, 24 aa, Mycobacterium
ALVIGALGGVIGRKTAEVVEAFTT

SEQ ID NO: 968350 - protein, 19 aa, Mycobacterium
ALVLFPIGKLFAGTLVVWF

SEQ ID NO: 968351 - protein, 20 aa, Mycobacterium
ALVLFPIGKLFAGTLVVWFF

SEQ ID NO: 968352 - protein, 24 aa, Mycobacterium
ALVPYIRWPMWLRTIAATVGLAIV

SEQ ID NO: 968353 - protein, 19 aa, Mycobacterium
ALVRAPRTIEALGRVDTVC

SEQ ID NO: 968354 - protein, 24 aa, Mycobacterium
ALVRGRYPQLTAYQVINRLIHTAR

SEQ ID NO: 968355 - protein, 25 aa, Mycobacterium
ALVRPWRAPVVLVVMAVRVAPRVAV

SEQ ID NO: 968356 - protein, 25 aa, Mycobacterium
ALVSALLVGTGWIWSLSGDGLSTAT

SEQ ID NO: 968357 - protein, 20 aa, Mycobacterium
ALVWAGSLFWYLQRVGTEPD

SEQ ID NO: 968358 - protein, 22 aa, Mycobacterium
ALWPAEALEAVRLLIFGGEACP

SEQ ID NO: 968359 - protein, 25 aa, Mycobacterium
ALWTPARQRFVWLTLLLAVITLIAT

SEQ ID NO: 968360 - protein, 19 aa, Mycobacterium
AMASSITLLVAFRAAQGLG

SEQ ID NO: 968361 - protein, 22 aa, Mycobacterium
AMFDLWFPAALGARAVITEEQA

SEQ ID NO: 968362 - protein, 22 aa, Mycobacterium
AMFGALALMLGNFLLGMFGVGG

SEQ ID NO: 968363 - protein, 19 aa, Mycobacterium
AMFPFVWNVFKSWRYGEVV

SEQ ID NO: 968364 - protein, 28 aa, Mycobacterium
AMIVIICVFSMLIAQLMVRPIRRLEAGT

SEQ ID NO: 968365 - protein, 18 aa, Mycobacterium
AMLARLSGEYPPVRGVIH

SEQ ID NO: 968366 - protein, 17 aa, Mycobacterium
AMLKRYGPLPPPRAVAI

SEQ ID NO: 968367 - protein, 26 aa, Mycobacterium
AMLPPRRLRLLLSIAAVVLTLDIVTK

SEQ ID NO: 968368 - protein, 18 aa, Mycobacterium
AMLRSGWYRLPPADQRKK

SEQ ID NO: 968369 - protein, 17 aa, Mycobacterium
AMMRRRPAEPGAEADTS

SEQ ID NO: 968370 - protein, 19 aa, Mycobacterium
AMMYELFFPSLLEKRLLRL

SEQ ID NO: 968371 - protein, 19 aa, Mycobacterium
ANADLWLTFAQDYRDETGS

SEQ ID NO: 968372 - protein, 18 aa, Mycobacterium
ANATRFMFAVTFFGSCLL

SEQ ID NO: 968373 - protein, 17 aa, Mycobacterium
ANDTGWRDFCLRAADRI

SEQ ID NO: 968374 - protein, 18 aa, Mycobacterium
ANGDAVGVSGIWDGSTLF

SEQ ID NO: 968375 - protein, 25 aa, Mycobacterium
ANHNGRRLFAVLLHGTRQPIAPWEQ

SEQ ID NO: 968376 - protein, 19 aa, Mycobacterium
ANIALTERIIEFARTQQAL

SEQ ID NO: 968377 - protein, 21 aa, Mycobacterium
ANIPRTALGPGLRRAPRRHMF

SEQ ID NO: 968378 - protein, 19 aa, Mycobacterium
ANLACVVCAIGLGSVAGIS

SEQ ID NO: 968379 - protein, 18 aa, Mycobacterium
ANNPLPRVADEQPSHSTV

SEQ ID NO: 968380 - protein, 34 aa, Mycobacterium; identical to SEQ ID NO: 300406

SEQ ID NO: 968381 - protein, 26 aa, Mycobacterium
ANRTLPELWKLLGHIDAVHGFYYLLM

SEQ ID NO: 968382 - protein, 18 aa, Mycobacterium
ANSLWTWVTGAFVLVLGL

SEQ ID NO: 968383 - protein, 22 aa, Mycobacterium
ANVEGLSSFMARMGMEGAAEDL

SEQ ID NO: 968384 - protein, 25 aa, Mycobacterium
ANVRELRETWTLSGRALGVGMPLTM

SEQ ID NO: 968385 - protein, 17 aa, Mycobacterium
APADAMRGQRVLATAMG

SEQ ID NO: 968386 - protein, 24 aa, Mycobacterium
APAEAFSRPGLPVEYLQVPSPSMG

SEQ ID NO: 968387 - protein, 24 aa, Mycobacterium
APAGTRLSSRSLLISNAVVAFAVI

SEQ ID NO: 968388 - protein, 18 aa, Mycobacterium
APAMYRIVRELAASAHQP

SEQ ID NO: 968389 - protein, 25 aa, Mycobacterium
APARLDNARFLLPVVGVPPDRDADF

SEQ ID NO: 968390 - protein, 36 aa, Mycobacterium; identical to SEQ ID NO: 300478

SEQ ID NO: 968391 - protein, 22 aa, Mycobacterium
APDTMRCAASMALAPEEPVNLS

SEQ ID NO: 968392 - protein, 18 aa, Mycobacterium
APELYRITYDGSIADEPH

SEQ ID NO: 968393 - protein, 18 aa, Mycobacterium
APESEFAMRLYAVSLDQL

SEQ ID NO: 968394 - protein, 23 aa, Mycobacterium
APETILPRCRFADPDADLEHAEA

SEQ ID NO: 968395 - protein, 20 aa, Mycobacterium
APEVPVLPAPAIPEPVVAVP

SEQ ID NO: 968396 - protein, 24 aa, Mycobacterium
APFGWYYDLLAMWAHVSTASVWMR

SEQ ID NO: 968397 - protein, 25 aa, Mycobacterium
APFNVRGARNLPCVTVPGKRAPTAK

SEQ ID NO: 968398 - protein, 17 aa, Mycobacterium
APFVLPLAVTIFVFILI

SEQ ID NO: 968399 - protein, 18 aa, Mycobacterium
APGDIGFVVVVVVVVGAV

SEQ ID NO: 968400 - protein, 19 aa, Mycobacterium
APGEFPPLALHATRTLFDL

SEQ ID NO: 968401 - protein, 25 aa, Mycobacterium
APGQEWRMVWDSALDRAEIGQGVES

SEQ ID NO: 968402 - protein, 22 aa, Mycobacterium
APGYACACGTAIAPGDAQATMN

SEQ ID NO: 968403 - protein, 17 aa, Mycobacterium
APIAGPILGGWLIDAFG

SEQ ID NO: 968404 - protein, 20 aa, Mycobacterium
APIGAPVWLRIFGVATVVSL

SEQ ID NO: 968405 - protein, 23 aa, Mycobacterium
APKLLRRLTDAWVILIGISLFGS

SEQ ID NO: 968406 - protein, 23 aa, Mycobacterium
APLAAVLCRQRREIVLAAGAMLA

SEQ ID NO: 968407 - protein, 23 aa, Mycobacterium
APLDGGRLVRAYLWRRHGDIVRA

SEQ ID NO: 968408 - protein, 19 aa, Mycobacterium
APLLLWQLATRHFTNITVE

SEQ ID NO: 968409 - protein, 19 aa, Mycobacterium
APLTMVFAHGFCLRMGAFH

SEQ ID NO: 968410 - protein, 23 aa, Mycobacterium
APLVTGCTAVLLSPMSFLRRPAR

SEQ ID NO: 968411 - protein, 20 aa, Mycobacterium
APNGLLLVDSWMRAISGRAE

SEQ ID NO: 968412 - protein, 28 aa, Mycobacterium
APPGGPKTRIWAAPPLSYPTTRPPGISG

SEQ ID NO: 968413 - protein, 24 aa, Mycobacterium
APPGPEHPAEWVGPPQEAAPVQPD

SEQ ID NO: 968414 - protein, 24 aa, Mycobacterium
APPPRPAAPKARRKKTERRWGKIV

SEQ ID NO: 968415 - protein, 17 aa, Mycobacterium
APPTMLAAAPVEGDATS

SEQ ID NO: 968416 - protein, 19 aa, Mycobacterium
APPVPALVVERLVIQNDGV

SEQ ID NO: 968417 - protein, 17 aa, Mycobacterium
APQHWIALTPPRIPQLR

SEQ ID NO: 968418 - protein, 22 aa, Mycobacterium
APRGVPAPVVLKAGAAEGVSAA

SEQ ID NO: 968419 - protein, 18 aa, Mycobacterium
APSLRFLNQPVLNAATVF

SEQ ID NO: 968420 - protein, 19 aa, Mycobacterium
APSVVALNRIGHVFNEGET

SEQ ID NO: 968421 - protein, 23 aa, Mycobacterium
APTSRPDAYAGIASDVDILSIRQ

SEQ ID NO: 968422 - protein, 19 aa, Mycobacterium
APVLELLATLGVAVIAVSI

SEQ ID NO: 968423 - protein, 25 aa, Mycobacterium
APVRTPVTMRLRLASAESIDIAEGI

SEQ ID NO: 968424 - protein, 20 aa, Mycobacterium
APYLRASLRSAISPQIETTK

SEQ ID NO: 968425 - protein, 17 aa, Mycobacterium
APYTGYLTLVFLFAVLV

SEQ ID NO: 968426 - protein, 26 aa, Mycobacterium
AQAEPAAWLRFWFPDPKGSNTEYQRA

SEQ ID NO: 968427 - protein, 26 aa, Mycobacterium
AQCVKAEMLAASSWRVAVNAGSESSA

SEQ ID NO: 968428 - protein, 20 aa, Mycobacterium
AQIAEWPKGPAVGIAGAPVQ

SEQ ID NO: 968429 - protein, 18 aa, Mycobacterium
AQLGALRGALLTEPALAP

SEQ ID NO: 968430 - protein, 19 aa, Mycobacterium
AQLLIRFTGPQVWWVLHVA

SEQ ID NO: 968431 - protein, 17 aa, Mycobacterium
AQLMVRPIRRLEAGTEK

SEQ ID NO: 968432 - protein, 18 aa, Mycobacterium
AQLVTAMLAVLVMIAITL

SEQ ID NO: 968433 - protein, 21 aa, Mycobacterium
AQLYEQFPVFAAAFDDVVDAL

SEQ ID NO: 968434 - protein, 25 aa, Mycobacterium
AQMRLRAGSPILFYPAGALAVTVLA

SEQ ID NO: 968435 - protein, 22 aa, Mycobacterium
AQNIRRLLGRRGDLLADLDAIE

SEQ ID NO: 968436 - protein, 21 aa, Mycobacterium
AQQGRRVHRLAVSHAFHSPLM

SEQ ID NO: 968437 - protein, 17 aa, Mycobacterium
AQRGVAVSFWLVAPLVA

SEQ ID NO: 968438 - protein, 26 aa, Mycobacterium
AQRWSSPFWQTWDLLLLWLAQLHGGN

SEQ ID NO: 968439 - protein, 21 aa, Mycobacterium
AQSRWMFSALMGLSVVVVVLL

SEQ ID NO: 968440 - protein, 23 aa, Mycobacterium
AQSVWVSLCIVFALLGLYLTYVG

SEQ ID NO: 968441 - protein, 28 aa, Mycobacterium
AQVVLRVEMPNALPLILGGLRSATLQVV

SEQ ID NO: 968442 - protein, 20 aa, Mycobacterium
ARAAALLLLGLGFAAVIVIG

SEQ ID NO: 968443 - protein, 19 aa, Mycobacterium
ARAALRAWIAQAVTWHDPA

SEQ ID NO: 968444 - protein, 20 aa, Mycobacterium
ARADVIPAITKYMSALDVAL

SEQ ID NO: 968445 - protein, 25 aa, Mycobacterium
ARATFLRWIWYAARREGLHLNGADD

SEQ ID NO: 968446 - protein, 23 aa, Mycobacterium
ARDPEALAFIIGHEVGHLAAGHA

SEQ ID NO: 968447 - protein, 20 aa, Mycobacterium
ARDPLAHRSLIWFTVVSSVV

SEQ ID NO: 968448 - protein, 21 aa, Mycobacterium
ARDPRKPVLILAAIGLCGFAL

SEQ ID NO: 968449 - protein, 19 aa, Mycobacterium
ARDSDWTVCDAISSGSQGG

SEQ ID NO: 968450 - protein, 20 aa, Mycobacterium
AREWMWAILLAGAVAVIVTA

SEQ ID NO: 968451 - protein, 22 aa, Mycobacterium
ARFAALTWPIAIAVSPALTYGV

SEQ ID NO: 968452 - protein, 23 aa, Mycobacterium
ARFGESFWMFLPRSMFGSLKSAW

SEQ ID NO: 968453 - protein, 23 aa, Mycobacterium
ARFPRAIANFNRYAGSVTRGLDE

SEQ ID NO: 968454 - protein, 25 aa, Mycobacterium
ARGKPLRIMILLVIVTAVASALLDN

SEQ ID NO: 968455 - protein, 19 aa, Mycobacterium
ARGMGMSRLTTLVRLELPL

SEQ ID NO: 968456 - protein, 19 aa, Mycobacterium
ARHTKRLERMTVDGTAVSV

SEQ ID NO: 968457 - protein, 18 aa, Mycobacterium
ARHTVDWMRSELPQVAGG

SEQ ID NO: 968458 - protein, 22 aa, Mycobacterium
ARHWTDAAIIAGLLMMNGGVAF

SEQ ID NO: 968459 - protein, 26 aa, Mycobacterium
ARIKYKVGPTIAWYQDFLRYYFLTVE

SEQ ID NO: 968460 - protein, 26 aa, Mycobacterium
ARLCELAKSFPGRLLASAETLAGASE

SEQ ID NO: 968461 - protein, 18 aa, Mycobacterium
ARLCELAKSYSTRLVASS

SEQ ID NO: 968462 - protein, 18 aa, Mycobacterium
ARLEFRGRDTLFVLYLGT

SEQ ID NO: 968463 - protein, 23 aa, Mycobacterium
ARLLAWRPLVWLGTISYGIYLWH

SEQ ID NO: 968464 - protein, 26 aa, Mycobacterium
ARLLGKMSGLPLGWFTGRGSGSIKQL

SEQ ID NO: 968465 - protein, 21 aa, Mycobacterium
ARLMRFIPRSVMVGFVNALAI

SEQ ID NO: 968466 - protein, 24 aa, Mycobacterium
ARLPDLLPGVPLVVSGRYRGSAPG

SEQ ID NO: 968467 - protein, 25 aa, Mycobacterium
ARLRLFGIGIPAAIGLLAGIVAQSY

SEQ ID NO: 968468 - protein, 21 aa, Mycobacterium
ARLVAARGRLMAGLAAGGAMV

SEQ ID NO: 968469 - protein, 22 aa, Mycobacterium
ARLWLPSYLAWFLGGMLLTVLQ

SEQ ID NO: 968470 - protein, 18 aa, Mycobacterium
ARMSYLMGLTVFGFASLV

SEQ ID NO: 968471 - protein, 20 aa, Mycobacterium
ARNSSLAGLLARTRPLSDGV

SEQ ID NO: 968472 - protein, 21 aa, Mycobacterium
ARPAVMVLGVLTWVNVWNDFL

SEQ ID NO: 968473 - protein, 31 aa, Mycobacterium
ARPFRGYLYWEQHCFNIPVCWASRSVFDAID

SEQ ID NO: 968474 - protein, 21 aa, Mycobacterium
ARPMAFVGAIAFLIFAGWAWR

SEQ ID NO: 968475 - protein, 22 aa, Mycobacterium
ARPRHRVVIIGSGFGGLNAAKK

SEQ ID NO: 968476 - protein, 26 aa, Mycobacterium
ARPSAVWWKVTLPLLMPGLVSGAVLA

SEQ ID NO: 968477 - protein, 20 aa, Mycobacterium
ARPTIHMPLDHDPYQAPEGY

SEQ ID NO: 968478 - protein, 24 aa, Mycobacterium
ARQARRVVTANLFIAGTFISVLVL

SEQ ID NO: 968479 - protein, 22 aa, Mycobacterium
ARQFPQRYGRRIVGAAVISSAA

SEQ ID NO: 968480 - protein, 23 aa, Mycobacterium
ARQLLSLGDIRWIQHRNTECASL

SEQ ID NO: 968481 - protein, 19 aa, Mycobacterium
ARQRLADFQSYARGRIDEI

SEQ ID NO: 968482 - protein, 26 aa, Mycobacterium
ARRAAPRLPPGFRWIAVRPGAAPPHR

SEQ ID NO: 968483 - protein, 26 aa, Mycobacterium
ARRGQLRAGTALIARGEFSLIIIGLV

SEQ ID NO: 968484 - protein, 24 aa, Mycobacterium
ARRVPLIDIRDGLAMNLGRADGPR

SEQ ID NO: 968485 - protein, 19 aa, Mycobacterium
ARSAFRHSVDAVAICSLSG

SEQ ID NO: 968486 - protein, 17 aa, Mycobacterium
ARSANMNTLISLGTLTA

SEQ ID NO: 968487 - protein, 24 aa, Mycobacterium
ARSVTGIAPAGGWTRWSPAKFEVI

SEQ ID NO: 968488 - protein, 23 aa, Mycobacterium
ARTLLRRLLVAAVLFVPLADLST

SEQ ID NO: 968489 - protein, 17 aa, Mycobacterium
ARTLWYLVMVVASVMLS

SEQ ID NO: 968490 - protein, 21 aa, Mycobacterium
ARTRRLTILVGNVVVGALGVV

SEQ ID NO: 968491 - protein, 21 aa, Mycobacterium
ARTVLSSALLFLVAGALLGPG

SEQ ID NO: 968492 - protein, 19 aa, Mycobacterium
ARTVVHWIRISVLILTGLV

SEQ ID NO: 968493 - protein, 21 aa, Mycobacterium
ARVAVSVLFFLYGGKLSLEQA

SEQ ID NO: 968494 - protein, 18 aa, Mycobacterium
ARVDAAGGSLVFLNTPTG

SEQ ID NO: 968495 - protein, 19 aa, Mycobacterium
ARVPVSLAQLLGDANGLRA

SEQ ID NO: 968496 - protein, 17 aa, Mycobacterium
ARVPWGLLALPTAGPTR

SEQ ID NO: 968497 - protein, 32 aa, Mycobacterium; identical to SEQ ID NO: 301275

SEQ ID NO: 968498 - protein, 29 aa, Mycobacterium
ARWIRRLAIPIMLGWLAIIVLINILVPSL

SEQ ID NO: 968499 - protein, 17 aa, Mycobacterium
ARYRPWMPAAGNHENEL

SEQ ID NO: 968500 - protein, 19 aa, Mycobacterium
ASAFLPHGYLGVWSALPFA

SEQ ID NO: 968501 - protein, 25 aa, Mycobacterium
ASAGGRPRCSLLVFSDWVSSTRISS

SEQ ID NO: 968502 - protein, 24 aa, Mycobacterium
ASALSYWSGMVLNDWADRKRDAVE

SEQ ID NO: 968503 - protein, 23 aa, Mycobacterium
ASARRLTHFGALVRIPRSVEALG

SEQ ID NO: 968504 - protein, 19 aa, Mycobacterium
ASDPIAWWTPDLLFSEPDW

SEQ ID NO: 968505 - protein, 30 aa, Mycobacterium; identical to SEQ ID NO: 301353

SEQ ID NO: 968506 - protein, 25 aa, Mycobacterium
ASEYPLWSSFVWRNELADTFVETVA

SEQ ID NO: 968507 - protein, 17 aa, Mycobacterium
ASFTTLLGIPDASRLDV

SEQ ID NO: 968508 - protein, 17 aa, Mycobacterium
ASGRAAARIPWQLADIT

SEQ ID NO: 968509 - protein, 26 aa, Mycobacterium
ASGSFMLCAAFNVLLRAVSGRDTAPA

SEQ ID NO: 968510 - protein, 22 aa, Mycobacterium
ASGTGLLAVWSRQTVAAGQPGP

SEQ ID NO: 968511 - protein, 20 aa, Mycobacterium
ASHPKCFSAAPNFAFELAVR

SEQ ID NO: 968512 - protein, 18 aa, Mycobacterium
ASIIKVLVVMVSIKELNQ

SEQ ID NO: 968513 - protein, 18 aa, Mycobacterium
ASIREIVKEQAIYRREHG

SEQ ID NO: 968514 - protein, 22 aa, Mycobacterium
ASKLMQCVVDGPGYVQSSPTLG

SEQ ID NO: 968515 - protein, 19 aa, Mycobacterium
ASLALYLLFVFTQTVRHRD

SEQ ID NO: 968516 - protein, 18 aa, Mycobacterium
ASLDVLFALIVLGVLTGR

SEQ ID NO: 968517 - protein, 20 aa, Mycobacterium
ASLFAAIIGSISFWGSIIAF

SEQ ID NO: 968518 - protein, 17 aa, Mycobacterium
ASLLADWAQHLDPDLAA

SEQ ID NO: 968519 - protein, 30 aa, Mycobacterium
ASLLFAGGLVPLVGTWGFDQIAWFVPAHWG

SEQ ID NO: 968520 - protein, 24 aa, Mycobacterium
ASLNIIAMIWSRLVLYGTSGTARV

SEQ ID NO: 968521 - protein, 17 aa, Mycobacterium
ASLRSGECDMALAGGVT

SEQ ID NO: 968522 - protein, 18 aa, Mycobacterium
ASLSELDEALTIAFLIIF

SEQ ID NO: 968523 - protein, 23 aa, Mycobacterium
ASLSRALGHPVTVELSWIPVRDP

SEQ ID NO: 968524 - protein, 24 aa, Mycobacterium
ASQRVRLRPILALREAADLLRESL

SEQ ID NO: 968525 - protein, 22 aa, Mycobacterium
ASRSRWQQLRLMMVITGPGLIA

SEQ ID NO: 968526 - protein, 24 aa, Mycobacterium
ASRSRWQQLRLMMVITGPGLIAMI

SEQ ID NO: 968527 - protein, 20 aa, Mycobacterium
ASRTRDEWAAVFAGTDACVT

SEQ ID NO: 968528 - protein, 29 aa, Mycobacterium
ASSRLVKRGGPAAGHRSDPDWKRQREWDH

SEQ ID NO: 968529 - protein, 24 aa, Mycobacterium
ASSSCSYAAVALARSLFRKGANFT

SEQ ID NO: 968530 - protein, 23 aa, Mycobacterium
ASSSRRADRLFKLFASTAGMTIV

SEQ ID NO: 968531 - protein, 22 aa, Mycobacterium
ASSVGPWLPLVFLLVHIVVTVP

SEQ ID NO: 968532 - protein, 18 aa, Mycobacterium
ASTILHGFWVLLFALPFA

SEQ ID NO: 968533 - protein, 18 aa, Mycobacterium
ASTLLNLLQQATAVADRT

SEQ ID NO: 968534 - protein, 18 aa, Mycobacterium
ASVISWVSIVVIYVIVLY

SEQ ID NO: 968535 - protein, 17 aa, Mycobacterium
ASVLRAALMASIALAAM

SEQ ID NO: 968536 - protein, 41 aa, Mycobacterium
ASVNWDRFYPTFALARPRPFLHEITEVMAYRESMRSSSAST

SEQ ID NO: 968537 - protein, 17 aa, Mycobacterium
ASVQAMRDFVLIRLSKA

SEQ ID NO: 968538 - protein, 20 aa, Mycobacterium
ASYLKDDWFRDWGALQRLTP

SEQ ID NO: 968539 - protein, 24 aa, Mycobacterium
ATAFAMGGLLAWARRKPWLSGVLI

SEQ ID NO: 968540 - protein, 18 aa, Mycobacterium
ATAGHAWCCMPKTVVAPV

SEQ ID NO: 968541 - protein, 24 aa, Mycobacterium
ATATHLVSVFAHRARLVFGQLAVA

SEQ ID NO: 968542 - protein, 23 aa, Mycobacterium
ATATHLVSVFAHRARLVLGRLAV

SEQ ID NO: 968543 - protein, 19 aa, Mycobacterium
ATAVVVCYGLWAFERDNYS

SEQ ID NO: 968544 - protein, 21 aa, Mycobacterium
ATDLKRLLGYSTIENMGLVTL

SEQ ID NO: 968545 - protein, 22 aa, Mycobacterium
ATEPRWRVVALPFTALLGPVFF

SEQ ID NO: 968546 - protein, 18 aa, Mycobacterium
ATFAGWTLLAANPVAGMT

SEQ ID NO: 968547 - protein, 22 aa, Mycobacterium
ATFAIGWGLVGFLWATVAGSVS

SEQ ID NO: 968548 - protein, 27 aa, Mycobacterium
ATFCLSFTRLPYFQTLGVPLAIGMVIV

SEQ ID NO: 968549 - protein, 24 aa, Mycobacterium
ATGIALWLPWLIVAGVVFILGSAA

SEQ ID NO: 968550 - protein, 19 aa, Mycobacterium
ATGPGRLGGYIDNNPVPST

SEQ ID NO: 968551 - protein, 17 aa, Mycobacterium
ATINFILVAGVVYFLVV

SEQ ID NO: 968552 - protein, 18 aa, Mycobacterium
ATLAVPSWAVEPVLELGA

SEQ ID NO: 968553 - protein, 19 aa, Mycobacterium
ATLCLIFVVMLAITRSVVA

SEQ ID NO: 968554 - protein, 21 aa, Mycobacterium
ATLGLVCAKFMMALVLLMLPV

SEQ ID NO: 968555 - protein, 18 aa, Mycobacterium
ATLIFGFILMWIMSWLTA

SEQ ID NO: 968556 - protein, 20 aa, Mycobacterium
ATLLLLWSMNRQLKKIPASF

SEQ ID NO: 968557 - protein, 19 aa, Mycobacterium
ATLWWLVALTQLRGVSPPF

SEQ ID NO: 968558 - protein, 24 aa, Mycobacterium
ATMHVGFSIWTLWSVMVLFMPQSV

SEQ ID NO: 968559 - protein, 26 aa, Mycobacterium
ATMRTIRTNMIWAFGYNVAAIPIAAA

SEQ ID NO: 968560 - protein, 25 aa, Mycobacterium
ATNAEMWEALRIAAADGFVAAHPDG

SEQ ID NO: 968561 - protein, 34 aa, Mycobacterium
ATPATLLSWRLWACISWRRFCKRCGLSASEQVTR

SEQ ID NO: 968562 - protein, 31 aa, Mycobacterium; identical to SEQ ID NO: 301733

SEQ ID NO: 968563 - protein, 18 aa, Mycobacterium
ATPGFRFIDHTVIGCSLV

SEQ ID NO: 968564 - protein, 34 aa, Mycobacterium; identical to SEQ ID NO: 301738

SEQ ID NO: 968565 - protein, 23 aa, Mycobacterium
ATPPRTPPPLQFPGNGVQVGHRL

SEQ ID NO: 968566 - protein, 25 aa, Mycobacterium
ATPSSITLSGIWLLIVPSELAKTDP

SEQ ID NO: 968567 - protein, 29 aa, Mycobacterium
ATPYELAATIARRLGLTGALGTVAESVDG

SEQ ID NO: 968568 - protein, 18 aa, Mycobacterium
ATRPRLVRLVVSLVAGFL

SEQ ID NO: 968569 - protein, 22 aa, Mycobacterium
ATRPSTFLWLIAVTGTLLVINH

SEQ ID NO: 968570 - protein, 19 aa, Mycobacterium
ATRWAHLRGSLKDQLGTRI

SEQ ID NO: 968571 - protein, 31 aa, Mycobacterium; identical to SEQ ID NO: 301776

SEQ ID NO: 968572 - protein, 18 aa, Mycobacterium
ATSHGLALFDAALATGQP

SEQ ID NO: 968573 - protein, 18 aa, Mycobacterium
ATSPRPQVHLAIGVGARG

SEQ ID NO: 968574 - protein, 31 aa, Mycobacterium; identical to SEQ ID NO: 301783

SEQ ID NO: 968575 - protein, 21 aa, Mycobacterium
ATTGDCLMWPEGTPEAATIVD

SEQ ID NO: 968576 - protein, 18 aa, Mycobacterium
ATTSWVLGSGVPLVGIIL

SEQ ID NO: 968577 - protein, 24 aa, Mycobacterium
ATTVRGARNYPCQEFPGKRAPTIQ

SEQ ID NO: 968578 - protein, 24 aa, Mycobacterium
ATVAFPMYFLKSFAYAGVATVAFV

SEQ ID NO: 968579 - protein, 17 aa, Mycobacterium
ATVDIRDGLTITVGDPH

SEQ ID NO: 968580 - protein, 18 aa, Mycobacterium
ATVIGLLTILGFSLYDTV

SEQ ID NO: 968581 - protein, 17 aa, Mycobacterium
ATYGFQHVVAFYAGAVV

SEQ ID NO: 968582 - protein, 24 aa, Mycobacterium
AVACLSFTWLPYFHSLGIPQPHWA

SEQ ID NO: 968583 - protein, 26 aa, Mycobacterium
AVADRLKFGAWLLFAGLWATFVYFPV

SEQ ID NO: 968584 - protein, 17 aa, Mycobacterium
AVAGFWWFDGYTLVQQR

SEQ ID NO: 968585 - protein, 17 aa, Mycobacterium
AVAGRFVHMSVRTTVGA

SEQ ID NO: 968586 - protein, 17 aa, Mycobacterium
AVAIYFITFVRRHYGGR

SEQ ID NO: 968587 - protein, 25 aa, Mycobacterium
AVALVLWWRMIRFEYALLVTIATTA

SEQ ID NO: 968588 - protein, 20 aa, Mycobacterium
AVAPNIACLIIFRAVQGGGG

SEQ ID NO: 968589 - protein, 18 aa, Mycobacterium
AVASFPFEHARIRLAYGM

SEQ ID NO: 968590 - protein, 18 aa, Mycobacterium
AVASRSGDIPPGIKVPNP

SEQ ID NO: 968591 - protein, 18 aa, Mycobacterium
AVATRFGLLDPRRMIKVR

SEQ ID NO: 968592 - protein, 24 aa, Mycobacterium
AVAVSFAALVWVFGGLLAAALPVA

SEQ ID NO: 968593 - protein, 22 aa, Mycobacterium
AVDPLRRLAVIAVIAATIASTT

SEQ ID NO: 968594 - protein, 24 aa, Mycobacterium
AVEDRARKGLSILMAPEGTRLDTT

SEQ ID NO: 968595 - protein, 18 aa, Mycobacterium
AVEPMKTFAETRAQLAAL

SEQ ID NO: 968596 - protein, 17 aa, Mycobacterium
AVGAPLGLRSTVTEGIV

SEQ ID NO: 968597 - protein, 17 aa, Mycobacterium
AVGGRGVIWSGVVSKVI

SEQ ID NO: 968598 - protein, 25 aa, Mycobacterium
AVGLLVGGLWAWVAPAVHAVVAVTR

SEQ ID NO: 968599 - protein, 23 aa, Mycobacterium
AVGPAWRLVLRGGPNEVVLDRAA

SEQ ID NO: 968600 - protein, 26 aa, Mycobacterium
AVIAVLLLLWARRSLVAAAVVLLTAG

SEQ ID NO: 968601 - protein, 23 aa, Mycobacterium
AVIAVSIGLRLVFGEMTLTAGLT

SEQ ID NO: 968602 - protein, 19 aa, Mycobacterium
AVICAAAVFSAIVLRDLRI

SEQ ID NO: 968603 - protein, 18 aa, Mycobacterium
AVICSMLSPKAKRVGDIF

SEQ ID NO: 968604 - protein, 17 aa, Mycobacterium
AVIFIMLLLVYRSPLTV

SEQ ID NO: 968605 - protein, 18 aa, Mycobacterium
AVILPWLAPNKFRNSPFI

SEQ ID NO: 968606 - protein, 17 aa, Mycobacterium
AVIPPRTAVILSAALNL

SEQ ID NO: 968607 - protein, 19 aa, Mycobacterium
AVIVGRASLLADWAQHLDP

SEQ ID NO: 968608 - protein, 20 aa, Mycobacterium
AVLAAGLWAGFLWGVDGRLP

SEQ ID NO: 968609 - protein, 22 aa, Mycobacterium
AVLAARFVTWVAKRVTQRLDLG

SEQ ID NO: 968610 - protein, 24 aa, Mycobacterium
AVLAGTAALGWLWKEQRDNEIAGR

SEQ ID NO: 968611 - protein, 22 aa, Mycobacterium
AVLCGAASYIAVPAVQRLAIPE

SEQ ID NO: 968612 - protein, 20 aa, Mycobacterium
AVLGFFAFYLSFVAELPPPP

SEQ ID NO: 968613 - protein, 19 aa, Mycobacterium
AVLSIGLIRVHPLLAVGLN

SEQ ID NO: 968614 - protein, 31 aa, Mycobacterium
AVLTYHIVKPWRWGYLAVLLVIFGFPLLTMD

SEQ ID NO: 968615 - protein, 25 aa, Mycobacterium
AVLYGRVSYEYVPKIILGTSLSGIA

SEQ ID NO: 968616 - protein, 18 aa, Mycobacterium
AVMCCAIVIAAAALCGVI

SEQ ID NO: 968617 - protein, 19 aa, Mycobacterium
AVNKWGPRLPVVTCLAAMV

SEQ ID NO: 968618 - protein, 22 aa, Mycobacterium
AVPDPRIDRSRIKMTMEKVDGR

SEQ ID NO: 968619 - protein, 25 aa, Mycobacterium
AVPLCALCAALGLNIWVGYFPTVQA

SEQ ID NO: 968620 - protein, 23 aa, Mycobacterium
AVRAELFDPLTPMPALGATASAV

SEQ ID NO: 968621 - protein, 24 aa, Mycobacterium
AVRAYPRTASVVIWYSPAHCDTAA

SEQ ID NO: 968622 - protein, 17 aa, Mycobacterium
AVRGFVAQGLMFVNQTA

SEQ ID NO: 968623 - protein, 27 aa, Mycobacterium
AVRRPSIRFCARWCDRCALRLGPCRRV

SEQ ID NO: 968624 - protein, 19 aa, Mycobacterium
AVRSLHAALVVRLATSVAE

SEQ ID NO: 968625 - protein, 23 aa, Mycobacterium
AVRWPDPWPSTFGYHEFFHACTA

SEQ ID NO: 968626 - protein, 24 aa, Mycobacterium
AVSAPKRWNAPAAMACATGSETAP

SEQ ID NO: 968627 - protein, 17 aa, Mycobacterium
AVSHAFHSPLMEPMLEE

SEQ ID NO: 968628 - protein, 21 aa, Mycobacterium
AVSLARAALRILSESSPRHID

SEQ ID NO: 968629 - protein, 19 aa, Mycobacterium
AVSLYLGFRSGTKVFHDTV

SEQ ID NO: 968630 - protein, 20 aa, Mycobacterium
AVSPLPNWLGDSLRAAAAGV

SEQ ID NO: 968631 - protein, 24 aa, Mycobacterium
AVSRALCLAVDPDLLVTVNAMTGG

SEQ ID NO: 968632 - protein, 17 aa, Mycobacterium
AVTFRLGSGATMAGASL

SEQ ID NO: 968633 - protein, 22 aa, Mycobacterium
AVVAFGAVLAWLVAGLAVSESV

SEQ ID NO: 968634 - protein, 35 aa, Mycobacterium; identical to SEQ ID NO: 302251

SEQ ID NO: 968635 - protein, 24 aa, Mycobacterium
AVVLKLLPIPGLDGYDALEPHLSP

SEQ ID NO: 968636 - protein, 19 aa, Mycobacterium
AVVMALGFVLTSQVTNRVF

SEQ ID NO: 968637 - protein, 17 aa, Mycobacterium
AVVMCYGLWAFERDRHS

SEQ ID NO: 968638 - protein, 20 aa, Mycobacterium
AVVPQPGRHDWPFADQVFAR

SEQ ID NO: 968639 - protein, 24 aa, Mycobacterium
AVVSGCSLALFAVLTKAVVEVVGG

SEQ ID NO: 968640 - protein, 29 aa, Mycobacterium
AVVVRRLPGWPIWFAVLWGAQEWLKSIVP

SEQ ID NO: 968641 - protein, 21 aa, Mycobacterium
AVVVVLGWSFFYFSDDTRGYK

SEQ ID NO: 968642 - protein, 29 aa, Mycobacterium
AVVVVVVGVIGWRFFGDVLSNRSQTAAAR

SEQ ID NO: 968643 - protein, 27 aa, Mycobacterium
AVYFGARTGTGFGRDLRAAMFEHVITF

SEQ ID NO: 968644 - protein, 26 aa, Mycobacterium
AWANMFMLGVAFVFALAGAMLAAVFH

SEQ ID NO: 968645 - protein, 19 aa, Mycobacterium
AWFVARVSLLPTLMLTIPY

SEQ ID NO: 968646 - protein, 24 aa, Mycobacterium
AWHEAHPYLPFVFTGSAAASGGGL

SEQ ID NO: 968647 - protein, 22 aa, Mycobacterium
AWPGGWWIDPGIGLVIAGIAVW

SEQ ID NO: 968648 - protein, 18 aa, Mycobacterium
AWPPEVLSSALWSGSGPG

SEQ ID NO: 968649 - protein, 21 aa, Mycobacterium
AWRHVDVFQFFYLVLPLFCGA

SEQ ID NO: 968650 - protein, 23 aa, Mycobacterium
AWRYWRMVVGVVAAVAVLVIGSL

SEQ ID NO: 968651 - protein, 22 aa, Mycobacterium
AWYQDFLRYYFLTVETNIDGSM

SEQ ID NO: 968652 - protein, 25 aa, Mycobacterium
AYAPEEIFLMLSVAGLAAYSMAPWI

SEQ ID NO: 968653 - protein, 24 aa, Mycobacterium
AYDALPRRVVHALDLVNFSLADVR

SEQ ID NO: 968654 - protein, 26 aa, Mycobacterium
AYDIGLFYRYAWQNPIFADIVATRTF

SEQ ID NO: 968655 - protein, 18 aa, Mycobacterium
AYFFCVFIQHVSPGAFAA

SEQ ID NO: 968656 - protein, 20 aa, Mycobacterium
AYFRYRLRSAFLLDTSRFAV

SEQ ID NO: 968657 - protein, 27 aa, Mycobacterium
AYGLGWRPRLLVAMLVATALALVGTNG

SEQ ID NO: 968658 - protein, 26 aa, Mycobacterium
AYHEGGHTLAAWAMPDIDPVYKVTIL

SEQ ID NO: 968659 - protein, 28 aa, Mycobacterium
AYKPLARKGFLSIWSWTFGLVVTEFPLQ

SEQ ID NO: 968660 - protein, 29 aa, Mycobacterium
AYMTYRRGRPLSVRWLLEPVLGRRRVEGV

SEQ ID NO: 968661 - protein, 35 aa, Mycobacterium
AYQALSRQGIYGDFFSFYLCDVVLKLNGRGGQPVY

SEQ ID NO: 968662 - protein, 19 aa, Mycobacterium
AYREFRQNLGRSILIGLGL

SEQ ID NO: 968663 - protein, 25 aa, Mycobacterium
AYSEPRLQPPNGYKDTTVPGIWVPD

SEQ ID NO: 968664 - protein, 18 aa, Mycobacterium
AYVAGWMYFLNWAMTSIV

SEQ ID NO: 968665 - protein, 19 aa, Mycobacterium
CAAAASALFGAWSLARADV

SEQ ID NO: 968666 - protein, 19 aa, Mycobacterium
CAAPHAMEVTGTVNLAEKF

SEQ ID NO: 968667 - protein, 20 aa, Mycobacterium
CAGIALAAAIVVGWLLPARA

SEQ ID NO: 968668 - protein, 25 aa, Mycobacterium
CALAPNILSLIFFRVLQGVGGGMLM

SEQ ID NO: 968669 - protein, 27 aa, Mycobacterium
CALLGDRYGRRRGFFVGLALFVASSVV

SEQ ID NO: 968670 - protein, 20 aa, Mycobacterium
CAPTCVPSALGSPRRPPRAA

SEQ ID NO: 968671 - protein, 17 aa, Mycobacterium
CDISLKINGLQPGGPVR

SEQ ID NO: 968672 - protein, 17 aa, Mycobacterium
CDLEQVIPLMPGAQLTG

SEQ ID NO: 968673 - protein, 18 aa, Mycobacterium
CDMGVGELLSMIQAGLNH

SEQ ID NO: 968674 - protein, 21 aa, Mycobacterium
CDRCALRLGPCRRVAGGERSG

SEQ ID NO: 968675 - protein, 21 aa, Mycobacterium
CEITATALLVVFFRHNLSMNG

SEQ ID NO: 968676 - protein, 25 aa, Mycobacterium
CFLWDEAWYAFATAVPWARQRTAMV

SEQ ID NO: 968677 - protein, 17 aa, Mycobacterium
CFTAPLVQARPDLPEVL

SEQ ID NO: 968678 - protein, 27 aa, Mycobacterium
CGAVRCGAVLFSARWVGPRAAVALAGI

SEQ ID NO: 968679 - protein, 23 aa, Mycobacterium
CGVLLLRVLMRRFWPDAEDPNGS

SEQ ID NO: 968680 - protein, 17 aa, Mycobacterium
CIGASALGVVLLIVDAL

SEQ ID NO: 968681 - protein, 24 aa, Mycobacterium
CILLLEVLFLRWLLDGRVSHQWWA

SEQ ID NO: 968682 - protein, 17 aa, Mycobacterium
CISLSPADAEWYYNTVN

SEQ ID NO: 968683 - protein, 20 aa, Mycobacterium
CIVPGLIFGFLAQFAIIAAV

SEQ ID NO: 968684 - protein, 17 aa, Mycobacterium
CKALREKIGKRKDVKAV

SEQ ID NO: 968685 - protein, 19 aa, Mycobacterium
CLAGLLGAGWAWRRGGRLR

SEQ ID NO: 968686 - protein, 21 aa, Mycobacterium
CLGASAVLISPAWKRAEVDHA

SEQ ID NO: 968687 - protein, 19 aa, Mycobacterium
CLLEGAKYLLDHGGYEAPG

SEQ ID NO: 968688 - protein, 19 aa, Mycobacterium
CLPMLAQIPVFLGLYHVLR

SEQ ID NO: 968689 - protein, 19 aa, Mycobacterium
CLVSVWRSVPFATVVLLAA

SEQ ID NO: 968690 - protein, 25 aa, Mycobacterium
CNFKRSVMTASVWIAWPPEVLSSAL

SEQ ID NO: 968691 - protein, 26 aa, Mycobacterium
CPACQSGDYSLCWSFTDGGIQPGIHT

SEQ ID NO: 968692 - protein, 18 aa, Mycobacterium
CRIPQFELACGYTPEIDW

SEQ ID NO: 968693 - protein, 17 aa, Mycobacterium
CRKTSPQSVMWVADLCD

SEQ ID NO: 968694 - protein, 34 aa, Mycobacterium
CRTLPPGGVPRSWLIQEFACFAYLVGVAVLFGLG

SEQ ID NO: 968695 - protein, 25 aa, Mycobacterium
CSAAAGRAAQPCVVGAAGPAGTPMA

SEQ ID NO: 968696 - protein, 19 aa, Mycobacterium
CSILDRGGTVLIYVLCVAT

SEQ ID NO: 968697 - protein, 20 aa, Mycobacterium
CSLRVPGLYPPQIYNGQLHV

SEQ ID NO: 968698 - protein, 17 aa, Mycobacterium
CSPALCRVVPSACAYAE

SEQ ID NO: 968699 - protein, 18 aa, Mycobacterium
CSPALCRVVPSACAYAES

SEQ ID NO: 968700 - protein, 44 aa, Mycobacterium
CTEVGVLPETDFRLLPKYMDMLNMFDAWEFGRGGGQKIAVIDTG

SEQ ID NO: 968701 - protein, 21 aa, Mycobacterium
CTPLDRVGWAQALGAAAAATA

SEQ ID NO: 968702 - protein, 18 aa, Mycobacterium
CVALLWFLGVYLVVLAFV

SEQ ID NO: 968703 - protein, 24 aa, Mycobacterium
CVFVIAALTAAGWLLAGGSPDRAF

SEQ ID NO: 968704 - protein, 29 aa, Mycobacterium
CVGALAVFCAVCWLIALLARNYRHEDWQA

SEQ ID NO: 968705 - protein, 20 aa, Mycobacterium
CVGLVGGIRVWNRIRERFGL

SEQ ID NO: 968706 - protein, 26 aa, Mycobacterium
CYGGLRMSVSFLRRIAFSGFAFTIVL

SEQ ID NO: 968707 - protein, 24 aa, Mycobacterium
DAALRAAVKIHLLVAERFGQELRI

SEQ ID NO: 968708 - protein, 22 aa, Mycobacterium
DAAMIFGFLLWHVIGANSSDDG

SEQ ID NO: 968709 - protein, 17 aa, Mycobacterium
DADFCRTLPPGGVPRSW

SEQ ID NO: 968710 - protein, 19 aa, Mycobacterium
DADKIAANYPGVWYRAFDL

SEQ ID NO: 968711 - protein, 25 aa, Mycobacterium
DADNLAIRLANRFLRTSQNYNGDRF

SEQ ID NO: 968712 - protein, 27 aa, Mycobacterium
DAERLASLRKRGCAAMRTGMERTSTQD

SEQ ID NO: 968713 - protein, 31 aa, Mycobacterium
DAFDRSPGMRRLKLLEISYGVGVSVNVGDGL

SEQ ID NO: 968714 - protein, 17 aa, Mycobacterium
DAFRRFHTAMFSKDIQP

SEQ ID NO: 968715 - protein, 23 aa, Mycobacterium
DAFRRRFERDSAIAARLYHSHIV

SEQ ID NO: 968716 - protein, 24 aa, Mycobacterium
DAGRPRRAGVSSFGISGTNAHVIL

SEQ ID NO: 968717 - protein, 21 aa, Mycobacterium
DAGTGLSFVPWVISAKSAEAL

SEQ ID NO: 968718 - protein, 18 aa, Mycobacterium
DAIAALQNRGFKTRTLLK

SEQ ID NO: 968719 - protein, 20 aa, Mycobacterium
DALAAFLWMANWRFVAQKTD

SEQ ID NO: 968720 - protein, 38 aa, Mycobacterium
DALGVRTAFRVPFLRNWKVSRAYLNWLADRLQKTKTRE

SEQ ID NO: 968721 - protein, 22 aa, Mycobacterium
DALPVRVGVAVIGAIIVFGLML

SEQ ID NO: 968722 - protein, 30 aa, Mycobacterium
DALSSILWRALERDAAPRSQILVPPTSWHL

SEQ ID NO: 968723 - protein, 31 aa, Mycobacterium
DALSSILWRALERDAAPRSQILVPPTSWHLQ

SEQ ID NO: 968724 - protein, 20 aa, Mycobacterium
DAMFGWLGYMSFWTLDIEYR

SEQ ID NO: 968725 - protein, 24 aa, Mycobacterium
DAPDRVCALLSRVAAALPQLDGGF

SEQ ID NO: 968726 - protein, 25 aa, Mycobacterium
DAPVLRPRALRALDRVDAIMIDPRA

SEQ ID NO: 968727 - protein, 19 aa, Mycobacterium
DAPYACMGGACGTCRAKLI

SEQ ID NO: 968728 - protein, 25 aa, Mycobacterium
DAQSGSIGLGFAIPVDQAKRIADEL

SEQ ID NO: 968729 - protein, 36 aa, Mycobacterium
DARGHRWAVIPGCWVFALGVFLFWLLTTSRADYASR

SEQ ID NO: 968730 - protein, 24 aa, Mycobacterium
DARGRRLAWCPSDFAGVTVVSIEL

SEQ ID NO: 968731 - protein, 23 aa, Mycobacterium
DARHPFLVMELIEGGTLRELLSE

SEQ ID NO: 968732 - protein, 18 aa, Mycobacterium
DARVRLGPRHQHHRRLDP

SEQ ID NO: 968733 - protein, 22 aa, Mycobacterium
DASLRLLVSGGRFIEMGKTDLR

SEQ ID NO: 968734 - protein, 19 aa, Mycobacterium
DASRLDVTTLWAPRRRDDE

SEQ ID NO: 968735 - protein, 24 aa, Mycobacterium
DATMIRMLIIFGIVTVVALVAATT

SEQ ID NO: 968736 - protein, 22 aa, Mycobacterium
DATRAICSRSHLMGEGEAMLFG

SEQ ID NO: 968737 - protein, 18 aa, Mycobacterium
DAVAAWRTGSDTEPVVLR

SEQ ID NO: 968738 - protein, 21 aa, Mycobacterium
DAVACAIPLPPIAKILDDLGV

SEQ ID NO: 968739 - protein, 17 aa, Mycobacterium
DAVGVSGIWDGSTLFAD

SEQ ID NO: 968740 - protein, 22 aa, Mycobacterium
DAVTERLPLVLGLMAAITFVLL

SEQ ID NO: 968741 - protein, 25 aa, Mycobacterium
DAYPGSGGVSLWWMIGLLAAAGVLG

SEQ ID NO: 968742 - protein, 22 aa, Mycobacterium
DCPQTRITGVPGRGPETRTANQ

SEQ ID NO: 968743 - protein, 24 aa, Mycobacterium
DDAAWERLCALLAQPTDEDQFAIR

SEQ ID NO: 968744 - protein, 29 aa, Mycobacterium
DDAFLTWSLCSGFWILMFPFMGELDFYHV

SEQ ID NO: 968745 - protein, 17 aa, Mycobacterium
DDALAALMGEWRDDLRW

SEQ ID NO: 968746 - protein, 19 aa, Mycobacterium
DDALGPWLLLVRDLAHLLD

SEQ ID NO: 968747 - protein, 20 aa, Mycobacterium
DDAYRFAVVLSLPVTVLVAG

SEQ ID NO: 968748 - protein, 20 aa, Mycobacterium
DDGPRTPAMPSTWDGDPAPS

SEQ ID NO: 968749 - protein, 20 aa, Mycobacterium
DDIIAIRLVAMASKTVARSG

SEQ ID NO: 968750 - protein, 21 aa, Mycobacterium
DDKLGAVLRAFSSRLPNQKLP

SEQ ID NO: 968751 - protein, 27 aa, Mycobacterium
DDLIRCSSAALVWGLGRVVALEHPGSW

SEQ ID NO: 968752 - protein, 18 aa, Mycobacterium
DDNAWFFALTDHVSIAEA

SEQ ID NO: 968753 - protein, 28 aa, Mycobacterium
DDPNSLLPRWLSEAGDGSGLLSRVRADP

SEQ ID NO: 968754 - protein, 25 aa, Mycobacterium
DDPYRFPDNLPIIGAKGGPGGKPGC

SEQ ID NO: 968755 - protein, 21 aa, Mycobacterium
DDQRLAPGWHHLADIPGAGRT

SEQ ID NO: 968756 - protein, 23 aa, Mycobacterium
DDTDFLRRVGLEQPVPGAEAETE

SEQ ID NO: 968757 - protein, 23 aa, Mycobacterium
DDVFWSFLEAIIIAAIVMVTHCY

SEQ ID NO: 968758 - protein, 24 aa, Mycobacterium
DDYRRLRVRGQRLLALYFPLVPLI

SEQ ID NO: 968759 - protein, 21 aa, Mycobacterium
DEFQVLYAARRLRPRPMPVTR

SEQ ID NO: 968760 - protein, 18 aa, Mycobacterium
DEGKFRAGADLLMAASNL

SEQ ID NO: 968761 - protein, 25 aa, Mycobacterium
DEISERVYLTRVMQAAAEWTDVLIN

SEQ ID NO: 968762 - protein, 22 aa, Mycobacterium
DELHTIPTLIGLARQARRVVTA

SEQ ID NO: 968763 - protein, 20 aa, Mycobacterium
DELRTNFAHDLAMAVPVVVP

SEQ ID NO: 968764 - protein, 27 aa, Mycobacterium
DEPKPRRRPILLAGRSLAALFAVLALV

SEQ ID NO: 968765 - protein, 21 aa, Mycobacterium
DEPRLRQVLSNLVGNALQHTP

SEQ ID NO: 968766 - protein, 23 aa, Mycobacterium
DERAYPGFVRRVLTSALPSGLVV

SEQ ID NO: 968767 - protein, 34 aa, Mycobacterium
DERDRLALWSRVLPITFTAIGWVALVGGGLLTSF

SEQ ID NO: 968768 - protein, 20 aa, Mycobacterium
DEVEARLALGQPSRQAAAPY

SEQ ID NO: 968769 - protein, 18 aa, Mycobacterium
DEVIAAGAPLGLRSTVTH

SEQ ID NO: 968770 - protein, 24 aa, Mycobacterium
DEWRAEVMPEDKLEVVRDLQDEGY

SEQ ID NO: 968771 - protein, 23 aa, Mycobacterium
DFAPYVVVTGIGWLIMMVTTTPS

SEQ ID NO: 968772 - protein, 22 aa, Mycobacterium
DFFCAVVIVGLLAGVAGLSTTV

SEQ ID NO: 968773 - protein, 37 aa, Mycobacterium
DFFRPIRSYFYWEKHCYDIPVCFALRSIYDALDGIDQ

SEQ ID NO: 968774 - protein, 22 aa, Mycobacterium
DFFSVGWWPVFNVADPSVVGGA

SEQ ID NO: 968775 - protein, 26 aa, Mycobacterium
DFLRRWLPGQLLQGIGVGATLPVLSS

SEQ ID NO: 968776 - protein, 25 aa, Mycobacterium
DGDQTWRLLGVLALADPPRADSAET

SEQ ID NO: 968777 - protein, 25 aa, Mycobacterium
DGKKAVLWTSGWTPRFHGETIYLAR

SEQ ID NO: 968778 - protein, 19 aa, Mycobacterium
DGLLALAGWASVPGTGRVS

SEQ ID NO: 968779 - protein, 18 aa, Mycobacterium
DGLLGWLDGDSARWPGIR

SEQ ID NO: 968780 - protein, 25 aa, Mycobacterium
DGMLPRRLQPLFGRLSARSRVPVHG

SEQ ID NO: 968781 - protein, 25 aa, Mycobacterium
DGPAGYRVALPVAVYSWAFGPGLWN

SEQ ID NO: 968782 - protein, 19 aa, Mycobacterium
DGPAMPMLPATWGPALATV

SEQ ID NO: 968783 - protein, 19 aa, Mycobacterium
DGPMAPTRAIEIIADACQA

SEQ ID NO: 968784 - protein, 23 aa, Mycobacterium
DGPYILVGWSLGGVLAYACAIGL

SEQ ID NO: 968785 - protein, 21 aa, Mycobacterium
DGRSRLMFLIAGYVAGTAAFA

SEQ ID NO: 968786 - protein, 23 aa, Mycobacterium
DGSQTRLATWVAEPGHTATPAGS

SEQ ID NO: 968787 - protein, 18 aa, Mycobacterium
DGVGLSLGQRQRLALARV

SEQ ID NO: 968788 - protein, 23 aa, Mycobacterium
DGVTPPLRWHSGRRVHFDLDPLL

SEQ ID NO: 968789 - protein, 18 aa, Mycobacterium
DGVVLFPGAGFVELALRA

SEQ ID NO: 968790 - protein, 26 aa, Mycobacterium
DHDLWRGEPISVLGLALLTSLALGVG

SEQ ID NO: 968791 - protein, 17 aa, Mycobacterium
DHIRRPVRFADSVASLE

SEQ ID NO: 968792 - protein, 19 aa, Mycobacterium
DHPDFPPRPAGSSTSSQAP

SEQ ID NO: 968793 - protein, 20 aa, Mycobacterium
DHPDQVLGWAGYLRAPDSTS

SEQ ID NO: 968794 - protein, 28 aa, Mycobacterium
DHPILALAVICLSVFVISVDATIVNVAL

SEQ ID NO: 968795 - protein, 22 aa, Mycobacterium
DHRIAHRVRLIWAAHQPHHSSE

SEQ ID NO: 968796 - protein, 20 aa, Mycobacterium
DHRRIEGLIAPGTFNIDPAG

SEQ ID NO: 968797 - protein, 20 aa, Mycobacterium
DIARLRWQFERLARSIPISA

SEQ ID NO: 968798 - protein, 19 aa, Mycobacterium
DIASMPWWAVVGGLVGAVQ

SEQ ID NO: 968799 - protein, 18 aa, Mycobacterium
DIDLPRPVADDFQPDIPA

SEQ ID NO: 968800 - protein, 17 aa, Mycobacterium
DIERRLSAAPAPVAAAF

SEQ ID NO: 968801 - protein, 31 aa, Mycobacterium
DIGSHISGVISFLGIHGSEFSDSGAVKTLNL

SEQ ID NO: 968802 - protein, 19 aa, Mycobacterium
DIIAGHSFPSFKSVKQGVI

SEQ ID NO: 968803 - protein, 20 aa, Mycobacterium
DIIAGHSFPSFKSVKQGVID

SEQ ID NO: 968804 - protein, 18 aa, Mycobacterium
DIMVSGRGLDIWSALPVL

SEQ ID NO: 968805 - protein, 21 aa, Mycobacterium
DINVRPGVLLVLAGDAPADLA

SEQ ID NO: 968806 - protein, 18 aa, Mycobacterium
DIQQFMMRLSRNLRRFRW

SEQ ID NO: 968807 - protein, 24 aa, Mycobacterium
DIVVVFLVTWPLVYLASKSPRLAK

SEQ ID NO: 968808 - protein, 17 aa, Mycobacterium
DKLGPLASDWPLVVADA

SEQ ID NO: 968809 - protein, 21 aa, Mycobacterium
DKLRACPDAKVTVNGYTDNSG

SEQ ID NO: 968810 - protein, 21 aa, Mycobacterium
DKMVRAIWVLRALLREHGRRL

SEQ ID NO: 968811 - protein, 48 aa, Mycobacterium
DKREKAARPNRSWARYLRRGAMPLLLAGALALSAFLDWQQWQQHQVKL

SEQ ID NO: 968812 - protein, 19 aa, Mycobacterium
DLAAFAGFIRRSVELMYFL

SEQ ID NO: 968813 - protein, 25 aa, Mycobacterium
DLESGLWSWLKWLPHVDIPGQADGV

SEQ ID NO: 968814 - protein, 20 aa, Mycobacterium
DLFGIKIHWIVAALSVIILL

SEQ ID NO: 968815 - protein, 19 aa, Mycobacterium
DLFLRIAPELYLKRLCVGG

SEQ ID NO: 968816 - protein, 21 aa, Mycobacterium
DLGAAWRIMHAIPAAKAARRR

SEQ ID NO: 968817 - protein, 21 aa, Mycobacterium
DLGVAFSWSLFNWIADVACLG

SEQ ID NO: 968818 - protein, 26 aa, Mycobacterium
DLIAEFGWGITCFITAVAGLMQILLG

SEQ ID NO: 968819 - protein, 24 aa, Mycobacterium
DLKVGQLLCKFGMKTGRAECGQVT

SEQ ID NO: 968820 - protein, 19 aa, Mycobacterium
DLMAIMTRVTWECEPDDVS

SEQ ID NO: 968821 - protein, 19 aa, Mycobacterium
DLMLYALIMAFSFTTLSTY

SEQ ID NO: 968822 - protein, 18 aa, Mycobacterium
DLNARMSSYFTAHVASSD

SEQ ID NO: 968823 - protein, 24 aa, Mycobacterium
DLPAPRPIAPGLFNAIPEAAPLAA

SEQ ID NO: 968824 - protein, 20 aa, Mycobacterium
DLQGAEQLLVRWQQANDRIN

SEQ ID NO: 968825 - protein, 17 aa, Mycobacterium
DLQRPDAPWGKPRVVYL

SEQ ID NO: 968826 - protein, 23 aa, Mycobacterium
DLWRPIRSYFYWERHGSDIPICW

SEQ ID NO: 968827 - protein, 22 aa, Mycobacterium
DNLRRGGIQFADTRGYAYDRRD

SEQ ID NO: 968828 - protein, 17 aa, Mycobacterium
DPADERRILSYTYRGGW

SEQ ID NO: 968829 - protein, 23 aa, Mycobacterium
DPAGRPVAIRVFAGNTADPAAFT

SEQ ID NO: 968830 - protein, 19 aa, Mycobacterium
DPALDLQVMMMLRQLADAG

SEQ ID NO: 968831 - protein, 17 aa, Mycobacterium
DPALRFASLQTVFQHGR

SEQ ID NO: 968832 - protein, 19 aa, Mycobacterium
DPAVITLIIRKGHTFVPMP

SEQ ID NO: 968833 - protein, 26 aa, Mycobacterium
DPDDRYPRCIDFAKALAAGPGSIAEH

SEQ ID NO: 968834 - protein, 20 aa, Mycobacterium
DPDWSWLKWLPHVQHQTETD

SEQ ID NO: 968835 - protein, 21 aa, Mycobacterium
DPEMRAAVVSIDPHNGAVRAY

SEQ ID NO: 968836 - protein, 26 aa, Mycobacterium
DPGGLRLKMWLFPWLSYATIALMASV

SEQ ID NO: 968837 - protein, 22 aa, Mycobacterium
DPGQTWVLVFAITMMAGLVVSL

SEQ ID NO: 968838 - protein, 21 aa, Mycobacterium
DPKETVSFVAWVVYAAYLHAR

SEQ ID NO: 968839 - protein, 17 aa, Mycobacterium
DPLVDRSRMKITMEKTD

SEQ ID NO: 968840 - protein, 19 aa, Mycobacterium
DPNARMGSYFTAHVASSDP

SEQ ID NO: 968841 - protein, 26 aa, Mycobacterium
DPNSKFTTSMLWSGDRAWRQAGERRM

SEQ ID NO: 968842 - protein, 25 aa, Mycobacterium
DPPAAARWQRFFGFAVAVPAIAAIH

SEQ ID NO: 968843 - protein, 25 aa, Mycobacterium
DPQQRLMLEVSWEALEHAGIDPMSL

SEQ ID NO: 968844 - protein, 26 aa, Mycobacterium
DPQQRMALELTWEALEHARIPPSSLR

SEQ ID NO: 968845 - protein, 21 aa, Mycobacterium
DPSGLVPIALDGKMLRGALRT

SEQ ID NO: 968846 - protein, 26 aa, Mycobacterium
DPVPFPGFKNGVGLVLQLPQPTVVGS

SEQ ID NO: 968847 - protein, 29 aa, Mycobacterium
DQAEWATHGRLGIAILKNLLLATFAVEMA

SEQ ID NO: 968848 - protein, 17 aa, Mycobacterium
DQGRAEAIAGLVMSAGW

SEQ ID NO: 968849 - protein, 19 aa, Mycobacterium
DQHTSYYLVIWVTSAYLLT

SEQ ID NO: 968850 - protein, 23 aa, Mycobacterium
DQKVGINHIALWARSRAEIDRFH

SEQ ID NO: 968851 - protein, 20 aa, Mycobacterium
DQLMLPFSWQGVSLHAAGAA

SEQ ID NO: 968852 - protein, 18 aa, Mycobacterium
DQLSGVRVVRAFTREPFE

SEQ ID NO: 968853 - protein, 19 aa, Mycobacterium
DQPGTFMSGFVERIGDSVA

SEQ ID NO: 968854 - protein, 21 aa, Mycobacterium
DQPLYRYALYQTQGEALANES

SEQ ID NO: 968855 - protein, 19 aa, Mycobacterium
DQRALGAAVRYAAVDKNVV

SEQ ID NO: 968856 - protein, 17 aa, Mycobacterium
DRAAVLEAIGGAKHVAA

SEQ ID NO: 968857 - protein, 23 aa, Mycobacterium
DRAGSETGFFVWLANMVSSHPVN

SEQ ID NO: 968858 - protein, 20 aa, Mycobacterium
DRAVVAIKLNVARTAANAIT

SEQ ID NO: 968859 - protein, 30 aa, Mycobacterium; identical to SEQ ID NO: 303872

SEQ ID NO: 968860 - protein, 25 aa, Mycobacterium
DRDRVAGLLLSRGALDVQTRDEQPS

SEQ ID NO: 968861 - protein, 20 aa, Mycobacterium
DRFGRKRLLMTGLVIFGLVS

SEQ ID NO: 968862 - protein, 25 aa, Mycobacterium
DRFGTKRLWMGSVLAFALGSLLCAL

SEQ ID NO: 968863 - protein, 24 aa, Mycobacterium
DRGEFDGRLWISMDYVDGTDTRHL

SEQ ID NO: 968864 - protein, 19 aa, Mycobacterium
DRLAFSNGIIFLSAAAVGA

SEQ ID NO: 968865 - protein, 19 aa, Mycobacterium
DRLGLIVGSAMGYEPEDLP

SEQ ID NO: 968866 - protein, 21 aa, Mycobacterium
DRLLLPGMVLGAVSFAYVVRL

SEQ ID NO: 968867 - protein, 23 aa, Mycobacterium
DRLLRRVCPGDIVVLDALDLDRI

SEQ ID NO: 968868 - protein, 24 aa, Mycobacterium
DRLPKLCRSYLLAPSRQAREQGWG

SEQ ID NO: 968869 - protein, 19 aa, Mycobacterium
DRLPYVANRVIGFALADPD

SEQ ID NO: 968870 - protein, 18 aa, Mycobacterium
DRLWIRFIPDTEHRSQVI

SEQ ID NO: 968871 - protein, 17 aa, Mycobacterium
DRNAGVLVMNNVPPPSP

SEQ ID NO: 968872 - protein, 29 aa, Mycobacterium
DRPPQILTLRIAPLDVILTVAFLGALLVV

SEQ ID NO: 968873 - protein, 22 aa, Mycobacterium
DRRGRYPSLRRAHRRPAPSPIR

SEQ ID NO: 968874 - protein, 20 aa, Mycobacterium
DRTAAGLIKLAGDGYDDGPR

SEQ ID NO: 968875 - protein, 23 aa, Mycobacterium
DRTLRCFASLFGDDALEPLDYAD

SEQ ID NO: 968876 - protein, 25 aa, Mycobacterium
DRVTGWSMLEVSRFGASSLLTRTTT

SEQ ID NO: 968877 - protein, 22 aa, Mycobacterium
DRWREIMSAVVGVARAGATAAE

SEQ ID NO: 968878 - protein, 24 aa, Mycobacterium
DRYELGDILGFGGMSEVHLARDLR

SEQ ID NO: 968879 - protein, 21 aa, Mycobacterium
DRYWPEHSTIALAVGNLSTNF

SEQ ID NO: 968880 - protein, 23 aa, Mycobacterium
DSAGGYPYPGWEQPGDTVGHFGD

SEQ ID NO: 968881 - protein, 18 aa, Mycobacterium
DSAGMLITAHLMAPIPRP

SEQ ID NO: 968882 - protein, 20 aa, Mycobacterium
DSALLFRRAWAIPAVAIGWL

SEQ ID NO: 968883 - protein, 23 aa, Mycobacterium
DSARRSGNEFLFQQLAQQAIETL

SEQ ID NO: 968884 - protein, 27 aa, Mycobacterium
DSAYKMPGGVVMCWAILGFFVFVIWTL

SEQ ID NO: 968885 - protein, 29 aa, Mycobacterium
DSDETKLPFCWRGVSLHAGGAGRVRARLT

SEQ ID NO: 968886 - protein, 32 aa, Mycobacterium; identical to SEQ ID NO: 304045

SEQ ID NO: 968887 - protein, 18 aa, Mycobacterium
DSLAGWQIDIPTAGDGTG

SEQ ID NO: 968888 - protein, 22 aa, Mycobacterium
DSLRTGIFGVVLVICVVLIAFG

SEQ ID NO: 968889 - protein, 18 aa, Mycobacterium
DSLTAVELRNRFKSATGL

SEQ ID NO: 968890 - protein, 23 aa, Mycobacterium
DSMGRSRLRAPFGNRSDNGELLF

SEQ ID NO: 968891 - protein, 27 aa, Mycobacterium
DTACSSSLVAIHWAMASLRSGECDMAL

SEQ ID NO: 968892 - protein, 17 aa, Mycobacterium
DTALARGAALAAASSPL

SEQ ID NO: 968893 - protein, 19 aa, Mycobacterium
DTARAAFRRPFQFREFLDQ

SEQ ID NO: 968894 - protein, 33 aa, Mycobacterium
DTDAHAPRAPRRWRSRWSRMRVKRVGVGLNQAI

SEQ ID NO: 968895 - protein, 17 aa, Mycobacterium
DTFDCSVSIDGMQKRVT

SEQ ID NO: 968896 - protein, 28 aa, Mycobacterium
DTFDRPTPELALRFAGNRWVAIDQSRNG

SEQ ID NO: 968897 - protein, 19 aa, Mycobacterium
DTGAPQECGSTCGPTGASV

SEQ ID NO: 968898 - protein, 22 aa, Mycobacterium
DTGIDWDVIFLLLGMMIIVSVL

SEQ ID NO: 968899 - protein, 24 aa, Mycobacterium
DTLFRLDHLAARLRRNSANLLVLA

SEQ ID NO: 968900 - protein, 19 aa, Mycobacterium
DTLVPRLTRTSVLIGKSTV

SEQ ID NO: 968901 - protein, 17 aa, Mycobacterium
DTPAMWRYAGMAASALV

SEQ ID NO: 968902 - protein, 26 aa, Mycobacterium
DTPEFPWTGLTISLLIGVLAAAVGTR

SEQ ID NO: 968903 - protein, 25 aa, Mycobacterium
DTSNFAPNMGWRLAFGLGAIFGIFV

SEQ ID NO: 968904 - protein, 26 aa, Mycobacterium
DTTKWGLQIDHFWWTAVWAATLLSIV

SEQ ID NO: 968905 - protein, 24 aa, Mycobacterium
DVARWPELRAVLTEAFGRYDRDHW

SEQ ID NO: 968906 - protein, 18 aa, Mycobacterium
DVDIKLIARTTHHLFQPL

SEQ ID NO: 968907 - protein, 20 aa, Mycobacterium
DVFEPLPGMGRWQTVLLVDG

SEQ ID NO: 968908 - protein, 27 aa, Mycobacterium
DVGSLRPSLSWLWPSGLDFGTQMAPAL

SEQ ID NO: 968909 - protein, 24 aa, Mycobacterium
DVHTPWFWCLLALRAVVFTLVMAA

SEQ ID NO: 968910 - protein, 20 aa, Mycobacterium
DVIHAFWVPEFLFKRDVMPN

SEQ ID NO: 968911 - protein, 18 aa, Mycobacterium
DVKIADFGLVRAVAAAGI

SEQ ID NO: 968912 - protein, 18 aa, Mycobacterium
DVLCDLEQVIPLMPGAQL

SEQ ID NO: 968913 - protein, 18 aa, Mycobacterium
DVLDELSRSMVVDVDNAV

SEQ ID NO: 968914 - protein, 18 aa, Mycobacterium
DVLDWPGNRALEQSMGAL

SEQ ID NO: 968915 - protein, 18 aa, Mycobacterium
DVLHRLRLVDGLRSLPAV

SEQ ID NO: 968916 - protein, 18 aa, Mycobacterium
DVLNAWAMSVLLWDVLIA

SEQ ID NO: 968917 - protein, 18 aa, Mycobacterium
DVLRRIATDFDRSQRAAS

SEQ ID NO: 968918 - protein, 25 aa, Mycobacterium
DVMYCAAAMLVGRFAGPAVEGLGSW

SEQ ID NO: 968919 - protein, 24 aa, Mycobacterium
DVRIPRNRAVVMLVIDVSQSMRAT

SEQ ID NO: 968920 - protein, 18 aa, Mycobacterium
DVRLDRPVALKVMDSRYA

SEQ ID NO: 968921 - protein, 20 aa, Mycobacterium
DVRLETRSAATLPDGPQTDV

SEQ ID NO: 968922 - protein, 28 aa, Mycobacterium
DVSAEAWLVGDLDSGAIIAARDPHGRHR

SEQ ID NO: 968923 - protein, 18 aa, Mycobacterium
DVVGVSFPGGSRWARIDL

SEQ ID NO: 968924 - protein, 25 aa, Mycobacterium
DVVPSRLRRPGAVVLEIDDEDPIFE

SEQ ID NO: 968925 - protein, 26 aa, Mycobacterium
DVYSLGCALFRLLTGRAPYEDLRGPA

SEQ ID NO: 968926 - protein, 19 aa, Mycobacterium
DWVPVTALVVLAGYAGSAG

SEQ ID NO: 968927 - protein, 18 aa, Mycobacterium
DYADYCWGTEQFAPGGPT

SEQ ID NO: 968928 - protein, 17 aa, Mycobacterium
DYARMWIQAATTMSAYQ

SEQ ID NO: 968929 - protein, 21 aa, Mycobacterium
DYGAPAGWRAPGWPPPSERPQ

SEQ ID NO: 968930 - protein, 20 aa, Mycobacterium
DYIFGFSFYDGHYFGAWVFI

SEQ ID NO: 968931 - protein, 24 aa, Mycobacterium
DYLKAHPLIGPWLNKLQAFDVFSS

SEQ ID NO: 968932 - protein, 26 aa, Mycobacterium
DYLSSVEWDTLLFFVGLFIMVGALVK

SEQ ID NO: 968933 - protein, 27 aa, Mycobacterium
DYPSERLIACRNPLLATQRARKRAELL

SEQ ID NO: 968934 - protein, 18 aa, Mycobacterium
DYRGSVLDALASAFHDHG

SEQ ID NO: 968935 - protein, 18 aa, Mycobacterium
DYVRMWIQAAAVMGGYQD

SEQ ID NO: 968936 - protein, 26 aa, Mycobacterium
EAAGRGRWALCLIDGSPLRATQSLTE

SEQ ID NO: 968937 - protein, 18 aa, Mycobacterium
EAASAYFAGGLSLRDATR

SEQ ID NO: 968938 - protein, 25 aa, Mycobacterium
EAATRAMLAAEAWNGRSTWFRHEPR

SEQ ID NO: 968939 - protein, 19 aa, Mycobacterium
EACPPELAERLAVDGRELW

SEQ ID NO: 968940 - protein, 35 aa, Mycobacterium
EAEPKPWYRNPVTLTGWALLVMILIALIVYGIIEL

SEQ ID NO: 968941 - protein, 20 aa, Mycobacterium
EAIQPYLPIAVVAALDAVFG

SEQ ID NO: 968942 - protein, 22 aa, Mycobacterium
EAIRVYRDIGRHALCRARLTNL

SEQ ID NO: 968943 - protein, 18 aa, Mycobacterium
EALAKLQSWLAGDDPGVL

SEQ ID NO: 968944 - protein, 19 aa, Mycobacterium
EAMERGWPVLSFSRPVSLR

SEQ ID NO: 968945 - protein, 21 aa, Mycobacterium
EAMLIPMYFLIGGFGQGRARS

SEQ ID NO: 968946 - protein, 25 aa, Mycobacterium
EAPGLRLAVVFLCTAALVAAVLTGY

SEQ ID NO: 968947 - protein, 18 aa, Mycobacterium
EAPLKFRAPHVTLQIGLG

SEQ ID NO: 968948 - protein, 19 aa, Mycobacterium
EARRRTVVFTNGYDFGYYS

SEQ ID NO: 968949 - protein, 35 aa, Mycobacterium
EASGKRDLWRIKVNLRPVSIILVVLVMISGGIAAW

SEQ ID NO: 968950 - protein, 22 aa, Mycobacterium
EASRRIELHVGRDLQFIRINGT

SEQ ID NO: 968951 - protein, 18 aa, Mycobacterium
EATQCGKDDILAGNDDPK

SEQ ID NO: 968952 - protein, 17 aa, Mycobacterium
EAVQLFGGNGYMAEYRV

SEQ ID NO: 968953 - protein, 17 aa, Mycobacterium
EAVRPVFPLVKAAAAVG

SEQ ID NO: 968954 - protein, 22 aa, Mycobacterium
EAVSVDGVRIGPNVTIRQAGGA

SEQ ID NO: 968955 - protein, 23 aa, Mycobacterium
ECKPVQRPAHRWLVMGQDDQPGR

SEQ ID NO: 968956 - protein, 23 aa, Mycobacterium
EDACAKLAADVQVFARVSPEQKV

SEQ ID NO: 968957 - protein, 21 aa, Mycobacterium
EDDARAVLRDVLIKALQPDMD

SEQ ID NO: 968958 - protein, 31 aa, Mycobacterium; identical to SEQ ID NO: 304552

SEQ ID NO: 968959 - protein, 20 aa, Mycobacterium
EDFTWKGMLDFATCTECGRC

SEQ ID NO: 968960 - protein, 23 aa, Mycobacterium
EDRRIPIPETRHMTLHSDTKIDR

SEQ ID NO: 968961 - protein, 24 aa, Mycobacterium
EDTKEAREALGLGLTPSPTPWVVL

SEQ ID NO: 968962 - protein, 18 aa, Mycobacterium
EEFHSRAADFTKVVEQSK

SEQ ID NO: 968963 - protein, 19 aa, Mycobacterium
EEIGAGLKTGMIRSMASTG

SEQ ID NO: 968964 - protein, 20 aa, Mycobacterium
EEIYSGLAVVQAFGHQTPVR

SEQ ID NO: 968965 - protein, 25 aa, Mycobacterium
EELAFRGVLHGALNRAWGFRGVALA

SEQ ID NO: 968966 - protein, 21 aa, Mycobacterium
EELHSGLLFMCLVSSTMQSAI

SEQ ID NO: 968967 - protein, 18 aa, Mycobacterium
EERMRRFITDASHELRTP

SEQ ID NO: 968968 - protein, 24 aa, Mycobacterium
EESNFPAIVKFLSEKVLSRETDRV

SEQ ID NO: 968969 - protein, 20 aa, Mycobacterium
EFGLSGFIAVSGYAVARRGG

SEQ ID NO: 968970 - protein, 21 aa, Mycobacterium
EFIGVSMALGFLGCPKAVAIP

SEQ ID NO: 968971 - protein, 19 aa, Mycobacterium
EFINVFELIVGIVVLSTYG

SEQ ID NO: 968972 - protein, 24 aa, Mycobacterium
EFVGSPLRYRAGRIGHLLRIEGPP

SEQ ID NO: 968973 - protein, 17 aa, Mycobacterium
EGADWDLLIAGISSLCL

SEQ ID NO: 968974 - protein, 18 aa, Mycobacterium
EGAEFGGGPHGMLIGTTG

SEQ ID NO: 968975 - protein, 19 aa, Mycobacterium
EGAEFGGGPHGMLIGTTGS

SEQ ID NO: 968976 - protein, 22 aa, Mycobacterium
EGAEGWECQRVMSVANNVIVDI

SEQ ID NO: 968977 - protein, 19 aa, Mycobacterium
EGALGRLVVELEDGADSDT

SEQ ID NO: 968978 - protein, 22 aa, Mycobacterium
EGALLVGVFFWFAVVGGATLVM

SEQ ID NO: 968979 - protein, 20 aa, Mycobacterium
EGAPDDGLWVRTGDYGTYFK

SEQ ID NO: 968980 - protein, 20 aa, Mycobacterium
EGDIAPPTRVVLRRQRNAQV

SEQ ID NO: 968981 - protein, 19 aa, Mycobacterium
EGDTCARVTAIGQHTRLAG

SEQ ID NO: 968982 - protein, 25 aa, Mycobacterium
EGEAMLFGEYIRLMALVEYSADEIK

SEQ ID NO: 968983 - protein, 26 aa, Mycobacterium
EGFTRLWPTVICLTIYGFSFAMLAMS

SEQ ID NO: 968984 - protein, 21 aa, Mycobacterium
EGKVGIAPGDIGFVVVVVVVV

SEQ ID NO: 968985 - protein, 23 aa, Mycobacterium
EGLSYRFPFHTEKKSYPYFDPIA

SEQ ID NO: 968986 - protein, 20 aa, Mycobacterium
EGPWLRTGDLGVMSNGELFI

SEQ ID NO: 968987 - protein, 25 aa, Mycobacterium
EGPYALPSMELLVAGDPPKKRSAAN

SEQ ID NO: 968988 - protein, 20 aa, Mycobacterium
EGQPRILLKGFGIAAPHGAP

SEQ ID NO: 968989 - protein, 20 aa, Mycobacterium
EGRFGTHLLTIVLLAGLLWL

SEQ ID NO: 968990 - protein, 23 aa, Mycobacterium
EGRSLRWAVGYVLKIRTNVALMV

SEQ ID NO: 968991 - protein, 20 aa, Mycobacterium
EGSWQPPSYPAADYQQYQQP

SEQ ID NO: 968992 - protein, 17 aa, Mycobacterium
EGTRFQFTLPVAAPATA

SEQ ID NO: 968993 - protein, 26 aa, Mycobacterium
EGVFVVGCGVDIVALKPVLEAATSLV

SEQ ID NO: 968994 - protein, 17 aa, Mycobacterium
EGVHFGYLIAASFMGFI

SEQ ID NO: 968995 - protein, 24 aa, Mycobacterium
EGVYKGLFYGGGFDQLVRQAVGAS

SEQ ID NO: 968996 - protein, 19 aa, Mycobacterium
EGYPAVIWLLLGGNLVVRA

SEQ ID NO: 968997 - protein, 25 aa, Mycobacterium
EGYPVKASARFGLYYTPSSALYYDT

SEQ ID NO: 968998 - protein, 17 aa, Mycobacterium
EHARTLLRRLLVAAVLF

SEQ ID NO: 968999 - protein, 22 aa, Mycobacterium
EHEAMAAAYCAALAAMPTMGEL

SEQ ID NO: 969000 - protein, 25 aa, Mycobacterium
EHIGFTVWMLWSIVVVQMMAVGAPG

SEQ ID NO: 969001 - protein, 21 aa, Mycobacterium
EIAFSFKRTRKVTVNTESSDD

SEQ ID NO: 969002 - protein, 21 aa, Mycobacterium
EIALPPGYLPIRVPIEVNFTQ

SEQ ID NO: 969003 - protein, 20 aa, Mycobacterium
EIDGQLYLDMRLIERTHLAL

SEQ ID NO: 969004 - protein, 20 aa, Mycobacterium
EIDGQMFLEMRLIEGTDLDS

SEQ ID NO: 969005 - protein, 20 aa, Mycobacterium
EIDGQMYLEMRLIEGTNLDS

SEQ ID NO: 969006 - protein, 18 aa, Mycobacterium
EIGVPIFFVLSGFLLFRP

SEQ ID NO: 969007 - protein, 20 aa, Mycobacterium
EIIVVPVLLALMLSALLVPV

SEQ ID NO: 969008 - protein, 32 aa, Mycobacterium
EIPCVCALLTLLPDNLWWLVTVDAMHTQVVTA

SEQ ID NO: 969009 - protein, 30 aa, Mycobacterium
EIPCVCALLTLLPGNLRWLVTVDAMHTQVV

SEQ ID NO: 969010 - protein, 19 aa, Mycobacterium
EIPCVRALLTLLPDNLRRL

SEQ ID NO: 969011 - protein, 23 aa, Mycobacterium
EIPCVRALLTLLPDSLRWLVTVD

SEQ ID NO: 969012 - protein, 19 aa, Mycobacterium
EIPCVRALLTLLPGSLRWL

SEQ ID NO: 969013 - protein, 23 aa, Mycobacterium
EIPCVRALLTLLPGSLRWLVIVD

SEQ ID NO: 969014 - protein, 22 aa, Mycobacterium
EIPCVRALLTLLPGSLRWLVTV

SEQ ID NO: 969015 - protein, 23 aa, Mycobacterium
EIPCVRALLTLLSGSLRWLVTVD

SEQ ID NO: 969016 - protein, 20 aa, Mycobacterium
EIPCVRALLTLPPDNLRWLV

SEQ ID NO: 969017 - protein, 22 aa, Mycobacterium
EIPCVRALLTLPPGSLRWLVTV

SEQ ID NO: 969018 - protein, 24 aa, Mycobacterium
EIPGCLVALYLVARLRHRGMDEAG

SEQ ID NO: 969019 - protein, 27 aa, Mycobacterium
EIRHQRRWNLDLGFRAGGPDERVRAAH

SEQ ID NO: 969020 - protein, 20 aa, Mycobacterium
EISGRVVVFARAFEFEEMGE

SEQ ID NO: 969021 - protein, 18 aa, Mycobacterium
EIVDRLVAVVGEHRTAVP

SEQ ID NO: 969022 - protein, 18 aa, Mycobacterium
EKANEILIQIARAEPATG

SEQ ID NO: 969023 - protein, 25 aa, Mycobacterium
EKHCYDIANCWTFRSLFDALDGLDQ

SEQ ID NO: 969024 - protein, 19 aa, Mycobacterium
EKLAFGIRDLFMVTMLSSI

SEQ ID NO: 969025 - protein, 24 aa, Mycobacterium
EKLRVRMWFFPWLPILTVVGIFVV

SEQ ID NO: 969026 - protein, 19 aa, Mycobacterium
EKVGRGFEYADLEPDTDHD

SEQ ID NO: 969027 - protein, 25 aa, Mycobacterium
EKYGPWTVILARFVPFARTFVPVIA

SEQ ID NO: 969028 - protein, 22 aa, Mycobacterium
ELAETMQAFAIIFGVPVWGFAM

SEQ ID NO: 969029 - protein, 22 aa, Mycobacterium
ELARSRVLRMPFYRTLISVGSW

SEQ ID NO: 969030 - protein, 21 aa, Mycobacterium
ELDEALTIAFLIIFTVLVLVG

SEQ ID NO: 969031 - protein, 23 aa, Mycobacterium
ELDSWRYQVTWLSSPATPSSITL

SEQ ID NO: 969032 - protein, 22 aa, Mycobacterium
ELDWPSAESTYLLSAHALALAP

SEQ ID NO: 969033 - protein, 19 aa, Mycobacterium
ELESCLRTRESLFGEQGID

SEQ ID NO: 969034 - protein, 18 aa, Mycobacterium
ELGADTAQLQWIVDAYTL

SEQ ID NO: 969035 - protein, 24 aa, Mycobacterium
ELGCGPGRLVARLVQRGIPALGID

SEQ ID NO: 969036 - protein, 39 aa, Mycobacterium
ELGQCGKLGVRDVLFGGRVSYLALVILVFIALALGAIGG

SEQ ID NO: 969037 - protein, 20 aa, Mycobacterium
ELGVTMLRLAVIRRGVIPAS

SEQ ID NO: 969038 - protein, 19 aa, Mycobacterium
ELIGSEFLDVLASVPDSRD

SEQ ID NO: 969039 - protein, 25 aa, Mycobacterium
ELMPARLRRTWLGALLARLARPAGL

SEQ ID NO: 969040 - protein, 25 aa, Mycobacterium
ELNRAAFELAAFAAFGSAASATEWW

SEQ ID NO: 969041 - protein, 25 aa, Mycobacterium
ELNVPEFPWTVLTIVLLIGVLVAAI

SEQ ID NO: 969042 - protein, 19 aa, Mycobacterium
ELQPIIQRLMRIHVTEEAR

SEQ ID NO: 969043 - protein, 18 aa, Mycobacterium
ELRNRLKSSTGLTLSPTL

SEQ ID NO: 969044 - protein, 19 aa, Mycobacterium
ELRRSATRFLFEFADDLQH

SEQ ID NO: 969045 - protein, 21 aa, Mycobacterium
ELSLQPGIYAVHWYAGEQSNP

SEQ ID NO: 969046 - protein, 40 aa, Mycobacterium
ELTFGAQVRLILRRQVRVFLASRLYFVFLTLLPFALDALT

SEQ ID NO: 969047 - protein, 25 aa, Mycobacterium
ELVDALGGVRMCLTEPIGDPLAGID

SEQ ID NO: 969048 - protein, 19 aa, Mycobacterium
EMAGGFVLALLVVYGNYLR

SEQ ID NO: 969049 - protein, 35 aa, Mycobacterium
EMDKIDGLYYFFGVLARLAALPSLTPILLPDTGRT

SEQ ID NO: 969050 - protein, 20 aa, Mycobacterium
EMFVPVALFLSHGGWPTTAA

SEQ ID NO: 969051 - protein, 18 aa, Mycobacterium
EMPVDALGLGLVLGLTMG

SEQ ID NO: 969052 - protein, 20 aa, Mycobacterium
EMTGRWPWRQPTVSPETTAA

SEQ ID NO: 969053 - protein, 25 aa, Mycobacterium
ENFSIPVIGHWDALGFLQDFFATAV

SEQ ID NO: 969054 - protein, 19 aa, Mycobacterium
ENLRGKWRVSPGVAATGHF

SEQ ID NO: 969055 - protein, 17 aa, Mycobacterium
ENRGWVFTGRISPRTQP

SEQ ID NO: 969056 - protein, 24 aa, Mycobacterium
EPATSRPALVFVIAVLSGSVALMA

SEQ ID NO: 969057 - protein, 22 aa, Mycobacterium
EPDYRFTLANERTFLAWQRTAL

SEQ ID NO: 969058 - protein, 24 aa, Mycobacterium
EPEPRWPKSEPITRTKAGPERSEY

SEQ ID NO: 969059 - protein, 26 aa, Mycobacterium
EPETRLRKDLTWRDLVVFGVSVVIGA

SEQ ID NO: 969060 - protein, 30 aa, Mycobacterium
EPGAAPRWPWVVGVAAILAAISLVVSVSLL

SEQ ID NO: 969061 - protein, 20 aa, Mycobacterium
EPGFPGWQVLEILPQSWSSD

SEQ ID NO: 969062 - protein, 25 aa, Mycobacterium
EPGRSLWWSWAWIAGMIGYAGDVAR

SEQ ID NO: 969063 - protein, 18 aa, Mycobacterium
EPKKRSALWEFAILAVIA

SEQ ID NO: 969064 - protein, 19 aa, Mycobacterium
EPKKRSALWEFAILAVIAI

SEQ ID NO: 969065 - protein, 21 aa, Mycobacterium
EPLGFGMSVVRQLAHIVDAVI

SEQ ID NO: 969066 - protein, 20 aa, Mycobacterium
EPMLEEFARIAAQVEAREPQ

SEQ ID NO: 969067 - protein, 18 aa, Mycobacterium
EPPGPYPSARGRFDDDVT

SEQ ID NO: 969068 - protein, 25 aa, Mycobacterium
EPPLWRPVAADGQWLPPGAPGSHWV

SEQ ID NO: 969069 - protein, 19 aa, Mycobacterium
EPPYKIAGIALFLVGLLIL

SEQ ID NO: 969070 - protein, 21 aa, Mycobacterium
EPRAPKLWLPPLDESIQLTAI

SEQ ID NO: 969071 - protein, 22 aa, Mycobacterium
EPRRLSPRVVVAPFDPAVGAAL

SEQ ID NO: 969072 - protein, 23 aa, Mycobacterium
EPTLHGCSGCVGDRIMVDKITYR

SEQ ID NO: 969073 - protein, 24 aa, Mycobacterium
EPTLHGCSGCVGDRIMVDKITYRF

SEQ ID NO: 969074 - protein, 18 aa, Mycobacterium
EPVYRSVLIVYFVVMSCF

SEQ ID NO: 969075 - protein, 67 aa, Mycobacterium
EQARSGIRFWSRRAWLAWPLGLLASGLTMFFGAYPWAGWLAFAATIPVQFIAGWPFLVGAVQQARAR

SEQ ID NO: 969076 - protein, 24 aa, Mycobacterium
EQAVGLSAWAYLSAKVSVFCAFAV

SEQ ID NO: 969077 - protein, 29 aa, Mycobacterium
EQDSVFGVFCRRWGVPLIDGGTVRLPRLI

SEQ ID NO: 969078 - protein, 22 aa, Mycobacterium
EQHRATLICFGATLAAVVSTLL

SEQ ID NO: 969079 - protein, 20 aa, Mycobacterium
EQIMPLLVVAVMSQLVFSGG

SEQ ID NO: 969080 - protein, 29 aa, Mycobacterium
EQLPGPAWLRRLWLAVIIVAPASLWLEPI

SEQ ID NO: 969081 - protein, 34 aa, Mycobacterium; identical to SEQ ID NO: 305285

SEQ ID NO: 969082 - protein, 22 aa, Mycobacterium
EQRPRAWRMRITVQQVGDEAKV

SEQ ID NO: 969083 - protein, 29 aa, Mycobacterium
EQTRKRFGDTMGYRMVIYPEYAVLDRKDP

SEQ ID NO: 969084 - protein, 24 aa, Mycobacterium
EQVYFGPNFANFVAVTGNNPAAQT

SEQ ID NO: 969085 - protein, 21 aa, Mycobacterium
ERDSPTWSPRFVDHMVGDRIH

SEQ ID NO: 969086 - protein, 23 aa, Mycobacterium
ERFGRGWAWLSAFTLFASAIGAL

SEQ ID NO: 969087 - protein, 28 aa, Mycobacterium
ERGAGLPRWRYLVLPVIGAAVDIYLLAH

SEQ ID NO: 969088 - protein, 25 aa, Mycobacterium
ERGEPWPQPMPEPAFKQAIAQATQA

SEQ ID NO: 969089 - protein, 24 aa, Mycobacterium
ERHFSRSRLEPELLMIETDHDLRN

SEQ ID NO: 969090 - protein, 31 aa, Mycobacterium
ERHTLGLIFVCCYIALVATNFAWLFPVLTGL

SEQ ID NO: 969091 - protein, 21 aa, Mycobacterium
ERLAISVSRRSWWQERLMLWA

SEQ ID NO: 969092 - protein, 17 aa, Mycobacterium
ERLCVPIGATADGSPVL

SEQ ID NO: 969093 - protein, 18 aa, Mycobacterium
ERMPLLGKIAVWLTGAAW

SEQ ID NO: 969094 - protein, 22 aa, Mycobacterium
ERPGAQIVGWGWLALSVVGVPW

SEQ ID NO: 969095 - protein, 17 aa, Mycobacterium
ERQMVFERFSRGSTASH

SEQ ID NO: 969096 - protein, 23 aa, Mycobacterium
ERQWRARMAGLRTNALVATGATL

SEQ ID NO: 969097 - protein, 19 aa, Mycobacterium
ERRAQPGARARLFGMTEAF

SEQ ID NO: 969098 - protein, 21 aa, Mycobacterium
ERRILSYTYRGGWGDPTGSAR

SEQ ID NO: 969099 - protein, 24 aa, Mycobacterium
ERTIPRAIVLIALIGGAIFVTVAY

SEQ ID NO: 969100 - protein, 24 aa, Mycobacterium
ERTSGLLSRLWVLPVHRMSGLMAR

SEQ ID NO: 969101 - protein, 19 aa, Mycobacterium
ERVGRVCAMVGDGSNDAAA

SEQ ID NO: 969102 - protein, 23 aa, Mycobacterium
ERYMTISAIAAMIFDLTVTAGVY

SEQ ID NO: 969103 - protein, 21 aa, Mycobacterium
ERYPTCSDFAAALAGQHPLAP

SEQ ID NO: 969104 - protein, 25 aa, Mycobacterium
ESAELCAQYLAPVLDAIKFNYFPFG

SEQ ID NO: 969105 - protein, 24 aa, Mycobacterium
ESALKYFLLGAFSSAVFLYGVALL

SEQ ID NO: 969106 - protein, 37 aa, Mycobacterium
ESERSRRGLLRRPKLSTLTAALAVLVILAALAGSAYM

SEQ ID NO: 969107 - protein, 20 aa, Mycobacterium
ESKRRMGVMLATGLIVGESL

SEQ ID NO: 969108 - protein, 22 aa, Mycobacterium
ESLDGPNAIAIVYTNTTTTSPL

SEQ ID NO: 969109 - protein, 23 aa, Mycobacterium
ESPIPRWLRFVLASDRAGSAWYI

SEQ ID NO: 969110 - protein, 21 aa, Mycobacterium
ESRTRFELSQTWQVLTATARN

SEQ ID NO: 969111 - protein, 22 aa, Mycobacterium
ESSDWSWLKWLPHVDIPGQLDG

SEQ ID NO: 969112 - protein, 31 aa, Mycobacterium
ESSSALLQWGWRVPFLLSALLIAFALYVRLE

SEQ ID NO: 969113 - protein, 22 aa, Mycobacterium
ESTDILQRWTRGVMSTVGEVPA

SEQ ID NO: 969114 - protein, 20 aa, Mycobacterium
ESVAVLRAAARLSTSGIPVD

SEQ ID NO: 969115 - protein, 18 aa, Mycobacterium
ESVDLLLTSRRGMAADGA

SEQ ID NO: 969116 - protein, 25 aa, Mycobacterium
ESVQKAIPILGEFVTNSVVTHPADG

SEQ ID NO: 969117 - protein, 17 aa, Mycobacterium
ESVRMLAPIPGKSAVGI

SEQ ID NO: 969118 - protein, 23 aa, Mycobacterium
ESYTSTYLRFVWTLSATAVVMCY

SEQ ID NO: 969119 - protein, 24 aa, Mycobacterium
ESYTSTYLRFVWTLSATAVVMCYG

SEQ ID NO: 969120 - protein, 23 aa, Mycobacterium
ESYTSTYLRFVWTLSATAVVVCY

SEQ ID NO: 969121 - protein, 23 aa, Mycobacterium
ETAARCFDGFTGYELLEPAHDGG

SEQ ID NO: 969122 - protein, 20 aa, Mycobacterium
ETAKGYGAVVYWIAGGCGAL

SEQ ID NO: 969123 - protein, 26 aa, Mycobacterium
ETATALVWFPLWFVILGIGWALVRRR

SEQ ID NO: 969124 - protein, 17 aa, Mycobacterium
ETDPVIIVGPFVLFDML

SEQ ID NO: 969125 - protein, 18 aa, Mycobacterium
ETFRNFRAGYGATIATMM

SEQ ID NO: 969126 - protein, 19 aa, Mycobacterium
ETFWEFLPRTVFGSLRSAI

SEQ ID NO: 969127 - protein, 21 aa, Mycobacterium
ETGYRLRVRMTPTEGQYKISK

SEQ ID NO: 969128 - protein, 19 aa, Mycobacterium
ETHGYPFALAVTIVPVLTV

SEQ ID NO: 969129 - protein, 19 aa, Mycobacterium
ETLDEVWLSDAPEVGATVL

SEQ ID NO: 969130 - protein, 20 aa, Mycobacterium
ETLTPLPIKTFDVRLARQAY

SEQ ID NO: 969131 - protein, 23 aa, Mycobacterium
ETNLRTAYQKALASNEIDFVWIT

SEQ ID NO: 969132 - protein, 21 aa, Mycobacterium
ETPVWRLVLPFAAMGAGMAFV

SEQ ID NO: 969133 - protein, 18 aa, Mycobacterium
ETRLPLIIQNSHRYFFYV

SEQ ID NO: 969134 - protein, 20 aa, Mycobacterium
EVAAARWLYTVFTVLAAVGF

SEQ ID NO: 969135 - protein, 24 aa, Mycobacterium
EVACSIGATLSNGGWATLVNSAKG

SEQ ID NO: 969136 - protein, 19 aa, Mycobacterium
EVAFLVAMVMARPQLDQLL

SEQ ID NO: 969137 - protein, 29 aa, Mycobacterium
EVALFALLRFWGVVPDYVIGHSVGELAAA

SEQ ID NO: 969138 - protein, 19 aa, Mycobacterium
EVAVFVFFGLVTVLGTQYT

SEQ ID NO: 969139 - protein, 33 aa, Mycobacterium
EVAYLGVTVAFLFWEFFIPLLLSLLQGLLGLIG

SEQ ID NO: 969140 - protein, 19 aa, Mycobacterium
EVDAKPKPAIDAGRSTWYT

SEQ ID NO: 969141 - protein, 18 aa, Mycobacterium
EVETFTGRGLRVLAVAAA

SEQ ID NO: 969142 - protein, 26 aa, Mycobacterium
EVFGQRRLLRWSIPGIAHFFTMWGFF

SEQ ID NO: 969143 - protein, 34 aa, Mycobacterium
EVGGRALLFAGILPPTWLAGTAMLGLSKILDNME

SEQ ID NO: 969144 - protein, 25 aa, Mycobacterium
EVLADRTAVIFTRRRSMLSLADRVA

SEQ ID NO: 969145 - protein, 20 aa, Mycobacterium
EVLDYPAYGWPAVAPPQPPV

SEQ ID NO: 969146 - protein, 19 aa, Mycobacterium
EVLKCGAQVVLPADADGHA

SEQ ID NO: 969147 - protein, 18 aa, Mycobacterium
EVLPRDVIEREPDPESAP

SEQ ID NO: 969148 - protein, 25 aa, Mycobacterium
EVPEYGFWAWLAMLFSAGMGIGLVF

SEQ ID NO: 969149 - protein, 23 aa, Mycobacterium
EVPSARWGWSRINYRTWHITGAC

SEQ ID NO: 969150 - protein, 22 aa, Mycobacterium
EVQEICELYGIPYNRGPLLRQF

SEQ ID NO: 969151 - protein, 22 aa, Mycobacterium
EVVGRRKLWYGISGAIMAIAIL

SEQ ID NO: 969152 - protein, 19 aa, Mycobacterium
EVVIICLAAGLAIGTGGLG

SEQ ID NO: 969153 - protein, 17 aa, Mycobacterium
EWNEAWRSDQFVLDATR

SEQ ID NO: 969154 - protein, 20 aa, Mycobacterium
EYFLLCPMLIVFGIAVVGVL

SEQ ID NO: 969155 - protein, 22 aa, Mycobacterium
EYGSGRLARLTTFMVDVLAGVP

SEQ ID NO: 969156 - protein, 18 aa, Mycobacterium
EYQRAAVAVGRIRSLLNT

SEQ ID NO: 969157 - protein, 22 aa, Mycobacterium
EYSIGAFFVLYGLLVFGLAAIP

SEQ ID NO: 969158 - protein, 19 aa, Mycobacterium
FAAFPGWYATVFSTLYLPL

SEQ ID NO: 969159 - protein, 17 aa, Mycobacterium
FAAGRLYTTLSVADAAA

SEQ ID NO: 969160 - protein, 25 aa, Mycobacterium
FAALQRWGLQPDFVMGHSVGELSAA

SEQ ID NO: 969161 - protein, 27 aa, Mycobacterium
FAAPLLGVLCSIYWQRPVPTVHVHAEP

SEQ ID NO: 969162 - protein, 24 aa, Mycobacterium
FACYIGAAILTWVRYVRPTETAAG

SEQ ID NO: 969163 - protein, 23 aa, Mycobacterium
FADVGAAPAWRNLRATLSAIPDS

SEQ ID NO: 969164 - protein, 22 aa, Mycobacterium
FADWLENLWILNVIVFVAGLTY

SEQ ID NO: 969165 - protein, 18 aa, Mycobacterium
FAFFCIATVFWTYRSFAT

SEQ ID NO: 969166 - protein, 25 aa, Mycobacterium
FAFFGWHWSLPLGVAILLAAVGGGL

SEQ ID NO: 969167 - protein, 26 aa, Mycobacterium
FAGLVGGIVWNLLTWLLGIPSSSSHA

SEQ ID NO: 969168 - protein, 17 aa, Mycobacterium
FAGNRLGLVHIGDSRGY

SEQ ID NO: 969169 - protein, 19 aa, Mycobacterium
FAGPLMLAAAFSRRPRDLG

SEQ ID NO: 969170 - protein, 19 aa, Mycobacterium
FAGYVIQRLLGTGGMGEVY

SEQ ID NO: 969171 - protein, 17 aa, Mycobacterium
FAHVPRIGRDFTAVPLL

SEQ ID NO: 969172 - protein, 18 aa, Mycobacterium
FAIFHLLVWGTFTILLTA

SEQ ID NO: 969173 - protein, 24 aa, Mycobacterium
FAIRPSGVFLRRLIHAPATTTSKS

SEQ ID NO: 969174 - protein, 24 aa, Mycobacterium
FAISRGVLHYCERLATHDIALRAA

SEQ ID NO: 969175 - protein, 18 aa, Mycobacterium
FALCGWSESIAVDLAGSG

SEQ ID NO: 969176 - protein, 25 aa, Mycobacterium
FALDVGSLLSWMLYVGLLITVADVL

SEQ ID NO: 969177 - protein, 18 aa, Mycobacterium
FALLTVVSSFVLAELSDK

SEQ ID NO: 969178 - protein, 28 aa, Mycobacterium
FALNLKLLVPVFRWQRRDNLVAAADPSA

SEQ ID NO: 969179 - protein, 17 aa, Mycobacterium
FALSGFLLWRGHAAAAR

SEQ ID NO: 969180 - protein, 18 aa, Mycobacterium
FAPLRRRATAALATAGAR

SEQ ID NO: 969181 - protein, 19 aa, Mycobacterium
FARGLRARLLGKMSGLPLG

SEQ ID NO: 969182 - protein, 17 aa, Mycobacterium
FARRPLIASGYGMAALG

SEQ ID NO: 969183 - protein, 23 aa, Mycobacterium
FASHSQRFWFWLSVATLTLNIVL

SEQ ID NO: 969184 - protein, 21 aa, Mycobacterium
FASISDWFLVATIPLAVMNLP

SEQ ID NO: 969185 - protein, 24 aa, Mycobacterium
FASLRRLTACFAVLAVCATLATTT

SEQ ID NO: 969186 - protein, 30 aa, Mycobacterium; identical to SEQ ID NO: 305988

SEQ ID NO: 969187 - protein, 27 aa, Mycobacterium
FATASPGKWDTLRAMGFDDDHIANSRT

SEQ ID NO: 969188 - protein, 19 aa, Mycobacterium
FAVGVVRLGQRQCLVQELP

SEQ ID NO: 969189 - protein, 19 aa, Mycobacterium
FAVVLSLPVTVLVAGFGVW

SEQ ID NO: 969190 - protein, 22 aa, Mycobacterium
FCAVLALPVVPIFAYSRTAAML

SEQ ID NO: 969191 - protein, 26 aa, Mycobacterium
FCNSPFCWIGGFAFGLLATLLAGSTL

SEQ ID NO: 969192 - protein, 19 aa, Mycobacterium
FCQVCGTATAALARHPAPD

SEQ ID NO: 969193 - protein, 18 aa, Mycobacterium
FDGLLARNYGMATEFGAF

SEQ ID NO: 969194 - protein, 20 aa, Mycobacterium
FDIPICASLRSLFDAIDGVD

SEQ ID NO: 969195 - protein, 26 aa, Mycobacterium
FDKVSFGYRPGVPVIRDVSLQLRPGT

SEQ ID NO: 969196 - protein, 19 aa, Mycobacterium
FDLGICLVLITLPTLALFV

SEQ ID NO: 969197 - protein, 18 aa, Mycobacterium
FDLIWEFLQDPIGNTIKI

SEQ ID NO: 969198 - protein, 23 aa, Mycobacterium
FDLLKRYHKGLEQVLVFLPQGAS

SEQ ID NO: 969199 - protein, 20 aa, Mycobacterium
FDLSSSWMTGQCCDLAARGY

SEQ ID NO: 969200 - protein, 17 aa, Mycobacterium
FDNPDFQRGLKLFLSSD

SEQ ID NO: 969201 - protein, 35 aa, Mycobacterium; identical to SEQ ID NO: 306118

SEQ ID NO: 969202 - protein, 50 aa, Mycobacterium; identical to SEQ ID NO: 306121

SEQ ID NO: 969203 - protein, 24 aa, Mycobacterium
FDPLLVVAAVIEWILGGGAALGSV

SEQ ID NO: 969204 - protein, 17 aa, Mycobacterium
FDVIGVLLLSPGLAAFL

SEQ ID NO: 969205 - protein, 23 aa, Mycobacterium
FEAIRVYRDIGRHALCRARLTNL

SEQ ID NO: 969206 - protein, 19 aa, Mycobacterium
FECDSVVAAVSRLTTSQAP

SEQ ID NO: 969207 - protein, 41 aa, Mycobacterium
FEGAGLFYFDFVRLRSIPALREFRLFFFHRLLMMTPLIALF

SEQ ID NO: 969208 - protein, 17 aa, Mycobacterium
FEGARLRSVNVLLGADW

SEQ ID NO: 969209 - protein, 22 aa, Mycobacterium
FEHLDYAGPVRGYGWPRDLPRA

SEQ ID NO: 969210 - protein, 18 aa, Mycobacterium
FEHYLPEMMALKDIVDAK

SEQ ID NO: 969211 - protein, 18 aa, Mycobacterium
FENMPAMLVILLTTTTLL

SEQ ID NO: 969212 - protein, 21 aa, Mycobacterium
FENTNRWAATAKWEGNQWKIS

SEQ ID NO: 969213 - protein, 18 aa, Mycobacterium
FEPDVRFDGVDLLVHLQM

SEQ ID NO: 969214 - protein, 23 aa, Mycobacterium
FEPLLAALRDFGCMALMMSGRCD

SEQ ID NO: 969215 - protein, 19 aa, Mycobacterium
FEQPIRRWRPARVPLLPLA

SEQ ID NO: 969216 - protein, 21 aa, Mycobacterium
FEVPVAGWGRTVVPVQPGRHR

SEQ ID NO: 969217 - protein, 22 aa, Mycobacterium
FEVRGGLFVRQVHHWAALMFAA

SEQ ID NO: 969218 - protein, 18 aa, Mycobacterium
FFALFLYVVGLLFIVISA

SEQ ID NO: 969219 - protein, 17 aa, Mycobacterium
FFGEKRWAPGAHPHEAP

SEQ ID NO: 969220 - protein, 18 aa, Mycobacterium
FFGVFPILRNVVVGLTGV

SEQ ID NO: 969221 - protein, 31 aa, Mycobacterium; identical to SEQ ID NO: 306241

SEQ ID NO: 969222 - protein, 24 aa, Mycobacterium
FFNLVGWPTWALILSSPFLLPAAL

SEQ ID NO: 969223 - protein, 25 aa, Mycobacterium
FGALFGRTALILAVLFAVGMNVYVY

SEQ ID NO: 969224 - protein, 18 aa, Mycobacterium
FGAMALVAVTAYLHAGWY

SEQ ID NO: 969225 - protein, 17 aa, Mycobacterium
FGATLAAVVSTLLGAVL

SEQ ID NO: 969226 - protein, 17 aa, Mycobacterium
FGDMRSAFYAGYDESDR

SEQ ID NO: 969227 - protein, 17 aa, Mycobacterium
FGEKAAYVAGWMYFLNW

SEQ ID NO: 969228 - protein, 17 aa, Mycobacterium
FGEKTSTYKAEFSNVTG

SEQ ID NO: 969229 - protein, 19 aa, Mycobacterium
FGELFAFTKVCSHLGCPSS

SEQ ID NO: 969230 - protein, 24 aa, Mycobacterium
FGFAALRIASYALWPFGRTIVEKP

SEQ ID NO: 969231 - protein, 20 aa, Mycobacterium
FGFLAQFAIIAAVDRSLSPI

SEQ ID NO: 969232 - protein, 20 aa, Mycobacterium
FGGLLGVMYSIPLRRALVTG

SEQ ID NO: 969233 - protein, 20 aa, Mycobacterium
FGGLPSKFALFNEPLVIVDD

SEQ ID NO: 969234 - protein, 21 aa, Mycobacterium
FGGQVSYLALIVLAVIALVIG

SEQ ID NO: 969235 - protein, 18 aa, Mycobacterium
FGGTVIGVFGMLPTAMFA

SEQ ID NO: 969236 - protein, 18 aa, Mycobacterium
FGIARAFDDTTLTAIGSL

SEQ ID NO: 969237 - protein, 21 aa, Mycobacterium
FGIDFKGGTTVSFPRGDSQVT

SEQ ID NO: 969238 - protein, 17 aa, Mycobacterium
FGKASPMGLLVIVLLLV

SEQ ID NO: 969239 - protein, 19 aa, Mycobacterium
FGLAAGAGAAWLFLQSFNS

SEQ ID NO: 969240 - protein, 19 aa, Mycobacterium
FGMGLPITVGAGFSPSLQP

SEQ ID NO: 969241 - protein, 20 aa, Mycobacterium
FGMLRYCLQLFPDASTYFRP

SEQ ID NO: 969242 - protein, 25 aa, Mycobacterium
FGMPKFDFVACLTMIIVLMIIVVES

SEQ ID NO: 969243 - protein, 20 aa, Mycobacterium
FGNDHFAEFAPGMKSIDDAL

SEQ ID NO: 969244 - protein, 17 aa, Mycobacterium
FGNSLVVTAIFVAIVVP

SEQ ID NO: 969245 - protein, 30 aa, Mycobacterium; identical to SEQ ID NO: 306417

SEQ ID NO: 969246 - protein, 25 aa, Mycobacterium
FGPAPEGMAIWIIGMVAATGLALWI

SEQ ID NO: 969247 - protein, 17 aa, Mycobacterium
FGPGLWNAWQQPTAEAI

SEQ ID NO: 969248 - protein, 20 aa, Mycobacterium
FGQTWVPQALAKRVGHSQLT

SEQ ID NO: 969249 - protein, 17 aa, Mycobacterium
FGSAFGTYLMRQFFRTL

SEQ ID NO: 969250 - protein, 33 aa, Mycobacterium; identical to SEQ ID NO: 306484

SEQ ID NO: 969251 - protein, 17 aa, Mycobacterium
FGTYLMRQFFRTLPSDL

SEQ ID NO: 969252 - protein, 24 aa, Mycobacterium
FGVGCLACAVFAAVGAVVVAFLLP

SEQ ID NO: 969253 - protein, 20 aa, Mycobacterium
FGWHGMGEWAVRGIATQDTN

SEQ ID NO: 969254 - protein, 20 aa, Mycobacterium
FGWRETCFITVVAGGLQLAF

SEQ ID NO: 969255 - protein, 24 aa, Mycobacterium
FHDRNRLVTFIAIFLAGGVMFSLT

SEQ ID NO: 969256 - protein, 17 aa, Mycobacterium
FHEAAKIGFRYIETDVR

SEQ ID NO: 969257 - protein, 26 aa, Mycobacterium
FHFMPELDAWWGYPAVIGTMAIICLI

SEQ ID NO: 969258 - protein, 21 aa, Mycobacterium
FHWAIGIAIGVPVDLILLTEL

SEQ ID NO: 969259 - protein, 22 aa, Mycobacterium
FIAAIGWVVFFFMFRTEKAADS

SEQ ID NO: 969260 - protein, 32 aa, Mycobacterium; identical to SEQ ID NO: 306567

SEQ ID NO: 969261 - protein, 30 aa, Mycobacterium; identical to SEQ ID NO: 296464

SEQ ID NO: 969262 - protein, 17 aa, Mycobacterium
FIDFCGPAVYVVIFALS

SEQ ID NO: 969263 - protein, 17 aa, Mycobacterium
FIIGISAMLGWGLFRIY

SEQ ID NO: 969264 - protein, 19 aa, Mycobacterium
FILEGFDFGVGMLMAPFAH

SEQ ID NO: 969265 - protein, 26 aa, Mycobacterium
FILLIKKIWWPLAVWLLLVVMNVNAG

SEQ ID NO: 969266 - protein, 26 aa, Mycobacterium
FIRGREWIRLPAIFGAGMVVRATGLY

SEQ ID NO: 969267 - protein, 18 aa, Mycobacterium
FIRHERRAPFPLIDLQLF

SEQ ID NO: 969268 - protein, 17 aa, Mycobacterium
FISEFLVLLGTFNRYWL

SEQ ID NO: 969269 - protein, 19 aa, Mycobacterium
FISGAYLPADLSLYDYDGY

SEQ ID NO: 969270 - protein, 21 aa, Mycobacterium
FKAVMFGAIVAVVSAQKGLST

SEQ ID NO: 969271 - protein, 32 aa, Mycobacterium; identical to SEQ ID NO: 306641

SEQ ID NO: 969272 - protein, 22 aa, Mycobacterium
FKGSLGVASIVVFIPMLSAAIG

SEQ ID NO: 969273 - protein, 20 aa, Mycobacterium
FKMMGVTGVVIMIMLFIVYR

SEQ ID NO: 969274 - protein, 21 aa, Mycobacterium
FKSATGLTLPPTVIFDHPTPT

SEQ ID NO: 969275 - protein, 19 aa, Mycobacterium
FKTSWYLLGPAFVAAIAYV

SEQ ID NO: 969276 - protein, 17 aa, Mycobacterium
FKTTVVFNDGKDVPANL

SEQ ID NO: 969277 - protein, 17 aa, Mycobacterium
FKTTVVFNDGKEVPASL

SEQ ID NO: 969278 - protein, 26 aa, Mycobacterium
FKYFVKRFALKRGVLLFGKLLPAGIG

SEQ ID NO: 969279 - protein, 23 aa, Mycobacterium
FLAAWRAAVVDLILWGSGAVLLT

SEQ ID NO: 969280 - protein, 25 aa, Mycobacterium
FLAIPVLFALLALWLTRGGRIPDKR

SEQ ID NO: 969281 - protein, 19 aa, Mycobacterium
FLCAAPVAAIGFVLALFMR

SEQ ID NO: 969282 - protein, 31 aa, Mycobacterium
FLCPACGMFERAFGPTVSRLVDIGAVAADYT

SEQ ID NO: 969283 - protein, 17 aa, Mycobacterium
FLEEPRIAERVANARTR

SEQ ID NO: 969284 - protein, 23 aa, Mycobacterium
FLEFGYASALAWVIFAILLVLTV

SEQ ID NO: 969285 - protein, 21 aa, Mycobacterium
FLGSAGFELIGIAAVISTASA

SEQ ID NO: 969286 - protein, 22 aa, Mycobacterium
FLGVSVALRLTRSGVPKARAAA

SEQ ID NO: 969287 - protein, 18 aa, Mycobacterium
FLGWTMDAFDYFIVVLVY

SEQ ID NO: 969288 - protein, 33 aa, Mycobacterium; identical to SEQ ID NO: 306746

SEQ ID NO: 969289 - protein, 20 aa, Mycobacterium
FLKNPALEAVRFTARSAPKL

SEQ ID NO: 969290 - protein, 19 aa, Mycobacterium
FLLLPRLTNVLSELPEGSD

SEQ ID NO: 969291 - protein, 22 aa, Mycobacterium
FLLPGDPLAAIAGDRPLTPAVA

SEQ ID NO: 969292 - protein, 18 aa, Mycobacterium
FLLVRVGRRQVPLDAALR

SEQ ID NO: 969293 - protein, 25 aa, Mycobacterium
FLREWLPGQLLQGIGVGATLPVLGS

SEQ ID NO: 969294 - protein, 17 aa, Mycobacterium
FLRKPLMERGRILAQSW

SEQ ID NO: 969295 - protein, 17 aa, Mycobacterium
FLRPVLVPRDARLNSAL

SEQ ID NO: 969296 - protein, 20 aa, Mycobacterium
FLSIGWWPVFNVADPSVVVG

SEQ ID NO: 969297 - protein, 21 aa, Mycobacterium
FLSIGWWPVFNVADPSVVVGA

SEQ ID NO: 969298 - protein, 23 aa, Mycobacterium
FLSRPLGAAVFGHFGDRLGRKKT

SEQ ID NO: 969299 - protein, 17 aa, Mycobacterium
FLTFFVVAAFGALIVDR

SEQ ID NO: 969300 - protein, 26 aa, Mycobacterium
FLTGLNWPTAFLVGAILSPTDPVFAA

SEQ ID NO: 969301 - protein, 19 aa, Mycobacterium
FLVGHIYLNVCIREVLWPI

SEQ ID NO: 969302 - protein, 18 aa, Mycobacterium
FLVGHLLQLPAWITQRLW

SEQ ID NO: 969303 - protein, 17 aa, Mycobacterium
FLVLLGTFNRYWLAAAL

SEQ ID NO: 969304 - protein, 18 aa, Mycobacterium
FLVLVWVFGGLLAAALPM

SEQ ID NO: 969305 - protein, 27 aa, Mycobacterium
FMHVMGRWNWWAPKPLVWLHQRFGISE

SEQ ID NO: 969306 - protein, 19 aa, Mycobacterium
FMLRLKVGMAAGIVLACPI

SEQ ID NO: 969307 - protein, 33 aa, Mycobacterium
FMMRLSRNLRRFRWLVFTGWMLALVPAIYLALT

SEQ ID NO: 969308 - protein, 24 aa, Mycobacterium
FMSLPKLITFTGVVIAIVYLLVAL

SEQ ID NO: 969309 - protein, 20 aa, Mycobacterium
FMVLVGLDFLSYRLGKQRNR

SEQ ID NO: 969310 - protein, 27 aa, Mycobacterium
FMVPSIAALLGRWFWWPINVRTRPARA

SEQ ID NO: 969311 - protein, 17 aa, Mycobacterium
FNAHRAFQELGFDSLTA

SEQ ID NO: 969312 - protein, 18 aa, Mycobacterium
FNCTDFADLFTLLEQDKA

SEQ ID NO: 969313 - protein, 26 aa, Mycobacterium
FNEPICPPCGAFIRSYASDIDAAVAN

SEQ ID NO: 969314 - protein, 18 aa, Mycobacterium
FNFPDTSFAWSFVLALLA

SEQ ID NO: 969315 - protein, 34 aa, Mycobacterium; identical to SEQ ID NO: 306925

SEQ ID NO: 969316 - protein, 20 aa, Mycobacterium
FNMQLALGWSTLALAAVAVL

SEQ ID NO: 969317 - protein, 36 aa, Mycobacterium
FNMTIASWWLHRQCGYHTPVLFLLRLSVPTAASVAV

SEQ ID NO: 969318 - protein, 32 aa, Mycobacterium; identical to SEQ ID NO: 306937

SEQ ID NO: 969319 - protein, 17 aa, Mycobacterium
FNTMNLLLLLLVTFLPF

SEQ ID NO: 969320 - protein, 18 aa, Mycobacterium
FNTWMFDLIWEFLQDPIG

SEQ ID NO: 969321 - protein, 21 aa, Mycobacterium
FPDDLRPGLLSRMLAHLSTFI

SEQ ID NO: 969322 - protein, 23 aa, Mycobacterium
FPDLEVCVYAAPTQTVIGGPPEQ

SEQ ID NO: 969323 - protein, 27 aa, Mycobacterium
FPFEHARIRLAYGMRLRRLRRYRNARV

SEQ ID NO: 969324 - protein, 20 aa, Mycobacterium
FPGGDRAPLILVVTRSDGTT

SEQ ID NO: 969325 - protein, 19 aa, Mycobacterium
FPGGSRWARIDLPDDEYIP

SEQ ID NO: 969326 - protein, 27 aa, Mycobacterium
FPGKRAPTIQLCRDPKGYFPVGRNPWR

SEQ ID NO: 969327 - protein, 17 aa, Mycobacterium
FPGKTPVLLLIIAALMV

SEQ ID NO: 969328 - protein, 32 aa, Mycobacterium
FPIDIGPQPGWRNLRFPLAWAPPEANVARIVA

SEQ ID NO: 969329 - protein, 17 aa, Mycobacterium
FPIVAASALCFLVGFAG

SEQ ID NO: 969330 - protein, 17 aa, Mycobacterium
FPPKRAEELTSLIDSRF

SEQ ID NO: 969331 - protein, 27 aa, Mycobacterium
FPRQFGYNMPLELVLTVTPFLIISVLF

SEQ ID NO: 969332 - protein, 21 aa, Mycobacterium
FPVGRNPWRGPPVPYDTPVTD

SEQ ID NO: 969333 - protein, 23 aa, Mycobacterium
FPWTECIRQASFMAATAIMPTIL

SEQ ID NO: 969334 - protein, 20 aa, Mycobacterium
FPYSRYDTMTLAAFDLVTAA

SEQ ID NO: 969335 - protein, 20 aa, Mycobacterium
FQLAGSWPNLVAISLVIALA

SEQ ID NO: 969336 - protein, 19 aa, Mycobacterium
FQQRSVIVLTSLLLIIVAL

SEQ ID NO: 969337 - protein, 19 aa, Mycobacterium
FQRGQIMVCSYVLRTAGQY

SEQ ID NO: 969338 - protein, 18 aa, Mycobacterium
FQRQRFWLDANRIGQGDP

SEQ ID NO: 969339 - protein, 25 aa, Mycobacterium
FQTLGIPCSVGMLVALLVALTLAPA

SEQ ID NO: 969340 - protein, 19 aa, Mycobacterium
FQVPYAKNRARLGVGASDR

SEQ ID NO: 969341 - protein, 17 aa, Mycobacterium
FQYWSWANLACVVCAIG

SEQ ID NO: 969342 - protein, 17 aa, Mycobacterium
FRAGERIGSLFSTHPPI

SEQ ID NO: 969343 - protein, 20 aa, Mycobacterium
FRGLPEVVIILISGWASDPS

SEQ ID NO: 969344 - protein, 25 aa, Mycobacterium
FRKGANFTAAMAFEIGSTNLVVELG

SEQ ID NO: 969345 - protein, 35 aa, Mycobacterium
FRPIRSYFYWEKHCFDIPVCWSLRSVFDTLDGVDL

SEQ ID NO: 969346 - protein, 17 aa, Mycobacterium
FRQNLGRSILIGLGLLV

SEQ ID NO: 969347 - protein, 22 aa, Mycobacterium
FRSFPPLTVWTGLSLLGVAIAE

SEQ ID NO: 969348 - protein, 17 aa, Mycobacterium
FRVRFIREADLAATLSH

SEQ ID NO: 969349 - protein, 18 aa, Mycobacterium
FSAAPNFAFELAVRRTTD

SEQ ID NO: 969350 - protein, 19 aa, Mycobacterium
FSASASLLPLACWTCGVFS

SEQ ID NO: 969351 - protein, 17 aa, Mycobacterium
FSDCLRAELDAADVGLT

SEQ ID NO: 969352 - protein, 31 aa, Mycobacterium
FSDKFFEEVWDPASTVAHGRVNVSFTPSYTY

SEQ ID NO: 969353 - protein, 17 aa, Mycobacterium
FSEVSLRPARAALAGDT

SEQ ID NO: 969354 - protein, 27 aa, Mycobacterium
FSFYDGHYFGAWVFIAGFLMHIAVKMP

SEQ ID NO: 969355 - protein, 24 aa, Mycobacterium
FSGLLWWVAFGMRDRLLVVATLIC

SEQ ID NO: 969356 - protein, 21 aa, Mycobacterium
FSGTVGGLVPRFPGGLDSTVL

SEQ ID NO: 969357 - protein, 25 aa, Mycobacterium
FSNASGLRPGQFVRASGVEIGKVKS

SEQ ID NO: 969358 - protein, 18 aa, Mycobacterium
FSNVGAWWTEPIVFEKAV

SEQ ID NO: 969359 - protein, 17 aa, Mycobacterium
FSPNFTVLVILRLLHGI

SEQ ID NO: 969360 - protein, 20 aa, Mycobacterium
FSPPSLRWAGAGDQRGPASA

SEQ ID NO: 969361 - protein, 17 aa, Mycobacterium
FSRDRNAGVLVMNNVPP

SEQ ID NO: 969362 - protein, 17 aa, Mycobacterium
FSSFFVVSNSLQLRNFG

SEQ ID NO: 969363 - protein, 18 aa, Mycobacterium
FSSVFVVSNSLRLRSFTS

SEQ ID NO: 969364 - protein, 19 aa, Mycobacterium
FSTALARRDQLIGDTITNL

SEQ ID NO: 969365 - protein, 22 aa, Mycobacterium
FSVGWLYWYFWVIVVGFEAVAG

SEQ ID NO: 969366 - protein, 17 aa, Mycobacterium
FSVLAAYAFARLEFPGR

SEQ ID NO: 969367 - protein, 22 aa, Mycobacterium
FSVLFAALWLSCLAIFNTRSQH

SEQ ID NO: 969368 - protein, 21 aa, Mycobacterium
FSVPVLAPLVLRATLSRASVR

SEQ ID NO: 969369 - protein, 18 aa, Mycobacterium
FSWLRRRSGSLIAPIALH

SEQ ID NO: 969370 - protein, 18 aa, Mycobacterium
FTAIPAYWHQAADWLSEH

SEQ ID NO: 969371 - protein, 17 aa, Mycobacterium
FTAPLVPVRPDLPDVLL

SEQ ID NO: 969372 - protein, 22 aa, Mycobacterium
FTASVLPVWLLLAPRDYLSTFM

SEQ ID NO: 969373 - protein, 26 aa, Mycobacterium
FTEPEMWFLRKAHQLCPAGVVVATKT

SEQ ID NO: 969374 - protein, 26 aa, Mycobacterium
FTGPQVWWVLHVARWAADVPGATVAV

SEQ ID NO: 969375 - protein, 17 aa, Mycobacterium
FTGRGLRVLAVAAAPRD

SEQ ID NO: 969376 - protein, 27 aa, Mycobacterium
FTHEQRRALGLTGRLPAAVLTLDQQSE

SEQ ID NO: 969377 - protein, 24 aa, Mycobacterium
FTISSVLCAVAWDEATLVIARLSQ

SEQ ID NO: 969378 - protein, 38 aa, Mycobacterium
FTKFTLVMTLPWLLAIAAVYVILCWFFARDLVAEPNRE

SEQ ID NO: 969379 - protein, 27 aa, Mycobacterium
FTLRLAVGLGCGALIGIERQWRARMAG

SEQ ID NO: 969380 - protein, 18 aa, Mycobacterium
FTMAGPWVGIAAPGENIV

SEQ ID NO: 969381 - protein, 23 aa, Mycobacterium
FTRYPRRAFLGLALFIGQAFLYN

SEQ ID NO: 969382 - protein, 17 aa, Mycobacterium
FTSVSHVFVMEWAAILR

SEQ ID NO: 969383 - protein, 18 aa, Mycobacterium
FTTLRMIYEDVQAHFRAD

SEQ ID NO: 969384 - protein, 26 aa, Mycobacterium
FTVGFYIPFAIPWNHYVGGGASGVPS

SEQ ID NO: 969385 - protein, 27 aa, Mycobacterium
FTVSYLLAALIERLMGFRVSREEEVSG

SEQ ID NO: 969386 - protein, 27 aa, Mycobacterium
FVAGGLVGGVWLVFIGWFIFAAAREEE

SEQ ID NO: 969387 - protein, 18 aa, Mycobacterium
FVALIAFVMLLISIHSVL

SEQ ID NO: 969388 - protein, 18 aa, Mycobacterium
FVFVCYHAAGIWRRGIVG

SEQ ID NO: 969389 - protein, 25 aa, Mycobacterium
FVIVDWRMHVAVLPHSVFGSGPLKW

SEQ ID NO: 969390 - protein, 18 aa, Mycobacterium
FVLVPIFLYLLFYDGGHQ

SEQ ID NO: 969391 - protein, 19 aa, Mycobacterium
FVNFYSCDISLKINGLQPG

SEQ ID NO: 969392 - protein, 23 aa, Mycobacterium
FVPLADLSTMFALVPSTRFPGWG

SEQ ID NO: 969393 - protein, 24 aa, Mycobacterium
FVPNLRRWLSTEVRPKLKEVTSDL

SEQ ID NO: 969394 - protein, 18 aa, Mycobacterium
FVVGVAFNRIMAAARPAS

SEQ ID NO: 969395 - protein, 17 aa, Mycobacterium
FVVPYPPGFPVLVPGQV

SEQ ID NO: 969396 - protein, 20 aa, Mycobacterium
FVWDAWTVGLQWWRRFGPQR

SEQ ID NO: 969397 - protein, 18 aa, Mycobacterium
FWAARFGTTVLYSQATGV

SEQ ID NO: 969398 - protein, 17 aa, Mycobacterium
FWINVPLTAIAMLMIQF

SEQ ID NO: 969399 - protein, 19 aa, Mycobacterium
FYGARARRLLPAAATVGVA

SEQ ID NO: 969400 - protein, 18 aa, Mycobacterium
FYLALPLLAFLARRVPVG

SEQ ID NO: 969401 - protein, 17 aa, Mycobacterium
FYLGHGVGVNAAEMPMI

SEQ ID NO: 969402 - protein, 25 aa, Mycobacterium
FYLPPEVFENADFKRAMGSFLSPDG

SEQ ID NO: 969403 - protein, 24 aa, Mycobacterium
FYLPPEVFNNPDFKRGLEQFLSPD

SEQ ID NO: 969404 - protein, 27 aa, Mycobacterium
FYLPPEVFNNPDFKRGLKLFLSPDGKA

SEQ ID NO: 969405 - protein, 22 aa, Mycobacterium
FYLTCAVFVFGVLGVLLYVVSG

SEQ ID NO: 969406 - protein, 21 aa, Mycobacterium
FYPHRRKGFALGFNAGAGNLG

SEQ ID NO: 969407 - protein, 18 aa, Mycobacterium
FYVLLPFLAYLLLVVISR

SEQ ID NO: 969408 - protein, 17 aa, Mycobacterium
FYWAVGIAAALPVLVVI

SEQ ID NO: 969409 - protein, 30 aa, Mycobacterium
FYWERHGSDIPICWSLRSLFDAIDGVDKLS

SEQ ID NO: 969410 - protein, 25 aa, Mycobacterium
GAAADALRRGWAMAAICFVVVAIAA

SEQ ID NO: 969411 - protein, 19 aa, Mycobacterium
GAADFGWRTAYTPLSNAAH

SEQ ID NO: 969412 - protein, 26 aa, Mycobacterium
GAALLRPGRGPSVWYQPDRTSAQPVG

SEQ ID NO: 969413 - protein, 19 aa, Mycobacterium
GAALPWLWIAILGTPAILI

SEQ ID NO: 969414 - protein, 19 aa, Mycobacterium
GAAMAFSSFFVVSNSLQLR

SEQ ID NO: 969415 - protein, 18 aa, Mycobacterium
GAAMAFSSVFVVSNSLRL

SEQ ID NO: 969416 - protein, 19 aa, Mycobacterium
GADLRMVLKSAAKLKQLAP

SEQ ID NO: 969417 - protein, 21 aa, Mycobacterium
GAETLRLKGYLIMSRNSSRDY

SEQ ID NO: 969418 - protein, 25 aa, Mycobacterium
GAFRLESPLNYAAMATEIAKWGEFG

SEQ ID NO: 969419 - protein, 26 aa, Mycobacterium
GAGAAARLPGLWAATRPRLVRLVVSL

SEQ ID NO: 969420 - protein, 17 aa, Mycobacterium
GAGAIAVAAVWTFLKIA

SEQ ID NO: 969421 - protein, 19 aa, Mycobacterium
GAGFGRAALVTALMTTVIL

SEQ ID NO: 969422 - protein, 25 aa, Mycobacterium
GAGILDPAAALTWELPAADGGAPQV

SEQ ID NO: 969423 - protein, 21 aa, Mycobacterium
GAGKSTFARLVAGYTHPTNGT

SEQ ID NO: 969424 - protein, 37 aa, Mycobacterium
GAGLFIAFDQLWRWNSIVALVLSVLVILGLVVGVRVV

SEQ ID NO: 969425 - protein, 25 aa, Mycobacterium
GAGLLPPLLIRHGIDVGIRQHVLAA

SEQ ID NO: 969426 - protein, 22 aa, Mycobacterium
GAGLPALFAVGVRLQADSGQIT

SEQ ID NO: 969427 - protein, 22 aa, Mycobacterium
GAHPLHLLTMLAGLALVGYIVA

SEQ ID NO: 969428 - protein, 26 aa, Mycobacterium
GAIAFLIFAGWAWREGREDPAGADGV

SEQ ID NO: 969429 - protein, 25 aa, Mycobacterium
GAIALRILFGLPLPIGGIITGVISL

SEQ ID NO: 969430 - protein, 23 aa, Mycobacterium
GAIAVAAVWTFLKIAGPIMAGIA

SEQ ID NO: 969431 - protein, 26 aa, Mycobacterium
GAIGYGLGVFAVWLVRYMRSQDDSPP

SEQ ID NO: 969432 - protein, 23 aa, Mycobacterium
GAIIWAGSLVWYLQRVGTEPNFL

SEQ ID NO: 969433 - protein, 24 aa, Mycobacterium
GAITRWQTGGGWQAYIDHADQLGA

SEQ ID NO: 969434 - protein, 29 aa, Mycobacterium
GAIVGYYLLRRALCPGGGQLVGTREVHTI

SEQ ID NO: 969435 - protein, 19 aa, Mycobacterium
GAKAAMPPMAPVALAVQVG

SEQ ID NO: 969436 - protein, 19 aa, Mycobacterium
GALAGLGWWLLRRRTDVPP

SEQ ID NO: 969437 - protein, 23 aa, Mycobacterium
GALEGGFPWAAFVVGLSSAGPPP

SEQ ID NO: 969438 - protein, 23 aa, Mycobacterium
GALELLGAAGLLLPVTRVAAALC

SEQ ID NO: 969439 - protein, 26 aa, Mycobacterium
GALFRAPEFYVWIAAALGGMIFQQSS

SEQ ID NO: 969440 - protein, 18 aa, Mycobacterium
GALGFRIAAASTKLAILG

SEQ ID NO: 969441 - protein, 18 aa, Mycobacterium
GALLCLSVAAWPVLSQRR

SEQ ID NO: 969442 - protein, 25 aa, Mycobacterium
GALLHRTPIRFIRAFSGAARVSGPL

SEQ ID NO: 969443 - protein, 17 aa, Mycobacterium
GALLKLTVFAVGVMPYI

SEQ ID NO: 969444 - protein, 20 aa, Mycobacterium
GALSYARIAVLFIEPDTATL

SEQ ID NO: 969445 - protein, 27 aa, Mycobacterium
GALTEVSWRLAFMVNVPIGLVMIYLAR

SEQ ID NO: 969446 - protein, 18 aa, Mycobacterium
GALVLGWWIAVLVYLLPR

SEQ ID NO: 969447 - protein, 29 aa, Mycobacterium
GALYVRVGDRLYPALNLASARLITGRASN

SEQ ID NO: 969448 - protein, 25 aa, Mycobacterium
GAMYCLSFTRLPYFQTLGSPCSIGL

SEQ ID NO: 969449 - protein, 24 aa, Mycobacterium
GANIGRLILIAGIGTILAFEAGDL

SEQ ID NO: 969450 - protein, 20 aa, Mycobacterium
GAPEKAAWGIALGLTVTLVW

SEQ ID NO: 969451 - protein, 20 aa, Mycobacterium
GAPFPDRNLIIFVVSVVILV

SEQ ID NO: 969452 - protein, 20 aa, Mycobacterium
GAPLAMEGLMAFFFESTFIG

SEQ ID NO: 969453 - protein, 19 aa, Mycobacterium
GAPPTRWPVTLHVLPNVRD

SEQ ID NO: 969454 - protein, 29 aa, Mycobacterium
GAPQGSWRRRLPVIFVDVARFVLIGAGLA

SEQ ID NO: 969455 - protein, 26 aa, Mycobacterium
GAQEWLKSIVPFGGFPWGSVAFGQVD

SEQ ID NO: 969456 - protein, 18 aa, Mycobacterium
GAQGLRILLLGVAAVAVD

SEQ ID NO: 969457 - protein, 18 aa, Mycobacterium
GAQTALICVYAFAALWAL

SEQ ID NO: 969458 - protein, 22 aa, Mycobacterium
GARPWLPHFYLGHGVGVNAAEM

SEQ ID NO: 969459 - protein, 19 aa, Mycobacterium
GARRHPRSRVSEAHHRPAN

SEQ ID NO: 969460 - protein, 25 aa, Mycobacterium
GARSPRTGIALSIAALAPVGAALAL

SEQ ID NO: 969461 - protein, 25 aa, Mycobacterium
GASRGWRAGAPLVRDDAWIIFTSGS

SEQ ID NO: 969462 - protein, 19 aa, Mycobacterium
GATASMLAPIWQVMPTSRA

SEQ ID NO: 969463 - protein, 24 aa, Mycobacterium
GATELPIIIVIVALVAQWARQDRQ

SEQ ID NO: 969464 - protein, 30 aa, Mycobacterium
GATFCLHLPRLSYFKALGIPSALGLLVVIA

SEQ ID NO: 969465 - protein, 18 aa, Mycobacterium
GATFGRRSRNLLIGIGAG

SEQ ID NO: 969466 - protein, 18 aa, Mycobacterium
GATGVPWLLISGPLGSAA

SEQ ID NO: 969467 - protein, 25 aa, Mycobacterium
GATGWKVFTSVIFPSLMPALLSGAG

SEQ ID NO: 969468 - protein, 23 aa, Mycobacterium
GATWWRVVQYGVWGAVLGATTQL

SEQ ID NO: 969469 - protein, 29 aa, Mycobacterium
GATYCLSFARLPWFNTMGAPVAIGMLVVV

SEQ ID NO: 969470 - protein, 20 aa, Mycobacterium
GAVAGMLRRLVVEAMGVALL

SEQ ID NO: 969471 - protein, 21 aa, Mycobacterium
GAVGPWLLRSAFGQQYQASGS

SEQ ID NO: 969472 - protein, 23 aa, Mycobacterium
GAVICAAYGWAIVASALSIYALG

SEQ ID NO: 969473 - protein, 19 aa, Mycobacterium
GAVLARLVARLARDVQPVP

SEQ ID NO: 969474 - protein, 25 aa, Mycobacterium
GAVPSRPRIAAAALMCVVSVGLLIW

SEQ ID NO: 969475 - protein, 25 aa, Mycobacterium
GAVSRALCLAVDPDLLVTVNAMTGG

SEQ ID NO: 969476 - protein, 24 aa, Mycobacterium
GAVSVLWLGVAGWSLWAANSPGMG

SEQ ID NO: 969477 - protein, 19 aa, Mycobacterium
GAWLQARLGPSPMVEKHQE

SEQ ID NO: 969478 - protein, 17 aa, Mycobacterium
GAYFLRSYFVLIVVAAV

SEQ ID NO: 969479 - protein, 24 aa, Mycobacterium
GCGPSDRQLIGIGLVVVLLAAVLT

SEQ ID NO: 969480 - protein, 18 aa, Mycobacterium
GCISLSPADAEWYYNTVN

SEQ ID NO: 969481 - protein, 21 aa, Mycobacterium
GCLPAMIWLACHRPNRRWWRY

SEQ ID NO: 969482 - protein, 25 aa, Mycobacterium
GCSGAGKGFVFWGIAFGLGPAVGAG

SEQ ID NO: 969483 - protein, 17 aa, Mycobacterium
GCVTGAMGVGRVLCRPV

SEQ ID NO: 969484 - protein, 23 aa, Mycobacterium
GDEVSVGIAQLFSAHAQDYQTLA

SEQ ID NO: 969485 - protein, 27 aa, Mycobacterium
GDGRASKCTLCYDRLRDGLEPACAKAC

SEQ ID NO: 969486 - protein, 17 aa, Mycobacterium
GDIGSLDAAGWLRVTDR

SEQ ID NO: 969487 - protein, 19 aa, Mycobacterium
GDLANPVLFKATTKTLESA

SEQ ID NO: 969488 - protein, 17 aa, Mycobacterium
GDLFVVVGLLFLGTVAL

SEQ ID NO: 969489 - protein, 17 aa, Mycobacterium
GDMFGRKRVFQVAVLLF

SEQ ID NO: 969490 - protein, 22 aa, Mycobacterium
GDQAFEVLTPFAVDGGPTVLVD

SEQ ID NO: 969491 - protein, 21 aa, Mycobacterium
GDRSMRLILLVTFAVIVVMLL

SEQ ID NO: 969492 - protein, 25 aa, Mycobacterium
GDRYGRRGWLTIGLVIVGASSAVAA

SEQ ID NO: 969493 - protein, 22 aa, Mycobacterium
GDSGRFGDKIARISHRANPVDG

SEQ ID NO: 969494 - protein, 18 aa, Mycobacterium
GDTFDCSVSIDGMQKRVT

SEQ ID NO: 969495 - protein, 27 aa, Mycobacterium
GDVPNCPGDMLCVAAGKVIDPVDRVVD

SEQ ID NO: 969496 - protein, 25 aa, Mycobacterium
GDVRASWPWAVAVFIVVVFVGPLCE

SEQ ID NO: 969497 - protein, 20 aa, Mycobacterium
GEALFGYTGLGWRFSGALLG

SEQ ID NO: 969498 - protein, 22 aa, Mycobacterium
GEATFRFPLVVAPRYIPGEPLA

SEQ ID NO: 969499 - protein, 18 aa, Mycobacterium
GEGARLVTTLARHPGGAS

SEQ ID NO: 969500 - protein, 23 aa, Mycobacterium
GEGTRPLLLASIAWVVIPTGIVL

SEQ ID NO: 969501 - protein, 19 aa, Mycobacterium
GEHAGALWISMDDVEGTDA

SEQ ID NO: 969502 - protein, 23 aa, Mycobacterium
GEIYEAMDWLLARQDAIEKQLAA

SEQ ID NO: 969503 - protein, 25 aa, Mycobacterium
GELDGRLWIAMDYIEGIDVGQLMRD

SEQ ID NO: 969504 - protein, 21 aa, Mycobacterium
GELFIMGRIKDLVIVDGRNHY

SEQ ID NO: 969505 - protein, 25 aa, Mycobacterium
GELPVALGKPVWDRPIGGLLATTAG

SEQ ID NO: 969506 - protein, 20 aa, Mycobacterium
GELQRLALAAALAREPAMLI

SEQ ID NO: 969507 - protein, 22 aa, Mycobacterium
GEPGIRHPFELTITPGDGASNI

SEQ ID NO: 969508 - protein, 31 aa, Mycobacterium
GEPPAVVRRRLRWWPVIAYGLLPALALLLAG

SEQ ID NO: 969509 - protein, 21 aa, Mycobacterium
GEQFLSLILEKIHGLAVFALA

SEQ ID NO: 969510 - protein, 22 aa, Mycobacterium
GEQISLLVFMIFASKGAAGVSG

SEQ ID NO: 969511 - protein, 21 aa, Mycobacterium
GEQYLPAMFFFAVLGFANFAD

SEQ ID NO: 969512 - protein, 23 aa, Mycobacterium
GERPGAQIVGWGWLALSVVGVPW

SEQ ID NO: 969513 - protein, 19 aa, Mycobacterium
GERSELIGSEFLDVLASVP

SEQ ID NO: 969514 - protein, 17 aa, Mycobacterium
GESLGSFGGEAPFMNLN

SEQ ID NO: 969515 - protein, 18 aa, Mycobacterium
GEVPLLAVVIAFSLAFGM

SEQ ID NO: 969516 - protein, 22 aa, Mycobacterium
GEVWRCLRCGDFTLGAPRGRGH

SEQ ID NO: 969517 - protein, 19 aa, Mycobacterium
GFAELYRQGAARDVAMLLS

SEQ ID NO: 969518 - protein, 20 aa, Mycobacterium
GFAMLPAYLLLVVRGQHGGE

SEQ ID NO: 969519 - protein, 34 aa, Mycobacterium
GFARLRPGVLHARRYVAIMGFAWLLLAVSAIANA

SEQ ID NO: 969520 - protein, 24 aa, Mycobacterium
GFASLAVAVAVAIRPTAASEPVEG

SEQ ID NO: 969521 - protein, 24 aa, Mycobacterium
GFDGGLNWLGKIGVALPVGVIGGV

SEQ ID NO: 969522 - protein, 19 aa, Mycobacterium
GFFSPHSWWPIMVALSGSV

SEQ ID NO: 969523 - protein, 26 aa, Mycobacterium
GFGAMIVVCMFWRLFMQDNLPHDGAG

SEQ ID NO: 969524 - protein, 24 aa, Mycobacterium
GFPRSEFAVSLALVLLMLPVIVRA

SEQ ID NO: 969525 - protein, 23 aa, Mycobacterium
GFSHFTLLLVHALRRQFSRVRVF

SEQ ID NO: 969526 - protein, 18 aa, Mycobacterium
GFWVPGYPVTPILSILAC

SEQ ID NO: 969527 - protein, 38 aa, Mycobacterium; identical to SEQ ID NO: 308599

SEQ ID NO: 969528 - protein, 28 aa, Mycobacterium
GGALLRSWPAFLAYLVSFVFIGSSWLAH

SEQ ID NO: 969529 - protein, 23 aa, Mycobacterium
GGARPSGGVARVQLRAVGAGFRA

SEQ ID NO: 969530 - protein, 23 aa, Mycobacterium
GGCLPKDIRAFMARAGELGANQA

SEQ ID NO: 969531 - protein, 26 aa, Mycobacterium
GGDALRDWRSPIAWLSRYRPRLPRLS

SEQ ID NO: 969532 - protein, 21 aa, Mycobacterium
GGEIVVGVLLVLGLFTPLAGA

SEQ ID NO: 969533 - protein, 21 aa, Mycobacterium
GGGARGFAHLGILEELEQAGV

SEQ ID NO: 969534 - protein, 26 aa, Mycobacterium
GGGFGRMAIGGGIGGLLIVVVAMFLG

SEQ ID NO: 969535 - protein, 18 aa, Mycobacterium
GGGFRFVTSPAYLGELIA

SEQ ID NO: 969536 - protein, 27 aa, Mycobacterium
GGGHRRTSWRVLLIGLAVIAAYLLLTL

SEQ ID NO: 969537 - protein, 25 aa, Mycobacterium
GGGKPRWLCATAALAAALVGALPWL

SEQ ID NO: 969538 - protein, 25 aa, Mycobacterium
GGGLGTRWVAMNALTFASKGALALR

SEQ ID NO: 969539 - protein, 18 aa, Mycobacterium
GGGRLRQALLGLPMAHPG

SEQ ID NO: 969540 - protein, 23 aa, Mycobacterium
GGIRRRPRRPKPRPVPPAEADVD

SEQ ID NO: 969541 - protein, 20 aa, Mycobacterium
GGKILRTALNPSLKLSPITE

SEQ ID NO: 969542 - protein, 25 aa, Mycobacterium
GGLAAGWRLAEYAMIATTPTHTAAT

SEQ ID NO: 969543 - protein, 17 aa, Mycobacterium
GGLARMFTLARLSEALL

SEQ ID NO: 969544 - protein, 19 aa, Mycobacterium
GGLFPYGLLPLVVVTSGVV

SEQ ID NO: 969545 - protein, 20 aa, Mycobacterium
GGLVWPFVLLPHLGMIRGAA

SEQ ID NO: 969546 - protein, 26 aa, Mycobacterium
GGPMSHAAVVAREFGFPCVVDAQGAT

SEQ ID NO: 969547 - protein, 20 aa, Mycobacterium
GGPPRTVIIAAVVLTAATIG

SEQ ID NO: 969548 - protein, 24 aa, Mycobacterium
GGPRAPRRRKRGIIAAAMGLVTIV

SEQ ID NO: 969549 - protein, 22 aa, Mycobacterium
GGQAADWLGYFMLLASFILGAT

SEQ ID NO: 969550 - protein, 22 aa, Mycobacterium
GGRAMRATWMMAAKGTGGAARS

SEQ ID NO: 969551 - protein, 26 aa, Mycobacterium
GGRIPDKRWFGWFALLTIPAPFLANI

SEQ ID NO: 969552 - protein, 18 aa, Mycobacterium
GGRVGHRLHSAVIIAIIG

SEQ ID NO: 969553 - protein, 22 aa, Mycobacterium
GGRYSVYVWALLAMVAARMGLG

SEQ ID NO: 969554 - protein, 20 aa, Mycobacterium
GGSILGAVAIYLAYIAGLTM

SEQ ID NO: 969555 - protein, 17 aa, Mycobacterium
GGTTVSFPRGDSQVTQV

SEQ ID NO: 969556 - protein, 17 aa, Mycobacterium
GGTVLIYVLCVATLGLV

SEQ ID NO: 969557 - protein, 20 aa, Mycobacterium
GGVAFLGYHRIIGLSTFATN

SEQ ID NO: 969558 - protein, 25 aa, Mycobacterium
GGVVGGIALLFVVVILVLGFWVPGF

SEQ ID NO: 969559 - protein, 18 aa, Mycobacterium
GGVVLSLSAAIAVALGLW

SEQ ID NO: 969560 - protein, 18 aa, Mycobacterium
GHASYWRQLMQLAMRVPL

SEQ ID NO: 969561 - protein, 18 aa, Mycobacterium
GHATARRLAIEFVGNIAS

SEQ ID NO: 969562 - protein, 23 aa, Mycobacterium
GHEAPYWVCAVYLVLIAIAGLGA

SEQ ID NO: 969563 - protein, 20 aa, Mycobacterium
GHGFRRYVVVYSDLFEIRGQ

SEQ ID NO: 969564 - protein, 29 aa, Mycobacterium
GHLELFWLSLRDSRWWLGALGAIANYLLQ

SEQ ID NO: 969565 - protein, 25 aa, Mycobacterium
GIAERLRPGGVIQREIAMRTVAVFA

SEQ ID NO: 969566 - protein, 19 aa, Mycobacterium
GIAGIAVAVFAGRVTAVLG

SEQ ID NO: 969567 - protein, 25 aa, Mycobacterium
GIAKRADNPISFWEFTRKGIVVTTM

SEQ ID NO: 969568 - protein, 20 aa, Mycobacterium
GICASCAVPLGVGYRRACTH

SEQ ID NO: 969569 - protein, 20 aa, Mycobacterium
GICAVCAVPLAVGWRRASTH

SEQ ID NO: 969570 - protein, 18 aa, Mycobacterium
GIDISELDPVDWWRQLSW

SEQ ID NO: 969571 - protein, 20 aa, Mycobacterium
GIEGYNFLDLLGLGPATGLI

SEQ ID NO: 969572 - protein, 21 aa, Mycobacterium
GIESWKAAVLALTLVLFLVGG

SEQ ID NO: 969573 - protein, 18 aa, Mycobacterium
GIFYLMLTVPLAHLVNYI

SEQ ID NO: 969574 - protein, 22 aa, Mycobacterium
GIGIAWPHLTVRAMDCVDDPAE

SEQ ID NO: 969575 - protein, 23 aa, Mycobacterium
GIGLAMILSYVWGVRVGGIFTAL

SEQ ID NO: 969576 - protein, 18 aa, Mycobacterium
GIGLGVIVAGARLLTQGM

SEQ ID NO: 969577 - protein, 19 aa, Mycobacterium
GIIERPERLIIVLAGAGVS

SEQ ID NO: 969578 - protein, 17 aa, Mycobacterium
GIILGGLITLVFTAANV

SEQ ID NO: 969579 - protein, 23 aa, Mycobacterium
GILSALPATFAFTGDLTVEVGRA

SEQ ID NO: 969580 - protein, 25 aa, Mycobacterium
GILVWPRVRFANGRHRAFFTASIVY

SEQ ID NO: 969581 - protein, 20 aa, Mycobacterium
GIMVAWRWAPAKVAAVPGPL

SEQ ID NO: 969582 - protein, 21 aa, Mycobacterium
GIRLTGRSGALSRSARIQLVS

SEQ ID NO: 969583 - protein, 22 aa, Mycobacterium
GISALCLIFIIMLIITRSVVAA

SEQ ID NO: 969584 - protein, 19 aa, Mycobacterium
GITTMWITAGAFGLSLLAI

SEQ ID NO: 969585 - protein, 38 aa, Mycobacterium
GIVILGAVGIDFGASIYAEYRLSTSVRKAAHLGSDPFV

SEQ ID NO: 969586 - protein, 18 aa, Mycobacterium
GIVPWWFIAALLARDAAL

SEQ ID NO: 969587 - protein, 23 aa, Mycobacterium
GIVSALHRPVPLSGEGSDTDTVI

SEQ ID NO: 969588 - protein, 24 aa, Mycobacterium
GIVSALHRPVPLSGEGSDTDTVID

SEQ ID NO: 969589 - protein, 18 aa, Mycobacterium
GIVTEIMLVLARVMGEMA

SEQ ID NO: 969590 - protein, 20 aa, Mycobacterium
GIVTRFQYRDALLLDLQGNV

SEQ ID NO: 969591 - protein, 21 aa, Mycobacterium
GKASPLGLLVVVVLVIATLFL

SEQ ID NO: 969592 - protein, 18 aa, Mycobacterium
GKDVRFVGLIDAVRAGEE

SEQ ID NO: 969593 - protein, 17 aa, Mycobacterium
GKEQVIMPSIPQSLLWI

SEQ ID NO: 969594 - protein, 21 aa, Mycobacterium
GKEVLPSYGLPVLTGAIVAAV

SEQ ID NO: 969595 - protein, 17 aa, Mycobacterium
GKGGVLLGLLIPHGLVE

SEQ ID NO: 969596 - protein, 20 aa, Mycobacterium
GKGLSALQMVQWDEIGQIAI

SEQ ID NO: 969597 - protein, 17 aa, Mycobacterium
GKGWLINSLSLPFFTFI

SEQ ID NO: 969598 - protein, 32 aa, Mycobacterium
GKMAAVAKRRGWPILKFNSRGGVGIGAQLRTL

SEQ ID NO: 969599 - protein, 20 aa, Mycobacterium
GKQRPGVFSVDGPVTNGPVW

SEQ ID NO: 969600 - protein, 18 aa, Mycobacterium
GKSSLLWISIVATPIVLF

SEQ ID NO: 969601 - protein, 18 aa, Mycobacterium
GKSTLAWVMAGLTVPTTG

SEQ ID NO: 969602 - protein, 19 aa, Mycobacterium
GKTRLANVVAALDDKINAM

SEQ ID NO: 969603 - protein, 17 aa, Mycobacterium
GKVAAAVACEVKDKATA

SEQ ID NO: 969604 - protein, 24 aa, Mycobacterium
GLAAKDIPLVFGYDYQTVERSLNA

SEQ ID NO: 969605 - protein, 20 aa, Mycobacterium
GLACFVPLLPWIGTLVGPVP

SEQ ID NO: 969606 - protein, 22 aa, Mycobacterium
GLAKGLALLVLYGLATVLLAPY

SEQ ID NO: 969607 - protein, 23 aa, Mycobacterium
GLALAYRTRPVFVPNNDNDPVAR

SEQ ID NO: 969608 - protein, 19 aa, Mycobacterium
GLALMRWSPIDLLPKHREA

SEQ ID NO: 969609 - protein, 20 aa, Mycobacterium
GLALPFLFWVWMRHLHERRG

SEQ ID NO: 969610 - protein, 20 aa, Mycobacterium
GLANGLGFLAGAIVGYYLLR

SEQ ID NO: 969611 - protein, 26 aa, Mycobacterium
GLDAPRLIPLSGRPRPAPRRASSAER

SEQ ID NO: 969612 - protein, 20 aa, Mycobacterium
GLDLGRLASGMPREAAIPFS

SEQ ID NO: 969613 - protein, 17 aa, Mycobacterium
GLELALWCDLRVAEQDS

SEQ ID NO: 969614 - protein, 23 aa, Mycobacterium
GLFDTWPELILPYITFALPLAIY

SEQ ID NO: 969615 - protein, 19 aa, Mycobacterium
GLGAHIGRGVWCESYWLPE

SEQ ID NO: 969616 - protein, 17 aa, Mycobacterium
GLGAVLIAHGLQKLFGW

SEQ ID NO: 969617 - protein, 23 aa, Mycobacterium
GLGEPAGSFARRGAARRHRGAND

SEQ ID NO: 969618 - protein, 25 aa, Mycobacterium
GLGISRISLNFAMFRSAFEQGAQLG

SEQ ID NO: 969619 - protein, 25 aa, Mycobacterium
GLGLRSGGPLAILFSLVVIGIAAFS

SEQ ID NO: 969620 - protein, 34 aa, Mycobacterium; identical to SEQ ID NO: 309318

SEQ ID NO: 969621 - protein, 26 aa, Mycobacterium
GLGSWPEVIGALLLVVVAAAGIARGL

SEQ ID NO: 969622 - protein, 18 aa, Mycobacterium
GLIRKLRADKKHVLSIQD

SEQ ID NO: 969623 - protein, 20 aa, Mycobacterium
GLIVDRVRLRGVALVGAALV

SEQ ID NO: 969624 - protein, 18 aa, Mycobacterium
GLLGVALYGLVGVALQGA

SEQ ID NO: 969625 - protein, 19 aa, Mycobacterium
GLLLACIVLRGLATMRVPW

SEQ ID NO: 969626 - protein, 19 aa, Mycobacterium
GLLVCGARVALLLVAKNGL

SEQ ID NO: 969627 - protein, 20 aa, Mycobacterium
GLLVSWLGGMLLSGILTVVV

SEQ ID NO: 969628 - protein, 29 aa, Mycobacterium
GLMNRRAVLKSSYAQFIFLLSGADHDQMD

SEQ ID NO: 969629 - protein, 23 aa, Mycobacterium
GLMPLKLFPHWIHPFVRNQPITQ

SEQ ID NO: 969630 - protein, 19 aa, Mycobacterium
GLNTSYRMVIWVTSGYVLA

SEQ ID NO: 969631 - protein, 17 aa, Mycobacterium
GLPHGLSTVLIVGAQAV

SEQ ID NO: 969632 - protein, 18 aa, Mycobacterium
GLQARRNLHDLLLAATSR

SEQ ID NO: 969633 - protein, 22 aa, Mycobacterium
GLRPGEEKLVFSRFWRADPSRV

SEQ ID NO: 969634 - protein, 20 aa, Mycobacterium
GLRRMKLVALGFLVGATIVF

SEQ ID NO: 969635 - protein, 24 aa, Mycobacterium
GLRTRFGAWLGRPMTSFHLIIAVA

SEQ ID NO: 969636 - protein, 24 aa, Mycobacterium
GLSALLCPLLVYGWLGLPRMELAG

SEQ ID NO: 969637 - protein, 24 aa, Mycobacterium
GLSLFYWWFHTIDKTLPVFVVLVY

SEQ ID NO: 969638 - protein, 23 aa, Mycobacterium
GLTSLRAGLIAGAIGLALVLLYS

SEQ ID NO: 969639 - protein, 23 aa, Mycobacterium
GLTTYRFTQNIGYNSEGKLVAPV

SEQ ID NO: 969640 - protein, 25 aa, Mycobacterium
GLVCAIGLSGGYAFSVFLQGVNPGA

SEQ ID NO: 969641 - protein, 19 aa, Mycobacterium
GLVGCFVFSLIRPNGQVGS

SEQ ID NO: 969642 - protein, 18 aa, Mycobacterium
GLVIATAVAVSWTARALG

SEQ ID NO: 969643 - protein, 22 aa, Mycobacterium
GLVLCALVPLLPVKQTTATILW

SEQ ID NO: 969644 - protein, 20 aa, Mycobacterium
GLWTFGWSRLPRLVHLACIW

SEQ ID NO: 969645 - protein, 17 aa, Mycobacterium
GMRGYAGFATWAATAPD

SEQ ID NO: 969646 - protein, 23 aa, Mycobacterium
GMSEVHLARDLRLHRDVAVKVLR

SEQ ID NO: 969647 - protein, 24 aa, Mycobacterium
GMSLHEPYLMGCLNARNELSQISY

SEQ ID NO: 969648 - protein, 18 aa, Mycobacterium
GMVLASIFVTLPFVVREV

SEQ ID NO: 969649 - protein, 18 aa, Mycobacterium
GMVTRAGLRPVGRLTEAA

SEQ ID NO: 969650 - protein, 27 aa, Mycobacterium
GNDLRLYLDGGLQFSTRDEYRYTESLV

SEQ ID NO: 969651 - protein, 18 aa, Mycobacterium
GNLLPDILLIKSARDLRD

SEQ ID NO: 969652 - protein, 18 aa, Mycobacterium
GNLLTLVAAAGFYCYVLT

SEQ ID NO: 969653 - protein, 23 aa, Mycobacterium
GNPRTGRLATLFHRLPAHAVSCG

SEQ ID NO: 969654 - protein, 19 aa, Mycobacterium
GNPYPGWFLSAAEPTGYFL

SEQ ID NO: 969655 - protein, 19 aa, Mycobacterium
GNRELEAFAPLNIPNSDLH

SEQ ID NO: 969656 - protein, 17 aa, Mycobacterium
GNSLGWATSCPPPRHNF

SEQ ID NO: 969657 - protein, 23 aa, Mycobacterium
GNTALSWLVQYAVVLAGELLCFV

SEQ ID NO: 969658 - protein, 17 aa, Mycobacterium
GNVILMLGIPLALGSYW

SEQ ID NO: 969659 - protein, 18 aa, Mycobacterium
GNVNEFRHGLLILVALAA

SEQ ID NO: 969660 - protein, 17 aa, Mycobacterium
GNVRGWDVLFSSNGATD

SEQ ID NO: 969661 - protein, 18 aa, Mycobacterium
GPALFAFNGYDWPLYFSE

SEQ ID NO: 969662 - protein, 18 aa, Mycobacterium
GPDFGKASPLGLLVVVVL

SEQ ID NO: 969663 - protein, 25 aa, Mycobacterium
GPDGGWRGNAAQAYWVQNLAQSRHA

SEQ ID NO: 969664 - protein, 20 aa, Mycobacterium
GPELRRLITGSSKLAIDARA

SEQ ID NO: 969665 - protein, 26 aa, Mycobacterium
GPEPLERRRAWLHKLTPGKVVVAVVG

SEQ ID NO: 969666 - protein, 26 aa, Mycobacterium
GPHLFDRDGVDFAIGPPPPALPYLDV

SEQ ID NO: 969667 - protein, 17 aa, Mycobacterium
GPIGGPILGGWLISSFG

SEQ ID NO: 969668 - protein, 20 aa, Mycobacterium
GPILGGWLIDAFGWQWIFLI

SEQ ID NO: 969669 - protein, 25 aa, Mycobacterium
GPKRLGRLMAAIGIPMLLGPIGGPI

SEQ ID NO: 969670 - protein, 28 aa, Mycobacterium
GPLTRLTARWRLPAVIQLAVRSLTRSRG

SEQ ID NO: 969671 - protein, 19 aa, Mycobacterium
GPPLLRWAPGIRGRTIVVW

SEQ ID NO: 969672 - protein, 26 aa, Mycobacterium
GPPPRRIVSGIMGRTILIWLLGSGVP

SEQ ID NO: 969673 - protein, 19 aa, Mycobacterium
GPQLSFGVAAPFLYQDEMG

SEQ ID NO: 969674 - protein, 20 aa, Mycobacterium
GPRMPMIPGTWSADSAPSSG

SEQ ID NO: 969675 - protein, 17 aa, Mycobacterium
GPTVTRYEVELGPGVKV

SEQ ID NO: 969676 - protein, 19 aa, Mycobacterium
GPVAAAFRLSSGDLVARVG

SEQ ID NO: 969677 - protein, 19 aa, Mycobacterium
GPVAAMWGSVLLLAATAPA

SEQ ID NO: 969678 - protein, 18 aa, Mycobacterium
GPVALVRPWRAPVVLVVM

SEQ ID NO: 969679 - protein, 34 aa, Mycobacterium; identical to SEQ ID NO: 309888

SEQ ID NO: 969680 - protein, 19 aa, Mycobacterium
GPYRRRLLRVTRWDVGLAM

SEQ ID NO: 969681 - protein, 20 aa, Mycobacterium
GQAADWAPWIWAVLVAGVGF

SEQ ID NO: 969682 - protein, 20 aa, Mycobacterium
GQESFNFGELFAFTKVCSHL

SEQ ID NO: 969683 - protein, 20 aa, Mycobacterium
GQFFSWIPVISLSYAQIIIG

SEQ ID NO: 969684 - protein, 24 aa, Mycobacterium
GQGRARSGAAVKFLLYNLFGGLIM

SEQ ID NO: 969685 - protein, 26 aa, Mycobacterium
GQIFFCSLAGYAFARLEFRGRDTLFV

SEQ ID NO: 969686 - protein, 30 aa, Mycobacterium; identical to SEQ ID NO: 309948

SEQ ID NO: 969687 - protein, 26 aa, Mycobacterium
GQLTFESPMLFSLGFLVTFLAGGLTG

SEQ ID NO: 969688 - protein, 23 aa, Mycobacterium
GQLTVAVAFIGMWASLVDLGIGR

SEQ ID NO: 969689 - protein, 17 aa, Mycobacterium
GQPHLSATLGLLPDADA

SEQ ID NO: 969690 - protein, 25 aa, Mycobacterium
GQPLARFGHMIAFYLHTVLAIPVAL

SEQ ID NO: 969691 - protein, 25 aa, Mycobacterium
GQPMTKMSIAGPWVSIAAPGTDVIG

SEQ ID NO: 969692 - protein, 18 aa, Mycobacterium
GQPSKFTMAGPWVGIAAP

SEQ ID NO: 969693 - protein, 19 aa, Mycobacterium
GQRALLWAAGVLGALAIII

SEQ ID NO: 969694 - protein, 23 aa, Mycobacterium
GQRFPVKYYLTAMLFIVFDIEIV

SEQ ID NO: 969695 - protein, 22 aa, Mycobacterium
GQRRIPVQYAKRMVGRRMYGGT

SEQ ID NO: 969696 - protein, 23 aa, Mycobacterium
GQTVFRIRLPLIDAPLNASAPGR

SEQ ID NO: 969697 - protein, 17 aa, Mycobacterium
GQVLFAFLLVAQNSDSR

SEQ ID NO: 969698 - protein, 21 aa, Mycobacterium
GRAAARIPWQLADITEYTDGY

SEQ ID NO: 969699 - protein, 21 aa, Mycobacterium
GRALCAITHGLLWSVIAPIAT

SEQ ID NO: 969700 - protein, 30 aa, Mycobacterium; identical to SEQ ID NO: 310066

SEQ ID NO: 969701 - protein, 23 aa, Mycobacterium
GRGPNAWTSLAWRELAQRGMRIN

SEQ ID NO: 969702 - protein, 22 aa, Mycobacterium
GRGVIWSGVVSKVIVPAVVAAL

SEQ ID NO: 969703 - protein, 19 aa, Mycobacterium
GRIKDLVIIDGRNHYPQDL

SEQ ID NO: 969704 - protein, 20 aa, Mycobacterium
GRILAQSWVEYGFPSPRMVH

SEQ ID NO: 969705 - protein, 17 aa, Mycobacterium
GRKPLRFTSFGDQGTPT

SEQ ID NO: 969706 - protein, 28 aa, Mycobacterium
GRLAGAGRIGVKVGKVLAKFKMAKHFHL

SEQ ID NO: 969707 - protein, 17 aa, Mycobacterium
GRLATPWERSSRGRRRF

SEQ ID NO: 969708 - protein, 18 aa, Mycobacterium
GRLFTPFFITVGLVEAAY

SEQ ID NO: 969709 - protein, 17 aa, Mycobacterium
GRLPAAVLTLDQQSERV

SEQ ID NO: 969710 - protein, 19 aa, Mycobacterium
GRLVTMLLVGVVLLAVGYS

SEQ ID NO: 969711 - protein, 22 aa, Mycobacterium
GRNRLGAALCGLALLTGSALQR

SEQ ID NO: 969712 - protein, 22 aa, Mycobacterium
GRRAERRLAFALVAPATILMLL

SEQ ID NO: 969713 - protein, 23 aa, Mycobacterium
GRRRARRWSVGDVVRLEAFLHHV

SEQ ID NO: 969714 - protein, 20 aa, Mycobacterium
GRTAVALGIGAGIGAIFAAP

SEQ ID NO: 969715 - protein, 19 aa, Mycobacterium
GRTAYLVMELVNGEPLNSV

SEQ ID NO: 969716 - protein, 31 aa, Mycobacterium
GRTEATMLWLRNWLRAHRRQIIAVAVGLAGI

SEQ ID NO: 969717 - protein, 19 aa, Mycobacterium
GRTGKLGVRDVLFGGQVSY

SEQ ID NO: 969718 - protein, 18 aa, Mycobacterium
GRTGRYKIFPVLGTALMT

SEQ ID NO: 969719 - protein, 20 aa, Mycobacterium
GRTHPLRIAGMVGLASAVVI

SEQ ID NO: 969720 - protein, 19 aa, Mycobacterium
GRTIREFIGAVLLVPTVIA

SEQ ID NO: 969721 - protein, 18 aa, Mycobacterium
GRVGIGIKLTGGRTAQAW

SEQ ID NO: 969722 - protein, 25 aa, Mycobacterium
GRVVALEHPGSWGGLVDLPESPDDA

SEQ ID NO: 969723 - protein, 19 aa, Mycobacterium
GRWARSVCRAAGFEPDVRF

SEQ ID NO: 969724 - protein, 29 aa, Mycobacterium
GRWEWSPLYFKEISWVGSNAFGVEEVEGV

SEQ ID NO: 969725 - protein, 25 aa, Mycobacterium
GRYKIFPVLGTALMTLAFLLMSRTD

SEQ ID NO: 969726 - protein, 31 aa, Mycobacterium; identical to SEQ ID NO: 310275

SEQ ID NO: 969727 - protein, 23 aa, Mycobacterium
GRYRVVSALSRRGDELIVTGLSM

SEQ ID NO: 969728 - protein, 25 aa, Mycobacterium
GSASMAAFMTWRITAEMPPGFDADR

SEQ ID NO: 969729 - protein, 17 aa, Mycobacterium
GSAVCFISSVAGMGWEN

SEQ ID NO: 969730 - protein, 17 aa, Mycobacterium
GSDRLIVGVSLSIADRI

SEQ ID NO: 969731 - protein, 17 aa, Mycobacterium
GSDVLWVGVELVLGLAL

SEQ ID NO: 969732 - protein, 23 aa, Mycobacterium
GSFRRWEQMMFLLIAVNVVIIPM

SEQ ID NO: 969733 - protein, 21 aa, Mycobacterium
GSGALSWFSPLGWSLLVRPYA

SEQ ID NO: 969734 - protein, 17 aa, Mycobacterium
GSGHLRAERTHHIVVVM

SEQ ID NO: 969735 - protein, 23 aa, Mycobacterium
GSGLLLFTFVRKARRGVRPPTSD

SEQ ID NO: 969736 - protein, 21 aa, Mycobacterium
GSIAGYFGRWRDRVLMWVVDL

SEQ ID NO: 969737 - protein, 26 aa, Mycobacterium
GSILCGIGIRCVMPVLASAAIDAMPG

SEQ ID NO: 969738 - protein, 23 aa, Mycobacterium
GSKAGLLPLHAWLPRAHPESPSP

SEQ ID NO: 969739 - protein, 17 aa, Mycobacterium
GSKVGLLPMWEIVMILL

SEQ ID NO: 969740 - protein, 17 aa, Mycobacterium
GSLLILFGIYRWLNRHG

SEQ ID NO: 969741 - protein, 23 aa, Mycobacterium
GSLLRLLILGVIMAPIVIAVLLA

SEQ ID NO: 969742 - protein, 17 aa, Mycobacterium
GSLLWRAVNRRFGVRGM

SEQ ID NO: 969743 - protein, 20 aa, Mycobacterium
GSLPRLLSTRVMVYGGEISF

SEQ ID NO: 969744 - protein, 17 aa, Mycobacterium
GSLRPLFTMSPCSRWST

SEQ ID NO: 969745 - protein, 18 aa, Mycobacterium
GSLVVHWATMQELYGITD

SEQ ID NO: 969746 - protein, 17 aa, Mycobacterium
GSPATASARGWSTSTAS

SEQ ID NO: 969747 - protein, 26 aa, Mycobacterium
GSQKSLVCGLPMAMVMFPEAISGVVM

SEQ ID NO: 969748 - protein, 20 aa, Mycobacterium
GSQLDFLPIMLVVFGVGSLN

SEQ ID NO: 969749 - protein, 19 aa, Mycobacterium
GSSADLRVGQPVVAVGSPL

SEQ ID NO: 969750 - protein, 26 aa, Mycobacterium
GSSLREVLPLVVPVILASLLFAGGLV

SEQ ID NO: 969751 - protein, 24 aa, Mycobacterium
GSVCLCRHDRAALPVRPGGGVVSP

SEQ ID NO: 969752 - protein, 22 aa, Mycobacterium
GSVCPLRILPRLKLHEQGCNSG

SEQ ID NO: 969753 - protein, 29 aa, Mycobacterium
GSVEDMLQRSGVPRPSLAAVAAVGGGAAI

SEQ ID NO: 969754 - protein, 19 aa, Mycobacterium
GSVHLRVWFAERLAEASGA

SEQ ID NO: 969755 - protein, 17 aa, Mycobacterium
GSVPFPISALISGLVNA

SEQ ID NO: 969756 - protein, 22 aa, Mycobacterium
GSWQSARFALSRVDTIPDEASC

SEQ ID NO: 969757 - protein, 30 aa, Mycobacterium
GTALHRLFTHAGIHPDYLLGHSIGELTAAY

SEQ ID NO: 969758 - protein, 31 aa, Mycobacterium; identical to SEQ ID NO: 310482

SEQ ID NO: 969759 - protein, 26 aa, Mycobacterium
GTCALAALCYAEFASTLPVAGSAYTF

SEQ ID NO: 969760 - protein, 19 aa, Mycobacterium
GTCLFVWQLAAARRGARGA

SEQ ID NO: 969761 - protein, 19 aa, Mycobacterium
GTEPDFLRRWLPGQLLQGI

SEQ ID NO: 969762 - protein, 19 aa, Mycobacterium
GTIGGLFTAVSIPFLMFTQ

SEQ ID NO: 969763 - protein, 20 aa, Mycobacterium
GTILGWLVARGWRRPTSVAP

SEQ ID NO: 969764 - protein, 18 aa, Mycobacterium
GTIPRLSLTGLLDIARLR

SEQ ID NO: 969765 - protein, 22 aa, Mycobacterium
GTITYWLVHMIGGYPGAIIGFA

SEQ ID NO: 969766 - protein, 17 aa, Mycobacterium
GTIVRFDGAVPFVNLQV

SEQ ID NO: 969767 - protein, 22 aa, Mycobacterium
GTLAAFLWSLYALFLGTAGEPG

SEQ ID NO: 969768 - protein, 17 aa, Mycobacterium
GTLQRWLEPVGGAHEEA

SEQ ID NO: 969769 - protein, 17 aa, Mycobacterium
GTLVAGIVAGQPGNDGF

SEQ ID NO: 969770 - protein, 19 aa, Mycobacterium
GTVGEIWAHGEHVAMGYWQ

SEQ ID NO: 969771 - protein, 24 aa, Mycobacterium
GTVIAILLVWSRLPAMVRMVPGPL

SEQ ID NO: 969772 - protein, 30 aa, Mycobacterium
GTVSHFQRAVLRIGNYLIVLAAALVALTVA

SEQ ID NO: 969773 - protein, 21 aa, Mycobacterium
GTVVRQIVKLAFRGSDRQEAH

SEQ ID NO: 969774 - protein, 19 aa, Mycobacterium
GTWLVYRITATVSEKDTER

SEQ ID NO: 969775 - protein, 20 aa, Mycobacterium
GTWRDVRLGLVFGLGGLVVS

SEQ ID NO: 969776 - protein, 17 aa, Mycobacterium
GTWWGWHGAGWFLLTLM

SEQ ID NO: 969777 - protein, 23 aa, Mycobacterium
GTYLGGWRIIRTLGKGLVEIKPP

SEQ ID NO: 969778 - protein, 19 aa, Mycobacterium
GVAALRYLAIDLVTGRFPW

SEQ ID NO: 969779 - protein, 27 aa, Mycobacterium
GVAFALVAACFWALYILAGKRITGQQT

SEQ ID NO: 969780 - protein, 28 aa, Mycobacterium
GVAGRLFGRFDLAVAVFFALSGFLLWRG

SEQ ID NO: 969781 - protein, 22 aa, Mycobacterium
GVALCARLWFIGRRVIATVGHN

SEQ ID NO: 969782 - protein, 30 aa, Mycobacterium
GVAPGQCRLRRSAGFAVRFQAERGGFGRSV

SEQ ID NO: 969783 - protein, 19 aa, Mycobacterium
GVAQLPWMIGAVLVGTLCT

SEQ ID NO: 969784 - protein, 25 aa, Mycobacterium
GVAQTEIFPLLTLSVGGMMVFPAAN

SEQ ID NO: 969785 - protein, 19 aa, Mycobacterium
GVASIIQSVGFWKIGVRLP

SEQ ID NO: 969786 - protein, 26 aa, Mycobacterium
GVATRAQYLPTLLVGLAIMGMGTGCT

SEQ ID NO: 969787 - protein, 18 aa, Mycobacterium
GVAWRRSLQLRVVALTLG

SEQ ID NO: 969788 - protein, 20 aa, Mycobacterium
GVAYLDSWSAAIAVGLAAMF

SEQ ID NO: 969789 - protein, 23 aa, Mycobacterium
GVEALRHGWVLAAVCFAAVAVLA

SEQ ID NO: 969790 - protein, 28 aa, Mycobacterium
GVGALLRLPYTFAIPVFGGRNWTTISAS

SEQ ID NO: 969791 - protein, 28 aa, Mycobacterium
GVGLWLLKRWGEYFAVVATSVFLPLEIH

SEQ ID NO: 969792 - protein, 26 aa, Mycobacterium
GVIQRCARTPLATGLEVRAAGFTAIE

SEQ ID NO: 969793 - protein, 24 aa, Mycobacterium
GVKHPGWVNFWFAVSFVLGPITTR

SEQ ID NO: 969794 - protein, 26 aa, Mycobacterium
GVLAVVGVCRLRRARQSPSAPADNSS

SEQ ID NO: 969795 - protein, 19 aa, Mycobacterium
GVLFQPNFHLPIIGRWNAI

SEQ ID NO: 969796 - protein, 24 aa, Mycobacterium
GVLGWWRWHHNTWLTTIFASVIAV

SEQ ID NO: 969797 - protein, 26 aa, Mycobacterium
GVLLWQHLFWFFGHPEVYILALPFFG

SEQ ID NO: 969798 - protein, 18 aa, Mycobacterium
GVLPGSVVTPVLKARGRA

SEQ ID NO: 969799 - protein, 25 aa, Mycobacterium
GVLPSVIMPTFFGVFPILRNVVVGL

SEQ ID NO: 969800 - protein, 17 aa, Mycobacterium
GVLTWVNVWNDFLWPLL

SEQ ID NO: 969801 - protein, 17 aa, Mycobacterium
GVLVIGIMVAWRWAPAK

SEQ ID NO: 969802 - protein, 23 aa, Mycobacterium
GVMAGPGIPVWLRAPRAIPGALV

SEQ ID NO: 969803 - protein, 23 aa, Mycobacterium
GVMLALGGALAFVVIYITMTVNM

SEQ ID NO: 969804 - protein, 25 aa, Mycobacterium
GVPKWKTIVRIVVPIAMPGIVSGVL

SEQ ID NO: 969805 - protein, 23 aa, Mycobacterium
GVPLLLGALWASGRFARRADKVA

SEQ ID NO: 969806 - protein, 25 aa, Mycobacterium
GVPPARLTKMTAMPQLVAFFNGVGG

SEQ ID NO: 969807 - protein, 21 aa, Mycobacterium
GVPYFPNLVAPIVIGGIGIGM

SEQ ID NO: 969808 - protein, 26 aa, Mycobacterium
GVRAVLAFRGYFYWDDLILVGRAGTQ

SEQ ID NO: 969809 - protein, 30 aa, Mycobacterium
GVRDVLFGGRVSYLALVILVFIALALGAIG

SEQ ID NO: 969810 - protein, 24 aa, Mycobacterium
GVRFRWPSEKTFRAVLSRLDPADL

SEQ ID NO: 969811 - protein, 19 aa, Mycobacterium
GVRIGGLFTALGVTSVVIG

SEQ ID NO: 969812 - protein, 18 aa, Mycobacterium
GVRLVPLAFSYAGLSVIA

SEQ ID NO: 969813 - protein, 25 aa, Mycobacterium
GVRRWRAAVCSAIVFLVSVGVSLLI

SEQ ID NO: 969814 - protein, 19 aa, Mycobacterium
GVRTARIVTPRVMQFTLRA

SEQ ID NO: 969815 - protein, 17 aa, Mycobacterium
GVSDWPGVVVVPAPQPA

SEQ ID NO: 969816 - protein, 23 aa, Mycobacterium
GVSSFGFGGANAHVVVREVLPRD

SEQ ID NO: 969817 - protein, 18 aa, Mycobacterium
GVSTCWEVIFDRAPRRAV

SEQ ID NO: 969818 - protein, 21 aa, Mycobacterium
GVTDPRTWGLVGWISDLVPHL

SEQ ID NO: 969819 - protein, 21 aa, Mycobacterium
GVTGLPRRASTVGLVALVSAQ

SEQ ID NO: 969820 - protein, 34 aa, Mycobacterium
GVTLNRSRLGRGWLTGIAVALLLAGCGIGTGGYC

SEQ ID NO: 969821 - protein, 21 aa, Mycobacterium
GVTVALCLGGGVFGLSLGKHV

SEQ ID NO: 969822 - protein, 23 aa, Mycobacterium
GVTVTLWAFAFVGVRSAGRVFSP

SEQ ID NO: 969823 - protein, 17 aa, Mycobacterium
GVTVVHCSSTLPHREQY

SEQ ID NO: 969824 - protein, 17 aa, Mycobacterium
GVVGRVIGGLARALLGM

SEQ ID NO: 969825 - protein, 30 aa, Mycobacterium; identical to SEQ ID NO: 310908

SEQ ID NO: 969826 - protein, 20 aa, Mycobacterium
GVVTFILALILKYTIGLRLG

SEQ ID NO: 969827 - protein, 26 aa, Mycobacterium
GWDRQQWRSAALFAVALAGMNGFFFA

SEQ ID NO: 969828 - protein, 23 aa, Mycobacterium
GWKAIVCNRSFLGFAAAMTGAYV

SEQ ID NO: 969829 - protein, 20 aa, Mycobacterium
GWLAGMWRDLLGAAISGPEA

SEQ ID NO: 969830 - protein, 29 aa, Mycobacterium
GWSAMPLALRLLLPIAFVLISAGIGVAFW

SEQ ID NO: 969831 - protein, 18 aa, Mycobacterium
GWSDGLVVRGWPKVLADG

SEQ ID NO: 969832 - protein, 24 aa, Mycobacterium
GWTGMRLFAARCALTVAIAALSWW

SEQ ID NO: 969833 - protein, 18 aa, Mycobacterium
GWVAHRLLSAPLSAARAA

SEQ ID NO: 969834 - protein, 28 aa, Mycobacterium
GWWRSGRLFCIAVGFLALVFASSTTAGV

SEQ ID NO: 969835 - protein, 18 aa, Mycobacterium
GYFRKSLEDIIRFQAEFL

SEQ ID NO: 969836 - protein, 18 aa, Mycobacterium
GYGSAAYWVEHVRKPVRF

SEQ ID NO: 969837 - protein, 33 aa, Mycobacterium; identical to SEQ ID NO: 311040

SEQ ID NO: 969838 - protein, 19 aa, Mycobacterium
GYHPVRSRTGWQLWTTERL

SEQ ID NO: 969839 - protein, 17 aa, Mycobacterium
GYLPIRVPIEVNFTQRV

SEQ ID NO: 969840 - protein, 21 aa, Mycobacterium
GYMRVPAMVGIGQYRVTVELP

SEQ ID NO: 969841 - protein, 23 aa, Mycobacterium
GYSARLLTGIAIAFAGVVLISAG

SEQ ID NO: 969842 - protein, 27 aa, Mycobacterium
GYVVIASVGLWWFIRRQISRQRRGIEP

SEQ ID NO: 969843 - protein, 17 aa, Mycobacterium
HAAASPAIWAAQEQPDP

SEQ ID NO: 969844 - protein, 20 aa, Mycobacterium
HAAGAARLRVRITPADAGSV

SEQ ID NO: 969845 - protein, 24 aa, Mycobacterium
HAIYILKLIFGYALGVVIVATLTS

SEQ ID NO: 969846 - protein, 25 aa, Mycobacterium
HALAYSGFRRPGLDLSGRPSGRAGY

SEQ ID NO: 969847 - protein, 22 aa, Mycobacterium
HANHYFAREAMKPEVTLANYKV

SEQ ID NO: 969848 - protein, 17 aa, Mycobacterium
HAPHPQDLLSIVGTQRQ

SEQ ID NO: 969849 - protein, 22 aa, Mycobacterium
HAVAQRVARRPAPVALVTVALL

SEQ ID NO: 969850 - protein, 17 aa, Mycobacterium
HDLDMRTLFQGPAGPAD

SEQ ID NO: 969851 - protein, 20 aa, Mycobacterium
HDLSHAYAVVFVVAVGLVAL

SEQ ID NO: 969852 - protein, 25 aa, Mycobacterium
HDRGEFNGQLWISMDYIEGTDAAAL

SEQ ID NO: 969853 - protein, 17 aa, Mycobacterium
HDVLRCAVHAAPATNGG

SEQ ID NO: 969854 - protein, 23 aa, Mycobacterium
HDVVWPVMIVLLLNVAAAYSAKR

SEQ ID NO: 969855 - protein, 20 aa, Mycobacterium
HDWHSLPIAEVRRLLPRPAE

SEQ ID NO: 969856 - protein, 17 aa, Mycobacterium
HDWVECGEWIRELRPHI

SEQ ID NO: 969857 - protein, 22 aa, Mycobacterium
HEAVEILAALNFAAVLMGTALT

SEQ ID NO: 969858 - protein, 19 aa, Mycobacterium
HELLYYKVLTEHLVELMPV

SEQ ID NO: 969859 - protein, 21 aa, Mycobacterium
HELRTPLTTIRGFAELYRQGA

SEQ ID NO: 969860 - protein, 21 aa, Mycobacterium
HELRTPLTTVRMAADLIYDHS

SEQ ID NO: 969861 - protein, 23 aa, Mycobacterium
HETGVDWDVIFLLLGMMIIVSVL

SEQ ID NO: 969862 - protein, 24 aa, Mycobacterium
HFFGCTPLGPVAWTGVFSATAGAT

SEQ ID NO: 969863 - protein, 19 aa, Mycobacterium
HFLIVGYLFYWAIIGIDPG

SEQ ID NO: 969864 - protein, 23 aa, Mycobacterium
HFWRVFEGIPQWALALFALGIAL

SEQ ID NO: 969865 - protein, 26 aa, Mycobacterium
HGAFVVRGAMKVAWDKFKGATGKLGA

SEQ ID NO: 969866 - protein, 26 aa, Mycobacterium
HGANAGWWPVLWFTAKVWGFLFMYFW

SEQ ID NO: 969867 - protein, 18 aa, Mycobacterium
HGGGHGRGGFNIPFIPGI

SEQ ID NO: 969868 - protein, 17 aa, Mycobacterium
HGGSRFRALWAAGAGLV

SEQ ID NO: 969869 - protein, 18 aa, Mycobacterium
HGIWPWVVVLTLLVAGAF

SEQ ID NO: 969870 - protein, 25 aa, Mycobacterium
HGLLIKCGIVLLLVFTAFVANSALH

SEQ ID NO: 969871 - protein, 26 aa, Mycobacterium
HGRFLCPGAWLARCEMQSLLRGLVTR

SEQ ID NO: 969872 - protein, 17 aa, Mycobacterium
HHHHGMFKPGGSGGPGG

SEQ ID NO: 969873 - protein, 19 aa, Mycobacterium
HHPAMMLRPGMHHGGAPAV

SEQ ID NO: 969874 - protein, 24 aa, Mycobacterium
HHVRREHPYMLAITAGTDCGIFLV

SEQ ID NO: 969875 - protein, 24 aa, Mycobacterium
HHWARVRSGALIGFAGSFGALGGV

SEQ ID NO: 969876 - protein, 18 aa, Mycobacterium
HIAVKMPKMITGLRSFSI

SEQ ID NO: 969877 - protein, 20 aa, Mycobacterium
HITVGLLLRIKSSGVVFRTA

SEQ ID NO: 969878 - protein, 17 aa, Mycobacterium
HIYLNVCIREVLWPIVL

SEQ ID NO: 969879 - protein, 24 aa, Mycobacterium
HKDLTHVFAGFYIVGCIAAVLAVR

SEQ ID NO: 969880 - protein, 18 aa, Mycobacterium
HKGCYGRVVADPKLIEPT

SEQ ID NO: 969881 - protein, 20 aa, Mycobacterium
HLAVDMGFALSVVATAALVV

SEQ ID NO: 969882 - protein, 35 aa, Mycobacterium
HLLQLPAWITQRLWWALLLTIGFWGLLRVAEGLGI

SEQ ID NO: 969883 - protein, 17 aa, Mycobacterium
HLSFGLLLAGSFVLFSF

SEQ ID NO: 969884 - protein, 22 aa, Mycobacterium
HLSPGRWYTWVIAIVGVDLLYY

SEQ ID NO: 969885 - protein, 26 aa, Mycobacterium
HLWQARLAPQAKPYRGWHRVHGVEVV

SEQ ID NO: 969886 - protein, 22 aa, Mycobacterium
HLYDRKGFHRIPGAVEMAIAAE

SEQ ID NO: 969887 - protein, 25 aa, Mycobacterium
HLYPGRTGTSFALLTGQIVGVGYSG

SEQ ID NO: 969888 - protein, 23 aa, Mycobacterium
HMGRQAFAAVLGRGLASEGQLVL

SEQ ID NO: 969889 - protein, 27 aa, Mycobacterium
HNEVWAHYAGWWAFDIGMLVTFGVVAA

SEQ ID NO: 969890 - protein, 23 aa, Mycobacterium
HNGRPRAGTWFLSSAVLADHVER

SEQ ID NO: 969891 - protein, 21 aa, Mycobacterium
HNLFKPLLLFFYFGFLIPILK

SEQ ID NO: 969892 - protein, 23 aa, Mycobacterium
HPALSLLLPMVFIALGGIGLPGA

SEQ ID NO: 969893 - protein, 17 aa, Mycobacterium
HPAPRPARAEPAPPQPV

SEQ ID NO: 969894 - protein, 21 aa, Mycobacterium
HPARYLSVFLVLLIGVYLLVF

SEQ ID NO: 969895 - protein, 23 aa, Mycobacterium
HPAWHTLILVLLFVAAMWVTYAL

SEQ ID NO: 969896 - protein, 17 aa, Mycobacterium
HPGRTEATMLWLRNWLR

SEQ ID NO: 969897 - protein, 18 aa, Mycobacterium
HPHWARLVWPVVVLILIT

SEQ ID NO: 969898 - protein, 23 aa, Mycobacterium
HPLHGPHRFRYAVTVTYSDDDLL

SEQ ID NO: 969899 - protein, 26 aa, Mycobacterium
HPLMSHLAELGWVCVAINYRHSPRNT

SEQ ID NO: 969900 - protein, 21 aa, Mycobacterium
HPPGALLTFVWLDRIGLGGGA

SEQ ID NO: 969901 - protein, 20 aa, Mycobacterium
HPRLPHLIAGGDYVMAGGDG

SEQ ID NO: 969902 - protein, 19 aa, Mycobacterium
HPRPCRDGSAWPVWIRGCC

SEQ ID NO: 969903 - protein, 24 aa, Mycobacterium
HPSELSWGVVGAWTGSAAAGLLVS

SEQ ID NO: 969904 - protein, 23 aa, Mycobacterium
HPSVPFYRYVRTWKRNEEAYLER

SEQ ID NO: 969905 - protein, 30 aa, Mycobacterium; identical to SEQ ID NO: 311575

SEQ ID NO: 969906 - protein, 17 aa, Mycobacterium
HQVCAHCGAAIGSGSAF

SEQ ID NO: 969907 - protein, 25 aa, Mycobacterium
HQVTGWRFVMRRIASGIALHDTRML

SEQ ID NO: 969908 - protein, 17 aa, Mycobacterium
HRALMAIAIGEAGVANT

SEQ ID NO: 969909 - protein, 20 aa, Mycobacterium
HRAPLISLAIFRDWEFSLCN

SEQ ID NO: 969910 - protein, 28 aa, Mycobacterium
HRCGDRAGGHPGDWARMLGIGEIATYHP

SEQ ID NO: 969911 - protein, 19 aa, Mycobacterium
HREPVPLLTVISAAVSEVE

SEQ ID NO: 969912 - protein, 23 aa, Mycobacterium
HREQWPVAGPVLGRLGWFVESKL

SEQ ID NO: 969913 - protein, 21 aa, Mycobacterium
HRMLLEVAWESLEHAGIAPDS

SEQ ID NO: 969914 - protein, 26 aa, Mycobacterium
HRPNRRWWRYTAWFMLALLLATLWWL

SEQ ID NO: 969915 - protein, 21 aa, Mycobacterium
HRRRIVLADFGIAREVGAISG

SEQ ID NO: 969916 - protein, 18 aa, Mycobacterium
HRRTRTALEATWKYVVIC

SEQ ID NO: 969917 - protein, 19 aa, Mycobacterium
HRSDPDWKRQREWDHEAHD

SEQ ID NO: 969918 - protein, 19 aa, Mycobacterium
HRSGNEFLFQQLAAQAVEI

SEQ ID NO: 969919 - protein, 19 aa, Mycobacterium
HRSTLQLWAGCLTPLANLL

SEQ ID NO: 969920 - protein, 17 aa, Mycobacterium
HSADLLLEPAVSPPAHL

SEQ ID NO: 969921 - protein, 25 aa, Mycobacterium
HSADRLIVIYADFKGEAGADSFRNF

SEQ ID NO: 969922 - protein, 24 aa, Mycobacterium
HSAERLIVIYADFKGEAGADSFRN

SEQ ID NO: 969923 - protein, 31 aa, Mycobacterium; identical to SEQ ID NO: 311672

SEQ ID NO: 969924 - protein, 26 aa, Mycobacterium
HSLHWKISEAPLFYGGYAALLAISAA

SEQ ID NO: 969925 - protein, 18 aa, Mycobacterium
HSNRAVVVGQHLNMPPPR

SEQ ID NO: 969926 - protein, 23 aa, Mycobacterium
HSQPGFFCLLLVYLAATPTLIWQ

SEQ ID NO: 969927 - protein, 21 aa, Mycobacterium
HSTTAWLFDMAMLAALSVVYS

SEQ ID NO: 969928 - protein, 18 aa, Mycobacterium
HSVWILVFTLFFAGLIQQ

SEQ ID NO: 969929 - protein, 27 aa, Mycobacterium
HTIRILAVPIILGWVLLTVLVNVVVPS

SEQ ID NO: 969930 - protein, 24 aa, Mycobacterium
HTLPEEWRMRGVRKYITRTLCLFV

SEQ ID NO: 969931 - protein, 22 aa, Mycobacterium
HTMMFQEMVNRVGADVLGMPRR

SEQ ID NO: 969932 - protein, 18 aa, Mycobacterium
HTSIPFLISMQGTSQKLT

SEQ ID NO: 969933 - protein, 21 aa, Mycobacterium
HTVKDILGRFGHVDYLVNNAG

SEQ ID NO: 969934 - protein, 24 aa, Mycobacterium
HTVWGVGVALAFVTLPFVVRAVQP

SEQ ID NO: 969935 - protein, 19 aa, Mycobacterium
HVLRGSILHDLRRIEESTE

SEQ ID NO: 969936 - protein, 24 aa, Mycobacterium
HVNDLRPSWLPKIMAHVGGTTAEF

SEQ ID NO: 969937 - protein, 18 aa, Mycobacterium
HWGVEIFVTASRGKWDTL

SEQ ID NO: 969938 - protein, 27 aa, Mycobacterium
HWQSPRSSDRFAFFFGLTAINPVTLVY

SEQ ID NO: 969939 - protein, 26 aa, Mycobacterium
HWSLLLGYGCLPWVAATMLGLRAPEA

SEQ ID NO: 969940 - protein, 20 aa, Mycobacterium
HYCHYWKALQFVPQWTLALV

SEQ ID NO: 969941 - protein, 22 aa, Mycobacterium
HYFPRHRFLFGDKYDSVMIDQK

SEQ ID NO: 969942 - protein, 18 aa, Mycobacterium
HYIVLVFLYLGAFVATVI

SEQ ID NO: 969943 - protein, 23 aa, Mycobacterium
IAADDFWYLWRQMVSQPGVVDPA

SEQ ID NO: 969944 - protein, 18 aa, Mycobacterium
IAAKLGLQVRFVGTDFSG

SEQ ID NO: 969945 - protein, 23 aa, Mycobacterium
IAALADWLPYAILFTVAAAALLW

SEQ ID NO: 969946 - protein, 25 aa, Mycobacterium
IAALLGKWFWWPQVVRQRPAPQPWP

SEQ ID NO: 969947 - protein, 20 aa, Mycobacterium
IAALLGRWFWWPQTPPRKRL

SEQ ID NO: 969948 - protein, 23 aa, Mycobacterium
IAALRSRGLRTILLTGDNQAVAD

SEQ ID NO: 969949 - protein, 21 aa, Mycobacterium
IAANYPGVWYRAFDLSEAGPV

SEQ ID NO: 969950 - protein, 18 aa, Mycobacterium
IAARLCLSPRTVGAHLYR

SEQ ID NO: 969951 - protein, 23 aa, Mycobacterium
IAATSRAAWAWFRHLHGLADRTL

SEQ ID NO: 969952 - protein, 22 aa, Mycobacterium
IADAVACGEPQLVVRSGVIHGA

SEQ ID NO: 969953 - protein, 19 aa, Mycobacterium
IADDIRAAIAVGHGVTVRD

SEQ ID NO: 969954 - protein, 18 aa, Mycobacterium
IADGTWPQLYSKWVPRIL

SEQ ID NO: 969955 - protein, 18 aa, Mycobacterium
IADSIGIPETKGSLGGTE

SEQ ID NO: 969956 - protein, 25 aa, Mycobacterium
IAEEMFFRGALYTALGRFYPVAVST

SEQ ID NO: 969957 - protein, 25 aa, Mycobacterium
IAEGISVTAAPGWTLVNRGPNWVTL

SEQ ID NO: 969958 - protein, 17 aa, Mycobacterium
IAERFAEGHLSERMPVR

SEQ ID NO: 969959 - protein, 19 aa, Mycobacterium
IAEVWKTTPFMSLLLLAGL

SEQ ID NO: 969960 - protein, 17 aa, Mycobacterium
IAFLSAPVLELLATLGV

SEQ ID NO: 969961 - protein, 17 aa, Mycobacterium
IAGAACGVLLLRVLMRR

SEQ ID NO: 969962 - protein, 29 aa, Mycobacterium
IAGALGILRLVAVFGPVHFFAQPVVSLIG

SEQ ID NO: 969963 - protein, 18 aa, Mycobacterium
IAGLSLIGGFAWHAWHRA

SEQ ID NO: 969964 - protein, 24 aa, Mycobacterium
IAGMTCASCAMRIEKKLNKLDGVS

SEQ ID NO: 969965 - protein, 25 aa, Mycobacterium
IAGPIARLALVGAAAEGSAVIDQSS

SEQ ID NO: 969966 - protein, 22 aa, Mycobacterium
IAGRQALSAALRFTENLTTIDS

SEQ ID NO: 969967 - protein, 35 aa, Mycobacterium
IAGTFISVLVLWDLFGQLPLPLGVAGHEGSTVLVA

SEQ ID NO: 969968 - protein, 19 aa, Mycobacterium
IAGVIGFFGGFAYGAVSDA

SEQ ID NO: 969969 - protein, 24 aa, Mycobacterium
IAGVLGVVIAHPWRSPGPPTASAP

SEQ ID NO: 969970 - protein, 29 aa, Mycobacterium
IAHELGMPIPAGWKLWLYGVFAITAVGVT

SEQ ID NO: 969971 - protein, 20 aa, Mycobacterium
IAIASLWLLYRYYRTRDPLF

SEQ ID NO: 969972 - protein, 19 aa, Mycobacterium
IAIGGLIFVRAMFLENALN

SEQ ID NO: 969973 - protein, 21 aa, Mycobacterium
IALICASVWLMLNLTALIWIR

SEQ ID NO: 969974 - protein, 25 aa, Mycobacterium
IALNEGRGDFFAVVRSLALFVNALH

SEQ ID NO: 969975 - protein, 24 aa, Mycobacterium
IALRPDTVSALGWYVVAATAATAT

SEQ ID NO: 969976 - protein, 17 aa, Mycobacterium
IALTYVVVNLWDQRRLV

SEQ ID NO: 969977 - protein, 19 aa, Mycobacterium
IAMRTVAVFAHRLYGAITS

SEQ ID NO: 969978 - protein, 18 aa, Mycobacterium
IAPAPWILVLGGEAAAVV

SEQ ID NO: 969979 - protein, 20 aa, Mycobacterium
IAPELYLKRLCVGGVERVFE

SEQ ID NO: 969980 - protein, 19 aa, Mycobacterium
IASMEMFRRRKFGGEAGPV

SEQ ID NO: 969981 - protein, 22 aa, Mycobacterium
IASTILCYYGFYASGGPEGVGV

SEQ ID NO: 969982 - protein, 22 aa, Mycobacterium
IATGCALAAWYALYRAPDLRTR

SEQ ID NO: 969983 - protein, 17 aa, Mycobacterium
IAVCAAVTVLLGILPQP

SEQ ID NO: 969984 - protein, 19 aa, Mycobacterium
IAVPAHFLTGLNWPTAFLV

SEQ ID NO: 969985 - protein, 26 aa, Mycobacterium
IAVPAHWKPTAVQALRNGLRTHVGFV

SEQ ID NO: 969986 - protein, 22 aa, Mycobacterium
IAVSLPLLWWRFRRDDRAALTG

SEQ ID NO: 969987 - protein, 17 aa, Mycobacterium
IAVSVGFGGNPSGGQPR

SEQ ID NO: 969988 - protein, 19 aa, Mycobacterium
ICASCAVPLGVGYRRACTH

SEQ ID NO: 969989 - protein, 18 aa, Mycobacterium
ICLAVDPDLLVTVNAMTA

SEQ ID NO: 969990 - protein, 18 aa, Mycobacterium
ICLGCQLYPLVARLRRAP

SEQ ID NO: 969991 - protein, 25 aa, Mycobacterium
ICSLPFEHARPTAIMTWMRQHCGIE

SEQ ID NO: 969992 - protein, 33 aa, Mycobacterium; identical to SEQ ID NO: 312208

SEQ ID NO: 969993 - protein, 22 aa, Mycobacterium
ICVADPLAFTGCEGVGKGPERI

SEQ ID NO: 969994 - protein, 25 aa, Mycobacterium
IDAEGRLGWPLWAAYVSVFALTVLV

SEQ ID NO: 969995 - protein, 26 aa, Mycobacterium
IDAIGARVGFELGFAVLDHSQHGVAD

SEQ ID NO: 969996 - protein, 18 aa, Mycobacterium
IDAMAGSLGEFFYNDPRR

SEQ ID NO: 969997 - protein, 20 aa, Mycobacterium
IDAPGIFPVLVNVNGTPDYG

SEQ ID NO: 969998 - protein, 24 aa, Mycobacterium
IDAWLRLCQTYGWSPGVMGASSQG

SEQ ID NO: 969999 - protein, 24 aa, Mycobacterium
IDCPGCGILRMLYSLMHGDLLAAA

SEQ ID NO: 970000 - protein, 25 aa, Mycobacterium
IDDALELRGRILSAFEQAERSRDAE

SEQ ID NO: 970001 - protein, 17 aa, Mycobacterium
IDHTVIGCSLVRGTPYR

SEQ ID NO: 970002 - protein, 29 aa, Mycobacterium
IDLTGFWIRRARRLLPALVLMVLTVAAAR

SEQ ID NO: 970003 - protein, 24 aa, Mycobacterium
IDNWVRRLFALPAFPDGSADDVLQ

SEQ ID NO: 970004 - protein, 22 aa, Mycobacterium
IDPTAAINMAWRAAGGATGPLG

SEQ ID NO: 970005 - protein, 25 aa, Mycobacterium
IDQRRRGWRSWALYAAMPAVGVVLT

SEQ ID NO: 970006 - protein, 27 aa, Mycobacterium
IDSRFNYRIPVSLAWTRTSGPAKSDGT

SEQ ID NO: 970007 - protein, 21 aa, Mycobacterium
IDTVLRAKVDAAWNLHEATLD

SEQ ID NO: 970008 - protein, 18 aa, Mycobacterium
IDVAFAIDRAYTMYSSTR

SEQ ID NO: 970009 - protein, 25 aa, Mycobacterium
IDVGQLMRDRFPAVLPVGEVLEIVA

SEQ ID NO: 970010 - protein, 23 aa, Mycobacterium
IDVGSFRVVWAFLGTLTIATIPF

SEQ ID NO: 970011 - protein, 23 aa, Mycobacterium
IEAESRFTLIYGNRTKESTMFRA

SEQ ID NO: 970012 - protein, 22 aa, Mycobacterium
IEALARLNVVCFDKTGTPSDNR

SEQ ID NO: 970013 - protein, 19 aa, Mycobacterium
IEALGRVDTVCFDKTGTLT

SEQ ID NO: 970014 - protein, 23 aa, Mycobacterium
IEIAEGMRGMLQRIWNEQIRTKE

SEQ ID NO: 970015 - protein, 22 aa, Mycobacterium
IEIPLIGYLVHPGRTEATMLWL

SEQ ID NO: 970016 - protein, 17 aa, Mycobacterium
IELALALVAVWATAASW

SEQ ID NO: 970017 - protein, 23 aa, Mycobacterium
IELHRRGCVVQRLILLDPPQLPG

SEQ ID NO: 970018 - protein, 18 aa, Mycobacterium
IENGLHWIRDVTFDEDRH

SEQ ID NO: 970019 - protein, 18 aa, Mycobacterium
IENSLHWIRDVTFDEYRQ

SEQ ID NO: 970020 - protein, 29 aa, Mycobacterium
IEPEVVQWKLKPGVVSTMNAQARYTDPNT

SEQ ID NO: 970021 - protein, 17 aa, Mycobacterium
IEQRYSIGVVIATLALI

SEQ ID NO: 970022 - protein, 21 aa, Mycobacterium
IERVANLFLTKAVYSALLALL

SEQ ID NO: 970023 - protein, 24 aa, Mycobacterium
IESGQRSQVFWSFIIGAAVMAVAG

SEQ ID NO: 970024 - protein, 17 aa, Mycobacterium
IETTALLAHIAVMLAFL

SEQ ID NO: 970025 - protein, 18 aa, Mycobacterium
IFDVLDLKPTFISDETQK

SEQ ID NO: 970026 - protein, 19 aa, Mycobacterium
IFEPQRRGVALAIWTATGG

SEQ ID NO: 970027 - protein, 24 aa, Mycobacterium
IFLGIPLLAGYLFRRLGERAKGRG

SEQ ID NO: 970028 - protein, 20 aa, Mycobacterium
IFMMVGIMMMMFRSVGAGGQ

SEQ ID NO: 970029 - protein, 23 aa, Mycobacterium
IFPSLMPALLSGAGLAFSRAIGE

SEQ ID NO: 970030 - protein, 17 aa, Mycobacterium
IFSLVLMLFSVMIIIVF

SEQ ID NO: 970031 - protein, 22 aa, Mycobacterium
IFSTSRLRPWDARHLQRGALAA

SEQ ID NO: 970032 - protein, 28 aa, Mycobacterium
IFTGYPFLRGALRFGKTGTDALVSAATI

SEQ ID NO: 970033 - protein, 29 aa, Mycobacterium
IFTGYPFLRGALRFGKTGTDALVSVATIA

SEQ ID NO: 970034 - protein, 19 aa, Mycobacterium
IFTGYPFLRGALRSLRSGK

SEQ ID NO: 970035 - protein, 20 aa, Mycobacterium
IGACAAVWLALVGVGVAAVV

SEQ ID NO: 970036 - protein, 22 aa, Mycobacterium
IGAFLCSVFLMHVSAGAWVTGL

SEQ ID NO: 970037 - protein, 18 aa, Mycobacterium
IGAGLGVWSRVGIRALAV

SEQ ID NO: 970038 - protein, 19 aa, Mycobacterium
IGALAGWIAGKIVKGAGSG

SEQ ID NO: 970039 - protein, 17 aa, Mycobacterium
IGALAVRALPVVLLTTL

SEQ ID NO: 970040 - protein, 21 aa, Mycobacterium
IGDLVPREMIVVAPLIAMLLI

SEQ ID NO: 970041 - protein, 19 aa, Mycobacterium
IGFALGWRPALAALALGGA

SEQ ID NO: 970042 - protein, 24 aa, Mycobacterium
IGGITVRTGLLWWTVAIHLLASMT

SEQ ID NO: 970043 - protein, 17 aa, Mycobacterium
IGGLLIVVVAMFLGVDP

SEQ ID NO: 970044 - protein, 23 aa, Mycobacterium
IGGPRRKGRIISEHEKKITAYHE

SEQ ID NO: 970045 - protein, 18 aa, Mycobacterium
IGHLLRIEGPPGLRRAVG

SEQ ID NO: 970046 - protein, 26 aa, Mycobacterium
IGIAQEFADKVFIIFQRLHGRDSYGG

SEQ ID NO: 970047 - protein, 25 aa, Mycobacterium
IGIDLKYGIELSVGAGLFTKIATTE

SEQ ID NO: 970048 - protein, 20 aa, Mycobacterium
IGISAMLGWGLFRIYVLGNQ

SEQ ID NO: 970049 - protein, 31 aa, Mycobacterium
IGLLSRLWVLPIHRASGLLARILANTIRTFV

SEQ ID NO: 970050 - protein, 32 aa, Mycobacterium
IGLLSRLWVLPIHRASGLLARILANTIRTFVT

SEQ ID NO: 970051 - protein, 17 aa, Mycobacterium
IGLLTILGFSLYDTVIV

SEQ ID NO: 970052 - protein, 34 aa, Mycobacterium
IGLTAGEIFAGYTILRLLGSGGMGEVYLAKHPRL

SEQ ID NO: 970053 - protein, 19 aa, Mycobacterium
IGLVFSVLVGRGLDERADS

SEQ ID NO: 970054 - protein, 19 aa, Mycobacterium
IGMALSYLAVGIMSDSWGR

SEQ ID NO: 970055 - protein, 25 aa, Mycobacterium
IGPIWRSPISWGLTFMFSMTSLITY

SEQ ID NO: 970056 - protein, 18 aa, Mycobacterium
IGPSQAWYTENLRYYYLI

SEQ ID NO: 970057 - protein, 19 aa, Mycobacterium
IGQLAQWLLSLVGLAYLVW

SEQ ID NO: 970058 - protein, 20 aa, Mycobacterium
IGRDIWRAAARNELLLIAVW

SEQ ID NO: 970059 - protein, 17 aa, Mycobacterium
IGRPWYLAWAGLVYVVA

SEQ ID NO: 970060 - protein, 18 aa, Mycobacterium
IGRQCLNAGLGFGGGCLP

SEQ ID NO: 970061 - protein, 20 aa, Mycobacterium
IGSAIPFVYDHKVFFAVAAI

SEQ ID NO: 970062 - protein, 17 aa, Mycobacterium
IGTEIRDAHSINGTFVN

SEQ ID NO: 970063 - protein, 21 aa, Mycobacterium
IGTICTVFFAVYGMLLLTTQF

SEQ ID NO: 970064 - protein, 18 aa, Mycobacterium
IGVAGSWGPLAGKIKPMT

SEQ ID NO: 970065 - protein, 17 aa, Mycobacterium
IGVARMARRRAVVRHLP

SEQ ID NO: 970066 - protein, 30 aa, Mycobacterium
IGVAVPRILGHAADLLFNGVIGRQLPAGIT

SEQ ID NO: 970067 - protein, 21 aa, Mycobacterium
IGVLVGTVFVHWLIFESLYRI

SEQ ID NO: 970068 - protein, 25 aa, Mycobacterium
IGWASARTAAGFALAVVLLAVFLWL

SEQ ID NO: 970069 - protein, 31 aa, Mycobacterium
IGWRSRRRLPAAVIFGAIAAWVTRWYLGTLA

SEQ ID NO: 970070 - protein, 24 aa, Mycobacterium
IGYTMGFGSLGWVYASESFPTRLR

SEQ ID NO: 970071 - protein, 19 aa, Mycobacterium
IHDCPKLVQLRSFPTIAIG

SEQ ID NO: 970072 - protein, 24 aa, Mycobacterium
IHDRGEFHGQLWISMDYVEGTDAA

SEQ ID NO: 970073 - protein, 18 aa, Mycobacterium
IHLAFAFRGMNTHGRALY

SEQ ID NO: 970074 - protein, 22 aa, Mycobacterium
IHYRVELIRLIAQMGLGAGALM

SEQ ID NO: 970075 - protein, 24 aa, Mycobacterium
IIANRVSYFYDFRGPSVAIDTACS

SEQ ID NO: 970076 - protein, 20 aa, Mycobacterium
IIGQLGVAYLDSWSAAIAVG

SEQ ID NO: 970077 - protein, 22 aa, Mycobacterium
IIGSISFWGSIIAFGKLQELIS

SEQ ID NO: 970078 - protein, 23 aa, Mycobacterium
IILRSAAKPGNWSLFDGGYTFAS

SEQ ID NO: 970079 - protein, 18 aa, Mycobacterium
IILYWFSNNIWTFGQQHY

SEQ ID NO: 970080 - protein, 17 aa, Mycobacterium
IIPVSSLLRSHAVTLSE

SEQ ID NO: 970081 - protein, 17 aa, Mycobacterium
IIRTLGKGLVEIKPPQG

SEQ ID NO: 970082 - protein, 26 aa, Mycobacterium
IISTFPLAVPLEWNVLFAYATIFLFL

SEQ ID NO: 970083 - protein, 22 aa, Mycobacterium
IITLWLGLVAHFGEMANGGSAN

SEQ ID NO: 970084 - protein, 18 aa, Mycobacterium
IKDTCTRMTGAYLGPIKL

SEQ ID NO: 970085 - protein, 17 aa, Mycobacterium
IKPAVLVALLFRTLDAF

SEQ ID NO: 970086 - protein, 20 aa, Mycobacterium
IKPGDVMPATYIGIWQTFAD

SEQ ID NO: 970087 - protein, 22 aa, Mycobacterium
IKPMTGGIRFWTRPGTIRLRPW

SEQ ID NO: 970088 - protein, 24 aa, Mycobacterium
ILAACGLPYLLDRTATPISTEAPI

SEQ ID NO: 970089 - protein, 19 aa, Mycobacterium
ILAAILMGFWIGAITAGAI

SEQ ID NO: 970090 - protein, 25 aa, Mycobacterium
ILAAVAVLWRRRWRAETSNTHTDVA

SEQ ID NO: 970091 - protein, 19 aa, Mycobacterium
ILALILKYTIGLRLGPGQE

SEQ ID NO: 970092 - protein, 26 aa, Mycobacterium
ILASLSVSAVLGWHLFAAHHANVAAE

SEQ ID NO: 970093 - protein, 26 aa, Mycobacterium
ILCDRFGRRRVMLVGWAVGLFWSPLV

SEQ ID NO: 970094 - protein, 18 aa, Mycobacterium
ILEGPSWGWGQRRTLLLL

SEQ ID NO: 970095 - protein, 25 aa, Mycobacterium
ILGALRVNWALGFQLFDYTGETSPG

SEQ ID NO: 970096 - protein, 22 aa, Mycobacterium
ILKVLRERDAMVAMTLADNKKS

SEQ ID NO: 970097 - protein, 19 aa, Mycobacterium
ILLAFPMGVPLEWNVFMIF

SEQ ID NO: 970098 - protein, 27 aa, Mycobacterium
ILLFGGRRTDAWGHWLGCAAALASFGV

SEQ ID NO: 970099 - protein, 26 aa, Mycobacterium
ILLGLLWYAGLPLRVFMSSFAAVVVS

SEQ ID NO: 970100 - protein, 19 aa, Mycobacterium
ILLLFCVAGLAFVDGSRFS

SEQ ID NO: 970101 - protein, 19 aa, Mycobacterium
ILLLPGIILALIGMHMALV

SEQ ID NO: 970102 - protein, 21 aa, Mycobacterium
ILLYILVGWLIVFSTKGIEGF

SEQ ID NO: 970103 - protein, 19 aa, Mycobacterium
ILMGFEFRQGLIASLMWLC

SEQ ID NO: 970104 - protein, 18 aa, Mycobacterium
ILMLPRLFPGSFEADPER

SEQ ID NO: 970105 - protein, 25 aa, Mycobacterium
ILQILKANGIPLNRMVDIRSNPVLR

SEQ ID NO: 970106 - protein, 23 aa, Mycobacterium
ILRGTEQAFGWSLFDGGSTFATK

SEQ ID NO: 970107 - protein, 22 aa, Mycobacterium
ILRRLTVLVVLVFAQAGVGTVQ

SEQ ID NO: 970108 - protein, 27 aa, Mycobacterium
ILRRQARCRPDHPFLVCDSDRISYAQA

SEQ ID NO: 970109 - protein, 26 aa, Mycobacterium
ILTGLLAAWCHFRMDYAGHTEVKDNR

SEQ ID NO: 970110 - protein, 22 aa, Mycobacterium
ILTRGMGLLRWQQADRAMRRGG

SEQ ID NO: 970111 - protein, 17 aa, Mycobacterium
ILVAGVVYFLVVVPYNT

SEQ ID NO: 970112 - protein, 30 aa, Mycobacterium
ILVALRLLQGFAVGGEWAGSALLSIESAPA

SEQ ID NO: 970113 - protein, 19 aa, Mycobacterium
ILVSLPISVTLSIQFALLA

SEQ ID NO: 970114 - protein, 22 aa, Mycobacterium
ILVTGFLWPAWLVTTKLDVNKA

SEQ ID NO: 970115 - protein, 25 aa, Mycobacterium
ILVVLLAALLIKWTYGPASDAQTPA

SEQ ID NO: 970116 - protein, 29 aa, Mycobacterium
ILWFGGWLIPLLAIWAYWQVFHVLKQHFG

SEQ ID NO: 970117 - protein, 18 aa, Mycobacterium
IMPPGGFIPLSRTSPALD

SEQ ID NO: 970118 - protein, 17 aa, Mycobacterium
IMPTILVALPIGATLSI

SEQ ID NO: 970119 - protein, 18 aa, Mycobacterium
INAILGVLLLIVLATGSV

SEQ ID NO: 970120 - protein, 22 aa, Mycobacterium
INARCIMSPRGPPAGAPTSINS

SEQ ID NO: 970121 - protein, 27 aa, Mycobacterium
INCQRAIPHVVGWYRAYKDSGLEVIGV

SEQ ID NO: 970122 - protein, 20 aa, Mycobacterium
INECHRLCVDYAKTRTLWGK

SEQ ID NO: 970123 - protein, 17 aa, Mycobacterium
INFGAFTAFTLVNVSVV

SEQ ID NO: 970124 - protein, 17 aa, Mycobacterium
INFILVAGVVYFLVVVP

SEQ ID NO: 970125 - protein, 22 aa, Mycobacterium
INGSRARLPFNLDPARTPVLGS

SEQ ID NO: 970126 - protein, 18 aa, Mycobacterium
INLLPLLPFDGGHIAVAV

SEQ ID NO: 970127 - protein, 29 aa, Mycobacterium
INLVLNAGWSWLFFRFHRLGASALGAAVL

SEQ ID NO: 970128 - protein, 19 aa, Mycobacterium
INPRLDILAIAGGWTALTM

SEQ ID NO: 970129 - protein, 29 aa, Mycobacterium
INRRWTFQAAPCGARFAAVMALYGVTFAV

SEQ ID NO: 970130 - protein, 21 aa, Mycobacterium
IPAIIRGLIAVAWYGIQTYLA

SEQ ID NO: 970131 - protein, 22 aa, Mycobacterium
IPAKLLVTLLVCSILSVAVVGV

SEQ ID NO: 970132 - protein, 17 aa, Mycobacterium
IPALPVAILLAVVTAAT

SEQ ID NO: 970133 - protein, 17 aa, Mycobacterium
IPCVRALLTLLPDNLRW

SEQ ID NO: 970134 - protein, 18 aa, Mycobacterium
IPCVRALLTLLPGSLRWL

SEQ ID NO: 970135 - protein, 17 aa, Mycobacterium
IPDVALRGAELAQVSVI

SEQ ID NO: 970136 - protein, 24 aa, Mycobacterium
IPDVLRPDLTIAYTDTDGYGERGD

SEQ ID NO: 970137 - protein, 24 aa, Mycobacterium
IPEDSRLPTVLFQTTVSKLRDLLA

SEQ ID NO: 970138 - protein, 19 aa, Mycobacterium
IPGQVPGAPGPVPLPGQLP

SEQ ID NO: 970139 - protein, 26 aa, Mycobacterium
IPIALFMGCYLRFLRPGRVAEVSVIG

SEQ ID NO: 970140 - protein, 19 aa, Mycobacterium
IPIILIWLLLTIAVNVFVP

SEQ ID NO: 970141 - protein, 25 aa, Mycobacterium
IPLAFLPKWSALTALSQTSSLERTP

SEQ ID NO: 970142 - protein, 17 aa, Mycobacterium
IPMILGVHSHDWELVGI

SEQ ID NO: 970143 - protein, 17 aa, Mycobacterium
IPPAHRAAIEFNPPLPT

SEQ ID NO: 970144 - protein, 23 aa, Mycobacterium
IPPPEGKPWWLIVVGVVVVGLLG

SEQ ID NO: 970145 - protein, 17 aa, Mycobacterium
IPPSIGLWLGAPPDRKG

SEQ ID NO: 970146 - protein, 26 aa, Mycobacterium
IPQGFPADVLYEFRLVSLGTQLVLWA

SEQ ID NO: 970147 - protein, 19 aa, Mycobacterium
IPRPSHIVVGLPPAIDDVI

SEQ ID NO: 970148 - protein, 22 aa, Mycobacterium
IPSDLLWSFLQAIVMAIAVMLV

SEQ ID NO: 970149 - protein, 19 aa, Mycobacterium
IPVDCAAPHAMEVTGTVNL

SEQ ID NO: 970150 - protein, 18 aa, Mycobacterium
IPVLGAWALLRRRRGRTS

SEQ ID NO: 970151 - protein, 20 aa, Mycobacterium
IPVLIVGTVVWVGITNDRKE

SEQ ID NO: 970152 - protein, 20 aa, Mycobacterium
IPYRAQWDAGAVVLELYEHL

SEQ ID NO: 970153 - protein, 25 aa, Mycobacterium
IQIGGTAFVVFFAVALVFYIVTSHQ

SEQ ID NO: 970154 - protein, 17 aa, Mycobacterium
IQLTIFAVIALSVLAIT

SEQ ID NO: 970155 - protein, 25 aa, Mycobacterium
IQQARVQLCYFARSRCASVRTELQE

SEQ ID NO: 970156 - protein, 25 aa, Mycobacterium
IRAIDLRSPLLLAIVLAAVAVVVAG

SEQ ID NO: 970157 - protein, 20 aa, Mycobacterium
IRAPIAFGRNDIRGTYREPL

SEQ ID NO: 970158 - protein, 24 aa, Mycobacterium
IRARSEGRCGAGILQPWRDLHKQL

SEQ ID NO: 970159 - protein, 19 aa, Mycobacterium
IRARSRMQSYAFWDITTFL

SEQ ID NO: 970160 - protein, 20 aa, Mycobacterium
IRATTVFGAKFVDLIYPEDP

SEQ ID NO: 970161 - protein, 22 aa, Mycobacterium
IREVLWPIVLPGVRVSRVADGI

SEQ ID NO: 970162 - protein, 31 aa, Mycobacterium; identical to SEQ ID NO: 313438

SEQ ID NO: 970163 - protein, 29 aa, Mycobacterium
IRGKMKGGPLPRGRGLLMAEDTGVFVQVA

SEQ ID NO: 970164 - protein, 17 aa, Mycobacterium
IRIEMMLGHVSAEATAT

SEQ ID NO: 970165 - protein, 17 aa, Mycobacterium
IRLERLKTLAALRDSGA

SEQ ID NO: 970166 - protein, 27 aa, Mycobacterium
IRLPEVSRATVIIGSLVLVLGLVAAFV

SEQ ID NO: 970167 - protein, 17 aa, Mycobacterium
IRLWRNAWNEFIPFLDY

SEQ ID NO: 970168 - protein, 28 aa, Mycobacterium
IRMNGWPEAIFRFGLYAFLCATALMVVR

SEQ ID NO: 970169 - protein, 22 aa, Mycobacterium
IRPDTRAVGLLEFHQIDAAREA

SEQ ID NO: 970170 - protein, 27 aa, Mycobacterium
IRPEFRPKLKAFMAHLCWIENIGARGF

SEQ ID NO: 970171 - protein, 25 aa, Mycobacterium
IRPVAPEAYALYGISRVLPPALRST

SEQ ID NO: 970172 - protein, 17 aa, Mycobacterium
IRRPVRFADSVASLEAM

SEQ ID NO: 970173 - protein, 18 aa, Mycobacterium
IRVFGGAAASSFKRQLDE

SEQ ID NO: 970174 - protein, 28 aa, Mycobacterium
IRVWNRIRERFGLVGLFAGSAILSIAAA

SEQ ID NO: 970175 - protein, 17 aa, Mycobacterium
ISAPFGIVGQILLGATA

SEQ ID NO: 970176 - protein, 23 aa, Mycobacterium
ISCGVLAAWSFFRLVWLLYVSMP

SEQ ID NO: 970177 - protein, 35 aa, Mycobacterium
ISELDPVDWWRQLSWLPQRSVLIPGTVRDNLVLLG

SEQ ID NO: 970178 - protein, 17 aa, Mycobacterium
ISFEVRGGLFVRQVHHW

SEQ ID NO: 970179 - protein, 26 aa, Mycobacterium
ISFVIGRPLIWLSFRNEKLNAAFRYA

SEQ ID NO: 970180 - protein, 18 aa, Mycobacterium
ISGFGWASGYVGSVVLLI

SEQ ID NO: 970181 - protein, 32 aa, Mycobacterium
ISLATIWLRTGLMPRWLAGISYAAAAALLTVS

SEQ ID NO: 970182 - protein, 26 aa, Mycobacterium
ISLLYMCASGSFLGFAFAFGQVLQHN

SEQ ID NO: 970183 - protein, 17 aa, Mycobacterium
ISLPIALGLLIMMNPVL

SEQ ID NO: 970184 - protein, 19 aa, Mycobacterium
ISLYLPLTMRSLANAILVP

SEQ ID NO: 970185 - protein, 20 aa, Mycobacterium
ISMGVLRFFANHSIVENNIV

SEQ ID NO: 970186 - protein, 24 aa, Mycobacterium
ISPCILPVLPVVFFSGAHGGATVA

SEQ ID NO: 970187 - protein, 21 aa, Mycobacterium
ISSRRAAVVLALTLVGFGLAL

SEQ ID NO: 970188 - protein, 17 aa, Mycobacterium
ISTALVIPKFTVIEDGA

SEQ ID NO: 970189 - protein, 18 aa, Mycobacterium
ISTISFGTPYGFVEINDQ

SEQ ID NO: 970190 - protein, 20 aa, Mycobacterium
ISVLVAWLAVLLFASLAAAP

SEQ ID NO: 970191 - protein, 19 aa, Mycobacterium
ITAGALFGLAALPVVFTLL

SEQ ID NO: 970192 - protein, 17 aa, Mycobacterium
ITARWIPYARADLVLGI

SEQ ID NO: 970193 - protein, 25 aa, Mycobacterium
ITDLPEGRWSEFLEEPRIAERVANA

SEQ ID NO: 970194 - protein, 24 aa, Mycobacterium
ITGFARIVLLAAILGAALSSSFSV

SEQ ID NO: 970195 - protein, 28 aa, Mycobacterium
ITGGWLLEHFSWGSIFLVNVPIAVAAMA

SEQ ID NO: 970196 - protein, 22 aa, Mycobacterium
ITGLRFPFDIPIEDFLFGFAMV

SEQ ID NO: 970197 - protein, 24 aa, Mycobacterium
ITHYSEWLGALVITSGDAFEHVLP

SEQ ID NO: 970198 - protein, 29 aa, Mycobacterium
ITISEAWARVRGRILALIGLALLEGAGLV

SEQ ID NO: 970199 - protein, 19 aa, Mycobacterium
ITLEVLWTGGISRPPTVLY

SEQ ID NO: 970200 - protein, 20 aa, Mycobacterium
ITLLPACLGVLGRHVDALGV

SEQ ID NO: 970201 - protein, 22 aa, Mycobacterium
ITLPVALPLGIGGYVNYREQSA

SEQ ID NO: 970202 - protein, 18 aa, Mycobacterium
ITPAPGWTLTDRGPNWVT

SEQ ID NO: 970203 - protein, 28 aa, Mycobacterium
ITPDRLSGLSWRDWLLAVVVIAVIRPAA

SEQ ID NO: 970204 - protein, 19 aa, Mycobacterium
ITSGGMPMLRMMGGSPEAE

SEQ ID NO: 970205 - protein, 17 aa, Mycobacterium
ITSGHKWRVLTVATADL

SEQ ID NO: 970206 - protein, 25 aa, Mycobacterium
ITTVSACLLVFVTVWFALRDTARAE

SEQ ID NO: 970207 - protein, 22 aa, Mycobacterium
ITVCSLMFASHVTRYHAARKDH

SEQ ID NO: 970208 - protein, 17 aa, Mycobacterium
ITVGLLLRIKSSGVVFR

SEQ ID NO: 970209 - protein, 26 aa, Mycobacterium
IVAASALCFLVGFAGLLWAPLTAPIV

SEQ ID NO: 970210 - protein, 22 aa, Mycobacterium
IVAGTCTFLSVPRLTHVLASIP

SEQ ID NO: 970211 - protein, 20 aa, Mycobacterium
IVALVVGLLRYRRRRISLAA

SEQ ID NO: 970212 - protein, 26 aa, Mycobacterium
IVCTDAEAILGIGDWGIGGIQIAVGK

SEQ ID NO: 970213 - protein, 24 aa, Mycobacterium
IVDAVICYIGFLFPLWDAKRQTLA

SEQ ID NO: 970214 - protein, 24 aa, Mycobacterium
IVELHHWVNILGMHSGYKVTRLFG

SEQ ID NO: 970215 - protein, 18 aa, Mycobacterium
IVEMGASLDVLFALIVLG

SEQ ID NO: 970216 - protein, 18 aa, Mycobacterium
IVGTRLATRVGFPSMLLF

SEQ ID NO: 970217 - protein, 32 aa, Mycobacterium; identical to SEQ ID NO: 313858

SEQ ID NO: 970218 - protein, 17 aa, Mycobacterium
IVIYFVVAIIFPKPWSW

SEQ ID NO: 970219 - protein, 23 aa, Mycobacterium
IVKSINLSKDWARAVIDIPVPTG

SEQ ID NO: 970220 - protein, 19 aa, Mycobacterium
IVLGLSGIVPWWFIAALLA

SEQ ID NO: 970221 - protein, 18 aa, Mycobacterium
IVLMAIWFHFWQDDVRDL

SEQ ID NO: 970222 - protein, 17 aa, Mycobacterium
IVLSAAINFLLIALVVY

SEQ ID NO: 970223 - protein, 21 aa, Mycobacterium
IVLSCGALINGVKEFPGPWAL

SEQ ID NO: 970224 - protein, 18 aa, Mycobacterium
IVNKRMVWILDGYTTLDN

SEQ ID NO: 970225 - protein, 33 aa, Mycobacterium; identical to SEQ ID NO: 313915

SEQ ID NO: 970226 - protein, 17 aa, Mycobacterium
IVRLRPVVVEPAAMAVR

SEQ ID NO: 970227 - protein, 22 aa, Mycobacterium
IVSALHRPVPLSGEGSDTDTVI

SEQ ID NO: 970228 - protein, 18 aa, Mycobacterium
IVTEIMLVLARVMGEMAP

SEQ ID NO: 970229 - protein, 19 aa, Mycobacterium
IVWAGRPFHQAAWVNLKHG

SEQ ID NO: 970230 - protein, 24 aa, Mycobacterium
IWDSVSCKAWLLAQPYLVASVLLV

SEQ ID NO: 970231 - protein, 25 aa, Mycobacterium
IWLDRLRTLARRTCVVTLAYAQADL

SEQ ID NO: 970232 - protein, 21 aa, Mycobacterium
IWLLHYGNRGWFFPLSIRQVP

SEQ ID NO: 970233 - protein, 24 aa, Mycobacterium
IYALACVLFECLTGSPPYRSDSAG

SEQ ID NO: 970234 - protein, 18 aa, Mycobacterium
IYDNGGARIYEWSGKTAQ

SEQ ID NO: 970235 - protein, 25 aa, Mycobacterium
IYGSGLPSDIWKATMDGALKGTEVE

SEQ ID NO: 970236 - protein, 17 aa, Mycobacterium
IYLTQRFIIAWRVWLTD

SEQ ID NO: 970237 - protein, 18 aa, Mycobacterium
IYYPRYLILTAPAAAVIL

SEQ ID NO: 970238 - protein, 24 aa, Mycobacterium
IYYSPRIFEAMGFTGDFALLGLPA

SEQ ID NO: 970239 - protein, 29 aa, Mycobacterium
KAAARPKRLTGRRLAAVGAAITALLFVGS

SEQ ID NO: 970240 - protein, 17 aa, Mycobacterium
KAGQKVRIAGVPVGSVK

SEQ ID NO: 970241 - protein, 25 aa, Mycobacterium
KALDARVGFMVGWAVLLDYLFLPLV

SEQ ID NO: 970242 - protein, 18 aa, Mycobacterium
KALFLGFMFAFAIKAPLW

SEQ ID NO: 970243 - protein, 21 aa, Mycobacterium
KALFRLRSLVFAHAQRLDLDA

SEQ ID NO: 970244 - protein, 18 aa, Mycobacterium
KANGYRLVTVSELLGPRA

SEQ ID NO: 970245 - protein, 23 aa, Mycobacterium
KAPLWPFHRWLPDAAVESTPATA

SEQ ID NO: 970246 - protein, 19 aa, Mycobacterium
KAPPLKLFDVRSAQQAYRY

SEQ ID NO: 970247 - protein, 21 aa, Mycobacterium
KASAWVGALVLGWWIAVLVYL

SEQ ID NO: 970248 - protein, 24 aa, Mycobacterium
KATAAHLVSVFAHRARLVLGQLAV

SEQ ID NO: 970249 - protein, 24 aa, Mycobacterium
KATATHLVSVFAHRARLVLGQVAV

SEQ ID NO: 970250 - protein, 22 aa, Mycobacterium
KATATHLVSVFAHRARSVLGQL

SEQ ID NO: 970251 - protein, 23 aa, Mycobacterium
KATATHLVSVFAHRARSVLGQLA

SEQ ID NO: 970252 - protein, 24 aa, Mycobacterium
KATATHLVSVFAHRVRLVLGQLAV

SEQ ID NO: 970253 - protein, 25 aa, Mycobacterium
KATATHLVSVFAHRVRLVLGQLAVA

SEQ ID NO: 970254 - protein, 28 aa, Mycobacterium
KAVSPKVWGRRGAPLLLVFSVAARLAWT

SEQ ID NO: 970255 - protein, 23 aa, Mycobacterium
KDKRLNSLLSLWWQAVLFKTEQY

SEQ ID NO: 970256 - protein, 26 aa, Mycobacterium
KDPVFLDWLVGLAFPCQRPFGHQNGV

SEQ ID NO: 970257 - protein, 18 aa, Mycobacterium
KDRLAADVHMVWWMVAVV

SEQ ID NO: 970258 - protein, 29 aa, Mycobacterium
KEDAGVPLCCIHDGLGLSWSYRALGNYLD

SEQ ID NO: 970259 - protein, 18 aa, Mycobacterium
KEFRCVSVDLIAGNPSCT

SEQ ID NO: 970260 - protein, 26 aa, Mycobacterium
KEQAIYRREHGIGMSGGRVETPGPGT

SEQ ID NO: 970261 - protein, 17 aa, Mycobacterium
KEYLRYLAGLRGRVTTS

SEQ ID NO: 970262 - protein, 24 aa, Mycobacterium
KFFTPWGRQFWRITSEYFIGPKSI

SEQ ID NO: 970263 - protein, 30 aa, Mycobacterium
KFGHMFTGMAIRIADVWKITRRVGVQESYG

SEQ ID NO: 970264 - protein, 27 aa, Mycobacterium
KFYLPPRLVSLYGTEMWDEMTREQQIE

SEQ ID NO: 970265 - protein, 26 aa, Mycobacterium
KGALALRLLTIAFFALVYLLPLILWL

SEQ ID NO: 970266 - protein, 19 aa, Mycobacterium
KGATGKLGAPVADQTEVGD

SEQ ID NO: 970267 - protein, 22 aa, Mycobacterium
KGEPSLPVVPWVISARSAEALT

SEQ ID NO: 970268 - protein, 17 aa, Mycobacterium
KGGSAVKPFAGVPHVSR

SEQ ID NO: 970269 - protein, 18 aa, Mycobacterium
KGHFAFRSATILVYYQRT

SEQ ID NO: 970270 - protein, 17 aa, Mycobacterium
KGIWQALLGSDAIYFEV

SEQ ID NO: 970271 - protein, 23 aa, Mycobacterium
KGNPDVLWWALALGTDFGGDLTA

SEQ ID NO: 970272 - protein, 32 aa, Mycobacterium
KGSTEPRGQVVLPFTGLNFRFAPGGVAVDANG

SEQ ID NO: 970273 - protein, 23 aa, Mycobacterium
KHKVTAMVVVPVMLSRLLDAVEK

SEQ ID NO: 970274 - protein, 19 aa, Mycobacterium
KHRGELVYLPPAWFASYPP

SEQ ID NO: 970275 - protein, 19 aa, Mycobacterium
KHVARRAAPFVAIAPTAIW

SEQ ID NO: 970276 - protein, 27 aa, Mycobacterium
KIELPRPRVVPRAASPQLPAPAAPAQR

SEQ ID NO: 970277 - protein, 18 aa, Mycobacterium
KILRPGRAAGELPPGAVT

SEQ ID NO: 970278 - protein, 24 aa, Mycobacterium
KIPAGSRVWLCLGAINRDGSDATS

SEQ ID NO: 970279 - protein, 21 aa, Mycobacterium
KIVVTCPHCFNTIGKEYRQLG

SEQ ID NO: 970280 - protein, 22 aa, Mycobacterium
KIVVTCPHCFNTIGKEYRQLGG

SEQ ID NO: 970281 - protein, 26 aa, Mycobacterium
KKDPRKYRLIVTITRDGDQLKMSKVE

SEQ ID NO: 970282 - protein, 20 aa, Mycobacterium
KKKLSSWLPPGPVAVADYPA

SEQ ID NO: 970283 - protein, 19 aa, Mycobacterium
KKLRARVGVEGDKPGQTAD

SEQ ID NO: 970284 - protein, 17 aa, Mycobacterium
KKLTGWAAIIAVPTAIT

SEQ ID NO: 970285 - protein, 20 aa, Mycobacterium
KKRPRVIAVDAVPTEVASTW

SEQ ID NO: 970286 - protein, 18 aa, Mycobacterium
KLFDVRSAQQAYRYVSQA

SEQ ID NO: 970287 - protein, 19 aa, Mycobacterium
KLGPFVVMHAIADYVVDHY

SEQ ID NO: 970288 - protein, 17 aa, Mycobacterium
KLGRTLILHGLWPQPPT

SEQ ID NO: 970289 - protein, 20 aa, Mycobacterium
KLHQLRSYRLVSVLRLGVLV

SEQ ID NO: 970290 - protein, 25 aa, Mycobacterium
KLLIKCGVVLLAVFATFIAHPVLHI

SEQ ID NO: 970291 - protein, 18 aa, Mycobacterium
KLLLARLSTRKALPLYIA

SEQ ID NO: 970292 - protein, 25 aa, Mycobacterium
KLQNPSWRPGAWLATILVVAGWGGT

SEQ ID NO: 970293 - protein, 17 aa, Mycobacterium
KLSDLRPDLARLDALFA

SEQ ID NO: 970294 - protein, 19 aa, Mycobacterium
KLSLDWVIFGNNWLNGWPG

SEQ ID NO: 970295 - protein, 18 aa, Mycobacterium
KLSPWLNRRNQYVTVSLP

SEQ ID NO: 970296 - protein, 25 aa, Mycobacterium
KLTGGRTAQAWARRHRHLRAALTPL

SEQ ID NO: 970297 - protein, 26 aa, Mycobacterium
KMQCGEGWWTSVWFLAFWITGTSMLM

SEQ ID NO: 970298 - protein, 18 aa, Mycobacterium
KMTAARRAASRIVDALTS

SEQ ID NO: 970299 - protein, 23 aa, Mycobacterium
KNLGYTCVIYLAALQGVRRDLLE

SEQ ID NO: 970300 - protein, 21 aa, Mycobacterium
KNTSYRIGLKVANASVSRQII

SEQ ID NO: 970301 - protein, 17 aa, Mycobacterium
KPAQWRAIRRAIDAHDE

SEQ ID NO: 970302 - protein, 19 aa, Mycobacterium
KPFVRQIRTTRQMQELQPQ

SEQ ID NO: 970303 - protein, 18 aa, Mycobacterium
KPGSRAVAAPTLPDFAAI

SEQ ID NO: 970304 - protein, 26 aa, Mycobacterium
KPLSWRDRAVKWARIARLSIVVKVAA

SEQ ID NO: 970305 - protein, 20 aa, Mycobacterium
KPQTVHWSLRVEVSDVDGKL

SEQ ID NO: 970306 - protein, 17 aa, Mycobacterium
KPSQFKTTVVFNDGKDV

SEQ ID NO: 970307 - protein, 17 aa, Mycobacterium
KQGIPSIIMEFSEGQWR

SEQ ID NO: 970308 - protein, 23 aa, Mycobacterium
KRAERGVALWLLLGGFFGLALLL

SEQ ID NO: 970309 - protein, 17 aa, Mycobacterium
KRAIRIRFWRRIGTAVV

SEQ ID NO: 970310 - protein, 28 aa, Mycobacterium
KRFGPLTPPRAVAIITQIASALDAAHAD

SEQ ID NO: 970311 - protein, 26 aa, Mycobacterium
KRFGPLTPPRAVAIITQVASALDAAH

SEQ ID NO: 970312 - protein, 22 aa, Mycobacterium
KRGGPATGHRSDHNWELDEDWR

SEQ ID NO: 970313 - protein, 20 aa, Mycobacterium
KRGQKVPVGPVVFGGVAWAQ

SEQ ID NO: 970314 - protein, 20 aa, Mycobacterium
KRGSSWLGSPPMRLRRKPAE

SEQ ID NO: 970315 - protein, 20 aa, Mycobacterium
KRLIGGMGRPRIPPRRPRRW

SEQ ID NO: 970316 - protein, 19 aa, Mycobacterium
KRLKPREGGDFGTTEQWRY

SEQ ID NO: 970317 - protein, 17 aa, Mycobacterium
KRLLMTGLVIFGLVSIP

SEQ ID NO: 970318 - protein, 18 aa, Mycobacterium
KRLLRLLFRVDAAVFGKR

SEQ ID NO: 970319 - protein, 18 aa, Mycobacterium
KRLSGLLNTSGLPAVLEP

SEQ ID NO: 970320 - protein, 23 aa, Mycobacterium
KRPLRTAWQAGIRLWTAALALTA

SEQ ID NO: 970321 - protein, 22 aa, Mycobacterium
KRRGWPTTLFRPHNLPFVMLGA

SEQ ID NO: 970322 - protein, 18 aa, Mycobacterium
KRTARLVGEVPIYDIIVG

SEQ ID NO: 970323 - protein, 17 aa, Mycobacterium
KRVFQVAVLLFVAGSVS

SEQ ID NO: 970324 - protein, 25 aa, Mycobacterium
KRVLLSYSGTLAFIAGFVNAVGLLL

SEQ ID NO: 970325 - protein, 24 aa, Mycobacterium
KRWRVDIDGTLSFLLLPRLTNVLS

SEQ ID NO: 970326 - protein, 21 aa, Mycobacterium
KSLYLRNPVFAEWIEKVDALV

SEQ ID NO: 970327 - protein, 21 aa, Mycobacterium
KSPSRTVPRLKIEITDLVHLH

SEQ ID NO: 970328 - protein, 26 aa, Mycobacterium
KSTLVNLLMRFYEVDSGRILIDGVDI

SEQ ID NO: 970329 - protein, 25 aa, Mycobacterium
KSVVALAFAGGVLFVAENPSRSLQK

SEQ ID NO: 970330 - protein, 19 aa, Mycobacterium
KTAEIVDAFTTSKVTLATT

SEQ ID NO: 970331 - protein, 20 aa, Mycobacterium
KTAEIVDAFTTSKVTLATTN

SEQ ID NO: 970332 - protein, 24 aa, Mycobacterium
KTERRWGKIVALSLLTAVLLAGAG

SEQ ID NO: 970333 - protein, 20 aa, Mycobacterium
KTFDVRLARQAYRFVSQARH

SEQ ID NO: 970334 - protein, 17 aa, Mycobacterium
KTGQLVGATPWKQQVAL

SEQ ID NO: 970335 - protein, 24 aa, Mycobacterium
KTNVRRFVDDVSFVVGKESRDRLK

SEQ ID NO: 970336 - protein, 24 aa, Mycobacterium
KTPAWEWKIAAYLFSGGLSAGSAL

SEQ ID NO: 970337 - protein, 18 aa, Mycobacterium
KTPLIGMSMVFGAMALVA

SEQ ID NO: 970338 - protein, 20 aa, Mycobacterium
KTRRQTLKDYVAFPLLAGPF

SEQ ID NO: 970339 - protein, 19 aa, Mycobacterium
KTSEVDWVLDRLGRELEEL

SEQ ID NO: 970340 - protein, 18 aa, Mycobacterium
KTYTRYGAFLDDAAGFDA

SEQ ID NO: 970341 - protein, 21 aa, Mycobacterium
KVGPVTSEFSGKVHFVERDRD

SEQ ID NO: 970342 - protein, 22 aa, Mycobacterium
KVHRHWGFGGGPHRCLGSHLAR

SEQ ID NO: 970343 - protein, 17 aa, Mycobacterium
KVKVGPVTSEFSGKVHF

SEQ ID NO: 970344 - protein, 23 aa, Mycobacterium
KVPAKRLRPGDIIEVHADEVVPA

SEQ ID NO: 970345 - protein, 19 aa, Mycobacterium
KVSFLPSMRQYAGNWASAV

SEQ ID NO: 970346 - protein, 17 aa, Mycobacterium
KVSGLWAQGRYAEAQAA

SEQ ID NO: 970347 - protein, 20 aa, Mycobacterium
KWILAIPHYIVLVFLYLGAF

SEQ ID NO: 970348 - protein, 18 aa, Mycobacterium
KWSAIAMSVVTVAFIASV

SEQ ID NO: 970349 - protein, 23 aa, Mycobacterium
KYAFRKRVLMVMAIILVGSAAAA

SEQ ID NO: 970350 - protein, 26 aa, Mycobacterium
KYMEMLNINEAWQFGRGAGVKVAVID

SEQ ID NO: 970351 - protein, 19 aa, Mycobacterium
KYQPQWVPRYACYEDARVI

SEQ ID NO: 970352 - protein, 18 aa, Mycobacterium
KYTGEVAFYCYGEGKVQA

SEQ ID NO: 970353 - protein, 21 aa, Mycobacterium
LAAAVGTRFMQLRARRSATSP

SEQ ID NO: 970354 - protein, 17 aa, Mycobacterium
LAADVHMVWWMVAVVGF

SEQ ID NO: 970355 - protein, 19 aa, Mycobacterium
LAAFGCLYLASTFLPSYAQ

SEQ ID NO: 970356 - protein, 22 aa, Mycobacterium
LAAGVELLWQLPVSSIGCGLIV

SEQ ID NO: 970357 - protein, 22 aa, Mycobacterium
LAAICCAELASAVPVSGSSYSY

SEQ ID NO: 970358 - protein, 26 aa, Mycobacterium
LAAISLVVSVSLLFTRTDTSKLSTPT

SEQ ID NO: 970359 - protein, 27 aa, Mycobacterium
LAALCGLCAVAYLVSRHAAGAPAGVAM

SEQ ID NO: 970360 - protein, 20 aa, Mycobacterium
LAALCVDWLLAYGLALLGVG

SEQ ID NO: 970361 - protein, 18 aa, Mycobacterium
LAAMVLLFFARAALLGVL

SEQ ID NO: 970362 - protein, 24 aa, Mycobacterium
LAAPIVIWAAWPFHSVAIRNARHR

SEQ ID NO: 970363 - protein, 26 aa, Mycobacterium
LAASGIRWLTDWPLWADGAVFLIVSV

SEQ ID NO: 970364 - protein, 19 aa, Mycobacterium
LAATLWHPHIVGVHDRGEF

SEQ ID NO: 970365 - protein, 29 aa, Mycobacterium
LAAVVAMAALASWFGFHAYQSHQADQQRK

SEQ ID NO: 970366 - protein, 20 aa, Mycobacterium
LAAYSMAPWIALAVAAVLLV

SEQ ID NO: 970367 - protein, 17 aa, Mycobacterium
LADARADVIPAITKYMS

SEQ ID NO: 970368 - protein, 30 aa, Mycobacterium
LADLNLPAWGSLRLALPMNGNSDATFLAGE

SEQ ID NO: 970369 - protein, 19 aa, Mycobacterium
LADPHGLAFDSADTCYVVD

SEQ ID NO: 970370 - protein, 32 aa, Mycobacterium; identical to SEQ ID NO: 314986

SEQ ID NO: 970371 - protein, 22 aa, Mycobacterium
LADRLRRVLPLVNRISGGLLAV

SEQ ID NO: 970372 - protein, 22 aa, Mycobacterium
LADRYSLVSGMSLGHWEFYMAL

SEQ ID NO: 970373 - protein, 25 aa, Mycobacterium
LADVLGRKRMFVFGVVLFTIASGLC

SEQ ID NO: 970374 - protein, 26 aa, Mycobacterium
LAEAFLPRRLRYGAQVTLALSGLVAA

SEQ ID NO: 970375 - protein, 18 aa, Mycobacterium
LAEAVPRDRGYWVTEDRS

SEQ ID NO: 970376 - protein, 23 aa, Mycobacterium
LAEHLPAALVPRLVQIDELPTRT

SEQ ID NO: 970377 - protein, 19 aa, Mycobacterium
LAELEYKAPVWGYSAGSLG

SEQ ID NO: 970378 - protein, 18 aa, Mycobacterium
LAERACMLYAGTTMVTGT

SEQ ID NO: 970379 - protein, 18 aa, Mycobacterium
LAERLAVDGRELWNTYGP

SEQ ID NO: 970380 - protein, 25 aa, Mycobacterium
LAESYGWRASLAIWALIPAVAVLPW

SEQ ID NO: 970381 - protein, 21 aa, Mycobacterium
LAETRPDLIIDTGSLDKATYN

SEQ ID NO: 970382 - protein, 23 aa, Mycobacterium
LAFEAGDLLLLFVALLANGLARF

SEQ ID NO: 970383 - protein, 26 aa, Mycobacterium
LAFTVFCLNGFPFLIAAVLWGIVDSI

SEQ ID NO: 970384 - protein, 25 aa, Mycobacterium
LAGALGAVMAFSFARIGLHSRRNLT

SEQ ID NO: 970385 - protein, 24 aa, Mycobacterium
LAGAWGLSEVFGWRHTLNQRPNRA

SEQ ID NO: 970386 - protein, 32 aa, Mycobacterium
LAGCASCRAAVAELCGVPAVLSQLGADEVAAI

SEQ ID NO: 970387 - protein, 20 aa, Mycobacterium
LAGFCLHATLLGMLAGTNRW

SEQ ID NO: 970388 - protein, 28 aa, Mycobacterium
LAGGPWRWDRWAPASPWATPPPTVMALG

SEQ ID NO: 970389 - protein, 23 aa, Mycobacterium
LAGHPWPHLFLPFREGASQESEL

SEQ ID NO: 970390 - protein, 18 aa, Mycobacterium
LAGLVGAVPQVWWGPAEQ

SEQ ID NO: 970391 - protein, 26 aa, Mycobacterium
LAGPRLIDAYVDWLWFGELGYLSVFT

SEQ ID NO: 970392 - protein, 18 aa, Mycobacterium
LAGRSAFEHRAVVVGADR

SEQ ID NO: 970393 - protein, 20 aa, Mycobacterium
LAGTTGWLAGMWRDLLGAAI

SEQ ID NO: 970394 - protein, 25 aa, Mycobacterium
LAGVMLAFVGVGWALTLPAALFVVG

SEQ ID NO: 970395 - protein, 22 aa, Mycobacterium
LAILLCLVLGVAIVTQVRQTES

SEQ ID NO: 970396 - protein, 18 aa, Mycobacterium
LAISMTWLSIEMVPETPV

SEQ ID NO: 970397 - protein, 30 aa, Mycobacterium; identical to SEQ ID NO: 315158

SEQ ID NO: 970398 - protein, 19 aa, Mycobacterium
LAITGMVAAAAWTIGSNLS

SEQ ID NO: 970399 - protein, 17 aa, Mycobacterium
LAKGIFRAPGISRVQAI

SEQ ID NO: 970400 - protein, 19 aa, Mycobacterium
LAKHPRLPRHEALKVLGAG

SEQ ID NO: 970401 - protein, 19 aa, Mycobacterium
LALAIAMTGWRVLRAKVEA

SEQ ID NO: 970402 - protein, 18 aa, Mycobacterium
LALFKAVMFGAIVAVVSA

SEQ ID NO: 970403 - protein, 21 aa, Mycobacterium
LALGAIGGVIGRKTAEIVDAF

SEQ ID NO: 970404 - protein, 18 aa, Mycobacterium
LALGSYWGLVIVPPSVLV

SEQ ID NO: 970405 - protein, 17 aa, Mycobacterium
LALGVGVGMLEHHLTKL

SEQ ID NO: 970406 - protein, 19 aa, Mycobacterium
LALGWWQWTRFESTSGSFQ

SEQ ID NO: 970407 - protein, 18 aa, Mycobacterium
LALIPVFVYVMLIAPAHG

SEQ ID NO: 970408 - protein, 24 aa, Mycobacterium
LALLANLFVPWGIAGADPSLIGIA

SEQ ID NO: 970409 - protein, 18 aa, Mycobacterium
LALLLATLWWLVALTQLR

SEQ ID NO: 970410 - protein, 27 aa, Mycobacterium
LALLLERFGPVTPPWAVALVHQVASAL

SEQ ID NO: 970411 - protein, 20 aa, Mycobacterium
LALLLVFLFWPWEYKPSGDK

SEQ ID NO: 970412 - protein, 20 aa, Mycobacterium
LALMTRRWTLAWVALAGSAL

SEQ ID NO: 970413 - protein, 24 aa, Mycobacterium
LALSWARLTTVFVIDLLILIVASH

SEQ ID NO: 970414 - protein, 17 aa, Mycobacterium
LALVLFLGHLVRQIRIE

SEQ ID NO: 970415 - protein, 17 aa, Mycobacterium
LAMMVLSKSFSVLRSAM

SEQ ID NO: 970416 - protein, 19 aa, Mycobacterium
LAMSVVVATGFKPSGEHYQ

SEQ ID NO: 970417 - protein, 18 aa, Mycobacterium
LANHLVDQGCDGLVVSGT

SEQ ID NO: 970418 - protein, 26 aa, Mycobacterium
LAPHRGRWFIRHIIDLLIVALPMMRP

SEQ ID NO: 970419 - protein, 21 aa, Mycobacterium
LAPLRRALALLGREQVADTDD

SEQ ID NO: 970420 - protein, 25 aa, Mycobacterium
LAPPPAMPPTLAWWASSLQLSGLSA

SEQ ID NO: 970421 - protein, 25 aa, Mycobacterium
LAPSGFSVFGVFWGAFGLVSGTANG

SEQ ID NO: 970422 - protein, 18 aa, Mycobacterium
LAPVAFVVGVAFNRIMAA

SEQ ID NO: 970423 - protein, 25 aa, Mycobacterium
LAQAFSIQLICRILGMLASVVSVML

SEQ ID NO: 970424 - protein, 27 aa, Mycobacterium
LAQHPRLPRRDALKVLPPDVSADTAFR

SEQ ID NO: 970425 - protein, 18 aa, Mycobacterium
LAQLPDRYPLKGIFHAAG

SEQ ID NO: 970426 - protein, 17 aa, Mycobacterium
LAQTVGCALDYEYIAML

SEQ ID NO: 970427 - protein, 18 aa, Mycobacterium
LARATWPLRAPRAAMVLW

SEQ ID NO: 970428 - protein, 18 aa, Mycobacterium
LARRTKRRINPGLVVGAL

SEQ ID NO: 970429 - protein, 25 aa, Mycobacterium
LARSRARLMRLMRPLILLPLVLPPV

SEQ ID NO: 970430 - protein, 19 aa, Mycobacterium
LASAAAWKSLSGEYASAAA

SEQ ID NO: 970431 - protein, 22 aa, Mycobacterium
LASGDHSLTYVIEAPPVFFARH

SEQ ID NO: 970432 - protein, 23 aa, Mycobacterium
LASICSTGALLLVIDSDFIAALL

SEQ ID NO: 970433 - protein, 20 aa, Mycobacterium
LASLLWQLLLVWIGAVVGAG

SEQ ID NO: 970434 - protein, 21 aa, Mycobacterium
LASLRLWRHLGRLCLMSPDPS

SEQ ID NO: 970435 - protein, 22 aa, Mycobacterium
LASLRTSLGILFDADVEQRPAL

SEQ ID NO: 970436 - protein, 17 aa, Mycobacterium
LASMPILLAVDALDKRV

SEQ ID NO: 970437 - protein, 26 aa, Mycobacterium
LATFAVEMALMFAVPAGPAMARSFGF

SEQ ID NO: 970438 - protein, 20 aa, Mycobacterium
LATRALSFWLNPGVPTRITI

SEQ ID NO: 970439 - protein, 20 aa, Mycobacterium
LAVAVPAAWAQTHIIDRDGC

SEQ ID NO: 970440 - protein, 18 aa, Mycobacterium
LAVAWPLAAALRAIPGQN

SEQ ID NO: 970441 - protein, 25 aa, Mycobacterium
LAVFFPWNLYFGFRIPGSSNYVLAV

SEQ ID NO: 970442 - protein, 24 aa, Mycobacterium
LAVPRTPPAPVIIKPGADAAAQFA

SEQ ID NO: 970443 - protein, 17 aa, Mycobacterium
LAVRGWPLRGLAALLAM

SEQ ID NO: 970444 - protein, 31 aa, Mycobacterium; identical to SEQ ID NO: 315518

SEQ ID NO: 970445 - protein, 20 aa, Mycobacterium
LAVVAAVCAFAFMNNLAEAK

SEQ ID NO: 970446 - protein, 17 aa, Mycobacterium
LAVVWVLRRKIFSRASG

SEQ ID NO: 970447 - protein, 22 aa, Mycobacterium
LAWWFDWLPHHGLEDTQRTNRY

SEQ ID NO: 970448 - protein, 27 aa, Mycobacterium
LAYGHQSSYGWLVWVFVAMFGVGLIDL

SEQ ID NO: 970449 - protein, 20 aa, Mycobacterium
LCVLSVPPLAVFVLLVSLIY

SEQ ID NO: 970450 - protein, 18 aa, Mycobacterium
LDAACDRISDGAVFSGLL

SEQ ID NO: 970451 - protein, 18 aa, Mycobacterium
LDAAGWLRVTDRLKEMIK

SEQ ID NO: 970452 - protein, 23 aa, Mycobacterium
LDAGGRPKLWLTTRALQRLAHAV

SEQ ID NO: 970453 - protein, 24 aa, Mycobacterium
LDAHLRLPLRQVMWGTDEGLLEST

SEQ ID NO: 970454 - protein, 19 aa, Mycobacterium
LDASRWERAGWRVFRLGAR

SEQ ID NO: 970455 - protein, 18 aa, Mycobacterium
LDATISWTSDGIKESVQK

SEQ ID NO: 970456 - protein, 27 aa, Mycobacterium
LDATVVRMFLVPSVMKLLGDDCWWAPR

SEQ ID NO: 970457 - protein, 17 aa, Mycobacterium
LDEALPGVIQRCARTPL

SEQ ID NO: 970458 - protein, 19 aa, Mycobacterium
LDECGACGLWFEQVAGQAS

SEQ ID NO: 970459 - protein, 27 aa, Mycobacterium
LDERLAKFHFWLTFLGFHATFLVQHWL

SEQ ID NO: 970460 - protein, 18 aa, Mycobacterium
LDGSLLRIAGICVFASVA

SEQ ID NO: 970461 - protein, 17 aa, Mycobacterium
LDGYGVRHLVLASRRGD

SEQ ID NO: 970462 - protein, 25 aa, Mycobacterium
LDHRERRGALVLAVLVGDNSKNAVA

SEQ ID NO: 970463 - protein, 18 aa, Mycobacterium
LDHRFGWSSVPTAVCLIG

SEQ ID NO: 970464 - protein, 21 aa, Mycobacterium
LDHVFTLSVPSLWRETPAPYG

SEQ ID NO: 970465 - protein, 18 aa, Mycobacterium
LDILADWPVDELPKAALY

SEQ ID NO: 970466 - protein, 19 aa, Mycobacterium
LDIMHSRLWGRAEAIRTTL

SEQ ID NO: 970467 - protein, 17 aa, Mycobacterium
LDLDLSMFVLCSSIAAT

SEQ ID NO: 970468 - protein, 18 aa, Mycobacterium
LDLLLAIVRRTRAGRSAF

SEQ ID NO: 970469 - protein, 18 aa, Mycobacterium
LDLSIAVVAVRTFAISRG

SEQ ID NO: 970470 - protein, 23 aa, Mycobacterium
LDLSRIDAGLPLDRHDTDLAEIV

SEQ ID NO: 970471 - protein, 27 aa, Mycobacterium
LDMLGGLAHRMRCTTTFFGIAALGASG

SEQ ID NO: 970472 - protein, 24 aa, Mycobacterium
LDMRLIERTHLALLLERFGPVTPP

SEQ ID NO: 970473 - protein, 19 aa, Mycobacterium
LDNYRGVFGGDLFSSALIN

SEQ ID NO: 970474 - protein, 24 aa, Mycobacterium
LDPLPRWVRPDVLSSGDLVISGVL

SEQ ID NO: 970475 - protein, 25 aa, Mycobacterium
LDRAHPRAVAGFGFSVVAISLIWFS

SEQ ID NO: 970476 - protein, 23 aa, Mycobacterium
LDRFPRGNLIGIPGAPERMVQSE

SEQ ID NO: 970477 - protein, 25 aa, Mycobacterium
LDRHLRIPLCEVMWGSDVALLDSTE

SEQ ID NO: 970478 - protein, 23 aa, Mycobacterium
LDRRPKGTIIFCVAGLTFAFVLL

SEQ ID NO: 970479 - protein, 21 aa, Mycobacterium
LDRWLLFNWMRWGRALEYLKI

SEQ ID NO: 970480 - protein, 25 aa, Mycobacterium
LDSLAEKRRTLGLPATSVAWGLWAG

SEQ ID NO: 970481 - protein, 21 aa, Mycobacterium
LDVINELRAAGAEAIQVSDAQ

SEQ ID NO: 970482 - protein, 19 aa, Mycobacterium
LDVLRRVASDFDRIQKVAS

SEQ ID NO: 970483 - protein, 20 aa, Mycobacterium
LDVLRRVASDFDRIQKVASG

SEQ ID NO: 970484 - protein, 21 aa, Mycobacterium
LDWREAFAGLGAQRTDLPTYG

SEQ ID NO: 970485 - protein, 23 aa, Mycobacterium
LEAHLLQPLVMGRAVSIHPLGVV

SEQ ID NO: 970486 - protein, 24 aa, Mycobacterium
LEASRTWAQASWRHSMPSVEGPDP

SEQ ID NO: 970487 - protein, 21 aa, Mycobacterium
LEERGRTAVYVGQDGQVVGVL

SEQ ID NO: 970488 - protein, 18 aa, Mycobacterium
LEGAVRAMAKRGFAVSML

SEQ ID NO: 970489 - protein, 18 aa, Mycobacterium
LEHGFPPVVGDPTLLTML

SEQ ID NO: 970490 - protein, 22 aa, Mycobacterium
LELPEGPWRLAVGGGGTLEDVL

SEQ ID NO: 970491 - protein, 38 aa, Mycobacterium; identical to SEQ ID NO: 315911

SEQ ID NO: 970492 - protein, 17 aa, Mycobacterium
LEPVFLVTVRFTAVAVS

SEQ ID NO: 970493 - protein, 17 aa, Mycobacterium
LEQVIPLMPGAQLTGHQ

SEQ ID NO: 970494 - protein, 34 aa, Mycobacterium
LESIHMSWLRFGHGLVLSSIVLWLGVGLMLIAWL

SEQ ID NO: 970495 - protein, 22 aa, Mycobacterium
LESPSTAAGPCADVESGNADDV

SEQ ID NO: 970496 - protein, 17 aa, Mycobacterium
LESRYADRLEILHVMSN

SEQ ID NO: 970497 - protein, 26 aa, Mycobacterium
LESYNKTWLRFAAVAVVAVVIAAMLV

SEQ ID NO: 970498 - protein, 23 aa, Mycobacterium
LETARPADLLVLLDSLRQREGTL

SEQ ID NO: 970499 - protein, 18 aa, Mycobacterium
LEVFATASPGKWDTLRAM

SEQ ID NO: 970500 - protein, 23 aa, Mycobacterium
LEVWPVILVGALAWLSAAMAAFL

SEQ ID NO: 970501 - protein, 25 aa, Mycobacterium
LFAQANRVAHDWLFSEAQSAADGER

SEQ ID NO: 970502 - protein, 18 aa, Mycobacterium
LFCVGLITAYLAARAGTT

SEQ ID NO: 970503 - protein, 18 aa, Mycobacterium
LFDFNVGVMRWRWRVAFY

SEQ ID NO: 970504 - protein, 19 aa, Mycobacterium
LFDMAMLAALSVVYSAVVW

SEQ ID NO: 970505 - protein, 18 aa, Mycobacterium
LFFAVYFMQVTYSLMTFW

SEQ ID NO: 970506 - protein, 19 aa, Mycobacterium
LFGELEFWAALIKVIALVI

SEQ ID NO: 970507 - protein, 28 aa, Mycobacterium
LFIVDWRVALVLLIPVLMYLVMTSSLAV

SEQ ID NO: 970508 - protein, 17 aa, Mycobacterium
LFIVYRSVSTVLLVLAV

SEQ ID NO: 970509 - protein, 28 aa, Mycobacterium
LFLVFGGAVAACLPVMVGGLSIAGALGI

SEQ ID NO: 970510 - protein, 18 aa, Mycobacterium
LFLWETILAIIAFIAKLA

SEQ ID NO: 970511 - protein, 23 aa, Mycobacterium
LFMPSALALLFAMFAVPQLQLYM

SEQ ID NO: 970512 - protein, 17 aa, Mycobacterium
LFPKLGVTNRAGLHDAL

SEQ ID NO: 970513 - protein, 22 aa, Mycobacterium
LFPSRRREWVVAGAGTFVAHAA

SEQ ID NO: 970514 - protein, 17 aa, Mycobacterium
LFRNRVVTVANATIVFV

SEQ ID NO: 970515 - protein, 19 aa, Mycobacterium
LFRPRFIKRMFFAKFPDDL

SEQ ID NO: 970516 - protein, 18 aa, Mycobacterium
LFTVLLIIGVSAPVSGII

SEQ ID NO: 970517 - protein, 18 aa, Mycobacterium
LFVAAMWVTYALFMGSLR

SEQ ID NO: 970518 - protein, 18 aa, Mycobacterium
LFVVRSLIGMYQIRLFAE

SEQ ID NO: 970519 - protein, 17 aa, Mycobacterium
LGALVWGVIDAVLILTD

SEQ ID NO: 970520 - protein, 20 aa, Mycobacterium
LGAMAACAVARLDFPGKRLL

SEQ ID NO: 970521 - protein, 24 aa, Mycobacterium
LGANWRTCAIAALTAATIDRLGRV

SEQ ID NO: 970522 - protein, 29 aa, Mycobacterium
LGASFPALLPVVAAAAVWNGAFGGIPSIY

SEQ ID NO: 970523 - protein, 36 aa, Mycobacterium
LGFGCGSGPLTGRFMPPVGVFLYWLRPKTIRLPPWP

SEQ ID NO: 970524 - protein, 17 aa, Mycobacterium
LGFLRYGLPPNDRIQLQ

SEQ ID NO: 970525 - protein, 18 aa, Mycobacterium
LGFLTVFGVFGLLISPVI

SEQ ID NO: 970526 - protein, 17 aa, Mycobacterium
LGFRFRQGVIASLMWVS

SEQ ID NO: 970527 - protein, 24 aa, Mycobacterium
LGFVMPGDIPFQVQLPPGAVVAPQ

SEQ ID NO: 970528 - protein, 20 aa, Mycobacterium
LGGFCDIVGMTSVEKLEPDE

SEQ ID NO: 970529 - protein, 17 aa, Mycobacterium
LGGGLGIAVLGSVLTAT

SEQ ID NO: 970530 - protein, 18 aa, Mycobacterium
LGGGVFGLSLGKHVTQSG

SEQ ID NO: 970531 - protein, 19 aa, Mycobacterium
LGGNRPRWMGADIGQRQFY

SEQ ID NO: 970532 - protein, 23 aa, Mycobacterium
LGGWASIHVFGFPALDNSTPLFA

SEQ ID NO: 970533 - protein, 28 aa, Mycobacterium
LGHLGFFVLDGWLRPVPVGVVGESYVAG

SEQ ID NO: 970534 - protein, 26 aa, Mycobacterium
LGIARRAGTPISFWEFTRKGIVVTTI

SEQ ID NO: 970535 - protein, 17 aa, Mycobacterium
LGIELHWLVLAMAVIIL

SEQ ID NO: 970536 - protein, 20 aa, Mycobacterium
LGLATWQFRRASSWTYRQAR

SEQ ID NO: 970537 - protein, 19 aa, Mycobacterium
LGLFGLFAYTGMRIARRSA

SEQ ID NO: 970538 - protein, 25 aa, Mycobacterium
LGLIIPMLIGGWFLVRDRVLEIARR

SEQ ID NO: 970539 - protein, 26 aa, Mycobacterium
LGLLVIAIMVAWRWAPAKVAPVPGPL

SEQ ID NO: 970540 - protein, 23 aa, Mycobacterium
LGLLWWMMVCWSQPLRGRSDNPV

SEQ ID NO: 970541 - protein, 19 aa, Mycobacterium
LGLMLGRARREGIESWKAA

SEQ ID NO: 970542 - protein, 22 aa, Mycobacterium
LGLMRAIICQLTFSHGPDHVQF

SEQ ID NO: 970543 - protein, 23 aa, Mycobacterium
LGLPPWMVFFGFSVSLIYQFWVH

SEQ ID NO: 970544 - protein, 27 aa, Mycobacterium
LGLSERRRSRRAWAAIGSVAATLLALS

SEQ ID NO: 970545 - protein, 17 aa, Mycobacterium
LGLVFGLGGLVVSVAAS

SEQ ID NO: 970546 - protein, 18 aa, Mycobacterium
LGLVLWAPMGGWQLSRQL

SEQ ID NO: 970547 - protein, 19 aa, Mycobacterium
LGNKQWLPLIVRIDDPWLA

SEQ ID NO: 970548 - protein, 19 aa, Mycobacterium
LGPELSRLITGTSNLAIDA

SEQ ID NO: 970549 - protein, 19 aa, Mycobacterium
LGPLQRVRPAAVIDTQNGL

SEQ ID NO: 970550 - protein, 24 aa, Mycobacterium
LGPMAGPILGGWLIDDYGWQWIFW

SEQ ID NO: 970551 - protein, 17 aa, Mycobacterium
LGPRATLAWTMTIAAGV

SEQ ID NO: 970552 - protein, 26 aa, Mycobacterium
LGPVIRLPLVLGLAELLGRIPLPGSA

SEQ ID NO: 970553 - protein, 21 aa, Mycobacterium
LGPVMVFCVLGARIWSGSVAA

SEQ ID NO: 970554 - protein, 23 aa, Mycobacterium
LGQAELDAGYILTCQSHPTTPFV

SEQ ID NO: 970555 - protein, 22 aa, Mycobacterium
LGQCGKLGVRDVLFGGRVSYLA

SEQ ID NO: 970556 - protein, 25 aa, Mycobacterium
LGQTARLYIRPVMNSMPAQPAAQEP

SEQ ID NO: 970557 - protein, 17 aa, Mycobacterium
LGRRLLGRPEPPPRPVA

SEQ ID NO: 970558 - protein, 25 aa, Mycobacterium
LGSALALAGVSAWLITRASQMPPVL

SEQ ID NO: 970559 - protein, 24 aa, Mycobacterium
LGSDPFVAILGFPFIPQAMRHRYF

SEQ ID NO: 970560 - protein, 18 aa, Mycobacterium
LGSLVSMGFGRALRRELF

SEQ ID NO: 970561 - protein, 24 aa, Mycobacterium
LGTFNRYWLAAALGVTALVLSAIY

SEQ ID NO: 970562 - protein, 18 aa, Mycobacterium
LGTIEAFIQYVRQFNQPV

SEQ ID NO: 970563 - protein, 19 aa, Mycobacterium
LGTKRLVMGSVLLFTLGSL

SEQ ID NO: 970564 - protein, 19 aa, Mycobacterium
LGVAMRWVCGAIFVAISAS

SEQ ID NO: 970565 - protein, 18 aa, Mycobacterium
LGVARLMRFIPRSVMVGF

SEQ ID NO: 970566 - protein, 17 aa, Mycobacterium
LGVDLIFGSGISIGAVA

SEQ ID NO: 970567 - protein, 19 aa, Mycobacterium
LGVFLMISSTFNKPSAFST

SEQ ID NO: 970568 - protein, 17 aa, Mycobacterium
LGVGVGMLEHHLTKLVL

SEQ ID NO: 970569 - protein, 23 aa, Mycobacterium
LGVLRDGQKWVALAMPGYAVSAA

SEQ ID NO: 970570 - protein, 17 aa, Mycobacterium
LGVPCGVLVATVVAGDK

SEQ ID NO: 970571 - protein, 25 aa, Mycobacterium
LGVSILLGVAIGWGLYGNTRSPLDF

SEQ ID NO: 970572 - protein, 17 aa, Mycobacterium
LGVVLLIVDALRERQQR

SEQ ID NO: 970573 - protein, 26 aa, Mycobacterium
LGWTAVTPVLWWIGPFLLYLLLPALD

SEQ ID NO: 970574 - protein, 17 aa, Mycobacterium
LGYSVWTLWPVMELFMP

SEQ ID NO: 970575 - protein, 19 aa, Mycobacterium
LHERRGYRPAHAFLVAAAA

SEQ ID NO: 970576 - protein, 19 aa, Mycobacterium
LHGSMPIVVERDGTTVTAN

SEQ ID NO: 970577 - protein, 22 aa, Mycobacterium
LHIPLWLGYAFSTLLIFPLVIY

SEQ ID NO: 970578 - protein, 19 aa, Mycobacterium
LHLVFNMWALYVVGPPLEM

SEQ ID NO: 970579 - protein, 25 aa, Mycobacterium
LHLVPWTVSVNWWLIVVAFVAFVTP

SEQ ID NO: 970580 - protein, 17 aa, Mycobacterium
LHRFGELVAPLTFVGAA

SEQ ID NO: 970581 - protein, 17 aa, Mycobacterium
LHVTRLIGIAIIAVSLP

SEQ ID NO: 970582 - protein, 19 aa, Mycobacterium
LHYQRARMNDLLTQADEMA

SEQ ID NO: 970583 - protein, 19 aa, Mycobacterium
LHYRHELLYYKVLTEHLVE

SEQ ID NO: 970584 - protein, 18 aa, Mycobacterium
LIAGASCNDAALTHDDAR

SEQ ID NO: 970585 - protein, 18 aa, Mycobacterium
LIAGMLAELSRLLCAETL

SEQ ID NO: 970586 - protein, 17 aa, Mycobacterium
LIAGRWQLIAFAAPLLG

SEQ ID NO: 970587 - protein, 17 aa, Mycobacterium
LIAIIVVLWVSRTDGVV

SEQ ID NO: 970588 - protein, 19 aa, Mycobacterium
LIALWRLDRLDGRRLRSLF

SEQ ID NO: 970589 - protein, 17 aa, Mycobacterium
LIATGGMGQVWEAVDSR

SEQ ID NO: 970590 - protein, 18 aa, Mycobacterium
LIATGGMGQVWEAVDSRL

SEQ ID NO: 970591 - protein, 26 aa, Mycobacterium
LIATLGLRFYLGWITHTGYTYGALST

SEQ ID NO: 970592 - protein, 18 aa, Mycobacterium
LIAWAGFALLTWSLAGVA

SEQ ID NO: 970593 - protein, 20 aa, Mycobacterium
LIDAFGWQWIFLINLPIGAL

SEQ ID NO: 970594 - protein, 20 aa, Mycobacterium
LIDLRLFRNRVVTVANATIV

SEQ ID NO: 970595 - protein, 19 aa, Mycobacterium
LIDLRLLKNRAVAAANATR

SEQ ID NO: 970596 - protein, 25 aa, Mycobacterium
LIDVLHWPGYLLVVAGVIGGVGSLA

SEQ ID NO: 970597 - protein, 18 aa, Mycobacterium
LIDWERSALVNGLVPAQF

SEQ ID NO: 970598 - protein, 24 aa, Mycobacterium
LIGLRRLSVTYLRQHPAASLATAG

SEQ ID NO: 970599 - protein, 17 aa, Mycobacterium
LIGTAIAIPLGLFVQHA

SEQ ID NO: 970600 - protein, 17 aa, Mycobacterium
LIHRRVVERFGEEFRIG

SEQ ID NO: 970601 - protein, 23 aa, Mycobacterium
LIIAFPCALGLATPTALLVGTGR

SEQ ID NO: 970602 - protein, 22 aa, Mycobacterium
LIKDRTVLVIAHRLHTITGADQ

SEQ ID NO: 970603 - protein, 17 aa, Mycobacterium
LILAAFFSGGWRVVMLG

SEQ ID NO: 970604 - protein, 18 aa, Mycobacterium
LILLPLVAVYAVAQRAFI

SEQ ID NO: 970605 - protein, 17 aa, Mycobacterium
LILRLVLGLTMAAHGFN

SEQ ID NO: 970606 - protein, 18 aa, Mycobacterium
LILSSPFLLPAALGLALS

SEQ ID NO: 970607 - protein, 24 aa, Mycobacterium
LIMIAVFCGFAFAGMPLVAEIGVA

SEQ ID NO: 970608 - protein, 34 aa, Mycobacterium; identical to SEQ ID NO: 316796

SEQ ID NO: 970609 - protein, 23 aa, Mycobacterium
LIRKRRIGAVWLTAAGYAVACQV

SEQ ID NO: 970610 - protein, 19 aa, Mycobacterium
LIRLIRRLLPAMVVVLAAC

SEQ ID NO: 970611 - protein, 18 aa, Mycobacterium
LIRSQYPAGMPVAEVVAV

SEQ ID NO: 970612 - protein, 24 aa, Mycobacterium
LISFSIWYFWADRFSLLALSVLIG

SEQ ID NO: 970613 - protein, 18 aa, Mycobacterium
LITGWWRSGRLFCIAVGF

SEQ ID NO: 970614 - protein, 17 aa, Mycobacterium
LITRMPQGWSFAQAAAV

SEQ ID NO: 970615 - protein, 19 aa, Mycobacterium
LIVGAAWPMIVEQISVKPN

SEQ ID NO: 970616 - protein, 19 aa, Mycobacterium
LIVGLSWAAIGFLYLLWLT

SEQ ID NO: 970617 - protein, 19 aa, Mycobacterium
LIVSRQWKLLGAYAAAAIM

SEQ ID NO: 970618 - protein, 22 aa, Mycobacterium
LIVWRRDLRSIVWLLAAQGLAL

SEQ ID NO: 970619 - protein, 24 aa, Mycobacterium
LIWIRCAVWLLAGIAIYVGYRYQH

SEQ ID NO: 970620 - protein, 17 aa, Mycobacterium
LKAGERVLIHAGAGGVG

SEQ ID NO: 970621 - protein, 17 aa, Mycobacterium
LKAGGATVALLTTSALQ

SEQ ID NO: 970622 - protein, 19 aa, Mycobacterium
LKDMREFTGLLAQHDDLLS

SEQ ID NO: 970623 - protein, 18 aa, Mycobacterium
LKFAMFMLAEYVNMTTVS

SEQ ID NO: 970624 - protein, 26 aa, Mycobacterium
LKHVRKRLRDAFGFPKSVVHAQAYWT

SEQ ID NO: 970625 - protein, 19 aa, Mycobacterium
LKITYGWSLLLIVTFTVLY

SEQ ID NO: 970626 - protein, 21 aa, Mycobacterium
LKIVGKLAQFGSGMLQQVSEK

SEQ ID NO: 970627 - protein, 23 aa, Mycobacterium
LKRERDAVELDLRANVGAMSATL

SEQ ID NO: 970628 - protein, 29 aa, Mycobacterium
LKRYFAEGLHYWPWVLLGYFTVAIMVVSL

SEQ ID NO: 970629 - protein, 26 aa, Mycobacterium
LKRYGPLPPPRAVAITRQIGSALDAA

SEQ ID NO: 970630 - protein, 19 aa, Mycobacterium
LKTVPKRLSGLLNTSGLPA

SEQ ID NO: 970631 - protein, 23 aa, Mycobacterium
LKVKTVRPAPGFTPGQVLDAALS

SEQ ID NO: 970632 - protein, 25 aa, Mycobacterium
LKVNQAGVIPVIFASSLIYIPHLIT

SEQ ID NO: 970633 - protein, 19 aa, Mycobacterium
LKVSAVVAAPGWDADEVLA

SEQ ID NO: 970634 - protein, 24 aa, Mycobacterium
LLAAGGRYAALWAAHSRVGRPSPS

SEQ ID NO: 970635 - protein, 21 aa, Mycobacterium
LLAATIVGRLWGWRTAIRRSG

SEQ ID NO: 970636 - protein, 27 aa, Mycobacterium
LLADEGHHLVATRLCWSDQDRAEDLRR

SEQ ID NO: 970637 - protein, 18 aa, Mycobacterium
LLAGFGWMISSRMVRGMT

SEQ ID NO: 970638 - protein, 22 aa, Mycobacterium
LLAGIALLISRQVVVPVRSASR

SEQ ID NO: 970639 - protein, 24 aa, Mycobacterium
LLAHLCFLGAMLPMAWGAVPSRPR

SEQ ID NO: 970640 - protein, 20 aa, Mycobacterium
LLAINAKLALLIFATLPMLG

SEQ ID NO: 970641 - protein, 24 aa, Mycobacterium
LLAIRPELQQALGNQNWAAVPGLQ

SEQ ID NO: 970642 - protein, 19 aa, Mycobacterium
LLALRAVVFTLVMAATFWL

SEQ ID NO: 970643 - protein, 21 aa, Mycobacterium
LLAPFRFAIFHLLVWGTFTIL

SEQ ID NO: 970644 - protein, 26 aa, Mycobacterium
LLAQVPARYPLRGVIHAAGVLDDGLI

SEQ ID NO: 970645 - protein, 33 aa, Mycobacterium; identical to SEQ ID NO: 317038

SEQ ID NO: 970646 - protein, 18 aa, Mycobacterium
LLASMPSWGMVVTLVAWG

SEQ ID NO: 970647 - protein, 19 aa, Mycobacterium
LLASMTMVWLSVLLYAKVG

SEQ ID NO: 970648 - protein, 18 aa, Mycobacterium
LLATRAIRADRWLNGLHG

SEQ ID NO: 970649 - protein, 26 aa, Mycobacterium
LLAVIWWLAGAGWAIAAALAVLVVGV

SEQ ID NO: 970650 - protein, 24 aa, Mycobacterium
LLAVRPEFEQALANKGWAALPGLQ

SEQ ID NO: 970651 - protein, 17 aa, Mycobacterium
LLDLGRKGYLVLTAFAS

SEQ ID NO: 970652 - protein, 42 aa, Mycobacterium
LLDPRRMIKVRGWRRIGTAIVRWPGPVFVASLLIALVGMMVV

SEQ ID NO: 970653 - protein, 18 aa, Mycobacterium
LLDSHDWLVVLTALGSLA

SEQ ID NO: 970654 - protein, 20 aa, Mycobacterium
LLELATPYALHAVSDEERLD

SEQ ID NO: 970655 - protein, 22 aa, Mycobacterium
LLFPVVQPWYLLWAIIPMAAWA

SEQ ID NO: 970656 - protein, 17 aa, Mycobacterium
LLFRVDAAVFGKRLRHR

SEQ ID NO: 970657 - protein, 21 aa, Mycobacterium
LLFTRPRLRIGAAGISVRNLL

SEQ ID NO: 970658 - protein, 25 aa, Mycobacterium
LLFYVGAALLTWSRYGRRAVPVAGT

SEQ ID NO: 970659 - protein, 28 aa, Mycobacterium
LLGAIARRFALSPIPVYLLAGLSLGKGG

SEQ ID NO: 970660 - protein, 25 aa, Mycobacterium
LLGALCMLGTLWLVVRARSSTRAGA

SEQ ID NO: 970661 - protein, 31 aa, Mycobacterium; identical to SEQ ID NO: 317134

SEQ ID NO: 970662 - protein, 24 aa, Mycobacterium
LLGDRARNAFDLAHRVAPSARLLV

SEQ ID NO: 970663 - protein, 26 aa, Mycobacterium
LLGDRLDALNVWKLGRRLLGRPEPPP

SEQ ID NO: 970664 - protein, 25 aa, Mycobacterium
LLGFERWAPDMPWEISTGKTVLTGE

SEQ ID NO: 970665 - protein, 32 aa, Mycobacterium
LLGGYFTDCLGWRWAFWINLPVSAVVICVATA

SEQ ID NO: 970666 - protein, 23 aa, Mycobacterium
LLGKFTFGVLMLRVEETAIGAVI

SEQ ID NO: 970667 - protein, 26 aa, Mycobacterium
LLGLGFAAVIVIGGWALSTESSPGKA

SEQ ID NO: 970668 - protein, 30 aa, Mycobacterium
LLGPAAGYFMGWSYWFAWIVAGIADLVAIT

SEQ ID NO: 970669 - protein, 24 aa, Mycobacterium
LLGPRLDALNVRRLARRMLGRPKP

SEQ ID NO: 970670 - protein, 18 aa, Mycobacterium
LLGVPAVVYPFVIVGLLL

SEQ ID NO: 970671 - protein, 17 aa, Mycobacterium
LLGVRYALHVSLLAEAQ

SEQ ID NO: 970672 - protein, 18 aa, Mycobacterium
LLHGLLMHSGNDAAHALA

SEQ ID NO: 970673 - protein, 18 aa, Mycobacterium
LLHRDVKPANILVTEPSE

SEQ ID NO: 970674 - protein, 21 aa, Mycobacterium
LLIGLIRWYIGMAQRTSALAT

SEQ ID NO: 970675 - protein, 26 aa, Mycobacterium
LLILTYRSSVLWLLPLLVIAFADRVA

SEQ ID NO: 970676 - protein, 19 aa, Mycobacterium
LLIPVSDLYLFFTWLPSGQ

SEQ ID NO: 970677 - protein, 22 aa, Mycobacterium
LLKASALVYFLGLIAQQRELFQ

SEQ ID NO: 970678 - protein, 25 aa, Mycobacterium
LLLDALAGRERFSLNDPDDDALAAL

SEQ ID NO: 970679 - protein, 20 aa, Mycobacterium
LLLFLQWRTMPAVIWDVQYP

SEQ ID NO: 970680 - protein, 24 aa, Mycobacterium
LLLGGCRFAKEHLSAAPVATIATG

SEQ ID NO: 970681 - protein, 17 aa, Mycobacterium
LLLGIAVALAREASDRT

SEQ ID NO: 970682 - protein, 17 aa, Mycobacterium
LLLVYRSIITAAIMLTM

SEQ ID NO: 970683 - protein, 17 aa, Mycobacterium
LLLVYRSPLTVVLLLLT

SEQ ID NO: 970684 - protein, 23 aa, Mycobacterium
LLLWTIGLCLYGLVMGSVVHGIG

SEQ ID NO: 970685 - protein, 18 aa, Mycobacterium
LLMLGDWMRALAREQGPV

SEQ ID NO: 970686 - protein, 24 aa, Mycobacterium
LLMLMAGVALFWIVTLVVAAARGL

SEQ ID NO: 970687 - protein, 30 aa, Mycobacterium; identical to SEQ ID NO: 317338

SEQ ID NO: 970688 - protein, 18 aa, Mycobacterium
LLMTGLVIFGLVSIPAAF

SEQ ID NO: 970689 - protein, 21 aa, Mycobacterium
LLPDNLRWLVTVDAMHTQVVI

SEQ ID NO: 970690 - protein, 22 aa, Mycobacterium
LLPDSLRWLVTVDAMHTQVVTV

SEQ ID NO: 970691 - protein, 21 aa, Mycobacterium
LLPGSLRWLVTVDAMHTQVVI

SEQ ID NO: 970692 - protein, 18 aa, Mycobacterium
LLPISWQLGLAALAGVPL

SEQ ID NO: 970693 - protein, 25 aa, Mycobacterium
LLPMWEIVMILLLLAMVGLRDKVIF

SEQ ID NO: 970694 - protein, 18 aa, Mycobacterium
LLPPERRAQPGARARLFG

SEQ ID NO: 970695 - protein, 24 aa, Mycobacterium
LLPPGLRQLAKWTGLIASVVTLAM

SEQ ID NO: 970696 - protein, 24 aa, Mycobacterium
LLPTIGLAGLLWVAAALIAISLAV

SEQ ID NO: 970697 - protein, 24 aa, Mycobacterium
LLPTLLATVRWRRRRTRLAIWVAL

SEQ ID NO: 970698 - protein, 17 aa, Mycobacterium
LLRALYVILGWRRVLLI

SEQ ID NO: 970699 - protein, 27 aa, Mycobacterium
LLRLKVFPLAISLPWGIAPAALPQLPL

SEQ ID NO: 970700 - protein, 20 aa, Mycobacterium
LLRSRFRISQTLAISLIAII

SEQ ID NO: 970701 - protein, 17 aa, Mycobacterium
LLRTVALGMMVGNSPEV

SEQ ID NO: 970702 - protein, 17 aa, Mycobacterium
LLSGAQESRLWHVGLAA

SEQ ID NO: 970703 - protein, 24 aa, Mycobacterium
LLSGGFLASFSLRTESALTESGLD

SEQ ID NO: 970704 - protein, 21 aa, Mycobacterium
LLSGSLRWLVTVDAMHTQVVT

SEQ ID NO: 970705 - protein, 18 aa, Mycobacterium
LLSIAFVVAMSRACAGIG

SEQ ID NO: 970706 - protein, 24 aa, Mycobacterium
LLTICDRYARILARRSEQYLDPGC

SEQ ID NO: 970707 - protein, 17 aa, Mycobacterium
LLTLLPDNLRWLVTADA

SEQ ID NO: 970708 - protein, 20 aa, Mycobacterium
LLTSFSLRTESILMDPSLDR

SEQ ID NO: 970709 - protein, 18 aa, Mycobacterium
LLVAGRLPGALVIDSVPR

SEQ ID NO: 970710 - protein, 17 aa, Mycobacterium
LLVCSILSVAVVGVIGY

SEQ ID NO: 970711 - protein, 24 aa, Mycobacterium
LLVGCVIEPWALYRPFIPWLGWPM

SEQ ID NO: 970712 - protein, 17 aa, Mycobacterium
LLVGIFVIVDWRMHVAV

SEQ ID NO: 970713 - protein, 17 aa, Mycobacterium
LLVGLAIMGMGTGCTMM

SEQ ID NO: 970714 - protein, 24 aa, Mycobacterium
LLVMTWGPSLCRVERNNSGCKSGH

SEQ ID NO: 970715 - protein, 25 aa, Mycobacterium
LLVSIPFTVLVAFTLNILLREIGAA

SEQ ID NO: 970716 - protein, 18 aa, Mycobacterium
LLVSTLLVASAWWLFEWE

SEQ ID NO: 970717 - protein, 19 aa, Mycobacterium
LLVVFAISVLLTFYPGWVT

SEQ ID NO: 970718 - protein, 30 aa, Mycobacterium
LLWQHILHMPLHWLVLPMAVIVMLAVGSDY

SEQ ID NO: 970719 - protein, 21 aa, Mycobacterium
LLWYAGLPLRVFITSLLAVFI

SEQ ID NO: 970720 - protein, 20 aa, Mycobacterium
LLYRRWIARPGCTTESISMR

SEQ ID NO: 970721 - protein, 19 aa, Mycobacterium
LLYRYYRTRDPLFWFTTSS

SEQ ID NO: 970722 - protein, 23 aa, Mycobacterium
LLYSLLYYRVLGLLTALSLIASG

SEQ ID NO: 970723 - protein, 18 aa, Mycobacterium
LMAAAATDLATIGSTLSA

SEQ ID NO: 970724 - protein, 18 aa, Mycobacterium
LMALGIINECHRLCVDYA

SEQ ID NO: 970725 - protein, 31 aa, Mycobacterium; identical to SEQ ID NO: 317558

SEQ ID NO: 970726 - protein, 37 aa, Mycobacterium; identical to SEQ ID NO: 317559

SEQ ID NO: 970727 - protein, 21 aa, Mycobacterium
LMDLSARFSRLVIDGPPVLAT

SEQ ID NO: 970728 - protein, 26 aa, Mycobacterium
LMGGLLVEYFWWGAIFLINVPLALLV

SEQ ID NO: 970729 - protein, 21 aa, Mycobacterium
LMHYRGWAIPVAFVIAQAVST

SEQ ID NO: 970730 - protein, 18 aa, Mycobacterium
LMLGLAVVRLDGRMPVGV

SEQ ID NO: 970731 - protein, 17 aa, Mycobacterium
LMPLATRALSFWLNPGV

SEQ ID NO: 970732 - protein, 26 aa, Mycobacterium
LMRAAVETCRLLPMMVTVAIGLAVLG

SEQ ID NO: 970733 - protein, 18 aa, Mycobacterium
LMRWDGRQQDRWSSGQLI

SEQ ID NO: 970734 - protein, 21 aa, Mycobacterium
LMVGTAFCYLYARGMLARRGR

SEQ ID NO: 970735 - protein, 24 aa, Mycobacterium
LMWIGYRQDWGWLHAMDWSLLNAS

SEQ ID NO: 970736 - protein, 22 aa, Mycobacterium
LMWLCVPVTLGIAFAVMVTTVA

SEQ ID NO: 970737 - protein, 24 aa, Mycobacterium
LMYGEIFTITAFVCVFGAVLGLLV

SEQ ID NO: 970738 - protein, 21 aa, Mycobacterium
LNAAFRYALVRLRDAAEAVGF

SEQ ID NO: 970739 - protein, 18 aa, Mycobacterium
LNAGLGFGGGCLPKDIRA

SEQ ID NO: 970740 - protein, 18 aa, Mycobacterium
LNCTSCHNFTGKGGALSS

SEQ ID NO: 970741 - protein, 23 aa, Mycobacterium
LNDGLALPFVMIFLATAQGDGSD

SEQ ID NO: 970742 - protein, 19 aa, Mycobacterium
LNDPPPCNVGFLPPPLIRS

SEQ ID NO: 970743 - protein, 23 aa, Mycobacterium
LNFELQRALKIVGSSGVRVMVAT

SEQ ID NO: 970744 - protein, 24 aa, Mycobacterium
LNIAFALGYPMDFATYVTLLSQTF

SEQ ID NO: 970745 - protein, 23 aa, Mycobacterium
LNKPIPVRYAHWVTHAVRGDFGV

SEQ ID NO: 970746 - protein, 17 aa, Mycobacterium
LNLLEGVVIGLGVAIAF

SEQ ID NO: 970747 - protein, 22 aa, Mycobacterium
LNLPPPCSTGFLPAQQQRVPTF

SEQ ID NO: 970748 - protein, 22 aa, Mycobacterium
LNLPPPCTTGFLPAQQQRVPTF

SEQ ID NO: 970749 - protein, 18 aa, Mycobacterium
LNMPPPRISKRHPKLAHL

SEQ ID NO: 970750 - protein, 23 aa, Mycobacterium
LNNRKHQAAARCVGGHQTVAVVA

SEQ ID NO: 970751 - protein, 18 aa, Mycobacterium
LNTRMFKYFVKRFALKRG

SEQ ID NO: 970752 - protein, 23 aa, Mycobacterium
LNTRNVFGPPAWAPVINNGVAIA

SEQ ID NO: 970753 - protein, 17 aa, Mycobacterium
LNVLFSYQGNDMYTALQ

SEQ ID NO: 970754 - protein, 25 aa, Mycobacterium
LNVLLWLSYFVMLGLYAVAFGSYGA

SEQ ID NO: 970755 - protein, 24 aa, Mycobacterium
LNVPEFPWTVLTIVLLIGVLVAAI

SEQ ID NO: 970756 - protein, 23 aa, Mycobacterium
LNVYPRYLPLIPENVDAQIKATT

SEQ ID NO: 970757 - protein, 24 aa, Mycobacterium
LPAAAVLTMCFIVAGIIAPSLARR

SEQ ID NO: 970758 - protein, 19 aa, Mycobacterium
LPAALPFAELIPAIVESLG

SEQ ID NO: 970759 - protein, 25 aa, Mycobacterium
LPAAVTIILAIGVARMARRRAVVRH

SEQ ID NO: 970760 - protein, 18 aa, Mycobacterium
LPAMVRMVPGPLVAIAGA

SEQ ID NO: 970761 - protein, 17 aa, Mycobacterium
LPARRWELPQFPQLPVL

SEQ ID NO: 970762 - protein, 18 aa, Mycobacterium
LPASFGVDQVRQLAARDT

SEQ ID NO: 970763 - protein, 22 aa, Mycobacterium
LPDDLLSGIGLRAALSSITLGM

SEQ ID NO: 970764 - protein, 27 aa, Mycobacterium
LPDFAGYAPKLWRYWAQHLDPDRALRD

SEQ ID NO: 970765 - protein, 18 aa, Mycobacterium
LPDGKWSAIAMSVVTVAF

SEQ ID NO: 970766 - protein, 25 aa, Mycobacterium
LPDLRARGPLWLIILGFSAGVALLV

SEQ ID NO: 970767 - protein, 20 aa, Mycobacterium
LPDNLRWLVTVDAMHTQVVI

SEQ ID NO: 970768 - protein, 22 aa, Mycobacterium
LPDNSWQGSASYAYASQNTALQ

SEQ ID NO: 970769 - protein, 26 aa, Mycobacterium
LPEQLLHLLASLLFLLFGLWMLFEGA

SEQ ID NO: 970770 - protein, 20 aa, Mycobacterium
LPFSNLTAPWGITVDSAGNV

SEQ ID NO: 970771 - protein, 29 aa, Mycobacterium
LPFTGLNTPCRWRWTRRATSTSPIAVTAG

SEQ ID NO: 970772 - protein, 22 aa, Mycobacterium
LPFVILIGLIVSRQWKLLGAYA

SEQ ID NO: 970773 - protein, 17 aa, Mycobacterium
LPFVWNVFKSWRFGEPV

SEQ ID NO: 970774 - protein, 18 aa, Mycobacterium
LPGAAAVPWETGAWSATR

SEQ ID NO: 970775 - protein, 19 aa, Mycobacterium
LPGLQAWLADNGYALRPAV

SEQ ID NO: 970776 - protein, 19 aa, Mycobacterium
LPGRGWSIFIGVISLIAGV

SEQ ID NO: 970777 - protein, 19 aa, Mycobacterium
LPGSLRWLVIVDAMHTQVV

SEQ ID NO: 970778 - protein, 19 aa, Mycobacterium
LPGSLRWLVTVDAMHTQVV

SEQ ID NO: 970779 - protein, 23 aa, Mycobacterium
LPHPDHPSVLLVVGVNGTGKTTT

SEQ ID NO: 970780 - protein, 25 aa, Mycobacterium
LPKEFRCVSVDLLARQAVVHRRGPV

SEQ ID NO: 970781 - protein, 19 aa, Mycobacterium
LPLACLLTATAGWLAVTAF

SEQ ID NO: 970782 - protein, 32 aa, Mycobacterium; identical to SEQ ID NO: 317925

SEQ ID NO: 970783 - protein, 30 aa, Mycobacterium
LPLATWATACGWPFSLAMIDGFERGFAGRL

SEQ ID NO: 970784 - protein, 17 aa, Mycobacterium
LPMLGLATWQFRRASSW

SEQ ID NO: 970785 - protein, 21 aa, Mycobacterium
LPMYLNVAVAVLGFLAYLASF

SEQ ID NO: 970786 - protein, 20 aa, Mycobacterium
LPPLLGELAARPKRRLISDA

SEQ ID NO: 970787 - protein, 21 aa, Mycobacterium
LPPLQARRVFVDGIASALYVG

SEQ ID NO: 970788 - protein, 18 aa, Mycobacterium
LPPSINFAGPSPYIDFDA

SEQ ID NO: 970789 - protein, 20 aa, Mycobacterium
LPPWPERVPWTAGTKRKPVD

SEQ ID NO: 970790 - protein, 20 aa, Mycobacterium
LPQQCLRSDRLSALQQWGLP

SEQ ID NO: 970791 - protein, 20 aa, Mycobacterium
LPRLEVRGGVSWQGHLCGAL

SEQ ID NO: 970792 - protein, 20 aa, Mycobacterium
LPRLRRELEKRLGPEGTDVL

SEQ ID NO: 970793 - protein, 20 aa, Mycobacterium
LPSPRFALLTVVSSFVLAEL

SEQ ID NO: 970794 - protein, 20 aa, Mycobacterium
LPTVRQRVRRSGPRVSGLTG

SEQ ID NO: 970795 - protein, 21 aa, Mycobacterium
LPVIACSPLRGARLDTVGRVL

SEQ ID NO: 970796 - protein, 25 aa, Mycobacterium
LPVLGELWAPLGLRLHAVHHLFPKL

SEQ ID NO: 970797 - protein, 21 aa, Mycobacterium
LPVLVLLVLWRARRRGPDDPP

SEQ ID NO: 970798 - protein, 22 aa, Mycobacterium
LPVQLGKDWVWLHAARVTAPTV

SEQ ID NO: 970799 - protein, 18 aa, Mycobacterium
LPVTGADEYGDYGPDDDE

SEQ ID NO: 970800 - protein, 18 aa, Mycobacterium
LPVWKKLRTGDFAADDAQ

SEQ ID NO: 970801 - protein, 25 aa, Mycobacterium
LQAYRPELLGGVALVAGTDTFMKEA

SEQ ID NO: 970802 - protein, 26 aa, Mycobacterium
LQGLICTAISMPIVFMVGIYLVEYGS

SEQ ID NO: 970803 - protein, 24 aa, Mycobacterium
LQHGRRVALALSFGLRTVLALVLI

SEQ ID NO: 970804 - protein, 21 aa, Mycobacterium
LQIPALLGVGRYPLKAELPAS

SEQ ID NO: 970805 - protein, 25 aa, Mycobacterium
LQKISELYDRVGFAAAGKFNEFDNL

SEQ ID NO: 970806 - protein, 24 aa, Mycobacterium
LQKLFGWWGGSGVTAFKNSLSDVG

SEQ ID NO: 970807 - protein, 24 aa, Mycobacterium
LQQIGPTFRYREFSGDEIDQLILN

SEQ ID NO: 970808 - protein, 27 aa, Mycobacterium
LQTKRLLTRWARDYVTIIGALVLPILF

SEQ ID NO: 970809 - protein, 28 aa, Mycobacterium
LQTKRLLTRWARDYVTIIGALVLPILFL

SEQ ID NO: 970810 - protein, 22 aa, Mycobacterium
LQVLCAVGAVYFGARTGTGFGR

SEQ ID NO: 970811 - protein, 18 aa, Mycobacterium
LQVLGASPWGVRDSIPLT

SEQ ID NO: 970812 - protein, 28 aa, Mycobacterium
LRAHVMATYLSRDWARDWGSLRQFETLV

SEQ ID NO: 970813 - protein, 19 aa, Mycobacterium
LRAQWPILLVGLIFAVAFA

SEQ ID NO: 970814 - protein, 19 aa, Mycobacterium
LRARFRAVTEDAERQIDSC

SEQ ID NO: 970815 - protein, 17 aa, Mycobacterium
LRASTLLNLLQQATAVA

SEQ ID NO: 970816 - protein, 20 aa, Mycobacterium
LRASTLLNLLQQATAVADRT

SEQ ID NO: 970817 - protein, 17 aa, Mycobacterium
LRDGRVVAEGALHHRVI

SEQ ID NO: 970818 - protein, 22 aa, Mycobacterium
LRDRSWWSGPGIYLMVDDYDLE

SEQ ID NO: 970819 - protein, 20 aa, Mycobacterium
LREAPSVPGLPMIVVALAGL

SEQ ID NO: 970820 - protein, 26 aa, Mycobacterium
LREGIACAVLRRPDHRDTYDAMFDLW

SEQ ID NO: 970821 - protein, 31 aa, Mycobacterium; identical to SEQ ID NO: 296727

SEQ ID NO: 970822 - protein, 18 aa, Mycobacterium
LREVHALLYHEVFDTLGS

SEQ ID NO: 970823 - protein, 20 aa, Mycobacterium
LRFTGRRLAIYTAIVTICGL

SEQ ID NO: 970824 - protein, 17 aa, Mycobacterium
LRGATLLAGALGLLTLA

SEQ ID NO: 970825 - protein, 20 aa, Mycobacterium
LRGPAMLMAHVLQPIPRPSH

SEQ ID NO: 970826 - protein, 21 aa, Mycobacterium
LRGSYGGVVMIGMLSSVAGLG

SEQ ID NO: 970827 - protein, 18 aa, Mycobacterium
LRHGQWWLGSAAALSSFT

SEQ ID NO: 970828 - protein, 30 aa, Mycobacterium
LRKRLPKLTKRQRFWISLYLPLTMRSLANA

SEQ ID NO: 970829 - protein, 30 aa, Mycobacterium; identical to SEQ ID NO: 318395

SEQ ID NO: 970830 - protein, 18 aa, Mycobacterium
LRLLPSLIPIGLLAGLLA

SEQ ID NO: 970831 - protein, 19 aa, Mycobacterium
LRLSRHIHRKRVGKGEDPR

SEQ ID NO: 970832 - protein, 19 aa, Mycobacterium
LRLSRIDKPGVARVLDVLH

SEQ ID NO: 970833 - protein, 17 aa, Mycobacterium
LRLSYMALFSVPVLAPL

SEQ ID NO: 970834 - protein, 25 aa, Mycobacterium
LRLWPDRRLSRRGVEIIARRGPRGD

SEQ ID NO: 970835 - protein, 23 aa, Mycobacterium
LRNRMVAGSLFFRLKQPALVPPT

SEQ ID NO: 970836 - protein, 26 aa, Mycobacterium
LRPDLARLDALFARALATEPAGRFRT

SEQ ID NO: 970837 - protein, 17 aa, Mycobacterium
LRPGDVIEVRTHEVVPA

SEQ ID NO: 970838 - protein, 19 aa, Mycobacterium
LRPGWIALALVVIAFTYLC

SEQ ID NO: 970839 - protein, 17 aa, Mycobacterium
LRPPFLRATIFVITLGF

SEQ ID NO: 970840 - protein, 18 aa, Mycobacterium
LRQRFPDLTPAQIINRII

SEQ ID NO: 970841 - protein, 19 aa, Mycobacterium
LRQRFPDLTPAQIINRIIA

SEQ ID NO: 970842 - protein, 19 aa, Mycobacterium
LRRLRRYRNARVVLRAAAE

SEQ ID NO: 970843 - protein, 19 aa, Mycobacterium
LRRPQYRSLWVFLLLPVLI

SEQ ID NO: 970844 - protein, 22 aa, Mycobacterium
LRRRPAQSVAIAVIVMLGVLLF

SEQ ID NO: 970845 - protein, 17 aa, Mycobacterium
LRRTRRAISELLRGNQD

SEQ ID NO: 970846 - protein, 23 aa, Mycobacterium
LRRVELPLSLPVIVAGVRTALVL

SEQ ID NO: 970847 - protein, 17 aa, Mycobacterium
LRSAIGLEAQRLRRQGR

SEQ ID NO: 970848 - protein, 25 aa, Mycobacterium
LRSHIGMVLQDTWLFDGTISENIAY

SEQ ID NO: 970849 - protein, 25 aa, Mycobacterium
LRSRIGMVLQDTWLLAGTIAENIGY

SEQ ID NO: 970850 - protein, 26 aa, Mycobacterium
LRTATLQRLLPRLGIGSSADPQAVAI

SEQ ID NO: 970851 - protein, 17 aa, Mycobacterium
LRTEVRRLAALLREQHS

SEQ ID NO: 970852 - protein, 17 aa, Mycobacterium
LRTPLAAIQGYAELTRQ

SEQ ID NO: 970853 - protein, 18 aa, Mycobacterium
LRTRLLISLAAILLTTIF

SEQ ID NO: 970854 - protein, 17 aa, Mycobacterium
LRTVLRSPAGAAFGPVL

SEQ ID NO: 970855 - protein, 17 aa, Mycobacterium
LRVARAADIGRLNAAVE

SEQ ID NO: 970856 - protein, 17 aa, Mycobacterium
LRVLGQFGSTVCIGLLL

SEQ ID NO: 970857 - protein, 20 aa, Mycobacterium
LRVLPLPRRVAGLLEAESGF

SEQ ID NO: 970858 - protein, 17 aa, Mycobacterium
LRVQRIIAAAVILTQGG

SEQ ID NO: 970859 - protein, 21 aa, Mycobacterium
LRWGLLAVWGPGLVVMLADTD

SEQ ID NO: 970860 - protein, 23 aa, Mycobacterium
LRYFPDLVVVLALLATVALTAAN

SEQ ID NO: 970861 - protein, 22 aa, Mycobacterium
LRYPEDLFKVQRMLLAKYHVND

SEQ ID NO: 970862 - protein, 26 aa, Mycobacterium
LRYYRKEILRLIAQIGMGTGAMAVVG

SEQ ID NO: 970863 - protein, 18 aa, Mycobacterium
LSAAIAVALGLWPRLKEY

SEQ ID NO: 970864 - protein, 21 aa, Mycobacterium
LSAAINFLLIALVVYFLVVLP

SEQ ID NO: 970865 - protein, 17 aa, Mycobacterium
LSAAPAPVAAAFDEEVR

SEQ ID NO: 970866 - protein, 19 aa, Mycobacterium
LSAFLSYFAQILMAVLMAT

SEQ ID NO: 970867 - protein, 18 aa, Mycobacterium
LSAFVLFSSMAGIIGTAG

SEQ ID NO: 970868 - protein, 32 aa, Mycobacterium
LSAIGGFLADWVPFLLGAVVALLWNYPLATLL

SEQ ID NO: 970869 - protein, 18 aa, Mycobacterium
LSAIRLALIPVFVYVMLI

SEQ ID NO: 970870 - protein, 21 aa, Mycobacterium
LSALARTVGYGSPVTIAAPAY

SEQ ID NO: 970871 - protein, 19 aa, Mycobacterium
LSAQASRLLTRLDDDPVVD

SEQ ID NO: 970872 - protein, 17 aa, Mycobacterium
LSDAALVSRSWGMALAT

SEQ ID NO: 970873 - protein, 27 aa, Mycobacterium
LSDRYGRRGWLSAGLILFALTSALAAQ

SEQ ID NO: 970874 - protein, 18 aa, Mycobacterium
LSELMGGPDIEPVQSTLQ

SEQ ID NO: 970875 - protein, 23 aa, Mycobacterium
LSEVTKFAALIVFGALITPDRLS

SEQ ID NO: 970876 - protein, 19 aa, Mycobacterium
LSFTRMPYFQTLGIPCSVG

SEQ ID NO: 970877 - protein, 18 aa, Mycobacterium
LSGAPGWVSLGCFLVALV

SEQ ID NO: 970878 - protein, 24 aa, Mycobacterium
LSGFAHSWFFLFLLVVAGLIAIYV

SEQ ID NO: 970879 - protein, 17 aa, Mycobacterium
LSGFAVLAAGLWAGFLW

SEQ ID NO: 970880 - protein, 23 aa, Mycobacterium
LSGGFLASFSLRTESALTESGLD

SEQ ID NO: 970881 - protein, 23 aa, Mycobacterium
LSGLTKRHRTALVHITHYNNEAD

SEQ ID NO: 970882 - protein, 29 aa, Mycobacterium
LSGPGRYGLDAGRGWAHRPFIGSFVALLT

SEQ ID NO: 970883 - protein, 22 aa, Mycobacterium
LSGRYRLHRLIATGGMGQVWEA

SEQ ID NO: 970884 - protein, 20 aa, Mycobacterium
LSGVAARTVLSSALLFLVAG

SEQ ID NO: 970885 - protein, 18 aa, Mycobacterium
LSIAYTAIVWWKIRLKRR

SEQ ID NO: 970886 - protein, 17 aa, Mycobacterium
LSIDAPGIFPVLVNVNG

SEQ ID NO: 970887 - protein, 34 aa, Mycobacterium; identical to SEQ ID NO: 318795

SEQ ID NO: 970888 - protein, 35 aa, Mycobacterium
LSIVVKVAALLIVFGFAGLSAYFVWNHGQVTQRQE

SEQ ID NO: 970889 - protein, 17 aa, Mycobacterium
LSLLMLVGGVLFEIVTG

SEQ ID NO: 970890 - protein, 20 aa, Mycobacterium
LSLTAAFGALVWIFQDGHLG

SEQ ID NO: 970891 - protein, 18 aa, Mycobacterium
LSLTGLLDIARLRWQFER

SEQ ID NO: 970892 - protein, 17 aa, Mycobacterium
LSLWYPHYAWLLLTIYL

SEQ ID NO: 970893 - protein, 17 aa, Mycobacterium
LSLYRWDLLGPLRYVGL

SEQ ID NO: 970894 - protein, 19 aa, Mycobacterium
LSMRIPRWVEVTAGEVPAT

SEQ ID NO: 970895 - protein, 24 aa, Mycobacterium
LSMSRRYQPDFSFASYDPAWIDTL

SEQ ID NO: 970896 - protein, 23 aa, Mycobacterium
LSNLLWRRVLRQHNVEAGVSEYT

SEQ ID NO: 970897 - protein, 32 aa, Mycobacterium; identical to SEQ ID NO: 318858

SEQ ID NO: 970898 - protein, 18 aa, Mycobacterium
LSPARAAAMKEIQSAIGA

SEQ ID NO: 970899 - protein, 18 aa, Mycobacterium
LSPEQWFAFTPPRVPVLE

SEQ ID NO: 970900 - protein, 19 aa, Mycobacterium
LSPQVSRWAVCDAAAETLR

SEQ ID NO: 970901 - protein, 27 aa, Mycobacterium
LSPRTVGAHLYRLFPKLGVTNRAGLHD

SEQ ID NO: 970902 - protein, 20 aa, Mycobacterium
LSQFVPWLLSPILMLGATYL

SEQ ID NO: 970903 - protein, 17 aa, Mycobacterium
LSRAMVLSVDWFGVVVL

SEQ ID NO: 970904 - protein, 17 aa, Mycobacterium
LSRARRGAHRLVTGTAP

SEQ ID NO: 970905 - protein, 20 aa, Mycobacterium
LSSVALVWFGATAIDAGQMR

SEQ ID NO: 970906 - protein, 21 aa, Mycobacterium
LSSYRRPLLGTGLFGGLTTFS

SEQ ID NO: 970907 - protein, 24 aa, Mycobacterium
LSTLDRFLPVWIGLAMAAGLLLGR

SEQ ID NO: 970908 - protein, 20 aa, Mycobacterium
LSTPIWRLVLPITALGVAIP

SEQ ID NO: 970909 - protein, 18 aa, Mycobacterium
LSTRAMALIAKRGGQHDA

SEQ ID NO: 970910 - protein, 20 aa, Mycobacterium
LSTRKALPLYIAFLAGLGVL

SEQ ID NO: 970911 - protein, 19 aa, Mycobacterium
LSVEVGFYLALPLLAFLAR

SEQ ID NO: 970912 - protein, 24 aa, Mycobacterium
LSVHIYRLVWRQMIFFAHNIVIYF

SEQ ID NO: 970913 - protein, 17 aa, Mycobacterium
LSVLLIVTACLGLLAIL

SEQ ID NO: 970914 - protein, 29 aa, Mycobacterium
LSVLVWEYLFGIKLYWVVLALAVILLLAV

SEQ ID NO: 970915 - protein, 17 aa, Mycobacterium
LSVMFAVVPSTRFTGWE

SEQ ID NO: 970916 - protein, 17 aa, Mycobacterium
LSVVYSAVVWWRIRLKR

SEQ ID NO: 970917 - protein, 25 aa, Mycobacterium
LTADFSLAAAWPLAAVVQRQTGGTV

SEQ ID NO: 970918 - protein, 18 aa, Mycobacterium
LTAIPMGVPLEWNVFMIF

SEQ ID NO: 970919 - protein, 17 aa, Mycobacterium
LTALGWMIFAIILAVVV

SEQ ID NO: 970920 - protein, 17 aa, Mycobacterium
LTARGLRVLATAVRVGG

SEQ ID NO: 970921 - protein, 18 aa, Mycobacterium
LTARPGTLTAVIGGSGAG

SEQ ID NO: 970922 - protein, 17 aa, Mycobacterium
LTATLTLENLLATAAAL

SEQ ID NO: 970923 - protein, 23 aa, Mycobacterium
LTCGQAIRATWLVAAKGAGGAAR

SEQ ID NO: 970924 - protein, 24 aa, Mycobacterium
LTENRLRVVCAIPSSTSPLDPFID

SEQ ID NO: 970925 - protein, 17 aa, Mycobacterium
LTGESVLIRNAHSIEAL

SEQ ID NO: 970926 - protein, 17 aa, Mycobacterium
LTGFASAFFNAREIQPG

SEQ ID NO: 970927 - protein, 18 aa, Mycobacterium
LTGFMVLVGLDFLSYRLG

SEQ ID NO: 970928 - protein, 18 aa, Mycobacterium
LTGHEVEPTLTIREARAG

SEQ ID NO: 970929 - protein, 36 aa, Mycobacterium
LTGHFSVALSLLWNYAMLWFGFVVPPALQIVFDPLL

SEQ ID NO: 970930 - protein, 21 aa, Mycobacterium
LTHGFFKAGLFLGSGSVIHAI

SEQ ID NO: 970931 - protein, 27 aa, Mycobacterium
LTIAALICAAGFVAAVWLPSKSTMPAR

SEQ ID NO: 970932 - protein, 17 aa, Mycobacterium
LTIPYTVLLTFIENILL

SEQ ID NO: 970933 - protein, 26 aa, Mycobacterium
LTIREARAGDRYLLCSDGLSDPVSDE

SEQ ID NO: 970934 - protein, 21 aa, Mycobacterium
LTIRLAEVMLSSGSGTADVVA

SEQ ID NO: 970935 - protein, 19 aa, Mycobacterium
LTLAPAVLVVGGRFGAFDP

SEQ ID NO: 970936 - protein, 17 aa, Mycobacterium
LTLIFLIMLLLTRSVVA

SEQ ID NO: 970937 - protein, 17 aa, Mycobacterium
LTLSRLLAGLAPGLDLG

SEQ ID NO: 970938 - protein, 21 aa, Mycobacterium
LTLTDGRVVIWGTTDRAEEKA

SEQ ID NO: 970939 - protein, 19 aa, Mycobacterium
LTLTIAGPVRTYFAQRTEM

SEQ ID NO: 970940 - protein, 17 aa, Mycobacterium
LTMFSERAGLVMDPGSK

SEQ ID NO: 970941 - protein, 19 aa, Mycobacterium
LTNAALACFAWLTLLIRRP

SEQ ID NO: 970942 - protein, 18 aa, Mycobacterium
LTNSLVIYARGLTVIDAV

SEQ ID NO: 970943 - protein, 19 aa, Mycobacterium
LTPARWGFAASASTIDTHR

SEQ ID NO: 970944 - protein, 17 aa, Mycobacterium
LTPAVFLLYFLLRRDNR

SEQ ID NO: 970945 - protein, 19 aa, Mycobacterium
LTPEARAGLDAVLAKLAAP

SEQ ID NO: 970946 - protein, 19 aa, Mycobacterium
LTPPGTFTAIPAYWHQAAD

SEQ ID NO: 970947 - protein, 18 aa, Mycobacterium
LTRVIEVPYVLPILAQGR

SEQ ID NO: 970948 - protein, 20 aa, Mycobacterium
LTSKGPVCYRAERIGINGQP

SEQ ID NO: 970949 - protein, 27 aa, Mycobacterium
LTTLVRLELPLAWPVIMTGVRVSAQML

SEQ ID NO: 970950 - protein, 25 aa, Mycobacterium
LTTPLRRLDMLAGYGTAFSLAAAAQ

SEQ ID NO: 970951 - protein, 19 aa, Mycobacterium
LTTPTARALLRVGLTPDAI

SEQ ID NO: 970952 - protein, 18 aa, Mycobacterium
LTVEQALSYAARMRLPPD

SEQ ID NO: 970953 - protein, 24 aa, Mycobacterium
LTVPEAIALIVVIARYLEPFTAVS

SEQ ID NO: 970954 - protein, 27 aa, Mycobacterium
LTVRTLRRGMPFALTWWSLTFPVGTFV

SEQ ID NO: 970955 - protein, 18 aa, Mycobacterium
LTWTSPRTRATFGTTAEE

SEQ ID NO: 970956 - protein, 20 aa, Mycobacterium
LTYLDVCDQVLLLAPGGKTA

SEQ ID NO: 970957 - protein, 17 aa, Mycobacterium
LVAGFLMYASFPPTNWW

SEQ ID NO: 970958 - protein, 30 aa, Mycobacterium; identical to SEQ ID NO: 319336

SEQ ID NO: 970959 - protein, 18 aa, Mycobacterium
LVAIPIGLIIGHTGRGQL

SEQ ID NO: 970960 - protein, 17 aa, Mycobacterium
LVALPLSLGIAIASDAP

SEQ ID NO: 970961 - protein, 25 aa, Mycobacterium
LVAMALFPMYLLKSFAYAGVAVVVF

SEQ ID NO: 970962 - protein, 17 aa, Mycobacterium
LVAMASKTVARSGNRTS

SEQ ID NO: 970963 - protein, 18 aa, Mycobacterium
LVARGWRRPTSVAPTGVI

SEQ ID NO: 970964 - protein, 23 aa, Mycobacterium
LVARSTWPLRAPRAAMVLWQTIA

SEQ ID NO: 970965 - protein, 24 aa, Mycobacterium
LVARSTWPLRAPRAAMVLWQTIAL

SEQ ID NO: 970966 - protein, 22 aa, Mycobacterium
LVARTLPGKQFAAGRQLRVLVI

SEQ ID NO: 970967 - protein, 17 aa, Mycobacterium
LVATNFFGLNAIPIALN

SEQ ID NO: 970968 - protein, 23 aa, Mycobacterium
LVDRSHPLPVLGFGFSALAISMT

SEQ ID NO: 970969 - protein, 21 aa, Mycobacterium
LVDTWGWRSIFYVNVPMGVFV

SEQ ID NO: 970970 - protein, 18 aa, Mycobacterium
LVEPTILLAVFALSIPAK

SEQ ID NO: 970971 - protein, 21 aa, Mycobacterium
LVFCGVMICAVWVGASAGGRP

SEQ ID NO: 970972 - protein, 29 aa, Mycobacterium
LVGATIVFLACRWVQAQGGAPLWVGYLGA

SEQ ID NO: 970973 - protein, 19 aa, Mycobacterium
LVGAVIMWSFLGHILNNRK

SEQ ID NO: 970974 - protein, 17 aa, Mycobacterium
LVGDSRSLLSLTPFTGN

SEQ ID NO: 970975 - protein, 18 aa, Mycobacterium
LVGIGLALFALRAVVLPW

SEQ ID NO: 970976 - protein, 18 aa, Mycobacterium
LVGISAVLLLAAGGIGAG

SEQ ID NO: 970977 - protein, 19 aa, Mycobacterium
LVHHCHREQWPVAGPVLGR

SEQ ID NO: 970978 - protein, 26 aa, Mycobacterium
LVHSLAERGLRVLAVAKRPWEHDTAD

SEQ ID NO: 970979 - protein, 21 aa, Mycobacterium
LVIATLFLLRSMNRQLRKVPE

SEQ ID NO: 970980 - protein, 22 aa, Mycobacterium
LVICLGSLLWSFISPSGQINDS

SEQ ID NO: 970981 - protein, 24 aa, Mycobacterium
LVIPCLLLSWAVSHPGIPFVLLTL

SEQ ID NO: 970982 - protein, 26 aa, Mycobacterium
LVIVGWLTLWPFLSWLTTHFVVTNRR

SEQ ID NO: 970983 - protein, 17 aa, Mycobacterium
LVLARWGSRHRPEPVTS

SEQ ID NO: 970984 - protein, 19 aa, Mycobacterium
LVLDGPLLPADWTVELNYL

SEQ ID NO: 970985 - protein, 17 aa, Mycobacterium
LVLIVGGIGVWTITQPP

SEQ ID NO: 970986 - protein, 17 aa, Mycobacterium
LVLLACLAITAPLEAFG

SEQ ID NO: 970987 - protein, 19 aa, Mycobacterium
LVLMHDLSHAYAVVFVVAV

SEQ ID NO: 970988 - protein, 18 aa, Mycobacterium
LVLQRAGGVLTIIMGLVF

SEQ ID NO: 970989 - protein, 18 aa, Mycobacterium
LVLRRFLRNRAAVASLAV

SEQ ID NO: 970990 - protein, 17 aa, Mycobacterium
LVLTLVVAAAYLLVGAL

SEQ ID NO: 970991 - protein, 18 aa, Mycobacterium
LVLWASIGLVFSVLVGRG

SEQ ID NO: 970992 - protein, 32 aa, Mycobacterium; identical to SEQ ID NO: 319571

SEQ ID NO: 970993 - protein, 25 aa, Mycobacterium
LVMISGGIAAWLYVKTYRPDQQVDP

SEQ ID NO: 970994 - protein, 18 aa, Mycobacterium
LVPDAVAAMAAANSELGI

SEQ ID NO: 970995 - protein, 18 aa, Mycobacterium
LVPESRSQARLVLDGLSV

SEQ ID NO: 970996 - protein, 18 aa, Mycobacterium
LVPLALFFCHGGWPTTIA

SEQ ID NO: 970997 - protein, 22 aa, Mycobacterium
LVPLVWLLWVVIERGWYAVVQP

SEQ ID NO: 970998 - protein, 22 aa, Mycobacterium
LVPPCIILFFHTQYWWAGIALV

SEQ ID NO: 970999 - protein, 23 aa, Mycobacterium
LVPPCIILFFHTQYWWAGIALVV

SEQ ID NO: 971000 - protein, 24 aa, Mycobacterium
LVPPKEFWAEFDIPREVKKELFFR

SEQ ID NO: 971001 - protein, 25 aa, Mycobacterium
LVQMMWAMRGIGIWSDVRGTNMLDG

SEQ ID NO: 971002 - protein, 24 aa, Mycobacterium
LVQPCPRVDLAAGQVRVAVGAAGV

SEQ ID NO: 971003 - protein, 28 aa, Mycobacterium
LVRAAGWRLNRLVPHGAVDRLDERLRER

SEQ ID NO: 971004 - protein, 25 aa, Mycobacterium
LVRDPQLRRLMAVCATFLTSNSAHG

SEQ ID NO: 971005 - protein, 23 aa, Mycobacterium
LVRGRYPQLTAYQVINRLIHTAR

SEQ ID NO: 971006 - protein, 23 aa, Mycobacterium
LVRHVEKWARVRGDKLAYRFLDF

SEQ ID NO: 971007 - protein, 18 aa, Mycobacterium
LVRLRDAAEAVGFYRGER

SEQ ID NO: 971008 - protein, 17 aa, Mycobacterium
LVRPIRRLEAGTEKIRS

SEQ ID NO: 971009 - protein, 18 aa, Mycobacterium
LVRTGVAVAIPFGMVGLV

SEQ ID NO: 971010 - protein, 17 aa, Mycobacterium
LVSARGRLMQALPAGGA

SEQ ID NO: 971011 - protein, 23 aa, Mycobacterium
LVSGLGWEWIFFVNIPIGLAGLV

SEQ ID NO: 971012 - protein, 26 aa, Mycobacterium
LVSPLHWYWAVIAAFVVFAGTNSWGE

SEQ ID NO: 971013 - protein, 17 aa, Mycobacterium
LVSWRLHSPETFEERFA

SEQ ID NO: 971014 - protein, 19 aa, Mycobacterium
LVTAGSLVVHWATMQELYG

SEQ ID NO: 971015 - protein, 24 aa, Mycobacterium
LVTGLAGWLFGWLAERSGSLAAPM

SEQ ID NO: 971016 - protein, 17 aa, Mycobacterium
LVTYLLYVEMLFAPVDK

SEQ ID NO: 971017 - protein, 18 aa, Mycobacterium
LVVAALFGLIIAMPLGIW

SEQ ID NO: 971018 - protein, 20 aa, Mycobacterium
LVVAGATAFVLAKPKGSTEP

SEQ ID NO: 971019 - protein, 17 aa, Mycobacterium
LVVLWLFVLVPMLISKR

SEQ ID NO: 971020 - protein, 18 aa, Mycobacterium
LVVRAGVAYQARLKPAES

SEQ ID NO: 971021 - protein, 18 aa, Mycobacterium
LVVSEWIRGGSLQEVADT

SEQ ID NO: 971022 - protein, 26 aa, Mycobacterium
LVVSLLVRRRRVWARLTPENDAPGTV

SEQ ID NO: 971023 - protein, 25 aa, Mycobacterium
LVVSRWRRGGLRAAVDPLRRLAVIA

SEQ ID NO: 971024 - protein, 21 aa, Mycobacterium
LVVVPARWAGPAAVAASEVPV

SEQ ID NO: 971025 - protein, 25 aa, Mycobacterium
LVWGPRVARKLSWRVLPLATWATAC

SEQ ID NO: 971026 - protein, 17 aa, Mycobacterium
LVWLGWLTAATVSGWVI

SEQ ID NO: 971027 - protein, 25 aa, Mycobacterium
LVYLLPLILWLWRGETTHDRHAAAR

SEQ ID NO: 971028 - protein, 17 aa, Mycobacterium
LWASGRFARRADKVADE

SEQ ID NO: 971029 - protein, 22 aa, Mycobacterium
LWGALERRWGQWVALVVSTAVF

SEQ ID NO: 971030 - protein, 22 aa, Mycobacterium
LWGGMLMWLTLWVLYLSIVNVG

SEQ ID NO: 971031 - protein, 20 aa, Mycobacterium
LWHLPIFLALNGERTGWTGM

SEQ ID NO: 971032 - protein, 19 aa, Mycobacterium
LWISLVVLWLFVLVPMLIS

SEQ ID NO: 971033 - protein, 18 aa, Mycobacterium
LWKGRRMGPLVAEEMPVV

SEQ ID NO: 971034 - protein, 22 aa, Mycobacterium
LWLAPIGAFGWIASIIGATGWG

SEQ ID NO: 971035 - protein, 23 aa, Mycobacterium
LWMLFEGALGWRSVAIGVTAAVA

SEQ ID NO: 971036 - protein, 25 aa, Mycobacterium
LWQARLAPQAKPYRGWHRVHGVEVV

SEQ ID NO: 971037 - protein, 17 aa, Mycobacterium
LWRSVRSLPDFWRLLQV

SEQ ID NO: 971038 - protein, 19 aa, Mycobacterium
LWTLLRIPTLIACGDHDLM

SEQ ID NO: 971039 - protein, 25 aa, Mycobacterium
LWVIFLPSVVRRRLPEKWAADHDVD

SEQ ID NO: 971040 - protein, 20 aa, Mycobacterium
LWYAGLPLRVFITSLLAVFI

SEQ ID NO: 971041 - protein, 24 aa, Mycobacterium
LYADPWCAWALLAATVAIPTGLAV

SEQ ID NO: 971042 - protein, 22 aa, Mycobacterium
LYAFLCATALMVVRSEERHARS

SEQ ID NO: 971043 - protein, 18 aa, Mycobacterium
LYAGPLWDHRQRYLKPRG

SEQ ID NO: 971044 - protein, 22 aa, Mycobacterium
LYALLVNRWPLPEAGADSGFAP

SEQ ID NO: 971045 - protein, 24 aa, Mycobacterium
LYDHPRLGSLAGFLDELGPPPQVD

SEQ ID NO: 971046 - protein, 18 aa, Mycobacterium
LYDIPGRSAVPIESETIR

SEQ ID NO: 971047 - protein, 18 aa, Mycobacterium
LYEGHILAAILMGFWIGA

SEQ ID NO: 971048 - protein, 19 aa, Mycobacterium
LYFGGQVLFAFLLVAQNSD

SEQ ID NO: 971049 - protein, 28 aa, Mycobacterium
LYFWLPCLACLLALAELHLRTARLTVAF

SEQ ID NO: 971050 - protein, 29 aa, Mycobacterium
LYGIFIVWLFHDWRDVFWINVPLTAIAML

SEQ ID NO: 971051 - protein, 31 aa, Mycobacterium
LYGLIDIRFIPKYLFSVSFCGILVATGSYLL

SEQ ID NO: 971052 - protein, 17 aa, Mycobacterium
LYGNTRSPLDFTTDPGA

SEQ ID NO: 971053 - protein, 25 aa, Mycobacterium
LYIVGYCLLAIAIGAVLSFGADLLG

SEQ ID NO: 971054 - protein, 18 aa, Mycobacterium
LYLLLGWVAVWYTATILH

SEQ ID NO: 971055 - protein, 24 aa, Mycobacterium
LYLNYVWHYSLLKAGFAIAPAALI

SEQ ID NO: 971056 - protein, 24 aa, Mycobacterium
LYLWHWPLLIFWLSYTGHRHANFI

SEQ ID NO: 971057 - protein, 17 aa, Mycobacterium
LYPGRTGTSLALLTGQI

SEQ ID NO: 971058 - protein, 18 aa, Mycobacterium
LYPGRTGTSLALLTGQII

SEQ ID NO: 971059 - protein, 17 aa, Mycobacterium
LYPLLPIYLATVLGAPP

SEQ ID NO: 971060 - protein, 24 aa, Mycobacterium
LYQKERRFAVAFVIPAALLFVAGA

SEQ ID NO: 971061 - protein, 23 aa, Mycobacterium
LYRLGELVPALALVIAANVSLVV

SEQ ID NO: 971062 - protein, 29 aa, Mycobacterium
LYSLAVLAAFFAARFTTVFINGQSAGLYD

SEQ ID NO: 971063 - protein, 19 aa, Mycobacterium
LYTGTGAFEVVGRRKLWYG

SEQ ID NO: 971064 - protein, 24 aa, Mycobacterium
LYVILGWRRVLLIPLTFALFTPLG

SEQ ID NO: 971065 - protein, 22 aa, Mycobacterium
MAAGLLLGRWIPGLNTALEKVQ

SEQ ID NO: 971066 - protein, 25 aa, Mycobacterium
MAATVARVVLAAAMAVTRATAGPAA

SEQ ID NO: 971067 - protein, 20 aa, Mycobacterium
MAAVQLARHWGVEIFVTASR

SEQ ID NO: 971068 - protein, 17 aa, Mycobacterium
MAFALTIHGDGPRFFTK

SEQ ID NO: 971069 - protein, 27 aa, Mycobacterium
MAFQACFISAAAVAARFGAAALAAHQV

SEQ ID NO: 971070 - protein, 20 aa, Mycobacterium
MAHDRIRTWSDWLETNGRSA

SEQ ID NO: 971071 - protein, 17 aa, Mycobacterium
MALAYRYGGTIKALLVC

SEQ ID NO: 971072 - protein, 21 aa, Mycobacterium
MALLLLACVPLNWIVTMIAKG

SEQ ID NO: 971073 - protein, 17 aa, Mycobacterium
MALPLFHWGLHAWAIYV

SEQ ID NO: 971074 - protein, 17 aa, Mycobacterium
MAQLGLRNTFWALVLPF

SEQ ID NO: 971075 - protein, 23 aa, Mycobacterium
MARPGFKRWWTRFVPKTVERSTY

SEQ ID NO: 971076 - protein, 24 aa, Mycobacterium
MATDRGRGWATLRDAGPVVIGDGF

SEQ ID NO: 971077 - protein, 21 aa, Mycobacterium
MAVGLLAAYLAALGISTALWQ

SEQ ID NO: 971078 - protein, 25 aa, Mycobacterium
MAVVGWASGLGFGWMFTLGTANVVR

SEQ ID NO: 971079 - protein, 17 aa, Mycobacterium
MCACSAAALSSQVSVTR

SEQ ID NO: 971080 - protein, 24 aa, Mycobacterium
MDANAALRWSLIAGASCNDAALTH

SEQ ID NO: 971081 - protein, 19 aa, Mycobacterium
MDPQHRMLLEVAWESLEHA

SEQ ID NO: 971082 - protein, 25 aa, Mycobacterium
MDPQHRMLLEVAWESLEHAGIAPDS

SEQ ID NO: 971083 - protein, 26 aa, Mycobacterium
MDPQQRLLLEVCWEALETAGIPAHTL

SEQ ID NO: 971084 - protein, 18 aa, Mycobacterium
MDSNYRWFHPAPSTLAAA

SEQ ID NO: 971085 - protein, 24 aa, Mycobacterium
MEAKSDFEPVCATMRYEDFSGNQI

SEQ ID NO: 971086 - protein, 20 aa, Mycobacterium
MELIEGGTLRELLSERGPMP

SEQ ID NO: 971087 - protein, 23 aa, Mycobacterium
MEPMLEEFARLASEIVVEQPQIP

SEQ ID NO: 971088 - protein, 24 aa, Mycobacterium
MESEFPSELSVLFKNLENKGNPWG

SEQ ID NO: 971089 - protein, 19 aa, Mycobacterium
MFAPEQHRATLICFGATLA

SEQ ID NO: 971090 - protein, 18 aa, Mycobacterium
MFEHRAVVVGADRHQLQR

SEQ ID NO: 971091 - protein, 22 aa, Mycobacterium
MFLLTLFLDFVFNDREIKWLKW

SEQ ID NO: 971092 - protein, 18 aa, Mycobacterium
MFVIRTVAFVVWALATVV

SEQ ID NO: 971093 - protein, 33 aa, Mycobacterium; identical to SEQ ID NO: 320206

SEQ ID NO: 971094 - protein, 17 aa, Mycobacterium
MGAQLYEQFPVFAAAFD

SEQ ID NO: 971095 - protein, 18 aa, Mycobacterium
MGGACGTCRAKLIEGNVE

SEQ ID NO: 971096 - protein, 19 aa, Mycobacterium
MGGEWGLGAALAMEKVPVG

SEQ ID NO: 971097 - protein, 32 aa, Mycobacterium; identical to SEQ ID NO: 320231

SEQ ID NO: 971098 - protein, 25 aa, Mycobacterium
MGKLFPGACVVWFFVLFDMLDGAMA

SEQ ID NO: 971099 - protein, 20 aa, Mycobacterium
MGLSVIRRLVVPRFAAAIMI

SEQ ID NO: 971100 - protein, 23 aa, Mycobacterium
MGRDGLLPARFAAVHPRFQTPVS

SEQ ID NO: 971101 - protein, 24 aa, Mycobacterium
MGTASWPDIFARVSADPQAAHQSF

SEQ ID NO: 971102 - protein, 23 aa, Mycobacterium
MGVAETFLLLALAKQVFGLDQDL

SEQ ID NO: 971103 - protein, 23 aa, Mycobacterium
MGVPGLRVGPVALVRPWRAPVVL

SEQ ID NO: 971104 - protein, 25 aa, Mycobacterium
MGYLKARVADMYTMIDELQHMIDIA

SEQ ID NO: 971105 - protein, 18 aa, Mycobacterium
MIANPFRAGERIGSLFST

SEQ ID NO: 971106 - protein, 22 aa, Mycobacterium
MIFNVIWTYVLVRGSAVNNETL

SEQ ID NO: 971107 - protein, 32 aa, Mycobacterium
MIGYRSPRYLRFGWAAARLDDLANYFGARVTA

SEQ ID NO: 971108 - protein, 24 aa, Mycobacterium
MILTPRFIALTGHARDLEIATQTL

SEQ ID NO: 971109 - protein, 20 aa, Mycobacterium
MIQDITRPLGIPIQHSSIPF

SEQ ID NO: 971110 - protein, 24 aa, Mycobacterium
MIRTLAVPIILFWLAVVVLLSVFV

SEQ ID NO: 971111 - protein, 17 aa, Mycobacterium
MKVTFHYQNKYKVPANA

SEQ ID NO: 971112 - protein, 26 aa, Mycobacterium
MLAALWAVYTTRWWLSGLLVGVAAGI

SEQ ID NO: 971113 - protein, 19 aa, Mycobacterium
MLAGVAGFAGRRSIQHSVR

SEQ ID NO: 971114 - protein, 17 aa, Mycobacterium
MLAPAILDRPAYAGSAA

SEQ ID NO: 971115 - protein, 19 aa, Mycobacterium
MLLKVGARMSYLMGLTVFG

SEQ ID NO: 971116 - protein, 18 aa, Mycobacterium
MLLPACVALCGVAAGLFM

SEQ ID NO: 971117 - protein, 24 aa, Mycobacterium
MLLVLRFLQGGACSAFIVIAIAIA

SEQ ID NO: 971118 - protein, 24 aa, Mycobacterium
MLMPFAGISFLWFIGVVRDGFGRY

SEQ ID NO: 971119 - protein, 18 aa, Mycobacterium
MLMSCALLGDRYGRRRGF

SEQ ID NO: 971120 - protein, 23 aa, Mycobacterium
MLNDLPWWVTVLILSRELGVTML

SEQ ID NO: 971121 - protein, 18 aa, Mycobacterium
MLNFPYSRYDTMTLAAFD

SEQ ID NO: 971122 - protein, 23 aa, Mycobacterium
MLSIVAVYLVRWLSMRMDMFNAG

SEQ ID NO: 971123 - protein, 20 aa, Mycobacterium
MMGLPRLYRIPVHTIHKFGH

SEQ ID NO: 971124 - protein, 33 aa, Mycobacterium; identical to SEQ ID NO: 320478

SEQ ID NO: 971125 - protein, 24 aa, Mycobacterium
MMRPLRLLRLLVLVGALQKAVGNA

SEQ ID NO: 971126 - protein, 17 aa, Mycobacterium
MNALLLPIVLGLLLVLE

SEQ ID NO: 971127 - protein, 23 aa, Mycobacterium
MNANEKWEAVGMGRSTETYLAGS

SEQ ID NO: 971128 - protein, 25 aa, Mycobacterium
MNLAGARPRLIWYAPHLVEGETSSP

SEQ ID NO: 971129 - protein, 20 aa, Mycobacterium
MPASLSARFDRACALSQLPD

SEQ ID NO: 971130 - protein, 30 aa, Mycobacterium
MPAVGTLLGRWFWWPRPLAGQTRKPQMVSQ

SEQ ID NO: 971131 - protein, 20 aa, Mycobacterium
MPGPLSWFVHRMPRPLHRIE

SEQ ID NO: 971132 - protein, 25 aa, Mycobacterium
MPLFPELRSISLLQVLTGIASSVFA

SEQ ID NO: 971133 - protein, 24 aa, Mycobacterium
MPLLGRASDRFGRKLMLQVSLLGF

SEQ ID NO: 971134 - protein, 17 aa, Mycobacterium
MPQGWSFAQAAAVPVVF

SEQ ID NO: 971135 - protein, 24 aa, Mycobacterium
MPRIWRIRITLERVDDGFKAAKVG

SEQ ID NO: 971136 - protein, 27 aa, Mycobacterium
MPVLLFCIAFGLSMDYEVFLVARIREY

SEQ ID NO: 971137 - protein, 17 aa, Mycobacterium
MQAIHRIGAVFKESDSD

SEQ ID NO: 971138 - protein, 17 aa, Mycobacterium
MQLLASHPKCFSAAPNF

SEQ ID NO: 971139 - protein, 34 aa, Mycobacterium; identical to SEQ ID NO: 320598

SEQ ID NO: 971140 - protein, 22 aa, Mycobacterium
MQQWRRLPLVPATIVGWGGLAL

SEQ ID NO: 971141 - protein, 18 aa, Mycobacterium
MRDPVLFAIPFFLFLLTV

SEQ ID NO: 971142 - protein, 23 aa, Mycobacterium
MRFKDLELRYARLARAIALEGAQ

SEQ ID NO: 971143 - protein, 19 aa, Mycobacterium
MRGDACWRNLTCLYYHHET

SEQ ID NO: 971144 - protein, 21 aa, Mycobacterium
MRGGKWWTKPFVRSAYGNAVI

SEQ ID NO: 971145 - protein, 17 aa, Mycobacterium
MRMALLLLACVPLNWIV

SEQ ID NO: 971146 - protein, 18 aa, Mycobacterium
MRQHWGIENGLHWIRDVT

SEQ ID NO: 971147 - protein, 17 aa, Mycobacterium
MRSKYRAVISFFIHGCA

SEQ ID NO: 971148 - protein, 17 aa, Mycobacterium
MRVNLSFTPSHSYTRAD

SEQ ID NO: 971149 - protein, 35 aa, Mycobacterium; identical to SEQ ID NO: 320687

SEQ ID NO: 971150 - protein, 25 aa, Mycobacterium
MSLNTPYYRLMLKLKGGPEAVADAA

SEQ ID NO: 971151 - protein, 17 aa, Mycobacterium
MSMADLRTAATKSTPAT

SEQ ID NO: 971152 - protein, 17 aa, Mycobacterium
MSNGELFIMGRIKDLVI

SEQ ID NO: 971153 - protein, 17 aa, Mycobacterium
MSNLLVWISTLGSTGGK

SEQ ID NO: 971154 - protein, 23 aa, Mycobacterium
MSREHVHLPALLIGLGTFGVGTA

SEQ ID NO: 971155 - protein, 24 aa, Mycobacterium
MSRGELDRTLVLWMLPLLIAPPMY

SEQ ID NO: 971156 - protein, 19 aa, Mycobacterium
MSTAMSLTVIVVVLLLTTV

SEQ ID NO: 971157 - protein, 17 aa, Mycobacterium
MTFSVLAAYAFARLEFP

SEQ ID NO: 971158 - protein, 20 aa, Mycobacterium
MTIDALVWVPRMYYLYDNAS

SEQ ID NO: 971159 - protein, 18 aa, Mycobacterium
MTLFSVLFAALWLSCLAI

SEQ ID NO: 971160 - protein, 25 aa, Mycobacterium
MTLPRPRDLAPLLAAWVASVGVMVF

SEQ ID NO: 971161 - protein, 29 aa, Mycobacterium
MTPAIAALLGRWFWWPLRVRSRPDRGAIQ

SEQ ID NO: 971162 - protein, 27 aa, Mycobacterium
MTPLGWRWAALVWAYALFWFLIEDRVK

SEQ ID NO: 971163 - protein, 27 aa, Mycobacterium
MTPSIAALLGRWFWWPMRVRTRPARTP

SEQ ID NO: 971164 - protein, 35 aa, Mycobacterium
MTPSIAVLLGRWFWWPQRVRPRPASQMLRPSGPRS

SEQ ID NO: 971165 - protein, 18 aa, Mycobacterium
MTRYYAAQRTFWVDPVTG

SEQ ID NO: 971166 - protein, 21 aa, Mycobacterium
MVAGGSFRRWEQVMFMLISVN

SEQ ID NO: 971167 - protein, 19 aa, Mycobacterium
MVILPPFVYFISYRWSIGL

SEQ ID NO: 971168 - protein, 17 aa, Mycobacterium
MVIYPEYAVLDRKDPAD

SEQ ID NO: 971169 - protein, 17 aa, Mycobacterium
MVLSLGVAIAVALGLWP

SEQ ID NO: 971170 - protein, 20 aa, Mycobacterium
MVLVPAFMHVMGRWNWWAPK

SEQ ID NO: 971171 - protein, 18 aa, Mycobacterium
MVRPIRRLEAGTEKISGG

SEQ ID NO: 971172 - protein, 19 aa, Mycobacterium
MVWLGEISYEIFLVHLVTM

SEQ ID NO: 971173 - protein, 17 aa, Mycobacterium
MWIMSWLTATPVRVAGP

SEQ ID NO: 971174 - protein, 17 aa, Mycobacterium
MWVQAATVMSVYQAGST

SEQ ID NO: 971175 - protein, 20 aa, Mycobacterium
MYKQATWKRVAVLFAGPGMN

SEQ ID NO: 971176 - protein, 23 aa, Mycobacterium
MYMVACFIFFFIGGLMALLMRAA

SEQ ID NO: 971177 - protein, 21 aa, Mycobacterium
MYRTGDLVCWGRDGQLQYRGR

SEQ ID NO: 971178 - protein, 17 aa, Mycobacterium
MYTQSSVQLRQLLIDNK

SEQ ID NO: 971179 - protein, 30 aa, Mycobacterium; identical to SEQ ID NO: 296804

SEQ ID NO: 971180 - protein, 23 aa, Mycobacterium
NAKSATYRALAWSQDADTGNEPV

SEQ ID NO: 971181 - protein, 26 aa, Mycobacterium
NAMPPTSVMGLWTFDGHKGQTEVTTG

SEQ ID NO: 971182 - protein, 25 aa, Mycobacterium
NATGRWELSFGFLLVPLIALLAGGY

SEQ ID NO: 971183 - protein, 20 aa, Mycobacterium
NATRQFLVDAAHELRTPIAG

SEQ ID NO: 971184 - protein, 24 aa, Mycobacterium
NDGKEVPASLVGRDPKTDLAVLKV

SEQ ID NO: 971185 - protein, 37 aa, Mycobacterium
NDRVAPPLVMLWLVRWLLFRVEFGAGLIKMRGDACWR

SEQ ID NO: 971186 - protein, 18 aa, Mycobacterium
NDYAKIGVLLGEAHAAAA

SEQ ID NO: 971187 - protein, 21 aa, Mycobacterium
NEALAVPIWWAYAAAEILITA

SEQ ID NO: 971188 - protein, 17 aa, Mycobacterium
NEARWVRGAVPFEGDIG

SEQ ID NO: 971189 - protein, 32 aa, Mycobacterium
NEIPCVCALFTLLPGSLWWLVTVDAMHTQVVT

SEQ ID NO: 971190 - protein, 21 aa, Mycobacterium
NEIPCVRALLTLLPDNLRWLV

SEQ ID NO: 971191 - protein, 21 aa, Mycobacterium
NELPDCIVVSVSHRPALERLH

SEQ ID NO: 971192 - protein, 23 aa, Mycobacterium
NEQIMPLLVVSLMLQLVLAGGVV

SEQ ID NO: 971193 - protein, 22 aa, Mycobacterium
NERELRAVLGHELSHVYNRDIL

SEQ ID NO: 971194 - protein, 23 aa, Mycobacterium
NERYWRCADFAQALSQVASPQGA

SEQ ID NO: 971195 - protein, 17 aa, Mycobacterium
NESPCTVNSFASLAQQG

SEQ ID NO: 971196 - protein, 18 aa, Mycobacterium
NEYARLAAANIHSLTFAE

SEQ ID NO: 971197 - protein, 31 aa, Mycobacterium; identical to SEQ ID NO: 321075

SEQ ID NO: 971198 - protein, 20 aa, Mycobacterium
NFRDVVAALGMYPGAAPPLG

SEQ ID NO: 971199 - protein, 30 aa, Mycobacterium; identical to SEQ ID NO: 321105

SEQ ID NO: 971200 - protein, 24 aa, Mycobacterium
NGGISFGGVIAFIFADLLILPILN

SEQ ID NO: 971201 - protein, 21 aa, Mycobacterium
NGLFGRLAFLFVGPVVAFPAF

SEQ ID NO: 971202 - protein, 18 aa, Mycobacterium
NGPRMPMVPGSWDSPQEG

SEQ ID NO: 971203 - protein, 18 aa, Mycobacterium
NGRSTWFRHEPRLGSYAT

SEQ ID NO: 971204 - protein, 24 aa, Mycobacterium
NGVKEFPGPWALVPVGAAMLMIMA

SEQ ID NO: 971205 - protein, 23 aa, Mycobacterium
NGYLLRFGADADRAGLHADITSL

SEQ ID NO: 971206 - protein, 24 aa, Mycobacterium
NHEVGHAIGYLRHEACEKPGGLAP

SEQ ID NO: 971207 - protein, 22 aa, Mycobacterium
NIEPALRFYVVFFLALLFVTWH

SEQ ID NO: 971208 - protein, 17 aa, Mycobacterium
NIERRIGLFDTWPELIL

SEQ ID NO: 971209 - protein, 26 aa, Mycobacterium
NIFGLSFPRAMFWTVLIYVLVATIIS

SEQ ID NO: 971210 - protein, 19 aa, Mycobacterium
NIGEGLVILAAIAFGTALP

SEQ ID NO: 971211 - protein, 18 aa, Mycobacterium
NILPGSPPAGAWIDQAIV

SEQ ID NO: 971212 - protein, 20 aa, Mycobacterium
NIRVAMLLAAAWLAVLASPL

SEQ ID NO: 971213 - protein, 21 aa, Mycobacterium
NIVAAVLFHRLVVLIGVALIV

SEQ ID NO: 971214 - protein, 23 aa, Mycobacterium
NIVEVLETLMGFGPPAEGDELLV

SEQ ID NO: 971215 - protein, 22 aa, Mycobacterium
NKDRWSMFHSIAFDFSVWELWG

SEQ ID NO: 971216 - protein, 17 aa, Mycobacterium
NKLKKLRSSGIDAYPVG

SEQ ID NO: 971217 - protein, 25 aa, Mycobacterium
NKLQAFDVFSSFWFTAIYVLLFVSL

SEQ ID NO: 971218 - protein, 22 aa, Mycobacterium
NKPSMPYRLRVIVHEDDTGRMT

SEQ ID NO: 971219 - protein, 40 aa, Mycobacterium
NKSPRPSGGIPLLVVLSVLAVAVAIFWIVMRYRASRRRTN

SEQ ID NO: 971220 - protein, 20 aa, Mycobacterium
NKTREAWGQGVANVVTGFFG

SEQ ID NO: 971221 - protein, 17 aa, Mycobacterium
NLDRIESYIFRNSGEDR

SEQ ID NO: 971222 - protein, 20 aa, Mycobacterium
NLFVELFVPYLLATGYTGSL

SEQ ID NO: 971223 - protein, 25 aa, Mycobacterium
NLLQMAFRFWAFRRWVFPDEFARNP

SEQ ID NO: 971224 - protein, 26 aa, Mycobacterium
NLNPKLGWWLMEILATVVFAIFYLTG

SEQ ID NO: 971225 - protein, 19 aa, Mycobacterium
NLVRELRTDPGPVLLITAL

SEQ ID NO: 971226 - protein, 24 aa, Mycobacterium
NLVTWWTGDALLVFNTGKLTQRYT

SEQ ID NO: 971227 - protein, 22 aa, Mycobacterium
NLYPRMVSFLPGMRYYAGNWDA

SEQ ID NO: 971228 - protein, 20 aa, Mycobacterium
NMAGAPWLVYYARALGADIG

SEQ ID NO: 971229 - protein, 24 aa, Mycobacterium
NMIGRAIGSYGDFVNFYSCDISLK

SEQ ID NO: 971230 - protein, 27 aa, Mycobacterium
NNGLRPEPIIALGILLTWCSVERAVAT

SEQ ID NO: 971231 - protein, 18 aa, Mycobacterium
NNIRLLWTATAGMAISGL

SEQ ID NO: 971232 - protein, 18 aa, Mycobacterium
NNPSQFKTTVVFNDGKEV

SEQ ID NO: 971233 - protein, 37 aa, Mycobacterium
NPADRYARCIDFAHVFARAARCGRHPKSSASTMPAPL

SEQ ID NO: 971234 - protein, 19 aa, Mycobacterium
NPATSRWNATRRPCGERSG

SEQ ID NO: 971235 - protein, 22 aa, Mycobacterium
NPKEKARAIGIWTAVASVGTAT

SEQ ID NO: 971236 - protein, 24 aa, Mycobacterium
NPLNWPPAFFSWFAAGMLLAEWVH

SEQ ID NO: 971237 - protein, 19 aa, Mycobacterium
NPPLPAWLTPSPRVPGTGD

SEQ ID NO: 971238 - protein, 21 aa, Mycobacterium
NPQRIGWRTGGMIAAVGSALI

SEQ ID NO: 971239 - protein, 18 aa, Mycobacterium
NPSTCWWWERTAGENRSR

SEQ ID NO: 971240 - protein, 25 aa, Mycobacterium
NQLYTERHVRLWVVYVDDFSGQSAT

SEQ ID NO: 971241 - protein, 24 aa, Mycobacterium
NQMQRITWIVTMYLLGYIAAMPLL

SEQ ID NO: 971242 - protein, 23 aa, Mycobacterium
NQNRIRWGNLLTLPVGQGGLLYV

SEQ ID NO: 971243 - protein, 29 aa, Mycobacterium
NQSAFRLKTRLLFMPGVMVTSVPWQLTSS

SEQ ID NO: 971244 - protein, 19 aa, Mycobacterium
NQTALEPLPPIAGPSSTIA

SEQ ID NO: 971245 - protein, 31 aa, Mycobacterium; identical to SEQ ID NO: 321385

SEQ ID NO: 971246 - protein, 25 aa, Mycobacterium
NRGNVRPKLVLGVIVLGSFIASIDL

SEQ ID NO: 971247 - protein, 21 aa, Mycobacterium
NRLLLPPILGWSLGRALCGIT

SEQ ID NO: 971248 - protein, 19 aa, Mycobacterium
NRPAAWDMRSVLTIATALG

SEQ ID NO: 971249 - protein, 23 aa, Mycobacterium
NRRPKRLLIGTLLALALVGALTA

SEQ ID NO: 971250 - protein, 19 aa, Mycobacterium
NRTVLRRAFGLLGPLEAVL

SEQ ID NO: 971251 - protein, 24 aa, Mycobacterium
NSGAWLVLFMIFNVIWTYVLVRGS

SEQ ID NO: 971252 - protein, 18 aa, Mycobacterium
NSLDAVWTQLMPDRYTRP

SEQ ID NO: 971253 - protein, 28 aa, Mycobacterium
NSLPLLAALAWVCGDAILLIRTGNQRYA

SEQ ID NO: 971254 - protein, 17 aa, Mycobacterium
NSLYRAGLAIGLSLLPV

SEQ ID NO: 971255 - protein, 32 aa, Mycobacterium
NSMAGLKLPSWGSLRLALPVGGNGDATFLAGE

SEQ ID NO: 971256 - protein, 27 aa, Mycobacterium
NSMFIPRFLFALSFCGLGVTTASYMFT

SEQ ID NO: 971257 - protein, 18 aa, Mycobacterium
NTANPWLYEGHILAAILM

SEQ ID NO: 971258 - protein, 20 aa, Mycobacterium
NTFGLTWRLDRGALLLWTIG

SEQ ID NO: 971259 - protein, 20 aa, Mycobacterium
NTIYSPLFRKFVEWTEYLCL

SEQ ID NO: 971260 - protein, 26 aa, Mycobacterium
NTMFIPRFLFAVTFCGVLVATGNYLL

SEQ ID NO: 971261 - protein, 22 aa, Mycobacterium
NTQPGWIVAPGMQGQQVGPITA

SEQ ID NO: 971262 - protein, 18 aa, Mycobacterium
NVFTRINAILGVLLLIVL

SEQ ID NO: 971263 - protein, 19 aa, Mycobacterium
NVKDVKCNDGTDPTVKKGA

SEQ ID NO: 971264 - protein, 19 aa, Mycobacterium
NVKGDSVVIIAVDTKPVTI

SEQ ID NO: 971265 - protein, 27 aa, Mycobacterium
NVPKLADIRIRKAILGLLDVDLLAAVG

SEQ ID NO: 971266 - protein, 25 aa, Mycobacterium
NVSARPHSQFSYFLPDDHEYQITLV

SEQ ID NO: 971267 - protein, 20 aa, Mycobacterium
NVWNDFLWPLLMVQRDSIAT

SEQ ID NO: 971268 - protein, 24 aa, Mycobacterium
NVYLGLKVGLTFATSIPAAVISMG

SEQ ID NO: 971269 - protein, 23 aa, Mycobacterium
NYAELRHRIGFVPQDDILHTPLT

SEQ ID NO: 971270 - protein, 30 aa, Mycobacterium; identical to SEQ ID NO: 321588

SEQ ID NO: 971271 - protein, 26 aa, Mycobacterium
NYGAARAGARIILLNSEFSGPQIKEV

SEQ ID NO: 971272 - protein, 26 aa, Mycobacterium
NYYVAEFDGTVSIMRGIQGSFLGMSL

SEQ ID NO: 971273 - protein, 22 aa, Mycobacterium
PAALWVWVGLTAVAAAMLVVGW

SEQ ID NO: 971274 - protein, 18 aa, Mycobacterium
PADLSLYDYDGYDDSLDE

SEQ ID NO: 971275 - protein, 28 aa, Mycobacterium
PADRRGKLILCAAVGVLSVVVRAIGTVL

SEQ ID NO: 971276 - protein, 27 aa, Mycobacterium
PADVGWLRLPGFDWPAHPSWLYRLTQG

SEQ ID NO: 971277 - protein, 26 aa, Mycobacterium
PAESSFVRRQLCTVRNIGVFGVNLVG

SEQ ID NO: 971278 - protein, 26 aa, Mycobacterium
PAGDRRAMMLAHWAWLSMLLAGGAGM

SEQ ID NO: 971279 - protein, 25 aa, Mycobacterium
PAGWSFSGPLLWLKSAIVDRDRQYA

SEQ ID NO: 971280 - protein, 25 aa, Mycobacterium
PAHGFPARLWRTLERHPPPGVRRLA

SEQ ID NO: 971281 - protein, 21 aa, Mycobacterium
PAHRAAIEFNPPLPTGYQELA

SEQ ID NO: 971282 - protein, 17 aa, Mycobacterium
PAHYPSFGVIVYAGALI

SEQ ID NO: 971283 - protein, 19 aa, Mycobacterium
PAIILIGLCALLLIRGVSE

SEQ ID NO: 971284 - protein, 19 aa, Mycobacterium
PAKIRTRFMPAIDLDHDPD

SEQ ID NO: 971285 - protein, 19 aa, Mycobacterium
PAKPIAVNVIDFGADPDRK

SEQ ID NO: 971286 - protein, 19 aa, Mycobacterium
PAKPIAVNVIDFGTDPDQA

SEQ ID NO: 971287 - protein, 37 aa, Mycobacterium
PALGWASYLILWVLQACVFWRGMEAIRKFIDFCGPAV

SEQ ID NO: 971288 - protein, 24 aa, Mycobacterium
PALLITIFIYWGFDTAVACNDETD

SEQ ID NO: 971289 - protein, 17 aa, Mycobacterium
PALQSVRAMLDRIRSVL

SEQ ID NO: 971290 - protein, 18 aa, Mycobacterium
PALVLSVLQTVGWLPSFL

SEQ ID NO: 971291 - protein, 17 aa, Mycobacterium
PANARHMGLFVVGRLAA

SEQ ID NO: 971292 - protein, 22 aa, Mycobacterium
PAPDGLRLSATIDTRFSTTPTT

SEQ ID NO: 971293 - protein, 18 aa, Mycobacterium
PAPLRIIVAFSVVVAALA

SEQ ID NO: 971294 - protein, 17 aa, Mycobacterium
PARRLEPDPAVFADEET

SEQ ID NO: 971295 - protein, 23 aa, Mycobacterium
PASGGRYHGIWSMTLAIASVVAP

SEQ ID NO: 971296 - protein, 20 aa, Mycobacterium
PASLALAWVFGKLGWTAVTP

SEQ ID NO: 971297 - protein, 20 aa, Mycobacterium
PASLVPLLISQVGGLAAGLV

SEQ ID NO: 971298 - protein, 18 aa, Mycobacterium
PASQLLRPYGPRPLVRAL

SEQ ID NO: 971299 - protein, 19 aa, Mycobacterium
PASWERFGADPVRSPRGDR

SEQ ID NO: 971300 - protein, 27 aa, Mycobacterium
PATGARLRWVPLRGPSATPAQGLEHAD

SEQ ID NO: 971301 - protein, 25 aa, Mycobacterium
PATLLFFRYYWLRSEPLPSQRPTTT

SEQ ID NO: 971302 - protein, 17 aa, Mycobacterium
PATRAQLRIAVKHIPGG

SEQ ID NO: 971303 - protein, 23 aa, Mycobacterium
PATSRPKQQWGHTLAQQAATVSA

SEQ ID NO: 971304 - protein, 17 aa, Mycobacterium
PAVAAALDPYVREGWAF

SEQ ID NO: 971305 - protein, 20 aa, Mycobacterium
PAVDMPTNIVGAAGTIGAMT

SEQ ID NO: 971306 - protein, 18 aa, Mycobacterium
PAVDWVIVCMHQTAISTA

SEQ ID NO: 971307 - protein, 19 aa, Mycobacterium
PAVLRVWPVPVVMAVMVAL

SEQ ID NO: 971308 - protein, 18 aa, Mycobacterium
PAVLSVLVLEDFAMAGYL

SEQ ID NO: 971309 - protein, 19 aa, Mycobacterium
PAVVSWADFCAGGDGGAAG

SEQ ID NO: 971310 - protein, 21 aa, Mycobacterium
PCGFAFLPGYLGLVIAGSQGT

SEQ ID NO: 971311 - protein, 20 aa, Mycobacterium
PCNVGFLPPPLIRSPADETL

SEQ ID NO: 971312 - protein, 18 aa, Mycobacterium
PDALDIAVEALRAGSAEN

SEQ ID NO: 971313 - protein, 23 aa, Mycobacterium
PDASRITPPMLVAGFAHSVPVTI

SEQ ID NO: 971314 - protein, 24 aa, Mycobacterium
PDERRCAAMAIELITRPSLLVVDE

SEQ ID NO: 971315 - protein, 19 aa, Mycobacterium
PDERYMSAGDLAIAAHEAL

SEQ ID NO: 971316 - protein, 19 aa, Mycobacterium
PDFRISLVSPVTVREGCGY

SEQ ID NO: 971317 - protein, 21 aa, Mycobacterium
PDGGAAFVRRLVTLTTALLIV

SEQ ID NO: 971318 - protein, 22 aa, Mycobacterium
PDGLQPISPVLAAIVRNTNSYG

SEQ ID NO: 971319 - protein, 24 aa, Mycobacterium
PDGSHGMYSWLHFWIATGCALAAW

SEQ ID NO: 971320 - protein, 18 aa, Mycobacterium
PDGTPLWPGLPPAPPPGA

SEQ ID NO: 971321 - protein, 25 aa, Mycobacterium
PDILDPALLRPGRFDRQIPVTNPDL

SEQ ID NO: 971322 - protein, 26 aa, Mycobacterium
PDKARAAVTQGLFPVISLVLLGLGLA

SEQ ID NO: 971323 - protein, 26 aa, Mycobacterium
PDKFPADTTVVSWLPLFHDMGLILGI

SEQ ID NO: 971324 - protein, 18 aa, Mycobacterium
PDLDLSAKAPVLFQIPGG

SEQ ID NO: 971325 - protein, 23 aa, Mycobacterium
PDLPEYRTGLIIVGLARCIAMVI

SEQ ID NO: 971326 - protein, 27 aa, Mycobacterium
PDPDRRADLAMTWLVAGLVAGILSGAV

SEQ ID NO: 971327 - protein, 21 aa, Mycobacterium
PDPHSFAVLFAPPRLAAQLTG

SEQ ID NO: 971328 - protein, 21 aa, Mycobacterium
PDPNLRPQIVGVFTDLTGPAP

SEQ ID NO: 971329 - protein, 19 aa, Mycobacterium
PDRAFSAAIAVLVIACPCA

SEQ ID NO: 971330 - protein, 29 aa, Mycobacterium
PDRVESVLRAKAAGAWNLHGLTHGMDLVA

SEQ ID NO: 971331 - protein, 25 aa, Mycobacterium
PDRYPLKGIFHAAGVLDDAVLASLT

SEQ ID NO: 971332 - protein, 19 aa, Mycobacterium
PDSTIPIELPFTGLADPHG

SEQ ID NO: 971333 - protein, 17 aa, Mycobacterium
PDSWPSQADFVAGDIRD

SEQ ID NO: 971334 - protein, 26 aa, Mycobacterium
PDTPFRLDHVVNFLATLGLWVAIIVA

SEQ ID NO: 971335 - protein, 25 aa, Mycobacterium
PDTRPRLILGSSLIALSFLGLRHLW

SEQ ID NO: 971336 - protein, 19 aa, Mycobacterium
PDTSFAWSFVLALLAAALA

SEQ ID NO: 971337 - protein, 17 aa, Mycobacterium
PEAMLDVINELRAAGAE

SEQ ID NO: 971338 - protein, 25 aa, Mycobacterium
PEAQWRSVTATGHYLSDVQVLARLR

SEQ ID NO: 971339 - protein, 19 aa, Mycobacterium
PEDFLALLVAERVSVLSQT

SEQ ID NO: 971340 - protein, 18 aa, Mycobacterium
PEEDLVRWDGRIDDPAGG

SEQ ID NO: 971341 - protein, 26 aa, Mycobacterium
PEGPKTPRWLWIAAGAAVVLVIGLVI

SEQ ID NO: 971342 - protein, 22 aa, Mycobacterium
PEKISFLPAMRYYVGNWATSVW

SEQ ID NO: 971343 - protein, 18 aa, Mycobacterium
PELARLVESARLLVDEAN

SEQ ID NO: 971344 - protein, 24 aa, Mycobacterium
PELMTLEKIAAWAITEPDSGSDAF

SEQ ID NO: 971345 - protein, 23 aa, Mycobacterium
PELRQRAAGFIGFTIGGPLSDGL

SEQ ID NO: 971346 - protein, 25 aa, Mycobacterium
PEPPPRRLRLLLSVAAVVLALDVVT

SEQ ID NO: 971347 - protein, 20 aa, Mycobacterium
PEQRKSSLPGENVVQEPIRR

SEQ ID NO: 971348 - protein, 20 aa, Mycobacterium
PERFRQALFRALAAVVEIWM

SEQ ID NO: 971349 - protein, 19 aa, Mycobacterium
PERNTMIGVLPRWQPVAIL

SEQ ID NO: 971350 - protein, 25 aa, Mycobacterium
PESLYPALLGFILLSAVAATLLVAM

SEQ ID NO: 971351 - protein, 25 aa, Mycobacterium
PESYSLPLRRLLGFLAAGLDASLIP

SEQ ID NO: 971352 - protein, 26 aa, Mycobacterium
PETDKPVWITMLWPLADRPRLAPGVP

SEQ ID NO: 971353 - protein, 29 aa, Mycobacterium
PEVLNLLLIDFKGGATFLDLEKAPHVAAV

SEQ ID NO: 971354 - protein, 17 aa, Mycobacterium
PEVLSSALWSGSGPGPL

SEQ ID NO: 971355 - protein, 19 aa, Mycobacterium
PEVPKRQWGLPLAATAAAV

SEQ ID NO: 971356 - protein, 24 aa, Mycobacterium
PFAAMGAGMAFVWSPLAATATRNL

SEQ ID NO: 971357 - protein, 32 aa, Mycobacterium; identical to SEQ ID NO: 322251

SEQ ID NO: 971358 - protein, 19 aa, Mycobacterium
PFDHYRSGPITVELFSGAA

SEQ ID NO: 971359 - protein, 17 aa, Mycobacterium
PFGPVVSVFGHRTPLQL

SEQ ID NO: 971360 - protein, 18 aa, Mycobacterium
PFHQAAWVNLKHGTATMD

SEQ ID NO: 971361 - protein, 17 aa, Mycobacterium
PFIAWPPALPVAMWLLA

SEQ ID NO: 971362 - protein, 22 aa, Mycobacterium
PFLILLIVLEWIAARKLLTTSA

SEQ ID NO: 971363 - protein, 28 aa, Mycobacterium
PFLLGFRLTCYYYRKAYYRSVWQSPTGC

SEQ ID NO: 971364 - protein, 24 aa, Mycobacterium
PFLRASLAGPRRWGPWLRKRIASA

SEQ ID NO: 971365 - protein, 20 aa, Mycobacterium
PFNNGLRPEGIIALGSLVTY

SEQ ID NO: 971366 - protein, 21 aa, Mycobacterium
PFRMPLWPLPPVLAVVGVVVT

SEQ ID NO: 971367 - protein, 27 aa, Mycobacterium
PFRPRNPRPAIIVVILLVVLTGVVWTV

SEQ ID NO: 971368 - protein, 25 aa, Mycobacterium
PFTGLNFPAGVTMDLSGNVYVADLN

SEQ ID NO: 971369 - protein, 25 aa, Mycobacterium
PFVMLGAGLLWFGWYGFNAGSATSS

SEQ ID NO: 971370 - protein, 23 aa, Mycobacterium
PFVYDHKVFFAVAAILLVTALNL

SEQ ID NO: 971371 - protein, 19 aa, Mycobacterium
PFYPPGWFWIGGRAAALTG

SEQ ID NO: 971372 - protein, 19 aa, Mycobacterium
PGAAEGLAGVLMVFVAVLS

SEQ ID NO: 971373 - protein, 22 aa, Mycobacterium
PGANPRPAAPLISADTKAAISV

SEQ ID NO: 971374 - protein, 21 aa, Mycobacterium
PGAPRRAGDALLVFSSGTTGL

SEQ ID NO: 971375 - protein, 19 aa, Mycobacterium
PGEASLLVASYPEVPKRQW

SEQ ID NO: 971376 - protein, 21 aa, Mycobacterium
PGEGCCFRVTLPRVSEAAVEL

SEQ ID NO: 971377 - protein, 21 aa, Mycobacterium
PGGAPGCWQSITHDFWPAPEL

SEQ ID NO: 971378 - protein, 18 aa, Mycobacterium
PGGPGRMFFLPGPPPPGM

SEQ ID NO: 971379 - protein, 18 aa, Mycobacterium
PGGSDPASWLGRAAAAAG

SEQ ID NO: 971380 - protein, 17 aa, Mycobacterium
PGGVMVSRARPARFGSG

SEQ ID NO: 971381 - protein, 24 aa, Mycobacterium
PGISGVAVGRWRVDRNAPPVPTHD

SEQ ID NO: 971382 - protein, 19 aa, Mycobacterium
PGLFGLSAVVVRRLPGWPI

SEQ ID NO: 971383 - protein, 20 aa, Mycobacterium
PGLPLWLYLVCAAFTGLGGG

SEQ ID NO: 971384 - protein, 20 aa, Mycobacterium
PGLPLWPYLVCAALSGVGGG

SEQ ID NO: 971385 - protein, 24 aa, Mycobacterium
PGLRYRSGGPFADAVAAVRAGRRP

SEQ ID NO: 971386 - protein, 19 aa, Mycobacterium
PGNLLPDILLIKSARDLRD

SEQ ID NO: 971387 - protein, 21 aa, Mycobacterium
PGPREWLTWLLHSRVTAFFSH

SEQ ID NO: 971388 - protein, 18 aa, Mycobacterium
PGQILVLLNVGAVFMGTA

SEQ ID NO: 971389 - protein, 20 aa, Mycobacterium
PGRHDWPFADQVFARALPWL

SEQ ID NO: 971390 - protein, 29 aa, Mycobacterium
PGRVRAVDVARLWALVVVMFGHRALLLAT

SEQ ID NO: 971391 - protein, 18 aa, Mycobacterium
PGSLRPLFTMSPCSRWST

SEQ ID NO: 971392 - protein, 17 aa, Mycobacterium
PGSMATIAIVVGVLGAV

SEQ ID NO: 971393 - protein, 19 aa, Mycobacterium
PGSTRWQGNPIRPWQTRRK

SEQ ID NO: 971394 - protein, 17 aa, Mycobacterium
PGSWTRYGQLLRKPVGP

SEQ ID NO: 971395 - protein, 24 aa, Mycobacterium
PGTGQAAANIWLDRLRTLARRTCV

SEQ ID NO: 971396 - protein, 19 aa, Mycobacterium
PGTLICRLMLPPSAIDPGR

SEQ ID NO: 971397 - protein, 28 aa, Mycobacterium
PGVERRPSRLGRGWLVGISAVLLLAAGG

SEQ ID NO: 971398 - protein, 35 aa, Mycobacterium
PGVVPAPIPLPIPIIIPPWPNWSPGMPTPSTVTVT

SEQ ID NO: 971399 - protein, 25 aa, Mycobacterium
PGWVSAVNWFWLLAFAIAAIIRAAM

SEQ ID NO: 971400 - protein, 17 aa, Mycobacterium
PHDRLPYVANRVIGFAL

SEQ ID NO: 971401 - protein, 32 aa, Mycobacterium
PHELANSADLDWRSVWDRGWSAAAEAQETPVQ

SEQ ID NO: 971402 - protein, 25 aa, Mycobacterium
PHFLAASLRNPWMLLGAAALVALIV

SEQ ID NO: 971403 - protein, 20 aa, Mycobacterium
PHFLRIRMVSPTLFEDAQAE

SEQ ID NO: 971404 - protein, 27 aa, Mycobacterium
PHGYLGVWSALPFAIWFFLAVEGVPLA

SEQ ID NO: 971405 - protein, 17 aa, Mycobacterium
PHIVGVHDRGEFNGQLW

SEQ ID NO: 971406 - protein, 26 aa, Mycobacterium
PHLDSGPFLSYGIQWIAFGILAPIGL

SEQ ID NO: 971407 - protein, 17 aa, Mycobacterium
PHLFERFVRSSKSRSSA

SEQ ID NO: 971408 - protein, 20 aa, Mycobacterium
PHMPPALTSYIFGGGADAAR

SEQ ID NO: 971409 - protein, 18 aa, Mycobacterium
PHRRRVALGVLTSVTVAL

SEQ ID NO: 971410 - protein, 31 aa, Mycobacterium; identical to SEQ ID NO: 322576

SEQ ID NO: 971411 - protein, 21 aa, Mycobacterium
PIAEDRLSSLLLSPAEVNSVM

SEQ ID NO: 971412 - protein, 20 aa, Mycobacterium
PIAEVRRLLPRPAEEDRRDA

SEQ ID NO: 971413 - protein, 22 aa, Mycobacterium
PIALICASVWLMLNLTALIWIR

SEQ ID NO: 971414 - protein, 22 aa, Mycobacterium
PICRRSSLAIVKLLGRKKSYGQ

SEQ ID NO: 971415 - protein, 20 aa, Mycobacterium
PIFFVLSGFLLFRPWVHSAV

SEQ ID NO: 971416 - protein, 20 aa, Mycobacterium
PIGFLIAGVIGFFGGFAYGA

SEQ ID NO: 971417 - protein, 22 aa, Mycobacterium
PIGTMRRFSWSGRAPVLDPLPR

SEQ ID NO: 971418 - protein, 30 aa, Mycobacterium; identical to SEQ ID NO: 322629

SEQ ID NO: 971419 - protein, 37 aa, Mycobacterium; identical to SEQ ID NO: 322631

SEQ ID NO: 971420 - protein, 19 aa, Mycobacterium
PIRSYLYWEKHCYDIANCW

SEQ ID NO: 971421 - protein, 26 aa, Mycobacterium
PITAHPRLRVHWVPRRDETSLAEAIE

SEQ ID NO: 971422 - protein, 26 aa, Mycobacterium
PITALGVAIPFVWAPLAAIGSRDLPA

SEQ ID NO: 971423 - protein, 33 aa, Mycobacterium; identical to SEQ ID NO: 322683

SEQ ID NO: 971424 - protein, 18 aa, Mycobacterium
PKGYFPVGRNPWRGPPVP

SEQ ID NO: 971425 - protein, 23 aa, Mycobacterium
PKKSRKNWIIGAAVVAVLLVVAG

SEQ ID NO: 971426 - protein, 20 aa, Mycobacterium
PKKSRKSPGIWWAVTSVVAI

SEQ ID NO: 971427 - protein, 20 aa, Mycobacterium
PKLSRRILHQLYLGYPDSAA

SEQ ID NO: 971428 - protein, 20 aa, Mycobacterium
PKLTERMAVRLASMDLRPHA

SEQ ID NO: 971429 - protein, 23 aa, Mycobacterium
PKLVQLRSFPTIAIGGDRPGADR

SEQ ID NO: 971430 - protein, 20 aa, Mycobacterium
PKPDLLRRLLHDFRGPLIVS

SEQ ID NO: 971431 - protein, 19 aa, Mycobacterium
PKRAALLAGGMADSFATLV

SEQ ID NO: 971432 - protein, 26 aa, Mycobacterium
PKRNPWPIVAGVAALVFVLIVGGIGV

SEQ ID NO: 971433 - protein, 23 aa, Mycobacterium
PKTPEFRRGMLYAINPVGFGSML

SEQ ID NO: 971434 - protein, 18 aa, Mycobacterium
PKTTVTFFDGRTASFTVV

SEQ ID NO: 971435 - protein, 18 aa, Mycobacterium
PKVGPWALYGLLFTIVIL

SEQ ID NO: 971436 - protein, 17 aa, Mycobacterium
PKVVMTFYEDFLCPACG

SEQ ID NO: 971437 - protein, 21 aa, Mycobacterium
PLAALAAACRRFTEGNFGERI

SEQ ID NO: 971438 - protein, 18 aa, Mycobacterium
PLASDWPLVVADASQPAT

SEQ ID NO: 971439 - protein, 25 aa, Mycobacterium
PLATGCLRVRASITISPEDLVSGEI

SEQ ID NO: 971440 - protein, 24 aa, Mycobacterium
PLDQPRIYYGPVISNTPADYAIVG

SEQ ID NO: 971441 - protein, 36 aa, Mycobacterium; identical to SEQ ID NO: 322800

SEQ ID NO: 971442 - protein, 20 aa, Mycobacterium
PLFDRLGRRFPKHFGPGHVA

SEQ ID NO: 971443 - protein, 19 aa, Mycobacterium
PLFYGEGTTMLFGDAKKSV

SEQ ID NO: 971444 - protein, 19 aa, Mycobacterium
PLGAEPMQAIGQFLGAVRA

SEQ ID NO: 971445 - protein, 17 aa, Mycobacterium
PLGIWVFAPLRRRATAA

SEQ ID NO: 971446 - protein, 18 aa, Mycobacterium
PLGRAIVEEVRRRGITIP

SEQ ID NO: 971447 - protein, 27 aa, Mycobacterium
PLGRMGIAVLCARILLRKVTPGSYPRG

SEQ ID NO: 971448 - protein, 25 aa, Mycobacterium
PLGYAPGTCRAFLPAKDSLARVTCD

SEQ ID NO: 971449 - protein, 25 aa, Mycobacterium
PLIGNRLSERLQVPVFTTAQPIFSA

SEQ ID NO: 971450 - protein, 18 aa, Mycobacterium
PLIPLAVSAFLTSRKKAA

SEQ ID NO: 971451 - protein, 29 aa, Mycobacterium
PLKEPAWRRFRVSQVLIGLSAVVAMTAIG

SEQ ID NO: 971452 - protein, 19 aa, Mycobacterium
PLLPACLDIGEQLRSSTQA

SEQ ID NO: 971453 - protein, 21 aa, Mycobacterium
PLPQIFGPGGGGGFPGGDDDR

SEQ ID NO: 971454 - protein, 17 aa, Mycobacterium
PLPQPFWVSVTVALLLG

SEQ ID NO: 971455 - protein, 18 aa, Mycobacterium
PLRFLARATSLWNSELPF

SEQ ID NO: 971456 - protein, 20 aa, Mycobacterium
PLRRTVLTALGWMIFAIILA

SEQ ID NO: 971457 - protein, 20 aa, Mycobacterium
PLTIIWPSGWSWGHGSSHYL

SEQ ID NO: 971458 - protein, 25 aa, Mycobacterium
PLVAEIGVACAVAIAVDATIVRLIM

SEQ ID NO: 971459 - protein, 18 aa, Mycobacterium
PLVFAIPIVLGMILLVIP

SEQ ID NO: 971460 - protein, 20 aa, Mycobacterium
PLVLAFVALIAFVMLLISIH

SEQ ID NO: 971461 - protein, 18 aa, Mycobacterium
PLVPAGIFYLMLTVPLAH

SEQ ID NO: 971462 - protein, 21 aa, Mycobacterium
PLVPLICSLATTLVLFEGGRD

SEQ ID NO: 971463 - protein, 18 aa, Mycobacterium
PLVPLKIFSDRNFSLSSI

SEQ ID NO: 971464 - protein, 23 aa, Mycobacterium
PLYCVGVLASFWAARFGTTVLYS

SEQ ID NO: 971465 - protein, 20 aa, Mycobacterium
PLYEAATAWTALSAEHASVA

SEQ ID NO: 971466 - protein, 21 aa, Mycobacterium
PMASAAPPWPGPQPAEPAAPR

SEQ ID NO: 971467 - protein, 25 aa, Mycobacterium
PMGSSLYWLRFGTIRLPPWPERVPW

SEQ ID NO: 971468 - protein, 21 aa, Mycobacterium
PMGVPLEWNVFMIFGVLALFV

SEQ ID NO: 971469 - protein, 24 aa, Mycobacterium
PMGVPLEWNVFMIFGVLWLFVAHA

SEQ ID NO: 971470 - protein, 25 aa, Mycobacterium
PMLLAARFLLGLAVGVSIVVVPVYV

SEQ ID NO: 971471 - protein, 21 aa, Mycobacterium
PMLPGLAVFRAVFYFAADSHF

SEQ ID NO: 971472 - protein, 19 aa, Mycobacterium
PMLSMRRISAFVLGQGLIT

SEQ ID NO: 971473 - protein, 25 aa, Mycobacterium
PMQFVCSSIQAGSRLGYQESAELCA

SEQ ID NO: 971474 - protein, 18 aa, Mycobacterium
PMSNLLVWISTLGSTGGK

SEQ ID NO: 971475 - protein, 19 aa, Mycobacterium
PNAIWKSFDLFVGAIQAFI

SEQ ID NO: 971476 - protein, 32 aa, Mycobacterium
PNDYRPNLFVTYWSFRAMIGFLAIPVLFALLA

SEQ ID NO: 971477 - protein, 25 aa, Mycobacterium
PNGDAKAALMTSLKGLLSQNVTVVD

SEQ ID NO: 971478 - protein, 21 aa, Mycobacterium
PNLFATIGIIVAHSYAYLTNS

SEQ ID NO: 971479 - protein, 27 aa, Mycobacterium
PNNTEGRWKLGLYAAGRASQMRRMRAP

SEQ ID NO: 971480 - protein, 18 aa, Mycobacterium
PNRLARLMSVMGIPLLLG

SEQ ID NO: 971481 - protein, 24 aa, Mycobacterium
PNSDLRWAILATRDDWDAYERLSS

SEQ ID NO: 971482 - protein, 24 aa, Mycobacterium
PNTRSFTAAGIWLAIASFAAAGAV

SEQ ID NO: 971483 - protein, 22 aa, Mycobacterium
PNVNIRLAIEWLDTYSDGMPLS

SEQ ID NO: 971484 - protein, 22 aa, Mycobacterium
PNWKQSMTVLLMLYPTIMCISY

SEQ ID NO: 971485 - protein, 26 aa, Mycobacterium
PNYFGDACVWWGLWLVTITGWVPLIT

SEQ ID NO: 971486 - protein, 17 aa, Mycobacterium
PPADPLPAVAMPAPPLA

SEQ ID NO: 971487 - protein, 19 aa, Mycobacterium
PPAGAWIDQAIVIWVLIAL

SEQ ID NO: 971488 - protein, 23 aa, Mycobacterium
PPAHARTAAFFDLDKTIIAKSST

SEQ ID NO: 971489 - protein, 17 aa, Mycobacterium
PPAPAVAAWLVRRVPVV

SEQ ID NO: 971490 - protein, 20 aa, Mycobacterium
PPDNLRWLVTVDAMHTQVVT

SEQ ID NO: 971491 - protein, 19 aa, Mycobacterium
PPEELQFVLADLKGGSAVK

SEQ ID NO: 971492 - protein, 33 aa, Mycobacterium; identical to SEQ ID NO: 323129

SEQ ID NO: 971493 - protein, 18 aa, Mycobacterium
PPETMPGVAPADRPPSGG

SEQ ID NO: 971494 - protein, 25 aa, Mycobacterium
PPFEHARPTAIMTWMRQHCGIENTL

SEQ ID NO: 971495 - protein, 18 aa, Mycobacterium
PPFGTWYAAMLFAVVPLR

SEQ ID NO: 971496 - protein, 19 aa, Mycobacterium
PPGACWVGAGAAAARRARR

SEQ ID NO: 971497 - protein, 26 aa, Mycobacterium
PPGSKSRKGRAFAIVAALLALAAIAV

SEQ ID NO: 971498 - protein, 19 aa, Mycobacterium
PPGSLRWLVTVDAMHTQVV

SEQ ID NO: 971499 - protein, 36 aa, Mycobacterium
PPITAVAMRAWWQTGRSVFWPLAIGLIGLAALAGSF

SEQ ID NO: 971500 - protein, 25 aa, Mycobacterium
PPKGPGSKAPWLIIAGVAVLGVLAL

SEQ ID NO: 971501 - protein, 20 aa, Mycobacterium
PPLHDQWRPVLWAISILTMA

SEQ ID NO: 971502 - protein, 21 aa, Mycobacterium
PPLKFAQLVGLVFAVCGVAGF

SEQ ID NO: 971503 - protein, 20 aa, Mycobacterium
PPLRLKLMRAAVETCRLLPM

SEQ ID NO: 971504 - protein, 20 aa, Mycobacterium
PPNVRELIEITLVKNPGLRY

SEQ ID NO: 971505 - protein, 18 aa, Mycobacterium
PPPARIVLFSDGKETMPT

SEQ ID NO: 971506 - protein, 24 aa, Mycobacterium
PPPCLTGFIPAEQWRSFADTSLQP

SEQ ID NO: 971507 - protein, 18 aa, Mycobacterium
PPPDGMRVYITGPAALTT

SEQ ID NO: 971508 - protein, 19 aa, Mycobacterium
PPPPFTSWMPPDYPPQAPQ

SEQ ID NO: 971509 - protein, 19 aa, Mycobacterium
PPPPPRPVATATTTVAPPV

SEQ ID NO: 971510 - protein, 25 aa, Mycobacterium
PPPRPVAQSFWYRTAKLVTRHAIPV

SEQ ID NO: 971511 - protein, 27 aa, Mycobacterium
PPPRRPAHRKLVGWLSAAAGLVLAAAL

SEQ ID NO: 971512 - protein, 22 aa, Mycobacterium
PPPSLRRYTAHRVRRIMPAYVV

SEQ ID NO: 971513 - protein, 20 aa, Mycobacterium
PPPSPGTVYQMWLVDAKGPT

SEQ ID NO: 971514 - protein, 26 aa, Mycobacterium
PPPSVSRYAWHRVRRIMPAYVITVLF

SEQ ID NO: 971515 - protein, 17 aa, Mycobacterium
PPQPVVITAVPAPQATT

SEQ ID NO: 971516 - protein, 23 aa, Mycobacterium
PPRTRLGARLAPIVQAPLAIATW

SEQ ID NO: 971517 - protein, 25 aa, Mycobacterium
PPSVSRYAWHRVRRIMPAYVITVLF

SEQ ID NO: 971518 - protein, 26 aa, Mycobacterium
PPTNWWWAAIVSVALLTWVLMHPAST

SEQ ID NO: 971519 - protein, 19 aa, Mycobacterium
PPVKAALAAATARAPHDPT

SEQ ID NO: 971520 - protein, 24 aa, Mycobacterium
PPVLIPWSVLSLFAPGPTLSRADA

SEQ ID NO: 971521 - protein, 17 aa, Mycobacterium
PPVRRLPASFGVDQVRQ

SEQ ID NO: 971522 - protein, 23 aa, Mycobacterium
PQAYKFLGGNGYSLNSHTTPLSA

SEQ ID NO: 971523 - protein, 27 aa, Mycobacterium
PQDSWRKRLPTIFLDVARFALIGIGLA

SEQ ID NO: 971524 - protein, 26 aa, Mycobacterium
PQECGSTCGPTGASVAARPASTTGPT

SEQ ID NO: 971525 - protein, 21 aa, Mycobacterium
PQERRLVFERFYRSTTARSLP

SEQ ID NO: 971526 - protein, 22 aa, Mycobacterium
PQERRLVFERFYRSTTARSLPG

SEQ ID NO: 971527 - protein, 22 aa, Mycobacterium
PQLFARRIGRNESFNHAGNATA

SEQ ID NO: 971528 - protein, 19 aa, Mycobacterium
PQLRVAIEGVARFSQTLDE

SEQ ID NO: 971529 - protein, 27 aa, Mycobacterium
PQLSRGDWRLRIHGMVDREISYTFDDL

SEQ ID NO: 971530 - protein, 19 aa, Mycobacterium
PQPMPAPRFSRTVPSRPRP

SEQ ID NO: 971531 - protein, 21 aa, Mycobacterium
PQRLKAGQVLMSRNVTSEANT

SEQ ID NO: 971532 - protein, 21 aa, Mycobacterium
PQRQWRWPLGEIDKPFEMRRD

SEQ ID NO: 971533 - protein, 25 aa, Mycobacterium
PQTLFFPFVMLLAATALYRGNDNKM

SEQ ID NO: 971534 - protein, 23 aa, Mycobacterium
PRALAPSYLDVCANADRGAGSLA

SEQ ID NO: 971535 - protein, 19 aa, Mycobacterium
PRATLAWTMTIAAGVLVGM

SEQ ID NO: 971536 - protein, 24 aa, Mycobacterium
PRESDIWLLGAIGPRMVYSTNLDA

SEQ ID NO: 971537 - protein, 26 aa, Mycobacterium
PRGGFVTGWMYWYFFVVVVAVETVAG

SEQ ID NO: 971538 - protein, 17 aa, Mycobacterium
PRHEALKVLGAGVCADD

SEQ ID NO: 971539 - protein, 21 aa, Mycobacterium
PRILPPGWKPGSRAVAAPTLP

SEQ ID NO: 971540 - protein, 21 aa, Mycobacterium
PRITFEVGHHQGVIGLLPPPE

SEQ ID NO: 971541 - protein, 22 aa, Mycobacterium
PRKISFLPGMRYYAGNWDTTLW

SEQ ID NO: 971542 - protein, 28 aa, Mycobacterium
PRLGVRWWRFGAGVLLGLAFATKWSGLY

SEQ ID NO: 971543 - protein, 17 aa, Mycobacterium
PRLPAVMMIGGQFNTPA

SEQ ID NO: 971544 - protein, 17 aa, Mycobacterium
PRLPDLVAVPPTLIDHL

SEQ ID NO: 971545 - protein, 19 aa, Mycobacterium
PRLPHLIAGGDYVMAGGDG

SEQ ID NO: 971546 - protein, 19 aa, Mycobacterium
PRLSNIAVISAADIVDRIL

SEQ ID NO: 971547 - protein, 23 aa, Mycobacterium
PRNLVIPCCAVLLPTAVAHLVAE

SEQ ID NO: 971548 - protein, 24 aa, Mycobacterium
PRNLVIPCCAVLLPTAVAHLVAER

SEQ ID NO: 971549 - protein, 22 aa, Mycobacterium
PRPARPELVVLCDVSGSVAGFS

SEQ ID NO: 971550 - protein, 22 aa, Mycobacterium
PRPASYMLGPFGPRRLVRSLLL

SEQ ID NO: 971551 - protein, 24 aa, Mycobacterium
PRPEELPRVWALINATSADPLAPF

SEQ ID NO: 971552 - protein, 19 aa, Mycobacterium
PRPMPVTRKARRQRRGMEV

SEQ ID NO: 971553 - protein, 21 aa, Mycobacterium
PRPMVNLLAFWFGGMATGIGV

SEQ ID NO: 971554 - protein, 21 aa, Mycobacterium
PRPQVHLAIGVGARGMTTIAT

SEQ ID NO: 971555 - protein, 19 aa, Mycobacterium
PRPRHLVLVLDRSRSMAGW

SEQ ID NO: 971556 - protein, 21 aa, Mycobacterium
PRRLSPRVVVAPFDPAVGAAL

SEQ ID NO: 971557 - protein, 20 aa, Mycobacterium
PRRYADYLPTDGFQTLNVIS

SEQ ID NO: 971558 - protein, 18 aa, Mycobacterium
PRSDVYSAGILTYELLTG

SEQ ID NO: 971559 - protein, 25 aa, Mycobacterium
PRSSLLPPRITQIIMGIDSIGAGFN

SEQ ID NO: 971560 - protein, 17 aa, Mycobacterium
PRSSLLVLGDGRTNYRN

SEQ ID NO: 971561 - protein, 20 aa, Mycobacterium
PRSSRPMSVTARWRPDARAM

SEQ ID NO: 971562 - protein, 18 aa, Mycobacterium
PRSYRRWSPAVVGISALG

SEQ ID NO: 971563 - protein, 25 aa, Mycobacterium
PRTADAVPPWYADVLLPDLGAAWRI

SEQ ID NO: 971564 - protein, 20 aa, Mycobacterium
PRTSMSSALRCSRRHRCGVG

SEQ ID NO: 971565 - protein, 19 aa, Mycobacterium
PRVHRWARGVDLIRFAPSA

SEQ ID NO: 971566 - protein, 20 aa, Mycobacterium
PRVQVVIGDAMKWLRGTDSG

SEQ ID NO: 971567 - protein, 17 aa, Mycobacterium
PRVTIGLDQTRFARSVH

SEQ ID NO: 971568 - protein, 19 aa, Mycobacterium
PRWWQPRNVDLGSVHVHHV

SEQ ID NO: 971569 - protein, 24 aa, Mycobacterium
PRYIPGEPLADIAVGDGYADDTDA

SEQ ID NO: 971570 - protein, 24 aa, Mycobacterium
PSANLGANCQYPASPDKAAKPAKP

SEQ ID NO: 971571 - protein, 26 aa, Mycobacterium
PSAQCCIAAYLPYLSWLMQASADSAA

SEQ ID NO: 971572 - protein, 24 aa, Mycobacterium
PSCTAGAGSLMWLDVRYGCLESIR

SEQ ID NO: 971573 - protein, 17 aa, Mycobacterium
PSEKTFRAVLSRLDPAD

SEQ ID NO: 971574 - protein, 21 aa, Mycobacterium
PSELGAQPGLWIPGSSVSAAR

SEQ ID NO: 971575 - protein, 18 aa, Mycobacterium
PSGFLKRSLFKRYPDDLR

SEQ ID NO: 971576 - protein, 18 aa, Mycobacterium
PSGLSMLGAESGGLRVPV

SEQ ID NO: 971577 - protein, 20 aa, Mycobacterium
PSGLVPIALDGKMLRGTLRA

SEQ ID NO: 971578 - protein, 20 aa, Mycobacterium
PSGMGRWTPDTGETIADRLG

SEQ ID NO: 971579 - protein, 18 aa, Mycobacterium
PSLFSRELFQEVFLNPGL

SEQ ID NO: 971580 - protein, 23 aa, Mycobacterium
PSLLPRGPLFQGLVSGISGAIGY

SEQ ID NO: 971581 - protein, 20 aa, Mycobacterium
PSLWGWRNTPVLRWFVLGAG

SEQ ID NO: 971582 - protein, 17 aa, Mycobacterium
PSMPMAANMPASAESTI

SEQ ID NO: 971583 - protein, 18 aa, Mycobacterium
PSPARAAAWQLRLHRSTI

SEQ ID NO: 971584 - protein, 19 aa, Mycobacterium
PSPARAAAWQLRLHRSTIA

SEQ ID NO: 971585 - protein, 17 aa, Mycobacterium
PSPCAPSCSAVFRCSVR

SEQ ID NO: 971586 - protein, 21 aa, Mycobacterium
PSPPRGVWHLGPLPIRAYAFF

SEQ ID NO: 971587 - protein, 23 aa, Mycobacterium
PSPQPPNVTTWWAIQSSCIPTGC

SEQ ID NO: 971588 - protein, 22 aa, Mycobacterium
PSPQTSLAVCWKVFPYSYPTVF

SEQ ID NO: 971589 - protein, 22 aa, Mycobacterium
PSPTCIIVGLPAGLRLAVDNAI

SEQ ID NO: 971590 - protein, 18 aa, Mycobacterium
PSQSGIRPAVGTGSSPSA

SEQ ID NO: 971591 - protein, 18 aa, Mycobacterium
PSRLAEVMAHAAGTTVEV

SEQ ID NO: 971592 - protein, 23 aa, Mycobacterium
PSRSGSLTSVWLLLGLLAISAVL

SEQ ID NO: 971593 - protein, 18 aa, Mycobacterium
PSTLSDFIAHFSTAVEGL

SEQ ID NO: 971594 - protein, 17 aa, Mycobacterium
PSTRHWLGTNALGQDLL

SEQ ID NO: 971595 - protein, 21 aa, Mycobacterium
PSVAFPMVWTTLYSDIAASSA

SEQ ID NO: 971596 - protein, 18 aa, Mycobacterium
PSVMGRATTSWVLGSGVP

SEQ ID NO: 971597 - protein, 21 aa, Mycobacterium
PSVVLRRRIVVGVVLVIGAVV

SEQ ID NO: 971598 - protein, 19 aa, Mycobacterium
PSWGWGQRRTLLLLIAGAI

SEQ ID NO: 971599 - protein, 17 aa, Mycobacterium
PTAIMTWMRQHCGIENS

SEQ ID NO: 971600 - protein, 25 aa, Mycobacterium
PTAMWICVLNPLVLIHLMGGVHNEM

SEQ ID NO: 971601 - protein, 26 aa, Mycobacterium
PTDMMLLDRIAKGVFHLPGIARVQGI

SEQ ID NO: 971602 - protein, 17 aa, Mycobacterium
PTEIGGYAGVPAPPPPP

SEQ ID NO: 971603 - protein, 19 aa, Mycobacterium
PTFGDWGFALARRGGTAPI

SEQ ID NO: 971604 - protein, 19 aa, Mycobacterium
PTGAFFRTEFGTVVVQQDI

SEQ ID NO: 971605 - protein, 18 aa, Mycobacterium
PTGMSAAELARWTYQGHT

SEQ ID NO: 971606 - protein, 19 aa, Mycobacterium
PTLPVAICVPPEYAAATQA

SEQ ID NO: 971607 - protein, 20 aa, Mycobacterium
PTLREAALWSAVYIGVAILF

SEQ ID NO: 971608 - protein, 19 aa, Mycobacterium
PTLRISLIAFGRLVISAGL

SEQ ID NO: 971609 - protein, 21 aa, Mycobacterium
PTSRPDAYAGIASDVDILSIR

SEQ ID NO: 971610 - protein, 26 aa, Mycobacterium
PTVATRAAMAVVCAGDGVAAGTTGTA

SEQ ID NO: 971611 - protein, 19 aa, Mycobacterium
PTVEIVPGITIPVGPPTTI

SEQ ID NO: 971612 - protein, 17 aa, Mycobacterium
PTVRQRVRRSGPRVSGL

SEQ ID NO: 971613 - protein, 24 aa, Mycobacterium
PTWPQCFPGSFTPVAVAEVPRIHQ

SEQ ID NO: 971614 - protein, 21 aa, Mycobacterium
PTYGFVRRRYWLKELGVDQTK

SEQ ID NO: 971615 - protein, 19 aa, Mycobacterium
PVAATPRGSWRAQAAGRLL

SEQ ID NO: 971616 - protein, 19 aa, Mycobacterium
PVASLIQTYTWRKLSGGQV

SEQ ID NO: 971617 - protein, 27 aa, Mycobacterium
PVASPRTWPLVALAIIAIVGVVLGAAA

SEQ ID NO: 971618 - protein, 24 aa, Mycobacterium
PVFGFGVIFGAIWAEQAWGRYWGW

SEQ ID NO: 971619 - protein, 19 aa, Mycobacterium
PVGALIFGLWADRVGRRVP

SEQ ID NO: 971620 - protein, 19 aa, Mycobacterium
PVGEVLEIVAPVADAPLDY

SEQ ID NO: 971621 - protein, 20 aa, Mycobacterium
PVHTAWGWAVLQFELTPQDN

SEQ ID NO: 971622 - protein, 26 aa, Mycobacterium
PVHVLGHDWGSVAIWDYLTRSGAADR

SEQ ID NO: 971623 - protein, 17 aa, Mycobacterium
PVIALVVAVGYGLATDY

SEQ ID NO: 971624 - protein, 19 aa, Mycobacterium
PVLAEAFSRPFGSVDSLQR

SEQ ID NO: 971625 - protein, 20 aa, Mycobacterium
PVLEEAFSRPVGGADSLQRH

SEQ ID NO: 971626 - protein, 26 aa, Mycobacterium
PVLERHAAEMIAGFAGRGECDAMAEF

SEQ ID NO: 971627 - protein, 23 aa, Mycobacterium
PVLLGTVLAVMVWRSRGAPRPAP

SEQ ID NO: 971628 - protein, 30 aa, Mycobacterium; identical to SEQ ID NO: 323965

SEQ ID NO: 971629 - protein, 25 aa, Mycobacterium
PVLSLMVVAVWLLGVGTLKDLALVQ

SEQ ID NO: 971630 - protein, 21 aa, Mycobacterium
PVLVPRDARLNSALMLTSAFA

SEQ ID NO: 971631 - protein, 19 aa, Mycobacterium
PVLWILSLSPKPTSTVKDG

SEQ ID NO: 971632 - protein, 19 aa, Mycobacterium
PVNLRSGLITVTQNDREIA

SEQ ID NO: 971633 - protein, 19 aa, Mycobacterium
PVNTWRAAALRNRMVAGSL

SEQ ID NO: 971634 - protein, 32 aa, Mycobacterium
PVQAAALRDALAWHKVENVMLVSGFLAAAALG

SEQ ID NO: 971635 - protein, 19 aa, Mycobacterium
PVRCETRCAAIAPGSCCCG

SEQ ID NO: 971636 - protein, 30 aa, Mycobacterium; identical to SEQ ID NO: 324008

SEQ ID NO: 971637 - protein, 23 aa, Mycobacterium
PVSPSRPLPRRNLVMGLAAGLLL

SEQ ID NO: 971638 - protein, 18 aa, Mycobacterium
PVSYPGLPPAPGGYRNRR

SEQ ID NO: 971639 - protein, 26 aa, Mycobacterium
PVTVAHFLPPVLRRLSIFVPPSPSVA

SEQ ID NO: 971640 - protein, 17 aa, Mycobacterium
PVWMIFACHAIVLFYQF

SEQ ID NO: 971641 - protein, 25 aa, Mycobacterium
PVWQSLRHVDTWILALLYIGTFGSF

SEQ ID NO: 971642 - protein, 36 aa, Mycobacterium; identical to SEQ ID NO: 324047

SEQ ID NO: 971643 - protein, 24 aa, Mycobacterium
PWALFMVTVTYVWKNLGYTCVIYL

SEQ ID NO: 971644 - protein, 27 aa, Mycobacterium
PWICAPLAIAVMWRWILAPTDGAISTL

SEQ ID NO: 971645 - protein, 19 aa, Mycobacterium
PWLAESWRAKQFGGSDTRW

SEQ ID NO: 971646 - protein, 20 aa, Mycobacterium
PWLLPLRWSLVEYYYLKYYI

SEQ ID NO: 971647 - protein, 27 aa, Mycobacterium
PWPDQRPPRRGQWVAVYGLTSLLLAGL

SEQ ID NO: 971648 - protein, 17 aa, Mycobacterium
PWQLLWQLLQYLWNAYT

SEQ ID NO: 971649 - protein, 19 aa, Mycobacterium
PWQLRLRRPTIAMGSVVVL

SEQ ID NO: 971650 - protein, 20 aa, Mycobacterium
PYAEVVEIIAAVADALDYAH

SEQ ID NO: 971651 - protein, 18 aa, Mycobacterium
PYAGERWWVLLLPLATTA

SEQ ID NO: 971652 - protein, 27 aa, Mycobacterium
PYAIFLLREHFRIIPNDMINAARLDGA

SEQ ID NO: 971653 - protein, 19 aa, Mycobacterium
PYEVELCVAEVAHYGETKA

SEQ ID NO: 971654 - protein, 22 aa, Mycobacterium
PYHLRLDWLMWFAAISPGYALP

SEQ ID NO: 971655 - protein, 19 aa, Mycobacterium
PYLVCAVYLVLLAIAGLGA

SEQ ID NO: 971656 - protein, 23 aa, Mycobacterium
PYTCAAVAMYLWSRHADATGEHV

SEQ ID NO: 971657 - protein, 20 aa, Mycobacterium
QAALHAAEFAFIGPALGSLA

SEQ ID NO: 971658 - protein, 25 aa, Mycobacterium
QAANVLGSWSDFWEEFVYNFFDIFT

SEQ ID NO: 971659 - protein, 21 aa, Mycobacterium
QAARMLLWFLIALPIGAVTGG

SEQ ID NO: 971660 - protein, 24 aa, Mycobacterium
QADVTSIDEIVYWSQYQAQVLFTM

SEQ ID NO: 971661 - protein, 24 aa, Mycobacterium
QAEILWDVIPFDWANDSNTAATRY

SEQ ID NO: 971662 - protein, 25 aa, Mycobacterium
QAGERRMLCGLQLPGPNNQQTAFKG

SEQ ID NO: 971663 - protein, 24 aa, Mycobacterium
QAGLAERRRLHAAFGTYVDPALAA

SEQ ID NO: 971664 - protein, 20 aa, Mycobacterium
QAIAGARARGDNTFAELLSG

SEQ ID NO: 971665 - protein, 17 aa, Mycobacterium
QALRLSYMALFSVPVLA

SEQ ID NO: 971666 - protein, 19 aa, Mycobacterium
QALVPIHLAFAFRGMNTHG

SEQ ID NO: 971667 - protein, 27 aa, Mycobacterium
QAMLPPRRLRLLLSIAAVVLTLDIVTK

SEQ ID NO: 971668 - protein, 25 aa, Mycobacterium
QAMTELRRGRTCFVIAHRLSTIRDA

SEQ ID NO: 971669 - protein, 28 aa, Mycobacterium
QAPPVRRLPARFGMEQVRERAVRDTRQG

SEQ ID NO: 971670 - protein, 29 aa, Mycobacterium
QAPPVRRLPARFGMEQVRERAVRDTRQGV

SEQ ID NO: 971671 - protein, 21 aa, Mycobacterium
QASGSLLAWLTAAAVAIAMLT

SEQ ID NO: 971672 - protein, 19 aa, Mycobacterium
QASSILLTLALTVSIVNAM

SEQ ID NO: 971673 - protein, 22 aa, Mycobacterium
QDALGAMLWRSLWGEAAPRTQI

SEQ ID NO: 971674 - protein, 19 aa, Mycobacterium
QDEEVWLFCVQRYESTGEP

SEQ ID NO: 971675 - protein, 23 aa, Mycobacterium
QDKATDWTARFNASPLRAALTPD

SEQ ID NO: 971676 - protein, 33 aa, Mycobacterium; identical to SEQ ID NO: 324286

SEQ ID NO: 971677 - protein, 24 aa, Mycobacterium
QEAALTWLLLVSVPILALANYWIM

SEQ ID NO: 971678 - protein, 26 aa, Mycobacterium
QEGDRGVSWLPFFHDMGLITVLLASV

SEQ ID NO: 971679 - protein, 18 aa, Mycobacterium
QEIPAGINTGIIRSMGGT

SEQ ID NO: 971680 - protein, 24 aa, Mycobacterium
QELRHWLVVIALTIVGWVLAAFAM

SEQ ID NO: 971681 - protein, 21 aa, Mycobacterium
QELRIGVGINTGVIIAGTIGG

SEQ ID NO: 971682 - protein, 20 aa, Mycobacterium
QEMTVRLGIVTGKGHGALIR

SEQ ID NO: 971683 - protein, 21 aa, Mycobacterium
QEMVLRLGAVVRVGHARLIFE

SEQ ID NO: 971684 - protein, 19 aa, Mycobacterium
QEPFTVIGVAFALSLLLGV

SEQ ID NO: 971685 - protein, 21 aa, Mycobacterium
QEPRIWRLRVTVTEEDGQYKM

SEQ ID NO: 971686 - protein, 20 aa, Mycobacterium
QERRLVFERFYRSTSARAMP

SEQ ID NO: 971687 - protein, 20 aa, Mycobacterium
QFDALHFAKPIFGPAARALA

SEQ ID NO: 971688 - protein, 20 aa, Mycobacterium
QFELACGYTPEIDWPSATLG

SEQ ID NO: 971689 - protein, 31 aa, Mycobacterium; identical to SEQ ID NO: 324348

SEQ ID NO: 971690 - protein, 18 aa, Mycobacterium
QFMLRTAPFSHDSWLGNW

SEQ ID NO: 971691 - protein, 18 aa, Mycobacterium
QFRDASTMRVEVPEDPTF

SEQ ID NO: 971692 - protein, 24 aa, Mycobacterium
QFSGSRWFMFPALAAISDDVLTRP

SEQ ID NO: 971693 - protein, 23 aa, Mycobacterium
QFSRGEGQLVAILDTGVQPGPRL

SEQ ID NO: 971694 - protein, 21 aa, Mycobacterium
QFTAWDVFLGYELPQPPDVGR

SEQ ID NO: 971695 - protein, 22 aa, Mycobacterium
QFVMPDLSGMFWTDAEPRLRAL

SEQ ID NO: 971696 - protein, 31 aa, Mycobacterium; identical to SEQ ID NO: 324407

SEQ ID NO: 971697 - protein, 26 aa, Mycobacterium
QGQVGRIFVGNAFPFEGYTGGGHKQI

SEQ ID NO: 971698 - protein, 33 aa, Mycobacterium; identical to SEQ ID NO: 324418

SEQ ID NO: 971699 - protein, 17 aa, Mycobacterium
QHDKLPPSINFAGPSPY

SEQ ID NO: 971700 - protein, 21 aa, Mycobacterium
QHILGLDLNWIAPVFGVIILL

SEQ ID NO: 971701 - protein, 27 aa, Mycobacterium
QHPRLPRLDALKILSLDATDDDEFRAR

SEQ ID NO: 971702 - protein, 20 aa, Mycobacterium
QHVLAALWWAALAGAAIVAI

SEQ ID NO: 971703 - protein, 17 aa, Mycobacterium
QIAWFVPAHWGFAATAS

SEQ ID NO: 971704 - protein, 17 aa, Mycobacterium
QIMESRGGVIFAAVCAA

SEQ ID NO: 971705 - protein, 18 aa, Mycobacterium
QKAIKLLDDYTMSLGESV

SEQ ID NO: 971706 - protein, 18 aa, Mycobacterium
QKALGQRSAVLFGLAYMT

SEQ ID NO: 971707 - protein, 21 aa, Mycobacterium
QKRWTMRWKPALNVDQRNSFI

SEQ ID NO: 971708 - protein, 20 aa, Mycobacterium
QLADRKGIWQALLGSDAIYF

SEQ ID NO: 971709 - protein, 27 aa, Mycobacterium
QLGEDYLRLAALGSYGAFFNIYFCTVT

SEQ ID NO: 971710 - protein, 25 aa, Mycobacterium
QLGRSWDALCMAWRAVLAHPNEPLA

SEQ ID NO: 971711 - protein, 21 aa, Mycobacterium
QLGTRIELRLGDPADSEVDRR

SEQ ID NO: 971712 - protein, 18 aa, Mycobacterium
QLIMFGTLTVLSLLVLGV

SEQ ID NO: 971713 - protein, 25 aa, Mycobacterium
QLLGPGPKWWGVTLLVIGAFSAMYG

SEQ ID NO: 971714 - protein, 23 aa, Mycobacterium
QLLPRSGQGPSLKDGDVIPSSRT

SEQ ID NO: 971715 - protein, 24 aa, Mycobacterium
QLLVLLCGGLVGPIFLIVYFALDV

SEQ ID NO: 971716 - protein, 24 aa, Mycobacterium
QLQRITWIVTWYLLGYIAAMPLLG

SEQ ID NO: 971717 - protein, 25 aa, Mycobacterium
QLRDSFFDWDMYRQAIPTLFKTGLP

SEQ ID NO: 971718 - protein, 19 aa, Mycobacterium
QLRITRWVAAHWRVSRSLV

SEQ ID NO: 971719 - protein, 17 aa, Mycobacterium
QLVLMYLYITLRGAIAM

SEQ ID NO: 971720 - protein, 19 aa, Mycobacterium
QLVVRSGVIHGARLRFIDS

SEQ ID NO: 971721 - protein, 18 aa, Mycobacterium
QMLMGIAAIVAFALGPGL

SEQ ID NO: 971722 - protein, 19 aa, Mycobacterium
QMMKILNLLIADLIVLALD

SEQ ID NO: 971723 - protein, 23 aa, Mycobacterium
QMQRITWIVTMYLLGYIAAMPLL

SEQ ID NO: 971724 - protein, 23 aa, Mycobacterium
QNAQPGKFMPLLPTQQQAPVPPP

SEQ ID NO: 971725 - protein, 18 aa, Mycobacterium
QNRVKTLLPTSAVGLWTF

SEQ ID NO: 971726 - protein, 25 aa, Mycobacterium
QNSYCTEVGVLPGTDFKLQPKYMEM

SEQ ID NO: 971727 - protein, 18 aa, Mycobacterium
QNVGLWLLHFLQNAAGSL

SEQ ID NO: 971728 - protein, 17 aa, Mycobacterium
QNWDLFRAPTFVGLQNF

SEQ ID NO: 971729 - protein, 24 aa, Mycobacterium
QPDLRISGPLSIPSFPTSEANVPL

SEQ ID NO: 971730 - protein, 21 aa, Mycobacterium
QPFLGRWLLLTAVMFALSAAT

SEQ ID NO: 971731 - protein, 22 aa, Mycobacterium
QPPAELRQALLAAAEPAQSRRQ

SEQ ID NO: 971732 - protein, 17 aa, Mycobacterium
QPPFRLASYVTDNADAL

SEQ ID NO: 971733 - protein, 17 aa, Mycobacterium
QPPSVAFPMVWTTLYSD

SEQ ID NO: 971734 - protein, 17 aa, Mycobacterium
QPQLARGAVILFSTNLV

SEQ ID NO: 971735 - protein, 17 aa, Mycobacterium
QPSMIGQLAQWLLSLVG

SEQ ID NO: 971736 - protein, 21 aa, Mycobacterium
QPTDVSLRWGDVENELGKHRN

SEQ ID NO: 971737 - protein, 32 aa, Mycobacterium
QPTHPPTHRFPHLPPLPSVITIPGVPTTITLP

SEQ ID NO: 971738 - protein, 17 aa, Mycobacterium
QPVAVDFEHHAHLLILG

SEQ ID NO: 971739 - protein, 20 aa, Mycobacterium
QPVTPRPAAAPARPPQTTAD

SEQ ID NO: 971740 - protein, 19 aa, Mycobacterium
QQLDGRSALGYVRSRATPR

SEQ ID NO: 971741 - protein, 20 aa, Mycobacterium
QQLFWFFGHPEVYVIALPFF

SEQ ID NO: 971742 - protein, 23 aa, Mycobacterium
QQLRSVLRYDVPASIVVFLIALP

SEQ ID NO: 971743 - protein, 17 aa, Mycobacterium
QQWVPAGAIAFGLFMVT

SEQ ID NO: 971744 - protein, 23 aa, Mycobacterium
QRAKGPLVFDLGICLVLITLPTL

SEQ ID NO: 971745 - protein, 17 aa, Mycobacterium
QRALGAAVRYAAVDKNV

SEQ ID NO: 971746 - protein, 22 aa, Mycobacterium
QRFDLKSVDGRSGRAVVIAGTV

SEQ ID NO: 971747 - protein, 18 aa, Mycobacterium
QRFWRITLPMLRPTTFFV

SEQ ID NO: 971748 - protein, 22 aa, Mycobacterium
QRLTAHGALVRAPRTIEALGRV

SEQ ID NO: 971749 - protein, 19 aa, Mycobacterium
QRMKARAIADWMAIGMVGA

SEQ ID NO: 971750 - protein, 31 aa, Mycobacterium
QRNQPAALPRWRVAHSDTRCAGQPACRDAGN

SEQ ID NO: 971751 - protein, 21 aa, Mycobacterium
QRPDAPWGKPRVVYLQHASDP

SEQ ID NO: 971752 - protein, 37 aa, Mycobacterium; identical to SEQ ID NO: 324816

SEQ ID NO: 971753 - protein, 26 aa, Mycobacterium
QRPSRYRHIPAMLLALSLVLFTVAMA

SEQ ID NO: 971754 - protein, 26 aa, Mycobacterium
QRQKFFWNLLVDYWFRMEIDGWENIP

SEQ ID NO: 971755 - protein, 37 aa, Mycobacterium
QRRNPVLVFLGYFWAPIPWMIEAALVLSLAARHWTDA

SEQ ID NO: 971756 - protein, 23 aa, Mycobacterium
QRRPHGRIRAGDAAHHRAVQPPT

SEQ ID NO: 971757 - protein, 17 aa, Mycobacterium
QRSLIMRALTGHEVEPT

SEQ ID NO: 971758 - protein, 17 aa, Mycobacterium
QRSRWAAPVTLSLVLVW

SEQ ID NO: 971759 - protein, 24 aa, Mycobacterium
QRTKVWLPECFQMAQQKTGALFGV

SEQ ID NO: 971760 - protein, 25 aa, Mycobacterium
QRTVRARAFGWLWQVLAATLVAAVF

SEQ ID NO: 971761 - protein, 17 aa, Mycobacterium
QRVDILLVFGLGAFLSA

SEQ ID NO: 971762 - protein, 19 aa, Mycobacterium
QRVTVALTIINPLTYEDGE

SEQ ID NO: 971763 - protein, 20 aa, Mycobacterium
QSERPRLVVLSMSRRYQPDF

SEQ ID NO: 971764 - protein, 18 aa, Mycobacterium
QSGRLWKLTSAMTTDDRT

SEQ ID NO: 971765 - protein, 20 aa, Mycobacterium
QSILLVAGAWRIDLAIDRNM

SEQ ID NO: 971766 - protein, 21 aa, Mycobacterium
QSITHDFWPAPELVMDTGNSL

SEQ ID NO: 971767 - protein, 20 aa, Mycobacterium
QSMLLPAFIAVFGIIAALFL

SEQ ID NO: 971768 - protein, 25 aa, Mycobacterium
QSRRQPRWRTAVFASAAAIAVGLGA

SEQ ID NO: 971769 - protein, 21 aa, Mycobacterium
QSRTRGVPVIDVPVQLIVNTK

SEQ ID NO: 971770 - protein, 24 aa, Mycobacterium
QSSCIPTGCLAAAAMLDGYGHGQA

SEQ ID NO: 971771 - protein, 24 aa, Mycobacterium
QTHSSDAIAGWASHLAAVTTELQT

SEQ ID NO: 971772 - protein, 21 aa, Mycobacterium
QTLFFPFVLLLAATALFRGND

SEQ ID NO: 971773 - protein, 20 aa, Mycobacterium
QTPPAPVWWPGQPAPQPLIQ

SEQ ID NO: 971774 - protein, 17 aa, Mycobacterium
QTPSWLAPMVKSSPAML

SEQ ID NO: 971775 - protein, 21 aa, Mycobacterium
QTRFDAWLGRPMASFHLIIAV

SEQ ID NO: 971776 - protein, 17 aa, Mycobacterium
QVAPLLWAAVGGVPAVL

SEQ ID NO: 971777 - protein, 18 aa, Mycobacterium
QVDQPTDVSLRWGDVENE

SEQ ID NO: 971778 - protein, 29 aa, Mycobacterium
QVIMPSIPQSLLWISLVVLWLFVLVPMLI

SEQ ID NO: 971779 - protein, 18 aa, Mycobacterium
QVSFWKLSIVQVANTFAA

SEQ ID NO: 971780 - protein, 19 aa, Mycobacterium
QWLPLIVRIDDPWLAESWR

SEQ ID NO: 971781 - protein, 23 aa, Mycobacterium
QWLPPGAPGSHWVAEEAAGAETQ

SEQ ID NO: 971782 - protein, 20 aa, Mycobacterium
QWNNFMWPLVITSGHKWRVL

SEQ ID NO: 971783 - protein, 17 aa, Mycobacterium
QWQEFVRQGAFMAGTAV

SEQ ID NO: 971784 - protein, 22 aa, Mycobacterium
QWWTWACALVLTDLAYYGWQRM

SEQ ID NO: 971785 - protein, 24 aa, Mycobacterium
QYAPRRVAGPLAYLVDLLAAVPSI

SEQ ID NO: 971786 - protein, 21 aa, Mycobacterium
QYPPARVVLWGLFGLGWVVVF

SEQ ID NO: 971787 - protein, 26 aa, Mycobacterium
QYRVTVELPEAGGLYPRSNVTYRGVE

SEQ ID NO: 971788 - protein, 19 aa, Mycobacterium
QYVAAHLPYVAWLLQASAD

SEQ ID NO: 971789 - protein, 17 aa, Mycobacterium
RAAADAIRLSRRTLNTI

SEQ ID NO: 971790 - protein, 25 aa, Mycobacterium
RAAAMKEIQSAIGAARDAQKKGDFA

SEQ ID NO: 971791 - protein, 19 aa, Mycobacterium
RAAAQWSHPEPTALAGVPG

SEQ ID NO: 971792 - protein, 20 aa, Mycobacterium
RAAAVGLGLALLIMPLIGLW

SEQ ID NO: 971793 - protein, 23 aa, Mycobacterium
RAADAPPGWLPGWLRPVHSRRVT

SEQ ID NO: 971794 - protein, 20 aa, Mycobacterium
RAAGFAYPFMAFHVAGRGFA

SEQ ID NO: 971795 - protein, 24 aa, Mycobacterium
RAAMHRIGPILGWTLVATTVGLIL

SEQ ID NO: 971796 - protein, 24 aa, Mycobacterium
RAAQLKREALALAEDEEYDEYEDD

SEQ ID NO: 971797 - protein, 26 aa, Mycobacterium
RAAQVWLRPRSWLLRRTTTEATVVVE

SEQ ID NO: 971798 - protein, 23 aa, Mycobacterium
RAARQGRLQISLNLAYGSAMASI

SEQ ID NO: 971799 - protein, 24 aa, Mycobacterium
RAATPRECRDPKPYVPAGTNPWYG

SEQ ID NO: 971800 - protein, 21 aa, Mycobacterium
RADAWGRKPIFLVAFAVLTAC

SEQ ID NO: 971801 - protein, 21 aa, Mycobacterium
RAEAIAGLVMSAGWVAVLFAL

SEQ ID NO: 971802 - protein, 21 aa, Mycobacterium
RAEDLRRALDDSGVLDVAVLS

SEQ ID NO: 971803 - protein, 30 aa, Mycobacterium; identical to SEQ ID NO: 325120

SEQ ID NO: 971804 - protein, 30 aa, Mycobacterium
RAENPAVWLNPWRWYSVPRAAAAALTVDQG

SEQ ID NO: 971805 - protein, 19 aa, Mycobacterium
RAFSDGRLVLLFASSLATL

SEQ ID NO: 971806 - protein, 20 aa, Mycobacterium
RAGAIALAVVAALAVLVTAF

SEQ ID NO: 971807 - protein, 17 aa, Mycobacterium
RAGGPALALRFLALTAG

SEQ ID NO: 971808 - protein, 22 aa, Mycobacterium
RAGLGGICLVLAVGLVGMLVVG

SEQ ID NO: 971809 - protein, 26 aa, Mycobacterium
RAGVGFIPFVIAMGIGLGVSSQLVSR

SEQ ID NO: 971810 - protein, 19 aa, Mycobacterium
RAGVTVVHCSTTPPHREQY

SEQ ID NO: 971811 - protein, 19 aa, Mycobacterium
RAGYGMPGDHGSVFEDLTA

SEQ ID NO: 971812 - protein, 17 aa, Mycobacterium
RAIAAKLGLQVRFVGTD

SEQ ID NO: 971813 - protein, 25 aa, Mycobacterium
RAIDRLGPELSVREIAEEAGTAKPK

SEQ ID NO: 971814 - protein, 18 aa, Mycobacterium
RAITPPKGLEIFVGGTPA

SEQ ID NO: 971815 - protein, 20 aa, Mycobacterium
RALEYLKITYGWSLLLIVTF

SEQ ID NO: 971816 - protein, 27 aa, Mycobacterium
RALFNRLRPTLPIVLANLVSVGEVAVA

SEQ ID NO: 971817 - protein, 17 aa, Mycobacterium
RALGVGMPLTMIGIAVP

SEQ ID NO: 971818 - protein, 17 aa, Mycobacterium
RALLTLLPDSLRWLVTV

SEQ ID NO: 971819 - protein, 17 aa, Mycobacterium
RALLTLLPGSLRWLVTV

SEQ ID NO: 971820 - protein, 25 aa, Mycobacterium
RALPAESYTPWITRVLAALIDFAPY

SEQ ID NO: 971821 - protein, 18 aa, Mycobacterium
RALTKPRFRGWIHVYSAG

SEQ ID NO: 971822 - protein, 19 aa, Mycobacterium
RAMGVLIIIVMVSWLLLAV

SEQ ID NO: 971823 - protein, 22 aa, Mycobacterium
RAMPYMIVILIVGMIIAMVATG

SEQ ID NO: 971824 - protein, 27 aa, Mycobacterium
RAMVLRLAAWAVWDFRGARGAIQTTLD

SEQ ID NO: 971825 - protein, 19 aa, Mycobacterium
RANWLPTFIALIVLSCVAA

SEQ ID NO: 971826 - protein, 25 aa, Mycobacterium
RAPAAPWFIGAAMGLQVLGTFSVGQ

SEQ ID NO: 971827 - protein, 23 aa, Mycobacterium
RAPALLISRLVSWVDDLWCRAIG

SEQ ID NO: 971828 - protein, 28 aa, Mycobacterium
RAPLGLTPPRLWAGLRLGAVAAAPVATA

SEQ ID NO: 971829 - protein, 31 aa, Mycobacterium; identical to SEQ ID NO: 325263

SEQ ID NO: 971830 - protein, 17 aa, Mycobacterium
RAQAELMHAKHDSAPAP

SEQ ID NO: 971831 - protein, 26 aa, Mycobacterium
RAQAGGLPPLFAGVVRRPRRRQIEDT

SEQ ID NO: 971832 - protein, 18 aa, Mycobacterium
RAQFMLMLDMLRETAQES

SEQ ID NO: 971833 - protein, 24 aa, Mycobacterium
RAQIPMYLGYAFRAMNTHGRALFT

SEQ ID NO: 971834 - protein, 23 aa, Mycobacterium
RAQRLCRPVFWYLAAWTGALVVV

SEQ ID NO: 971835 - protein, 24 aa, Mycobacterium
RARGQCQTIALAIGDRQGVSRLIQ

SEQ ID NO: 971836 - protein, 21 aa, Mycobacterium
RARRKSLAPPKCHRAERRAKR

SEQ ID NO: 971837 - protein, 18 aa, Mycobacterium
RARRPALIALVIIAASGC

SEQ ID NO: 971838 - protein, 22 aa, Mycobacterium
RARSTGKMVFVFPGQGAQYLGM

SEQ ID NO: 971839 - protein, 19 aa, Mycobacterium
RARTVQKLLLAGADPEALA

SEQ ID NO: 971840 - protein, 20 aa, Mycobacterium
RASLREMLIPLVPAAVIALA

SEQ ID NO: 971841 - protein, 38 aa, Mycobacterium
RATLPRLRYDQFMALGWKLLIPVSLVWVLIAAVIRTLR

SEQ ID NO: 971842 - protein, 26 aa, Mycobacterium
RATRARPGRRGVPVELVASAAMVLRA

SEQ ID NO: 971843 - protein, 17 aa, Mycobacterium
RATVYGLVVLILATAIA

SEQ ID NO: 971844 - protein, 19 aa, Mycobacterium
RAVIRYDDLIGGRYLALEE

SEQ ID NO: 971845 - protein, 19 aa, Mycobacterium
RAVPWRPKLLPVEDRRSIM

SEQ ID NO: 971846 - protein, 20 aa, Mycobacterium
RAVVPLTVLGAIFGAGLVVA

SEQ ID NO: 971847 - protein, 19 aa, Mycobacterium
RAWHAGLLLAGQRFNRDAA

SEQ ID NO: 971848 - protein, 17 aa, Mycobacterium
RDAPAMQAIHRIGAVFK

SEQ ID NO: 971849 - protein, 26 aa, Mycobacterium
RDDELRVPIGITAGGEPLMFDLKDEA

SEQ ID NO: 971850 - protein, 18 aa, Mycobacterium
RDDFAYLVDFGIASATGD

SEQ ID NO: 971851 - protein, 24 aa, Mycobacterium
RDEGTALMSWCIVAAQVVMVPVAY

SEQ ID NO: 971852 - protein, 17 aa, Mycobacterium
RDFCLRVADRIVLVTGD

SEQ ID NO: 971853 - protein, 17 aa, Mycobacterium
RDHTVDGVVLFPGAGFV

SEQ ID NO: 971854 - protein, 20 aa, Mycobacterium
RDNGVRRIVMLTGDHPDIAK

SEQ ID NO: 971855 - protein, 19 aa, Mycobacterium
RDRTGHIVAVFKAPDGKTV

SEQ ID NO: 971856 - protein, 22 aa, Mycobacterium
RDSELTVAFILGVLLIGTPGWQ

SEQ ID NO: 971857 - protein, 31 aa, Mycobacterium; identical to SEQ ID NO: 325509

SEQ ID NO: 971858 - protein, 18 aa, Mycobacterium
RDVGPWFRLASVGVDSAA

SEQ ID NO: 971859 - protein, 18 aa, Mycobacterium
RDYPDLRVEVAQREADEA

SEQ ID NO: 971860 - protein, 18 aa, Mycobacterium
REAIKGTPLQGAAIYLGD

SEQ ID NO: 971861 - protein, 31 aa, Mycobacterium; identical to SEQ ID NO: 325534

SEQ ID NO: 971862 - protein, 21 aa, Mycobacterium
REATDLAALVRAAATQVLPDA

SEQ ID NO: 971863 - protein, 17 aa, Mycobacterium
REDLPPRVVIDCQLGSG

SEQ ID NO: 971864 - protein, 27 aa, Mycobacterium
REGSQFGPYRLRRIVGRGAMGDVYEAE

SEQ ID NO: 971865 - protein, 19 aa, Mycobacterium
REIARGSTLISVTQQVGGS

SEQ ID NO: 971866 - protein, 21 aa, Mycobacterium
REITRPVLDYVKRVSKESPRT

SEQ ID NO: 971867 - protein, 17 aa, Mycobacterium
RELEKRLGPEGTDVLFG

SEQ ID NO: 971868 - protein, 17 aa, Mycobacterium
RELFDRVTGWSMLEVSR

SEQ ID NO: 971869 - protein, 24 aa, Mycobacterium
RELGVMPLFPAMLMVWGTARTTAL

SEQ ID NO: 971870 - protein, 21 aa, Mycobacterium
RELLRLPRIERIVQVELDPAV

SEQ ID NO: 971871 - protein, 18 aa, Mycobacterium
RELLRVVLEAVGDRARVI

SEQ ID NO: 971872 - protein, 21 aa, Mycobacterium
RELMGRAGSVADLLAAESSLT

SEQ ID NO: 971873 - protein, 20 aa, Mycobacterium
RELPTLAPGQEWRMVWDSAL

SEQ ID NO: 971874 - protein, 19 aa, Mycobacterium
RELWIGAVIASLVVGVIVW

SEQ ID NO: 971875 - protein, 18 aa, Mycobacterium
RENLKTVVDEAAVAVGGL

SEQ ID NO: 971876 - protein, 19 aa, Mycobacterium
REPPATMLVGMAVAALGCV

SEQ ID NO: 971877 - protein, 21 aa, Mycobacterium
REPWFRRYATTYLLFAPISLG

SEQ ID NO: 971878 - protein, 27 aa, Mycobacterium
RERKRMSWQRWALLCVGIAQVAVGIVQ

SEQ ID NO: 971879 - protein, 19 aa, Mycobacterium
RERLSVLIAVVLGVLVVCA

SEQ ID NO: 971880 - protein, 20 aa, Mycobacterium
REVLPRLGPAVAASKPANWA

SEQ ID NO: 971881 - protein, 25 aa, Mycobacterium
REVVELRRCVHPLSVAFGRMQTDNK

SEQ ID NO: 971882 - protein, 19 aa, Mycobacterium
REYIAQAWFVARVSLLPTL

SEQ ID NO: 971883 - protein, 21 aa, Mycobacterium
RFAALTWPIAIAVSPALTYGV

SEQ ID NO: 971884 - protein, 24 aa, Mycobacterium
RFDDAEFRSTIGFFAEDAHIFATT

SEQ ID NO: 971885 - protein, 21 aa, Mycobacterium
RFDLKSVDGRSGRAVVIAGTV

SEQ ID NO: 971886 - protein, 23 aa, Mycobacterium
RFDRACALSQLPDAVIAALIGVD

SEQ ID NO: 971887 - protein, 24 aa, Mycobacterium
RFDRAKAYWTRQGWAARAPIKTES

SEQ ID NO: 971888 - protein, 18 aa, Mycobacterium
RFGFLITALCLFTAVFIM

SEQ ID NO: 971889 - protein, 18 aa, Mycobacterium
RFGGLPVITPALVRSVHA

SEQ ID NO: 971890 - protein, 25 aa, Mycobacterium
RFIREADVAAALWHPNIVRVNDRGE

SEQ ID NO: 971891 - protein, 26 aa, Mycobacterium
RFQLGITGMSCFACARKVQSTLNKVP

SEQ ID NO: 971892 - protein, 21 aa, Mycobacterium
RFSVDEIPQFINVVKRDMSVV

SEQ ID NO: 971893 - protein, 24 aa, Mycobacterium
RFTGWEWVLTALALPVVTWAAWPF

SEQ ID NO: 971894 - protein, 19 aa, Mycobacterium
RFTPVVWGVLIGFVALYLL

SEQ ID NO: 971895 - protein, 23 aa, Mycobacterium
RFVACPFGGVGERMYRTGDLVCW

SEQ ID NO: 971896 - protein, 17 aa, Mycobacterium
RGAIAMVTLVADFLNKV

SEQ ID NO: 971897 - protein, 19 aa, Mycobacterium
RGAPTVPWVLSARSAPALA

SEQ ID NO: 971898 - protein, 26 aa, Mycobacterium
RGAVPSMPRWLFVVLAFGGLTAALAG

SEQ ID NO: 971899 - protein, 18 aa, Mycobacterium
RGAVSLAAALAVPMTTHS

SEQ ID NO: 971900 - protein, 21 aa, Mycobacterium
RGDVFGLRRWYVITFLMGLFF

SEQ ID NO: 971901 - protein, 18 aa, Mycobacterium
RGGTAFFLDKCFGTAIGG

SEQ ID NO: 971902 - protein, 19 aa, Mycobacterium
RGIGNGMSLLIFVGIAARI

SEQ ID NO: 971903 - protein, 19 aa, Mycobacterium
RGLARTGFRGTLVQTTSLV

SEQ ID NO: 971904 - protein, 19 aa, Mycobacterium
RGLEAHLSYRVCLKTLSAI

SEQ ID NO: 971905 - protein, 17 aa, Mycobacterium
RGLLHWQSIPSTWDAVW

SEQ ID NO: 971906 - protein, 25 aa, Mycobacterium
RGLPRGAAVSLVLLGGFSILGGILT

SEQ ID NO: 971907 - protein, 26 aa, Mycobacterium
RGLRRPWLYFVSSLFTSFAFALGFYF

SEQ ID NO: 971908 - protein, 17 aa, Mycobacterium
RGMEVIDLLAAAITVTL

SEQ ID NO: 971909 - protein, 19 aa, Mycobacterium
RGPIHLRFAATVAGLTVQQ

SEQ ID NO: 971910 - protein, 25 aa, Mycobacterium
RGPMPPHAVAAVLRPVLGGLATAHR

SEQ ID NO: 971911 - protein, 20 aa, Mycobacterium
RGQIGEWIITRGLRIVMVLI

SEQ ID NO: 971912 - protein, 35 aa, Mycobacterium; identical to SEQ ID NO: 325949

SEQ ID NO: 971913 - protein, 20 aa, Mycobacterium
RGRALGMVAFMAYFYSLYLR

SEQ ID NO: 971914 - protein, 28 aa, Mycobacterium
RGRLPLLCCLVAFILTFFVTRTFVRVIR

SEQ ID NO: 971915 - protein, 24 aa, Mycobacterium
RGSSSPNRTYGWHRAEVFTAVANA

SEQ ID NO: 971916 - protein, 17 aa, Mycobacterium
RGTEISTALVIPKFTVI

SEQ ID NO: 971917 - protein, 22 aa, Mycobacterium
RGTPTLALLFIAVGLRFIATTL

SEQ ID NO: 971918 - protein, 19 aa, Mycobacterium
RGTQNFGLLILRVGLGAVL

SEQ ID NO: 971919 - protein, 20 aa, Mycobacterium
RGVAVSFWLVAPLVAAESIR

SEQ ID NO: 971920 - protein, 17 aa, Mycobacterium
RGVEIIARRGPRGDEYD

SEQ ID NO: 971921 - protein, 19 aa, Mycobacterium
RGVFGGDLFSSALINSIGI

SEQ ID NO: 971922 - protein, 24 aa, Mycobacterium
RGVGVCGGRVRGRVRIVRPETIDE

SEQ ID NO: 971923 - protein, 17 aa, Mycobacterium
RGWLAILSLRLIPAVPF

SEQ ID NO: 971924 - protein, 28 aa, Mycobacterium
RGYDVLPQTRWIPLVTFLQVSADMAVAV

SEQ ID NO: 971925 - protein, 24 aa, Mycobacterium
RHEACEKPGGLAPVMMQQTFSTSD

SEQ ID NO: 971926 - protein, 21 aa, Mycobacterium
RHELADPLTPILAVGAAASAI

SEQ ID NO: 971927 - protein, 19 aa, Mycobacterium
RHHIYRGAIGLALVAALIA

SEQ ID NO: 971928 - protein, 30 aa, Mycobacterium; identical to SEQ ID NO: 326049

SEQ ID NO: 971929 - protein, 30 aa, Mycobacterium
RHPHGAAGAGRTRHPALAALAAVAAGGGVV

SEQ ID NO: 971930 - protein, 25 aa, Mycobacterium
RHPNYFGEFGFWFALALFGVSASPS

SEQ ID NO: 971931 - protein, 20 aa, Mycobacterium
RHVANGKVAAAVACEVKDKA

SEQ ID NO: 971932 - protein, 24 aa, Mycobacterium
RIALGSLRNKLVFILPGAMLLSQF

SEQ ID NO: 971933 - protein, 20 aa, Mycobacterium
RIALPLLVYFAVMWGGGYLL

SEQ ID NO: 971934 - protein, 21 aa, Mycobacterium
RIALRGRRDPVPVAGQRSRTS

SEQ ID NO: 971935 - protein, 25 aa, Mycobacterium
RIAQLSWPIAIAVGPPLTYGVIALA

SEQ ID NO: 971936 - protein, 18 aa, Mycobacterium
RIARALRSRGHVVAMTGD

SEQ ID NO: 971937 - protein, 18 aa, Mycobacterium
RIARLAGLAGALGLLAVT

SEQ ID NO: 971938 - protein, 17 aa, Mycobacterium
RIDDPWLAESWRAKQFG

SEQ ID NO: 971939 - protein, 25 aa, Mycobacterium
RIEGPPGLRRAVGRVVRLEPTKNAQ

SEQ ID NO: 971940 - protein, 24 aa, Mycobacterium
RIFDPKVFVVSFVFNVLVAALIVY

SEQ ID NO: 971941 - protein, 19 aa, Mycobacterium
RIGLTVLAWWFDWLPHHGL

SEQ ID NO: 971942 - protein, 36 aa, Mycobacterium; identical to SEQ ID NO: 160134

SEQ ID NO: 971943 - protein, 17 aa, Mycobacterium
RINRVPLYELVRCGLEV

SEQ ID NO: 971944 - protein, 28 aa, Mycobacterium
RIPLPGSAPKPVWLGAFAHPERDKRVAA

SEQ ID NO: 971945 - protein, 24 aa, Mycobacterium
RIPVDEWAVVLALALRAFPMLIDE

SEQ ID NO: 971946 - protein, 18 aa, Mycobacterium
RIQEARAALLRVDPAADV

SEQ ID NO: 971947 - protein, 22 aa, Mycobacterium
RIREATRLSGPDIYRNLQPVTR

SEQ ID NO: 971948 - protein, 31 aa, Mycobacterium; identical to SEQ ID NO: 326203

SEQ ID NO: 971949 - protein, 19 aa, Mycobacterium
RISAVFVPVVFAIAGVAGV

SEQ ID NO: 971950 - protein, 17 aa, Mycobacterium
RITDIFFGLPLLLAAIV

SEQ ID NO: 971951 - protein, 17 aa, Mycobacterium
RITSEYFIGPKSIRVWL

SEQ ID NO: 971952 - protein, 27 aa, Mycobacterium
RIVDTSLRFGVLCRFTADVASELRDGR

SEQ ID NO: 971953 - protein, 17 aa, Mycobacterium
RIYPEMRKLVQAHVARG

SEQ ID NO: 971954 - protein, 18 aa, Mycobacterium
RKAALELCAGQSADLAFE

SEQ ID NO: 971955 - protein, 20 aa, Mycobacterium
RKEFGRALSKLNLVVSNLNE

SEQ ID NO: 971956 - protein, 17 aa, Mycobacterium
RKEGWGLAVVEAAQHGV

SEQ ID NO: 971957 - protein, 24 aa, Mycobacterium
RKETIRLVAEMTLGAGALVMIGGT

SEQ ID NO: 971958 - protein, 19 aa, Mycobacterium
RKGIARGKSVVALAFAGGV

SEQ ID NO: 971959 - protein, 17 aa, Mycobacterium
RKIKIGMWRQANVAKVG

SEQ ID NO: 971960 - protein, 24 aa, Mycobacterium
RKKRPDLERGFRAPWVPVLPIASL

SEQ ID NO: 971961 - protein, 22 aa, Mycobacterium
RKLEAFATFNIFYQAGILLGPL

SEQ ID NO: 971962 - protein, 19 aa, Mycobacterium
RKLLISSLLLNWVAGPALM

SEQ ID NO: 971963 - protein, 28 aa, Mycobacterium
RKQSWLGRFVSTYGWRAYALPVLMVLTV

SEQ ID NO: 971964 - protein, 19 aa, Mycobacterium
RKRRLRRILIGSVVAILLV

SEQ ID NO: 971965 - protein, 17 aa, Mycobacterium
RKRRRAMAFYKGCVRRQ

SEQ ID NO: 971966 - protein, 28 aa, Mycobacterium
RKRRSRRDPLSIFLILVIVFSLVLAGVI

SEQ ID NO: 971967 - protein, 21 aa, Mycobacterium
RKRYLWLVGLVLPTALPASLA

SEQ ID NO: 971968 - protein, 18 aa, Mycobacterium
RKSREIGLQRQLSRITRR

SEQ ID NO: 971969 - protein, 26 aa, Mycobacterium
RKYAFRKRMLVAMAVVLVGSAIAAFE

SEQ ID NO: 971970 - protein, 25 aa, Mycobacterium
RKYAFRKRVLMVMAIILVGSAAAAF

SEQ ID NO: 971971 - protein, 23 aa, Mycobacterium
RLAESTAGPGARVVPLHLADSAL

SEQ ID NO: 971972 - protein, 18 aa, Mycobacterium
RLAFGLGAIFGIFVLLVR

SEQ ID NO: 971973 - protein, 18 aa, Mycobacterium
RLAGPEGVNGEFDTPIDP

SEQ ID NO: 971974 - protein, 18 aa, Mycobacterium
RLAPGVPGGTIPVRLIDD

SEQ ID NO: 971975 - protein, 17 aa, Mycobacterium
RLARVPWGLLALPTAGP

SEQ ID NO: 971976 - protein, 25 aa, Mycobacterium
RLASGMPREAAIPFSSERQYMATLH

SEQ ID NO: 971977 - protein, 23 aa, Mycobacterium
RLATPRSVLIAAIVSLMIGAAAG

SEQ ID NO: 971978 - protein, 20 aa, Mycobacterium
RLAVIRRGVIPASWGGKLKT

SEQ ID NO: 971979 - protein, 25 aa, Mycobacterium
RLDFPGKRLLVGVTLLITMFPAISL

SEQ ID NO: 971980 - protein, 34 aa, Mycobacterium; identical to SEQ ID NO: 326403

SEQ ID NO: 971981 - protein, 26 aa, Mycobacterium
RLDRRLDEAAGFAIPFVPRGLDEIPR

SEQ ID NO: 971982 - protein, 24 aa, Mycobacterium
RLEFPGRDGLFWVYIATLMVPATV

SEQ ID NO: 971983 - protein, 22 aa, Mycobacterium
RLELWRSDMVRMLSYGETDARV

SEQ ID NO: 971984 - protein, 24 aa, Mycobacterium
RLETRLMMVLGVGFGLGVALTLSR

SEQ ID NO: 971985 - protein, 23 aa, Mycobacterium
RLGATPLPVWGIIAGKSLAVVAV

SEQ ID NO: 971986 - protein, 20 aa, Mycobacterium
RLGELSVIYRDAWADAARRG

SEQ ID NO: 971987 - protein, 17 aa, Mycobacterium
RLGFLIAGVCLCYYLGG

SEQ ID NO: 971988 - protein, 19 aa, Mycobacterium
RLGGGTATVMFSRDRNAGV

SEQ ID NO: 971989 - protein, 23 aa, Mycobacterium
RLGKLHFWLTFIGFHTTFLVQHW

SEQ ID NO: 971990 - protein, 17 aa, Mycobacterium
RLHAAASPAIWAAQEQP

SEQ ID NO: 971991 - protein, 23 aa, Mycobacterium
RLIANRLADRGYRAHELAVSHAF

SEQ ID NO: 971992 - protein, 20 aa, Mycobacterium
RLIATGGMGQVWEAVDSRLG

SEQ ID NO: 971993 - protein, 19 aa, Mycobacterium
RLIGPRVAVVFVAVALLAF

SEQ ID NO: 971994 - protein, 23 aa, Mycobacterium
RLIRWKDAIIALGLLASLDDADL

SEQ ID NO: 971995 - protein, 19 aa, Mycobacterium
RLISSLCGFLLTLTVSRVI

SEQ ID NO: 971996 - protein, 21 aa, Mycobacterium
RLKEMIKVRGFQVAPTEIEAV

SEQ ID NO: 971997 - protein, 24 aa, Mycobacterium
RLKTFLLLVGMSAMIVFFGALFGR

SEQ ID NO: 971998 - protein, 25 aa, Mycobacterium
RLLAPLRFALILSGVLQVVATLVQL

SEQ ID NO: 971999 - protein, 24 aa, Mycobacterium
RLLEKGSSVSGGWFTITVLVILLV

SEQ ID NO: 972000 - protein, 18 aa, Mycobacterium
RLLKRGGPATGHRSDHNW

SEQ ID NO: 972001 - protein, 25 aa, Mycobacterium
RLLKRGGPATGHRSDHNWELDEDWR

SEQ ID NO: 972002 - protein, 21 aa, Mycobacterium
RLLLELATLVGAEFINVFELI

SEQ ID NO: 972003 - protein, 25 aa, Mycobacterium
RLLRVTRWDVGLAMIVAGGVNAAML

SEQ ID NO: 972004 - protein, 20 aa, Mycobacterium
RLLTAMICHLAVFHPPDLLQ

SEQ ID NO: 972005 - protein, 31 aa, Mycobacterium; identical to SEQ ID NO: 326518

SEQ ID NO: 972006 - protein, 17 aa, Mycobacterium
RLMGVIFGTMFFLMFTP

SEQ ID NO: 972007 - protein, 30 aa, Mycobacterium; identical to SEQ ID NO: 326560

SEQ ID NO: 972008 - protein, 18 aa, Mycobacterium
RLQLGRPAVLVVRCTMVV

SEQ ID NO: 972009 - protein, 27 aa, Mycobacterium
RLRAESRLNRLLALQIPPARKVVTGQD

SEQ ID NO: 972010 - protein, 18 aa, Mycobacterium
RLRHRGMDEAGYMPDEPG

SEQ ID NO: 972011 - protein, 19 aa, Mycobacterium
RLRITRLTRVLAVTGAVAC

SEQ ID NO: 972012 - protein, 25 aa, Mycobacterium
RLRRPAQLGGLVFVSAFTVVTLGMP

SEQ ID NO: 972013 - protein, 18 aa, Mycobacterium
RLRVAQVHPGPGFSDHDV

SEQ ID NO: 972014 - protein, 30 aa, Mycobacterium; identical to SEQ ID NO: 723405

SEQ ID NO: 972015 - protein, 19 aa, Mycobacterium
RLTDRARRASGYLSVLLIA

SEQ ID NO: 972016 - protein, 21 aa, Mycobacterium
RLTIFQPYSWVAAAAVLVLLA

SEQ ID NO: 972017 - protein, 18 aa, Mycobacterium
RLVDGLRSLPAVPHPRVL

SEQ ID NO: 972018 - protein, 21 aa, Mycobacterium
RLVDGLSPWLLLGVAAALVAV

SEQ ID NO: 972019 - protein, 19 aa, Mycobacterium
RLVHLSSFVVNADVTVPQV

SEQ ID NO: 972020 - protein, 27 aa, Mycobacterium
RLVMRAGEPRLSAWVRYHSDERLPKEL

SEQ ID NO: 972021 - protein, 25 aa, Mycobacterium
RLVTLCPAVAILALGLDPTRTLVLS

SEQ ID NO: 972022 - protein, 17 aa, Mycobacterium
RLVVLSMSRRYQPDFSF

SEQ ID NO: 972023 - protein, 18 aa, Mycobacterium
RLVVPRFAAAIMIGVALT

SEQ ID NO: 972024 - protein, 20 aa, Mycobacterium
RMAPFHHHFELVGWAETTVI

SEQ ID NO: 972025 - protein, 24 aa, Mycobacterium
RMELSLVISEWLCRIPQFELACGY

SEQ ID NO: 972026 - protein, 17 aa, Mycobacterium
RMPPWWSTRATPITYWP

SEQ ID NO: 972027 - protein, 23 aa, Mycobacterium
RMQAEFPSMIAVATSMRGTLLIL

SEQ ID NO: 972028 - protein, 17 aa, Mycobacterium
RMRAEAFDLVLQTGAAG

SEQ ID NO: 972029 - protein, 19 aa, Mycobacterium
RMYSLHILLLPGIILALIG

SEQ ID NO: 972030 - protein, 23 aa, Mycobacterium
RNADYRLGWYVIIGTIPICVLGL

SEQ ID NO: 972031 - protein, 28 aa, Mycobacterium
RNAFLAPWRLALVPVVSWTIGSALFAVL

SEQ ID NO: 972032 - protein, 19 aa, Mycobacterium
RNAYWPAEYLIDASGTVRH

SEQ ID NO: 972033 - protein, 22 aa, Mycobacterium
RNIGVVLERVFRGVTVVAGVLA

SEQ ID NO: 972034 - protein, 26 aa, Mycobacterium
RNLEECDRGLRLLGLVALEDPPREGI

SEQ ID NO: 972035 - protein, 17 aa, Mycobacterium
RNLIIFVVSVVILVTVL

SEQ ID NO: 972036 - protein, 20 aa, Mycobacterium
RNLTWLVLNAHIAFSVWYLW

SEQ ID NO: 972037 - protein, 25 aa, Mycobacterium
RNLVVPRLLAAMVIGVALCGVVCFV

SEQ ID NO: 972038 - protein, 22 aa, Mycobacterium
RNRIFERLVRLDAARTRDHGGA

SEQ ID NO: 972039 - protein, 22 aa, Mycobacterium
RNRVGAEWLFTPVLLSQNYHLV

SEQ ID NO: 972040 - protein, 18 aa, Mycobacterium
RNWLRARTAAATGSADSE

SEQ ID NO: 972041 - protein, 17 aa, Mycobacterium
RPADFVVGSPIQVVDRV

SEQ ID NO: 972042 - protein, 25 aa, Mycobacterium
RPAFLRPVLAPGYGRFARAVQSPTA

SEQ ID NO: 972043 - protein, 20 aa, Mycobacterium
RPASQMLRPSGPRSLVRALL

SEQ ID NO: 972044 - protein, 24 aa, Mycobacterium
RPATVIRHYLGYGVAVATMGALLG

SEQ ID NO: 972045 - protein, 19 aa, Mycobacterium
RPAVLVVRCTMVVTAFALA

SEQ ID NO: 972046 - protein, 22 aa, Mycobacterium
RPDEELRAWPSPNTEPDGEIGE

SEQ ID NO: 972047 - protein, 27 aa, Mycobacterium
RPDQPRGWRFWHRPRRQLQTQVVLDWE

SEQ ID NO: 972048 - protein, 23 aa, Mycobacterium
RPDRTRWLYFAVIGAVILGVIAG

SEQ ID NO: 972049 - protein, 19 aa, Mycobacterium
RPDVFTIRVGNIVPGQRVT

SEQ ID NO: 972050 - protein, 20 aa, Mycobacterium
RPEGIIALGSLVTYVLIERS

SEQ ID NO: 972051 - protein, 31 aa, Mycobacterium; identical to SEQ ID NO: 326890

SEQ ID NO: 972052 - protein, 17 aa, Mycobacterium
RPFALLASIMGSIFIIG

SEQ ID NO: 972053 - protein, 34 aa, Mycobacterium; identical to SEQ ID NO: 326934

SEQ ID NO: 972054 - protein, 27 aa, Mycobacterium
RPIRNYLHWERHCFDIPICASLRSLFD

SEQ ID NO: 972055 - protein, 17 aa, Mycobacterium
RPLAYAGVFVFAIAGWL

SEQ ID NO: 972056 - protein, 17 aa, Mycobacterium
RPLGAIVDLLAAVPSII

SEQ ID NO: 972057 - protein, 25 aa, Mycobacterium
RPLSGKLAALWRGTLVVLQSILAVV

SEQ ID NO: 972058 - protein, 22 aa, Mycobacterium
RPMPLPPGRAVLVTWAGDERLV

SEQ ID NO: 972059 - protein, 20 aa, Mycobacterium
RPNWSELPIARPAGRRPSTN

SEQ ID NO: 972060 - protein, 20 aa, Mycobacterium
RPNWTLLRKTVRDLRRRPAQ

SEQ ID NO: 972061 - protein, 20 aa, Mycobacterium
RPPSPIACRLIDALEFSASA

SEQ ID NO: 972062 - protein, 21 aa, Mycobacterium
RPRPTGLAFLGGWVLGLIAVT

SEQ ID NO: 972063 - protein, 20 aa, Mycobacterium
RPRYINLVVLLRIVCEITAT

SEQ ID NO: 972064 - protein, 25 aa, Mycobacterium
RPSAARPGIPAGFDNVIARGMAKDP

SEQ ID NO: 972065 - protein, 20 aa, Mycobacterium
RPVAGFPLLHVEKPQYLGAQ

SEQ ID NO: 972066 - protein, 21 aa, Mycobacterium
RPVGTRCCWSLSSATTSPPGA

SEQ ID NO: 972067 - protein, 17 aa, Mycobacterium
RPVHPVTVWRGRLSIAL

SEQ ID NO: 972068 - protein, 17 aa, Mycobacterium
RPWNIKPGDVMPATYIG

SEQ ID NO: 972069 - protein, 19 aa, Mycobacterium
RPWYLAWAGLVYVVATLAT

SEQ ID NO: 972070 - protein, 25 aa, Mycobacterium
RQDALVGLVCLQAAAVLGRPSPEDI

SEQ ID NO: 972071 - protein, 22 aa, Mycobacterium
RQDTIRWVALAALVAIGLGLIF

SEQ ID NO: 972072 - protein, 20 aa, Mycobacterium
RQELYADPIIAYRHTSYQEI

SEQ ID NO: 972073 - protein, 25 aa, Mycobacterium
RQFKSCITFRPWSRCWRPVRCETRC

SEQ ID NO: 972074 - protein, 18 aa, Mycobacterium
RQHGSLMRLFAMQVPGQL

SEQ ID NO: 972075 - protein, 35 aa, Mycobacterium
RQHISLRPLWGIDDRLKRFGAMAAAMVLYVLVSQL

SEQ ID NO: 972076 - protein, 20 aa, Mycobacterium
RQLAGMSYVWWALAVIVVAG

SEQ ID NO: 972077 - protein, 25 aa, Mycobacterium
RQLDEYIKFLVTWQRPLVGKKTMMD

SEQ ID NO: 972078 - protein, 26 aa, Mycobacterium
RQLLARGGIALVVVLLVTSWLLAKSM

SEQ ID NO: 972079 - protein, 20 aa, Mycobacterium
RQLMIGAGLVTLVVAALLLV

SEQ ID NO: 972080 - protein, 19 aa, Mycobacterium
RQLYLDILADWPVDELPKA

SEQ ID NO: 972081 - protein, 28 aa, Mycobacterium
RQMRLIISDRGYFIFLAILPFVMGSLSM

SEQ ID NO: 972082 - protein, 17 aa, Mycobacterium
RQPDVVLRIAAAVESGS

SEQ ID NO: 972083 - protein, 22 aa, Mycobacterium
RQPGEATFYWLTLTLAAVWALG

SEQ ID NO: 972084 - protein, 19 aa, Mycobacterium
RQRCITSWAGFRGAVSLAA

SEQ ID NO: 972085 - protein, 17 aa, Mycobacterium
RQRTAMVSAEYLESMLA

SEQ ID NO: 972086 - protein, 19 aa, Mycobacterium
RQRYLKPRGLFLANTSHGD

SEQ ID NO: 972087 - protein, 17 aa, Mycobacterium
RQSHIALVGALMVAALA

SEQ ID NO: 972088 - protein, 17 aa, Mycobacterium
RQTRIEAKVRRRRMQRQ

SEQ ID NO: 972089 - protein, 22 aa, Mycobacterium
RQVCAHCGAMIEAEAAFCQVCG

SEQ ID NO: 972090 - protein, 19 aa, Mycobacterium
RQVDIEGFQLVRQVYDMAL

SEQ ID NO: 972091 - protein, 28 aa, Mycobacterium
RQVRLVIADRAYFAFLAILPFILGTLSL

SEQ ID NO: 972092 - protein, 27 aa, Mycobacterium
RQYRVPRPWLGMLRRDLIPTGYALALI

SEQ ID NO: 972093 - protein, 17 aa, Mycobacterium
RRAGIGVVVGNLVYTVG

SEQ ID NO: 972094 - protein, 19 aa, Mycobacterium
RRAGLAMLPYAVWCAFATV

SEQ ID NO: 972095 - protein, 20 aa, Mycobacterium
RRAGSAGLWHRPAGPGTAKA

SEQ ID NO: 972096 - protein, 18 aa, Mycobacterium
RRAPEVPRLALLAVAAFS

SEQ ID NO: 972097 - protein, 19 aa, Mycobacterium
RRAPFPLIDLQLFTEPVYR

SEQ ID NO: 972098 - protein, 19 aa, Mycobacterium
RRARSRTKVAAALAAAAVL

SEQ ID NO: 972099 - protein, 18 aa, Mycobacterium
RRASTVGLVALVSAQLGQ

SEQ ID NO: 972100 - protein, 18 aa, Mycobacterium
RRAVEHRALMAIAIGEAG

SEQ ID NO: 972101 - protein, 21 aa, Mycobacterium
RRAVVPLTVLGAIFGAGLVVA

SEQ ID NO: 972102 - protein, 18 aa, Mycobacterium
RRDAKRRARGHVAKEPQP

SEQ ID NO: 972103 - protein, 25 aa, Mycobacterium
RRDDELRIPIGVTGTGEPLMFDLKD

SEQ ID NO: 972104 - protein, 18 aa, Mycobacterium
RRDIKAGHFSPMSHPQVM

SEQ ID NO: 972105 - protein, 20 aa, Mycobacterium
RRFAARGGERGVIYDIALWM

SEQ ID NO: 972106 - protein, 21 aa, Mycobacterium
RRGGRRPGWVLLTTLLVLAIG

SEQ ID NO: 972107 - protein, 18 aa, Mycobacterium
RRGIPLPAFLDAVAPGVV

SEQ ID NO: 972108 - protein, 26 aa, Mycobacterium
RRGITIPGAEDFRALPGRGVRASVGR

SEQ ID NO: 972109 - protein, 21 aa, Mycobacterium
RRGPGKSVLLGIVLIAVGLAM

SEQ ID NO: 972110 - protein, 18 aa, Mycobacterium
RRGQIDKMFALRSYGPDK

SEQ ID NO: 972111 - protein, 18 aa, Mycobacterium
RRHRHLRAALTPLVQERV

SEQ ID NO: 972112 - protein, 24 aa, Mycobacterium
RRIESACKVWSAGVQASRLGRDLA

SEQ ID NO: 972113 - protein, 17 aa, Mycobacterium
RRIGVEFHAAQDGKSAA

SEQ ID NO: 972114 - protein, 25 aa, Mycobacterium
RRILPPRWWSIGALDGLVTAVLVWW

SEQ ID NO: 972115 - protein, 18 aa, Mycobacterium
RRKPDLRGATLLAGALGL

SEQ ID NO: 972116 - protein, 20 aa, Mycobacterium
RRKRGRSKRPWVIAGAVTVV

SEQ ID NO: 972117 - protein, 20 aa, Mycobacterium
RRLAGVGGGRCVLVDNEDRL

SEQ ID NO: 972118 - protein, 24 aa, Mycobacterium
RRLGRVCVAGCRCRGDRGHRGTGS

SEQ ID NO: 972119 - protein, 32 aa, Mycobacterium; identical to SEQ ID NO: 327378

SEQ ID NO: 972120 - protein, 20 aa, Mycobacterium
RRLLGTHLRTMFVVLLSALT

SEQ ID NO: 972121 - protein, 20 aa, Mycobacterium
RRLLHDFRGPLIVSLLLVAL

SEQ ID NO: 972122 - protein, 27 aa, Mycobacterium
RRLPYPGRIGLLFAVMPFHAFFGIALM

SEQ ID NO: 972123 - protein, 23 aa, Mycobacterium
RRLRSLFPANWRTFTLVDAAMIF

SEQ ID NO: 972124 - protein, 21 aa, Mycobacterium
RRNRPAERRNQSLLLAAGLTC

SEQ ID NO: 972125 - protein, 20 aa, Mycobacterium
RRPAPSPIRPGCHASAHRPE

SEQ ID NO: 972126 - protein, 20 aa, Mycobacterium
RRPILLSGIAIMIVADVALM

SEQ ID NO: 972127 - protein, 17 aa, Mycobacterium
RRPLIASGYGMAALGKL

SEQ ID NO: 972128 - protein, 18 aa, Mycobacterium
RRPLPPLPAMGKLLAAAL

SEQ ID NO: 972129 - protein, 20 aa, Mycobacterium
RRPVGVVVMAVRAVSVEVGA

SEQ ID NO: 972130 - protein, 17 aa, Mycobacterium
RRPWAIWANLGIQLVPI

SEQ ID NO: 972131 - protein, 17 aa, Mycobacterium
RRQGLRQAVASGIAVTV

SEQ ID NO: 972132 - protein, 24 aa, Mycobacterium
RRRALRWALIFSAGCVFWAAVTAV

SEQ ID NO: 972133 - protein, 24 aa, Mycobacterium
RRRAMAFYKGCVRRQIAVNGGGTH

SEQ ID NO: 972134 - protein, 19 aa, Mycobacterium
RRRFFGYLNLFLASMLLLV

SEQ ID NO: 972135 - protein, 20 aa, Mycobacterium
RRRILMIVGSAVAAVAVIAA

SEQ ID NO: 972136 - protein, 21 aa, Mycobacterium
RRRLAPPNTRKGTITIEAPPE

SEQ ID NO: 972137 - protein, 25 aa, Mycobacterium
RRRRELKTPWWETAQPAGRPEQAAP

SEQ ID NO: 972138 - protein, 50 aa, Mycobacterium; identical to SEQ ID NO: 327519

SEQ ID NO: 972139 - protein, 26 aa, Mycobacterium
RRRRRVLGGFVFGLLVVFVVVVVVFG

SEQ ID NO: 972140 - protein, 17 aa, Mycobacterium
RRRRVVAIVACTASVVS

SEQ ID NO: 972141 - protein, 18 aa, Mycobacterium
RRRSMLSLADRVAVLDSG

SEQ ID NO: 972142 - protein, 18 aa, Mycobacterium
RRRTWLILRMNPQRNVAA

SEQ ID NO: 972143 - protein, 27 aa, Mycobacterium
RRTAMALTRWRVRMEVEPGRRQTLAVV

SEQ ID NO: 972144 - protein, 19 aa, Mycobacterium
RRTEVLVYAWLMPASTVVQ

SEQ ID NO: 972145 - protein, 20 aa, Mycobacterium
RRTRSIECVYRLSQTIDPTM

SEQ ID NO: 972146 - protein, 18 aa, Mycobacterium
RRVLTPKLRVGAAETLAI

SEQ ID NO: 972147 - protein, 24 aa, Mycobacterium
RRVPDLRGAMLLGVALGLMTLGLV

SEQ ID NO: 972148 - protein, 26 aa, Mycobacterium
RRWGPWLRKRIASARRWLSTSMLAAS

SEQ ID NO: 972149 - protein, 24 aa, Mycobacterium
RRWSPDGRPIVGFVGRLAPEKDAE

SEQ ID NO: 972150 - protein, 19 aa, Mycobacterium
RRWYVITFLMGLFFVLGQG

SEQ ID NO: 972151 - protein, 18 aa, Mycobacterium
RRYADYLPTDGFQGLNIV

SEQ ID NO: 972152 - protein, 26 aa, Mycobacterium
RRYGGLRAALPVTFVTFGLGYLAIIG

SEQ ID NO: 972153 - protein, 19 aa, Mycobacterium
RRYSLMVLLAIAVLATAAG

SEQ ID NO: 972154 - protein, 26 aa, Mycobacterium
RSAELARGLIALGIGKAAHVGLLYPN

SEQ ID NO: 972155 - protein, 20 aa, Mycobacterium
RSARLMWRICKIDGEPSRYR

SEQ ID NO: 972156 - protein, 24 aa, Mycobacterium
RSARSRAWVKVGYVLFVLAGIYAV

SEQ ID NO: 972157 - protein, 25 aa, Mycobacterium
RSDAHLPFRSGRSFSASVSDTELSI

SEQ ID NO: 972158 - protein, 17 aa, Mycobacterium
RSDVTIGVLRARHPPPW

SEQ ID NO: 972159 - protein, 18 aa, Mycobacterium
RSELARKGIARGKSVVAL

SEQ ID NO: 972160 - protein, 19 aa, Mycobacterium
RSFALYWHAVCGIPLMVPQ

SEQ ID NO: 972161 - protein, 17 aa, Mycobacterium
RSGGALRQLWWKLRLRG

SEQ ID NO: 972162 - protein, 24 aa, Mycobacterium
RSGKFGAGLTKWSVVIDAPPSSER

SEQ ID NO: 972163 - protein, 18 aa, Mycobacterium
RSGNEFLFQQLAAQAVEI

SEQ ID NO: 972164 - protein, 19 aa, Mycobacterium
RSIPISAPWAANRAADLDG

SEQ ID NO: 972165 - protein, 19 aa, Mycobacterium
RSKGAYGRDAINFRGFGNG

SEQ ID NO: 972166 - protein, 22 aa, Mycobacterium
RSLAELWPFASGTLSRPDGAND

SEQ ID NO: 972167 - protein, 29 aa, Mycobacterium
RSLIVRRWRLIGKCLRPLPNKWNGLTDPE

SEQ ID NO: 972168 - protein, 21 aa, Mycobacterium
RSLRARMAIVVDTAADTVRAG

SEQ ID NO: 972169 - protein, 25 aa, Mycobacterium
RSLVRSGMDLGPWLVTRDVTVVSTV

SEQ ID NO: 972170 - protein, 19 aa, Mycobacterium
RSMAGWKMTAARRAASRIV

SEQ ID NO: 972171 - protein, 19 aa, Mycobacterium
RSNLAYDMWGGAVQMAYRM

SEQ ID NO: 972172 - protein, 19 aa, Mycobacterium
RSNPVLRQQIQAVVRRAAQ

SEQ ID NO: 972173 - protein, 19 aa, Mycobacterium
RSPEYLWPARSRQDILPDP

SEQ ID NO: 972174 - protein, 27 aa, Mycobacterium
RSPGVISRLMLAWVLSTAVPLLAIVLA

SEQ ID NO: 972175 - protein, 27 aa, Mycobacterium
RSPTEPAHPRWWFVSTTPGRILTIGIV

SEQ ID NO: 972176 - protein, 18 aa, Mycobacterium
RSRKGGSTGLGLAIVAAV

SEQ ID NO: 972177 - protein, 21 aa, Mycobacterium
RSRPTFAAWANMFMLGVAFVF

SEQ ID NO: 972178 - protein, 27 aa, Mycobacterium
RSRPVVEFAETLFMFALSITGLTIAIV

SEQ ID NO: 972179 - protein, 21 aa, Mycobacterium
RSRSRPELDRGVAYPMPPSRG

SEQ ID NO: 972180 - protein, 24 aa, Mycobacterium
RSSSRWPGSLGWFTNRLLVPAVLI

SEQ ID NO: 972181 - protein, 17 aa, Mycobacterium
RSVELMYFLVVPIAVVG

SEQ ID NO: 972182 - protein, 22 aa, Mycobacterium
RSVLPVAAAFLVWDELAVAARV

SEQ ID NO: 972183 - protein, 23 aa, Mycobacterium
RSVRSLPDFWRLLQVRIASQFGD

SEQ ID NO: 972184 - protein, 18 aa, Mycobacterium
RTANWTWALLGLAVSALT

SEQ ID NO: 972185 - protein, 18 aa, Mycobacterium
RTCRAGGPALALRFLALT

SEQ ID NO: 972186 - protein, 26 aa, Mycobacterium
RTDELFLAMPRIGPWSDATTLSDLEY

SEQ ID NO: 972187 - protein, 22 aa, Mycobacterium
RTFADLLLRTEVRYRDPEQRPA

SEQ ID NO: 972188 - protein, 25 aa, Mycobacterium
RTGPDRGRCAMYFVAQAVSYLLIAY

SEQ ID NO: 972189 - protein, 19 aa, Mycobacterium
RTGTSLALLTGQIIDVGYS

SEQ ID NO: 972190 - protein, 22 aa, Mycobacterium
RTHPLQWAFLGAFAAVAVVLRI

SEQ ID NO: 972191 - protein, 23 aa, Mycobacterium
RTILHRRYKQFGALPLLAPLLAA

SEQ ID NO: 972192 - protein, 27 aa, Mycobacterium
RTLNTIKTNLFWAFGYNVAALPLAAFG

SEQ ID NO: 972193 - protein, 24 aa, Mycobacterium
RTLRTDLWWWAPLVTNIGFLAFIV

SEQ ID NO: 972194 - protein, 24 aa, Mycobacterium
RTLRTIYQNLGWAFGYNTAAIPLA

SEQ ID NO: 972195 - protein, 26 aa, Mycobacterium
RTPKNSRRWWAWMLLAGPGWVIFGAA

SEQ ID NO: 972196 - protein, 19 aa, Mycobacterium
RTPRRGFWLSWLGSSMLAA

SEQ ID NO: 972197 - protein, 24 aa, Mycobacterium
RTQSRSVLMGVLIFITGLVGCFVF

SEQ ID NO: 972198 - protein, 22 aa, Mycobacterium
RTRISTFLAGLFLLGLVVGLGD

SEQ ID NO: 972199 - protein, 26 aa, Mycobacterium
RTRLLRAMGPQARRLVVAAPFAGEGT

SEQ ID NO: 972200 - protein, 19 aa, Mycobacterium
RTVDLRRKILFTLGILVLY

SEQ ID NO: 972201 - protein, 19 aa, Mycobacterium
RTVDLRRKILFTLGIVVLY

SEQ ID NO: 972202 - protein, 25 aa, Mycobacterium
RTVGLACASWLTSRCEPCLQRSTTR

SEQ ID NO: 972203 - protein, 19 aa, Mycobacterium
RTVLARRVVAGLLVVLAAV

SEQ ID NO: 972204 - protein, 20 aa, Mycobacterium
RTVVLARLRLFGIGIPAAIG

SEQ ID NO: 972205 - protein, 29 aa, Mycobacterium
RTWSKGMLPGVFPVPLAITGNVADWPFDH

SEQ ID NO: 972206 - protein, 24 aa, Mycobacterium
RVAAALCLLILMLAMFPANIYAAR

SEQ ID NO: 972207 - protein, 24 aa, Mycobacterium
RVADRRPRAGMLAVSALAIAVVSA

SEQ ID NO: 972208 - protein, 19 aa, Mycobacterium
RVAQQKVLLFGVAFALIAR

SEQ ID NO: 972209 - protein, 18 aa, Mycobacterium
RVAVSGLRVSVVMVATPV

SEQ ID NO: 972210 - protein, 25 aa, Mycobacterium
RVDTVLRAKIDGAWNLHELTRGLNL

SEQ ID NO: 972211 - protein, 19 aa, Mycobacterium
RVDVVARGGLLIGDGTVEA

SEQ ID NO: 972212 - protein, 26 aa, Mycobacterium
RVELLKLAVVLALWAAVAGAFVSVLY

SEQ ID NO: 972213 - protein, 17 aa, Mycobacterium
RVGQPVVAVGSPLGLAG

SEQ ID NO: 972214 - protein, 18 aa, Mycobacterium
RVGRRPILLSGIAIMIVA

SEQ ID NO: 972215 - protein, 24 aa, Mycobacterium
RVGVDGYLAALGRYLQFHEDRRIP

SEQ ID NO: 972216 - protein, 18 aa, Mycobacterium
RVGVGLNQAILAVILASL

SEQ ID NO: 972217 - protein, 18 aa, Mycobacterium
RVLILIALGVIALLLAGP

SEQ ID NO: 972218 - protein, 28 aa, Mycobacterium
RVLLNLWAYWCAECTAELPALAEYQRRV

SEQ ID NO: 972219 - protein, 22 aa, Mycobacterium
RVMLGTPASGFGRVVSAETRTY

SEQ ID NO: 972220 - protein, 18 aa, Mycobacterium
RVNVSFTPSYTYTRADCP

SEQ ID NO: 972221 - protein, 17 aa, Mycobacterium
RVPWTAGTKRKPVDVAL

SEQ ID NO: 972222 - protein, 18 aa, Mycobacterium
RVRGKIGPSQAWYTENLR

SEQ ID NO: 972223 - protein, 21 aa, Mycobacterium
RVRSAEFSWQESVDGMRSVLE

SEQ ID NO: 972224 - protein, 17 aa, Mycobacterium
RVSEPFTTLSPGTTVIS

SEQ ID NO: 972225 - protein, 18 aa, Mycobacterium
RVSHQWWAGIAIGFTLVL

SEQ ID NO: 972226 - protein, 20 aa, Mycobacterium
RVSLVPTLLVSIPFTVLVAF

SEQ ID NO: 972227 - protein, 19 aa, Mycobacterium
RVSWPRGGGGGPAYGEEMP

SEQ ID NO: 972228 - protein, 23 aa, Mycobacterium
RVTAAIYRCCVGLTVALICGYAI

SEQ ID NO: 972229 - protein, 19 aa, Mycobacterium
RVVESIKVLNIRYILTSSP

SEQ ID NO: 972230 - protein, 21 aa, Mycobacterium
RVVPLHLADSALIDLIRVGDV

SEQ ID NO: 972231 - protein, 27 aa, Mycobacterium
RVVRACARDGFERGRFGQVSASYSRTA

SEQ ID NO: 972232 - protein, 18 aa, Mycobacterium
RWLLDGRVSHQWWAGIAI

SEQ ID NO: 972233 - protein, 19 aa, Mycobacterium
RWLLLALVAIWGLRLSRHI

SEQ ID NO: 972234 - protein, 17 aa, Mycobacterium
RWLTFGVGAGYDVTAFV

SEQ ID NO: 972235 - protein, 27 aa, Mycobacterium
RWRRRRTRLAIWVALSAAAVFLGIGVL

SEQ ID NO: 972236 - protein, 18 aa, Mycobacterium
RWTPARYALLMVSSGFGF

SEQ ID NO: 972237 - protein, 19 aa, Mycobacterium
RYADRLEILHVMSNEPLHT

SEQ ID NO: 972238 - protein, 19 aa, Mycobacterium
RYATCGDLSAAAYSALATP

SEQ ID NO: 972239 - protein, 20 aa, Mycobacterium
RYDLVIAVIATVCLIFAIML

SEQ ID NO: 972240 - protein, 27 aa, Mycobacterium
RYGARRWLARIAVSWGIVVVATGFAPN

SEQ ID NO: 972241 - protein, 18 aa, Mycobacterium
RYGAVPWVGVAAAPQLGP

SEQ ID NO: 972242 - protein, 24 aa, Mycobacterium
RYGGDAWVIREGRRSRIDATDRSV

SEQ ID NO: 972243 - protein, 19 aa, Mycobacterium
RYIEIAHRLFPRAMLHFED

SEQ ID NO: 972244 - protein, 20 aa, Mycobacterium
RYLNCYGIRVDAIRITGRTT

SEQ ID NO: 972245 - protein, 25 aa, Mycobacterium
RYPLKAELPASGGLYPTANVTYRGI

SEQ ID NO: 972246 - protein, 19 aa, Mycobacterium
RYQEVIAMHECRSAKQLAT

SEQ ID NO: 972247 - protein, 19 aa, Mycobacterium
RYQRLMLAVVGVAWLLILV

SEQ ID NO: 972248 - protein, 18 aa, Mycobacterium
RYRIYRPAVVVGDSRTGE

SEQ ID NO: 972249 - protein, 18 aa, Mycobacterium
RYRNARVVLRAAAEIFAG

SEQ ID NO: 972250 - protein, 26 aa, Mycobacterium
RYRPRLPRLSRWCVGFATWLTDAAVI

SEQ ID NO: 972251 - protein, 18 aa, Mycobacterium
RYRRAIRARGHFPTEQSA

SEQ ID NO: 972252 - protein, 22 aa, Mycobacterium
RYRRRNRPCLERSEEDNVTSDQ

SEQ ID NO: 972253 - protein, 19 aa, Mycobacterium
RYTRPHLRLFSGQVSTGCG

SEQ ID NO: 972254 - protein, 23 aa, Mycobacterium
RYWGPPAKPGLILFRRAGAPATL

SEQ ID NO: 972255 - protein, 21 aa, Mycobacterium
RYYCCQPPRRQWIATQLVRRL

SEQ ID NO: 972256 - protein, 23 aa, Mycobacterium
SAADLWWLVFLGAGPSAIAFTTW

SEQ ID NO: 972257 - protein, 19 aa, Mycobacterium
SAAELARWTYQGHTHYLII

SEQ ID NO: 972258 - protein, 20 aa, Mycobacterium
SAAELSRWAFAGHIHYLLID

SEQ ID NO: 972259 - protein, 26 aa, Mycobacterium
SAAPTCRAHLPALALLGACVALLTGT

SEQ ID NO: 972260 - protein, 27 aa, Mycobacterium
SAAPTCRAHLPALALLGACVALLTGTL

SEQ ID NO: 972261 - protein, 23 aa, Mycobacterium
SADELYERVGLVLQETQLVHGTV

SEQ ID NO: 972262 - protein, 23 aa, Mycobacterium
SADGRRGVSVGVIVALVAVVVVV

SEQ ID NO: 972263 - protein, 23 aa, Mycobacterium
SADHPEWKRSVAREAMRSLPGRT

SEQ ID NO: 972264 - protein, 26 aa, Mycobacterium
SAFAQFAILCRRYVAVIAADRQYAVF

SEQ ID NO: 972265 - protein, 24 aa, Mycobacterium
SAFARTEFQAVQFIPLVMVPQLLL

SEQ ID NO: 972266 - protein, 20 aa, Mycobacterium
SAFCQVCGTATAALASHPAL

SEQ ID NO: 972267 - protein, 18 aa, Mycobacterium
SAGARPTIHMPLDHDPYQ

SEQ ID NO: 972268 - protein, 24 aa, Mycobacterium
SAIYMLWLYQRVMTGPLAKGNERI

SEQ ID NO: 972269 - protein, 23 aa, Mycobacterium
SAKKFTMWSAIAGIIVFVIYGIL

SEQ ID NO: 972270 - protein, 17 aa, Mycobacterium
SAKKWAIISAIGGVVVA

SEQ ID NO: 972271 - protein, 21 aa, Mycobacterium
SALCFVSAVVLLYVDIDRRRG

SEQ ID NO: 972272 - protein, 18 aa, Mycobacterium
SALLRRAENPAVWLNPWR

SEQ ID NO: 972273 - protein, 18 aa, Mycobacterium
SAMLLFKGFKHMHLGLTT

SEQ ID NO: 972274 - protein, 22 aa, Mycobacterium
SAMNRFKRDYLAAYISASSDPA

SEQ ID NO: 972275 - protein, 25 aa, Mycobacterium
SAPKCPLPRPAIGPGTYNLVVQLGN

SEQ ID NO: 972276 - protein, 20 aa, Mycobacterium
SAPLTYTWLVVLAITTIIQN

SEQ ID NO: 972277 - protein, 20 aa, Mycobacterium
SAPVAPRITTDFVNVGGMTL

SEQ ID NO: 972278 - protein, 25 aa, Mycobacterium
SAPVPTPWAGVPGWGVGHTGTTGAP

SEQ ID NO: 972279 - protein, 23 aa, Mycobacterium
SAQARLAALSILVGAVGATGPGV

SEQ ID NO: 972280 - protein, 23 aa, Mycobacterium
SARAMPGSGLGLAIVKQVVLNHG

SEQ ID NO: 972281 - protein, 20 aa, Mycobacterium
SARRLRRWQAVRSRELPSNP

SEQ ID NO: 972282 - protein, 32 aa, Mycobacterium; identical to SEQ ID NO: 328565

SEQ ID NO: 972283 - protein, 20 aa, Mycobacterium
SASDSARDVVLWESGSADGD

SEQ ID NO: 972284 - protein, 18 aa, Mycobacterium
SASGLGFAIPVNEMEFVA

SEQ ID NO: 972285 - protein, 20 aa, Mycobacterium
SASGLNLIGLKSMSADLAVQ

SEQ ID NO: 972286 - protein, 25 aa, Mycobacterium
SATRLRDRLGYAFGPPGWQPSTTAT

SEQ ID NO: 972287 - protein, 26 aa, Mycobacterium
SATRLYLPMPFFWVGGFGGGILSALF

SEQ ID NO: 972288 - protein, 24 aa, Mycobacterium
SATTFPWVFLFPAGVLVLILVCAN

SEQ ID NO: 972289 - protein, 24 aa, Mycobacterium
SAVNGLRALPTLGVLLLGVLLFGL

SEQ ID NO: 972290 - protein, 21 aa, Mycobacterium
SAWSAANARFNDFFRGIVTRF

SEQ ID NO: 972291 - protein, 19 aa, Mycobacterium
SCLLFPAYFQQVLGKTPLQ

SEQ ID NO: 972292 - protein, 22 aa, Mycobacterium
SCLSLARLPYFRTLGIPCAVGM

SEQ ID NO: 972293 - protein, 20 aa, Mycobacterium
SCQKVLEGSGFVIAPDRVMT

SEQ ID NO: 972294 - protein, 29 aa, Mycobacterium
SDAEHARHLLIRLAVAAVLFVPLADLSVM

SEQ ID NO: 972295 - protein, 19 aa, Mycobacterium
SDAPLWITFAVMPAYVVIA

SEQ ID NO: 972296 - protein, 24 aa, Mycobacterium
SDAPSLIAMRRIGKDFQQFDSDNT

SEQ ID NO: 972297 - protein, 19 aa, Mycobacterium
SDEDGRTAVALGIGAGIGA

SEQ ID NO: 972298 - protein, 23 aa, Mycobacterium
SDGGRRGVSIGVIATLVAVVVLV

SEQ ID NO: 972299 - protein, 18 aa, Mycobacterium
SDLFNMQLALGWSTLALA

SEQ ID NO: 972300 - protein, 17 aa, Mycobacterium
SDLGVGVADAGLRSVSV

SEQ ID NO: 972301 - protein, 17 aa, Mycobacterium
SDLRVLGQFGSTVCIGL

SEQ ID NO: 972302 - protein, 17 aa, Mycobacterium
SDLYLFFTWLPSGQDSN

SEQ ID NO: 972303 - protein, 18 aa, Mycobacterium
SDMSMALVGVGLLSVGLL

SEQ ID NO: 972304 - protein, 24 aa, Mycobacterium
SDPNAKWGFWVGLFITYADVMIAL

SEQ ID NO: 972305 - protein, 22 aa, Mycobacterium
SDPSGLVPIALDGKMLRGTLRA

SEQ ID NO: 972306 - protein, 22 aa, Mycobacterium
SDPSGLVPIALDGKVLRGALRA

SEQ ID NO: 972307 - protein, 23 aa, Mycobacterium
SDPSGLVPIALDGRMLRGALRAK

SEQ ID NO: 972308 - protein, 21 aa, Mycobacterium
SDQGAGPWGFVSTASKGIVAQ

SEQ ID NO: 972309 - protein, 18 aa, Mycobacterium
SDRHFPPARMEPEVLMIE

SEQ ID NO: 972310 - protein, 27 aa, Mycobacterium
SDSTDALLRFAMRADATLTGLMGLALA

SEQ ID NO: 972311 - protein, 17 aa, Mycobacterium
SDTVPLYGAELLNQGKF

SEQ ID NO: 972312 - protein, 26 aa, Mycobacterium
SDVGSVEAFSLFRVSKLNCLITTSDG

SEQ ID NO: 972313 - protein, 19 aa, Mycobacterium
SDVIAGWALGYVYFLFWLW

SEQ ID NO: 972314 - protein, 17 aa, Mycobacterium
SDVIRLARHAHHYLAVF

SEQ ID NO: 972315 - protein, 27 aa, Mycobacterium
SEATLGFCVGCYMHKLIWGCEDCEVPY

SEQ ID NO: 972316 - protein, 19 aa, Mycobacterium
SEAVDRVWLRGTVALVGTI

SEQ ID NO: 972317 - protein, 24 aa, Mycobacterium
SEDAPRPAPPDVIHAIETQHWTDE

SEQ ID NO: 972318 - protein, 20 aa, Mycobacterium
SEFALRPVAAQALAAGPPPR

SEQ ID NO: 972319 - protein, 23 aa, Mycobacterium
SEGAKWDLLIAGIASLCLIFVIM

SEQ ID NO: 972320 - protein, 25 aa, Mycobacterium
SEGKLVAPVKYPSLYAGDEDGKVTT

SEQ ID NO: 972321 - protein, 17 aa, Mycobacterium
SEIMNRALAGIGLKAFW

SEQ ID NO: 972322 - protein, 17 aa, Mycobacterium
SEIPVLVLPAGKRIEFQ

SEQ ID NO: 972323 - protein, 22 aa, Mycobacterium
SELHPGSAEVLLFVDQSTTSKD

SEQ ID NO: 972324 - protein, 17 aa, Mycobacterium
SELIPPAATIAVDELTG

SEQ ID NO: 972325 - protein, 22 aa, Mycobacterium
SELRPPVRSGFGSRVELRLAAV

SEQ ID NO: 972326 - protein, 19 aa, Mycobacterium
SERQRLRDLFGRYVGEDVA

SEQ ID NO: 972327 - protein, 28 aa, Mycobacterium
SEYFIGPKSIRVWLMLGVLLFSVVLAVR

SEQ ID NO: 972328 - protein, 23 aa, Mycobacterium
SEYTRLGLCTVPVSLVAAVIGLW

SEQ ID NO: 972329 - protein, 19 aa, Mycobacterium
SFAAIALEIEKWWRTGSPA

SEQ ID NO: 972330 - protein, 28 aa, Mycobacterium
SFAALAAMGVCFVVLIKWLVARRAVAFA

SEQ ID NO: 972331 - protein, 21 aa, Mycobacterium
SFGEFEYWFSSIKVIAVVVFL

SEQ ID NO: 972332 - protein, 20 aa, Mycobacterium
SFHIAVAACGVVQVAAAATL

SEQ ID NO: 972333 - protein, 19 aa, Mycobacterium
SFLEYGIASMEMFRRRKFG

SEQ ID NO: 972334 - protein, 25 aa, Mycobacterium
SFLMQLCVQGAWGVIPAYLTEMSPD

SEQ ID NO: 972335 - protein, 26 aa, Mycobacterium
SFLYMCASGSFIGFAFVFGQVLQFNL

SEQ ID NO: 972336 - protein, 17 aa, Mycobacterium
SFSQRWASGGSVATYSE

SEQ ID NO: 972337 - protein, 34 aa, Mycobacterium; identical to SEQ ID NO: 328902

SEQ ID NO: 972338 - protein, 23 aa, Mycobacterium
SFTTRPGSLIAVVGPSRARNSSL

SEQ ID NO: 972339 - protein, 17 aa, Mycobacterium
SFVAMFVVNVAPSVVLR

SEQ ID NO: 972340 - protein, 30 aa, Mycobacterium
SFVDRALGWALRFFAAVAVYNAVSMIASAM

SEQ ID NO: 972341 - protein, 23 aa, Mycobacterium
SGAANFLIVWLIPVALGVGYARR

SEQ ID NO: 972342 - protein, 18 aa, Mycobacterium
SGALYVRVGDTWHPVLNL

SEQ ID NO: 972343 - protein, 26 aa, Mycobacterium
SGATAFWVCGLLLCLFIGPSQSSARA

SEQ ID NO: 972344 - protein, 18 aa, Mycobacterium
SGAVPIGIVGDAGQWTKI

SEQ ID NO: 972345 - protein, 23 aa, Mycobacterium
SGCSWSEALALGWPEGITPEAHV

SEQ ID NO: 972346 - protein, 21 aa, Mycobacterium
SGDAISRWAHNLNVLATQTAE

SEQ ID NO: 972347 - protein, 22 aa, Mycobacterium
SGEDLPAWPFAVGVVAAVGAAA

SEQ ID NO: 972348 - protein, 17 aa, Mycobacterium
SGEYPPVRGVIHAAGVL

SEQ ID NO: 972349 - protein, 25 aa, Mycobacterium
SGFRIPWRDQVFLSWAGLRGAVPIV

SEQ ID NO: 972350 - protein, 20 aa, Mycobacterium
SGGLFPLALGVLQILALDLG

SEQ ID NO: 972351 - protein, 20 aa, Mycobacterium
SGHVPLFFIVWALSNFVGPL

SEQ ID NO: 972352 - protein, 36 aa, Mycobacterium; identical to SEQ ID NO: 329003

SEQ ID NO: 972353 - protein, 20 aa, Mycobacterium
SGIPGWISIINWLWFAFFCI

SEQ ID NO: 972354 - protein, 23 aa, Mycobacterium
SGIPMKKMHAVAVPPNLAAVLLA

SEQ ID NO: 972355 - protein, 19 aa, Mycobacterium
SGIPVDWQSVFDGRSTQTV

SEQ ID NO: 972356 - protein, 22 aa, Mycobacterium
SGKIRRAACVERYRSDGFNRLD

SEQ ID NO: 972357 - protein, 26 aa, Mycobacterium
SGKQYSACFADAGGLTTGVRVQVSGF

SEQ ID NO: 972358 - protein, 17 aa, Mycobacterium
SGLALALDRDRLSELRG

SEQ ID NO: 972359 - protein, 18 aa, Mycobacterium
SGLCAVAGSGEWLVAFRV

SEQ ID NO: 972360 - protein, 20 aa, Mycobacterium
SGLMRKAKELVIATKMSGEW

SEQ ID NO: 972361 - protein, 25 aa, Mycobacterium
SGLPLGAGFVSEWLLVQSLIHARPE

SEQ ID NO: 972362 - protein, 22 aa, Mycobacterium
SGLRILPMVIGMLITSIGSGSM

SEQ ID NO: 972363 - protein, 20 aa, Mycobacterium
SGLTALTWPTMANFAVDSSM

SEQ ID NO: 972364 - protein, 22 aa, Mycobacterium
SGLVLGCSIVFGVEQPRIHYTL

SEQ ID NO: 972365 - protein, 19 aa, Mycobacterium
SGMAPRLVPDAVAAMAAAN

SEQ ID NO: 972366 - protein, 17 aa, Mycobacterium
SGMCGWWLRQRRKHAWG

SEQ ID NO: 972367 - protein, 21 aa, Mycobacterium
SGNPWNALSAMMIGFFMIMLD

SEQ ID NO: 972368 - protein, 25 aa, Mycobacterium
SGPLPYIVMEYVNGFTLRDIVHTDG

SEQ ID NO: 972369 - protein, 27 aa, Mycobacterium
SGPWLPARWRHWWWGLLLAFVPTHLVI

SEQ ID NO: 972370 - protein, 28 aa, Mycobacterium
SGRPAALKQRNWGWVLAIVVIVLALAAI

SEQ ID NO: 972371 - protein, 22 aa, Mycobacterium
SGTETPAFWAFLVCYLCAAALT

SEQ ID NO: 972372 - protein, 24 aa, Mycobacterium
SGVDTFLRPSVPNIQAPVPRQQPK

SEQ ID NO: 972373 - protein, 26 aa, Mycobacterium
SGVFVPIVIAIAVTTLGVWLGAGYPV

SEQ ID NO: 972374 - protein, 36 aa, Mycobacterium
SGVLQRPSFRMPLSPYSGWITLAFLASVLILMPFDE

SEQ ID NO: 972375 - protein, 18 aa, Mycobacterium
SGYDFRPQIVGVFTDLTG

SEQ ID NO: 972376 - protein, 22 aa, Mycobacterium
SHELRTPLAAIRGYTELAQRMG

SEQ ID NO: 972377 - protein, 17 aa, Mycobacterium
SHELRTPLTAMRTNLEV

SEQ ID NO: 972378 - protein, 27 aa, Mycobacterium
SHINAPRAKLFAALFLILGLVVVGEVA

SEQ ID NO: 972379 - protein, 19 aa, Mycobacterium
SHRRVVLLIYLWVGIVAFG

SEQ ID NO: 972380 - protein, 23 aa, Mycobacterium
SHVDAHAPYLAWLTTTSAGYAAT

SEQ ID NO: 972381 - protein, 19 aa, Mycobacterium
SHYGSLMVTDAIIRVAVSA

SEQ ID NO: 972382 - protein, 20 aa, Mycobacterium
SIAGYFGRWRDRVLMWVVDL

SEQ ID NO: 972383 - protein, 17 aa, Mycobacterium
SIINWLWFAFFCIATVF

SEQ ID NO: 972384 - protein, 30 aa, Mycobacterium
SILARSIYKFAVPIALFWLAVCAIIAAFVP

SEQ ID NO: 972385 - protein, 32 aa, Mycobacterium
SIPDATKAAARWIRPLVPPFVARVIDNTTQPI

SEQ ID NO: 972386 - protein, 27 aa, Mycobacterium
SIPGIAHFFTMWGFFILLTVYIEAYGF

SEQ ID NO: 972387 - protein, 23 aa, Mycobacterium
SIPRPSLQRFRRPGGQIRAGKDQ

SEQ ID NO: 972388 - protein, 18 aa, Mycobacterium
SITDRFDGLLARNYGMAT

SEQ ID NO: 972389 - protein, 18 aa, Mycobacterium
SIVAALFLYALWVGVLGF

SEQ ID NO: 972390 - protein, 20 aa, Mycobacterium
SKGLKWLSNINMALAALLAL

SEQ ID NO: 972391 - protein, 17 aa, Mycobacterium
SKILLLIFFSAVLVAKR

SEQ ID NO: 972392 - protein, 19 aa, Mycobacterium
SKKDCKQNPIFDPLQPDDP

SEQ ID NO: 972393 - protein, 21 aa, Mycobacterium
SKKNCKQNPLFDPLQPNDPRG

SEQ ID NO: 972394 - protein, 22 aa, Mycobacterium
SKKNCKQNPLFDPLQPNDPRGW

SEQ ID NO: 972395 - protein, 27 aa, Mycobacterium
SKPAARAASPFVFVYNYLKQVVAEMRK

SEQ ID NO: 972396 - protein, 22 aa, Mycobacterium
SKPFFAQGLMNRRAVLKSSYAQ

SEQ ID NO: 972397 - protein, 26 aa, Mycobacterium
SKQGIVYRPSFRMWGAPYTGYLTLVF

SEQ ID NO: 972398 - protein, 29 aa, Mycobacterium
SKRARGGCSSRVFVALALLTSGAFAGLPP

SEQ ID NO: 972399 - protein, 18 aa, Mycobacterium
SKVALYLLITIAPFAVVA

SEQ ID NO: 972400 - protein, 17 aa, Mycobacterium
SKVPVFVFHPAGGSTVV

SEQ ID NO: 972401 - protein, 21 aa, Mycobacterium
SLAARPGMLTAVIGPSGAGKS

SEQ ID NO: 972402 - protein, 19 aa, Mycobacterium
SLADGLARFTAELRQADPG

SEQ ID NO: 972403 - protein, 24 aa, Mycobacterium
SLAFAMEAGCRFIAQLGSMRIAEE

SEQ ID NO: 972404 - protein, 18 aa, Mycobacterium
SLAKMPVVNRLDLSAYPD

SEQ ID NO: 972405 - protein, 30 aa, Mycobacterium
SLARERGWEIRDFRTARKAARIGVPSALAL

SEQ ID NO: 972406 - protein, 23 aa, Mycobacterium
SLARQGISYLVLRNDLDPESSRS

SEQ ID NO: 972407 - protein, 28 aa, Mycobacterium
SLAWQASFFAAASWSGLKLVGGGGGAIT

SEQ ID NO: 972408 - protein, 17 aa, Mycobacterium
SLCALGRANGIDCAVVP

SEQ ID NO: 972409 - protein, 28 aa, Mycobacterium
SLEDIIRFQAEFLWRDYFQPGITVDGEE

SEQ ID NO: 972410 - protein, 18 aa, Mycobacterium
SLEGWDISVERVGDASQT

SEQ ID NO: 972411 - protein, 22 aa, Mycobacterium
SLESRLAALGSRAGAGALPKGP

SEQ ID NO: 972412 - protein, 20 aa, Mycobacterium
SLFTSFAFALGFYFATIERQ

SEQ ID NO: 972413 - protein, 18 aa, Mycobacterium
SLGAAAFVEVGPSGGLTA

SEQ ID NO: 972414 - protein, 28 aa, Mycobacterium
SLGGVLAYACAIGLKRLGKDVRFVGLID

SEQ ID NO: 972415 - protein, 17 aa, Mycobacterium
SLGGWVAFELERRGRAR

SEQ ID NO: 972416 - protein, 28 aa, Mycobacterium
SLGLFGIRNGWWVYLTIYALFIGIHLSG

SEQ ID NO: 972417 - protein, 22 aa, Mycobacterium
SLGQRQRLALARVLGSPSPVLL

SEQ ID NO: 972418 - protein, 19 aa, Mycobacterium
SLGRALCGITVVRRDSHDG

SEQ ID NO: 972419 - protein, 24 aa, Mycobacterium
SLIALSFLGLRHLWAGSPESPELR

SEQ ID NO: 972420 - protein, 19 aa, Mycobacterium
SLIGGFAWHAWHRADHPLI

SEQ ID NO: 972421 - protein, 17 aa, Mycobacterium
SLIPVVTFLGADLGALM

SEQ ID NO: 972422 - protein, 20 aa, Mycobacterium
SLLGLAVGWFVGALVVLAVG

SEQ ID NO: 972423 - protein, 25 aa, Mycobacterium
SLLISNAVVAFAVIGFASLAVAVAV

SEQ ID NO: 972424 - protein, 18 aa, Mycobacterium
SLLLGMLVTARFRHPIRW

SEQ ID NO: 972425 - protein, 17 aa, Mycobacterium
SLLLILAMFEGYFGYSM

SEQ ID NO: 972426 - protein, 18 aa, Mycobacterium
SLLLILAMFEGYFGYSMP

SEQ ID NO: 972427 - protein, 20 aa, Mycobacterium
SLLRLPRLPDLVAVPPTLID

SEQ ID NO: 972428 - protein, 24 aa, Mycobacterium
SLMALGWRVGDPFPTGAHLAAASG

SEQ ID NO: 972429 - protein, 18 aa, Mycobacterium
SLPAVPHPRVLAWITSTK

SEQ ID NO: 972430 - protein, 24 aa, Mycobacterium
SLPTRPDTVFLVGSGIDLPLIKPT

SEQ ID NO: 972431 - protein, 25 aa, Mycobacterium
SLPVPLPTHRLILGAVLAMAVFLIA

SEQ ID NO: 972432 - protein, 18 aa, Mycobacterium
SLQGWRPVTVAGLVVGLF

SEQ ID NO: 972433 - protein, 25 aa, Mycobacterium
SLQTAASVPVVFLTAFYGLRVLAEV

SEQ ID NO: 972434 - protein, 23 aa, Mycobacterium
SLRLANLLVITAWITAVVIANLI

SEQ ID NO: 972435 - protein, 25 aa, Mycobacterium
SLSDAKSALGSWLPHGPAPVADYPA

SEQ ID NO: 972436 - protein, 18 aa, Mycobacterium
SLSGVAFAGIVVGTGYGG

SEQ ID NO: 972437 - protein, 20 aa, Mycobacterium
SLVLVLGLVAAFVGLKLYQK

SEQ ID NO: 972438 - protein, 31 aa, Mycobacterium
SLVVMNWLGLSWRWLFGLSIIPALISLIIRY

SEQ ID NO: 972439 - protein, 29 aa, Mycobacterium
SLYRIGSLCPYCMVVWIITATLLVVVGSI

SEQ ID NO: 972440 - protein, 24 aa, Mycobacterium
SMDLRPHALLSRVPFVVLVIGSLG

SEQ ID NO: 972441 - protein, 23 aa, Mycobacterium
SMKAMMRLGHNFREFDSNSTVMI

SEQ ID NO: 972442 - protein, 25 aa, Mycobacterium
SMLQRKLRVGFAKAGRLMDLMETRN

SEQ ID NO: 972443 - protein, 19 aa, Mycobacterium
SMSVLRLVTFTTDVSIFAL

SEQ ID NO: 972444 - protein, 18 aa, Mycobacterium
SNPGFSFSGFARAIKNNL

SEQ ID NO: 972445 - protein, 17 aa, Mycobacterium
SNSLRLRSFTSVITDAP

SEQ ID NO: 972446 - protein, 23 aa, Mycobacterium
SPAAMPGLLEVVSHAQAEGINLK

SEQ ID NO: 972447 - protein, 24 aa, Mycobacterium
SPAAMPGLLEVVSHAQAEGINLKI

SEQ ID NO: 972448 - protein, 23 aa, Mycobacterium
SPACGKAGCQTYKWETFLTSELP

SEQ ID NO: 972449 - protein, 23 aa, Mycobacterium
SPAHRLGLFTLRAYLVVAVVLVV

SEQ ID NO: 972450 - protein, 19 aa, Mycobacterium
SPASRAVAQIVLLDNRFAT

SEQ ID NO: 972451 - protein, 19 aa, Mycobacterium
SPASSCAVRPMWQPEPAPA

SEQ ID NO: 972452 - protein, 19 aa, Mycobacterium
SPATSSWLVCDTVAGPSTM

SEQ ID NO: 972453 - protein, 17 aa, Mycobacterium
SPDRPGTGYVIAEDGHT

SEQ ID NO: 972454 - protein, 19 aa, Mycobacterium
SPEETWRALLEGRDAITDL

SEQ ID NO: 972455 - protein, 25 aa, Mycobacterium
SPEFNRTALERFLAVAIPLFAPPIT

SEQ ID NO: 972456 - protein, 19 aa, Mycobacterium
SPELHPWLRDHTVDGVVLF

SEQ ID NO: 972457 - protein, 23 aa, Mycobacterium
SPESRKWLRDMFADVRMLAHDTG

SEQ ID NO: 972458 - protein, 19 aa, Mycobacterium
SPGQPVHVLGHDWGSVAIW

SEQ ID NO: 972459 - protein, 24 aa, Mycobacterium
SPHSYRGAPLPELAPILEAGATAA

SEQ ID NO: 972460 - protein, 23 aa, Mycobacterium
SPITFRHKIVFGVIAAVGAVAWA

SEQ ID NO: 972461 - protein, 17 aa, Mycobacterium
SPKKSWEGFAGSLFCGI

SEQ ID NO: 972462 - protein, 28 aa, Mycobacterium
SPKPAPSKVRLAIVVGLAAVVAMAALAS

SEQ ID NO: 972463 - protein, 17 aa, Mycobacterium
SPLECVYYAVGIASIAF

SEQ ID NO: 972464 - protein, 24 aa, Mycobacterium
SPLNVRGARNIPCETVPGKRAPTV

SEQ ID NO: 972465 - protein, 25 aa, Mycobacterium
SPLTAALSLMWGWRLAAVCVTVAAA

SEQ ID NO: 972466 - protein, 24 aa, Mycobacterium
SPMSFLRRPARWMQLLASHPKCFS

SEQ ID NO: 972467 - protein, 26 aa, Mycobacterium
SPPPPRWVWPPLIAVGGVGIVLMAIW

SEQ ID NO: 972468 - protein, 18 aa, Mycobacterium
SPQSVMWVADLCDTAGAA

SEQ ID NO: 972469 - protein, 21 aa, Mycobacterium
SPRKWGKLAITGGAIVVVAIL

SEQ ID NO: 972470 - protein, 19 aa, Mycobacterium
SPRRRGVVVVDRHSDTDVL

SEQ ID NO: 972471 - protein, 22 aa, Mycobacterium
SPRSLYRGRARSKGAYGRDAIN

SEQ ID NO: 972472 - protein, 17 aa, Mycobacterium
SPSDPNAKWGFWVGLFI

SEQ ID NO: 972473 - protein, 19 aa, Mycobacterium
SPTGLRWDMDPTVLVSADV

SEQ ID NO: 972474 - protein, 23 aa, Mycobacterium
SPTSRIIAAAAFALSPRVLTTLG

SEQ ID NO: 972475 - protein, 39 aa, Mycobacterium; identical to SEQ ID NO: 329776

SEQ ID NO: 972476 - protein, 28 aa, Mycobacterium
SPWQIYWRILLPHARPAVMVLGVLTWVN

SEQ ID NO: 972477 - protein, 22 aa, Mycobacterium
SPYMLMMPLMMIVMMVGTLAGG

SEQ ID NO: 972478 - protein, 18 aa, Mycobacterium
SQAANTWADYTAAHIGTQ

SEQ ID NO: 972479 - protein, 22 aa, Mycobacterium
SQAVLYSSMLVQAYQAANVHVQ

SEQ ID NO: 972480 - protein, 18 aa, Mycobacterium
SQFWLSMLSWVAVLGIYG

SEQ ID NO: 972481 - protein, 27 aa, Mycobacterium
SQLRPDIPATFDAVIARGMAKRPEDRF

SEQ ID NO: 972482 - protein, 19 aa, Mycobacterium
SQLRPGRVPAALDEVIAKG

SEQ ID NO: 972483 - protein, 17 aa, Mycobacterium
SQPTRFGAPPQFGQPGQ

SEQ ID NO: 972484 - protein, 23 aa, Mycobacterium
SQRVYKPYPYVVAIVDELADLMM

SEQ ID NO: 972485 - protein, 20 aa, Mycobacterium
SQTDFPSEGLVRFEGDSYSE

SEQ ID NO: 972486 - protein, 18 aa, Mycobacterium
SQWAEHRLLPDPKRARVR

SEQ ID NO: 972487 - protein, 18 aa, Mycobacterium
SRAARYLRRTRSQGLAVP

SEQ ID NO: 972488 - protein, 25 aa, Mycobacterium
SRALKACGWAFLIWGLYAYLWAFVL

SEQ ID NO: 972489 - protein, 20 aa, Mycobacterium
SRELFQEVFLNPGLALLLGG

SEQ ID NO: 972490 - protein, 23 aa, Mycobacterium
SRGELLCGVKAPAIVLLSFIPMY

SEQ ID NO: 972491 - protein, 23 aa, Mycobacterium
SRGKWDTLRAMGFDDDHIGDSRT

SEQ ID NO: 972492 - protein, 23 aa, Mycobacterium
SRGKWDTLRAMGFDDEHIGDSRS

SEQ ID NO: 972493 - protein, 19 aa, Mycobacterium
SRIAAVHLFLWGLGTLLFT

SEQ ID NO: 972494 - protein, 20 aa, Mycobacterium
SRIALHRLIELAGRDVNPPT

SEQ ID NO: 972495 - protein, 23 aa, Mycobacterium
SRITRRALPFSVASGGLVGLLSM

SEQ ID NO: 972496 - protein, 17 aa, Mycobacterium
SRLTVFGLLGGTMAGGA

SEQ ID NO: 972497 - protein, 17 aa, Mycobacterium
SRPAFVVDDGGYVSARW

SEQ ID NO: 972498 - protein, 23 aa, Mycobacterium
SRPQRLFYLLIHLLDPLISLESL

SEQ ID NO: 972499 - protein, 17 aa, Mycobacterium
SRRDLGVAFSWSLFNWI

SEQ ID NO: 972500 - protein, 21 aa, Mycobacterium
SRRWPCAVSAGLVTVGVVGAG

SEQ ID NO: 972501 - protein, 25 aa, Mycobacterium
SRRWQRLRTLMVISGPGLIVMVGDN

SEQ ID NO: 972502 - protein, 23 aa, Mycobacterium
SRSEMRRALAMAPRKSREIGLQR

SEQ ID NO: 972503 - protein, 20 aa, Mycobacterium
SRSGNTLTLIGDFPNGDAKA

SEQ ID NO: 972504 - protein, 23 aa, Mycobacterium
SRTMLALCGLAIGLRLKVSAPKP

SEQ ID NO: 972505 - protein, 17 aa, Mycobacterium
SRVRMVFYDQRGHGQSG

SEQ ID NO: 972506 - protein, 24 aa, Mycobacterium
SRWGSQAVFFGRFIALLRILAGPL

SEQ ID NO: 972507 - protein, 18 aa, Mycobacterium
SSAALLRTGKQLFDTSCV

SEQ ID NO: 972508 - protein, 24 aa, Mycobacterium
SSAGIKYPICVAIGATALTFVFLL

SEQ ID NO: 972509 - protein, 25 aa, Mycobacterium
SSALPAAGGGYTFARRALGPWGGFA

SEQ ID NO: 972510 - protein, 19 aa, Mycobacterium
SSASFWTFGAIAMVTLLAK

SEQ ID NO: 972511 - protein, 17 aa, Mycobacterium
SSERLRNVRALLGPNAQ

SEQ ID NO: 972512 - protein, 20 aa, Mycobacterium
SSLLLNWVAGPALMFALAWL

SEQ ID NO: 972513 - protein, 21 aa, Mycobacterium
SSLPAVVRWARVPGDVAHADE

SEQ ID NO: 972514 - protein, 17 aa, Mycobacterium
SSLPRLPLFAAAAKVVA

SEQ ID NO: 972515 - protein, 17 aa, Mycobacterium
SSLRGGPVGVYVGVSNN

SEQ ID NO: 972516 - protein, 19 aa, Mycobacterium
SSLVEMLRGTDSWTPFVAP

SEQ ID NO: 972517 - protein, 19 aa, Mycobacterium
SSPFLLPAALGLALSAIAF

SEQ ID NO: 972518 - protein, 24 aa, Mycobacterium
SSPHVYRPGLPMPATEHGAVAPAS

SEQ ID NO: 972519 - protein, 28 aa, Mycobacterium
SSQFSVRLLRTFLRDMPNQMVLAMFACT

SEQ ID NO: 972520 - protein, 20 aa, Mycobacterium
SSVAGLGLFNPVSVGAGLIL

SEQ ID NO: 972521 - protein, 30 aa, Mycobacterium; identical to SEQ ID NO: 330141

SEQ ID NO: 972522 - protein, 25 aa, Mycobacterium
SSYPRLIRVAMMYNDKIGYGPTVRD

SEQ ID NO: 972523 - protein, 18 aa, Mycobacterium
STALCAGAVFAILPRVTW

SEQ ID NO: 972524 - protein, 23 aa, Mycobacterium
STALRAGNWQALMLPVTTLTINV

SEQ ID NO: 972525 - protein, 26 aa, Mycobacterium
STGARRGRSRLLFGALAILLCLVLGV

SEQ ID NO: 972526 - protein, 17 aa, Mycobacterium
STLAALLARFHDVEQGS

SEQ ID NO: 972527 - protein, 21 aa, Mycobacterium
STLVLRRKFKPQLVLEDIEKH

SEQ ID NO: 972528 - protein, 21 aa, Mycobacterium
STPFWRINGFTGQSLSDMGPV

SEQ ID NO: 972529 - protein, 17 aa, Mycobacterium
STQPAQLLVLLIIGGAL

SEQ ID NO: 972530 - protein, 18 aa, Mycobacterium
STRFPGWGYLLTALAAPI

SEQ ID NO: 972531 - protein, 23 aa, Mycobacterium
STVATYLRGDWHRDWGSVEQYYR

SEQ ID NO: 972532 - protein, 23 aa, Mycobacterium
SVALMAFAIIARLRDPRAVAPSA

SEQ ID NO: 972533 - protein, 17 aa, Mycobacterium
SVAQFFAYAGKDGRATA

SEQ ID NO: 972534 - protein, 25 aa, Mycobacterium
SVATLLERWFWWPLRVRPRSASQML

SEQ ID NO: 972535 - protein, 24 aa, Mycobacterium
SVDAFRALQNWVPLVAAAGSMIIS

SEQ ID NO: 972536 - protein, 20 aa, Mycobacterium
SVDGIHWGTFINLRCVCLAP

SEQ ID NO: 972537 - protein, 24 aa, Mycobacterium
SVFTEAPWWITFVVVPSYIVVALA

SEQ ID NO: 972538 - protein, 19 aa, Mycobacterium
SVGFWKIGVRLPLLQGVAF

SEQ ID NO: 972539 - protein, 18 aa, Mycobacterium
SVGSVFWVNVPIAVVAIV

SEQ ID NO: 972540 - protein, 17 aa, Mycobacterium
SVIAPRIVERVGTTAVV

SEQ ID NO: 972541 - protein, 24 aa, Mycobacterium
SVIRNWPAWMGIYGFMTLDRWLLF

SEQ ID NO: 972542 - protein, 21 aa, Mycobacterium
SVITRPRWVALEKSISEIVGV

SEQ ID NO: 972543 - protein, 24 aa, Mycobacterium
SVLASRFLLQRSKQLRVARAADIG

SEQ ID NO: 972544 - protein, 21 aa, Mycobacterium
SVLGRSWSVICDELLDHYAEV

SEQ ID NO: 972545 - protein, 26 aa, Mycobacterium
SVLKRTGRLSLRHALDMLEQTGRALQ

SEQ ID NO: 972546 - protein, 19 aa, Mycobacterium
SVLRLGVLVFLIGAMLIGT

SEQ ID NO: 972547 - protein, 22 aa, Mycobacterium
SVLVAWLMFTWMIARLPRQPGR

SEQ ID NO: 972548 - protein, 24 aa, Mycobacterium
SVPEEPDMALARRAALASANAPLF

SEQ ID NO: 972549 - protein, 20 aa, Mycobacterium
SVPPLPAFKPSANLGANCQY

SEQ ID NO: 972550 - protein, 24 aa, Mycobacterium
SVPRAKLPALQRVWADDQVSSSNA

SEQ ID NO: 972551 - protein, 24 aa, Mycobacterium
SVSRTRWLSSHLVMVAGSAVATVL

SEQ ID NO: 972552 - protein, 19 aa, Mycobacterium
SVTLSIQFALLAGQVGATS

SEQ ID NO: 972553 - protein, 22 aa, Mycobacterium
SVVAGCTLRWLGRYPSGSGMLK

SEQ ID NO: 972554 - protein, 21 aa, Mycobacterium
SVVQCYYGFCAEGGPEGVGVA

SEQ ID NO: 972555 - protein, 19 aa, Mycobacterium
SVVRDMPAKGGVVLGTAPK

SEQ ID NO: 972556 - protein, 19 aa, Mycobacterium
SVVTPVLKARGRAKVLRNM

SEQ ID NO: 972557 - protein, 20 aa, Mycobacterium
SVWYLLWLVAAAALGYVAWR

SEQ ID NO: 972558 - protein, 19 aa, Mycobacterium
SWAGLRGAVPIVLATFPIV

SEQ ID NO: 972559 - protein, 24 aa, Mycobacterium
SWFDAARPVGAWVDAVLRTFIGSA

SEQ ID NO: 972560 - protein, 22 aa, Mycobacterium
SWIMWVWYKLFALVLGPSNFFA

SEQ ID NO: 972561 - protein, 19 aa, Mycobacterium
SWLAPMVKSSPAMLPTADP

SEQ ID NO: 972562 - protein, 35 aa, Mycobacterium; identical to SEQ ID NO: 330486

SEQ ID NO: 972563 - protein, 29 aa, Mycobacterium
SWLLLAVFRGRLHPIGGLGVALGLTVLLF

SEQ ID NO: 972564 - protein, 20 aa, Mycobacterium
SWPGWAVVGVTLVFGLLIGT

SEQ ID NO: 972565 - protein, 26 aa, Mycobacterium
SWQGENRIAWWVGVGIAVLVTLLSVV

SEQ ID NO: 972566 - protein, 24 aa, Mycobacterium
SWRILKGHLSLMLFPLLSTLFAFL

SEQ ID NO: 972567 - protein, 20 aa, Mycobacterium
SWTHHWVWLVPLMIWVLSGP

SEQ ID NO: 972568 - protein, 18 aa, Mycobacterium
SWYRRYLAVQLLFGSVVL

SEQ ID NO: 972569 - protein, 18 aa, Mycobacterium
SYMALFSVPVLAPLVLRA

SEQ ID NO: 972570 - protein, 28 aa, Mycobacterium
SYMFTEFALRPVAAMALAAGPPLLRWAP

SEQ ID NO: 972571 - protein, 17 aa, Mycobacterium
SYRVCLKTLSAIESRTA

SEQ ID NO: 972572 - protein, 25 aa, Mycobacterium
SYSEEGPCWSMRLNMIEPLKEPAWR

SEQ ID NO: 972573 - protein, 19 aa, Mycobacterium
SYSTRLVHLSSFVVNADVT

SEQ ID NO: 972574 - protein, 23 aa, Mycobacterium
SYSTRLVHLSSFVVNADVTVPQV

SEQ ID NO: 972575 - protein, 18 aa, Mycobacterium
SYYLVIWVTSAYLLTYAA

SEQ ID NO: 972576 - protein, 21 aa, Mycobacterium
TAAAWWLCSAATVVTMLYLAY

SEQ ID NO: 972577 - protein, 24 aa, Mycobacterium
TAAESGAQWGYRMVLPQLILMPIL

SEQ ID NO: 972578 - protein, 25 aa, Mycobacterium
TAAFRRILPFVGRIAGVIVLITGLY

SEQ ID NO: 972579 - protein, 28 aa, Mycobacterium
TAAISRRWRPAWIGWWVALGLAAAIAGG

SEQ ID NO: 972580 - protein, 21 aa, Mycobacterium
TAASLRLVRDFAAEMRDDLSD

SEQ ID NO: 972581 - protein, 24 aa, Mycobacterium
TADFSLAAAWPLAAVVQRQTGGTV

SEQ ID NO: 972582 - protein, 19 aa, Mycobacterium
TADGLGCYGPPQRALAVMR

SEQ ID NO: 972583 - protein, 24 aa, Mycobacterium
TAELYPRYTCDYGTPSYLPSAADY

SEQ ID NO: 972584 - protein, 18 aa, Mycobacterium
TAFFSHPIIAFILFVASP

SEQ ID NO: 972585 - protein, 24 aa, Mycobacterium
TAFQWNWKFGYQKVDFHDHTLTYD

SEQ ID NO: 972586 - protein, 20 aa, Mycobacterium
TAHRRVWRDREPALASPGRP

SEQ ID NO: 972587 - protein, 20 aa, Mycobacterium
TAISEIWLSLDSVGQWLFGI

SEQ ID NO: 972588 - protein, 21 aa, Mycobacterium
TAIVLLLAIGWRSRRRLPAAV

SEQ ID NO: 972589 - protein, 24 aa, Mycobacterium
TAKGGIVFRVQQELGVPVKLVGLG

SEQ ID NO: 972590 - protein, 24 aa, Mycobacterium
TALFGLACAAIVYIALTAPRRPRL

SEQ ID NO: 972591 - protein, 34 aa, Mycobacterium; identical to SEQ ID NO: 330697

SEQ ID NO: 972592 - protein, 17 aa, Mycobacterium
TALIQLYIVGVFISFTL

SEQ ID NO: 972593 - protein, 23 aa, Mycobacterium
TALLCSPMPIAAFLVTPIVGKIV

SEQ ID NO: 972594 - protein, 19 aa, Mycobacterium
TALPLLFFALAGRETAGRV

SEQ ID NO: 972595 - protein, 20 aa, Mycobacterium
TARVPTLWIVLGPLGQSITA

SEQ ID NO: 972596 - protein, 35 aa, Mycobacterium; identical to SEQ ID NO: 330780

SEQ ID NO: 972597 - protein, 17 aa, Mycobacterium
TATAWATPSPRYLAPLR

SEQ ID NO: 972598 - protein, 17 aa, Mycobacterium
TATHLVSVFAHRARLVL

SEQ ID NO: 972599 - protein, 27 aa, Mycobacterium
TATNRLRLGLNIPYLLLLLAFVVYDIF

SEQ ID NO: 972600 - protein, 17 aa, Mycobacterium
TATRQIPFWTFLRNSVI

SEQ ID NO: 972601 - protein, 22 aa, Mycobacterium
TATVISLVFRFDLTRITLTGSP

SEQ ID NO: 972602 - protein, 17 aa, Mycobacterium
TAVAVSWTARALGMESH

SEQ ID NO: 972603 - protein, 24 aa, Mycobacterium
TAVLSRSRVVGVSFAVGVVVLLGL

SEQ ID NO: 972604 - protein, 19 aa, Mycobacterium
TAVRRTVMTAGRTVAFSAV

SEQ ID NO: 972605 - protein, 18 aa, Mycobacterium
TAVVSLIVLFAFVEVGQF

SEQ ID NO: 972606 - protein, 24 aa, Mycobacterium
TAYLEGLGFAYNVYFKRGPNDPPE

SEQ ID NO: 972607 - protein, 26 aa, Mycobacterium
TAYLLAKICVYTVFAVVQSAIVTIIV

SEQ ID NO: 972608 - protein, 23 aa, Mycobacterium
TDAEPRLRALGWTGSLDKGPDVD

SEQ ID NO: 972609 - protein, 21 aa, Mycobacterium
TDCDGRGTLVAGIVAGQPGND

SEQ ID NO: 972610 - protein, 22 aa, Mycobacterium
TDDLRPIPVFGSDELARLTEAF

SEQ ID NO: 972611 - protein, 20 aa, Mycobacterium
TDEGPSWLLWSVILLTSGLV

SEQ ID NO: 972612 - protein, 17 aa, Mycobacterium
TDFPRQFGYNMPLELVL

SEQ ID NO: 972613 - protein, 20 aa, Mycobacterium
TDIFFGLPLLLAAIVLMQVM

SEQ ID NO: 972614 - protein, 22 aa, Mycobacterium
TDLFCTPDRCPTIIGNTLVFRD

SEQ ID NO: 972615 - protein, 23 aa, Mycobacterium
TDLRRAPQAGGREVLRVEIGAPS

SEQ ID NO: 972616 - protein, 19 aa, Mycobacterium
TDLTPVVGVFADNAQHFVP

SEQ ID NO: 972617 - protein, 21 aa, Mycobacterium
TDMFPALAVAITSQYDDPEDD

SEQ ID NO: 972618 - protein, 23 aa, Mycobacterium
TDPQFGKDLGFYAFELPFYRLLL

SEQ ID NO: 972619 - protein, 25 aa, Mycobacterium
TDPVPRAKAIGLWTAMVGVGVAVGP

SEQ ID NO: 972620 - protein, 17 aa, Mycobacterium
TDRASAIVLADHEYFDN

SEQ ID NO: 972621 - protein, 17 aa, Mycobacterium
TDVPIAIALHGAGVVTI

SEQ ID NO: 972622 - protein, 19 aa, Mycobacterium
TEAPFDWYHELLAHLAQIS

SEQ ID NO: 972623 - protein, 21 aa, Mycobacterium
TEARRARPRVFSLEDDGLRSL

SEQ ID NO: 972624 - protein, 21 aa, Mycobacterium
TEFWSRVPSCLAIGAAAAGVT

SEQ ID NO: 972625 - protein, 22 aa, Mycobacterium
TEFWSRVPSCLAIGAAAAGVTV

SEQ ID NO: 972626 - protein, 20 aa, Mycobacterium
TEFWSRVPSSLAIGGAAAGV

SEQ ID NO: 972627 - protein, 17 aa, Mycobacterium
TEISTALVIPKFTVIED

SEQ ID NO: 972628 - protein, 25 aa, Mycobacterium
TELLDRLGAHLTRYIGPGVEYADIR

SEQ ID NO: 972629 - protein, 34 aa, Mycobacterium; identical to SEQ ID NO: 330986

SEQ ID NO: 972630 - protein, 25 aa, Mycobacterium
TELQADCYAGVWAHYASTVRQESTG

SEQ ID NO: 972631 - protein, 17 aa, Mycobacterium
TELRTRLLISLAAILLT

SEQ ID NO: 972632 - protein, 24 aa, Mycobacterium
TEPVAVVGIGCRFPGGADGPEGLW

SEQ ID NO: 972633 - protein, 23 aa, Mycobacterium
TESERGFSMALGRLGDPADTDCL

SEQ ID NO: 972634 - protein, 18 aa, Mycobacterium
TETPAFWIFFACYIGAAI

SEQ ID NO: 972635 - protein, 43 aa, Mycobacterium
TEVGVLPETDFRLLPKYMDMLNMFDAWEFGRGGGQKIAVIDTG

SEQ ID NO: 972636 - protein, 23 aa, Mycobacterium
TFALPQWRDAFLAIANQGESGAV

SEQ ID NO: 972637 - protein, 30 aa, Mycobacterium
TFAQPYPAWRELFSNILPAHIVKDVPGGFA

SEQ ID NO: 972638 - protein, 23 aa, Mycobacterium
TFFDGRTASFTVVGADPTSDIAV

SEQ ID NO: 972639 - protein, 21 aa, Mycobacterium
TFGEFLAWVIGWNLVLELAIG

SEQ ID NO: 972640 - protein, 19 aa, Mycobacterium
TFLFRRLLGTHLRTMFVVL

SEQ ID NO: 972641 - protein, 26 aa, Mycobacterium
TFVAMVHPPFAWREYIAQAWFVARVS

SEQ ID NO: 972642 - protein, 32 aa, Mycobacterium; identical to SEQ ID NO: 331116

SEQ ID NO: 972643 - protein, 30 aa, Mycobacterium; identical to SEQ ID NO: 331124

SEQ ID NO: 972644 - protein, 23 aa, Mycobacterium
TGAIRVTPRFTRMIVAAMFGALA

SEQ ID NO: 972645 - protein, 25 aa, Mycobacterium
TGEFKDMYTRSSVQLRQLLIDNKAT

SEQ ID NO: 972646 - protein, 26 aa, Mycobacterium
TGGAAVRVLFQWRWSIATLWLTAVFL

SEQ ID NO: 972647 - protein, 29 aa, Mycobacterium
TGGLFAQFGLWRWAFGVMATMAGLMTLLV

SEQ ID NO: 972648 - protein, 21 aa, Mycobacterium
TGGVVKPILWGPGKAAAVQRF

SEQ ID NO: 972649 - protein, 27 aa, Mycobacterium
TGLFRRPAHWLSMLIVLGFQVPVDGWL

SEQ ID NO: 972650 - protein, 31 aa, Mycobacterium
TGLLAGPCKPRCWWCARDAPPSMKSTTRCRR

SEQ ID NO: 972651 - protein, 19 aa, Mycobacterium
TGLMCIRLPSLRELDHAPT

SEQ ID NO: 972652 - protein, 25 aa, Mycobacterium
TGMRTPWLVPGWLFLSAVVYVPLAL

SEQ ID NO: 972653 - protein, 21 aa, Mycobacterium
TGMSVDALRHLMIVIDEPDYD

SEQ ID NO: 972654 - protein, 17 aa, Mycobacterium
TGQCCDLAARGYSRDGK

SEQ ID NO: 972655 - protein, 26 aa, Mycobacterium
TGSDGHSAMAMVWLVGQAGSTQARES

SEQ ID NO: 972656 - protein, 19 aa, Mycobacterium
TGSPTRWDATPESPAELST

SEQ ID NO: 972657 - protein, 26 aa, Mycobacterium
TGTARTALPAVVPVAAGQAGQPGAAL

SEQ ID NO: 972658 - protein, 18 aa, Mycobacterium
TGTSLALLTGQIIDVGYS

SEQ ID NO: 972659 - protein, 19 aa, Mycobacterium
TGVARSPEYLWPARSRQDI

SEQ ID NO: 972660 - protein, 21 aa, Mycobacterium
TGVAVAIPFGMVGLVHPRSGL

SEQ ID NO: 972661 - protein, 19 aa, Mycobacterium
TGWVFCVMIAIIASDVGGY

SEQ ID NO: 972662 - protein, 26 aa, Mycobacterium
TGYLLAGTHSWRWMLGLATVPAMLLL

SEQ ID NO: 972663 - protein, 25 aa, Mycobacterium
THRWIKDLPDEPVWVNGDHARLHQL

SEQ ID NO: 972664 - protein, 25 aa, Mycobacterium
TIATACPFCRVMVTDGVNDRQEEAG

SEQ ID NO: 972665 - protein, 27 aa, Mycobacterium
TIGGGYLLVCAMIYGWAFMQRGVPYFP

SEQ ID NO: 972666 - protein, 25 aa, Mycobacterium
TIGVLRARHPPPWGADVLVSDLTGA

SEQ ID NO: 972667 - protein, 24 aa, Mycobacterium
TILGFYVNCGMAWVVTVASDIVFN

SEQ ID NO: 972668 - protein, 27 aa, Mycobacterium
TIQAAQLSAVWARFPLPVIPAPGDPTP

SEQ ID NO: 972669 - protein, 24 aa, Mycobacterium
TISAERLALAIAFLVGIASVFVIS

SEQ ID NO: 972670 - protein, 20 aa, Mycobacterium
TIVPLPWVIQAPRLFAGQID

SEQ ID NO: 972671 - protein, 23 aa, Mycobacterium
TKAKRGVDRAVVWHAEPMAGKEI

SEQ ID NO: 972672 - protein, 23 aa, Mycobacterium
TKALRVGYVAAFSVPANQLPQKV

SEQ ID NO: 972673 - protein, 18 aa, Mycobacterium
TKAQAIAGARARGDNTFA

SEQ ID NO: 972674 - protein, 23 aa, Mycobacterium
TKTLSGFPAAYCEYRVNWTNHKE

SEQ ID NO: 972675 - protein, 24 aa, Mycobacterium
TKTLSGFPAAYCEYRVNWTNHKEI

SEQ ID NO: 972676 - protein, 21 aa, Mycobacterium
TKTRVRDVLRNAAIIRRFVYL

SEQ ID NO: 972677 - protein, 20 aa, Mycobacterium
TKVCSHLGCPSSLYEQQSYR

SEQ ID NO: 972678 - protein, 18 aa, Mycobacterium
TLAAAALLMRLASIVESL

SEQ ID NO: 972679 - protein, 27 aa, Mycobacterium
TLADRYGRRRWYLMGIVLFTLGSIACG

SEQ ID NO: 972680 - protein, 27 aa, Mycobacterium
TLAEIWSHPALETWMAIEIAARGRAGA

SEQ ID NO: 972681 - protein, 24 aa, Mycobacterium
TLAGIACWLLISRFVLRRLGPGKN

SEQ ID NO: 972682 - protein, 26 aa, Mycobacterium
TLAGLARFVWATAIVWILGGFGTWLI

SEQ ID NO: 972683 - protein, 18 aa, Mycobacterium
TLALFVAIQMITRRRKFQ

SEQ ID NO: 972684 - protein, 21 aa, Mycobacterium
TLAVLMLLPLSAFEATNALPA

SEQ ID NO: 972685 - protein, 18 aa, Mycobacterium
TLEDYTLRFAPRSYRRWS

SEQ ID NO: 972686 - protein, 27 aa, Mycobacterium
TLEVYRLTGLWPKLGAPWYAFWRLLPK

SEQ ID NO: 972687 - protein, 19 aa, Mycobacterium
TLFCCLPLGIVSIVYSSKV

SEQ ID NO: 972688 - protein, 24 aa, Mycobacterium
TLGSPCSIGLLAVILASLTLAPAV

SEQ ID NO: 972689 - protein, 28 aa, Mycobacterium
TLLIRHCVRRFGGITGDVLGCAIELATT

SEQ ID NO: 972690 - protein, 27 aa, Mycobacterium
TLLVASAWWLFEWEVGKGASVEAARTA

SEQ ID NO: 972691 - protein, 20 aa, Mycobacterium
TLLVCDRLVINPAPYLMAEA

SEQ ID NO: 972692 - protein, 32 aa, Mycobacterium
TLNRSRLGRGWLTGIAVALLLAGCGIGTGGYC

SEQ ID NO: 972693 - protein, 22 aa, Mycobacterium
TLPPGSQVRLCMAAVNRDGSDA

SEQ ID NO: 972694 - protein, 17 aa, Mycobacterium
TLRFAPRSYRRWSPAVV

SEQ ID NO: 972695 - protein, 19 aa, Mycobacterium
TLRPLRRVAATAATVAAMP

SEQ ID NO: 972696 - protein, 28 aa, Mycobacterium
TLSGGALWRFAALMVLSSMVASIGLLQN

SEQ ID NO: 972697 - protein, 23 aa, Mycobacterium
TLSLPECQGALYTSQDPVYSGTG

SEQ ID NO: 972698 - protein, 25 aa, Mycobacterium
TLSQRFGRRYTIAFCAVLALPVVPI

SEQ ID NO: 972699 - protein, 17 aa, Mycobacterium
TLTKSLRNFVMRGVVPL

SEQ ID NO: 972700 - protein, 31 aa, Mycobacterium
TLTRPADTTQEWNWQNQLTWIATSLGRTTTA

SEQ ID NO: 972701 - protein, 29 aa, Mycobacterium
TLVFAPRGWVAICAFAMVVATHEVVRRLR

SEQ ID NO: 972702 - protein, 18 aa, Mycobacterium
TLVGAEFINVFELIVGIV

SEQ ID NO: 972703 - protein, 28 aa, Mycobacterium
TLVIPALFTLIGDRIWWPSDPKTTAHQP

SEQ ID NO: 972704 - protein, 21 aa, Mycobacterium
TLYPHCAPKIGVLGENPSLDQ

SEQ ID NO: 972705 - protein, 22 aa, Mycobacterium
TMIGVLPRWQPVAILSVLAVLG

SEQ ID NO: 972706 - protein, 20 aa, Mycobacterium
TMLYGCYAMFGLSFVASLNI

SEQ ID NO: 972707 - protein, 18 aa, Mycobacterium
TMRPALDKLNGVLTILDN

SEQ ID NO: 972708 - protein, 25 aa, Mycobacterium
TMRTVKLNLAWAFGYNIAAIPIAAA

SEQ ID NO: 972709 - protein, 26 aa, Mycobacterium
TMTGHAVAFLGPWLFSIFVDIFSAVR

SEQ ID NO: 972710 - protein, 25 aa, Mycobacterium
TMTYALRYRWWVVLTGVAIASVTVH

SEQ ID NO: 972711 - protein, 18 aa, Mycobacterium
TNFKRALIEVSYFSGLGV

SEQ ID NO: 972712 - protein, 23 aa, Mycobacterium
TNHRLTTWIGWGVAVLISVLNVA

SEQ ID NO: 972713 - protein, 20 aa, Mycobacterium
TNLVGIVVMAAVVFLLSGLV

SEQ ID NO: 972714 - protein, 17 aa, Mycobacterium
TNPASFRRWLNPVNTAA

SEQ ID NO: 972715 - protein, 17 aa, Mycobacterium
TNPAVVISRHLSTPPPA

SEQ ID NO: 972716 - protein, 22 aa, Mycobacterium
TNRASAVFGGWLAGLAGAWFVV

SEQ ID NO: 972717 - protein, 17 aa, Mycobacterium
TNVLSELPEGSDITLNL

SEQ ID NO: 972718 - protein, 23 aa, Mycobacterium
TPAHLCVLGGFLVGAIVVEGLVR

SEQ ID NO: 972719 - protein, 20 aa, Mycobacterium
TPALIRLFTKQGFGHQIRED

SEQ ID NO: 972720 - protein, 18 aa, Mycobacterium
TPAPYGPLFLWIGRGISD

SEQ ID NO: 972721 - protein, 22 aa, Mycobacterium
TPDVYWPLRRIGVEFHAAQDGK

SEQ ID NO: 972722 - protein, 20 aa, Mycobacterium
TPFLIISVLFYFTVVVQERM

SEQ ID NO: 972723 - protein, 18 aa, Mycobacterium
TPIQRLLLELATLVGAEF

SEQ ID NO: 972724 - protein, 24 aa, Mycobacterium
TPKVFKAAAWVAIVAGIVFIVSVI

SEQ ID NO: 972725 - protein, 17 aa, Mycobacterium
TPLQVGIHMIPLGLGAA

SEQ ID NO: 972726 - protein, 22 aa, Mycobacterium
TPLTAKLAWFSKVLTIAILGLA

SEQ ID NO: 972727 - protein, 24 aa, Mycobacterium
TPPEHWDSPLFKKINTVITIVWAG

SEQ ID NO: 972728 - protein, 18 aa, Mycobacterium
TPPLPLPFPRTGQGGEPH

SEQ ID NO: 972729 - protein, 21 aa, Mycobacterium
TPQRRGRWRIFAAASTVLALT

SEQ ID NO: 972730 - protein, 19 aa, Mycobacterium
TPRGRFTIPTPYGGPVLPI

SEQ ID NO: 972731 - protein, 28 aa, Mycobacterium
TPRSSSGNRAFWIIAAVFVVGILGAVAA

SEQ ID NO: 972732 - protein, 19 aa, Mycobacterium
TPSAFPISAKIVPGGVAVD

SEQ ID NO: 972733 - protein, 26 aa, Mycobacterium
TPSIAALLGRWFWWPLNIRSRPPRLT

SEQ ID NO: 972734 - protein, 25 aa, Mycobacterium
TPSIAALMGRWFWWPQQVRTRPASQ

SEQ ID NO: 972735 - protein, 34 aa, Mycobacterium
TPSVAALLGRWFWWPLRVRPRPASYMLGPFGPRR

SEQ ID NO: 972736 - protein, 23 aa, Mycobacterium
TPTKWTHHFGVFAGLAGSLGALA

SEQ ID NO: 972737 - protein, 19 aa, Mycobacterium
TPTKWVHHFGLFAAVGAAM

SEQ ID NO: 972738 - protein, 26 aa, Mycobacterium
TPTLIWQRRLLKRLPDRLARLHAAAS

SEQ ID NO: 972739 - protein, 19 aa, Mycobacterium
TPTLYRPAGGLSNAAVRQT

SEQ ID NO: 972740 - protein, 19 aa, Mycobacterium
TPTWRRLLDDLSYEPLVSP

SEQ ID NO: 972741 - protein, 18 aa, Mycobacterium
TPVLGSWRSGIQVPAMLR

SEQ ID NO: 972742 - protein, 17 aa, Mycobacterium
TPWCAVGLLATPVALRA

SEQ ID NO: 972743 - protein, 20 aa, Mycobacterium
TPWRWLPRIVTQFVAGALAA

SEQ ID NO: 972744 - protein, 19 aa, Mycobacterium
TPWVVLRLLPQGPTLSRAD

SEQ ID NO: 972745 - protein, 17 aa, Mycobacterium
TQIPAPVILVVATTVAF

SEQ ID NO: 972746 - protein, 24 aa, Mycobacterium
TQPKKAAAALAWLVEEMEQRYQDM

SEQ ID NO: 972747 - protein, 25 aa, Mycobacterium
TQPVAIDDLVNWFLGHPWQKEYGSA

SEQ ID NO: 972748 - protein, 26 aa, Mycobacterium
TQPVLLDWAVGLAFPCQQPMLHVNGV

SEQ ID NO: 972749 - protein, 18 aa, Mycobacterium
TQRFSWVIIGLTLFTAGS

SEQ ID NO: 972750 - protein, 18 aa, Mycobacterium
TQVSGLWAQGRYAEAQAA

SEQ ID NO: 972751 - protein, 19 aa, Mycobacterium
TRDAVAYGVSTSARTITSA

SEQ ID NO: 972752 - protein, 20 aa, Mycobacterium
TRDEYRYTESLVYPALGDGA

SEQ ID NO: 972753 - protein, 21 aa, Mycobacterium
TREDFAYLVDFGIASATTDEK

SEQ ID NO: 972754 - protein, 28 aa, Mycobacterium
TRLATRVGFPSMLLFLLVGVIVGEDGFG

SEQ ID NO: 972755 - protein, 22 aa, Mycobacterium
TRLFELPGALFVVVAVTVAGAL

SEQ ID NO: 972756 - protein, 23 aa, Mycobacterium
TRLRTEVLAGLVVALALIPEAIS

SEQ ID NO: 972757 - protein, 17 aa, Mycobacterium
TRMLGAYRKLWADISSE

SEQ ID NO: 972758 - protein, 17 aa, Mycobacterium
TRMPQGWSFAQAAAVPV

SEQ ID NO: 972759 - protein, 18 aa, Mycobacterium
TRNAWWVRHYTFTGSAVG

SEQ ID NO: 972760 - protein, 18 aa, Mycobacterium
TRPGTARPVVTTKLPPFA

SEQ ID NO: 972761 - protein, 20 aa, Mycobacterium
TRPYRVIAGLVLSFCLVTLT

SEQ ID NO: 972762 - protein, 20 aa, Mycobacterium
TRQIPFWTFLRNSVIITSVL

SEQ ID NO: 972763 - protein, 31 aa, Mycobacterium; identical to SEQ ID NO: 332018

SEQ ID NO: 972764 - protein, 24 aa, Mycobacterium
TRRIRLRLIISCALVLIPWTVFLG

SEQ ID NO: 972765 - protein, 28 aa, Mycobacterium
TRRLPRRYWAVVSFLVLFSIANFPDALL

SEQ ID NO: 972766 - protein, 17 aa, Mycobacterium
TRSAATLPDGPQTDVGA

SEQ ID NO: 972767 - protein, 22 aa, Mycobacterium
TRSEGAGMLVLKRVDDARRDGD

SEQ ID NO: 972768 - protein, 31 aa, Mycobacterium; identical to SEQ ID NO: 332046

SEQ ID NO: 972769 - protein, 24 aa, Mycobacterium
TSAAALPVVAVRPAAAATGATSVA

SEQ ID NO: 972770 - protein, 26 aa, Mycobacterium
TSAFAGIGMFGPWGIIIGPVLMILIV

SEQ ID NO: 972771 - protein, 20 aa, Mycobacterium
TSDELACIRNAVRITDEAMV

SEQ ID NO: 972772 - protein, 30 aa, Mycobacterium; identical to SEQ ID NO: 332083

SEQ ID NO: 972773 - protein, 23 aa, Mycobacterium
TSGLPAFWHVAAWWNQPIVYQKV

SEQ ID NO: 972774 - protein, 30 aa, Mycobacterium; identical to SEQ ID NO: 332115

SEQ ID NO: 972775 - protein, 25 aa, Mycobacterium
TSNLTLSAFVMFSSVAGIWGGKSQG

SEQ ID NO: 972776 - protein, 24 aa, Mycobacterium
TSPDPECRAAIELYGPHQRSGGAL

SEQ ID NO: 972777 - protein, 25 aa, Mycobacterium
TSPYSSWLVVRWVIASALGGPLLIA

SEQ ID NO: 972778 - protein, 21 aa, Mycobacterium
TSRPRAVLRAGAATAGMSLGF

SEQ ID NO: 972779 - protein, 23 aa, Mycobacterium
TSSGVLLLWSWLAMSLAQGYYSM

SEQ ID NO: 972780 - protein, 20 aa, Mycobacterium
TSTYKAEFSNVTGLEQNDFV

SEQ ID NO: 972781 - protein, 21 aa, Mycobacterium
TSVAWGLWAGGGMGDRPSASG

SEQ ID NO: 972782 - protein, 23 aa, Mycobacterium
TTAASAFARYVHKPEQLAKLAKA

SEQ ID NO: 972783 - protein, 19 aa, Mycobacterium
TTFFPRLSTAAIEIGLVAG

SEQ ID NO: 972784 - protein, 22 aa, Mycobacterium
TTGARYLATFAHNVDAYASTAV

SEQ ID NO: 972785 - protein, 18 aa, Mycobacterium
TTLAALPWVTWLAVGNNI

SEQ ID NO: 972786 - protein, 17 aa, Mycobacterium
TTLRMIYQEMLANYHVG

SEQ ID NO: 972787 - protein, 25 aa, Mycobacterium
TTLVNLLMRFYEVDSGRILVDGIDI

SEQ ID NO: 972788 - protein, 25 aa, Mycobacterium
TTPGRPSFGRWALQPLTCAFAVAGA

SEQ ID NO: 972789 - protein, 17 aa, Mycobacterium
TTPRPGRETEFLAAEKA

SEQ ID NO: 972790 - protein, 32 aa, Mycobacterium; identical to SEQ ID NO: 332247

SEQ ID NO: 972791 - protein, 34 aa, Mycobacterium; identical to SEQ ID NO: 332251

SEQ ID NO: 972792 - protein, 23 aa, Mycobacterium
TTSRIEGLLTWLGGGHWRELGER

SEQ ID NO: 972793 - protein, 17 aa, Mycobacterium
TTSRMAFALTIHGDGPR

SEQ ID NO: 972794 - protein, 24 aa, Mycobacterium
TTTSKSSTAWAPRGTVLITGGTGA

SEQ ID NO: 972795 - protein, 27 aa, Mycobacterium
TTVAFGAFAHRWLARRTKRRINPGLVV

SEQ ID NO: 972796 - protein, 24 aa, Mycobacterium
TTVIIRFWLLTAITCGLGVALFYG

SEQ ID NO: 972797 - protein, 25 aa, Mycobacterium
TTVVLRFVEHLTYHYAFGSLLEGIT

SEQ ID NO: 972798 - protein, 18 aa, Mycobacterium
TTVWCLVLLSLALTVTTF

SEQ ID NO: 972799 - protein, 26 aa, Mycobacterium
TVAIMVVSLIGWWALSRLLERMRGIP

SEQ ID NO: 972800 - protein, 17 aa, Mycobacterium
TVASRFGLLEPKRAIRI

SEQ ID NO: 972801 - protein, 37 aa, Mycobacterium; identical to SEQ ID NO: 332332

SEQ ID NO: 972802 - protein, 23 aa, Mycobacterium
TVGCALDYEYIAMLFVEADSATL

SEQ ID NO: 972803 - protein, 19 aa, Mycobacterium
TVIASLWFTIFGDAALLRQ

SEQ ID NO: 972804 - protein, 20 aa, Mycobacterium
TVIVSSLIAGLAFGSAMVGM

SEQ ID NO: 972805 - protein, 18 aa, Mycobacterium
TVLFQTALTKLRDILAAA

SEQ ID NO: 972806 - protein, 18 aa, Mycobacterium
TVLGRDGVGLSLGQRQRL

SEQ ID NO: 972807 - protein, 26 aa, Mycobacterium
TVLVILRLLYDIGMGGEWGLGAALAM

SEQ ID NO: 972808 - protein, 28 aa, Mycobacterium
TVLVVALWRFRWIRLAMISALLATQGSG

SEQ ID NO: 972809 - protein, 19 aa, Mycobacterium
TVNRGCVVQTHLFHDRIMR

SEQ ID NO: 972810 - protein, 22 aa, Mycobacterium
TVPAMLLLPLLIRMPDTPRWYV

SEQ ID NO: 972811 - protein, 26 aa, Mycobacterium
TVPLVRWTAHWPRRHALMVSLVCLTI

SEQ ID NO: 972812 - protein, 32 aa, Mycobacterium; identical to SEQ ID NO: 332430

SEQ ID NO: 972813 - protein, 25 aa, Mycobacterium
TVSADWGHAVVLVFVDQTTVIGDDP

SEQ ID NO: 972814 - protein, 31 aa, Mycobacterium; identical to SEQ ID NO: 332449

SEQ ID NO: 972815 - protein, 19 aa, Mycobacterium
TVTLVWLYIEILRLLSYLQ

SEQ ID NO: 972816 - protein, 21 aa, Mycobacterium
TVVAVLSMMVWISPLLALITL

SEQ ID NO: 972817 - protein, 22 aa, Mycobacterium
TVVCAAVLFSVRLIGPRVAVVF

SEQ ID NO: 972818 - protein, 19 aa, Mycobacterium
TVVCLRAPGMTMFRMPIFT

SEQ ID NO: 972819 - protein, 17 aa, Mycobacterium
TVVKARWGESATGAATI

SEQ ID NO: 972820 - protein, 21 aa, Mycobacterium
TVVLCVVALYAVNVILTTIGV

SEQ ID NO: 972821 - protein, 17 aa, Mycobacterium
TVVMPRLSRNAAAEDIL

SEQ ID NO: 972822 - protein, 24 aa, Mycobacterium
TVVYRVSCELFFASSNDLVYQFNY

SEQ ID NO: 972823 - protein, 23 aa, Mycobacterium
TVWVRPRQGPKLADLIAQPDTTR

SEQ ID NO: 972824 - protein, 21 aa, Mycobacterium
TWFRHEPRLGSYATPDATAAT

SEQ ID NO: 972825 - protein, 39 aa, Mycobacterium; identical to SEQ ID NO: 332533

SEQ ID NO: 972826 - protein, 19 aa, Mycobacterium
TWYTVDRPVYVALTLPSGS

SEQ ID NO: 972827 - protein, 24 aa, Mycobacterium
TYGLKLPLLALLDFLTGHFSVALS

SEQ ID NO: 972828 - protein, 18 aa, Mycobacterium
TYLMFSWMQVFTASGFAF

SEQ ID NO: 972829 - protein, 29 aa, Mycobacterium
TYQRLKKPILVWWIAWVVSTATSLFAIAT

SEQ ID NO: 972830 - protein, 17 aa, Mycobacterium
VAAAALGYVAWRLFGHI

SEQ ID NO: 972831 - protein, 17 aa, Mycobacterium
VAAAVACEVKDKATASF

SEQ ID NO: 972832 - protein, 23 aa, Mycobacterium
VAAAVAFAWRAKILTAETHLQPL

SEQ ID NO: 972833 - protein, 23 aa, Mycobacterium
VAACAACGIIYEIALLTLSTSLD

SEQ ID NO: 972834 - protein, 17 aa, Mycobacterium
VAACLAGAIAGFARLRP

SEQ ID NO: 972835 - protein, 22 aa, Mycobacterium
VAAICHGVLLAARSIDPATGRS

SEQ ID NO: 972836 - protein, 20 aa, Mycobacterium
VAAIGDWAAGYIRRHPLAAL

SEQ ID NO: 972837 - protein, 17 aa, Mycobacterium
VAAIGTRFMQLRSKRLA

SEQ ID NO: 972838 - protein, 17 aa, Mycobacterium
VAAKTWPWIAAAVAVVV

SEQ ID NO: 972839 - protein, 25 aa, Mycobacterium
VAALEAAALIALWRLLARARQENDE

SEQ ID NO: 972840 - protein, 18 aa, Mycobacterium
VAALICFLLIVTIPFGFA

SEQ ID NO: 972841 - protein, 18 aa, Mycobacterium
VAALSAWGLYRFNQILAG

SEQ ID NO: 972842 - protein, 19 aa, Mycobacterium
VAALTFKGSLGVASIVVFI

SEQ ID NO: 972843 - protein, 23 aa, Mycobacterium
VAAPGLAQHGPWIAILTAALTAL

SEQ ID NO: 972844 - protein, 18 aa, Mycobacterium
VAAVIAFVGSHAGAKPAN

SEQ ID NO: 972845 - protein, 17 aa, Mycobacterium
VAAWIAVAVIANLAVVL

SEQ ID NO: 972846 - protein, 19 aa, Mycobacterium
VACQVPIYLMRSSRFTALE

SEQ ID NO: 972847 - protein, 17 aa, Mycobacterium
VADGRRVVLGAADTFRA

SEQ ID NO: 972848 - protein, 25 aa, Mycobacterium
VADLAFLPRLVVLIVVALVITGAVY

SEQ ID NO: 972849 - protein, 24 aa, Mycobacterium
VADRLPGVRLDWFTADNTATARQA

SEQ ID NO: 972850 - protein, 21 aa, Mycobacterium
VADYPAVLLNGSWLSQEQTTA

SEQ ID NO: 972851 - protein, 21 aa, Mycobacterium
VADYPAVLLNGSWLTQEQAAA

SEQ ID NO: 972852 - protein, 18 aa, Mycobacterium
VAEGLGIGSPTSRIIAAA

SEQ ID NO: 972853 - protein, 21 aa, Mycobacterium
VAELCGQWTQMWAYGTAFLLA

SEQ ID NO: 972854 - protein, 32 aa, Mycobacterium; identical to SEQ ID NO: 332751

SEQ ID NO: 972855 - protein, 21 aa, Mycobacterium
VAFFAWERFARTRLIDPNGVH

SEQ ID NO: 972856 - protein, 19 aa, Mycobacterium
VAFVAGWMYFLNWAMTGVV

SEQ ID NO: 972857 - protein, 17 aa, Mycobacterium
VAFVVGVAFNRIMAAAR

SEQ ID NO: 972858 - protein, 23 aa, Mycobacterium
VAFVVTVFAAVYVRRFGPRGRAL

SEQ ID NO: 972859 - protein, 21 aa, Mycobacterium
VAGAWRIDLAIDRNMGVAQAE

SEQ ID NO: 972860 - protein, 20 aa, Mycobacterium
VAGCGVSRIVDGHRIEVGKP

SEQ ID NO: 972861 - protein, 23 aa, Mycobacterium
VAGCLGMLGWLAVEQIRDGKPTT

SEQ ID NO: 972862 - protein, 20 aa, Mycobacterium
VAGGSFRRWEQVMFMLISVN

SEQ ID NO: 972863 - protein, 26 aa, Mycobacterium
VAGILSGAVAWIIALFYKSIYVGGLI

SEQ ID NO: 972864 - protein, 26 aa, Mycobacterium
VAGPLRPGHWLMFAVISAATLGAMVA

SEQ ID NO: 972865 - protein, 22 aa, Mycobacterium
VAGRLRVAAFRTLLLSLPPRVL

SEQ ID NO: 972866 - protein, 22 aa, Mycobacterium
VAGRMPGHMNVLLAEAEVDYDA

SEQ ID NO: 972867 - protein, 19 aa, Mycobacterium
VAGSGEWLVAFRVLQGIGA

SEQ ID NO: 972868 - protein, 19 aa, Mycobacterium
VAGSYRKTRLVPFGEYFPL

SEQ ID NO: 972869 - protein, 28 aa, Mycobacterium
VAGTMLLRLCMLPGLALLIWATPRLAHH

SEQ ID NO: 972870 - protein, 17 aa, Mycobacterium
VAGVAWIVVMTCICYRG

SEQ ID NO: 972871 - protein, 19 aa, Mycobacterium
VAIACIIGALTLFSGPTGI

SEQ ID NO: 972872 - protein, 20 aa, Mycobacterium
VAIACPWLLFLSLDWPLTPL

SEQ ID NO: 972873 - protein, 19 aa, Mycobacterium
VAIACPWLLFLSLDWPVTP

SEQ ID NO: 972874 - protein, 19 aa, Mycobacterium
VAIALSLLAMLLIRQLRRR

SEQ ID NO: 972875 - protein, 24 aa, Mycobacterium
VAILAVTGYLIFKPSGQAPVKRVD

SEQ ID NO: 972876 - protein, 27 aa, Mycobacterium
VAITGYSKFWWPDVPTWAPALVTIAVM

SEQ ID NO: 972877 - protein, 20 aa, Mycobacterium
VAIWGLRLSRHIHRKRVGKG

SEQ ID NO: 972878 - protein, 17 aa, Mycobacterium
VALAVAVPAAWAQTHII

SEQ ID NO: 972879 - protein, 25 aa, Mycobacterium
VALCGVVCFVGFLASYLFNVYVQGG

SEQ ID NO: 972880 - protein, 25 aa, Mycobacterium
VALELARFAALSAIFTGLGGVVVGI

SEQ ID NO: 972881 - protein, 17 aa, Mycobacterium
VALEVALAIDIRPTVAL

SEQ ID NO: 972882 - protein, 17 aa, Mycobacterium
VALIPMAALVAVMIMVS

SEQ ID NO: 972883 - protein, 27 aa, Mycobacterium
VALLATFSWPALRPTATLFLVGTAVVA

SEQ ID NO: 972884 - protein, 23 aa, Mycobacterium
VALPDGRHVWEFAPREATDLAAL

SEQ ID NO: 972885 - protein, 21 aa, Mycobacterium
VALPQMRFNIDIKADSAVEPT

SEQ ID NO: 972886 - protein, 17 aa, Mycobacterium
VALRGVRIGRIESLHLT

SEQ ID NO: 972887 - protein, 26 aa, Mycobacterium
VALTGVVCFVGFFASYMFNVYFQNGA

SEQ ID NO: 972888 - protein, 20 aa, Mycobacterium
VALTSILGFVFGVLGMAIAA

SEQ ID NO: 972889 - protein, 23 aa, Mycobacterium
VANLELYLIFPLANEQATITLVR

SEQ ID NO: 972890 - protein, 22 aa, Mycobacterium
VAPARARPVWVVPEARAVTAAT

SEQ ID NO: 972891 - protein, 29 aa, Mycobacterium
VAPGQCRLRRSAGFAVRFQAERGGFGRSV

SEQ ID NO: 972892 - protein, 17 aa, Mycobacterium
VAPKLSRRILHQLYLGY

SEQ ID NO: 972893 - protein, 31 aa, Mycobacterium; identical to SEQ ID NO: 333027

SEQ ID NO: 972894 - protein, 22 aa, Mycobacterium
VAQAEAALRCPATQAVLNSVRA

SEQ ID NO: 972895 - protein, 18 aa, Mycobacterium
VAQFGWRETCFITVVAGG

SEQ ID NO: 972896 - protein, 18 aa, Mycobacterium
VAQMAAVLLVWRRVSDGW

SEQ ID NO: 972897 - protein, 21 aa, Mycobacterium
VAQRQWRWPLGEIDKPFEMRR

SEQ ID NO: 972898 - protein, 17 aa, Mycobacterium
VARLRHRGMDEAGYMPD

SEQ ID NO: 972899 - protein, 23 aa, Mycobacterium
VARTAPHRWLKTSGMVRDTATDS

SEQ ID NO: 972900 - protein, 17 aa, Mycobacterium
VARYKLVVGRRIQSSTM

SEQ ID NO: 972901 - protein, 17 aa, Mycobacterium
VASCLLLEYGVATAAVA

SEQ ID NO: 972902 - protein, 25 aa, Mycobacterium
VASRPELLEGIGRRVLAWVNSIRGR

SEQ ID NO: 972903 - protein, 19 aa, Mycobacterium
VASYSWYYAWTPGTGYLAN

SEQ ID NO: 972904 - protein, 17 aa, Mycobacterium
VATIAGLIGFVLSVATP

SEQ ID NO: 972905 - protein, 24 aa, Mycobacterium
VATIKRFTERFAPFNLSPAAVRPS

SEQ ID NO: 972906 - protein, 30 aa, Mycobacterium; identical to SEQ ID NO: 333098

SEQ ID NO: 972907 - protein, 26 aa, Mycobacterium
VATRAYPLLKRGIRINAICPGPTDTP

SEQ ID NO: 972908 - protein, 22 aa, Mycobacterium
VATVIVCWRMGRQLRGQRSASR

SEQ ID NO: 972909 - protein, 25 aa, Mycobacterium
VATVTAVARRTRDTGAPQECGSTCG

SEQ ID NO: 972910 - protein, 19 aa, Mycobacterium
VAVLPWILVLVRRRTNGTD

SEQ ID NO: 972911 - protein, 18 aa, Mycobacterium
VAVLVYLFIVDWRVALVL

SEQ ID NO: 972912 - protein, 22 aa, Mycobacterium
VAVSAMVAVGVGWITATLLPAT

SEQ ID NO: 972913 - protein, 26 aa, Mycobacterium
VAYQARLKPAESLLRLPPPGENWRLV

SEQ ID NO: 972914 - protein, 17 aa, Mycobacterium
VCATMRYEDFSGNQIDQ

SEQ ID NO: 972915 - protein, 18 aa, Mycobacterium
VCGHSSCRSMQALLDNGA

SEQ ID NO: 972916 - protein, 18 aa, Mycobacterium
VCGVFAFLILRALSELVL

SEQ ID NO: 972917 - protein, 25 aa, Mycobacterium
VCISEDCPPVPFAVNYYIYPVMWGG

SEQ ID NO: 972918 - protein, 22 aa, Mycobacterium
VCYHAAGIWRRGIVGHPIKLLK

SEQ ID NO: 972919 - protein, 18 aa, Mycobacterium
VDAAHELRTPIAGMQVAA

SEQ ID NO: 972920 - protein, 35 aa, Mycobacterium
VDAASREAFGRPCGFSGSFVAEYVRPQKYRDRSEF

SEQ ID NO: 972921 - protein, 23 aa, Mycobacterium
VDAGRVMAALGFEDREVLREGIA

SEQ ID NO: 972922 - protein, 17 aa, Mycobacterium
VDALILGLSERRRSRRA

SEQ ID NO: 972923 - protein, 25 aa, Mycobacterium
VDASLRLLVPGGRFIEMGKTDLRDP

SEQ ID NO: 972924 - protein, 23 aa, Mycobacterium
VDASLRLLVRGGRFLEMGKTDIR

SEQ ID NO: 972925 - protein, 17 aa, Mycobacterium
VDDGGYVSARWPGDTHT

SEQ ID NO: 972926 - protein, 18 aa, Mycobacterium
VDGGTWAAFGDRLKHLVL

SEQ ID NO: 972927 - protein, 19 aa, Mycobacterium
VDGRELWNTYGPTEATVVA

SEQ ID NO: 972928 - protein, 19 aa, Mycobacterium
VDILLVFGLGAFLSAVLFA

SEQ ID NO: 972929 - protein, 17 aa, Mycobacterium
VDLLPFLLLGTTFGVRL

SEQ ID NO: 972930 - protein, 21 aa, Mycobacterium
VDLTVCVAVGYTAFLLCPARQ

SEQ ID NO: 972931 - protein, 26 aa, Mycobacterium
VDPDGALARWNWVLDGMVDTKALSAK

SEQ ID NO: 972932 - protein, 29 aa, Mycobacterium
VDPIAEGWFFDRPDLIGADGVHPNDAGHA

SEQ ID NO: 972933 - protein, 18 aa, Mycobacterium
VDPVAALTWDVPEGPVKP

SEQ ID NO: 972934 - protein, 27 aa, Mycobacterium
VDQKRWSGDLAMTWDLLCRSITHGIVG

SEQ ID NO: 972935 - protein, 24 aa, Mycobacterium
VDQLRYRRCRNITHYSEWLGALVI

SEQ ID NO: 972936 - protein, 18 aa, Mycobacterium
VDSDELWDIRNRGVIPPG

SEQ ID NO: 972937 - protein, 18 aa, Mycobacterium
VDTLGWQWIFFVNIPVGI

SEQ ID NO: 972938 - protein, 17 aa, Mycobacterium
VDTRTELLIARATAELR

SEQ ID NO: 972939 - protein, 17 aa, Mycobacterium
VDYAKTRTLWGKNIGQF

SEQ ID NO: 972940 - protein, 24 aa, Mycobacterium
VEASSLFRVSRLNCSITTSDGTVL

SEQ ID NO: 972941 - protein, 24 aa, Mycobacterium
VEASSWRLVFLVNIPLGIVAVLVA

SEQ ID NO: 972942 - protein, 17 aa, Mycobacterium
VEAVAPWLTTDSAVYPA

SEQ ID NO: 972943 - protein, 18 aa, Mycobacterium
VEAWHLVAVVALDALLLA

SEQ ID NO: 972944 - protein, 17 aa, Mycobacterium
VEELPKEFRCVSVDLLA

SEQ ID NO: 972945 - protein, 17 aa, Mycobacterium
VEEVRRRGITIPGAEDF

SEQ ID NO: 972946 - protein, 24 aa, Mycobacterium
VEGACTFLSLPRLTRVLASVPDSA

SEQ ID NO: 972947 - protein, 23 aa, Mycobacterium
VEGLAALIFSRYLWAFELTSALL

SEQ ID NO: 972948 - protein, 32 aa, Mycobacterium
VEGYVAVAIPTGWPTQRVIGGPGSMRVQITSP

SEQ ID NO: 972949 - protein, 17 aa, Mycobacterium
VEIADAAGLPVLTVGAL

SEQ ID NO: 972950 - protein, 20 aa, Mycobacterium
VEKIRSALVGYRIMAWTTGV

SEQ ID NO: 972951 - protein, 24 aa, Mycobacterium
VEKRPRLTMFDDFGGRIPSDKPPI

SEQ ID NO: 972952 - protein, 22 aa, Mycobacterium
VELGIILALLMGWQFTAAESVG

SEQ ID NO: 972953 - protein, 20 aa, Mycobacterium
VELPLSIPVLVSGLRVVVVT

SEQ ID NO: 972954 - protein, 20 aa, Mycobacterium
VELRNRFKSATGLTLPPTVI

SEQ ID NO: 972955 - protein, 20 aa, Mycobacterium
VELRNRLKTATGLTLSPTLI

SEQ ID NO: 972956 - protein, 22 aa, Mycobacterium
VEPRLWNMSTVLPILQDTTIVV

SEQ ID NO: 972957 - protein, 19 aa, Mycobacterium
VEPTLTIREARAGDRYLLC

SEQ ID NO: 972958 - protein, 18 aa, Mycobacterium
VEQLTWRDGLVVGVAQTL

SEQ ID NO: 972959 - protein, 32 aa, Mycobacterium; identical to SEQ ID NO: 297092

SEQ ID NO: 972960 - protein, 26 aa, Mycobacterium
VERFGEEFRIGIGINTGVVIAGTIGG

SEQ ID NO: 972961 - protein, 21 aa, Mycobacterium
VESAAWPAGVPWNDASLSSAA

SEQ ID NO: 972962 - protein, 22 aa, Mycobacterium
VESAAWPAGVPWNDASLSSAAG

SEQ ID NO: 972963 - protein, 22 aa, Mycobacterium
VESAAWPAGVPWTDASLTAAAG

SEQ ID NO: 972964 - protein, 23 aa, Mycobacterium
VESMHAFSHAYARYRNGEHTSIH

SEQ ID NO: 972965 - protein, 21 aa, Mycobacterium
VESMISTLAQLYVHGHDLDMR

SEQ ID NO: 972966 - protein, 24 aa, Mycobacterium
VETLGWRSVFAVSVPLGAIVLVLT

SEQ ID NO: 972967 - protein, 46 aa, Mycobacterium
VETVHRPRWSWRRMALVAELVVLLVVAGLFISRAVIRNNYYVAEFD

SEQ ID NO: 972968 - protein, 25 aa, Mycobacterium
VEVGQFIRRLFSFLVRQLDRIAPFR

SEQ ID NO: 972969 - protein, 26 aa, Mycobacterium
VEVPEDPTFALARGAAMAAAGAGSTM

SEQ ID NO: 972970 - protein, 18 aa, Mycobacterium
VEWDELRNSITNIIDKLG

SEQ ID NO: 972971 - protein, 22 aa, Mycobacterium
VEYRRGFVTRHQVTGWRFVMRR

SEQ ID NO: 972972 - protein, 18 aa, Mycobacterium
VFAGCVHDYLVLWISTRR

SEQ ID NO: 972973 - protein, 17 aa, Mycobacterium
VFCAFAVAQAAIATGIV

SEQ ID NO: 972974 - protein, 24 aa, Mycobacterium
VFDIEIVFLYPWAVSFDALGTFAL

SEQ ID NO: 972975 - protein, 25 aa, Mycobacterium
VFDRGDIALGWAFLGAGIGSVIRPL

SEQ ID NO: 972976 - protein, 25 aa, Mycobacterium
VFGGLNWWAPKPLERWHSRSGADRF

SEQ ID NO: 972977 - protein, 20 aa, Mycobacterium
VFHASVGLAHRLPGGPVIKP

SEQ ID NO: 972978 - protein, 23 aa, Mycobacterium
VFLAGAVGMRLGWSVIAPGDRPR

SEQ ID NO: 972979 - protein, 26 aa, Mycobacterium
VFPEHKYRIVRLLQGRGHIVGMTGDG

SEQ ID NO: 972980 - protein, 21 aa, Mycobacterium
VFPSATSRWVFEARPDLPTTV

SEQ ID NO: 972981 - protein, 17 aa, Mycobacterium
VFRALNIVEVVFALVLA

SEQ ID NO: 972982 - protein, 23 aa, Mycobacterium
VFRRWLQTMKAWRFSWGTMETGL

SEQ ID NO: 972983 - protein, 29 aa, Mycobacterium
VGAALVGLLMRWRNRYGWSAFVFGLPVLP

SEQ ID NO: 972984 - protein, 21 aa, Mycobacterium
VGAFAIGFAWLGIGTSYLAVL

SEQ ID NO: 972985 - protein, 21 aa, Mycobacterium
VGALADWFAVTALFKHPLGIP

SEQ ID NO: 972986 - protein, 23 aa, Mycobacterium
VGALGILVMVVWVGTALTLSTAA

SEQ ID NO: 972987 - protein, 20 aa, Mycobacterium
VGALRLTPFASSYRVTVSLP

SEQ ID NO: 972988 - protein, 27 aa, Mycobacterium
VGARRTLPVSLPRTAVVAALVLAVCAV

SEQ ID NO: 972989 - protein, 18 aa, Mycobacterium
VGASRWYTQLPFLMEAML

SEQ ID NO: 972990 - protein, 17 aa, Mycobacterium
VGAVAWAMIAFARGETV

SEQ ID NO: 972991 - protein, 18 aa, Mycobacterium
VGCVVAYGLGDMSFAKVD

SEQ ID NO: 972992 - protein, 23 aa, Mycobacterium
VGDAGLALGMFVMFSTFGTLSYA

SEQ ID NO: 972993 - protein, 23 aa, Mycobacterium
VGDEVIAAGAPLGLRSTVTHGIV

SEQ ID NO: 972994 - protein, 19 aa, Mycobacterium
VGDHCMMVTVKPVGSEAAL

SEQ ID NO: 972995 - protein, 17 aa, Mycobacterium
VGEVPIYDIIVGNGDGE

SEQ ID NO: 972996 - protein, 25 aa, Mycobacterium
VGFKTKVSTLLSWTVTFLSTRRGQL

SEQ ID NO: 972997 - protein, 18 aa, Mycobacterium
VGFSMLALMTRRWTLAWV

SEQ ID NO: 972998 - protein, 34 aa, Mycobacterium; identical to SEQ ID NO: 333749

SEQ ID NO: 972999 - protein, 19 aa, Mycobacterium
VGGSGDWGPSLGPTVGGRS

SEQ ID NO: 973000 - protein, 18 aa, Mycobacterium
VGGVRAVRAYPRTASVVI

SEQ ID NO: 973001 - protein, 17 aa, Mycobacterium
VGGWPVWVALSGVLVVQ

SEQ ID NO: 973002 - protein, 20 aa, Mycobacterium
VGHNMRMRKVLVGLTATAIV

SEQ ID NO: 973003 - protein, 24 aa, Mycobacterium
VGKGRPADRPALLGAVKTNIGHLE

SEQ ID NO: 973004 - protein, 20 aa, Mycobacterium
VGLASYLLIGFWYHKASAAT

SEQ ID NO: 973005 - protein, 35 aa, Mycobacterium; identical to SEQ ID NO: 333826

SEQ ID NO: 973006 - protein, 21 aa, Mycobacterium
VGLLILSLVYLQFRGDFDRKV

SEQ ID NO: 973007 - protein, 21 aa, Mycobacterium
VGLLRYRRRRISLAARPEVES

SEQ ID NO: 973008 - protein, 20 aa, Mycobacterium
VGLVALMFVPVAFLPKKPPA

SEQ ID NO: 973009 - protein, 24 aa, Mycobacterium
VGMAAVQLAQLWGLEVFATASPGK

SEQ ID NO: 973010 - protein, 18 aa, Mycobacterium
VGMAVSLYLGFRSGTKVF

SEQ ID NO: 973011 - protein, 17 aa, Mycobacterium
VGNYRAATQVALGESED

SEQ ID NO: 973012 - protein, 31 aa, Mycobacterium
VGPFKKGPFRIAMAVGIPIVPIVFRNAEIVA

SEQ ID NO: 973013 - protein, 20 aa, Mycobacterium
VGQQCARRPLPPLPAMGKLL

SEQ ID NO: 973014 - protein, 17 aa, Mycobacterium
VGQRVDILLVFGLGAFL

SEQ ID NO: 973015 - protein, 19 aa, Mycobacterium
VGRVLCRPVMRAIGRVSYS

SEQ ID NO: 973016 - protein, 32 aa, Mycobacterium
VGSMLLGVVVMLIWWAISPGFFRGRTLRRHSA

SEQ ID NO: 973017 - protein, 18 aa, Mycobacterium
VGTEPNFLREWLPGQLLQ

SEQ ID NO: 973018 - protein, 20 aa, Mycobacterium
VGTLCTFVMSTYVLPDRPES

SEQ ID NO: 973019 - protein, 25 aa, Mycobacterium
VGTPAMWWLAVPVLLYAAWRMFVRR

SEQ ID NO: 973020 - protein, 17 aa, Mycobacterium
VGVAAAVAFAWRAKILT

SEQ ID NO: 973021 - protein, 17 aa, Mycobacterium
VGVELVLGLALGVGVAA

SEQ ID NO: 973022 - protein, 21 aa, Mycobacterium
VGVMRWRWRVAFYALTVLGTD

SEQ ID NO: 973023 - protein, 18 aa, Mycobacterium
VGVPRGRVGIGIKLTGGR

SEQ ID NO: 973024 - protein, 18 aa, Mycobacterium
VGVSGIWDGSTLFADAVV

SEQ ID NO: 973025 - protein, 19 aa, Mycobacterium
VGYIDGWVPSWVTIPVNAA

SEQ ID NO: 973026 - protein, 18 aa, Mycobacterium
VGYLFYWAIIGIDPGPRR

SEQ ID NO: 973027 - protein, 26 aa, Mycobacterium
VHAYAGSLAQVFLCAAPVAAIGFVLA

SEQ ID NO: 973028 - protein, 25 aa, Mycobacterium
VHAYPRTGSVVVWYSPRRCDRAAVL

SEQ ID NO: 973029 - protein, 21 aa, Mycobacterium
VHDAMREIWTFTPAGAISVRG

SEQ ID NO: 973030 - protein, 19 aa, Mycobacterium
VHDLHVWTLAPGKDMATAH

SEQ ID NO: 973031 - protein, 18 aa, Mycobacterium
VHDYLVLWISTRRRGRSL

SEQ ID NO: 973032 - protein, 27 aa, Mycobacterium
VHFDLDPLLPFPRWHEHAAVVEEPVRR

SEQ ID NO: 973033 - protein, 17 aa, Mycobacterium
VHHFGLFAAVGAAMAAL

SEQ ID NO: 973034 - protein, 23 aa, Mycobacterium
VHKHWDFGGGTHRCLGSHLARME

SEQ ID NO: 973035 - protein, 25 aa, Mycobacterium
VHLARIFFTGAFRRPREANWIIGSL

SEQ ID NO: 973036 - protein, 18 aa, Mycobacterium
VHLDSALVVARCEYHPTA

SEQ ID NO: 973037 - protein, 20 aa, Mycobacterium
VHWIVDYWNRFSLWVQHLVT

SEQ ID NO: 973038 - protein, 17 aa, Mycobacterium
VIACPCALGLATPTAMM

SEQ ID NO: 973039 - protein, 24 aa, Mycobacterium
VIANRLRSILSKWDGTRSPELPAE

SEQ ID NO: 973040 - protein, 28 aa, Mycobacterium
VIAVFGMRLVFPLTIVWVTAGLDPVRAM

SEQ ID NO: 973041 - protein, 22 aa, Mycobacterium
VIDEFYEWFRIMPTAVDVLDSI

SEQ ID NO: 973042 - protein, 24 aa, Mycobacterium
VIGGAALALLGVRRYVFARPPLLG

SEQ ID NO: 973043 - protein, 25 aa, Mycobacterium
VIGSIWSWIVGMLVWVWQGILEVAY

SEQ ID NO: 973044 - protein, 17 aa, Mycobacterium
VIIQAVFGFCLLEAVCS

SEQ ID NO: 973045 - protein, 17 aa, Mycobacterium
VILPWLAPNKFRNSPFI

SEQ ID NO: 973046 - protein, 17 aa, Mycobacterium
VILSGPGRYGLDAGRGW

SEQ ID NO: 973047 - protein, 19 aa, Mycobacterium
VILVLGFWVPGFFVTTKLD

SEQ ID NO: 973048 - protein, 18 aa, Mycobacterium
VIQAPRLFAGQIDFGDVG

SEQ ID NO: 973049 - protein, 29 aa, Mycobacterium
VIQTEFNVALPWNREVSLSRSANHPASVT

SEQ ID NO: 973050 - protein, 25 aa, Mycobacterium
VIVGRVRPAFFFALGLPALIIVLLA

SEQ ID NO: 973051 - protein, 19 aa, Mycobacterium
VIVLFAWWRGLYLTTILHR

SEQ ID NO: 973052 - protein, 26 aa, Mycobacterium
VIVLYEIVDILPFPVGSLVGPAAVLG

SEQ ID NO: 973053 - protein, 20 aa, Mycobacterium
VKAEMLVGTPAMWWLAVPVL

SEQ ID NO: 973054 - protein, 21 aa, Mycobacterium
VKAKVIEFVTKPAVTVTLVGI

SEQ ID NO: 973055 - protein, 19 aa, Mycobacterium
VKARTFSGLARRRRLVNSL

SEQ ID NO: 973056 - protein, 26 aa, Mycobacterium
VKMTTEWLHVPLLPIPIPIRVPASQA

SEQ ID NO: 973057 - protein, 17 aa, Mycobacterium
VKPKGVALPDFITPSAD

SEQ ID NO: 973058 - protein, 23 aa, Mycobacterium
VKPTRISKLFILASRSVRRETAS

SEQ ID NO: 973059 - protein, 26 aa, Mycobacterium
VKTLLPTSAVGLWTFDGREGRTEVPT

SEQ ID NO: 973060 - protein, 17 aa, Mycobacterium
VKVHWSVLVILWLFTWS

SEQ ID NO: 973061 - protein, 20 aa, Mycobacterium
VLAAPLLVRLMLGRDPQVNE

SEQ ID NO: 973062 - protein, 18 aa, Mycobacterium
VLAAYAFARLEFPGRDGL

SEQ ID NO: 973063 - protein, 19 aa, Mycobacterium
VLAFIPLAFLPKWSALTAL

SEQ ID NO: 973064 - protein, 27 aa, Mycobacterium
VLAFRHFGNAVLLLAIWIGIGFIFRGV

SEQ ID NO: 973065 - protein, 17 aa, Mycobacterium
VLAGLTLGPAVVFVGSR

SEQ ID NO: 973066 - protein, 23 aa, Mycobacterium
VLALRRVWWLYKLIMSGQPASGR

SEQ ID NO: 973067 - protein, 18 aa, Mycobacterium
VLAQLGLRFRRPSEKTFR

SEQ ID NO: 973068 - protein, 17 aa, Mycobacterium
VLARGLLRLPARSRRRT

SEQ ID NO: 973069 - protein, 19 aa, Mycobacterium
VLAVLAWRALEPADHLGKL

SEQ ID NO: 973070 - protein, 24 aa, Mycobacterium
VLAWATSGINGWFYVGNYGVPWYD

SEQ ID NO: 973071 - protein, 28 aa, Mycobacterium
VLCALAVGLKFRLGFDDSLDVVGVHLVG

SEQ ID NO: 973072 - protein, 36 aa, Mycobacterium; identical to SEQ ID NO: 334352

SEQ ID NO: 973073 - protein, 18 aa, Mycobacterium
VLDLTIRLAEVMLSSGSG

SEQ ID NO: 973074 - protein, 19 aa, Mycobacterium
VLETLEFALVVTIASVPVA

SEQ ID NO: 973075 - protein, 24 aa, Mycobacterium
VLFGALTAVFGWQVLPFLIIQGLF

SEQ ID NO: 973076 - protein, 18 aa, Mycobacterium
VLFLPYSLLGPFAGALMD

SEQ ID NO: 973077 - protein, 18 aa, Mycobacterium
VLFSSLLWIDGRNLEPYL

SEQ ID NO: 973078 - protein, 27 aa, Mycobacterium
VLGFLAYLASFGPMFTISSELGGGSSE

SEQ ID NO: 973079 - protein, 22 aa, Mycobacterium
VLGFRRFACPDSDESPDPDESQ

SEQ ID NO: 973080 - protein, 17 aa, Mycobacterium
VLGRIYDSWAQRSGDED

SEQ ID NO: 973081 - protein, 25 aa, Mycobacterium
VLGVLALVVVLVFTLGGNKSNNAGP

SEQ ID NO: 973082 - protein, 25 aa, Mycobacterium
VLHVAQPLAYCLPGVRSRVVVSEGA

SEQ ID NO: 973083 - protein, 26 aa, Mycobacterium
VLIGAGLAVILSFVWGVRIGGLFTAL

SEQ ID NO: 973084 - protein, 17 aa, Mycobacterium
VLIGLSAVVAMTAIGGV

SEQ ID NO: 973085 - protein, 24 aa, Mycobacterium
VLIGWSAACAVAYLRGFGRRPAWV

SEQ ID NO: 973086 - protein, 18 aa, Mycobacterium
VLISPAWKRAEVDHALAL

SEQ ID NO: 973087 - protein, 18 aa, Mycobacterium
VLLADFGIARAFDDTTLT

SEQ ID NO: 973088 - protein, 39 aa, Mycobacterium; identical to SEQ ID NO: 334479

SEQ ID NO: 973089 - protein, 17 aa, Mycobacterium
VLLEFAIQIARLHDKRK

SEQ ID NO: 973090 - protein, 21 aa, Mycobacterium
VLLFFARAALLGVLTRRAVTI

SEQ ID NO: 973091 - protein, 24 aa, Mycobacterium
VLLGVGLLWFGWFGFNAGSALAAN

SEQ ID NO: 973092 - protein, 17 aa, Mycobacterium
VLLLAGFGWMISSRMVR

SEQ ID NO: 973093 - protein, 18 aa, Mycobacterium
VLLLFLPAILYWESLNTS

SEQ ID NO: 973094 - protein, 19 aa, Mycobacterium
VLLLTPDVYWPLRRIGVEF

SEQ ID NO: 973095 - protein, 17 aa, Mycobacterium
VLLNGSWLSQEQTTAAS

SEQ ID NO: 973096 - protein, 24 aa, Mycobacterium
VLLRRGWVGGLARGPAWRLIGTTA

SEQ ID NO: 973097 - protein, 27 aa, Mycobacterium
VLLVWRRVSDGWAFLCIAVVVAAVVLL

SEQ ID NO: 973098 - protein, 26 aa, Mycobacterium
VLLWQHIIGMPLHWLVIAMSVIVLLA

SEQ ID NO: 973099 - protein, 25 aa, Mycobacterium
VLLYAVCVVLRLARFNALLDDGTQP

SEQ ID NO: 973100 - protein, 22 aa, Mycobacterium
VLMLGQCRVLFAMARDGLLPRQ

SEQ ID NO: 973101 - protein, 19 aa, Mycobacterium
VLMTIPWAVISGFLFNVLL

SEQ ID NO: 973102 - protein, 27 aa, Mycobacterium
VLNAHIAFSVWYLWSVMVLFMPQSIYG

SEQ ID NO: 973103 - protein, 24 aa, Mycobacterium
VLPDLRVLPDLRMRRHVTMRVKDE

SEQ ID NO: 973104 - protein, 25 aa, Mycobacterium
VLREEAARFGVEWLAPKSFVADRLP

SEQ ID NO: 973105 - protein, 24 aa, Mycobacterium
VLSIAAALALRFTGRRLAIYTAIV

SEQ ID NO: 973106 - protein, 27 aa, Mycobacterium
VLSLPLYLMCGLARHRRLLSQESALKY

SEQ ID NO: 973107 - protein, 18 aa, Mycobacterium
VLSVDWFGVVVLAVWGTL

SEQ ID NO: 973108 - protein, 24 aa, Mycobacterium
VLTCWLPVFLGWPIMRWLTKSEMI

SEQ ID NO: 973109 - protein, 19 aa, Mycobacterium
VLTEHLVELMPVVYTPTVG

SEQ ID NO: 973110 - protein, 23 aa, Mycobacterium
VLTGCLWTSLSVGAFAIGFAWLG

SEQ ID NO: 973111 - protein, 20 aa, Mycobacterium
VLTGLRFVLVPIFLYLLFYD

SEQ ID NO: 973112 - protein, 31 aa, Mycobacterium; identical to SEQ ID NO: 334668

SEQ ID NO: 973113 - protein, 22 aa, Mycobacterium
VLTTCYRPLLFATVDPEVAAAC

SEQ ID NO: 973114 - protein, 23 aa, Mycobacterium
VLTTCYRPLLFATVDPEVAAACG

SEQ ID NO: 973115 - protein, 21 aa, Mycobacterium
VLVAAIGTRFMQLRSKRLATS

SEQ ID NO: 973116 - protein, 19 aa, Mycobacterium
VLVALLFRTLDAFRIFDNI

SEQ ID NO: 973117 - protein, 19 aa, Mycobacterium
VLVASRWLLKGTREYQLPT

SEQ ID NO: 973118 - protein, 25 aa, Mycobacterium
VLVLLKTVAYWLNRYELLSHTRGGK

SEQ ID NO: 973119 - protein, 19 aa, Mycobacterium
VLVRGEADAVVYATGAASY

SEQ ID NO: 973120 - protein, 30 aa, Mycobacterium
VLVSGWLAAITWRLSFLWLAVTGLLLTLAL

SEQ ID NO: 973121 - protein, 19 aa, Mycobacterium
VLVVGAFVYGWFRPAGTID

SEQ ID NO: 973122 - protein, 19 aa, Mycobacterium
VLVVTNFFGINAIPIALNE

SEQ ID NO: 973123 - protein, 22 aa, Mycobacterium
VLVWVFDCWQLFVRPPRSTRGA

SEQ ID NO: 973124 - protein, 26 aa, Mycobacterium
VLWIASRLGWVVIRSFDGLGPPKEVT

SEQ ID NO: 973125 - protein, 18 aa, Mycobacterium
VLWMLPLLIAPPMYSKDV

SEQ ID NO: 973126 - protein, 17 aa, Mycobacterium
VLWVSRTDGVVVHWIVD

SEQ ID NO: 973127 - protein, 18 aa, Mycobacterium
VLYPCALAMMVLSKSFSV

SEQ ID NO: 973128 - protein, 24 aa, Mycobacterium
VMALSFASVNGWWYVSNFGVPWSN

SEQ ID NO: 973129 - protein, 19 aa, Mycobacterium
VMDAALHAWGFATATDQLM

SEQ ID NO: 973130 - protein, 25 aa, Mycobacterium
VMDTARLHDEWKFQPAFTAEESVED

SEQ ID NO: 973131 - protein, 22 aa, Mycobacterium
VMEEVLAIKPDICFLWDEAWYA

SEQ ID NO: 973132 - protein, 21 aa, Mycobacterium
VMIIACLFFAVYFMQVTYSLM

SEQ ID NO: 973133 - protein, 28 aa, Mycobacterium
VMIIIVFGQIRFDRTYAYSAEFSNASGL

SEQ ID NO: 973134 - protein, 23 aa, Mycobacterium
VMISRMIGLLLHKGCYGRVVADP

SEQ ID NO: 973135 - protein, 18 aa, Mycobacterium
VMPFHAFFGIALMTMNSA

SEQ ID NO: 973136 - protein, 23 aa, Mycobacterium
VMTAGAALVMWMGELITERGIGN

SEQ ID NO: 973137 - protein, 22 aa, Mycobacterium
VNAAPLPWSFTISTTLPSVSAN

SEQ ID NO: 973138 - protein, 20 aa, Mycobacterium
VNAGFLRRLAGVGGGRCVLV

SEQ ID NO: 973139 - protein, 18 aa, Mycobacterium
VNDPRLSNIAVISAADIV

SEQ ID NO: 973140 - protein, 26 aa, Mycobacterium
VNFFAPMRMTLALLPRMLARGSGTIV

SEQ ID NO: 973141 - protein, 24 aa, Mycobacterium
VNFRDVLVALGMYPGGGALGAEGA

SEQ ID NO: 973142 - protein, 24 aa, Mycobacterium
VNFRDVLVALGMYPGGGELGVEGA

SEQ ID NO: 973143 - protein, 26 aa, Mycobacterium
VNISRFRTLLLKWGLMTVLALLTSAV

SEQ ID NO: 973144 - protein, 17 aa, Mycobacterium
VNSFASLAQQGFFKDTK

SEQ ID NO: 973145 - protein, 20 aa, Mycobacterium
VPAAFCWSADPSCPLDAERL

SEQ ID NO: 973146 - protein, 25 aa, Mycobacterium
VPAIMGLLGRWFWWSPPPFLRASLA

SEQ ID NO: 973147 - protein, 24 aa, Mycobacterium
VPALYRVAAWVVIVAGITFIASTL

SEQ ID NO: 973148 - protein, 18 aa, Mycobacterium
VPASTTGWRSRPDVSDQR

SEQ ID NO: 973149 - protein, 21 aa, Mycobacterium
VPAYRVLKRMPPWWSTRATPI

SEQ ID NO: 973150 - protein, 17 aa, Mycobacterium
VPCGVLVATVVAGDKVF

SEQ ID NO: 973151 - protein, 20 aa, Mycobacterium
VPDASQWMMQAEVAVTNFVA

SEQ ID NO: 973152 - protein, 17 aa, Mycobacterium
VPDELREASFALGVPKW

SEQ ID NO: 973153 - protein, 23 aa, Mycobacterium
VPDSYRLLNIVFMLVVVFTLVQG

SEQ ID NO: 973154 - protein, 23 aa, Mycobacterium
VPDVLRGLFGTRLLQREYYDDEF

SEQ ID NO: 973155 - protein, 21 aa, Mycobacterium
VPELWRLLSHIDAVHGLYYLL

SEQ ID NO: 973156 - protein, 21 aa, Mycobacterium
VPESPRWLFIHGREQEAEQIV

SEQ ID NO: 973157 - protein, 18 aa, Mycobacterium
VPGGFAAGLARTLPVTGG

SEQ ID NO: 973158 - protein, 22 aa, Mycobacterium
VPGKRAPTVNLCESNEQYVPLN

SEQ ID NO: 973159 - protein, 21 aa, Mycobacterium
VPGLPPPPLIFAEREAPTGTN

SEQ ID NO: 973160 - protein, 27 aa, Mycobacterium
VPGWDFGSEFARIGLLAGLLLVLVWVF

SEQ ID NO: 973161 - protein, 19 aa, Mycobacterium
VPIQIPLPQIFGPGGGGGF

SEQ ID NO: 973162 - protein, 19 aa, Mycobacterium
VPLALPLASIVFLGAFIPL

SEQ ID NO: 973163 - protein, 17 aa, Mycobacterium
VPLAYAWSKAQFGNIEP

SEQ ID NO: 973164 - protein, 17 aa, Mycobacterium
VPLGGFCDIVGMTSVEK

SEQ ID NO: 973165 - protein, 22 aa, Mycobacterium
VPLGGFCDIVGMTSVEKLEPDE

SEQ ID NO: 973166 - protein, 18 aa, Mycobacterium
VPLPRGSHSLGAPQLAAA

SEQ ID NO: 973167 - protein, 23 aa, Mycobacterium
VPLSLLVTRAITRRSQRLFVAHW

SEQ ID NO: 973168 - protein, 20 aa, Mycobacterium
VPNGTFFFVLAIFLVVLAVI

SEQ ID NO: 973169 - protein, 23 aa, Mycobacterium
VPNIPGAPWWGAVLIAVSTTALG

SEQ ID NO: 973170 - protein, 27 aa, Mycobacterium
VPPDSVWWWVCVSLLALVVLVMAANRL

SEQ ID NO: 973171 - protein, 24 aa, Mycobacterium
VPPLRFAQLVGLVFAAAGVVGFAL

SEQ ID NO: 973172 - protein, 26 aa, Mycobacterium
VPRIGRDFTAVPLLWLLAIDITLILL

SEQ ID NO: 973173 - protein, 18 aa, Mycobacterium
VPSNVFAVSSIQLVEHGP

SEQ ID NO: 973174 - protein, 18 aa, Mycobacterium
VPSRRLNPTPAISAEHAA

SEQ ID NO: 973175 - protein, 23 aa, Mycobacterium
VPTAVCLIGDLLIATGLGIAMLV

SEQ ID NO: 973176 - protein, 24 aa, Mycobacterium
VPTGLKFFNWIGTMWRGQLTFESP

SEQ ID NO: 973177 - protein, 17 aa, Mycobacterium
VPVHGFLFLFLGNGLLC

SEQ ID NO: 973178 - protein, 30 aa, Mycobacterium
VPVPDSLIHLCLFIGALTFMYISARAVGDA

SEQ ID NO: 973179 - protein, 22 aa, Mycobacterium
VPYGGICLTAAIGLIGVLLNGV

SEQ ID NO: 973180 - protein, 18 aa, Mycobacterium
VPYPGFGTLAGFLASTSV

SEQ ID NO: 973181 - protein, 19 aa, Mycobacterium
VPYVGPWRLSGTRFAPTAT

SEQ ID NO: 973182 - protein, 19 aa, Mycobacterium
VQAGCRFTTQIGAMRVAEE

SEQ ID NO: 973183 - protein, 17 aa, Mycobacterium
VQAIAVFLSTGLVPLNQ

SEQ ID NO: 973184 - protein, 18 aa, Mycobacterium
VQGLSRAVGARGQMTLQE

SEQ ID NO: 973185 - protein, 21 aa, Mycobacterium
VQLRVGLVAATLALVLCGLLA

SEQ ID NO: 973186 - protein, 18 aa, Mycobacterium
VQPTLPILLANLVSVGQV

SEQ ID NO: 973187 - protein, 18 aa, Mycobacterium
VRAAGLNFHDVVVALGLI

SEQ ID NO: 973188 - protein, 18 aa, Mycobacterium
VRALLTLLPGSLRWLVTV

SEQ ID NO: 973189 - protein, 19 aa, Mycobacterium
VRALLTLLPGSLRWLVTVD

SEQ ID NO: 973190 - protein, 18 aa, Mycobacterium
VRCTMVVTAFALAAAVAG

SEQ ID NO: 973191 - protein, 24 aa, Mycobacterium
VRDRRPGAVMDHGLWSWSRHPNYF

SEQ ID NO: 973192 - protein, 19 aa, Mycobacterium
VRFIREADLAATLSHPNIV

SEQ ID NO: 973193 - protein, 20 aa, Mycobacterium
VRGLKMLLATVALVVVGVGL

SEQ ID NO: 973194 - protein, 21 aa, Mycobacterium
VRGSRNIPCVDVPGKRAATPR

SEQ ID NO: 973195 - protein, 18 aa, Mycobacterium
VRGWPLRGLAALLAMVSL

SEQ ID NO: 973196 - protein, 21 aa, Mycobacterium
VRHPLMLGFIIAFWATPTMTA

SEQ ID NO: 973197 - protein, 26 aa, Mycobacterium
VRIPRSVEALGRVDMVCFDKTETLSE

SEQ ID NO: 973198 - protein, 24 aa, Mycobacterium
VRKVPSAFGSWFSFNEVDGANTPN

SEQ ID NO: 973199 - protein, 27 aa, Mycobacterium
VRNRIGTRLGKPGPRSVAVLDPSSGDH

SEQ ID NO: 973200 - protein, 24 aa, Mycobacterium
VRPYGYDETARWVPRLWRRDIKAG

SEQ ID NO: 973201 - protein, 18 aa, Mycobacterium
VRQIRIEMMLGHVSAEAT

SEQ ID NO: 973202 - protein, 19 aa, Mycobacterium
VRQRFFALFLYVVGLLFIV

SEQ ID NO: 973203 - protein, 23 aa, Mycobacterium
VRRDRPWLWLLYALVLMVSILIN

SEQ ID NO: 973204 - protein, 22 aa, Mycobacterium
VRRWRLQYSRRLRITDSAIVFA

SEQ ID NO: 973205 - protein, 18 aa, Mycobacterium
VRSLVWLQIGIGAGVLVV

SEQ ID NO: 973206 - protein, 19 aa, Mycobacterium
VRTSLIFSAFVLVMISLAV

SEQ ID NO: 973207 - protein, 19 aa, Mycobacterium
VRVAPRVAVSGLRVSVVMV

SEQ ID NO: 973208 - protein, 18 aa, Mycobacterium
VRVGEHIAITGANGSGKT

SEQ ID NO: 973209 - protein, 17 aa, Mycobacterium
VRVMPVFAVKSGAFFAA

SEQ ID NO: 973210 - protein, 18 aa, Mycobacterium
VRVTRWVATIAGLIGFVL

SEQ ID NO: 973211 - protein, 28 aa, Mycobacterium
VRWAVATRMVAAWVITLPLAGLVGTITY

SEQ ID NO: 973212 - protein, 17 aa, Mycobacterium
VRYSGWDAIPVMLGAIA

SEQ ID NO: 973213 - protein, 17 aa, Mycobacterium
VSADFVAGGGLYKNANV

SEQ ID NO: 973214 - protein, 18 aa, Mycobacterium
VSADPAFDIAAARRQLAE

SEQ ID NO: 973215 - protein, 17 aa, Mycobacterium
VSAEYGLYVGIGSAVCA

SEQ ID NO: 973216 - protein, 25 aa, Mycobacterium
VSAGERPLGEIISAGKLSFPISAAP

SEQ ID NO: 973217 - protein, 20 aa, Mycobacterium
VSAKSLRVGDVIDLAAPEVV

SEQ ID NO: 973218 - protein, 18 aa, Mycobacterium
VSALNRPVSTTGESGNQN

SEQ ID NO: 973219 - protein, 18 aa, Mycobacterium
VSALRRFLEAHARVTDVP

SEQ ID NO: 973220 - protein, 25 aa, Mycobacterium
VSALVCARLLAPHRCGDRAGGHPGD

SEQ ID NO: 973221 - protein, 24 aa, Mycobacterium
VSAQWCLGDSTLLRGLDQPTRLAT

SEQ ID NO: 973222 - protein, 26 aa, Mycobacterium
VSDRNRPGWEWLKWLPHNQHPSHHDE

SEQ ID NO: 973223 - protein, 32 aa, Mycobacterium
VSDSWGIALLYLCCSGSFLGFAFAFGEVLGHN

SEQ ID NO: 973224 - protein, 18 aa, Mycobacterium
VSEREGAKLIIYDDEYTG

SEQ ID NO: 973225 - protein, 20 aa, Mycobacterium
VSESVSWPGWAVVGVTLVFG

SEQ ID NO: 973226 - protein, 18 aa, Mycobacterium
VSGAICWAGGTTALVYYA

SEQ ID NO: 973227 - protein, 22 aa, Mycobacterium
VSGRGLDIWSALPVLGSVSLIG

SEQ ID NO: 973228 - protein, 17 aa, Mycobacterium
VSLALDFLGCPKTIAIP

SEQ ID NO: 973229 - protein, 18 aa, Mycobacterium
VSLGRRVVSLPWRLANIQ

SEQ ID NO: 973230 - protein, 17 aa, Mycobacterium
VSLIYQFWVHTERINKL

SEQ ID NO: 973231 - protein, 20 aa, Mycobacterium
VSLLPRRNPGSSGIADVPGQ

SEQ ID NO: 973232 - protein, 18 aa, Mycobacterium
VSLLPTLMLTIPYTVLLT

SEQ ID NO: 973233 - protein, 25 aa, Mycobacterium
VSLVIGAGMAVVFGVPVIVAPSFSP

SEQ ID NO: 973234 - protein, 17 aa, Mycobacterium
VSMVKGWYMSFWPIIAI

SEQ ID NO: 973235 - protein, 23 aa, Mycobacterium
VSMVLAKLLVRPIRRLEAGTEKI

SEQ ID NO: 973236 - protein, 25 aa, Mycobacterium
VSMWVTLMFPAWVLLVSGLILARSQ

SEQ ID NO: 973237 - protein, 22 aa, Mycobacterium
VSPEPSNWGIVGWSMGGTCAVD

SEQ ID NO: 973238 - protein, 25 aa, Mycobacterium
VSRRSWWQERLMLWATSGLAVVSSM

SEQ ID NO: 973239 - protein, 26 aa, Mycobacterium
VSSDLAEWEWVKWLPHFGDSRRYDAA

SEQ ID NO: 973240 - protein, 23 aa, Mycobacterium
VSSFGEFEFWFAGIKVAVIVVFL

SEQ ID NO: 973241 - protein, 18 aa, Mycobacterium
VSSGFGFLLLAHTRWTSA

SEQ ID NO: 973242 - protein, 19 aa, Mycobacterium
VSTLPGVLMTIPWAVISGF

SEQ ID NO: 973243 - protein, 20 aa, Mycobacterium
VSTPRLTATLTLENLLATAA

SEQ ID NO: 973244 - protein, 19 aa, Mycobacterium
VSTSLVVFVGFRSSRKSAS

SEQ ID NO: 973245 - protein, 17 aa, Mycobacterium
VSVFCAFAVAQAAIATG

SEQ ID NO: 973246 - protein, 17 aa, Mycobacterium
VSVGFLISLWAGSSAIS

SEQ ID NO: 973247 - protein, 22 aa, Mycobacterium
VSVGSWISRTVFAAKFAERNFL

SEQ ID NO: 973248 - protein, 23 aa, Mycobacterium
VSWSHHWVWMLPAVVVTGVLAWR

SEQ ID NO: 973249 - protein, 32 aa, Mycobacterium; identical to SEQ ID NO: 335647

SEQ ID NO: 973250 - protein, 26 aa, Mycobacterium
VTAAGATAAWAIGRWTPGTERRTATM

SEQ ID NO: 973251 - protein, 17 aa, Mycobacterium
VTADVDAIVAFLRTGLV

SEQ ID NO: 973252 - protein, 23 aa, Mycobacterium
VTAGFLTLFGFIFVITQYFQFIK

SEQ ID NO: 973253 - protein, 23 aa, Mycobacterium
VTALCGYTVIYLAARDLAPSGFS

SEQ ID NO: 973254 - protein, 17 aa, Mycobacterium
VTARSAFRHSVDAVAIC

SEQ ID NO: 973255 - protein, 19 aa, Mycobacterium
VTAVLGCRRSVPAAAGSSL

SEQ ID NO: 973256 - protein, 29 aa, Mycobacterium
VTDAGVGRPWASWMMPKMISPIRTAINTP

SEQ ID NO: 973257 - protein, 19 aa, Mycobacterium
VTGGFWRVLGIRLLTAIVV

SEQ ID NO: 973258 - protein, 17 aa, Mycobacterium
VTGKALQEFGRYQSVVY

SEQ ID NO: 973259 - protein, 19 aa, Mycobacterium
VTGTLAWPALAMFAIIFFW

SEQ ID NO: 973260 - protein, 21 aa, Mycobacterium
VTIDRPHDWVECGEWIRELRP

SEQ ID NO: 973261 - protein, 23 aa, Mycobacterium
VTIDRPHDWVECGEWIRELRPHI

SEQ ID NO: 973262 - protein, 21 aa, Mycobacterium
VTIPFGIGMAFYGNIGGGAFV

SEQ ID NO: 973263 - protein, 17 aa, Mycobacterium
VTIRSWEPLAFTAVDIA

SEQ ID NO: 973264 - protein, 21 aa, Mycobacterium
VTLPVCDRLAINPSPFLMAEV

SEQ ID NO: 973265 - protein, 26 aa, Mycobacterium
VTLQIGLGIGRLVFRALNIVEVVFAL

SEQ ID NO: 973266 - protein, 23 aa, Mycobacterium
VTLRGVLLLAFPKAFVSAANSMI

SEQ ID NO: 973267 - protein, 20 aa, Mycobacterium
VTMGVAWSVLYIPLGGVGTI

SEQ ID NO: 973268 - protein, 18 aa, Mycobacterium
VTMLSKWQVGWVVVLLYA

SEQ ID NO: 973269 - protein, 18 aa, Mycobacterium
VTNTGFGTGMDWRPNPGI

SEQ ID NO: 973270 - protein, 24 aa, Mycobacterium
VTPHPRFPHLIPGGDYVMGGDGLQ

SEQ ID NO: 973271 - protein, 21 aa, Mycobacterium
VTPRLCARAANPFPIVAASAL

SEQ ID NO: 973272 - protein, 29 aa, Mycobacterium
VTQGLRFVWNLRVLRALALIDLTVTALYL

SEQ ID NO: 973273 - protein, 28 aa, Mycobacterium
VTRRRVTRWEWTWAVLLAVSLAVVVIVG

SEQ ID NO: 973274 - protein, 25 aa, Mycobacterium
VTTAYLVMCGFIFVATQYLQFVAAY

SEQ ID NO: 973275 - protein, 18 aa, Mycobacterium
VTTLGVWLGAGYPVSVAL

SEQ ID NO: 973276 - protein, 24 aa, Mycobacterium
VTVAVVSLGLWVIFLPSVVRRRLP

SEQ ID NO: 973277 - protein, 24 aa, Mycobacterium
VTVITVLYWRVDGVILSLLNTHSE

SEQ ID NO: 973278 - protein, 17 aa, Mycobacterium
VTVWRGRLSIALDALET

SEQ ID NO: 973279 - protein, 17 aa, Mycobacterium
VTYLKMGCPLSTEHVPL

SEQ ID NO: 973280 - protein, 26 aa, Mycobacterium
VVAALAICYRPLLFATVDPEVAAARG

SEQ ID NO: 973281 - protein, 22 aa, Mycobacterium
VVAALCLIFIIMLGITRSPVAS

SEQ ID NO: 973282 - protein, 27 aa, Mycobacterium
VVACYAMLKAFRFDLLTTPRLLHVTVP

SEQ ID NO: 973283 - protein, 41 aa, Mycobacterium; identical to SEQ ID NO: 335871

SEQ ID NO: 973284 - protein, 17 aa, Mycobacterium
VVADGKYTGEVAFYCYG

SEQ ID NO: 973285 - protein, 27 aa, Mycobacterium
VVAEAWRSIKPPVFVPASLVIVTMIVV

SEQ ID NO: 973286 - protein, 21 aa, Mycobacterium
VVAEMRKVIWPNRKQMLTYTS

SEQ ID NO: 973287 - protein, 23 aa, Mycobacterium
VVAGGLQLAFGLIRIARAVLAIS

SEQ ID NO: 973288 - protein, 24 aa, Mycobacterium
VVAHWVWAPSGWLAKMGVLDYAGG

SEQ ID NO: 973289 - protein, 17 aa, Mycobacterium
VVAICFVLTWSEATLGF

SEQ ID NO: 973290 - protein, 20 aa, Mycobacterium
VVAIIFPKPWSWADLSVVPA

SEQ ID NO: 973291 - protein, 17 aa, Mycobacterium
VVAPEVVDRILIGACAA

SEQ ID NO: 973292 - protein, 20 aa, Mycobacterium
VVASVLYFLVAFAILIVGFV

SEQ ID NO: 973293 - protein, 24 aa, Mycobacterium
VVAVALRLNTRWVAHVVLLIPTVI

SEQ ID NO: 973294 - protein, 18 aa, Mycobacterium
VVAVGLVALMFVPVAFLP

SEQ ID NO: 973295 - protein, 17 aa, Mycobacterium
VVCAIGLGSVAGISRVV

SEQ ID NO: 973296 - protein, 18 aa, Mycobacterium
VVCVLPINLGMFTAARVI

SEQ ID NO: 973297 - protein, 19 aa, Mycobacterium
VVCVLTLTIAGPVRTYFAQ

SEQ ID NO: 973298 - protein, 19 aa, Mycobacterium
VVDRILIGACAAVWLALVG

SEQ ID NO: 973299 - protein, 17 aa, Mycobacterium
VVFAIAAVGHFRLANLV

SEQ ID NO: 973300 - protein, 25 aa, Mycobacterium
VVFGDFRFGPTNVYHATFTNASRLK

SEQ ID NO: 973301 - protein, 18 aa, Mycobacterium
VVFGESLGSFGGEAPFMN

SEQ ID NO: 973302 - protein, 24 aa, Mycobacterium
VVGARPPRPAAFHEWHAMSVEQVQ

SEQ ID NO: 973303 - protein, 26 aa, Mycobacterium
VVGFLCAFAPNFTVLVILRLLYDIGM

SEQ ID NO: 973304 - protein, 23 aa, Mycobacterium
VVGGRLHPALNLMSAQLIAGSPD

SEQ ID NO: 973305 - protein, 24 aa, Mycobacterium
VVGLGCGFGPLNNRFFPPMGSSLY

SEQ ID NO: 973306 - protein, 19 aa, Mycobacterium
VVGLLDFGASASYVTLMEA

SEQ ID NO: 973307 - protein, 26 aa, Mycobacterium
VVGNFPADRGWDVAGLFDPDPDAVGK

SEQ ID NO: 973308 - protein, 17 aa, Mycobacterium
VVGWRGARWRRRTASLV

SEQ ID NO: 973309 - protein, 17 aa, Mycobacterium
VVHLKWYDYPLTAVVSL

SEQ ID NO: 973310 - protein, 18 aa, Mycobacterium
VVHPSWWSAARVAVVTRA

SEQ ID NO: 973311 - protein, 24 aa, Mycobacterium
VVIGTAFTALVTRFTDSIITPLIN

SEQ ID NO: 973312 - protein, 19 aa, Mycobacterium
VVIMIMLFIVYRSVSTVLL

SEQ ID NO: 973313 - protein, 19 aa, Mycobacterium
VVIPVNRTIWGGMLRCGST

SEQ ID NO: 973314 - protein, 25 aa, Mycobacterium
VVKFALGVFSAFGLVFVQFPGKTPV

SEQ ID NO: 973315 - protein, 26 aa, Mycobacterium
VVLAFAVARPRGWPEAVAAVPAAGIL

SEQ ID NO: 973316 - protein, 26 aa, Mycobacterium
VVLAGELLCFVGMLVGVPVASLIQTY

SEQ ID NO: 973317 - protein, 21 aa, Mycobacterium
VVLAVRLNVLFSYQGNDMYTA

SEQ ID NO: 973318 - protein, 19 aa, Mycobacterium
VVLLIYLWVGIVAFGAAST

SEQ ID NO: 973319 - protein, 26 aa, Mycobacterium
VVLLVTSWLLAKSMGYLDRGVQVVAD

SEQ ID NO: 973320 - protein, 28 aa, Mycobacterium
VVLPPLLALCGRRLFWPFIPRAEDTTAL

SEQ ID NO: 973321 - protein, 24 aa, Mycobacterium
VVLRCGLDGPAEFVVGSPIQAVDQ

SEQ ID NO: 973322 - protein, 22 aa, Mycobacterium
VVLSCQLLIVAMLTRLEPVFLV

SEQ ID NO: 973323 - protein, 21 aa, Mycobacterium
VVLVALPARLANMVAGSALGQ

SEQ ID NO: 973324 - protein, 25 aa, Mycobacterium
VVLVGYCAGWLPWFADIDRQMYFFY

SEQ ID NO: 973325 - protein, 18 aa, Mycobacterium
VVMSCFFGTLMVITQFFQ

SEQ ID NO: 973326 - protein, 18 aa, Mycobacterium
VVPLGVVVMFARRRPAFL

SEQ ID NO: 973327 - protein, 21 aa, Mycobacterium
VVPLLLAMVLGGLRIHGGMAN

SEQ ID NO: 973328 - protein, 20 aa, Mycobacterium
VVPRWPELMGDTAHSLGTGL

SEQ ID NO: 973329 - protein, 19 aa, Mycobacterium
VVRPARVAAVAVRVTRVPA

SEQ ID NO: 973330 - protein, 22 aa, Mycobacterium
VVRRPVVGFLWSWTSGRDQGWR

SEQ ID NO: 973331 - protein, 19 aa, Mycobacterium
VVSAPVWPAVTAEPAVLVA

SEQ ID NO: 973332 - protein, 17 aa, Mycobacterium
VVSEIFPVFSRKPIFGY

SEQ ID NO: 973333 - protein, 19 aa, Mycobacterium
VVSLPWRLANIQDLPAIDA

SEQ ID NO: 973334 - protein, 21 aa, Mycobacterium
VVSVVWWLAAVNLMLGLFNLL

SEQ ID NO: 973335 - protein, 31 aa, Mycobacterium
VVTAARVATVLSIWQAVLVRRLVRAAVPATV

SEQ ID NO: 973336 - protein, 17 aa, Mycobacterium
VVTGLWVLYGYSVAFGN

SEQ ID NO: 973337 - protein, 19 aa, Mycobacterium
VVTIAGLVFAFTMGSMLTS

SEQ ID NO: 973338 - protein, 26 aa, Mycobacterium
VVTSNQLVAWVCIGASALGVVLLIVD

SEQ ID NO: 973339 - protein, 18 aa, Mycobacterium
VVVADLIAEFGWGITCFI

SEQ ID NO: 973340 - protein, 27 aa, Mycobacterium
VVVALAAPLGWFGFRVHLAGQAQARQG

SEQ ID NO: 973341 - protein, 18 aa, Mycobacterium
VVVATGFKPSGEHYQFVE

SEQ ID NO: 973342 - protein, 41 aa, Mycobacterium; identical to SEQ ID NO: 336216

SEQ ID NO: 973343 - protein, 17 aa, Mycobacterium
VVVGGWPVWVALSGVLV

SEQ ID NO: 973344 - protein, 18 aa, Mycobacterium
VVVGLAVALWVVRTRALL

SEQ ID NO: 973345 - protein, 18 aa, Mycobacterium
VVVGQHLNMPPPRISKRH

SEQ ID NO: 973346 - protein, 18 aa, Mycobacterium
VVVLMSFAVYAVISAALY

SEQ ID NO: 973347 - protein, 21 aa, Mycobacterium
VVVTCPHCFNTLGKEYRQLGS

SEQ ID NO: 973348 - protein, 24 aa, Mycobacterium
VWEAVDSRLGRRVAVKVLKQEFSS

SEQ ID NO: 973349 - protein, 17 aa, Mycobacterium
VWGFLFMYFWLRATLPR

SEQ ID NO: 973350 - protein, 18 aa, Mycobacterium
VWHLGPLPIRAYAFFIII

SEQ ID NO: 973351 - protein, 19 aa, Mycobacterium
VWNDFLWPLLMIQRNSLAT

SEQ ID NO: 973352 - protein, 22 aa, Mycobacterium
VWNVFKSWRFGEPVLVDDPWGH

SEQ ID NO: 973353 - protein, 25 aa, Mycobacterium
VWTVIAILALFGWPQIARIARSSVL

SEQ ID NO: 973354 - protein, 21 aa, Mycobacterium
VWVNNSWVAAKCIAMSVVLGV

SEQ ID NO: 973355 - protein, 18 aa, Mycobacterium
VWYGFGWESLLLETGFLV

SEQ ID NO: 973356 - protein, 19 aa, Mycobacterium
VWYLQRVGTEPNFLREWLP

SEQ ID NO: 973357 - protein, 27 aa, Mycobacterium
VYAVLAVIWFWLLKRYIVEGPLEHDAE

SEQ ID NO: 973358 - protein, 18 aa, Mycobacterium
VYCIPLTLVAAGSGLLVY

SEQ ID NO: 973359 - protein, 18 aa, Mycobacterium
VYDAPRPVMGAAIAELIP

SEQ ID NO: 973360 - protein, 18 aa, Mycobacterium
VYDMALVFRHRVRKDRLI

SEQ ID NO: 973361 - protein, 22 aa, Mycobacterium
VYIEAYGFLFVENFSIPVIGHW

SEQ ID NO: 973362 - protein, 17 aa, Mycobacterium
VYIFSLVGYHWLASTPG

SEQ ID NO: 973363 - protein, 19 aa, Mycobacterium
VYLPRTVLVDGQRPGSAAG

SEQ ID NO: 973364 - protein, 24 aa, Mycobacterium
VYPDRLDAGLLRIAGVCVLASLMS

SEQ ID NO: 973365 - protein, 25 aa, Mycobacterium
VYPLCLFKLLTGWNCPFCGGLRLMH

SEQ ID NO: 973366 - protein, 26 aa, Mycobacterium
VYPLCLFKLLTGWNCPFCGGLRLMHD

SEQ ID NO: 973367 - protein, 18 aa, Mycobacterium
WAADRFGTKRLWMGSVLA

SEQ ID NO: 973368 - protein, 25 aa, Mycobacterium
WAAGVLGALAIIIAVLIVINSRADS

SEQ ID NO: 973369 - protein, 18 aa, Mycobacterium
WAATAKWEGNQWKISNLL

SEQ ID NO: 973370 - protein, 20 aa, Mycobacterium
WAEAMSTLLKPGDVATAPVH

SEQ ID NO: 973371 - protein, 29 aa, Mycobacterium
WAFLVCYLCAAALTWARYVRPRSPVASAP

SEQ ID NO: 973372 - protein, 20 aa, Mycobacterium
WAGAFTFAGTVGFIGDYLWH

SEQ ID NO: 973373 - protein, 23 aa, Mycobacterium
WAMPELVARVALAGLAVRAVRLM

SEQ ID NO: 973374 - protein, 18 aa, Mycobacterium
WAMVSLCLVSVWRSVPFA

SEQ ID NO: 973375 - protein, 24 aa, Mycobacterium
WAPTARLGSMYGYGVSYAVASLSC

SEQ ID NO: 973376 - protein, 22 aa, Mycobacterium
WARLVWPVVVLILITGLAALGS

SEQ ID NO: 973377 - protein, 24 aa, Mycobacterium
WARQHARRTVLIWVAVVLAITGMV

SEQ ID NO: 973378 - protein, 31 aa, Mycobacterium; identical to SEQ ID NO: 336487

SEQ ID NO: 973379 - protein, 18 aa, Mycobacterium
WATIVACQLRFHRLTISG

SEQ ID NO: 973380 - protein, 20 aa, Mycobacterium
WATPARWGFATSASTVDLIK

SEQ ID NO: 973381 - protein, 27 aa, Mycobacterium
WAVCDAAAETLRGVPVVTGIDGQLALG

SEQ ID NO: 973382 - protein, 17 aa, Mycobacterium
WCAFATVLATHVWRLNR

SEQ ID NO: 973383 - protein, 17 aa, Mycobacterium
WCAVGLLATPVALRAAA

SEQ ID NO: 973384 - protein, 17 aa, Mycobacterium
WCCMPKTVVAPVRAVMC

SEQ ID NO: 973385 - protein, 19 aa, Mycobacterium
WDALWSRALKACGWAFLIW

SEQ ID NO: 973386 - protein, 21 aa, Mycobacterium
WDEIGQIAISWVLSPLLGGLV

SEQ ID NO: 973387 - protein, 19 aa, Mycobacterium
WDFRGARGAIQTTLDRDLP

SEQ ID NO: 973388 - protein, 17 aa, Mycobacterium
WDGPAWSISAEWLAYLL

SEQ ID NO: 973389 - protein, 17 aa, Mycobacterium
WDLLLLWLAQLHGGNGL

SEQ ID NO: 973390 - protein, 20 aa, Mycobacterium
WDQRRLVLPTTYFTTTPFEN

SEQ ID NO: 973391 - protein, 22 aa, Mycobacterium
WDRVEARGEAAARAVLPGLAAK

SEQ ID NO: 973392 - protein, 23 aa, Mycobacterium
WDTIGRPIARRNLVFSIFAEHIG

SEQ ID NO: 973393 - protein, 24 aa, Mycobacterium
WDVELRPYWTPLFAYAAAFLIAAA

SEQ ID NO: 973394 - protein, 22 aa, Mycobacterium
WDVRCAPAAFRFMSQARHIGKV

SEQ ID NO: 973395 - protein, 19 aa, Mycobacterium
WEALEHAGIDPMSLRGSST

SEQ ID NO: 973396 - protein, 25 aa, Mycobacterium
WEALEHARIPPSSLRGGPVGVYVGV

SEQ ID NO: 973397 - protein, 22 aa, Mycobacterium
WEAVDSRLGRRVAVKVLKGEFS

SEQ ID NO: 973398 - protein, 23 aa, Mycobacterium
WEAVDSRLGRRVAVKVLKGEFSS

SEQ ID NO: 973399 - protein, 27 aa, Mycobacterium
WEKHCFDVPICWSFRSLFDSLDGIDKL

SEQ ID NO: 973400 - protein, 22 aa, Mycobacterium
WEKLPPIRMVHRGTAASLRLVR

SEQ ID NO: 973401 - protein, 18 aa, Mycobacterium
WETLLFFAGLFIMVGALV

SEQ ID NO: 973402 - protein, 18 aa, Mycobacterium
WFLVATIPLAVMNLPVLY

SEQ ID NO: 973403 - protein, 18 aa, Mycobacterium
WGARLRAFVVKKPDTDLD

SEQ ID NO: 973404 - protein, 22 aa, Mycobacterium
WGETLTKGWQRLLGTVLGVPCG

SEQ ID NO: 973405 - protein, 19 aa, Mycobacterium
WGLGAALAMEKVPVGRRGF

SEQ ID NO: 973406 - protein, 23 aa, Mycobacterium
WGNGKPGLADRIFRWLAQGAGVL

SEQ ID NO: 973407 - protein, 20 aa, Mycobacterium
WGPRLPVVTCLAAMVTGLVL

SEQ ID NO: 973408 - protein, 17 aa, Mycobacterium
WGQWVALVVSTAVFALA

SEQ ID NO: 973409 - protein, 22 aa, Mycobacterium
WGRAKMTDVMIVIRTDRAAGGG

SEQ ID NO: 973410 - protein, 22 aa, Mycobacterium
WGRYPIEARVDVVARGGLLIGD

SEQ ID NO: 973411 - protein, 25 aa, Mycobacterium
WGTFINLRCVCLAPPDAHHDTLAMV

SEQ ID NO: 973412 - protein, 25 aa, Mycobacterium
WGVDGRLPLLISGGAGAVFALALLA

SEQ ID NO: 973413 - protein, 20 aa, Mycobacterium
WGVRVGGIFTALGVTSVVIG

SEQ ID NO: 973414 - protein, 18 aa, Mycobacterium
WHALDPEIVYARLAGGAR

SEQ ID NO: 973415 - protein, 19 aa, Mycobacterium
WHHTIPAPVWVALIMGLIF

SEQ ID NO: 973416 - protein, 17 aa, Mycobacterium
WHPHIVGVHDRGEFDGR

SEQ ID NO: 973417 - protein, 19 aa, Mycobacterium
WHVAVPMLLGGLAIPVALH

SEQ ID NO: 973418 - protein, 17 aa, Mycobacterium
WIALALVVIAFTYLCFT

SEQ ID NO: 973419 - protein, 20 aa, Mycobacterium
WIAVAAPLFVYALRVADRER

SEQ ID NO: 973420 - protein, 25 aa, Mycobacterium
WIPYARADLVLGIVVVIVGATALMA

SEQ ID NO: 973421 - protein, 22 aa, Mycobacterium
WIRCAVWLLAGIAIYVGYRYQH

SEQ ID NO: 973422 - protein, 23 aa, Mycobacterium
WKKGLRHSVYFTHGIRNAVDSGH

SEQ ID NO: 973423 - protein, 17 aa, Mycobacterium
WKNCAGKTVTVTNKSKT

SEQ ID NO: 973424 - protein, 24 aa, Mycobacterium
WKPTRPKRFAWLLGAALAATCLAM

SEQ ID NO: 973425 - protein, 36 aa, Mycobacterium
WKRVAVLFAGPGMNFVICLVLIYGIAVVWGLPNLHP

SEQ ID NO: 973426 - protein, 20 aa, Mycobacterium
WKSFDLFVGAIQAFIFALLT

SEQ ID NO: 973427 - protein, 18 aa, Mycobacterium
WKTIKRLVLEGVDDPSSV

SEQ ID NO: 973428 - protein, 18 aa, Mycobacterium
WKVFPYSYPTVFALAVVS

SEQ ID NO: 973429 - protein, 22 aa, Mycobacterium
WLADHVIGGVVLFPGAGFVELA

SEQ ID NO: 973430 - protein, 18 aa, Mycobacterium
WLAIAAWAALAVVAVALI

SEQ ID NO: 973431 - protein, 27 aa, Mycobacterium
WLAILSLRLIPAVPFAALNYGAGASAV

SEQ ID NO: 973432 - protein, 18 aa, Mycobacterium
WLAPNKFRNSPFIWWAVT

SEQ ID NO: 973433 - protein, 19 aa, Mycobacterium
WLAPNKFRNSPFIWWAVTS

SEQ ID NO: 973434 - protein, 29 aa, Mycobacterium
WLDGDSARWPGIRGVALVAMPGQDPVVVE

SEQ ID NO: 973435 - protein, 25 aa, Mycobacterium
WLDYELDVAKLLDFPVMTDMRDPIT

SEQ ID NO: 973436 - protein, 19 aa, Mycobacterium
WLGLQIPFGTVWAEEAAFR

SEQ ID NO: 973437 - protein, 25 aa, Mycobacterium
WLGRLRFGGLYALSALGGSVLVYLI

SEQ ID NO: 973438 - protein, 17 aa, Mycobacterium
WLGSPPMRLRRKPAEAD

SEQ ID NO: 973439 - protein, 19 aa, Mycobacterium
WLIEHFSVGSVFWVNVPIA

SEQ ID NO: 973440 - protein, 17 aa, Mycobacterium
WLLAVVVIAVIRPAAML

SEQ ID NO: 973441 - protein, 27 aa, Mycobacterium
WLLEPVLGRRRVEGVLGHAVDVVAIVG

SEQ ID NO: 973442 - protein, 19 aa, Mycobacterium
WLLHSRVTAFFSHPIIAFI

SEQ ID NO: 973443 - protein, 17 aa, Mycobacterium
WLLLAPRDYLSTFMKVG

SEQ ID NO: 973444 - protein, 17 aa, Mycobacterium
WLLLTAVMFALSAATYA

SEQ ID NO: 973445 - protein, 27 aa, Mycobacterium
WLNEHAVESAVLFPGTGFVELALHVAD

SEQ ID NO: 973446 - protein, 17 aa, Mycobacterium
WLNGWPGLVASLGLGLA

SEQ ID NO: 973447 - protein, 26 aa, Mycobacterium
WLPLFHDMGLILGICAPLVTGCTAVL

SEQ ID NO: 973448 - protein, 18 aa, Mycobacterium
WLQRFSWVGLVIAVVGGL

SEQ ID NO: 973449 - protein, 26 aa, Mycobacterium
WLSATRWLGCLLACALAGAVLVMPLT

SEQ ID NO: 973450 - protein, 25 aa, Mycobacterium
WLSSELMFFAGLFAMYFTARSQAGG

SEQ ID NO: 973451 - protein, 24 aa, Mycobacterium
WLTDPRFLLGTLVYLAGFVLLVWS

SEQ ID NO: 973452 - protein, 20 aa, Mycobacterium
WLTPARWGYAASAATVNLRE

SEQ ID NO: 973453 - protein, 17 aa, Mycobacterium
WLVALFAAVMGASAWMP

SEQ ID NO: 973454 - protein, 20 aa, Mycobacterium
WLYTVFTVLAAVGFIASYQA

SEQ ID NO: 973455 - protein, 26 aa, Mycobacterium
WLYVLCGALVFAALAWVTPRVQGEKP

SEQ ID NO: 973456 - protein, 17 aa, Mycobacterium
WMANWRFVAQKTDYFTQ

SEQ ID NO: 973457 - protein, 17 aa, Mycobacterium
WMLGLATVPAMLLLPLL

SEQ ID NO: 973458 - protein, 21 aa, Mycobacterium
WMLLAGPGWVIFGAAKQIIGL

SEQ ID NO: 973459 - protein, 19 aa, Mycobacterium
WMMQAEVAVTNFVASMDVS

SEQ ID NO: 973460 - protein, 31 aa, Mycobacterium; identical to SEQ ID NO: 337023

SEQ ID NO: 973461 - protein, 21 aa, Mycobacterium
WMRQHCGIGQHWGIENSLHWI

SEQ ID NO: 973462 - protein, 18 aa, Mycobacterium
WMSCAFVAAAAVIRRWAG

SEQ ID NO: 973463 - protein, 24 aa, Mycobacterium
WMSHLRVALSEMWAHPVQRVGYVR

SEQ ID NO: 973464 - protein, 17 aa, Mycobacterium
WMTGQCCDLAARGYSRD

SEQ ID NO: 973465 - protein, 18 aa, Mycobacterium
WMVARVSLVPTLLVSIPF

SEQ ID NO: 973466 - protein, 18 aa, Mycobacterium
WNDFLWPLLMIQRNSLAT

SEQ ID NO: 973467 - protein, 26 aa, Mycobacterium
WNLHELTRGLNLSAFVLFSSMAGIIG

SEQ ID NO: 973468 - protein, 19 aa, Mycobacterium
WNPEFLREGFAVRDTLRPD

SEQ ID NO: 973469 - protein, 17 aa, Mycobacterium
WNVFMIFGVLALFVGHA

SEQ ID NO: 973470 - protein, 18 aa, Mycobacterium
WNVLFAYATIFLFLGFPA

SEQ ID NO: 973471 - protein, 21 aa, Mycobacterium
WNVVLRPYWTPVVAYTAAILI

SEQ ID NO: 973472 - protein, 25 aa, Mycobacterium
WPGISAEQLAPWLFDAELSVEWVAI

SEQ ID NO: 973473 - protein, 18 aa, Mycobacterium
WPKGPAVGIAGAPVQTPT

SEQ ID NO: 973474 - protein, 21 aa, Mycobacterium
WPLADRPRLAPGVPGGTIPVR

SEQ ID NO: 973475 - protein, 18 aa, Mycobacterium
WPLGEIDKPFEMRRDLLM

SEQ ID NO: 973476 - protein, 18 aa, Mycobacterium
WPLGEIDKPFEMRRDPLV

SEQ ID NO: 973477 - protein, 17 aa, Mycobacterium
WPLRAPRAAMVLWQAIS

SEQ ID NO: 973478 - protein, 17 aa, Mycobacterium
WPLSARSAPGLSAQAAR

SEQ ID NO: 973479 - protein, 19 aa, Mycobacterium
WPNYRTMRRLLRRDPPAAA

SEQ ID NO: 973480 - protein, 19 aa, Mycobacterium
WPPALPVAMWLLAVTSVIT

SEQ ID NO: 973481 - protein, 42 aa, Mycobacterium; identical to SEQ ID NO: 337108

SEQ ID NO: 973482 - protein, 18 aa, Mycobacterium
WPSGLDFGTQMAPALLIT

SEQ ID NO: 973483 - protein, 18 aa, Mycobacterium
WPSVPNPATSRWNATRRP

SEQ ID NO: 973484 - protein, 34 aa, Mycobacterium; identical to SEQ ID NO: 337125

SEQ ID NO: 973485 - protein, 17 aa, Mycobacterium
WQALPAPVATLVISLSS

SEQ ID NO: 973486 - protein, 27 aa, Mycobacterium
WQHILHMPLHWLVLPMAIIVMLAVGSD

SEQ ID NO: 973487 - protein, 19 aa, Mycobacterium
WQIAKSVLIFLGIPLLAGY

SEQ ID NO: 973488 - protein, 23 aa, Mycobacterium
WQRLGLERQVVWAAARALVQLLL

SEQ ID NO: 973489 - protein, 17 aa, Mycobacterium
WQRRHHATGGKVRIDGA

SEQ ID NO: 973490 - protein, 18 aa, Mycobacterium
WQRRSWAGRMFVAPNLAA

SEQ ID NO: 973491 - protein, 17 aa, Mycobacterium
WQVGWVVVLLYAVCVVL

SEQ ID NO: 973492 - protein, 17 aa, Mycobacterium
WQVLPFLIIQGLFGASL

SEQ ID NO: 973493 - protein, 18 aa, Mycobacterium
WQYDTMRYAQIAGVQALQ

SEQ ID NO: 973494 - protein, 24 aa, Mycobacterium
WRAPSAKNRQPWDFVLVTERSALQ

SEQ ID NO: 973495 - protein, 25 aa, Mycobacterium
WRAYALPVLMVLTVVVGYQTVTGTT

SEQ ID NO: 973496 - protein, 20 aa, Mycobacterium
WRDFCLRAADRIVLVSEGPA

SEQ ID NO: 973497 - protein, 26 aa, Mycobacterium
WRELILQCWFVMRVALLPTIMVSIPL

SEQ ID NO: 973498 - protein, 22 aa, Mycobacterium
WREVPRAVYAFDVATLGWTLVF

SEQ ID NO: 973499 - protein, 18 aa, Mycobacterium
WRGARWRRRTASLVAVPL

SEQ ID NO: 973500 - protein, 20 aa, Mycobacterium
WRHGACLVPAPRSLVRSGMD

SEQ ID NO: 973501 - protein, 22 aa, Mycobacterium
WRITLPMLRPTTFFVLVTGIVS

SEQ ID NO: 973502 - protein, 18 aa, Mycobacterium
WRLDRGALLLWTIGLCLY

SEQ ID NO: 973503 - protein, 20 aa, Mycobacterium
WRNAWNEFIPFLDYDTEIRK

SEQ ID NO: 973504 - protein, 18 aa, Mycobacterium
WRNLRFARDKMPADAVAV

SEQ ID NO: 973505 - protein, 22 aa, Mycobacterium
WRPMRSYFYWEKHCFDVPICWS

SEQ ID NO: 973506 - protein, 20 aa, Mycobacterium
WRRDRNLVYFLIASAIFRDG

SEQ ID NO: 973507 - protein, 18 aa, Mycobacterium
WRSIFYVNVPMGVFVILL

SEQ ID NO: 973508 - protein, 18 aa, Mycobacterium
WRTMPAVIWDVQYPPARV

SEQ ID NO: 973509 - protein, 17 aa, Mycobacterium
WRVLGIRLLTAIVVGLV

SEQ ID NO: 973510 - protein, 21 aa, Mycobacterium
WRVSPGVAATGHFDAVHRVLG

SEQ ID NO: 973511 - protein, 20 aa, Mycobacterium
WRYPLLRERAGRWEFAVDLV

SEQ ID NO: 973512 - protein, 17 aa, Mycobacterium
WSEGPRYQRLMLAVVGV

SEQ ID NO: 973513 - protein, 24 aa, Mycobacterium
WSFAQAAAVPVVFLTALFGLQDLA

SEQ ID NO: 973514 - protein, 17 aa, Mycobacterium
WSGLKLVGGGGGAITVV

SEQ ID NO: 973515 - protein, 17 aa, Mycobacterium
WSGLRAGAPPAPERHAS

SEQ ID NO: 973516 - protein, 25 aa, Mycobacterium
WSLAQAAGVPVVFLTAFYGLSVLAG

SEQ ID NO: 973517 - protein, 20 aa, Mycobacterium
WSPPGGRVGIRLRQLDPSHA

SEQ ID NO: 973518 - protein, 21 aa, Mycobacterium
WSQVHARACVVADELTMYGVP

SEQ ID NO: 973519 - protein, 19 aa, Mycobacterium
WSRCWRPVRCETRCAAIAP

SEQ ID NO: 973520 - protein, 19 aa, Mycobacterium
WSRYGRRAVPVAGTAGTAS

SEQ ID NO: 973521 - protein, 17 aa, Mycobacterium
WSTPKALVAKIKEIVGP

SEQ ID NO: 973522 - protein, 21 aa, Mycobacterium
WTMDAFDYFIVVLVYADIAKT

SEQ ID NO: 973523 - protein, 23 aa, Mycobacterium
WVAAHWRVSRSLVVGAAILAMAF

SEQ ID NO: 973524 - protein, 17 aa, Mycobacterium
WVAETSWGASWFSLSPV

SEQ ID NO: 973525 - protein, 18 aa, Mycobacterium
WVAGPALMFALAWLLLPD

SEQ ID NO: 973526 - protein, 23 aa, Mycobacterium
WVDVPDRLLQRWTGVDLTLDVSG

SEQ ID NO: 973527 - protein, 18 aa, Mycobacterium
WVGPRAAVALAGIALVAF

SEQ ID NO: 973528 - protein, 19 aa, Mycobacterium
WVGQLTFVPGIAVLAYTII

SEQ ID NO: 973529 - protein, 18 aa, Mycobacterium
WVVVLTLLVAGAFSVSWY

SEQ ID NO: 973530 - protein, 22 aa, Mycobacterium
WWGVASLVLWNWIAITNNRSAR

SEQ ID NO: 973531 - protein, 22 aa, Mycobacterium
WWLTEAGARFGVEDTKEAREAL

SEQ ID NO: 973532 - protein, 32 aa, Mycobacterium; identical to SEQ ID NO: 159772

SEQ ID NO: 973533 - protein, 18 aa, Mycobacterium
WWRTSELLAMFGGHLNLG

SEQ ID NO: 973534 - protein, 18 aa, Mycobacterium
WYAAMLFAVVPLRNILPG

SEQ ID NO: 973535 - protein, 17 aa, Mycobacterium
WYMSFWPIIAIAVITVT

SEQ ID NO: 973536 - protein, 19 aa, Mycobacterium
WYTQLPFLMEAMLAATLGV

SEQ ID NO: 973537 - protein, 19 aa, Mycobacterium
WYWLLAGPFSALSLILIEK

SEQ ID NO: 973538 - protein, 17 aa, Mycobacterium
YAACLAIGYLTTQVVVG

SEQ ID NO: 973539 - protein, 24 aa, Mycobacterium
YAADGNWAAAIRHRLRAVARELEE

SEQ ID NO: 973540 - protein, 32 aa, Mycobacterium; identical to SEQ ID NO: 337607

SEQ ID NO: 973541 - protein, 21 aa, Mycobacterium
YAFQRRRFWEVPGADGPADAT

SEQ ID NO: 973542 - protein, 25 aa, Mycobacterium
YAICSLPFEHAHPTAIMTWMRQHCG

SEQ ID NO: 973543 - protein, 30 aa, Mycobacterium
YAICSLPFEHARPTAIMTWMRQHCGIENGL

SEQ ID NO: 973544 - protein, 30 aa, Mycobacterium
YAICSLPFEHARPTAIMTWMRQHCGIENTL

SEQ ID NO: 973545 - protein, 30 aa, Mycobacterium
YAICSLPFEHARPTAIMTWMRQHGGIENSL

SEQ ID NO: 973546 - protein, 19 aa, Mycobacterium
YAICSPPFEHARPTAIMTW

SEQ ID NO: 973547 - protein, 25 aa, Mycobacterium
YALACVLGECLTGAPPYRADSVERL

SEQ ID NO: 973548 - protein, 21 aa, Mycobacterium
YALGCTAFHLLAGSAPFQHTN

SEQ ID NO: 973549 - protein, 20 aa, Mycobacterium
YALLMVSSGFGFLLLAHTRW

SEQ ID NO: 973550 - protein, 19 aa, Mycobacterium
YALVLLGLRVFYAREQPWT

SEQ ID NO: 973551 - protein, 19 aa, Mycobacterium
YAMAANWFGGSTWTTISSL

SEQ ID NO: 973552 - protein, 20 aa, Mycobacterium
YAQADLRSAELARGLIALGI

SEQ ID NO: 973553 - protein, 22 aa, Mycobacterium
YAREQPWTPILIIIIITSVKIG

SEQ ID NO: 973554 - protein, 20 aa, Mycobacterium
YARREHLGAVALTMLPVFVT

SEQ ID NO: 973555 - protein, 22 aa, Mycobacterium
YATIFLFLGFPAWQGYGVTSMS

SEQ ID NO: 973556 - protein, 17 aa, Mycobacterium
YAVVSLILFVNWIRVLV

SEQ ID NO: 973557 - protein, 27 aa, Mycobacterium
YAYGPGFQGLVGVWRRDSELFAEVVAP

SEQ ID NO: 973558 - protein, 20 aa, Mycobacterium
YCAPEQLQGAPLDGRADQYA

SEQ ID NO: 973559 - protein, 20 aa, Mycobacterium
YCLGLGIPFVLLAFGSAGAV

SEQ ID NO: 973560 - protein, 17 aa, Mycobacterium
YCSDFGRTWIVGRDPQP

SEQ ID NO: 973561 - protein, 22 aa, Mycobacterium
YCVSGCPYGVIARREGDGRASK

SEQ ID NO: 973562 - protein, 17 aa, Mycobacterium
YDAYECADGGYVAVGAI

SEQ ID NO: 973563 - protein, 26 aa, Mycobacterium
YDDFQRRSKPFIKVVQHFQSKSVGTI

SEQ ID NO: 973564 - protein, 24 aa, Mycobacterium
YDFCIYGTAAALVFPAVFYPGLSP

SEQ ID NO: 973565 - protein, 25 aa, Mycobacterium
YDLACNELDGFMVLPGTTRASIERG

SEQ ID NO: 973566 - protein, 28 aa, Mycobacterium
YDLLRPRLPRVLAAIALGVLPLGSALAL

SEQ ID NO: 973567 - protein, 22 aa, Mycobacterium
YDLSSLRFIMWGATPVSAGIAE

SEQ ID NO: 973568 - protein, 24 aa, Mycobacterium
YEHNLSAFIMFSSMAGMIGSPGLG

SEQ ID NO: 973569 - protein, 17 aa, Mycobacterium
YEMPIRTFGWPRDLPRA

SEQ ID NO: 973570 - protein, 18 aa, Mycobacterium
YESRFLPKVGPWALYGLL

SEQ ID NO: 973571 - protein, 18 aa, Mycobacterium
YETSRISSDFTFADAPND

SEQ ID NO: 973572 - protein, 21 aa, Mycobacterium
YEVAMGLSFAAVFLYAGSMST

SEQ ID NO: 973573 - protein, 18 aa, Mycobacterium
YFDWPNYRTMRRLLRRDP

SEQ ID NO: 973574 - protein, 19 aa, Mycobacterium
YFFIARFFTGSGIGGEYAA

SEQ ID NO: 973575 - protein, 17 aa, Mycobacterium
YFIGRRIGPALFKKEDS

SEQ ID NO: 973576 - protein, 19 aa, Mycobacterium
YFISYRWSIGLQRSDRAVL

SEQ ID NO: 973577 - protein, 27 aa, Mycobacterium
YFRTLGIPCAVGMLLAVVVALTLGPAV

SEQ ID NO: 973578 - protein, 19 aa, Mycobacterium
YFVMLGRLAFAMIGSGRAA

SEQ ID NO: 973579 - protein, 25 aa, Mycobacterium
YGAFFNIYFCTVTIKINGPAGSDIL

SEQ ID NO: 973580 - protein, 23 aa, Mycobacterium
YGALRAARRLGVPTVAVYQTDVL

SEQ ID NO: 973581 - protein, 17 aa, Mycobacterium
YGLLPALALLLAGGTGF

SEQ ID NO: 973582 - protein, 23 aa, Mycobacterium
YGPPQPGPGPGWPQGPVNTPPAD

SEQ ID NO: 973583 - protein, 22 aa, Mycobacterium
YGPQAPRLWLPPLDEPIPLSTL

SEQ ID NO: 973584 - protein, 22 aa, Mycobacterium
YGPRPLVRALLLPRNGDSADGP

SEQ ID NO: 973585 - protein, 24 aa, Mycobacterium
YGPTPRYTVMPRWGLGDRVAQPGP

SEQ ID NO: 973586 - protein, 18 aa, Mycobacterium
YGQPGYFGAQFSQCGIPG

SEQ ID NO: 973587 - protein, 19 aa, Mycobacterium
YGQPGYFGAQFSQCGIPGQ

SEQ ID NO: 973588 - protein, 18 aa, Mycobacterium
YGSAGYWVDHIRRPVRFA

SEQ ID NO: 973589 - protein, 17 aa, Mycobacterium
YGSWRAALPHFLGSSGV

SEQ ID NO: 973590 - protein, 23 aa, Mycobacterium
YGTGPGWPTGPYSPGPPPKGPGS

SEQ ID NO: 973591 - protein, 26 aa, Mycobacterium
YGTYFKGHLYIAGRIKDLVIIDGRNH

SEQ ID NO: 973592 - protein, 21 aa, Mycobacterium
YGVAWFGAYSIVISWAEQHID

SEQ ID NO: 973593 - protein, 20 aa, Mycobacterium
YGVLFQPNFHLPIIGRWNAI

SEQ ID NO: 973594 - protein, 17 aa, Mycobacterium
YGVTRADVDAVKFTQVL

SEQ ID NO: 973595 - protein, 18 aa, Mycobacterium
YGYSGLGEVAVFVFFGLV

SEQ ID NO: 973596 - protein, 18 aa, Mycobacterium
YIACLTISYLSCQLMVTF

SEQ ID NO: 973597 - protein, 19 aa, Mycobacterium
YILLPRLDLGFGPDGQNPP

SEQ ID NO: 973598 - protein, 18 aa, Mycobacterium
YIPAGAPSNIGYRASDRH

SEQ ID NO: 973599 - protein, 24 aa, Mycobacterium
YITEALKRLPAYATTLGEVVGSGP

SEQ ID NO: 973600 - protein, 20 aa, Mycobacterium
YITRTLCLFVIAFGLYMVPQ

SEQ ID NO: 973601 - protein, 20 aa, Mycobacterium
YIVGCIAAVLAVRQSGVFTA

SEQ ID NO: 973602 - protein, 18 aa, Mycobacterium
YKAPVWGYSAGSLGTPPQ

SEQ ID NO: 973603 - protein, 32 aa, Mycobacterium
YKFAAPRLRSYGGFAYRARWLIIAVVAAANTA

SEQ ID NO: 973604 - protein, 20 aa, Mycobacterium
YKLIPWKDVVGVSFPGGSRW

SEQ ID NO: 973605 - protein, 18 aa, Mycobacterium
YLACAALTGCGRANYAAS

SEQ ID NO: 973606 - protein, 25 aa, Mycobacterium
YLAGREIPAAVPLVSFAILAACGLP

SEQ ID NO: 973607 - protein, 18 aa, Mycobacterium
YLALIVLAVIALVIGALG

SEQ ID NO: 973608 - protein, 18 aa, Mycobacterium
YLAYLRRQTRIEAKVRRR

SEQ ID NO: 973609 - protein, 30 aa, Mycobacterium
YLDRRFTIGHGRLFASYVALYCVGRFCVEL

SEQ ID NO: 973610 - protein, 25 aa, Mycobacterium
YLETVSHMWVVKFLRTHGLIHDCPK

SEQ ID NO: 973611 - protein, 18 aa, Mycobacterium
YLFTPLFNWFNKRLNAGL

SEQ ID NO: 973612 - protein, 18 aa, Mycobacterium
YLLLTLLLSRLFTPDEVA

SEQ ID NO: 973613 - protein, 18 aa, Mycobacterium
YLLWAIIPMAAWATRTGF

SEQ ID NO: 973614 - protein, 17 aa, Mycobacterium
YLNVCIREVLWPIVLPG

SEQ ID NO: 973615 - protein, 18 aa, Mycobacterium
YLPPEAFDNPDFQRGLKL

SEQ ID NO: 973616 - protein, 18 aa, Mycobacterium
YLPPEAFDNPDFQRGLTL

SEQ ID NO: 973617 - protein, 19 aa, Mycobacterium
YLPPEAFDNPDFQTGLRMF

SEQ ID NO: 973618 - protein, 18 aa, Mycobacterium
YLPPEAFQNPDFQRGLTL

SEQ ID NO: 973619 - protein, 19 aa, Mycobacterium
YLPTDGFQGLNIVSTIGAF

SEQ ID NO: 973620 - protein, 25 aa, Mycobacterium
YLQDRFPAVPFWTWIVGFAALTTVL

SEQ ID NO: 973621 - protein, 23 aa, Mycobacterium
YLREFGNLVFHFSLLGLLVAVAV

SEQ ID NO: 973622 - protein, 20 aa, Mycobacterium
YLRFRREAQNAAALNHPAIV

SEQ ID NO: 973623 - protein, 24 aa, Mycobacterium
YLVLCAVASLLLSMVQGRPLITAL

SEQ ID NO: 973624 - protein, 24 aa, Mycobacterium
YLVPLEDLCVYPWSPFSLVNGSVS

SEQ ID NO: 973625 - protein, 18 aa, Mycobacterium
YLVSFVFIGSSWLAHTRL

SEQ ID NO: 973626 - protein, 26 aa, Mycobacterium
YLVWPALIIATAWLLRRIGKNNRGAT

SEQ ID NO: 973627 - protein, 24 aa, Mycobacterium
YLWAFELTSALLITAAIGAMVLAH

SEQ ID NO: 973628 - protein, 17 aa, Mycobacterium
YLYARGMLARRGRGHPS

SEQ ID NO: 973629 - protein, 20 aa, Mycobacterium
YLYITLRGAIAMVTLVADFL

SEQ ID NO: 973630 - protein, 31 aa, Mycobacterium; identical to SEQ ID NO: 159821

SEQ ID NO: 973631 - protein, 18 aa, Mycobacterium
YNGCGYCVSGCPYGVIAR

SEQ ID NO: 973632 - protein, 21 aa, Mycobacterium
YNIGTPWAKTALRDLNFVVEQ

SEQ ID NO: 973633 - protein, 24 aa, Mycobacterium
YNKLIKPFVDWLANIPFLQALFSG

SEQ ID NO: 973634 - protein, 34 aa, Mycobacterium; identical to SEQ ID NO: 338194

SEQ ID NO: 973635 - protein, 18 aa, Mycobacterium
YPAGMPVAEVVAVVTAVA

SEQ ID NO: 973636 - protein, 19 aa, Mycobacterium
YPARLVVPGLYGYVSATKW

SEQ ID NO: 973637 - protein, 23 aa, Mycobacterium
YPENLPRVNAHGGPGGAPGCWQS

SEQ ID NO: 973638 - protein, 27 aa, Mycobacterium
YPGMGADLYRQFPVFAHALDEVAAALN

SEQ ID NO: 973639 - protein, 19 aa, Mycobacterium
YPHGGGRVGHRLHSAVIIA

SEQ ID NO: 973640 - protein, 22 aa, Mycobacterium
YPIMRKLFSQFGLDVLAAESVK

SEQ ID NO: 973641 - protein, 26 aa, Mycobacterium
YPLAWGLCGLFPLAAIPLVPTRLRPP

SEQ ID NO: 973642 - protein, 19 aa, Mycobacterium
YPPVEPRPAAPAKAPEAPV

SEQ ID NO: 973643 - protein, 17 aa, Mycobacterium
YPTGYAVDLFNALTAKN

SEQ ID NO: 973644 - protein, 25 aa, Mycobacterium
YPTLSHNFYLWWLAKAGAVGMAVFA

SEQ ID NO: 973645 - protein, 20 aa, Mycobacterium
YPVICRTAFGVLGANIPAII

SEQ ID NO: 973646 - protein, 17 aa, Mycobacterium
YPYREPLPAPPPGGPPP

SEQ ID NO: 973647 - protein, 24 aa, Mycobacterium
YQALGAKIPKGVLLYGPPGTGKTL

SEQ ID NO: 973648 - protein, 18 aa, Mycobacterium
YQGYPGYQPPPGSVPPSP

SEQ ID NO: 973649 - protein, 17 aa, Mycobacterium
YQLPGDWKANIAAQPLV

SEQ ID NO: 973650 - protein, 24 aa, Mycobacterium
YQTERLWAAIGLVPQRGYLFSGTV

SEQ ID NO: 973651 - protein, 21 aa, Mycobacterium
YRAVEHLARVEARGDTEMLAP

SEQ ID NO: 973652 - protein, 21 aa, Mycobacterium
YRAVLNFRRGWDIYNEHFDYV

SEQ ID NO: 973653 - protein, 23 aa, Mycobacterium
YREVRTGHDVRWTVVLDTAVRIS

SEQ ID NO: 973654 - protein, 20 aa, Mycobacterium
YRGELKVVLINLDPATPIVV

SEQ ID NO: 973655 - protein, 18 aa, Mycobacterium
YRGLLHWQSIPSTWDAVW

SEQ ID NO: 973656 - protein, 33 aa, Mycobacterium
YRKTRLVPFGEYFPLRWLVGWITQGTKAAAEDR

SEQ ID NO: 973657 - protein, 20 aa, Mycobacterium
YRLRCKTTRGCDNRIGDFTC

SEQ ID NO: 973658 - protein, 17 aa, Mycobacterium
YRNVFVVGDMAAIDGVP

SEQ ID NO: 973659 - protein, 20 aa, Mycobacterium
YRPELGVLYPSELATGMRIY

SEQ ID NO: 973660 - protein, 26 aa, Mycobacterium
YRPGPPSYPSRPSWPSPPPDRPPDPV

SEQ ID NO: 973661 - protein, 19 aa, Mycobacterium
YRQAIPTLFKTGLPNTLIL

SEQ ID NO: 973662 - protein, 34 aa, Mycobacterium; identical to SEQ ID NO: 338373

SEQ ID NO: 973663 - protein, 19 aa, Mycobacterium
YRSGMPLEDVIEIVTAVAE

SEQ ID NO: 973664 - protein, 18 aa, Mycobacterium
YRSLWVFLLLPVLILLTV

SEQ ID NO: 973665 - protein, 18 aa, Mycobacterium
YRYRLRVLVAATVAAGVI

SEQ ID NO: 973666 - protein, 19 aa, Mycobacterium
YSALRAGVGFIPFVIAMGI

SEQ ID NO: 973667 - protein, 20 aa, Mycobacterium
YSIGGILYAVRWPDPWPSTF

SEQ ID NO: 973668 - protein, 19 aa, Mycobacterium
YSIPLRRALVTGSDLPYPE

SEQ ID NO: 973669 - protein, 20 aa, Mycobacterium
YSKWVPRILPPGWKPGSRAV

SEQ ID NO: 973670 - protein, 22 aa, Mycobacterium
YSLDNKRLWSNLDCAPSNETLV

SEQ ID NO: 973671 - protein, 19 aa, Mycobacterium
YSPEYTCLLEGAKYLLDHG

SEQ ID NO: 973672 - protein, 19 aa, Mycobacterium
YSPRRCDRAAVLEAIGGAK

SEQ ID NO: 973673 - protein, 19 aa, Mycobacterium
YSVLPAPMVAMVFDTVFQP

SEQ ID NO: 973674 - protein, 25 aa, Mycobacterium
YSWYLWHWPVLLLLPPLLGDPAGLP

SEQ ID NO: 973675 - protein, 18 aa, Mycobacterium
YSYLPSWLSFLVDKENAR

SEQ ID NO: 973676 - protein, 24 aa, Mycobacterium
YTFTGSAVGLIFLWFSMTPSLLPR

SEQ ID NO: 973677 - protein, 19 aa, Mycobacterium
YTGYLTLVFLFAVLVLMGF

SEQ ID NO: 973678 - protein, 26 aa, Mycobacterium
YTRADCPRYGELKGPSCFTAPLVPVR

SEQ ID NO: 973679 - protein, 30 aa, Mycobacterium; identical to SEQ ID NO: 338496

SEQ ID NO: 973680 - protein, 19 aa, Mycobacterium
YTSVVLVFLAFMVALVGSA

SEQ ID NO: 973681 - protein, 18 aa, Mycobacterium
YTTGPAHRTRKWAEYLTV

SEQ ID NO: 973682 - protein, 22 aa, Mycobacterium
YVFARPPLLGPSGRMVATGVTI

SEQ ID NO: 973683 - protein, 31 aa, Mycobacterium; identical to SEQ ID NO: 338529

SEQ ID NO: 973684 - protein, 17 aa, Mycobacterium
YVGNVILMLGIPLALGS

SEQ ID NO: 973685 - protein, 22 aa, Mycobacterium
YVIEAPPVFFARHASLVAATLL

SEQ ID NO: 973686 - protein, 19 aa, Mycobacterium
YVLHRAWVGPMVLLVLDDP

SEQ ID NO: 973687 - protein, 18 aa, Mycobacterium
YVMGGAMLGMIVIMVAGG

SEQ ID NO: 973688 - protein, 17 aa, Mycobacterium
YVRTWKRNEEAYLERNA

SEQ ID NO: 973689 - protein, 21 aa, Mycobacterium
YVVTCFIFFLIGGLLALLMRT

SEQ ID NO: 973690 - protein, 21 aa, Mycobacterium
YWFRGHFWLATIVVLSVQYLG

SEQ ID NO: 973691 - protein, 22 aa, Mycobacterium
YWIMTHMLPLFRSMQALIDGIN

SEQ ID NO: 973692 - protein, 17 aa, Mycobacterium
YWLGRLVLERGVAAVYL

SEQ ID NO: 973693 - protein, 18 aa, Mycobacterium
YWLTVLVVWTVVIVMTSM

SEQ ID NO: 973694 - protein, 19 aa, Mycobacterium
YWQARVFMAVFAVATLVPS

SEQ ID NO: 973695 - protein, 17 aa, Mycobacterium
YWVAGAVSVLWLGVAGW

SEQ ID NO: 973696 - protein, 18 aa, Mycobacterium
YWYRKGYNPAAVIATAVS

SEQ ID NO: 973697 - protein, 28 aa, Mycobacterium
YYLAAFVVGSAVAWGIVTVSIKPVATTA

SEQ ID NO: 973698 - protein, 18 aa, Mycobacterium
YYPVSWIMWVWYKLFALV

SEQ ID NO: 973699 - protein, 23 aa, Mycobacterium
YYRYCTYAFIPLQMVSLVLACYL

SEQ ID NO: 973700 - protein, 24 aa, Mycobacterium
YYVGNWATSVWCFRAGAEEKIEAS

SEQ ID NO: 973701 - protein, 18 aa, Mycobacterium
PFEHARPTAIMTWMRQHC

SEQ ID NO: 973702 - protein, 18 aa, Mycobacterium
PFEHARPTAIMTWMRQHW

SEQ ID NO: 973703 - protein, 17 aa, Mycobacterium
FEHARPTAIMTWMRQHC

SEQ ID NO: 973704 - protein, 17 aa, Mycobacterium
FEHARPTAIMTWMRQHW

SEQ ID NO: 973705 - protein, 22 aa, Mycobacterium
VMSGRIAYTLGLEGPAITVDTA

SEQ ID NO: 973706 - protein, 21 aa, Mycobacterium
WNVLYCQARPLTLPTYAFQHQ

SEQ ID NO: 973707 - protein, 21 aa, Mycobacterium
GADLYRQFPVFAHALDACDAA

SEQ ID NO: 973708 - protein, 22 aa, Mycobacterium
MVSLAALWRWAGITPDAVIGHS

SEQ ID NO: 973709 - protein, 21 aa, Mycobacterium
PELTPRPSTIAMYSTVDGEPH

SEQ ID NO: 973710 - protein, 23 aa, Mycobacterium
YWYRNIRNTVRFHDTVAALLGAG

SEQ ID NO: 973711 - protein, 24 aa, Mycobacterium
AALIKVCALMAFLVVGTIFLGGRY

SEQ ID NO: 973712 - protein, 17 aa, Mycobacterium
LALLPRGGHFVEIGKTD

SEQ ID NO: 973713 - protein, 25 aa, Mycobacterium
RWSFPQAASIPVVFLTAYIALAEIS

SEQ ID NO: 973714 - protein, 18 aa, Mycobacterium
TIPARWSFPQAASIPVVF

SEQ ID NO: 973715 - protein, 18 aa, Mycobacterium
FASVNGWWYVSNFGVPWS

SEQ ID NO: 973716 - protein, 21 aa, Mycobacterium
GADLYRQFPVFAHALDEVAAA

SEQ ID NO: 973717 - protein, 20 aa, Mycobacterium
GLRTRSEMIAQLVFAMGGRA

SEQ ID NO: 973718 - protein, 24 aa, Mycobacterium
GTMLLRLCMLPGLALLIWATPRLA

SEQ ID NO: 973719 - protein, 20 aa, Mycobacterium
IFERFGKFWGAFSVGDLLIL

SEQ ID NO: 973720 - protein, 18 aa, Mycobacterium
LAARFGFLLAIPAVFASG

SEQ ID NO: 973721 - protein, 18 aa, Mycobacterium
LGDILGFGGMSEVHLARD

SEQ ID NO: 973722 - protein, 18 aa, Mycobacterium
LIGSEFLDVLAWVPDPRD

SEQ ID NO: 973723 - protein, 18 aa, Mycobacterium
PFEHARPTAIMTWMRQHG

SEQ ID NO: 973724 - protein, 20 aa, Mycobacterium
PLLLLVGLFVMFSRMQGGAR

SEQ ID NO: 973725 - protein, 19 aa, Mycobacterium
TVVRMFLVPSVMKLLGDDC

SEQ ID NO: 973726 - protein, 17 aa, Mycobacterium
AAAALVWLVEEMEQRYQ

SEQ ID NO: 973727 - protein, 20 aa, Mycobacterium
AAAVVFGVVIWRAHHDNSAE

SEQ ID NO: 973728 - protein, 24 aa, Mycobacterium
AAFPRYHPRWAWWLTSVPVLREFV

SEQ ID NO: 973729 - protein, 25 aa, Mycobacterium
AAIFVCLFCAFYIYDGNLQPDARCM

SEQ ID NO: 973730 - protein, 17 aa, Mycobacterium
AAVACGRLAGAGRIGVK

SEQ ID NO: 973731 - protein, 18 aa, Mycobacterium
AAVISRLPVRYTFDNRYF

SEQ ID NO: 973732 - protein, 17 aa, Mycobacterium
AAVLRIGLRAMLGVNVA

SEQ ID NO: 973733 - protein, 17 aa, Mycobacterium
ACLRVPYSLATALFGGR

SEQ ID NO: 973734 - protein, 20 aa, Mycobacterium
AEPRLRALGWTGVLDKGPDV

SEQ ID NO: 973735 - protein, 23 aa, Mycobacterium
AETLRLVSYLIMCRNSIRDYAEL

SEQ ID NO: 973736 - protein, 24 aa, Mycobacterium
AGPRLVDAYVEWLWFGELGYRSVF

SEQ ID NO: 973737 - protein, 24 aa, Mycobacterium
AGQFMWLATSWRLAEYVCSTGYFW

SEQ ID NO: 973738 - protein, 24 aa, Mycobacterium
AGTAPRPAICSMHVGPPVGIDSGA

SEQ ID NO: 973739 - protein, 18 aa, Mycobacterium
AISKLGFWSVVMLGINSI

SEQ ID NO: 973740 - protein, 18 aa, Mycobacterium
AKSLRAGDVIDLAAPEVV

SEQ ID NO: 973741 - protein, 17 aa, Mycobacterium
ALACADLGLAMGRGTDV

SEQ ID NO: 973742 - protein, 18 aa, Mycobacterium
ALELRGRILSAFEQAERS

SEQ ID NO: 973743 - protein, 17 aa, Mycobacterium
ALFGWGAWQRRWIADDG

SEQ ID NO: 973744 - protein, 21 aa, Mycobacterium
ALTEVSWRLAFLVNVPIGLVM

SEQ ID NO: 973745 - protein, 26 aa, Mycobacterium
ALTGTPAWEIFKPWAITSITIAVAIT

SEQ ID NO: 973746 - protein, 20 aa, Mycobacterium
AMNFVICLVLIYGIALVWGL

SEQ ID NO: 973747 - protein, 26 aa, Mycobacterium
APDITKPVWITMLWPLADRPRLSPGA

SEQ ID NO: 973748 - protein, 20 aa, Mycobacterium
APEGMAIWIIGMVTAIGLAL

SEQ ID NO: 973749 - protein, 18 aa, Mycobacterium
APVMYRIVRELATGAHQP

SEQ ID NO: 973750 - protein, 19 aa, Mycobacterium
AQEWLKSVVPFGGFPWGSV

SEQ ID NO: 973751 - protein, 20 aa, Mycobacterium
ARANPAWAINLFLKYHAGEY

SEQ ID NO: 973752 - protein, 21 aa, Mycobacterium
ARDDYPTLCWAWERKASDQAP

SEQ ID NO: 973753 - protein, 20 aa, Mycobacterium
ARLDNARFLLPVAGVPPAKS

SEQ ID NO: 973754 - protein, 19 aa, Mycobacterium
ARMALGLLVRISMASIAAV

SEQ ID NO: 973755 - protein, 22 aa, Mycobacterium
ARQHARRMVLIWVGVVVAIAGL

SEQ ID NO: 973756 - protein, 19 aa, Mycobacterium
ARSLRAMPVIAPRNLARLP

SEQ ID NO: 973757 - protein, 19 aa, Mycobacterium
ASEALAFVRQRHGLDNGDL

SEQ ID NO: 973758 - protein, 19 aa, Mycobacterium
ASVALELLTGPSLLILDEP

SEQ ID NO: 973759 - protein, 20 aa, Mycobacterium
ATWAMLVPRLPRLVVAVVAG

SEQ ID NO: 973760 - protein, 22 aa, Mycobacterium
AVACLPDWLSGFLTGGLIAGSS

SEQ ID NO: 973761 - protein, 22 aa, Mycobacterium
AVCLVFRWFSPMICVCRPTLSK

SEQ ID NO: 973762 - protein, 23 aa, Mycobacterium
AVICCIGFLFPLWDSKRQTLADK

SEQ ID NO: 973763 - protein, 22 aa, Mycobacterium
AVMTKLRWVLLIVGSLGVAVAA

SEQ ID NO: 973764 - protein, 24 aa, Mycobacterium
AVPGPAWLRRLWLAVIIVSPAAIW

SEQ ID NO: 973765 - protein, 17 aa, Mycobacterium
AYMIGGAVPAGADQSTA

SEQ ID NO: 973766 - protein, 20 aa, Mycobacterium
CAAVGRISYLLGLRGPAMAV

SEQ ID NO: 973767 - protein, 17 aa, Mycobacterium
CAGWLPWFADIDRQMYL

SEQ ID NO: 973768 - protein, 19 aa, Mycobacterium
CAPLAIAVLWRWLLAPTDG

SEQ ID NO: 973769 - protein, 22 aa, Mycobacterium
CASAWLDALVMWRKASGLPSAV

SEQ ID NO: 973770 - protein, 28 aa, Mycobacterium
CGPGRYGLDAGRRWAYRPFIGSFIVLIA

SEQ ID NO: 973771 - protein, 18 aa, Mycobacterium
CGVSWVYHYAVAVYRDDR

SEQ ID NO: 973772 - protein, 20 aa, Mycobacterium
CLPAVIWWACHRPNRLWWRY

SEQ ID NO: 973773 - protein, 17 aa, Mycobacterium
CQRRWQPRLVLVVLAGM

SEQ ID NO: 973774 - protein, 19 aa, Mycobacterium
CSLAGYAFARLQFRGRDAL

SEQ ID NO: 973775 - protein, 21 aa, Mycobacterium
CYLVWHLRKAWAPMTYTDENP

SEQ ID NO: 973776 - protein, 18 aa, Mycobacterium
DAAVIWLNRLRALAHRMC

SEQ ID NO: 973777 - protein, 20 aa, Mycobacterium
DGSIGRWVAVVAVLAVLTIA

SEQ ID NO: 973778 - protein, 18 aa, Mycobacterium
DGTLRFLLWTAALFSALA

SEQ ID NO: 973779 - protein, 20 aa, Mycobacterium
DLICGVACWLLLSREVLPRL

SEQ ID NO: 973780 - protein, 24 aa, Mycobacterium
DLRAKAGAMSLILASRILGVDITA

SEQ ID NO: 973781 - protein, 25 aa, Mycobacterium
DLVRARFPPLFTRGCTAQRRRTLTI

SEQ ID NO: 973782 - protein, 17 aa, Mycobacterium
DQLWRWNSIVALVLSVL

SEQ ID NO: 973783 - protein, 24 aa, Mycobacterium
DRAGAFWRRTGVRIVRRPVAYLSA

SEQ ID NO: 973784 - protein, 18 aa, Mycobacterium
DRPVHPFTLWRSRFSVAI

SEQ ID NO: 973785 - protein, 17 aa, Mycobacterium
DRTSFIIAHHLPTIRDA

SEQ ID NO: 973786 - protein, 23 aa, Mycobacterium
DRWSRLRWQIPMSLTGAALGAFL

SEQ ID NO: 973787 - protein, 17 aa, Mycobacterium
DRYELGDILGFGGMSEV

SEQ ID NO: 973788 - protein, 17 aa, Mycobacterium
DSAWLLVSILWQMRLTA

SEQ ID NO: 973789 - protein, 17 aa, Mycobacterium
DSYRLASRLGMPPWRVQ

SEQ ID NO: 973790 - protein, 19 aa, Mycobacterium
DYGAPPGWHAPGWPPQQPP

SEQ ID NO: 973791 - protein, 19 aa, Mycobacterium
EAALTWLLLVSVPILAVTN

SEQ ID NO: 973792 - protein, 23 aa, Mycobacterium
EAAQLSALWARFPLPVIPAPGDP

SEQ ID NO: 973793 - protein, 19 aa, Mycobacterium
EAVDSRLGRRVAVKVLKGE

SEQ ID NO: 973794 - protein, 18 aa, Mycobacterium
EAWYAFATAVPWARQRTA

SEQ ID NO: 973795 - protein, 27 aa, Mycobacterium
EDVIRFQAEFLWRDYFRGVTLDGEEQP

SEQ ID NO: 973796 - protein, 18 aa, Mycobacterium
EFRLPRLGTSVFHGVEIE

SEQ ID NO: 973797 - protein, 18 aa, Mycobacterium
EFSGRWLSGWLMALYSFF

SEQ ID NO: 973798 - protein, 17 aa, Mycobacterium
EGRSFRSAVPRGWVRAR

SEQ ID NO: 973799 - protein, 19 aa, Mycobacterium
EGWWPTMIGLAMNDSGGYN

SEQ ID NO: 973800 - protein, 19 aa, Mycobacterium
EKRPRLTMFDDFGGRIPSD

SEQ ID NO: 973801 - protein, 26 aa, Mycobacterium
ELLDTWLWRWVALLIVFAIMVMVTAA

SEQ ID NO: 973802 - protein, 18 aa, Mycobacterium
ELPDCIIVSVSHRRAVEL

SEQ ID NO: 973803 - protein, 23 aa, Mycobacterium
ELPFYRLVLSYVFVAVFLAFVVN

SEQ ID NO: 973804 - protein, 19 aa, Mycobacterium
ELRMKVVDKHMEWPDTGHL

SEQ ID NO: 973805 - protein, 20 aa, Mycobacterium
ELRPWYPAVEIYRVAVSDGT

SEQ ID NO: 973806 - protein, 35 aa, Mycobacterium
EMINMPAGFSIGWAMWFILVCSVLQAIAAVAALLL

SEQ ID NO: 973807 - protein, 19 aa, Mycobacterium
ENFSRCFVPTSFVVSAITL

SEQ ID NO: 973808 - protein, 20 aa, Mycobacterium
ETNWLYPFIEFRLPRLGTSV

SEQ ID NO: 973809 - protein, 25 aa, Mycobacterium
EVLRWSRNRMAFLAALLFVMTLCFA

SEQ ID NO: 973810 - protein, 17 aa, Mycobacterium
FAMMLAIITTVGALVAL

SEQ ID NO: 973811 - protein, 17 aa, Mycobacterium
FAVGVSIMATVLKLVAV

SEQ ID NO: 973812 - protein, 24 aa, Mycobacterium
FEKHGRWTIILARFLPFMRTFTPV

SEQ ID NO: 973813 - protein, 35 aa, Mycobacterium
FEPKRLIKVRGWRRIGTVVVRWPLPILITTCAIAM

SEQ ID NO: 973814 - protein, 17 aa, Mycobacterium
FGASWAFVVMPFMGTYD

SEQ ID NO: 973815 - protein, 17 aa, Mycobacterium
FGVVIWRAHHDNSAERA

SEQ ID NO: 973816 - protein, 25 aa, Mycobacterium
FGVVVGGPFLPLAIILYWFSNNIWT

SEQ ID NO: 973817 - protein, 19 aa, Mycobacterium
FKGGSTFLGMEKLPHTAAV

SEQ ID NO: 973818 - protein, 17 aa, Mycobacterium
FLCPGCGDFERNFGPTV

SEQ ID NO: 973819 - protein, 19 aa, Mycobacterium
FLLRARQAIRIVVIMLLTA

SEQ ID NO: 973820 - protein, 17 aa, Mycobacterium
FNLSWSIEGTRSRTGKM

SEQ ID NO: 973821 - protein, 18 aa, Mycobacterium
FNVVLPWSKQVSLSKSAV

SEQ ID NO: 973822 - protein, 17 aa, Mycobacterium
FPPARLTKVTAMPQLVA

SEQ ID NO: 973823 - protein, 21 aa, Mycobacterium
FPSYLGFRIVERWQFHYSQVI

SEQ ID NO: 973824 - protein, 23 aa, Mycobacterium
FRFMPELNWTWSYPLVMAGMTIV

SEQ ID NO: 973825 - protein, 18 aa, Mycobacterium
FSGFIAWLMWLVLHLMYL

SEQ ID NO: 973826 - protein, 19 aa, Mycobacterium
FSRILDVAPRLAILLDDYA

SEQ ID NO: 973827 - protein, 26 aa, Mycobacterium
FTVPLRSAWWWLCMAVGGIVILSMLV

SEQ ID NO: 973828 - protein, 18 aa, Mycobacterium
FVRWGIRTPWPLFSLSML

SEQ ID NO: 973829 - protein, 23 aa, Mycobacterium
FWIRRACRLLPALVLMVLTVGIA

SEQ ID NO: 973830 - protein, 20 aa, Mycobacterium
GALCILVMVMWVGTALTIST

SEQ ID NO: 973831 - protein, 17 aa, Mycobacterium
GAMPWILIVCLFVTILA

SEQ ID NO: 973832 - protein, 22 aa, Mycobacterium
GDDCWWAPRWARLLQNRIGLGE

SEQ ID NO: 973833 - protein, 17 aa, Mycobacterium
GEARMALGLLVRISMAS

SEQ ID NO: 973834 - protein, 18 aa, Mycobacterium
GGDAWVIRQGRRSRIDAM

SEQ ID NO: 973835 - protein, 25 aa, Mycobacterium
GGGWLLMVAMLYGWAFMNRGVPYFP

SEQ ID NO: 973836 - protein, 19 aa, Mycobacterium
GGPLPRGRGLLMAEDTGVL

SEQ ID NO: 973837 - protein, 20 aa, Mycobacterium
GGWCSGEVLALASAVEAASE

SEQ ID NO: 973838 - protein, 23 aa, Mycobacterium
GIVGWASGLGFGWIYTLGTANVV

SEQ ID NO: 973839 - protein, 17 aa, Mycobacterium
GIVPWWFVVALLARDVL

SEQ ID NO: 973840 - protein, 18 aa, Mycobacterium
GIYQWRWSIATLWFITVF

SEQ ID NO: 973841 - protein, 17 aa, Mycobacterium
GLAEIWSRHLGRAILPD

SEQ ID NO: 973842 - protein, 17 aa, Mycobacterium
GLFGVLRWTAVGLVATL

SEQ ID NO: 973843 - protein, 18 aa, Mycobacterium
GLFYRYAWQNPSFSNIVA

SEQ ID NO: 973844 - protein, 23 aa, Mycobacterium
GLGGLGLVVARWLVDRGAGRVVL

SEQ ID NO: 973845 - protein, 20 aa, Mycobacterium
GLQHWPWMLLGYFVITILVV

SEQ ID NO: 973846 - protein, 19 aa, Mycobacterium
GLQIDHFWWTAIWAAIVLS

SEQ ID NO: 973847 - protein, 18 aa, Mycobacterium
GLSWRARPKLAINPDGLA

SEQ ID NO: 973848 - protein, 19 aa, Mycobacterium
GPLPGWPIWFAVVWAAQEW

SEQ ID NO: 973849 - protein, 25 aa, Mycobacterium
GQGACFRLTLPLVRGHKVTTSPLPM

SEQ ID NO: 973850 - protein, 19 aa, Mycobacterium
GQLRAGTALVARGEFSLII

SEQ ID NO: 973851 - protein, 17 aa, Mycobacterium
GQQCTRHPLPLLAALAK

SEQ ID NO: 973852 - protein, 28 aa, Mycobacterium
GQVWQVDWIFRVSWHYVFDITQRQYFDH

SEQ ID NO: 973853 - protein, 17 aa, Mycobacterium
GRLSLLELRGFAMPLYL

SEQ ID NO: 973854 - protein, 17 aa, Mycobacterium
GRRCSLMALLAIAVLAT

SEQ ID NO: 973855 - protein, 19 aa, Mycobacterium
GRRLMAVLLHGTRQPIAPW

SEQ ID NO: 973856 - protein, 18 aa, Mycobacterium
GRRLWHRFRIQTEGADSN

SEQ ID NO: 973857 - protein, 19 aa, Mycobacterium
GRWALCLIDGTPLWPTQSL

SEQ ID NO: 973858 - protein, 20 aa, Mycobacterium
GSLLRLTVLTSIMLPTMAVV

SEQ ID NO: 973859 - protein, 18 aa, Mycobacterium
GSSFKVFALIAALEQGIG

SEQ ID NO: 973860 - protein, 19 aa, Mycobacterium
GSVLLLCWRDIGHPQGGGS

SEQ ID NO: 973861 - protein, 21 aa, Mycobacterium
GVDGLPFEWSVKSWAKKTQQS

SEQ ID NO: 973862 - protein, 21 aa, Mycobacterium
GVLTWKMYVCRPLPGNLHDEA

SEQ ID NO: 973863 - protein, 18 aa, Mycobacterium
GVVLDWPRWWVSACSVLV

SEQ ID NO: 973864 - protein, 27 aa, Mycobacterium
GWCLIRTRWGQLIARFLPVLGLAGLAA

SEQ ID NO: 973865 - protein, 19 aa, Mycobacterium
GWITQRLWWALLLTAGFWG

SEQ ID NO: 973866 - protein, 19 aa, Mycobacterium
GWLTLWPFLNWLTTHFVVT

SEQ ID NO: 973867 - protein, 17 aa, Mycobacterium
GYISGLTGLVFLAIPAP

SEQ ID NO: 973868 - protein, 24 aa, Mycobacterium
GYRCRRFADKIVFGLLVVVVVLAT

SEQ ID NO: 973869 - protein, 17 aa, Mycobacterium
HAFAVSIILDWLAICVV

SEQ ID NO: 973870 - protein, 22 aa, Mycobacterium
HEGGHTLAAWAMPDIEPIYKVT

SEQ ID NO: 973871 - protein, 24 aa, Mycobacterium
HEPKSPHWFLWVVAGASVVLVVGL

SEQ ID NO: 973872 - protein, 23 aa, Mycobacterium
HGLGMPIPLGWQLWLYGVFAISA

SEQ ID NO: 973873 - protein, 19 aa, Mycobacterium
HGSPLRILLLLVLVMALGS

SEQ ID NO: 973874 - protein, 19 aa, Mycobacterium
HLFWFFGHPEVYIIALPFF

SEQ ID NO: 973875 - protein, 18 aa, Mycobacterium
HRVGEPFGSLVLAAAVTV

SEQ ID NO: 973876 - protein, 20 aa, Mycobacterium
HSAVWWKALLALVVAVALVI

SEQ ID NO: 973877 - protein, 18 aa, Mycobacterium
HVLAHDWGSVGVWEYLSR

SEQ ID NO: 973878 - protein, 17 aa, Mycobacterium
HVMSTYLARDWGRDWGS

SEQ ID NO: 973879 - protein, 22 aa, Mycobacterium
IAAEHPEMWGGLVDLAASALGA

SEQ ID NO: 973880 - protein, 23 aa, Mycobacterium
IATACPFCRVMVTDGVNDRQEEA

SEQ ID NO: 973881 - protein, 23 aa, Mycobacterium
IELMGNEGFVWIGLHEPEASHMH

SEQ ID NO: 973882 - protein, 18 aa, Mycobacterium
IFAPLTLAYQGWTYLIFR

SEQ ID NO: 973883 - protein, 20 aa, Mycobacterium
IGALCAYCMVIWAVSVSLLV

SEQ ID NO: 973884 - protein, 17 aa, Mycobacterium
IGFIPFVIAMGIGLGVS

SEQ ID NO: 973885 - protein, 17 aa, Mycobacterium
IGLLFAVMPFHAFFGIA

SEQ ID NO: 973886 - protein, 26 aa, Mycobacterium
IGRSWLMTPLRVMFLIGLVFLALGWS

SEQ ID NO: 973887 - protein, 17 aa, Mycobacterium
IMLAAAVFVFLQRRKIG

SEQ ID NO: 973888 - protein, 19 aa, Mycobacterium
IPATLSYRLHRKPLRQSWP

SEQ ID NO: 973889 - protein, 18 aa, Mycobacterium
IPGVPWWAALLIATTASA

SEQ ID NO: 973890 - protein, 19 aa, Mycobacterium
IPRGKVTGVVRLDGVTFTY

SEQ ID NO: 973891 - protein, 22 aa, Mycobacterium
IRNWPAWLGIYGFLTLDRWLLF

SEQ ID NO: 973892 - protein, 19 aa, Mycobacterium
IRVPREFINNYLFNFPDTS

SEQ ID NO: 973893 - protein, 23 aa, Mycobacterium
ISAPRAKLFAALFLILALVVIGE

SEQ ID NO: 973894 - protein, 20 aa, Mycobacterium
ITALCLFTAVLITLRRKQIP

SEQ ID NO: 973895 - protein, 17 aa, Mycobacterium
ITDRLDGLLARRYGMAT

SEQ ID NO: 973896 - protein, 22 aa, Mycobacterium
IYLWHWPIFLALNGERTGWSGV

SEQ ID NO: 973897 - protein, 18 aa, Mycobacterium
IYRLISWLLIAAIGWVVF

SEQ ID NO: 973898 - protein, 20 aa, Mycobacterium
KDSFPASFIIKLANPVQHKE

SEQ ID NO: 973899 - protein, 23 aa, Mycobacterium
KELVIAIKMSDAWSKDDVLQSYL

SEQ ID NO: 973900 - protein, 19 aa, Mycobacterium
KPIFMWWIVWVFSYVISVV

SEQ ID NO: 973901 - protein, 19 aa, Mycobacterium
KPPFVARMIHRFAVPIILV

SEQ ID NO: 973902 - protein, 25 aa, Mycobacterium
KQTRLGRFVSVFGWRAYALPFLMAL

SEQ ID NO: 973903 - protein, 19 aa, Mycobacterium
KRLIWPAVVLILATGLVSF

SEQ ID NO: 973904 - protein, 23 aa, Mycobacterium
KSTGHWWWLVAAVAVLLVIVMFV

SEQ ID NO: 973905 - protein, 19 aa, Mycobacterium
KVRHNMRMRKVLTSVIATV

SEQ ID NO: 973906 - protein, 20 aa, Mycobacterium
KVSLLLSVALFFVWMIAVAF

SEQ ID NO: 973907 - protein, 18 aa, Mycobacterium
KYWWVRWVVLSLVAIVLV

SEQ ID NO: 973908 - protein, 17 aa, Mycobacterium
LAAAWPLAAVVQRQTGG

SEQ ID NO: 973909 - protein, 21 aa, Mycobacterium
LAGILFQFTMFGRWVKAIGGN

SEQ ID NO: 973910 - protein, 23 aa, Mycobacterium
LAGVAIGRWVIRDNYYIAEYSGK

SEQ ID NO: 973911 - protein, 17 aa, Mycobacterium
LAHRMCVASLPYAQADL

SEQ ID NO: 973912 - protein, 17 aa, Mycobacterium
LAKRLLIGYVISGTLIL

SEQ ID NO: 973913 - protein, 18 aa, Mycobacterium
LALILKFTIGFWLGADKE

SEQ ID NO: 973914 - protein, 18 aa, Mycobacterium
LALTELWRSYGVTPDAVI

SEQ ID NO: 973915 - protein, 17 aa, Mycobacterium
LAPQAKPYRGWHRVHGV

SEQ ID NO: 973916 - protein, 25 aa, Mycobacterium
LASSVLLVWWRWHHGFWLSVIYATV

SEQ ID NO: 973917 - protein, 18 aa, Mycobacterium
LAVAAALFVPLAHLSVMF

SEQ ID NO: 973918 - protein, 17 aa, Mycobacterium
LCLVPIFPLALWLMDVY

SEQ ID NO: 973919 - protein, 20 aa, Mycobacterium
LCSIATQWCPARVLGRSDLP

SEQ ID NO: 973920 - protein, 17 aa, Mycobacterium
LCVVALYAVNVVLTTIG

SEQ ID NO: 973921 - protein, 19 aa, Mycobacterium
LDAGPFLSYGIQWISFGII

SEQ ID NO: 973922 - protein, 18 aa, Mycobacterium
LDGLLARRYGMATEFGAF

SEQ ID NO: 973923 - protein, 18 aa, Mycobacterium
LDNKRLWSNLDCAPSNET

SEQ ID NO: 973924 - protein, 22 aa, Mycobacterium
LDPLLPFPRWHEYAAVVEEPVR

SEQ ID NO: 973925 - protein, 18 aa, Mycobacterium
LDQPRVYFGPVISNTSAD

SEQ ID NO: 973926 - protein, 17 aa, Mycobacterium
LDQRLKRFGAMATAMVL

SEQ ID NO: 973927 - protein, 17 aa, Mycobacterium
LDVILAMTIAGIVNTAM

SEQ ID NO: 973928 - protein, 24 aa, Mycobacterium
LDWPRWWVSACSVLVLLIVEGVGV

SEQ ID NO: 973929 - protein, 24 aa, Mycobacterium
LEPTWSYPGWRHIKYVNGFATSFW

SEQ ID NO: 973930 - protein, 23 aa, Mycobacterium
LEVAQPLAYCLPGVRSRVVVSEG

SEQ ID NO: 973931 - protein, 17 aa, Mycobacterium
LFALLAYGFIVAAFYVF

SEQ ID NO: 973932 - protein, 18 aa, Mycobacterium
LFEAIGIRLRDMLWAAIF

SEQ ID NO: 973933 - protein, 18 aa, Mycobacterium
LFIFCLWIATLGFQQSAF

SEQ ID NO: 973934 - protein, 18 aa, Mycobacterium
LFSPWSLYFGWGLGHTRQ

SEQ ID NO: 973935 - protein, 23 aa, Mycobacterium
LFVRRGWDIIGCMVLFAYGGVLL

SEQ ID NO: 973936 - protein, 20 aa, Mycobacterium
LFVTILAGILFQFTMFGRWV

SEQ ID NO: 973937 - protein, 19 aa, Mycobacterium
LGCQLYPVVVWFRRTAAPR

SEQ ID NO: 973938 - protein, 18 aa, Mycobacterium
LGGWRIIRTLGKGMVEIK

SEQ ID NO: 973939 - protein, 19 aa, Mycobacterium
LGMICMLGTLWLIVRTSSS

SEQ ID NO: 973940 - protein, 18 aa, Mycobacterium
LGVRWWRFLGGILLGLAC

SEQ ID NO: 973941 - protein, 19 aa, Mycobacterium
LGWVCADAILLVCTGNHRY

SEQ ID NO: 973942 - protein, 18 aa, Mycobacterium
LITLCPAIAILALGFDPT

SEQ ID NO: 973943 - protein, 17 aa, Mycobacterium
LKSWRRGLIFAMFVFAA

SEQ ID NO: 973944 - protein, 18 aa, Mycobacterium
LKTSWYLLGPAFVAAIAY

SEQ ID NO: 973945 - protein, 17 aa, Mycobacterium
LLAPIVVPLIYRAAIAT

SEQ ID NO: 973946 - protein, 18 aa, Mycobacterium
LLGLRARAIFFWLLVESV

SEQ ID NO: 973947 - protein, 18 aa, Mycobacterium
LLHGIGMGGEWGLGAALA

SEQ ID NO: 973948 - protein, 17 aa, Mycobacterium
LLIGYVISGTLILCSGA

SEQ ID NO: 973949 - protein, 19 aa, Mycobacterium
LLRGCPWALAISPPVVDPG

SEQ ID NO: 973950 - protein, 21 aa, Mycobacterium
LLRVTRLDVILAMTIAGIVNT

SEQ ID NO: 973951 - protein, 23 aa, Mycobacterium
LLVGIPVLVGWVVLRRRLGQSVL

SEQ ID NO: 973952 - protein, 17 aa, Mycobacterium
LLVSLLTCWQRHPSRSY

SEQ ID NO: 973953 - protein, 18 aa, Mycobacterium
LMFFAGLFAMYFTARAQA

SEQ ID NO: 973954 - protein, 24 aa, Mycobacterium
LNWWWAAVVAFALLAWVLTHPTTT

SEQ ID NO: 973955 - protein, 17 aa, Mycobacterium
LQDRTSFIIAHHLPTIR

SEQ ID NO: 973956 - protein, 25 aa, Mycobacterium
LQMAFRFWAFRRWVFPDAFARNPEK

SEQ ID NO: 973957 - protein, 19 aa, Mycobacterium
LRDLLKFDFYFADSAAFRA

SEQ ID NO: 973958 - protein, 17 aa, Mycobacterium
LRFPGRDTLFWAYIMTL

SEQ ID NO: 973959 - protein, 18 aa, Mycobacterium
LRGDHRAVLLARGNTPGW

SEQ ID NO: 973960 - protein, 19 aa, Mycobacterium
LRIYLKWITGTGYTYGALT

SEQ ID NO: 973961 - protein, 17 aa, Mycobacterium
LRRSCLRLHTYGFTGTD

SEQ ID NO: 973962 - protein, 24 aa, Mycobacterium
LRSRIGMVLQDAWLFDGTIAENIA

SEQ ID NO: 973963 - protein, 17 aa, Mycobacterium
LRYALRHQQRWRNGLTV

SEQ ID NO: 973964 - protein, 18 aa, Mycobacterium
LSIMPLLPVLLMVWATAH

SEQ ID NO: 973965 - protein, 23 aa, Mycobacterium
LTARLKAAWAPQGLIHFRQGQWY

SEQ ID NO: 973966 - protein, 20 aa, Mycobacterium
LTELPRRWRAVLLAVVAACV

SEQ ID NO: 973967 - protein, 18 aa, Mycobacterium
LTLTELWRSYGVQPDLVI

SEQ ID NO: 973968 - protein, 17 aa, Mycobacterium
LTTMCFDLTVTAGVYSL

SEQ ID NO: 973969 - protein, 19 aa, Mycobacterium
LVAEIGVACAVAIAVDVTA

SEQ ID NO: 973970 - protein, 30 aa, Mycobacterium
LVAVVPWLVLRFWFFRHKWTVTTLAATPAG

SEQ ID NO: 973971 - protein, 18 aa, Mycobacterium
LVPCRRRYWLVAGAGVFA

SEQ ID NO: 973972 - protein, 18 aa, Mycobacterium
LVSVFAYRARLVLGQLAV

SEQ ID NO: 973973 - protein, 20 aa, Mycobacterium
LYQKIWWPSIAWLVLTVATV

SEQ ID NO: 973974 - protein, 18 aa, Mycobacterium
MALSRLRLIGVGIPAAIG

SEQ ID NO: 973975 - protein, 19 aa, Mycobacterium
MFAQWNWWLPRWLSRALPA

SEQ ID NO: 973976 - protein, 20 aa, Mycobacterium
MGRTPLPPRRDWELDTLDAG

SEQ ID NO: 973977 - protein, 21 aa, Mycobacterium
MIAARTCWLRALIVVAGGSLP

SEQ ID NO: 973978 - protein, 23 aa, Mycobacterium
MIHRFAVPIILVWLAIAVTVSVF

SEQ ID NO: 973979 - protein, 17 aa, Mycobacterium
MLGTLWLIVRTSSSVRA

SEQ ID NO: 973980 - protein, 21 aa, Mycobacterium
MLPVWRKFRFGEADGGVLKGS

SEQ ID NO: 973981 - protein, 21 aa, Mycobacterium
MPVKLFPRWIHPFVLNQPVSQ

SEQ ID NO: 973982 - protein, 19 aa, Mycobacterium
MSPVRRIGLLMLRGYLVLA

SEQ ID NO: 973983 - protein, 23 aa, Mycobacterium
MSRFWRKMFLTIGILIAAFGMRL

SEQ ID NO: 973984 - protein, 17 aa, Mycobacterium
MVALLFRTLDAFRIFDN

SEQ ID NO: 973985 - protein, 25 aa, Mycobacterium
MVTAIAVVVLLGWSFFYFSDDTRGY

SEQ ID NO: 973986 - protein, 25 aa, Mycobacterium
NGLRPEPIIALGILLTWCSVERAVA

SEQ ID NO: 973987 - protein, 29 aa, Mycobacterium
NGLRPEPLIALGVLFTWVLVERAIALRRL

SEQ ID NO: 973988 - protein, 24 aa, Mycobacterium
NGMKAMLWTSGWTPRYHGETIYLA

SEQ ID NO: 973989 - protein, 21 aa, Mycobacterium
NIKYLPDWVPRYACYEDARLI

SEQ ID NO: 973990 - protein, 20 aa, Mycobacterium
NSFPKLRWSLTTALLELTVI

SEQ ID NO: 973991 - protein, 17 aa, Mycobacterium
NWSWLKWLPHIQHPTET

SEQ ID NO: 973992 - protein, 18 aa, Mycobacterium
PAALPWYYSWPLAVAAPL

SEQ ID NO: 973993 - protein, 20 aa, Mycobacterium
PADWEPLGAIAIGYAHEPTD

SEQ ID NO: 973994 - protein, 19 aa, Mycobacterium
PALMAYPWWFTRSYWLLGI

SEQ ID NO: 973995 - protein, 18 aa, Mycobacterium
PAPTDGFIGVAPDVRLLS

SEQ ID NO: 973996 - protein, 18 aa, Mycobacterium
PATARSGPTFTYPEALAE

SEQ ID NO: 973997 - protein, 20 aa, Mycobacterium
PAVPIPWSILSLFAVGPTLS

SEQ ID NO: 973998 - protein, 23 aa, Mycobacterium
PCGDLRMVLKLAAKLKNLAPDAI

SEQ ID NO: 973999 - protein, 23 aa, Mycobacterium
PETDFRLLPKYMDMLNMFDAWEF

SEQ ID NO: 974000 - protein, 19 aa, Mycobacterium
PFEHARPTAIMTWMRQHGG

SEQ ID NO: 974001 - protein, 19 aa, Mycobacterium
PFEHARPTVIMTWMRQHCG

SEQ ID NO: 974002 - protein, 23 aa, Mycobacterium
PFGEYLPMPWLFKRLSKYADRVS

SEQ ID NO: 974003 - protein, 18 aa, Mycobacterium
PFGSLVLAAAVTVIEVAL

SEQ ID NO: 974004 - protein, 22 aa, Mycobacterium
PGQPIWWLARGLEFFQDGEQFW

SEQ ID NO: 974005 - protein, 17 aa, Mycobacterium
PGVVSTMSARARYTDPD

SEQ ID NO: 974006 - protein, 17 aa, Mycobacterium
PGWPAFRPVWRSCLKGG

SEQ ID NO: 974007 - protein, 18 aa, Mycobacterium
PLKFAQLLGFVFVVCGVT

SEQ ID NO: 974008 - protein, 17 aa, Mycobacterium
PLLRNWRMSHACLNWLA

SEQ ID NO: 974009 - protein, 20 aa, Mycobacterium
PLLRRSGVIFIRRNIGDNPL

SEQ ID NO: 974010 - protein, 17 aa, Mycobacterium
PLPRWVRDDVLTTGDLI

SEQ ID NO: 974011 - protein, 17 aa, Mycobacterium
PMLIRRLITLCPAIAIL

SEQ ID NO: 974012 - protein, 19 aa, Mycobacterium
PNGTHSWPYWNQQLVAMKP

SEQ ID NO: 974013 - protein, 34 aa, Mycobacterium
PNRLWWRYTGWWLLALCLATLWWVVALVLLHGVS

SEQ ID NO: 974014 - protein, 19 aa, Mycobacterium
PNRPVQWRHVPAILLMLAL

SEQ ID NO: 974015 - protein, 18 aa, Mycobacterium
PNVLRPDLTIAYTDTDGH

SEQ ID NO: 974016 - protein, 19 aa, Mycobacterium
PPVRRLPARFGMEQVRERA

SEQ ID NO: 974017 - protein, 17 aa, Mycobacterium
PQQRLLLEVAWEALEHA

SEQ ID NO: 974018 - protein, 20 aa, Mycobacterium
PRATSFVRVRIDKVTPDVVT

SEQ ID NO: 974019 - protein, 18 aa, Mycobacterium
PRDLAPLLAAWVISVSVM

SEQ ID NO: 974020 - protein, 20 aa, Mycobacterium
PSLNRGWCLIRTRWGQLIAR

SEQ ID NO: 974021 - protein, 19 aa, Mycobacterium
PTCRAHLPALALLGACVAL

SEQ ID NO: 974022 - protein, 19 aa, Mycobacterium
PVAPEAYALYGISRVLPQV

SEQ ID NO: 974023 - protein, 17 aa, Mycobacterium
PVAVVGIGCRFPGNVTG

SEQ ID NO: 974024 - protein, 23 aa, Mycobacterium
PVFLDWLVGLAFPCQRPFDHQYG

SEQ ID NO: 974025 - protein, 18 aa, Mycobacterium
PVSHMWVVKFLRTHGLVH

SEQ ID NO: 974026 - protein, 20 aa, Mycobacterium
PWILIVCLFVTILAGILFQF

SEQ ID NO: 974027 - protein, 19 aa, Mycobacterium
PWWFTRSYWLLGIVALVVV

SEQ ID NO: 974028 - protein, 21 aa, Mycobacterium
QPAWRNLRFPLTWAPPEANVA

SEQ ID NO: 974029 - protein, 23 aa, Mycobacterium
QRWSSPFWRFWDLALLWLAQVHG

SEQ ID NO: 974030 - protein, 23 aa, Mycobacterium
QTLGVPCAVGMLIAVAVALTLGP

SEQ ID NO: 974031 - protein, 21 aa, Mycobacterium
QWPLFAGFCLYTYHNFVRYEE

SEQ ID NO: 974032 - protein, 24 aa, Mycobacterium
RAIHKPSRIRIALTRSFMTLTSFV

SEQ ID NO: 974033 - protein, 18 aa, Mycobacterium
RATGPGWRVPGSRLNRTW

SEQ ID NO: 974034 - protein, 18 aa, Mycobacterium
RCCWWRFAFLHSKLIQSR

SEQ ID NO: 974035 - protein, 22 aa, Mycobacterium
RDRLKIPFGHEFKTGNIMYLDI

SEQ ID NO: 974036 - protein, 20 aa, Mycobacterium
RDRNRLVTFIAIFLAGGVIF

SEQ ID NO: 974037 - protein, 23 aa, Mycobacterium
REWCLRCRGALIAPQAEMPTAVK

SEQ ID NO: 974038 - protein, 17 aa, Mycobacterium
RFAGIAISEFIWARQHA

SEQ ID NO: 974039 - protein, 17 aa, Mycobacterium
RFTAWDVFLGYELPQPP

SEQ ID NO: 974040 - protein, 20 aa, Mycobacterium
RFVAAHGAYLVWLEQTSINN

SEQ ID NO: 974041 - protein, 17 aa, Mycobacterium
RGGLFVRQIHHWAALMF

SEQ ID NO: 974042 - protein, 23 aa, Mycobacterium
RHCFNIPICWSFRSIFDALDGVD

SEQ ID NO: 974043 - protein, 20 aa, Mycobacterium
RHFGCGFAPSGWDSLTKYLI

SEQ ID NO: 974044 - protein, 18 aa, Mycobacterium
RHPHWKRLIWPAVVLILA

SEQ ID NO: 974045 - protein, 20 aa, Mycobacterium
RITLPMLRPTMFFVLVTGIV

SEQ ID NO: 974046 - protein, 18 aa, Mycobacterium
RITPRWMRYGRADLVVGI

SEQ ID NO: 974047 - protein, 18 aa, Mycobacterium
RIWVVLCAGAIFVASHEV

SEQ ID NO: 974048 - protein, 18 aa, Mycobacterium
RKPLKWSGCAGQHVRSGK

SEQ ID NO: 974049 - protein, 18 aa, Mycobacterium
RKRIAWLLLLGNMVLAAV

SEQ ID NO: 974050 - protein, 19 aa, Mycobacterium
RLAQLGGLVFVSAFTVVTL

SEQ ID NO: 974051 - protein, 19 aa, Mycobacterium
RLASRLGMPPWRVQKAQQQ

SEQ ID NO: 974052 - protein, 20 aa, Mycobacterium
RLLLEVAWEALEHAGISSNS

SEQ ID NO: 974053 - protein, 19 aa, Mycobacterium
RLRLGWPIVPNTVFIAFGE

SEQ ID NO: 974054 - protein, 18 aa, Mycobacterium
RLRLIGVGIPAAIGLLAG

SEQ ID NO: 974055 - protein, 23 aa, Mycobacterium
RLWRGLLLFFSRWWQLETLYRSN

SEQ ID NO: 974056 - protein, 24 aa, Mycobacterium
RLYAERWCAWALLAAAVVIPTGLT

SEQ ID NO: 974057 - protein, 22 aa, Mycobacterium
RNRPRLWLCYALTLMLSILLNL

SEQ ID NO: 974058 - protein, 23 aa, Mycobacterium
RRFRWLVFTGWLLALVPAIYLAM

SEQ ID NO: 974059 - protein, 21 aa, Mycobacterium
RRIGLLMLRGYLVLACVLVVV

SEQ ID NO: 974060 - protein, 23 aa, Mycobacterium
RRRNARPAIFVVVFLVIVAGVSW

SEQ ID NO: 974061 - protein, 25 aa, Mycobacterium
RRTAMALTRWRVRMEVEPGRRQTLA

SEQ ID NO: 974062 - protein, 23 aa, Mycobacterium
RRTRPDLQWGFRVPLLPIALICA

SEQ ID NO: 974063 - protein, 19 aa, Mycobacterium
RSAVPRGWVRARKTIVSGN

SEQ ID NO: 974064 - protein, 17 aa, Mycobacterium
RSMNFWTVFGTAWSVLC

SEQ ID NO: 974065 - protein, 19 aa, Mycobacterium
RSRHRGVIALTVLAVAAST

SEQ ID NO: 974066 - protein, 21 aa, Mycobacterium
RTADYWLGWYVIIGTIPICIL

SEQ ID NO: 974067 - protein, 18 aa, Mycobacterium
RTPTLWRPAGGLSNEAVR

SEQ ID NO: 974068 - protein, 20 aa, Mycobacterium
RVAAMAGMLADWVEGPGAEV

SEQ ID NO: 974069 - protein, 26 aa, Mycobacterium
RVELLKLAVILALWAAVAGAFVSVFY

SEQ ID NO: 974070 - protein, 18 aa, Mycobacterium
RVGARIILLNSEFSGPQI

SEQ ID NO: 974071 - protein, 18 aa, Mycobacterium
RWGLIFGFGCLFWGVVTA

SEQ ID NO: 974072 - protein, 18 aa, Mycobacterium
RWWSIGCLDGLVITILAW

SEQ ID NO: 974073 - protein, 19 aa, Mycobacterium
RYEAVLVRRSYRDGKKVRH

SEQ ID NO: 974074 - protein, 21 aa, Mycobacterium
SACSRPLPHLGDVRHPVAPDS

SEQ ID NO: 974075 - protein, 21 aa, Mycobacterium
SALRVNWAFGIQLFDYTGETS

SEQ ID NO: 974076 - protein, 20 aa, Mycobacterium
SCELDWWLGFSSVASLLGSP

SEQ ID NO: 974077 - protein, 19 aa, Mycobacterium
SDLPTGRGLVGLVIVECVL

SEQ ID NO: 974078 - protein, 20 aa, Mycobacterium
SDTAVQCLFGIYGAAAASAV

SEQ ID NO: 974079 - protein, 29 aa, Mycobacterium
SDWAKRNPRRWSVIDAWFTLGMMFEMRSY

SEQ ID NO: 974080 - protein, 28 aa, Mycobacterium
SEFGGDDVIAWRGQHRFVERLCKATLDA

SEQ ID NO: 974081 - protein, 26 aa, Mycobacterium
SGIATRLRFMWSLRVLHTLAMIDLAI

SEQ ID NO: 974082 - protein, 17 aa, Mycobacterium
SGLAVARPLPTVIADAL

SEQ ID NO: 974083 - protein, 18 aa, Mycobacterium
SGLRLSATIDTRFSSTPT

SEQ ID NO: 974084 - protein, 21 aa, Mycobacterium
SIAALLGRWFWWPQQGRTRPL

SEQ ID NO: 974085 - protein, 22 aa, Mycobacterium
SIAALLGRWFWWPQQGRTRPLL

SEQ ID NO: 974086 - protein, 22 aa, Mycobacterium
SMLGDLPWWVTVLIMTRELGVT

SEQ ID NO: 974087 - protein, 20 aa, Mycobacterium
SQLFRLTYMVLFSIPVLVPM

SEQ ID NO: 974088 - protein, 20 aa, Mycobacterium
SQPVLLDWEVGLAFPCQQPM

SEQ ID NO: 974089 - protein, 17 aa, Mycobacterium
SQVGRLWGLTSALTADG

SEQ ID NO: 974090 - protein, 19 aa, Mycobacterium
SRSAIALIWLQGEAGTTRA

SEQ ID NO: 974091 - protein, 17 aa, Mycobacterium
SRWLRWLTQIYIDVFRG

SEQ ID NO: 974092 - protein, 17 aa, Mycobacterium
STISFGTVYGFVEINGQ

SEQ ID NO: 974093 - protein, 20 aa, Mycobacterium
STLPVVIRWARMPENVAHAE

SEQ ID NO: 974094 - protein, 18 aa, Mycobacterium
STPPLWVIVCCAIAIAAG

SEQ ID NO: 974095 - protein, 23 aa, Mycobacterium
STRARVIMRWGRIAVLIVTGLIT

SEQ ID NO: 974096 - protein, 19 aa, Mycobacterium
SVACKAWLLAQPYLVASVL

SEQ ID NO: 974097 - protein, 21 aa, Mycobacterium
SVSIPSWWQPYVLSVASLTPS

SEQ ID NO: 974098 - protein, 28 aa, Mycobacterium
SWTLRCLVFLLRFGFAFLFYSGIVNPII

SEQ ID NO: 974099 - protein, 17 aa, Mycobacterium
TATHLVSVFAYRARLVL

SEQ ID NO: 974100 - protein, 22 aa, Mycobacterium
TDPTTAISMAWRAAGGVSGPLG

SEQ ID NO: 974101 - protein, 25 aa, Mycobacterium
TEGLARIWPAWEFYFWHHTIPAPVW

SEQ ID NO: 974102 - protein, 18 aa, Mycobacterium
TESHWRLGLYAAGRASQM

SEQ ID NO: 974103 - protein, 24 aa, Mycobacterium
TGARLRWVPLQGPSATPVQGREHA

SEQ ID NO: 974104 - protein, 19 aa, Mycobacterium
TGGLLAWSRCRPISAGVLI

SEQ ID NO: 974105 - protein, 18 aa, Mycobacterium
TGNPWVVEAVRVFNIRYI

SEQ ID NO: 974106 - protein, 20 aa, Mycobacterium
THLFTMWGFFILLTVYIEAY

SEQ ID NO: 974107 - protein, 24 aa, Mycobacterium
TMRTIKFNMVWAFGYNIAAIPIAA

SEQ ID NO: 974108 - protein, 24 aa, Mycobacterium
TMRTIRINMIWAFGYNVAAIPIAS

SEQ ID NO: 974109 - protein, 17 aa, Mycobacterium
TPAMWWLAVPVLVYATW

SEQ ID NO: 974110 - protein, 19 aa, Mycobacterium
TPFALGIAGLLGRIPLPGS

SEQ ID NO: 974111 - protein, 24 aa, Mycobacterium
TPSCWWCTRLSRWAWLKESGSASI

SEQ ID NO: 974112 - protein, 18 aa, Mycobacterium
TPSEAFTAWEYVDAYDVA

SEQ ID NO: 974113 - protein, 18 aa, Mycobacterium
TQRPELRDSSILSVSAHR

SEQ ID NO: 974114 - protein, 24 aa, Mycobacterium
TQSLFWTRWVGWVMHRPWISASAA

SEQ ID NO: 974115 - protein, 17 aa, Mycobacterium
TRLPWRPLQMVPAKRSE

SEQ ID NO: 974116 - protein, 17 aa, Mycobacterium
TRLSRAIVHAADLGARV

SEQ ID NO: 974117 - protein, 21 aa, Mycobacterium
TRLTEVLSRIYGHPVTVQMQI

SEQ ID NO: 974118 - protein, 19 aa, Mycobacterium
TRSAYRWQPHHILRRQRRP

SEQ ID NO: 974119 - protein, 23 aa, Mycobacterium
TRVIEIPYGLPFLANSQFSNVTL

SEQ ID NO: 974120 - protein, 17 aa, Mycobacterium
TTLKRFAMMLAIITTVG

SEQ ID NO: 974121 - protein, 21 aa, Mycobacterium
TVLAVIWCWLLKRYVTEGSQE

SEQ ID NO: 974122 - protein, 19 aa, Mycobacterium
VAALLRRASWWPARPWGNN

SEQ ID NO: 974123 - protein, 17 aa, Mycobacterium
VACAVAIAVDVTAVRLV

SEQ ID NO: 974124 - protein, 23 aa, Mycobacterium
VAGLRWLRQYGRAIQVFGGMLLI

SEQ ID NO: 974125 - protein, 17 aa, Mycobacterium
VALRNARYRAASMETLI

SEQ ID NO: 974126 - protein, 17 aa, Mycobacterium
VAPRLAILLDDYAVPAD

SEQ ID NO: 974127 - protein, 26 aa, Mycobacterium
VASSALRQSFLWGFGGVIAAEHPEMW

SEQ ID NO: 974128 - protein, 18 aa, Mycobacterium
VCGVAFKATMIGSFPILS

SEQ ID NO: 974129 - protein, 17 aa, Mycobacterium
VEVLRRLYGRVGDRLVL

SEQ ID NO: 974130 - protein, 17 aa, Mycobacterium
VEVWKTTPFMSLLLLVG

SEQ ID NO: 974131 - protein, 21 aa, Mycobacterium
VFDLIPFWRMFFNTVLYAGYV

SEQ ID NO: 974132 - protein, 18 aa, Mycobacterium
VFRGRLHPIGGLGVALGV

SEQ ID NO: 974133 - protein, 23 aa, Mycobacterium
VGFAAIVYLVWWYVVPPVCRLMR

SEQ ID NO: 974134 - protein, 17 aa, Mycobacterium
VGTGWPLIVEQLIAKPD

SEQ ID NO: 974135 - protein, 19 aa, Mycobacterium
VIQTEFNVVLPWSKQVSLS

SEQ ID NO: 974136 - protein, 21 aa, Mycobacterium
VKAHILIAMLACYLVWHLRKA

SEQ ID NO: 974137 - protein, 20 aa, Mycobacterium
VKALLARTTRWGSFLEDIDA

SEQ ID NO: 974138 - protein, 27 aa, Mycobacterium
VLGTKLRSARHFHWGWVVALLMMVLAL

SEQ ID NO: 974139 - protein, 17 aa, Mycobacterium
VLPRLGPAIVGFKPALW

SEQ ID NO: 974140 - protein, 24 aa, Mycobacterium
VLPSMPRWLWIVVVLGGFTAALAG

SEQ ID NO: 974141 - protein, 20 aa, Mycobacterium
VLRHRIEWLSDPSLALPVVS

SEQ ID NO: 974142 - protein, 21 aa, Mycobacterium
VLVLYRWFPPITVWTGLSLLA

SEQ ID NO: 974143 - protein, 19 aa, Mycobacterium
VLWRCFRVAMISALMVAVA

SEQ ID NO: 974144 - protein, 23 aa, Mycobacterium
VNLKLLMPVFRWQRRDNRLAEAD

SEQ ID NO: 974145 - protein, 17 aa, Mycobacterium
VPCGMQLFWEAITVQMR

SEQ ID NO: 974146 - protein, 19 aa, Mycobacterium
VPFPGFKNGVGLMLHLPKP

SEQ ID NO: 974147 - protein, 25 aa, Mycobacterium
VPTLAMALTCWWLISREVIPRLGHA

SEQ ID NO: 974148 - protein, 18 aa, Mycobacterium
VRCSWKRIYALIRLIALF

SEQ ID NO: 974149 - protein, 20 aa, Mycobacterium
VRWLLVRSLVAWFWEEPLRA

SEQ ID NO: 974150 - protein, 18 aa, Mycobacterium
VSIILDWLAICVVLTVFV

SEQ ID NO: 974151 - protein, 17 aa, Mycobacterium
VSLLTCWQRHPSRSYRF

SEQ ID NO: 974152 - protein, 24 aa, Mycobacterium
VSPSTMLWPTFALNFTSNVLYDLS

SEQ ID NO: 974153 - protein, 17 aa, Mycobacterium
VTGESRWSYARDSDLCG

SEQ ID NO: 974154 - protein, 18 aa, Mycobacterium
VVALSFASVNGWWYVSNF

SEQ ID NO: 974155 - protein, 17 aa, Mycobacterium
VVKELFELFNIDRQTLN

SEQ ID NO: 974156 - protein, 17 aa, Mycobacterium
VVSLGFLISLWAGSSAI

SEQ ID NO: 974157 - protein, 18 aa, Mycobacterium
VYFLPRWPWLRVADKDTS

SEQ ID NO: 974158 - protein, 17 aa, Mycobacterium
VYRYRFIVIGITVALCL

SEQ ID NO: 974159 - protein, 17 aa, Mycobacterium
VYVLPLLLLVGLFVMFS

SEQ ID NO: 974160 - protein, 17 aa, Mycobacterium
WAAGCLLVLAATAWAML

SEQ ID NO: 974161 - protein, 19 aa, Mycobacterium
WCWLLKRYVTEGSQEHDAE

SEQ ID NO: 974162 - protein, 25 aa, Mycobacterium
WGNCTIKVMVGFLFLYPAFVAKEHQ

SEQ ID NO: 974163 - protein, 18 aa, Mycobacterium
WHWDRWAPASPWAAPPPL

SEQ ID NO: 974164 - protein, 20 aa, Mycobacterium
WKITEAPLFYGSYTALLGIS

SEQ ID NO: 974165 - protein, 17 aa, Mycobacterium
WKLKPGVVSTMSARARY

SEQ ID NO: 974166 - protein, 23 aa, Mycobacterium
WLFSDWRYVFWINIPLTAIAMLM

SEQ ID NO: 974167 - protein, 23 aa, Mycobacterium
WLMWLVLHLMYLIGFKTKITTLL

SEQ ID NO: 974168 - protein, 20 aa, Mycobacterium
WLREEYYRRIYLALNQTSHI

SEQ ID NO: 974169 - protein, 19 aa, Mycobacterium
WPLPEAGMHSGLAPAQQDT

SEQ ID NO: 974170 - protein, 19 aa, Mycobacterium
WRFLLRRVEHAIVRRDTRM

SEQ ID NO: 974171 - protein, 20 aa, Mycobacterium
WRHVPAILLMLALLLFTIAM

SEQ ID NO: 974172 - protein, 17 aa, Mycobacterium
WRRGLIFAMFVFAAVFT

SEQ ID NO: 974173 - protein, 21 aa, Mycobacterium
WRSGALGSLLSLIGVLFGAMA

SEQ ID NO: 974174 - protein, 43 aa, Mycobacterium
WRVPGSRLNRTWLLHLNRQVNWRWVRYSLYLAVVVLLLLPIVT

SEQ ID NO: 974175 - protein, 18 aa, Mycobacterium
WSLLVGYGCLPWVAEAML

SEQ ID NO: 974176 - protein, 17 aa, Mycobacterium
WSLPLGVAIMLSAVGGG

SEQ ID NO: 974177 - protein, 18 aa, Mycobacterium
WSMLKVSLLLSVALFFVW

SEQ ID NO: 974178 - protein, 17 aa, Mycobacterium
WVIRQGRRSRIDAMNRS

SEQ ID NO: 974179 - protein, 18 aa, Mycobacterium
WWLAVPVLVYATWRTVIQ

SEQ ID NO: 974180 - protein, 21 aa, Mycobacterium
WWVTRTGARFGVEDTKDVRDA

SEQ ID NO: 974181 - protein, 32 aa, Mycobacterium
YKYFLRFFQRLGFRPAIAVVLAIIALQLYDFL

SEQ ID NO: 974182 - protein, 18 aa, Mycobacterium
YMAISALTTMCFDLTVTA

SEQ ID NO: 974183 - protein, 25 aa, Mycobacterium
YMDMLNMFDAWEFGRGGGQKIAVID

SEQ ID NO: 974184 - protein, 17 aa, Mycobacterium
YNMPLELVLTVTPFLII

SEQ ID NO: 974185 - protein, 20 aa, Mycobacterium
YPFLRGALRFGKTGTDALVS

SEQ ID NO: 974186 - protein, 18 aa, Mycobacterium
YPLIERFPLMLGTAGSVL

SEQ ID NO: 974187 - protein, 19 aa, Mycobacterium
YRLRVKMALAEGQYKISKL

SEQ ID NO: 974188 - protein, 24 aa, Mycobacterium
YVVPPVCRLMRARRDAVRQQLTEA

SEQ ID NO: 974189 - protein, 18 aa, Mycobacterium
YWPHWDTGAVVLKLYEHL

SEQ ID NO: 974190 - protein, 19 aa, Mycobacterium
AAALIALWRLLARARQEND

SEQ ID NO: 974191 - protein, 17 aa, Mycobacterium
AACAVAYLRGFGRRPAW

SEQ ID NO: 974192 - protein, 19 aa, Mycobacterium
AAFELAAFAAFGSAASATE

SEQ ID NO: 974193 - protein, 18 aa, Mycobacterium
AAFRRILPFVGRIAGVIV

SEQ ID NO: 974194 - protein, 18 aa, Mycobacterium
AALLIKWTYGPASDAQTP

SEQ ID NO: 974195 - protein, 24 aa, Mycobacterium
AALLRPGRGPSVWYQPDRTSAQPV

SEQ ID NO: 974196 - protein, 19 aa, Mycobacterium
AALPRWRVAHSDTRCAGQP

SEQ ID NO: 974197 - protein, 17 aa, Mycobacterium
AALRIASYALWPFGRTI

SEQ ID NO: 974198 - protein, 25 aa, Mycobacterium
AAPLLGVLCSIYWQRPVPTVHVHAE

SEQ ID NO: 974199 - protein, 17 aa, Mycobacterium
AAPRLRSYGGFAYRARW

SEQ ID NO: 974200 - protein, 18 aa, Mycobacterium
AATIARRLGLTGALGTVA

SEQ ID NO: 974201 - protein, 17 aa, Mycobacterium
AAVIVIGGWALSTESSP

SEQ ID NO: 974202 - protein, 17 aa, Mycobacterium
AAWWVVVLALTAATMMA

SEQ ID NO: 974203 - protein, 20 aa, Mycobacterium
ACASGCLLLALGAGVLWWIT

SEQ ID NO: 974204 - protein, 18 aa, Mycobacterium
ACPFKWLTGWDCPACGGL

SEQ ID NO: 974205 - protein, 18 aa, Mycobacterium
ACSIGATLSNGGWATLVN

SEQ ID NO: 974206 - protein, 23 aa, Mycobacterium
ACSSSLVAIHWAMASLRSGECDM

SEQ ID NO: 974207 - protein, 19 aa, Mycobacterium
ADAPPGWLPGWLRPVHSRR

SEQ ID NO: 974208 - protein, 20 aa, Mycobacterium
ADPWCAWALLAATVAIPTGL

SEQ ID NO: 974209 - protein, 17 aa, Mycobacterium
ADRLIVIYADFKGEAGA

SEQ ID NO: 974210 - protein, 22 aa, Mycobacterium
ADRLPGVRLDWFTADNTATARQ

SEQ ID NO: 974211 - protein, 18 aa, Mycobacterium
ADRLRCWLITIVIWVWTV

SEQ ID NO: 974212 - protein, 18 aa, Mycobacterium
ADVLYEFRLVSLGTQLVL

SEQ ID NO: 974213 - protein, 17 aa, Mycobacterium
AELCAQYLAPVLDAIKF

SEQ ID NO: 974214 - protein, 18 aa, Mycobacterium
AERGLRVLAVAKRPWEHD

SEQ ID NO: 974215 - protein, 21 aa, Mycobacterium
AESRLNRLLALQIPPARKVVT

SEQ ID NO: 974216 - protein, 20 aa, Mycobacterium
AFDQLWRWNSIVALVLSVLV

SEQ ID NO: 974217 - protein, 24 aa, Mycobacterium
AFKQGVGLILRLAKPTALSEVTID

SEQ ID NO: 974218 - protein, 22 aa, Mycobacterium
AFLIFAGWAWREGREDPAGADG

SEQ ID NO: 974219 - protein, 17 aa, Mycobacterium
AGARIILLNSEFSGPQI

SEQ ID NO: 974220 - protein, 21 aa, Mycobacterium
AGARPRLIWYAPHLVEGETSS

SEQ ID NO: 974221 - protein, 19 aa, Mycobacterium
AGATAAWAIGRWTPGTERR

SEQ ID NO: 974222 - protein, 19 aa, Mycobacterium
AGATTAWAIGRWTPGTERR

SEQ ID NO: 974223 - protein, 18 aa, Mycobacterium
AGAWGLSEVFGWRHTLNQ

SEQ ID NO: 974224 - protein, 21 aa, Mycobacterium
AGGLPPLFAGVVRRPRRRQIE

SEQ ID NO: 974225 - protein, 17 aa, Mycobacterium
AGLALGMFVMFSTFGTL

SEQ ID NO: 974226 - protein, 17 aa, Mycobacterium
AGLKLPSWGSLRLALPV

SEQ ID NO: 974227 - protein, 17 aa, Mycobacterium
AGMAVVFGVPVIVAPSF

SEQ ID NO: 974228 - protein, 18 aa, Mycobacterium
AGNPIAIAGIPVGTVTSM

SEQ ID NO: 974229 - protein, 23 aa, Mycobacterium
AGPLRPGHWLMFAVISAATLGAM

SEQ ID NO: 974230 - protein, 24 aa, Mycobacterium
AGPRLIDAYVDWLWFGELGYLSVF

SEQ ID NO: 974231 - protein, 17 aa, Mycobacterium
AGSPILFYPAGALAVTV

SEQ ID NO: 974232 - protein, 23 aa, Mycobacterium
AGVPLCCIHDGLGLSWSYRALGN

SEQ ID NO: 974233 - protein, 18 aa, Mycobacterium
AGVPVVFLTAFYGLSVLA

SEQ ID NO: 974234 - protein, 17 aa, Mycobacterium
AGWRLNRLVPHGAVDRL

SEQ ID NO: 974235 - protein, 17 aa, Mycobacterium
AHLYRLFPKLGVTNRAG

SEQ ID NO: 974236 - protein, 24 aa, Mycobacterium
AHQKLCEVYKLAAREVQIQTHGNN

SEQ ID NO: 974237 - protein, 23 aa, Mycobacterium
AIGARVGFELGFAVLDHSQHGVA

SEQ ID NO: 974238 - protein, 19 aa, Mycobacterium
AIRALRESHDWSLADLAAA

SEQ ID NO: 974239 - protein, 28 aa, Mycobacterium
AIRLGTFLLVCFLGVIGLFAVFGQLRFG

SEQ ID NO: 974240 - protein, 18 aa, Mycobacterium
AISLVVSVSLLFTRTDTS

SEQ ID NO: 974241 - protein, 19 aa, Mycobacterium
AIYILKLIFGYALGVVIVA

SEQ ID NO: 974242 - protein, 17 aa, Mycobacterium
AKVDWPNFWSLITSTSS

SEQ ID NO: 974243 - protein, 23 aa, Mycobacterium
ALAAPLGWFGFRVHLAGQAQARQ

SEQ ID NO: 974244 - protein, 18 aa, Mycobacterium
ALAGGWRRATAVLTVLSA

SEQ ID NO: 974245 - protein, 23 aa, Mycobacterium
ALCGLCAVAYLVSRHAAGAPAGV

SEQ ID NO: 974246 - protein, 19 aa, Mycobacterium
ALCGVVCFVGFLASYLFNV

SEQ ID NO: 974247 - protein, 17 aa, Mycobacterium
ALELTWEALEHARIPPS

SEQ ID NO: 974248 - protein, 18 aa, Mycobacterium
ALIIATAWLLRRIGKNNR

SEQ ID NO: 974249 - protein, 19 aa, Mycobacterium
ALLCPLLVYGWLGLPRMEL

SEQ ID NO: 974250 - protein, 20 aa, Mycobacterium
ALLGKWFWWPQVVRQRPAPQ

SEQ ID NO: 974251 - protein, 18 aa, Mycobacterium
ALQRWGLQPDFVMGHSVG

SEQ ID NO: 974252 - protein, 22 aa, Mycobacterium
ALTGVVCFVGFFASYMFNVYFQ

SEQ ID NO: 974253 - protein, 21 aa, Mycobacterium
ALVAACFWALYILAGKRITGQ

SEQ ID NO: 974254 - protein, 17 aa, Mycobacterium
AMKEIQSAIGAARDAQK

SEQ ID NO: 974255 - protein, 20 aa, Mycobacterium
APAAPWFIGAAMGLQVLGTF

SEQ ID NO: 974256 - protein, 17 aa, Mycobacterium
APEEIFLMLSVAGLAAY

SEQ ID NO: 974257 - protein, 20 aa, Mycobacterium
APEGMAIWIIGMVAATGLAL

SEQ ID NO: 974258 - protein, 17 aa, Mycobacterium
APLAIAVMWRWILAPTD

SEQ ID NO: 974259 - protein, 19 aa, Mycobacterium
APVPTPWAGVPGWGVGHTG

SEQ ID NO: 974260 - protein, 18 aa, Mycobacterium
AQAFSIQLICRILGMLAS

SEQ ID NO: 974261 - protein, 22 aa, Mycobacterium
AQEWLKSIVPFGGFPWGSVAFG

SEQ ID NO: 974262 - protein, 18 aa, Mycobacterium
AQIKLHFHLTDPDGVALD

SEQ ID NO: 974263 - protein, 21 aa, Mycobacterium
AQIPMYLGYAFRAMNTHGRAL

SEQ ID NO: 974264 - protein, 20 aa, Mycobacterium
ARAASPFVFVYNYLKQVVAE

SEQ ID NO: 974265 - protein, 27 aa, Mycobacterium
ARCIDFAHVFARAARCGRHPKSSASTM

SEQ ID NO: 974266 - protein, 24 aa, Mycobacterium
ARIPLGVAVTIEFAGPLMLAAAFS

SEQ ID NO: 974267 - protein, 21 aa, Mycobacterium
ARKAGRAELGRSTLSAGPAGA

SEQ ID NO: 974268 - protein, 18 aa, Mycobacterium
ARLPGLWAATRPRLVRLV

SEQ ID NO: 974269 - protein, 17 aa, Mycobacterium
ARLWRTLERHPPPGVRR

SEQ ID NO: 974270 - protein, 30 aa, Mycobacterium; identical to SEQ ID NO: 339642

SEQ ID NO: 974271 - protein, 21 aa, Mycobacterium
ARTALPAVVPVAAGQAGQPGA

SEQ ID NO: 974272 - protein, 18 aa, Mycobacterium
ARVPMPIIPVSSLLRSHA

SEQ ID NO: 974273 - protein, 27 aa, Mycobacterium
ARWIRRLAIPIMLGWLAIIVLINILVP

SEQ ID NO: 974274 - protein, 19 aa, Mycobacterium
ASFAWQFVFYLGQIVVAYG

SEQ ID NO: 974275 - protein, 18 aa, Mycobacterium
ASISDWFLVATIPLAVMN

SEQ ID NO: 974276 - protein, 19 aa, Mycobacterium
ASIYAEYRLSTSVRKAAHL

SEQ ID NO: 974277 - protein, 17 aa, Mycobacterium
ASLRLLVPGGRFIEMGK

SEQ ID NO: 974278 - protein, 17 aa, Mycobacterium
ASLRLLVRGGRFLEMGK

SEQ ID NO: 974279 - protein, 18 aa, Mycobacterium
ASVLPVWLLLAPRDYLST

SEQ ID NO: 974280 - protein, 22 aa, Mycobacterium
ATELPIIIVILIQIILVLLEIL

SEQ ID NO: 974281 - protein, 24 aa, Mycobacterium
ATGARLRWVPLRGPSATPAQGLEH

SEQ ID NO: 974282 - protein, 17 aa, Mycobacterium
ATGFGWITALRAPAIAK

SEQ ID NO: 974283 - protein, 22 aa, Mycobacterium
ATGRWELSFGFLLVPLIALLAG

SEQ ID NO: 974284 - protein, 19 aa, Mycobacterium
ATIPVQFIAGWPFLVGAVQ

SEQ ID NO: 974285 - protein, 21 aa, Mycobacterium
ATKAAARWIRPLVPPFVARVI

SEQ ID NO: 974286 - protein, 19 aa, Mycobacterium
ATLGLRFYLGWITHTGYTY

SEQ ID NO: 974287 - protein, 22 aa, Mycobacterium
ATLLERWFWWPLRVRPRSASQM

SEQ ID NO: 974288 - protein, 26 aa, Mycobacterium
ATLLSWRLWACISWRRFCKRCGLSAS

SEQ ID NO: 974289 - protein, 24 aa, Mycobacterium
ATPVWRLAVPIAFLGVGMVFAWPV

SEQ ID NO: 974290 - protein, 21 aa, Mycobacterium
ATSSLSLRWRVMLLAMSMVAM

SEQ ID NO: 974291 - protein, 18 aa, Mycobacterium
ATVIRHYLGYGVAVATMG

SEQ ID NO: 974292 - protein, 23 aa, Mycobacterium
AVAKRRGWPILKFNSRGGVGIGA

SEQ ID NO: 974293 - protein, 20 aa, Mycobacterium
AVFCGLLWWMAFGLHSKHLV

SEQ ID NO: 974294 - protein, 20 aa, Mycobacterium
AVGLKFRLGFDDSLDVVGVH

SEQ ID NO: 974295 - protein, 21 aa, Mycobacterium
AVGTLLGRWFWWPRPLAGQTR

SEQ ID NO: 974296 - protein, 19 aa, Mycobacterium
AVPSMPRWLFVVLAFGGLT

SEQ ID NO: 974297 - protein, 18 aa, Mycobacterium
AVTQGLFPVISLVLLGLG

SEQ ID NO: 974298 - protein, 24 aa, Mycobacterium
AVVAMAALASWFGFHAYQSHQADQ

SEQ ID NO: 974299 - protein, 18 aa, Mycobacterium
AVVAREFGFPCVVDAQGA

SEQ ID NO: 974300 - protein, 19 aa, Mycobacterium
AWLRLCQTYGWSPGVMGAS

SEQ ID NO: 974301 - protein, 21 aa, Mycobacterium
AWLVLHLVYLVGFKTKVSTLL

SEQ ID NO: 974302 - protein, 24 aa, Mycobacterium
AWQQGVRWARRLAWISLAVLVTEG

SEQ ID NO: 974303 - protein, 22 aa, Mycobacterium
AWRYWRMVVGVVAAVAVLVIGS

SEQ ID NO: 974304 - protein, 17 aa, Mycobacterium
AWYAFATAVPWARQRTA

SEQ ID NO: 974305 - protein, 18 aa, Mycobacterium
AYPLLKRGIRINAICPGP

SEQ ID NO: 974306 - protein, 19 aa, Mycobacterium
CFISAAAVAARFGAAALAA

SEQ ID NO: 974307 - protein, 24 aa, Mycobacterium
CGDRAGGHPGDWARMLGIGEIATY

SEQ ID NO: 974308 - protein, 18 aa, Mycobacterium
CGSTCGPTGASVAARPAS

SEQ ID NO: 974309 - protein, 21 aa, Mycobacterium
CLGVFCAFILYFALYSRHQLV

SEQ ID NO: 974310 - protein, 20 aa, Mycobacterium
CLSFTRLPYFQTLGSPCSIG

SEQ ID NO: 974311 - protein, 20 aa, Mycobacterium
CLSFTRLPYFQTLGVPLAIG

SEQ ID NO: 974312 - protein, 29 aa, Mycobacterium
CRSLTRSAWRIGFWSNRWIIFGVAAQAIA

SEQ ID NO: 974313 - protein, 21 aa, Mycobacterium
CVKAEMLAASSWRVAVNAGSE

SEQ ID NO: 974314 - protein, 22 aa, Mycobacterium
CYLCAAALTWARYVRPRSPVAS

SEQ ID NO: 974315 - protein, 29 aa, Mycobacterium
DAHAPRAPRRWRSRWSRMRVKRVGVGLNQ

SEQ ID NO: 974316 - protein, 17 aa, Mycobacterium
DALCMAWRAVLAHPNEP

SEQ ID NO: 974317 - protein, 18 aa, Mycobacterium
DALRDWRSPIAWLSRYRP

SEQ ID NO: 974318 - protein, 20 aa, Mycobacterium
DCPRYGELRAPSCFTAPLVQ

SEQ ID NO: 974319 - protein, 22 aa, Mycobacterium
DDRYPRCIDFAKALAAGPGSIA

SEQ ID NO: 974320 - protein, 20 aa, Mycobacterium
DEGHHLVATRLCWSDQDRAE

SEQ ID NO: 974321 - protein, 28 aa, Mycobacterium
DEPSTPRWPWVVGVAAIMAAIALVASVS

SEQ ID NO: 974322 - protein, 22 aa, Mycobacterium
DFFSFYLCDVVLKLNGRGGQPV

SEQ ID NO: 974323 - protein, 19 aa, Mycobacterium
DGALARWNWVLDGMVDTKA

SEQ ID NO: 974324 - protein, 17 aa, Mycobacterium
DGGWRGNAAQAYWVQNL

SEQ ID NO: 974325 - protein, 24 aa, Mycobacterium
DGRASKCTLCYDRLRDGLEPACAK

SEQ ID NO: 974326 - protein, 19 aa, Mycobacterium
DHRERRGALVLAVLVGDNS

SEQ ID NO: 974327 - protein, 17 aa, Mycobacterium
DKARAAVTQGLFPVISL

SEQ ID NO: 974328 - protein, 22 aa, Mycobacterium
DMDQRLVGMIARIVETYGKYNS

SEQ ID NO: 974329 - protein, 19 aa, Mycobacterium
DMYTRSSVQLRQLLIDNKA

SEQ ID NO: 974330 - protein, 20 aa, Mycobacterium
DNWVRRLFALPAFPDGSADD

SEQ ID NO: 974331 - protein, 19 aa, Mycobacterium
DQPRGWRFWHRPRRQLQTQ

SEQ ID NO: 974332 - protein, 17 aa, Mycobacterium
DQPRIYYGPVISNTPAD

SEQ ID NO: 974333 - protein, 17 aa, Mycobacterium
DQTWRLLGVLALADPPR

SEQ ID NO: 974334 - protein, 20 aa, Mycobacterium
DQYLRLPLRQVMWGDDEGLL

SEQ ID NO: 974335 - protein, 20 aa, Mycobacterium
DRAKAYWTRQGWAARAPIKT

SEQ ID NO: 974336 - protein, 17 aa, Mycobacterium
DRARKGLSILMAPEGTR

SEQ ID NO: 974337 - protein, 18 aa, Mycobacterium
DRNRLVTFIAIFLAGGVM

SEQ ID NO: 974338 - protein, 21 aa, Mycobacterium
DRPTPELALRFAGNRWVAIDQ

SEQ ID NO: 974339 - protein, 18 aa, Mycobacterium
DRQQWRSAALFAVALAGM

SEQ ID NO: 974340 - protein, 24 aa, Mycobacterium
DRVKAHILIAMLACYLVWHLRKAW

SEQ ID NO: 974341 - protein, 18 aa, Mycobacterium
DSGPFLSYGIQWIAFGIL

SEQ ID NO: 974342 - protein, 19 aa, Mycobacterium
DTSLRFGVLCRFTADVASE

SEQ ID NO: 974343 - protein, 17 aa, Mycobacterium
DTTQEWNWQNQLTWIAT

SEQ ID NO: 974344 - protein, 18 aa, Mycobacterium
DVGWLRLPGFDWPAHPSW

SEQ ID NO: 974345 - protein, 21 aa, Mycobacterium
DVLHWPGYLLVVAGVIGGVGS

SEQ ID NO: 974346 - protein, 17 aa, Mycobacterium
DVTSIDEIVYWSQYQAQ

SEQ ID NO: 974347 - protein, 19 aa, Mycobacterium
EAESRFTLIYGNRTKESTM

SEQ ID NO: 974348 - protein, 26 aa, Mycobacterium
EAFGRPCGFSGSFVAEYVRPQKYRDR

SEQ ID NO: 974349 - protein, 18 aa, Mycobacterium
EAFLPRRLRYGAQVTLAL

SEQ ID NO: 974350 - protein, 17 aa, Mycobacterium
EAIALIVVIARYLEPFT

SEQ ID NO: 974351 - protein, 20 aa, Mycobacterium
EATLGFCVGCYMHKLIWGCE

SEQ ID NO: 974352 - protein, 25 aa, Mycobacterium
EATWKYVVICSVGIAVAFLGTVLLY

SEQ ID NO: 974353 - protein, 19 aa, Mycobacterium
EAVDSRLGRRVAVKVLKQE

SEQ ID NO: 974354 - protein, 18 aa, Mycobacterium
EDAPRPAPPDVIHAIETQ

SEQ ID NO: 974355 - protein, 24 aa, Mycobacterium
EDIIRFQAEFLWRDYFQPGITVDG

SEQ ID NO: 974356 - protein, 17 aa, Mycobacterium
EDSRLPTVLFQTTVSKL

SEQ ID NO: 974357 - protein, 17 aa, Mycobacterium
EEFRIGIGINTGVVIAG

SEQ ID NO: 974358 - protein, 20 aa, Mycobacterium
EEMFFRGALYTALGRFYPVA

SEQ ID NO: 974359 - protein, 17 aa, Mycobacterium
EFRCVSVDLLARQAVVH

SEQ ID NO: 974360 - protein, 17 aa, Mycobacterium
EGAGRFAAGAGRHGAQA

SEQ ID NO: 974361 - protein, 17 aa, Mycobacterium
EGGFPWAAFVVGLSSAG

SEQ ID NO: 974362 - protein, 17 aa, Mycobacterium
EGISVTAAPGWTLVNRG

SEQ ID NO: 974363 - protein, 19 aa, Mycobacterium
EGRGDFFAVVRSLALFVNA

SEQ ID NO: 974364 - protein, 18 aa, Mycobacterium
EGRSFRSAVPRGWARARK

SEQ ID NO: 974365 - protein, 21 aa, Mycobacterium
EGWFFDRPDLIGADGVHPNDA

SEQ ID NO: 974366 - protein, 17 aa, Mycobacterium
EIWSHPALETWMAIEIA

SEQ ID NO: 974367 - protein, 24 aa, Mycobacterium
EKHCYDIPVCFALRSIYDALDGID

SEQ ID NO: 974368 - protein, 18 aa, Mycobacterium
EKRPRLTMFDDFGGRIPS

SEQ ID NO: 974369 - protein, 17 aa, Mycobacterium
ELARGLIALGIGKAAHV

SEQ ID NO: 974370 - protein, 19 aa, Mycobacterium
ELFWLSLRDSRWWLGALGA

SEQ ID NO: 974371 - protein, 26 aa, Mycobacterium
ELLDTWLWRWVAFLIVFGLMVLTTGM

SEQ ID NO: 974372 - protein, 19 aa, Mycobacterium
ELPFYRLLLSYLFVAIFLA

SEQ ID NO: 974373 - protein, 23 aa, Mycobacterium
EPICPPCGAFIRSYASDIDAAVA

SEQ ID NO: 974374 - protein, 18 aa, Mycobacterium
ERGFSMALGRLGDPADTD

SEQ ID NO: 974375 - protein, 17 aa, Mycobacterium
ERRCAAMAIELITRPSL

SEQ ID NO: 974376 - protein, 21 aa, Mycobacterium
ERRPSRLGRGWLVGISAVLLL

SEQ ID NO: 974377 - protein, 22 aa, Mycobacterium
ESLYPALLGFILLSAVAATLLV

SEQ ID NO: 974378 - protein, 20 aa, Mycobacterium
ETRLMMVLGVGFGLGVALTL

SEQ ID NO: 974379 - protein, 17 aa, Mycobacterium
EVGVLPGTDFKLQPKYM

SEQ ID NO: 974380 - protein, 22 aa, Mycobacterium
EWATHGRLGIAILKNLLLATFA

SEQ ID NO: 974381 - protein, 18 aa, Mycobacterium
EWEWVKWLPHFGDSRRYD

SEQ ID NO: 974382 - protein, 17 aa, Mycobacterium
FAALWALALAFRRSRPM

SEQ ID NO: 974383 - protein, 21 aa, Mycobacterium
FAELMLRPAATIALGGGQPTR

SEQ ID NO: 974384 - protein, 18 aa, Mycobacterium
FAILCRRYVAVIAADRQY

SEQ ID NO: 974385 - protein, 20 aa, Mycobacterium
FALGVFSAFGLVFVQFPGKT

SEQ ID NO: 974386 - protein, 25 aa, Mycobacterium
FAPRGWVAICAFAMVVATHEVVRRL

SEQ ID NO: 974387 - protein, 19 aa, Mycobacterium
FAVARPRGWPEAVAAVPAA

SEQ ID NO: 974388 - protein, 19 aa, Mycobacterium
FCVGCYMHKLIWGCEDCEV

SEQ ID NO: 974389 - protein, 19 aa, Mycobacterium
FDMAMLAFISLCYVSFVRW

SEQ ID NO: 974390 - protein, 17 aa, Mycobacterium
FEHARPTAIMAWMRQHW

SEQ ID NO: 974391 - protein, 17 aa, Mycobacterium
FEHARPTAIMTWMRQHG

SEQ ID NO: 974392 - protein, 17 aa, Mycobacterium
FFAPMRMTLALLPRMLA

SEQ ID NO: 974393 - protein, 23 aa, Mycobacterium
FFEEVWDPASTVAHGRVNVSFTP

SEQ ID NO: 974394 - protein, 18 aa, Mycobacterium
FFTMWGFFILLTVYIEAY

SEQ ID NO: 974395 - protein, 20 aa, Mycobacterium
FGAFAHRWLARRTKRRINPG

SEQ ID NO: 974396 - protein, 22 aa, Mycobacterium
FGEYLPMPWLFRHLSGYADRAG

SEQ ID NO: 974397 - protein, 22 aa, Mycobacterium
FGLSFPRAMFWTVLIYVLVATI

SEQ ID NO: 974398 - protein, 18 aa, Mycobacterium
FGRRRVMLVGWAVGLFWS

SEQ ID NO: 974399 - protein, 19 aa, Mycobacterium
FGVFCRRWGVPLIDGGTVR

SEQ ID NO: 974400 - protein, 18 aa, Mycobacterium
FIREADVAAALWHPNIVR

SEQ ID NO: 974401 - protein, 28 aa, Mycobacterium
FKSATKWSGISFRDHGNWVIGAPDVLLD

SEQ ID NO: 974402 - protein, 19 aa, Mycobacterium
FKSCITFRPWSRCWRPVRC

SEQ ID NO: 974403 - protein, 17 aa, Mycobacterium
FLAMPRIGPWSDATTLS

SEQ ID NO: 974404 - protein, 22 aa, Mycobacterium
FLAYLASFGPMFTISSELGGGS

SEQ ID NO: 974405 - protein, 18 aa, Mycobacterium
FLRRPARWMQLLASHPKC

SEQ ID NO: 974406 - protein, 19 aa, Mycobacterium
FMLGVAFVFALAGAMLAAV

SEQ ID NO: 974407 - protein, 18 aa, Mycobacterium
FNGQLWISMDYIEGTDAA

SEQ ID NO: 974408 - protein, 21 aa, Mycobacterium
FNVALPWNREVSLSRSANHPA

SEQ ID NO: 974409 - protein, 27 aa, Mycobacterium
FRELRWNLRIVIMFSIGLVIATAVAVS

SEQ ID NO: 974410 - protein, 19 aa, Mycobacterium
FRGLRSVWRRGREIYAEVV

SEQ ID NO: 974411 - protein, 17 aa, Mycobacterium
FRIGIGINTGVVIAGTI

SEQ ID NO: 974412 - protein, 18 aa, Mycobacterium
FRVPELLAGSFLLALLAV

SEQ ID NO: 974413 - protein, 21 aa, Mycobacterium
FSGSRWFMFPALAAISDDVLT

SEQ ID NO: 974414 - protein, 28 aa, Mycobacterium
FSVALSLLWNYAMLWFGFVVPPALQIVF

SEQ ID NO: 974415 - protein, 20 aa, Mycobacterium
FSVRLLRTFLRDMPNQMVLA

SEQ ID NO: 974416 - protein, 22 aa, Mycobacterium
FTGLNFPAGVTMDLSGNVYVAD

SEQ ID NO: 974417 - protein, 19 aa, Mycobacterium
FTIGHGRLFASYVALYCVG

SEQ ID NO: 974418 - protein, 21 aa, Mycobacterium
FTLRLAVGLGCGALIGIERQW

SEQ ID NO: 974419 - protein, 20 aa, Mycobacterium
FTVFCLNGFPFLIAAVLWGI

SEQ ID NO: 974420 - protein, 20 aa, Mycobacterium
FTVWMLWSIVVVQMMAVGAP

SEQ ID NO: 974421 - protein, 24 aa, Mycobacterium
FVSMFRPPFAWREYLLQCWFVARV

SEQ ID NO: 974422 - protein, 17 aa, Mycobacterium
FVVGSAVAWGIVTVSIK

SEQ ID NO: 974423 - protein, 20 aa, Mycobacterium
FYIPFAIPWNHYVGGGASGV

SEQ ID NO: 974424 - protein, 19 aa, Mycobacterium
GAGKGFVFWGIAFGLGPAV

SEQ ID NO: 974425 - protein, 24 aa, Mycobacterium
GALLRLPYTFAIPVFGGRNWTTIS

SEQ ID NO: 974426 - protein, 21 aa, Mycobacterium
GALRVNWALGFQLFDYTGETS

SEQ ID NO: 974427 - protein, 18 aa, Mycobacterium
GALWRFAALMVLSSMVAS

SEQ ID NO: 974428 - protein, 18 aa, Mycobacterium
GAMIVVCMFWRLFMQDNL

SEQ ID NO: 974429 - protein, 21 aa, Mycobacterium
GASHLGVWFGHFPWWIPLGSL

SEQ ID NO: 974430 - protein, 18 aa, Mycobacterium
GATTAWAIGRWTPGTERR

SEQ ID NO: 974431 - protein, 18 aa, Mycobacterium
GAVAACLPVMVGGLSIAG

SEQ ID NO: 974432 - protein, 19 aa, Mycobacterium
GAVGIDFGASIYAEYRLST

SEQ ID NO: 974433 - protein, 25 aa, Mycobacterium
GAVRCGAVLFSARWVGPRAAVALAG

SEQ ID NO: 974434 - protein, 22 aa, Mycobacterium
GDRGVSWLPFFHDMGLITVLLA

SEQ ID NO: 974435 - protein, 22 aa, Mycobacterium
GDSARWPGIRGVALVAMPGQDP

SEQ ID NO: 974436 - protein, 23 aa, Mycobacterium
GEDYLRLAALGSYGAFFNIYFCT

SEQ ID NO: 974437 - protein, 24 aa, Mycobacterium
GEERAWMAIMFFAGFLILYSLGVM

SEQ ID NO: 974438 - protein, 20 aa, Mycobacterium
GELLCFVGMLVGVPVASLIQ

SEQ ID NO: 974439 - protein, 20 aa, Mycobacterium
GELTHFFALLLWAAAVLAFF

SEQ ID NO: 974440 - protein, 21 aa, Mycobacterium
GENRIAWWVGVGIAVLVTLLS

SEQ ID NO: 974441 - protein, 24 aa, Mycobacterium
GFFRMCVLTGKALFRRPFQWRELI

SEQ ID NO: 974442 - protein, 18 aa, Mycobacterium
GFLLPWIPVLGVLVLAVV

SEQ ID NO: 974443 - protein, 24 aa, Mycobacterium
GFSELAVGFPVLFLTAAAIAEYVV

SEQ ID NO: 974444 - protein, 22 aa, Mycobacterium
GGAPLRRASVLHLFQHQAAEVG

SEQ ID NO: 974445 - protein, 17 aa, Mycobacterium
GGARFRLTLPLAVAGGV

SEQ ID NO: 974446 - protein, 18 aa, Mycobacterium
GGIAAWLYVKTYRPDQQV

SEQ ID NO: 974447 - protein, 22 aa, Mycobacterium
GGLRLKMWLFPWLSYATIALMA

SEQ ID NO: 974448 - protein, 22 aa, Mycobacterium
GGLRMSVSFLRRIAFSGFAFTI

SEQ ID NO: 974449 - protein, 26 aa, Mycobacterium
GGMLVDWASWRWVFLVNIPLGVVAVL

SEQ ID NO: 974450 - protein, 18 aa, Mycobacterium
GGPATGHRSDHNWELDED

SEQ ID NO: 974451 - protein, 19 aa, Mycobacterium
GGPATGHRSDHNWELDEDW

SEQ ID NO: 974452 - protein, 19 aa, Mycobacterium
GGPLPRGRGLLMAEDTGVF

SEQ ID NO: 974453 - protein, 29 aa, Mycobacterium
GGVTARFTRKAIWWSAFRQLLFGSVAVAA

SEQ ID NO: 974454 - protein, 18 aa, Mycobacterium
GGVVMCWAILGFFVFVIW

SEQ ID NO: 974455 - protein, 28 aa, Mycobacterium
GGYFTDCLGWRWAFWINLPVSAVVICVA

SEQ ID NO: 974456 - protein, 17 aa, Mycobacterium
GHAIGYLRHEACEKPGG

SEQ ID NO: 974457 - protein, 18 aa, Mycobacterium
GIGTGGYCMLRYHQDSQA

SEQ ID NO: 974458 - protein, 17 aa, Mycobacterium
GILRLVAVFGPVHFFAQ

SEQ ID NO: 974459 - protein, 17 aa, Mycobacterium
GISRISLNFAMFRSAFE

SEQ ID NO: 974460 - protein, 25 aa, Mycobacterium
GKLSFPISAAPGWSVFGDDQSPNLI

SEQ ID NO: 974461 - protein, 18 aa, Mycobacterium
GKPLRIMILLVIVTAVAS

SEQ ID NO: 974462 - protein, 22 aa, Mycobacterium
GLAAGWRLAEYAMIATTPTHTA

SEQ ID NO: 974463 - protein, 19 aa, Mycobacterium
GLAGWLFGWLAERSGSLAA

SEQ ID NO: 974464 - protein, 19 aa, Mycobacterium
GLARFVWATAIVWILGGFG

SEQ ID NO: 974465 - protein, 23 aa, Mycobacterium
GLGLIFPRLEQWLQRPFSRIPHN

SEQ ID NO: 974466 - protein, 19 aa, Mycobacterium
GLGTRWVAMNALTFASKGA

SEQ ID NO: 974467 - protein, 17 aa, Mycobacterium
GLGYPASTPILGAQPVD

SEQ ID NO: 974468 - protein, 19 aa, Mycobacterium
GLQIDHFWWTAVWAATLLS

SEQ ID NO: 974469 - protein, 23 aa, Mycobacterium
GLRFVWNLRVLRALALIDLTVTA

SEQ ID NO: 974470 - protein, 18 aa, Mycobacterium
GLSWRDWLLAVVVIAVIR

SEQ ID NO: 974471 - protein, 18 aa, Mycobacterium
GLTPPRLWAGLRLGAVAA

SEQ ID NO: 974472 - protein, 17 aa, Mycobacterium
GLVPLVGTWGFDQIAWF

SEQ ID NO: 974473 - protein, 17 aa, Mycobacterium
GMDLGPWLVTRDVTVVS

SEQ ID NO: 974474 - protein, 23 aa, Mycobacterium
GMLPRRLQPLFGRLSARSRVPVH

SEQ ID NO: 974475 - protein, 20 aa, Mycobacterium
GMNFVICLVLIYGIAVVWGL

SEQ ID NO: 974476 - protein, 17 aa, Mycobacterium
GMTCASCAMRIEKKLNK

SEQ ID NO: 974477 - protein, 17 aa, Mycobacterium
GPAAGHRSDPDWKRQRE

SEQ ID NO: 974478 - protein, 21 aa, Mycobacterium
GPAWLRRLWLAVIIVAPASLW

SEQ ID NO: 974479 - protein, 25 aa, Mycobacterium
GPCKPRCWWCARDAPPSMKSTTRCR

SEQ ID NO: 974480 - protein, 17 aa, Mycobacterium
GPCWSMRLNMIEPLKEP

SEQ ID NO: 974481 - protein, 18 aa, Mycobacterium
GPGRLVARLVQRGIPALG

SEQ ID NO: 974482 - protein, 24 aa, Mycobacterium
GPGRYGLDAGRGWAHRPFIGSFVA

SEQ ID NO: 974483 - protein, 17 aa, Mycobacterium
GPHRFRYAVTVTYSDDD

SEQ ID NO: 974484 - protein, 18 aa, Mycobacterium
GPKTRIWAAPPLSYPTTR

SEQ ID NO: 974485 - protein, 17 aa, Mycobacterium
GPTFRYREFSGDEIDQL

SEQ ID NO: 974486 - protein, 22 aa, Mycobacterium
GQCRLRRSAGFAVRFQAERGGF

SEQ ID NO: 974487 - protein, 23 aa, Mycobacterium
GQCRLRRSAGFAVRFQAERGGFG

SEQ ID NO: 974488 - protein, 20 aa, Mycobacterium
GQEWRMVWDSALDRAEIGQG

SEQ ID NO: 974489 - protein, 20 aa, Mycobacterium
GQRRLLRWSIPGIAHFFTMW

SEQ ID NO: 974490 - protein, 21 aa, Mycobacterium
GRFMPPVGVFLYWLRPKTIRL

SEQ ID NO: 974491 - protein, 18 aa, Mycobacterium
GRGLDIWSALPVLGSVSL

SEQ ID NO: 974492 - protein, 18 aa, Mycobacterium
GRIGLLFAVMPFHAFFGI

SEQ ID NO: 974493 - protein, 17 aa, Mycobacterium
GRPRCSLLVFSDWVSST

SEQ ID NO: 974494 - protein, 19 aa, Mycobacterium
GRTAQAWARRHRHLRAALT

SEQ ID NO: 974495 - protein, 19 aa, Mycobacterium
GRVRPAFFFALGLPALIIV

SEQ ID NO: 974496 - protein, 20 aa, Mycobacterium
GRYRVVSALSRRGDELIVTG

SEQ ID NO: 974497 - protein, 20 aa, Mycobacterium
GSALALAGVSAWLITRASQM

SEQ ID NO: 974498 - protein, 22 aa, Mycobacterium
GSFMLCAAFNVLLRAVSGRDTA

SEQ ID NO: 974499 - protein, 18 aa, Mycobacterium
GSHISGVISFLGIHGSEF

SEQ ID NO: 974500 - protein, 18 aa, Mycobacterium
GSSFKVFALVAALEQGIG

SEQ ID NO: 974501 - protein, 17 aa, Mycobacterium
GSVLDWWSDPLTVPLGT

SEQ ID NO: 974502 - protein, 23 aa, Mycobacterium
GSWPEVIGALLLVVVAAAGIARG

SEQ ID NO: 974503 - protein, 18 aa, Mycobacterium
GTAWALTMVHLRLSLIPV

SEQ ID NO: 974504 - protein, 27 aa, Mycobacterium
GTGMDWRPNPGIGFPGWANYFPVTRGT

SEQ ID NO: 974505 - protein, 18 aa, Mycobacterium
GTHSWRWMLGLATVPAML

SEQ ID NO: 974506 - protein, 23 aa, Mycobacterium
GTYFKGHLYIAGRIKDLVIIDGR

SEQ ID NO: 974507 - protein, 19 aa, Mycobacterium
GVAIAFLLIRVIRAPIEAR

SEQ ID NO: 974508 - protein, 18 aa, Mycobacterium
GVALTFTFLWFVFVGVGD

SEQ ID NO: 974509 - protein, 18 aa, Mycobacterium
GVAMGWGWADGVAGLAVT

SEQ ID NO: 974510 - protein, 22 aa, Mycobacterium
GVDPRVGLFASFTMAVTIAVVG

SEQ ID NO: 974511 - protein, 18 aa, Mycobacterium
GVFLAWRAIPALARNKEN

SEQ ID NO: 974512 - protein, 17 aa, Mycobacterium
GVIPVIFASSLIYIPHL

SEQ ID NO: 974513 - protein, 18 aa, Mycobacterium
GVIPVIFASSLIYIPHLI

SEQ ID NO: 974514 - protein, 22 aa, Mycobacterium
GVISRLMLAWVLSTAVPLLAIV

SEQ ID NO: 974515 - protein, 17 aa, Mycobacterium
GVLGVVIAHPWRSPGPP

SEQ ID NO: 974516 - protein, 23 aa, Mycobacterium
GVLQRPSFRMPLSPYSGWITLAF

SEQ ID NO: 974517 - protein, 18 aa, Mycobacterium
GVLRARHPPPWGADVLVS

SEQ ID NO: 974518 - protein, 19 aa, Mycobacterium
GVPLEWNVFFIFSLFYLFG

SEQ ID NO: 974519 - protein, 20 aa, Mycobacterium
GVSWVYRYAVAVYRDDRGCG

SEQ ID NO: 974520 - protein, 27 aa, Mycobacterium
GVTVAFLFWEFFIPLLLSLLQGLLGLI

SEQ ID NO: 974521 - protein, 17 aa, Mycobacterium
GWLTLWPFLSWLTTHFV

SEQ ID NO: 974522 - protein, 26 aa, Mycobacterium
GWRKIGAAIVRWPGPILIGAVALALV

SEQ ID NO: 974523 - protein, 19 aa, Mycobacterium
GWWPVLWFTAKVWGFLFMY

SEQ ID NO: 974524 - protein, 18 aa, Mycobacterium
GYGPAFRGLRSVWRRGRE

SEQ ID NO: 974525 - protein, 21 aa, Mycobacterium
GYLKARVADMYTMIDELQHMI

SEQ ID NO: 974526 - protein, 21 aa, Mycobacterium
GYLLVCAMIYGWAFMQRGVPY

SEQ ID NO: 974527 - protein, 19 aa, Mycobacterium
HAAVWWKALLALVVAVALT

SEQ ID NO: 974528 - protein, 19 aa, Mycobacterium
HAVAFLGPWLFSIFVDIFS

SEQ ID NO: 974529 - protein, 17 aa, Mycobacterium
HAYAGSLAQVFLCAAPV

SEQ ID NO: 974530 - protein, 17 aa, Mycobacterium
HDLELLGYVGLADTARP

SEQ ID NO: 974531 - protein, 21 aa, Mycobacterium
HEGGHTLAAWAMPDIDPVYKV

SEQ ID NO: 974532 - protein, 23 aa, Mycobacterium
HELGMPIPAGWKLWLYGVFAITA

SEQ ID NO: 974533 - protein, 19 aa, Mycobacterium
HFAKLPAMLFGVGRYTVTM

SEQ ID NO: 974534 - protein, 19 aa, Mycobacterium
HFGNAVLLLAIWIGIGFIF

SEQ ID NO: 974535 - protein, 18 aa, Mycobacterium
HLFDRDGVDFAIGPPPPA

SEQ ID NO: 974536 - protein, 25 aa, Mycobacterium
HLLDTLPLLIGWLWPLWDSRRRTFA

SEQ ID NO: 974537 - protein, 21 aa, Mycobacterium
HPAWHTLILVLLFVAAMWVTY

SEQ ID NO: 974538 - protein, 18 aa, Mycobacterium
HPPFAWREYIAQAWFVAR

SEQ ID NO: 974539 - protein, 18 aa, Mycobacterium
HRVGEPFGSLVLAVAVTV

SEQ ID NO: 974540 - protein, 21 aa, Mycobacterium
HSSDAIAGWASHLAAVTTELQ

SEQ ID NO: 974541 - protein, 19 aa, Mycobacterium
HVLGHDWGSVAIWDYLTRS

SEQ ID NO: 974542 - protein, 22 aa, Mycobacterium
HVMGRWNWWAPKPLVWLHQRFG

SEQ ID NO: 974543 - protein, 19 aa, Mycobacterium
IAALLGRWFWWPINVRTRP

SEQ ID NO: 974544 - protein, 19 aa, Mycobacterium
IAALLGRWFWWPLNIRSRP

SEQ ID NO: 974545 - protein, 23 aa, Mycobacterium
IAALLGRWFWWPLRVRSRPDRGA

SEQ ID NO: 974546 - protein, 21 aa, Mycobacterium
IAALLGRWFWWPMRVRTRPAR

SEQ ID NO: 974547 - protein, 18 aa, Mycobacterium
IAALMGRWFWWPQQVRTR

SEQ ID NO: 974548 - protein, 18 aa, Mycobacterium
IAAVACGRLAGAGRIGVK

SEQ ID NO: 974549 - protein, 19 aa, Mycobacterium
IAERLRPGGVIQREIAMRT

SEQ ID NO: 974550 - protein, 21 aa, Mycobacterium
IAGPIARLALVGAAAEGSAVI

SEQ ID NO: 974551 - protein, 17 aa, Mycobacterium
IALFMGCYLRFLRPGRV

SEQ ID NO: 974552 - protein, 17 aa, Mycobacterium
IALGWAFLGAGIGSVIR

SEQ ID NO: 974553 - protein, 21 aa, Mycobacterium
IALTAWRVMWFRIHAEPSGDE

SEQ ID NO: 974554 - protein, 17 aa, Mycobacterium
IAPLDVILTVAFLGALL

SEQ ID NO: 974555 - protein, 23 aa, Mycobacterium
IAQEFADKVFIIFQRLHGRDSYG

SEQ ID NO: 974556 - protein, 23 aa, Mycobacterium
IARRAGTPISFWEFTRKGIVVTT

SEQ ID NO: 974557 - protein, 22 aa, Mycobacterium
IASLCACLWLMLNLTALTWIRF

SEQ ID NO: 974558 - protein, 21 aa, Mycobacterium
IASRLGWVVIRSFDGLGPPKE

SEQ ID NO: 974559 - protein, 21 aa, Mycobacterium
IASVGLWWFIRRQISRQRRGI

SEQ ID NO: 974560 - protein, 22 aa, Mycobacterium
IATACPFCRVMVTDGVNDRQEE

SEQ ID NO: 974561 - protein, 20 aa, Mycobacterium
IAVFCGFAFAGMPLVAEIGV

SEQ ID NO: 974562 - protein, 23 aa, Mycobacterium
IAVLLGRWFWWPQRVRPRPASQM

SEQ ID NO: 974563 - protein, 22 aa, Mycobacterium
IAVLLLLWARRSLVAAAVVLLT

SEQ ID NO: 974564 - protein, 18 aa, Mycobacterium
IDDLVNWFLGHPWQKEYG

SEQ ID NO: 974565 - protein, 19 aa, Mycobacterium
IDDRLKRFGAMAAAMVLYV

SEQ ID NO: 974566 - protein, 18 aa, Mycobacterium
IFLMLSVAGLAAYSMAPW

SEQ ID NO: 974567 - protein, 27 aa, Mycobacterium
IGFILGWPWWWISACSVLVLLVLEGVA

SEQ ID NO: 974568 - protein, 21 aa, Mycobacterium
IGLFYRYAWQNPIFADIVATR

SEQ ID NO: 974569 - protein, 22 aa, Mycobacterium
IGPKSIRVWLMLGVLLFSVVLA

SEQ ID NO: 974570 - protein, 18 aa, Mycobacterium
IGVLPRWQPVAILSVLAV

SEQ ID NO: 974571 - protein, 23 aa, Mycobacterium
IGYGLGVFAVWLVRYMRSQDDSP

SEQ ID NO: 974572 - protein, 20 aa, Mycobacterium
IKTNLFWAFGYNVAALPLAA

SEQ ID NO: 974573 - protein, 19 aa, Mycobacterium
IKVPREFINSYLFNFPDTS

SEQ ID NO: 974574 - protein, 17 aa, Mycobacterium
ILACGYLLYSLHWYTWI

SEQ ID NO: 974575 - protein, 18 aa, Mycobacterium
ILLPHARPAVMVLGVLTW

SEQ ID NO: 974576 - protein, 18 aa, Mycobacterium
ILPPTWLAGTAMLGLSKI

SEQ ID NO: 974577 - protein, 18 aa, Mycobacterium
ILPVLPVVFFSGAHGGAT

SEQ ID NO: 974578 - protein, 22 aa, Mycobacterium
ILRDHLFCFGCMLAFLILWVVN

SEQ ID NO: 974579 - protein, 19 aa, Mycobacterium
IMGLLGRWFWWSPPPFLRA

SEQ ID NO: 974580 - protein, 17 aa, Mycobacterium
IMIAVFCGFAFAGMPLV

SEQ ID NO: 974581 - protein, 23 aa, Mycobacterium
INAPRAKLFAALFLILGLVVVGE

SEQ ID NO: 974582 - protein, 22 aa, Mycobacterium
IPALFTLIGDRIWWPSDPKTTA

SEQ ID NO: 974583 - protein, 19 aa, Mycobacterium
IPGAEDFRALPGRGVRASV

SEQ ID NO: 974584 - protein, 18 aa, Mycobacterium
IPGAPWWGAVLIAVSTTA

SEQ ID NO: 974585 - protein, 18 aa, Mycobacterium
IPLIGYLVHPGRTEATML

SEQ ID NO: 974586 - protein, 20 aa, Mycobacterium
IPQSLLWISLVVLWLFVLVP

SEQ ID NO: 974587 - protein, 19 aa, Mycobacterium
IPVIGHWDALGFLQDFFAT

SEQ ID NO: 974588 - protein, 24 aa, Mycobacterium
IQAAQLSAVWARFPLPVIPAPGDP

SEQ ID NO: 974589 - protein, 21 aa, Mycobacterium
IREFKRLGLTPVLLTGDNPTV

SEQ ID NO: 974590 - protein, 27 aa, Mycobacterium
IRFWRRIGTAVVRWPAPILLASLAAAL

SEQ ID NO: 974591 - protein, 18 aa, Mycobacterium
IRGREWIRLPAIFGAGMV

SEQ ID NO: 974592 - protein, 25 aa, Mycobacterium
IRHQRRWNLDLGFRAGGPDERVRAA

SEQ ID NO: 974593 - protein, 19 aa, Mycobacterium
IRIADVWKITRRVGVQESY

SEQ ID NO: 974594 - protein, 24 aa, Mycobacterium
IRILAVPIILGWVLLTVLVNVVVP

SEQ ID NO: 974595 - protein, 17 aa, Mycobacterium
IRLSQWFLLTAAFGSLF

SEQ ID NO: 974596 - protein, 18 aa, Mycobacterium
ISEDCPPVPFAVNYYIYP

SEQ ID NO: 974597 - protein, 17 aa, Mycobacterium
ISFGGVIAFIFADLLIL

SEQ ID NO: 974598 - protein, 20 aa, Mycobacterium
ISGVISFLGIHGSEFSDSGA

SEQ ID NO: 974599 - protein, 24 aa, Mycobacterium
ISHQRWLRWPARVYTDIFRGLPEV

SEQ ID NO: 974600 - protein, 18 aa, Mycobacterium
ISLNFAMFRSAFEQGAQL

SEQ ID NO: 974601 - protein, 19 aa, Mycobacterium
ISVTAAPGWTLVNRGPNWV

SEQ ID NO: 974602 - protein, 17 aa, Mycobacterium
ITLPMLRPTTFFVLVTG

SEQ ID NO: 974603 - protein, 19 aa, Mycobacterium
ITLSGIWLLIVPSELAKTD

SEQ ID NO: 974604 - protein, 17 aa, Mycobacterium
ITRPRWVALEKSISEIV

SEQ ID NO: 974605 - protein, 23 aa, Mycobacterium
IVIICVFSMLIAQLMVRPIRRLE

SEQ ID NO: 974606 - protein, 23 aa, Mycobacterium
IVLYEIVDILPFPVGSLVGPAAV

SEQ ID NO: 974607 - protein, 17 aa, Mycobacterium
IVVKVAALLIVFGFAGL

SEQ ID NO: 974608 - protein, 18 aa, Mycobacterium
IVYRPSFRMWGAPYTGYL

SEQ ID NO: 974609 - protein, 19 aa, Mycobacterium
KAGMFHLLIAVAFTMMGMV

SEQ ID NO: 974610 - protein, 18 aa, Mycobacterium
KAIVCNRSFLGFAAAMTG

SEQ ID NO: 974611 - protein, 17 aa, Mycobacterium
KASARFGLYYTPSSALY

SEQ ID NO: 974612 - protein, 23 aa, Mycobacterium
KDPRKYRLIVTITRDGDQLKMSK

SEQ ID NO: 974613 - protein, 19 aa, Mycobacterium
KDSFPASFIVKLENPEQHK

SEQ ID NO: 974614 - protein, 25 aa, Mycobacterium
KEPAWRRFRVSQVLIGLSAVVAMTA

SEQ ID NO: 974615 - protein, 22 aa, Mycobacterium
KFERRPLGVSWLIGVVVIPLLL

SEQ ID NO: 974616 - protein, 19 aa, Mycobacterium
KGANFTAAMAFEIGSTNLV

SEQ ID NO: 974617 - protein, 24 aa, Mycobacterium
KGPFRIAMAVGIPIVPIVFRNAEI

SEQ ID NO: 974618 - protein, 18 aa, Mycobacterium
KGPLVFDLGICLVLITLP

SEQ ID NO: 974619 - protein, 24 aa, Mycobacterium
KHVRKRLRDAFGFPKSVVHAQAYW

SEQ ID NO: 974620 - protein, 23 aa, Mycobacterium
KIGFEMFRILPAAVIVIGLLALL

SEQ ID NO: 974621 - protein, 26 aa, Mycobacterium
KIRGWRRIGTVVVRWPGPVLAATIAI

SEQ ID NO: 974622 - protein, 17 aa, Mycobacterium
KISELYDRVGFAAAGKF

SEQ ID NO: 974623 - protein, 22 aa, Mycobacterium
KKFTWHWWWLAAAIPVLLLVVF

SEQ ID NO: 974624 - protein, 25 aa, Mycobacterium
KKGHLKWAWIPGVPLLWDLIVTLTA

SEQ ID NO: 974625 - protein, 18 aa, Mycobacterium
KLAALWRGTLVVLQSILA

SEQ ID NO: 974626 - protein, 19 aa, Mycobacterium
KLAIIAAGIDFRRRMSELA

SEQ ID NO: 974627 - protein, 17 aa, Mycobacterium
KLMQCVVDGPGYVQSSP

SEQ ID NO: 974628 - protein, 17 aa, Mycobacterium
KLRVGFAKAGRLMDLME

SEQ ID NO: 974629 - protein, 18 aa, Mycobacterium
KMTTEWLHVPLLPIPIPI

SEQ ID NO: 974630 - protein, 25 aa, Mycobacterium
KPLARKGFLSIWSWTFGLVVTEFPL

SEQ ID NO: 974631 - protein, 24 aa, Mycobacterium
KPPFSVGEAISWAWNRFTQNAMAL

SEQ ID NO: 974632 - protein, 18 aa, Mycobacterium
KPRWLCATAALAAALVGA

SEQ ID NO: 974633 - protein, 21 aa, Mycobacterium
KRADNPISFWEFTRKGIVVTT

SEQ ID NO: 974634 - protein, 29 aa, Mycobacterium
KREKAARPNRSWARYLRRGAMPLLLAGAL

SEQ ID NO: 974635 - protein, 17 aa, Mycobacterium
KRLGRLMAAIGIPMLLG

SEQ ID NO: 974636 - protein, 21 aa, Mycobacterium
KRLLTRWARDYVTIIGALVLP

SEQ ID NO: 974637 - protein, 19 aa, Mycobacterium
KRMSWQRWALLCVGIAQVA

SEQ ID NO: 974638 - protein, 22 aa, Mycobacterium
KRWSGDLAMTWDLLCRSITHGI

SEQ ID NO: 974639 - protein, 20 aa, Mycobacterium
KSRKGRAFAIVAALLALAAI

SEQ ID NO: 974640 - protein, 18 aa, Mycobacterium
KSSTAWAPRGTVLITGGT

SEQ ID NO: 974641 - protein, 19 aa, Mycobacterium
KVAALLIVFGFAGLSAYFV

SEQ ID NO: 974642 - protein, 19 aa, Mycobacterium
KVGPTIAWYQDFLRYYFLT

SEQ ID NO: 974643 - protein, 28 aa, Mycobacterium
KVRGWRRIGTAIVRWPGPVFVASLLIAL

SEQ ID NO: 974644 - protein, 20 aa, Mycobacterium
LAAITWRLSFLWLAVTGLLL

SEQ ID NO: 974645 - protein, 20 aa, Mycobacterium
LAAKDIPLVFGYDYQTVERS

SEQ ID NO: 974646 - protein, 20 aa, Mycobacterium
LAALCYAEFASTLPVAGSAY

SEQ ID NO: 974647 - protein, 24 aa, Mycobacterium
LAALLFTLALCWATTNGWWYVSSY

SEQ ID NO: 974648 - protein, 18 aa, Mycobacterium
LAALRPTPGFPASGVVAL

SEQ ID NO: 974649 - protein, 22 aa, Mycobacterium
LAARKRIAWLLLLTNVVLAAFL

SEQ ID NO: 974650 - protein, 18 aa, Mycobacterium
LAAWAVWDFRGARGAIQT

SEQ ID NO: 974651 - protein, 17 aa, Mycobacterium
LACAVFAAVGAVVVAFL

SEQ ID NO: 974652 - protein, 17 aa, Mycobacterium
LACLLALAELHLRTARL

SEQ ID NO: 974653 - protein, 23 aa, Mycobacterium
LACYLVWHLRKAWAPMTYTDENP

SEQ ID NO: 974654 - protein, 19 aa, Mycobacterium
LADIRIRKAILGLLDVDLL

SEQ ID NO: 974655 - protein, 18 aa, Mycobacterium
LAELGWVCVAINYRHSPR

SEQ ID NO: 974656 - protein, 18 aa, Mycobacterium
LAERFRILRYDNRGVGLS

SEQ ID NO: 974657 - protein, 20 aa, Mycobacterium
LAFISLCYVSFVRWKIRLKG

SEQ ID NO: 974658 - protein, 19 aa, Mycobacterium
LAFLPKWSALTALSQTSSL

SEQ ID NO: 974659 - protein, 17 aa, Mycobacterium
LAFLPRLVVLIVVALVI

SEQ ID NO: 974660 - protein, 19 aa, Mycobacterium
LAGREIPAAVPLVSFAILA

SEQ ID NO: 974661 - protein, 17 aa, Mycobacterium
LAGVSAWLITRASQMPP

SEQ ID NO: 974662 - protein, 18 aa, Mycobacterium
LAICYRPLLFATVDPEVA

SEQ ID NO: 974663 - protein, 20 aa, Mycobacterium
LALSWARLTTVFVIDLLILI

SEQ ID NO: 974664 - protein, 22 aa, Mycobacterium
LAMALTCWWVISREVIPRLGHA

SEQ ID NO: 974665 - protein, 18 aa, Mycobacterium
LANHPSFGRRDLSSMRRG

SEQ ID NO: 974666 - protein, 19 aa, Mycobacterium
LAPTWSRPGWRHLKHFNGY

SEQ ID NO: 974667 - protein, 17 aa, Mycobacterium
LAQAAGVPVVFLTAFYG

SEQ ID NO: 974668 - protein, 17 aa, Mycobacterium
LARIWPPWEFYFWHHTI

SEQ ID NO: 974669 - protein, 17 aa, Mycobacterium
LARRTAMALTRWRVRME

SEQ ID NO: 974670 - protein, 18 aa, Mycobacterium
LASLSVSAVLGWHLFAAH

SEQ ID NO: 974671 - protein, 21 aa, Mycobacterium
LATGCLRVRASITISPEDLVS

SEQ ID NO: 974672 - protein, 25 aa, Mycobacterium
LATWATACGWPFSLAMIDGFERGFA

SEQ ID NO: 974673 - protein, 19 aa, Mycobacterium
LAVPLEWNVLFAYATIFLF

SEQ ID NO: 974674 - protein, 19 aa, Mycobacterium
LAVVGVCRLRRARQSPSAP

SEQ ID NO: 974675 - protein, 20 aa, Mycobacterium
LCALCAALGLNIWVGYFPTV

SEQ ID NO: 974676 - protein, 18 aa, Mycobacterium
LDALAGRERFSLNDPDDD

SEQ ID NO: 974677 - protein, 17 aa, Mycobacterium
LDALFARALATEPAGRF

SEQ ID NO: 974678 - protein, 22 aa, Mycobacterium
LDAWRFGWIVSIGRAITGGVGG

SEQ ID NO: 974679 - protein, 21 aa, Mycobacterium
LDPLLPFPRWHEHAAVVEEPV

SEQ ID NO: 974680 - protein, 25 aa, Mycobacterium
LDRLPWGRFHWRVVIGLGGVWVLDG

SEQ ID NO: 974681 - protein, 20 aa, Mycobacterium
LEGRTAVFTIFYRHDLDGLR

SEQ ID NO: 974682 - protein, 19 aa, Mycobacterium
LEHPGSWGGLVDLPESPDD

SEQ ID NO: 974683 - protein, 17 aa, Mycobacterium
LFAALWLSCLAIFNTRS

SEQ ID NO: 974684 - protein, 22 aa, Mycobacterium
LFALLRFWGVVPDYVIGHSVGE

SEQ ID NO: 974685 - protein, 19 aa, Mycobacterium
LFGQLPLPLGVAGHEGSTV

SEQ ID NO: 974686 - protein, 19 aa, Mycobacterium
LFNEPRVSEDQIMLSAKAD

SEQ ID NO: 974687 - protein, 24 aa, Mycobacterium
LFNRLRPTLPIVLANLVSVGEVAV

SEQ ID NO: 974688 - protein, 21 aa, Mycobacterium
LFRAPEFYVWIAAALGGMIFQ

SEQ ID NO: 974689 - protein, 24 aa, Mycobacterium
LFVVGRLAARHGIRVGLRGPSTGE

SEQ ID NO: 974690 - protein, 17 aa, Mycobacterium
LFWFFGHPEVYILALPF

SEQ ID NO: 974691 - protein, 23 aa, Mycobacterium
LGDDCWWAPRWMRRLQTRIGLGE

SEQ ID NO: 974692 - protein, 20 aa, Mycobacterium
LGFRLTCYYYRKAYYRSVWQ

SEQ ID NO: 974693 - protein, 25 aa, Mycobacterium
LGGWLLGFAWPWRPVVCGGRTGSPT

SEQ ID NO: 974694 - protein, 20 aa, Mycobacterium
LGIPCSVGMLVALLVALTLA

SEQ ID NO: 974695 - protein, 24 aa, Mycobacterium
LGLFGIRNGWWVYLTIYALFIGIH

SEQ ID NO: 974696 - protein, 17 aa, Mycobacterium
LGLLASGLTMFFGAYPW

SEQ ID NO: 974697 - protein, 18 aa, Mycobacterium
LGNWTIFYWGWWISWAPF

SEQ ID NO: 974698 - protein, 22 aa, Mycobacterium
LGRLRFGGLYALSALGGSVLVY

SEQ ID NO: 974699 - protein, 18 aa, Mycobacterium
LGVMPLFPAMLMVWGTAR

SEQ ID NO: 974700 - protein, 25 aa, Mycobacterium
LGVVVGGPFLPLAIILYWFSNNIWT

SEQ ID NO: 974701 - protein, 17 aa, Mycobacterium
LHIPLWLGYAFSTLLIF

SEQ ID NO: 974702 - protein, 20 aa, Mycobacterium
LHLPRLSYFKALGIPSALGL

SEQ ID NO: 974703 - protein, 20 aa, Mycobacterium
LHVAQPLAYCLPGVRSRVVV

SEQ ID NO: 974704 - protein, 19 aa, Mycobacterium
LHVVDARFARGLRARLLGK

SEQ ID NO: 974705 - protein, 23 aa, Mycobacterium
LHWKISEAPLFYGGYAALLAISA

SEQ ID NO: 974706 - protein, 17 aa, Mycobacterium
LHWYTWIAFGGWVGIAL

SEQ ID NO: 974707 - protein, 22 aa, Mycobacterium
LICTAISMPIVFMVGIYLVEYG

SEQ ID NO: 974708 - protein, 21 aa, Mycobacterium
LIDIRFIPKYLFSVSFCGILV

SEQ ID NO: 974709 - protein, 17 aa, Mycobacterium
LIHLCLFIGALTFMYIS

SEQ ID NO: 974710 - protein, 17 aa, Mycobacterium
LIIAIGVFLAWRAIPAL

SEQ ID NO: 974711 - protein, 22 aa, Mycobacterium
LIKCGVVLLAVFATFIAHPVLH

SEQ ID NO: 974712 - protein, 23 aa, Mycobacterium
LIMGWGHRLLRGLALVAVSAMVA

SEQ ID NO: 974713 - protein, 19 aa, Mycobacterium
LIVSWIAVILLTFHWARVV

SEQ ID NO: 974714 - protein, 17 aa, Mycobacterium
LKAFWYHFAIMFEALFI

SEQ ID NO: 974715 - protein, 17 aa, Mycobacterium
LKFFNWIGTMWRGQLTF

SEQ ID NO: 974716 - protein, 21 aa, Mycobacterium
LKKPILVWWIAWVVSTATSLF

SEQ ID NO: 974717 - protein, 23 aa, Mycobacterium
LKLPSWGSLRLALPVGGNGDATF

SEQ ID NO: 974718 - protein, 19 aa, Mycobacterium
LLAKICVYTVFAVVQSAIV

SEQ ID NO: 974719 - protein, 18 aa, Mycobacterium
LLDRLGAHLTRYIGPGVE

SEQ ID NO: 974720 - protein, 24 aa, Mycobacterium
LLDTRWMPLPAFVIAMVLLRSSLA

SEQ ID NO: 974721 - protein, 18 aa, Mycobacterium
LLEGIGRRVLAWVNSIRG

SEQ ID NO: 974722 - protein, 19 aa, Mycobacterium
LLEHFSWGSIFLVNVPIAV

SEQ ID NO: 974723 - protein, 17 aa, Mycobacterium
LLFAGILPPTWLAGTAM

SEQ ID NO: 974724 - protein, 18 aa, Mycobacterium
LLGDRYGRRRGFFVGLAL

SEQ ID NO: 974725 - protein, 19 aa, Mycobacterium
LLIKKIWWPLAVWLLLVVM

SEQ ID NO: 974726 - protein, 22 aa, Mycobacterium
LLKLAVVLALWAAVAGAFVSVL

SEQ ID NO: 974727 - protein, 17 aa, Mycobacterium
LLQGFAVGGEWAGSALL

SEQ ID NO: 974728 - protein, 17 aa, Mycobacterium
LLRSWPAFLAYLVSFVF

SEQ ID NO: 974729 - protein, 17 aa, Mycobacterium
LLSRLWVLPIHRASGLL

SEQ ID NO: 974730 - protein, 24 aa, Mycobacterium
LLVASAWWLFEWEVGKGASVEAAR

SEQ ID NO: 974731 - protein, 19 aa, Mycobacterium
LLWWMMVCWAQPLRNRSQS

SEQ ID NO: 974732 - protein, 17 aa, Mycobacterium
LLYDIGMGGEWGLGAAL

SEQ ID NO: 974733 - protein, 18 aa, Mycobacterium
LMFFAGLFAMYFTARSQA

SEQ ID NO: 974734 - protein, 18 aa, Mycobacterium
LMQLCVQGAWGVIPAYLT

SEQ ID NO: 974735 - protein, 21 aa, Mycobacterium
LNAGWSWLFFRFHRLGASALG

SEQ ID NO: 974736 - protein, 17 aa, Mycobacterium
LNLAWAFGYNIAAIPIA

SEQ ID NO: 974737 - protein, 23 aa, Mycobacterium
LNLKLLVPVFRWQRRDNLVAAAD

SEQ ID NO: 974738 - protein, 21 aa, Mycobacterium
LPAWGSLRLALPMNGNSDATF

SEQ ID NO: 974739 - protein, 23 aa, Mycobacterium
LPDLFAGLVCWLLLSREVLPRLG

SEQ ID NO: 974740 - protein, 20 aa, Mycobacterium
LPFDPRLRRMAVVAADQILV

SEQ ID NO: 974741 - protein, 17 aa, Mycobacterium
LPILAVTCAVALVGLIT

SEQ ID NO: 974742 - protein, 17 aa, Mycobacterium
LPLLALLDFLTGHFSVA

SEQ ID NO: 974743 - protein, 20 aa, Mycobacterium
LPPRWWSIGALDGLVTAVLV

SEQ ID NO: 974744 - protein, 19 aa, Mycobacterium
LPQTRWIPLVTFLQVSADM

SEQ ID NO: 974745 - protein, 17 aa, Mycobacterium
LPRRVVHALDLVNFSLA

SEQ ID NO: 974746 - protein, 21 aa, Mycobacterium
LQADCYAGVWAHYASTVRQES

SEQ ID NO: 974747 - protein, 20 aa, Mycobacterium
LQMAFRFWAFRRWVFPDEFA

SEQ ID NO: 974748 - protein, 17 aa, Mycobacterium
LQPISPVLAAIVRNTNS

SEQ ID NO: 974749 - protein, 19 aa, Mycobacterium
LRAAVKIHLLVAERFGQEL

SEQ ID NO: 974750 - protein, 19 aa, Mycobacterium
LRESHDWSLADLAAATGVS

SEQ ID NO: 974751 - protein, 21 aa, Mycobacterium
LREVLPLVVPVILASLLFAGG

SEQ ID NO: 974752 - protein, 17 aa, Mycobacterium
LRFAQLVGLVFAAAGVV

SEQ ID NO: 974753 - protein, 19 aa, Mycobacterium
LRFYLGWITHTGYTYGALS

SEQ ID NO: 974754 - protein, 17 aa, Mycobacterium
LRGAMLLGVALGLMTLG

SEQ ID NO: 974755 - protein, 17 aa, Mycobacterium
LRLALPMNGNSDATFLA

SEQ ID NO: 974756 - protein, 18 aa, Mycobacterium
LRLLVPGGRFIEMGKTDL

SEQ ID NO: 974757 - protein, 17 aa, Mycobacterium
LRPGGVIQREIAMRTVA

SEQ ID NO: 974758 - protein, 18 aa, Mycobacterium
LRPRALRALDRVDAIMID

SEQ ID NO: 974759 - protein, 18 aa, Mycobacterium
LRRDRTSFIIAHRLSTIR

SEQ ID NO: 974760 - protein, 18 aa, Mycobacterium
LRVTRWDVGLAMIVAGGV

SEQ ID NO: 974761 - protein, 17 aa, Mycobacterium
LRVVCAIPSSTSPLDPF

SEQ ID NO: 974762 - protein, 18 aa, Mycobacterium
LRWRVMLLAMSMVAMVVV

SEQ ID NO: 974763 - protein, 17 aa, Mycobacterium
LRYRWWVVLTGVAIASV

SEQ ID NO: 974764 - protein, 21 aa, Mycobacterium
LSATCYFFAELMLRPAATIAL

SEQ ID NO: 974765 - protein, 18 aa, Mycobacterium
LSFTWLPYFHSLGIPQPH

SEQ ID NO: 974766 - protein, 21 aa, Mycobacterium
LSGRYRLHRLIATGGMGQVWE

SEQ ID NO: 974767 - protein, 18 aa, Mycobacterium
LSLARLPYFRTLGIPCAV

SEQ ID NO: 974768 - protein, 18 aa, Mycobacterium
LSRGDWRLRIHGMVDREI

SEQ ID NO: 974769 - protein, 19 aa, Mycobacterium
LSSLRGRVVLVDFWAYSCI

SEQ ID NO: 974770 - protein, 20 aa, Mycobacterium
LSVSAVLGWHLFAAHHANVA

SEQ ID NO: 974771 - protein, 18 aa, Mycobacterium
LSYFKALGIPSALGLLVV

SEQ ID NO: 974772 - protein, 22 aa, Mycobacterium
LTAALSLMWGWRLAAVCVTVAA

SEQ ID NO: 974773 - protein, 19 aa, Mycobacterium
LTAGEIFAGYTILRLLGSG

SEQ ID NO: 974774 - protein, 18 aa, Mycobacterium
LTAHGALVRAPRTIEALG

SEQ ID NO: 974775 - protein, 17 aa, Mycobacterium
LTAVFGWQVLPFLIIQG

SEQ ID NO: 974776 - protein, 21 aa, Mycobacterium
LTEVSWRLAFMVNVPIGLVMI

SEQ ID NO: 974777 - protein, 17 aa, Mycobacterium
LTFHWARVVWQRTIVQL

SEQ ID NO: 974778 - protein, 18 aa, Mycobacterium
LTKMTAMPQLVAFFNGVG

SEQ ID NO: 974779 - protein, 20 aa, Mycobacterium
LTMVHLRLSLIPVLIGTAIA

SEQ ID NO: 974780 - protein, 25 aa, Mycobacterium
LTRLTARWRLPAVIQLAVRSLTRSR

SEQ ID NO: 974781 - protein, 19 aa, Mycobacterium
LVAEIGVACAVAIAVDATI

SEQ ID NO: 974782 - protein, 17 aa, Mycobacterium
LVEYFWWGAIFLINVPL

SEQ ID NO: 974783 - protein, 20 aa, Mycobacterium
LVGLLMRWRNRYGWSAFVFG

SEQ ID NO: 974784 - protein, 18 aa, Mycobacterium
LVTLCPAVAILALGLDPT

SEQ ID NO: 974785 - protein, 24 aa, Mycobacterium
LVVALWRFRWIRLAMISALLATQG

SEQ ID NO: 974786 - protein, 18 aa, Mycobacterium
LVVPRLLAAMVIGVALCG

SEQ ID NO: 974787 - protein, 24 aa, Mycobacterium
LVWEYLFGIKLYWVVLALAVILLL

SEQ ID NO: 974788 - protein, 18 aa, Mycobacterium
LWALALAFRRSRPMVSLD

SEQ ID NO: 974789 - protein, 18 aa, Mycobacterium
LWWALLLTIGFWGLLRVA

SEQ ID NO: 974790 - protein, 18 aa, Mycobacterium
LWWMMVCWAQPLRNRSQS

SEQ ID NO: 974791 - protein, 18 aa, Mycobacterium
LYDRVGFAAAGKFNEFDN

SEQ ID NO: 974792 - protein, 21 aa, Mycobacterium
LYMCASGSFLGFAFAFGQVLQ

SEQ ID NO: 974793 - protein, 20 aa, Mycobacterium
MALFPMYLLKSFAYAGVAVV

SEQ ID NO: 974794 - protein, 17 aa, Mycobacterium
MALSFASVNGWWYVSNF

SEQ ID NO: 974795 - protein, 25 aa, Mycobacterium
MATEIAKWGEFGMLPSFNARRHPHR

SEQ ID NO: 974796 - protein, 18 aa, Mycobacterium
MEAGCRFIAQLGSMRIAE

SEQ ID NO: 974797 - protein, 21 aa, Mycobacterium
MFTGMAIRIADVWKITRRVGV

SEQ ID NO: 974798 - protein, 21 aa, Mycobacterium
MGIAVLCARILLRKVTPGSYP

SEQ ID NO: 974799 - protein, 24 aa, Mycobacterium
MGIFYLRLPATFGIGTYEVSADFV

SEQ ID NO: 974800 - protein, 19 aa, Mycobacterium
MGWLRLGALVLVAAALAAL

SEQ ID NO: 974801 - protein, 17 aa, Mycobacterium
MLEVSWEALEHAGIDPM

SEQ ID NO: 974802 - protein, 21 aa, Mycobacterium
MLPALQFRYWQWASLALAAPV

SEQ ID NO: 974803 - protein, 22 aa, Mycobacterium
MLPPRRLRLLLSIAAVVLTLDI

SEQ ID NO: 974804 - protein, 23 aa, Mycobacterium
MLPPRRLRLLLSIAAVVLTLDIV

SEQ ID NO: 974805 - protein, 24 aa, Mycobacterium
MNGWPEAIFRFGLYAFLCATALMV

SEQ ID NO: 974806 - protein, 24 aa, Mycobacterium
MPLALRLLLPIAFVLISAGIGVAF

SEQ ID NO: 974807 - protein, 23 aa, Mycobacterium
MPPTSVMGLWTFDGHKGQTEVTT

SEQ ID NO: 974808 - protein, 23 aa, Mycobacterium
MRAGEPRLSAWVRYHSDERLPKE

SEQ ID NO: 974809 - protein, 19 aa, Mycobacterium
MRLRAGSPILFYPAGALAV

SEQ ID NO: 974810 - protein, 21 aa, Mycobacterium
MTELRRGRTCFVIAHRLSTIR

SEQ ID NO: 974811 - protein, 19 aa, Mycobacterium
MWEALRIAAADGFVAAHPD

SEQ ID NO: 974812 - protein, 19 aa, Mycobacterium
MWFLRKAHQLCPAGVVVAT

SEQ ID NO: 974813 - protein, 20 aa, Mycobacterium
MWIGYRQDWGWLHAMDWSLL

SEQ ID NO: 974814 - protein, 17 aa, Mycobacterium
MYGEIFTITAFVCVFGA

SEQ ID NO: 974815 - protein, 17 aa, Mycobacterium
NAGWWPVLWFTAKVWGF

SEQ ID NO: 974816 - protein, 24 aa, Mycobacterium
NCQRAIPHVVGWYRAYKDSGLEVI

SEQ ID NO: 974817 - protein, 22 aa, Mycobacterium
NEVWAHYAGWWAFDIGMLVTFG

SEQ ID NO: 974818 - protein, 20 aa, Mycobacterium
NFPADRGWDVAGLFDPDPDA

SEQ ID NO: 974819 - protein, 19 aa, Mycobacterium
NGIRVRIGIHMGRSVRRGD

SEQ ID NO: 974820 - protein, 24 aa, Mycobacterium
NGLRPEPIIALGILLTWCSVERAV

SEQ ID NO: 974821 - protein, 25 aa, Mycobacterium
NGLRPEPLIALGVLVTWALVERAIA

SEQ ID NO: 974822 - protein, 18 aa, Mycobacterium
NKTWLRFAAVAVVAVVIA

SEQ ID NO: 974823 - protein, 17 aa, Mycobacterium
NLYFGFRIPGSSNYVLA

SEQ ID NO: 974824 - protein, 17 aa, Mycobacterium
NMFMLGVAFVFALAGAM

SEQ ID NO: 974825 - protein, 24 aa, Mycobacterium
NNTEGRWKLGLYAAGRASQMRRMR

SEQ ID NO: 974826 - protein, 19 aa, Mycobacterium
NQLVAWVCIGASALGVVLL

SEQ ID NO: 974827 - protein, 17 aa, Mycobacterium
NRIRERFGLVGLFAGSA

SEQ ID NO: 974828 - protein, 17 aa, Mycobacterium
NRVAHDWLFSEAQSAAD

SEQ ID NO: 974829 - protein, 20 aa, Mycobacterium
NSDLRWAILATRDDWDAYER

SEQ ID NO: 974830 - protein, 19 aa, Mycobacterium
NSLLPRWLSEAGDGSGLLS

SEQ ID NO: 974831 - protein, 20 aa, Mycobacterium
NSPFCWIGGFAFGLLATLLA

SEQ ID NO: 974832 - protein, 17 aa, Mycobacterium
NTIKTNLFWAFGYNVAA

SEQ ID NO: 974833 - protein, 23 aa, Mycobacterium
NVSWIVWQLWLAVILVALWKGRR

SEQ ID NO: 974834 - protein, 23 aa, Mycobacterium
NYFGDACVWWGLWLVTITGWVPL

SEQ ID NO: 974835 - protein, 29 aa, Mycobacterium
NYFHWEPHCFDIPVCWALRSVSDSVDGID

SEQ ID NO: 974836 - protein, 23 aa, Mycobacterium
PACQSGDYSLCWSFTDGGIQPGI

SEQ ID NO: 974837 - protein, 19 aa, Mycobacterium
PAHWLSMLIVLGFQVPVDG

SEQ ID NO: 974838 - protein, 22 aa, Mycobacterium
PAIAALLGRWFWWPRRVPTHAA

SEQ ID NO: 974839 - protein, 19 aa, Mycobacterium
PALLPVVAAAAVWNGAFGG

SEQ ID NO: 974840 - protein, 29 aa, Mycobacterium
PAPIPLPIPIIIPPWPNWSPGMPTPSTVT

SEQ ID NO: 974841 - protein, 20 aa, Mycobacterium
PDLARLDALFARALATEPAG

SEQ ID NO: 974842 - protein, 18 aa, Mycobacterium
PDNLWWLVTVDAMHTQVV

SEQ ID NO: 974843 - protein, 18 aa, Mycobacterium
PDVLRPDLTIAYTDTDGY

SEQ ID NO: 974844 - protein, 20 aa, Mycobacterium
PELDAWWGYPAVIGTMAIIC

SEQ ID NO: 974845 - protein, 17 aa, Mycobacterium
PELSLSLLSVSRSGNTL

SEQ ID NO: 974846 - protein, 22 aa, Mycobacterium
PEVVQWKLKPGVVSTMNAQARY

SEQ ID NO: 974847 - protein, 19 aa, Mycobacterium
PFAGISFLWFIGVVRDGFG

SEQ ID NO: 974848 - protein, 24 aa, Mycobacterium
PFEHARIRLAYGMRLRRLRRYRNA

SEQ ID NO: 974849 - protein, 19 aa, Mycobacterium
PFEHARPTAIMTWMRQHCG

SEQ ID NO: 974850 - protein, 18 aa, Mycobacterium
PFEHARPTAVMTWMRQHC

SEQ ID NO: 974851 - protein, 26 aa, Mycobacterium
PFTGLNTPCRWRWTRRATSTSPIAVT

SEQ ID NO: 974852 - protein, 27 aa, Mycobacterium
PGAAPRWPWVVGVAAILAAISLVVSVS

SEQ ID NO: 974853 - protein, 18 aa, Mycobacterium
PGIAHFFTMWGFFILLTV

SEQ ID NO: 974854 - protein, 21 aa, Mycobacterium
PGPEHPAEWVGPPQEAAPVQP

SEQ ID NO: 974855 - protein, 19 aa, Mycobacterium
PGWVNFWFAVSFVLGPITT

SEQ ID NO: 974856 - protein, 19 aa, Mycobacterium
PHSQFSYFLPDDHEYQITL

SEQ ID NO: 974857 - protein, 19 aa, Mycobacterium
PHYLGFHIVERWQFHYSQV

SEQ ID NO: 974858 - protein, 17 aa, Mycobacterium
PICWSFRSLFDSLDGID

SEQ ID NO: 974859 - protein, 18 aa, Mycobacterium
PILALAVICLSVFVISVD

SEQ ID NO: 974860 - protein, 22 aa, Mycobacterium
PIWQWREHRGPALVAAFAAGLV

SEQ ID NO: 974861 - protein, 22 aa, Mycobacterium
PKPRRRPILLAGRSLAALFAVL

SEQ ID NO: 974862 - protein, 19 aa, Mycobacterium
PKTPRWLWIAAGAAVVLVI

SEQ ID NO: 974863 - protein, 17 aa, Mycobacterium
PLAYCLPGVRSRVVVSE

SEQ ID NO: 974864 - protein, 21 aa, Mycobacterium
PLEGRTAVFTIFYRHDLDGLR

SEQ ID NO: 974865 - protein, 17 aa, Mycobacterium
PLFHDMGLILGICAPLV

SEQ ID NO: 974866 - protein, 20 aa, Mycobacterium
PLFPELRSISLLQVLTGIAS

SEQ ID NO: 974867 - protein, 18 aa, Mycobacterium
PLKAELPASGGLYPTANV

SEQ ID NO: 974868 - protein, 19 aa, Mycobacterium
PLLALCGRRLFWPFIPRAE

SEQ ID NO: 974869 - protein, 17 aa, Mycobacterium
PLMTWQRWALLCVGIAQ

SEQ ID NO: 974870 - protein, 18 aa, Mycobacterium
PLMTWQRWALLCVGIAQI

SEQ ID NO: 974871 - protein, 23 aa, Mycobacterium
PLPGSAPKPVWLGAFAHPERDKR

SEQ ID NO: 974872 - protein, 18 aa, Mycobacterium
PLPTEIYWRRRGLAVGIT

SEQ ID NO: 974873 - protein, 23 aa, Mycobacterium
PLPTEIYWRRRGLAVGITVIVIV

SEQ ID NO: 974874 - protein, 17 aa, Mycobacterium
PMHQVFLGVRSLLYLNG

SEQ ID NO: 974875 - protein, 19 aa, Mycobacterium
PMTKMSIAGPWVSIAAPGT

SEQ ID NO: 974876 - protein, 17 aa, Mycobacterium
PNLRRWLSTEVRPKLKE

SEQ ID NO: 974877 - protein, 21 aa, Mycobacterium
PNRRWWRYTAWFMLALLLATL

SEQ ID NO: 974878 - protein, 27 aa, Mycobacterium
PPAVVRRRLRWWPVIAYGLLPALALLL

SEQ ID NO: 974879 - protein, 24 aa, Mycobacterium
PPDSVWWWVCVSLLALVVLVMAAN

SEQ ID NO: 974880 - protein, 17 aa, Mycobacterium
PPPAMPPTLAWWASSLQ

SEQ ID NO: 974881 - protein, 21 aa, Mycobacterium
PPPRWVWPPLIAVGGVGIVLM

SEQ ID NO: 974882 - protein, 17 aa, Mycobacterium
PPRRLRLLLSVAAVVLA

SEQ ID NO: 974883 - protein, 24 aa, Mycobacterium
PPRRPAHRKLVGWLSAAAGLVLAA

SEQ ID NO: 974884 - protein, 25 aa, Mycobacterium
PPSLFRVAGHRGLRGWQGGHRSADG

SEQ ID NO: 974885 - protein, 29 aa, Mycobacterium
PRGPLPTEIYWRRRGLALGIAVVVIGVAV

SEQ ID NO: 974886 - protein, 21 aa, Mycobacterium
PRGQVVLPFTGLNFRFAPGGV

SEQ ID NO: 974887 - protein, 18 aa, Mycobacterium
PRHRVVIIGSGFGGLNAA

SEQ ID NO: 974888 - protein, 22 aa, Mycobacterium
PRLRSYGGFAYRARWLIIAVVA

SEQ ID NO: 974889 - protein, 20 aa, Mycobacterium
PRLVSLYGTEMWDEMTREQQ

SEQ ID NO: 974890 - protein, 20 aa, Mycobacterium
PRPFIPRMIRTFAVPLILGW

SEQ ID NO: 974891 - protein, 17 aa, Mycobacterium
PRPLRPDWVITRPRLTG

SEQ ID NO: 974892 - protein, 18 aa, Mycobacterium
PRRLRYGAQVTLALSGLV

SEQ ID NO: 974893 - protein, 19 aa, Mycobacterium
PRSSDRFAFFFGLTAINPV

SEQ ID NO: 974894 - protein, 17 aa, Mycobacterium
PRYTCDYGTPSYLPSAA

SEQ ID NO: 974895 - protein, 19 aa, Mycobacterium
PSGVFLRRLIHAPATTTSK

SEQ ID NO: 974896 - protein, 18 aa, Mycobacterium
PTAPRWVGVPLYLLLGWV

SEQ ID NO: 974897 - protein, 23 aa, Mycobacterium
PTEPAHPRWWFVSTTPGRILTIG

SEQ ID NO: 974898 - protein, 17 aa, Mycobacterium
PTRPKRFAWLLGAALAA

SEQ ID NO: 974899 - protein, 19 aa, Mycobacterium
PVAPEAYALYGISRVLPPA

SEQ ID NO: 974900 - protein, 28 aa, Mycobacterium
PVARLWRWLLVFFSRWWQIETLYRSNQK

SEQ ID NO: 974901 - protein, 25 aa, Mycobacterium
PVASPRTWPLVALAIIAIVGVVLGA

SEQ ID NO: 974902 - protein, 23 aa, Mycobacterium
PVFLDWLVGLAFPCQRPFGHQNG

SEQ ID NO: 974903 - protein, 23 aa, Mycobacterium
PVLGELWAPLGLRLHAVHHLFPK

SEQ ID NO: 974904 - protein, 18 aa, Mycobacterium
PVLIPWSVLSLFAPGPTL

SEQ ID NO: 974905 - protein, 24 aa, Mycobacterium
PWSNSFPRLRWSLTTALLELSVIV

SEQ ID NO: 974906 - protein, 19 aa, Mycobacterium
PWTVSVNWWLIVVAFVAFV

SEQ ID NO: 974907 - protein, 18 aa, Mycobacterium
PYALPSMELLVAGDPPKK

SEQ ID NO: 974908 - protein, 17 aa, Mycobacterium
PYARADLVLGIVVVIVG

SEQ ID NO: 974909 - protein, 25 aa, Mycobacterium
PYPAWRELFSNILPAHIVKDVPGGF

SEQ ID NO: 974910 - protein, 17 aa, Mycobacterium
PYSSWLVVRWVIASALG

SEQ ID NO: 974911 - protein, 20 aa, Mycobacterium
PYVREGWAFVAMRLTSTVPI

SEQ ID NO: 974912 - protein, 18 aa, Mycobacterium
QAAALRAGNPIAIAGIPV

SEQ ID NO: 974913 - protein, 22 aa, Mycobacterium
QAEPAAWLRFWFPDPKGSNTEY

SEQ ID NO: 974914 - protein, 17 aa, Mycobacterium
QALSRQGIYGDFFSFYL

SEQ ID NO: 974915 - protein, 23 aa, Mycobacterium
QAYRPELLGGVALVAGTDTFMKE

SEQ ID NO: 974916 - protein, 17 aa, Mycobacterium
QCFPGSFTPVAVAEVPR

SEQ ID NO: 974917 - protein, 21 aa, Mycobacterium
QDRFPAVPFWTWIVGFAALTT

SEQ ID NO: 974918 - protein, 21 aa, Mycobacterium
QDTFLRWVWYAARREGLALDG

SEQ ID NO: 974919 - protein, 23 aa, Mycobacterium
QGACFRLTLPLVRGHKVTTSPLP

SEQ ID NO: 974920 - protein, 17 aa, Mycobacterium
QGFPADVLYEFRLVSLG

SEQ ID NO: 974921 - protein, 20 aa, Mycobacterium
QPLARFGHMIAFYLHTVLAI

SEQ ID NO: 974922 - protein, 19 aa, Mycobacterium
QPVLLDWAVGLAFPCQQPM

SEQ ID NO: 974923 - protein, 29 aa, Mycobacterium
QRDWLRRINWKWVRRSAYLAAAVVILLPI

SEQ ID NO: 974924 - protein, 22 aa, Mycobacterium
QRRRGWRSWALYAAMPAVGVVL

SEQ ID NO: 974925 - protein, 17 aa, Mycobacterium
QRVRLRPILALREAADL

SEQ ID NO: 974926 - protein, 24 aa, Mycobacterium
QSAFRLKTRLLFMPGVMVTSVPWQ

SEQ ID NO: 974927 - protein, 21 aa, Mycobacterium
QSGSIGLGFAIPVDQAKRIAD

SEQ ID NO: 974928 - protein, 23 aa, Mycobacterium
QTKRLLTRWARDYVTIIGALVLP

SEQ ID NO: 974929 - protein, 22 aa, Mycobacterium
QVRLILRRQVRVFLASRLYFVF

SEQ ID NO: 974930 - protein, 17 aa, Mycobacterium
RADAVLILTEWQEFVDL

SEQ ID NO: 974931 - protein, 17 aa, Mycobacterium
RAGDRYLLCSDGLSDPV

SEQ ID NO: 974932 - protein, 19 aa, Mycobacterium
RAMPYMIVILIVGMIIAMV

SEQ ID NO: 974933 - protein, 21 aa, Mycobacterium
RATFLRWIWYAARREGLHLNG

SEQ ID NO: 974934 - protein, 18 aa, Mycobacterium
RATLHFLWLRLARVWPVY

SEQ ID NO: 974935 - protein, 22 aa, Mycobacterium
RDDLRWPPASALVSQNEAVDAL

SEQ ID NO: 974936 - protein, 22 aa, Mycobacterium
REEAARFGVEWLAPKSFVADRL

SEQ ID NO: 974937 - protein, 17 aa, Mycobacterium
REHGIGMSGGRVETPGP

SEQ ID NO: 974938 - protein, 17 aa, Mycobacterium
REWIRLPAIFGAGMVVR

SEQ ID NO: 974939 - protein, 19 aa, Mycobacterium
RFEKAWPLLWFVVIGVVAA

SEQ ID NO: 974940 - protein, 25 aa, Mycobacterium
RGAGLPRWRYLVLPVIGAAVDIYLL

SEQ ID NO: 974941 - protein, 23 aa, Mycobacterium
RGGCSSRVFVALALLTSGAFAGL

SEQ ID NO: 974942 - protein, 24 aa, Mycobacterium
RGGFVTGWMYWYFFVVVVAVETVA

SEQ ID NO: 974943 - protein, 17 aa, Mycobacterium
RGGLFVRQVHHWAALMF

SEQ ID NO: 974944 - protein, 18 aa, Mycobacterium
RGGLLLRILRQFHHPLIY

SEQ ID NO: 974945 - protein, 17 aa, Mycobacterium
RGPLWLIILGFSAGVAL

SEQ ID NO: 974946 - protein, 21 aa, Mycobacterium
RGRNPWPIVAAVAIVLVLIVG

SEQ ID NO: 974947 - protein, 19 aa, Mycobacterium
RGRRLRFRPGRAVTGVALL

SEQ ID NO: 974948 - protein, 17 aa, Mycobacterium
RGVALWLLLGGFFGLAL

SEQ ID NO: 974949 - protein, 19 aa, Mycobacterium
RHCVRRFGGITGDVLGCAI

SEQ ID NO: 974950 - protein, 18 aa, Mycobacterium
RHLRIPLCEVMWGSDVAL

SEQ ID NO: 974951 - protein, 17 aa, Mycobacterium
RILGHAADLLFNGVIGR

SEQ ID NO: 974952 - protein, 22 aa, Mycobacterium
RIPDKRWFGWFALLTIPAPFLA

SEQ ID NO: 974953 - protein, 18 aa, Mycobacterium
RKLRVGFAKAGRLMDLME

SEQ ID NO: 974954 - protein, 19 aa, Mycobacterium
RKLRVGFAKAGRLMDLMET

SEQ ID NO: 974955 - protein, 22 aa, Mycobacterium
RKTAAWSWRLLVILAALVALLL

SEQ ID NO: 974956 - protein, 18 aa, Mycobacterium
RLDALKILSLDATDDDEF

SEQ ID NO: 974957 - protein, 19 aa, Mycobacterium
RLFGHIPYRIDIDIYQMGG

SEQ ID NO: 974958 - protein, 18 aa, Mycobacterium
RLFPRAMLHFEDFGPTNA

SEQ ID NO: 974959 - protein, 18 aa, Mycobacterium
RLGLAVGVALTFTFLWFV

SEQ ID NO: 974960 - protein, 17 aa, Mycobacterium
RLGWPLWAAYVSVFALT

SEQ ID NO: 974961 - protein, 18 aa, Mycobacterium
RLHDEWKFQPAFTAEESV

SEQ ID NO: 974962 - protein, 18 aa, Mycobacterium
RLPGFDWPAHPSWLYRLT

SEQ ID NO: 974963 - protein, 23 aa, Mycobacterium
RLPRRYWAVVSFLVLFSIANFPD

SEQ ID NO: 974964 - protein, 20 aa, Mycobacterium
RLRKDLTWRDLVVFGVSVVI

SEQ ID NO: 974965 - protein, 18 aa, Mycobacterium
RLRYDQFMALGWKLLIPV

SEQ ID NO: 974966 - protein, 18 aa, Mycobacterium
RLSLIPVLIGTAIAIPLG

SEQ ID NO: 974967 - protein, 17 aa, Mycobacterium
RLSRNLRRFRWLVFTGW

SEQ ID NO: 974968 - protein, 19 aa, Mycobacterium
RLTIFQPYSWVAAAAVLVL

SEQ ID NO: 974969 - protein, 18 aa, Mycobacterium
RLVIVGANIGRLILIAGI

SEQ ID NO: 974970 - protein, 19 aa, Mycobacterium
RLYLDGGLQFSTRDEYRYT

SEQ ID NO: 974971 - protein, 26 aa, Mycobacterium
RMIRTFAVPLILGWVLLIAVLNSVVP

SEQ ID NO: 974972 - protein, 26 aa, Mycobacterium
RNLRRFRWLVFTGWMLALVPAIYLAL

SEQ ID NO: 974973 - protein, 22 aa, Mycobacterium
RNRPGWEWLKWLPHNQHPSHHD

SEQ ID NO: 974974 - protein, 22 aa, Mycobacterium
RNWKVSRAYLNWLADRLQKTKT

SEQ ID NO: 974975 - protein, 18 aa, Mycobacterium
RPAQLGGLVFVSAFTVVT

SEQ ID NO: 974976 - protein, 18 aa, Mycobacterium
RPAVMVLGVLTWVNVWND

SEQ ID NO: 974977 - protein, 20 aa, Mycobacterium
RPDIPATFDAVIARGMAKRP

SEQ ID NO: 974978 - protein, 17 aa, Mycobacterium
RPEELPRVWALINATSA

SEQ ID NO: 974979 - protein, 20 aa, Mycobacterium
RPFLHEITEVMAYRESMRSS

SEQ ID NO: 974980 - protein, 17 aa, Mycobacterium
RPGDLLYGLHAMLFNEP

SEQ ID NO: 974981 - protein, 18 aa, Mycobacterium
RPLGEIISAGKLSFPISA

SEQ ID NO: 974982 - protein, 19 aa, Mycobacterium
RPNWTLLRKTVRDLRRRPA

SEQ ID NO: 974983 - protein, 19 aa, Mycobacterium
RPRLPRVLAAIALGVLPLG

SEQ ID NO: 974984 - protein, 24 aa, Mycobacterium
RPRNPRPAIIVVILLVVLTGVVWT

SEQ ID NO: 974985 - protein, 17 aa, Mycobacterium
RPRVVPRAASPQLPAPA

SEQ ID NO: 974986 - protein, 20 aa, Mycobacterium
RPSGGIPLLVVLSVLAVAVA

SEQ ID NO: 974987 - protein, 17 aa, Mycobacterium
RPTPGFPASGVVALCDF

SEQ ID NO: 974988 - protein, 20 aa, Mycobacterium
RQARCRPDHPFLVCDSDRIS

SEQ ID NO: 974989 - protein, 21 aa, Mycobacterium
RRADLAMTWLVAGLVAGILSG

SEQ ID NO: 974990 - protein, 19 aa, Mycobacterium
RRAMMLAHWAWLSMLLAGG

SEQ ID NO: 974991 - protein, 21 aa, Mycobacterium
RRGKLILCAAVGVLSVVVRAI

SEQ ID NO: 974992 - protein, 17 aa, Mycobacterium
RRIKPATLIAGLVAVAL

SEQ ID NO: 974993 - protein, 20 aa, Mycobacterium
RRILPFVGRIAGVIVLITGL

SEQ ID NO: 974994 - protein, 21 aa, Mycobacterium
RRLDEAAGFAIPFVPRGLDEI

SEQ ID NO: 974995 - protein, 17 aa, Mycobacterium
RRLDMLAGYGTAFSLAA

SEQ ID NO: 974996 - protein, 22 aa, Mycobacterium
RRLPGWPIWFAVLWGAQEWLKS

SEQ ID NO: 974997 - protein, 18 aa, Mycobacterium
RRMLCGLQLPGPNNQQTA

SEQ ID NO: 974998 - protein, 27 aa, Mycobacterium
RRPHPKSSWAAVLAWVVLPSLALLLAI

SEQ ID NO: 974999 - protein, 19 aa, Mycobacterium
RRPSIRFCARWCDRCALRL

SEQ ID NO: 975000 - protein, 18 aa, Mycobacterium
RRRTRLAIWVALSAAAVF

SEQ ID NO: 975001 - protein, 23 aa, Mycobacterium
RRVGTAIVRWPLPILAVTCAVAL

SEQ ID NO: 975002 - protein, 20 aa, Mycobacterium
RRVSDGWAFLCIAVVVAAVV

SEQ ID NO: 975003 - protein, 24 aa, Mycobacterium
RRVTRWEWTWAVLLAVSLAVVVIV

SEQ ID NO: 975004 - protein, 19 aa, Mycobacterium
RRWLPGQLLQGIGVGATLP

SEQ ID NO: 975005 - protein, 21 aa, Mycobacterium
RSFAEGVGWLAQIGLFVLLGL

SEQ ID NO: 975006 - protein, 29 aa, Mycobacterium
RSGIRFWSRRAWLAWPLGLLASGLTMFFG

SEQ ID NO: 975007 - protein, 17 aa, Mycobacterium
RSIKPPVFVPASLVIVT

SEQ ID NO: 975008 - protein, 25 aa, Mycobacterium
RSIYKFAVPIALFWLAVCAIIAAFV

SEQ ID NO: 975009 - protein, 18 aa, Mycobacterium
RSRARLMRLMRPLILLPL

SEQ ID NO: 975010 - protein, 22 aa, Mycobacterium
RSRIGMVLQDTWLLAGTIAENI

SEQ ID NO: 975011 - protein, 18 aa, Mycobacterium
RSRWFVTRMTTITSLDLT

SEQ ID NO: 975012 - protein, 19 aa, Mycobacterium
RSSLLPPRITQIIMGIDSI

SEQ ID NO: 975013 - protein, 18 aa, Mycobacterium
RSSVLWLLPLLVIAFADR

SEQ ID NO: 975014 - protein, 21 aa, Mycobacterium
RTAFRVPFLRNWKVSRAYLNW

SEQ ID NO: 975015 - protein, 18 aa, Mycobacterium
RTIPRAIVLIALIGGAIF

SEQ ID NO: 975016 - protein, 24 aa, Mycobacterium
RTLGIPCAVGMLLAVVVALTLGPA

SEQ ID NO: 975017 - protein, 21 aa, Mycobacterium
RTLPELWKLLGHIDAVHGFYY

SEQ ID NO: 975018 - protein, 17 aa, Mycobacterium
RTPWLVPGWLFLSAVVY

SEQ ID NO: 975019 - protein, 17 aa, Mycobacterium
RTVKLNLAWAFGYNIAA

SEQ ID NO: 975020 - protein, 25 aa, Mycobacterium
RVIPPSMLRRAMPVLIVILIVGMII

SEQ ID NO: 975021 - protein, 23 aa, Mycobacterium
RVRAVDVARLWALVVVMFGHRAL

SEQ ID NO: 975022 - protein, 17 aa, Mycobacterium
RVSEDQIMLSAKADLAK

SEQ ID NO: 975023 - protein, 19 aa, Mycobacterium
RVSYFYDFRGPSVAIDTAC

SEQ ID NO: 975024 - protein, 18 aa, Mycobacterium
RWALIFSAGCVFWAAVTA

SEQ ID NO: 975025 - protein, 19 aa, Mycobacterium
RWFWWPRRVPTHAASPPAV

SEQ ID NO: 975026 - protein, 18 aa, Mycobacterium
RWGEYFAVVATSVFLPLE

SEQ ID NO: 975027 - protein, 20 aa, Mycobacterium
RWNSIVALVLSVLVILGLVV

SEQ ID NO: 975028 - protein, 19 aa, Mycobacterium
RWQRLRTLMVISGPGLIVM

SEQ ID NO: 975029 - protein, 18 aa, Mycobacterium
RYGGYALAGVSSFGFGGA

SEQ ID NO: 975030 - protein, 18 aa, Mycobacterium
RYPLKGIFHAAGVLDDAV

SEQ ID NO: 975031 - protein, 20 aa, Mycobacterium
RYRHIPAMLLALSLVLFTVA

SEQ ID NO: 975032 - protein, 25 aa, Mycobacterium
SADLDWRSVWDRGWSAAAEAQETPV

SEQ ID NO: 975033 - protein, 20 aa, Mycobacterium
SADWGHAVVLVFVDQTTVIG

SEQ ID NO: 975034 - protein, 18 aa, Mycobacterium
SALCFVSAVVLLYVDIDR

SEQ ID NO: 975035 - protein, 18 aa, Mycobacterium
SAPKRWNAPAAMACATGS

SEQ ID NO: 975036 - protein, 19 aa, Mycobacterium
SAVNWFWLLAFAIAAIIRA

SEQ ID NO: 975037 - protein, 17 aa, Mycobacterium
SAVPRGWARARKTIVSG

SEQ ID NO: 975038 - protein, 17 aa, Mycobacterium
SAVWWKVTLPLLMPGLV

SEQ ID NO: 975039 - protein, 24 aa, Mycobacterium
SDETKLPFCWRGVSLHAGGAGRVR

SEQ ID NO: 975040 - protein, 23 aa, Mycobacterium
SDGHSAMAMVWLVGQAGSTQARE

SEQ ID NO: 975041 - protein, 17 aa, Mycobacterium
SEFAVSLALVLLMLPVI

SEQ ID NO: 975042 - protein, 17 aa, Mycobacterium
SELMFFAGLFAMYFTAR

SEQ ID NO: 975043 - protein, 17 aa, Mycobacterium
SELSWGVVGAWTGSAAA

SEQ ID NO: 975044 - protein, 25 aa, Mycobacterium
SEQRSGSGWIWWFGGAWLVAAVVGA

SEQ ID NO: 975045 - protein, 26 aa, Mycobacterium
SFPVVAYRAWRWWLATAVAFFAVAAL

SEQ ID NO: 975046 - protein, 24 aa, Mycobacterium
SFVIGRPLIWLSFRNEKLNAAFRY

SEQ ID NO: 975047 - protein, 22 aa, Mycobacterium
SFYWGHHFGRLFAHPDSEQLLL

SEQ ID NO: 975048 - protein, 20 aa, Mycobacterium
SGLWSWLKWLPHVDIPGQAD

SEQ ID NO: 975049 - protein, 19 aa, Mycobacterium
SGNRAFWIIAAVFVVGILG

SEQ ID NO: 975050 - protein, 19 aa, Mycobacterium
SGSLTSVWLLLGLLAISAV

SEQ ID NO: 975051 - protein, 24 aa, Mycobacterium
SHFQRAVLRIGNYLIVLAAALVAL

SEQ ID NO: 975052 - protein, 24 aa, Mycobacterium
SIATLLGRWFWWPQVVHPRGDNAR

SEQ ID NO: 975053 - protein, 20 aa, Mycobacterium
SKFTTSMLWSGDRAWRQAGE

SEQ ID NO: 975054 - protein, 19 aa, Mycobacterium
SKYTISMLWSGDRAWRQSG

SEQ ID NO: 975055 - protein, 20 aa, Mycobacterium
SKYTISMLWSGDRAWRQSGE

SEQ ID NO: 975056 - protein, 18 aa, Mycobacterium
SLAGYAFARLEFRGRDTL

SEQ ID NO: 975057 - protein, 19 aa, Mycobacterium
SLRKRGCAAMRTGMERTST

SEQ ID NO: 975058 - protein, 21 aa, Mycobacterium
SLWMSIRFIRRIAFFSYVITI

SEQ ID NO: 975059 - protein, 18 aa, Mycobacterium
SLWWSWAWIAGMIGYAGD

SEQ ID NO: 975060 - protein, 25 aa, Mycobacterium
SMFIPRFLFALSFCGLGVTTASYMF

SEQ ID NO: 975061 - protein, 18 aa, Mycobacterium
SPCSIGLLAVILASLTLA

SEQ ID NO: 975062 - protein, 19 aa, Mycobacterium
SPHVYRPGLPMPATEHGAV

SEQ ID NO: 975063 - protein, 21 aa, Mycobacterium
SPLVRWIIKVPREFINSYLFN

SEQ ID NO: 975064 - protein, 23 aa, Mycobacterium
SPRYLRFGWAAARLDDLANYFGA

SEQ ID NO: 975065 - protein, 25 aa, Mycobacterium
SRFNYRIPVSLAWTRTSGPAKSDGT

SEQ ID NO: 975066 - protein, 17 aa, Mycobacterium
SRLRRPGAVVLEIDDED

SEQ ID NO: 975067 - protein, 18 aa, Mycobacterium
SRLRRPGAVVLEIDDEDP

SEQ ID NO: 975068 - protein, 19 aa, Mycobacterium
SRLRRPGAVVLEIDDEDPI

SEQ ID NO: 975069 - protein, 20 aa, Mycobacterium
SRWPGSLGWFTNRLLVPAVL

SEQ ID NO: 975070 - protein, 22 aa, Mycobacterium
SSALLQWGWRVPFLLSALLIAF

SEQ ID NO: 975071 - protein, 17 aa, Mycobacterium
SSITLSGIWLLIVPSEL

SEQ ID NO: 975072 - protein, 22 aa, Mycobacterium
SSLWMSIRFIRRIAFFSYVITI

SEQ ID NO: 975073 - protein, 20 aa, Mycobacterium
STDALLRFAMRADATLTGLM

SEQ ID NO: 975074 - protein, 17 aa, Mycobacterium
STFPLAVPLEWNVLFAY

SEQ ID NO: 975075 - protein, 25 aa, Mycobacterium
STQSRFWTRWVGWVMHRPWITALSA

SEQ ID NO: 975076 - protein, 17 aa, Mycobacterium
STVARLANHPSFGRRDL

SEQ ID NO: 975077 - protein, 20 aa, Mycobacterium
STVPLVVAIALSLLAMLLIR

SEQ ID NO: 975078 - protein, 17 aa, Mycobacterium
SVWYLLWLVAAAALGYV

SEQ ID NO: 975079 - protein, 25 aa, Mycobacterium
SWFLRFLLRHSMYWFVGYRVVVGVV

SEQ ID NO: 975080 - protein, 23 aa, Mycobacterium
SWLGRFVSTYGWRAYALPVLMVL

SEQ ID NO: 975081 - protein, 18 aa, Mycobacterium
SWPALRPTATLFLVGTAV

SEQ ID NO: 975082 - protein, 17 aa, Mycobacterium
SWSTRATLHFLWLRLAR

SEQ ID NO: 975083 - protein, 18 aa, Mycobacterium
SYGWLVWVFVAMFGVGLI

SEQ ID NO: 975084 - protein, 17 aa, Mycobacterium
TAALGWLWKEQRDNEIA

SEQ ID NO: 975085 - protein, 19 aa, Mycobacterium
TAGVLRWQYDTMRYAQIAG

SEQ ID NO: 975086 - protein, 21 aa, Mycobacterium
TAHPRLRVHWVPRRDETSLAE

SEQ ID NO: 975087 - protein, 20 aa, Mycobacterium
TALCLFTAVFIMLRRKRVAG

SEQ ID NO: 975088 - protein, 18 aa, Mycobacterium
TALMSWCIVAAQVVMVPV

SEQ ID NO: 975089 - protein, 21 aa, Mycobacterium
TATLQRLLPRLGIGSSADPQA

SEQ ID NO: 975090 - protein, 20 aa, Mycobacterium
TAYLVMCGFIFVATQYLQFV

SEQ ID NO: 975091 - protein, 18 aa, Mycobacterium
TCALAALCYAEFASTLPV

SEQ ID NO: 975092 - protein, 26 aa, Mycobacterium
TDAGVGRPWASWMMPKMISPIRTAIN

SEQ ID NO: 975093 - protein, 17 aa, Mycobacterium
TDILQRWTRGVMSTVGE

SEQ ID NO: 975094 - protein, 17 aa, Mycobacterium
TDIRLSQWFLLTAAFGS

SEQ ID NO: 975095 - protein, 22 aa, Mycobacterium
TDKPVWITMLWPLADRPRLAPG

SEQ ID NO: 975096 - protein, 19 aa, Mycobacterium
TDPVIGCAAALEAHGALVT

SEQ ID NO: 975097 - protein, 17 aa, Mycobacterium
TDWPRYGGYALAGVSSF

SEQ ID NO: 975098 - protein, 27 aa, Mycobacterium
TEATMLWLRNWLRAHRRQIIAVAVGLA

SEQ ID NO: 975099 - protein, 19 aa, Mycobacterium
TEFALRPVAAMALAAGPPL

SEQ ID NO: 975100 - protein, 20 aa, Mycobacterium
TEIYWRRRGLAVGITVIVIV

SEQ ID NO: 975101 - protein, 17 aa, Mycobacterium
TEPRGQVVLPFTGLNFR

SEQ ID NO: 975102 - protein, 20 aa, Mycobacterium
TERHVRLWVVYVDDFSGQSA

SEQ ID NO: 975103 - protein, 22 aa, Mycobacterium
TFAVEMALMFAVPAGPAMARSF

SEQ ID NO: 975104 - protein, 17 aa, Mycobacterium
TFGWVWLIKRVLAGLRW

SEQ ID NO: 975105 - protein, 18 aa, Mycobacterium
TGFARIVLLAAILGAALS

SEQ ID NO: 975106 - protein, 17 aa, Mycobacterium
TGIALSIAALAPVGAAL

SEQ ID NO: 975107 - protein, 17 aa, Mycobacterium
TGLNWPTAFLVGAILSP

SEQ ID NO: 975108 - protein, 19 aa, Mycobacterium
TGMSVDWPAVFAGSGATRV

SEQ ID NO: 975109 - protein, 19 aa, Mycobacterium
TGPDRGRCAMYFVAQAVSY

SEQ ID NO: 975110 - protein, 25 aa, Mycobacterium
TGSPAWEMFKPWAITSIAVAVAVAL

SEQ ID NO: 975111 - protein, 17 aa, Mycobacterium
TGSVVVWYSPRRCDRAA

SEQ ID NO: 975112 - protein, 17 aa, Mycobacterium
TIASWWLHRQCGYHTPV

SEQ ID NO: 975113 - protein, 19 aa, Mycobacterium
TIFYWGWWISWAPFVGMFI

SEQ ID NO: 975114 - protein, 19 aa, Mycobacterium
TKRALPWQPLPDVVMLEAK

SEQ ID NO: 975115 - protein, 17 aa, Mycobacterium
TLNRSRLGRGWLTGIAV

SEQ ID NO: 975116 - protein, 17 aa, Mycobacterium
TLTKGWQRLLGTVLGVP

SEQ ID NO: 975117 - protein, 18 aa, Mycobacterium
TMFIPRFLFAVTFCGVLV

SEQ ID NO: 975118 - protein, 23 aa, Mycobacterium
TMRTIRTNMIWAFGYNVAAIPIA

SEQ ID NO: 975119 - protein, 17 aa, Mycobacterium
TNFKTGPAILGIADISN

SEQ ID NO: 975120 - protein, 23 aa, Mycobacterium
TNRLRLGLNIPYLLLLLAFVVYD

SEQ ID NO: 975121 - protein, 18 aa, Mycobacterium
TPLRRLDMLAGYGTAFSL

SEQ ID NO: 975122 - protein, 18 aa, Mycobacterium
TPPAPVIIKPGADAAAQF

SEQ ID NO: 975123 - protein, 18 aa, Mycobacterium
TPPRAVAIITQIASALDA

SEQ ID NO: 975124 - protein, 19 aa, Mycobacterium
TPSVGRWVAVVAVLAVLTI

SEQ ID NO: 975125 - protein, 22 aa, Mycobacterium
TRKRFGDTMGYRMVIYPEYAVL

SEQ ID NO: 975126 - protein, 17 aa, Mycobacterium
TRLATWVAEPGHTATPA

SEQ ID NO: 975127 - protein, 22 aa, Mycobacterium
TRLYLPMPFFWVGGFGGGILSA

SEQ ID NO: 975128 - protein, 19 aa, Mycobacterium
TRMVAAWVITLPLAGLVGT

SEQ ID NO: 975129 - protein, 28 aa, Mycobacterium
TRRWRRIGTIVVRWPGPVLVAAALISLI

SEQ ID NO: 975130 - protein, 17 aa, Mycobacterium
TSPPWAFFSLPTRAWEL

SEQ ID NO: 975131 - protein, 25 aa, Mycobacterium
TTLVRLELPLAWPVIMTGVRVSAQM

SEQ ID NO: 975132 - protein, 24 aa, Mycobacterium
TVHRPRWSWRRMALVAELVVLLVV

SEQ ID NO: 975133 - protein, 18 aa, Mycobacterium
TVIIRFWLLTAIACGLGV

SEQ ID NO: 975134 - protein, 18 aa, Mycobacterium
TVISLVFRFDLTRITLTG

SEQ ID NO: 975135 - protein, 22 aa, Mycobacterium
TVSACLLVFVTVWFALRDTARA

SEQ ID NO: 975136 - protein, 23 aa, Mycobacterium
VAALLGRWFWWPLRVRPRPASYM

SEQ ID NO: 975137 - protein, 26 aa, Mycobacterium
VAGIVEWPILLAVGGSALLLRRMSQR

SEQ ID NO: 975138 - protein, 17 aa, Mycobacterium
VALAGRRLWHRFRGQPD

SEQ ID NO: 975139 - protein, 18 aa, Mycobacterium
VALGKPVWDRPIGGLLAT

SEQ ID NO: 975140 - protein, 18 aa, Mycobacterium
VALVLLIPVLMYLVMTSS

SEQ ID NO: 975141 - protein, 23 aa, Mycobacterium
VAMPWLFLRLRFFRRKWTVTALA

SEQ ID NO: 975142 - protein, 23 aa, Mycobacterium
VAQTEIFPLLTLSVGGMMVFPAA

SEQ ID NO: 975143 - protein, 22 aa, Mycobacterium
VATRAAMAVVCAGDGVAAGTTG

SEQ ID NO: 975144 - protein, 20 aa, Mycobacterium
VATVLSIWQAVLVRRLVRAA

SEQ ID NO: 975145 - protein, 17 aa, Mycobacterium
VCPLRILPRLKLHEQGC

SEQ ID NO: 975146 - protein, 18 aa, Mycobacterium
VCVVLRLARFNALLDDGT

SEQ ID NO: 975147 - protein, 23 aa, Mycobacterium
VDRALGWALRFFAAVAVYNAVSM

SEQ ID NO: 975148 - protein, 17 aa, Mycobacterium
VEALGRVDMVCFDKTET

SEQ ID NO: 975149 - protein, 23 aa, Mycobacterium
VEISGFIAWLAWLVLHLVYLVGF

SEQ ID NO: 975150 - protein, 20 aa, Mycobacterium
VEMPNALPLILGGLRSATLQ

SEQ ID NO: 975151 - protein, 19 aa, Mycobacterium
VFCGLLWWMAFGLHSKHLV

SEQ ID NO: 975152 - protein, 19 aa, Mycobacterium
VFFPWNLYFGFRIPGSSNY

SEQ ID NO: 975153 - protein, 20 aa, Mycobacterium
VFGQIRFDRTYAYSAEFSNA

SEQ ID NO: 975154 - protein, 26 aa, Mycobacterium
VGALAVFCAVCWLIALLARNYRHEDW

SEQ ID NO: 975155 - protein, 17 aa, Mycobacterium
VGFIPFVIAMGIGLGVS

SEQ ID NO: 975156 - protein, 17 aa, Mycobacterium
VGIALVFLVARSFSSGC

SEQ ID NO: 975157 - protein, 19 aa, Mycobacterium
VGQFIRRLFSFLVRQLDRI

SEQ ID NO: 975158 - protein, 19 aa, Mycobacterium
VGSAVAWGIVTVSIKPVAT

SEQ ID NO: 975159 - protein, 18 aa, Mycobacterium
VGSLLSWMLYVGLLITVA

SEQ ID NO: 975160 - protein, 24 aa, Mycobacterium
VGSLRPSLSWLWPSGLDFGTQMAP

SEQ ID NO: 975161 - protein, 17 aa, Mycobacterium
VIIRFWLLTAIACGLGV

SEQ ID NO: 975162 - protein, 18 aa, Mycobacterium
VIMPTFFGVFPILRNVVV

SEQ ID NO: 975163 - protein, 24 aa, Mycobacterium
VIQRCARTPLATGLEVRAAGFTAI

SEQ ID NO: 975164 - protein, 17 aa, Mycobacterium
VIVCWRMGRQLRGQRSA

SEQ ID NO: 975165 - protein, 22 aa, Mycobacterium
VKSAWDLLWRYGGQYVATALAQ

SEQ ID NO: 975166 - protein, 18 aa, Mycobacterium
VLAAWGWFALLLQITGAI

SEQ ID NO: 975167 - protein, 18 aa, Mycobacterium
VLAVIWFWLLKRYIVEGP

SEQ ID NO: 975168 - protein, 20 aa, Mycobacterium
VLLFCIAFGLSMDYEVFLVA

SEQ ID NO: 975169 - protein, 19 aa, Mycobacterium
VLLSYSGTLAFIAGFVNAV

SEQ ID NO: 975170 - protein, 21 aa, Mycobacterium
VLLVTSWLLAKSMGYLDRGVQ

SEQ ID NO: 975171 - protein, 21 aa, Mycobacterium
VLQACVFWRGMEAIRKFIDFC

SEQ ID NO: 975172 - protein, 24 aa, Mycobacterium
VLRWSRNRMAFLAALLFTLALCWA

SEQ ID NO: 975173 - protein, 25 aa, Mycobacterium
VLSVLAVAVAIFWIVMRYRASRRRT

SEQ ID NO: 975174 - protein, 19 aa, Mycobacterium
VLVILRLLYDIGMGGEWGL

SEQ ID NO: 975175 - protein, 17 aa, Mycobacterium
VMRWRWRVAFYALTVLG

SEQ ID NO: 975176 - protein, 17 aa, Mycobacterium
VMTASVWIAWPPEVLSS

SEQ ID NO: 975177 - protein, 17 aa, Mycobacterium
VMTLPWLLAIAAVYVIL

SEQ ID NO: 975178 - protein, 17 aa, Mycobacterium
VPRILGHAADLLFNGVI

SEQ ID NO: 975179 - protein, 18 aa, Mycobacterium
VQAAVPFYGVYDFTRFDD

SEQ ID NO: 975180 - protein, 19 aa, Mycobacterium
VQKAIPILGEFVTNSVVTH

SEQ ID NO: 975181 - protein, 17 aa, Mycobacterium
VQVWSLWSTTLRRLAEG

SEQ ID NO: 975182 - protein, 19 aa, Mycobacterium
VRASWPWAVAVFIVVVFVG

SEQ ID NO: 975183 - protein, 19 aa, Mycobacterium
VRGAMKVAWDKFKGATGKL

SEQ ID NO: 975184 - protein, 17 aa, Mycobacterium
VRGARNYPCQEFPGKRA

SEQ ID NO: 975185 - protein, 18 aa, Mycobacterium
VRSLPDFWRLLQVRIASQ

SEQ ID NO: 975186 - protein, 17 aa, Mycobacterium
VSALHRPVPLSGEGSDT

SEQ ID NO: 975187 - protein, 18 aa, Mycobacterium
VSALHRPVPLSGEGSDTD

SEQ ID NO: 975188 - protein, 19 aa, Mycobacterium
VSFGYRPGVPVIRDVSLQL

SEQ ID NO: 975189 - protein, 17 aa, Mycobacterium
VSGCSLALFAVLTKAVV

SEQ ID NO: 975190 - protein, 21 aa, Mycobacterium
VSGWRSGALGSMLSFAGVLLG

SEQ ID NO: 975191 - protein, 19 aa, Mycobacterium
VSIPSLWQPYVLSVASLTA

SEQ ID NO: 975192 - protein, 17 aa, Mycobacterium
VSLPLLWWRFRRDDRAA

SEQ ID NO: 975193 - protein, 17 aa, Mycobacterium
VSLPLLWWRYRRDDRSA

SEQ ID NO: 975194 - protein, 18 aa, Mycobacterium
VSLPLLWWRYRRDDRSAL

SEQ ID NO: 975195 - protein, 17 aa, Mycobacterium
VSVFAYRARLVLGQLAV

SEQ ID NO: 975196 - protein, 17 aa, Mycobacterium
VVCFVGFLASYLFNVYV

SEQ ID NO: 975197 - protein, 19 aa, Mycobacterium
VVCMFWRLFMQDNLPHDGA

SEQ ID NO: 975198 - protein, 20 aa, Mycobacterium
VVGCGVDIVALKPVLEAATS

SEQ ID NO: 975199 - protein, 20 aa, Mycobacterium
VVGVIGWRFFGDVLSNRSQT

SEQ ID NO: 975200 - protein, 22 aa, Mycobacterium
VVGWASGLGFGWMFTLGTANVV

SEQ ID NO: 975201 - protein, 19 aa, Mycobacterium
VVSLIGWWALSRLLERMRG

SEQ ID NO: 975202 - protein, 18 aa, Mycobacterium
VWGRRGAPLLLVFSVAAR

SEQ ID NO: 975203 - protein, 19 aa, Mycobacterium
VWVSLCIVFALLGLYLTYV

SEQ ID NO: 975204 - protein, 17 aa, Mycobacterium
VYTTRWWLSGLLVGVAA

SEQ ID NO: 975205 - protein, 18 aa, Mycobacterium
VYVLPLLLLVGLFVMFSR

SEQ ID NO: 975206 - protein, 24 aa, Mycobacterium
WAAWPFHRIALRNARHHGASMETL

SEQ ID NO: 975207 - protein, 18 aa, Mycobacterium
WALFMVTVTYVWKNLGYT

SEQ ID NO: 975208 - protein, 20 aa, Mycobacterium
WAMPELVARVALAGLAVRAV

SEQ ID NO: 975209 - protein, 19 aa, Mycobacterium
WARVRGRILALIGLALLEG

SEQ ID NO: 975210 - protein, 18 aa, Mycobacterium
WASARTAAGFALAVVLLA

SEQ ID NO: 975211 - protein, 26 aa, Mycobacterium
WAVIPGCWVFALGVFLFWLLTTSRAD

SEQ ID NO: 975212 - protein, 20 aa, Mycobacterium
WCLVRTRWGRRVARFLPVIG

SEQ ID NO: 975213 - protein, 22 aa, Mycobacterium
WDGVVPRLAERFRILRYDNRGV

SEQ ID NO: 975214 - protein, 17 aa, Mycobacterium
WEIRDFRTARKAARIGV

SEQ ID NO: 975215 - protein, 25 aa, Mycobacterium
WEKHCFDIPVCWSLRSVFDTLDGVD

SEQ ID NO: 975216 - protein, 26 aa, Mycobacterium
WERHGSDIPICWSLRSLFDAIDGVDK

SEQ ID NO: 975217 - protein, 17 aa, Mycobacterium
WGITCFITAVAGLMQIL

SEQ ID NO: 975218 - protein, 25 aa, Mycobacterium
WGNCTIKVMVGFLFLYPAFVAKAHD

SEQ ID NO: 975219 - protein, 17 aa, Mycobacterium
WGVVGAWTGSAAAGLLV

SEQ ID NO: 975220 - protein, 21 aa, Mycobacterium
WIAVILLTFHWARVVWQRTIV

SEQ ID NO: 975221 - protein, 17 aa, Mycobacterium
WIGGFAFGLLATLLAGS

SEQ ID NO: 975222 - protein, 17 aa, Mycobacterium
WIRLPAIFGAGMVVRAT

SEQ ID NO: 975223 - protein, 18 aa, Mycobacterium
WIRRARRLLPALVLMVLT

SEQ ID NO: 975224 - protein, 19 aa, Mycobacterium
WITQRLWWALLLTIGFWGL

SEQ ID NO: 975225 - protein, 18 aa, Mycobacterium
WKLLIPVSLVWVLIAAVI

SEQ ID NO: 975226 - protein, 21 aa, Mycobacterium
WLAKFEPMHQVFLGVRSLLYL

SEQ ID NO: 975227 - protein, 19 aa, Mycobacterium
WLFHDWRDVFWINVPLTAI

SEQ ID NO: 975228 - protein, 23 aa, Mycobacterium
WLGLSWRWLFGLSIIPALISLII

SEQ ID NO: 975229 - protein, 18 aa, Mycobacterium
WLHVPLLPIPIPIRVPAS

SEQ ID NO: 975230 - protein, 21 aa, Mycobacterium
WLISSFGWHWIFLVNLPIGLA

SEQ ID NO: 975231 - protein, 18 aa, Mycobacterium
WLLAKSMGYLDRGVQVVA

SEQ ID NO: 975232 - protein, 22 aa, Mycobacterium
WLPARWRHWWWGLLLAFVPTHL

SEQ ID NO: 975233 - protein, 17 aa, Mycobacterium
WLPQRSVLIPGTVRDNL

SEQ ID NO: 975234 - protein, 17 aa, Mycobacterium
WNVFFIFSLFYLFGHYG

SEQ ID NO: 975235 - protein, 19 aa, Mycobacterium
WPAFLAYLVSFVFIGSSWL

SEQ ID NO: 975236 - protein, 21 aa, Mycobacterium
WPMFAWFCVYAYRKFVRYEET

SEQ ID NO: 975237 - protein, 23 aa, Mycobacterium
WRITLPSIRWGLTYGIVLTVART

SEQ ID NO: 975238 - protein, 21 aa, Mycobacterium
WRKRLPTIFLDVARFALIGIG

SEQ ID NO: 975239 - protein, 18 aa, Mycobacterium
WRLNRLVPHGAVDRLDER

SEQ ID NO: 975240 - protein, 18 aa, Mycobacterium
WRNLRFPLAWAPPEANVA

SEQ ID NO: 975241 - protein, 19 aa, Mycobacterium
WRQLSWLPQRSVLIPGTVR

SEQ ID NO: 975242 - protein, 17 aa, Mycobacterium
WRRGREIYAEVVAPEDA

SEQ ID NO: 975243 - protein, 19 aa, Mycobacterium
WRRRLPVIFVDVARFVLIG

SEQ ID NO: 975244 - protein, 24 aa, Mycobacterium
WRRVGTAVVRWPAPILALSGAIVL

SEQ ID NO: 975245 - protein, 26 aa, Mycobacterium
WRSGRLFCIAVGFLALVFASSTTAGV

SEQ ID NO: 975246 - protein, 18 aa, Mycobacterium
WSSPFWQTWDLLLLWLAQ

SEQ ID NO: 975247 - protein, 18 aa, Mycobacterium
WVGVPLYLLLGWVAVWYT

SEQ ID NO: 975248 - protein, 17 aa, Mycobacterium
WVWYAARREGLALDGAG

SEQ ID NO: 975249 - protein, 29 aa, Mycobacterium
YAEAAPLPWYKRAAVVFSLAAAGLAILVA

SEQ ID NO: 975250 - protein, 21 aa, Mycobacterium
YAGSLAQVFLCAAPVAAIGFV

SEQ ID NO: 975251 - protein, 18 aa, Mycobacterium
YAIFLLREHFRIIPNDMI

SEQ ID NO: 975252 - protein, 21 aa, Mycobacterium
YAPGTCRAFLPAKDSLARVTC

SEQ ID NO: 975253 - protein, 22 aa, Mycobacterium
YCLSFARLPWFNTMGAPVAIGM

SEQ ID NO: 975254 - protein, 22 aa, Mycobacterium
YDHPRLGSLAGFLDELGPPPQV

SEQ ID NO: 975255 - protein, 24 aa, Mycobacterium
YFAEGLHYWPWVLLGYFTVAIMVV

SEQ ID NO: 975256 - protein, 17 aa, Mycobacterium
YFLLCPMLIVFGIAVVG

SEQ ID NO: 975257 - protein, 19 aa, Mycobacterium
YFMGWSYWFAWIVAGIADL

SEQ ID NO: 975258 - protein, 19 aa, Mycobacterium
YFWLPCLACLLALAELHLR

SEQ ID NO: 975259 - protein, 23 aa, Mycobacterium
YGGLRAALPVTFVTFGLGYLAII

SEQ ID NO: 975260 - protein, 24 aa, Mycobacterium
YGLGWRPRLLVAMLVATALALVGT

SEQ ID NO: 975261 - protein, 19 aa, Mycobacterium
YGRRGWLTIGLVIVGASSA

SEQ ID NO: 975262 - protein, 18 aa, Mycobacterium
YGRRRGFFVGLALFVASS

SEQ ID NO: 975263 - protein, 27 aa, Mycobacterium
YKYFLEFFQRMGFSPAVAVILAIIALQ

SEQ ID NO: 975264 - protein, 21 aa, Mycobacterium
YLCLMPIFPLAFWLMNVYAAI

SEQ ID NO: 975265 - protein, 17 aa, Mycobacterium
YLMCGLARHRRLLSQES

SEQ ID NO: 975266 - protein, 17 aa, Mycobacterium
YLPPRVETFRDRKQVRP

SEQ ID NO: 975267 - protein, 19 aa, Mycobacterium
YLWHWPVLLLLPPLLGDPA

SEQ ID NO: 975268 - protein, 21 aa, Mycobacterium
YMCASGSFIGFAFVFGQVLQF

SEQ ID NO: 975269 - protein, 23 aa, Mycobacterium
YMEMLNINEAWQFGRGAGVKVAV

SEQ ID NO: 975270 - protein, 23 aa, Mycobacterium
YMRYPVFLAFDIVGGISWGAGVT

SEQ ID NO: 975271 - protein, 18 aa, Mycobacterium
YNMPLELVLTVTPFLIIS

SEQ ID NO: 975272 - protein, 20 aa, Mycobacterium
YPCSWRRSGARPVGWQPHRP

SEQ ID NO: 975273 - protein, 17 aa, Mycobacterium
YPGRIGLLFAVMPFHAF

SEQ ID NO: 975274 - protein, 17 aa, Mycobacterium
YPLWSSFVWRNELADTF

SEQ ID NO: 975275 - protein, 17 aa, Mycobacterium
YPTFALARPRPFLHEIT

SEQ ID NO: 975276 - protein, 25 aa, Mycobacterium
YRFLVRRLECALLRGGLDPADGRPR

SEQ ID NO: 975277 - protein, 23 aa, Mycobacterium
YRIGSLCPYCMVVWIITATLLVV

SEQ ID NO: 975278 - protein, 20 aa, Mycobacterium
YRKEILRLIAQIGMGTGAMA

SEQ ID NO: 975279 - protein, 19 aa, Mycobacterium
YRLTGLWPKLGAPWYAFWR

SEQ ID NO: 975280 - protein, 18 aa, Mycobacterium
YRPGLPMPATEHGAVAPA

SEQ ID NO: 975281 - protein, 21 aa, Mycobacterium
YRPNLFVTYWSFRAMIGFLAI

SEQ ID NO: 975282 - protein, 24 aa, Mycobacterium
YRPRLPRLSRWCVGFATWLTDAAV

SEQ ID NO: 975283 - protein, 23 aa, Mycobacterium
YRVPRPWLGMLRRDLIPTGYALA

SEQ ID NO: 975284 - protein, 22 aa, Mycobacterium
YRVTVELPEAGGLYPRSNVTYR

SEQ ID NO: 975285 - protein, 18 aa, Mycobacterium
YSEPRLQPPNGYKDTTVP

SEQ ID NO: 975286 - protein, 22 aa, Mycobacterium
YSLGCALFRLLTGRAPYEDLRG

SEQ ID NO: 975287 - protein, 18 aa, Mycobacterium
YSLPLRRLLGFLAAGLDA

SEQ ID NO: 975288 - protein, 17 aa, Mycobacterium
YTAEFLQAAALRAGNPI

SEQ ID NO: 975289 - protein, 18 aa, Mycobacterium
YVAIMGFAWLLLAVSAIA

SEQ ID NO: 975290 - protein, 17 aa, Mycobacterium
YVAWRLFGHIPYRIDID

SEQ ID NO: 975291 - protein, 20 aa, Mycobacterium
YYLAAFVVGSAVAWGIVTVS

SEQ ID NO: 975292 - protein, 17 aa, Mycobacterium
PRDPRGRRYSLMALLAI

SEQ ID NO: 975293 - protein, 21 aa, Mycobacterium
PRGRRYSLMALLAIAVLATAA

SEQ ID NO: 975294 - protein, 23 aa, Mycobacterium
DPRGRRYSLMALLAIAVLATAAG

SEQ ID NO: 975295 - protein, 25 aa, Mycobacterium
IPCVRALLTLLPDNLRWLVTVDAMH

SEQ ID NO: 975296 - protein, 17 aa, Mycobacterium
VSVFAHRARLVLGQLAV

SEQ ID NO: 975297 - protein, 22 aa, Mycobacterium
DPRGRRYSLMALLAIAVLATAA

SEQ ID NO: 975298 - protein, 18 aa, Mycobacterium
RQHWGIENSLHWIRDVTF

SEQ ID NO: 975299 - protein, 28 aa, Mycobacterium
EIPCVRALLTLLPGSLRWLVTVDAMHTQ

SEQ ID NO: 975300 - protein, 18 aa, Mycobacterium
VSVFAHRARLVLGQLAVA

SEQ ID NO: 975301 - protein, 28 aa, Mycobacterium
IPCVCALLTLLPGSLRWLVTVDAMHTQV

SEQ ID NO: 975302 - protein, 25 aa, Mycobacterium
PRDPRGRRYSLMALLAIAVLATAAG

SEQ ID NO: 975303 - protein, 25 aa, Mycobacterium
EIPCVCALLTLLPDNLRWLVTVDAM

SEQ ID NO: 975304 - protein, 21 aa, Mycobacterium
EIPCVCALLTLLPDNLRWLVT

SEQ ID NO: 975305 - protein, 20 aa, Mycobacterium
AIIDSLITRPLTTATGSAPA

SEQ ID NO: 975306 - protein, 21 aa, Mycobacterium
DALADYRHRLGLPATSLAWGY

SEQ ID NO: 975307 - protein, 17 aa, Mycobacterium
ELIVHTPLLLAGHDTAD

SEQ ID NO: 975308 - protein, 23 aa, Mycobacterium
GDQLDQVLAPKIDAAWQLHQLTY

SEQ ID NO: 975309 - protein, 18 aa, Mycobacterium
HHHTPDQPLWLGSIKSNI

SEQ ID NO: 975310 - protein, 28 aa, Mycobacterium
IDGYGIHPALFDAALHPLLALTQPPTND

SEQ ID NO: 975311 - protein, 24 aa, Mycobacterium
LAENRGWVFTGRISPRTQPWLNEH

SEQ ID NO: 975312 - protein, 17 aa, Mycobacterium
LHCHGISPSWNVLYCQA

SEQ ID NO: 975313 - protein, 17 aa, Mycobacterium
PHIDWSSGTVRLLTEPI

SEQ ID NO: 975314 - protein, 42 aa, Mycobacterium
SPSWNVLYCQARPLTLPTYAFQHQRYWLLPTAGDFSGANTHA

SEQ ID NO: 975315 - protein, 25 aa, Mycobacterium
TGDQVRLPYAFTGISLHATHATRLR

SEQ ID NO: 975316 - protein, 19 aa, Mycobacterium
TTAAGLLHLSWPPHPDTTT

SEQ ID NO: 975317 - protein, 18 aa, Mycobacterium
VDQPSPHIDWSSGTVRLL

SEQ ID NO: 975318 - protein, 29 aa, Mycobacterium
EIPCVCALLTLLPGSLRWLVTVDAMHTQV

SEQ ID NO: 975319 - protein, 23 aa, Mycobacterium
SDPAVGVLVWPLSARSAPGLSAQ

SEQ ID NO: 975320 - protein, 27 aa, Mycobacterium
TDHNHLPLTPVPWPPPGTAAIEVDDFY

SEQ ID NO: 975321 - protein, 19 aa, Mycobacterium
AEILARITALPWAEVPAAA

SEQ ID NO: 975322 - protein, 27 aa, Mycobacterium
EIPCVRALLTLLPGSLRWLVTVDAMHT

SEQ ID NO: 975323 - protein, 17 aa, Mycobacterium
NTLAPILSALITTPRRR

SEQ ID NO: 975324 - protein, 30 aa, Mycobacterium
DTYDGKILFDLWMANLPILLCAQALARHYT

SEQ ID NO: 975325 - protein, 24 aa, Mycobacterium
LPATSLAWGYWQTHTGLTAHLTDV

SEQ ID NO: 975326 - protein, 17 aa, Mycobacterium
MALLAIAVLATAAGMRG

SEQ ID NO: 975327 - protein, 24 aa, Mycobacterium
PRDPRGRRYSLMALLAIAVLATAA

SEQ ID NO: 975328 - protein, 18 aa, Mycobacterium
TQPWLNEHAVESAVLFPG

SEQ ID NO: 975329 - protein, 22 aa, Mycobacterium
DACDAALQPFTGWSVLAVLHDE

SEQ ID NO: 975330 - protein, 24 aa, Mycobacterium
EIPCVCALLTLLPDNLRWLVTVDA

SEQ ID NO: 975331 - protein, 25 aa, Mycobacterium
GMGADLYRQFPVFAHALDACDAALQ

SEQ ID NO: 975332 - protein, 18 aa, Mycobacterium
LHATYGHHHTPDQPLWLG

SEQ ID NO: 975333 - protein, 20 aa, Mycobacterium
PLTQLLARWDGKITVAAVNG

SEQ ID NO: 975334 - protein, 31 aa, Mycobacterium
QPVLFSVMVSLAALWRWAGITPDAVIGHSQG

SEQ ID NO: 975335 - protein, 20 aa, Mycobacterium
TMTADYWYRNIRNTVRFHDT

SEQ ID NO: 975336 - protein, 18 aa, Mycobacterium
YRNIRNTVRFHDTVAALL

SEQ ID NO: 975337 - protein, 22 aa, Mycobacterium
AAQLTFSAPTLPILSNLTGQIA

SEQ ID NO: 975338 - protein, 27 aa, Mycobacterium
EIPCVRALLTLLPDSLRWLVTVDAMHT

SEQ ID NO: 975339 - protein, 28 aa, Mycobacterium
GISSLCLIFIIMLIITRAFVAAAVIVGT

SEQ ID NO: 975340 - protein, 27 aa, Mycobacterium
IPCVCALLTLLPGSLRWLVTVDAMHTQ

SEQ ID NO: 975341 - protein, 28 aa, Mycobacterium
IPCVRALLTLLPDNLRWLVTVDAIHTQV

SEQ ID NO: 975342 - protein, 22 aa, Mycobacterium
IRRDTIHIPRLTRTAVLTPPDS

SEQ ID NO: 975343 - protein, 17 aa, Mycobacterium
LHATYGHHHTPDQPLWL

SEQ ID NO: 975344 - protein, 17 aa, Mycobacterium
NFHDVVVALGLIPDDGF

SEQ ID NO: 975345 - protein, 25 aa, Mycobacterium
PQAASIPVVFLTAYIALAEISGLSR

SEQ ID NO: 975346 - protein, 23 aa, Mycobacterium
SPDHIQRTLAQLSPLFATDTLKP

SEQ ID NO: 975347 - protein, 42 aa, Mycobacterium
TAMAQLLDQTFYAQPALFALGTALHRLFTHAGIHPDYLLGHS

SEQ ID NO: 975348 - protein, 20 aa, Mycobacterium
THPGVIYRALDLLSVSPDHI

SEQ ID NO: 975349 - protein, 26 aa, Mycobacterium
YVGSVILLALLLPYSAFKASESPFVT

SEQ ID NO: 975350 - protein, 22 aa, Mycobacterium
YVVGWLYFLDWAMTAIVDTTAI

SEQ ID NO: 975351 - protein, 20 aa, Mycobacterium
DLVYQFIPVLKANGYRLVTV

SEQ ID NO: 975352 - protein, 25 aa, Mycobacterium
EGMGTTLTAILFAGNRLGLVHIGDS

SEQ ID NO: 975353 - protein, 30 aa, Mycobacterium
EIPCVCALLTLLPDNLRWLVTVDAIHTQVV

SEQ ID NO: 975354 - protein, 27 aa, Mycobacterium
EIPCVRALLTLLPDNLRWLVTVDAMHT

SEQ ID NO: 975355 - protein, 21 aa, Mycobacterium
EIYEAMDWLLARQDAIEKQLA

SEQ ID NO: 975356 - protein, 19 aa, Mycobacterium
ESKPWSWPMSLRPVLYAID

SEQ ID NO: 975357 - protein, 19 aa, Mycobacterium
FAAGRLYTTLSVADAAAAT

SEQ ID NO: 975358 - protein, 21 aa, Mycobacterium
GAAIPVLIVGTVVWVGITNDR

SEQ ID NO: 975359 - protein, 25 aa, Mycobacterium
GPFLPLAIILYWFSNNIWTFGQQHY

SEQ ID NO: 975360 - protein, 25 aa, Mycobacterium
HPDYPSERLIACRNPLLATQRARKR

SEQ ID NO: 975361 - protein, 31 aa, Mycobacterium
IATYLHRWTIFTALPQWTLALLALAVVLVMN

SEQ ID NO: 975362 - protein, 20 aa, Mycobacterium
IDDRWGLDALTKFAGQITAA

SEQ ID NO: 975363 - protein, 25 aa, Mycobacterium
IPCVCALLTLLPDSLRWLVTVDAMH

SEQ ID NO: 975364 - protein, 26 aa, Mycobacterium
IPCVCALLTLLPGSLRWLVTVDAMHT

SEQ ID NO: 975365 - protein, 39 aa, Mycobacterium
LDDRVKAHILIAMLACYLVWHLRKAWAPMTYTDENPPAR

SEQ ID NO: 975366 - protein, 18 aa, Mycobacterium
LDLPPTLIFDHPTPTALT

SEQ ID NO: 975367 - protein, 25 aa, Mycobacterium
LLDATVVRMFLVPSVMKLLGDDCWW

SEQ ID NO: 975368 - protein, 19 aa, Mycobacterium
LVIMDLRDHWMAKAPYILG

SEQ ID NO: 975369 - protein, 20 aa, Mycobacterium
LVSVFAYRARLVLGQLAVAE

SEQ ID NO: 975370 - protein, 25 aa, Mycobacterium
LVYAVCGVFVFLILRALGELVLHRP

SEQ ID NO: 975371 - protein, 25 aa, Mycobacterium
MGADLYRQFPVFAHALDEVAAALNP

SEQ ID NO: 975372 - protein, 25 aa, Mycobacterium
PRDPRGRRYSLMALLAIAVLATAAR

SEQ ID NO: 975373 - protein, 20 aa, Mycobacterium
PRGRRYSLMALLAIAVLATT

SEQ ID NO: 975374 - protein, 20 aa, Mycobacterium
SILVLIAFPLLTAALFGLAA

SEQ ID NO: 975375 - protein, 18 aa, Mycobacterium
SRAQLLIASGSLAADPGK

SEQ ID NO: 975376 - protein, 20 aa, Mycobacterium
SWRRGLIFAMFVFAAVFTPG

SEQ ID NO: 975377 - protein, 21 aa, Mycobacterium
TDDLRPIPVFGSDELARLTEA

SEQ ID NO: 975378 - protein, 30 aa, Mycobacterium
VADHRMVMTIPARWSFPQAASIPVVFLTAY

SEQ ID NO: 975379 - protein, 23 aa, Mycobacterium
VDYSLFILMRFREELRSGRQPQE

SEQ ID NO: 975380 - protein, 26 aa, Mycobacterium
WPALAMFAIIFFWTPPHTWALAMRYK

SEQ ID NO: 975381 - protein, 25 aa, Mycobacterium
YTENLRYYYLILPTVDGSLSRRFGF

SEQ ID NO: 975382 - protein, 20 aa, Mycobacterium
AAAVLAVFVVPMLIRVLLSL

SEQ ID NO: 975383 - protein, 21 aa, Mycobacterium
AAAVLFLTLLTRGGARRHSGY

SEQ ID NO: 975384 - protein, 17 aa, Mycobacterium
AAAVRILSALPVARSAS

SEQ ID NO: 975385 - protein, 31 aa, Mycobacterium
AAGRLGWPLWAAYVAAFALTVLVGARLIVAI

SEQ ID NO: 975386 - protein, 21 aa, Mycobacterium
AALELMAAAWDQPIAMIVNEW

SEQ ID NO: 975387 - protein, 20 aa, Mycobacterium
AALLMLYTIVIVRGLRTAIA

SEQ ID NO: 975388 - protein, 17 aa, Mycobacterium
AALVMIGVVLDWPRWWV

SEQ ID NO: 975389 - protein, 25 aa, Mycobacterium
AAQTTESLWWVTRTGARFGVEDTKD

SEQ ID NO: 975390 - protein, 28 aa, Mycobacterium
AASGASLLLLPQGFVKSLTYALIAAVTL

SEQ ID NO: 975391 - protein, 28 aa, Mycobacterium
AATLTWMHLPWVAVQLKRYFADGLQHWP

SEQ ID NO: 975392 - protein, 27 aa, Mycobacterium
AAVALPLRIFAWLSLVFGVGFSMLALM

SEQ ID NO: 975393 - protein, 23 aa, Mycobacterium
AAWGWFTLLLQITGSIAVLQAIP

SEQ ID NO: 975394 - protein, 27 aa, Mycobacterium
AAWTAAGMFLAVWLPLDNGLRPEPIIA

SEQ ID NO: 975395 - protein, 26 aa, Mycobacterium
ACATKWSGLYFVLFFGVMSLAFDVSS

SEQ ID NO: 975396 - protein, 17 aa, Mycobacterium
ADFLILDKLARGIFRVP

SEQ ID NO: 975397 - protein, 27 aa, Mycobacterium
ADPGNPLAILMPLTAAVMDLVALSAAV

SEQ ID NO: 975398 - protein, 24 aa, Mycobacterium
ADSELRPWYPAVEIYRVAVSDGTN

SEQ ID NO: 975399 - protein, 31 aa, Mycobacterium
ADYARNLLRRLIVAALLFVPLADLSTMFAIV

SEQ ID NO: 975400 - protein, 24 aa, Mycobacterium
ADYSFLAYYPYWGFQGLTSHYANP

SEQ ID NO: 975401 - protein, 26 aa, Mycobacterium
AEELALPPFRVPAPRNTAQYRSAALH

SEQ ID NO: 975402 - protein, 26 aa, Mycobacterium
AEELLSRSWWSGPEIFLIIDDIQQLP

SEQ ID NO: 975403 - protein, 18 aa, Mycobacterium
AEIVGAYFPLGWPLTCHL

SEQ ID NO: 975404 - protein, 21 aa, Mycobacterium
AEPVWTSRFASPVGAAQIAIT

SEQ ID NO: 975405 - protein, 31 aa, Mycobacterium
AESQLRKLLADSLLPTCPPPRATSPPGPFTM

SEQ ID NO: 975406 - protein, 17 aa, Mycobacterium
AEYPTMALGVESVAELA

SEQ ID NO: 975407 - protein, 25 aa, Mycobacterium
AFGLALAWLATIWATAGLAGLRIWD

SEQ ID NO: 975408 - protein, 18 aa, Mycobacterium
AFHILFRVSLLLGGVITG

SEQ ID NO: 975409 - protein, 34 aa, Mycobacterium
AFLINGLLAAWPHSPLFSFFLPDGNEHQITLIVM

SEQ ID NO: 975410 - protein, 24 aa, Mycobacterium
AGAALLWQLTPLTIGCGLILAALL

SEQ ID NO: 975411 - protein, 27 aa, Mycobacterium
AGALGILRFIALFGPVHFFAQPVVSLI

SEQ ID NO: 975412 - protein, 23 aa, Mycobacterium
AGETVFFLEATAVFVLTIASVYG

SEQ ID NO: 975413 - protein, 23 aa, Mycobacterium
AGGPFLFLQALLRTSTISTYLRD

SEQ ID NO: 975414 - protein, 28 aa, Mycobacterium
AGGRYSVYLWALLAMAAARFGLGPLRRV

SEQ ID NO: 975415 - protein, 26 aa, Mycobacterium
AGLAVAYLGIGLLLACILLRGLATLR

SEQ ID NO: 975416 - protein, 25 aa, Mycobacterium
AGLILPYITFALPLAIYTLSAFFAE

SEQ ID NO: 975417 - protein, 23 aa, Mycobacterium
AGLTYYTIFALFPMLMVSFSVVG

SEQ ID NO: 975418 - protein, 19 aa, Mycobacterium
AGMTIVCLVLYWQFRNRNW

SEQ ID NO: 975419 - protein, 24 aa, Mycobacterium
AGPAMNFVICLVLIYGIALVWGLP

SEQ ID NO: 975420 - protein, 23 aa, Mycobacterium
AGPLPYIVMEYVDGATLRDIVHT

SEQ ID NO: 975421 - protein, 29 aa, Mycobacterium
AGQKYGMNLLWTLVLLIPVLYVNQEMVLR

SEQ ID NO: 975422 - protein, 24 aa, Mycobacterium
AGVGFVHWLIFQSLYRIGALCAYC

SEQ ID NO: 975423 - protein, 17 aa, Mycobacterium
AGVWMRIPATLAGIACW

SEQ ID NO: 975424 - protein, 25 aa, Mycobacterium
AGYHRLLGQCFFAIGVFTGFSMAGY

SEQ ID NO: 975425 - protein, 18 aa, Mycobacterium
AHLTIIMMAVIVGTAETL

SEQ ID NO: 975426 - protein, 17 aa, Mycobacterium
AIAGLVATVAWTIGSHL

SEQ ID NO: 975427 - protein, 21 aa, Mycobacterium
AIAVLWRWLLAPTDGAFSMVL

SEQ ID NO: 975428 - protein, 24 aa, Mycobacterium
AIFVCLFCAFYIYDGNLQPDARCM

SEQ ID NO: 975429 - protein, 35 aa, Mycobacterium
AIGLSLVLLYSLLYYRVLGLLTAFSLFCSGTIIFA

SEQ ID NO: 975430 - protein, 44 aa, Mycobacterium
AIHKPSRIRIALTRSFMTLTSFVAVLLTGAGYWVAHRALEDITV

SEQ ID NO: 975431 - protein, 18 aa, Mycobacterium
AIHLPNDSSLLISKSLRP

SEQ ID NO: 975432 - protein, 30 aa, Mycobacterium
AILLEEVYLSTAIPMLVFSGVMNAGQGFVN

SEQ ID NO: 975433 - protein, 17 aa, Mycobacterium
AIRVYRDIGRHALCRAR

SEQ ID NO: 975434 - protein, 30 aa, Mycobacterium
AITLRDFRIPAIGLVLLMLSSLIVGTGWPL

SEQ ID NO: 975435 - protein, 19 aa, Mycobacterium
AITLVLWWQMIRFEYALLV

SEQ ID NO: 975436 - protein, 23 aa, Mycobacterium
AIVLLVPTVALAVPWLTELQRLF

SEQ ID NO: 975437 - protein, 18 aa, Mycobacterium
AIVPLIVLFVGFQRHIIP

SEQ ID NO: 975438 - protein, 35 aa, Mycobacterium
AKTEPLMLVFVALIAFVMLLISIRSVFLAFKGVLM

SEQ ID NO: 975439 - protein, 17 aa, Mycobacterium
ALALLSAPWLIMVGATC

SEQ ID NO: 975440 - protein, 29 aa, Mycobacterium
ALARPAFTVMALLGVQFIMATAAAHVLDR

SEQ ID NO: 975441 - protein, 20 aa, Mycobacterium
ALFYQILGLALFVFWLLLIA

SEQ ID NO: 975442 - protein, 21 aa, Mycobacterium
ALGVLFTWVLVERAIALRRLA

SEQ ID NO: 975443 - protein, 19 aa, Mycobacterium
ALIWIRCAVWLLAGIAIYV

SEQ ID NO: 975444 - protein, 56 aa, Mycobacterium
ALLAVMPALMAYPWWFTRSYWLLGIVALVVVVLFGWWRGLYLTTILRRRLAMMWRR

SEQ ID NO: 975445 - protein, 26 aa, Mycobacterium
ALLELTVIVLLLAAWFHFVATTNGSA

SEQ ID NO: 975446 - protein, 20 aa, Mycobacterium
ALLMVSLWMAGLSLAVMGIV

SEQ ID NO: 975447 - protein, 21 aa, Mycobacterium
ALLVLVVVVLAWAVVALNPRI

SEQ ID NO: 975448 - protein, 33 aa, Mycobacterium
ALPILVAVVPWLVLRFWFFRHKWTVTTLAATPA

SEQ ID NO: 975449 - protein, 29 aa, Mycobacterium
ALTAGSFFWLWWTTNLLSGLLALATVAFY

SEQ ID NO: 975450 - protein, 19 aa, Mycobacterium
ALTAVGWLIAGSGPDRVFS

SEQ ID NO: 975451 - protein, 17 aa, Mycobacterium
ALVALLTVPMSLLATRA

SEQ ID NO: 975452 - protein, 17 aa, Mycobacterium
ALVLSVLVILGLVVGVR

SEQ ID NO: 975453 - protein, 25 aa, Mycobacterium
ALVVGVFFWFAVVGWVTVVVACGIK

SEQ ID NO: 975454 - protein, 20 aa, Mycobacterium
ALVVLLALRPEVVSQVARIA

SEQ ID NO: 975455 - protein, 21 aa, Mycobacterium
ALVWNFRFSVLLTGLIIIIAI

SEQ ID NO: 975456 - protein, 22 aa, Mycobacterium
ALWARFPLPVIPAPGDPTPSAP

SEQ ID NO: 975457 - protein, 38 aa, Mycobacterium
AMGAMPWILIVCLFVTILAGILFQFTMFGRWVKAIGGN

SEQ ID NO: 975458 - protein, 17 aa, Mycobacterium
AMILGVVLTIVALVALH

SEQ ID NO: 975459 - protein, 30 aa, Mycobacterium
AMLLAAAWLALLALPLLLTAHRLPSLGEVS

SEQ ID NO: 975460 - protein, 21 aa, Mycobacterium
AMNGKFDWLDSKVVQWVPDRY

SEQ ID NO: 975461 - protein, 19 aa, Mycobacterium
ANDPVSWIWQLPQARWNAY

SEQ ID NO: 975462 - protein, 18 aa, Mycobacterium
ANPIVFIYNYLKQVVGEM

SEQ ID NO: 975463 - protein, 24 aa, Mycobacterium
ANQDDLQLVLLRPGKEDDEPQQHL

SEQ ID NO: 975464 - protein, 21 aa, Mycobacterium
APACFARHPRWVAPVRRVGLL

SEQ ID NO: 975465 - protein, 22 aa, Mycobacterium
APKRTMLIGQHLPLQPSAMSTG

SEQ ID NO: 975466 - protein, 21 aa, Mycobacterium
APMLMLKGAPEKILPRCRFAD

SEQ ID NO: 975467 - protein, 26 aa, Mycobacterium
APPGKYWWVRWVVLSLVAIVLVVELA

SEQ ID NO: 975468 - protein, 20 aa, Mycobacterium
APRMFRLPADRALLNRMGFN

SEQ ID NO: 975469 - protein, 24 aa, Mycobacterium
APSPYRGLLIAAHLTWLVILVMAV

SEQ ID NO: 975470 - protein, 27 aa, Mycobacterium
APVLWADMPTLPLYRQQRMLLMSKTMY

SEQ ID NO: 975471 - protein, 40 aa, Mycobacterium
AQAPLMVIMLITTTMLLMFLAFGSFVLPIKAAVMSALTLG

SEQ ID NO: 975472 - protein, 23 aa, Mycobacterium
AQARLLNVTVQRIMFALRSDVED

SEQ ID NO: 975473 - protein, 20 aa, Mycobacterium
AQFVFEIRLLIAPITVGERA

SEQ ID NO: 975474 - protein, 23 aa, Mycobacterium
AQKSLWLWVTLSGLAAAVLLLGW

SEQ ID NO: 975475 - protein, 22 aa, Mycobacterium
AQSYWVRIQLFLHGDNFGIRDP

SEQ ID NO: 975476 - protein, 17 aa, Mycobacterium
AQTLLTRRHSPLVVATA

SEQ ID NO: 975477 - protein, 33 aa, Mycobacterium
ARGIYQWRWSIATLWFITVFLLIMVRFWNYWQT

SEQ ID NO: 975478 - protein, 17 aa, Mycobacterium
ARKPWPIAGVLVLFAVA

SEQ ID NO: 975479 - protein, 29 aa, Mycobacterium
ARKVLGPLRDLFAAIFFLAIGISVDPHKL

SEQ ID NO: 975480 - protein, 23 aa, Mycobacterium
ARLNLLWSVLTVHLGYSVWTLWP

SEQ ID NO: 975481 - protein, 24 aa, Mycobacterium
ARQGIIFQLIITPLDYHNLSGKSA

SEQ ID NO: 975482 - protein, 26 aa, Mycobacterium
ARRQDALSSILWRALERDAAPRSQIL

SEQ ID NO: 975483 - protein, 24 aa, Mycobacterium
ASAGWLRLGVLVLALAALTALLIN

SEQ ID NO: 975484 - protein, 25 aa, Mycobacterium
ASGELLFIVIVTVTISLLGRLLGRL

SEQ ID NO: 975485 - protein, 32 aa, Mycobacterium
ASGPAIYNYTWLVLMLPFGIIGVTVLTVVMPR

SEQ ID NO: 975486 - protein, 19 aa, Mycobacterium
ASLLKRAVGPSLKWFDEHI

SEQ ID NO: 975487 - protein, 20 aa, Mycobacterium
ASLVVFLVALPLSLGIAIAS

SEQ ID NO: 975488 - protein, 26 aa, Mycobacterium
ASMWIRLPDLICGVACWLLLSREVLP

SEQ ID NO: 975489 - protein, 26 aa, Mycobacterium
ASPQTAPWVIVRLLVEGPVLSRDAAL

SEQ ID NO: 975490 - protein, 24 aa, Mycobacterium
ASPVWFYQLWAFITPGLYTKERRF

SEQ ID NO: 975491 - protein, 24 aa, Mycobacterium
ASVSVFMLFPLGFSLYMSFQKWDM

SEQ ID NO: 975492 - protein, 18 aa, Mycobacterium
ATAMVLYVLISQLGLVVT

SEQ ID NO: 975493 - protein, 24 aa, Mycobacterium
ATAPPPPALPYIDVGHPGPIDPAT

SEQ ID NO: 975494 - protein, 23 aa, Mycobacterium
ATGGMVLLVLLSGIALLVSRQVV

SEQ ID NO: 975495 - protein, 58 aa, Mycobacterium
ATLAGCLPAVIWWACHRPNRLWWRYTGWWLLALCLATLWWVVALVLLHGVSPPFLDFI

SEQ ID NO: 975496 - protein, 37 aa, Mycobacterium
ATLYRNHISFGAIALLALIMLIAVIVALWVSRTDGVV

SEQ ID NO: 975497 - protein, 29 aa, Mycobacterium
ATNIPLSQWFLLTAAFGSLFMVAGKRYAE

SEQ ID NO: 975498 - protein, 24 aa, Mycobacterium
ATRLRFMWSLRVLHTLAMIDLAIT

SEQ ID NO: 975499 - protein, 25 aa, Mycobacterium
ATRSRLILASLGVSSFFVVGVPCIP

SEQ ID NO: 975500 - protein, 20 aa, Mycobacterium
ATSLAWGYWQTRTGVTAHLT

SEQ ID NO: 975501 - protein, 22 aa, Mycobacterium
ATTAWAIGRWTPGTERRTATMG

SEQ ID NO: 975502 - protein, 24 aa, Mycobacterium
ATVLTAWHYLFRHLVLFGDKYDSV

SEQ ID NO: 975503 - protein, 24 aa, Mycobacterium
AVASVIWWVLVVITAIWVVLQISD

SEQ ID NO: 975504 - protein, 19 aa, Mycobacterium
AVAVWLFPVSAATLTWHLL

SEQ ID NO: 975505 - protein, 24 aa, Mycobacterium
AVDAWLELCQTYGWAPGVMGASSQ

SEQ ID NO: 975506 - protein, 46 aa, Mycobacterium
AVDVTAVRLVLVPTLMAMFAQWNWWLPRWLSRALPAVDFDKPFPPV

SEQ ID NO: 975507 - protein, 25 aa, Mycobacterium
AVFFGRFIALLRILAGPLAGALKMH

SEQ ID NO: 975508 - protein, 23 aa, Mycobacterium
AVGAMARTLGLPALLGPRCRSRD

SEQ ID NO: 975509 - protein, 26 aa, Mycobacterium
AVGIALWLPWLIVAGVVFVLASAAGL

SEQ ID NO: 975510 - protein, 28 aa, Mycobacterium
AVIQPPLILFCAVPAAYWLFHGSKIKSL

SEQ ID NO: 975511 - protein, 19 aa, Mycobacterium
AVLCHRLMMLIGVGLVVWA

SEQ ID NO: 975512 - protein, 26 aa, Mycobacterium
AVLTAGAMFLAAWLPFNNGLRPEPLI

SEQ ID NO: 975513 - protein, 25 aa, Mycobacterium
AVLYTMIYFGPFAPLLLIDAVGLTG

SEQ ID NO: 975514 - protein, 30 aa, Mycobacterium
AVPGPAWLRRLWLAVIIVSPAAIWLEPISS

SEQ ID NO: 975515 - protein, 20 aa, Mycobacterium
AVRSLWYYHAKTLQFHAGLT

SEQ ID NO: 975516 - protein, 18 aa, Mycobacterium
AVRTRLLDRMADKWRLDL

SEQ ID NO: 975517 - protein, 28 aa, Mycobacterium
AVTGWVTRLPAVPQTIRAAAALVNHQPR

SEQ ID NO: 975518 - protein, 24 aa, Mycobacterium
AVTIFVFILISNWLSVLPLQYTNA

SEQ ID NO: 975519 - protein, 23 aa, Mycobacterium
AVTYWIVHLIGGYPGAVIGFSLL

SEQ ID NO: 975520 - protein, 24 aa, Mycobacterium
AVVASIIPLLLWIAGVYDMVRNLS

SEQ ID NO: 975521 - protein, 17 aa, Mycobacterium
AVVASVSAALLGCLGAL

SEQ ID NO: 975522 - protein, 25 aa, Mycobacterium
AVVFYPLHLLPFALVAFLWQITTIA

SEQ ID NO: 975523 - protein, 19 aa, Mycobacterium
AVVPLTVLGAIFGAGLVVA

SEQ ID NO: 975524 - protein, 18 aa, Mycobacterium
AVVVGALITLGPLALSLQ

SEQ ID NO: 975525 - protein, 17 aa, Mycobacterium
AVWLVLIGVSVAAAVAL

SEQ ID NO: 975526 - protein, 17 aa, Mycobacterium
AWLMKAAADYMDVATQQ

SEQ ID NO: 975527 - protein, 21 aa, Mycobacterium
AWQRFWRITLPMLRPTMFFVL

SEQ ID NO: 975528 - protein, 25 aa, Mycobacterium
AYGKVLFEITLTAATILIVLAGRRL

SEQ ID NO: 975529 - protein, 22 aa, Mycobacterium
AYSSWLVIRWVVASALGGPLLI

SEQ ID NO: 975530 - protein, 22 aa, Mycobacterium
CAGLIYIYMVFDLDGHLMCGVL

SEQ ID NO: 975531 - protein, 24 aa, Mycobacterium
CALLALPIVPLFAYLHAAVIVVML

SEQ ID NO: 975532 - protein, 26 aa, Mycobacterium
CASAWLDALVMWRKASGLPSAVINWG

SEQ ID NO: 975533 - protein, 30 aa, Mycobacterium
CGIIGLGAAFLIAALLLATYTSSRITKIPL

SEQ ID NO: 975534 - protein, 17 aa, Mycobacterium
CGWAFLIWGTYAYLWAF

SEQ ID NO: 975535 - protein, 18 aa, Mycobacterium
CGYEFRLETSCYNPSFGP

SEQ ID NO: 975536 - protein, 23 aa, Mycobacterium
CKQNPLFDPLQPNDPRGWNGVNT

SEQ ID NO: 975537 - protein, 18 aa, Mycobacterium
CRFCPVLYWLLSLYYVRL

SEQ ID NO: 975538 - protein, 17 aa, Mycobacterium
CRFTYLVLLMIASSLDE

SEQ ID NO: 975539 - protein, 30 aa, Mycobacterium
CTAQRRRTLTIALLLVAMVPLATGCLRVTA

SEQ ID NO: 975540 - protein, 24 aa, Mycobacterium
CTRHPLPLLAALAKLLVAAATGAL

SEQ ID NO: 975541 - protein, 27 aa, Mycobacterium
CVLVVRRMLASPFRLGIDRRLVERKDD

SEQ ID NO: 975542 - protein, 17 aa, Mycobacterium
CWLLLSREVLPRLGPAI

SEQ ID NO: 975543 - protein, 26 aa, Mycobacterium
CWSAPEPRWPKSPPLTHLRTGLQRSA

SEQ ID NO: 975544 - protein, 31 aa, Mycobacterium
DADNARYLLIRLAVAAALFVPLAHLSVMFAV

SEQ ID NO: 975545 - protein, 23 aa, Mycobacterium
DAMNRSVLLPLGLTPEQVSQARP

SEQ ID NO: 975546 - protein, 25 aa, Mycobacterium
DATARWVPRLWRRDIKAGHFSPMSH

SEQ ID NO: 975547 - protein, 18 aa, Mycobacterium
DCLMWPDSTPHTAVIVNC

SEQ ID NO: 975548 - protein, 24 aa, Mycobacterium
DDHVVAILSLVPWGTTGVSLDVMR

SEQ ID NO: 975549 - protein, 19 aa, Mycobacterium
DDLSYTRALSPLRKPVTKL

SEQ ID NO: 975550 - protein, 28 aa, Mycobacterium
DDSVAGLTWMPFIVGCYTAVAGGSMMKN

SEQ ID NO: 975551 - protein, 27 aa, Mycobacterium
DDVLQSYLNIIYFGRGAYGISAAAKAY

SEQ ID NO: 975552 - protein, 26 aa, Mycobacterium
DEHLAMLRRLIMDDNWYRGELIFVFD

SEQ ID NO: 975553 - protein, 23 aa, Mycobacterium
DFMHGRVLLAPLFCLLAPVVVIP

SEQ ID NO: 975554 - protein, 25 aa, Mycobacterium
DFTIVPLLWLLAIDAVLITLVTKAF

SEQ ID NO: 975555 - protein, 22 aa, Mycobacterium
DGAQLPWSLLMTTTLAAVMGNL

SEQ ID NO: 975556 - protein, 30 aa, Mycobacterium
DGITFSTIFFILFAIVALYAYYLHFTNTGH

SEQ ID NO: 975557 - protein, 23 aa, Mycobacterium
DGKAWILPIVLAGELGTSASYQA

SEQ ID NO: 975558 - protein, 18 aa, Mycobacterium
DGLRLWITSLTLTVIWVT

SEQ ID NO: 975559 - protein, 21 aa, Mycobacterium
DGMGLLAWGALGFGYAEVGTV

SEQ ID NO: 975560 - protein, 18 aa, Mycobacterium
DGPWVKWYPGIPGYLDQA

SEQ ID NO: 975561 - protein, 33 aa, Mycobacterium
DGSIGRWVAVVAVLAVLTIAIVAAFNTFGGNTR

SEQ ID NO: 975562 - protein, 21 aa, Mycobacterium
DGTLLLSRFPALNAPAVAIDI

SEQ ID NO: 975563 - protein, 17 aa, Mycobacterium
DIAVLAVAFIAAISGWR

SEQ ID NO: 975564 - protein, 22 aa, Mycobacterium
DILDPALLRPGRFDRQIPVSNP

SEQ ID NO: 975565 - protein, 23 aa, Mycobacterium
DLAPQHWIALTPPRIPQLRTLQD

SEQ ID NO: 975566 - protein, 22 aa, Mycobacterium
DLFFVLSGFLITSLLLDELRHT

SEQ ID NO: 975567 - protein, 26 aa, Mycobacterium
DLMHAWSPDILAKPLVRYTVRTDKNG

SEQ ID NO: 975568 - protein, 28 aa, Mycobacterium
DLSLATRLTLITLIPTVAFMTAGGSAMG

SEQ ID NO: 975569 - protein, 17 aa, Mycobacterium
DMHMAIAAALNMYDNIL

SEQ ID NO: 975570 - protein, 21 aa, Mycobacterium
DNPVIFWTPDHGAFVVRGALN

SEQ ID NO: 975571 - protein, 23 aa, Mycobacterium
DPGQAWVFVFAIAMMVGLVVSLM

SEQ ID NO: 975572 - protein, 26 aa, Mycobacterium
DPHTTWVLYGIIVVSVLIIAGAVPVL

SEQ ID NO: 975573 - protein, 21 aa, Mycobacterium
DPLLLPIVALLNGLGLVMIHR

SEQ ID NO: 975574 - protein, 21 aa, Mycobacterium
DPQQRLLLEVAWEALEHAGIS

SEQ ID NO: 975575 - protein, 18 aa, Mycobacterium
DPRDPRGRRYSLMALLAI

SEQ ID NO: 975576 - protein, 26 aa, Mycobacterium
DPRDPRGRRYSLMALLAIAVLATAAG

SEQ ID NO: 975577 - protein, 34 aa, Mycobacterium
DRATNQLYVLLSGHLYPVYNLTSARLALGKPANP

SEQ ID NO: 975578 - protein, 28 aa, Mycobacterium
DRIGAYERYWLYPGAANLAAFRGYLATM

SEQ ID NO: 975579 - protein, 17 aa, Mycobacterium
DRKPYIVCGLYVVLLII

SEQ ID NO: 975580 - protein, 37 aa, Mycobacterium
DRMKVFWAQAMRLRDLLKFDFYFADSAAFRANIAEEI

SEQ ID NO: 975581 - protein, 18 aa, Mycobacterium
DRNIDRLLRRICPGDIVV

SEQ ID NO: 975582 - protein, 24 aa, Mycobacterium
DRRRDLAMTWLLTGILVGVLSDAV

SEQ ID NO: 975583 - protein, 20 aa, Mycobacterium
DRRSPILPWLTGVVVILLLI

SEQ ID NO: 975584 - protein, 20 aa, Mycobacterium
DSFDGYEYLFWVGCAGAYDD

SEQ ID NO: 975585 - protein, 25 aa, Mycobacterium
DSIGWTWMHYLPPTPGFAFIDHTVI

SEQ ID NO: 975586 - protein, 24 aa, Mycobacterium
DTATGFGWITALRAPAIAKLAGDD

SEQ ID NO: 975587 - protein, 30 aa, Mycobacterium; identical to SEQ ID NO: 20470

SEQ ID NO: 975588 - protein, 22 aa, Mycobacterium
DTWRWVGVLIFLCTGKALLQKI

SEQ ID NO: 975589 - protein, 30 aa, Mycobacterium
DVAFPRLNAFSFWLFLFGAAIGMAGFITPG

SEQ ID NO: 975590 - protein, 23 aa, Mycobacterium
DVEYPLLAKMRSASRRALVDLAD

SEQ ID NO: 975591 - protein, 23 aa, Mycobacterium
DVLKLPSRNLAPAALTALVEQLE

SEQ ID NO: 975592 - protein, 19 aa, Mycobacterium
DVLLVPTAFTRWVVTAVGM

SEQ ID NO: 975593 - protein, 27 aa, Mycobacterium
DVLPSMPRWLWIVVVLGGFTAALAGGS

SEQ ID NO: 975594 - protein, 22 aa, Mycobacterium
DVRRTMTVLLIACPCAVGLATP

SEQ ID NO: 975595 - protein, 25 aa, Mycobacterium
DVSAQHFLVFWPQMYYLLMALLGGM

SEQ ID NO: 975596 - protein, 26 aa, Mycobacterium
DVVVPVTRFYKSVLWCAAHSICLVHA

SEQ ID NO: 975597 - protein, 18 aa, Mycobacterium
DWLIFGKNWFDSCDGLLI

SEQ ID NO: 975598 - protein, 24 aa, Mycobacterium
EAALVTYVLLLSAVVYQLFFNAIG

SEQ ID NO: 975599 - protein, 19 aa, Mycobacterium
EAEQFIGIELSAIMLFNHP

SEQ ID NO: 975600 - protein, 27 aa, Mycobacterium
EAERWNLPIILIVLLAVFGSLAAAAVP

SEQ ID NO: 975601 - protein, 28 aa, Mycobacterium
EAIGIRLRDMLWAAIFPAIDLATDSARE

SEQ ID NO: 975602 - protein, 25 aa, Mycobacterium
EDVIRFQAEFLWRDYFRGVTLDGEE

SEQ ID NO: 975603 - protein, 37 aa, Mycobacterium
EEGKSSNFLLPNGTFFFVLAIFLVVLGVIGTFVVPPI

SEQ ID NO: 975604 - protein, 25 aa, Mycobacterium
EENPFALLLVSLLGPIAATVVRLAV

SEQ ID NO: 975605 - protein, 21 aa, Mycobacterium
EERLGMPPIPLHHLQVPNSQS

SEQ ID NO: 975606 - protein, 26 aa, Mycobacterium
EFGRRPAVIAALVSCAVLTVIVVVRK

SEQ ID NO: 975607 - protein, 35 aa, Mycobacterium
EFLRKRLTHLTKRQLFWVSLYYPLTMRVLCNAIMV

SEQ ID NO: 975608 - protein, 26 aa, Mycobacterium
EFMMRATIGFWLTPLLLSVPVFSRDT

SEQ ID NO: 975609 - protein, 34 aa, Mycobacterium
EGLTLPPPHEPKSPHWFLWVVAGASVVLVVGLVM

SEQ ID NO: 975610 - protein, 17 aa, Mycobacterium
EGPGWVAVLPAGTMRRF

SEQ ID NO: 975611 - protein, 24 aa, Mycobacterium
EGRSTLFLLTYFTQGHLTAVDTWA

SEQ ID NO: 975612 - protein, 18 aa, Mycobacterium
EGVAWLYSFIKAQGERNY

SEQ ID NO: 975613 - protein, 21 aa, Mycobacterium
EHPPIGVVIFVGGAATGLDDG

SEQ ID NO: 975614 - protein, 19 aa, Mycobacterium
EHPTINALAAYLIAPAPDP

SEQ ID NO: 975615 - protein, 24 aa, Mycobacterium
EHYFRTFLRPDDVFWSFLEAVIIT

SEQ ID NO: 975616 - protein, 26 aa, Mycobacterium
EIIRLVRRLLPALVVVLTGCALLTVV

SEQ ID NO: 975617 - protein, 29 aa, Mycobacterium
EIPCVCALLTLLPDNLRWLVTVDAIHTQV

SEQ ID NO: 975618 - protein, 26 aa, Mycobacterium
EIPCVCALLTLLPDSLRWLVTVDAMH

SEQ ID NO: 975619 - protein, 23 aa, Mycobacterium
EKLTKPVWLVILGAAVSLTSILG

SEQ ID NO: 975620 - protein, 28 aa, Mycobacterium
EKPDDPNWSWLKWLPHIQHPTETDAAGA

SEQ ID NO: 975621 - protein, 51 aa, Mycobacterium
ELAMLFHAKKSTGHWWWLVAAVAVLLVIVMFVLLALGWRRRRTAHDIVADS

SEQ ID NO: 975622 - protein, 17 aa, Mycobacterium
ELCVYLRSLIGDGVLAV

SEQ ID NO: 975623 - protein, 22 aa, Mycobacterium
ELGIYRCCWWRFAFLHSKLIQS

SEQ ID NO: 975624 - protein, 22 aa, Mycobacterium
ELLYAGEIWGVAFVVVVVAATK

SEQ ID NO: 975625 - protein, 17 aa, Mycobacterium
ELMFCRNSIDLHHKQAA

SEQ ID NO: 975626 - protein, 34 aa, Mycobacterium
ELVLTVTPFLIISMLFYFTVIVQDKMLYLAKDPE

SEQ ID NO: 975627 - protein, 19 aa, Mycobacterium
EPGDWLYFVTVDTQGTTLF

SEQ ID NO: 975628 - protein, 26 aa, Mycobacterium
EPLPQWQITLYWRTKGQPLWTNDALL

SEQ ID NO: 975629 - protein, 22 aa, Mycobacterium
EPRLRALGWTGVLDKGPDVDAG

SEQ ID NO: 975630 - protein, 19 aa, Mycobacterium
EPVPDRFAGIAISEFIWAR

SEQ ID NO: 975631 - protein, 21 aa, Mycobacterium
ERIQPVLVGIQLALTELWRSY

SEQ ID NO: 975632 - protein, 31 aa, Mycobacterium
ERNFRWYLAGYGLIFWSLFASAHLAIRRFAP

SEQ ID NO: 975633 - protein, 22 aa, Mycobacterium
ESAPWPAIPGPRRGAVSSFGLS

SEQ ID NO: 975634 - protein, 29 aa, Mycobacterium
ESKSKVALYLLITIAPFAVIAPLIGPALD

SEQ ID NO: 975635 - protein, 26 aa, Mycobacterium
ETARASWLVLTDWDPSIKSLTDEFIA

SEQ ID NO: 975636 - protein, 26 aa, Mycobacterium
ETQFYVPASIKQVWLGDTATGPCGAV

SEQ ID NO: 975637 - protein, 34 aa, Mycobacterium
ETVALLLHIGVMLAFLLIVLHSKHLHIFLAPINV

SEQ ID NO: 975638 - protein, 17 aa, Mycobacterium
EVAAGITVFVLAGKYYT

SEQ ID NO: 975639 - protein, 21 aa, Mycobacterium
EVAVFVFFGLVAVLGTEYTQA

SEQ ID NO: 975640 - protein, 27 aa, Mycobacterium
EVEDQVFRFSRILDVAPRLAILLDDYA

SEQ ID NO: 975641 - protein, 31 aa, Mycobacterium; identical to SEQ ID NO: 20533

SEQ ID NO: 975642 - protein, 22 aa, Mycobacterium
EVLLTFYPGWVTIGLVAALVCG

SEQ ID NO: 975643 - protein, 17 aa, Mycobacterium
EVTLLPAPMFHALGYLH

SEQ ID NO: 975644 - protein, 24 aa, Mycobacterium
EVYNGRLGVWFETKLTREGVDDAA

SEQ ID NO: 975645 - protein, 21 aa, Mycobacterium
EWHVLVAGACTFLALPRLTRV

SEQ ID NO: 975646 - protein, 30 aa, Mycobacterium
FAAGAIVGYYLLRRALLPTGGHLFGVQEIR

SEQ ID NO: 975647 - protein, 19 aa, Mycobacterium
FAALTWPIAIAVSPALTYG

SEQ ID NO: 975648 - protein, 23 aa, Mycobacterium
FAATWYTLLLAYTAFTVVLMTLL

SEQ ID NO: 975649 - protein, 17 aa, Mycobacterium
FAGLAFGAANVVALVVL

SEQ ID NO: 975650 - protein, 19 aa, Mycobacterium
FALIYVDRWFTLGHGRLFA

SEQ ID NO: 975651 - protein, 27 aa, Mycobacterium
FAWALSVMFLVFTLRALLYKPFVRQIR

SEQ ID NO: 975652 - protein, 26 aa, Mycobacterium
FCSGTIIFAILVLLGRYINYTLDLAG

SEQ ID NO: 975653 - protein, 17 aa, Mycobacterium
FDDPLQFYSRSIALGIV

SEQ ID NO: 975654 - protein, 17 aa, Mycobacterium
FDTLVRYHWGHEFMAIH

SEQ ID NO: 975655 - protein, 30 aa, Mycobacterium
FEFEIPRAMFWIVIVYVLLATIITFWIGRP

SEQ ID NO: 975656 - protein, 26 aa, Mycobacterium
FEIEFYQVYLVFVLGFPLVGSADLVV

SEQ ID NO: 975657 - protein, 19 aa, Mycobacterium
FEVVGRRRLWYSVGGVIVA

SEQ ID NO: 975658 - protein, 18 aa, Mycobacterium
FFDVVAFGLALAWLATIW

SEQ ID NO: 975659 - protein, 19 aa, Mycobacterium
FFTTATGAKLLYGPVLGKY

SEQ ID NO: 975660 - protein, 21 aa, Mycobacterium
FGFGVGSILYICFRSLVIRAP

SEQ ID NO: 975661 - protein, 26 aa, Mycobacterium
FGGGSMFLLVGILAALWERQTSGKGQ

SEQ ID NO: 975662 - protein, 20 aa, Mycobacterium
FGGMLLIAIGAALIAGVWDD

SEQ ID NO: 975663 - protein, 26 aa, Mycobacterium
FGITAFLTLAFPLSLRFDSLNLTGLA

SEQ ID NO: 975664 - protein, 25 aa, Mycobacterium
FGLRRWYVITLLMGLFFVLGQGYEY

SEQ ID NO: 975665 - protein, 26 aa, Mycobacterium
FGLSVLLWQHILGIELHYLVLAMSVI

SEQ ID NO: 975666 - protein, 41 aa, Mycobacterium
FGQRRLLQWSLPGLTHLFTMWGFFILLTVYIEAYGVLFQPN

SEQ ID NO: 975667 - protein, 23 aa, Mycobacterium
FGSPYAIFLLREHFRIIPNDLIN

SEQ ID NO: 975668 - protein, 17 aa, Mycobacterium
FGVVTFNTGSRGWVPGR

SEQ ID NO: 975669 - protein, 18 aa, Mycobacterium
FIPVLKANGYRLVTVTEL

SEQ ID NO: 975670 - protein, 17 aa, Mycobacterium
FKMAKHFHLDITDTTLT

SEQ ID NO: 975671 - protein, 20 aa, Mycobacterium
FLGSTLVLRRRFKPATVLED

SEQ ID NO: 975672 - protein, 17 aa, Mycobacterium
FLISRYHDYIRMGSGSA

SEQ ID NO: 975673 - protein, 34 aa, Mycobacterium
FMAIHFLLVGYIFYWAIIGIDPGPRRLPYLARIG

SEQ ID NO: 975674 - protein, 30 aa, Mycobacterium
FMMPSIAALLGRWFWWPQQGRTRPLLTVAA

SEQ ID NO: 975675 - protein, 21 aa, Mycobacterium
FNIDLLLYPFRPIHATIVVWF

SEQ ID NO: 975676 - protein, 41 aa, Mycobacterium
FQDGEQFWELLFINPTAAFQFLLYIVVLDLPTHIVQLGTWL

SEQ ID NO: 975677 - protein, 19 aa, Mycobacterium
FRGYFYWDDLILIGKTGTQ

SEQ ID NO: 975678 - protein, 22 aa, Mycobacterium
FRPVRLFIINIVLTGLAMLAAG

SEQ ID NO: 975679 - protein, 29 aa, Mycobacterium
FSAMVIWWLFFAGLVWVVLWWAGGVWVVD

SEQ ID NO: 975680 - protein, 19 aa, Mycobacterium
FSAQFFSGLVSPATMFISN

SEQ ID NO: 975681 - protein, 21 aa, Mycobacterium
FSGANNRYIPVRRPPSSSAVI

SEQ ID NO: 975682 - protein, 21 aa, Mycobacterium
FSMGRALLVTALVPPCIILFF

SEQ ID NO: 975683 - protein, 23 aa, Mycobacterium
FTLVDVAVIFGFLLWHVIGANSS

SEQ ID NO: 975684 - protein, 33 aa, Mycobacterium
FTNRVELLKLAVILALWAAVAGAFVSVFYRRQS

SEQ ID NO: 975685 - protein, 19 aa, Mycobacterium
FTTSWIKQFSIAGILWVVL

SEQ ID NO: 975686 - protein, 25 aa, Mycobacterium
FVETGLLFPLLPGESLLFTGGLLAT

SEQ ID NO: 975687 - protein, 19 aa, Mycobacterium
FVLIAVLVFMLLGSFILPH

SEQ ID NO: 975688 - protein, 18 aa, Mycobacterium
FVNFYSCDITLKINGLQP

SEQ ID NO: 975689 - protein, 32 aa, Mycobacterium
FVVQPTFLYELIWNVLVFFALIYVDRWFTLGH

SEQ ID NO: 975690 - protein, 17 aa, Mycobacterium
FWAKVRRGALFKAAAVL

SEQ ID NO: 975691 - protein, 21 aa, Mycobacterium
FWTRWVGWVMHRPWISASAAS

SEQ ID NO: 975692 - protein, 19 aa, Mycobacterium
FYYLSITWVGALEPWRLRR

SEQ ID NO: 975693 - protein, 28 aa, Mycobacterium
GAAAKLYPLLFLVPLFVLGVRTGRLGGV

SEQ ID NO: 975694 - protein, 27 aa, Mycobacterium
GAAVPYIRWPAWLRTVVATVALAAILS

SEQ ID NO: 975695 - protein, 31 aa, Mycobacterium
GAGLFVAFDQLWRWNSIVALVLSVLVILGLV

SEQ ID NO: 975696 - protein, 17 aa, Mycobacterium
GAHLFHTSSKRVWDYVR

SEQ ID NO: 975697 - protein, 25 aa, Mycobacterium
GAILIAWYLILRLFKYTLSSVAAPT

SEQ ID NO: 975698 - protein, 23 aa, Mycobacterium
GALIYFVMMVWPQADGLIDAQAF

SEQ ID NO: 975699 - protein, 24 aa, Mycobacterium
GALLAALIRRPSVLDPAINLKGVT

SEQ ID NO: 975700 - protein, 20 aa, Mycobacterium
GAPEKILPRCRFADPEADVA

SEQ ID NO: 975701 - protein, 23 aa, Mycobacterium
GAPIGIVLLLLTLGLEFSATEFA

SEQ ID NO: 975702 - protein, 22 aa, Mycobacterium
GASWAFVVMPFMGTYDSVLMDV

SEQ ID NO: 975703 - protein, 25 aa, Mycobacterium
GATITLRILMHLPVAIGAVLAIAVW

SEQ ID NO: 975704 - protein, 25 aa, Mycobacterium
GATLYALLVNRWPLPEAGMHSGLAP

SEQ ID NO: 975705 - protein, 23 aa, Mycobacterium
GAVEALRWAMMRGEPLVVLADAL

SEQ ID NO: 975706 - protein, 23 aa, Mycobacterium
GDTRLELWRSDMVRMLAYGEIDA

SEQ ID NO: 975707 - protein, 18 aa, Mycobacterium
GDVYLVIDNYRALVEENE

SEQ ID NO: 975708 - protein, 20 aa, Mycobacterium
GEFLSIFLSPTETLKHFVSL

SEQ ID NO: 975709 - protein, 32 aa, Mycobacterium
GEHSIGWLAISLLGAILVPCRRRYWLVAGAGV

SEQ ID NO: 975710 - protein, 26 aa, Mycobacterium
GEIALYSFIVLLLTGVYLTLFFDPSM

SEQ ID NO: 975711 - protein, 17 aa, Mycobacterium
GEVMIFVGKNFVVTVRH

SEQ ID NO: 975712 - protein, 30 aa, Mycobacterium
GFAVHVVAILLLVLSYREFWAKVRRGALFK

SEQ ID NO: 975713 - protein, 17 aa, Mycobacterium
GFEPPLTYAAMAVAMRK

SEQ ID NO: 975714 - protein, 18 aa, Mycobacterium
GFFAALINVRIAAPVITG

SEQ ID NO: 975715 - protein, 17 aa, Mycobacterium
GFGLITNLKMISPFDCY

SEQ ID NO: 975716 - protein, 25 aa, Mycobacterium
GGAAVTGLALLRRASLRQAVADGVA

SEQ ID NO: 975717 - protein, 25 aa, Mycobacterium
GGITVLTGLLWWTVAIHLLTSMIMV

SEQ ID NO: 975718 - protein, 23 aa, Mycobacterium
GGLGAPVLLYLAAAGVGTIGIID

SEQ ID NO: 975719 - protein, 26 aa, Mycobacterium
GGVLLWQHLFWFFGHPEVYIIALPFF

SEQ ID NO: 975720 - protein, 21 aa, Mycobacterium
GGYTLTIRYILAADGSHSCVR

SEQ ID NO: 975721 - protein, 25 aa, Mycobacterium
GHPIGVLFAIILLDASLIGANVVGL

SEQ ID NO: 975722 - protein, 21 aa, Mycobacterium
GHRRDGIALALLGLAVVVAAS

SEQ ID NO: 975723 - protein, 18 aa, Mycobacterium
GHVVDFLSIGWWPVFNVA

SEQ ID NO: 975724 - protein, 27 aa, Mycobacterium
GIAILARNHRWFVIANYGCARVGARII

SEQ ID NO: 975725 - protein, 27 aa, Mycobacterium
GIATTLVVFQATLLRGCPWALAISPPV

SEQ ID NO: 975726 - protein, 18 aa, Mycobacterium
GINLFGAAFRFLATRRCS

SEQ ID NO: 975727 - protein, 20 aa, Mycobacterium
GIPLAQIGQFSGPSARLSAR

SEQ ID NO: 975728 - protein, 17 aa, Mycobacterium
GISGPEALWQFLCDRRS

SEQ ID NO: 975729 - protein, 32 aa, Mycobacterium
GISIFKLLSRIWIPLVILVVLVVGGFVVYRVH

SEQ ID NO: 975730 - protein, 20 aa, Mycobacterium
GIVPWWFVVALLARDVLLTA

SEQ ID NO: 975731 - protein, 17 aa, Mycobacterium
GIVTAVMPVIEWIYVRQ

SEQ ID NO: 975732 - protein, 23 aa, Mycobacterium
GKIYVRFPEAVSMRQYLGAPHGA

SEQ ID NO: 975733 - protein, 41 aa, Mycobacterium
GKLVNFVMKRPLVFAIPIVIGMILLVIPLGNLSFGGMSEKY

SEQ ID NO: 975734 - protein, 23 aa, Mycobacterium
GKVNPGIFSLISRATCVDLDGNR

SEQ ID NO: 975735 - protein, 21 aa, Mycobacterium
GKVRDVVIALAADLALTGARS

SEQ ID NO: 975736 - protein, 17 aa, Mycobacterium
GLALALLSAPWLIMVGA

SEQ ID NO: 975737 - protein, 21 aa, Mycobacterium
GLALFVFWLLLIARVVVEFIR

SEQ ID NO: 975738 - protein, 30 aa, Mycobacterium
GLALLAGMITLWLGLMADVSQVIDGDATGF

SEQ ID NO: 975739 - protein, 18 aa, Mycobacterium
GLAMVVWAIAVAGALTLA

SEQ ID NO: 975740 - protein, 26 aa, Mycobacterium
GLFGVLRWTAVGLVATLVASLALTAC

SEQ ID NO: 975741 - protein, 29 aa, Mycobacterium
GLGMPIPLGWQLWLYGVFAISAVGITSSS

SEQ ID NO: 975742 - protein, 26 aa, Mycobacterium
GLLGFFALACWIALAGLTPTGLMLAA

SEQ ID NO: 975743 - protein, 25 aa, Mycobacterium
GLNGTPNLAPWVALRLLSQGPTLSR

SEQ ID NO: 975744 - protein, 20 aa, Mycobacterium
GLNYRDLYLEPPPPGMVPSC

SEQ ID NO: 975745 - protein, 25 aa, Mycobacterium
GLRNTFWALVLPFMFGSPYAIFLLR

SEQ ID NO: 975746 - protein, 25 aa, Mycobacterium
GMHGFWMSLGIFSILAVIFIARVMA

SEQ ID NO: 975747 - protein, 19 aa, Mycobacterium
GMPDFRISLVSPLTIRAGC

SEQ ID NO: 975748 - protein, 26 aa, Mycobacterium
GMQLTLTELWRSYGVQPDLVIGHSLG

SEQ ID NO: 975749 - protein, 19 aa, Mycobacterium
GMSYVWWALAVIVATGLTV

SEQ ID NO: 975750 - protein, 32 aa, Mycobacterium
GPAIVGFKPALWAAGLVLLAAWMPFNNGLRPE

SEQ ID NO: 975751 - protein, 27 aa, Mycobacterium
GPFLSYGIQWISFGIIAPIGLGYLAYA

SEQ ID NO: 975752 - protein, 25 aa, Mycobacterium
GPLDRYFDYAAGRLGWRTLDFEVEV

SEQ ID NO: 975753 - protein, 26 aa, Mycobacterium
GPRLGVRWWRFLGGILLGLACATKWS

SEQ ID NO: 975754 - protein, 20 aa, Mycobacterium
GPVPVWLDKVRFRYPHAGQD

SEQ ID NO: 975755 - protein, 34 aa, Mycobacterium
GRIGAFVRWGIRTPWPLFSLSMLQSDIIGALFVL

SEQ ID NO: 975756 - protein, 31 aa, Mycobacterium
GRLIRTLTVSFWAPIPFAAGLMTLVFIGSMV

SEQ ID NO: 975757 - protein, 25 aa, Mycobacterium
GRMATAWLVTLPLAGSVGAVTYWIV

SEQ ID NO: 975758 - protein, 19 aa, Mycobacterium
GRRCSLMALLAIAVLATAA

SEQ ID NO: 975759 - protein, 18 aa, Mycobacterium
GRRVGVSLRLLIIGSLTG

SEQ ID NO: 975760 - protein, 22 aa, Mycobacterium
GRWNAIGFLQDFFALAVLTSTV

SEQ ID NO: 975761 - protein, 26 aa, Mycobacterium
GRWTIILARFLPFMRTFTPVIAGLSY

SEQ ID NO: 975762 - protein, 27 aa, Mycobacterium
GSAGASLWWMIGLLVAAGVLGLMVVLS

SEQ ID NO: 975763 - protein, 23 aa, Mycobacterium
GSEFLDVLAWVPDPRDPRGRRYS

SEQ ID NO: 975764 - protein, 23 aa, Mycobacterium
GSGTLITFPTLVALGYSPVTSTM

SEQ ID NO: 975765 - protein, 18 aa, Mycobacterium
GSHAKLLARRGAYYRMTQ

SEQ ID NO: 975766 - protein, 62 aa, Mycobacterium
GSRLNRTWLLHLNRQVNWRWVRYSLYLAVVVLLLLPIVTFTMTYFMVKVPRPGDIRTNQVST

SEQ ID NO: 975767 - protein, 17 aa, Mycobacterium
GSSALILASYYPQQFPY

SEQ ID NO: 975768 - protein, 29 aa, Mycobacterium
GTAAWLHSAVWWKALLALVVAVALVIGVN

SEQ ID NO: 975769 - protein, 34 aa, Mycobacterium
GTILGTMFFLTFAPTKWVHHFGLFAALGAAVAAL

SEQ ID NO: 975770 - protein, 30 aa, Mycobacterium
GTMLLRLCMLPGLALLIWATPRLAQHFGAD

SEQ ID NO: 975771 - protein, 20 aa, Mycobacterium
GTPLPAKIPLPKAAESSASR

SEQ ID NO: 975772 - protein, 25 aa, Mycobacterium
GTQLRIMFVVLLGALMIASFIYATF

SEQ ID NO: 975773 - protein, 31 aa, Mycobacterium
GTTIGLGLLFDTLIVRSFMMPSIAALLGRWF

SEQ ID NO: 975774 - protein, 25 aa, Mycobacterium
GTVFLIVSVLLLTLVRPAVRRLTPA

SEQ ID NO: 975775 - protein, 21 aa, Mycobacterium
GVAIGPWRLLLRDLTHLLDTA

SEQ ID NO: 975776 - protein, 18 aa, Mycobacterium
GVEPPVTLILQGASLQDL

SEQ ID NO: 975777 - protein, 24 aa, Mycobacterium
GVFRTLYVLPWICAPLAIAVLWRW

SEQ ID NO: 975778 - protein, 20 aa, Mycobacterium
GVFTRILALILKFTIGFWLG

SEQ ID NO: 975779 - protein, 29 aa, Mycobacterium
GVLPETDFRLLPKYMDMLNMFDAWEFGRG

SEQ ID NO: 975780 - protein, 23 aa, Mycobacterium
GVLTIVMGLVFVGLLPALQRQVQ

SEQ ID NO: 975781 - protein, 35 aa, Mycobacterium
GVLWGVWLVIVGWLTLWPFLNWLTTHFVVTNRRVM

SEQ ID NO: 975782 - protein, 17 aa, Mycobacterium
GVNFWLLRRDSVTIGTD

SEQ ID NO: 975783 - protein, 25 aa, Mycobacterium
GVPLALMRSLRYRALDLDNAQQDYS

SEQ ID NO: 975784 - protein, 28 aa, Mycobacterium
GVQLILSPFTAIALSKWSALSPTGRCNS

SEQ ID NO: 975785 - protein, 25 aa, Mycobacterium
GVQLIVVLTAAWLLATPLTQSKEQP

SEQ ID NO: 975786 - protein, 24 aa, Mycobacterium
GVTPLYALLTFLSKILSGFAIPVN

SEQ ID NO: 975787 - protein, 20 aa, Mycobacterium
GVYYTLLPRDDQLASLLAVD

SEQ ID NO: 975788 - protein, 20 aa, Mycobacterium
GWEVDPYAIPLLQTAHRTGA

SEQ ID NO: 975789 - protein, 30 aa, Mycobacterium
GWSKVQTIATPAWYAPLVLTVGGIAQNGMP

SEQ ID NO: 975790 - protein, 22 aa, Mycobacterium
GWVQLGMLGLIGTAAAIGNFAG

SEQ ID NO: 975791 - protein, 24 aa, Mycobacterium
GYAFARLRFPGRDTLFWAYIMTLM

SEQ ID NO: 975792 - protein, 31 aa, Mycobacterium
GYGFLFGLAFYLPLLSWISSLVGATPWWALA

SEQ ID NO: 975793 - protein, 18 aa, Mycobacterium
GYLFGVYLQNVSGGAYLA

SEQ ID NO: 975794 - protein, 35 aa, Mycobacterium
HALIGRSWLMTPLRVMFLIGLVFLALGWSTKAACL

SEQ ID NO: 975795 - protein, 18 aa, Mycobacterium
HASIALLALAALSAKDAA

SEQ ID NO: 975796 - protein, 20 aa, Mycobacterium
HATLAMFLGSTLVLRRRFKP

SEQ ID NO: 975797 - protein, 26 aa, Mycobacterium
HCAAVGRISYLLGLRGPAMAVDTACS

SEQ ID NO: 975798 - protein, 24 aa, Mycobacterium
HEETAGLWPLLRVPALIACGDHDL

SEQ ID NO: 975799 - protein, 28 aa, Mycobacterium
HFESILVRGLMNYTFWMPNGSPEYRYCL

SEQ ID NO: 975800 - protein, 20 aa, Mycobacterium
HGIVSALHRPVPLSGEGSDT

SEQ ID NO: 975801 - protein, 32 aa, Mycobacterium
HGLAFETNWLYPFIEFRLPRLGTSVFHGVEIE

SEQ ID NO: 975802 - protein, 17 aa, Mycobacterium
HGRPFRRRNARPAIFVV

SEQ ID NO: 975803 - protein, 17 aa, Mycobacterium
HGYTYGLLWVAGAVVIV

SEQ ID NO: 975804 - protein, 27 aa, Mycobacterium
HHHVVFILSLILIWTQPRPAPLVRRRV

SEQ ID NO: 975805 - protein, 25 aa, Mycobacterium
HIDAVHGLYYLLMHGWFAIFPSTEF

SEQ ID NO: 975806 - protein, 29 aa, Mycobacterium
HISAPRAKLFAALFLILALVVIGEVVGVV

SEQ ID NO: 975807 - protein, 17 aa, Mycobacterium
HLGPLPIRAYALLIILG

SEQ ID NO: 975808 - protein, 21 aa, Mycobacterium
HLITPIITQPKKAAAALVWLV

SEQ ID NO: 975809 - protein, 19 aa, Mycobacterium
HNPALTSIAVLNRSKTFNA

SEQ ID NO: 975810 - protein, 17 aa, Mycobacterium
HPFTLWRSRFSVAIDAL

SEQ ID NO: 975811 - protein, 22 aa, Mycobacterium
HPGYRLHPVVLDAALQSVGAAI

SEQ ID NO: 975812 - protein, 23 aa, Mycobacterium
HPHWKRLIWPAVVLILATGLVSF

SEQ ID NO: 975813 - protein, 24 aa, Mycobacterium
HQVTGWRFVMRRIASGIALHDTRM

SEQ ID NO: 975814 - protein, 19 aa, Mycobacterium
HRWLARRTRRRINLGLVAG

SEQ ID NO: 975815 - protein, 25 aa, Mycobacterium
HSEYRAILIVWCFPPLLSVVYAGSH

SEQ ID NO: 975816 - protein, 26 aa, Mycobacterium
HSKRRLLLALFITALPFGFAFTVFFA

SEQ ID NO: 975817 - protein, 31 aa, Mycobacterium
HTAVSGILPIHLWQARLAPQAKPYRGWHRVH

SEQ ID NO: 975818 - protein, 34 aa, Mycobacterium
HTGRIDAINFWIRRACRLLPALVLMVLTVGIARE

SEQ ID NO: 975819 - protein, 17 aa, Mycobacterium
HTPIGLNLPFTYPPLAA

SEQ ID NO: 975820 - protein, 17 aa, Mycobacterium
HVENWYLIGFAALVFFV

SEQ ID NO: 975821 - protein, 27 aa, Mycobacterium
HVGQRWLPLLLAGFTSGFLLLRGRSYV

SEQ ID NO: 975822 - protein, 17 aa, Mycobacterium
HVPYFTSAFIYHLVAAF

SEQ ID NO: 975823 - protein, 22 aa, Mycobacterium
HYTYKWETFLTQEMPSWLQANK

SEQ ID NO: 975824 - protein, 29 aa, Mycobacterium
IAAGVNLLLSPAVFRGFDQVGALSPTGCC

SEQ ID NO: 975825 - protein, 18 aa, Mycobacterium
IAGILWVVLIGQLTGELF

SEQ ID NO: 975826 - protein, 24 aa, Mycobacterium
IAHSRWLRWLTQIYIDVFRGLLEE

SEQ ID NO: 975827 - protein, 22 aa, Mycobacterium
IAMIVNEWFGISSDGALCLGNE

SEQ ID NO: 975828 - protein, 42 aa, Mycobacterium
IANFDDFWRPIRSYFYWERHCFNIPICWSFRSIFDALDGVDQ

SEQ ID NO: 975829 - protein, 22 aa, Mycobacterium
IAQLLLVVAAGALWMAARLPWV

SEQ ID NO: 975830 - protein, 18 aa, Mycobacterium
IATMLLMTSILLTAGYVT

SEQ ID NO: 975831 - protein, 28 aa, Mycobacterium
IAVVVLLGWSFFYFSDDTRGYKFVDTSV

SEQ ID NO: 975832 - protein, 35 aa, Mycobacterium
IAWSMLIVVLFVPAALPWYYSWPLAVAAPLAQSRQ

SEQ ID NO: 975833 - protein, 21 aa, Mycobacterium
ICGVWGWYVLAPQLCPITTWL

SEQ ID NO: 975834 - protein, 20 aa, Mycobacterium
IDAMLLTKRPLISDAMLRVF

SEQ ID NO: 975835 - protein, 28 aa, Mycobacterium
IDSPSAGIEQLIFAPQGLLAAAAARRAL

SEQ ID NO: 975836 - protein, 18 aa, Mycobacterium
IEDASLAGLLLPLDSISW

SEQ ID NO: 975837 - protein, 18 aa, Mycobacterium
IEITLVKNPGMRYPSGGL

SEQ ID NO: 975838 - protein, 29 aa, Mycobacterium
IELRTTTLTLIYPTLSLSSWAAGSRKVAC

SEQ ID NO: 975839 - protein, 23 aa, Mycobacterium
IEPVYYPRYLILTAPAAAIVIAV

SEQ ID NO: 975840 - protein, 19 aa, Mycobacterium
IEWRLVMVAVLLFSRSRLT

SEQ ID NO: 975841 - protein, 20 aa, Mycobacterium
IFDDFLWPGYLRARANPAWA

SEQ ID NO: 975842 - protein, 17 aa, Mycobacterium
IFGIPGQGSYAAANSYL

SEQ ID NO: 975843 - protein, 23 aa, Mycobacterium
IFGLWGVFVLAPKLQPIAVFLNH

SEQ ID NO: 975844 - protein, 18 aa, Mycobacterium
IFMLCYAAAGVLTWKMYV

SEQ ID NO: 975845 - protein, 20 aa, Mycobacterium
IFRTIVFLPLAISSVVMAVV

SEQ ID NO: 975846 - protein, 27 aa, Mycobacterium
IFSAADKPVIFWTPDHGAFVVRGAMKA

SEQ ID NO: 975847 - protein, 19 aa, Mycobacterium
IFVQRATVIDLPTAVWHLL

SEQ ID NO: 975848 - protein, 36 aa, Mycobacterium
IGAAALTLLGVRRYVFARPLLLPTTSRLVASGVTIF

SEQ ID NO: 975849 - protein, 27 aa, Mycobacterium
IGAGVLYFYFVLPRWPELIGETTHTLG

SEQ ID NO: 975850 - protein, 25 aa, Mycobacterium
IGDARAGFGLLLKEAGYTLAAPADG

SEQ ID NO: 975851 - protein, 19 aa, Mycobacterium
IGGGWLLMVAMLYGWAFMN

SEQ ID NO: 975852 - protein, 20 aa, Mycobacterium
IGGLWAWIAPPIHAVVGLTR

SEQ ID NO: 975853 - protein, 18 aa, Mycobacterium
IGIELSAIMLFNHPTVAL

SEQ ID NO: 975854 - protein, 24 aa, Mycobacterium
IGMVILPLLVYFITYRWCIGLQRS

SEQ ID NO: 975855 - protein, 28 aa, Mycobacterium
IGNLLQMAFRFWAFRRWVFPDAFARNPE

SEQ ID NO: 975856 - protein, 25 aa, Mycobacterium
IGSFPILSVFGFVVMFGGVLFAITG

SEQ ID NO: 975857 - protein, 19 aa, Mycobacterium
IHRSHWWPMCAGTAWWCTA

SEQ ID NO: 975858 - protein, 18 aa, Mycobacterium
IIALPFFGIVSEIFPVFS

SEQ ID NO: 975859 - protein, 24 aa, Mycobacterium
IIANRLSYFLDLRGPSVAVDTACS

SEQ ID NO: 975860 - protein, 19 aa, Mycobacterium
IILGILFVSLLPALIAAWH

SEQ ID NO: 975861 - protein, 23 aa, Mycobacterium
IIPQFILMRVLGWTDTPWAMIVP

SEQ ID NO: 975862 - protein, 19 aa, Mycobacterium
IISLLIVVIVVWYYQLNVN

SEQ ID NO: 975863 - protein, 22 aa, Mycobacterium
IIVRLGIVMLAVTGLQALCSVG

SEQ ID NO: 975864 - protein, 18 aa, Mycobacterium
IKQFSIAGILWVVLIGQL

SEQ ID NO: 975865 - protein, 35 aa, Mycobacterium
IKTVLALQHAYIPRNVHFTQWNPAIDASTTRLFVP

SEQ ID NO: 975866 - protein, 17 aa, Mycobacterium
IKVRGWRRIGTVVVRWP

SEQ ID NO: 975867 - protein, 24 aa, Mycobacterium
ILAGLVVIVPLYAVAMIMAFLSPH

SEQ ID NO: 975868 - protein, 17 aa, Mycobacterium
ILIYTWLTALSTLVLAL

SEQ ID NO: 975869 - protein, 24 aa, Mycobacterium
ILPDTRRHLGRHLSLLDLISADNA

SEQ ID NO: 975870 - protein, 26 aa, Mycobacterium
ILTGLRLMLVPVFLVALFAGNGHEIV

SEQ ID NO: 975871 - protein, 18 aa, Mycobacterium
ILVLLPAAGLIAAAVVPN

SEQ ID NO: 975872 - protein, 27 aa, Mycobacterium
INCGYPLIERFPLMLGTAGSVLLIGLV

SEQ ID NO: 975873 - protein, 19 aa, Mycobacterium
INFLYYLFEPMAQSVLFST

SEQ ID NO: 975874 - protein, 24 aa, Mycobacterium
INNYLFNFPDTSIAWSFVLALLAA

SEQ ID NO: 975875 - protein, 20 aa, Mycobacterium
IPCVCALVTLLPDNLRWLVT

SEQ ID NO: 975876 - protein, 26 aa, Mycobacterium
IPCVRALLTLLPDNLRWLVTVDAMHT

SEQ ID NO: 975877 - protein, 18 aa, Mycobacterium
IPMLIRRLITLCPAIAIL

SEQ ID NO: 975878 - protein, 22 aa, Mycobacterium
IPPVLGTKLRSARHFHWGWVVA

SEQ ID NO: 975879 - protein, 20 aa, Mycobacterium
IQTPVISQFFGCTPLGPIAW

SEQ ID NO: 975880 - protein, 20 aa, Mycobacterium
IRAYALLIILGIVAALVVGG

SEQ ID NO: 975881 - protein, 17 aa, Mycobacterium
IRPLWVVATALVAFSGV

SEQ ID NO: 975882 - protein, 18 aa, Mycobacterium
ISFTVPLAISYPGSWAAA

SEQ ID NO: 975883 - protein, 24 aa, Mycobacterium
ISGATIFFFLFVHVLDAAMLRVNP

SEQ ID NO: 975884 - protein, 23 aa, Mycobacterium
ISHWPVDLLNYRRSIFGLFSVPT

SEQ ID NO: 975885 - protein, 22 aa, Mycobacterium
ISLPFMVWVWMRQLHNRRGYRP

SEQ ID NO: 975886 - protein, 22 aa, Mycobacterium
ISLVFLQLLVSLTLLRALYVIL

SEQ ID NO: 975887 - protein, 26 aa, Mycobacterium
ISTQLPQHGFLARFYTGLSRLYTGTG

SEQ ID NO: 975888 - protein, 21 aa, Mycobacterium
ISVIALPVMAPYLVGIAASQH

SEQ ID NO: 975889 - protein, 18 aa, Mycobacterium
ISVLLGFAGALGQLLIFY

SEQ ID NO: 975890 - protein, 30 aa, Mycobacterium
ISWPRPHVSFYLDPMTFWRAWSAEPNTAAA

SEQ ID NO: 975891 - protein, 23 aa, Mycobacterium
ITAPIIVFVWIFQRRIVAGLTSG

SEQ ID NO: 975892 - protein, 19 aa, Mycobacterium
ITLFSVFVLLVLKSLLTAW

SEQ ID NO: 975893 - protein, 18 aa, Mycobacterium
ITVLLPPALVLTWSGLRA

SEQ ID NO: 975894 - protein, 20 aa, Mycobacterium
IVALWALELLVTGAGIGTSW

SEQ ID NO: 975895 - protein, 23 aa, Mycobacterium
IVAWLLIVILLAWLFAPHNVNPS

SEQ ID NO: 975896 - protein, 35 aa, Mycobacterium
IVEALGLKLPAVPIPWSILSLFAVGPTLSRADALL

SEQ ID NO: 975897 - protein, 25 aa, Mycobacterium
IVLIPVGYMVFALLGARSVSSPMLL

SEQ ID NO: 975898 - protein, 36 aa, Mycobacterium
IVLPTPLSIPPPEGKPWWVIVIGVVVIGLVGGMVAM

SEQ ID NO: 975899 - protein, 18 aa, Mycobacterium
IVLRTILCAAAELGYSTL

SEQ ID NO: 975900 - protein, 18 aa, Mycobacterium
IVNKRLVWIIDGYTTLDN

SEQ ID NO: 975901 - protein, 24 aa, Mycobacterium
IVVMAGMYIIITTYRSISTSSVRD

SEQ ID NO: 975902 - protein, 27 aa, Mycobacterium
IVYNLPKMVSLLVEPWYALIGDREQTL

SEQ ID NO: 975903 - protein, 27 aa, Mycobacterium
IYGMNFRFMPELNWTWSYPLVMAGMTI

SEQ ID NO: 975904 - protein, 45 aa, Mycobacterium
IYQEAALTWLLLVSVPILAVTNYWIISHMLPLFRSMQSLIDDINR

SEQ ID NO: 975905 - protein, 19 aa, Mycobacterium
KDAWMVGYTPSLSTAVWVG

SEQ ID NO: 975906 - protein, 43 aa, Mycobacterium
KDLGFYAFELPFYRLVLSYVFVAVFLAFVVNLLAHYIFGGIRL

SEQ ID NO: 975907 - protein, 25 aa, Mycobacterium
KELFALLAYGFIVAAFYVFTGEARM

SEQ ID NO: 975908 - protein, 22 aa, Mycobacterium
KFPARLTIAVIGTALLAGLVGV

SEQ ID NO: 975909 - protein, 19 aa, Mycobacterium
KFVLLEPCVLFAKLNSRIP

SEQ ID NO: 975910 - protein, 18 aa, Mycobacterium
KGLELTIIFGLSGIVLAS

SEQ ID NO: 975911 - protein, 32 aa, Mycobacterium
KGNQFVMPDLSGMFWADAEPRLRALGWTGVLD

SEQ ID NO: 975912 - protein, 28 aa, Mycobacterium
KHHVLQSSWLHLLPSRKEGWGLAVVEAA

SEQ ID NO: 975913 - protein, 18 aa, Mycobacterium
KHLHIFLAPINVTFKRLP

SEQ ID NO: 975914 - protein, 25 aa, Mycobacterium
KILPYVMVGCIVGMIAIMVLGGTKQ

SEQ ID NO: 975915 - protein, 19 aa, Mycobacterium
KLAKLAGLLPGRDPYHPNR

SEQ ID NO: 975916 - protein, 31 aa, Mycobacterium
KLCIWYTQIAWLLLTSYLVAAIIALMVFGAT

SEQ ID NO: 975917 - protein, 21 aa, Mycobacterium
KLFGLAAKFPARLTIAVIGTA

SEQ ID NO: 975918 - protein, 18 aa, Mycobacterium
KLITGIGAPLLGRLMIYN

SEQ ID NO: 975919 - protein, 24 aa, Mycobacterium
KLLGDDCWWAPRWARLLQNRIGLG

SEQ ID NO: 975920 - protein, 19 aa, Mycobacterium
KLLQMRTFPTIAVGGDTAG

SEQ ID NO: 975921 - protein, 18 aa, Mycobacterium
KLRILLSFGDIAEFIALG

SEQ ID NO: 975922 - protein, 22 aa, Mycobacterium
KLRSLMAVARKDVVLSAGWNED

SEQ ID NO: 975923 - protein, 17 aa, Mycobacterium
KPLFRALDPDKINTIAS

SEQ ID NO: 975924 - protein, 24 aa, Mycobacterium
KQLITIARAFLARPQLLILDEATS

SEQ ID NO: 975925 - protein, 25 aa, Mycobacterium
KQLSPYMLMMPIMMVMMMAGGSGGG

SEQ ID NO: 975926 - protein, 45 aa, Mycobacterium
KRSALWEFAILAVIAIGLYYVMLTFVARPYLIPSESMEPTLHGCS

SEQ ID NO: 975927 - protein, 44 aa, Mycobacterium
KRTERMVTFWLLLGGVLGLTLLLIFLFWPWEYKPKEASGSFLYT

SEQ ID NO: 975928 - protein, 18 aa, Mycobacterium
KSLTDEFIARWRSPMRRV

SEQ ID NO: 975929 - protein, 18 aa, Mycobacterium
KTTLMLILAGREPTSGTV

SEQ ID NO: 975930 - protein, 23 aa, Mycobacterium
KVQQPINLLLLVGAIVAAVVIGL

SEQ ID NO: 975931 - protein, 26 aa, Mycobacterium
LAAFLTYFTQILMAVLMATMALVVLP

SEQ ID NO: 975932 - protein, 17 aa, Mycobacterium
LAALLRQRFPDLTPAQI

SEQ ID NO: 975933 - protein, 24 aa, Mycobacterium
LAAVTLMPALLVLAGTRGWVAPRR

SEQ ID NO: 975934 - protein, 19 aa, Mycobacterium
LADHKVFGQPIMPAAAFAE

SEQ ID NO: 975935 - protein, 22 aa, Mycobacterium
LAEVIWLVIGLLGLSVPEITAA

SEQ ID NO: 975936 - protein, 26 aa, Mycobacterium
LAFTIESRALTFQPKKIRQQLEEAKQ

SEQ ID NO: 975937 - protein, 22 aa, Mycobacterium
LAFTILAVLLVGPTPTLVARST

SEQ ID NO: 975938 - protein, 19 aa, Mycobacterium
LAGLLLPLDSISWPRPHVS

SEQ ID NO: 975939 - protein, 24 aa, Mycobacterium
LAHPGLPLWPYLACAALTGLGGGN

SEQ ID NO: 975940 - protein, 17 aa, Mycobacterium
LAHRMCVASLPYAQADL

SEQ ID NO: 975941 - protein, 18 aa, Mycobacterium
LAILVLSGFVGFAVISKV

SEQ ID NO: 975942 - protein, 18 aa, Mycobacterium
LALFCDAVRNAYGWGAHD

SEQ ID NO: 975943 - protein, 19 aa, Mycobacterium
LALGWWQWTRFQSASGTFQ

SEQ ID NO: 975944 - protein, 21 aa, Mycobacterium
LALLIMPVIGLWAMIATLRAG

SEQ ID NO: 975945 - protein, 20 aa, Mycobacterium
LAMSVMLWAFFNLLPRDAEI

SEQ ID NO: 975946 - protein, 32 aa, Mycobacterium
LARIWPAWEFYFWHHTIPAPVWVAVIMALVFV

SEQ ID NO: 975947 - protein, 24 aa, Mycobacterium
LAVANLMWFVFAGLGALTVKMNMI

SEQ ID NO: 975948 - protein, 27 aa, Mycobacterium
LAVIARFIQFIIVPIALFALARSRTTN

SEQ ID NO: 975949 - protein, 17 aa, Mycobacterium
LAVIPIWRRDPFGAGRG

SEQ ID NO: 975950 - protein, 18 aa, Mycobacterium
LAYLLLVLLCQRRWQPRL

SEQ ID NO: 975951 - protein, 22 aa, Mycobacterium
LCGVSWVYHYAVAVYRDDRGCG

SEQ ID NO: 975952 - protein, 17 aa, Mycobacterium
LCIWRMRSARISGSLLV

SEQ ID NO: 975953 - protein, 19 aa, Mycobacterium
LCPAIAILALGFDPTRALV

SEQ ID NO: 975954 - protein, 19 aa, Mycobacterium
LDAGRRWAYRPFIGSFIVL

SEQ ID NO: 975955 - protein, 19 aa, Mycobacterium
LDEAAGFAIPFVPRGLDEI

SEQ ID NO: 975956 - protein, 30 aa, Mycobacterium
LDFIADPYKYFLRFFQRLGFRPAIAVVLAI

SEQ ID NO: 975957 - protein, 28 aa, Mycobacterium
LDTAAVFAGWLWPLWDSRRRTFADILLR

SEQ ID NO: 975958 - protein, 20 aa, Mycobacterium
LEATFTAIFVPVLVRAERSD

SEQ ID NO: 975959 - protein, 18 aa, Mycobacterium
LEDFAMAAYLPLFAVLAA

SEQ ID NO: 975960 - protein, 17 aa, Mycobacterium
LEELLTDPVLRDQLGAK

SEQ ID NO: 975961 - protein, 22 aa, Mycobacterium
LEPVSHMWVVKFLRTHGLVHDC

SEQ ID NO: 975962 - protein, 18 aa, Mycobacterium
LFWFTCSTGVLLLWSWLV

SEQ ID NO: 975963 - protein, 40 aa, Mycobacterium
LGAGPIARLWRGLLLFFSRWWQLETLYRSNIKYLPDWVPR

SEQ ID NO: 975964 - protein, 25 aa, Mycobacterium
LGAISAIPQLLRWLESTRGLRMSEQ

SEQ ID NO: 975965 - protein, 19 aa, Mycobacterium
LGFGGMSEVHLARDIRLHR

SEQ ID NO: 975966 - protein, 17 aa, Mycobacterium
LGFVAFYLSFVAALPPP

SEQ ID NO: 975967 - protein, 20 aa, Mycobacterium
LGGLGISVALWQHILGHELQ

SEQ ID NO: 975968 - protein, 25 aa, Mycobacterium
LGIAGLLGRIPLPGSAPVLVWLSSF

SEQ ID NO: 975969 - protein, 23 aa, Mycobacterium
LGKIFALSVFIAGGLWTIITQHV

SEQ ID NO: 975970 - protein, 17 aa, Mycobacterium
LGLALLIMPVIGLWAMI

SEQ ID NO: 975971 - protein, 35 aa, Mycobacterium
LGLCVLVFQVLLRQQLHWSVPGLAFVVLVAVGADY

SEQ ID NO: 975972 - protein, 21 aa, Mycobacterium
LGMALLVVGPLMRPGYLLLRD

SEQ ID NO: 975973 - protein, 18 aa, Mycobacterium
LGMPPWRVQKAQQQARRW

SEQ ID NO: 975974 - protein, 28 aa, Mycobacterium
LGSDPFVAILAFPFIPQAMRDHYTELEI

SEQ ID NO: 975975 - protein, 34 aa, Mycobacterium
LGTIAYTLYLWHWPLLIFWLSYTGHHHANFVEGA

SEQ ID NO: 975976 - protein, 28 aa, Mycobacterium
LGTISYGIYLWHWPIFLALNGERTGWSG

SEQ ID NO: 975977 - protein, 30 aa, Mycobacterium
LGVEEQYYLVWPLLLIAVTLLLAARARRRC

SEQ ID NO: 975978 - protein, 24 aa, Mycobacterium
LGVIMMAAVLWPGVAAGLAGVLTV

SEQ ID NO: 975979 - protein, 35 aa, Mycobacterium; identical to SEQ ID NO: 22414

SEQ ID NO: 975980 - protein, 29 aa, Mycobacterium
LGYSTLFEIRFEQPIFANLPRLIQVVVDN

SEQ ID NO: 975981 - protein, 24 aa, Mycobacterium
LIAAFGMRLIFPAVIVWATAKLDP

SEQ ID NO: 975982 - protein, 24 aa, Mycobacterium
LIALTYTRLPWRPLQMVPAKRSEL

SEQ ID NO: 975983 - protein, 25 aa, Mycobacterium
LIGGQFTVWLTWPYRTVGALAGFGA

SEQ ID NO: 975984 - protein, 17 aa, Mycobacterium
LIKRMVRRIRPNHPAVT

SEQ ID NO: 975985 - protein, 20 aa, Mycobacterium
LILASYYPQQFPYAASLSGF

SEQ ID NO: 975986 - protein, 32 aa, Mycobacterium
LILRENVVALAVLWLLNIGEYLQDLTLRRTRR

SEQ ID NO: 975987 - protein, 26 aa, Mycobacterium
LIPRLYALHILLIPGVILALIGLHLA

SEQ ID NO: 975988 - protein, 27 aa, Mycobacterium
LISVKTLTFLVFIAVLLAINIFGNLVI

SEQ ID NO: 975989 - protein, 31 aa, Mycobacterium
LISVLPVLALMVVAVWLLGVGTLKDLALVQL

SEQ ID NO: 975990 - protein, 20 aa, Mycobacterium
LIVRNWRLIGKCLRPLPNKW

SEQ ID NO: 975991 - protein, 17 aa, Mycobacterium
LIWGTYAYLWAFVLYVV

SEQ ID NO: 975992 - protein, 22 aa, Mycobacterium
LKEPYLRPVTMNADLSFSPCLG

SEQ ID NO: 975993 - protein, 22 aa, Mycobacterium
LKGLVRVLALENPDLRATLLDL

SEQ ID NO: 975994 - protein, 17 aa, Mycobacterium
LKSHYLMIVKPNQAKIL

SEQ ID NO: 975995 - protein, 21 aa, Mycobacterium
LKTSWYLLGPAFVAAIAYVDP

SEQ ID NO: 975996 - protein, 18 aa, Mycobacterium
LLALCGVDGLPFEWSVKS

SEQ ID NO: 975997 - protein, 17 aa, Mycobacterium
LLFVFTQTIRHRDFFLP

SEQ ID NO: 975998 - protein, 25 aa, Mycobacterium
LLGTVPMGLLAYRYRFRVLMTAMVA

SEQ ID NO: 975999 - protein, 19 aa, Mycobacterium
LLIFTLNVLLAQFSAADLS

SEQ ID NO: 976000 - protein, 25 aa, Mycobacterium
LLIGAVLLAYFKPQGKLGASTLLTD

SEQ ID NO: 976001 - protein, 30 aa, Mycobacterium
LLLHLPEKVFTAIVPMLLVLALVLVVAGPR

SEQ ID NO: 976002 - protein, 18 aa, Mycobacterium
LLRGCPWALAISPPVVDP

SEQ ID NO: 976003 - protein, 18 aa, Mycobacterium
LLRNGPDDLFWLGTTEAL

SEQ ID NO: 976004 - protein, 39 aa, Mycobacterium
LLSPTRIRRVLTVSRLLAPIVVPLIYRAAIATRALIDQR

SEQ ID NO: 976005 - protein, 27 aa, Mycobacterium
LLSVALFFVWMIAVAFLYLLLGGMGVW

SEQ ID NO: 976006 - protein, 17 aa, Mycobacterium
LLTLVRPAVRRLTPALG

SEQ ID NO: 976007 - protein, 18 aa, Mycobacterium
LLVILQQTVVLAIVGYGM

SEQ ID NO: 976008 - protein, 28 aa, Mycobacterium
LMTLSGPLAFWVCGLVLCLFIGPSQSSS

SEQ ID NO: 976009 - protein, 18 aa, Mycobacterium
LNCQVMTLRDLRPSGGAQ

SEQ ID NO: 976010 - protein, 24 aa, Mycobacterium
LNGYTLLGSLATAGLFLLYGAVLS

SEQ ID NO: 976011 - protein, 26 aa, Mycobacterium
LNTSYYRLMLKLKNGPQAVADAAHQA

SEQ ID NO: 976012 - protein, 24 aa, Mycobacterium
LNVEPIYLLKREVIELRRCVAPLS

SEQ ID NO: 976013 - protein, 17 aa, Mycobacterium
LNYVVLLALASFLTYCL

SEQ ID NO: 976014 - protein, 17 aa, Mycobacterium
LPLRTNPWAKMFEARHG

SEQ ID NO: 976015 - protein, 19 aa, Mycobacterium
LPSPHHRPHWGEEGVMPAS

SEQ ID NO: 976016 - protein, 43 aa, Mycobacterium
LPSTHFPGWEWMLTALAIPVVTWAAWPFHRVAIHNARYHGASM

SEQ ID NO: 976017 - protein, 20 aa, Mycobacterium
LPTEIYWRRRGLAVGITVIV

SEQ ID NO: 976018 - protein, 26 aa, Mycobacterium
LQAIPATLLLLRYRWLRSEPLPTWRP

SEQ ID NO: 976019 - protein, 33 aa, Mycobacterium
LQDMTYLGLPPFYPPGWFWIGGRVAALTGTPAW

SEQ ID NO: 976020 - protein, 19 aa, Mycobacterium
LQILAFRTTGRRVFRMAPF

SEQ ID NO: 976021 - protein, 32 aa, Mycobacterium
LQLARAGFLMLLWVFIWSVLQILKTDIYAPTG

SEQ ID NO: 976022 - protein, 32 aa, Mycobacterium
LQLRVVALTFGLSLAVILALGFVLTSQLTSRV

SEQ ID NO: 976023 - protein, 19 aa, Mycobacterium
LQMTGMYQVIANDGVRIPP

SEQ ID NO: 976024 - protein, 18 aa, Mycobacterium
LQRKLRVGFAKAGRLMDL

SEQ ID NO: 976025 - protein, 28 aa, Mycobacterium
LQSDIIGALFVLGFLRYGLPPQDRVELQ

SEQ ID NO: 976026 - protein, 24 aa, Mycobacterium
LRADLARDPSFYLRFRREAQNAAA

SEQ ID NO: 976027 - protein, 28 aa, Mycobacterium
LREFGNLVFHFSLLGLLVAVAVDKLFGY

SEQ ID NO: 976028 - protein, 18 aa, Mycobacterium
LRNALFDAFGPKGADAKP

SEQ ID NO: 976029 - protein, 17 aa, Mycobacterium
LRQRLRIPGLHLDIVGG

SEQ ID NO: 976030 - protein, 18 aa, Mycobacterium
LSEFRYEQPYPARFYRAL

SEQ ID NO: 976031 - protein, 22 aa, Mycobacterium
LSIMPLLPVLLMVWATAHSTSQ

SEQ ID NO: 976032 - protein, 19 aa, Mycobacterium
LSRFIWVTAMVWIFGGSAT

SEQ ID NO: 976033 - protein, 24 aa, Mycobacterium
LSSLAHWLGWRRRSLRPRLPVAMK

SEQ ID NO: 976034 - protein, 19 aa, Mycobacterium
LTFGLFTPLAVPGFAWWAA

SEQ ID NO: 976035 - protein, 29 aa, Mycobacterium
LTHDAVLLAGMLFAVVALASMWVSAGSGV

SEQ ID NO: 976036 - protein, 25 aa, Mycobacterium
LTTAFAYLLLPQVLAYGLSSVFMAI

SEQ ID NO: 976037 - protein, 24 aa, Mycobacterium
LTTLLWYLIDWLEALLRLLFGLLK

SEQ ID NO: 976038 - protein, 19 aa, Mycobacterium
LTTNPLRFLARATNLWNSD

SEQ ID NO: 976039 - protein, 26 aa, Mycobacterium
LTTRKRIAWLLLLGNMVLAAVLNAVD

SEQ ID NO: 976040 - protein, 23 aa, Mycobacterium
LTVNLFNILLLISSYLLQQVERQ

SEQ ID NO: 976041 - protein, 18 aa, Mycobacterium
LVAPITYPSLYASDEDGK

SEQ ID NO: 976042 - protein, 19 aa, Mycobacterium
LVDRLEELLTDPVLRDQLG

SEQ ID NO: 976043 - protein, 17 aa, Mycobacterium
LVGANFWRRGALLIGIG

SEQ ID NO: 976044 - protein, 22 aa, Mycobacterium
LVGASRWYTQLPFLLEAMVAAT

SEQ ID NO: 976045 - protein, 28 aa, Mycobacterium
LVGGIVWNLLTWLLGIPSSSSHALIGGI

SEQ ID NO: 976046 - protein, 28 aa, Mycobacterium
LVGGLTMITLILLGVVLGALVAFIIFGR

SEQ ID NO: 976047 - protein, 20 aa, Mycobacterium
LVGLGMRTWADGRTLLLGSP

SEQ ID NO: 976048 - protein, 26 aa, Mycobacterium
LVGTPAMWWLAVPVLVYATWRTVIQR

SEQ ID NO: 976049 - protein, 26 aa, Mycobacterium
LVIAYCMGLGIPFVLLASGSAQAVAG

SEQ ID NO: 976050 - protein, 22 aa, Mycobacterium
LVIPELIIVLGRRLLTRVRFCG

SEQ ID NO: 976051 - protein, 18 aa, Mycobacterium
LVLSFTCLVLYSTLVQAA

SEQ ID NO: 976052 - protein, 19 aa, Mycobacterium
LVLVGVVAVALTFAQSPGQ

SEQ ID NO: 976053 - protein, 18 aa, Mycobacterium
LVNLLMRFYDVDSGQILI

SEQ ID NO: 976054 - protein, 24 aa, Mycobacterium
LVPSPTCIIVGLPAGLRLAVDNAV

SEQ ID NO: 976055 - protein, 29 aa, Mycobacterium
LVSTLVSWLLFTWMIAWLPRKSVNLVASM

SEQ ID NO: 976056 - protein, 23 aa, Mycobacterium
LVTLAWVIYALVLMVVILGVLYI

SEQ ID NO: 976057 - protein, 28 aa, Mycobacterium
LVTLIALFPPYIMWAPNAIWKSFDLFVG

SEQ ID NO: 976058 - protein, 17 aa, Mycobacterium
LVTLLPDNLRWLVTVDA

SEQ ID NO: 976059 - protein, 19 aa, Mycobacterium
LVTTRILAGLVVIVPLYAV

SEQ ID NO: 976060 - protein, 17 aa, Mycobacterium
LVYAVILPWLAPNKFRN

SEQ ID NO: 976061 - protein, 19 aa, Mycobacterium
LWIYQDIYEFLKNLIAKTV

SEQ ID NO: 976062 - protein, 20 aa, Mycobacterium
LWPGYLRARANPAWAINLFL

SEQ ID NO: 976063 - protein, 19 aa, Mycobacterium
LWVGFTAVSALLILGLAQT

SEQ ID NO: 976064 - protein, 18 aa, Mycobacterium
LYHYLTIAVVVLGLAVYL

SEQ ID NO: 976065 - protein, 17 aa, Mycobacterium
LYILVRRHRAVGAWPLV

SEQ ID NO: 976066 - protein, 20 aa, Mycobacterium
MAARLPWVVIRSFDGLGPPK

SEQ ID NO: 976067 - protein, 20 aa, Mycobacterium
MAAVLPLLALVIVSGASRLA

SEQ ID NO: 976068 - protein, 22 aa, Mycobacterium
MAAYLPLFAVLAAGGSWLDAVV

SEQ ID NO: 976069 - protein, 19 aa, Mycobacterium
MALLYLVELIDQLTRHSLD

SEQ ID NO: 976070 - protein, 20 aa, Mycobacterium
MALTCWWLISREVIPRLGHA

SEQ ID NO: 976071 - protein, 17 aa, Mycobacterium
MAPPQLAAAIMLAAGGV

SEQ ID NO: 976072 - protein, 23 aa, Mycobacterium
MDANYRWFHPAPTTLAAAVGSSR

SEQ ID NO: 976073 - protein, 24 aa, Mycobacterium
MFLVLFIGVYLLAFLTGDKRVVPR

SEQ ID NO: 976074 - protein, 28 aa, Mycobacterium
MFRMPIFTWNILVTSILVLIAFPLLTAA

SEQ ID NO: 976075 - protein, 26 aa, Mycobacterium
MGLLVSMFIFMILGLPSAGATVPLEA

SEQ ID NO: 976076 - protein, 25 aa, Mycobacterium
MGLNHLCLFLFHYQEPWAIPIAFVI

SEQ ID NO: 976077 - protein, 18 aa, Mycobacterium
MINRRWTFQMSPSTTRFA

SEQ ID NO: 976078 - protein, 23 aa, Mycobacterium
MISVLAVYLWSLLSILTTLARTT

SEQ ID NO: 976079 - protein, 17 aa, Mycobacterium
MIYNALEMSYRRIRIHK

SEQ ID NO: 976080 - protein, 27 aa, Mycobacterium
MLALMTRRWVLAWIALAGAAMASIVGL

SEQ ID NO: 976081 - protein, 25 aa, Mycobacterium
MLVNRLLLPTIIGWSLGRALCGISV

SEQ ID NO: 976082 - protein, 24 aa, Mycobacterium
MMADFHLLWVRPSSVVWFLAALAT

SEQ ID NO: 976083 - protein, 29 aa, Mycobacterium
MMPSIAALLGRWFWWPQQGRTRPLLTVAA

SEQ ID NO: 976084 - protein, 30 aa, Mycobacterium
MPAGFSIGWAMWFILVCSVLQAIAAVAALL

SEQ ID NO: 976085 - protein, 17 aa, Mycobacterium
MSEVHLARDIRLHRDVA

SEQ ID NO: 976086 - protein, 33 aa, Mycobacterium
MSLSGFEHSWFFLFIFIVFGLAAFYVMMQVARQ

SEQ ID NO: 976087 - protein, 21 aa, Mycobacterium
MSRFWRKMFLTIGILIAAFGM

SEQ ID NO: 976088 - protein, 17 aa, Mycobacterium
MVAGMAFLLSRGSICLG

SEQ ID NO: 976089 - protein, 22 aa, Mycobacterium
MVFSYFTAYLVLFAASWAATAE

SEQ ID NO: 976090 - protein, 19 aa, Mycobacterium
MVRRRRVWVRLTPAAGTVN

SEQ ID NO: 976091 - protein, 28 aa, Mycobacterium
MYRVVRRLLFLTPPERIHTLVFAMLRCV

SEQ ID NO: 976092 - protein, 26 aa, Mycobacterium
NCTIKVMVGFLFLYPAFVAKEHQANG

SEQ ID NO: 976093 - protein, 23 aa, Mycobacterium
NDSPPVPVKLVTVPPPPAPKDNT

SEQ ID NO: 976094 - protein, 22 aa, Mycobacterium
NEALLFFAFSGIGVLLSMAPLW

SEQ ID NO: 976095 - protein, 18 aa, Mycobacterium
NEAWRSDQFVLDPTRVTL

SEQ ID NO: 976096 - protein, 33 aa, Mycobacterium
NEGSILGELLVYVLPLLLLVGLFVMFSRMQGGA

SEQ ID NO: 976097 - protein, 21 aa, Mycobacterium
NETMFLSQLPYVPLGNLRGVV

SEQ ID NO: 976098 - protein, 21 aa, Mycobacterium
NEVLFLFLVPSTVRSSIAFTS

SEQ ID NO: 976099 - protein, 23 aa, Mycobacterium
NFEKFAWLFMRFSGVALVVLAFG

SEQ ID NO: 976100 - protein, 39 aa, Mycobacterium
NFNQPYVLWVPLVLLVLLGLLLMLIHRWPSFMHPLETPD

SEQ ID NO: 976101 - protein, 30 aa, Mycobacterium
NGEQLLLTMFIPITLLIGLTLLPLGSFGHH

SEQ ID NO: 976102 - protein, 33 aa, Mycobacterium
NGLDYDDYVYPGQPIWWLARGLEFFQDGEQFWE

SEQ ID NO: 976103 - protein, 28 aa, Mycobacterium
NGLSAFYYALLLLLTGFTGSIVVSTLVD

SEQ ID NO: 976104 - protein, 22 aa, Mycobacterium
NGMLTVLRFLARRSFWRSLNVF

SEQ ID NO: 976105 - protein, 25 aa, Mycobacterium
NGQVYQFPMGLGLVSQFFGRYFTPD

SEQ ID NO: 976106 - protein, 17 aa, Mycobacterium
NIMLGWIGIGPIPWLVN

SEQ ID NO: 976107 - protein, 20 aa, Mycobacterium
NLGYALQWPLFAGFCLYTYH

SEQ ID NO: 976108 - protein, 27 aa, Mycobacterium
NLHSMPVPFILNQPPPPPGSSGPALAP

SEQ ID NO: 976109 - protein, 29 aa, Mycobacterium
NLRNDAIATFLWVANWRFVVHKADYFTQG

SEQ ID NO: 976110 - protein, 18 aa, Mycobacterium
NLVIPCCAVLLPTAVAHL

SEQ ID NO: 976111 - protein, 39 aa, Mycobacterium
NNLHRRVLLICGFAIAAAAVFAWLLAAFAVRPFKQLAQQ

SEQ ID NO: 976112 - protein, 30 aa, Mycobacterium
NPACRCYFDDVYWITFAGMATVDNPRYVIG

SEQ ID NO: 976113 - protein, 19 aa, Mycobacterium
NRLVTFIAIFLAGGVIFSL

SEQ ID NO: 976114 - protein, 20 aa, Mycobacterium
NSKYTISMLWSGDRAWRQSG

SEQ ID NO: 976115 - protein, 23 aa, Mycobacterium
NTPASLAPLGGILSKVPFRAHEV

SEQ ID NO: 976116 - protein, 23 aa, Mycobacterium
NTSTVWTYLLYAGSWVGGPMRFE

SEQ ID NO: 976117 - protein, 18 aa, Mycobacterium
NVRELIEITLVKNPGMRY

SEQ ID NO: 976118 - protein, 19 aa, Mycobacterium
NVVAFALIEIPLAAYLLAP

SEQ ID NO: 976119 - protein, 25 aa, Mycobacterium
NWYRGELIFVFDGDAAGQAAALKAF

SEQ ID NO: 976120 - protein, 19 aa, Mycobacterium
PAAYWLFHGSKIKSLKDLL

SEQ ID NO: 976121 - protein, 25 aa, Mycobacterium
PAEFSKILLLIFFAAVLVAKRSLFT

SEQ ID NO: 976122 - protein, 25 aa, Mycobacterium
PAKLILIAIALICAAAVFSAITLRD

SEQ ID NO: 976123 - protein, 29 aa, Mycobacterium
PAPHHTRPVRFVWLQTPAVRTRLLDRMAD

SEQ ID NO: 976124 - protein, 25 aa, Mycobacterium
PAPSYPGQAPPPYPSYPPCPSYPPP

SEQ ID NO: 976125 - protein, 28 aa, Mycobacterium
PARGRLVTMLVIGVVLLSAGYSGGLGSP

SEQ ID NO: 976126 - protein, 25 aa, Mycobacterium
PARLDNARFLLPVAGVPPAKSDAMD

SEQ ID NO: 976127 - protein, 32 aa, Mycobacterium
PASALGVLLLVLVLWRCFRVAMISALMVAVAC

SEQ ID NO: 976128 - protein, 25 aa, Mycobacterium
PATCWGLTLQWILVGTAGAIVLAAM

SEQ ID NO: 976129 - protein, 24 aa, Mycobacterium
PCGDLRMVLKLAAKLKNLAPDAIC

SEQ ID NO: 976130 - protein, 18 aa, Mycobacterium
PDFPLPFTYPPFAAVVFY

SEQ ID NO: 976131 - protein, 23 aa, Mycobacterium
PDGARLWLPTYLAWFLGGMILAV

SEQ ID NO: 976132 - protein, 21 aa, Mycobacterium
PDGIRTINFINFLVAFNQAMN

SEQ ID NO: 976133 - protein, 29 aa, Mycobacterium
PDGYPIKASPRFGLYYTPASELYHDTLAE

SEQ ID NO: 976134 - protein, 33 aa, Mycobacterium
PDITKPVWITMLWPLADRPRLSPGAPGGTIPVR

SEQ ID NO: 976135 - protein, 17 aa, Mycobacterium
PEILASTRFRAGLEKIS

SEQ ID NO: 976136 - protein, 24 aa, Mycobacterium
PEMRSISYFTWVVEQLAAAGDLGD

SEQ ID NO: 976137 - protein, 18 aa, Mycobacterium
PFPDRSLIIYVVTAIILI

SEQ ID NO: 976138 - protein, 21 aa, Mycobacterium
PFSLLFALAGFVTLLLLAQAV

SEQ ID NO: 976139 - protein, 24 aa, Mycobacterium
PGEEKLVFSRFWRSDPSRVRRSGG

SEQ ID NO: 976140 - protein, 20 aa, Mycobacterium
PGGLVVLSYTIWLGPFGGHE

SEQ ID NO: 976141 - protein, 17 aa, Mycobacterium
PGLRPFLSEVPTVTDIG

SEQ ID NO: 976142 - protein, 34 aa, Mycobacterium
PGMPRRLRWLSPLVPLVAGPLPVAFFIGVLAGEE

SEQ ID NO: 976143 - protein, 19 aa, Mycobacterium
PGRYGLDAGRRWAYRPFIG

SEQ ID NO: 976144 - protein, 21 aa, Mycobacterium
PGSVDFFYLTSSAAGIFGIPG

SEQ ID NO: 976145 - protein, 33 aa, Mycobacterium
PGVILGVLVITILIAWRWVPARVARIPGPLVAI

SEQ ID NO: 976146 - protein, 25 aa, Mycobacterium
PGVTLRLMLTWVPSTGVPVLAIVLA

SEQ ID NO: 976147 - protein, 36 aa, Mycobacterium
PGVTVPRMLFRPSPTLRPTIHLPLDDPYQVPDGYPI

SEQ ID NO: 976148 - protein, 22 aa, Mycobacterium
PIGLNLPFTYPPLAAIAFCPFA

SEQ ID NO: 976149 - protein, 23 aa, Mycobacterium
PIRYVTGTLVKMRWGIERHIAGG

SEQ ID NO: 976150 - protein, 19 aa, Mycobacterium
PISLTVLLAARFGHRGRGF

SEQ ID NO: 976151 - protein, 24 aa, Mycobacterium
PKAIPLTILTVGVIYILALVVAML

SEQ ID NO: 976152 - protein, 18 aa, Mycobacterium
PLDSISWPRPHVSFYLDP

SEQ ID NO: 976153 - protein, 19 aa, Mycobacterium
PLLGRLMIYNALEMSYRRI

SEQ ID NO: 976154 - protein, 24 aa, Mycobacterium
PLLTLPILIFGLLSVGLMPVKLFP

SEQ ID NO: 976155 - protein, 24 aa, Mycobacterium
PLTWPPAFFSWFAAGMLLAEWSYS

SEQ ID NO: 976156 - protein, 19 aa, Mycobacterium
PLWGLDQRLKRFGAMATAM

SEQ ID NO: 976157 - protein, 26 aa, Mycobacterium
PMLQFSLLGMICMLGTLWLIVRTSSS

SEQ ID NO: 976158 - protein, 19 aa, Mycobacterium
PMLQLMLFSIFTDGLVVND

SEQ ID NO: 976159 - protein, 18 aa, Mycobacterium
PMSRALFDALPVGPDLVV

SEQ ID NO: 976160 - protein, 24 aa, Mycobacterium
PNGTHSWPYWNQQLVAMKPDIQQI

SEQ ID NO: 976161 - protein, 27 aa, Mycobacterium
PPGTSIYVLLPGRPMPVSAYSTLADQD

SEQ ID NO: 976162 - protein, 22 aa, Mycobacterium
PPGWHAPGWPPQQPPDYWYPPE

SEQ ID NO: 976163 - protein, 22 aa, Mycobacterium
PPLTYAAMAVAMRKWGDLAMLP

SEQ ID NO: 976164 - protein, 21 aa, Mycobacterium
PPLVMALGWLLLIGVLALSLV

SEQ ID NO: 976165 - protein, 17 aa, Mycobacterium
PPQLSSPLNLPKLPAHR

SEQ ID NO: 976166 - protein, 19 aa, Mycobacterium
PPRRRRPLMTWQRWALLCV

SEQ ID NO: 976167 - protein, 17 aa, Mycobacterium
PPWLKTVPKRLSALLNT

SEQ ID NO: 976168 - protein, 24 aa, Mycobacterium
PQERRLVFERFYRSTTARSLPGSG

SEQ ID NO: 976169 - protein, 18 aa, Mycobacterium
PQFSLWLVPLAVLALPHR

SEQ ID NO: 976170 - protein, 29 aa, Mycobacterium
PQRGPSPAMPPSLAWWASSLQLSGLNTRQ

SEQ ID NO: 976171 - protein, 23 aa, Mycobacterium
PRDPRGRRYSLMALLAIAVLATT

SEQ ID NO: 976172 - protein, 33 aa, Mycobacterium
PRDRDTWMVIDDKPWFFALADQLSFAEAEEFAQ

SEQ ID NO: 976173 - protein, 22 aa, Mycobacterium
PRGRRYSLMALLAIAVLATAAG

SEQ ID NO: 976174 - protein, 18 aa, Mycobacterium
PRRLPYLARIGLLFAVMP

SEQ ID NO: 976175 - protein, 18 aa, Mycobacterium
PRWVAPVRRVGLLRIWNQ

SEQ ID NO: 976176 - protein, 35 aa, Mycobacterium
PSAISAMLIYRLISWLLIAAIGWVVFFFMFRTENV

SEQ ID NO: 976177 - protein, 19 aa, Mycobacterium
PSCWWCTRLSRWAWLKESG

SEQ ID NO: 976178 - protein, 31 aa, Mycobacterium
PSFIFRHRGGNVVIFALMLVAATQLFNLQVS

SEQ ID NO: 976179 - protein, 27 aa, Mycobacterium
PSIVAALFIFCLWIATLGFQQSAFAVS

SEQ ID NO: 976180 - protein, 19 aa, Mycobacterium
PSRMALFDLSSSWMTGQCC

SEQ ID NO: 976181 - protein, 25 aa, Mycobacterium
PTAIPLRHDGLSYRFPFHTEKKTYP

SEQ ID NO: 976182 - protein, 19 aa, Mycobacterium
PTFYIDFPTSVSPLTRPHR

SEQ ID NO: 976183 - protein, 20 aa, Mycobacterium
PTHRIALGRYLQFIRINGTV

SEQ ID NO: 976184 - protein, 18 aa, Mycobacterium
PTHRLVFGAILATAVFVI

SEQ ID NO: 976185 - protein, 24 aa, Mycobacterium
PTWSYPGWRHIKYVNGFATSFWVT

SEQ ID NO: 976186 - protein, 18 aa, Mycobacterium
PVAMVFAYGFYLRMDSFH

SEQ ID NO: 976187 - protein, 22 aa, Mycobacterium
PVAPEAYALYGISRVLPQVLRS

SEQ ID NO: 976188 - protein, 19 aa, Mycobacterium
PVEFQWPSTLQARATRRGL

SEQ ID NO: 976189 - protein, 17 aa, Mycobacterium
PVGPVPVWLDKVRFRYP

SEQ ID NO: 976190 - protein, 24 aa, Mycobacterium
PVGQAIPEYLLIQSPHDLRTPRAL

SEQ ID NO: 976191 - protein, 28 aa, Mycobacterium
PVKQRLFALFLYIAMLAFVVATAPLVVV

SEQ ID NO: 976192 - protein, 18 aa, Mycobacterium
PVQLIVNTMDRYVRPYGY

SEQ ID NO: 976193 - protein, 17 aa, Mycobacterium
PVRIGYQGPNARLAATV

SEQ ID NO: 976194 - protein, 18 aa, Mycobacterium
PVVLAWLAVLLVIALPES

SEQ ID NO: 976195 - protein, 29 aa, Mycobacterium
PVYINIYFGLIIFFTYFYVSVTFNPDERA

SEQ ID NO: 976196 - protein, 23 aa, Mycobacterium
PWALSVAMWLLVVASLITCAQRL

SEQ ID NO: 976197 - protein, 19 aa, Mycobacterium
PWLTGVVVILLLIGSVDCG

SEQ ID NO: 976198 - protein, 25 aa, Mycobacterium
PWLVALPLWVWLLTVGLLSLGGPGV

SEQ ID NO: 976199 - protein, 22 aa, Mycobacterium
PWQHSRFWVADRSAMSELAVAH

SEQ ID NO: 976200 - protein, 17 aa, Mycobacterium
PYPISVTAMLWVRPRQG

SEQ ID NO: 976201 - protein, 19 aa, Mycobacterium
QAFIFSILTILYFSQAMEV

SEQ ID NO: 976202 - protein, 34 aa, Mycobacterium
QAFNVFSSVWFTAIYTLLFVSLVGCLTPRMIEHA

SEQ ID NO: 976203 - protein, 21 aa, Mycobacterium
QAGNLVTWWTGDTLMVFNQSN

SEQ ID NO: 976204 - protein, 29 aa, Mycobacterium
QATAKFGVTPLLLWQFATQHFTNISVETA

SEQ ID NO: 976205 - protein, 26 aa, Mycobacterium
QDNDPALYFIGKSYRFHQLELSVFLA

SEQ ID NO: 976206 - protein, 24 aa, Mycobacterium
QDPVFLDWLVGLAFPCQRPFDHQY

SEQ ID NO: 976207 - protein, 23 aa, Mycobacterium
QEAGFTLVAPIRSTTKPSMAIDQ

SEQ ID NO: 976208 - protein, 24 aa, Mycobacterium
QFFGCTPLGPIAWSGVITATAGAT

SEQ ID NO: 976209 - protein, 20 aa, Mycobacterium
QGNDLPWSILKQLHAGDSND

SEQ ID NO: 976210 - protein, 17 aa, Mycobacterium
QGTLTVIALALFAGLAF

SEQ ID NO: 976211 - protein, 25 aa, Mycobacterium
QHGPTQPDYGAPPGWHAPGWPPQQP

SEQ ID NO: 976212 - protein, 25 aa, Mycobacterium
QHHGPVFAVLTRITRLLDGSAETEI

SEQ ID NO: 976213 - protein, 17 aa, Mycobacterium
QHLGLLVLRVGLGVVLA

SEQ ID NO: 976214 - protein, 23 aa, Mycobacterium
QHRRLLPSRWWSIGCLDGLVITI

SEQ ID NO: 976215 - protein, 17 aa, Mycobacterium
QHWVPTGAVAFGLFIVT

SEQ ID NO: 976216 - protein, 22 aa, Mycobacterium
QIARLWNTTWDLKPAVDLRRFP

SEQ ID NO: 976217 - protein, 29 aa, Mycobacterium
QITKKVVIALVVFLVLVGLYITVRYERYM

SEQ ID NO: 976218 - protein, 23 aa, Mycobacterium
QLALTELWRSYGVTPDAVIGHSM

SEQ ID NO: 976219 - protein, 20 aa, Mycobacterium
QLAMRAMAPPQLAAAIMLAA

SEQ ID NO: 976220 - protein, 26 aa, Mycobacterium
QLGTWLAEYPQLLLVALGGTIANLGA

SEQ ID NO: 976221 - protein, 30 aa, Mycobacterium
QLRRIDFEPYRLWQPPLTQPVAIDDLVNRF

SEQ ID NO: 976222 - protein, 24 aa, Mycobacterium
QLVDYILSGLRRPWRPRTFARAVS

SEQ ID NO: 976223 - protein, 52 aa, Mycobacterium
QNQAYGYLFPHGTFFLIGQLLGSPGWITQRLWWALLLTAGFWGLLRVAETLS

SEQ ID NO: 976224 - protein, 25 aa, Mycobacterium
QNVFAWMIVWSLVVLSLMLTVVTLF

SEQ ID NO: 976225 - protein, 21 aa, Mycobacterium
QPIRHWRPVRVPLLPLAAATV

SEQ ID NO: 976226 - protein, 24 aa, Mycobacterium
QPMTVSFDLFVVGSGFFGLTIAER

SEQ ID NO: 976227 - protein, 19 aa, Mycobacterium
QPNFHLPIIGRWNAIGFLQ

SEQ ID NO: 976228 - protein, 23 aa, Mycobacterium
QPSQSPYWPQPAPSYPGQAPPPY

SEQ ID NO: 976229 - protein, 30 aa, Mycobacterium
QQLVPFVALIALFVFFTAAAGAKFYAPSNL

SEQ ID NO: 976230 - protein, 36 aa, Mycobacterium
QQRWSQRQTGITLTLLVLLVLAGVAIGRWVIRDNYY

SEQ ID NO: 976231 - protein, 18 aa, Mycobacterium
QRFESPNLHIPFAELRMK

SEQ ID NO: 976232 - protein, 23 aa, Mycobacterium
QRGKNFYYFPDQLSIDRYLDKKG

SEQ ID NO: 976233 - protein, 26 aa, Mycobacterium
QRLMLWIISVIFLLLLVPAGVVIGIH

SEQ ID NO: 976234 - protein, 31 aa, Mycobacterium
QRRMEVLALPLVAVVLFLVFGGVIAACLPVM

SEQ ID NO: 976235 - protein, 26 aa, Mycobacterium
QSATTFPWVFLFPAGVLVVILVCANL

SEQ ID NO: 976236 - protein, 23 aa, Mycobacterium
QSHTDILWWALALGADFGGNLTA

SEQ ID NO: 976237 - protein, 22 aa, Mycobacterium
QSRLFTPFFITVGLVEAAYFIN

SEQ ID NO: 976238 - protein, 24 aa, Mycobacterium
QSVPDWIVQLLTDILDFIADPYKY

SEQ ID NO: 976239 - protein, 24 aa, Mycobacterium
QTGPGYFRYAFWAYARTGNPWVVE

SEQ ID NO: 976240 - protein, 21 aa, Mycobacterium
QTILTDPYWWTALAVTLAITV

SEQ ID NO: 976241 - protein, 26 aa, Mycobacterium
QTTRPLAPAWFLDPGGSVHLTVDKRR

SEQ ID NO: 976242 - protein, 20 aa, Mycobacterium
QVDWIFRVSWHYVFDITQRQ

SEQ ID NO: 976243 - protein, 23 aa, Mycobacterium
QVELLRAQLTRQLRLKFGHESVR

SEQ ID NO: 976244 - protein, 18 aa, Mycobacterium
QVLLDNLVLECCCIADFT

SEQ ID NO: 976245 - protein, 17 aa, Mycobacterium
QVMIFYVGAFLAIPTIF

SEQ ID NO: 976246 - protein, 26 aa, Mycobacterium
RAGCLLPLVNLLWAPVYVIELALMEN

SEQ ID NO: 976247 - protein, 17 aa, Mycobacterium
RAGIGFIPFVIAMGIGL

SEQ ID NO: 976248 - protein, 18 aa, Mycobacterium
RAHEVTLLPAPMFHALGY

SEQ ID NO: 976249 - protein, 17 aa, Mycobacterium
RALAKREPGKPVALWIV

SEQ ID NO: 976250 - protein, 21 aa, Mycobacterium
RALGFPVRLPELPTGWRSNSG

SEQ ID NO: 976251 - protein, 29 aa, Mycobacterium
RALRMPFYHTIISLVTWGIGGAVFIIASW

SEQ ID NO: 976252 - protein, 30 aa, Mycobacterium
RALTSMGTALVLLFLLALGAIPGALLPQRD

SEQ ID NO: 976253 - protein, 29 aa, Mycobacterium
RAPVGTRQLLLVNLLTDMFPALSIAVTSQ

SEQ ID NO: 976254 - protein, 30 aa, Mycobacterium
RASSIMHGIWILLFTIPFAGLVDQIPSAAL

SEQ ID NO: 976255 - protein, 24 aa, Mycobacterium
RATRRGLLLTALGGLLIGGLVTAI

SEQ ID NO: 976256 - protein, 26 aa, Mycobacterium
RAVGAWPLVAPLLAAGTVVLTVVFAE

SEQ ID NO: 976257 - protein, 17 aa, Mycobacterium
RCIGITHFFVFGVIFQG

SEQ ID NO: 976258 - protein, 27 aa, Mycobacterium
RCRSRDLVLGLIISRVLRPASKLATLA

SEQ ID NO: 976259 - protein, 35 aa, Mycobacterium
RDERDRLALWSRVLPITFTAVGLITLLSGGFLASF

SEQ ID NO: 976260 - protein, 23 aa, Mycobacterium
RDRAGAFWRRTGVRIVRRPVAYL

SEQ ID NO: 976261 - protein, 28 aa, Mycobacterium
RDSAWLLVSILWQMRLTAWVVSSSATSY

SEQ ID NO: 976262 - protein, 19 aa, Mycobacterium
REHISLHPLWGLDQRLKRF

SEQ ID NO: 976263 - protein, 17 aa, Mycobacterium
RELSIMPLLPVLLMVWA

SEQ ID NO: 976264 - protein, 23 aa, Mycobacterium
RELTSKVLPLTLAGGAAVTGLAL

SEQ ID NO: 976265 - protein, 18 aa, Mycobacterium
REPGKPVALWIVTRGVYE

SEQ ID NO: 976266 - protein, 22 aa, Mycobacterium
REYVGYIVEKRFNLSWSIEGTR

SEQ ID NO: 976267 - protein, 17 aa, Mycobacterium
RFATPFFDALRAYAAAP

SEQ ID NO: 976268 - protein, 20 aa, Mycobacterium
RFFTVWRFDSLIGATAIVLG

SEQ ID NO: 976269 - protein, 23 aa, Mycobacterium
RFGFLLAIPAVFASGLFSIPDAF

SEQ ID NO: 976270 - protein, 18 aa, Mycobacterium
RFHQLELSVFLAALEATI

SEQ ID NO: 976271 - protein, 17 aa, Mycobacterium
RFIGIVIIAVSLPLLWW

SEQ ID NO: 976272 - protein, 18 aa, Mycobacterium
RFIVIGITVALCLCGGVF

SEQ ID NO: 976273 - protein, 18 aa, Mycobacterium
RFLGHPWQKDYGSARNLV

SEQ ID NO: 976274 - protein, 32 aa, Mycobacterium
RFVDNELVWAWIRNFPVPDGIRTINFINFLVA

SEQ ID NO: 976275 - protein, 32 aa, Mycobacterium
RFVSVFGWRAYALPFLMALTAVVLYQTVTGTN

SEQ ID NO: 976276 - protein, 18 aa, Mycobacterium
RGAMKAAWDKLKGPNGKL

SEQ ID NO: 976277 - protein, 29 aa, Mycobacterium
RGELDRTLLLWTLPLLIAPPMYSKDVYSY

SEQ ID NO: 976278 - protein, 29 aa, Mycobacterium
RGHKVTTSPLPMKPILQPSPQASTAGQQH

SEQ ID NO: 976279 - protein, 25 aa, Mycobacterium
RGIQGSLLGMPLHEPYLVGCLNTRN

SEQ ID NO: 976280 - protein, 31 aa, Mycobacterium
RGPMDRFHRRLLWPILTLAGEVIGFGARRLF

SEQ ID NO: 976281 - protein, 21 aa, Mycobacterium
RGRRYSLMVLLAIAVLATAAG

SEQ ID NO: 976282 - protein, 19 aa, Mycobacterium
RIAFARILLTKPKAIFLDE

SEQ ID NO: 976283 - protein, 28 aa, Mycobacterium
RINTYDMDLFLRIAPELYLKRLCIGGVE

SEQ ID NO: 976284 - protein, 18 aa, Mycobacterium
RIVVFFIGSVFLLVVLLP

SEQ ID NO: 976285 - protein, 18 aa, Mycobacterium
RIYALIRLIALFGVDWLT

SEQ ID NO: 976286 - protein, 18 aa, Mycobacterium
RLARLQLVSLVGVLVLLK

SEQ ID NO: 976287 - protein, 20 aa, Mycobacterium
RLAVLFLCAAYLICGTHAPA

SEQ ID NO: 976288 - protein, 19 aa, Mycobacterium
RLDVFTHHILVDGGAIRII

SEQ ID NO: 976289 - protein, 19 aa, Mycobacterium
RLKTFVLLVGMSTLIVVVG

SEQ ID NO: 976290 - protein, 30 aa, Mycobacterium
RLLQDGRDMFWSLVPLVVGCILLAGMAGTC

SEQ ID NO: 976291 - protein, 18 aa, Mycobacterium
RLMAVLLHGTRQPIAPWE

SEQ ID NO: 976292 - protein, 17 aa, Mycobacterium
RLRWQIPMSLTGAALGA

SEQ ID NO: 976293 - protein, 28 aa, Mycobacterium
RLSIFSLVLLLFTVMIIVVFGQMRFGRT

SEQ ID NO: 976294 - protein, 20 aa, Mycobacterium
RLSWVIIGLVLFTAGSTIAY

SEQ ID NO: 976295 - protein, 27 aa, Mycobacterium
RLVDAYVEWLWFGELGYRSVFSTVLVT

SEQ ID NO: 976296 - protein, 17 aa, Mycobacterium
RLWIRFIADTERRSQVI

SEQ ID NO: 976297 - protein, 19 aa, Mycobacterium
RLWITSLTLTVIWVTLYLA

SEQ ID NO: 976298 - protein, 18 aa, Mycobacterium
RLWSVIGLVPQRCYLFSG

SEQ ID NO: 976299 - protein, 17 aa, Mycobacterium
RMGGLAMYLGVLAAVFL

SEQ ID NO: 976300 - protein, 28 aa, Mycobacterium
RMIHRFAVPIILVWLAIAVTVSVFIPSL

SEQ ID NO: 976301 - protein, 18 aa, Mycobacterium
RMLLMSKTMYAVTRNPTR

SEQ ID NO: 976302 - protein, 25 aa, Mycobacterium
RPDLQWGFRVPLLPIALICASVWLM

SEQ ID NO: 976303 - protein, 33 aa, Mycobacterium
RPFRRRNARPAIFVVVFLVIVAGVSWTIALTRP

SEQ ID NO: 976304 - protein, 25 aa, Mycobacterium
RPPRSAPLQELLQPHMKDWQPDAAD

SEQ ID NO: 976305 - protein, 33 aa, Mycobacterium
RPVQWRHVPAILLMLALLLFTIAMAGPTNDVRI

SEQ ID NO: 976306 - protein, 25 aa, Mycobacterium
RQHARRMVLIWVGVVVAIAGLVATV

SEQ ID NO: 976307 - protein, 18 aa, Mycobacterium
RQHWGIENGLHWIRDVTF

SEQ ID NO: 976308 - protein, 24 aa, Mycobacterium
RQLPLMLDVMFYSVVRFLCTFSPN

SEQ ID NO: 976309 - protein, 17 aa, Mycobacterium
RQTLAVVASVSAALLGC

SEQ ID NO: 976310 - protein, 41 aa, Mycobacterium
RRFADKIVFGLLVVVVVLATFVGLRLWHTLFGSADGYTDYA

SEQ ID NO: 976311 - protein, 29 aa, Mycobacterium
RRFRWLVFTGWLLALVPAIYLAMTQSGKL

SEQ ID NO: 976312 - protein, 24 aa, Mycobacterium
RRGALMFGKILPIGIGAAVGGAGN

SEQ ID NO: 976313 - protein, 34 aa, Mycobacterium
RRGQLLFERVITGLLFVIVVGFTSSFFVATPSPE

SEQ ID NO: 976314 - protein, 17 aa, Mycobacterium
RRHRAVGAWPLVAPLLA

SEQ ID NO: 976315 - protein, 25 aa, Mycobacterium
RRIERRVVPLPLAQKIFDAEWIESP

SEQ ID NO: 976316 - protein, 20 aa, Mycobacterium
RRILAVRVLGVIALSRLVGG

SEQ ID NO: 976317 - protein, 19 aa, Mycobacterium
RRLVLMGRTPLPPRRDWEL

SEQ ID NO: 976318 - protein, 26 aa, Mycobacterium
RRNLTVYITALLFVLAWATAGINGWF

SEQ ID NO: 976319 - protein, 24 aa, Mycobacterium
RRRLLRVTRLDVILAMTIAGIVNT

SEQ ID NO: 976320 - protein, 28 aa, Mycobacterium
RRRQYRPLWVFLLVSVLILLTISGRWLY

SEQ ID NO: 976321 - protein, 17 aa, Mycobacterium
RRRSIGFGLITNLKMIS

SEQ ID NO: 976322 - protein, 23 aa, Mycobacterium
RSALISLALLLVALIAVVGLAEL

SEQ ID NO: 976323 - protein, 27 aa, Mycobacterium
RSHGSPLRILLLLVLVMALGSALLDNV

SEQ ID NO: 976324 - protein, 21 aa, Mycobacterium
RSLIIYVVTAIILITTLLQGS

SEQ ID NO: 976325 - protein, 22 aa, Mycobacterium
RSLYILYIQLLIAALCFAMLAY

SEQ ID NO: 976326 - protein, 25 aa, Mycobacterium
RSNIKYLPDWVPRYACYEDARLIPR

SEQ ID NO: 976327 - protein, 20 aa, Mycobacterium
RSQILVPPTSWHLQADDARV

SEQ ID NO: 976328 - protein, 18 aa, Mycobacterium
RSTTARSLPGSGLGLAIV

SEQ ID NO: 976329 - protein, 25 aa, Mycobacterium
RSVVPVRVFWMPPAERSKLAKLAGL

SEQ ID NO: 976330 - protein, 37 aa, Mycobacterium
RSYVKAIRLRWLREEYYRRIYLALNQTSHIEALTLNF

SEQ ID NO: 976331 - protein, 21 aa, Mycobacterium
RTFIGSAVVVLPLVIAAVAVV

SEQ ID NO: 976332 - protein, 25 aa, Mycobacterium
RTIKFNMVWAFGYNIAAIPIAAAGL

SEQ ID NO: 976333 - protein, 31 aa, Mycobacterium
RTLGLALSLYLVYTLLTWAQARLLNVTVQRI

SEQ ID NO: 976334 - protein, 24 aa, Mycobacterium
RTLIMVALGVIVLLLAGPRLVDAY

SEQ ID NO: 976335 - protein, 32 aa, Mycobacterium
RTRRQQGCHTMSIDWVAWRGLGFAANAQIVSD

SEQ ID NO: 976336 - protein, 45 aa, Mycobacterium
RTSIELVIAVLLLTILMIIYRNPITMLLPLITIGASLMTAQAVVS

SEQ ID NO: 976337 - protein, 24 aa, Mycobacterium
RTTHHLFQPLLYQVATGIISEGEI

SEQ ID NO: 976338 - protein, 22 aa, Mycobacterium
RVALLWTAIAIWIEPLRSAFDY

SEQ ID NO: 976339 - protein, 17 aa, Mycobacterium
RVELFYVWFADFVVGFA

SEQ ID NO: 976340 - protein, 20 aa, Mycobacterium
RVGDRLYPALNLASARLITG

SEQ ID NO: 976341 - protein, 19 aa, Mycobacterium
RVIMRWGRIAVLIVTGLIT

SEQ ID NO: 976342 - protein, 24 aa, Mycobacterium
RVPATWAMLVPRLPRLVVAVVAGL

SEQ ID NO: 976343 - protein, 19 aa, Mycobacterium
RVYAWLMPISTVLQAVIGG

SEQ ID NO: 976344 - protein, 22 aa, Mycobacterium
RWAYRPFIGSFIVLIAGIAAGI

SEQ ID NO: 976345 - protein, 19 aa, Mycobacterium
RWLLIKCGVVLLLVFVAFI

SEQ ID NO: 976346 - protein, 25 aa, Mycobacterium
RWMERFSWIALIITVVVGIIAAILL

SEQ ID NO: 976347 - protein, 17 aa, Mycobacterium
RWSYGMFVWHLAALAMV

SEQ ID NO: 976348 - protein, 21 aa, Mycobacterium
RYLPDLVIVLALLTAIAFHAP

SEQ ID NO: 976349 - protein, 24 aa, Mycobacterium
RYYDGLFTIAFRFGAAIAAAIVVV

SEQ ID NO: 976350 - protein, 25 aa, Mycobacterium
SAAAVVFGVVIWRAHHDNSAERAYL

SEQ ID NO: 976351 - protein, 29 aa, Mycobacterium
SAALLGCLGALLWSFISPSGQLNESPIII

SEQ ID NO: 976352 - protein, 23 aa, Mycobacterium
SAGIMTYELLTGHTPFTGDSALS

SEQ ID NO: 976353 - protein, 24 aa, Mycobacterium
SAISAEFYRSVNLPWLASIDADQH

SEQ ID NO: 976354 - protein, 23 aa, Mycobacterium
SAKGRLVDLPPTPWQHSRFWVAD

SEQ ID NO: 976355 - protein, 32 aa, Mycobacterium
SALMVAVACLPDWLSGFLTGGLIAGSSARRAT

SEQ ID NO: 976356 - protein, 24 aa, Mycobacterium
SASMPLPNRLLATAPLVALGTIAY

SEQ ID NO: 976357 - protein, 20 aa, Mycobacterium
SASRLVMLLVALGIIAIVVV

SEQ ID NO: 976358 - protein, 27 aa, Mycobacterium
SDADRGLWTPWNTYVSPGLPATAICSP

SEQ ID NO: 976359 - protein, 21 aa, Mycobacterium
SDAVAWVISLLYNGIYTGGLV

SEQ ID NO: 976360 - protein, 36 aa, Mycobacterium
SDGLTAWIAAPLLFIGALFGLLLLTGTTVREVPEVL

SEQ ID NO: 976361 - protein, 21 aa, Mycobacterium
SDLVMMKYLAFGLMAALLLDA

SEQ ID NO: 976362 - protein, 29 aa, Mycobacterium
SDVYSLGCVLYEILTGEPPFIGDSPVSVA

SEQ ID NO: 976363 - protein, 18 aa, Mycobacterium
SERLITINTLLLGVLLAL

SEQ ID NO: 976364 - protein, 27 aa, Mycobacterium
SFGLSVLLWQHILGIELHYLVLAMSVI

SEQ ID NO: 976365 - protein, 18 aa, Mycobacterium
SFRLQPTLTVLLVTAGVF

SEQ ID NO: 976366 - protein, 19 aa, Mycobacterium
SFVFVFSKPLRAITYLIYE

SEQ ID NO: 976367 - protein, 17 aa, Mycobacterium
SGKLFFTTATGAKLLYG

SEQ ID NO: 976368 - protein, 24 aa, Mycobacterium
SGLATWVWDCFADPRAALAAGCTP

SEQ ID NO: 976369 - protein, 26 aa, Mycobacterium
SGLVLTYLGLLWWMMVCWAQPLRNRS

SEQ ID NO: 976370 - protein, 20 aa, Mycobacterium
SGMCGWWLRQRRKHAWGAFT

SEQ ID NO: 976371 - protein, 21 aa, Mycobacterium
SGPEALWQFLCDRRSSIGQVP

SEQ ID NO: 976372 - protein, 27 aa, Mycobacterium
SGRMPVALVWLIFALVLACAEALTGDM

SEQ ID NO: 976373 - protein, 29 aa, Mycobacterium
SGTQILPGNLLPDILLIKSARDLRDPAAL

SEQ ID NO: 976374 - protein, 28 aa, Mycobacterium
SGVTIFTGYPFLRGALRFGKTGTDALVS

SEQ ID NO: 976375 - protein, 27 aa, Mycobacterium
SHRRVVLLIYLWVGIVAFGAASTIFFN

SEQ ID NO: 976376 - protein, 31 aa, Mycobacterium
SHTGGAWLILFMIFNVIWTYAVFRGASVDAL

SEQ ID NO: 976377 - protein, 18 aa, Mycobacterium
SIAVLNRSKTFNANSLIF

SEQ ID NO: 976378 - protein, 18 aa, Mycobacterium
SIGAAILVLLPAAGLIAA

SEQ ID NO: 976379 - protein, 20 aa, Mycobacterium
SIGLYIQDILGYSALRAGIG

SEQ ID NO: 976380 - protein, 22 aa, Mycobacterium
SIILDWLAICVVLTVFVPSLEV

SEQ ID NO: 976381 - protein, 21 aa, Mycobacterium
SIKSISFLVTTRILAGLVVIV

SEQ ID NO: 976382 - protein, 21 aa, Mycobacterium
SILAVVFGAGLFVAFDQLWRW

SEQ ID NO: 976383 - protein, 22 aa, Mycobacterium
SIRYVVLQLLLPFEACQLMRPG

SEQ ID NO: 976384 - protein, 26 aa, Mycobacterium
SKSASPITLRRWFSPVNAAAATALVT

SEQ ID NO: 976385 - protein, 21 aa, Mycobacterium
SLAVQIILFVAVVFGTLNVIG

SEQ ID NO: 976386 - protein, 45 aa, Mycobacterium
SLLELRGFAMPLYLQMVIVRWLLVRSLVAWFWEEPLRASVIRHGT

SEQ ID NO: 976387 - protein, 24 aa, Mycobacterium
SLMSLGCYLGAYPLQRRSAVRADL

SEQ ID NO: 976388 - protein, 25 aa, Mycobacterium
SLPITAVAVWAWWVTGRSPFWSLAI

SEQ ID NO: 976389 - protein, 21 aa, Mycobacterium
SLPQWYWIGLAVGTLAGVGFV

SEQ ID NO: 976390 - protein, 19 aa, Mycobacterium
SLSFFRNNYAAFAAFRAAI

SEQ ID NO: 976391 - protein, 34 aa, Mycobacterium
SLTLLRALYVILGWRRVLLIPLTFGLFTPLAVPG

SEQ ID NO: 976392 - protein, 21 aa, Mycobacterium
SLVGATPWWALATAAAFLPGF

SEQ ID NO: 976393 - protein, 23 aa, Mycobacterium
SLVMVFQWGWLENLGFTHINSID

SEQ ID NO: 976394 - protein, 25 aa, Mycobacterium
SMALLNIIWYRLPALTFGRILLAVH

SEQ ID NO: 976395 - protein, 25 aa, Mycobacterium
SMDAYRRFRAALYSRSFQPSELASS

SEQ ID NO: 976396 - protein, 25 aa, Mycobacterium
SMDYEIFLLTRIRERFLQTGHTRDA

SEQ ID NO: 976397 - protein, 20 aa, Mycobacterium
SMIMVWLAVLLYVKVGEPDG

SEQ ID NO: 976398 - protein, 23 aa, Mycobacterium
SMLGDLPWWVTVLIMTRELGVTL

SEQ ID NO: 976399 - protein, 31 aa, Mycobacterium
SMTRRFPVLVLLLCMFGVLVVLLRRSRVPGL

SEQ ID NO: 976400 - protein, 23 aa, Mycobacterium
SMVILIVLALCASLVRFNYDDRK

SEQ ID NO: 976401 - protein, 24 aa, Mycobacterium
SNILCFWCKRRLRPSFYRLQHEFK

SEQ ID NO: 976402 - protein, 19 aa, Mycobacterium
SNLLVWISTLGSTGGKSLA

SEQ ID NO: 976403 - protein, 22 aa, Mycobacterium
SPATGARLRWVPLQGPSATPVQ

SEQ ID NO: 976404 - protein, 18 aa, Mycobacterium
SPDQWLAFTPPRVPVLQT

SEQ ID NO: 976405 - protein, 24 aa, Mycobacterium
SPEDPFGWYYNLLALMIHVSDASM

SEQ ID NO: 976406 - protein, 22 aa, Mycobacterium
SPSTMLWPTFALNFTSNVLYDL

SEQ ID NO: 976407 - protein, 22 aa, Mycobacterium
SPWQIYWRVLLPHAKPAVGVLA

SEQ ID NO: 976408 - protein, 22 aa, Mycobacterium
SPYIVYFTPLFDTLVRYHWGHE

SEQ ID NO: 976409 - protein, 26 aa, Mycobacterium
SQIELPPGYLPLRVPIEVNFTQRVAV

SEQ ID NO: 976410 - protein, 26 aa, Mycobacterium
SQVTNLELYLIFPLKNEQATVTLVRG

SEQ ID NO: 976411 - protein, 20 aa, Mycobacterium
SRFHTLVVKWGLMVVLALIT

SEQ ID NO: 976412 - protein, 18 aa, Mycobacterium
SRGLYIHSAPWAVQSMGF

SEQ ID NO: 976413 - protein, 26 aa, Mycobacterium
SSDLEQWDWVKWLPHFGDPRRQDAAG

SEQ ID NO: 976414 - protein, 31 aa, Mycobacterium
SSETLPMMLSPWVLLPTILALQGAPGRSVRT

SEQ ID NO: 976415 - protein, 24 aa, Mycobacterium
SSVLGQMMWAMRASGMWSDTGGTN

SEQ ID NO: 976416 - protein, 20 aa, Mycobacterium
STDLIIGLLAVMPVGASLVQ

SEQ ID NO: 976417 - protein, 20 aa, Mycobacterium
STFVFIGAVVYIILAPKGRE

SEQ ID NO: 976418 - protein, 24 aa, Mycobacterium
STKFTPLIAVLWLTAVAAVCLVFR

SEQ ID NO: 976419 - protein, 19 aa, Mycobacterium
STLPAKKVPAKAAKAPAKK

SEQ ID NO: 976420 - protein, 25 aa, Mycobacterium
STRDSWVLALLYLASFGSFIGFSFA

SEQ ID NO: 976421 - protein, 28 aa, Mycobacterium
STSAYDIGLFYRYAWQNPSFSNIVATRT

SEQ ID NO: 976422 - protein, 23 aa, Mycobacterium
STVFGVRFPGPLGLAAGFDKDGM

SEQ ID NO: 976423 - protein, 22 aa, Mycobacterium
STWLITRAWQMPPALDLAVAVV

SEQ ID NO: 976424 - protein, 28 aa, Mycobacterium
SVACKAWLLAQPYLVASVLLGLYTATGR

SEQ ID NO: 976425 - protein, 25 aa, Mycobacterium
SVDIAILAVPHLPPAPLRFDDTKAK

SEQ ID NO: 976426 - protein, 20 aa, Mycobacterium
SVFFVLYALIMAFSFTTLSI

SEQ ID NO: 976427 - protein, 24 aa, Mycobacterium
SVGVWLMLAVLLFSVVISVRLNVL

SEQ ID NO: 976428 - protein, 36 aa, Mycobacterium
SVIVILVTLLLVYRSFITVILLLFTVGIESAVARGV

SEQ ID NO: 976429 - protein, 17 aa, Mycobacterium
SVLVLLIVEGVGVNFWL

SEQ ID NO: 976430 - protein, 31 aa, Mycobacterium
SVPSLWRETPAPYGPLFLWIGRGISALTGDN

SEQ ID NO: 976431 - protein, 26 aa, Mycobacterium
SVSCELDWWLGFSSVASLLGSPGQAA

SEQ ID NO: 976432 - protein, 17 aa, Mycobacterium
SVVLGVLVIACPCTLGL

SEQ ID NO: 976433 - protein, 19 aa, Mycobacterium
SWALLPKLIDSGDVLIIMI

SEQ ID NO: 976434 - protein, 17 aa, Mycobacterium
SWLPDWLHPAGMRRVVT

SEQ ID NO: 976435 - protein, 21 aa, Mycobacterium
SWLTELPRRWRAVLLAVVAAC

SEQ ID NO: 976436 - protein, 19 aa, Mycobacterium
SYGRLGWLLPWSDRQGWAQ

SEQ ID NO: 976437 - protein, 24 aa, Mycobacterium
SYTSTYLRFVWTLSATAVVMCYGL

SEQ ID NO: 976438 - protein, 25 aa, Mycobacterium
TAATILIVLAGRRLWHRFRIQTEGA

SEQ ID NO: 976439 - protein, 23 aa, Mycobacterium
TADYWLGWYVIIGTIPICILGLV

SEQ ID NO: 976440 - protein, 31 aa, Mycobacterium
TAGSVLLIGLVRWFFQLMYRTTASSNSEDDT

SEQ ID NO: 976441 - protein, 22 aa, Mycobacterium
TAQIRYLDLIGNRYLELKHGEG

SEQ ID NO: 976442 - protein, 24 aa, Mycobacterium
TATLLLPFCLIYVRATQPFIVLYN

SEQ ID NO: 976443 - protein, 18 aa, Mycobacterium
TAWGLYRFNQILAGLSTA

SEQ ID NO: 976444 - protein, 17 aa, Mycobacterium
TAYVFIMAIAGPVLARY

SEQ ID NO: 976445 - protein, 24 aa, Mycobacterium
TAYVLTFGGLMLLGGRLGDTIGRK

SEQ ID NO: 976446 - protein, 20 aa, Mycobacterium
TCHSFIEISPHPVLTHAITD

SEQ ID NO: 976447 - protein, 25 aa, Mycobacterium
TCICLRFRWLVQPGYLRVTPGSPIW

SEQ ID NO: 976448 - protein, 21 aa, Mycobacterium
TDEFIARWRSPMRRVYTANLH

SEQ ID NO: 976449 - protein, 18 aa, Mycobacterium
TDKTIDLLIACHLAGCGY

SEQ ID NO: 976450 - protein, 28 aa, Mycobacterium
TEAVMTKLRWVLLIVGSLGVAVAAVAGG

SEQ ID NO: 976451 - protein, 26 aa, Mycobacterium
TEVFDLIPFWRMFFNTVLYAGYVTVG

SEQ ID NO: 976452 - protein, 24 aa, Mycobacterium
TEVSWRLAFLVNVPIGLVMIYLAR

SEQ ID NO: 976453 - protein, 42 aa, Mycobacterium
TFARAVSQLFRLTYMVLFSIPVLVPMVLWIALSSATIRRTMV

SEQ ID NO: 976454 - protein, 30 aa, Mycobacterium
TFLLLPIIVVIWLSLFRWDLLGPLHYVGLA

SEQ ID NO: 976455 - protein, 31 aa, Mycobacterium
TFSSGQRALLWAAGMLGALAIIIAVLIVINS

SEQ ID NO: 976456 - protein, 22 aa, Mycobacterium
TFVIANLLILSALRVNWAFGIQ

SEQ ID NO: 976457 - protein, 27 aa, Mycobacterium
TFVVGYALLPVLWILSLSLKPASTVKD

SEQ ID NO: 976458 - protein, 22 aa, Mycobacterium
TGAAVWLGIASFSAASVVVLLA

SEQ ID NO: 976459 - protein, 31 aa, Mycobacterium
TGGIVVSLFLLGWWLMNALLHPVRSRAADAR

SEQ ID NO: 976460 - protein, 26 aa, Mycobacterium
TGIGMLAFWFAWLMATAYLVWNYGYR

SEQ ID NO: 976461 - protein, 34 aa, Mycobacterium
TGVAVAAFPRYHPRWAWWLTSVPVLREFVVSNLV

SEQ ID NO: 976462 - protein, 20 aa, Mycobacterium
TGVLLLWSWLVLPLAQGYYS

SEQ ID NO: 976463 - protein, 24 aa, Mycobacterium
THHWVWLVPLMIWLIHGPLGERPG

SEQ ID NO: 976464 - protein, 19 aa, Mycobacterium
THPPGTPLLKLVRELRTDR

SEQ ID NO: 976465 - protein, 19 aa, Mycobacterium
TIAVAITLVLWWQMIRFEY

SEQ ID NO: 976466 - protein, 29 aa, Mycobacterium
TIGLGLLFDTLIVRSFMMPSIAALLGRWF

SEQ ID NO: 976467 - protein, 31 aa, Mycobacterium
TILDLVVVFLVTWPLVYLASKSPLLARPAYN

SEQ ID NO: 976468 - protein, 22 aa, Mycobacterium
TIPAIALASIWLTGPLILGLGA

SEQ ID NO: 976469 - protein, 20 aa, Mycobacterium
TLAALLSITLLPACLAILAK

SEQ ID NO: 976470 - protein, 25 aa, Mycobacterium
TLAPALFVLFCMVIVSAWSNAVNFT

SEQ ID NO: 976471 - protein, 19 aa, Mycobacterium
TLAWLFGFLVVLVPICLVI

SEQ ID NO: 976472 - protein, 19 aa, Mycobacterium
TLDRWLLFNWMRYGRALEY

SEQ ID NO: 976473 - protein, 26 aa, Mycobacterium
TLGSTMGILTWIFVDGHLSKWLNFTP

SEQ ID NO: 976474 - protein, 17 aa, Mycobacterium
TLISRITGFARVVLLAA

SEQ ID NO: 976475 - protein, 19 aa, Mycobacterium
TLLPAPMFHALGYLHATLA

SEQ ID NO: 976476 - protein, 28 aa, Mycobacterium
TLVYTVLAVIWCWLLKRYVTEGSQEHDA

SEQ ID NO: 976477 - protein, 49 aa, Mycobacterium
TMFAIVPTNRFPGWGYLLTALAAPIVTWAAWPFHRVALRNARYRAASME

SEQ ID NO: 976478 - protein, 17 aa, Mycobacterium
TMGVIFLALMSYGTVSK

SEQ ID NO: 976479 - protein, 23 aa, Mycobacterium
TMHGTIMLLFYATPIVFGFANLV

SEQ ID NO: 976480 - protein, 21 aa, Mycobacterium
TMRTIRINMIWAFGYNVAAIP

SEQ ID NO: 976481 - protein, 32 aa, Mycobacterium
TMTLVVFTVPLRSAWWWLCMAVGGIVILSMLV

SEQ ID NO: 976482 - protein, 22 aa, Mycobacterium
TNLEILFDTDLQHRPALAGAEA

SEQ ID NO: 976483 - protein, 17 aa, Mycobacterium
TPAVFLLYFVLRRDNRA

SEQ ID NO: 976484 - protein, 24 aa, Mycobacterium
TPEAPFGWYYDLLALWAHVTTTSA

SEQ ID NO: 976485 - protein, 24 aa, Mycobacterium
TPLAVPGFAWWAAALNSLPMLAAL

SEQ ID NO: 976486 - protein, 21 aa, Mycobacterium
TPPLAPVWVALLIVGAASGVA

SEQ ID NO: 976487 - protein, 27 aa, Mycobacterium
TQLQKPIFMWWIVWVFSYVISVVAVVT

SEQ ID NO: 976488 - protein, 26 aa, Mycobacterium
TQNGWPFLARLLYGSRVVVLVHHCHR

SEQ ID NO: 976489 - protein, 39 aa, Mycobacterium
TRDVFALLSPFLLVVAVMFVPMLDLLLAIVRRIRAGRSA

SEQ ID NO: 976490 - protein, 19 aa, Mycobacterium
TRGFLIATNFFGINTIPIA

SEQ ID NO: 976491 - protein, 17 aa, Mycobacterium
TRLLDRMADKWRLDLAS

SEQ ID NO: 976492 - protein, 24 aa, Mycobacterium
TRVIEIPYGLPFLANSQFSNVTLH

SEQ ID NO: 976493 - protein, 25 aa, Mycobacterium
TRWGQLIARFLPVLGLAGLAAATHY

SEQ ID NO: 976494 - protein, 18 aa, Mycobacterium
TRWGRQYWRITRGYFIGP

SEQ ID NO: 976495 - protein, 20 aa, Mycobacterium
TRYYAAQRTFWVDPVSGTIV

SEQ ID NO: 976496 - protein, 22 aa, Mycobacterium
TSAALIMIAVFVGFAFAGMPLV

SEQ ID NO: 976497 - protein, 18 aa, Mycobacterium
TSAFIYHLVAAFAAARDM

SEQ ID NO: 976498 - protein, 28 aa, Mycobacterium
TSPALDLDALIGGFKPLFRALDPDKINT

SEQ ID NO: 976499 - protein, 25 aa, Mycobacterium
TSYDIGLLILRLVLGLTLAAHGYNK

SEQ ID NO: 976500 - protein, 24 aa, Mycobacterium
TTATLIMRPVGALLFGLWADQTGR

SEQ ID NO: 976501 - protein, 24 aa, Mycobacterium
TTLLLLSTTLSVLAAPLLVRLMLG

SEQ ID NO: 976502 - protein, 24 aa, Mycobacterium
TTPIAFLLFAFFGGFAIMLGAEFN

SEQ ID NO: 976503 - protein, 18 aa, Mycobacterium
TVAAVWLVAPCTELLHDN

SEQ ID NO: 976504 - protein, 28 aa, Mycobacterium
TVALVVSILLTPALIRLFTRHGFGQEIR

SEQ ID NO: 976505 - protein, 19 aa, Mycobacterium
TVFTGFYITGCVAAVLAVR

SEQ ID NO: 976506 - protein, 17 aa, Mycobacterium
TVGVYYTLLPRDDQLAS

SEQ ID NO: 976507 - protein, 22 aa, Mycobacterium
TVKRWRCPPPTRLRSTACSPVD

SEQ ID NO: 976508 - protein, 36 aa, Mycobacterium
TVSLGIILLALLWYAGLPLRVFITSLLAVFIAGAIL

SEQ ID NO: 976509 - protein, 27 aa, Mycobacterium
TVVMAAMVSLIWWTSDAQATHSRPATI

SEQ ID NO: 976510 - protein, 17 aa, Mycobacterium
TWVLVERAIALRRLASA

SEQ ID NO: 976511 - protein, 39 aa, Mycobacterium
VAAKISWTLRCLVFLLRFGFAFLFYSGIVNPIIIWHGFA

SEQ ID NO: 976512 - protein, 20 aa, Mycobacterium
VAALRAGLIALALLAVLALI

SEQ ID NO: 976513 - protein, 18 aa, Mycobacterium
VAALTWDITPGSASELFN

SEQ ID NO: 976514 - protein, 29 aa, Mycobacterium
VAAPVNYLKLMPATYVVLVFVVGYVLLTV

SEQ ID NO: 976515 - protein, 25 aa, Mycobacterium
VACRKPMFEFAIRSLIPDGMVLDDD

SEQ ID NO: 976516 - protein, 24 aa, Mycobacterium
VAGCAYLFRRPLGTQLRIMFVVLL

SEQ ID NO: 976517 - protein, 25 aa, Mycobacterium
VAGVLLVLGLFAPVVAAGALAFLIN

SEQ ID NO: 976518 - protein, 17 aa, Mycobacterium
VAIFAVVVVFAVMKSQH

SEQ ID NO: 976519 - protein, 24 aa, Mycobacterium
VAIGLFLLPLTQLSVPFHVGAAVV

SEQ ID NO: 976520 - protein, 51 aa, Mycobacterium
VAKIGPLEFSGFIAWLMWLVLHLMYLIGFKTKITTLLSWTVTFLSTRRGQL

SEQ ID NO: 976521 - protein, 24 aa, Mycobacterium
VALALLYAPPALAINPPSIDPGAV

SEQ ID NO: 976522 - protein, 21 aa, Mycobacterium
VARLLALRPLVWLGTISYGIY

SEQ ID NO: 976523 - protein, 25 aa, Mycobacterium
VASSALRQSFLWGFGGVIAAEHPEM

SEQ ID NO: 976524 - protein, 19 aa, Mycobacterium
VASYSWYYAWTPGTGYLAS

SEQ ID NO: 976525 - protein, 17 aa, Mycobacterium
VATFFRFVARRLDIRPE

SEQ ID NO: 976526 - protein, 34 aa, Mycobacterium
VATMFFFTSFLIALVPLVWLLSVVVARGFYAVTR

SEQ ID NO: 976527 - protein, 22 aa, Mycobacterium
VAVFFALSGFLLWRGHAATARQ

SEQ ID NO: 976528 - protein, 21 aa, Mycobacterium
VAVFFSAILNLVGAFLSTAVA

SEQ ID NO: 976529 - protein, 27 aa, Mycobacterium
VAVSWLLRFLVQHNLYWFVGYRIVVGV

SEQ ID NO: 976530 - protein, 17 aa, Mycobacterium
VAYALWSAIGTAAIVLI

SEQ ID NO: 976531 - protein, 26 aa, Mycobacterium
VDAVICCIGFLFPLWDSKRQTLADKI

SEQ ID NO: 976532 - protein, 26 aa, Mycobacterium
VDGHLSKWLNFTPTPLMVVIIALVVA

SEQ ID NO: 976533 - protein, 28 aa, Mycobacterium
VDKRRYVHPWIAWLVRGSVVPGDVLVFT

SEQ ID NO: 976534 - protein, 29 aa, Mycobacterium
VDYADVLYVSPWLLLLGVALAALTGYATL

SEQ ID NO: 976535 - protein, 28 aa, Mycobacterium
VESDARLRLGWPIVPNTVFIAFGELVIV

SEQ ID NO: 976536 - protein, 19 aa, Mycobacterium
VFAVAALTAVGWLIAGSGP

SEQ ID NO: 976537 - protein, 46 aa, Mycobacterium
VFFIAALVVLFYSTFFFFLFLAELLDTWLWRWVALLIVFAIMVMVT

SEQ ID NO: 976538 - protein, 20 aa, Mycobacterium
VFGALSHRWLARRTRRRINL

SEQ ID NO: 976539 - protein, 18 aa, Mycobacterium
VFGQPIMPAAAFAEIAVA

SEQ ID NO: 976540 - protein, 24 aa, Mycobacterium
VFLAAWVPLFASFAALLVYPKDGA

SEQ ID NO: 976541 - protein, 23 aa, Mycobacterium
VFTQLLLLPVAWYLVVGSHQSAF

SEQ ID NO: 976542 - protein, 19 aa, Mycobacterium
VFVLLVLKSLLTAWFLRGG

SEQ ID NO: 976543 - protein, 29 aa, Mycobacterium
VGFAAIVYLVWWYVVPPVCRLMRARRDAV

SEQ ID NO: 976544 - protein, 17 aa, Mycobacterium
VGITVVVMVLVLVSYHG

SEQ ID NO: 976545 - protein, 19 aa, Mycobacterium
VGLFVMFSRMQGGARMGFG

SEQ ID NO: 976546 - protein, 25 aa, Mycobacterium
VGLIVAWITLILLTFHWARVVWSST

SEQ ID NO: 976547 - protein, 24 aa, Mycobacterium
VGPERFYDMVRKFGLGQLTGVGLP

SEQ ID NO: 976548 - protein, 27 aa, Mycobacterium
VGYLLVLVLYRWFPPITVWTGLSLLAV

SEQ ID NO: 976549 - protein, 19 aa, Mycobacterium
VIALALFAGLAFGAANVVA

SEQ ID NO: 976550 - protein, 22 aa, Mycobacterium
VIDRLRHLILPTLTLALVGAAG

SEQ ID NO: 976551 - protein, 24 aa, Mycobacterium
VIGKARVVVWPPSRWGGVGSVNSQ

SEQ ID NO: 976552 - protein, 39 aa, Mycobacterium
VIGLLALKLQFGAGWWTSTWFLCIWVTGTSMLLISRIPM

SEQ ID NO: 976553 - protein, 25 aa, Mycobacterium
VIHHRTIWTVIAILALLGLPQVARI

SEQ ID NO: 976554 - protein, 21 aa, Mycobacterium
VISFTAILWNLSGRLAVFEFE

SEQ ID NO: 976555 - protein, 23 aa, Mycobacterium
VISKVMGIMRAAIRGVLVVIGIA

SEQ ID NO: 976556 - protein, 17 aa, Mycobacterium
VISLLYNGIYTGGLVSE

SEQ ID NO: 976557 - protein, 19 aa, Mycobacterium
VITIILLVLVLIPGIGNLA

SEQ ID NO: 976558 - protein, 18 aa, Mycobacterium
VITILAWWHFVGANTSDD

SEQ ID NO: 976559 - protein, 17 aa, Mycobacterium
VITLSLMSALAALYLGG

SEQ ID NO: 976560 - protein, 26 aa, Mycobacterium
VIVAGVSWTIALTRPAKVREPEVCNP

SEQ ID NO: 976561 - protein, 17 aa, Mycobacterium
VIWLNRLRALAHRMCVA

SEQ ID NO: 976562 - protein, 22 aa, Mycobacterium
VKWETLLFFAGLFIMVGALVKT

SEQ ID NO: 976563 - protein, 35 aa, Mycobacterium
VLAAIGMAILLYQKIWWPSIAWLVLTVATVYSAAP

SEQ ID NO: 976564 - protein, 18 aa, Mycobacterium
VLAAYLGGLGISVALWQH

SEQ ID NO: 976565 - protein, 20 aa, Mycobacterium
VLAFLAFMVALVGLADFGLA

SEQ ID NO: 976566 - protein, 30 aa, Mycobacterium
VLAGAYPMYLDAYPLPQFAIYGAVSLRTIK

SEQ ID NO: 976567 - protein, 26 aa, Mycobacterium
VLAPYLLIWVIILTYLCHIPFAIHNQ

SEQ ID NO: 976568 - protein, 33 aa, Mycobacterium
VLASSVLLVWWRWHHGFWLSVIYATVIALLILV

SEQ ID NO: 976569 - protein, 28 aa, Mycobacterium
VLASVVEIWMLLGSPAVICSMLSPKAKH

SEQ ID NO: 976570 - protein, 22 aa, Mycobacterium
VLGWFAIVTLTGSLWVSMSIQS

SEQ ID NO: 976571 - protein, 18 aa, Mycobacterium
VLHHTQLLNWLVHDKKLV

SEQ ID NO: 976572 - protein, 22 aa, Mycobacterium
VLIIMVMACWLLLAVFRGRLHP

SEQ ID NO: 976573 - protein, 23 aa, Mycobacterium
VLILIIVVALVISGLIGAELFAR

SEQ ID NO: 976574 - protein, 21 aa, Mycobacterium
VLLIVEGVGVNFWLLRRDSVT

SEQ ID NO: 976575 - protein, 17 aa, Mycobacterium
VLLLVFVAFIAHPVLHT

SEQ ID NO: 976576 - protein, 17 aa, Mycobacterium
VLLNAIFGLFGALALIM

SEQ ID NO: 976577 - protein, 22 aa, Mycobacterium
VLLPFFSFMTYLIAVPTGIKFF

SEQ ID NO: 976578 - protein, 22 aa, Mycobacterium
VLRPASKLATLAWWADTTLGED

SEQ ID NO: 976579 - protein, 28 aa, Mycobacterium
VLSAFTLIPYGLVLLQLRVFYAREQPWT

SEQ ID NO: 976580 - protein, 24 aa, Mycobacterium
VLSSILLWTGVSLMLIAWLRLGRR

SEQ ID NO: 976581 - protein, 18 aa, Mycobacterium
VLVFMLLGSFILPHTGQV

SEQ ID NO: 976582 - protein, 30 aa, Mycobacterium
VMIGVVLDWPRWWVSACSVLVLLIVEGVGV

SEQ ID NO: 976583 - protein, 19 aa, Mycobacterium
VMILYRVALPIPLPTHRLV

SEQ ID NO: 976584 - protein, 25 aa, Mycobacterium
VNINLFLLIIVVITALAFDFTNGFH

SEQ ID NO: 976585 - protein, 30 aa, Mycobacterium
VNLNPILRGVVASFLYFLVVVAILATNFVT

SEQ ID NO: 976586 - protein, 22 aa, Mycobacterium
VNTVVTPSWFSEYVLTVGAVDS

SEQ ID NO: 976587 - protein, 18 aa, Mycobacterium
VNVPIGLVMIYLARTALH

SEQ ID NO: 976588 - protein, 26 aa, Mycobacterium
VPEQLFSPILLLALAVLVVGLVSTWL

SEQ ID NO: 976589 - protein, 28 aa, Mycobacterium
VPLEAVPPFFRWLSEFEPLHQLFLGVRS

SEQ ID NO: 976590 - protein, 25 aa, Mycobacterium
VPLVSFAILAPCGVLYLVTSLEAAR

SEQ ID NO: 976591 - protein, 26 aa, Mycobacterium
VPNTIYSPLFRKLVEWIEYLCLVPIF

SEQ ID NO: 976592 - protein, 28 aa, Mycobacterium
VQPFGEYLPMPWLFKRLSKYADRVSHIV

SEQ ID NO: 976593 - protein, 26 aa, Mycobacterium
VRGLKTLFATVMFSIAGFGLGLALYV

SEQ ID NO: 976594 - protein, 24 aa, Mycobacterium
VRKYMTLMAFRIPALMLTTVAYSA

SEQ ID NO: 976595 - protein, 18 aa, Mycobacterium
VRLVYDMALVFRHRVRKD

SEQ ID NO: 976596 - protein, 22 aa, Mycobacterium
VRRSNALQNWSYGRQFRYSETM

SEQ ID NO: 976597 - protein, 17 aa, Mycobacterium
VSFFLVASNFALATPLT

SEQ ID NO: 976598 - protein, 25 aa, Mycobacterium
VSGLIFGWLAFLLVFGLFVRRGWDI

SEQ ID NO: 976599 - protein, 22 aa, Mycobacterium
VSQRGLLRLLEDLRCERGLTVV

SEQ ID NO: 976600 - protein, 26 aa, Mycobacterium
VSQTIVPLPWILQAPRLFAGKINLGD

SEQ ID NO: 976601 - protein, 26 aa, Mycobacterium
VSTWHGRSPRLWLIAGGGLSVQDDEL

SEQ ID NO: 976602 - protein, 19 aa, Mycobacterium
VSVLAPQWLNKAFGIAQLN

SEQ ID NO: 976603 - protein, 25 aa, Mycobacterium
VSWSHHWVWMLPAVLVTGILSWRRQ

SEQ ID NO: 976604 - protein, 21 aa, Mycobacterium
VTAAFWIFMLCYAAAGVLTWK

SEQ ID NO: 976605 - protein, 24 aa, Mycobacterium
VTAAILVFIFAWNDLLLALSLTST

SEQ ID NO: 976606 - protein, 23 aa, Mycobacterium
VTAAYVLITFWQYRNACVTAPGL

SEQ ID NO: 976607 - protein, 21 aa, Mycobacterium
VTAIILITTLLQGSTLPVVIR

SEQ ID NO: 976608 - protein, 24 aa, Mycobacterium
VTALACCLALILALPDLAWGVWGK

SEQ ID NO: 976609 - protein, 38 aa, Mycobacterium
VTALVPPCIILFFHTQYWWAGIALVVLVVILTLVEFSG

SEQ ID NO: 976610 - protein, 18 aa, Mycobacterium
VTARWNWVLDGMVDINAL

SEQ ID NO: 976611 - protein, 17 aa, Mycobacterium
VTCDDLVLTWAAQSGRF

SEQ ID NO: 976612 - protein, 30 aa, Mycobacterium
VTSIAVLRRLLRWVLGPTDPVLASTVFGVR

SEQ ID NO: 976613 - protein, 29 aa, Mycobacterium
VTSVSIPSWWQPYVLSVASLTPSGRPSKF

SEQ ID NO: 976614 - protein, 25 aa, Mycobacterium
VVAAILLIAIFLLLRAVPSLRANHA

SEQ ID NO: 976615 - protein, 40 aa, Mycobacterium
VVAGLLFCASFPSLNWWWAAVVAFALLAWVLTHPTTTPVG

SEQ ID NO: 976616 - protein, 18 aa, Mycobacterium
VVALLAALLAGLDLLPKA

SEQ ID NO: 976617 - protein, 17 aa, Mycobacterium
VVELFGLLLSPISWTHH

SEQ ID NO: 976618 - protein, 26 aa, Mycobacterium
VVGVIVWGLIFWSTIFHRKKTTDTEL

SEQ ID NO: 976619 - protein, 23 aa, Mycobacterium
VVGVPWLLSFAQPTIWQLGRPWY

SEQ ID NO: 976620 - protein, 23 aa, Mycobacterium
VVHGWVYFVYVLTAFNLAIKVRW

SEQ ID NO: 976621 - protein, 18 aa, Mycobacterium
VVHSFWVPKFLFKRDVMP

SEQ ID NO: 976622 - protein, 21 aa, Mycobacterium
VVIVVYLRGHFLLTYTAAMYW

SEQ ID NO: 976623 - protein, 24 aa, Mycobacterium
VVKSALVLGLWLAGWGAARLVVTA

SEQ ID NO: 976624 - protein, 46 aa, Mycobacterium
VVLAIIALQLYDFLWYPYYASYGMLLLPFFAPALSVLGTLSVLWNG

SEQ ID NO: 976625 - protein, 26 aa, Mycobacterium
VVLLFAARRVLWLYKLTMSGQPANGR

SEQ ID NO: 976626 - protein, 26 aa, Mycobacterium
VVLVANDRWWGLKATTKRITVRPQEA

SEQ ID NO: 976627 - protein, 19 aa, Mycobacterium
VVLVLVAIVLFGAASLLFG

SEQ ID NO: 976628 - protein, 21 aa, Mycobacterium
VVRTLDRSYVKAIRLRWLREE

SEQ ID NO: 976629 - protein, 24 aa, Mycobacterium
VVSKEIIYFLAQLDVKEIHGYNHE

SEQ ID NO: 976630 - protein, 19 aa, Mycobacterium
VVTAPLVLASWPGSALLPL

SEQ ID NO: 976631 - protein, 17 aa, Mycobacterium
VVTLGRWLRPSRPLSPV

SEQ ID NO: 976632 - protein, 23 aa, Mycobacterium
VVTTIFGFIWYSHSIFGLESLGE

SEQ ID NO: 976633 - protein, 28 aa, Mycobacterium
VVVGPLPGWPIWFAVVWAAQEWLKSVVP

SEQ ID NO: 976634 - protein, 19 aa, Mycobacterium
VVVMVLVLVSYHGITLMSG

SEQ ID NO: 976635 - protein, 26 aa, Mycobacterium
VVVRWPLPILITTCAIAMVGLLALPG

SEQ ID NO: 976636 - protein, 19 aa, Mycobacterium
VVVWIYFLKSFTYAGVPFV

SEQ ID NO: 976637 - protein, 18 aa, Mycobacterium
VYDLFSGANNRYIPVRRP

SEQ ID NO: 976638 - protein, 23 aa, Mycobacterium
VYLLRSFFFYFHDNKAVTNGFPL

SEQ ID NO: 976639 - protein, 33 aa, Mycobacterium
VYQLFFNAIGWTTWALILSSPFTVPLASSLGLF

SEQ ID NO: 976640 - protein, 19 aa, Mycobacterium
VYRYRFIVIGITVALCLCG

SEQ ID NO: 976641 - protein, 27 aa, Mycobacterium
VYYPVSWIMWVWYKLFAAVLGPSNFFA

SEQ ID NO: 976642 - protein, 26 aa, Mycobacterium
WAETTVIIRFWLLTAIACGLGVVLFY

SEQ ID NO: 976643 - protein, 17 aa, Mycobacterium
WAGIVAMPTMVAAIYGM

SEQ ID NO: 976644 - protein, 19 aa, Mycobacterium
WAIFSVMVLLIPTIATMVL

SEQ ID NO: 976645 - protein, 25 aa, Mycobacterium
WAKRNPRRWSVIDAWFTLGMMFEMR

SEQ ID NO: 976646 - protein, 20 aa, Mycobacterium
WDSLTKYLISKGFEFTELEA

SEQ ID NO: 976647 - protein, 30 aa, Mycobacterium
WHNGQRVHLDLDPLLPFPRWHEYAAVVEEP

SEQ ID NO: 976648 - protein, 33 aa, Mycobacterium
WIALTLVVTAFTYLCFMVLAPWQLGKNTRMSRE

SEQ ID NO: 976649 - protein, 17 aa, Mycobacterium
WIVVTICALLVTLTLRV

SEQ ID NO: 976650 - protein, 26 aa, Mycobacterium
WLLVNLPVLLLFPRGWSEFFRFNTRR

SEQ ID NO: 976651 - protein, 18 aa, Mycobacterium
WNNFMWPLVITSGNKWRV

SEQ ID NO: 976652 - protein, 19 aa, Mycobacterium
WPILLVGMIFAGAFVLVGA

SEQ ID NO: 976653 - protein, 24 aa, Mycobacterium
WQLGRPWYLAWGGLVYIVVALVTL

SEQ ID NO: 976654 - protein, 23 aa, Mycobacterium
WQSRFEALWRGSLIVLQSILAVV

SEQ ID NO: 976655 - protein, 18 aa, Mycobacterium
WRRRLDDLSYTRALSPLR

SEQ ID NO: 976656 - protein, 24 aa, Mycobacterium
WSAVLLPLALLMLAATVAAIAVRG

SEQ ID NO: 976657 - protein, 26 aa, Mycobacterium
WSNSFPKLRWSLTTALLELTVIVLLL

SEQ ID NO: 976658 - protein, 27 aa, Mycobacterium
WSRNRMAFLAALLFVMTLCFATTNGWW

SEQ ID NO: 976659 - protein, 23 aa, Mycobacterium
WSSPFWRFWDLALLWLAQVHGGN

SEQ ID NO: 976660 - protein, 24 aa, Mycobacterium
WTSVYEANWWWLLAAVLAAAAAVH

SEQ ID NO: 976661 - protein, 17 aa, Mycobacterium
WTWGFSGTATLAAVIVG

SEQ ID NO: 976662 - protein, 20 aa, Mycobacterium
WVGVLVYFLPRWPWLRVADK

SEQ ID NO: 976663 - protein, 19 aa, Mycobacterium
WVKWYPGIPGYLDQAWIAQ

SEQ ID NO: 976664 - protein, 19 aa, Mycobacterium
WVMHRPWISASAASTILII

SEQ ID NO: 976665 - protein, 18 aa, Mycobacterium
WYYAWTPGTGYLASLLPQ

SEQ ID NO: 976666 - protein, 26 aa, Mycobacterium
YAGVPTLAPPPPLKKVIQPTIEVAPG

SEQ ID NO: 976667 - protein, 19 aa, Mycobacterium
YAIPLLQTAHRTGARVVLR

SEQ ID NO: 976668 - protein, 18 aa, Mycobacterium
YAVFLISRYHDYIRMGSG

SEQ ID NO: 976669 - protein, 18 aa, Mycobacterium
YAVTFTLLALSISRGMKT

SEQ ID NO: 976670 - protein, 24 aa, Mycobacterium
YDAPEVIIPFMVPDGAHAYPDAAR

SEQ ID NO: 976671 - protein, 39 aa, Mycobacterium
YDRDLQLIVIVTMIVVLLILMALLRSIVAPIYLVGSVIV

SEQ ID NO: 976672 - protein, 47 aa, Mycobacterium
YFADGLQHWPWMLLGYFVITILVVSLIGWWVLSRVLERIRDIPDVHK

SEQ ID NO: 976673 - protein, 17 aa, Mycobacterium
YFGFLLNLLVVFGVSFE

SEQ ID NO: 976674 - protein, 27 aa, Mycobacterium
YFGLPTWLIVFLRLLFTVLAICSLWLL

SEQ ID NO: 976675 - protein, 18 aa, Mycobacterium
YGQAEILWDVIPFDWTND

SEQ ID NO: 976676 - protein, 22 aa, Mycobacterium
YGRSRLPGRSRHRGVIALTVLA

SEQ ID NO: 976677 - protein, 22 aa, Mycobacterium
YILAFALFITGLMGLTGPRTAV

SEQ ID NO: 976678 - protein, 24 aa, Mycobacterium
YIRPYRRLVAVLMVLQLVSTLASL

SEQ ID NO: 976679 - protein, 24 aa, Mycobacterium
YLDRRGARRRSHCGGYWLGHRRGV

SEQ ID NO: 976680 - protein, 17 aa, Mycobacterium
YLGGWRIIRTLGKGMVE

SEQ ID NO: 976681 - protein, 22 aa, Mycobacterium
YMANYYRWFGTPEAPFGWYYDL

SEQ ID NO: 976682 - protein, 18 aa, Mycobacterium
YMMWTEGLARIWPAWEFY

SEQ ID NO: 976683 - protein, 20 aa, Mycobacterium
YPTLLPSGRFPSGRFIAAVI

SEQ ID NO: 976684 - protein, 17 aa, Mycobacterium
YQVIANDGVRIPPRIIK

SEQ ID NO: 976685 - protein, 21 aa, Mycobacterium
YRAMALSRLRLIGVGIPAAIG

SEQ ID NO: 976686 - protein, 17 aa, Mycobacterium
YRIMAWTTGIWLIALCY

SEQ ID NO: 976687 - protein, 31 aa, Mycobacterium
YRPGLAAGLALLPLLALLALWGRRNERAADA

SEQ ID NO: 976688 - protein, 31 aa, Mycobacterium
YRSILPNIPGVPWWAALLIATTASAIGYAID

SEQ ID NO: 976689 - protein, 22 aa, Mycobacterium
YRTTIFAFPVFGFGVIFGAIWA

SEQ ID NO: 976690 - protein, 20 aa, Mycobacterium
YSIIYIIYDLPAMFDPLLLV

SEQ ID NO: 976691 - protein, 17 aa, Mycobacterium
YSLGGFGPAPEGMAIWI

SEQ ID NO: 976692 - protein, 20 aa, Mycobacterium
YSSIFFATPLLVTLRERTEL

SEQ ID NO: 976693 - protein, 17 aa, Mycobacterium
YTDLWVGFTAVSALLIL

SEQ ID NO: 976694 - protein, 17 aa, Mycobacterium
YTYGLLWVAGAVVIVGV

SEQ ID NO: 976695 - protein, 25 aa, Mycobacterium
YVGSVVLLLLIYLGFISGTGELRGL

SEQ ID NO: 976696 - protein, 19 aa, Mycobacterium
YVIVLGLGYVLGAKAGRRR

SEQ ID NO: 976697 - protein, 23 aa, Mycobacterium
AAAKLYPLLFLGVLAVLGIRSGR

SEQ ID NO: 976698 - protein, 18 aa, Mycobacterium
AAALPFGLAAGAGAAWLF

SEQ ID NO: 976699 - protein, 24 aa, Mycobacterium
AAARALVQLLLVGGALTLLFEPGR

SEQ ID NO: 976700 - protein, 30 aa, Mycobacterium
AAATLFLLTTTLLDGFWYVASASFAADQFG

SEQ ID NO: 976701 - protein, 18 aa, Mycobacterium
AAATYLSSLIGAAVPVQC

SEQ ID NO: 976702 - protein, 30 aa, Mycobacterium
AAAVLAGTAALGWLWKEQRDNEIAGRQALS

SEQ ID NO: 976703 - protein, 24 aa, Mycobacterium
AAAVLVALAGRRLWHRFRGQPDRA

SEQ ID NO: 976704 - protein, 17 aa, Mycobacterium
AAAVRILSAIPVARASS

SEQ ID NO: 976705 - protein, 33 aa, Mycobacterium
AADGFAQVFPEHKYRIVRLLQGRGHIVGMTGDG

SEQ ID NO: 976706 - protein, 31 aa, Mycobacterium
AADRNALMAIPLWIIIVLPVAKILATSLSIG

SEQ ID NO: 976707 - protein, 23 aa, Mycobacterium
AADWAPWIWAVLVAGVGFMARAP

SEQ ID NO: 976708 - protein, 25 aa, Mycobacterium
AAELDAHLRLPLRQVMWGTDEGLLE

SEQ ID NO: 976709 - protein, 29 aa, Mycobacterium
AAERWNLPIILIVLLAVFGSLTAAAIALA

SEQ ID NO: 976710 - protein, 21 aa, Mycobacterium
AAFGMLSVALILAAIALPAAV

SEQ ID NO: 976711 - protein, 17 aa, Mycobacterium
AAFLLAQSMHCSGVVAV

SEQ ID NO: 976712 - protein, 43 aa, Mycobacterium
AAFSKALVLVTVAMIVIICVFSMLIAQLMVRPIRRLEAGTEKI

SEQ ID NO: 976713 - protein, 20 aa, Mycobacterium
AAFYVFGLTLLIMAGNLAKP

SEQ ID NO: 976714 - protein, 28 aa, Mycobacterium
AAGAAIPAGPAITARKAGRAELGRSTLS

SEQ ID NO: 976715 - protein, 24 aa, Mycobacterium
AAGIVWPVGRACASGCLLLALGAG

SEQ ID NO: 976716 - protein, 18 aa, Mycobacterium
AAGLVLAAALGTGVAVLM

SEQ ID NO: 976717 - protein, 25 aa, Mycobacterium
AAGPPIFGALITTAAYPLAWGLCGL

SEQ ID NO: 976718 - protein, 24 aa, Mycobacterium
AAGSWLPAILWGVAFAILVRGLPV

SEQ ID NO: 976719 - protein, 28 aa, Mycobacterium
AAGVAILTAPLLLARTPALHGVGVAALG

SEQ ID NO: 976720 - protein, 22 aa, Mycobacterium
AAGVIAFLIAGLGGFMGVVHSA

SEQ ID NO: 976721 - protein, 30 aa, Mycobacterium
AAGVPVVFLTAFYGLSVLAGLKAGERVLIH

SEQ ID NO: 976722 - protein, 23 aa, Mycobacterium
AAGYLNLPAIILIGLCALLLIRG

SEQ ID NO: 976723 - protein, 22 aa, Mycobacterium
AAILMLYTIVIIRGLRTAIATR

SEQ ID NO: 976724 - protein, 18 aa, Mycobacterium
AAIPLVPTRLRPPGLEPR

SEQ ID NO: 976725 - protein, 18 aa, Mycobacterium
AAITVCSLMFASHVTRYH

SEQ ID NO: 976726 - protein, 29 aa, Mycobacterium
AAIVVGLLLLLVARPLSVVLSLSGFRIPW

SEQ ID NO: 976727 - protein, 27 aa, Mycobacterium
AALACFAWLTLLIRRPFTMAYAKDTTP

SEQ ID NO: 976728 - protein, 27 aa, Mycobacterium
AALAGVPLLLGALWASGRFARRADKVA

SEQ ID NO: 976729 - protein, 27 aa, Mycobacterium
AALALVFLIVLLMLRSPVAAAVVIGAV

SEQ ID NO: 976730 - protein, 17 aa, Mycobacterium
AALAWLVEEMEQRYQDM

SEQ ID NO: 976731 - protein, 26 aa, Mycobacterium
AALCLLILMLAMFPANIYAARMPSPP

SEQ ID NO: 976732 - protein, 27 aa, Mycobacterium
AALEAAALIALWRLLARARQENDELRQ

SEQ ID NO: 976733 - protein, 33 aa, Mycobacterium
AALFAVEVALFAALQRWGLQPDFVMGHSVGELS

SEQ ID NO: 976734 - protein, 20 aa, Mycobacterium
AALGAAIRYAAVDKDVVIVA

SEQ ID NO: 976735 - protein, 19 aa, Mycobacterium
AALGLLVTLLVHARDIETT

SEQ ID NO: 976736 - protein, 27 aa, Mycobacterium
AALIFSRYLWAFELTSALLITAAIGAM

SEQ ID NO: 976737 - protein, 25 aa, Mycobacterium
AALLAQLPDRYPLKGIFHAAGVLDD

SEQ ID NO: 976738 - protein, 38 aa, Mycobacterium; identical to SEQ ID NO: 348400

SEQ ID NO: 976739 - protein, 26 aa, Mycobacterium
AALLGRWFWWPLNIRSRPPRLTRQRL

SEQ ID NO: 976740 - protein, 18 aa, Mycobacterium
AALLVVLVLARWGSRHRP

SEQ ID NO: 976741 - protein, 24 aa, Mycobacterium
AALPPLLGELAARPKRRLISDADA

SEQ ID NO: 976742 - protein, 23 aa, Mycobacterium
AALPVLVVILTEVQRLLRRRQSA

SEQ ID NO: 976743 - protein, 17 aa, Mycobacterium
AALVFVLIVGGIGVWLV

SEQ ID NO: 976744 - protein, 24 aa, Mycobacterium
AALWAVYTTRWWLSGLLVGVAAGI

SEQ ID NO: 976745 - protein, 17 aa, Mycobacterium
AAMVLYVLVSQLGLIVG

SEQ ID NO: 976746 - protein, 19 aa, Mycobacterium
AAMVWTAVAIWIEPLRSTF

SEQ ID NO: 976747 - protein, 22 aa, Mycobacterium
AAPRLPPGFRWIAVRPGAAPPH

SEQ ID NO: 976748 - protein, 23 aa, Mycobacterium
AAPTHRWIKDLPDEPVWVNGDHA

SEQ ID NO: 976749 - protein, 28 aa, Mycobacterium
AAPVNYLKLMPATYVVLVFVVGYMLLTV

SEQ ID NO: 976750 - protein, 25 aa, Mycobacterium
AAQARLFLVDFRRELLGLSESEYLG

SEQ ID NO: 976751 - protein, 26 aa, Mycobacterium
AAQDRVWYIFLLLPSFVIYLISMVGE

SEQ ID NO: 976752 - protein, 24 aa, Mycobacterium
AAQDTFLRWVWYAARREGLALDGA

SEQ ID NO: 976753 - protein, 27 aa, Mycobacterium
AAQVGLSLFYWWFHTIDKTLPVFVVLV

SEQ ID NO: 976754 - protein, 25 aa, Mycobacterium
AARAALPQIIPLLRSGPAGQTTGRA

SEQ ID NO: 976755 - protein, 26 aa, Mycobacterium
AARATFLRWIWYAARREGLHLNGADD

SEQ ID NO: 976756 - protein, 29 aa, Mycobacterium
AARHYFTYRDVLGFVYAQAKFQLLGTENS

SEQ ID NO: 976757 - protein, 19 aa, Mycobacterium
AARLLSIRVTSDKFSARSS

SEQ ID NO: 976758 - protein, 23 aa, Mycobacterium
AASALCFLVGFAGLLWAPLTAPI

SEQ ID NO: 976759 - protein, 25 aa, Mycobacterium
AASGHLIFALIATGTILSVHLLGRP

SEQ ID NO: 976760 - protein, 36 aa, Mycobacterium; identical to SEQ ID NO: 348557

SEQ ID NO: 976761 - protein, 27 aa, Mycobacterium
AASPTTLLLTLLSVLLASSIVAALTFK

SEQ ID NO: 976762 - protein, 23 aa, Mycobacterium
AASVPVVFLTAFYGLRVLAEVRS

SEQ ID NO: 976763 - protein, 25 aa, Mycobacterium
AATAVLALLAIYFVGIDQGAVSLVG

SEQ ID NO: 976764 - protein, 22 aa, Mycobacterium
AATIVGRLWGWRTAIRRSGTTV

SEQ ID NO: 976765 - protein, 27 aa, Mycobacterium
AATQAAPAPMPWYPTAPAPARPRRQVR

SEQ ID NO: 976766 - protein, 30 aa, Mycobacterium
AATTLLLMLMAGVALFWIVTLVVAAARGLT

SEQ ID NO: 976767 - protein, 24 aa, Mycobacterium
AAVLTHGFGLWSTSEPGPVVKAQQ

SEQ ID NO: 976768 - protein, 24 aa, Mycobacterium
AAVLTMCFIVAGIIAPSLARRAAQ

SEQ ID NO: 976769 - protein, 34 aa, Mycobacterium; identical to SEQ ID NO: 348658

SEQ ID NO: 976770 - protein, 30 aa, Mycobacterium; identical to SEQ ID NO: 348662

SEQ ID NO: 976771 - protein, 27 aa, Mycobacterium
AAVSWFLRFLLRHSMYWFVGYRVVVGV

SEQ ID NO: 976772 - protein, 18 aa, Mycobacterium
AAVVLLVVLRRRRTRLGA

SEQ ID NO: 976773 - protein, 29 aa, Mycobacterium
AAWRHVDVFQFFYLVLPLFCGAFEGAGLF

SEQ ID NO: 976774 - protein, 24 aa, Mycobacterium
AAWSFFRLVWLLYVSMPFGWFMGA

SEQ ID NO: 976775 - protein, 28 aa, Mycobacterium
AAWTAAGMFLAVWLPLNNGLRPEPIIAL

SEQ ID NO: 976776 - protein, 22 aa, Mycobacterium
AAWWVVVLALTAATMMAAALGG

SEQ ID NO: 976777 - protein, 29 aa, Mycobacterium
AAYDLLRPRLPRVLAAIALGVLPLGSALA

SEQ ID NO: 976778 - protein, 18 aa, Mycobacterium
ACFIFFFIGGLMALLMRA

SEQ ID NO: 976779 - protein, 25 aa, Mycobacterium
ADDSVPPLPAFKPSANLGANCQYPA

SEQ ID NO: 976780 - protein, 21 aa, Mycobacterium
ADEFIVAVRQLTIGQDASVEV

SEQ ID NO: 976781 - protein, 27 aa, Mycobacterium
ADFDDFFRPIRSYFYWEKHCFDIPVCW

SEQ ID NO: 976782 - protein, 24 aa, Mycobacterium
ADGPPRLPVSYPGLPPAPGGYRNR

SEQ ID NO: 976783 - protein, 24 aa, Mycobacterium
ADIDRQMYFFYAATMAPFLVMAIA

SEQ ID NO: 976784 - protein, 25 aa, Mycobacterium
ADLAFLPRLVVLIVVALVITGAVYG

SEQ ID NO: 976785 - protein, 27 aa, Mycobacterium
ADQPWLADHVIGGVVLFPGAGFVELAI

SEQ ID NO: 976786 - protein, 23 aa, Mycobacterium
ADYRLGWYVIIGTIPICVLGLLF

SEQ ID NO: 976787 - protein, 24 aa, Mycobacterium
AEAARSWPPLGGPWAPLGASQWNQ

SEQ ID NO: 976788 - protein, 21 aa, Mycobacterium
AEDLRRALDDSGVLDVAVLSE

SEQ ID NO: 976789 - protein, 26 aa, Mycobacterium
AEELLSRSWWSGPEIFLIVDDIQQLP

SEQ ID NO: 976790 - protein, 26 aa, Mycobacterium
AEGRLGWPLWAAYVSVFALTVLVGVR

SEQ ID NO: 976791 - protein, 40 aa, Mycobacterium; identical to SEQ ID NO: 348862

SEQ ID NO: 976792 - protein, 27 aa, Mycobacterium
AEHPQPGDWLYFVTIDSQGTTRFTRDY

SEQ ID NO: 976793 - protein, 21 aa, Mycobacterium
AELLDWIHRAADAGQPVILNA

SEQ ID NO: 976794 - protein, 17 aa, Mycobacterium
AELSRLLCAETLTPLPI

SEQ ID NO: 976795 - protein, 25 aa, Mycobacterium
AELVDQLERLLADPVLRDQLGAKAR

SEQ ID NO: 976796 - protein, 24 aa, Mycobacterium
AENMAGAPWLVYYARALGADIGKG

SEQ ID NO: 976797 - protein, 38 aa, Mycobacterium
AEQRRNPVLVFLGYFWAPIPWMIEAALVLSLAARHWTD

SEQ ID NO: 976798 - protein, 24 aa, Mycobacterium
AERILNRLLAVQDPPARRRLGPLD

SEQ ID NO: 976799 - protein, 23 aa, Mycobacterium
AERVDIAIVGLATRLPGEMNSPE

SEQ ID NO: 976800 - protein, 19 aa, Mycobacterium
AERVVFATWAIVTGKSAGG

SEQ ID NO: 976801 - protein, 17 aa, Mycobacterium
AERYPTCSDFAAALAGQ

SEQ ID NO: 976802 - protein, 23 aa, Mycobacterium
AESMPLGVDLIFGSGISIGAVAA

SEQ ID NO: 976803 - protein, 29 aa, Mycobacterium
AETERIWLPFTVWLTTAPALLRPRSDRLW

SEQ ID NO: 976804 - protein, 44 aa, Mycobacterium; identical to SEQ ID NO: 348927

SEQ ID NO: 976805 - protein, 22 aa, Mycobacterium
AFDARGRRLAWCPSDFAGVTVV

SEQ ID NO: 976806 - protein, 21 aa, Mycobacterium
AFDILAPLVAIAALVMIGFIL

SEQ ID NO: 976807 - protein, 17 aa, Mycobacterium
AFDLAHRVAPSARLLVI

SEQ ID NO: 976808 - protein, 28 aa, Mycobacterium
AFDVHTPWFWCLLALRAVVFTLVMAATF

SEQ ID NO: 976809 - protein, 21 aa, Mycobacterium
AFEVVGRRKLWYGISGAIMAI

SEQ ID NO: 976810 - protein, 26 aa, Mycobacterium
AFFSHPIIAFILFVASPYIVYFTPLF

SEQ ID NO: 976811 - protein, 25 aa, Mycobacterium
AFGAFAHRWLARRTKRRINPGLVVG

SEQ ID NO: 976812 - protein, 20 aa, Mycobacterium
AFGFIFTFRDIPTPPHTPGP

SEQ ID NO: 976813 - protein, 18 aa, Mycobacterium
AFGLIRIARAVLAISPVV

SEQ ID NO: 976814 - protein, 24 aa, Mycobacterium
AFGMGLAVLFIHLYPGRTGTSFAL

SEQ ID NO: 976815 - protein, 17 aa, Mycobacterium
AFLAYLVSFVFIGSSWL

SEQ ID NO: 976816 - protein, 28 aa, Mycobacterium
AFLTYALCGLLILLVMRMLAEMAAANPS

SEQ ID NO: 976817 - protein, 34 aa, Mycobacterium
AFMTPAIAALLGRWFWWPLRVRSRPDRGAIQRAA

SEQ ID NO: 976818 - protein, 29 aa, Mycobacterium
AFPRLNALSFWLFVFGALIALSGFIVPGG

SEQ ID NO: 976819 - protein, 35 aa, Mycobacterium
AFPYDPWVRISLWIGVAIIALLFGWGAWQRRWIAD

SEQ ID NO: 976820 - protein, 21 aa, Mycobacterium
AFSAAIAVLVIACPCALGLAT

SEQ ID NO: 976821 - protein, 26 aa, Mycobacterium
AFVGANFMLLPRWLAGGGDHGAAAVI

SEQ ID NO: 976822 - protein, 17 aa, Mycobacterium
AFVLMSSGVVILRRTRP

SEQ ID NO: 976823 - protein, 18 aa, Mycobacterium
AFVVLFVINIVVTAVGIP

SEQ ID NO: 976824 - protein, 25 aa, Mycobacterium
AFYDAMFGWLGYMSFWTLDIEYRST

SEQ ID NO: 976825 - protein, 39 aa, Mycobacterium; identical to SEQ ID NO: 349088

SEQ ID NO: 976826 - protein, 27 aa, Mycobacterium
AGAACGVLLLRVLMRRFWPDAEDPNGS

SEQ ID NO: 976827 - protein, 26 aa, Mycobacterium
AGAALPWLWIAILGTPAILISLAGNG

SEQ ID NO: 976828 - protein, 19 aa, Mycobacterium
AGAGAFWILRRLFDRRQCA

SEQ ID NO: 976829 - protein, 31 aa, Mycobacterium
AGAGAGATPLTALTAHPAVAAGAGIVTAVVG

SEQ ID NO: 976830 - protein, 26 aa, Mycobacterium
AGALCILVMVMWVGTALTISTTASRS

SEQ ID NO: 976831 - protein, 24 aa, Mycobacterium
AGAQLLIRFTGPQVWWVLHVARWA

SEQ ID NO: 976832 - protein, 28 aa, Mycobacterium
AGATFCLHLPRLSYFKALGIPSALGLLV

SEQ ID NO: 976833 - protein, 25 aa, Mycobacterium
AGATLLHSGFFTPLYRIAATFVGPD

SEQ ID NO: 976834 - protein, 27 aa, Mycobacterium
AGATYCLSFARLPWFNTMGAPVAIGML

SEQ ID NO: 976835 - protein, 29 aa, Mycobacterium
AGDFWAWALQFIVTLWVSTFLVVASHEFE

SEQ ID NO: 976836 - protein, 25 aa, Mycobacterium
AGDLLLLFVALLANGLARFVASGLS

SEQ ID NO: 976837 - protein, 26 aa, Mycobacterium
AGDPQARLLSYLPSGYASGVCTATTP

SEQ ID NO: 976838 - protein, 24 aa, Mycobacterium
AGDRSMRLILLVTFAVIVVMLLVI

SEQ ID NO: 976839 - protein, 24 aa, Mycobacterium
AGESLIDVLHWPGYLLVVAGVIGG

SEQ ID NO: 976840 - protein, 19 aa, Mycobacterium
AGFMLFMYLEVLDASFSFD

SEQ ID NO: 976841 - protein, 32 aa, Mycobacterium
AGFYCYVLTHVLYLNYVWGYSLLKAGFAIAPA

SEQ ID NO: 976842 - protein, 34 aa, Mycobacterium; identical to SEQ ID NO: 349207

SEQ ID NO: 976843 - protein, 28 aa, Mycobacterium
AGGRPKLWLTTRALQRLAHAVLPDLRVL

SEQ ID NO: 976844 - protein, 34 aa, Mycobacterium; identical to SEQ ID NO: 349212

SEQ ID NO: 976845 - protein, 27 aa, Mycobacterium
AGGSPMLIIALVLALIGLVVLVFAVAT

SEQ ID NO: 976846 - protein, 26 aa, Mycobacterium
AGHASYWRQLMQLAMRVPLLGPTLSR

SEQ ID NO: 976847 - protein, 20 aa, Mycobacterium
AGHMAATICWIAVAAPLFVY

SEQ ID NO: 976848 - protein, 26 aa, Mycobacterium
AGIGLKAFWYHFAIMFEALFILTTVD

SEQ ID NO: 976849 - protein, 24 aa, Mycobacterium
AGITFIASTLFFAGALVFGHGACH

SEQ ID NO: 976850 - protein, 32 aa, Mycobacterium; identical to SEQ ID NO: 349242

SEQ ID NO: 976851 - protein, 17 aa, Mycobacterium
AGLAVVYLGIGLLLACI

SEQ ID NO: 976852 - protein, 23 aa, Mycobacterium
AGLGWWLLRRRTDVPPLAGTIAD

SEQ ID NO: 976853 - protein, 24 aa, Mycobacterium
AGLKVAFFALALPIAITGLMCIRL

SEQ ID NO: 976854 - protein, 18 aa, Mycobacterium
AGLLAYVVDRLAGLGQLT

SEQ ID NO: 976855 - protein, 19 aa, Mycobacterium
AGLLIVIGIQLLQPAHIET

SEQ ID NO: 976856 - protein, 26 aa, Mycobacterium
AGLLPTIGLAGLLWVAAALIAISLAV

SEQ ID NO: 976857 - protein, 24 aa, Mycobacterium
AGLLSGYLLARKVVGARPPRPAAF

SEQ ID NO: 976858 - protein, 21 aa, Mycobacterium
AGLPRWRYLVLPVIGAAVDIY

SEQ ID NO: 976859 - protein, 25 aa, Mycobacterium
AGLTTGVRLLFAATLLMAIHRPRAF

SEQ ID NO: 976860 - protein, 23 aa, Mycobacterium
AGLVGAVPQVWWGPAEQSYAAAN

SEQ ID NO: 976861 - protein, 34 aa, Mycobacterium; identical to SEQ ID NO: 349312

SEQ ID NO: 976862 - protein, 23 aa, Mycobacterium
AGLWAGFLWGVDGRLPLLISGGA

SEQ ID NO: 976863 - protein, 18 aa, Mycobacterium
AGMPAIEWFYVRQLRRVS

SEQ ID NO: 976864 - protein, 25 aa, Mycobacterium
AGPGMNFVICLVLIYGIAVVWGLPN

SEQ ID NO: 976865 - protein, 18 aa, Mycobacterium
AGPYNLLGWSFGGVVAHE

SEQ ID NO: 976866 - protein, 22 aa, Mycobacterium
AGQRRRLLLARAALSPAQIVLL

SEQ ID NO: 976867 - protein, 26 aa, Mycobacterium
AGQTVFRIRLPLIDAPLNASAPGRPR

SEQ ID NO: 976868 - protein, 21 aa, Mycobacterium
AGRRRLVMLGLLGFGVVTGVT

SEQ ID NO: 976869 - protein, 26 aa, Mycobacterium
AGRRVLLNLWAYWCAECTAELPALAE

SEQ ID NO: 976870 - protein, 20 aa, Mycobacterium
AGRVVALVLIILGLAEFVAG

SEQ ID NO: 976871 - protein, 23 aa, Mycobacterium
AGSTSQVVLPFNGLKNPDGVAVD

SEQ ID NO: 976872 - protein, 25 aa, Mycobacterium
AGSVSWLILLLASPVARATARLLTP

SEQ ID NO: 976873 - protein, 31 aa, Mycobacterium; identical to SEQ ID NO: 349411

SEQ ID NO: 976874 - protein, 25 aa, Mycobacterium
AGTTGWLAGMWRDLLGAAISGPEAD

SEQ ID NO: 976875 - protein, 18 aa, Mycobacterium
AGTVLLIGLIRWYIGMAQ

SEQ ID NO: 976876 - protein, 17 aa, Mycobacterium
AGVAFALVAACFWALYI

SEQ ID NO: 976877 - protein, 26 aa, Mycobacterium
AGVGLGPLWYLVGPAPAAGPAIRVAL

SEQ ID NO: 976878 - protein, 37 aa, Mycobacterium
AGVIGVLIFAAILVTGFLWPAWLVTTKLDVNKAQASV

SEQ ID NO: 976879 - protein, 23 aa, Mycobacterium
AGVLYFFFVVPRWPELMGDTAHS

SEQ ID NO: 976880 - protein, 20 aa, Mycobacterium
AGVMLAFVGVGWALTLPAAL

SEQ ID NO: 976881 - protein, 18 aa, Mycobacterium
AGVTGLPRRASTVGLVAL

SEQ ID NO: 976882 - protein, 30 aa, Mycobacterium; identical to SEQ ID NO: 349450

SEQ ID NO: 976883 - protein, 24 aa, Mycobacterium
AGWSPWIWAMIAVGVGFVTVFVYW

SEQ ID NO: 976884 - protein, 19 aa, Mycobacterium
AGYLPLFTVLALHGDWLHA

SEQ ID NO: 976885 - protein, 24 aa, Mycobacterium
AGYPMVLVLFRSFPPLTVWTGLSL

SEQ ID NO: 976886 - protein, 18 aa, Mycobacterium
AGYYAVMTQLGFATLLLG

SEQ ID NO: 976887 - protein, 28 aa, Mycobacterium
AHCPAYLQLLVKALLLRGLRELAENAVP

SEQ ID NO: 976888 - protein, 28 aa, Mycobacterium
AHEDAALSWVLLVAVPVLAALTSWIMSH

SEQ ID NO: 976889 - protein, 22 aa, Mycobacterium
AHGVLLTVFAFSVGGAATVGVV

SEQ ID NO: 976890 - protein, 28 aa, Mycobacterium
AHIAFSVWYLWSVMVLFMPQSIYGFTTG

SEQ ID NO: 976891 - protein, 18 aa, Mycobacterium
AHILLNHLVVVLGPLTAI

SEQ ID NO: 976892 - protein, 24 aa, Mycobacterium
AHLAIRRFAPFTDPLLLPVVALLN

SEQ ID NO: 976893 - protein, 20 aa, Mycobacterium
AHLNRQLWIGAVVASLVVGV

SEQ ID NO: 976894 - protein, 21 aa, Mycobacterium
AHLNRQLWIGAVVASLVVGVI

SEQ ID NO: 976895 - protein, 29 aa, Mycobacterium
AHRVAPSARLLVIGPPWPTPDVPIPVLQI

SEQ ID NO: 976896 - protein, 18 aa, Mycobacterium
AHWKPTAVQALRNGLRTH

SEQ ID NO: 976897 - protein, 18 aa, Mycobacterium
AIAALQNRGFKTRTLLKP

SEQ ID NO: 976898 - protein, 34 aa, Mycobacterium; identical to SEQ ID NO: 349533

SEQ ID NO: 976899 - protein, 28 aa, Mycobacterium
AIAAPRRIIGVALLVFIAAAVFGIPVAN

SEQ ID NO: 976900 - protein, 23 aa, Mycobacterium
AIALILGVLIYNSPLRVAAGNAV

SEQ ID NO: 976901 - protein, 30 aa, Mycobacterium; identical to SEQ ID NO: 349554

SEQ ID NO: 976902 - protein, 17 aa, Mycobacterium
AIARRFALSPIPVYLLA

SEQ ID NO: 976903 - protein, 26 aa, Mycobacterium
AIDDLVNWFLGHPWQKEYGSARNLVF

SEQ ID NO: 976904 - protein, 30 aa, Mycobacterium
AIGFAWAVLVLLASFVLGLVLWAPMGGWQL

SEQ ID NO: 976905 - protein, 31 aa, Mycobacterium; identical to SEQ ID NO: 349588

SEQ ID NO: 976906 - protein, 24 aa, Mycobacterium
AIGSVIFIVASWSVARYAAPVVAI

SEQ ID NO: 976907 - protein, 25 aa, Mycobacterium
AIHLLASMTMVWLSVLLYAKVGQPD

SEQ ID NO: 976908 - protein, 23 aa, Mycobacterium
AIHRPRAFGWDRQQWRSAALFAV

SEQ ID NO: 976909 - protein, 19 aa, Mycobacterium
AIIPLYIACLTISYLSCQL

SEQ ID NO: 976910 - protein, 32 aa, Mycobacterium
AILVAVVVVLLVARALVRPLRQLRDGALKVAH

SEQ ID NO: 976911 - protein, 19 aa, Mycobacterium
AIMPTILVALPIGATLSIQ

SEQ ID NO: 976912 - protein, 29 aa, Mycobacterium
AINAKLALLIFATLPMLGLATWQFRRASS

SEQ ID NO: 976913 - protein, 26 aa, Mycobacterium
AIPFVYDHKVFFAVAAILLVTALNLR

SEQ ID NO: 976914 - protein, 26 aa, Mycobacterium
AIPTYAFIIGISAMLGWGLFRIYVLG

SEQ ID NO: 976915 - protein, 27 aa, Mycobacterium
AIRLGTFLLVCFLGVIGLFAVFGQLRF

SEQ ID NO: 976916 - protein, 28 aa, Mycobacterium
AISRRWRPAWIGWWVALGLAAAIAGGDF

SEQ ID NO: 976917 - protein, 26 aa, Mycobacterium
AISVSRRSWWQERLMLWATSGLAVVS

SEQ ID NO: 976918 - protein, 25 aa, Mycobacterium
AITAGVGWWYILVATAFVVFALYCG

SEQ ID NO: 976919 - protein, 19 aa, Mycobacterium
AIVGYYLLRRALCPGGGQL

SEQ ID NO: 976920 - protein, 21 aa, Mycobacterium
AIVLNIVFFHTGSHGPRVAGG

SEQ ID NO: 976921 - protein, 35 aa, Mycobacterium; identical to SEQ ID NO: 349725

SEQ ID NO: 976922 - protein, 17 aa, Mycobacterium
AIVRWPGPVFVASLLIA

SEQ ID NO: 976923 - protein, 28 aa, Mycobacterium
AIVTAAAVIAILFLLRARQAIRIVVIML

SEQ ID NO: 976924 - protein, 22 aa, Mycobacterium
AIVVYALMWIGYRQDWGWLHAM

SEQ ID NO: 976925 - protein, 18 aa, Mycobacterium
AIWNPYVAERLLQGHWSL

SEQ ID NO: 976926 - protein, 19 aa, Mycobacterium
AKAIELRSTQPAQLLVLLI

SEQ ID NO: 976927 - protein, 50 aa, Mycobacterium; identical to SEQ ID NO: 349753

SEQ ID NO: 976928 - protein, 19 aa, Mycobacterium
AKLLPVRMPVRSSSPHAVL

SEQ ID NO: 976929 - protein, 29 aa, Mycobacterium
AKNNPFSLLFTLGGFIALLLLAQAVASRP

SEQ ID NO: 976930 - protein, 41 aa, Mycobacterium; identical to SEQ ID NO: 349763

SEQ ID NO: 976931 - protein, 37 aa, Mycobacterium
AKRGGLLLRILRQFHHPLIYVLLVAGAITAGLQEYID

SEQ ID NO: 976932 - protein, 27 aa, Mycobacterium
AKSALGSWLPHGPAPVADYPAVLLNGS

SEQ ID NO: 976933 - protein, 26 aa, Mycobacterium
AKVLMYWIHAPLWLLSLCLMIMMTAT

SEQ ID NO: 976934 - protein, 21 aa, Mycobacterium
AKVVLALQHDKLPPSINFAGP

SEQ ID NO: 976935 - protein, 27 aa, Mycobacterium
ALAALLALFVLLLGPTLFLLQSWVQNL

SEQ ID NO: 976936 - protein, 28 aa, Mycobacterium
ALAARKRIAWLLLLTNVVLAAFLNAADI

SEQ ID NO: 976937 - protein, 26 aa, Mycobacterium
ALAFTVVYLVPFVKYPPNPPAVGQAD

SEQ ID NO: 976938 - protein, 24 aa, Mycobacterium
ALAGFLPLTWLSLVYGWGLAGIWS

SEQ ID NO: 976939 - protein, 27 aa, Mycobacterium
ALAGMNGFFFAAIARIPLGVAVTIEFA

SEQ ID NO: 976940 - protein, 17 aa, Mycobacterium
ALALLITGAGIGIAWPH

SEQ ID NO: 976941 - protein, 19 aa, Mycobacterium
ALALVYFGIAYGLYALTFF

SEQ ID NO: 976942 - protein, 25 aa, Mycobacterium
ALAQTRPELAAFDPVLAVALAKNPA

SEQ ID NO: 976943 - protein, 20 aa, Mycobacterium
ALASSLPRLPLFAAAAKVVA

SEQ ID NO: 976944 - protein, 18 aa, Mycobacterium
ALATLALVAAYQLASGQW

SEQ ID NO: 976945 - protein, 18 aa, Mycobacterium
ALAVPIWWAYAAAEILIT

SEQ ID NO: 976946 - protein, 31 aa, Mycobacterium
ALAVRALPVVLLTTLVFFNSNIWLMASTISA

SEQ ID NO: 976947 - protein, 19 aa, Mycobacterium
ALAVSPLPNWLGDSLRAAA

SEQ ID NO: 976948 - protein, 29 aa, Mycobacterium
ALAVVLLAVFLWLERRTWHPILDLSIFAN

SEQ ID NO: 976949 - protein, 20 aa, Mycobacterium
ALDHRAPLISLAIFRDWEFS

SEQ ID NO: 976950 - protein, 24 aa, Mycobacterium
ALDLDALIGGFKPVFRALDPDKVN

SEQ ID NO: 976951 - protein, 18 aa, Mycobacterium
ALDSGFWHAVAQRVARRP

SEQ ID NO: 976952 - protein, 19 aa, Mycobacterium
ALFALRAVVLPWLLARALG

SEQ ID NO: 976953 - protein, 25 aa, Mycobacterium
ALGAMLWRSLWGEAAPRTQILVPPT

SEQ ID NO: 976954 - protein, 19 aa, Mycobacterium
ALGCTAFHLLAGSAPFQHT

SEQ ID NO: 976955 - protein, 17 aa, Mycobacterium
ALGIYPLLMMTLLPILV

SEQ ID NO: 976956 - protein, 21 aa, Mycobacterium
ALGLLAALFVFSYRPDREVDA

SEQ ID NO: 976957 - protein, 26 aa, Mycobacterium
ALGNAILVIPLGLVPSWLALASTGFD

SEQ ID NO: 976958 - protein, 21 aa, Mycobacterium
ALHHRVIQPVAVPAPHDPPRV

SEQ ID NO: 976959 - protein, 32 aa, Mycobacterium; identical to SEQ ID NO: 942718

SEQ ID NO: 976960 - protein, 18 aa, Mycobacterium
ALIAGYWHGGVTALFLLV

SEQ ID NO: 976961 - protein, 20 aa, Mycobacterium
ALIGLVALVFAVVTSNQLVA

SEQ ID NO: 976962 - protein, 25 aa, Mycobacterium
ALIGSVGLVIAFYYGLTGYACAHYY

SEQ ID NO: 976963 - protein, 23 aa, Mycobacterium
ALIIAIGVFLAWRAIPALARNKE

SEQ ID NO: 976964 - protein, 17 aa, Mycobacterium
ALILLIAPGTLIARIAQ

SEQ ID NO: 976965 - protein, 24 aa, Mycobacterium
ALLGAFAASFYWGHHFGRLFAHPD

SEQ ID NO: 976966 - protein, 38 aa, Mycobacterium; identical to SEQ ID NO: 350000

SEQ ID NO: 976967 - protein, 30 aa, Mycobacterium
ALLGSPLDAFLVSSALLLNAALPAEQQLHA

SEQ ID NO: 976968 - protein, 23 aa, Mycobacterium
ALLLVLMMIFLHMGIYACAVWMR

SEQ ID NO: 976969 - protein, 24 aa, Mycobacterium
ALLLVLMMIFLHMGIYACAVWMRS

SEQ ID NO: 976970 - protein, 30 aa, Mycobacterium
ALLQWGWRVPFLLSALLIAFALYVRLEINE

SEQ ID NO: 976971 - protein, 23 aa, Mycobacterium
ALLTFVWLDRIGLGGGAWAGFLC

SEQ ID NO: 976972 - protein, 25 aa, Mycobacterium
ALMGEWRDDLRWPPASALVSQNEAV

SEQ ID NO: 976973 - protein, 26 aa, Mycobacterium
ALNAMAIRPIPYLVTTRLLASAVAII

SEQ ID NO: 976974 - protein, 23 aa, Mycobacterium
ALNTLVLSVFFLKSTLSTATELY

SEQ ID NO: 976975 - protein, 19 aa, Mycobacterium
ALPLAKRGGLLLRILRQFH

SEQ ID NO: 976976 - protein, 20 aa, Mycobacterium
ALPVVPIFAYSRTAAMLCLG

SEQ ID NO: 976977 - protein, 29 aa, Mycobacterium
ALQASATRRGLLLTALGGLLIAGLITAIP

SEQ ID NO: 976978 - protein, 25 aa, Mycobacterium
ALQNRGFKTRTLLKPDSTIPPDHVI

SEQ ID NO: 976979 - protein, 26 aa, Mycobacterium
ALREQRLTYLRVLHALLAVLVGAIAT

SEQ ID NO: 976980 - protein, 17 aa, Mycobacterium
ALRYRVIAEPTQQLPRY

SEQ ID NO: 976981 - protein, 19 aa, Mycobacterium
ALSLLTPFAAFLLAQSMHC

SEQ ID NO: 976982 - protein, 31 aa, Mycobacterium
ALTAAVAVLIIAFPCALGLATPTALLVGTGR

SEQ ID NO: 976983 - protein, 25 aa, Mycobacterium
ALTALALHLGFIAPTRPPSPIACRL

SEQ ID NO: 976984 - protein, 19 aa, Mycobacterium
ALTAVFGLGLVLVSAGSLG

SEQ ID NO: 976985 - protein, 18 aa, Mycobacterium
ALTGQSWRILKGHLSLML

SEQ ID NO: 976986 - protein, 21 aa, Mycobacterium
ALTLGFLQPIILACAAALVVV

SEQ ID NO: 976987 - protein, 17 aa, Mycobacterium
ALTMQQWRRLPLVPATI

SEQ ID NO: 976988 - protein, 17 aa, Mycobacterium
ALTVLLLLFSPPSLRWA

SEQ ID NO: 976989 - protein, 25 aa, Mycobacterium
ALVAACFWALYILAGKRITGQQTGH

SEQ ID NO: 976990 - protein, 35 aa, Mycobacterium; identical to SEQ ID NO: 350148

SEQ ID NO: 976991 - protein, 29 aa, Mycobacterium
ALVGALVPYIRWPMWLRTIAATVGLAIVL

SEQ ID NO: 976992 - protein, 20 aa, Mycobacterium
ALVLLMTPGLAFFYGGMVRA

SEQ ID NO: 976993 - protein, 29 aa, Mycobacterium
AMAEFARLYPFQVFLDLYGLPLQDRDRVI

SEQ ID NO: 976994 - protein, 24 aa, Mycobacterium
AMDPQQRLMLEVSWEALEHAGIDP

SEQ ID NO: 976995 - protein, 22 aa, Mycobacterium
AMERGWPVLSFSRPVSLRDRIP

SEQ ID NO: 976996 - protein, 23 aa, Mycobacterium
AMFAVLGWFYLSVLPGWLHLTQT

SEQ ID NO: 976997 - protein, 21 aa, Mycobacterium
AMFFVVELTTAWLINSIALLA

SEQ ID NO: 976998 - protein, 29 aa, Mycobacterium
AMGYEPEDLPWEVPLIELGLDSLMAVRIK

SEQ ID NO: 976999 - protein, 18 aa, Mycobacterium
AMIFSTSRLRPWDARHLQ

SEQ ID NO: 977000 - protein, 19 aa, Mycobacterium
AMILTPRFIALTGHARDLE

SEQ ID NO: 977001 - protein, 25 aa, Mycobacterium
AMLAVLVMIAITLTAYAVGARWPAH

SEQ ID NO: 977002 - protein, 28 aa, Mycobacterium
AMLPLLSLPILIFGLLSVGLMPLKLFPH

SEQ ID NO: 977003 - protein, 27 aa, Mycobacterium
AMLSTVVLVIWLLMGVLAVRPFGFTPG

SEQ ID NO: 977004 - protein, 17 aa, Mycobacterium
AMLTFLLPMIRVHWMRI

SEQ ID NO: 977005 - protein, 25 aa, Mycobacterium
AMNLAGARPRLIWYAPHLVEGETSS

SEQ ID NO: 977006 - protein, 17 aa, Mycobacterium
AMPLGIWVFAPLRRRAT

SEQ ID NO: 977007 - protein, 18 aa, Mycobacterium
AMPTAVFTGALYGDELAA

SEQ ID NO: 977008 - protein, 25 aa, Mycobacterium
AMWSGRPLGGRRLALPLASALSYWS

SEQ ID NO: 977009 - protein, 29 aa, Mycobacterium
ANFDDFFRPIRSYFYWEKHCYDIPVCFAL

SEQ ID NO: 977010 - protein, 17 aa, Mycobacterium
ANLFIAGTFISVLVLWD

SEQ ID NO: 977011 - protein, 17 aa, Mycobacterium
ANNALLNRLSRVPGDLL

SEQ ID NO: 977012 - protein, 20 aa, Mycobacterium
ANNPLPRVADEQPSHSTVPL

SEQ ID NO: 977013 - protein, 29 aa, Mycobacterium
ANQAMALPLFHWGLHAWAIYVVVGLGMAY

SEQ ID NO: 977014 - protein, 24 aa, Mycobacterium
ANQYILPFLTFVGSIIISLFVPSG

SEQ ID NO: 977015 - protein, 23 aa, Mycobacterium
ANRDAWMVGYTPSLSTAVWVGTV

SEQ ID NO: 977016 - protein, 25 aa, Mycobacterium
ANRGRLWRRVGTAVVRWPAPILALS

SEQ ID NO: 977017 - protein, 23 aa, Mycobacterium
ANRRRTWLILRMNPQRNVAAIAS

SEQ ID NO: 977018 - protein, 26 aa, Mycobacterium
ANSADLDWRSVWDRGWSAAAEAQETP

SEQ ID NO: 977019 - protein, 18 aa, Mycobacterium
APAAPLLAVPADESAWRL

SEQ ID NO: 977020 - protein, 24 aa, Mycobacterium
APALMTWPMILLAFGSVFSGGLLA

SEQ ID NO: 977021 - protein, 21 aa, Mycobacterium
APAPPVPALVVERLVIQNDGV

SEQ ID NO: 977022 - protein, 23 aa, Mycobacterium
APATPVWRLAVPIAFLGVGMVFA

SEQ ID NO: 977023 - protein, 26 aa, Mycobacterium
APDGTPLWPGLPPAPPPGAPRESGPT

SEQ ID NO: 977024 - protein, 25 aa, Mycobacterium
APDQGPLDVIWSPIPLSGSGTNGSA

SEQ ID NO: 977025 - protein, 18 aa, Mycobacterium
APIIAAVACGRLAGAGRI

SEQ ID NO: 977026 - protein, 25 aa, Mycobacterium
APLDPDKFYLPPRLVSLYGTEMWDE

SEQ ID NO: 977027 - protein, 17 aa, Mycobacterium
APLLAVPADESAWRLAA

SEQ ID NO: 977028 - protein, 19 aa, Mycobacterium
APLTLLFSTNKWLTLAAAA

SEQ ID NO: 977029 - protein, 19 aa, Mycobacterium
APMLAAPLVPLAAGAVLVP

SEQ ID NO: 977030 - protein, 26 aa, Mycobacterium
APPLVMLWLVRWLLFRVEFGAGLIKM

SEQ ID NO: 977031 - protein, 20 aa, Mycobacterium
APQIPYPKTLPPPPPPVGVG

SEQ ID NO: 977032 - protein, 20 aa, Mycobacterium
APQIYRPPAASPAPPAPLVV

SEQ ID NO: 977033 - protein, 24 aa, Mycobacterium
APRPTVVKPPPQYIAPATQPRRTP

SEQ ID NO: 977034 - protein, 22 aa, Mycobacterium
APRRWRSRWSRMRVKRVGVGLN

SEQ ID NO: 977035 - protein, 23 aa, Mycobacterium
APSAPVPTPWAGVPGWGVGHTGT

SEQ ID NO: 977036 - protein, 18 aa, Mycobacterium
APSLWGWRNTPVLRWFVL

SEQ ID NO: 977037 - protein, 23 aa, Mycobacterium
APVADYPAVLLNGSWLTQEQAAA

SEQ ID NO: 977038 - protein, 31 aa, Mycobacterium
APVPAPVPIPVPIQIPLPQIFGPGGGGGFPG

SEQ ID NO: 977039 - protein, 19 aa, Mycobacterium
APVPPPPPDAPTAGFQGGT

SEQ ID NO: 977040 - protein, 25 aa, Mycobacterium
APVVLIVLVIFVALLPRLFGSATVE

SEQ ID NO: 977041 - protein, 24 aa, Mycobacterium
APYHLRLDWLMWFAAISPGYALPW

SEQ ID NO: 977042 - protein, 18 aa, Mycobacterium
AQAGGLPPLFAGVVRRPR

SEQ ID NO: 977043 - protein, 24 aa, Mycobacterium
AQFGYLLLWVIVVANVMAGLVQYL

SEQ ID NO: 977044 - protein, 23 aa, Mycobacterium
AQGRLFTPFFITVGLVEAAYFIN

SEQ ID NO: 977045 - protein, 26 aa, Mycobacterium
AQHPPPPRPMPPVPAPHRVAPPPQRP

SEQ ID NO: 977046 - protein, 24 aa, Mycobacterium
AQKQRWLPELMTLEKIAAWAITEP

SEQ ID NO: 977047 - protein, 25 aa, Mycobacterium
AQLIQLAHIQIAWRTGNFAIYVITI

SEQ ID NO: 977048 - protein, 23 aa, Mycobacterium
AQPPAPQPVAPPPQYPTGDETVA

SEQ ID NO: 977049 - protein, 17 aa, Mycobacterium
AQPVGGLHLQYGKNAAT

SEQ ID NO: 977050 - protein, 25 aa, Mycobacterium
AQRGVAVSFWLVAPLVAAESIRHLT

SEQ ID NO: 977051 - protein, 23 aa, Mycobacterium
AQTLRYFPDLVVVLALLATVALT

SEQ ID NO: 977052 - protein, 23 aa, Mycobacterium
AQTTESLWWLTEAGARFGVEDTK

SEQ ID NO: 977053 - protein, 26 aa, Mycobacterium
AQVAPLLWAAVGGVPAVLVYRAVNTL

SEQ ID NO: 977054 - protein, 25 aa, Mycobacterium
AQVNAVAPTWLKTVPKRLSGLLNTS

SEQ ID NO: 977055 - protein, 35 aa, Mycobacterium; identical to SEQ ID NO: 350644

SEQ ID NO: 977056 - protein, 26 aa, Mycobacterium
ARERLSVLIAVVLGVLVVCAGLELGG

SEQ ID NO: 977057 - protein, 29 aa, Mycobacterium
ARFMTPVRVMFLMALVFLALGWSTKAACL

SEQ ID NO: 977058 - protein, 24 aa, Mycobacterium
ARFRHPIRWTPARYALLMVSSGFG

SEQ ID NO: 977059 - protein, 23 aa, Mycobacterium
ARFYRLSSLRLWPDRRLSRRGVE

SEQ ID NO: 977060 - protein, 22 aa, Mycobacterium
ARGEHYWLKLLRVLLPVHRSDR

SEQ ID NO: 977061 - protein, 24 aa, Mycobacterium
ARGKSVVALAFAGGVLFVAENPSR

SEQ ID NO: 977062 - protein, 31 aa, Mycobacterium; identical to SEQ ID NO: 350675

SEQ ID NO: 977063 - protein, 23 aa, Mycobacterium
ARGPAWRLIGTTAVGLLLLTFTP

SEQ ID NO: 977064 - protein, 26 aa, Mycobacterium
ARGVVRGLKMLLATVALVVVGVGLGL

SEQ ID NO: 977065 - protein, 24 aa, Mycobacterium
ARHMGLFVVGRLAARHGIRVGLRG

SEQ ID NO: 977066 - protein, 32 aa, Mycobacterium
ARIALFYVGSLFLLGLLLPYTDYKAGESPFVT

SEQ ID NO: 977067 - protein, 24 aa, Mycobacterium
ARIDYADIFFISPALLALGVAMAG

SEQ ID NO: 977068 - protein, 29 aa, Mycobacterium
ARKYAFRKRVLMVMAIILVGSAAAAFEVD

SEQ ID NO: 977069 - protein, 17 aa, Mycobacterium
ARLRRNSANLLVLAGAQ

SEQ ID NO: 977070 - protein, 17 aa, Mycobacterium
ARLWLIEPGTRLWRLPL

SEQ ID NO: 977071 - protein, 23 aa, Mycobacterium
ARNPTMLVLPATMSLSLMVMAVS

SEQ ID NO: 977072 - protein, 22 aa, Mycobacterium
ARNRVFLALAAIFGLLAGPQLS

SEQ ID NO: 977073 - protein, 44 aa, Mycobacterium
ARPNRSWARYLRRGAMPLLLAGALALSAFLDWQQWQQHQVKLAG

SEQ ID NO: 977074 - protein, 23 aa, Mycobacterium
ARPVLFGFMMISNLAGVVLVLVL

SEQ ID NO: 977075 - protein, 27 aa, Mycobacterium
ARQAIRIVVIMLLTADFSLAAAWPLAA

SEQ ID NO: 977076 - protein, 31 aa, Mycobacterium
ARQAIRIVVIMLLTADFSLAAAWPLAAVVQR

SEQ ID NO: 977077 - protein, 33 aa, Mycobacterium
ARQMLLVTCLPMRCRRRRWPSVPNPATSRWNAT

SEQ ID NO: 977078 - protein, 27 aa, Mycobacterium
ARRFALSPIPVYLLAGLSLGKGGVLPV

SEQ ID NO: 977079 - protein, 23 aa, Mycobacterium
ARRLTHFGALVRIPRSVEALGRV

SEQ ID NO: 977080 - protein, 17 aa, Mycobacterium
ARRPRLRRRSTAKTPRP

SEQ ID NO: 977081 - protein, 36 aa, Mycobacterium
ARRQMRLIISDRGYFIFLAILPFVMGSLSMSVPGDV

SEQ ID NO: 977082 - protein, 17 aa, Mycobacterium
ARSFGFTVSGLGIAIAM

SEQ ID NO: 977083 - protein, 25 aa, Mycobacterium
ARTTHHLFQPLLYQVATGIISEGDI

SEQ ID NO: 977084 - protein, 21 aa, Mycobacterium
ARTVKLRNVVAVALVSALLVG

SEQ ID NO: 977085 - protein, 23 aa, Mycobacterium
ARTVVHWIRISVLILTGLVTLQS

SEQ ID NO: 977086 - protein, 24 aa, Mycobacterium
ARVPTLWIVLGPLGQSITAAGLLG

SEQ ID NO: 977087 - protein, 35 aa, Mycobacterium
ARWIRRLAIPIMLGWLAIIVLINILVPSLQQVAAD

SEQ ID NO: 977088 - protein, 25 aa, Mycobacterium
ASAADLWWLVFLGAGPSAIAFTTWA

SEQ ID NO: 977089 - protein, 21 aa, Mycobacterium
ASALAMPLFPELRSISLLQVL

SEQ ID NO: 977090 - protein, 24 aa, Mycobacterium
ASALAWVIFAILLVLTVLQLRITR

SEQ ID NO: 977091 - protein, 24 aa, Mycobacterium
ASAMQTVLPALSSWRRAERTQSEL

SEQ ID NO: 977092 - protein, 21 aa, Mycobacterium
ASAMVLWRFTGSRTLSETAER

SEQ ID NO: 977093 - protein, 24 aa, Mycobacterium
ASDNPVIFWTPDHGAFVVRGAMNA

SEQ ID NO: 977094 - protein, 25 aa, Mycobacterium
ASELLYPLLPIYLATVLGAPPSVVG

SEQ ID NO: 977095 - protein, 35 aa, Mycobacterium
ASGIPGWISIINWLWFAFFCIATVFWTYRSFATSR

SEQ ID NO: 977096 - protein, 31 aa, Mycobacterium; identical to SEQ ID NO: 21911

SEQ ID NO: 977097 - protein, 23 aa, Mycobacterium
ASGRVAYVLGLEGPALSVDTACS

SEQ ID NO: 977098 - protein, 27 aa, Mycobacterium
ASHSQRFWFWLSVATLTLNIVLNLALD

SEQ ID NO: 977099 - protein, 24 aa, Mycobacterium
ASIVVFLIALPLSVGIAIASGAPV

SEQ ID NO: 977100 - protein, 17 aa, Mycobacterium
ASLAAAPRPWQGPAAVV

SEQ ID NO: 977101 - protein, 19 aa, Mycobacterium
ASLLKVAFLAMIIGSVIGL

SEQ ID NO: 977102 - protein, 20 aa, Mycobacterium
ASLLMLPQGFVKSLTYALLA

SEQ ID NO: 977103 - protein, 24 aa, Mycobacterium
ASLTLLPALIGLTGPSRLSSSRPV

SEQ ID NO: 977104 - protein, 19 aa, Mycobacterium
ASLVVFLVALPLSLGIAIA

SEQ ID NO: 977105 - protein, 24 aa, Mycobacterium
ASMRKFFKAFEPYGLRETAVKPSY

SEQ ID NO: 977106 - protein, 31 aa, Mycobacterium
ASPMGLLVIVLLLVATLLLLWSMNRQLKKIP

SEQ ID NO: 977107 - protein, 27 aa, Mycobacterium
ASQTGFFGLAFWIALAGLTPTGLLLAA

SEQ ID NO: 977108 - protein, 17 aa, Mycobacterium
ASRHHATLIPTPQGTEI

SEQ ID NO: 977109 - protein, 19 aa, Mycobacterium
ASRSLIGPILRAASYSDLE

SEQ ID NO: 977110 - protein, 29 aa, Mycobacterium
ASSATLVFGLLLIAISAWLTATPVRVVRA

SEQ ID NO: 977111 - protein, 24 aa, Mycobacterium
ASSFGYFFYTGLGTFAVALLRSRF

SEQ ID NO: 977112 - protein, 28 aa, Mycobacterium
ASSVGPWLPLVFLLVHIVVTVPPFPRTA

SEQ ID NO: 977113 - protein, 27 aa, Mycobacterium
ASTQIPLPVILIVSTTVVFGALSHRWL

SEQ ID NO: 977114 - protein, 24 aa, Mycobacterium
ASTYLIGKIIMFGLVAAVQAAILT

SEQ ID NO: 977115 - protein, 17 aa, Mycobacterium
ASVISWVSIVVIYVIVL

SEQ ID NO: 977116 - protein, 30 aa, Mycobacterium; identical to SEQ ID NO: 161965

SEQ ID NO: 977117 - protein, 24 aa, Mycobacterium
ASVNVGMAVSLYLGFRSGTKVFHD

SEQ ID NO: 977118 - protein, 26 aa, Mycobacterium
ASVNWDRFYPTFALARPRPFLHEITE

SEQ ID NO: 977119 - protein, 30 aa, Mycobacterium
ASVSAALVICLGSLLWSFISPSGQINDSPI

SEQ ID NO: 977120 - protein, 25 aa, Mycobacterium
ASVSLMLLVLLFVACYLLPSLLPYS

SEQ ID NO: 977121 - protein, 26 aa, Mycobacterium
ASVSLMLLVLLFVACYLLPSLLPYSY

SEQ ID NO: 977122 - protein, 19 aa, Mycobacterium
ASVWIAWPPEVLSSALWSG

SEQ ID NO: 977123 - protein, 18 aa, Mycobacterium
ASVWMRLPATLAGIACWL

SEQ ID NO: 977124 - protein, 25 aa, Mycobacterium
ASWAPWIWIMLLSGVVFMALFVYWQ

SEQ ID NO: 977125 - protein, 18 aa, Mycobacterium
ASYMFNVYFQNGAPGSFV

SEQ ID NO: 977126 - protein, 20 aa, Mycobacterium
ASYVFPLPDRAAVTRMRVSV

SEQ ID NO: 977127 - protein, 26 aa, Mycobacterium
ATAASGLLLLLPLPLEARTVVALLCG

SEQ ID NO: 977128 - protein, 27 aa, Mycobacterium
ATAGACIGFLWWNAAPAKIFMGDTGSL

SEQ ID NO: 977129 - protein, 21 aa, Mycobacterium
ATAGLFLFYGAVFVALKTAGP

SEQ ID NO: 977130 - protein, 28 aa, Mycobacterium
ATALVWFPLWFVILGIGWALVRRRPGHL

SEQ ID NO: 977131 - protein, 22 aa, Mycobacterium
ATARWIVVVYNAGAIIGGLMFG

SEQ ID NO: 977132 - protein, 28 aa, Mycobacterium
ATASFGVAPLLLWQLATRHFTNITVETA

SEQ ID NO: 977133 - protein, 23 aa, Mycobacterium
ATAVLWWIIGVAGLWLGLHGIAM

SEQ ID NO: 977134 - protein, 29 aa, Mycobacterium
ATDIRLSQWFLLTAAFGSLFMVAGKRYAE

SEQ ID NO: 977135 - protein, 23 aa, Mycobacterium
ATDLITGWWRSGRLFCIAVGFLA

SEQ ID NO: 977136 - protein, 31 aa, Mycobacterium
ATDLPAPRPIAPGLFNAIPEAAPLAAPAIPD

SEQ ID NO: 977137 - protein, 23 aa, Mycobacterium
ATEAPFDWYHELLAHLAQISTAS

SEQ ID NO: 977138 - protein, 17 aa, Mycobacterium
ATELLLGPLARGTVVSL

SEQ ID NO: 977139 - protein, 31 aa, Mycobacterium
ATELPIIIVILIQIILVLLEILYSIVAYTII

SEQ ID NO: 977140 - protein, 32 aa, Mycobacterium; identical to SEQ ID NO: 351055

SEQ ID NO: 977141 - protein, 25 aa, Mycobacterium
ATFCLSFTRLPYFQTLGVPLAIGMV

SEQ ID NO: 977142 - protein, 19 aa, Mycobacterium
ATFTAIFVPVLARAEQDDP

SEQ ID NO: 977143 - protein, 26 aa, Mycobacterium
ATFVYLLVMLAIIEIPLIGYLVHPGR

SEQ ID NO: 977144 - protein, 27 aa, Mycobacterium
ATGIALWLPWLIVAGVVFILGSAAGLV

SEQ ID NO: 977145 - protein, 35 aa, Mycobacterium
ATGMRIISPQTLFFPFVMLLAATALYRGNDNKMST

SEQ ID NO: 977146 - protein, 29 aa, Mycobacterium
ATGRWELSFGFLLVPLIALLAGGYHACKP

SEQ ID NO: 977147 - protein, 24 aa, Mycobacterium
ATHAILRRLTVLVVLVFAQAGVGT

SEQ ID NO: 977148 - protein, 27 aa, Mycobacterium
ATKAAARWIRPLVPPFVARVIDNTTQP

SEQ ID NO: 977149 - protein, 23 aa, Mycobacterium
ATLAGCLPAMIWLACHRPNRRWW

SEQ ID NO: 977150 - protein, 21 aa, Mycobacterium
ATMMFLFLLVVTYYQVRVMDR

SEQ ID NO: 977151 - protein, 23 aa, Mycobacterium
ATNFDAGFFGIPPSEVLAMDPQQ

SEQ ID NO: 977152 - protein, 27 aa, Mycobacterium
ATPEAPFGWYYDLLAMWAHVSTASVWM

SEQ ID NO: 977153 - protein, 30 aa, Mycobacterium
ATPILAVAMPWLFLRLRFFRRKWTVTALAA

SEQ ID NO: 977154 - protein, 26 aa, Mycobacterium
ATQPVDLPFTGLNFPAGVTMDLSGNV

SEQ ID NO: 977155 - protein, 26 aa, Mycobacterium
ATRPSTFLWLIAVTGTLLVINHRMDP

SEQ ID NO: 977156 - protein, 24 aa, Mycobacterium
ATRQIPFWTFLRNSVIITSVLAVV

SEQ ID NO: 977157 - protein, 20 aa, Mycobacterium
ATRYMLMRQIKPGSVVLFHD

SEQ ID NO: 977158 - protein, 23 aa, Mycobacterium
ATTAFWLAPLLLSVPIFSRDTYS

SEQ ID NO: 977159 - protein, 23 aa, Mycobacterium
ATTLLVWAYLVWTYGRLVGRRIG

SEQ ID NO: 977160 - protein, 17 aa, Mycobacterium
ATTVALIALWRLDRLDG

SEQ ID NO: 977161 - protein, 25 aa, Mycobacterium
ATVCLIFAIMLLITRSLVAAMVIVG

SEQ ID NO: 977162 - protein, 46 aa, Mycobacterium
ATVDGLVLTIGFLLPWIPVLGVLVLAVVWVLRRKIFSRASGVGHGT

SEQ ID NO: 977163 - protein, 27 aa, Mycobacterium
ATVGACIGFLWWNAAPAKIFMGDTGSL

SEQ ID NO: 977164 - protein, 27 aa, Mycobacterium
ATVGACIGFLWWNAAPAKVFMGDTGSL

SEQ ID NO: 977165 - protein, 38 aa, Mycobacterium
ATVSSLVVMNWLGLSWRWLFGLSIIPALISLIIRYRVK

SEQ ID NO: 977166 - protein, 17 aa, Mycobacterium
ATWAIVTGKSAGGIFNP

SEQ ID NO: 977167 - protein, 21 aa, Mycobacterium
AVAAVWTFLKIAGPIMAGIAE

SEQ ID NO: 977168 - protein, 22 aa, Mycobacterium
AVADYPAVLLNGSWLSQEQTTA

SEQ ID NO: 977169 - protein, 25 aa, Mycobacterium
AVALVLWWRMIRFEYALLVTIATTA

SEQ ID NO: 977170 - protein, 24 aa, Mycobacterium
AVAVFFALSGFLLWRGHAAAARGG

SEQ ID NO: 977171 - protein, 21 aa, Mycobacterium
AVAVRVTRVPAGPAGLAVLAA

SEQ ID NO: 977172 - protein, 19 aa, Mycobacterium
AVAYSLTMLMQAISYITSL

SEQ ID NO: 977173 - protein, 23 aa, Mycobacterium
AVDALILGLSERRRSRRAWAAIG

SEQ ID NO: 977174 - protein, 45 aa, Mycobacterium; identical to SEQ ID NO: 351293

SEQ ID NO: 977175 - protein, 20 aa, Mycobacterium
AVFAIFALTPLFGALRRGSD

SEQ ID NO: 977176 - protein, 20 aa, Mycobacterium
AVFCAVCWLIALLARNYRHE

SEQ ID NO: 977177 - protein, 26 aa, Mycobacterium
AVFFGRFIALLRILAGPLAGALKMHY

SEQ ID NO: 977178 - protein, 21 aa, Mycobacterium
AVFSGLLWWVAFGMRDRLLVV

SEQ ID NO: 977179 - protein, 17 aa, Mycobacterium
AVFVPVVFAIAGVAGVA

SEQ ID NO: 977180 - protein, 17 aa, Mycobacterium
AVFVPVVVRIAAATFAG

SEQ ID NO: 977181 - protein, 23 aa, Mycobacterium
AVGALLVYWRYGALDFDTVPLAS

SEQ ID NO: 977182 - protein, 17 aa, Mycobacterium
AVGLGCGALIGIERQWR

SEQ ID NO: 977183 - protein, 25 aa, Mycobacterium
AVGLIFTFAVYPLTIIWPSGWSWGH

SEQ ID NO: 977184 - protein, 46 aa, Mycobacterium; identical to SEQ ID NO: 351378

SEQ ID NO: 977185 - protein, 23 aa, Mycobacterium
AVIDLVVVLLIMGALYLGLILVK

SEQ ID NO: 977186 - protein, 34 aa, Mycobacterium; identical to SEQ ID NO: 351408

SEQ ID NO: 977187 - protein, 23 aa, Mycobacterium
AVILSFVWGVRIGGLFTALGVTS

SEQ ID NO: 977188 - protein, 27 aa, Mycobacterium
AVIQPPLILFITVPGAYWLFHSAKIGK

SEQ ID NO: 977189 - protein, 27 aa, Mycobacterium
AVIRRSVLTLYPHCAPKIGVLGENPSL

SEQ ID NO: 977190 - protein, 29 aa, Mycobacterium
AVITGFIGKWPSELGAQPGLWIPGSSVSA

SEQ ID NO: 977191 - protein, 30 aa, Mycobacterium
AVLAAITVPWWFLVAQLPFAGVVFALDGVL

SEQ ID NO: 977192 - protein, 20 aa, Mycobacterium
AVLGFFAFYLSFVAELPPPP

SEQ ID NO: 977193 - protein, 25 aa, Mycobacterium
AVLIALMIRGWRRRARLQSELIGAL

SEQ ID NO: 977194 - protein, 36 aa, Mycobacterium
AVLLFASFAVALVPLVWLLWVVIERGWYAVVQPDWW

SEQ ID NO: 977195 - protein, 24 aa, Mycobacterium
AVLLPFFSFMTFLIAVPTGIKFFN

SEQ ID NO: 977196 - protein, 24 aa, Mycobacterium
AVLLPFFSFMTFLIAVPTGLKFFN

SEQ ID NO: 977197 - protein, 20 aa, Mycobacterium
AVLVPPMALSRILLGVHYPS

SEQ ID NO: 977198 - protein, 30 aa, Mycobacterium
AVMAVVFAVIPLLYRLGELVPALALVIAAN

SEQ ID NO: 977199 - protein, 25 aa, Mycobacterium
AVMLFIASIIVLTVALRRPKTPARP

SEQ ID NO: 977200 - protein, 21 aa, Mycobacterium
AVNAGFLRRLAGVGGGRCVLV

SEQ ID NO: 977201 - protein, 17 aa, Mycobacterium
AVPKGVVLTKVDDRLIS

SEQ ID NO: 977202 - protein, 27 aa, Mycobacterium
AVRAELFDPLTPMPALGATASAVLGSP

SEQ ID NO: 977203 - protein, 30 aa, Mycobacterium
AVRRDRPWLWLLYALVLMVSILININLGLL

SEQ ID NO: 977204 - protein, 19 aa, Mycobacterium
AVSALAPKWLAKTVDVALE

SEQ ID NO: 977205 - protein, 29 aa, Mycobacterium
AVSARKYAFRKRMLVAMAVVLVGSAIAAF

SEQ ID NO: 977206 - protein, 31 aa, Mycobacterium
AVSVLLGCNLGEVSFALITTLLTGRSVFNAR

SEQ ID NO: 977207 - protein, 32 aa, Mycobacterium; identical to SEQ ID NO: 351594

SEQ ID NO: 977208 - protein, 30 aa, Mycobacterium
AVTAVLAAWGWFALLLQITGAIAVVQVIPA

SEQ ID NO: 977209 - protein, 24 aa, Mycobacterium
AVTGWVIRLPAAPQTTRAAAALIN

SEQ ID NO: 977210 - protein, 31 aa, Mycobacterium; identical to SEQ ID NO: 351607

SEQ ID NO: 977211 - protein, 24 aa, Mycobacterium
AVVATLCLIFVVMLAITRSVVASA

SEQ ID NO: 977212 - protein, 27 aa, Mycobacterium
AVVFYPLHLLPFGLVAFLWQLATITAL

SEQ ID NO: 977213 - protein, 19 aa, Mycobacterium
AVVLATMPPLLSAIADAGR

SEQ ID NO: 977214 - protein, 19 aa, Mycobacterium
AVVLLLFGALYPNLVPSTL

SEQ ID NO: 977215 - protein, 21 aa, Mycobacterium
AVVLVSMWRGALTAVVMAVGL

SEQ ID NO: 977216 - protein, 25 aa, Mycobacterium
AVVPLLLAMVLGGLRIHGGMANSSG

SEQ ID NO: 977217 - protein, 31 aa, Mycobacterium; identical to SEQ ID NO: 351665

SEQ ID NO: 977218 - protein, 22 aa, Mycobacterium
AVVSILGVFLMISSTFNKPSAF

SEQ ID NO: 977219 - protein, 31 aa, Mycobacterium
AVVVLVGAVIMWSFLGHILNNRKHQAAARCV

SEQ ID NO: 977220 - protein, 27 aa, Mycobacterium
AVVVVLGWSFFYFSDDTRGYKPVDTSV

SEQ ID NO: 977221 - protein, 25 aa, Mycobacterium
AWALSVMFLVFTLRALLYKPFVRQI

SEQ ID NO: 977222 - protein, 27 aa, Mycobacterium
AWGEQISLLVFMIFASKGAAGVSGAGL

SEQ ID NO: 977223 - protein, 26 aa, Mycobacterium
AWIDQAIVIWVLIALATAMMVYVVAW

SEQ ID NO: 977224 - protein, 19 aa, Mycobacterium
AWQWLVTEVPQRSLHNWQN

SEQ ID NO: 977225 - protein, 20 aa, Mycobacterium
AWREYIAQAWFVARVSLLPT

SEQ ID NO: 977226 - protein, 17 aa, Mycobacterium
AWRFGWIVSIGRAITGG

SEQ ID NO: 977227 - protein, 23 aa, Mycobacterium
AWRYWRMVVGVVAAVAVLVIGSL

SEQ ID NO: 977228 - protein, 27 aa, Mycobacterium
AWSGVPVLFWINAVACALLALVAARCI

SEQ ID NO: 977229 - protein, 33 aa, Mycobacterium; identical to SEQ ID NO: 162049

SEQ ID NO: 977230 - protein, 22 aa, Mycobacterium
AWVTRWYLGTLANEPVPAALWV

SEQ ID NO: 977231 - protein, 21 aa, Mycobacterium
AYACAIGLKRLGKDVRFVGLI

SEQ ID NO: 977232 - protein, 19 aa, Mycobacterium
AYKELAWITHRSLRHLRIT

SEQ ID NO: 977233 - protein, 18 aa, Mycobacterium
AYLPTLVTGLTIMGLGMG

SEQ ID NO: 977234 - protein, 30 aa, Mycobacterium
AYPGSGGVSLWWMIGLLAAAGVLGLMVVLP

SEQ ID NO: 977235 - protein, 25 aa, Mycobacterium
AYPLAWGLCGLFPLAAIPLVPTRLR

SEQ ID NO: 977236 - protein, 46 aa, Mycobacterium
AYPWHSRRDYWLIGIAAFVVIVLFAWWRGLYLTTILHRRVAMMRRR

SEQ ID NO: 977237 - protein, 20 aa, Mycobacterium
AYSMAPWIALAVAAVLLVVV

SEQ ID NO: 977238 - protein, 24 aa, Mycobacterium
AYVATRAYPLLKRGIRINAICPGP

SEQ ID NO: 977239 - protein, 23 aa, Mycobacterium
AYVDRFVHMLPASYQTRISGDGS

SEQ ID NO: 977240 - protein, 25 aa, Mycobacterium
CALAPNILSLIFFRVLQGVGGGMLM

SEQ ID NO: 977241 - protein, 17 aa, Mycobacterium
CAMFLIHDSPGYLWAGL

SEQ ID NO: 977242 - protein, 25 aa, Mycobacterium
CAPAAFRFMSQARHIGKVVLTMPSA

SEQ ID NO: 977243 - protein, 17 aa, Mycobacterium
CASGSFLGFAFAFGQVL

SEQ ID NO: 977244 - protein, 19 aa, Mycobacterium
CASVWLMLNLTALIWIRCA

SEQ ID NO: 977245 - protein, 22 aa, Mycobacterium
CASVWLMLNLTALIWIRCAVWL

SEQ ID NO: 977246 - protein, 17 aa, Mycobacterium
CAVLALPVVPIFAYSRT

SEQ ID NO: 977247 - protein, 18 aa, Mycobacterium
CCLGVFCAFILYFALYSR

SEQ ID NO: 977248 - protein, 46 aa, Mycobacterium
CGGLVGPIFLIVYFALDVGSLLSWMLYVGLLITVADVLIALALTSF

SEQ ID NO: 977249 - protein, 25 aa, Mycobacterium
CGTDAFHAQALLYTNMLVQAYQAAN

SEQ ID NO: 977250 - protein, 25 aa, Mycobacterium
CGYHTPVLFLLRLSVPTAASVAVVL

SEQ ID NO: 977251 - protein, 44 aa, Mycobacterium
CHRPNRRWWRYTAWFMLALLLATLWWLVALTQLRGVSPPFLDFI

SEQ ID NO: 977252 - protein, 19 aa, Mycobacterium
CHYWKALQFVPQWTLALVA

SEQ ID NO: 977253 - protein, 43 aa, Mycobacterium; identical to SEQ ID NO: 351887

SEQ ID NO: 977254 - protein, 18 aa, Mycobacterium
CIHDGLGLSWSYRALGNY

SEQ ID NO: 977255 - protein, 18 aa, Mycobacterium
CIIHLIRGTFRYAGRQHH

SEQ ID NO: 977256 - protein, 25 aa, Mycobacterium
CIVFALLGLYLTYVGWAPAASGPSQ

SEQ ID NO: 977257 - protein, 19 aa, Mycobacterium
CIVSFWLLGFDTAGSPVWV

SEQ ID NO: 977258 - protein, 23 aa, Mycobacterium
CLDASRWERAGWRVFRLGARIRA

SEQ ID NO: 977259 - protein, 18 aa, Mycobacterium
CLGSFLMQLCVQGAWGVI

SEQ ID NO: 977260 - protein, 30 aa, Mycobacterium
CLLLALGAGVLWWITDRRPRSRRWPCAVSA

SEQ ID NO: 977261 - protein, 22 aa, Mycobacterium
CMASAILGLLLSPIARSNEQIM

SEQ ID NO: 977262 - protein, 19 aa, Mycobacterium
CPTWPQCFPGSFTPVAVAE

SEQ ID NO: 977263 - protein, 24 aa, Mycobacterium
CQTYKWETFLTSELPQYLQSNKQI

SEQ ID NO: 977264 - protein, 17 aa, Mycobacterium
CRLLPMMVTVAIGLAVL

SEQ ID NO: 977265 - protein, 19 aa, Mycobacterium
CRRFIARQPFGTARFTVRV

SEQ ID NO: 977266 - protein, 23 aa, Mycobacterium
CSYHALMMLAMAWMYVAMSDQLL

SEQ ID NO: 977267 - protein, 21 aa, Mycobacterium
CWQSITHDFWPAPELVMDTGN

SEQ ID NO: 977268 - protein, 24 aa, Mycobacterium
DAAAALAALRPTPGFPASGVVALC

SEQ ID NO: 977269 - protein, 22 aa, Mycobacterium
DADEFIVAVRQLTIGQDASVEV

SEQ ID NO: 977270 - protein, 32 aa, Mycobacterium; identical to SEQ ID NO: 351983

SEQ ID NO: 977271 - protein, 32 aa, Mycobacterium
DAEHARTLLRRLLVAAVLFVPLADLSTMFALV

SEQ ID NO: 977272 - protein, 17 aa, Mycobacterium
DAEYRFEKAWPLLWFVV

SEQ ID NO: 977273 - protein, 17 aa, Mycobacterium
DAFLPFQSGRPFAAALA

SEQ ID NO: 977274 - protein, 21 aa, Mycobacterium
DAGTPYWLIAAVMAALGSGLG

SEQ ID NO: 977275 - protein, 25 aa, Mycobacterium
DAGYVWYHLFGPPPADDHDLLQLAR

SEQ ID NO: 977276 - protein, 20 aa, Mycobacterium
DAHPLTLWRALGGAFLVCGV

SEQ ID NO: 977277 - protein, 26 aa, Mycobacterium
DAKKKLSSWLPPGPVAVADYPAVLLN

SEQ ID NO: 977278 - protein, 44 aa, Mycobacterium
DALVPAPLFLWETILAIIAFIAKLAEFIYLFVSELIALLIAGEL

SEQ ID NO: 977279 - protein, 27 aa, Mycobacterium
DAPENLLMRLVWFTPGAGLHRAAPTET

SEQ ID NO: 977280 - protein, 34 aa, Mycobacterium; identical to SEQ ID NO: 352064

SEQ ID NO: 977281 - protein, 17 aa, Mycobacterium
DASLPTVALWALALLIT

SEQ ID NO: 977282 - protein, 23 aa, Mycobacterium
DASLRLLVRGGRFLEMGKTDIRD

SEQ ID NO: 977283 - protein, 23 aa, Mycobacterium
DATDRSVLLPLGLTPEQVTQARP

SEQ ID NO: 977284 - protein, 27 aa, Mycobacterium
DAVLAINHPLMVATLLDRPALEARAQA

SEQ ID NO: 977285 - protein, 20 aa, Mycobacterium
DAVQNPRVMLGTPASGFGRV

SEQ ID NO: 977286 - protein, 19 aa, Mycobacterium
DAWGHWLGCAAALASFGVG

SEQ ID NO: 977287 - protein, 25 aa, Mycobacterium
DAYTLVMSGLLLSAGSLSDRYGRRG

SEQ ID NO: 977288 - protein, 17 aa, Mycobacterium
DCLMWPEGTPEAATIVD

SEQ ID NO: 977289 - protein, 21 aa, Mycobacterium
DDAIMFEPRYAVRQPDGGWGE

SEQ ID NO: 977290 - protein, 26 aa, Mycobacterium
DDALGPWLLLVRDLAHLLDTLPLLIG

SEQ ID NO: 977291 - protein, 20 aa, Mycobacterium
DDMFLALFKAVMFGAIVAVV

SEQ ID NO: 977292 - protein, 19 aa, Mycobacterium
DDPWRDPAAAATLASPAVA

SEQ ID NO: 977293 - protein, 18 aa, Mycobacterium
DDPWRDPGAAAALGTPAV

SEQ ID NO: 977294 - protein, 24 aa, Mycobacterium
DDRFFATVFLGSGLLFLVMIFVMT

SEQ ID NO: 977295 - protein, 27 aa, Mycobacterium
DDVLQAYLNIIYFGRGAYGISAASKAY

SEQ ID NO: 977296 - protein, 20 aa, Mycobacterium
DEFVVAVRQLTIGQDAPVEV

SEQ ID NO: 977297 - protein, 18 aa, Mycobacterium
DELDRHLRIPLCEVMWGS

SEQ ID NO: 977298 - protein, 46 aa, Mycobacterium; identical to SEQ ID NO: 352180

SEQ ID NO: 977299 - protein, 22 aa, Mycobacterium
DESFTLVYDALVARGGQDAVLP

SEQ ID NO: 977300 - protein, 22 aa, Mycobacterium
DESQHWILGRHTVLRGLDRLTQ

SEQ ID NO: 977301 - protein, 29 aa, Mycobacterium
DEVRALFNRLRPTLPIVLANLVSVGEVAV

SEQ ID NO: 977302 - protein, 21 aa, Mycobacterium
DFHFPLRRALTSPRIWALALV

SEQ ID NO: 977303 - protein, 20 aa, Mycobacterium
DFMHGRVLLAPLFCVLAPVA

SEQ ID NO: 977304 - protein, 17 aa, Mycobacterium
DFVLIRLSKAQFNRIAD

SEQ ID NO: 977305 - protein, 32 aa, Mycobacterium
DFWEEFVYNFFDIFTYAWDSIALLGMDIGEYL

SEQ ID NO: 977306 - protein, 22 aa, Mycobacterium
DGALARWNWVLDGMVDTKALSA

SEQ ID NO: 977307 - protein, 21 aa, Mycobacterium
DGALTVAMKHIKEPPPPLPAE

SEQ ID NO: 977308 - protein, 25 aa, Mycobacterium
DGAVFCGLLWWMAFGLHSKHLVVAT

SEQ ID NO: 977309 - protein, 31 aa, Mycobacterium; identical to SEQ ID NO: 352246

SEQ ID NO: 977310 - protein, 26 aa, Mycobacterium
DGDQTWRLLGVLALADPPRADSAETI

SEQ ID NO: 977311 - protein, 22 aa, Mycobacterium
DGDRLWIRFIPDTEHRSQVIEH

SEQ ID NO: 977312 - protein, 21 aa, Mycobacterium
DGKVHRHWGFGGGPHRCLGSH

SEQ ID NO: 977313 - protein, 22 aa, Mycobacterium
DGLALPFVMIFLATAQGDGSDV

SEQ ID NO: 977314 - protein, 20 aa, Mycobacterium
DGLFWVYIATLMVPATVTVV

SEQ ID NO: 977315 - protein, 17 aa, Mycobacterium
DGPAMPMLPATWGPALA

SEQ ID NO: 977316 - protein, 37 aa, Mycobacterium
DGQLYLDMRLIERTHLALLLERFGPVTPPWAVALVHQ

SEQ ID NO: 977317 - protein, 24 aa, Mycobacterium
DGQNPFALLLVSLLGPIAATVVRM

SEQ ID NO: 977318 - protein, 26 aa, Mycobacterium
DGRRLRSLFPANWRTFTLVDAAMIFG

SEQ ID NO: 977319 - protein, 24 aa, Mycobacterium
DGRSRLMFLIAGYVAGTAAFAVAA

SEQ ID NO: 977320 - protein, 19 aa, Mycobacterium
DGRTLLLGSPSLLCAEKVK

SEQ ID NO: 977321 - protein, 23 aa, Mycobacterium
DGTKYLGEALAVQALSALARTVG

SEQ ID NO: 977322 - protein, 30 aa, Mycobacterium
DGTWPQLYSKWVPRILPPGWKPGSRAVAAP

SEQ ID NO: 977323 - protein, 30 aa, Mycobacterium; identical to SEQ ID NO: 352333

SEQ ID NO: 977324 - protein, 29 aa, Mycobacterium
DHRDTYDAMFDLWFPAALGARAVITEEQA

SEQ ID NO: 977325 - protein, 29 aa, Mycobacterium
DHRNLIIVTTSLALALWVTSYPDVAESMP

SEQ ID NO: 977326 - protein, 24 aa, Mycobacterium
DHSPKPDLLRRLLHDFRGPLIVSL

SEQ ID NO: 977327 - protein, 23 aa, Mycobacterium
DIEQLLVVFPMAISAEQAGILAN

SEQ ID NO: 977328 - protein, 25 aa, Mycobacterium
DIIIGLAVLFFYGGILLGALPRLEV

SEQ ID NO: 977329 - protein, 41 aa, Mycobacterium
DISFTKFTLVMTLPWLLAIAAVYVILCWFFARDLVAEPNRE

SEQ ID NO: 977330 - protein, 19 aa, Mycobacterium
DIWRRPDLDLSAKAPVLFQ

SEQ ID NO: 977331 - protein, 25 aa, Mycobacterium
DKGNPDVLWWALALGTDFGGDLTAI

SEQ ID NO: 977332 - protein, 25 aa, Mycobacterium
DKIAANYPGVWYRAFDLSEAGPVRM

SEQ ID NO: 977333 - protein, 20 aa, Mycobacterium
DKLGAVLRAFSSRLPNQKLP

SEQ ID NO: 977334 - protein, 23 aa, Mycobacterium
DKLTKPVWLVILGAAVALTSILG

SEQ ID NO: 977335 - protein, 23 aa, Mycobacterium
DLAPQHWIALTPPRIPQLRTLQE

SEQ ID NO: 977336 - protein, 23 aa, Mycobacterium
DLARGYLAVVLPVGTIALLASRN

SEQ ID NO: 977337 - protein, 19 aa, Mycobacterium
DLELLGMSHLLILAGLDTV

SEQ ID NO: 977338 - protein, 31 aa, Mycobacterium
DLMIVVVAALCLIFIIMLGITRSPVASAVIV

SEQ ID NO: 977339 - protein, 22 aa, Mycobacterium
DLNVYQLYRRVIEDRTGELCDT

SEQ ID NO: 977340 - protein, 18 aa, Mycobacterium
DLPPIPTLFVVADEFTLM

SEQ ID NO: 977341 - protein, 24 aa, Mycobacterium
DLRPDLARLDALFARALATEPAGR

SEQ ID NO: 977342 - protein, 31 aa, Mycobacterium
DLRSMLTHTFALPQWRDAFLAIANQGESGAV

SEQ ID NO: 977343 - protein, 24 aa, Mycobacterium
DLSAKAPVLFQIPGGAWTTGNKRG

SEQ ID NO: 977344 - protein, 21 aa, Mycobacterium
DLSSLRFIMWGATPVSAGIAE

SEQ ID NO: 977345 - protein, 49 aa, Mycobacterium
DLSTMFALVPSTRFPGWGYLLTALAAPIVIWAAWPFHSVAIRNARHRTA

SEQ ID NO: 977346 - protein, 24 aa, Mycobacterium
DLTANPLRFLARATSLWNSELPFG

SEQ ID NO: 977347 - protein, 19 aa, Mycobacterium
DLTGAWRVLHALPAARTAT

SEQ ID NO: 977348 - protein, 23 aa, Mycobacterium
DLTGELMFCRNSIDLYHKQAADT

SEQ ID NO: 977349 - protein, 23 aa, Mycobacterium
DLVVAMLSLVPWGTSGVSLDLMR

SEQ ID NO: 977350 - protein, 44 aa, Mycobacterium
DLWRIKVNLRPVSIILVVLVMISGGIAAWLYVKTYRPDQQVDPA

SEQ ID NO: 977351 - protein, 22 aa, Mycobacterium
DNGVRRIVMLTGDHPDIAKVVA

SEQ ID NO: 977352 - protein, 25 aa, Mycobacterium
DNIFLLVGIPVLGAWALLRRRRGRT

SEQ ID NO: 977353 - protein, 23 aa, Mycobacterium
DPAVRRALRLEGRTPYRVSRSLL

SEQ ID NO: 977354 - protein, 22 aa, Mycobacterium
DPDLVQFYCLDFGGGALAAVRD

SEQ ID NO: 977355 - protein, 18 aa, Mycobacterium
DPGGRIAAVLLPGARHPG

SEQ ID NO: 977356 - protein, 25 aa, Mycobacterium
DPGNPLAVLVPLTAAALDLAALGAA

SEQ ID NO: 977357 - protein, 24 aa, Mycobacterium
DPLEVLFSSLLWIDGRNLEPYLVL

SEQ ID NO: 977358 - protein, 19 aa, Mycobacterium
DPLPAVAMPAPPLASRRLE

SEQ ID NO: 977359 - protein, 20 aa, Mycobacterium
DPNSLLPRWLSEAGDGSGLL

SEQ ID NO: 977360 - protein, 22 aa, Mycobacterium
DPQQRMALELTWEALEHARIPP

SEQ ID NO: 977361 - protein, 26 aa, Mycobacterium
DPRDPRGRRYSLMALLAIAVLATAAR

SEQ ID NO: 977362 - protein, 21 aa, Mycobacterium
DPRGRRYSLMALLAIAVLATT

SEQ ID NO: 977363 - protein, 20 aa, Mycobacterium
DQADLRLVLLRPGKEEDEPE

SEQ ID NO: 977364 - protein, 24 aa, Mycobacterium
DQQNDKLFRYLKKVAVELDEARAR

SEQ ID NO: 977365 - protein, 21 aa, Mycobacterium
DQRVLAIHLPNGSSLLISKSL

SEQ ID NO: 977366 - protein, 19 aa, Mycobacterium
DQVFARALPWLAGQLGTPG

SEQ ID NO: 977367 - protein, 17 aa, Mycobacterium
DQVLLMAPGGKTAFLGP

SEQ ID NO: 977368 - protein, 18 aa, Mycobacterium
DRDLARMRRAGLDPLSTE

SEQ ID NO: 977369 - protein, 20 aa, Mycobacterium
DREIKWLKWIEAPFARIGRL

SEQ ID NO: 977370 - protein, 19 aa, Mycobacterium
DREYLERIVMSKPALLQEL

SEQ ID NO: 977371 - protein, 23 aa, Mycobacterium
DRFPAVPFWTWIVGFAALTTVLN

SEQ ID NO: 977372 - protein, 27 aa, Mycobacterium
DRFRPLPQPFWVSVTVALLLGVCLVST

SEQ ID NO: 977373 - protein, 19 aa, Mycobacterium
DRGYAYGPGFQGLVGVWRR

SEQ ID NO: 977374 - protein, 21 aa, Mycobacterium
DRHLRIPLCEVMWGSDVALLD

SEQ ID NO: 977375 - protein, 25 aa, Mycobacterium
DRKRYLWLVGLVLPTALPASLALAW

SEQ ID NO: 977376 - protein, 21 aa, Mycobacterium
DRLAKVPRPIGTTAPIAGAPP

SEQ ID NO: 977377 - protein, 17 aa, Mycobacterium
DRLLLSMMPEPVVQRYH

SEQ ID NO: 977378 - protein, 22 aa, Mycobacterium
DRLLTAMICHLAVFHPPDLLQI

SEQ ID NO: 977379 - protein, 19 aa, Mycobacterium
DRLSGLSWRDWLLAVVVIA

SEQ ID NO: 977380 - protein, 25 aa, Mycobacterium
DRNRPGWEWLKWLPHNQHPSHHDEV

SEQ ID NO: 977381 - protein, 19 aa, Mycobacterium
DRPRQWRKQSWLGRFVSTY

SEQ ID NO: 977382 - protein, 19 aa, Mycobacterium
DRQSQFLQWLKDIGYVDLY

SEQ ID NO: 977383 - protein, 27 aa, Mycobacterium
DRRAMMLAHWAWLSMLLAGGAGMAAGL

SEQ ID NO: 977384 - protein, 31 aa, Mycobacterium
DRSQLITMTYALRYRWWVVLTGVAIASVTVH

SEQ ID NO: 977385 - protein, 19 aa, Mycobacterium
DRTGPISIGLPLPGWDLAV

SEQ ID NO: 977386 - protein, 19 aa, Mycobacterium
DRTRWLYFAVIGAVILGVI

SEQ ID NO: 977387 - protein, 20 aa, Mycobacterium
DRVLMWVVDLLLVVPSFVLI

SEQ ID NO: 977388 - protein, 21 aa, Mycobacterium
DRVLMWVVDLLLVVPSFVLIA

SEQ ID NO: 977389 - protein, 19 aa, Mycobacterium
DRYGARRWLARIAVSWGIV

SEQ ID NO: 977390 - protein, 29 aa, Mycobacterium
DSAACKAWLLTQPYLVGGTLLVLYAATGH

SEQ ID NO: 977391 - protein, 26 aa, Mycobacterium
DSDETKLPFCWRGVSLHAGGAGRVRA

SEQ ID NO: 977392 - protein, 25 aa, Mycobacterium
DSLPRSRPTFAAWSNLSVFGVAFNF

SEQ ID NO: 977393 - protein, 31 aa, Mycobacterium
DSLRTGIFGVVLVICVVLIAFGYSGLPFLPQ

SEQ ID NO: 977394 - protein, 33 aa, Mycobacterium
DSWLGNWTIFYWGWWISWAPFVGMFIARISRGR

SEQ ID NO: 977395 - protein, 25 aa, Mycobacterium
DTATGFGWITALRAPAIAKLAGDDG

SEQ ID NO: 977396 - protein, 22 aa, Mycobacterium
DTEVIAIPAYSLQLLSELPDLG

SEQ ID NO: 977397 - protein, 17 aa, Mycobacterium
DTLIARSFMVPSIAALL

SEQ ID NO: 977398 - protein, 20 aa, Mycobacterium
DTLLFFVGLFIMVGALVKTG

SEQ ID NO: 977399 - protein, 26 aa, Mycobacterium
DTMSPARLPDLLPGVPLVVSGRYRGS

SEQ ID NO: 977400 - protein, 25 aa, Mycobacterium
DTNSSQFFMVYRDSQLPPQYTVFGT

SEQ ID NO: 977401 - protein, 17 aa, Mycobacterium
DTPAMWRYAGMAASALV

SEQ ID NO: 977402 - protein, 25 aa, Mycobacterium
DTTQEWNWQNQLTWIATSLGRTTTA

SEQ ID NO: 977403 - protein, 31 aa, Mycobacterium; identical to SEQ ID NO: 352965

SEQ ID NO: 977404 - protein, 26 aa, Mycobacterium
DTVGWRGIFLINVPIGLAVLAGLRNV

SEQ ID NO: 977405 - protein, 31 aa, Mycobacterium; identical to SEQ ID NO: 352978

SEQ ID NO: 977406 - protein, 30 aa, Mycobacterium
DVDATMIRMLIIFGIVTVVALVAATTAGAI

SEQ ID NO: 977407 - protein, 18 aa, Mycobacterium
DVFFVLSGFLITSLLLDE

SEQ ID NO: 977408 - protein, 18 aa, Mycobacterium
DVGSVMLVSPLLAAAALA

SEQ ID NO: 977409 - protein, 32 aa, Mycobacterium
DVLRNAAIIRRFVYLVLLMTAFNWMSHGTQDV

SEQ ID NO: 977410 - protein, 17 aa, Mycobacterium
DVPPPPGIKAYLTGPGA

SEQ ID NO: 977411 - protein, 28 aa, Mycobacterium
DVQHTVRSLVWLQIGIGAGVLVVVGLAG

SEQ ID NO: 977412 - protein, 24 aa, Mycobacterium
DVVHLASPALLGYGALRAARRLGV

SEQ ID NO: 977413 - protein, 17 aa, Mycobacterium
DVVLRKPRPARPELVVL

SEQ ID NO: 977414 - protein, 17 aa, Mycobacterium
DVVVAVLVALWVLPRAI

SEQ ID NO: 977415 - protein, 18 aa, Mycobacterium
DVVVAVLVALWVLPRAIS

SEQ ID NO: 977416 - protein, 18 aa, Mycobacterium
DVVWPVMIVLLLNVAAAY

SEQ ID NO: 977417 - protein, 17 aa, Mycobacterium
DWHSLPIAEVRRLLPRP

SEQ ID NO: 977418 - protein, 17 aa, Mycobacterium
DWPFADQVFARALPWLA

SEQ ID NO: 977419 - protein, 22 aa, Mycobacterium
DYITEALKRLPAYATTLGEVVG

SEQ ID NO: 977420 - protein, 18 aa, Mycobacterium
DYLAGPLGLAAWAVGLVM

SEQ ID NO: 977421 - protein, 33 aa, Mycobacterium; identical to SEQ ID NO: 353114

SEQ ID NO: 977422 - protein, 25 aa, Mycobacterium
DYLKAHPLIGPWLNKLQAFDVFSSF

SEQ ID NO: 977423 - protein, 23 aa, Mycobacterium
DYSFLSYYPYWGFQGLTSHYANP

SEQ ID NO: 977424 - protein, 18 aa, Mycobacterium
EAAQVVVFPLTPPQPTAI

SEQ ID NO: 977425 - protein, 17 aa, Mycobacterium
EADLLGNLPLFAGLDAA

SEQ ID NO: 977426 - protein, 24 aa, Mycobacterium
EAGFVIVAIPPAHRAAIEFNPPLP

SEQ ID NO: 977427 - protein, 20 aa, Mycobacterium
EAHLARLAGQFRPDQLAKLA

SEQ ID NO: 977428 - protein, 19 aa, Mycobacterium
EALGLGLTPSPTPWVVLRL

SEQ ID NO: 977429 - protein, 23 aa, Mycobacterium
EALIQLLADRAFQWSLNAGVIIQ

SEQ ID NO: 977430 - protein, 26 aa, Mycobacterium
EALTIAFLIIFTVLVLVGYPVIMETA

SEQ ID NO: 977431 - protein, 28 aa, Mycobacterium
EALVFPILFMLVLKIVLGNLIYAVTHHD

SEQ ID NO: 977432 - protein, 22 aa, Mycobacterium
EAPYWVCAVYLVLIAIAGLGAA

SEQ ID NO: 977433 - protein, 18 aa, Mycobacterium
EASSLFRVSRLNCSITTS

SEQ ID NO: 977434 - protein, 31 aa, Mycobacterium
EAVLTLTAFLVSLMALGWRVGDPFPTGAHLA

SEQ ID NO: 977435 - protein, 20 aa, Mycobacterium
EAYGFLFVENFSIPVIGHWD

SEQ ID NO: 977436 - protein, 18 aa, Mycobacterium
ECGHMWVARATGMKVRRY

SEQ ID NO: 977437 - protein, 28 aa, Mycobacterium
EDEPSTPRWPWVVGVAAIMAAIALVASV

SEQ ID NO: 977438 - protein, 29 aa, Mycobacterium
EDGEATFRFPLVVAPRYIPGEPLADIAVG

SEQ ID NO: 977439 - protein, 52 aa, Mycobacterium; identical to SEQ ID NO: 353263

SEQ ID NO: 977440 - protein, 26 aa, Mycobacterium
EDPEDPDWSWLKWLPHVQHQTETDGA

SEQ ID NO: 977441 - protein, 36 aa, Mycobacterium; identical to SEQ ID NO: 353279

SEQ ID NO: 977442 - protein, 35 aa, Mycobacterium; identical to SEQ ID NO: 353315

SEQ ID NO: 977443 - protein, 27 aa, Mycobacterium
EFSGRWLSGWLMALYSFFRRSSKPLDT

SEQ ID NO: 977444 - protein, 25 aa, Mycobacterium
EFVLYSALMLLFAYLGWRTKPSGPR

SEQ ID NO: 977445 - protein, 19 aa, Mycobacterium
EFWFALIKVAAILCLITVG

SEQ ID NO: 977446 - protein, 25 aa, Mycobacterium
EGAHGLLVVTPYYSKPPQSGLLAHF

SEQ ID NO: 977447 - protein, 23 aa, Mycobacterium
EGALLAALIRRPSTLDPAVDPDG

SEQ ID NO: 977448 - protein, 25 aa, Mycobacterium
EGALLVGVFFWFAVVGGATLVMAGG

SEQ ID NO: 977449 - protein, 38 aa, Mycobacterium; identical to SEQ ID NO: 353356

SEQ ID NO: 977450 - protein, 26 aa, Mycobacterium
EGHILAAILMGFWIGAITAGAILGNN

SEQ ID NO: 977451 - protein, 23 aa, Mycobacterium
EGIPHLITPIITQPKKAAAALAW

SEQ ID NO: 977452 - protein, 20 aa, Mycobacterium
EGIVSALHRPVPLSGEGSDT

SEQ ID NO: 977453 - protein, 17 aa, Mycobacterium
EGKMAAVAKRRGWPILK

SEQ ID NO: 977454 - protein, 26 aa, Mycobacterium
EGPSWLLWSVILLTSGLVLGCSIVFG

SEQ ID NO: 977455 - protein, 25 aa, Mycobacterium
EGQPRILLKGFGIAAPHGAPGDATG

SEQ ID NO: 977456 - protein, 19 aa, Mycobacterium
EGQQLWRRVHSAVSVLLGC

SEQ ID NO: 977457 - protein, 26 aa, Mycobacterium
EGTDLDSILKRFGPLTPPRAVAIITQ

SEQ ID NO: 977458 - protein, 20 aa, Mycobacterium
EGTRFQFTLPVAAPATADPE

SEQ ID NO: 977459 - protein, 27 aa, Mycobacterium
EGYPVKASARFGLYYTPSSALYYDTLA

SEQ ID NO: 977460 - protein, 46 aa, Mycobacterium; identical to SEQ ID NO: 353402

SEQ ID NO: 977461 - protein, 17 aa, Mycobacterium
EHFLFAAPQLDQVAVIN

SEQ ID NO: 977462 - protein, 17 aa, Mycobacterium
EHIGFTVWMLWSIVVVQ

SEQ ID NO: 977463 - protein, 17 aa, Mycobacterium
EHKLHRLPLSYFDGRQR

SEQ ID NO: 977464 - protein, 19 aa, Mycobacterium
EHSVGWLLVSALGAMLFPS

SEQ ID NO: 977465 - protein, 29 aa, Mycobacterium
EHYFRTFLRPDDVFWSFLEAIIIAAIVMV

SEQ ID NO: 977466 - protein, 25 aa, Mycobacterium
EIDQLILNHILTVTPGIDSAEVSGT

SEQ ID NO: 977467 - protein, 22 aa, Mycobacterium
EIPCVCALLTLLPDNLRWLVTV

SEQ ID NO: 977468 - protein, 29 aa, Mycobacterium
EIPCVCALLTLLPGNLRWLVTVDAMHTQV

SEQ ID NO: 977469 - protein, 25 aa, Mycobacterium
EIPCVRALLTLLPDNLRRLVTVDAM

SEQ ID NO: 977470 - protein, 30 aa, Mycobacterium
EIPCVRALLTLLPDNLRWLVTVDAIHTQVV

SEQ ID NO: 977471 - protein, 26 aa, Mycobacterium
EIPCVRALLTLLPDNLRWLVTVDAMH

SEQ ID NO: 977472 - protein, 26 aa, Mycobacterium
EIPCVRALLTLLPDSLRWLVTVDAMH

SEQ ID NO: 977473 - protein, 31 aa, Mycobacterium
EIPCVRALLTLLPGSLRWLVIVDAMHTQVVT

SEQ ID NO: 977474 - protein, 29 aa, Mycobacterium
EIPCVRALLTLLPGSLRWLVTVDAIHTQV

SEQ ID NO: 977475 - protein, 30 aa, Mycobacterium
EIPCVRALLTLLPGSLRWLVTVDAIHTQVV

SEQ ID NO: 977476 - protein, 27 aa, Mycobacterium
EIPCVRALLTLLSGSLRWLVTVDAMHT

SEQ ID NO: 977477 - protein, 26 aa, Mycobacterium
EIPCVRALLTLPPDNLRWLVTVDAMH

SEQ ID NO: 977478 - protein, 26 aa, Mycobacterium
EIPCVRALLTLPPGSLRWLVTVDAMH

SEQ ID NO: 977479 - protein, 25 aa, Mycobacterium
EITATALLVVFFRHNLSMNGGLFLA

SEQ ID NO: 977480 - protein, 29 aa, Mycobacterium
EIVVGVLLVLGLFTPLAGAGALAFLMNGT

SEQ ID NO: 977481 - protein, 24 aa, Mycobacterium
ELAATIARRLGLTGALGTVAESVD

SEQ ID NO: 977482 - protein, 17 aa, Mycobacterium
ELAGFWTGGFVQAQFNT

SEQ ID NO: 977483 - protein, 24 aa, Mycobacterium
ELALALVAVWATAASWLQTTSTVA

SEQ ID NO: 977484 - protein, 24 aa, Mycobacterium
ELASAYREHFGFPLIICARETERF

SEQ ID NO: 977485 - protein, 23 aa, Mycobacterium
ELDSWRYQVTWLSSPATPSSITL

SEQ ID NO: 977486 - protein, 30 aa, Mycobacterium
ELDTPEFPWTGLTISLLIGVLAAAVGTRFM

SEQ ID NO: 977487 - protein, 17 aa, Mycobacterium
ELGLLIDAPRSASVRAL

SEQ ID NO: 977488 - protein, 32 aa, Mycobacterium; identical to SEQ ID NO: 808340

SEQ ID NO: 977489 - protein, 21 aa, Mycobacterium
ELLVLIASIVGLIYAGIRAIS

SEQ ID NO: 977490 - protein, 19 aa, Mycobacterium
ELPRNPTGKILKRELREME

SEQ ID NO: 977491 - protein, 23 aa, Mycobacterium
ELQPKLLALLSPMIATMQTVKSL

SEQ ID NO: 977492 - protein, 24 aa, Mycobacterium
ELTALIQLYIVGVFISFTLSQIGM

SEQ ID NO: 977493 - protein, 36 aa, Mycobacterium; identical to SEQ ID NO: 353562

SEQ ID NO: 977494 - protein, 39 aa, Mycobacterium
EMDKIDGLYYFFGVLARLAALPSLTPILLPDTGRTNIVP

SEQ ID NO: 977495 - protein, 20 aa, Mycobacterium
EMLAPLRRALALLGREQVAD

SEQ ID NO: 977496 - protein, 24 aa, Mycobacterium
ENFARLLSELIPPAATIAVDELTG

SEQ ID NO: 977497 - protein, 26 aa, Mycobacterium
ENPAVWLNPWRWYSVPRAAAAALTVD

SEQ ID NO: 977498 - protein, 29 aa, Mycobacterium
ENTVNRYLGLFWAFVGVMLALGGALAFVV

SEQ ID NO: 977499 - protein, 24 aa, Mycobacterium
EPAGWSFSGPLLWLKSAIVDRDRQ

SEQ ID NO: 977500 - protein, 17 aa, Mycobacterium
EPEPRWPKSEPITRTKA

SEQ ID NO: 977501 - protein, 17 aa, Mycobacterium
EPIPLSTLLATAGVAQR

SEQ ID NO: 977502 - protein, 28 aa, Mycobacterium
EPRGQVVLPFTGLNFRFAPGGVAVDANG

SEQ ID NO: 977503 - protein, 17 aa, Mycobacterium
EPTILLAVFALSIPAKS

SEQ ID NO: 977504 - protein, 27 aa, Mycobacterium
EPVPAALWVWVGLTAVAAAMLVVGWRG

SEQ ID NO: 977505 - protein, 22 aa, Mycobacterium
EPVPPLRFAQLVGLVFAAAGVV

SEQ ID NO: 977506 - protein, 27 aa, Mycobacterium
EPVVAGLAGWILLGQTLSWVRGLAMVV

SEQ ID NO: 977507 - protein, 69 aa, Mycobacterium
EQARSGIRFWSRRAWLAWPLGLLASGLTMFFGAYPWAGWLAFAATIPVQFIAGWPFLVGAVQQARARSA

SEQ ID NO: 977508 - protein, 29 aa, Mycobacterium
EQAWDVLCDLEQVIPLMPGAQLTGHQDDD

SEQ ID NO: 977509 - protein, 22 aa, Mycobacterium
EQIMPLLVVAVMSQLVFSGGMI

SEQ ID NO: 977510 - protein, 36 aa, Mycobacterium
ERFATPATLLSWRLWACISWRRFCKRCGLSASEQVT

SEQ ID NO: 977511 - protein, 51 aa, Mycobacterium; identical to SEQ ID NO: 353714

SEQ ID NO: 977512 - protein, 17 aa, Mycobacterium
ERGLRVLAVAKRPWEHD

SEQ ID NO: 977513 - protein, 25 aa, Mycobacterium
ERHGSDIPICWSLRSLFDAIDGVDK

SEQ ID NO: 977514 - protein, 32 aa, Mycobacterium
ERPVAVVLAGHPWPHLFLPFREGASQESELPS

SEQ ID NO: 977515 - protein, 29 aa, Mycobacterium
ERRPFALLASIMGSIFIIGVGALAVSLAV

SEQ ID NO: 977516 - protein, 23 aa, Mycobacterium
ERRWLIAALLFSAAGDWLLAIPW

SEQ ID NO: 977517 - protein, 22 aa, Mycobacterium
ESAAWPAGVPWTDASLTAAAGK

SEQ ID NO: 977518 - protein, 25 aa, Mycobacterium
ESCMAAYLPYLQWLAQNSTVCGESA

SEQ ID NO: 977519 - protein, 28 aa, Mycobacterium
ESENFFVAPFLMLGLLGVVAVVAAVPIW

SEQ ID NO: 977520 - protein, 26 aa, Mycobacterium
ESGHVPLFFIVWALSNFVGPLVLGRL

SEQ ID NO: 977521 - protein, 29 aa, Mycobacterium
ESKSKVALYLLITIAPFAVVAPLIGPALD

SEQ ID NO: 977522 - protein, 23 aa, Mycobacterium
ESSDWSWLKWLPHVDIPGQLDGV

SEQ ID NO: 977523 - protein, 24 aa, Mycobacterium
ESSTWLAIAAWAALAVVAVALIVM

SEQ ID NO: 977524 - protein, 24 aa, Mycobacterium
ETARPADLLVLLDSLRQREGTLNA

SEQ ID NO: 977525 - protein, 46 aa, Mycobacterium
ETNNLHRRVLLICTFAIGAATVFAWLLAVFAVRPFKQLAEQTRSID

SEQ ID NO: 977526 - protein, 29 aa, Mycobacterium
ETPAFWAFLVCYLCAAALTWARYVRPRSP

SEQ ID NO: 977527 - protein, 24 aa, Mycobacterium
ETPAFWIFFACYIGAAILTWVRYV

SEQ ID NO: 977528 - protein, 42 aa, Mycobacterium; identical to SEQ ID NO: 353863

SEQ ID NO: 977529 - protein, 19 aa, Mycobacterium
ETVPPDSVWWWVCVSLLAL

SEQ ID NO: 977530 - protein, 19 aa, Mycobacterium
EVALAALLSQLGVVPDLVL

SEQ ID NO: 977531 - protein, 25 aa, Mycobacterium
EVALYSFIVLLITGVYLTLFFDPSM

SEQ ID NO: 977532 - protein, 25 aa, Mycobacterium
EVASFAWQFVFYLGQIVVAYGVMLL

SEQ ID NO: 977533 - protein, 21 aa, Mycobacterium
EVAVFVFFGLVTVLGTQYTQA

SEQ ID NO: 977534 - protein, 25 aa, Mycobacterium
EVFTLMPFWRMFFNTVLYAGCVTAG

SEQ ID NO: 977535 - protein, 25 aa, Mycobacterium
EVGCPLVQELTLLAPLALPQTGTVR

SEQ ID NO: 977536 - protein, 24 aa, Mycobacterium
EVGQRVVLNPWLSCRPRGIEPPCP

SEQ ID NO: 977537 - protein, 30 aa, Mycobacterium
EVLAIKPDICFLWDEAWYAFATAVPWARQR

SEQ ID NO: 977538 - protein, 17 aa, Mycobacterium
EVLPHLFERFVRSSKSR

SEQ ID NO: 977539 - protein, 24 aa, Mycobacterium
EVLVGLGMRTWADGRTLLLGSPSL

SEQ ID NO: 977540 - protein, 24 aa, Mycobacterium
EVMNALLLPIVLGLLLVLEAHTLP

SEQ ID NO: 977541 - protein, 31 aa, Mycobacterium; identical to SEQ ID NO: 353926

SEQ ID NO: 977542 - protein, 27 aa, Mycobacterium
EVTTFAAFTALIIFLPGISGVAVGRWR

SEQ ID NO: 977543 - protein, 39 aa, Mycobacterium
EWATHGRLGIAILKNLLLATFAVEMALMFAVPAGPAMAR

SEQ ID NO: 977544 - protein, 21 aa, Mycobacterium
EWETLLFFAGLFIMVGALVKT

SEQ ID NO: 977545 - protein, 29 aa, Mycobacterium
EWNVLFAYATIFLFLGFPAWQGYGVTSMS

SEQ ID NO: 977546 - protein, 28 aa, Mycobacterium
EWTEYLCLMPIFPLAFWLMNVYAAIRYR

SEQ ID NO: 977547 - protein, 17 aa, Mycobacterium
EYFLLCPMLIVFGIAVV

SEQ ID NO: 977548 - protein, 28 aa, Mycobacterium
EYRFEKAWPLLWFVVIGVVAAAIGYLYA

SEQ ID NO: 977549 - protein, 21 aa, Mycobacterium
FADLLILPILNIYRKYYGTKM

SEQ ID NO: 977550 - protein, 17 aa, Mycobacterium
FAFVLLTALAFGGHLAP

SEQ ID NO: 977551 - protein, 18 aa, Mycobacterium
FAFVLMSSGVVILRRTRP

SEQ ID NO: 977552 - protein, 29 aa, Mycobacterium
FAIIFGVPVWGFAMLWIALSTALTVRTLR

SEQ ID NO: 977553 - protein, 32 aa, Mycobacterium; identical to SEQ ID NO: 354026

SEQ ID NO: 977554 - protein, 27 aa, Mycobacterium
FAIMHLLTHGFFKAGLFLGSGSVIHAI

SEQ ID NO: 977555 - protein, 26 aa, Mycobacterium
FAPNFTVLVILRLLYDIGMGGEWGLG

SEQ ID NO: 977556 - protein, 38 aa, Mycobacterium; identical to SEQ ID NO: 354075

SEQ ID NO: 977557 - protein, 22 aa, Mycobacterium
FASIIALFVLRIAIDMAGYSHA

SEQ ID NO: 977558 - protein, 44 aa, Mycobacterium
FASKGALALRLLTIAFFALVYLLPLILWLWRGETTHDRHAAARA

SEQ ID NO: 977559 - protein, 17 aa, Mycobacterium
FAVERLGVALMALGIIN

SEQ ID NO: 977560 - protein, 18 aa, Mycobacterium
FAVLAVCATLATTTGRPL

SEQ ID NO: 977561 - protein, 19 aa, Mycobacterium
FAVSTWIALPVSAALFGGG

SEQ ID NO: 977562 - protein, 23 aa, Mycobacterium
FCGPAVYVVIFALSGYLISTAGW

SEQ ID NO: 977563 - protein, 17 aa, Mycobacterium
FDRDGVDFAIGPPPPAL

SEQ ID NO: 977564 - protein, 24 aa, Mycobacterium
FDTDFFQLLVTEFGSSGGPFAQEY

SEQ ID NO: 977565 - protein, 20 aa, Mycobacterium
FDVIGVLLLSPGLAAFLLAL

SEQ ID NO: 977566 - protein, 23 aa, Mycobacterium
FEAGLAMMPIFVAAALAAIPAGR

SEQ ID NO: 977567 - protein, 29 aa, Mycobacterium
FEDAQAEPAAWLRFWFPDPKGSNTEYQRA

SEQ ID NO: 977568 - protein, 17 aa, Mycobacterium
FEFPYVIYQGLTMYLLL

SEQ ID NO: 977569 - protein, 29 aa, Mycobacterium
FEHARIRLAYGMRLRRLRRYRNARVVLRA

SEQ ID NO: 977570 - protein, 21 aa, Mycobacterium
FEKYAWLFMRFSGVVLVFLAL

SEQ ID NO: 977571 - protein, 17 aa, Mycobacterium
FELEIKAIAVEHAVVGV

SEQ ID NO: 977572 - protein, 37 aa, Mycobacterium; identical to SEQ ID NO: 354197

SEQ ID NO: 977573 - protein, 26 aa, Mycobacterium
FEPGRSLWWSWAWIAGMIGYAGDVAR

SEQ ID NO: 977574 - protein, 17 aa, Mycobacterium
FFAPVLVLLSPWPAATA

SEQ ID NO: 977575 - protein, 24 aa, Mycobacterium
FFESTFIGLWTFGWSRLPRLVHLA

SEQ ID NO: 977576 - protein, 18 aa, Mycobacterium
FGALFPLIVQDLTHGTGH

SEQ ID NO: 977577 - protein, 25 aa, Mycobacterium
FGALLRVVYVALPPLHDQWRPVLWA

SEQ ID NO: 977578 - protein, 18 aa, Mycobacterium
FGALVWIFQDGHLGALGT

SEQ ID NO: 977579 - protein, 20 aa, Mycobacterium
FGAVLAWLVAGLAVSESVSW

SEQ ID NO: 977580 - protein, 25 aa, Mycobacterium
FGAVRMVLALLPHWRERRFGHVVNV

SEQ ID NO: 977581 - protein, 19 aa, Mycobacterium
FGDVRASWPWAVAVFIVVV

SEQ ID NO: 977582 - protein, 23 aa, Mycobacterium
FGDWGFALARRGGTAPIPAVPAD

SEQ ID NO: 977583 - protein, 19 aa, Mycobacterium
FGGLRRSPPAWASWARIVV

SEQ ID NO: 977584 - protein, 21 aa, Mycobacterium
FGIAYGLYALTFFLPSIISGF

SEQ ID NO: 977585 - protein, 17 aa, Mycobacterium
FGIFRGFIGSLPGMMCD

SEQ ID NO: 977586 - protein, 17 aa, Mycobacterium
FGLALFQLLLVASTALP

SEQ ID NO: 977587 - protein, 25 aa, Mycobacterium
FGLRRWYVITFLMGLFFVLGQGYEY

SEQ ID NO: 977588 - protein, 29 aa, Mycobacterium
FGLSFPRAMFWTVLIYVLVATIISFVIGR

SEQ ID NO: 977589 - protein, 34 aa, Mycobacterium
FGLSVLIWQHILHMPLHWLVLPMAIIVMLAVGSD

SEQ ID NO: 977590 - protein, 37 aa, Mycobacterium
FGLSVLIWQHVLGIELHWLVLAMAVIILLAVGADYNL

SEQ ID NO: 977591 - protein, 26 aa, Mycobacterium
FGPVSPLPGLLAVAVLLLATRGLHID

SEQ ID NO: 977592 - protein, 18 aa, Mycobacterium
FGPYRLRRIVGRGAMGDV

SEQ ID NO: 977593 - protein, 33 aa, Mycobacterium; identical to SEQ ID NO: 354415

SEQ ID NO: 977594 - protein, 34 aa, Mycobacterium; identical to SEQ ID NO: 354426

SEQ ID NO: 977595 - protein, 17 aa, Mycobacterium
FGWGITCFITAVAGLMQ

SEQ ID NO: 977596 - protein, 22 aa, Mycobacterium
FGYTGLGWRFSGALLGVVMVAL

SEQ ID NO: 977597 - protein, 19 aa, Mycobacterium
FHLGFLMIAAVTALILVLA

SEQ ID NO: 977598 - protein, 22 aa, Mycobacterium
FHSPLMEPMLEEFARIAAQVEA

SEQ ID NO: 977599 - protein, 17 aa, Mycobacterium
FIAAIVVLPFGIPAVPT

SEQ ID NO: 977600 - protein, 18 aa, Mycobacterium
FIAIFLAGGVMFSLTVCI

SEQ ID NO: 977601 - protein, 21 aa, Mycobacterium
FIREADVAAALWHPNIVRVND

SEQ ID NO: 977602 - protein, 18 aa, Mycobacterium
FISGAYLPADLSLYDYDG

SEQ ID NO: 977603 - protein, 17 aa, Mycobacterium
FISLYRYGDVTATHRRL

SEQ ID NO: 977604 - protein, 19 aa, Mycobacterium
FKASHRSVGKWQGGHRSDG

SEQ ID NO: 977605 - protein, 20 aa, Mycobacterium
FKRGLKLFLSPDGKAARMII

SEQ ID NO: 977606 - protein, 20 aa, Mycobacterium
FKTSWYLLGPAFVAAIAYVD

SEQ ID NO: 977607 - protein, 18 aa, Mycobacterium
FKVFALVAALEQGIGLGY

SEQ ID NO: 977608 - protein, 22 aa, Mycobacterium
FLAAAVLYFLAIGQVKGFAFTL

SEQ ID NO: 977609 - protein, 18 aa, Mycobacterium
FLAGLFLLGLVVGLGDVV

SEQ ID NO: 977610 - protein, 25 aa, Mycobacterium
FLAMTMIILAVFYMIQDALFLGVVQ

SEQ ID NO: 977611 - protein, 18 aa, Mycobacterium
FLCIAVVVAAVVLLLFGA

SEQ ID NO: 977612 - protein, 17 aa, Mycobacterium
FLLALGAIPGALVPQRS

SEQ ID NO: 977613 - protein, 17 aa, Mycobacterium
FLQWLKDIGYVDLYNKL

SEQ ID NO: 977614 - protein, 59 aa, Mycobacterium
FLTNPLQAIITYGPLLFALSYQIFFNLVGWPTWALILSSPFLLPAALGLALSAIAFTPI

SEQ ID NO: 977615 - protein, 26 aa, Mycobacterium
FLVGATIVFLACRWVQAQGGAPLWVG

SEQ ID NO: 977616 - protein, 18 aa, Mycobacterium
FLVRAALTSLALWVVTQF

SEQ ID NO: 977617 - protein, 20 aa, Mycobacterium
FLVRRLECALLRGGLDPADG

SEQ ID NO: 977618 - protein, 29 aa, Mycobacterium
FLVSKPRPMVNLLAFWFGGMATGIGVALA

SEQ ID NO: 977619 - protein, 25 aa, Mycobacterium
FMALGWKLLIPVSLVWVLIAAVIRT

SEQ ID NO: 977620 - protein, 18 aa, Mycobacterium
FMFALSITGLTIAIVTGN

SEQ ID NO: 977621 - protein, 23 aa, Mycobacterium
FMISLATIWLRTGLMPRWLAGIS

SEQ ID NO: 977622 - protein, 17 aa, Mycobacterium
FNAAFYVFGLTLLIMAG

SEQ ID NO: 977623 - protein, 20 aa, Mycobacterium
FNTFLRPTDVLWSSFEVVVL

SEQ ID NO: 977624 - protein, 32 aa, Mycobacterium; identical to SEQ ID NO: 354666

SEQ ID NO: 977625 - protein, 26 aa, Mycobacterium
FPEKISFLPAMRYYVGNWATSVWCFR

SEQ ID NO: 977626 - protein, 18 aa, Mycobacterium
FPGATPRSSSGNRAFWII

SEQ ID NO: 977627 - protein, 17 aa, Mycobacterium
FPGRDGLFWVYIATLMV

SEQ ID NO: 977628 - protein, 19 aa, Mycobacterium
FPGWQVLEILPQSWSSDDA

SEQ ID NO: 977629 - protein, 17 aa, Mycobacterium
FPLVLMHDLSHAYAVVF

SEQ ID NO: 977630 - protein, 18 aa, Mycobacterium
FPPMGSSLYWLRFGTIRL

SEQ ID NO: 977631 - protein, 17 aa, Mycobacterium
FPVFAHALDEVAAALNP

SEQ ID NO: 977632 - protein, 52 aa, Mycobacterium
FPVQAVVFFFSTLLGQFFSWIPVISLSYAQIIIGYFVGFLAAAPVLTSGAEI

SEQ ID NO: 977633 - protein, 23 aa, Mycobacterium
FPVTIRLAWIALAVEAVLGIGFG

SEQ ID NO: 977634 - protein, 21 aa, Mycobacterium
FQRGLTLFLSPDGTAARFIIT

SEQ ID NO: 977635 - protein, 19 aa, Mycobacterium
FRALQNWVPLVAAAGSMII

SEQ ID NO: 977636 - protein, 23 aa, Mycobacterium
FRDVLVALGMYPGGGALGAEGAG

SEQ ID NO: 977637 - protein, 17 aa, Mycobacterium
FRHGLLILVALAAVFVV

SEQ ID NO: 977638 - protein, 27 aa, Mycobacterium
FRMSIFTWNILVTSILVLIAFPLLTAA

SEQ ID NO: 977639 - protein, 17 aa, Mycobacterium
FRRLTRSTLETLLQERD

SEQ ID NO: 977640 - protein, 26 aa, Mycobacterium
FSAADKPVIFWTPDHGAFVVRGAMKV

SEQ ID NO: 977641 - protein, 23 aa, Mycobacterium
FSDLVMMKYLAFGLMAALLLDAT

SEQ ID NO: 977642 - protein, 24 aa, Mycobacterium
FSGFAFTIVLLVLVLIPGIGKEAN

SEQ ID NO: 977643 - protein, 26 aa, Mycobacterium
FSGRWLSGWLMALYSFFRRSSKPLDT

SEQ ID NO: 977644 - protein, 27 aa, Mycobacterium
FSHFTLLLVHALRRQFSRVRVFAFIDT

SEQ ID NO: 977645 - protein, 24 aa, Mycobacterium
FSINVAVVLYLLISKRLFGLRGGR

SEQ ID NO: 977646 - protein, 18 aa, Mycobacterium
FSRNEFEQLITQPLDRFI

SEQ ID NO: 977647 - protein, 25 aa, Mycobacterium
FSRSQFIQLVLIGALVYVAYPFIST

SEQ ID NO: 977648 - protein, 26 aa, Mycobacterium
FSSKRAFDILGSPLPLVPLAFDPPEH

SEQ ID NO: 977649 - protein, 17 aa, Mycobacterium
FSTNKWLTLAAAALMVS

SEQ ID NO: 977650 - protein, 25 aa, Mycobacterium
FTAAAPLVFAWYPCSWRRSGARPVG

SEQ ID NO: 977651 - protein, 29 aa, Mycobacterium
FTAKVWGFLFMYFWLRATLPRLRYDQFMA

SEQ ID NO: 977652 - protein, 18 aa, Mycobacterium
FTFFGWHWSLPLGVAIML

SEQ ID NO: 977653 - protein, 32 aa, Mycobacterium; identical to SEQ ID NO: 354841

SEQ ID NO: 977654 - protein, 26 aa, Mycobacterium
FTGVVIAIVYLLVALSAIVCRVRDRD

SEQ ID NO: 977655 - protein, 32 aa, Mycobacterium; identical to SEQ ID NO: 347715

SEQ ID NO: 977656 - protein, 19 aa, Mycobacterium
FTLSGWLGLYLLARDPRKP

SEQ ID NO: 977657 - protein, 24 aa, Mycobacterium
FTRINAILGVLLLIVLATGSVING

SEQ ID NO: 977658 - protein, 17 aa, Mycobacterium
FTRYPRRAFLGLALFIG

SEQ ID NO: 977659 - protein, 17 aa, Mycobacterium
FTTLRMIYEDVQAHFRA

SEQ ID NO: 977660 - protein, 28 aa, Mycobacterium
FTTLYGLIDIRFIPKYLFSVSFCGILVA

SEQ ID NO: 977661 - protein, 18 aa, Mycobacterium
FTTSSGVLLLWSWLAMSL

SEQ ID NO: 977662 - protein, 17 aa, Mycobacterium
FVAAYRAFDTGVRLVPL

SEQ ID NO: 977663 - protein, 20 aa, Mycobacterium
FVACPFGGVGERMYRTGDLV

SEQ ID NO: 977664 - protein, 18 aa, Mycobacterium
FVALYLLGSLAGVPQWLL

SEQ ID NO: 977665 - protein, 24 aa, Mycobacterium
FVARRAVFHAMMRSLDGFVGTLRQ

SEQ ID NO: 977666 - protein, 26 aa, Mycobacterium
FVDRALGWALRFFAAVAVYNAVSMIA

SEQ ID NO: 977667 - protein, 23 aa, Mycobacterium
FVEDRWLSVGLLSVGLAGFCLHA

SEQ ID NO: 977668 - protein, 26 aa, Mycobacterium
FVIDEGPLYFWLPCLACLLALAELHL

SEQ ID NO: 977669 - protein, 20 aa, Mycobacterium
FVLGFLAQYLFGVRLGLAPV

SEQ ID NO: 977670 - protein, 19 aa, Mycobacterium
FVLHHFYMDGALWKSKKNP

SEQ ID NO: 977671 - protein, 20 aa, Mycobacterium
FVLSGFLITSLLLDELGRSG

SEQ ID NO: 977672 - protein, 18 aa, Mycobacterium
FVLVFITVSLLYLRDHPD

SEQ ID NO: 977673 - protein, 17 aa, Mycobacterium
FVLVVVALTLVGFATAE

SEQ ID NO: 977674 - protein, 17 aa, Mycobacterium
FVNFYSCDISLKINGLQ

SEQ ID NO: 977675 - protein, 23 aa, Mycobacterium
FVQALDKLLWPAPTVFLMRRGAG

SEQ ID NO: 977676 - protein, 21 aa, Mycobacterium
FVRELYGPLLEAGVPFLVTDL

SEQ ID NO: 977677 - protein, 19 aa, Mycobacterium
FVRSRVVAWALWDCGSTGL

SEQ ID NO: 977678 - protein, 19 aa, Mycobacterium
FVRTLRPRPEGSSKVPVFV

SEQ ID NO: 977679 - protein, 20 aa, Mycobacterium
FVSLPFLVVPLEGAARTAGA

SEQ ID NO: 977680 - protein, 24 aa, Mycobacterium
FVTGWMYWYFFVVVVAVETVAGGR

SEQ ID NO: 977681 - protein, 17 aa, Mycobacterium
FVVANLLILGALRVNWA

SEQ ID NO: 977682 - protein, 21 aa, Mycobacterium
FVVLIKWLVARRAVAFAYYGL

SEQ ID NO: 977683 - protein, 20 aa, Mycobacterium
FVVVGLLFLGTVALTLAGID

SEQ ID NO: 977684 - protein, 18 aa, Mycobacterium
FYDAYWSVVPPLLALYWW

SEQ ID NO: 977685 - protein, 17 aa, Mycobacterium
FYLAFLLLIAGCTFLFR

SEQ ID NO: 977686 - protein, 20 aa, Mycobacterium
FYWAVGIAAALPVLVVILTE

SEQ ID NO: 977687 - protein, 26 aa, Mycobacterium
GAAAWLHAAVWWKALLALVVAVALTV

SEQ ID NO: 977688 - protein, 33 aa, Mycobacterium
GAAELMPARLRRTWLGALLARLARPAGLSAAAV

SEQ ID NO: 977689 - protein, 24 aa, Mycobacterium
GAAFVRRLVTLTTALLIVATTLSV

SEQ ID NO: 977690 - protein, 18 aa, Mycobacterium
GAAGAARTALAAATGRIG

SEQ ID NO: 977691 - protein, 27 aa, Mycobacterium
GAAGAGRTRHPALAALAAVAAGGGVVA

SEQ ID NO: 977692 - protein, 29 aa, Mycobacterium
GAAGLLIGTWLGGYALLLPAAACAVFAAT

SEQ ID NO: 977693 - protein, 23 aa, Mycobacterium
GAALTLWLHVVDARFARGLRARL

SEQ ID NO: 977694 - protein, 24 aa, Mycobacterium
GAARLALQAWQAMGGIDVLVNNAA

SEQ ID NO: 977695 - protein, 24 aa, Mycobacterium
GAATAKLFLFDLATLDGIFRVAAF

SEQ ID NO: 977696 - protein, 25 aa, Mycobacterium
GAAVKFLLYNLFGGLIMLAAVIGLY

SEQ ID NO: 977697 - protein, 19 aa, Mycobacterium
GAAVWMATFILAKTLRGES

SEQ ID NO: 977698 - protein, 25 aa, Mycobacterium
GAELTFPMLQFSLLGALCMLGTLWL

SEQ ID NO: 977699 - protein, 42 aa, Mycobacterium; identical to SEQ ID NO: 355151

SEQ ID NO: 977700 - protein, 21 aa, Mycobacterium
GAGLFYFDFVRLRSIPALREF

SEQ ID NO: 977701 - protein, 26 aa, Mycobacterium
GAIATILAWPAGIIPVLRPADIERAA

SEQ ID NO: 977702 - protein, 24 aa, Mycobacterium
GAIAVMLLLVYRSIVTTVIQLFMT

SEQ ID NO: 977703 - protein, 26 aa, Mycobacterium
GAIEPQFFVALLAGLGLSAAEVPSQV

SEQ ID NO: 977704 - protein, 35 aa, Mycobacterium; identical to SEQ ID NO: 355190

SEQ ID NO: 977705 - protein, 23 aa, Mycobacterium
GAKYDLMIAGIAALSLILLIMMF

SEQ ID NO: 977706 - protein, 21 aa, Mycobacterium
GALFPFLFITIACGALSGFHA

SEQ ID NO: 977707 - protein, 24 aa, Mycobacterium
GALFRAPEFYVWIAAALGGMIFQQ

SEQ ID NO: 977708 - protein, 20 aa, Mycobacterium
GALGALQSWLASDQPGVLAV

SEQ ID NO: 977709 - protein, 24 aa, Mycobacterium
GALITLLPFALGLLTSFTSAHQFA

SEQ ID NO: 977710 - protein, 18 aa, Mycobacterium
GALMVAALALSLDGLLAL

SEQ ID NO: 977711 - protein, 23 aa, Mycobacterium
GALSPYPIMRKLFSQFGLDVLAA

SEQ ID NO: 977712 - protein, 42 aa, Mycobacterium
GALSWFSPLGWSLLVRPYAGERWWVLLLPLATTAALTVLAYQ

SEQ ID NO: 977713 - protein, 19 aa, Mycobacterium
GALTVAMKHIKEPPPPLPA

SEQ ID NO: 977714 - protein, 20 aa, Mycobacterium
GALTVAMKHIKEPPPPLPAD

SEQ ID NO: 977715 - protein, 24 aa, Mycobacterium
GAMTLYLWHIPAIAVAAFVLHAVG

SEQ ID NO: 977716 - protein, 21 aa, Mycobacterium
GAMYCLSFTRLPYFQTLGSPC

SEQ ID NO: 977717 - protein, 25 aa, Mycobacterium
GANIPAIIRGLIAVAWYGIQTYLAS

SEQ ID NO: 977718 - protein, 21 aa, Mycobacterium
GANSPALYLLDGLRAQDDFSG

SEQ ID NO: 977719 - protein, 19 aa, Mycobacterium
GAPSPLLQGGLAFIDTPGV

SEQ ID NO: 977720 - protein, 19 aa, Mycobacterium
GAPTVPWVLSARSAPALAN

SEQ ID NO: 977721 - protein, 25 aa, Mycobacterium
GAQEWLKSIVPFGGFPWGSVAFGQV

SEQ ID NO: 977722 - protein, 19 aa, Mycobacterium
GAQLGIFIKGYQALETIHG

SEQ ID NO: 977723 - protein, 35 aa, Mycobacterium; identical to SEQ ID NO: 355294

SEQ ID NO: 977724 - protein, 33 aa, Mycobacterium; identical to SEQ ID NO: 355302

SEQ ID NO: 977725 - protein, 26 aa, Mycobacterium
GASAILWTINIVEVLETLMGFGPPAE

SEQ ID NO: 977726 - protein, 24 aa, Mycobacterium
GASVSVLALMRRATLRQAVADGVA

SEQ ID NO: 977727 - protein, 24 aa, Mycobacterium
GATAAWAIGRWTPGTERRTATMGL

SEQ ID NO: 977728 - protein, 19 aa, Mycobacterium
GATVLTLRLVMRAGEPRLS

SEQ ID NO: 977729 - protein, 22 aa, Mycobacterium
GAVLAIAVWRHSSTPRPTFDDE

SEQ ID NO: 977730 - protein, 23 aa, Mycobacterium
GAVLAIAVWRHSSTPRPTFDDEV

SEQ ID NO: 977731 - protein, 26 aa, Mycobacterium
GAVLLVPSYFHQLLRETPLQVGIHMI

SEQ ID NO: 977732 - protein, 27 aa, Mycobacterium
GAVPSMPRWLFVVLAFGGLTAALAGGD

SEQ ID NO: 977733 - protein, 29 aa, Mycobacterium
GAVVALLWNYPLATLLLVLGSSALVPLGL

SEQ ID NO: 977734 - protein, 35 aa, Mycobacterium
GAVVRTLALALALYLIASLLIWGQARLLNVTVQRT

SEQ ID NO: 977735 - protein, 24 aa, Mycobacterium
GAVVTGLGLLRRQGLRQAVASGIA

SEQ ID NO: 977736 - protein, 28 aa, Mycobacterium
GAYLAAGLMLFLLTLVVNAIARTALIGT

SEQ ID NO: 977737 - protein, 22 aa, Mycobacterium
GAYWLFHSAKIGKFKDLLINCG

SEQ ID NO: 977738 - protein, 24 aa, Mycobacterium
GCALDYEYIAMLFVEADSATLAVV

SEQ ID NO: 977739 - protein, 24 aa, Mycobacterium
GCSPWQIYWRILLPHARPAVMVLG

SEQ ID NO: 977740 - protein, 24 aa, Mycobacterium
GDACVWWGLWLVTITGWVPLITVG

SEQ ID NO: 977741 - protein, 23 aa, Mycobacterium
GDDCWWAPRWMRRLQTRIGLGEI

SEQ ID NO: 977742 - protein, 21 aa, Mycobacterium
GDPIGFLIAGVIGFFGGFAYG

SEQ ID NO: 977743 - protein, 27 aa, Mycobacterium
GDPTRRWLLLALVAIWGLRLSRHIHRK

SEQ ID NO: 977744 - protein, 19 aa, Mycobacterium
GDRLKHLVLPSLTLALGAA

SEQ ID NO: 977745 - protein, 23 aa, Mycobacterium
GDTMGYRMVIYPEYAVLDRKDPA

SEQ ID NO: 977746 - protein, 19 aa, Mycobacterium
GDVYLVIDNYRALAEENEV

SEQ ID NO: 977747 - protein, 28 aa, Mycobacterium
GDYGTYFKGHLYIAGRIKDLVIIDGRNH

SEQ ID NO: 977748 - protein, 22 aa, Mycobacterium
GEAVTFWILGALALVGALGVVM

SEQ ID NO: 977749 - protein, 25 aa, Mycobacterium
GEDRLFSRAIPQLRTAWVSYRRGAP

SEQ ID NO: 977750 - protein, 29 aa, Mycobacterium
GEHDPTNIRWLLYALGTIAIIVAIQRVFS

SEQ ID NO: 977751 - protein, 22 aa, Mycobacterium
GEHLDCNLMKLDDLRPPERAQV

SEQ ID NO: 977752 - protein, 26 aa, Mycobacterium
GEIALPPGYLPIRVPIEVNFTQRVAI

SEQ ID NO: 977753 - protein, 25 aa, Mycobacterium
GELDGRLWIAMDYIEGIDVGQLMRD

SEQ ID NO: 977754 - protein, 23 aa, Mycobacterium
GELKVVLINLDPATPIVVNRGDR

SEQ ID NO: 977755 - protein, 32 aa, Mycobacterium
GELNVPEFPWTVLTIVLLIGVLVAAIGTRFMQ

SEQ ID NO: 977756 - protein, 28 aa, Mycobacterium
GELPALTPLTWLVQVMPLFFMAGGAAGA

SEQ ID NO: 977757 - protein, 24 aa, Mycobacterium
GEPDPMPRIWRIRITLERVDDGFK

SEQ ID NO: 977758 - protein, 35 aa, Mycobacterium
GEVLMWVPLPLLGLPPWMVFFGFSVSLIYQFWVHT

SEQ ID NO: 977759 - protein, 23 aa, Mycobacterium
GEVPLLAVVIAFSLAFGMGLPIT

SEQ ID NO: 977760 - protein, 23 aa, Mycobacterium
GFALFIFWLLLIARVVVELIRSF

SEQ ID NO: 977761 - protein, 25 aa, Mycobacterium
GFDLRPYYPLILTAFLLLTSIIIVG

SEQ ID NO: 977762 - protein, 19 aa, Mycobacterium
GFIALFIVCGAGKGAVYKL

SEQ ID NO: 977763 - protein, 19 aa, Mycobacterium
GFILYLLAMPETASARLAG

SEQ ID NO: 977764 - protein, 23 aa, Mycobacterium
GFIVTLVLNAFFLDKYDAYGEVA

SEQ ID NO: 977765 - protein, 21 aa, Mycobacterium
GFLLAILWMDLIVDSQVVFRR

SEQ ID NO: 977766 - protein, 31 aa, Mycobacterium
GFNDSWPANLGDKPALWIPGSSISAARLAVT

SEQ ID NO: 977767 - protein, 18 aa, Mycobacterium
GFPGWANYFPVTRGTPEP

SEQ ID NO: 977768 - protein, 19 aa, Mycobacterium
GFPWAAFVVGLSSAGPPPV

SEQ ID NO: 977769 - protein, 19 aa, Mycobacterium
GFQGLVGVWRRDSELFAEV

SEQ ID NO: 977770 - protein, 27 aa, Mycobacterium
GFSELAVGFPVLFLTAAAIAEYVVVTR

SEQ ID NO: 977771 - protein, 23 aa, Mycobacterium
GFSIWTLWSVMVLFMPQSVYGIS

SEQ ID NO: 977772 - protein, 19 aa, Mycobacterium
GFSMLAIALTWLSFEMDPG

SEQ ID NO: 977773 - protein, 23 aa, Mycobacterium
GFVKSLTYALLAAVGLAALLSIT

SEQ ID NO: 977774 - protein, 25 aa, Mycobacterium
GFVNALAILIFLSQVPHLLGVPAVV

SEQ ID NO: 977775 - protein, 22 aa, Mycobacterium
GFVRPWAIPLITTGGALLSAFI

SEQ ID NO: 977776 - protein, 34 aa, Mycobacterium; identical to SEQ ID NO: 355648

SEQ ID NO: 977777 - protein, 23 aa, Mycobacterium
GFYGLLLAVVFFLTSHWHYSTFE

SEQ ID NO: 977778 - protein, 19 aa, Mycobacterium
GGALWRFAALMVLSSMVAS

SEQ ID NO: 977779 - protein, 27 aa, Mycobacterium
GGATRALFEPLLAALRDFGCMALMMSG

SEQ ID NO: 977780 - protein, 22 aa, Mycobacterium
GGAVAFTVVRRSSQPEPSPRPP

SEQ ID NO: 977781 - protein, 22 aa, Mycobacterium
GGDLPGLQAWLADNGYALRPAV

SEQ ID NO: 977782 - protein, 21 aa, Mycobacterium
GGFLGALERGWQSLIATVDGL

SEQ ID NO: 977783 - protein, 22 aa, Mycobacterium
GGGGLLEVVWSPLGRPGDDTAD

SEQ ID NO: 977784 - protein, 25 aa, Mycobacterium
GGGSMFLLVGILAALWERHNSGKGQ

SEQ ID NO: 977785 - protein, 25 aa, Mycobacterium
GGLAFFFGPVVVFWVLATMAAMSVV

SEQ ID NO: 977786 - protein, 25 aa, Mycobacterium
GGLGTRWVAMNALTFASKGALALRL

SEQ ID NO: 977787 - protein, 17 aa, Mycobacterium
GGLVPLVGTWGFDQIAW

SEQ ID NO: 977788 - protein, 25 aa, Mycobacterium
GGPALALRFLALTAGVFGVSAAVAA

SEQ ID NO: 977789 - protein, 23 aa, Mycobacterium
GGPARMRVIVLLALVVGLEGASN

SEQ ID NO: 977790 - protein, 18 aa, Mycobacterium
GGQYPYPPTGPYTNPQGG

SEQ ID NO: 977791 - protein, 23 aa, Mycobacterium
GGSMLVLLGIMAALYERERSGKG

SEQ ID NO: 977792 - protein, 20 aa, Mycobacterium
GGSRFRALWAAGAGLVLGWA

SEQ ID NO: 977793 - protein, 27 aa, Mycobacterium
GGVILFQQLFWFFGHPEVYVIALPFFG

SEQ ID NO: 977794 - protein, 27 aa, Mycobacterium
GGVLLWQHLFWFFGHPEVYILALPFFG

SEQ ID NO: 977795 - protein, 20 aa, Mycobacterium
GGVVKPILWGPGKAAAVQRF

SEQ ID NO: 977796 - protein, 23 aa, Mycobacterium
GGVWTFIIVLAAAFFLASAGASA

SEQ ID NO: 977797 - protein, 31 aa, Mycobacterium; identical to SEQ ID NO: 355858

SEQ ID NO: 977798 - protein, 32 aa, Mycobacterium; identical to SEQ ID NO: 355859

SEQ ID NO: 977799 - protein, 23 aa, Mycobacterium
GHDWGSVAIWDYLTRSGAADRVA

SEQ ID NO: 977800 - protein, 30 aa, Mycobacterium; identical to SEQ ID NO: 355880

SEQ ID NO: 977801 - protein, 23 aa, Mycobacterium
GHHQGVIGLLPPPETMPGVAPAD

SEQ ID NO: 977802 - protein, 27 aa, Mycobacterium
GHKVTTSPLPMKPIPQPAAQPNALEHT

SEQ ID NO: 977803 - protein, 27 aa, Mycobacterium
GHLGGWLLGFAWPWRPVVCGGRTGSPT

SEQ ID NO: 977804 - protein, 21 aa, Mycobacterium
GHLKWAWIPGVPLLWDLIVTL

SEQ ID NO: 977805 - protein, 30 aa, Mycobacterium; identical to SEQ ID NO: 355899

SEQ ID NO: 977806 - protein, 18 aa, Mycobacterium
GHRHLIDRLLANDQLPSG

SEQ ID NO: 977807 - protein, 29 aa, Mycobacterium
GHSNWLSATRWLGCLLACALAGAVLVMPL

SEQ ID NO: 977808 - protein, 19 aa, Mycobacterium
GHVVDFFSVGWWPVFNVAD

SEQ ID NO: 977809 - protein, 24 aa, Mycobacterium
GHWSLLLGYGCLPWVAATMLGLRA

SEQ ID NO: 977810 - protein, 23 aa, Mycobacterium
GIFATYPFFIKLGRRLGSRLATR

SEQ ID NO: 977811 - protein, 17 aa, Mycobacterium
GIFGALFPLIVQDLTHG

SEQ ID NO: 977812 - protein, 17 aa, Mycobacterium
GIFVLAPKLEPIAEFLN

SEQ ID NO: 977813 - protein, 24 aa, Mycobacterium
GIGGLLIVVVAMFLGVDPGGVLSQ

SEQ ID NO: 977814 - protein, 24 aa, Mycobacterium
GIGSWIGQLLRDILSFLADPYKYF

SEQ ID NO: 977815 - protein, 19 aa, Mycobacterium
GIIIGPVLMILIVTTIDVY

SEQ ID NO: 977816 - protein, 25 aa, Mycobacterium
GILVVLLAALLIKWTYGPASDAQTP

SEQ ID NO: 977817 - protein, 25 aa, Mycobacterium
GIMGRTILIWLLGSGVPVVDIALLA

SEQ ID NO: 977818 - protein, 17 aa, Mycobacterium
GINTLFPLFGIANQLLA

SEQ ID NO: 977819 - protein, 24 aa, Mycobacterium
GINVGFYMLMPYLADYLAGPLGLA

SEQ ID NO: 977820 - protein, 19 aa, Mycobacterium
GIPSEIFDVLDLKPTFISD

SEQ ID NO: 977821 - protein, 24 aa, Mycobacterium
GIQLITPVIFLVLVSVFVGIQVKA

SEQ ID NO: 977822 - protein, 19 aa, Mycobacterium
GIRPSFPALAANLANLGRV

SEQ ID NO: 977823 - protein, 24 aa, Mycobacterium
GIRVRIGIHMGRSVRRGDDLFGRN

SEQ ID NO: 977824 - protein, 28 aa, Mycobacterium
GISALCLIFIIMLIITRSVVAAAVIVGT

SEQ ID NO: 977825 - protein, 27 aa, Mycobacterium
GISPCILPVLPVVFFSGAHGGATVATT

SEQ ID NO: 977826 - protein, 24 aa, Mycobacterium
GISTFIWHDLLGKDLHWAVQSMAF

SEQ ID NO: 977827 - protein, 32 aa, Mycobacterium; identical to SEQ ID NO: 356053

SEQ ID NO: 977828 - protein, 23 aa, Mycobacterium
GIVFRVQQELGVPVKLVGLGEGP

SEQ ID NO: 977829 - protein, 24 aa, Mycobacterium
GIVLMAIWFHFWQDDVRDLMGVVH

SEQ ID NO: 977830 - protein, 19 aa, Mycobacterium
GIVMLLSGLTLVGAMQDAI

SEQ ID NO: 977831 - protein, 18 aa, Mycobacterium
GIVPWWFIAALLARDAAL

SEQ ID NO: 977832 - protein, 24 aa, Mycobacterium
GIVTRFQYRDALLLDLQGNVVYSV

SEQ ID NO: 977833 - protein, 27 aa, Mycobacterium
GIVVMAAVVFLLSGLVPLRKFRTHRRQ

SEQ ID NO: 977834 - protein, 19 aa, Mycobacterium
GIWVFAPLRRRATAALATA

SEQ ID NO: 977835 - protein, 39 aa, Mycobacterium; identical to SEQ ID NO: 356074

SEQ ID NO: 977836 - protein, 27 aa, Mycobacterium
GIYGDFFSFYLCDVVLKLNGRGGQPVY

SEQ ID NO: 977837 - protein, 21 aa, Mycobacterium
GKALFRRPFQWRELILQCWFV

SEQ ID NO: 977838 - protein, 23 aa, Mycobacterium
GKDLAAMLKRYGPLPPPRAVAIT

SEQ ID NO: 977839 - protein, 17 aa, Mycobacterium
GKGWLINSLSLPFFTFI

SEQ ID NO: 977840 - protein, 18 aa, Mycobacterium
GKLHFWLTFIGFHTTFLV

SEQ ID NO: 977841 - protein, 21 aa, Mycobacterium
GKNIGQFQLIQLKLAKMEVAR

SEQ ID NO: 977842 - protein, 31 aa, Mycobacterium
GKPAAKFVLNVYPRYLPLIPENVDAQIKATT

SEQ ID NO: 977843 - protein, 21 aa, Mycobacterium
GKPRWLCATAALAAALVGALP

SEQ ID NO: 977844 - protein, 22 aa, Mycobacterium
GKTTLLMTLAGLLSPLQGQVLL

SEQ ID NO: 977845 - protein, 20 aa, Mycobacterium
GKTTLMLILAGREPTSGTVE

SEQ ID NO: 977846 - protein, 17 aa, Mycobacterium
GLCDDGMHMMIALPNVA

SEQ ID NO: 977847 - protein, 26 aa, Mycobacterium
GLFAQFGLWRWAFGVMATMAGLMTLL

SEQ ID NO: 977848 - protein, 21 aa, Mycobacterium
GLFVLGFLRYGLPPNDRIQLQ

SEQ ID NO: 977849 - protein, 20 aa, Mycobacterium
GLGAFLPGLVELLRARMPAP

SEQ ID NO: 977850 - protein, 23 aa, Mycobacterium
GLGAVIFYLALKYTGEFLLGYLA

SEQ ID NO: 977851 - protein, 25 aa, Mycobacterium
GLGGYFFNYLFSNPIPYARAGLDPK

SEQ ID NO: 977852 - protein, 18 aa, Mycobacterium
GLGLLFDTLIARSFMVPS

SEQ ID NO: 977853 - protein, 23 aa, Mycobacterium
GLGNKYFSRLPQRALERVTPKPG

SEQ ID NO: 977854 - protein, 24 aa, Mycobacterium
GLILAGAVLLFTRPRLRIGAAGIS

SEQ ID NO: 977855 - protein, 19 aa, Mycobacterium
GLIMPNGVRWVQIAIALTR

SEQ ID NO: 977856 - protein, 17 aa, Mycobacterium
GLIVSRQWKLLGAYAAA

SEQ ID NO: 977857 - protein, 24 aa, Mycobacterium
GLLAWARRKPWLSGVLIGLGAAAK

SEQ ID NO: 977858 - protein, 17 aa, Mycobacterium
GLLAYRYRLRVLVAATV

SEQ ID NO: 977859 - protein, 30 aa, Mycobacterium
GLLLAGSFVLFSFWAFDYAGPGANKLILVL

SEQ ID NO: 977860 - protein, 25 aa, Mycobacterium
GLLPMWEIVMILLLLAMVGLRDKVI

SEQ ID NO: 977861 - protein, 20 aa, Mycobacterium
GLLVLVTRAPLGLTPPRLWA

SEQ ID NO: 977862 - protein, 25 aa, Mycobacterium
GLNQAILAVILASLSVSAVLGWHLF

SEQ ID NO: 977863 - protein, 26 aa, Mycobacterium
GLPATSLAWGYWQTRTGLTAHLTDVD

SEQ ID NO: 977864 - protein, 30 aa, Mycobacterium; identical to SEQ ID NO: 356349

SEQ ID NO: 977865 - protein, 28 aa, Mycobacterium
GLRNDALAAFLWMANWRFVAQKTDYFTQ

SEQ ID NO: 977866 - protein, 26 aa, Mycobacterium
GLSAFYYALLLLLAGFTGSIVVSTLV

SEQ ID NO: 977867 - protein, 28 aa, Mycobacterium
GLSLRGATGVPWLLISGPLGSAAESSIT

SEQ ID NO: 977868 - protein, 20 aa, Mycobacterium
GLSVLVWQHILGLDLNWIAP

SEQ ID NO: 977869 - protein, 27 aa, Mycobacterium
GLSWRDWLLAVVVIAVIRPAAMLLSLV

SEQ ID NO: 977870 - protein, 26 aa, Mycobacterium
GLTLSPTLIFGYPTPAALAEHLSTHL

SEQ ID NO: 977871 - protein, 29 aa, Mycobacterium
GLVGGIVWNLLTWLLGIPSSSSHALIGGI

SEQ ID NO: 977872 - protein, 33 aa, Mycobacterium
GLVLAGVYPLYLDAYPLPPFAIYGAVSLHTIKQ

SEQ ID NO: 977873 - protein, 19 aa, Mycobacterium
GLVLLVAMPIVILTGLLSY

SEQ ID NO: 977874 - protein, 31 aa, Mycobacterium; identical to SEQ ID NO: 356449

SEQ ID NO: 977875 - protein, 29 aa, Mycobacterium
GLVTTVFGLLLLAPPIRAAARPGLTAIAV

SEQ ID NO: 977876 - protein, 17 aa, Mycobacterium
GMALIVATFFRFVARRL

SEQ ID NO: 977877 - protein, 24 aa, Mycobacterium
GMDLVAFVMFSSLAGIAGAPGQGN

SEQ ID NO: 977878 - protein, 20 aa, Mycobacterium
GMGRVLYERFSAFRTAFDAV

SEQ ID NO: 977879 - protein, 17 aa, Mycobacterium
GMLLLTTQFLHNVRGYT

SEQ ID NO: 977880 - protein, 30 aa, Mycobacterium; identical to SEQ ID NO: 356495

SEQ ID NO: 977881 - protein, 25 aa, Mycobacterium
GMPRRLRWISPLVPLVAGPLPVAFF

SEQ ID NO: 977882 - protein, 24 aa, Mycobacterium
GMVILPPFVYFISYRWSIGLQRSD

SEQ ID NO: 977883 - protein, 29 aa, Mycobacterium
GNFLGLPLNFLLFSLLVVVTASLTVPVFG

SEQ ID NO: 977884 - protein, 17 aa, Mycobacterium
GNPQLLDTVFDKALHQI

SEQ ID NO: 977885 - protein, 28 aa, Mycobacterium
GNSLDAVWTQLMPDRYTRPHLRLFSGQV

SEQ ID NO: 977886 - protein, 21 aa, Mycobacterium
GNTWTRRLLVPNFSSPARLTA

SEQ ID NO: 977887 - protein, 22 aa, Mycobacterium
GNTWTRRLLVPNFSSPARLTAV

SEQ ID NO: 977888 - protein, 24 aa, Mycobacterium
GNVIWILLFGLWLAIGHLVSAVAM

SEQ ID NO: 977889 - protein, 17 aa, Mycobacterium
GPALFLVYAVCGVFAFL

SEQ ID NO: 977890 - protein, 35 aa, Mycobacterium; identical to SEQ ID NO: 20695

SEQ ID NO: 977891 - protein, 27 aa, Mycobacterium
GPFLSYGIQWIAFGILAPIGLGYFAYA

SEQ ID NO: 977892 - protein, 26 aa, Mycobacterium
GPGGPGRMFFLPGPPPPGMGPGMGPG

SEQ ID NO: 977893 - protein, 23 aa, Mycobacterium
GPGIPVWLRAPRAIPGALVLPGV

SEQ ID NO: 977894 - protein, 25 aa, Mycobacterium
GPHGPPPPPPPPPGGPPPGPPPDAT

SEQ ID NO: 977895 - protein, 26 aa, Mycobacterium
GPKSIRVWLMLGVLLFSVVLAVRLNV

SEQ ID NO: 977896 - protein, 20 aa, Mycobacterium
GPLKWIYLTMSVQMVAAMVT

SEQ ID NO: 977897 - protein, 46 aa, Mycobacterium
GPLMGGLLVEYFWWGAIFLINVPLALLVLLLVWRLVPESRSQARLV

SEQ ID NO: 977898 - protein, 36 aa, Mycobacterium
GPLYGIFIVWLFSDWRYVFWINIPLTAIAMLMIQVS

SEQ ID NO: 977899 - protein, 37 aa, Mycobacterium
GPLYGIFIVWLFSDWRYVFWINIPLTAIAMLMIQVSL

SEQ ID NO: 977900 - protein, 25 aa, Mycobacterium
GPPRVLIIAAALLAVAALGTILVIA

SEQ ID NO: 977901 - protein, 22 aa, Mycobacterium
GPQVWWVLHVARWAADVPGATV

SEQ ID NO: 977902 - protein, 38 aa, Mycobacterium
GPRKRRLRRILIGSVVAILLVGMLAVAIPSLREITSSP

SEQ ID NO: 977903 - protein, 23 aa, Mycobacterium
GPRLGVRWWRFGAGVLLGLAFAT

SEQ ID NO: 977904 - protein, 22 aa, Mycobacterium
GPVALVRPWRAPVVLVVMAVRV

SEQ ID NO: 977905 - protein, 24 aa, Mycobacterium
GPVGGRIFALLAAAALLMAGSPGI

SEQ ID NO: 977906 - protein, 38 aa, Mycobacterium
GPVILMAMLPALQFRYWQWASLALAAPVIVWAGRPFHQ

SEQ ID NO: 977907 - protein, 27 aa, Mycobacterium
GPVMTLFSVLFAALWLSCLAIFNTRSQ

SEQ ID NO: 977908 - protein, 28 aa, Mycobacterium
GQAADWLGYFMLLASFILGATVGGTISL

SEQ ID NO: 977909 - protein, 17 aa, Mycobacterium
GQAEILWDVIPFDWAND

SEQ ID NO: 977910 - protein, 31 aa, Mycobacterium; identical to SEQ ID NO: 347748

SEQ ID NO: 977911 - protein, 27 aa, Mycobacterium
GQLSHLELVYLAQALFAAGIDSTWVMI

SEQ ID NO: 977912 - protein, 26 aa, Mycobacterium
GQSKGYFLLGIWMSLLWAVVFALSIV

SEQ ID NO: 977913 - protein, 28 aa, Mycobacterium
GRALLFAGILPPTWLAGTAMLGLSKILD

SEQ ID NO: 977914 - protein, 19 aa, Mycobacterium
GRAVPWRPKLLPVEDRRSI

SEQ ID NO: 977915 - protein, 21 aa, Mycobacterium
GREALLRVLSGLTKRHRTALV

SEQ ID NO: 977916 - protein, 21 aa, Mycobacterium
GRGPFLQPPPPAPPGPEHPAE

SEQ ID NO: 977917 - protein, 23 aa, Mycobacterium
GRGWAWLSAFTLFASAIGALLTE

SEQ ID NO: 977918 - protein, 26 aa, Mycobacterium
GRHRVHVHVPYWLPSQIGPADTLVDV

SEQ ID NO: 977919 - protein, 19 aa, Mycobacterium
GRIFAYFRYRLRSAFLLDT

SEQ ID NO: 977920 - protein, 19 aa, Mycobacterium
GRILLGLQQRRLQPVAVDF

SEQ ID NO: 977921 - protein, 28 aa, Mycobacterium
GRIPDKRWFGWFALLTIPAPFLANISGW

SEQ ID NO: 977922 - protein, 24 aa, Mycobacterium
GRIPLEQLAWLSPSRWAYAMAAST

SEQ ID NO: 977923 - protein, 18 aa, Mycobacterium
GRPLAWGEQISLLVFMIF

SEQ ID NO: 977924 - protein, 26 aa, Mycobacterium
GRPTTWLQVSAYRFLVRRLECALLRG

SEQ ID NO: 977925 - protein, 27 aa, Mycobacterium
GRQHISLRPLWGIDDRLKRFGAMAAAM

SEQ ID NO: 977926 - protein, 20 aa, Mycobacterium
GRRAIMLPAGALVYIAVPPA

SEQ ID NO: 977927 - protein, 20 aa, Mycobacterium
GRRIGTSLRLLLIGSVVGAA

SEQ ID NO: 977928 - protein, 31 aa, Mycobacterium; identical to SEQ ID NO: 356885

SEQ ID NO: 977929 - protein, 24 aa, Mycobacterium
GRRTHPLQWAFLGAFAAVAVVLRI

SEQ ID NO: 977930 - protein, 25 aa, Mycobacterium
GRTPRRGFWLSWLGSSMLAATALVT

SEQ ID NO: 977931 - protein, 25 aa, Mycobacterium
GRVVALIVLLILVAAALRGYLPDDD

SEQ ID NO: 977932 - protein, 18 aa, Mycobacterium
GRYRVVSALSRRGDELIV

SEQ ID NO: 977933 - protein, 23 aa, Mycobacterium
GSATFSYPLALPPDTFALQGPWS

SEQ ID NO: 977934 - protein, 22 aa, Mycobacterium
GSCLLFPAYFQQVLGKTPLQSG

SEQ ID NO: 977935 - protein, 23 aa, Mycobacterium
GSEFARIGLLAGLLLVLVWVFDC

SEQ ID NO: 977936 - protein, 32 aa, Mycobacterium; identical to SEQ ID NO: 356946

SEQ ID NO: 977937 - protein, 24 aa, Mycobacterium
GSFPSWVLYPCALAMMVLSKSFSV

SEQ ID NO: 977938 - protein, 24 aa, Mycobacterium
GSGWWQTFWRITLPSIRWGLTYGI

SEQ ID NO: 977939 - protein, 22 aa, Mycobacterium
GSHPDYGAPAGWRAPGWPPPSE

SEQ ID NO: 977940 - protein, 27 aa, Mycobacterium
GSKAGLLPLHAWLPRAHPESPSPVSAL

SEQ ID NO: 977941 - protein, 19 aa, Mycobacterium
GSMLSFAGVLLGAIAGVLL

SEQ ID NO: 977942 - protein, 19 aa, Mycobacterium
GSPLLMTYFLVDVSGARLT

SEQ ID NO: 977943 - protein, 22 aa, Mycobacterium
GSPYAIFLLREHFRIIPNDMIN

SEQ ID NO: 977944 - protein, 29 aa, Mycobacterium
GSSVLVQMMWAMRGIGIWSDVRGTNMLDG

SEQ ID NO: 977945 - protein, 25 aa, Mycobacterium
GSVPPSPPPYGYQPAFPGATPRSSS

SEQ ID NO: 977946 - protein, 17 aa, Mycobacterium
GSYWGLVIVPPSVLVLA

SEQ ID NO: 977947 - protein, 21 aa, Mycobacterium
GTAICMLLPGRPMPDSAYPAA

SEQ ID NO: 977948 - protein, 24 aa, Mycobacterium
GTARTALPAVVPVAAGQAGQPGAA

SEQ ID NO: 977949 - protein, 27 aa, Mycobacterium
GTAVVRWPAPILALSGAIVLVGMVALP

SEQ ID NO: 977950 - protein, 23 aa, Mycobacterium
GTDAFHAQALLYTNMLVQAYQAA

SEQ ID NO: 977951 - protein, 28 aa, Mycobacterium
GTDTSAYWVFLLFYVGAALLTWSRYGRR

SEQ ID NO: 977952 - protein, 17 aa, Mycobacterium
GTFINLRCVCLAPPDAH

SEQ ID NO: 977953 - protein, 18 aa, Mycobacterium
GTFTAIPAYWHQAADWLS

SEQ ID NO: 977954 - protein, 25 aa, Mycobacterium
GTITYWLVHMIGGYPGAIIGFALLC

SEQ ID NO: 977955 - protein, 22 aa, Mycobacterium
GTKLAIAALLLHVLAHGIGKTV

SEQ ID NO: 977956 - protein, 17 aa, Mycobacterium
GTKLLVVFAISVLLTFY

SEQ ID NO: 977957 - protein, 29 aa, Mycobacterium
GTMLLRLCMLPGLALLIWATPRLAHHLGA

SEQ ID NO: 977958 - protein, 26 aa, Mycobacterium
GTNRTLFEVLLYGALLALLVVALVSD

SEQ ID NO: 977959 - protein, 26 aa, Mycobacterium
GTQNFGLLILRVGLGAVLIAHGLQKL

SEQ ID NO: 977960 - protein, 26 aa, Mycobacterium
GTRHRRILPPRWWSIGALDGLVTAVL

SEQ ID NO: 977961 - protein, 27 aa, Mycobacterium
GTSLLLYASFLVVLYLATQRFSWVIIG

SEQ ID NO: 977962 - protein, 48 aa, Mycobacterium
GTTIMIGLLFDTLVVRSFMMPAIAALLGRWFWWPRRVPTHAASPPAVT

SEQ ID NO: 977963 - protein, 27 aa, Mycobacterium
GTVLGRRYRVGPPVLLILLGLVPRFGD

SEQ ID NO: 977964 - protein, 24 aa, Mycobacterium
GTVLTLVLAFAAAALLWLVVEELL

SEQ ID NO: 977965 - protein, 21 aa, Mycobacterium
GTVMLLFYATPIVFGFANLVL

SEQ ID NO: 977966 - protein, 36 aa, Mycobacterium; identical to SEQ ID NO: 357230

SEQ ID NO: 977967 - protein, 24 aa, Mycobacterium
GVAWRRSLQLRVVALTLGLSLAVV

SEQ ID NO: 977968 - protein, 24 aa, Mycobacterium
GVCLVSTWHYFPRHRFLFGDKYDS

SEQ ID NO: 977969 - protein, 24 aa, Mycobacterium
GVDGYLAALGRYLQFHEDRRIPIP

SEQ ID NO: 977970 - protein, 24 aa, Mycobacterium
GVDLLVHLQMVQAGLAVAILPALL

SEQ ID NO: 977971 - protein, 29 aa, Mycobacterium
GVEEQYYIVWPLLLIAVTLLLAARARRYF

SEQ ID NO: 977972 - protein, 24 aa, Mycobacterium
GVGALLRLPYTFAIPVFGGRNWTT

SEQ ID NO: 977973 - protein, 26 aa, Mycobacterium
GVGGNGAFFLLLDEPEVYGLPPDPVV

SEQ ID NO: 977974 - protein, 36 aa, Mycobacterium; identical to SEQ ID NO: 357299

SEQ ID NO: 977975 - protein, 28 aa, Mycobacterium
GVGSIFPIFMMVGIMMMMFRSVGAGGQQ

SEQ ID NO: 977976 - protein, 25 aa, Mycobacterium
GVIAVMLFFVYRSVPTTLLVLLTVL

SEQ ID NO: 977977 - protein, 36 aa, Mycobacterium
GVIGVLIFAAILVTGFLWPAWLVTTKLDVNKAQASV

SEQ ID NO: 977978 - protein, 34 aa, Mycobacterium; identical to SEQ ID NO: 357327

SEQ ID NO: 977979 - protein, 18 aa, Mycobacterium
GVLAYACAIGLKRLGKDV

SEQ ID NO: 977980 - protein, 22 aa, Mycobacterium
GVLCNMIAAWLTATSVRDLHSA

SEQ ID NO: 977981 - protein, 21 aa, Mycobacterium
GVLLGLAITAAWPGGWWIDPG

SEQ ID NO: 977982 - protein, 21 aa, Mycobacterium
GVLMTIPWAVISGFLFNVLLT

SEQ ID NO: 977983 - protein, 23 aa, Mycobacterium
GVLQIIFGLSRMARAALAIAPVV

SEQ ID NO: 977984 - protein, 24 aa, Mycobacterium
GVLTIIMGLVFVGLIPALQRQARF

SEQ ID NO: 977985 - protein, 17 aa, Mycobacterium
GVLVFLIGAMLIGTPQH

SEQ ID NO: 977986 - protein, 18 aa, Mycobacterium
GVLWIASRLGWVVIRSFD

SEQ ID NO: 977987 - protein, 18 aa, Mycobacterium
GVMYSIPLRRALVTGSDL

SEQ ID NO: 977988 - protein, 23 aa, Mycobacterium
GVNFRDVLVALGMYPGGGELGVE

SEQ ID NO: 977989 - protein, 29 aa, Mycobacterium
GVPLGHLGFFVLDGWLRPVPVGVVGESYV

SEQ ID NO: 977990 - protein, 26 aa, Mycobacterium
GVQLVVVLTAAWLLATPLTQSKDQPE

SEQ ID NO: 977991 - protein, 38 aa, Mycobacterium
GVRDVLFGGQVSYLALIVLAVIALVIGALGGVIGRKTA

SEQ ID NO: 977992 - protein, 17 aa, Mycobacterium
GVRWVQIAIALTRIGAV

SEQ ID NO: 977993 - protein, 17 aa, Mycobacterium
GVSLLPKVKSYGAVVAV

SEQ ID NO: 977994 - protein, 33 aa, Mycobacterium
GVTVAFLFWEFFIPLLLSLLQGLLGLIGGLLSA

SEQ ID NO: 977995 - protein, 23 aa, Mycobacterium
GVVAAVVGVTHASLAAGPAGAAV

SEQ ID NO: 977996 - protein, 26 aa, Mycobacterium
GVVIMIMLFIVYRSVSTVLLVLAVVG

SEQ ID NO: 977997 - protein, 23 aa, Mycobacterium
GVVTGLWVLYGYSVAFGNDMGGV

SEQ ID NO: 977998 - protein, 25 aa, Mycobacterium
GVVVGIFWMGRRLVSPWWAVGLGMI

SEQ ID NO: 977999 - protein, 23 aa, Mycobacterium
GWALTLPAALFVVGALTALRITV

SEQ ID NO: 978000 - protein, 29 aa, Mycobacterium
GWAVLLDYLFLPLVIWLIGGSYLQDRFPA

SEQ ID NO: 978001 - protein, 25 aa, Mycobacterium
GWEVDPYAIPLLQTAHRTGARVVLR

SEQ ID NO: 978002 - protein, 20 aa, Mycobacterium
GWLAILSLRLIPAVPFAALN

SEQ ID NO: 978003 - protein, 20 aa, Mycobacterium
GWLGLYLLARDPRKPVLILA

SEQ ID NO: 978004 - protein, 17 aa, Mycobacterium
GWLLVSALGAMLFPSRR

SEQ ID NO: 978005 - protein, 19 aa, Mycobacterium
GWRHLKHFNGYATSFWVTP

SEQ ID NO: 978006 - protein, 20 aa, Mycobacterium
GWSLQTAASVPVVFLTAFYG

SEQ ID NO: 978007 - protein, 17 aa, Mycobacterium
GWVAHRLLSAPLSAARA

SEQ ID NO: 978008 - protein, 19 aa, Mycobacterium
GWVLLTVLVNVVVPSLEVV

SEQ ID NO: 978009 - protein, 20 aa, Mycobacterium
GWVQLGMLGLIGAAAAIGNF

SEQ ID NO: 978010 - protein, 29 aa, Mycobacterium
GWVSAVNWFWLLAFAIAAIIRAAMSVRAR

SEQ ID NO: 978011 - protein, 21 aa, Mycobacterium
GWWFTLFTAILGSVILLWIAG

SEQ ID NO: 978012 - protein, 18 aa, Mycobacterium
GWWFTLFTSILGSVILLW

SEQ ID NO: 978013 - protein, 27 aa, Mycobacterium
GYDETARWVPRLWRRDIKAGHFSPMSH

SEQ ID NO: 978014 - protein, 20 aa, Mycobacterium
GYGLGGFGPAPEGMAIWIIG

SEQ ID NO: 978015 - protein, 17 aa, Mycobacterium
GYQPPPGSVPPSPPPYG

SEQ ID NO: 978016 - protein, 24 aa, Mycobacterium
GYQQWVPAGAIAFGLFMVTNAAKL

SEQ ID NO: 978017 - protein, 22 aa, Mycobacterium
GYSKFWWPDVPTWAPALVTIAV

SEQ ID NO: 978018 - protein, 26 aa, Mycobacterium
GYVVIASVGLWWFIRRQISRQRRGIE

SEQ ID NO: 978019 - protein, 18 aa, Mycobacterium
HADLRVAHPLIDRAHLLL

SEQ ID NO: 978020 - protein, 17 aa, Mycobacterium
HAEAAMPAWSKLPSRLS

SEQ ID NO: 978021 - protein, 37 aa, Mycobacterium
HAIPVGLAIIVLLIALGIPFLNIKWGYPDDRVLPPSA

SEQ ID NO: 978022 - protein, 17 aa, Mycobacterium
HALGYLHATIAMFLGST

SEQ ID NO: 978023 - protein, 23 aa, Mycobacterium
HAPWPLNLWHGANAGWWPVLWFT

SEQ ID NO: 978024 - protein, 29 aa, Mycobacterium
HATPDKLFNPILLLALAALAIGSASTLLV

SEQ ID NO: 978025 - protein, 21 aa, Mycobacterium
HAYPRTGSVVVWYSPRRCDRA

SEQ ID NO: 978026 - protein, 17 aa, Mycobacterium
HDEWKFQPAFTAEESVE

SEQ ID NO: 978027 - protein, 27 aa, Mycobacterium
HDVDYWKKGLRHSVYFTHGIRNAVDSG

SEQ ID NO: 978028 - protein, 27 aa, Mycobacterium
HFESILVRGLMNYTFWMPNGSPEYRYC

SEQ ID NO: 978029 - protein, 17 aa, Mycobacterium
HFILMRTVGLVDTPWAM

SEQ ID NO: 978030 - protein, 17 aa, Mycobacterium
HFNGYATSFWVTPADIN

SEQ ID NO: 978031 - protein, 26 aa, Mycobacterium
HGGELVCLPHQGGARFRLTLPLAVAG

SEQ ID NO: 978032 - protein, 23 aa, Mycobacterium
HGHDLDMRTLFQGPAGPADYAII

SEQ ID NO: 978033 - protein, 18 aa, Mycobacterium
HGRLMNRTVLRRAFGLLG

SEQ ID NO: 978034 - protein, 32 aa, Mycobacterium
HGYLGVWSALPFAIWFFLAVEGVPLAAEETAD

SEQ ID NO: 978035 - protein, 21 aa, Mycobacterium
HGYTYGLLWVAGAAVIVGGAA

SEQ ID NO: 978036 - protein, 22 aa, Mycobacterium
HHEALLFFAFSGVGVLLSMAPL

SEQ ID NO: 978037 - protein, 17 aa, Mycobacterium
HHNLLSRLYTGTGAFEV

SEQ ID NO: 978038 - protein, 25 aa, Mycobacterium
HHVLQSSWVQLLPSRKEGWGLAVVE

SEQ ID NO: 978039 - protein, 25 aa, Mycobacterium
HIDAVHGFYYLLMHGWYAIFPPTEF

SEQ ID NO: 978040 - protein, 18 aa, Mycobacterium
HIGDSRGYLLRDGELTQI

SEQ ID NO: 978041 - protein, 23 aa, Mycobacterium
HIGKVVLTLPQGPAAQSVLSGGT

SEQ ID NO: 978042 - protein, 20 aa, Mycobacterium
HKGLEQVLVFLPQGASIAQT

SEQ ID NO: 978043 - protein, 22 aa, Mycobacterium
HLDYEMPIRTFGWPRDLPRAVG

SEQ ID NO: 978044 - protein, 32 aa, Mycobacterium; identical to SEQ ID NO: 357868

SEQ ID NO: 978045 - protein, 37 aa, Mycobacterium; identical to SEQ ID NO: 357871

SEQ ID NO: 978046 - protein, 20 aa, Mycobacterium
HLHSSLLVSYLALLVGLGFG

SEQ ID NO: 978047 - protein, 20 aa, Mycobacterium
HLIALVMLILLGTLGFRAAL

SEQ ID NO: 978048 - protein, 18 aa, Mycobacterium
HLILQQPPTPNPTQTPED

SEQ ID NO: 978049 - protein, 28 aa, Mycobacterium
HLQRARVPMPIIPVSSLLRSHAVTLSEK

SEQ ID NO: 978050 - protein, 18 aa, Mycobacterium
HLSFGLLLAGSFVLFSFW

SEQ ID NO: 978051 - protein, 31 aa, Mycobacterium; identical to SEQ ID NO: 357900

SEQ ID NO: 978052 - protein, 31 aa, Mycobacterium
HMIRWALPAILILAPLWLLPASLYVHSEMTV

SEQ ID NO: 978053 - protein, 18 aa, Mycobacterium
HMVWWMVAVVGFNSLLGA

SEQ ID NO: 978054 - protein, 24 aa, Mycobacterium
HNGRRLFAVLLHGTRQPIAPWEQA

SEQ ID NO: 978055 - protein, 23 aa, Mycobacterium
HNGSVHLYLGYGALGVLIVLVVA

SEQ ID NO: 978056 - protein, 25 aa, Mycobacterium
HPALSLLLPMVFIALGGIGLPGAAV

SEQ ID NO: 978057 - protein, 34 aa, Mycobacterium; identical to SEQ ID NO: 357920

SEQ ID NO: 978058 - protein, 27 aa, Mycobacterium
HPAWHTLILVLLFVAAMWVTYALFMGS

SEQ ID NO: 978059 - protein, 19 aa, Mycobacterium
HPGLPLWPYLACAALTGCG

SEQ ID NO: 978060 - protein, 24 aa, Mycobacterium
HPNYFGEFGFWFALALFGVSASPS

SEQ ID NO: 978061 - protein, 24 aa, Mycobacterium
HPSLAVQIILFVAVVFGTLNVIGG

SEQ ID NO: 978062 - protein, 31 aa, Mycobacterium; identical to SEQ ID NO: 357957

SEQ ID NO: 978063 - protein, 19 aa, Mycobacterium
HRLPLSYFDGRQRGELLSR

SEQ ID NO: 978064 - protein, 39 aa, Mycobacterium
HRSRPQRLFYLLIHLLDPLISLESLYRYLCKFHALDQRR

SEQ ID NO: 978065 - protein, 56 aa, Mycobacterium
HRSTTQRDWLRRINWKWVRRSAYLAAAVVILLPIVTFTVAYFIVDVPRPGDIRTNQ

SEQ ID NO: 978066 - protein, 28 aa, Mycobacterium
HSHRRVVLLIYLWVGIVAFGAASTIFVD

SEQ ID NO: 978067 - protein, 24 aa, Mycobacterium
HSSWVLYAVIVVSALIIVGAVPML

SEQ ID NO: 978068 - protein, 22 aa, Mycobacterium
HTLGLIFVCCYIALVATNFAWL

SEQ ID NO: 978069 - protein, 17 aa, Mycobacterium
HTVLAIPVALRRYRREF

SEQ ID NO: 978070 - protein, 23 aa, Mycobacterium
HTWLLVALPLAGAAILLFGGRRT

SEQ ID NO: 978071 - protein, 30 aa, Mycobacterium; identical to SEQ ID NO: 358073

SEQ ID NO: 978072 - protein, 22 aa, Mycobacterium
HVEDWFLIGFAVLTLAVLVRDL

SEQ ID NO: 978073 - protein, 31 aa, Mycobacterium
HVEKLGRTLILHGLWPQPPTEQFCDVPTADE

SEQ ID NO: 978074 - protein, 26 aa, Mycobacterium
HVGIAFYFLMSVLVAALVLGIDHLML

SEQ ID NO: 978075 - protein, 20 aa, Mycobacterium
HVRKVLDLTIRLAEVMLSSG

SEQ ID NO: 978076 - protein, 17 aa, Mycobacterium
HVSFMRMFGLGLTLAMA

SEQ ID NO: 978077 - protein, 18 aa, Mycobacterium
HVWTLAPGKDMATAHLTS

SEQ ID NO: 978078 - protein, 29 aa, Mycobacterium
HWDALGFLQDFFATAVFLGIATFAIIRIK

SEQ ID NO: 978079 - protein, 23 aa, Mycobacterium
HYFNTFLIPSDLLWSFLQAIVMA

SEQ ID NO: 978080 - protein, 23 aa, Mycobacterium
IAAATFAGWTLLAANPVAGMTAA

SEQ ID NO: 978081 - protein, 26 aa, Mycobacterium
IAACLIMGWGHRLLRGLALVAVSAMV

SEQ ID NO: 978082 - protein, 35 aa, Mycobacterium
IAADRQYAVFLLVLPLLVSLFAHAVPGKAGLSLAK

SEQ ID NO: 978083 - protein, 26 aa, Mycobacterium
IAALLGRWFWWPINVRTRPARARPVR

SEQ ID NO: 978084 - protein, 28 aa, Mycobacterium
IAALSLILLIMMFLTRSLVAALVIVGTV

SEQ ID NO: 978085 - protein, 25 aa, Mycobacterium
IAALTLIFVVMVIITRALVASLVIV

SEQ ID NO: 978086 - protein, 18 aa, Mycobacterium
IAALVISLLIVALAAWYY

SEQ ID NO: 978087 - protein, 22 aa, Mycobacterium
IAAMLVVHLAGAGYRRYTAEFL

SEQ ID NO: 978088 - protein, 38 aa, Mycobacterium; identical to SEQ ID NO: 358185

SEQ ID NO: 978089 - protein, 24 aa, Mycobacterium
IAAVLIVFILFVAAFPSLFTGIDP

SEQ ID NO: 978090 - protein, 17 aa, Mycobacterium
IAAYLFSGGLSAGSALL

SEQ ID NO: 978091 - protein, 27 aa, Mycobacterium
IACWLLISRFVLRRLGPGKNGLAANRV

SEQ ID NO: 978092 - protein, 22 aa, Mycobacterium
IADFCHDGLALVGFLGLSDTPR

SEQ ID NO: 978093 - protein, 18 aa, Mycobacterium
IADKIWPGTRELAQMHLD

SEQ ID NO: 978094 - protein, 28 aa, Mycobacterium
IAEFDDLWRPIRSYFYWERHGSDIPICW

SEQ ID NO: 978095 - protein, 24 aa, Mycobacterium
IAEFLNRNLGWLFLFKTGNVSLAG

SEQ ID NO: 978096 - protein, 18 aa, Mycobacterium
IAFFSYVITIILLVLVLI

SEQ ID NO: 978097 - protein, 19 aa, Mycobacterium
IAFFSYVITIILLVLVLIP

SEQ ID NO: 978098 - protein, 25 aa, Mycobacterium
IAFGYSGLPFLPQGKTYNAYFSDAG

SEQ ID NO: 978099 - protein, 24 aa, Mycobacterium
IAFMCVALLAYFVMLGRLAFAMIG

SEQ ID NO: 978100 - protein, 17 aa, Mycobacterium
IAFPSKTFALKSLPLRW

SEQ ID NO: 978101 - protein, 26 aa, Mycobacterium
IAGALGILRLVAVFGPVHFFAQPVVS

SEQ ID NO: 978102 - protein, 20 aa, Mycobacterium
IAGPIARLALVGAAAEGSAV

SEQ ID NO: 978103 - protein, 32 aa, Mycobacterium
IAGTFISVLVLWDLFGQLPLPLGVAGHEGSTV

SEQ ID NO: 978104 - protein, 20 aa, Mycobacterium
IAIRPIPFLVTTRLVASIVA

SEQ ID NO: 978105 - protein, 32 aa, Mycobacterium; identical to SEQ ID NO: 358295

SEQ ID NO: 978106 - protein, 39 aa, Mycobacterium
IALAAIGGFILLIKKIWWPLAVWLLLVVMNVNAGTPLGG

SEQ ID NO: 978107 - protein, 27 aa, Mycobacterium
IALLPPLPVILVLCALIGVVYGPIQPI

SEQ ID NO: 978108 - protein, 24 aa, Mycobacterium
IALSATCYFFAELMLRPAATIALG

SEQ ID NO: 978109 - protein, 17 aa, Mycobacterium
IALVGALMVAALALSLD

SEQ ID NO: 978110 - protein, 22 aa, Mycobacterium
IAMVTLLAKIDLARGYLAVVLP

SEQ ID NO: 978111 - protein, 18 aa, Mycobacterium
IAPWEQAAHLLDYGFSTA

SEQ ID NO: 978112 - protein, 22 aa, Mycobacterium
IAQAWFVARVSLLPTLMLTIPY

SEQ ID NO: 978113 - protein, 18 aa, Mycobacterium
IAQLLVGWLTCGLGALVW

SEQ ID NO: 978114 - protein, 35 aa, Mycobacterium; identical to SEQ ID NO: 358355

SEQ ID NO: 978115 - protein, 29 aa, Mycobacterium
IASGAMVFAILVLLGRYINYTLDLAGIAG

SEQ ID NO: 978116 - protein, 28 aa, Mycobacterium
IASLCLIFVIMLILTRALVGAGVIVGTV

SEQ ID NO: 978117 - protein, 17 aa, Mycobacterium
IASLWFTIFGDAALLRQ

SEQ ID NO: 978118 - protein, 18 aa, Mycobacterium
IATGVVVGIFWMGRRLVS

SEQ ID NO: 978119 - protein, 18 aa, Mycobacterium
IATMVITIPLAWVLHRFT

SEQ ID NO: 978120 - protein, 18 aa, Mycobacterium
IATYCPAVIYPLLPNRLQ

SEQ ID NO: 978121 - protein, 22 aa, Mycobacterium
IATYFHFWRVFEGIPQWALALF

SEQ ID NO: 978122 - protein, 30 aa, Mycobacterium
IATYLHRWTIFTALPQWTLALLALAVVLVM

SEQ ID NO: 978123 - protein, 20 aa, Mycobacterium
IAVAVAVALVLWWRMIRFEY

SEQ ID NO: 978124 - protein, 33 aa, Mycobacterium; identical to SEQ ID NO: 358395

SEQ ID NO: 978125 - protein, 24 aa, Mycobacterium
IAVIVMLGVLLFIASYDSFRNLTA

SEQ ID NO: 978126 - protein, 22 aa, Mycobacterium
IAVPYVGPWRLSGTRFAPTATN

SEQ ID NO: 978127 - protein, 21 aa, Mycobacterium
IAVRGLLRRVPLTGAAAASMA

SEQ ID NO: 978128 - protein, 30 aa, Mycobacterium; identical to SEQ ID NO: 358418

SEQ ID NO: 978129 - protein, 17 aa, Mycobacterium
ICFLLIVTIPFGFAALR

SEQ ID NO: 978130 - protein, 17 aa, Mycobacterium
ICFVLTWSEATLGFCVG

SEQ ID NO: 978131 - protein, 18 aa, Mycobacterium
ICGLILAAWFIPAVPTQA

SEQ ID NO: 978132 - protein, 18 aa, Mycobacterium
ICGSSTTVTVLYLAYLRR

SEQ ID NO: 978133 - protein, 29 aa, Mycobacterium
IDGEIVLLLFLPAILYWESLNTSFRELRW

SEQ ID NO: 978134 - protein, 32 aa, Mycobacterium; identical to SEQ ID NO: 358458

SEQ ID NO: 978135 - protein, 22 aa, Mycobacterium
IDGQMFLEMRLIEGTDLDSILK

SEQ ID NO: 978136 - protein, 24 aa, Mycobacterium
IDGQMYLEMRLIEGTNLDSLLKRF

SEQ ID NO: 978137 - protein, 18 aa, Mycobacterium
IDHLPRLRRELEKRLGPE

SEQ ID NO: 978138 - protein, 17 aa, Mycobacterium
IDLPLIKPTLEASTTLP

SEQ ID NO: 978139 - protein, 22 aa, Mycobacterium
IDRAHLLLRFEQGSWVPIDNNS

SEQ ID NO: 978140 - protein, 24 aa, Mycobacterium
IDSTRARVILLDAAPAVLPPFGDK

SEQ ID NO: 978141 - protein, 20 aa, Mycobacterium
IEFALEIELIVNRFANQSQH

SEQ ID NO: 978142 - protein, 28 aa, Mycobacterium
IEGTNLDSLLKRFGPLTPPRAVAIITQV

SEQ ID NO: 978143 - protein, 28 aa, Mycobacterium
IEMVPETPVWRLVLPFAAMGAGMAFVWS

SEQ ID NO: 978144 - protein, 30 aa, Mycobacterium; identical to SEQ ID NO: 358538

SEQ ID NO: 978145 - protein, 25 aa, Mycobacterium
IEPLKEPAWRRFRVSQVLIGLSAVV

SEQ ID NO: 978146 - protein, 29 aa, Mycobacterium
IEPWALYRPFIPWLGWPMVAVLVLSQGLR

SEQ ID NO: 978147 - protein, 20 aa, Mycobacterium
IERQWRARMAGLRTNALVAT

SEQ ID NO: 978148 - protein, 19 aa, Mycobacterium
IFAGYTILRLLGSGGMGEV

SEQ ID NO: 978149 - protein, 25 aa, Mycobacterium
IFATGLGLFMIFLDAFIVNVALPDI

SEQ ID NO: 978150 - protein, 19 aa, Mycobacterium
IFGLWGIFVLAPKLEPIAE

SEQ ID NO: 978151 - protein, 25 aa, Mycobacterium
IGAALYALLVNRWPLPEAGADSGFA

SEQ ID NO: 978152 - protein, 23 aa, Mycobacterium
IGAPVWLRIFGVATVVSLVVAAD

SEQ ID NO: 978153 - protein, 18 aa, Mycobacterium
IGAQPLAFLLGGHLGGWL

SEQ ID NO: 978154 - protein, 17 aa, Mycobacterium
IGAVLVPLSTLLRPREL

SEQ ID NO: 978155 - protein, 18 aa, Mycobacterium
IGDRPGVDALLKDMREFT

SEQ ID NO: 978156 - protein, 21 aa, Mycobacterium
IGFTVWMLWSIVVVQMMAVGA

SEQ ID NO: 978157 - protein, 24 aa, Mycobacterium
IGFVYAFFVGFMVSALWSQINNED

SEQ ID NO: 978158 - protein, 24 aa, Mycobacterium
IGGQLTVWLSWPYGVRGVLAGFGA

SEQ ID NO: 978159 - protein, 17 aa, Mycobacterium
IGKVVLTMPSALADGLA

SEQ ID NO: 978160 - protein, 31 aa, Mycobacterium
IGLFDTWPELILPYITFALPLAIYTLSAFFR

SEQ ID NO: 978161 - protein, 20 aa, Mycobacterium
IGLGLLFDTLIVRAFMTPSI

SEQ ID NO: 978162 - protein, 20 aa, Mycobacterium
IGLGLLFDTLIVRSFMTPSI

SEQ ID NO: 978163 - protein, 18 aa, Mycobacterium
IGLLLGGIFVLGALVVRK

SEQ ID NO: 978164 - protein, 23 aa, Mycobacterium
IGLLSRLWVLPIHRASGLLARIL

SEQ ID NO: 978165 - protein, 28 aa, Mycobacterium
IGLSLLPVLVLLVLWRARRRGPDDPPAR

SEQ ID NO: 978166 - protein, 24 aa, Mycobacterium
IGMGLLFDTLIVRSFMTPSIAALL

SEQ ID NO: 978167 - protein, 25 aa, Mycobacterium
IGNLLQMAFRFWAFRRWVFPDEFAR

SEQ ID NO: 978168 - protein, 27 aa, Mycobacterium
IGQIFDGALLIVIFATSGALDDVATKH

SEQ ID NO: 978169 - protein, 17 aa, Mycobacterium
IGQRPWTNLIGLLGQAG

SEQ ID NO: 978170 - protein, 30 aa, Mycobacterium; identical to SEQ ID NO: 358718

SEQ ID NO: 978171 - protein, 25 aa, Mycobacterium
IGSEFLDVLAWVPDPRDPRGRRYSL

SEQ ID NO: 978172 - protein, 24 aa, Mycobacterium
IGSFPILSVFGFVVMFGGVVFAIS

SEQ ID NO: 978173 - protein, 22 aa, Mycobacterium
IGTPYFFQRVTGAAVATLVAVA

SEQ ID NO: 978174 - protein, 17 aa, Mycobacterium
IGVLPRWQPVAILSVLA

SEQ ID NO: 978175 - protein, 29 aa, Mycobacterium
IGVPIFFVLSGFLLFRPWVHSAVTGAPPP

SEQ ID NO: 978176 - protein, 22 aa, Mycobacterium
IGVPSVLLYRVLTCWLPVFLGW

SEQ ID NO: 978177 - protein, 28 aa, Mycobacterium
IGVVIATLALIAIPLMLGTPVQVVLLRA

SEQ ID NO: 978178 - protein, 23 aa, Mycobacterium
IGWTMMHYLPATPGFRFIDHTVI

SEQ ID NO: 978179 - protein, 17 aa, Mycobacterium
IHSGLAVPRPLLALISE

SEQ ID NO: 978180 - protein, 22 aa, Mycobacterium
IIGSLVLVLGLVAAFVGLKLYQ

SEQ ID NO: 978181 - protein, 28 aa, Mycobacterium
IISFVIGRPLIWLSFRNEKLNAAFRYAL

SEQ ID NO: 978182 - protein, 18 aa, Mycobacterium
IITTPSWLEVPLAMRDGL

SEQ ID NO: 978183 - protein, 17 aa, Mycobacterium
IIVVITALAFDFTNGFH

SEQ ID NO: 978184 - protein, 25 aa, Mycobacterium
IKAPLWPFHRWLPDAAVESTPATAV

SEQ ID NO: 978185 - protein, 33 aa, Mycobacterium
IKIATFTVIIVLMLFFFRSVPTVLVLLGVVGIQ

SEQ ID NO: 978186 - protein, 26 aa, Mycobacterium
IKPFVDWLANIPFLQALFSGFDPYLL

SEQ ID NO: 978187 - protein, 26 aa, Mycobacterium
IKVSVFGVVMLVLAAALVVVFGDFRF

SEQ ID NO: 978188 - protein, 25 aa, Mycobacterium
ILAIPHYIVLVFLYLGAFVATVIAF

SEQ ID NO: 978189 - protein, 30 aa, Mycobacterium; identical to SEQ ID NO: 358877

SEQ ID NO: 978190 - protein, 33 aa, Mycobacterium; identical to SEQ ID NO: 358883

SEQ ID NO: 978191 - protein, 21 aa, Mycobacterium
ILAVTGYLIFKPSGQAPVKRV

SEQ ID NO: 978192 - protein, 18 aa, Mycobacterium
ILCRRYVAVIAADRQYAV

SEQ ID NO: 978193 - protein, 24 aa, Mycobacterium
ILDQHLYFVLNAPAAKTGGTAASA

SEQ ID NO: 978194 - protein, 18 aa, Mycobacterium
ILEGRELWQRVQAAVSVL

SEQ ID NO: 978195 - protein, 24 aa, Mycobacterium
ILGAINLLPLLPFDGGHIAVAVFE

SEQ ID NO: 978196 - protein, 29 aa, Mycobacterium
ILGLLVIAIMVAWRWAPAKVAPVPGPLVA

SEQ ID NO: 978197 - protein, 19 aa, Mycobacterium
ILGVVYLKDLVRQTFCAPD

SEQ ID NO: 978198 - protein, 25 aa, Mycobacterium
ILHRRYKQFGALPLLAPLLAAATVT

SEQ ID NO: 978199 - protein, 35 aa, Mycobacterium
ILIARNDRYWGPPAKPGLILFRRAGAPATLADSVR

SEQ ID NO: 978200 - protein, 21 aa, Mycobacterium
ILIPLQLIILARAAGPARLGR

SEQ ID NO: 978201 - protein, 17 aa, Mycobacterium
ILNIYRKYYGTKMMLTL

SEQ ID NO: 978202 - protein, 24 aa, Mycobacterium
ILQLWVPQIPLWVLSLGLLLALTA

SEQ ID NO: 978203 - protein, 22 aa, Mycobacterium
ILSAALNLLGAFLSTAVAATIA

SEQ ID NO: 978204 - protein, 29 aa, Mycobacterium
ILSFLADPYKYFLEFFQRMGFSPAVAVIL

SEQ ID NO: 978205 - protein, 27 aa, Mycobacterium
ILTAALLILLMFLWSAAYSSLFYLVAL

SEQ ID NO: 978206 - protein, 17 aa, Mycobacterium
ILTFRTTGRRVFRMAPF

SEQ ID NO: 978207 - protein, 28 aa, Mycobacterium
ILTTVFGFLVLVLLLSALNATVFASAPQ

SEQ ID NO: 978208 - protein, 43 aa, Mycobacterium; identical to SEQ ID NO: 358972

SEQ ID NO: 978209 - protein, 17 aa, Mycobacterium
ILVFVLLGSFILPHTGN

SEQ ID NO: 978210 - protein, 19 aa, Mycobacterium
ILVMGFPVLLKLTSNELGP

SEQ ID NO: 978211 - protein, 27 aa, Mycobacterium
IMVSIPLTVLLIFTLNVLLAQFGAADI

SEQ ID NO: 978212 - protein, 18 aa, Mycobacterium
IMYMVACFIFFFIGGLMA

SEQ ID NO: 978213 - protein, 17 aa, Mycobacterium
IMYVVTCFIFFLIGGLL

SEQ ID NO: 978214 - protein, 26 aa, Mycobacterium
INCGYPLIERFPLMLGTAGTVLLIGL

SEQ ID NO: 978215 - protein, 23 aa, Mycobacterium
INIVLYILGAWLFALSTSGVEGF

SEQ ID NO: 978216 - protein, 18 aa, Mycobacterium
INTALVVPQLSRGDWRLR

SEQ ID NO: 978217 - protein, 24 aa, Mycobacterium
IPAGWKLWLYGVFAITAVGVTSSS

SEQ ID NO: 978218 - protein, 24 aa, Mycobacterium
IPAKLLVTLLVCSILSVAVVGVIG

SEQ ID NO: 978219 - protein, 35 aa, Mycobacterium; identical to SEQ ID NO: 359059

SEQ ID NO: 978220 - protein, 32 aa, Mycobacterium
IPCVCALFTLLPGSLWWLVTVDAMHTQVVTAK

SEQ ID NO: 978221 - protein, 32 aa, Mycobacterium
IPCVCALLTLLPDNLWWLVTVDAMHTQVVTAK

SEQ ID NO: 978222 - protein, 26 aa, Mycobacterium
IPCVRALLTLLPDNLRWLVTVDAIHT

SEQ ID NO: 978223 - protein, 27 aa, Mycobacterium
IPCVRALLTLLPDNLRWLVTVDAIHTQ

SEQ ID NO: 978224 - protein, 25 aa, Mycobacterium
IPIILIWLLLTIAVNVFVPQIEFVA

SEQ ID NO: 978225 - protein, 25 aa, Mycobacterium
IPLSFLFALLPLFVVRSLIGMYQIR

SEQ ID NO: 978226 - protein, 24 aa, Mycobacterium
IPRMYSLHILLLPGIILALIGMHM

SEQ ID NO: 978227 - protein, 25 aa, Mycobacterium
IPSLALFVVLPLIIKMRILQEANVI

SEQ ID NO: 978228 - protein, 17 aa, Mycobacterium
IPVLKANGYRLVTVSEL

SEQ ID NO: 978229 - protein, 25 aa, Mycobacterium
IQDYKGDYLVFNLNLNLPPPCTTGF

SEQ ID NO: 978230 - protein, 23 aa, Mycobacterium
IQGSFLGMSLHEPYLMGCLNARN

SEQ ID NO: 978231 - protein, 43 aa, Mycobacterium; identical to SEQ ID NO: 359134

SEQ ID NO: 978232 - protein, 19 aa, Mycobacterium
IQMAIFAIVATTALLIMVF

SEQ ID NO: 978233 - protein, 30 aa, Mycobacterium; identical to SEQ ID NO: 359144

SEQ ID NO: 978234 - protein, 23 aa, Mycobacterium
IRDTVLVLGAILVAVVVVLLVAR

SEQ ID NO: 978235 - protein, 19 aa, Mycobacterium
IRKRWDRYAKFAEKTFNVT

SEQ ID NO: 978236 - protein, 19 aa, Mycobacterium
IRLPPWPERVPWTAGTKRK

SEQ ID NO: 978237 - protein, 22 aa, Mycobacterium
IRLRLIISCALVLIPWTVFLGL

SEQ ID NO: 978238 - protein, 25 aa, Mycobacterium
IRLRPWKWVPFTKGDRRTLLDVALY

SEQ ID NO: 978239 - protein, 19 aa, Mycobacterium
IRLSRRTLNTIKTNLFWAF

SEQ ID NO: 978240 - protein, 30 aa, Mycobacterium; identical to SEQ ID NO: 359172

SEQ ID NO: 978241 - protein, 21 aa, Mycobacterium
IRQVLMVQLWFQPFFDDSSWD

SEQ ID NO: 978242 - protein, 20 aa, Mycobacterium
IRWLTDWPLWADGAVFLIVS

SEQ ID NO: 978243 - protein, 25 aa, Mycobacterium
ISHQRWLRWPARVYTDIFRGLPEVV

SEQ ID NO: 978244 - protein, 18 aa, Mycobacterium
ISLLIVALAAWYYKLNVN

SEQ ID NO: 978245 - protein, 27 aa, Mycobacterium
ISSLCLIFIIMLILTRAFVAAAVIVGT

SEQ ID NO: 978246 - protein, 23 aa, Mycobacterium
ISTALWQYLAGREIPAAVPLVSF

SEQ ID NO: 978247 - protein, 23 aa, Mycobacterium
ITAHLMAPIPRPSQLRPDIPATF

SEQ ID NO: 978248 - protein, 17 aa, Mycobacterium
ITAVVIANLIFTLTQAK

SEQ ID NO: 978249 - protein, 25 aa, Mycobacterium
ITAYVLTFGGLMLLGGRLGDTIGRK

SEQ ID NO: 978250 - protein, 23 aa, Mycobacterium
ITDIFFGLPLLLAAIVLMQVMHH

SEQ ID NO: 978251 - protein, 23 aa, Mycobacterium
ITGAAIFFFLFVHVLDTALVRVR

SEQ ID NO: 978252 - protein, 19 aa, Mycobacterium
ITGFARVVLLAAILGAALS

SEQ ID NO: 978253 - protein, 23 aa, Mycobacterium
ITGPAIWISFLIAAGTCALAALC

SEQ ID NO: 978254 - protein, 17 aa, Mycobacterium
ITGWVPLITVGSPLLMT

SEQ ID NO: 978255 - protein, 24 aa, Mycobacterium
ITHGLLWSVIAPIATRLVPPSHAG

SEQ ID NO: 978256 - protein, 17 aa, Mycobacterium
ITRTLCLFVIAFGLYMV

SEQ ID NO: 978257 - protein, 27 aa, Mycobacterium
ITTTKPPPPPPPPPPPPSTEIPTATET

SEQ ID NO: 978258 - protein, 17 aa, Mycobacterium
ITVIIWLVSIMIVLTGV

SEQ ID NO: 978259 - protein, 21 aa, Mycobacterium
ITYAMFAWLPVIVTSAGGSEA

SEQ ID NO: 978260 - protein, 23 aa, Mycobacterium
IVAAKLVFLVIWMGAATSKLNRH

SEQ ID NO: 978261 - protein, 23 aa, Mycobacterium
IVAAVLFHRLVVLIGVALIVWAT

SEQ ID NO: 978262 - protein, 21 aa, Mycobacterium
IVALMLLGMPPLLAGTYAGIA

SEQ ID NO: 978263 - protein, 25 aa, Mycobacterium
IVALSLLTAVLLAGAGILGGALWLD

SEQ ID NO: 978264 - protein, 42 aa, Mycobacterium
IVDTLVVRIFTVPAIMGLLGRWFWWSPPPFLRASLAGPRRWG

SEQ ID NO: 978265 - protein, 23 aa, Mycobacterium
IVFPSSPHVYRPGLPMPATEHGA

SEQ ID NO: 978266 - protein, 22 aa, Mycobacterium
IVGALLVMSLLITPAAAAARVV

SEQ ID NO: 978267 - protein, 17 aa, Mycobacterium
IVGLAALGGWFYWDRVE

SEQ ID NO: 978268 - protein, 27 aa, Mycobacterium
IVGVMLSMFLLAFAGIPLTSGFISKFS

SEQ ID NO: 978269 - protein, 17 aa, Mycobacterium
IVLLLLTLGLEFSATEF

SEQ ID NO: 978270 - protein, 21 aa, Mycobacterium
IVLLLVFTAFVANSALHVKPS

SEQ ID NO: 978271 - protein, 37 aa, Mycobacterium; identical to SEQ ID NO: 359452

SEQ ID NO: 978272 - protein, 35 aa, Mycobacterium
IVLSAAINFLLIALVVYFLVVLPYTTIRKHGEVEQ

SEQ ID NO: 978273 - protein, 28 aa, Mycobacterium
IVLVLMALTYHRLPWRALPVESPPPAEV

SEQ ID NO: 978274 - protein, 18 aa, Mycobacterium
IVLYVLVAFVAVGNLDVA

SEQ ID NO: 978275 - protein, 17 aa, Mycobacterium
IVMVSWLLLAVFRGRLH

SEQ ID NO: 978276 - protein, 18 aa, Mycobacterium
IVNKRMVWILDGYTTLDN

SEQ ID NO: 978277 - protein, 18 aa, Mycobacterium
IVSIWMLGGLTIFCLGLI

SEQ ID NO: 978278 - protein, 20 aa, Mycobacterium
IVSWIAVILLTFHWARVVWQ

SEQ ID NO: 978279 - protein, 27 aa, Mycobacterium
IVTAAAVIAILFLLRARQAIRIVVIML

SEQ ID NO: 978280 - protein, 24 aa, Mycobacterium
IVTLRGVLLLAFPKAFVSAANSMI

SEQ ID NO: 978281 - protein, 23 aa, Mycobacterium
IVTPRVMQFTLRANVPKLADIRI

SEQ ID NO: 978282 - protein, 18 aa, Mycobacterium
IVVIVLIAAAVTALIVLS

SEQ ID NO: 978283 - protein, 27 aa, Mycobacterium
IVVSSDLAEWEWVKWLPHFGDSRRYDA

SEQ ID NO: 978284 - protein, 27 aa, Mycobacterium
IVVVIALVTLLIWWTSDARATVSRPAA

SEQ ID NO: 978285 - protein, 19 aa, Mycobacterium
IWAAIFVWELARPPIWMLV

SEQ ID NO: 978286 - protein, 17 aa, Mycobacterium
IWALALVYFGIAYGLYA

SEQ ID NO: 978287 - protein, 46 aa, Mycobacterium; identical to SEQ ID NO: 359539

SEQ ID NO: 978288 - protein, 25 aa, Mycobacterium
IWQIGRPWYLAWAGLVYVVATLATL

SEQ ID NO: 978289 - protein, 27 aa, Mycobacterium
IWTRTSPPWAFFSLPTRAWELAVGGLV

SEQ ID NO: 978290 - protein, 30 aa, Mycobacterium
IYLNVCIREVLWPIVLPGVRVSRVADGIGA

SEQ ID NO: 978291 - protein, 26 aa, Mycobacterium
KAAVLALTLVLFLVGGAAGLLIGTWL

SEQ ID NO: 978292 - protein, 19 aa, Mycobacterium
KAGGALRALAALGAKDVTV

SEQ ID NO: 978293 - protein, 19 aa, Mycobacterium
KALEPSFVPPPASAARAPS

SEQ ID NO: 978294 - protein, 22 aa, Mycobacterium
KAPAIVLLSFIPMYMIAVAYQE

SEQ ID NO: 978295 - protein, 20 aa, Mycobacterium
KAVVGSFKPSLHLPGDTTTL

SEQ ID NO: 978296 - protein, 38 aa, Mycobacterium; identical to SEQ ID NO: 359625

SEQ ID NO: 978297 - protein, 25 aa, Mycobacterium
KDPVFLDWLVGLAFPCQRPFGHQNG

SEQ ID NO: 978298 - protein, 29 aa, Mycobacterium
KDQRNAFLAPWRLALVPVVSWTIGSALFA

SEQ ID NO: 978299 - protein, 25 aa, Mycobacterium
KEDKRLLPYMIGAFVLIVGISVAVG

SEQ ID NO: 978300 - protein, 18 aa, Mycobacterium
KEMYLKSSAALQQALRDN

SEQ ID NO: 978301 - protein, 41 aa, Mycobacterium
KEQVIMPSIPQSLLWISLVVLWLFVLVPMLISKRDVVRRIS

SEQ ID NO: 978302 - protein, 24 aa, Mycobacterium
KFAAWMVFVPVWSIAVYSVVAHWV

SEQ ID NO: 978303 - protein, 17 aa, Mycobacterium
KFAQLVGLVFAVCGVAG

SEQ ID NO: 978304 - protein, 20 aa, Mycobacterium
KFFTPWGRQFWRITSEYFIG

SEQ ID NO: 978305 - protein, 37 aa, Mycobacterium; identical to SEQ ID NO: 359658

SEQ ID NO: 978306 - protein, 19 aa, Mycobacterium
KFKMAKHFHLDITDTTLTV

SEQ ID NO: 978307 - protein, 25 aa, Mycobacterium
KFMMALVLLMLPVDRLGYRENAANR

SEQ ID NO: 978308 - protein, 18 aa, Mycobacterium
KFRNSPFIWWAVTSVVAL

SEQ ID NO: 978309 - protein, 23 aa, Mycobacterium
KGEPSLPVVPWVISARSAEALTA

SEQ ID NO: 978310 - protein, 28 aa, Mycobacterium
KGPGSKAPWLIIAGVAVLGVLALVVVLV

SEQ ID NO: 978311 - protein, 25 aa, Mycobacterium
KGPLVFDLGICLVLITLPTLALFVA

SEQ ID NO: 978312 - protein, 25 aa, Mycobacterium
KGRSFRIHILFASQTLDFGKIKDID

SEQ ID NO: 978313 - protein, 23 aa, Mycobacterium
KGRSFRIHILFASQTLDVGKIKD

SEQ ID NO: 978314 - protein, 17 aa, Mycobacterium
KGWQRLLGTVLGVPCGV

SEQ ID NO: 978315 - protein, 22 aa, Mycobacterium
KGYLVLTAFASLRRLTACFAVL

SEQ ID NO: 978316 - protein, 23 aa, Mycobacterium
KHCFDVPICWSFRSLFDSLDGID

SEQ ID NO: 978317 - protein, 29 aa, Mycobacterium
KHRGELVYLPPAWFASYPPPRLPAVMMIG

SEQ ID NO: 978318 - protein, 22 aa, Mycobacterium
KHSWLDALSSAGALLGLCGVAM

SEQ ID NO: 978319 - protein, 21 aa, Mycobacterium
KILFTLGIVVLYRLGAALPSP

SEQ ID NO: 978320 - protein, 20 aa, Mycobacterium
KIPKGVLLYGPPGTGKTLLA

SEQ ID NO: 978321 - protein, 18 aa, Mycobacterium
KLARVLVADGRRVVLGAA

SEQ ID NO: 978322 - protein, 26 aa, Mycobacterium
KLEAFATFNIFYQAGILLGPLVGLAL

SEQ ID NO: 978323 - protein, 24 aa, Mycobacterium
KLESRIIIDSMHLGRHLGISDLMV

SEQ ID NO: 978324 - protein, 17 aa, Mycobacterium
KLFGWWGGSGVTAFKNS

SEQ ID NO: 978325 - protein, 24 aa, Mycobacterium
KLNLAWAFGYNIAAIPIAAAGVLN

SEQ ID NO: 978326 - protein, 19 aa, Mycobacterium
KLRDALFDAFHPKGADGKP

SEQ ID NO: 978327 - protein, 36 aa, Mycobacterium
KLRSARHFHWGWVVALLMMVLALAAIAILGTVLLTR

SEQ ID NO: 978328 - protein, 25 aa, Mycobacterium
KLRVRMWFFPWLPILTVVGIFVVLV

SEQ ID NO: 978329 - protein, 30 aa, Mycobacterium; identical to SEQ ID NO: 377798

SEQ ID NO: 978330 - protein, 28 aa, Mycobacterium
KLTKRQRFWISLYLPLTMRSLANAILVP

SEQ ID NO: 978331 - protein, 31 aa, Mycobacterium
KLVFKVLGMLLWLAPIGAFGWIASIIGATGW

SEQ ID NO: 978332 - protein, 26 aa, Mycobacterium
KLWSVIPKLFVWPPARSIATLLERLS

SEQ ID NO: 978333 - protein, 27 aa, Mycobacterium
KMAAVAKRRGWPILKFNSRGGVGIGAQ

SEQ ID NO: 978334 - protein, 20 aa, Mycobacterium
KNFYYFPDQLSIDRYFDRNN

SEQ ID NO: 978335 - protein, 26 aa, Mycobacterium
KNSRRWWAWMLLAGPGWVIFGAAKQI

SEQ ID NO: 978336 - protein, 25 aa, Mycobacterium
KNSTNMMFLVLLLAGFGWMISSRMV

SEQ ID NO: 978337 - protein, 19 aa, Mycobacterium
KNVFTMMMGLPRLYRIPVH

SEQ ID NO: 978338 - protein, 25 aa, Mycobacterium
KPAESLLRLPPPGENWRLVTGGGGT

SEQ ID NO: 978339 - protein, 22 aa, Mycobacterium
KPATLTLDPALRFASLQTVFQH

SEQ ID NO: 978340 - protein, 18 aa, Mycobacterium
KPLVWLHQRFGISETGAV

SEQ ID NO: 978341 - protein, 29 aa, Mycobacterium
KPSAFSTGWALWIVLVCIVFQAVAAVGAL

SEQ ID NO: 978342 - protein, 21 aa, Mycobacterium
KPYIVCGLYVVLLIIAGIGAM

SEQ ID NO: 978343 - protein, 25 aa, Mycobacterium
KQLITIARAFLARPQLLILDEATSS

SEQ ID NO: 978344 - protein, 22 aa, Mycobacterium
KQNPIFDPLQPDDPRDWNAVTT

SEQ ID NO: 978345 - protein, 43 aa, Mycobacterium; identical to SEQ ID NO: 359911

SEQ ID NO: 978346 - protein, 27 aa, Mycobacterium
KRARGKPLRIMILLVIVTAVASALLDN

SEQ ID NO: 978347 - protein, 25 aa, Mycobacterium
KRKPVDVALYALLLIMLVTALFTDG

SEQ ID NO: 978348 - protein, 17 aa, Mycobacterium
KRQLPWLSLAVLAIYLL

SEQ ID NO: 978349 - protein, 18 aa, Mycobacterium
KRQLPWLSLAVLAIYLLA

SEQ ID NO: 978350 - protein, 25 aa, Mycobacterium
KRYIEIAHRLFPRAMLHFEDFGPTN

SEQ ID NO: 978351 - protein, 24 aa, Mycobacterium
KSAGGIFNPLPKLDKDKAAKMAQR

SEQ ID NO: 978352 - protein, 33 aa, Mycobacterium
KSDLFVAIRERLRDMLWTSIFPSINLATDSARE

SEQ ID NO: 978353 - protein, 18 aa, Mycobacterium
KSHYLMIVKSRAPALLIS

SEQ ID NO: 978354 - protein, 26 aa, Mycobacterium
KSIEQLLVVFPALFAAITTAAGGVPQ

SEQ ID NO: 978355 - protein, 25 aa, Mycobacterium
KSSDNIMLLVLLLAGFGWMVSSRMV

SEQ ID NO: 978356 - protein, 26 aa, Mycobacterium
KSSDNIMLLVLLLAGFGWMVSSRMVR

SEQ ID NO: 978357 - protein, 30 aa, Mycobacterium
KTAAWSWRLLVILAALVALLLVIKKLEIIV

SEQ ID NO: 978358 - protein, 38 aa, Mycobacterium; identical to SEQ ID NO: 360000

SEQ ID NO: 978359 - protein, 31 aa, Mycobacterium
KTRLVPFGEYFPLRWLVGWITQGTKAAAEDR

SEQ ID NO: 978360 - protein, 18 aa, Mycobacterium
KTSINSVLLIFTIGVTWS

SEQ ID NO: 978361 - protein, 28 aa, Mycobacterium
KVDLNDPPPCNVGFLPPPLIRSPADETL

SEQ ID NO: 978362 - protein, 24 aa, Mycobacterium
KVKRLVTRRAAVDEVLLVLDATIG

SEQ ID NO: 978363 - protein, 35 aa, Mycobacterium; identical to SEQ ID NO: 360047

SEQ ID NO: 978364 - protein, 20 aa, Mycobacterium
KVVVLIFVDQTVTNMAVPDP

SEQ ID NO: 978365 - protein, 23 aa, Mycobacterium
KVWSPQFSLWLVPLAVLALPHRR

SEQ ID NO: 978366 - protein, 19 aa, Mycobacterium
KVYTDFYAALFASDFQPQE

SEQ ID NO: 978367 - protein, 17 aa, Mycobacterium
KWILAIPHYIVLVFLYL

SEQ ID NO: 978368 - protein, 22 aa, Mycobacterium
KWSGLYFIAFFGAMSLVFDVAA

SEQ ID NO: 978369 - protein, 23 aa, Mycobacterium
LAAGPPLLRWAPGIRGRTIVVWL

SEQ ID NO: 978370 - protein, 17 aa, Mycobacterium
LAAGVELLWQLPVSSIG

SEQ ID NO: 978371 - protein, 21 aa, Mycobacterium
LAALGGWFYWDRVEARGEAAA

SEQ ID NO: 978372 - protein, 20 aa, Mycobacterium
LAALPTLFIIVDEFAELLSQ

SEQ ID NO: 978373 - protein, 31 aa, Mycobacterium
LAALRRESWYRRYLAVQLLFGSVVLGSSFYS

SEQ ID NO: 978374 - protein, 19 aa, Mycobacterium
LAALYLPAVDARIIDRGIA

SEQ ID NO: 978375 - protein, 19 aa, Mycobacterium
LAAMVIGVALCGVVCFVGF

SEQ ID NO: 978376 - protein, 18 aa, Mycobacterium
LAAPLVLHPGMGVQVQVI

SEQ ID NO: 978377 - protein, 27 aa, Mycobacterium
LAAPNIAPAPWILVLGGEAAAVVGLAA

SEQ ID NO: 978378 - protein, 24 aa, Mycobacterium
LAASLTLLPTLIKLAGPSGQISPQ

SEQ ID NO: 978379 - protein, 25 aa, Mycobacterium
LAASLTLLPTLIKLAGPSGQISPQV

SEQ ID NO: 978380 - protein, 26 aa, Mycobacterium
LAATAFPLQVPWLPLAAPLAVLAIYV

SEQ ID NO: 978381 - protein, 32 aa, Mycobacterium; identical to SEQ ID NO: 360150

SEQ ID NO: 978382 - protein, 20 aa, Mycobacterium
LAAVAVFLLFPLGFSLYMSF

SEQ ID NO: 978383 - protein, 27 aa, Mycobacterium
LAAVGAAITALLFVGSAAFAGAAVQPY

SEQ ID NO: 978384 - protein, 30 aa, Mycobacterium
LAAVVAMAALASWFGFHAYQSHQADQQRKL

SEQ ID NO: 978385 - protein, 25 aa, Mycobacterium
LAAVVEIWMLLGSPAVICSMLSPKA

SEQ ID NO: 978386 - protein, 24 aa, Mycobacterium
LACPIWFYELWAFITPGLYQKERR

SEQ ID NO: 978387 - protein, 26 aa, Mycobacterium
LADFDDFWRPIRSYLYWEKHCYDIAN

SEQ ID NO: 978388 - protein, 17 aa, Mycobacterium
LADRIFRWLAQGAGVLV

SEQ ID NO: 978389 - protein, 26 aa, Mycobacterium
LAEFDDFWRPMRSYFYWEKHCFDVPI

SEQ ID NO: 978390 - protein, 18 aa, Mycobacterium
LAFLLLIAGCTFLFRRLL

SEQ ID NO: 978391 - protein, 17 aa, Mycobacterium
LAGAWIAIVAMGSVFIL

SEQ ID NO: 978392 - protein, 24 aa, Mycobacterium
LAGIGVALVIWASAAVAGTESVGK

SEQ ID NO: 978393 - protein, 26 aa, Mycobacterium
LAHEPPWVGALLGVLFVLTTTLGDLV

SEQ ID NO: 978394 - protein, 22 aa, Mycobacterium
LAIANLMWFVFAGFGALTVETD

SEQ ID NO: 978395 - protein, 19 aa, Mycobacterium
LAIIIAVLIVINSRADSQQ

SEQ ID NO: 978396 - protein, 19 aa, Mycobacterium
LAILVLSGFVGFAVISKVP

SEQ ID NO: 978397 - protein, 25 aa, Mycobacterium
LAITYLPAMNAVFATAPIGAPVWLR

SEQ ID NO: 978398 - protein, 23 aa, Mycobacterium
LAKFHFWLTFLGFHATFLVQHWL

SEQ ID NO: 978399 - protein, 25 aa, Mycobacterium
LAKGLALLVLYGLATVLLAPYGTRG

SEQ ID NO: 978400 - protein, 18 aa, Mycobacterium
LAKNPAERYPTCSDFAAA

SEQ ID NO: 978401 - protein, 33 aa, Mycobacterium; identical to SEQ ID NO: 360350

SEQ ID NO: 978402 - protein, 26 aa, Mycobacterium
LALTVISFFWLWLSANLLSGLLALAT

SEQ ID NO: 978403 - protein, 21 aa, Mycobacterium
LAMALTCWWVISREVIPRLGH

SEQ ID NO: 978404 - protein, 20 aa, Mycobacterium
LAMILSYVWGVRVGGIFTAL

SEQ ID NO: 978405 - protein, 19 aa, Mycobacterium
LAMPLTLVGALGGLALVLV

SEQ ID NO: 978406 - protein, 25 aa, Mycobacterium
LANPGLPLWPYLVCAALSGVGGGNY

SEQ ID NO: 978407 - protein, 23 aa, Mycobacterium
LAPELAGFWTGAFVQGPFNTRIV

SEQ ID NO: 978408 - protein, 17 aa, Mycobacterium
LAPGQEWRMVWDSALDR

SEQ ID NO: 978409 - protein, 46 aa, Mycobacterium; identical to SEQ ID NO: 360381

SEQ ID NO: 978410 - protein, 17 aa, Mycobacterium
LAPLALPQTGTVRMQLV

SEQ ID NO: 978411 - protein, 26 aa, Mycobacterium
LAPYILIWVIIIAYVCHIPFAVRSKR

SEQ ID NO: 978412 - protein, 27 aa, Mycobacterium
LAQHDDLLSNLLQISPIFFREATNITG

SEQ ID NO: 978413 - protein, 17 aa, Mycobacterium
LAQYLFGVRLGLAPVTV

SEQ ID NO: 978414 - protein, 25 aa, Mycobacterium
LARFGHMIAFYLHTVLAIPVALRRY

SEQ ID NO: 978415 - protein, 20 aa, Mycobacterium
LARFVWATAIVWILGGFGTW

SEQ ID NO: 978416 - protein, 19 aa, Mycobacterium
LARLTTAMLTLYFVLAVAA

SEQ ID NO: 978417 - protein, 19 aa, Mycobacterium
LARQLLSLGDIRWIQHRNT

SEQ ID NO: 978418 - protein, 32 aa, Mycobacterium
LARSIYKFAVPIALFWLAVCAIIAAFVPSLKS

SEQ ID NO: 978419 - protein, 31 aa, Mycobacterium; identical to SEQ ID NO: 360430

SEQ ID NO: 978420 - protein, 29 aa, Mycobacterium
LATAVIAVLLLLWARRSLVAAAVVLLTAG

SEQ ID NO: 978421 - protein, 20 aa, Mycobacterium
LATDLGRNLLLEQLHYRHEL

SEQ ID NO: 978422 - protein, 18 aa, Mycobacterium
LATFSWPALRPTATLFLV

SEQ ID NO: 978423 - protein, 24 aa, Mycobacterium
LATRLTMITLIPTVAFMTVGGSAM

SEQ ID NO: 978424 - protein, 25 aa, Mycobacterium
LATRMAFRRLAFADWTLYMVGAALL

SEQ ID NO: 978425 - protein, 23 aa, Mycobacterium
LATRVGFPSMLLFLLVGVIVGED

SEQ ID NO: 978426 - protein, 26 aa, Mycobacterium
LAVERLFRAMVLRLAAWAVWDFRGAR

SEQ ID NO: 978427 - protein, 26 aa, Mycobacterium
LAVGMALLAGLLAGVSLLPKVKSYGA

SEQ ID NO: 978428 - protein, 35 aa, Mycobacterium; identical to SEQ ID NO: 360496

SEQ ID NO: 978429 - protein, 37 aa, Mycobacterium
LAVLISSSFILVQFLTQAWIWQITLINIAATLVFATV

SEQ ID NO: 978430 - protein, 17 aa, Mycobacterium
LAVLLAGPTPALLARAT

SEQ ID NO: 978431 - protein, 18 aa, Mycobacterium
LAVLTIVVTIAINTFGGN

SEQ ID NO: 978432 - protein, 19 aa, Mycobacterium
LAVPRPLLALISEAAAHTE

SEQ ID NO: 978433 - protein, 34 aa, Mycobacterium
LAVRGRVSLGRRVVSLPWRLANIQDLPAIDASAQ

SEQ ID NO: 978434 - protein, 24 aa, Mycobacterium
LAVTLLSLIAIAVPYVGPWRLSGT

SEQ ID NO: 978435 - protein, 26 aa, Mycobacterium
LAVVAALAVLVTAFTLLHDRPAPVMS

SEQ ID NO: 978436 - protein, 17 aa, Mycobacterium
LAVVCGLLTLITARRRG

SEQ ID NO: 978437 - protein, 20 aa, Mycobacterium
LAVVYLGIGLLLACIVLRGL

SEQ ID NO: 978438 - protein, 22 aa, Mycobacterium
LAWVLGVTLLLMVVAFAALVAN

SEQ ID NO: 978439 - protein, 26 aa, Mycobacterium
LAYGLGWRPRLLVAMLVATALALVGT

SEQ ID NO: 978440 - protein, 18 aa, Mycobacterium
LAYIDPLAMFDTFGVVSQ

SEQ ID NO: 978441 - protein, 25 aa, Mycobacterium
LAYVAIFSLPLAQRKFFLDPSNLAT

SEQ ID NO: 978442 - protein, 33 aa, Mycobacterium; identical to SEQ ID NO: 360561

SEQ ID NO: 978443 - protein, 20 aa, Mycobacterium
LCEEILYRGLLWGALERRWG

SEQ ID NO: 978444 - protein, 24 aa, Mycobacterium
LCGRRLFWPFIPRAEDTTALDSGF

SEQ ID NO: 978445 - protein, 21 aa, Mycobacterium
LCLALMHYRGWAIPVAFVIAQ

SEQ ID NO: 978446 - protein, 25 aa, Mycobacterium
LCPQNLDYLISFFGALYSGRIAVPL

SEQ ID NO: 978447 - protein, 22 aa, Mycobacterium
LCVYPWSPFSLVNGSVSFVGVE

SEQ ID NO: 978448 - protein, 24 aa, Mycobacterium
LDARHPFLVMELIEGGTLRELLSE

SEQ ID NO: 978449 - protein, 24 aa, Mycobacterium
LDEYIKFLVTWQRPLVGKKTMMDL

SEQ ID NO: 978450 - protein, 18 aa, Mycobacterium
LDGDSARWPGIRGVALVA

SEQ ID NO: 978451 - protein, 29 aa, Mycobacterium
LDGETLTRMVNLLLAVSMFAADPALWQIT

SEQ ID NO: 978452 - protein, 22 aa, Mycobacterium
LDLPPTLIFDHPTPHALTQHLH

SEQ ID NO: 978453 - protein, 17 aa, Mycobacterium
LDLTIRLAEVMLSSGSG

SEQ ID NO: 978454 - protein, 18 aa, Mycobacterium
LDNARFLLPVVGVPPDRD

SEQ ID NO: 978455 - protein, 25 aa, Mycobacterium
LDNSTPLFAFLFLAALGVDYTIFLV

SEQ ID NO: 978456 - protein, 37 aa, Mycobacterium
LDPDTPFRLDHVVNFLATLGLWVAIIVALAGVALVSW

SEQ ID NO: 978457 - protein, 24 aa, Mycobacterium
LDQGALTAFLSWLESRPSPRAQKR

SEQ ID NO: 978458 - protein, 18 aa, Mycobacterium
LDQLPSPVSWFGRPGSMA

SEQ ID NO: 978459 - protein, 27 aa, Mycobacterium
LDQVQLVLMYLYITLRGAIAMVTLVAD

SEQ ID NO: 978460 - protein, 21 aa, Mycobacterium
LDRDLQLVLNSLWASGAEAVS

SEQ ID NO: 978461 - protein, 19 aa, Mycobacterium
LDRFLPVWIGLAMAAGLLL

SEQ ID NO: 978462 - protein, 19 aa, Mycobacterium
LDRLLRLKVFPLAISLPWG

SEQ ID NO: 978463 - protein, 27 aa, Mycobacterium
LDRTLVLWMLPLLIAPPMYSKDVYSYL

SEQ ID NO: 978464 - protein, 33 aa, Mycobacterium
LDTFVVRTLVIPALFTLIGDRIWWPSDPKTTAH

SEQ ID NO: 978465 - protein, 17 aa, Mycobacterium
LDTLFRLDHLAARLRRN

SEQ ID NO: 978466 - protein, 18 aa, Mycobacterium
LDVLLFYVFFEAMLIPMY

SEQ ID NO: 978467 - protein, 27 aa, Mycobacterium
LEAYAVVSLILFVNWIRVLVAHRYESE

SEQ ID NO: 978468 - protein, 27 aa, Mycobacterium
LEDIIRFQAEFLWRDYFQPGITVDGEE

SEQ ID NO: 978469 - protein, 19 aa, Mycobacterium
LEEGALSLLTPFAAFLLAQ

SEQ ID NO: 978470 - protein, 24 aa, Mycobacterium
LEFWAALIKVIALVIFLIIGVDLP

SEQ ID NO: 978471 - protein, 22 aa, Mycobacterium
LEGLGFAYNVYFKRGPNDPPEV

SEQ ID NO: 978472 - protein, 18 aa, Mycobacterium
LELAPNPVALMQVGLTTA

SEQ ID NO: 978473 - protein, 17 aa, Mycobacterium
LEPLFPTPPLPMKPLAQ

SEQ ID NO: 978474 - protein, 28 aa, Mycobacterium
LEQLHYRHELLYYKVLTEHLVELMPVVY

SEQ ID NO: 978475 - protein, 25 aa, Mycobacterium
LESYNKTWLRFAAVAVVAVVIAAML

SEQ ID NO: 978476 - protein, 18 aa, Mycobacterium
LFCIAVGFLALVFASSTT

SEQ ID NO: 978477 - protein, 33 aa, Mycobacterium; identical to SEQ ID NO: 360773

SEQ ID NO: 978478 - protein, 21 aa, Mycobacterium
LFDTAVLHRLPVTTWDVRCAP

SEQ ID NO: 978479 - protein, 19 aa, Mycobacterium
LFLGFFILEGFDFGVGMLM

SEQ ID NO: 978480 - protein, 24 aa, Mycobacterium
LFLVATLVFAPRGWVAICAFAMVV

SEQ ID NO: 978481 - protein, 20 aa, Mycobacterium
LFPTLNYAVSVAEACERADA

SEQ ID NO: 978482 - protein, 18 aa, Mycobacterium
LFRLGRTPRRGFWLSWLG

SEQ ID NO: 978483 - protein, 25 aa, Mycobacterium
LFSGRRWVTVLGAFILALAPGWLGV

SEQ ID NO: 978484 - protein, 24 aa, Mycobacterium
LGAAALVVALTRPGNAGSAAAPTT

SEQ ID NO: 978485 - protein, 39 aa, Mycobacterium
LGAAFGLSVLLWQHILHMPLHWLVLPMAVIVMLAVGSDY

SEQ ID NO: 978486 - protein, 35 aa, Mycobacterium; identical to SEQ ID NO: 360870

SEQ ID NO: 978487 - protein, 34 aa, Mycobacterium; identical to SEQ ID NO: 360891

SEQ ID NO: 978488 - protein, 39 aa, Mycobacterium; identical to SEQ ID NO: 360897

SEQ ID NO: 978489 - protein, 26 aa, Mycobacterium
LGDRRSELAPLDRVFAAALAKQPNER

SEQ ID NO: 978490 - protein, 19 aa, Mycobacterium
LGEDYLRLAALGSYGAFFN

SEQ ID NO: 978491 - protein, 33 aa, Mycobacterium
LGELNVPEFPWTVLTIVLLIGVLVAAIGTRFMQ

SEQ ID NO: 978492 - protein, 19 aa, Mycobacterium
LGFGGMSEVHLARDLRLHR

SEQ ID NO: 978493 - protein, 18 aa, Mycobacterium
LGGLATAGLFLFYGAVFV

SEQ ID NO: 978494 - protein, 24 aa, Mycobacterium
LGGWLIEHFSVGSVFWVNVPIAVV

SEQ ID NO: 978495 - protein, 30 aa, Mycobacterium; identical to SEQ ID NO: 360968

SEQ ID NO: 978496 - protein, 19 aa, Mycobacterium
LGLALAWLATVWATAGLAG

SEQ ID NO: 978497 - protein, 30 aa, Mycobacterium
LGLFTPSALVLLFITFGVPQLQLYMSPAML

SEQ ID NO: 978498 - protein, 17 aa, Mycobacterium
LGLGQLFADGRALDWRE

SEQ ID NO: 978499 - protein, 31 aa, Mycobacterium
LGLLAAALGVSILLGVAIGWGLYGNTRSPLD

SEQ ID NO: 978500 - protein, 30 aa, Mycobacterium; identical to SEQ ID NO: 361020

SEQ ID NO: 978501 - protein, 29 aa, Mycobacterium
LGLRNTFWALVLPFLFGSPYAIFLLREHF

SEQ ID NO: 978502 - protein, 28 aa, Mycobacterium
LGLTPSPTPWVVLRLLPQGPTLSRADAL

SEQ ID NO: 978503 - protein, 25 aa, Mycobacterium
LGNKQWLPLIVRIDDPWLAESWRAK

SEQ ID NO: 978504 - protein, 17 aa, Mycobacterium
LGNLPLFAGLDAAALAE

SEQ ID NO: 978505 - protein, 27 aa, Mycobacterium
LGPLYGIFIVWLFHDWRDVFWINVPLT

SEQ ID NO: 978506 - protein, 18 aa, Mycobacterium
LGPPIVALMLLGMPPLLA

SEQ ID NO: 978507 - protein, 30 aa, Mycobacterium; identical to SEQ ID NO: 347833

SEQ ID NO: 978508 - protein, 17 aa, Mycobacterium
LGRLGWFVESKLSPWLN

SEQ ID NO: 978509 - protein, 17 aa, Mycobacterium
LGRLYSAEFYALAAHAL

SEQ ID NO: 978510 - protein, 24 aa, Mycobacterium
LGSTMGILTWIFVDGHGSGVLNFT

SEQ ID NO: 978511 - protein, 25 aa, Mycobacterium
LGSTVLLALLLPYTAYREHVSPFVT

SEQ ID NO: 978512 - protein, 27 aa, Mycobacterium
LGSYGAFFNIYFCTVTIKINGPAGSDI

SEQ ID NO: 978513 - protein, 27 aa, Mycobacterium
LGTITLGFLLMPLATRALSFWLNPGVP

SEQ ID NO: 978514 - protein, 18 aa, Mycobacterium
LGTLLMLLVGFISSLPFA

SEQ ID NO: 978515 - protein, 39 aa, Mycobacterium
LGTLTAFIYSTYQLFAGGPLFFDTAALIIAFVVLGRYFE

SEQ ID NO: 978516 - protein, 23 aa, Mycobacterium
LGTPVQVVLLRAMTFMIVASPCA

SEQ ID NO: 978517 - protein, 25 aa, Mycobacterium
LGTQPLATRLVAAPLPPPHRSDPVT

SEQ ID NO: 978518 - protein, 19 aa, Mycobacterium
LGTVLLYFAAQHAGADGAN

SEQ ID NO: 978519 - protein, 17 aa, Mycobacterium
LGTVPTGLLAYRYRLRV

SEQ ID NO: 978520 - protein, 35 aa, Mycobacterium; identical to SEQ ID NO: 361120

SEQ ID NO: 978521 - protein, 25 aa, Mycobacterium
LGVALTLSRLLAGLAPGLDLGLTLA

SEQ ID NO: 978522 - protein, 25 aa, Mycobacterium
LGVASIVVFIPMLSAAIGATTMRFL

SEQ ID NO: 978523 - protein, 27 aa, Mycobacterium
LGVLVIGIMVAWRWAPAKVAAVPGPLV

SEQ ID NO: 978524 - protein, 18 aa, Mycobacterium
LGVLVVCAGLELGGPEGQ

SEQ ID NO: 978525 - protein, 24 aa, Mycobacterium
LGVVLLIVDALRERQQREAASKDQ

SEQ ID NO: 978526 - protein, 36 aa, Mycobacterium
LGWTAVTPVLWWIGPFLLYLLLPALDVFFGPDGENP

SEQ ID NO: 978527 - protein, 30 aa, Mycobacterium
LGYIAIYFGLIIFFTYFYVSITFNPDERAD

SEQ ID NO: 978528 - protein, 20 aa, Mycobacterium
LGYLAIIGVPPFAGFFSKDA

SEQ ID NO: 978529 - protein, 22 aa, Mycobacterium
LGYLRRQLLLLTAFTTGVLLIC

SEQ ID NO: 978530 - protein, 26 aa, Mycobacterium
LHDFRGPLIVSLLLVALETGAGLLPP

SEQ ID NO: 978531 - protein, 33 aa, Mycobacterium
LHIPLWLGYAFSTLLIFPLVIYGMKVLSQLQLW

SEQ ID NO: 978532 - protein, 19 aa, Mycobacterium
LHLRQDTIRWVALAALVAI

SEQ ID NO: 978533 - protein, 20 aa, Mycobacterium
LIAAHLMEPPPRPSQLRPGR

SEQ ID NO: 978534 - protein, 25 aa, Mycobacterium
LIAGCTFLFRRLLGTHLRTMFVVLL

SEQ ID NO: 978535 - protein, 17 aa, Mycobacterium
LIAGLVAIIPLYSLAVL

SEQ ID NO: 978536 - protein, 17 aa, Mycobacterium
LIAIHSFVEAALRPVRV

SEQ ID NO: 978537 - protein, 24 aa, Mycobacterium
LIAWAGFALLTWSLAGVAIFAITA

SEQ ID NO: 978538 - protein, 28 aa, Mycobacterium
LIGLAVIAAYLLLTLLLSRLFTPDEVAP

SEQ ID NO: 978539 - protein, 19 aa, Mycobacterium
LIIACPYALGLATPTAIIV

SEQ ID NO: 978540 - protein, 17 aa, Mycobacterium
LILAAWFIPAVPTQARQ

SEQ ID NO: 978541 - protein, 19 aa, Mycobacterium
LIMIAVFCGFAFAGMPLVA

SEQ ID NO: 978542 - protein, 25 aa, Mycobacterium
LIRLVDGLSPWLLLGVAAALVAVAV

SEQ ID NO: 978543 - protein, 19 aa, Mycobacterium
LIRWKDAIIALGLLASLDD

SEQ ID NO: 978544 - protein, 19 aa, Mycobacterium
LISILISVLVAWLMFTWMI

SEQ ID NO: 978545 - protein, 32 aa, Mycobacterium
LISVLPVLSLMVVAVWLLGVGTLKDLALVQLI

SEQ ID NO: 978546 - protein, 19 aa, Mycobacterium
LITIVIWVWTVRLTANWVR

SEQ ID NO: 978547 - protein, 24 aa, Mycobacterium
LITLTYFPPLWRKLMDHRVIEHYD

SEQ ID NO: 978548 - protein, 18 aa, Mycobacterium
LIVAGYIAALGAGALLVK

SEQ ID NO: 978549 - protein, 19 aa, Mycobacterium
LIVIIMMLITRSVVAAAVI

SEQ ID NO: 978550 - protein, 24 aa, Mycobacterium
LIYTDLWIGFTTVSALLILGLAQT

SEQ ID NO: 978551 - protein, 17 aa, Mycobacterium
LIYTWLTVLATLALTPA

SEQ ID NO: 978552 - protein, 28 aa, Mycobacterium
LKACGWAFLIWGLYAYLWAFVLYIVQMT

SEQ ID NO: 978553 - protein, 19 aa, Mycobacterium
LKCLYLVTRSLDPTGTGQK

SEQ ID NO: 978554 - protein, 24 aa, Mycobacterium
LKRGVLLFGKLLPAGIGAIIGAIG

SEQ ID NO: 978555 - protein, 18 aa, Mycobacterium
LKSHYLMIVKSNRAKILA

SEQ ID NO: 978556 - protein, 20 aa, Mycobacterium
LKTRLLFMPGVMVTSVPWQL

SEQ ID NO: 978557 - protein, 21 aa, Mycobacterium
LLAAAMWLLFANRMGYPVSTT

SEQ ID NO: 978558 - protein, 25 aa, Mycobacterium
LLAKGLVYALLTLALLITVNQLEAH

SEQ ID NO: 978559 - protein, 21 aa, Mycobacterium
LLASMLYAMQILAAASMLSKI

SEQ ID NO: 978560 - protein, 26 aa, Mycobacterium
LLDGRIESLLPSILEGRELWQRVQAA

SEQ ID NO: 978561 - protein, 32 aa, Mycobacterium; identical to SEQ ID NO: 361509

SEQ ID NO: 978562 - protein, 17 aa, Mycobacterium
LLELATPYALHAVSDEE

SEQ ID NO: 978563 - protein, 20 aa, Mycobacterium
LLERLPLSSYRRPLLGTGLF

SEQ ID NO: 978564 - protein, 17 aa, Mycobacterium
LLEVTVFISLFALMLAM

SEQ ID NO: 978565 - protein, 18 aa, Mycobacterium
LLEVWPVILVGALAWLSA

SEQ ID NO: 978566 - protein, 17 aa, Mycobacterium
LLFATMLVLGAAAFVYA

SEQ ID NO: 978567 - protein, 18 aa, Mycobacterium
LLFVYRPLVDNIRLSFFD

SEQ ID NO: 978568 - protein, 26 aa, Mycobacterium
LLFYVFFEAMLIPMYFLIGGFGQGRA

SEQ ID NO: 978569 - protein, 24 aa, Mycobacterium
LLGCTPLDRVGWAQALGAAAAATA

SEQ ID NO: 978570 - protein, 17 aa, Mycobacterium
LLGFERWAPDMPWEIST

SEQ ID NO: 978571 - protein, 18 aa, Mycobacterium
LLGMAVLALSYRLWKLRQ

SEQ ID NO: 978572 - protein, 18 aa, Mycobacterium
LLGPLVGLALLTLDFRMT

SEQ ID NO: 978573 - protein, 20 aa, Mycobacterium
LLGQVFVVAALITAALSLDA

SEQ ID NO: 978574 - protein, 25 aa, Mycobacterium
LLGYALQMMKILNLLIADLIVLALD

SEQ ID NO: 978575 - protein, 18 aa, Mycobacterium
LLGYVGLADTARPSARPL

SEQ ID NO: 978576 - protein, 24 aa, Mycobacterium
LLIALVVYFLVVLPYTTIRKHGEV

SEQ ID NO: 978577 - protein, 20 aa, Mycobacterium
LLIGLIRWYIGMAQRTSALA

SEQ ID NO: 978578 - protein, 19 aa, Mycobacterium
LLIKCGIVLLLVFTAFVAN

SEQ ID NO: 978579 - protein, 21 aa, Mycobacterium
LLILLVGFYLTCAVFVFGVLG

SEQ ID NO: 978580 - protein, 17 aa, Mycobacterium
LLISIHSVLLALKGVLM

SEQ ID NO: 978581 - protein, 18 aa, Mycobacterium
LLISNAVVAFAVIGFASL

SEQ ID NO: 978582 - protein, 20 aa, Mycobacterium
LLISSLLLNWVAGPALMFAL

SEQ ID NO: 978583 - protein, 22 aa, Mycobacterium
LLLAIWIGIGFIFRGVATTVSA

SEQ ID NO: 978584 - protein, 17 aa, Mycobacterium
LLLIPQTLAAAAVMPIV

SEQ ID NO: 978585 - protein, 18 aa, Mycobacterium
LLLLFSPPSLRWAGAGDQ

SEQ ID NO: 978586 - protein, 17 aa, Mycobacterium
LLLPTYLGSVPFPISAL

SEQ ID NO: 978587 - protein, 24 aa, Mycobacterium
LLLSALMLMRPLRILTLGGRRQDD

SEQ ID NO: 978588 - protein, 20 aa, Mycobacterium
LLLVLVWVFDCWQLFVRPPR

SEQ ID NO: 978589 - protein, 20 aa, Mycobacterium
LLMVVVLAISGFVVSRLHKI

SEQ ID NO: 978590 - protein, 17 aa, Mycobacterium
LLNAVFGLLIAWGLIRD

SEQ ID NO: 978591 - protein, 18 aa, Mycobacterium
LLPLAQLGGVPLLSTGVA

SEQ ID NO: 978592 - protein, 19 aa, Mycobacterium
LLRSWPAFLAYLVSFVFIG

SEQ ID NO: 978593 - protein, 24 aa, Mycobacterium
LLSATINFILVAGVVYFLVVVPYN

SEQ ID NO: 978594 - protein, 18 aa, Mycobacterium
LLTLLPDNLRWLVTADAM

SEQ ID NO: 978595 - protein, 17 aa, Mycobacterium
LLVALVILVAGGAVLIQ

SEQ ID NO: 978596 - protein, 19 aa, Mycobacterium
LLVASYPEVPKRQWGLPLA

SEQ ID NO: 978597 - protein, 17 aa, Mycobacterium
LLVFHGGIPPLQFWQAL

SEQ ID NO: 978598 - protein, 20 aa, Mycobacterium
LLVKPLLAHAAIAFIAVEVL

SEQ ID NO: 978599 - protein, 18 aa, Mycobacterium
LLVLLPAAGMTAAAVVPN

SEQ ID NO: 978600 - protein, 17 aa, Mycobacterium
LLVLLTVLIEMAAARGI

SEQ ID NO: 978601 - protein, 18 aa, Mycobacterium
LLVVSRWRRGGLRAAVDP

SEQ ID NO: 978602 - protein, 37 aa, Mycobacterium; identical to SEQ ID NO: 361799

SEQ ID NO: 978603 - protein, 19 aa, Mycobacterium
LMFAIITVALISGAVADRL

SEQ ID NO: 978604 - protein, 18 aa, Mycobacterium
LMFVIRTVAFVVWALATV

SEQ ID NO: 978605 - protein, 17 aa, Mycobacterium
LMIAFRLLLVRYRDTAA

SEQ ID NO: 978606 - protein, 25 aa, Mycobacterium
LMLKGAPETILPRCRFADPDADLEH

SEQ ID NO: 978607 - protein, 17 aa, Mycobacterium
LMLNLTALIWIRCAVWL

SEQ ID NO: 978608 - protein, 21 aa, Mycobacterium
LMLTIPYTVLLTFIENILLTE

SEQ ID NO: 978609 - protein, 17 aa, Mycobacterium
LMMLPVPAGFGMASLLA

SEQ ID NO: 978610 - protein, 25 aa, Mycobacterium
LMPMLHLDEPITPAAPLPGAPRRAG

SEQ ID NO: 978611 - protein, 35 aa, Mycobacterium
LMTPLGWRWAALVWAYALFWFLIEDRVKLATHYWL

SEQ ID NO: 978612 - protein, 31 aa, Mycobacterium; identical to SEQ ID NO: 361842

SEQ ID NO: 978613 - protein, 24 aa, Mycobacterium
LMVNLPVMVLYPRGWSEFFRLNTR

SEQ ID NO: 978614 - protein, 20 aa, Mycobacterium
LMVTLSGGALWRFAALMVLS

SEQ ID NO: 978615 - protein, 28 aa, Mycobacterium
LNAWAMSVLLWDVLIAVFGLGLIPFVII

SEQ ID NO: 978616 - protein, 18 aa, Mycobacterium
LNFTWPTHAHLETSGVRS

SEQ ID NO: 978617 - protein, 32 aa, Mycobacterium
LNRSRLGRGWLTGIAVALLLAGCGIGTGGYCM

SEQ ID NO: 978618 - protein, 21 aa, Mycobacterium
LNVYQLYRRVIEDRTGELCDT

SEQ ID NO: 978619 - protein, 35 aa, Mycobacterium
LPAPAIPEPVVAVPPLVPIVVPPVRVPSGVDTFLR

SEQ ID NO: 978620 - protein, 17 aa, Mycobacterium
LPDNLRWLVTVDAIHTQ

SEQ ID NO: 978621 - protein, 33 aa, Mycobacterium; identical to SEQ ID NO: 361936

SEQ ID NO: 978622 - protein, 17 aa, Mycobacterium
LPGFDWPAHPSWLYRLT

SEQ ID NO: 978623 - protein, 24 aa, Mycobacterium
LPGFGLVTAPLRAGALLAATAGST

SEQ ID NO: 978624 - protein, 33 aa, Mycobacterium
LPGILLIVFIETGLLLPLLPGESLLFTGGLLAA

SEQ ID NO: 978625 - protein, 21 aa, Mycobacterium
LPLASIVFLGAFIPLIGALIS

SEQ ID NO: 978626 - protein, 20 aa, Mycobacterium
LPLVPATIVGWGGLALLLLT

SEQ ID NO: 978627 - protein, 17 aa, Mycobacterium
LPPLFAGVVRRPRRRQI

SEQ ID NO: 978628 - protein, 19 aa, Mycobacterium
LPRLVHLACIWIVAISVNV

SEQ ID NO: 978629 - protein, 18 aa, Mycobacterium
LPSAFRPATDPNSPTGLR

SEQ ID NO: 978630 - protein, 28 aa, Mycobacterium
LPTLGVLLLGVLLFGLGLGPPIVALMLL

SEQ ID NO: 978631 - protein, 24 aa, Mycobacterium
LPVFVVLVYLVLCAVASLLLSMVQ

SEQ ID NO: 978632 - protein, 19 aa, Mycobacterium
LPVLTVRDLAFRPVSDQTS

SEQ ID NO: 978633 - protein, 24 aa, Mycobacterium
LPVSLPRTAVVAALVLAVCAVPVI

SEQ ID NO: 978634 - protein, 34 aa, Mycobacterium; identical to SEQ ID NO: 362062

SEQ ID NO: 978635 - protein, 18 aa, Mycobacterium
LQARRNLHDLLLAATSRA

SEQ ID NO: 978636 - protein, 48 aa, Mycobacterium
LQDLPPLNLAIFLTSVITLFLAGFALNLKLLVPVFRWQRRDNLVAAAD

SEQ ID NO: 978637 - protein, 29 aa, Mycobacterium
LQDPRKEVLPMRGLFTQTIALRLRSREEV

SEQ ID NO: 978638 - protein, 17 aa, Mycobacterium
LQGSYSPIPPSMAGQIV

SEQ ID NO: 978639 - protein, 18 aa, Mycobacterium
LQIDHFWWTAIWAAIVLS

SEQ ID NO: 978640 - protein, 19 aa, Mycobacterium
LQIDHFWWTAVWAATLLSI

SEQ ID NO: 978641 - protein, 17 aa, Mycobacterium
LQLAFVLVFITVSLLYL

SEQ ID NO: 978642 - protein, 19 aa, Mycobacterium
LQLWGFFALVLDSLAIAAQ

SEQ ID NO: 978643 - protein, 18 aa, Mycobacterium
LQPKYMEMLNINEAWQFG

SEQ ID NO: 978644 - protein, 27 aa, Mycobacterium
LQRQKFFWNLLVDYWFRMEIDGWENIP

SEQ ID NO: 978645 - protein, 27 aa, Mycobacterium
LRAQWPILLVGLIFAVAFALAGANFWR

SEQ ID NO: 978646 - protein, 20 aa, Mycobacterium
LRATVYGLVVLILATAIAVV

SEQ ID NO: 978647 - protein, 18 aa, Mycobacterium
LRCWLITIVIWVWTVRLT

SEQ ID NO: 978648 - protein, 25 aa, Mycobacterium
LRDWRSPIAWLSRYRPRLPRLSRWC

SEQ ID NO: 978649 - protein, 17 aa, Mycobacterium
LREAPSVPGLPMIVVAL

SEQ ID NO: 978650 - protein, 26 aa, Mycobacterium
LREFGNLVFHFSLLGLLVAVAVGKLF

SEQ ID NO: 978651 - protein, 19 aa, Mycobacterium
LRELTSKVLPLTLAGGASV

SEQ ID NO: 978652 - protein, 31 aa, Mycobacterium
LREVLPLVVPVILASLLFAGGLVPLVGTWGF

SEQ ID NO: 978653 - protein, 20 aa, Mycobacterium
LRGALLTEPALAPNGVAAAV

SEQ ID NO: 978654 - protein, 18 aa, Mycobacterium
LRGLFGTRLLQREYYDDE

SEQ ID NO: 978655 - protein, 18 aa, Mycobacterium
LRITALSIVLLALGAMVS

SEQ ID NO: 978656 - protein, 24 aa, Mycobacterium
LRITRLTRVLAVTGAVACVASFAA

SEQ ID NO: 978657 - protein, 26 aa, Mycobacterium
LRLLDTRWMPLPAFVIAMVLLRSSLA

SEQ ID NO: 978658 - protein, 21 aa, Mycobacterium
LRLLPSLIPIGLLAGLLAVVT

SEQ ID NO: 978659 - protein, 17 aa, Mycobacterium
LRLVFGEMTLTAGLTVL

SEQ ID NO: 978660 - protein, 19 aa, Mycobacterium
LRMAIGAAALTLLGVRRYV

SEQ ID NO: 978661 - protein, 40 aa, Mycobacterium; identical to SEQ ID NO: 362206

SEQ ID NO: 978662 - protein, 35 aa, Mycobacterium; identical to SEQ ID NO: 362211

SEQ ID NO: 978663 - protein, 30 aa, Mycobacterium; identical to SEQ ID NO: 362225

SEQ ID NO: 978664 - protein, 35 aa, Mycobacterium
LRSARHFHWGWVVALLMMVLALAAIAILGTVLLTR

SEQ ID NO: 978665 - protein, 23 aa, Mycobacterium
LRSFALYWHAVCGIPLMVPQFTY

SEQ ID NO: 978666 - protein, 26 aa, Mycobacterium
LRSGGPLAILFSLVVIGIAAFSFLID

SEQ ID NO: 978667 - protein, 25 aa, Mycobacterium
LRSIHYMLIHYRVELIRLIAQMGLG

SEQ ID NO: 978668 - protein, 22 aa, Mycobacterium
LRSIVPTWPLGAHADLLCPVAD

SEQ ID NO: 978669 - protein, 27 aa, Mycobacterium
LRSRIGMVLQDTWLLAGTIAENIGYGR

SEQ ID NO: 978670 - protein, 26 aa, Mycobacterium
LRTDPGPVLLITALHRDFASTDTLAA

SEQ ID NO: 978671 - protein, 27 aa, Mycobacterium
LRTFIGSAVVLLPIVLAGTAIVLMRTE

SEQ ID NO: 978672 - protein, 18 aa, Mycobacterium
LRTLAAQAGLAVALMGAV

SEQ ID NO: 978673 - protein, 33 aa, Mycobacterium; identical to SEQ ID NO: 362262

SEQ ID NO: 978674 - protein, 36 aa, Mycobacterium
LRVRGQRLLALYFPLVPLICSLATTLVLFEGGRDVQ

SEQ ID NO: 978675 - protein, 19 aa, Mycobacterium
LRWGLLAVWGPGLVVMLAD

SEQ ID NO: 978676 - protein, 20 aa, Mycobacterium
LRWQYDTMRYAQIAGVQALQ

SEQ ID NO: 978677 - protein, 18 aa, Mycobacterium
LRYVLSRITLPGSIYLGV

SEQ ID NO: 978678 - protein, 35 aa, Mycobacterium
LSAIIFVLPALIMIGWWSGFPYWTTVAVCGFGGLL

SEQ ID NO: 978679 - protein, 22 aa, Mycobacterium
LSALLCPLLVYGWLGLPRMELA

SEQ ID NO: 978680 - protein, 18 aa, Mycobacterium
LSAWVRYHSDERLPKELS

SEQ ID NO: 978681 - protein, 18 aa, Mycobacterium
LSFWVVAFENSGHYIEAA

SEQ ID NO: 978682 - protein, 26 aa, Mycobacterium
LSGAVAWIIALFYKSIYVGGLINEVT

SEQ ID NO: 978683 - protein, 21 aa, Mycobacterium
LSGLRVVELAGIGPGPHAAMI

SEQ ID NO: 978684 - protein, 19 aa, Mycobacterium
LSHFGEHSVGWLLVSALGA

SEQ ID NO: 978685 - protein, 27 aa, Mycobacterium
LSHNFVQQALLAALLLGLVAGLIGPFI

SEQ ID NO: 978686 - protein, 19 aa, Mycobacterium
LSICFVLLITGVGSLIHIY

SEQ ID NO: 978687 - protein, 48 aa, Mycobacterium; identical to SEQ ID NO: 362341

SEQ ID NO: 978688 - protein, 32 aa, Mycobacterium; identical to SEQ ID NO: 362343

SEQ ID NO: 978689 - protein, 28 aa, Mycobacterium
LSIVSWFPMWFSYLLLIAVYPAFLTMFW

SEQ ID NO: 978690 - protein, 21 aa, Mycobacterium
LSLDWVIFGNNWLNGWPGLVA

SEQ ID NO: 978691 - protein, 23 aa, Mycobacterium
LSLGTIEAFIQYVRQFNQPVTDV

SEQ ID NO: 978692 - protein, 28 aa, Mycobacterium
LSLVAMALFPMYLLKSFAYAGVAVVVFS

SEQ ID NO: 978693 - protein, 26 aa, Mycobacterium
LSMLNDLPWWVTVLILSRELGVTMLR

SEQ ID NO: 978694 - protein, 28 aa, Mycobacterium
LSPVTLSWLLIIYGFTASVLPVWLLLAP

SEQ ID NO: 978695 - protein, 18 aa, Mycobacterium
LSQALLEFTGQTPGNLIA

SEQ ID NO: 978696 - protein, 22 aa, Mycobacterium
LSRLLCAETLTPLPIKTFDVRL

SEQ ID NO: 978697 - protein, 25 aa, Mycobacterium
LSSIAFVIGSLLWRAVNRRFGVRGM

SEQ ID NO: 978698 - protein, 20 aa, Mycobacterium
LSSRSLLISNAVVAFAVIGF

SEQ ID NO: 978699 - protein, 25 aa, Mycobacterium
LSVPPLAVFVLLVSLIYLSISSVVA

SEQ ID NO: 978700 - protein, 26 aa, Mycobacterium
LSVSLPMLLAARFLLGLAVGVSIVVV

SEQ ID NO: 978701 - protein, 28 aa, Mycobacterium
LTALFAAVIGSLAVLRRPPWPDITIRDC

SEQ ID NO: 978702 - protein, 27 aa, Mycobacterium
LTDPNPPLPAWLTPSPRVPGTGDPDDA

SEQ ID NO: 978703 - protein, 50 aa, Mycobacterium
LTFGAQVRLILRRQVRVFLASRLYFVFLTLLPFALDALTLLIPGDAGLDR

SEQ ID NO: 978704 - protein, 19 aa, Mycobacterium
LTFSLTLITLQLASSQYTP

SEQ ID NO: 978705 - protein, 19 aa, Mycobacterium
LTGLIIIAAPIFVLGFLAQ

SEQ ID NO: 978706 - protein, 21 aa, Mycobacterium
LTGVVWTVALTRPPDITEAAV

SEQ ID NO: 978707 - protein, 21 aa, Mycobacterium
LTIPTIALASIWLSGSLLLGL

SEQ ID NO: 978708 - protein, 27 aa, Mycobacterium
LTLAGILGCVVVGLAVALWVVRTRALL

SEQ ID NO: 978709 - protein, 20 aa, Mycobacterium
LTLFITGIWLVSIVGVALLI

SEQ ID NO: 978710 - protein, 21 aa, Mycobacterium
LTLLPDNLRWLVTVDAIHTQV

SEQ ID NO: 978711 - protein, 19 aa, Mycobacterium
LTNNTVVAYFPSANALYPG

SEQ ID NO: 978712 - protein, 29 aa, Mycobacterium
LTPATRWAPILQWLMVGAAGVLILVAMRH

SEQ ID NO: 978713 - protein, 21 aa, Mycobacterium
LTPLANLLWAPVYLIELAVVE

SEQ ID NO: 978714 - protein, 26 aa, Mycobacterium
LTRNDLGLVLLLLAPAALVSGVLCNM

SEQ ID NO: 978715 - protein, 25 aa, Mycobacterium
LTTAFAYLLLPQVLVYGLSSVFIAI

SEQ ID NO: 978716 - protein, 22 aa, Mycobacterium
LTTVGPYTRYGLPLVAACAKAG

SEQ ID NO: 978717 - protein, 32 aa, Mycobacterium
LTVFDGGIGSLLRLLILGVIMAPIVIAVLLAG

SEQ ID NO: 978718 - protein, 18 aa, Mycobacterium
LTYTSVVLVFLAFMVALV

SEQ ID NO: 978719 - protein, 31 aa, Mycobacterium; identical to SEQ ID NO: 362695

SEQ ID NO: 978720 - protein, 28 aa, Mycobacterium
LVALIALFPPYIMWAPNAIWKSFDLFVG

SEQ ID NO: 978721 - protein, 23 aa, Mycobacterium
LVALMFVPVAFLPKKPPAVRRNP

SEQ ID NO: 978722 - protein, 17 aa, Mycobacterium
LVALWVLPRAISLARAA

SEQ ID NO: 978723 - protein, 18 aa, Mycobacterium
LVATAFVVFALYCGISQI

SEQ ID NO: 978724 - protein, 28 aa, Mycobacterium
LVDTLGWQWIFFVNIPVGIVGLVLAVRF

SEQ ID NO: 978725 - protein, 30 aa, Mycobacterium; identical to SEQ ID NO: 362755

SEQ ID NO: 978726 - protein, 17 aa, Mycobacterium
LVELLGRINAELAVYTG

SEQ ID NO: 978727 - protein, 26 aa, Mycobacterium
LVFAQYLQNFLGFTPIKAALLLTPMA

SEQ ID NO: 978728 - protein, 17 aa, Mycobacterium
LVFNMWALYVVGPPLEM

SEQ ID NO: 978729 - protein, 18 aa, Mycobacterium
LVGALPWLTASALGSSLT

SEQ ID NO: 978730 - protein, 19 aa, Mycobacterium
LVGFLWATVAGSVSWLILL

SEQ ID NO: 978731 - protein, 24 aa, Mycobacterium
LVGGVWLVFIGWFIFAAAREEETR

SEQ ID NO: 978732 - protein, 45 aa, Mycobacterium; identical to SEQ ID NO: 362806

SEQ ID NO: 978733 - protein, 19 aa, Mycobacterium
LVGMLVVVPARWAGPAAVA

SEQ ID NO: 978734 - protein, 23 aa, Mycobacterium
LVGTLLSWYALVAALTTVPLVRW

SEQ ID NO: 978735 - protein, 20 aa, Mycobacterium
LVGVLVLLKTVAYWLNRYEL

SEQ ID NO: 978736 - protein, 19 aa, Mycobacterium
LVIAVPIALARLYSGGLWA

SEQ ID NO: 978737 - protein, 18 aa, Mycobacterium
LVISAGVLWIASRLGWVV

SEQ ID NO: 978738 - protein, 17 aa, Mycobacterium
LVLELAIGAAVVAKGWS

SEQ ID NO: 978739 - protein, 24 aa, Mycobacterium
LVLGWAIFLSYGLALMGLPALAVL

SEQ ID NO: 978740 - protein, 26 aa, Mycobacterium
LVLITTFLIFPILGLAIRALVRSWMD

SEQ ID NO: 978741 - protein, 19 aa, Mycobacterium
LVLNAHIAFSVWYLWSVMV

SEQ ID NO: 978742 - protein, 18 aa, Mycobacterium
LVLRSFSQRWVSGGSVAA

SEQ ID NO: 978743 - protein, 24 aa, Mycobacterium
LVLSAIYMLWLYQRVMTGPLAKGN

SEQ ID NO: 978744 - protein, 24 aa, Mycobacterium
LVLTAVLIVWRRDLRSIVWLLAAQ

SEQ ID NO: 978745 - protein, 17 aa, Mycobacterium
LVMTWGPSLCRVERNNS

SEQ ID NO: 978746 - protein, 25 aa, Mycobacterium
LVNDGTSSWLLWDGKRSRMDLADHA

SEQ ID NO: 978747 - protein, 20 aa, Mycobacterium
LVNLLMRFYEVDSGRILIDG

SEQ ID NO: 978748 - protein, 24 aa, Mycobacterium
LVNYLLIGIYLNAQFPAVPAPVFC

SEQ ID NO: 978749 - protein, 22 aa, Mycobacterium
LVPLVAGPLPVAFFIGVLAGEE

SEQ ID NO: 978750 - protein, 17 aa, Mycobacterium
LVPMLISKRDVVRRISD

SEQ ID NO: 978751 - protein, 24 aa, Mycobacterium
LVPSPTCIIVGLPAGLRLAVDNAI

SEQ ID NO: 978752 - protein, 17 aa, Mycobacterium
LVQLLGRINAELSVYTG

SEQ ID NO: 978753 - protein, 20 aa, Mycobacterium
LVRAYLWRRHGDIVRAGIGA

SEQ ID NO: 978754 - protein, 20 aa, Mycobacterium
LVRVGRRQVPLDAALRVKDT

SEQ ID NO: 978755 - protein, 28 aa, Mycobacterium
LVSGLGWEWIFFVNIPIGLAGLVVAYLL

SEQ ID NO: 978756 - protein, 35 aa, Mycobacterium
LVSGWLAAITWRLSFLWLAVTGLLLTLALARTVPE

SEQ ID NO: 978757 - protein, 17 aa, Mycobacterium
LVSLPISVTLSIQFALL

SEQ ID NO: 978758 - protein, 18 aa, Mycobacterium
LVVAAVIEWILGGGAALG

SEQ ID NO: 978759 - protein, 19 aa, Mycobacterium
LVVELFGLLLSPISWTHHW

SEQ ID NO: 978760 - protein, 26 aa, Mycobacterium
LVVGVIVWGLIFWSATFHRKKKTDTD

SEQ ID NO: 978761 - protein, 52 aa, Mycobacterium; identical to SEQ ID NO: 363025

SEQ ID NO: 978762 - protein, 19 aa, Mycobacterium
LVVLSCQLLIVAMLTRLEP

SEQ ID NO: 978763 - protein, 18 aa, Mycobacterium
LVVRMWALQRAGMYRDMA

SEQ ID NO: 978764 - protein, 19 aa, Mycobacterium
LVVVFGDFRFGPTNVYHAT

SEQ ID NO: 978765 - protein, 27 aa, Mycobacterium
LVVVGVGLGLVLYFTPAMSARDVVVTG

SEQ ID NO: 978766 - protein, 19 aa, Mycobacterium
LWFQPFFDDSSWDGPAWSI

SEQ ID NO: 978767 - protein, 18 aa, Mycobacterium
LWGGMLMWLTLWVLYLSI

SEQ ID NO: 978768 - protein, 28 aa, Mycobacterium
LWISLVVLWLFVLVPMLISKREAVRRTS

SEQ ID NO: 978769 - protein, 20 aa, Mycobacterium
LWLGVGLMLIAWLRLGRGVL

SEQ ID NO: 978770 - protein, 18 aa, Mycobacterium
LWLPPLDESIQLTAILAS

SEQ ID NO: 978771 - protein, 18 aa, Mycobacterium
LWNPGTWWQSIAVWFAAA

SEQ ID NO: 978772 - protein, 17 aa, Mycobacterium
LYASALAGPALAGVMLA

SEQ ID NO: 978773 - protein, 20 aa, Mycobacterium
LYLLFVFTQTVRHRDFFLPV

SEQ ID NO: 978774 - protein, 18 aa, Mycobacterium
LYYDTLAEIWFATEAAAQ

SEQ ID NO: 978775 - protein, 17 aa, Mycobacterium
MAAAVVLLVVLRRRRTR

SEQ ID NO: 978776 - protein, 22 aa, Mycobacterium
MAAVLLVWRRVSDGWAFLCIAV

SEQ ID NO: 978777 - protein, 21 aa, Mycobacterium
MAFAVYVVISAALYSDIDNQL

SEQ ID NO: 978778 - protein, 17 aa, Mycobacterium
MAFIYNLVTTIAQMVYA

SEQ ID NO: 978779 - protein, 31 aa, Mycobacterium; identical to SEQ ID NO: 363164

SEQ ID NO: 978780 - protein, 28 aa, Mycobacterium
MAIARAFAVLFLPYSLLGPFAGALMDRW

SEQ ID NO: 978781 - protein, 21 aa, Mycobacterium
MALIIAYIFRPAGLGVVFGLA

SEQ ID NO: 978782 - protein, 19 aa, Mycobacterium
MANTMFIPRFLFAVTFCGV

SEQ ID NO: 978783 - protein, 26 aa, Mycobacterium
MAPALLITIFIYWGFDTAVACNDETD

SEQ ID NO: 978784 - protein, 17 aa, Mycobacterium
MAPLFNLVNGDLCYANM

SEQ ID NO: 978785 - protein, 27 aa, Mycobacterium
MATAAQLLYLRVPALNALFPDYRGSVL

SEQ ID NO: 978786 - protein, 28 aa, Mycobacterium
MATLIFGFILMWIMSWLTATPVRVAGPR

SEQ ID NO: 978787 - protein, 31 aa, Mycobacterium; identical to SEQ ID NO: 363208

SEQ ID NO: 978788 - protein, 32 aa, Mycobacterium; identical to SEQ ID NO: 363209

SEQ ID NO: 978789 - protein, 30 aa, Mycobacterium; identical to SEQ ID NO: 363217

SEQ ID NO: 978790 - protein, 24 aa, Mycobacterium
MCWAILGFFVFVIWTLTTETETET

SEQ ID NO: 978791 - protein, 33 aa, Mycobacterium; identical to SEQ ID NO: 363225

SEQ ID NO: 978792 - protein, 18 aa, Mycobacterium
MDANAALRWSLIAGASCN

SEQ ID NO: 978793 - protein, 32 aa, Mycobacterium
MDDWRDRVLAAMVLLFFARAALLGVLTRRAVT

SEQ ID NO: 978794 - protein, 32 aa, Mycobacterium; identical to SEQ ID NO: 363235

SEQ ID NO: 978795 - protein, 23 aa, Mycobacterium
MDSNYRWFHPAPSTLAAAVGSPR

SEQ ID NO: 978796 - protein, 20 aa, Mycobacterium
MDTARLHDEWKFQPAFTAEE

SEQ ID NO: 978797 - protein, 25 aa, Mycobacterium
MEINPVRWHRTLLVLSAVLGVVLVV

SEQ ID NO: 978798 - protein, 18 aa, Mycobacterium
MEPPPRPSQLRPGRVPAA

SEQ ID NO: 978799 - protein, 19 aa, Mycobacterium
MFAFAIKAPLWPFHRWLPD

SEQ ID NO: 978800 - protein, 18 aa, Mycobacterium
MFLIHDSPGYLWAGLALL

SEQ ID NO: 978801 - protein, 18 aa, Mycobacterium
MFVVLLSALTIASFVYAI

SEQ ID NO: 978802 - protein, 26 aa, Mycobacterium
MGAVSILFYVLFTLVSRNLLSALIGS

SEQ ID NO: 978803 - protein, 25 aa, Mycobacterium
MGEGEAMLFGEYIRLMALVEYSADE

SEQ ID NO: 978804 - protein, 19 aa, Mycobacterium
MGIPLLLGPMAGPILGGWL

SEQ ID NO: 978805 - protein, 33 aa, Mycobacterium; identical to SEQ ID NO: 363314

SEQ ID NO: 978806 - protein, 24 aa, Mycobacterium
MGLLASMLVFVTLGLPSAGATVPL

SEQ ID NO: 978807 - protein, 18 aa, Mycobacterium
MGLLSTVLTYSVENSKKA

SEQ ID NO: 978808 - protein, 22 aa, Mycobacterium
MGLLVDDLLTLARLDVQRPLER

SEQ ID NO: 978809 - protein, 24 aa, Mycobacterium
MGMYLPISLTLVIPVGAVLGRIYD

SEQ ID NO: 978810 - protein, 26 aa, Mycobacterium
MGPLTRLTARWRLPAVIQLAVRSLTR

SEQ ID NO: 978811 - protein, 24 aa, Mycobacterium
MGSVTLLLGGCRFAKEHLSAAPVA

SEQ ID NO: 978812 - protein, 30 aa, Mycobacterium
MGVPLEWNVFFIFSLFYLFGHYGSIRAIDL

SEQ ID NO: 978813 - protein, 26 aa, Mycobacterium
MGVVHLKWYDYPLTAVVSLIVLFAFV

SEQ ID NO: 978814 - protein, 22 aa, Mycobacterium
MGYLPGTIWIVAGAVFAGCVHD

SEQ ID NO: 978815 - protein, 19 aa, Mycobacterium
MHLDAGQQVWLITATPYEL

SEQ ID NO: 978816 - protein, 22 aa, Mycobacterium
MIGQLAQWLLSLVGLAYLVWDY

SEQ ID NO: 978817 - protein, 24 aa, Mycobacterium
MIKIRGWRRIGTVVVRWPGPVLAA

SEQ ID NO: 978818 - protein, 24 aa, Mycobacterium
MIKVRGWRRIGTAIVRWPGPVFVA

SEQ ID NO: 978819 - protein, 29 aa, Mycobacterium
MIMMSFISIPLVTVAWLLAGYSLAFSDGA

SEQ ID NO: 978820 - protein, 30 aa, Mycobacterium
MIRTLAVPIILFWLAVVVLLSVFVPSLEVV

SEQ ID NO: 978821 - protein, 26 aa, Mycobacterium
MITFGVALCARLWFIGRRVIATVGHN

SEQ ID NO: 978822 - protein, 26 aa, Mycobacterium
MITVLLPPVLVLTWSGLRAGAPPAPE

SEQ ID NO: 978823 - protein, 21 aa, Mycobacterium
MIVVCMFWRLFMQDNLPHDGA

SEQ ID NO: 978824 - protein, 18 aa, Mycobacterium
MIWAFGYNVAAIPIAAAG

SEQ ID NO: 978825 - protein, 17 aa, Mycobacterium
MLAAGGIQLLCSVAAVY

SEQ ID NO: 978826 - protein, 17 aa, Mycobacterium
MLAAVVLVSMWRGALTA

SEQ ID NO: 978827 - protein, 26 aa, Mycobacterium
MLALMTRRWTLAWVALAGSALASGTG

SEQ ID NO: 978828 - protein, 18 aa, Mycobacterium
MLAVVIVGLAALGGWFYW

SEQ ID NO: 978829 - protein, 25 aa, Mycobacterium
MLGGLAHRMRCTTTFFGIAALGASG

SEQ ID NO: 978830 - protein, 33 aa, Mycobacterium; identical to SEQ ID NO: 363437

SEQ ID NO: 978831 - protein, 17 aa, Mycobacterium
MLGTLWLVVRARSSTRA

SEQ ID NO: 978832 - protein, 17 aa, Mycobacterium
MLILAGREPTSGTVERP

SEQ ID NO: 978833 - protein, 17 aa, Mycobacterium
MLLDLLTDNPDLADMDQ

SEQ ID NO: 978834 - protein, 25 aa, Mycobacterium
MLLGVALGLMTLGLVKGPEWGWIST

SEQ ID NO: 978835 - protein, 20 aa, Mycobacterium
MLMPFAGISFLWFIGVVRDG

SEQ ID NO: 978836 - protein, 17 aa, Mycobacterium
MLMWLTLWVLYLSIVNV

SEQ ID NO: 978837 - protein, 19 aa, Mycobacterium
MLQRKLRVGFAKAGRLMDL

SEQ ID NO: 978838 - protein, 17 aa, Mycobacterium
MLRIYRDYAHDSNISYG

SEQ ID NO: 978839 - protein, 26 aa, Mycobacterium
MLSKWQVGWVVVLLYAVCVVLRLARF

SEQ ID NO: 978840 - protein, 17 aa, Mycobacterium
MLTGIAALGLILFAGLS

SEQ ID NO: 978841 - protein, 17 aa, Mycobacterium
MLVALLVALTLAPAVLV

SEQ ID NO: 978842 - protein, 30 aa, Mycobacterium
MLVGTPAMWWLAVPVLLYAAWRMFVRRDWR

SEQ ID NO: 978843 - protein, 18 aa, Mycobacterium
MLVPLATGCLRVRASITI

SEQ ID NO: 978844 - protein, 18 aa, Mycobacterium
MLVTFGVVAAGLARYRLR

SEQ ID NO: 978845 - protein, 18 aa, Mycobacterium
MLWSGDRAWRQAGERRML

SEQ ID NO: 978846 - protein, 18 aa, Mycobacterium
MMGLPRLYRIPVHTIHKF

SEQ ID NO: 978847 - protein, 21 aa, Mycobacterium
MPARPLVALPGASAIAPGTGI

SEQ ID NO: 978848 - protein, 31 aa, Mycobacterium
MPAVGTLLGRWFWWPRPLAGQTRKPQMVSQR

SEQ ID NO: 978849 - protein, 17 aa, Mycobacterium
MPDPYLFAVLLTVIVVA

SEQ ID NO: 978850 - protein, 23 aa, Mycobacterium
MPLLGKIAVWLTGAAWAIATFFV

SEQ ID NO: 978851 - protein, 17 aa, Mycobacterium
MPPPRISKRHPKLAHLD

SEQ ID NO: 978852 - protein, 30 aa, Mycobacterium
MQCGEGWWTSVWFLAFWITGTSMLMVSGIP

SEQ ID NO: 978853 - protein, 24 aa, Mycobacterium
MQRITWIVTMYLLGYIAAMPLLSR

SEQ ID NO: 978854 - protein, 26 aa, Mycobacterium
MQSCDRPMIFPLSNPTSRMEAMPADV

SEQ ID NO: 978855 - protein, 25 aa, Mycobacterium
MQVPPPMPSGPWPSQAPPQTGSHRP

SEQ ID NO: 978856 - protein, 17 aa, Mycobacterium
MRDFVLIRLSKAQFNRI

SEQ ID NO: 978857 - protein, 27 aa, Mycobacterium
MRDPVLFAIPFFLFLLTVEWAAARKLE

SEQ ID NO: 978858 - protein, 22 aa, Mycobacterium
MRGGKWWTKPFVRSAYGNAVIA

SEQ ID NO: 978859 - protein, 18 aa, Mycobacterium
MRHRYFELEIKAIAVEHA

SEQ ID NO: 978860 - protein, 17 aa, Mycobacterium
MRLNMIEPLKEPAWRRF

SEQ ID NO: 978861 - protein, 18 aa, Mycobacterium
MRLPTLAMALTCWWVISR

SEQ ID NO: 978862 - protein, 35 aa, Mycobacterium; identical to SEQ ID NO: 363597

SEQ ID NO: 978863 - protein, 19 aa, Mycobacterium
MRQHWGIENSLHWIRDVTF

SEQ ID NO: 978864 - protein, 38 aa, Mycobacterium
MSEDQPWQPYYLGNPVYAFLLMVLFQYGVALHELETER

SEQ ID NO: 978865 - protein, 17 aa, Mycobacterium
MSEVHLARDLRLHRDVA

SEQ ID NO: 978866 - protein, 22 aa, Mycobacterium
MSLTVIVVVLLLTTVASLVSVR

SEQ ID NO: 978867 - protein, 24 aa, Mycobacterium
MSNGELFIMGRIKDLVIVDGRNHY

SEQ ID NO: 978868 - protein, 21 aa, Mycobacterium
MSQFWQQMFLTIGIVIAVFGM

SEQ ID NO: 978869 - protein, 24 aa, Mycobacterium
MSRLTTLVRLELPLAWPVIMTGVR

SEQ ID NO: 978870 - protein, 24 aa, Mycobacterium
MSSPWLLAAIVAALLFFPILGNFR

SEQ ID NO: 978871 - protein, 32 aa, Mycobacterium; identical to SEQ ID NO: 363643

SEQ ID NO: 978872 - protein, 21 aa, Mycobacterium
MSVGTWILAAYGPGAGLAGAA

SEQ ID NO: 978873 - protein, 18 aa, Mycobacterium
MSVSFLRRIAFSGFAFTI

SEQ ID NO: 978874 - protein, 18 aa, Mycobacterium
MTIASWWLHRQCGYHTPV

SEQ ID NO: 978875 - protein, 24 aa, Mycobacterium
MTIPIALFMGCYLRFLRPGRVAEV

SEQ ID NO: 978876 - protein, 21 aa, Mycobacterium
MTLDRWLLFNWMRWGRALEYL

SEQ ID NO: 978877 - protein, 37 aa, Mycobacterium
MTLDTFVSMFRPPFAWREYLLQCWFVARVSTLPGVLM

SEQ ID NO: 978878 - protein, 31 aa, Mycobacterium
MTLSGFAHSWFFLFLLVVAGLIAIYVVLQLA

SEQ ID NO: 978879 - protein, 34 aa, Mycobacterium
MTLTAGLTVLLLTPDVYWPLRRIGVEFHAAQDGK

SEQ ID NO: 978880 - protein, 24 aa, Mycobacterium
MTRYYAAQRTFWVDPVTGTIVKQT

SEQ ID NO: 978881 - protein, 28 aa, Mycobacterium
MVAGSLFFRLKQPALVPPTAWAVPGDGG

SEQ ID NO: 978882 - protein, 18 aa, Mycobacterium
MVFCVLGARIWSGSVAAV

SEQ ID NO: 978883 - protein, 30 aa, Mycobacterium
MVGALADWFAVTALFKHPLGIPIPHTAIIK

SEQ ID NO: 978884 - protein, 18 aa, Mycobacterium
MVHPPFAWREYIAQAWFV

SEQ ID NO: 978885 - protein, 22 aa, Mycobacterium
MVLPQLILMPILYVVQEMTVRL

SEQ ID NO: 978886 - protein, 18 aa, Mycobacterium
MVPVWVAAGGLTGALLIG

SEQ ID NO: 978887 - protein, 25 aa, Mycobacterium
MVTVPISVLASRFLLQRSKQLRVAR

SEQ ID NO: 978888 - protein, 29 aa, Mycobacterium
MVVVLLVAAWWLFGALWHPVRGRLADLAT

SEQ ID NO: 978889 - protein, 25 aa, Mycobacterium
MVVVLMSFAVYAVISAALYSDIDNQ

SEQ ID NO: 978890 - protein, 19 aa, Mycobacterium
MWVARATGMKVRRYFVGFG

SEQ ID NO: 978891 - protein, 23 aa, Mycobacterium
NAAISALVLPSAFRPATDPNSPT

SEQ ID NO: 978892 - protein, 21 aa, Mycobacterium
NAAIYNGKLVCENFRRGLTVD

SEQ ID NO: 978893 - protein, 17 aa, Mycobacterium
NAGVTALVLLFVGGALY

SEQ ID NO: 978894 - protein, 22 aa, Mycobacterium
NAGWWPVLWFTAKVWGFLFMYF

SEQ ID NO: 978895 - protein, 17 aa, Mycobacterium
NAHLILQQPPTPNPTQT

SEQ ID NO: 978896 - protein, 25 aa, Mycobacterium
NATRFMFAVTFFGSCLLFPAYFQQV

SEQ ID NO: 978897 - protein, 23 aa, Mycobacterium
NAVATILVGWWTKTIDRAKVDAV

SEQ ID NO: 978898 - protein, 19 aa, Mycobacterium
NAVFGLLIAWGLIRDEFVG

SEQ ID NO: 978899 - protein, 25 aa, Mycobacterium
NAYGKALFAITLTAAAVLVALAGRR

SEQ ID NO: 978900 - protein, 30 aa, Mycobacterium
NAYKPLARKGFLSIWSWTFGLVVTEFPLQT

SEQ ID NO: 978901 - protein, 29 aa, Mycobacterium
NCTIKVMVGFLFLYPAFVAKAHDANGWVQ

SEQ ID NO: 978902 - protein, 19 aa, Mycobacterium
NDFMNIMLAALLAAAMWLL

SEQ ID NO: 978903 - protein, 29 aa, Mycobacterium
NEGRGDFFAVVRSLALFVNALHQDDKQFV

SEQ ID NO: 978904 - protein, 18 aa, Mycobacterium
NELGPVIRSWLGAQSLTL

SEQ ID NO: 978905 - protein, 26 aa, Mycobacterium
NEQIMPLLVVSLMLQLVLAGGVVPVT

SEQ ID NO: 978906 - protein, 25 aa, Mycobacterium
NFNAPNGLLLVDSWMRAISGRAEQF

SEQ ID NO: 978907 - protein, 23 aa, Mycobacterium
NFPDALLLLRLKQIGFSVVGVIM

SEQ ID NO: 978908 - protein, 21 aa, Mycobacterium
NFSRRFVPTSFIVSAITLLVT

SEQ ID NO: 978909 - protein, 31 aa, Mycobacterium; identical to SEQ ID NO: 363937

SEQ ID NO: 978910 - protein, 17 aa, Mycobacterium
NGGANSPALYLLDGLRA

SEQ ID NO: 978911 - protein, 26 aa, Mycobacterium
NGGARPWLPHFYLGHGVGVNAAEMPM

SEQ ID NO: 978912 - protein, 25 aa, Mycobacterium
NGPPPPFTSWMPPDYPPQAPQIPYP

SEQ ID NO: 978913 - protein, 17 aa, Mycobacterium
NHRLTTWIGWGVAVLIS

SEQ ID NO: 978914 - protein, 28 aa, Mycobacterium
NHRMDPVDLLPFLLLGTTFGVRLLGIAY

SEQ ID NO: 978915 - protein, 29 aa, Mycobacterium
NIEPALRFYVVFFLALLFVTWHCYLRSKT

SEQ ID NO: 978916 - protein, 31 aa, Mycobacterium
NIGVPLWIDVVLPIIVWALYVGSRRHGGDAV

SEQ ID NO: 978917 - protein, 17 aa, Mycobacterium
NILIVGIAALTLIFVVM

SEQ ID NO: 978918 - protein, 20 aa, Mycobacterium
NIQYDYIFGFSFYDGHYFGA

SEQ ID NO: 978919 - protein, 18 aa, Mycobacterium
NIRVAMLLAAAWLAVLAS

SEQ ID NO: 978920 - protein, 23 aa, Mycobacterium
NIWLDRLRTLARRTCVVTLAYAQ

SEQ ID NO: 978921 - protein, 27 aa, Mycobacterium
NKAMWLGTTVLVQPVPSAGLRAALRGQ

SEQ ID NO: 978922 - protein, 19 aa, Mycobacterium
NKFRNSPFIWWAVTSVVAL

SEQ ID NO: 978923 - protein, 18 aa, Mycobacterium
NKGWAALPGLQTNPNSLA

SEQ ID NO: 978924 - protein, 26 aa, Mycobacterium
NKNLSPPYSILAIGDPPTLAAAMNIP

SEQ ID NO: 978925 - protein, 20 aa, Mycobacterium
NKPLSWRDRAVKWARIARLS

SEQ ID NO: 978926 - protein, 18 aa, Mycobacterium
NKPRRAFRRLTRSTLETL

SEQ ID NO: 978927 - protein, 20 aa, Mycobacterium
NLDIRWVVALIAINLAITFV

SEQ ID NO: 978928 - protein, 17 aa, Mycobacterium
NLGLVAGALCILVMVMW

SEQ ID NO: 978929 - protein, 17 aa, Mycobacterium
NLLLEQLHYRHELLYYK

SEQ ID NO: 978930 - protein, 25 aa, Mycobacterium
NLQRPLLGWALFAVLIGWSAACAVA

SEQ ID NO: 978931 - protein, 37 aa, Mycobacterium
NLRSQPVPFILNPAPQPPGPLPAPGPALAPPPEAPPA

SEQ ID NO: 978932 - protein, 17 aa, Mycobacterium
NLSAFVLFSSMAGIIGT

SEQ ID NO: 978933 - protein, 20 aa, Mycobacterium
NLTLLAFAAAYFGSSLLIPT

SEQ ID NO: 978934 - protein, 42 aa, Mycobacterium; identical to SEQ ID NO: 364100

SEQ ID NO: 978935 - protein, 25 aa, Mycobacterium
NMCDRLLILAPGGRLAYFGPPQQAL

SEQ ID NO: 978936 - protein, 17 aa, Mycobacterium
NNFMWPLVITSGHKWRV

SEQ ID NO: 978937 - protein, 25 aa, Mycobacterium
NNVAMLLVLRFLQGGACSAFIVIAI

SEQ ID NO: 978938 - protein, 25 aa, Mycobacterium
NPLNWPPAFFSWFAAGMLLAEWVHS

SEQ ID NO: 978939 - protein, 25 aa, Mycobacterium
NPRRSLLLAYLISIGVVIVLYVLVA

SEQ ID NO: 978940 - protein, 21 aa, Mycobacterium
NPSRMALFDLSSSWMTGQCCD

SEQ ID NO: 978941 - protein, 53 aa, Mycobacterium
NQAYGYMFPHGTFFLVGHLLQLPAWITQRLWWALLLTIGFWGLLRVAEGLGIG

SEQ ID NO: 978942 - protein, 41 aa, Mycobacterium; identical to SEQ ID NO: 364193

SEQ ID NO: 978943 - protein, 37 aa, Mycobacterium
NQFVMPDLSGMFWTDAEPRLRALGWTGSLDKGPDVDG

SEQ ID NO: 978944 - protein, 26 aa, Mycobacterium
NQLQRITWIVTWYLLGYIAAMPLLGR

SEQ ID NO: 978945 - protein, 21 aa, Mycobacterium
NQLVAWVCIGASALGVVLLIV

SEQ ID NO: 978946 - protein, 20 aa, Mycobacterium
NQVELPFNGLNYPEGIAVDA

SEQ ID NO: 978947 - protein, 25 aa, Mycobacterium
NRIAWWVGVGIAVLVTLLSVVTYRG

SEQ ID NO: 978948 - protein, 27 aa, Mycobacterium
NRPDILDPALLRPGRFDRQIPVTNPDL

SEQ ID NO: 978949 - protein, 27 aa, Mycobacterium
NRRPKRLLIGTLLALALVGALTATIVY

SEQ ID NO: 978950 - protein, 32 aa, Mycobacterium
NRTALERFLAVAIPLFAPPITAVAMRAWWQTG

SEQ ID NO: 978951 - protein, 25 aa, Mycobacterium
NRTRVLWITVLIWSVAMALGGISAG

SEQ ID NO: 978952 - protein, 20 aa, Mycobacterium
NRWEKLPPIRMVHRGTAASL

SEQ ID NO: 978953 - protein, 26 aa, Mycobacterium
NSFLDGLAVHRRALGLPGVSVAWGLW

SEQ ID NO: 978954 - protein, 36 aa, Mycobacterium; identical to SEQ ID NO: 364262

SEQ ID NO: 978955 - protein, 18 aa, Mycobacterium
NSLLILLLVHHMRDVDVE

SEQ ID NO: 978956 - protein, 27 aa, Mycobacterium
NSMAGLKLPSWGSLRLALPVGGNGDAT

SEQ ID NO: 978957 - protein, 20 aa, Mycobacterium
NSYWLVGVQLLDGIGAGIFG

SEQ ID NO: 978958 - protein, 29 aa, Mycobacterium
NTAEGSLHLWLNLTLLAGVALVVVGAVVA

SEQ ID NO: 978959 - protein, 26 aa, Mycobacterium
NTMNLLLLLLVTFLPFSSALMSHYLV

SEQ ID NO: 978960 - protein, 30 aa, Mycobacterium
NTRSFTAAGIWLAIASFAAAGAVAALAWVS

SEQ ID NO: 978961 - protein, 23 aa, Mycobacterium
NTSTVWTYLLYAASWVGGPMRLE

SEQ ID NO: 978962 - protein, 37 aa, Mycobacterium
NVAELAPFLVWALSGGLFPLALGVLQILALDLGTDTL

SEQ ID NO: 978963 - protein, 24 aa, Mycobacterium
NVGLQHQLSQLTNRAWPVSMTGGA

SEQ ID NO: 978964 - protein, 22 aa, Mycobacterium
NVGLWLLHFLQNAAGSLAGAVT

SEQ ID NO: 978965 - protein, 32 aa, Mycobacterium
NVLTGLRFVLVPIFLYLLFYDGGHQTTFRIAA

SEQ ID NO: 978966 - protein, 29 aa, Mycobacterium
NVPPPSPGTVYQMWLVDAKGPTSAGTMGP

SEQ ID NO: 978967 - protein, 17 aa, Mycobacterium
NVRPGVLLVLAGDAPAD

SEQ ID NO: 978968 - protein, 24 aa, Mycobacterium
NVRPKLVLGVIVLGSFIASIDLTI

SEQ ID NO: 978969 - protein, 40 aa, Mycobacterium
PAAAPGVVPAPIPLPIPIIIPPWPNWSPGMPTPSTVTVTP

SEQ ID NO: 978970 - protein, 34 aa, Mycobacterium; identical to SEQ ID NO: 364411

SEQ ID NO: 978971 - protein, 18 aa, Mycobacterium
PAAPWFIGAAMGLQVLGT

SEQ ID NO: 978972 - protein, 28 aa, Mycobacterium
PAARAASPFVFVYNYLKQVVAEMRKVIW

SEQ ID NO: 978973 - protein, 24 aa, Mycobacterium
PADYAIIPPTRFKRKEHWLDAKFS

SEQ ID NO: 978974 - protein, 25 aa, Mycobacterium
PAEFSKILLLIFFSAVLVAKRGLFT

SEQ ID NO: 978975 - protein, 24 aa, Mycobacterium
PAFMHVFGGLNWWAPKPLERWHSR

SEQ ID NO: 978976 - protein, 22 aa, Mycobacterium
PAGPSGPIPRPPAAGQPGWQQA

SEQ ID NO: 978977 - protein, 23 aa, Mycobacterium
PAHKVPVWSLLLMGAAALAVSVA

SEQ ID NO: 978978 - protein, 35 aa, Mycobacterium
PAKFEVIIKFVMGIPLLALAWLFGPRVMRLPFSRR

SEQ ID NO: 978979 - protein, 27 aa, Mycobacterium
PAKQFGIFILLFLLLAPVLNQWLFEFV

SEQ ID NO: 978980 - protein, 25 aa, Mycobacterium
PALDLDALIGGFRPLLKALDPDQVN

SEQ ID NO: 978981 - protein, 22 aa, Mycobacterium
PALDLDALLGGLRPVLKGLDAD

SEQ ID NO: 978982 - protein, 24 aa, Mycobacterium
PALPRGFWVPGYPVTPILSILACG

SEQ ID NO: 978983 - protein, 39 aa, Mycobacterium; identical to SEQ ID NO: 364509

SEQ ID NO: 978984 - protein, 19 aa, Mycobacterium
PALRRKLAPAKALQLGIKA

SEQ ID NO: 978985 - protein, 19 aa, Mycobacterium
PALTTPAAMALLIASGFQI

SEQ ID NO: 978986 - protein, 23 aa, Mycobacterium
PAPSKVRLAIVVGLAAVVAMAAL

SEQ ID NO: 978987 - protein, 22 aa, Mycobacterium
PAQIKLHFHLTDPDGVALDSFD

SEQ ID NO: 978988 - protein, 28 aa, Mycobacterium
PARGRLVTMLLVGVVLLAVGYSGGLGSP

SEQ ID NO: 978989 - protein, 17 aa, Mycobacterium
PARLTAVVLATCALPVI

SEQ ID NO: 978990 - protein, 22 aa, Mycobacterium
PARLVVPGLYGYVSATKWVVEL

SEQ ID NO: 978991 - protein, 18 aa, Mycobacterium
PASFRRWLNPVNTAAATA

SEQ ID NO: 978992 - protein, 20 aa, Mycobacterium
PASTPQQPPYYPAAAAPAAG

SEQ ID NO: 978993 - protein, 28 aa, Mycobacterium
PATPSSITLSGIWLLIVPSELAKTDPVI

SEQ ID NO: 978994 - protein, 27 aa, Mycobacterium
PAVPALPGPPPLIPPGGHQGPHGPPPP

SEQ ID NO: 978995 - protein, 19 aa, Mycobacterium
PAWEWKIAAYLFSGGLSAG

SEQ ID NO: 978996 - protein, 19 aa, Mycobacterium
PAWPFAVGVVAAVGAAALW

SEQ ID NO: 978997 - protein, 19 aa, Mycobacterium
PCGFAMLPAYLLLVVRGQH

SEQ ID NO: 978998 - protein, 31 aa, Mycobacterium; identical to SEQ ID NO: 364650

SEQ ID NO: 978999 - protein, 20 aa, Mycobacterium
PDDRYPRCIDFAKALAAGPG

SEQ ID NO: 979000 - protein, 26 aa, Mycobacterium
PDELPATGARLRWVPLRGPSATPAQG

SEQ ID NO: 979001 - protein, 29 aa, Mycobacterium
PDFAGYAPKLWRYWAQHLDPDRALRDDPR

SEQ ID NO: 979002 - protein, 23 aa, Mycobacterium
PDGARLWLPSYLAWFLGGMLLTV

SEQ ID NO: 979003 - protein, 22 aa, Mycobacterium
PDLVVSVVWWLAAVNLMLGLFN

SEQ ID NO: 979004 - protein, 23 aa, Mycobacterium
PDPHSFAVLFAPPRLAAQLTGQP

SEQ ID NO: 979005 - protein, 32 aa, Mycobacterium; identical to SEQ ID NO: 364695

SEQ ID NO: 979006 - protein, 44 aa, Mycobacterium; identical to SEQ ID NO: 364697

SEQ ID NO: 979007 - protein, 23 aa, Mycobacterium
PDQQALWRAVGVRGTTTAAAATA

SEQ ID NO: 979008 - protein, 26 aa, Mycobacterium
PDRRADLAMTWLVAGLVAGILSGAVA

SEQ ID NO: 979009 - protein, 31 aa, Mycobacterium; identical to SEQ ID NO: 163268

SEQ ID NO: 979010 - protein, 20 aa, Mycobacterium
PDSVWWWVCVSLLALVVLVM

SEQ ID NO: 979011 - protein, 28 aa, Mycobacterium
PDSYRLLNIVFMLVVVFTLVQGPSLRPI

SEQ ID NO: 979012 - protein, 25 aa, Mycobacterium
PEAIALIVVIARYLEPFTAVSELAP

SEQ ID NO: 979013 - protein, 23 aa, Mycobacterium
PEIRHQRRWNLDLGFRAGGPDER

SEQ ID NO: 979014 - protein, 26 aa, Mycobacterium
PELHPWLRDHTVDGVVLFPGAGFVEL

SEQ ID NO: 979015 - protein, 17 aa, Mycobacterium
PEPAPAPPVPALVVERL

SEQ ID NO: 979016 - protein, 26 aa, Mycobacterium
PEPDNYLIWAILTTLFCCLPLGIVSI

SEQ ID NO: 979017 - protein, 26 aa, Mycobacterium
PEPLERRRAWLHKLTPGKVVVAVVGL

SEQ ID NO: 979018 - protein, 35 aa, Mycobacterium; identical to SEQ ID NO: 364793

SEQ ID NO: 979019 - protein, 18 aa, Mycobacterium
PEVLASRHHATLIPTPQG

SEQ ID NO: 979020 - protein, 23 aa, Mycobacterium
PEVLNLLLIDFKGGATFLDLEKA

SEQ ID NO: 979021 - protein, 28 aa, Mycobacterium
PFAGQRPWTPLIGLLAQAADLGLRVIVT

SEQ ID NO: 979022 - protein, 26 aa, Mycobacterium
PFGEYLPMPWLFRHLSGYADRAGHFV

SEQ ID NO: 979023 - protein, 27 aa, Mycobacterium
PFNNACLILLGLFPLVVIFIITSFTMQ

SEQ ID NO: 979024 - protein, 21 aa, Mycobacterium
PFRGYLYWEQHCFNIPVCWAS

SEQ ID NO: 979025 - protein, 20 aa, Mycobacterium
PFTFFGWHWSLPLGVAIMLS

SEQ ID NO: 979026 - protein, 20 aa, Mycobacterium
PFVARMIRTLAVPIILFWLA

SEQ ID NO: 979027 - protein, 21 aa, Mycobacterium
PFVFGMPKFDFVACLTMIIVL

SEQ ID NO: 979028 - protein, 23 aa, Mycobacterium
PGAIIGFALLCLVAATIWLRSRK

SEQ ID NO: 979029 - protein, 24 aa, Mycobacterium
PGARALVVAILVFVLLGSFILPHT

SEQ ID NO: 979030 - protein, 33 aa, Mycobacterium
PGARWTIAVLAVVVALIIALAAQLREGSGSAGH

SEQ ID NO: 979031 - protein, 28 aa, Mycobacterium
PGCWVFALGVFLFWLLTTSRADYASRWL

SEQ ID NO: 979032 - protein, 23 aa, Mycobacterium
PGDLLYGLHAMLFNEPRVSEDQI

SEQ ID NO: 979033 - protein, 17 aa, Mycobacterium
PGEASLLVASYPEVPKR

SEQ ID NO: 979034 - protein, 25 aa, Mycobacterium
PGEATFYWLTLTLAAVWALGSLASG

SEQ ID NO: 979035 - protein, 28 aa, Mycobacterium
PGGLRLKMWLFPWLSYATIALMASVILA

SEQ ID NO: 979036 - protein, 20 aa, Mycobacterium
PGHHLATRPVARPPVDAASR

SEQ ID NO: 979037 - protein, 21 aa, Mycobacterium
PGIKVPNPVTIPKAPQAPATS

SEQ ID NO: 979038 - protein, 27 aa, Mycobacterium
PGLAQHGPWIAILTAALTALALHLGFI

SEQ ID NO: 979039 - protein, 18 aa, Mycobacterium
PGLAVFRAVFYFAADSHF

SEQ ID NO: 979040 - protein, 17 aa, Mycobacterium
PGLIIGALMYIPLLNRL

SEQ ID NO: 979041 - protein, 21 aa, Mycobacterium
PGNLIAVMRDGVVIGSAVFSE

SEQ ID NO: 979042 - protein, 18 aa, Mycobacterium
PGPVFVASLLIALVGMMV

SEQ ID NO: 979043 - protein, 63 aa, Mycobacterium
PGSLGWFTNRLLVPAVLIELAFSLIVMWVPPVARLLGQWNPPLWGWAVALASMPILLAVDALD

SEQ ID NO: 979044 - protein, 43 aa, Mycobacterium
PGVERRPSRLGRGWLVGISAVLLLAAGGIGAGGYLALRSHQES

SEQ ID NO: 979045 - protein, 19 aa, Mycobacterium
PGWMAQLVMVVLVAPVGVV

SEQ ID NO: 979046 - protein, 20 aa, Mycobacterium
PHMPPALTSYIFGGGADAAR

SEQ ID NO: 979047 - protein, 25 aa, Mycobacterium
PHVFLNAMFGLFGALALIAATIVLF

SEQ ID NO: 979048 - protein, 25 aa, Mycobacterium
PIAADDFWYLWRQMVSQPGVVDPAG

SEQ ID NO: 979049 - protein, 21 aa, Mycobacterium
PIGLDLPFTYPPLSAVVFSPF

SEQ ID NO: 979050 - protein, 36 aa, Mycobacterium; identical to SEQ ID NO: 365042

SEQ ID NO: 979051 - protein, 30 aa, Mycobacterium
PIKLRTTTLTLIYPTLSLPSWSAGSREVAC

SEQ ID NO: 979052 - protein, 20 aa, Mycobacterium
PIMIALLAAAIAPVPLALAV

SEQ ID NO: 979053 - protein, 27 aa, Mycobacterium
PIPTLEELLVALPQMRFNIDIKADSAV

SEQ ID NO: 979054 - protein, 21 aa, Mycobacterium
PIRAYAFFIIIGIVMGLMIGD

SEQ ID NO: 979055 - protein, 27 aa, Mycobacterium
PITELIRLIRRLLPAMVVVLAACALLT

SEQ ID NO: 979056 - protein, 29 aa, Mycobacterium
PIVVIVMAVFILMLPRLFPGSFEADPERV

SEQ ID NO: 979057 - protein, 20 aa, Mycobacterium
PIVWGLNHFGWHLAAQVPLW

SEQ ID NO: 979058 - protein, 40 aa, Mycobacterium
PKEPKFERRPLGVSWLIGVVVIPLLLAALGYGAYQRPTSV

SEQ ID NO: 979059 - protein, 19 aa, Mycobacterium
PKGVVLTKVDDRLISSADA

SEQ ID NO: 979060 - protein, 22 aa, Mycobacterium
PKLGWWLMEILATVVFAIFYLT

SEQ ID NO: 979061 - protein, 28 aa, Mycobacterium
PKPAATPPPSLFRVAGHRGLRGWQGGHR

SEQ ID NO: 979062 - protein, 23 aa, Mycobacterium
PKSFVADRLPKLCRSYLLAPSRQ

SEQ ID NO: 979063 - protein, 25 aa, Mycobacterium
PKVGPWALYGLLFTIVILFALQGDQ

SEQ ID NO: 979064 - protein, 17 aa, Mycobacterium
PKWKTIVRIVIPTGLSG

SEQ ID NO: 979065 - protein, 31 aa, Mycobacterium; identical to SEQ ID NO: 365122

SEQ ID NO: 979066 - protein, 31 aa, Mycobacterium
PLARWVLSLVGLLLIGYLAAVALQPAILDQL

SEQ ID NO: 979067 - protein, 20 aa, Mycobacterium
PLEHCYAYSDSITDLPMLEA

SEQ ID NO: 979068 - protein, 25 aa, Mycobacterium
PLEQSAPPGPAPPAPIAAAEYDPAT

SEQ ID NO: 979069 - protein, 18 aa, Mycobacterium
PLFAYAAAFLIAAAHITV

SEQ ID NO: 979070 - protein, 33 aa, Mycobacterium
PLGADPLLYPFQPIHVTIAAWFTIGIPSFILSL

SEQ ID NO: 979071 - protein, 29 aa, Mycobacterium
PLGLLVVVVLVIATLFLLRSMNRQLRKVP

SEQ ID NO: 979072 - protein, 18 aa, Mycobacterium
PLHDQWRPVLWAISILTM

SEQ ID NO: 979073 - protein, 18 aa, Mycobacterium
PLHKLQNPSWRPGAWLAT

SEQ ID NO: 979074 - protein, 26 aa, Mycobacterium
PLISRVHLLLRFDQGRWIAIDNGSLN

SEQ ID NO: 979075 - protein, 20 aa, Mycobacterium
PLITVGSPLLMTYFLVDVSG

SEQ ID NO: 979076 - protein, 32 aa, Mycobacterium
PLLGGYFTDCLGWRWAFWINLPVSAVVICVAT

SEQ ID NO: 979077 - protein, 22 aa, Mycobacterium
PLMIIVLAVLFRLFVRTRLIDA

SEQ ID NO: 979078 - protein, 18 aa, Mycobacterium
PLMTWQRWALLCVGIAQI

SEQ ID NO: 979079 - protein, 26 aa, Mycobacterium
PLNTRQLLLVNMLTDALPAAALAVSK

SEQ ID NO: 979080 - protein, 22 aa, Mycobacterium
PLPTEIYWRRRGLALGIAVVVI

SEQ ID NO: 979081 - protein, 21 aa, Mycobacterium
PLPTHRLILGAVLAMAVFLIA

SEQ ID NO: 979082 - protein, 19 aa, Mycobacterium
PLREILPAVQRLVIPVAED

SEQ ID NO: 979083 - protein, 39 aa, Mycobacterium; identical to SEQ ID NO: 365265

SEQ ID NO: 979084 - protein, 26 aa, Mycobacterium
PLSGKLAALWRGTLVVLQSILAVVFG

SEQ ID NO: 979085 - protein, 18 aa, Mycobacterium
PLSVVLSLSGFRIPWRDQ

SEQ ID NO: 979086 - protein, 34 aa, Mycobacterium; identical to SEQ ID NO: 365274

SEQ ID NO: 979087 - protein, 18 aa, Mycobacterium
PLTIIWPSGWSWGHGSSH

SEQ ID NO: 979088 - protein, 26 aa, Mycobacterium
PLTTLAALPWVTWLAVGNNIAHDLHL

SEQ ID NO: 979089 - protein, 22 aa, Mycobacterium
PLVRWTAHWPRRHALMVSLVCL

SEQ ID NO: 979090 - protein, 17 aa, Mycobacterium
PLVVALSPLLITSAVVM

SEQ ID NO: 979091 - protein, 17 aa, Mycobacterium
PMALLVHPTFSGTVGGL

SEQ ID NO: 979092 - protein, 25 aa, Mycobacterium
PMALSRILLGVHYPSDVAAGIAVGA

SEQ ID NO: 979093 - protein, 18 aa, Mycobacterium
PMGRSRMMLSKPVIAAVS

SEQ ID NO: 979094 - protein, 19 aa, Mycobacterium
PMIVPSRRLNPTPAISAEH

SEQ ID NO: 979095 - protein, 20 aa, Mycobacterium
PMLFSLGFLVTFLAGGLTGV

SEQ ID NO: 979096 - protein, 19 aa, Mycobacterium
PMPLPPGRAVLVTWAGDER

SEQ ID NO: 979097 - protein, 18 aa, Mycobacterium
PMPMAPQPPATLLQAVAA

SEQ ID NO: 979098 - protein, 37 aa, Mycobacterium; identical to SEQ ID NO: 365325

SEQ ID NO: 979099 - protein, 30 aa, Mycobacterium
PNSLADLNLPAWGSLRLALPMNGNSDATFL

SEQ ID NO: 979100 - protein, 19 aa, Mycobacterium
PNVTTWWAIQSSCIPTGCL

SEQ ID NO: 979101 - protein, 18 aa, Mycobacterium
PPARVVLWGLFGLGWVVV

SEQ ID NO: 979102 - protein, 40 aa, Mycobacterium
PPAVVRRRLRWWPVIAYGLLPALALLLAGGTGFAKWQDCA

SEQ ID NO: 979103 - protein, 31 aa, Mycobacterium
PPDIPEERLTLPPIPLQVPPAAPAPRQTQTA

SEQ ID NO: 979104 - protein, 31 aa, Mycobacterium
PPEPTVAAKTWPWIAAAVAVVVVIAGVLGVV

SEQ ID NO: 979105 - protein, 30 aa, Mycobacterium
PPGGPKTRIWAAPPLSYPTTRPPGISGGAI

SEQ ID NO: 979106 - protein, 21 aa, Mycobacterium
PPGWLPGWLRPVHSRRVTVAA

SEQ ID NO: 979107 - protein, 28 aa, Mycobacterium
PPIGQPGTPPLPLPFPRTGQGGEPHRKL

SEQ ID NO: 979108 - protein, 34 aa, Mycobacterium; identical to SEQ ID NO: 365417

SEQ ID NO: 979109 - protein, 20 aa, Mycobacterium
PPMAPVALAVQVGPLVMAAT

SEQ ID NO: 979110 - protein, 34 aa, Mycobacterium; identical to SEQ ID NO: 347907

SEQ ID NO: 979111 - protein, 19 aa, Mycobacterium
PPNILITRDDFAYLVDFGI

SEQ ID NO: 979112 - protein, 18 aa, Mycobacterium
PPPPLPADLPPNVRELIE

SEQ ID NO: 979113 - protein, 23 aa, Mycobacterium
PPQPSIPLQAKPIAVLAARQLRD

SEQ ID NO: 979114 - protein, 22 aa, Mycobacterium
PPRRRRELKTPWWETAQPAGRP

SEQ ID NO: 979115 - protein, 21 aa, Mycobacterium
PPRTVIIAAVVLTAATIGTIL

SEQ ID NO: 979116 - protein, 22 aa, Mycobacterium
PPSHILGLLNIVAALRTGVRVR

SEQ ID NO: 979117 - protein, 17 aa, Mycobacterium
PPSSPVTSFPALPAPLS

SEQ ID NO: 979118 - protein, 26 aa, Mycobacterium
PPTAIPLRHEGLSYRFPFHTEKKSYP

SEQ ID NO: 979119 - protein, 24 aa, Mycobacterium
PPTHRFPHLPPLPSVITIPGVPTT

SEQ ID NO: 979120 - protein, 24 aa, Mycobacterium
PQAPAPVPVPIPQAPAPAPEAPVP

SEQ ID NO: 979121 - protein, 24 aa, Mycobacterium
PQERRLVFERFYRSTSARAMPGSG

SEQ ID NO: 979122 - protein, 29 aa, Mycobacterium
PQHKPVDQLFWYRSTKFVMRRALPVGLAV

SEQ ID NO: 979123 - protein, 21 aa, Mycobacterium
PQPGWRNLRFPLAWAPPEANV

SEQ ID NO: 979124 - protein, 19 aa, Mycobacterium
PQPRERKRMSWQRWALLCV

SEQ ID NO: 979125 - protein, 17 aa, Mycobacterium
PRDPRGRRYSLMTLLAI

SEQ ID NO: 979126 - protein, 24 aa, Mycobacterium
PRDVTFYCLDYGGGQLRAIQDLLH

SEQ ID NO: 979127 - protein, 31 aa, Mycobacterium
PRGRNPWPIVAAVAIVLVLIVGGIGVWTITQ

SEQ ID NO: 979128 - protein, 21 aa, Mycobacterium
PRGRRYSLMTLLAIAVLATAA

SEQ ID NO: 979129 - protein, 22 aa, Mycobacterium
PRGRRYSLMVLLAIAVLATAAG

SEQ ID NO: 979130 - protein, 19 aa, Mycobacterium
PRIFLADFGIARQLDDISG

SEQ ID NO: 979131 - protein, 17 aa, Mycobacterium
PRIWALALVYFGIAYGL

SEQ ID NO: 979132 - protein, 20 aa, Mycobacterium
PRKISFLPGMRYYAGNWDTT

SEQ ID NO: 979133 - protein, 28 aa, Mycobacterium
PRLAPPPAMPPTLAWWASSLQLSGLSAG

SEQ ID NO: 979134 - protein, 30 aa, Mycobacterium
PRLIDAYVDWLWFGELGYLSVFTTVLVTRF

SEQ ID NO: 979135 - protein, 18 aa, Mycobacterium
PRLPLFAAAAKVVADLLE

SEQ ID NO: 979136 - protein, 25 aa, Mycobacterium
PRMVHAIYILKLIFGYALGVVIVAT

SEQ ID NO: 979137 - protein, 20 aa, Mycobacterium
PRMVSFLPGMRYYAGNWDAT

SEQ ID NO: 979138 - protein, 19 aa, Mycobacterium
PRPPVFVLVVVALTLVGFA

SEQ ID NO: 979139 - protein, 31 aa, Mycobacterium; identical to SEQ ID NO: 365633

SEQ ID NO: 979140 - protein, 22 aa, Mycobacterium
PRTWGLVGWISDLVPHLGYGVV

SEQ ID NO: 979141 - protein, 36 aa, Mycobacterium; identical to SEQ ID NO: 365648

SEQ ID NO: 979142 - protein, 24 aa, Mycobacterium
PRWRVVALPFTALLGPVFFVVRFL

SEQ ID NO: 979143 - protein, 38 aa, Mycobacterium; identical to SEQ ID NO: 365674

SEQ ID NO: 979144 - protein, 24 aa, Mycobacterium
PSGPLPYIVMEYVNGFTLRDIVHT

SEQ ID NO: 979145 - protein, 28 aa, Mycobacterium
PSIAALLGKWFWWPQVVRQRPAPQPWPT

SEQ ID NO: 979146 - protein, 26 aa, Mycobacterium
PSPTEFLWIVDIYPLIMASLMLMAGA

SEQ ID NO: 979147 - protein, 31 aa, Mycobacterium
PSRYRHIPAMLLALSLVLFTVAMAGPTHDVR

SEQ ID NO: 979148 - protein, 25 aa, Mycobacterium
PSSLARTALLLAGALLCLSVAAWPV

SEQ ID NO: 979149 - protein, 18 aa, Mycobacterium
PSSLPTLLVPHVPFALET

SEQ ID NO: 979150 - protein, 42 aa, Mycobacterium
PSTRFTGWEWVLTALALPVVTWAAWPFHRIALRNARHHGASM

SEQ ID NO: 979151 - protein, 31 aa, Mycobacterium
PSVAALLGRWFWWPLRVRPRPASYMLGPFGP

SEQ ID NO: 979152 - protein, 26 aa, Mycobacterium
PTFAAWANMFMLGVAFVFALAGAMLA

SEQ ID NO: 979153 - protein, 23 aa, Mycobacterium
PTKASPLVVLLIDELAGLTAYMS

SEQ ID NO: 979154 - protein, 25 aa, Mycobacterium
PTKGDPWYTSLWHTIADAPHLPPAA

SEQ ID NO: 979155 - protein, 20 aa, Mycobacterium
PTMMPISVLVSMAQIDGKWL

SEQ ID NO: 979156 - protein, 37 aa, Mycobacterium; identical to SEQ ID NO: 365806

SEQ ID NO: 979157 - protein, 25 aa, Mycobacterium
PTRTALLMALLPIVVGLLTPFIGKS

SEQ ID NO: 979158 - protein, 20 aa, Mycobacterium
PTSVMGLWTFDGHKGQTEVT

SEQ ID NO: 979159 - protein, 17 aa, Mycobacterium
PTVLFQTTVSKLRDLLA

SEQ ID NO: 979160 - protein, 18 aa, Mycobacterium
PVAGPVLGRLGWFVESKL

SEQ ID NO: 979161 - protein, 18 aa, Mycobacterium
PVALVTVALLIGLATGLL

SEQ ID NO: 979162 - protein, 34 aa, Mycobacterium
PVASPRTWPLVALAIIAIVGVVLGAAALVVALTR

SEQ ID NO: 979163 - protein, 26 aa, Mycobacterium
PVDAPLTMVFAHGFCLRMGAFHFERM

SEQ ID NO: 979164 - protein, 26 aa, Mycobacterium
PVGNRWILPLYLFLATLACYATVSGL

SEQ ID NO: 979165 - protein, 20 aa, Mycobacterium
PVIVWAGRPFHQAAWVNLKH

SEQ ID NO: 979166 - protein, 19 aa, Mycobacterium
PVLKTPAWEWKIAAYLFSG

SEQ ID NO: 979167 - protein, 21 aa, Mycobacterium
PVLLPMIGVLLWTAGICAVCA

SEQ ID NO: 979168 - protein, 17 aa, Mycobacterium
PVLLVAPVVLVALGVVP

SEQ ID NO: 979169 - protein, 17 aa, Mycobacterium
PVLWAISILTMAVGTIT

SEQ ID NO: 979170 - protein, 17 aa, Mycobacterium
PVLWILSLSPKPTSTVK

SEQ ID NO: 979171 - protein, 20 aa, Mycobacterium
PVMIVLLLNVAAAYSAKRLA

SEQ ID NO: 979172 - protein, 26 aa, Mycobacterium
PVPDSLIHLCLFIGALTFMYISARAV

SEQ ID NO: 979173 - protein, 18 aa, Mycobacterium
PVQAPAPEVPPPVAVPEP

SEQ ID NO: 979174 - protein, 31 aa, Mycobacterium
PVSPSRPLPRRNLVMGLAAGLLLGIAVALAR

SEQ ID NO: 979175 - protein, 30 aa, Mycobacterium; identical to SEQ ID NO: 365974

SEQ ID NO: 979176 - protein, 17 aa, Mycobacterium
PVTIFLGATPIGDAASA

SEQ ID NO: 979177 - protein, 30 aa, Mycobacterium
PVTLTGWALLVMILIALIVYGIIELISDRQ

SEQ ID NO: 979178 - protein, 24 aa, Mycobacterium
PVTNGPVWVLAGFGAQHRKMGKSL

SEQ ID NO: 979179 - protein, 25 aa, Mycobacterium
PVVLAVWVLIVGWRRGPVGPVALVA

SEQ ID NO: 979180 - protein, 18 aa, Mycobacterium
PVVVRIAAATFAGWTLLA

SEQ ID NO: 979181 - protein, 30 aa, Mycobacterium
PWLPARWRHWWWGLLLAFVPTHLVISAIVP

SEQ ID NO: 979182 - protein, 26 aa, Mycobacterium
PWSNSFPRLRWSLTTALLELSVIVLV

SEQ ID NO: 979183 - protein, 21 aa, Mycobacterium
PWTVILARFVPFARTFVPVIA

SEQ ID NO: 979184 - protein, 20 aa, Mycobacterium
PYIVCGLYVVLLIIAGIGAM

SEQ ID NO: 979185 - protein, 20 aa, Mycobacterium
PYIVYFTPLFDTLVRYHWGH

SEQ ID NO: 979186 - protein, 28 aa, Mycobacterium
PYTGYLTLVFLFAVLVLMGFSYPIDTWT

SEQ ID NO: 979187 - protein, 23 aa, Mycobacterium
PYTQITLQMLLLGGGLGLTTAPA

SEQ ID NO: 979188 - protein, 18 aa, Mycobacterium
QAFIFALLTILYFSQAME

SEQ ID NO: 979189 - protein, 21 aa, Mycobacterium
QAGIRLWTAALALTAGWMVLY

SEQ ID NO: 979190 - protein, 28 aa, Mycobacterium
QAGQPGAALAALAALAAKAGGIVAGGGG

SEQ ID NO: 979191 - protein, 26 aa, Mycobacterium
QAIPTLFKTGLPNTLILTLSASIIGL

SEQ ID NO: 979192 - protein, 31 aa, Mycobacterium
QALKMSLNTPYYRLMLKLKGGPEAVADAAHQ

SEQ ID NO: 979193 - protein, 20 aa, Mycobacterium
QALLAALLLGLVAGLIGPFI

SEQ ID NO: 979194 - protein, 24 aa, Mycobacterium
QANNVLVFPGIGLGVIVAGARLLT

SEQ ID NO: 979195 - protein, 25 aa, Mycobacterium
QARLRDRSWWSGPGIYLMVDDYDLE

SEQ ID NO: 979196 - protein, 22 aa, Mycobacterium
QARSHLLMAGYLPAAATAEVMS

SEQ ID NO: 979197 - protein, 17 aa, Mycobacterium
QATPTVPGPVAPAPAAA

SEQ ID NO: 979198 - protein, 24 aa, Mycobacterium
QAVSYLLIAYLNFTWPTHAHLETS

SEQ ID NO: 979199 - protein, 25 aa, Mycobacterium
QCARRPLPPLPAMGKLLAAALLGAL

SEQ ID NO: 979200 - protein, 23 aa, Mycobacterium
QDEQFRVRFIREADLAATLSHPN

SEQ ID NO: 979201 - protein, 24 aa, Mycobacterium
QDIFYSLLKTVIFVWIASTILCYY

SEQ ID NO: 979202 - protein, 20 aa, Mycobacterium
QDIPQLPPGPPPPAAAGPGE

SEQ ID NO: 979203 - protein, 25 aa, Mycobacterium
QDQLTGFVYAFDDLLARNNASWADL

SEQ ID NO: 979204 - protein, 25 aa, Mycobacterium
QDQLVNYIFGGLRQPWRPKTFARAL

SEQ ID NO: 979205 - protein, 31 aa, Mycobacterium; identical to SEQ ID NO: 163405

SEQ ID NO: 979206 - protein, 24 aa, Mycobacterium
QELRGLWYSFTTGSVRVISLSNDD

SEQ ID NO: 979207 - protein, 25 aa, Mycobacterium
QESALKYFLLGAFSSAVFLYGVALL

SEQ ID NO: 979208 - protein, 23 aa, Mycobacterium
QESRLWHVGLAAVSLLGLGTLLG

SEQ ID NO: 979209 - protein, 27 aa, Mycobacterium
QFAIRPSGVFLRRLIHAPATTTSKSST

SEQ ID NO: 979210 - protein, 20 aa, Mycobacterium
QFDSLLSTVRPFLDKNREVL

SEQ ID NO: 979211 - protein, 26 aa, Mycobacterium
QFGITTVYHFIFLPLTIGLAPLLAIM

SEQ ID NO: 979212 - protein, 26 aa, Mycobacterium
QFKSCITFRPWSRCWRPVRCETRCAA

SEQ ID NO: 979213 - protein, 17 aa, Mycobacterium
QFLSIPLYILTLGLIHV

SEQ ID NO: 979214 - protein, 32 aa, Mycobacterium
QFSYAMMYELFFPSLLEKRLLRLLFRVDAAVF

SEQ ID NO: 979215 - protein, 17 aa, Mycobacterium
QFTLPVAAPATADPEHL

SEQ ID NO: 979216 - protein, 19 aa, Mycobacterium
QFWTKVRRGALFKAAAVLV

SEQ ID NO: 979217 - protein, 20 aa, Mycobacterium
QFYAAMLAGLGLDAVNLPPQ

SEQ ID NO: 979218 - protein, 22 aa, Mycobacterium
QFYTPWRWLPRIVTQFVAGALA

SEQ ID NO: 979219 - protein, 25 aa, Mycobacterium
QGKSQLLNALLNLPVARVGDDEATV

SEQ ID NO: 979220 - protein, 23 aa, Mycobacterium
QGLRFVWNLRVLRALALIDLTVT

SEQ ID NO: 979221 - protein, 26 aa, Mycobacterium
QHARRTVLIWVAVVLAITGMVAAAAW

SEQ ID NO: 979222 - protein, 18 aa, Mycobacterium
QHDSFGLPTPPRVSPDRL

SEQ ID NO: 979223 - protein, 25 aa, Mycobacterium
QHLNDWINELLYRLLEKGSSVSGGW

SEQ ID NO: 979224 - protein, 17 aa, Mycobacterium
QHLTPKVFKAAAWVAIV

SEQ ID NO: 979225 - protein, 17 aa, Mycobacterium
QIDHFWWTAIWAAIVLS

SEQ ID NO: 979226 - protein, 20 aa, Mycobacterium
QILNLLSIAAVFMGTALTIR

SEQ ID NO: 979227 - protein, 17 aa, Mycobacterium
QINPIWNLGPYKPAHVS

SEQ ID NO: 979228 - protein, 26 aa, Mycobacterium
QKASAWLFDMAMLAVLSIAYTAIVWW

SEQ ID NO: 979229 - protein, 24 aa, Mycobacterium
QKISELYDRVGFAAAGKFNEFDNL

SEQ ID NO: 979230 - protein, 25 aa, Mycobacterium
QKRAFDFCFALTALIAASPLLIAAA

SEQ ID NO: 979231 - protein, 20 aa, Mycobacterium
QKTMGVIFLALMSYGAVSTS

SEQ ID NO: 979232 - protein, 22 aa, Mycobacterium
QLADRKGIWQALLGSDAIYFEV

SEQ ID NO: 979233 - protein, 30 aa, Mycobacterium; identical to SEQ ID NO: 366378

SEQ ID NO: 979234 - protein, 17 aa, Mycobacterium
QLAQLWGLEVFATASPG

SEQ ID NO: 979235 - protein, 25 aa, Mycobacterium
QLARYEPRAPKLWLPPLDESIQLTA

SEQ ID NO: 979236 - protein, 19 aa, Mycobacterium
QLGALRGALLTEPALAPNG

SEQ ID NO: 979237 - protein, 25 aa, Mycobacterium
QLGTVRTAPLGRKPLRFTSFGDQGT

SEQ ID NO: 979238 - protein, 44 aa, Mycobacterium; identical to SEQ ID NO: 366412

SEQ ID NO: 979239 - protein, 25 aa, Mycobacterium
QLITIARAFLAGPQFLILDEATSSV

SEQ ID NO: 979240 - protein, 19 aa, Mycobacterium
QLLDTVFDKALHQICTRAT

SEQ ID NO: 979241 - protein, 26 aa, Mycobacterium
QLLGPGPKWWGVTLLVIGAFSAMYGV

SEQ ID NO: 979242 - protein, 38 aa, Mycobacterium
QLLPTLLATVRWRRRRTRLAIWVALSAAAVFLGIGVLV

SEQ ID NO: 979243 - protein, 17 aa, Mycobacterium
QLLVLLCGGLVGPIFLI

SEQ ID NO: 979244 - protein, 30 aa, Mycobacterium; identical to SEQ ID NO: 366433

SEQ ID NO: 979245 - protein, 30 aa, Mycobacterium
QLPPLSQIFELGVLIPVVAFAAALIAPLLV

SEQ ID NO: 979246 - protein, 31 aa, Mycobacterium
QLRRINFEPYRLWQPPLTQPVAIDDLVNWFL

SEQ ID NO: 979247 - protein, 17 aa, Mycobacterium
QLRRVAVWGPWVSIGAA

SEQ ID NO: 979248 - protein, 22 aa, Mycobacterium
QLVGLVVLVSLIPIGLLLGDFT

SEQ ID NO: 979249 - protein, 28 aa, Mycobacterium
QNAQPGKFMPLLPTQQQAPVPPPPPDAP

SEQ ID NO: 979250 - protein, 23 aa, Mycobacterium
QNEQLLLALMPEPVVQRYRADGE

SEQ ID NO: 979251 - protein, 26 aa, Mycobacterium
QNLGWAFGYNTAAIPLAALGVLNPVV

SEQ ID NO: 979252 - protein, 32 aa, Mycobacterium; identical to SEQ ID NO: 366520

SEQ ID NO: 979253 - protein, 18 aa, Mycobacterium
QNPSWRPGAWLATILVVA

SEQ ID NO: 979254 - protein, 27 aa, Mycobacterium
QNYGMTLLWTLALLIPVLYVNQEMVLR

SEQ ID NO: 979255 - protein, 23 aa, Mycobacterium
QPDNYLVWSILVTLFCCLPLGIV

SEQ ID NO: 979256 - protein, 18 aa, Mycobacterium
QPGLWIPGSSVSAARLVQ

SEQ ID NO: 979257 - protein, 22 aa, Mycobacterium
QPGTKGFVALIGSIAGVIGVLI

SEQ ID NO: 979258 - protein, 23 aa, Mycobacterium
QPGTKGFVALIGSIAGVIGVLIF

SEQ ID NO: 979259 - protein, 17 aa, Mycobacterium
QPKKAAAALVWLVEEME

SEQ ID NO: 979260 - protein, 35 aa, Mycobacterium
QPNLDTRPRLILGATLIALSFLGLRHLWSGSPETP

SEQ ID NO: 979261 - protein, 30 aa, Mycobacterium; identical to SEQ ID NO: 366561

SEQ ID NO: 979262 - protein, 22 aa, Mycobacterium
QPPGNPLPVVPLAFDPPEHTRY

SEQ ID NO: 979263 - protein, 17 aa, Mycobacterium
QPPPCLTGFIPAEQWRS

SEQ ID NO: 979264 - protein, 17 aa, Mycobacterium
QPRWVTRLGLAVGVALT

SEQ ID NO: 979265 - protein, 34 aa, Mycobacterium
QPSLFAVEVALFALLRFWGVVPDYVIGHSVGELA

SEQ ID NO: 979266 - protein, 37 aa, Mycobacterium
QPTVEIVPGITIPVGPPTTITLAPPPPPGAPPADNPP

SEQ ID NO: 979267 - protein, 23 aa, Mycobacterium
QPVFGFIFPIVFPVVLVVFVRSM

SEQ ID NO: 979268 - protein, 25 aa, Mycobacterium
QQALSYFNCTDFADLFTLLEQDKAT

SEQ ID NO: 979269 - protein, 18 aa, Mycobacterium
QQGKNFYYFPDQLSIDRY

SEQ ID NO: 979270 - protein, 26 aa, Mycobacterium
QQGVRWARRLAWISLAVLVTEGAVGV

SEQ ID NO: 979271 - protein, 19 aa, Mycobacterium
QQPFLGRWLLLTAVMFALS

SEQ ID NO: 979272 - protein, 18 aa, Mycobacterium
QQPPYYPAAAAPAAGSPP

SEQ ID NO: 979273 - protein, 17 aa, Mycobacterium
QQTALWQQVLNDGFTDL

SEQ ID NO: 979274 - protein, 20 aa, Mycobacterium
QQVGFTLSAPLRSLTKPSLS

SEQ ID NO: 979275 - protein, 19 aa, Mycobacterium
QQVWLITATPYELAATIAR

SEQ ID NO: 979276 - protein, 22 aa, Mycobacterium
QRITWIVTMYLLGYIAAMPLLS

SEQ ID NO: 979277 - protein, 27 aa, Mycobacterium
QRLKKPILVWWIAWVVSTATSLFAIAT

SEQ ID NO: 979278 - protein, 28 aa, Mycobacterium
QRNRPRLWLCYALTLMLSILLNLTLATL

SEQ ID NO: 979279 - protein, 31 aa, Mycobacterium; identical to SEQ ID NO: 347928

SEQ ID NO: 979280 - protein, 18 aa, Mycobacterium
QRRRFWEVPGADGPADAT

SEQ ID NO: 979281 - protein, 23 aa, Mycobacterium
QRSGGALRQLWWKLRLRGSETAP

SEQ ID NO: 979282 - protein, 23 aa, Mycobacterium
QRTLAVFLATFAYALTVLRSVRN

SEQ ID NO: 979283 - protein, 26 aa, Mycobacterium
QRTLRTDLWWWAPLVTNIGFLAFIVY

SEQ ID NO: 979284 - protein, 22 aa, Mycobacterium
QRVYRPYPYILAIVDELADLMM

SEQ ID NO: 979285 - protein, 23 aa, Mycobacterium
QRVYRPYPYILAIVDELADLMMT

SEQ ID NO: 979286 - protein, 17 aa, Mycobacterium
QRWTGVDLTLDVSGNVG

SEQ ID NO: 979287 - protein, 26 aa, Mycobacterium
QSATTFPWVFLFPAGVLVLILVCANL

SEQ ID NO: 979288 - protein, 24 aa, Mycobacterium
QSGSIGLGFAIPVDQAKRIADELI

SEQ ID NO: 979289 - protein, 28 aa, Mycobacterium
QSRSVLMGVLIFITGLVGCFVFSLIRPN

SEQ ID NO: 979290 - protein, 19 aa, Mycobacterium
QTFFIIAYMCACSAAALSS

SEQ ID NO: 979291 - protein, 25 aa, Mycobacterium
QTGNLVTWWTGDALLVFNTGKLTQR

SEQ ID NO: 979292 - protein, 29 aa, Mycobacterium
QTHQAPPAGPPPIGMPPKTAVPQSIPPRD

SEQ ID NO: 979293 - protein, 27 aa, Mycobacterium
QTLKDYVAFPLLAGPFAPFVFAGNLTA

SEQ ID NO: 979294 - protein, 28 aa, Mycobacterium
QTQAARMLLWFLIALPIGAVTGGWIATR

SEQ ID NO: 979295 - protein, 29 aa, Mycobacterium
QTVNLPTYAFQRQRFWLDANRIGQGDPAS

SEQ ID NO: 979296 - protein, 20 aa, Mycobacterium
QTWVLVFAITMMAGLVVSLL

SEQ ID NO: 979297 - protein, 47 aa, Mycobacterium
QVETVHRPRWSWRRMALVAELVVLLVVAGLFISRAVIRNNYYVAEFD

SEQ ID NO: 979298 - protein, 24 aa, Mycobacterium
QVGALPLLSPMLAAGTIILTVVFA

SEQ ID NO: 979299 - protein, 37 aa, Mycobacterium; identical to SEQ ID NO: 366771

SEQ ID NO: 979300 - protein, 28 aa, Mycobacterium
QVGLLRNYVLPLGALLLLLVNATGVPAH

SEQ ID NO: 979301 - protein, 20 aa, Mycobacterium
QVGRPRKYFGDTLVAVTGAG

SEQ ID NO: 979302 - protein, 20 aa, Mycobacterium
QVHIAWLVPLIGVDFDIGRL

SEQ ID NO: 979303 - protein, 26 aa, Mycobacterium
QVPIEEVLFFLVIPICALLTLNAVST

SEQ ID NO: 979304 - protein, 27 aa, Mycobacterium
QVRTIVVPVVVALLLVSAVAFAVTQVL

SEQ ID NO: 979305 - protein, 20 aa, Mycobacterium
QVTALLFALPIYARVTRRRV

SEQ ID NO: 979306 - protein, 23 aa, Mycobacterium
QVTGWRFVMRRIASGIALHDTRM

SEQ ID NO: 979307 - protein, 19 aa, Mycobacterium
QVVVFPLTPPQPTAIPQTE

SEQ ID NO: 979308 - protein, 20 aa, Mycobacterium
QVWLIDPRRQLLTALGSNYV

SEQ ID NO: 979309 - protein, 18 aa, Mycobacterium
QWIYWVDLTVCVAVGYTA

SEQ ID NO: 979310 - protein, 17 aa, Mycobacterium
QWRRLPLVPATIVGWGG

SEQ ID NO: 979311 - protein, 26 aa, Mycobacterium
QYALAATAFHLLAGVPPFDHSNRAVV

SEQ ID NO: 979312 - protein, 21 aa, Mycobacterium
QYDKLPLFQSGKQYSACFADA

SEQ ID NO: 979313 - protein, 21 aa, Mycobacterium
QYPSALRITIVERVPLVAKDF

SEQ ID NO: 979314 - protein, 19 aa, Mycobacterium
RAAADAIRLSRRTLNTIKT

SEQ ID NO: 979315 - protein, 27 aa, Mycobacterium
RAALLGVLTRRAVTIPLAALAAACRRF

SEQ ID NO: 979316 - protein, 19 aa, Mycobacterium
RAALPPPPTWFAALVLIFA

SEQ ID NO: 979317 - protein, 18 aa, Mycobacterium
RAAYWSEPEPRWPKSEPI

SEQ ID NO: 979318 - protein, 20 aa, Mycobacterium
RADLARDPSFYLRFRREAQN

SEQ ID NO: 979319 - protein, 28 aa, Mycobacterium
RADVYSLGCALFRLLTGRAPYEDLRGPA

SEQ ID NO: 979320 - protein, 27 aa, Mycobacterium
RAESRLNRLLALQIPPARKVVTGQDGQ

SEQ ID NO: 979321 - protein, 28 aa, Mycobacterium
RAGGRYSVYVWALLAMVAARMGLGPLQR

SEQ ID NO: 979322 - protein, 18 aa, Mycobacterium
RAGLFYVPLAVVAAVCAF

SEQ ID NO: 979323 - protein, 22 aa, Mycobacterium
RAGMIVVHPSWWSAARVAVVTR

SEQ ID NO: 979324 - protein, 21 aa, Mycobacterium
RAGVWLARRSGLARLINLYGT

SEQ ID NO: 979325 - protein, 17 aa, Mycobacterium
RAHLPALALLGACVALL

SEQ ID NO: 979326 - protein, 25 aa, Mycobacterium
RAIRIRFWRRIGTAVVRWPAPILLA

SEQ ID NO: 979327 - protein, 18 aa, Mycobacterium
RALDWREAFAGLGAQRTD

SEQ ID NO: 979328 - protein, 18 aa, Mycobacterium
RALGLTGRLPAAVLTLDQ

SEQ ID NO: 979329 - protein, 24 aa, Mycobacterium
RALMWLVDLLLVVPSFILIAIVTP

SEQ ID NO: 979330 - protein, 17 aa, Mycobacterium
RALRLMSQRVASAAGMG

SEQ ID NO: 979331 - protein, 25 aa, Mycobacterium
RAMPYMIVILIVGMIIAMVATGMRI

SEQ ID NO: 979332 - protein, 17 aa, Mycobacterium
RAPLRATSSLSLRWRVM

SEQ ID NO: 979333 - protein, 30 aa, Mycobacterium; identical to SEQ ID NO: 366996

SEQ ID NO: 979334 - protein, 30 aa, Mycobacterium; identical to SEQ ID NO: 367001

SEQ ID NO: 979335 - protein, 26 aa, Mycobacterium
RARGPLWLIILGFSAGVALLVGFRQF

SEQ ID NO: 979336 - protein, 30 aa, Mycobacterium; identical to SEQ ID NO: 367032

SEQ ID NO: 979337 - protein, 30 aa, Mycobacterium; identical to SEQ ID NO: 367039

SEQ ID NO: 979338 - protein, 18 aa, Mycobacterium
RAVAIVRQIAAALDAAHS

SEQ ID NO: 979339 - protein, 41 aa, Mycobacterium
RAVKWARIARLSIVVKVAALLIVFGFAGLSAYFVWNHGQVT

SEQ ID NO: 979340 - protein, 25 aa, Mycobacterium
RAVLRIGNYLIVLAAALVALTVAVS

SEQ ID NO: 979341 - protein, 24 aa, Mycobacterium
RAVRAYPRTASVVIWYSPAHCDTA

SEQ ID NO: 979342 - protein, 18 aa, Mycobacterium
RAWQLTRRTRRWDPDYYR

SEQ ID NO: 979343 - protein, 24 aa, Mycobacterium
RCRPDHPFLVCDSDRISYAQADLR

SEQ ID NO: 979344 - protein, 36 aa, Mycobacterium
RDERDRLALWSRVLPITFTAIGWVALVGGGLLTSFS

SEQ ID NO: 979345 - protein, 34 aa, Mycobacterium; identical to SEQ ID NO: 367110

SEQ ID NO: 979346 - protein, 23 aa, Mycobacterium
RDHVVHGWVLASGSFMLCAAFNV

SEQ ID NO: 979347 - protein, 35 aa, Mycobacterium; identical to SEQ ID NO: 367127

SEQ ID NO: 979348 - protein, 27 aa, Mycobacterium
RDLESGLWSWLKWLPHVDIPGQADGVG

SEQ ID NO: 979349 - protein, 18 aa, Mycobacterium
RDPSFYLRFRREAQNAAA

SEQ ID NO: 979350 - protein, 18 aa, Mycobacterium
RDRTSFIIAHRLSTIRDA

SEQ ID NO: 979351 - protein, 34 aa, Mycobacterium; identical to SEQ ID NO: 163488

SEQ ID NO: 979352 - protein, 36 aa, Mycobacterium
RDVLFGGRVSYLALVILVFIALALGAIGGVIGRKTA

SEQ ID NO: 979353 - protein, 23 aa, Mycobacterium
REAGYLIPVVPLLIGGQLTVWLS

SEQ ID NO: 979354 - protein, 26 aa, Mycobacterium
RECVALLWFLGVYLVVLAFVPALTRV

SEQ ID NO: 979355 - protein, 17 aa, Mycobacterium
RESIAIRPIPFLVTTRL

SEQ ID NO: 979356 - protein, 27 aa, Mycobacterium
REVLDYPAYGWPAVAPPQPPVHPGPMP

SEQ ID NO: 979357 - protein, 24 aa, Mycobacterium
RFGFLLAIPAVFASGLFSLPDAFH

SEQ ID NO: 979358 - protein, 33 aa, Mycobacterium; identical to SEQ ID NO: 367258

SEQ ID NO: 979359 - protein, 28 aa, Mycobacterium
RFGTHLLTIVLLAGLLWLVWMDRNPASD

SEQ ID NO: 979360 - protein, 20 aa, Mycobacterium
RFLHAAVFSGLIWLAVLLPM

SEQ ID NO: 979361 - protein, 19 aa, Mycobacterium
RFLMSGVTLVLILATYEVR

SEQ ID NO: 979362 - protein, 32 aa, Mycobacterium
RFMPPVGVFLYWLRPKTIRLPPWPAKVPFTDG

SEQ ID NO: 979363 - protein, 17 aa, Mycobacterium
RGAAGFLGFAIGGPLSD

SEQ ID NO: 979364 - protein, 19 aa, Mycobacterium
RGAIGLALVAALIAAAFGM

SEQ ID NO: 979365 - protein, 21 aa, Mycobacterium
RGAQLGIFLKGYQSLEATRSV

SEQ ID NO: 979366 - protein, 17 aa, Mycobacterium
RGEPISVLGLALLTSLA

SEQ ID NO: 979367 - protein, 23 aa, Mycobacterium
RGEQYLPAMFFFAVLGFANFADM

SEQ ID NO: 979368 - protein, 18 aa, Mycobacterium
RGFTSFRFPMNSMGAFHE

SEQ ID NO: 979369 - protein, 21 aa, Mycobacterium
RGHRWAVIPGCWVFALGVFLF

SEQ ID NO: 979370 - protein, 17 aa, Mycobacterium
RGKLILCAAVGVLSVVV

SEQ ID NO: 979371 - protein, 20 aa, Mycobacterium
RGLEVLPADKIPVLLDETAQ

SEQ ID NO: 979372 - protein, 20 aa, Mycobacterium
RGLRLLGLVALEDPPREGIG

SEQ ID NO: 979373 - protein, 24 aa, Mycobacterium
RGLRRPWLYFVSSLFTSFAFALGF

SEQ ID NO: 979374 - protein, 26 aa, Mycobacterium
RGLRTRLLRAMGPQARRLVVAAPFAG

SEQ ID NO: 979375 - protein, 19 aa, Mycobacterium
RGLVVWVRVWPAVTAGPGV

SEQ ID NO: 979376 - protein, 17 aa, Mycobacterium
RGMLLGSSLFSIAAALV

SEQ ID NO: 979377 - protein, 18 aa, Mycobacterium
RGQRFSRLPAGRAILLSD

SEQ ID NO: 979378 - protein, 18 aa, Mycobacterium
RGQRFSRLPAGRAMLLGD

SEQ ID NO: 979379 - protein, 32 aa, Mycobacterium; identical to SEQ ID NO: 367385

SEQ ID NO: 979380 - protein, 36 aa, Mycobacterium
RGRALGMVAFMAYFYSLYLRAGVAQLPWMIGAVLVG

SEQ ID NO: 979381 - protein, 22 aa, Mycobacterium
RGRDTLFVLYLGTLMVPLTVTV

SEQ ID NO: 979382 - protein, 33 aa, Mycobacterium
RGRLPLLCCLVAFILTFFVTRTFVRVIRGRPDD

SEQ ID NO: 979383 - protein, 21 aa, Mycobacterium
RGRRLRFRPGRAVTGVALLVV

SEQ ID NO: 979384 - protein, 25 aa, Mycobacterium
RGSTATIAALLLASGALAGLPPAYA

SEQ ID NO: 979385 - protein, 20 aa, Mycobacterium
RGVALAIWTATGGVATLVGP

SEQ ID NO: 979386 - protein, 30 aa, Mycobacterium; identical to SEQ ID NO: 367441

SEQ ID NO: 979387 - protein, 17 aa, Mycobacterium
RGYLLRDGELTQITKDD

SEQ ID NO: 979388 - protein, 28 aa, Mycobacterium
RHPHWARLVWPVVVLILITGLAALGSGF

SEQ ID NO: 979389 - protein, 24 aa, Mycobacterium
RHTDQWVLIIVGLVVGVALGVPPA

SEQ ID NO: 979390 - protein, 24 aa, Mycobacterium
RHVDTWILALLYIGTFGSFIGYSA

SEQ ID NO: 979391 - protein, 18 aa, Mycobacterium
RIGAQGLRILLLGVAAVA

SEQ ID NO: 979392 - protein, 18 aa, Mycobacterium
RIGLFYLGSTVLLALLLP

SEQ ID NO: 979393 - protein, 23 aa, Mycobacterium
RILRVLRGFEPDVVHLASPALLG

SEQ ID NO: 979394 - protein, 26 aa, Mycobacterium
RIMAGLVVIIPLYALAMIMSFFSPQM

SEQ ID NO: 979395 - protein, 20 aa, Mycobacterium
RISLIAFGRLVISAGLVGLS

SEQ ID NO: 979396 - protein, 21 aa, Mycobacterium
RITGFARVVLLAAILGAALSS

SEQ ID NO: 979397 - protein, 21 aa, Mycobacterium
RITRRALPFSVASGGLVGLLS

SEQ ID NO: 979398 - protein, 33 aa, Mycobacterium
RITSATRLYLPMPFFWVGGFGGGILSALFAGAT

SEQ ID NO: 979399 - protein, 17 aa, Mycobacterium
RIWDSAACKAWLLTQPY

SEQ ID NO: 979400 - protein, 17 aa, Mycobacterium
RIYNGLSLVYCIPLTLV

SEQ ID NO: 979401 - protein, 27 aa, Mycobacterium
RKNWIIGAAVVAVLLVVAGATAFVLAK

SEQ ID NO: 979402 - protein, 40 aa, Mycobacterium; identical to SEQ ID NO: 367620

SEQ ID NO: 979403 - protein, 27 aa, Mycobacterium
RKRGRSKRPWVIAGAVTVVVVAGGAVA

SEQ ID NO: 979404 - protein, 22 aa, Mycobacterium
RKRLLMTGLVIFGLVSIPAAFA

SEQ ID NO: 979405 - protein, 21 aa, Mycobacterium
RKRMFVFGVVLFTIASGLCAV

SEQ ID NO: 979406 - protein, 20 aa, Mycobacterium
RKRMSWQRWALLCVGIAQVA

SEQ ID NO: 979407 - protein, 21 aa, Mycobacterium
RKVLQPFFSPHALAAMLPSLQ

SEQ ID NO: 979408 - protein, 25 aa, Mycobacterium
RKYAFRKRVLMVMAIILVGSAAAAF

SEQ ID NO: 979409 - protein, 19 aa, Mycobacterium
RKYRLIVTITRDGDQLKMS

SEQ ID NO: 979410 - protein, 18 aa, Mycobacterium
RLAGQFRPDQLAKLAQRL

SEQ ID NO: 979411 - protein, 18 aa, Mycobacterium
RLALLQYERAAVAEWHIA

SEQ ID NO: 979412 - protein, 20 aa, Mycobacterium
RLAPGWHHLADIPGAGRTGR

SEQ ID NO: 979413 - protein, 25 aa, Mycobacterium
RLAVASWLSAVFAAIAAWVGALVSL

SEQ ID NO: 979414 - protein, 19 aa, Mycobacterium
RLAWFILTSLGQSGHALRY

SEQ ID NO: 979415 - protein, 32 aa, Mycobacterium; identical to SEQ ID NO: 854878

SEQ ID NO: 979416 - protein, 19 aa, Mycobacterium
RLDHLAARLRRNSANLLVL

SEQ ID NO: 979417 - protein, 18 aa, Mycobacterium
RLGAVMLAAGGIQLLCSV

SEQ ID NO: 979418 - protein, 31 aa, Mycobacterium; identical to SEQ ID NO: 367696

SEQ ID NO: 979419 - protein, 20 aa, Mycobacterium
RLGLFTLRAYLVVAVVLVVV

SEQ ID NO: 979420 - protein, 29 aa, Mycobacterium
RLHRGLVLIKWWLLAIPHYLILAAFFSGG

SEQ ID NO: 979421 - protein, 18 aa, Mycobacterium
RLITLWRFDSLVGVAGVV

SEQ ID NO: 979422 - protein, 25 aa, Mycobacterium
RLIVTLGALVWAGSLFWYLQRVGTE

SEQ ID NO: 979423 - protein, 24 aa, Mycobacterium
RLKTFLLLVGMSAMIVFFGALFGR

SEQ ID NO: 979424 - protein, 26 aa, Mycobacterium
RLKVFPLAISLPWGIAPAALPQLPLP

SEQ ID NO: 979425 - protein, 28 aa, Mycobacterium
RLLATVFGFLVLVLLLSGLNAAVFSGAP

SEQ ID NO: 979426 - protein, 20 aa, Mycobacterium
RLLDLIAGIPTLRALDRASG

SEQ ID NO: 979427 - protein, 19 aa, Mycobacterium
RLLLVTELVVFTLAGDFWA

SEQ ID NO: 979428 - protein, 26 aa, Mycobacterium
RLNARYWLTVLVVWTVVIVMTSMIIG

SEQ ID NO: 979429 - protein, 19 aa, Mycobacterium
RLPYFQTLGSPCSIGLLAV

SEQ ID NO: 979430 - protein, 23 aa, Mycobacterium
RLRAWHAGLLLAGQRFNRDAAGA

SEQ ID NO: 979431 - protein, 17 aa, Mycobacterium
RLRHLIFKVMTANVEGL

SEQ ID NO: 979432 - protein, 22 aa, Mycobacterium
RLRQALLGLPMAHPGAVDVVYD

SEQ ID NO: 979433 - protein, 36 aa, Mycobacterium
RLTIAALICAAGFVAAVWLPSKSTMPARPLVALPGA

SEQ ID NO: 979434 - protein, 17 aa, Mycobacterium
RLTIARAILADTPVLIL

SEQ ID NO: 979435 - protein, 18 aa, Mycobacterium
RLTKMTAMPQLVAFFNGV

SEQ ID NO: 979436 - protein, 17 aa, Mycobacterium
RLVLLRPGKEEDEPEQR

SEQ ID NO: 979437 - protein, 19 aa, Mycobacterium
RLVSWLIGCAVLVITSSSG

SEQ ID NO: 979438 - protein, 23 aa, Mycobacterium
RLVVAPWWVRVLANGLALAGIAV

SEQ ID NO: 979439 - protein, 23 aa, Mycobacterium
RLVVMAGAIIWAGSLVWYLQRVG

SEQ ID NO: 979440 - protein, 17 aa, Mycobacterium
RLYAWVTTLYLVGSVVS

SEQ ID NO: 979441 - protein, 18 aa, Mycobacterium
RMAIGAAALTLLGVRRYV

SEQ ID NO: 979442 - protein, 17 aa, Mycobacterium
RMGGLAMFLGVLAAVFL

SEQ ID NO: 979443 - protein, 20 aa, Mycobacterium
RMLKVELPLSIPVLVSGLRV

SEQ ID NO: 979444 - protein, 17 aa, Mycobacterium
RMMLSKPVIAAVSGYAV

SEQ ID NO: 979445 - protein, 28 aa, Mycobacterium
RMQSYAFWDITTFLINGSLWVFVGVQIP

SEQ ID NO: 979446 - protein, 18 aa, Mycobacterium
RMRGVRLAPLPASPKRQL

SEQ ID NO: 979447 - protein, 27 aa, Mycobacterium
RNIDNWVRRLFALPAFPDGSADDVLQV

SEQ ID NO: 979448 - protein, 21 aa, Mycobacterium
RNRLVTFIAIFLAGGVMFSLT

SEQ ID NO: 979449 - protein, 27 aa, Mycobacterium
RNRPRLWLCYALTLMLSILLNLTLATL

SEQ ID NO: 979450 - protein, 41 aa, Mycobacterium
RNTDVLRMVIGGAALALLGVRRYVFARPPLLGPSGRMVATG

SEQ ID NO: 979451 - protein, 36 aa, Mycobacterium; identical to SEQ ID NO: 367947

SEQ ID NO: 979452 - protein, 26 aa, Mycobacterium
RPAREGYPAVIWLLLGGNLVVRAAGF

SEQ ID NO: 979453 - protein, 26 aa, Mycobacterium
RPDQPRGWRFWHRPRRQLQTQVVLDW

SEQ ID NO: 979454 - protein, 23 aa, Mycobacterium
RPEFEQALANKGWAALPGLQTNP

SEQ ID NO: 979455 - protein, 24 aa, Mycobacterium
RPEFVAVLNVIWCLGASAVLISPA

SEQ ID NO: 979456 - protein, 30 aa, Mycobacterium; identical to SEQ ID NO: 367978

SEQ ID NO: 979457 - protein, 34 aa, Mycobacterium
RPFRPRNPRPAIIVVILLVVLTGVVWTVALTRPP

SEQ ID NO: 979458 - protein, 25 aa, Mycobacterium
RPGEEKLVFSRFWRADPSRVRRSGG

SEQ ID NO: 979459 - protein, 31 aa, Mycobacterium
RPHNLPFVMLGAGLLWFGWYGFNAGSATSSN

SEQ ID NO: 979460 - protein, 17 aa, Mycobacterium
RPILALREAADLLRESL

SEQ ID NO: 979461 - protein, 17 aa, Mycobacterium
RPLRYVVAGFGLSALLC

SEQ ID NO: 979462 - protein, 21 aa, Mycobacterium
RPNWTLLRKTVRDLRRRPAQS

SEQ ID NO: 979463 - protein, 32 aa, Mycobacterium; identical to SEQ ID NO: 368027

SEQ ID NO: 979464 - protein, 25 aa, Mycobacterium
RPRYINLVVLLRIVCEITATALLVV

SEQ ID NO: 979465 - protein, 19 aa, Mycobacterium
RPVAQSFWYRTAKLVTRHA

SEQ ID NO: 979466 - protein, 31 aa, Mycobacterium; identical to SEQ ID NO: 368054

SEQ ID NO: 979467 - protein, 23 aa, Mycobacterium
RPVVYAFGLVLFAVGYLGLGITT

SEQ ID NO: 979468 - protein, 21 aa, Mycobacterium
RQARRVVTANLFIAGTFISVL

SEQ ID NO: 979469 - protein, 18 aa, Mycobacterium
RQCLNAGLGFGGGCLPKD

SEQ ID NO: 979470 - protein, 17 aa, Mycobacterium
RQHWGIENSLHWIRDVT

SEQ ID NO: 979471 - protein, 24 aa, Mycobacterium
RQQTWLSVAGLVLTLVVAAAYLLV

SEQ ID NO: 979472 - protein, 18 aa, Mycobacterium
RRALGPWGGFATGTAVLI

SEQ ID NO: 979473 - protein, 30 aa, Mycobacterium; identical to SEQ ID NO: 368136

SEQ ID NO: 979474 - protein, 22 aa, Mycobacterium
RRDRPVLIFVLESGMAGLTQGK

SEQ ID NO: 979475 - protein, 22 aa, Mycobacterium
RRDVVLVTGPWLAGTSSVITAL

SEQ ID NO: 979476 - protein, 17 aa, Mycobacterium
RRFLAQHRAAAPAQPQT

SEQ ID NO: 979477 - protein, 25 aa, Mycobacterium
RRGANFFTSVFPPLVLAAAGVHLNV

SEQ ID NO: 979478 - protein, 29 aa, Mycobacterium
RRGGRRPGWVLLTTLLVLAIGASSALVFT

SEQ ID NO: 979479 - protein, 34 aa, Mycobacterium; identical to SEQ ID NO: 368166

SEQ ID NO: 979480 - protein, 18 aa, Mycobacterium
RRGRWRIFAAASTVLALT

SEQ ID NO: 979481 - protein, 34 aa, Mycobacterium
RRGWSAMPLALRLLLPIAFVLISAGIGVAFWLQS

SEQ ID NO: 979482 - protein, 19 aa, Mycobacterium
RRIGLLMLRGYLVLACVLV

SEQ ID NO: 979483 - protein, 20 aa, Mycobacterium
RRILHQLYLGYPDSAAAQGI

SEQ ID NO: 979484 - protein, 24 aa, Mycobacterium
RRKILFTLGILVLYRVSAALPSPG

SEQ ID NO: 979485 - protein, 25 aa, Mycobacterium
RRLETRLMMVLGVGFGLGVALTLSR

SEQ ID NO: 979486 - protein, 21 aa, Mycobacterium
RRLHRMVINTLPLAFQRGSML

SEQ ID NO: 979487 - protein, 17 aa, Mycobacterium
RRLLGRRGDLLADLDAI

SEQ ID NO: 979488 - protein, 21 aa, Mycobacterium
RRLLNYVVLLALASFLTYCLT

SEQ ID NO: 979489 - protein, 23 aa, Mycobacterium
RRLTKIILPLIKPAVLVALLFRT

SEQ ID NO: 979490 - protein, 17 aa, Mycobacterium
RRNLHDLLLAATSRADA

SEQ ID NO: 979491 - protein, 17 aa, Mycobacterium
RRRFIREADVAAALWHP

SEQ ID NO: 979492 - protein, 18 aa, Mycobacterium
RRRPAFLRPVLAPGYGRF

SEQ ID NO: 979493 - protein, 20 aa, Mycobacterium
RRRRALRWALIFSAGCVFWA

SEQ ID NO: 979494 - protein, 18 aa, Mycobacterium
RRRTPTPAPPPRPAAPKA

SEQ ID NO: 979495 - protein, 29 aa, Mycobacterium
RRRVLGGFVFGLLVVFVVVVVVFGTKLLN

SEQ ID NO: 979496 - protein, 23 aa, Mycobacterium
RRRWYLMGIVLFTLGSIACGLAP

SEQ ID NO: 979497 - protein, 32 aa, Mycobacterium
RRSRRDPLSIFLILVIVFSLVLAGVIASELYA

SEQ ID NO: 979498 - protein, 46 aa, Mycobacterium; identical to SEQ ID NO: 368290

SEQ ID NO: 979499 - protein, 23 aa, Mycobacterium
RRTVPLAIILTVLIGGATFLSVS

SEQ ID NO: 979500 - protein, 25 aa, Mycobacterium
RRVAVWGPWVSIGAAALAVVCGLLT

SEQ ID NO: 979501 - protein, 29 aa, Mycobacterium
RRVGTAIVRWPLPILAVTCAVALVGLITL

SEQ ID NO: 979502 - protein, 18 aa, Mycobacterium
RRVITVVILVMIGTAIFG

SEQ ID NO: 979503 - protein, 18 aa, Mycobacterium
RRWDSEHLGLLVLVPLIG

SEQ ID NO: 979504 - protein, 18 aa, Mycobacterium
RRWEQMMFLLIAVNVVII

SEQ ID NO: 979505 - protein, 18 aa, Mycobacterium
RRWGPWLRKRIASARRWL

SEQ ID NO: 979506 - protein, 26 aa, Mycobacterium
RSALATLRIAFLSAPVLELLATLGVA

SEQ ID NO: 979507 - protein, 21 aa, Mycobacterium
RSGRVLVYGAGSLGLCAIAIL

SEQ ID NO: 979508 - protein, 19 aa, Mycobacterium
RSILSKWDGTRSPELPAEL

SEQ ID NO: 979509 - protein, 28 aa, Mycobacterium
RSLSQAVLPALLWTPVATLAATAVYVLV

SEQ ID NO: 979510 - protein, 19 aa, Mycobacterium
RSLVTSPVLLAIRPELQQA

SEQ ID NO: 979511 - protein, 21 aa, Mycobacterium
RSPGMRRLKLLEISYGVGVSV

SEQ ID NO: 979512 - protein, 26 aa, Mycobacterium
RSPLRGPWLTSVFGLVLLVAMPIVIL

SEQ ID NO: 979513 - protein, 30 aa, Mycobacterium
RSRLGRGWLTGIAVALLLAGCGIGTGGYCM

SEQ ID NO: 979514 - protein, 21 aa, Mycobacterium
RSRTMLALCGLAIGLRLKVSA

SEQ ID NO: 979515 - protein, 20 aa, Mycobacterium
RSSLAIVKLLGRKKSYGQDI

SEQ ID NO: 979516 - protein, 18 aa, Mycobacterium
RSSTGLRYRIYRPAVVVG

SEQ ID NO: 979517 - protein, 23 aa, Mycobacterium
RSTGKMVFVFPGQGAQYLGMGRV

SEQ ID NO: 979518 - protein, 22 aa, Mycobacterium
RSVFWPLAIGLIGLAALAGSFV

SEQ ID NO: 979519 - protein, 29 aa, Mycobacterium
RSVIVLTSLLLIIVALLRTFIRHERRAPF

SEQ ID NO: 979520 - protein, 22 aa, Mycobacterium
RTAALNLFVVVEAFYLFSCRSL

SEQ ID NO: 979521 - protein, 18 aa, Mycobacterium
RTALAAATGRIGQTIAAV

SEQ ID NO: 979522 - protein, 18 aa, Mycobacterium
RTALKALWPAVLAALGVA

SEQ ID NO: 979523 - protein, 18 aa, Mycobacterium
RTALLERMPASLSARFDR

SEQ ID NO: 979524 - protein, 21 aa, Mycobacterium
RTANWTWALLGLAVSALTYVG

SEQ ID NO: 979525 - protein, 17 aa, Mycobacterium
RTDELFLAMPRIGPWSD

SEQ ID NO: 979526 - protein, 32 aa, Mycobacterium; identical to SEQ ID NO: 368450

SEQ ID NO: 979527 - protein, 32 aa, Mycobacterium; identical to SEQ ID NO: 368464

SEQ ID NO: 979528 - protein, 19 aa, Mycobacterium
RTFTFGVVIFTIASGLCAV

SEQ ID NO: 979529 - protein, 26 aa, Mycobacterium
RTGNFAIYVITILGVIFLNLLEGVVI

SEQ ID NO: 979530 - protein, 17 aa, Mycobacterium
RTIRTNMIWAFGYNVAA

SEQ ID NO: 979531 - protein, 19 aa, Mycobacterium
RTIYQNLGWAFGYNTAAIP

SEQ ID NO: 979532 - protein, 19 aa, Mycobacterium
RTLATRLAARRRRARAGSI

SEQ ID NO: 979533 - protein, 17 aa, Mycobacterium
RTLIFLKLSVSGHLTVF

SEQ ID NO: 979534 - protein, 25 aa, Mycobacterium
RTLVSTTFVVPYPPGFPVLVPGQVV

SEQ ID NO: 979535 - protein, 26 aa, Mycobacterium
RTLVSTTFVVPYPPGFPVLVPGQVVS

SEQ ID NO: 979536 - protein, 28 aa, Mycobacterium
RTPWLVPGWLFLSAVVYVPLALIGFPVW

SEQ ID NO: 979537 - protein, 17 aa, Mycobacterium
RTPWNTYMSEGLPATAI

SEQ ID NO: 979538 - protein, 29 aa, Mycobacterium
RTQAPLGWLYVLCGALVFAALAWVTPRVQ

SEQ ID NO: 979539 - protein, 23 aa, Mycobacterium
RTQHNVYIPWSMTVTPISQSDVG

SEQ ID NO: 979540 - protein, 17 aa, Mycobacterium
RTRRRINLGLVAGALCI

SEQ ID NO: 979541 - protein, 18 aa, Mycobacterium
RTSINSVLLIFTIGVTWS

SEQ ID NO: 979542 - protein, 29 aa, Mycobacterium
RTVLARRVVAGLLVVLAAVAALWPSPDTN

SEQ ID NO: 979543 - protein, 25 aa, Mycobacterium
RTVLRRAFGLLGPLEAVLTLTAFLV

SEQ ID NO: 979544 - protein, 21 aa, Mycobacterium
RTYASLLQKAWQLPNALYAID

SEQ ID NO: 979545 - protein, 32 aa, Mycobacterium
RVAGRLRVAAFRTLLLSLPPRVLDALARDYPD

SEQ ID NO: 979546 - protein, 25 aa, Mycobacterium
RVANLFLTKAVYSALLALLVGIECL

SEQ ID NO: 979547 - protein, 30 aa, Mycobacterium
RVATVLSIWQAVLVRRLVRAAVPATVVPAG

SEQ ID NO: 979548 - protein, 23 aa, Mycobacterium
RVCAIYLVLLTIGGIGAALFMDD

SEQ ID NO: 979549 - protein, 22 aa, Mycobacterium
RVDLPTYAFQRRRFWEVPGADG

SEQ ID NO: 979550 - protein, 19 aa, Mycobacterium
RVGDRLYPALNLASARLIT

SEQ ID NO: 979551 - protein, 21 aa, Mycobacterium
RVGRRVPLMVDVALYSVVGFL

SEQ ID NO: 979552 - protein, 24 aa, Mycobacterium
RVHDAMREIWTFTPAGAISVRGSQ

SEQ ID NO: 979553 - protein, 20 aa, Mycobacterium
RVLHVAQPLAYCLPGVRSRV

SEQ ID NO: 979554 - protein, 28 aa, Mycobacterium
RVLILIALGVIALLLAGPRLIDAYVDWL

SEQ ID NO: 979555 - protein, 19 aa, Mycobacterium
RVLSGLTKRHRTALVHITH

SEQ ID NO: 979556 - protein, 19 aa, Mycobacterium
RVLVIRALTGAGIITPADA

SEQ ID NO: 979557 - protein, 23 aa, Mycobacterium
RVMTPLLLVMLAVGGSDVLFAFD

SEQ ID NO: 979558 - protein, 19 aa, Mycobacterium
RVMWFRIHAEPSGDEWHVI

SEQ ID NO: 979559 - protein, 28 aa, Mycobacterium
RVNIQSNLMVLLLLSSIVSVAAIVAVGF

SEQ ID NO: 979560 - protein, 18 aa, Mycobacterium
RVPGLYPPQIYNGQLHVD

SEQ ID NO: 979561 - protein, 26 aa, Mycobacterium
RVPVHGFLFLFLGNGLLCVFMSLPKL

SEQ ID NO: 979562 - protein, 26 aa, Mycobacterium
RVRKYLTLMAFRIPALILAAIAYGLW

SEQ ID NO: 979563 - protein, 25 aa, Mycobacterium
RVRPAFFFALGLPALIIVLLAFARH

SEQ ID NO: 979564 - protein, 21 aa, Mycobacterium
RVTLAVFITMALFTGLLVAIS

SEQ ID NO: 979565 - protein, 26 aa, Mycobacterium
RVTRWEWTWAVLLAVSLAVVVIVGDP

SEQ ID NO: 979566 - protein, 17 aa, Mycobacterium
RVVELAGIGPGPHAAMI

SEQ ID NO: 979567 - protein, 17 aa, Mycobacterium
RVVSALSRRGDELIVTG

SEQ ID NO: 979568 - protein, 33 aa, Mycobacterium
RVVTLANVAMFLFAASFFGAGLLFPSYFQELLG

SEQ ID NO: 979569 - protein, 18 aa, Mycobacterium
RWNLRIVIMFSIGLVIAT

SEQ ID NO: 979570 - protein, 23 aa, Mycobacterium
RWQQLRLMMVITGPGLIAMIGDN

SEQ ID NO: 979571 - protein, 24 aa, Mycobacterium
RWQQLRLMMVITGPGLIAMIGDND

SEQ ID NO: 979572 - protein, 28 aa, Mycobacterium
RWRVDIDGTLSFLLLPRLTNVLSELPEG

SEQ ID NO: 979573 - protein, 23 aa, Mycobacterium
RWSYGLFIWHLAALDMVFPVIGT

SEQ ID NO: 979574 - protein, 23 aa, Mycobacterium
RYPAAIRLWRNAWNEFIPFLDYD

SEQ ID NO: 979575 - protein, 22 aa, Mycobacterium
RYPRRAFLGLALFIGQAFLYNG

SEQ ID NO: 979576 - protein, 17 aa, Mycobacterium
RYRVIAEPTQQLPRYLH

SEQ ID NO: 979577 - protein, 23 aa, Mycobacterium
RYVAIMGFAWLLLAVSAIANAIR

SEQ ID NO: 979578 - protein, 19 aa, Mycobacterium
SAAALTLVIAYGVAWFGAY

SEQ ID NO: 979579 - protein, 26 aa, Mycobacterium
SAAGDWLLAIPWWTQSFVLGLGSFLL

SEQ ID NO: 979580 - protein, 25 aa, Mycobacterium
SADALARLLSTLPLGYAPGTCRAFL

SEQ ID NO: 979581 - protein, 24 aa, Mycobacterium
SAFEHRAVVVGADRQQLLTGLATL

SEQ ID NO: 979582 - protein, 28 aa, Mycobacterium
SAFLSYFAQILMAVLMATMTLVVLPRAA

SEQ ID NO: 979583 - protein, 32 aa, Mycobacterium; identical to SEQ ID NO: 368836

SEQ ID NO: 979584 - protein, 19 aa, Mycobacterium
SAGFRWPRALQASATRRGL

SEQ ID NO: 979585 - protein, 27 aa, Mycobacterium
SAGVKSAWDLLWRYGGQYVATALAQVA

SEQ ID NO: 979586 - protein, 27 aa, Mycobacterium
SAIVEPIYYPRYLILTAPAAAVILAVC

SEQ ID NO: 979587 - protein, 25 aa, Mycobacterium
SAKNRQPWDFVLVTERSALQELSTV

SEQ ID NO: 979588 - protein, 24 aa, Mycobacterium
SALGALLMVPGVRGLGPGPVTTGA

SEQ ID NO: 979589 - protein, 18 aa, Mycobacterium
SALIIVGAVPMLLRARRM

SEQ ID NO: 979590 - protein, 22 aa, Mycobacterium
SALLISSFISLYRYGDVTATHR

SEQ ID NO: 979591 - protein, 30 aa, Mycobacterium; identical to SEQ ID NO: 368905

SEQ ID NO: 979592 - protein, 29 aa, Mycobacterium
SAQCCIAAYLPYLSWLMQASADSAATAAA

SEQ ID NO: 979593 - protein, 22 aa, Mycobacterium
SAQIRYLDLIGNRYLELKRGEG

SEQ ID NO: 979594 - protein, 24 aa, Mycobacterium
SAQLTSAIPLLPPPARPGAHTTAS

SEQ ID NO: 979595 - protein, 17 aa, Mycobacterium
SAQVWLIDPRRQLLTAL

SEQ ID NO: 979596 - protein, 24 aa, Mycobacterium
SATGTFYDDFQRRSKPFIKVVQHF

SEQ ID NO: 979597 - protein, 24 aa, Mycobacterium
SATVAFPMYFLKSFAYAGVATVAF

SEQ ID NO: 979598 - protein, 17 aa, Mycobacterium
SAVAIIPLYIACLTISY

SEQ ID NO: 979599 - protein, 18 aa, Mycobacterium
SAVFGGWLAGLAGAWFVV

SEQ ID NO: 979600 - protein, 27 aa, Mycobacterium
SAVIIAIIGVVILIAAAVTAAIVLSGK

SEQ ID NO: 979601 - protein, 18 aa, Mycobacterium
SAVNAAISALVLPSAFRP

SEQ ID NO: 979602 - protein, 25 aa, Mycobacterium
SAVWWKVTLPLLMPGLVSGAVLAFA

SEQ ID NO: 979603 - protein, 18 aa, Mycobacterium
SAWGLYRFNQILAGLSAA

SEQ ID NO: 979604 - protein, 22 aa, Mycobacterium
SAYFAGGLSLRDATRAICSRSH

SEQ ID NO: 979605 - protein, 17 aa, Mycobacterium
SAYMVLQHRDATRQRER

SEQ ID NO: 979606 - protein, 19 aa, Mycobacterium
SAYRLIELALRGGGPDNVT

SEQ ID NO: 979607 - protein, 26 aa, Mycobacterium
SDGAVFCGLLWWMAFGLHSKHLVVAT

SEQ ID NO: 979608 - protein, 18 aa, Mycobacterium
SDLLWSFLQAIVMAIAVM

SEQ ID NO: 979609 - protein, 31 aa, Mycobacterium; identical to SEQ ID NO: 369023

SEQ ID NO: 979610 - protein, 28 aa, Mycobacterium
SDVYSLGCVLYEILTGEPPFTGDSPVAV

SEQ ID NO: 979611 - protein, 22 aa, Mycobacterium
SEARRMASLVDELLLLSRLGEG

SEQ ID NO: 979612 - protein, 25 aa, Mycobacterium
SEDTDLPTVLFQTALTKLRDILAAA

SEQ ID NO: 979613 - protein, 23 aa, Mycobacterium
SEGKLVAPVKYPSLYAGDEDGKV

SEQ ID NO: 979614 - protein, 27 aa, Mycobacterium
SELDPVDWWRQLSWLPQRSVLIPGTVR

SEQ ID NO: 979615 - protein, 17 aa, Mycobacterium
SEMRRALAMAPRKSREI

SEQ ID NO: 979616 - protein, 31 aa, Mycobacterium; identical to SEQ ID NO: 369092

SEQ ID NO: 979617 - protein, 32 aa, Mycobacterium
SEVVGLLQEGILKAPPLKLFDVRSAQQAYRYV

SEQ ID NO: 979618 - protein, 21 aa, Mycobacterium
SEWFLFVMFPVLVLALVRFNR

SEQ ID NO: 979619 - protein, 18 aa, Mycobacterium
SEWLLVQSLIHARPEHNT

SEQ ID NO: 979620 - protein, 21 aa, Mycobacterium
SFALITIFFVGAFLIMPNPLP

SEQ ID NO: 979621 - protein, 33 aa, Mycobacterium
SFAMFAIGAVMPLIPYLLGFGSLSAGLIFGGAG

SEQ ID NO: 979622 - protein, 30 aa, Mycobacterium; identical to SEQ ID NO: 369122

SEQ ID NO: 979623 - protein, 19 aa, Mycobacterium
SFFDWDMYRQAIPTLFKTG

SEQ ID NO: 979624 - protein, 19 aa, Mycobacterium
SFGAFLAFLDSTIVNIAFP

SEQ ID NO: 979625 - protein, 39 aa, Mycobacterium
SFGLSVLVWEYLFGIKLYWVVLALAVILLLAVGSDYNLL

SEQ ID NO: 979626 - protein, 17 aa, Mycobacterium
SFLMQLCVQGAWGVIPA

SEQ ID NO: 979627 - protein, 21 aa, Mycobacterium
SFLRRIAFSGFAFTIVLLVLV

SEQ ID NO: 979628 - protein, 24 aa, Mycobacterium
SFLVYGKLAILLLFCVAGLAFVDG

SEQ ID NO: 979629 - protein, 20 aa, Mycobacterium
SFRVVWAFLGTLTIATIPFA

SEQ ID NO: 979630 - protein, 24 aa, Mycobacterium
SGAANFLIVWLIPVALGVGYARRL

SEQ ID NO: 979631 - protein, 24 aa, Mycobacterium
SGAGKGFVFWGIAFGLGPAVGAGV

SEQ ID NO: 979632 - protein, 26 aa, Mycobacterium
SGATAFWVCGLLLCLFIGPSQSSARA

SEQ ID NO: 979633 - protein, 24 aa, Mycobacterium
SGCLALGWWQWTRFESTSGSFQNL

SEQ ID NO: 979634 - protein, 22 aa, Mycobacterium
SGDFLAYYEQFTEQFVAPAAKQ

SEQ ID NO: 979635 - protein, 20 aa, Mycobacterium
SGDYSLCWSFTDGGIQPGIH

SEQ ID NO: 979636 - protein, 22 aa, Mycobacterium
SGEIIMFAILPLLGVPPWVVRG

SEQ ID NO: 979637 - protein, 30 aa, Mycobacterium
SGFDPYLLTLGNPLTYLSPLNIAFALGYPM

SEQ ID NO: 979638 - protein, 29 aa, Mycobacterium
SGFQYVAAHLPYVAWLLQASADGAGKAAE

SEQ ID NO: 979639 - protein, 17 aa, Mycobacterium
SGFWHAVAQRVARRPAP

SEQ ID NO: 979640 - protein, 20 aa, Mycobacterium
SGHTTFLELAPNPVALMQVG

SEQ ID NO: 979641 - protein, 23 aa, Mycobacterium
SGIIFLYVFMALLLNCEKLRTLI

SEQ ID NO: 979642 - protein, 29 aa, Mycobacterium
SGINKILQFITYLLIPAGLLTIYTQLFTT

SEQ ID NO: 979643 - protein, 34 aa, Mycobacterium
SGKSSLLWISIVATPIVLFALRGLTYGKQRANGV

SEQ ID NO: 979644 - protein, 21 aa, Mycobacterium
SGLLFLVMIFVMTAASAGLVA

SEQ ID NO: 979645 - protein, 23 aa, Mycobacterium
SGLSWQWIFLINVPIGICGLILA

SEQ ID NO: 979646 - protein, 26 aa, Mycobacterium
SGLVLAYLGLLWWMMVCWSQPLRGRS

SEQ ID NO: 979647 - protein, 24 aa, Mycobacterium
SGMRLTVLLALLANLFVPWGIAGA

SEQ ID NO: 979648 - protein, 35 aa, Mycobacterium
SGPGPHFLAASLRNPWMLLGAAALVALIVFAAQGI

SEQ ID NO: 979649 - protein, 24 aa, Mycobacterium
SGPTGVLAPQVPPGNSLTPLAPET

SEQ ID NO: 979650 - protein, 22 aa, Mycobacterium
SGSQQIILDRDLQLVLNSLWAS

SEQ ID NO: 979651 - protein, 19 aa, Mycobacterium
SGSRWFMFPALAAISDDVL

SEQ ID NO: 979652 - protein, 17 aa, Mycobacterium
SHIGMVLQDTWLFDGTI

SEQ ID NO: 979653 - protein, 30 aa, Mycobacterium; identical to SEQ ID NO: 369359

SEQ ID NO: 979654 - protein, 27 aa, Mycobacterium
SHLFGCTPVGPLAWGQALLAAAVAGSA

SEQ ID NO: 979655 - protein, 32 aa, Mycobacterium; identical to SEQ ID NO: 369362

SEQ ID NO: 979656 - protein, 24 aa, Mycobacterium
SHRVAALPLWTWLATVAVLSFGGP

SEQ ID NO: 979657 - protein, 30 aa, Mycobacterium
SHWHHTASAWWFDMAMLAFISLCYVSFVRW

SEQ ID NO: 979658 - protein, 27 aa, Mycobacterium
SIAALLGRWFWWPMRVRTRPARTPSSP

SEQ ID NO: 979659 - protein, 41 aa, Mycobacterium
SIEMSLSTPIWRLVLPITALGVAIPFVWAPLAAIGSRDLPA

SEQ ID NO: 979660 - protein, 24 aa, Mycobacterium
SIGLLSRLWVLPIHRASGLLARIL

SEQ ID NO: 979661 - protein, 25 aa, Mycobacterium
SIIANRVSYFYDFRGPSVAIDTACS

SEQ ID NO: 979662 - protein, 19 aa, Mycobacterium
SIRLDWGALLSVSIVSLLV

SEQ ID NO: 979663 - protein, 21 aa, Mycobacterium
SKAGAALRALAALSAKEVAVL

SEQ ID NO: 979664 - protein, 26 aa, Mycobacterium
SKAYAAYSTPFWRINGFTGQSLSDMG

SEQ ID NO: 979665 - protein, 29 aa, Mycobacterium
SKSRKGRAFAIVAALLALAAIAVAAVLTH

SEQ ID NO: 979666 - protein, 35 aa, Mycobacterium; identical to SEQ ID NO: 369494

SEQ ID NO: 979667 - protein, 18 aa, Mycobacterium
SLALYLLFVFTQTVRHRD

SEQ ID NO: 979668 - protein, 19 aa, Mycobacterium
SLAWQASFFAAASWSGLKL

SEQ ID NO: 979669 - protein, 17 aa, Mycobacterium
SLFFAAVLAVLIALMIR

SEQ ID NO: 979670 - protein, 29 aa, Mycobacterium
SLGHWEFYMALAYFKLAIIAAGIDFRRRM

SEQ ID NO: 979671 - protein, 24 aa, Mycobacterium
SLGIAMMLGANWRTCAIAALTAAT

SEQ ID NO: 979672 - protein, 22 aa, Mycobacterium
SLGLCAIAILRALYPDVAVAVV

SEQ ID NO: 979673 - protein, 33 aa, Mycobacterium
SLGVEDQFYLVWPALIIATAWLLRRIGKNNRGA

SEQ ID NO: 979674 - protein, 34 aa, Mycobacterium
SLILRENVVALTVLWLLNIGEYLQDLTLRRTRRA

SEQ ID NO: 979675 - protein, 24 aa, Mycobacterium
SLLGLAVGWFVGALVVLAVGTPAL

SEQ ID NO: 979676 - protein, 21 aa, Mycobacterium
SLLLPALIALLGVGAALFMSD

SEQ ID NO: 979677 - protein, 20 aa, Mycobacterium
SLLRGLVTRVPTLELAADVN

SEQ ID NO: 979678 - protein, 22 aa, Mycobacterium
SLLVIPCLLLSWAVSHPGIPFV

SEQ ID NO: 979679 - protein, 24 aa, Mycobacterium
SLMRLFAMQVPGQLLFSSASQLAL

SEQ ID NO: 979680 - protein, 22 aa, Mycobacterium
SLPTVALWALALLITGAGIGIA

SEQ ID NO: 979681 - protein, 27 aa, Mycobacterium
SLRLANLLVITAWITAVVIANLIFTLT

SEQ ID NO: 979682 - protein, 20 aa, Mycobacterium
SLRRRWSPDGRPIVGFVGRL

SEQ ID NO: 979683 - protein, 25 aa, Mycobacterium
SLSARFDRACALSQLPDAVIAALIG

SEQ ID NO: 979684 - protein, 27 aa, Mycobacterium
SLSGFRIPWRDQVFLSWAGLRGAVPIV

SEQ ID NO: 979685 - protein, 20 aa, Mycobacterium
SLSHLFKASHRSVGKWQGGH

SEQ ID NO: 979686 - protein, 24 aa, Mycobacterium
SLSVSAVLGWHLFAAHHANVAAEL

SEQ ID NO: 979687 - protein, 25 aa, Mycobacterium
SLTSVWLLLGLLAISAVLASYGVVS

SEQ ID NO: 979688 - protein, 25 aa, Mycobacterium
SLVPTLLVSIPFTVLVAFTLNILLR

SEQ ID NO: 979689 - protein, 42 aa, Mycobacterium; identical to SEQ ID NO: 369651

SEQ ID NO: 979690 - protein, 17 aa, Mycobacterium
SLVVFVGFRSSRKSASE

SEQ ID NO: 979691 - protein, 17 aa, Mycobacterium
SLWFTIFGDAALLRQRN

SEQ ID NO: 979692 - protein, 25 aa, Mycobacterium
SMDYEIFLLTRIRERFLHTGRTRDA

SEQ ID NO: 979693 - protein, 24 aa, Mycobacterium
SMDYEVFLVARIREYWLASGAAGP

SEQ ID NO: 979694 - protein, 19 aa, Mycobacterium
SMGWLRLGALVLVAAALAA

SEQ ID NO: 979695 - protein, 31 aa, Mycobacterium; identical to SEQ ID NO: 369709

SEQ ID NO: 979696 - protein, 18 aa, Mycobacterium
SMPFGWFMGAVAFQFVLW

SEQ ID NO: 979697 - protein, 18 aa, Mycobacterium
SMQYSYLPSWLSFLVDKE

SEQ ID NO: 979698 - protein, 38 aa, Mycobacterium; identical to SEQ ID NO: 369723

SEQ ID NO: 979699 - protein, 23 aa, Mycobacterium
SMVKGWYMSFWPIIAIAVITVTS

SEQ ID NO: 979700 - protein, 22 aa, Mycobacterium
SNNPLFRPRFIKRMFFAKFPDD

SEQ ID NO: 979701 - protein, 35 aa, Mycobacterium
SNPDTRPRLILGSSLIALSFLGLRHLWAGSPESPE

SEQ ID NO: 979702 - protein, 34 aa, Mycobacterium
SPALHDMIYIGLPPFYPPGWFWIGGRAAALTGSP

SEQ ID NO: 979703 - protein, 25 aa, Mycobacterium
SPAQYWHDFWRGQIGEWIITRGLRI

SEQ ID NO: 979704 - protein, 25 aa, Mycobacterium
SPCSIGLLAVILASLTLAPAVIALT

SEQ ID NO: 979705 - protein, 19 aa, Mycobacterium
SPEQWFAFTPPRVPVLETL

SEQ ID NO: 979706 - protein, 24 aa, Mycobacterium
SPESYSLPLRRLLGFLAAGLDASL

SEQ ID NO: 979707 - protein, 21 aa, Mycobacterium
SPKTTVTFFDGRTASFTVVGA

SEQ ID NO: 979708 - protein, 18 aa, Mycobacterium
SPLPLVPLAFDPPEHTRF

SEQ ID NO: 979709 - protein, 22 aa, Mycobacterium
SPLTAALSLMWGWRLAAVCVTV

SEQ ID NO: 979710 - protein, 32 aa, Mycobacterium; identical to SEQ ID NO: 369810

SEQ ID NO: 979711 - protein, 44 aa, Mycobacterium
SPRPSGGIPLLVVLSVLAVAVAIFWIVMRYRASRRRTNALAAAR

SEQ ID NO: 979712 - protein, 23 aa, Mycobacterium
SPRSSDRFAFFFGLTAINPVTLV

SEQ ID NO: 979713 - protein, 29 aa, Mycobacterium
SPTEPAHPRWWFVSTTPGRILTIGIVLAA

SEQ ID NO: 979714 - protein, 19 aa, Mycobacterium
SPYSGWITLAFLASVLILM

SEQ ID NO: 979715 - protein, 24 aa, Mycobacterium
SPYSSWLVVRWVIASALGGPLLIA

SEQ ID NO: 979716 - protein, 28 aa, Mycobacterium
SQDDSPPPPRWVWPPLIAVGGVGIVLMA

SEQ ID NO: 979717 - protein, 26 aa, Mycobacterium
SQEFTEPEMWFLRKAHQLCPAGVVVA

SEQ ID NO: 979718 - protein, 29 aa, Mycobacterium
SQLQLWTTPLWLILMVAPFGYLLISHPES

SEQ ID NO: 979719 - protein, 26 aa, Mycobacterium
SQSMLLPAFIAVFGIIAALFLVRSRT

SEQ ID NO: 979720 - protein, 23 aa, Mycobacterium
SQTIVPLPWVIQAPRLFAGQIDF

SEQ ID NO: 979721 - protein, 25 aa, Mycobacterium
SQVFAWLTLVFGVGFSMLALMTRRW

SEQ ID NO: 979722 - protein, 20 aa, Mycobacterium
SQWMRANLRHDFPASLVVFL

SEQ ID NO: 979723 - protein, 31 aa, Mycobacterium; identical to SEQ ID NO: 369892

SEQ ID NO: 979724 - protein, 27 aa, Mycobacterium
SREMSLPVDFPPADPLPAVAMPAPPLA

SEQ ID NO: 979725 - protein, 34 aa, Mycobacterium; identical to SEQ ID NO: 369903

SEQ ID NO: 979726 - protein, 27 aa, Mycobacterium
SRGTPTLALLFIAVGLRFIATTLGEGL

SEQ ID NO: 979727 - protein, 23 aa, Mycobacterium
SRHHDLLMALRALASSLPRLPLF

SEQ ID NO: 979728 - protein, 22 aa, Mycobacterium
SRITGFARIVLLAAILGAALSS

SEQ ID NO: 979729 - protein, 36 aa, Mycobacterium
SRNLRRFRWLVFTGWMLALVPAIYLALTQSGNLTGG

SEQ ID NO: 979730 - protein, 34 aa, Mycobacterium; identical to SEQ ID NO: 369932

SEQ ID NO: 979731 - protein, 46 aa, Mycobacterium; identical to SEQ ID NO: 369936

SEQ ID NO: 979732 - protein, 18 aa, Mycobacterium
SRQWKLLGAYAAAAIMAV

SEQ ID NO: 979733 - protein, 17 aa, Mycobacterium
SRRIIGIAIISFLAMMF

SEQ ID NO: 979734 - protein, 28 aa, Mycobacterium
SRRNLTLYVTALLFVLAWATSGINGWFY

SEQ ID NO: 979735 - protein, 24 aa, Mycobacterium
SRRQPRWRTAVFASAAAIAVGLGA

SEQ ID NO: 979736 - protein, 25 aa, Mycobacterium
SRRRLPAAVIFGAIAAWVTRWYLGT

SEQ ID NO: 979737 - protein, 18 aa, Mycobacterium
SRVLQLDRLLRLKVFPLA

SEQ ID NO: 979738 - protein, 20 aa, Mycobacterium
SRWCVGFATWLTDAAVIATL

SEQ ID NO: 979739 - protein, 22 aa, Mycobacterium
SRYVLRYRRDLLLGLFASVVGT

SEQ ID NO: 979740 - protein, 18 aa, Mycobacterium
SSADALVAAVRSKAPGDK

SEQ ID NO: 979741 - protein, 33 aa, Mycobacterium; identical to SEQ ID NO: 369998

SEQ ID NO: 979742 - protein, 23 aa, Mycobacterium
SSGALFVVVGGRLHPALNLMSAQ

SEQ ID NO: 979743 - protein, 21 aa, Mycobacterium
SSGVLLLWSWLAMSLAQGYYS

SEQ ID NO: 979744 - protein, 23 aa, Mycobacterium
SSLRDRVTAYVPLLLTAEDAINA

SEQ ID NO: 979745 - protein, 20 aa, Mycobacterium
SSPVTSFPALPAPLSVGDEG

SEQ ID NO: 979746 - protein, 28 aa, Mycobacterium
SSRLVNFLIVAAWIAVAVIANLAVVLAP

SEQ ID NO: 979747 - protein, 28 aa, Mycobacterium
SSRVANLELYLIFPLANEQATITLVRGT

SEQ ID NO: 979748 - protein, 24 aa, Mycobacterium
SSRVFVALALLTSGAFAGLPPAYA

SEQ ID NO: 979749 - protein, 19 aa, Mycobacterium
SSSLVAIHWAMASLRSGEC

SEQ ID NO: 979750 - protein, 40 aa, Mycobacterium; identical to SEQ ID NO: 370048

SEQ ID NO: 979751 - protein, 19 aa, Mycobacterium
SSVHYLLDVLRRIATDFDR

SEQ ID NO: 979752 - protein, 18 aa, Mycobacterium
SSVHYLLDVLRRVASDFD

SEQ ID NO: 979753 - protein, 19 aa, Mycobacterium
SSVHYLLDVLRRVASDFDR

SEQ ID NO: 979754 - protein, 43 aa, Mycobacterium; identical to SEQ ID NO: 370062

SEQ ID NO: 979755 - protein, 24 aa, Mycobacterium
STASELRRRYPQGRLAREVAAAQE

SEQ ID NO: 979756 - protein, 24 aa, Mycobacterium
STASWLAIVLAFAVAATPILAVAM

SEQ ID NO: 979757 - protein, 27 aa, Mycobacterium
STAVPPLPPVSLLPRRNPGSSGIADVP

SEQ ID NO: 979758 - protein, 24 aa, Mycobacterium
STAWPFLTGTILGWLVARGWRRPT

SEQ ID NO: 979759 - protein, 32 aa, Mycobacterium; identical to SEQ ID NO: 370076

SEQ ID NO: 979760 - protein, 20 aa, Mycobacterium
STFAGIYFWFPKMTGRLLDE

SEQ ID NO: 979761 - protein, 19 aa, Mycobacterium
STFVFIGAVVYIILAPKGR

SEQ ID NO: 979762 - protein, 23 aa, Mycobacterium
STPPTGFPSFSPPPSVSAGTGSQ

SEQ ID NO: 979763 - protein, 26 aa, Mycobacterium
STPQQALVWLGWLTAATVSGWVIDAI

SEQ ID NO: 979764 - protein, 24 aa, Mycobacterium
STPYTLKIMTWVTALFAPLTVVYQ

SEQ ID NO: 979765 - protein, 26 aa, Mycobacterium
STQIPLPVILIVSTTVVFGALSHRWL

SEQ ID NO: 979766 - protein, 26 aa, Mycobacterium
STQPAQLLVLLIIGGALMGCAASIRE

SEQ ID NO: 979767 - protein, 25 aa, Mycobacterium
STRDRLPLPNRLLAAGPLVTLGAMA

SEQ ID NO: 979768 - protein, 26 aa, Mycobacterium
STTVTVLYLAYLRRQTRIEEKVRSRR

SEQ ID NO: 979769 - protein, 17 aa, Mycobacterium
SVALLTWVLMHPASTPV

SEQ ID NO: 979770 - protein, 22 aa, Mycobacterium
SVARRFAVLALILALAVVVAMS

SEQ ID NO: 979771 - protein, 24 aa, Mycobacterium
SVATLLERWFWWPLRVRPRSASQM

SEQ ID NO: 979772 - protein, 26 aa, Mycobacterium
SVDSLLLMGIYLFLGGMAAASCNSAG

SEQ ID NO: 979773 - protein, 18 aa, Mycobacterium
SVDYAVRISSRGLYIHSA

SEQ ID NO: 979774 - protein, 19 aa, Mycobacterium
SVDYAVRISSRGLYIHSAP

SEQ ID NO: 979775 - protein, 25 aa, Mycobacterium
SVEAFSLFRVSKLNCLITTSDGTVL

SEQ ID NO: 979776 - protein, 18 aa, Mycobacterium
SVFGVFWGAFGLVSGTAN

SEQ ID NO: 979777 - protein, 17 aa, Mycobacterium
SVFLIYGDGLQIAGTGV

SEQ ID NO: 979778 - protein, 28 aa, Mycobacterium
SVFTTVLVTRFLVFLVAGVLVGGIVFAG

SEQ ID NO: 979779 - protein, 28 aa, Mycobacterium
SVGALVTYLLYVEMLFAPVDKLSQLFDE

SEQ ID NO: 979780 - protein, 26 aa, Mycobacterium
SVGRWVAVVAVLAVLTIVVTIAINTF

SEQ ID NO: 979781 - protein, 22 aa, Mycobacterium
SVISFTAILWNLSGTLNIFGLS

SEQ ID NO: 979782 - protein, 24 aa, Mycobacterium
SVLLTFYPGWVTIGLMAALVLVAA

SEQ ID NO: 979783 - protein, 18 aa, Mycobacterium
SVLRLGVLVFLIGAMLIG

SEQ ID NO: 979784 - protein, 30 aa, Mycobacterium; identical to SEQ ID NO: 370296

SEQ ID NO: 979785 - protein, 23 aa, Mycobacterium
SVRNLLGYKLIPWKDVVGVSFPG

SEQ ID NO: 979786 - protein, 18 aa, Mycobacterium
SVTLGVLVIACPCALGLA

SEQ ID NO: 979787 - protein, 19 aa, Mycobacterium
SVVFQHPYLFHGSIRENVL

SEQ ID NO: 979788 - protein, 23 aa, Mycobacterium
SVVPPLLALYWWAHAGSSADRLR

SEQ ID NO: 979789 - protein, 17 aa, Mycobacterium
SVVQCYYGFCAEGGPEG

SEQ ID NO: 979790 - protein, 17 aa, Mycobacterium
SVVTNVIFATFTFIFFA

SEQ ID NO: 979791 - protein, 27 aa, Mycobacterium
SVVYNLPKMISLLVEPWYALVGEREQA

SEQ ID NO: 979792 - protein, 22 aa, Mycobacterium
SVWYLLWLVAAAALGYVAWRLF

SEQ ID NO: 979793 - protein, 20 aa, Mycobacterium
SWILNAYNIVFAAFLVAAGR

SEQ ID NO: 979794 - protein, 27 aa, Mycobacterium
SWILNGYNIVFAAFLVASGRLADVLGR

SEQ ID NO: 979795 - protein, 22 aa, Mycobacterium
SWLEVPLVMRDGFGLRLELKLP

SEQ ID NO: 979796 - protein, 26 aa, Mycobacterium
SWNYTTWLNIIFLGIAAVLVTRFITS

SEQ ID NO: 979797 - protein, 29 aa, Mycobacterium
SWQQAIDAWLRLCQTYGWSPGVMGASSQG

SEQ ID NO: 979798 - protein, 17 aa, Mycobacterium
SWRAALPHFLGSSGVRL

SEQ ID NO: 979799 - protein, 32 aa, Mycobacterium
SWRILKGHLSLMLFPLLSTLFAFLAVVAIWAP

SEQ ID NO: 979800 - protein, 19 aa, Mycobacterium
SWRVLPLATWATACGWPFS

SEQ ID NO: 979801 - protein, 24 aa, Mycobacterium
SWSHHWVWMLPAVVVTGVLAWRRR

SEQ ID NO: 979802 - protein, 35 aa, Mycobacterium
SWVSIVVIYVIVLYEIVDILPFPVGSLVGPAAVLG

SEQ ID NO: 979803 - protein, 31 aa, Mycobacterium; identical to SEQ ID NO: 370405

SEQ ID NO: 979804 - protein, 20 aa, Mycobacterium
SYRMMAILFFVVIVCTMSVL

SEQ ID NO: 979805 - protein, 25 aa, Mycobacterium
SYTSTYLRFVWTLSATAVVVCYGLW

SEQ ID NO: 979806 - protein, 27 aa, Mycobacterium
TAAAAMIWQLKALVYGVALEPFEIDEP

SEQ ID NO: 979807 - protein, 20 aa, Mycobacterium
TAAAWWLCSAATVVTMLYLA

SEQ ID NO: 979808 - protein, 17 aa, Mycobacterium
TAAGWLLAGGSPDRAFS

SEQ ID NO: 979809 - protein, 28 aa, Mycobacterium
TAALTVWVVGITLRPLRRVAATAATVAA

SEQ ID NO: 979810 - protein, 34 aa, Mycobacterium; identical to SEQ ID NO: 370464

SEQ ID NO: 979811 - protein, 25 aa, Mycobacterium
TAAWPGGWWIDPGIGLVIAGIAVWQ

SEQ ID NO: 979812 - protein, 40 aa, Mycobacterium; identical to SEQ ID NO: 370471

SEQ ID NO: 979813 - protein, 18 aa, Mycobacterium
TADFSLAAAWPLAAVVQR

SEQ ID NO: 979814 - protein, 25 aa, Mycobacterium
TADGDLLRQLPLFAGLPAATMAELR

SEQ ID NO: 979815 - protein, 24 aa, Mycobacterium
TAEVYLPRTVLVDGQRPGSAAGQP

SEQ ID NO: 979816 - protein, 24 aa, Mycobacterium
TAFAFFGWHWSLPLGVAILLAAVG

SEQ ID NO: 979817 - protein, 24 aa, Mycobacterium
TAFRVPFLRNWKVSRAYLNWLADR

SEQ ID NO: 979818 - protein, 17 aa, Mycobacterium
TAFWRTVSTIKAAGYAV

SEQ ID NO: 979819 - protein, 22 aa, Mycobacterium
TAGAVFVAAWLPFNNGLRPEPL

SEQ ID NO: 979820 - protein, 27 aa, Mycobacterium
TAGLALPFLFWVWMRHLHERRGYRPAH

SEQ ID NO: 979821 - protein, 22 aa, Mycobacterium
TAGLLQLFFGFAGIGRFYVGSN

SEQ ID NO: 979822 - protein, 25 aa, Mycobacterium
TAGVIMLLLRRPFGRYLIVVGAVVA

SEQ ID NO: 979823 - protein, 25 aa, Mycobacterium
TAIVLLLAIGWRSRRRLPAAVIFGA

SEQ ID NO: 979824 - protein, 22 aa, Mycobacterium
TALAADRWQALPAPVATLVISL

SEQ ID NO: 979825 - protein, 18 aa, Mycobacterium
TALEPLPPIAGPSSTIAP

SEQ ID NO: 979826 - protein, 26 aa, Mycobacterium
TALISFSIWYFWADRFSLLALSVLIG

SEQ ID NO: 979827 - protein, 28 aa, Mycobacterium
TALPILPTQILWINMTTAIALGLMLAFE

SEQ ID NO: 979828 - protein, 24 aa, Mycobacterium
TALTFVFLLYRRWIARPGCTTESI

SEQ ID NO: 979829 - protein, 29 aa, Mycobacterium
TALYGMANSMFIPRFLFALSFCGLGVTTA

SEQ ID NO: 979830 - protein, 17 aa, Mycobacterium
TANRGLEVLPADKIPVL

SEQ ID NO: 979831 - protein, 21 aa, Mycobacterium
TASRMMFVLAGRREAPASLVK

SEQ ID NO: 979832 - protein, 24 aa, Mycobacterium
TASVLPVWLLLAPRDYLSTFMKVG

SEQ ID NO: 979833 - protein, 38 aa, Mycobacterium
TASVVALLLILTYRSSVLWLLPLLVIAFADRVATTVGT

SEQ ID NO: 979834 - protein, 26 aa, Mycobacterium
TATDQLMLPFSWQGVSLHAAGAARLR

SEQ ID NO: 979835 - protein, 34 aa, Mycobacterium; identical to SEQ ID NO: 370610

SEQ ID NO: 979836 - protein, 34 aa, Mycobacterium; identical to SEQ ID NO: 370620

SEQ ID NO: 979837 - protein, 18 aa, Mycobacterium
TAVMCCAIVIAAAALCGV

SEQ ID NO: 979838 - protein, 33 aa, Mycobacterium
TAVPLQVTSWLLMPISRLLVLLGNALTPGRGFR

SEQ ID NO: 979839 - protein, 19 aa, Mycobacterium
TAVPPGWSLQTAASVPVVF

SEQ ID NO: 979840 - protein, 25 aa, Mycobacterium
TAVVRWPAPILLASLAAALVGLIAL

SEQ ID NO: 979841 - protein, 17 aa, Mycobacterium
TAYLEGLGFAYNVYFKR

SEQ ID NO: 979842 - protein, 22 aa, Mycobacterium
TAYLHAGWYSIIGYVIAAAVAA

SEQ ID NO: 979843 - protein, 20 aa, Mycobacterium
TCRAHLPALALLGACVALLT

SEQ ID NO: 979844 - protein, 18 aa, Mycobacterium
TCTRMTGAYLGPIKLRTT

SEQ ID NO: 979845 - protein, 20 aa, Mycobacterium
TCWEVIFDRAPRRAVRNGAQ

SEQ ID NO: 979846 - protein, 19 aa, Mycobacterium
TDAGTGLSFVPWVISAKSA

SEQ ID NO: 979847 - protein, 28 aa, Mycobacterium
TDHNHLPLTPVPWPPPGTAAIEVDDFYD

SEQ ID NO: 979848 - protein, 24 aa, Mycobacterium
TDLCGVSWVYRYAVAVYRDDRGCG

SEQ ID NO: 979849 - protein, 21 aa, Mycobacterium
TDTILLVHLAGLGSSTPTALV

SEQ ID NO: 979850 - protein, 24 aa, Mycobacterium
TEKKSYPYFDPIAQKPFDANYDSE

SEQ ID NO: 979851 - protein, 28 aa, Mycobacterium
TELPFTGLNTPCRWRWTRRATSTSPIAV

SEQ ID NO: 979852 - protein, 21 aa, Mycobacterium
TELPVLLYDIPGRSAVPIESE

SEQ ID NO: 979853 - protein, 17 aa, Mycobacterium
TEMLAARSAGSDAIPGS

SEQ ID NO: 979854 - protein, 18 aa, Mycobacterium
TEPNFLREWLPGQLLQGI

SEQ ID NO: 979855 - protein, 23 aa, Mycobacterium
TEQPTFYLDFPTSVSPLTRPHRS

SEQ ID NO: 979856 - protein, 20 aa, Mycobacterium
TERRWGKIVALSLLTAVLLA

SEQ ID NO: 979857 - protein, 21 aa, Mycobacterium
TETLVHWATLGLAADRATLII

SEQ ID NO: 979858 - protein, 19 aa, Mycobacterium
TFADWLENLWILNVIVFVA

SEQ ID NO: 979859 - protein, 19 aa, Mycobacterium
TFCLSFTRMPYFQTLGIPC

SEQ ID NO: 979860 - protein, 19 aa, Mycobacterium
TFGLTWRLDRGALLLWTIG

SEQ ID NO: 979861 - protein, 22 aa, Mycobacterium
TGAIVLIVVLFLGSHLSLTKVL

SEQ ID NO: 979862 - protein, 19 aa, Mycobacterium
TGAYLGPIKLRTTTLTLIY

SEQ ID NO: 979863 - protein, 17 aa, Mycobacterium
TGAYVLITFWQDHNACV

SEQ ID NO: 979864 - protein, 25 aa, Mycobacterium
TGDVRRAMTMLLIACPCAVGLSTPT

SEQ ID NO: 979865 - protein, 28 aa, Mycobacterium
TGELVSPLHWYWAVIAAFVVFAGTNSWG

SEQ ID NO: 979866 - protein, 25 aa, Mycobacterium
TGFNTWMFDLIWEFLQDPIGNTIKI

SEQ ID NO: 979867 - protein, 28 aa, Mycobacterium
TGFWIRRARRLLPALVLMVLTVAAAREL

SEQ ID NO: 979868 - protein, 33 aa, Mycobacterium
TGGALLVLAVFFPWNLYFGFRIPGSSNYVLAVL

SEQ ID NO: 979869 - protein, 17 aa, Mycobacterium
TGGFWRVLGIRLLTAIV

SEQ ID NO: 979870 - protein, 25 aa, Mycobacterium
TGGWLLEHFSWGSIFLVNVPIAVAA

SEQ ID NO: 979871 - protein, 39 aa, Mycobacterium
TGHFSVALSLLWNYAMLWFGFVVPPALQIVFDPLLVVAA

SEQ ID NO: 979872 - protein, 25 aa, Mycobacterium
TGLDLPPTLIFDHPTPHAVAEHLLE

SEQ ID NO: 979873 - protein, 24 aa, Mycobacterium
TGLLAGPCKPRCWWCARDAPPSMK

SEQ ID NO: 979874 - protein, 20 aa, Mycobacterium
TGLPRRASTVGLVALVSAQL

SEQ ID NO: 979875 - protein, 21 aa, Mycobacterium
TGLSFVPWVISAKSAEALSAQ

SEQ ID NO: 979876 - protein, 26 aa, Mycobacterium
TGLTLSPTLIFDYPSPAALAEHLGIR

SEQ ID NO: 979877 - protein, 23 aa, Mycobacterium
TGLYLTVLLLGDAPLFCPSYPQP

SEQ ID NO: 979878 - protein, 41 aa, Mycobacterium; identical to SEQ ID NO: 348001

SEQ ID NO: 979879 - protein, 24 aa, Mycobacterium
TGPAVFFLLAAVWFATLTALRAKT

SEQ ID NO: 979880 - protein, 27 aa, Mycobacterium
TGRYKIFPVLGTALMTLAFLLMSRTDE

SEQ ID NO: 979881 - protein, 32 aa, Mycobacterium
TGSLALAFLSIGALIYFLHHLMHSIQLDTIMD

SEQ ID NO: 979882 - protein, 20 aa, Mycobacterium
TGTLLLARTPALHSVGTVAL

SEQ ID NO: 979883 - protein, 29 aa, Mycobacterium
TGVGLASLLWQLLLVWIGAVVGAGSTART

SEQ ID NO: 979884 - protein, 17 aa, Mycobacterium
TGVLLYASALAGPALAG

SEQ ID NO: 979885 - protein, 26 aa, Mycobacterium
TGVTIFTGYPFLRGALRSLRSGKAGT

SEQ ID NO: 979886 - protein, 17 aa, Mycobacterium
TGVVCFVGFFASYMFNV

SEQ ID NO: 979887 - protein, 22 aa, Mycobacterium
TGYRLRVRMTPTEGQYKISKLD

SEQ ID NO: 979888 - protein, 29 aa, Mycobacterium
THINTYSMDLFLRIAPELYLKRLCVGGVE

SEQ ID NO: 979889 - protein, 18 aa, Mycobacterium
THQSAFIDFRRTADAPSQ

SEQ ID NO: 979890 - protein, 41 aa, Mycobacterium
THSQPGFFCLLLVYLAATPTLIWQRRLLKRLPDRLARLHAA

SEQ ID NO: 979891 - protein, 27 aa, Mycobacterium
THSTTAWLFDMAMLAALSVVYSAVVWW

SEQ ID NO: 979892 - protein, 19 aa, Mycobacterium
THVFAGFYIVGCIAAVLAV

SEQ ID NO: 979893 - protein, 32 aa, Mycobacterium; identical to SEQ ID NO: 370998

SEQ ID NO: 979894 - protein, 21 aa, Mycobacterium
TIAASLLAGLLAYVVDRLAGL

SEQ ID NO: 979895 - protein, 28 aa, Mycobacterium
TIAMFLGSTLVLRRKFKPQLVLEDIEKH

SEQ ID NO: 979896 - protein, 18 aa, Mycobacterium
TICWIAVAAPLFVYALRV

SEQ ID NO: 979897 - protein, 21 aa, Mycobacterium
TIGLGLLFDTLIVRSLMTPSV

SEQ ID NO: 979898 - protein, 23 aa, Mycobacterium
TIGLGLLFDTLVVRAFMTPAIAA

SEQ ID NO: 979899 - protein, 27 aa, Mycobacterium
TIGLGSALLIAALLLSTYTSSKITKIP

SEQ ID NO: 979900 - protein, 28 aa, Mycobacterium
TIIGALVLPILFLVVLNIVLGNLAYVVT

SEQ ID NO: 979901 - protein, 32 aa, Mycobacterium; identical to SEQ ID NO: 371043

SEQ ID NO: 979902 - protein, 18 aa, Mycobacterium
TILMLLVIGYPIGYAMWL

SEQ ID NO: 979903 - protein, 20 aa, Mycobacterium
TILSVHLLGRPLGRLIDHDN

SEQ ID NO: 979904 - protein, 17 aa, Mycobacterium
TILVTIAASLLAGLLAY

SEQ ID NO: 979905 - protein, 32 aa, Mycobacterium; identical to SEQ ID NO: 371054

SEQ ID NO: 979906 - protein, 25 aa, Mycobacterium
TIMIGLLFDTLVVRSFMMPAVGTLL

SEQ ID NO: 979907 - protein, 25 aa, Mycobacterium
TISSLLFMFVWTMIVISYLVYRRRH

SEQ ID NO: 979908 - protein, 19 aa, Mycobacterium
TIVGWGGLALLLLTCTQLG

SEQ ID NO: 979909 - protein, 19 aa, Mycobacterium
TIVVRWPGPVLVAAALISL

SEQ ID NO: 979910 - protein, 18 aa, Mycobacterium
TIYVILELIVLSPALLQE

SEQ ID NO: 979911 - protein, 20 aa, Mycobacterium
TKFITWTLPTNIGEGLVILA

SEQ ID NO: 979912 - protein, 23 aa, Mycobacterium
TKLAILGLSNWPVSLASICSTGA

SEQ ID NO: 979913 - protein, 19 aa, Mycobacterium
TKPLIPLAVSAFLTSRKKA

SEQ ID NO: 979914 - protein, 25 aa, Mycobacterium
TLAALLFGAYFLRSYFVLIVVAAVG

SEQ ID NO: 979915 - protein, 22 aa, Mycobacterium
TLAKRWKLVVGALLACLAGATA

SEQ ID NO: 979916 - protein, 17 aa, Mycobacterium
TLAVVASVSAALLGCLG

SEQ ID NO: 979917 - protein, 26 aa, Mycobacterium
TLDAMIGYRSPRYLRFGWAAARLDDL

SEQ ID NO: 979918 - protein, 26 aa, Mycobacterium
TLDDRRLLSLILLARDHVVHGWVLAS

SEQ ID NO: 979919 - protein, 19 aa, Mycobacterium
TLEFALVVTIASVPVALPA

SEQ ID NO: 979920 - protein, 34 aa, Mycobacterium
TLFGLAVVVALAAPLGWFGFRVHLAGQAQARQGQ

SEQ ID NO: 979921 - protein, 28 aa, Mycobacterium
TLFYESGASWYWLLAGPFSALSLILIEK

SEQ ID NO: 979922 - protein, 19 aa, Mycobacterium
TLGLPATSVAWGLWAGGGM

SEQ ID NO: 979923 - protein, 18 aa, Mycobacterium
TLISIRRQALALVTATAG

SEQ ID NO: 979924 - protein, 33 aa, Mycobacterium
TLISVGTLAAFLWSLYALFLGTAGEPGIRHPFE

SEQ ID NO: 979925 - protein, 18 aa, Mycobacterium
TLLATMVILASSLVISGI

SEQ ID NO: 979926 - protein, 25 aa, Mycobacterium
TLLDQGFPRVHRWARGVDLIRFAPS

SEQ ID NO: 979927 - protein, 25 aa, Mycobacterium
TLLWLVPLAASVLTILLPPGLRQLA

SEQ ID NO: 979928 - protein, 21 aa, Mycobacterium
TLPQLVQVSAFLKNLRLDFAN

SEQ ID NO: 979929 - protein, 31 aa, Mycobacterium
TLREIATALRRPILPVGAALRRIGSVAEFQL

SEQ ID NO: 979930 - protein, 28 aa, Mycobacterium
TLRRGMPFALTWWSLTFPVGTFVTGTSQ

SEQ ID NO: 979931 - protein, 26 aa, Mycobacterium
TLSLLASISPLVRWIIKVPREFINSY

SEQ ID NO: 979932 - protein, 24 aa, Mycobacterium
TLTPALFVLFCVLVVSAWSNAVNF

SEQ ID NO: 979933 - protein, 17 aa, Mycobacterium
TLTPLPIKTFDVRLARQ

SEQ ID NO: 979934 - protein, 25 aa, Mycobacterium
TLVGFIVTLPFLPAAARELSLASAA

SEQ ID NO: 979935 - protein, 17 aa, Mycobacterium
TLVIAYGVAWFGAYSIV

SEQ ID NO: 979936 - protein, 25 aa, Mycobacterium
TLVQLAPFVLLVELARILLSGAQES

SEQ ID NO: 979937 - protein, 24 aa, Mycobacterium
TLVSTTFVVPYPPGFPVLVPGQVV

SEQ ID NO: 979938 - protein, 26 aa, Mycobacterium
TLVVAALLLVLVSRAALAPLDRLAAL

SEQ ID NO: 979939 - protein, 29 aa, Mycobacterium
TLVYAVLAVIWFWLLKRYIVEGPLEHDAE

SEQ ID NO: 979940 - protein, 18 aa, Mycobacterium
TMAGPWVGIAAPGENIVS

SEQ ID NO: 979941 - protein, 27 aa, Mycobacterium
TMATGSLVLLVLLAGIALLISRQVVVP

SEQ ID NO: 979942 - protein, 22 aa, Mycobacterium
TMDAFDYFIVVLVYADIAKTFH

SEQ ID NO: 979943 - protein, 20 aa, Mycobacterium
TMFLSQLPYVPLGSLRVVVC

SEQ ID NO: 979944 - protein, 18 aa, Mycobacterium
TMHGTVMLLFYATPIVFG

SEQ ID NO: 979945 - protein, 19 aa, Mycobacterium
TMMDLATRPSTFLWLIAVT

SEQ ID NO: 979946 - protein, 20 aa, Mycobacterium
TNDIIWLVVAVVFLVVVVTS

SEQ ID NO: 979947 - protein, 27 aa, Mycobacterium
TNFFRTLYVLPWICAPLAIAVMWRWIL

SEQ ID NO: 979948 - protein, 28 aa, Mycobacterium
TNFNRPYALWLPLVLVVPLGVVVMFARR

SEQ ID NO: 979949 - protein, 19 aa, Mycobacterium
TNLVLRSFSQRWASGGSVA

SEQ ID NO: 979950 - protein, 17 aa, Mycobacterium
TNPASFRRWLNPVNTAA

SEQ ID NO: 979951 - protein, 26 aa, Mycobacterium
TNWALMKPIALAWVIALPSAAILSAV

SEQ ID NO: 979952 - protein, 21 aa, Mycobacterium
TPAVFLLYFLLRRDNRAALTA

SEQ ID NO: 979953 - protein, 20 aa, Mycobacterium
TPDFPLPFTYPPFAAVVFYP

SEQ ID NO: 979954 - protein, 27 aa, Mycobacterium
TPGRPSFGRWALQPLTCAFAVAGALAY

SEQ ID NO: 979955 - protein, 20 aa, Mycobacterium
TPHPRFPHLIPGGDYVMGGD

SEQ ID NO: 979956 - protein, 22 aa, Mycobacterium
TPIAFLLFAFFGGFAVMIGAEL

SEQ ID NO: 979957 - protein, 24 aa, Mycobacterium
TPIDPRFPTFLATNLSEALPGPFS

SEQ ID NO: 979958 - protein, 22 aa, Mycobacterium
TPLPIKTFDVRLARQAYRFVSQ

SEQ ID NO: 979959 - protein, 34 aa, Mycobacterium; identical to SEQ ID NO: 371432

SEQ ID NO: 979960 - protein, 17 aa, Mycobacterium
TPLYRIAATFVGPDAMV

SEQ ID NO: 979961 - protein, 23 aa, Mycobacterium
TPPLGPVWVALLIIGASSGVAVG

SEQ ID NO: 979962 - protein, 18 aa, Mycobacterium
TPSALVLLFITFGVPQLQ

SEQ ID NO: 979963 - protein, 27 aa, Mycobacterium
TPSIAVLLGRWFWWPQRVRPRPASQML

SEQ ID NO: 979964 - protein, 18 aa, Mycobacterium
TPSPPYYQGSGWGGAPPP

SEQ ID NO: 979965 - protein, 22 aa, Mycobacterium
TPVLNMWLRGLGAHIGRGVWCE

SEQ ID NO: 979966 - protein, 17 aa, Mycobacterium
TPVVWGVLIGFVALYLL

SEQ ID NO: 979967 - protein, 24 aa, Mycobacterium
TQAAGLLVWFLIALPIGAVLGGWG

SEQ ID NO: 979968 - protein, 25 aa, Mycobacterium
TQAAGLLVWFLIALPIGAVLGGWGA

SEQ ID NO: 979969 - protein, 18 aa, Mycobacterium
TQGLFPVISLVLLGLGLA

SEQ ID NO: 979970 - protein, 29 aa, Mycobacterium
TQHRITAREWMWAILLAGAVAVIVTAGDP

SEQ ID NO: 979971 - protein, 17 aa, Mycobacterium
TQPALDLDALLGGLRPV

SEQ ID NO: 979972 - protein, 18 aa, Mycobacterium
TQPKKAAAALVWLVEEME

SEQ ID NO: 979973 - protein, 36 aa, Mycobacterium
TQPNLDTRPRLILGATLIALSFLGLRHLWSGSPETP

SEQ ID NO: 979974 - protein, 25 aa, Mycobacterium
TQTFLIMLTALFLAGTLILTVARRS

SEQ ID NO: 979975 - protein, 26 aa, Mycobacterium
TRAQRLCRPVFWYLAAWTGALVVVRA

SEQ ID NO: 979976 - protein, 25 aa, Mycobacterium
TRATLHFLWLRLARVWPVYLVTMHL

SEQ ID NO: 979977 - protein, 23 aa, Mycobacterium
TRGADLLLVSFMLALSAAALPVQ

SEQ ID NO: 979978 - protein, 23 aa, Mycobacterium
TRKALPLYIAFLAGLGVLAGQLD

SEQ ID NO: 979979 - protein, 25 aa, Mycobacterium
TRMFKYFVKRFALKRGVLLFGKLLP

SEQ ID NO: 979980 - protein, 26 aa, Mycobacterium
TRMVAAWVITLPLAGLVGTITYWLVH

SEQ ID NO: 979981 - protein, 25 aa, Mycobacterium
TRPVRAISWLVAGISALGLLNFNRA

SEQ ID NO: 979982 - protein, 22 aa, Mycobacterium
TRQLRQLMIGAGLVTLVVAALL

SEQ ID NO: 979983 - protein, 31 aa, Mycobacterium; identical to SEQ ID NO: 371586

SEQ ID NO: 979984 - protein, 39 aa, Mycobacterium
TRRQVRLVIADRAYFAFLAILPFILGTLSLTVPGDTGFG

SEQ ID NO: 979985 - protein, 26 aa, Mycobacterium
TRSLIVRRWRLIGKCLRPLPNKWNGL

SEQ ID NO: 979986 - protein, 25 aa, Mycobacterium
TSAAALPVVAVRPAAAATGATSVAA

SEQ ID NO: 979987 - protein, 45 aa, Mycobacterium; identical to SEQ ID NO: 371625

SEQ ID NO: 979988 - protein, 31 aa, Mycobacterium; identical to SEQ ID NO: 371631

SEQ ID NO: 979989 - protein, 27 aa, Mycobacterium
TSASNPLLALLEYLPYATDLGLHLIVA

SEQ ID NO: 979990 - protein, 23 aa, Mycobacterium
TSEPLIPLRIFGDRNFALCSFGV

SEQ ID NO: 979991 - protein, 26 aa, Mycobacterium
TSERWLPLMLAGFTSGFLMLRGRSYV

SEQ ID NO: 979992 - protein, 19 aa, Mycobacterium
TSFRRVLLPQLRPTTFFLS

SEQ ID NO: 979993 - protein, 17 aa, Mycobacterium
TSINSVLLIFTIGVTWS

SEQ ID NO: 979994 - protein, 21 aa, Mycobacterium
TSLIDSRFNYRIPVSLAWTRT

SEQ ID NO: 979995 - protein, 18 aa, Mycobacterium
TSLRLLLIGSVVGAALGV

SEQ ID NO: 979996 - protein, 17 aa, Mycobacterium
TSMLWSGDRAWRQAGER

SEQ ID NO: 979997 - protein, 32 aa, Mycobacterium
TSPLILTLLMTAIVGCALFLWLEGRSADPMMD

SEQ ID NO: 979998 - protein, 24 aa, Mycobacterium
TSRAAWAWFRHLHGLADRTLAPST

SEQ ID NO: 979999 - protein, 23 aa, Mycobacterium
TSSVITALRRRLPQHRFVESPRL

SEQ ID NO: 980000 - protein, 26 aa, Mycobacterium
TTAGAIIIRRALAPLRRVAQTATEVV

SEQ ID NO: 980001 - protein, 19 aa, Mycobacterium
TTAPMLPLTFYAQSVCGLS

SEQ ID NO: 980002 - protein, 19 aa, Mycobacterium
TTFTWASRAFGPVTGWLGG

SEQ ID NO: 980003 - protein, 24 aa, Mycobacterium
TTISSLVLLIPTLGTIVLLAHPGL

SEQ ID NO: 980004 - protein, 23 aa, Mycobacterium
TTNALWGIAIFAAVVFTTGLPLA

SEQ ID NO: 980005 - protein, 25 aa, Mycobacterium
TTPGRILTIGIVLAALGVASAFATS

SEQ ID NO: 980006 - protein, 28 aa, Mycobacterium
TTSTGPLLRLVPLAMSIATLIAMAATYV

SEQ ID NO: 980007 - protein, 24 aa, Mycobacterium
TTVGPYTRYGLPLVAACARTGTDY

SEQ ID NO: 980008 - protein, 25 aa, Mycobacterium
TTVGPYTRYGLPLVAACARTGTDYA

SEQ ID NO: 980009 - protein, 25 aa, Mycobacterium
TTVTVLYLAYLRRQTRIEEKVRSRR

SEQ ID NO: 980010 - protein, 21 aa, Mycobacterium
TTVVTPSWFSDYVLTVGAVDT

SEQ ID NO: 980011 - protein, 31 aa, Mycobacterium
TVADHRMVMTIPARWSFPQAASIPVVFLTAY

SEQ ID NO: 980012 - protein, 26 aa, Mycobacterium
TVAPTTLAVLMLLPLSAFEATNALPA

SEQ ID NO: 980013 - protein, 30 aa, Mycobacterium; identical to SEQ ID NO: 371839

SEQ ID NO: 980014 - protein, 20 aa, Mycobacterium
TVCALTTGFTYFHSDRRALL

SEQ ID NO: 980015 - protein, 32 aa, Mycobacterium
TVDQGAHVFDLARLGWALHGHPTALAVPIGEF

SEQ ID NO: 980016 - protein, 25 aa, Mycobacterium
TVFSTLYLPLLAILFGMIVRSVAIE

SEQ ID NO: 980017 - protein, 18 aa, Mycobacterium
TVGFAGAGAFWILRRLFD

SEQ ID NO: 980018 - protein, 23 aa, Mycobacterium
TVGILFAVVLLDASLIGANAIGL

SEQ ID NO: 980019 - protein, 18 aa, Mycobacterium
TVGLQWWRRFGPQRPLHG

SEQ ID NO: 980020 - protein, 33 aa, Mycobacterium; identical to SEQ ID NO: 371879

SEQ ID NO: 980021 - protein, 24 aa, Mycobacterium
TVIGVPWLLSFAQPTIWQIGRPWY

SEQ ID NO: 980022 - protein, 23 aa, Mycobacterium
TVISLVFRFDLTRITLTGSPLDA

SEQ ID NO: 980023 - protein, 35 aa, Mycobacterium
TVKMTTEWLHVPLLPIPIPIRVPASQAPPSPVSQN

SEQ ID NO: 980024 - protein, 18 aa, Mycobacterium
TVLLIAPVTLPVCDRLAI

SEQ ID NO: 980025 - protein, 17 aa, Mycobacterium
TVLLLLFSPPSLRWAGA

SEQ ID NO: 980026 - protein, 20 aa, Mycobacterium
TVMALGWLVLAGLLGLSLIR

SEQ ID NO: 980027 - protein, 22 aa, Mycobacterium
TVPLYIWSLLISLALNKVWRRH

SEQ ID NO: 980028 - protein, 31 aa, Mycobacterium; identical to SEQ ID NO: 371932

SEQ ID NO: 980029 - protein, 29 aa, Mycobacterium
TVRARAFGWLWQVLAATLVAAVFAAAVAQ

SEQ ID NO: 980030 - protein, 25 aa, Mycobacterium
TVRQFNDLLRVLPPLPQESPQEAEE

SEQ ID NO: 980031 - protein, 22 aa, Mycobacterium
TVRTGLLWWTVAIHLLASMTMV

SEQ ID NO: 980032 - protein, 27 aa, Mycobacterium
TVSMGIILLGLLWYAGLPLRVFMSSFA

SEQ ID NO: 980033 - protein, 28 aa, Mycobacterium
TVTSGITAWLWDWSADPGTALGAGCTPA

SEQ ID NO: 980034 - protein, 19 aa, Mycobacterium
TVVAYFPSANALYPGDKVQ

SEQ ID NO: 980035 - protein, 25 aa, Mycobacterium
TVVWAWLPVVLVVSVARAGLPGPAG

SEQ ID NO: 980036 - protein, 23 aa, Mycobacterium
TVVYAFICLFVINVVMTAIGVRI

SEQ ID NO: 980037 - protein, 26 aa, Mycobacterium
TVVYEPLLNRLPADTPMYGFERVEGS

SEQ ID NO: 980038 - protein, 21 aa, Mycobacterium
TVWQTANLMRKEGFGAAVRSS

SEQ ID NO: 980039 - protein, 19 aa, Mycobacterium
TWHITGACIFVFLLAMPRG

SEQ ID NO: 980040 - protein, 17 aa, Mycobacterium
TWHPILDLSIFANRRFS

SEQ ID NO: 980041 - protein, 22 aa, Mycobacterium
TWLVASLVLVAERRAINQFGGG

SEQ ID NO: 980042 - protein, 22 aa, Mycobacterium
TWSTALLPMALLMLAAAVAALA

SEQ ID NO: 980043 - protein, 18 aa, Mycobacterium
TWVLMHPASTPVGGLGYG

SEQ ID NO: 980044 - protein, 19 aa, Mycobacterium
TWVVIDDNAWFFALTDHVS

SEQ ID NO: 980045 - protein, 19 aa, Mycobacterium
TYLMFSWMQVFTASGFAFS

SEQ ID NO: 980046 - protein, 17 aa, Mycobacterium
VAAALGLLAALFVFSYR

SEQ ID NO: 980047 - protein, 27 aa, Mycobacterium
VAAARWLYTVFTVLAAVGFIASYQATH

SEQ ID NO: 980048 - protein, 23 aa, Mycobacterium
VAAGTVVILVLWGSFRVRKANTA

SEQ ID NO: 980049 - protein, 18 aa, Mycobacterium
VAALTFKGSLGVASIVVF

SEQ ID NO: 980050 - protein, 24 aa, Mycobacterium
VAAMWVTYALFMGSLRSVVPVTLT

SEQ ID NO: 980051 - protein, 22 aa, Mycobacterium
VAAPPVRLLPANLAPDAVGALY

SEQ ID NO: 980052 - protein, 24 aa, Mycobacterium
VACLSFTWLPYFHSLGIPQPHWAF

SEQ ID NO: 980053 - protein, 37 aa, Mycobacterium; identical to SEQ ID NO: 372146

SEQ ID NO: 980054 - protein, 17 aa, Mycobacterium
VAELLAIAGVKYLVLGT

SEQ ID NO: 980055 - protein, 18 aa, Mycobacterium
VAELLAIAGVKYLVLGTG

SEQ ID NO: 980056 - protein, 23 aa, Mycobacterium
VAFLAGDGLPVPAGARALPLVQA

SEQ ID NO: 980057 - protein, 24 aa, Mycobacterium
VAFLGPWLFSIFVDIFSAVRAGLG

SEQ ID NO: 980058 - protein, 22 aa, Mycobacterium
VAFVVLIWWRTSELLAMFGGHL

SEQ ID NO: 980059 - protein, 27 aa, Mycobacterium
VAGALCILVMVMWVGTALTISTTASRS

SEQ ID NO: 980060 - protein, 24 aa, Mycobacterium
VAGFHHGFFIFAIVLTAMSIIPLG

SEQ ID NO: 980061 - protein, 20 aa, Mycobacterium
VAGGLELALWCDLRVAEQDS

SEQ ID NO: 980062 - protein, 26 aa, Mycobacterium
VAGIVFIVSVIFFTGFRLGMHSGHGG

SEQ ID NO: 980063 - protein, 24 aa, Mycobacterium
VAGLGLFNPVSVGAGLILGRMAYK

SEQ ID NO: 980064 - protein, 25 aa, Mycobacterium
VAGVVYFLVVVPYNTLRKKGEVEQA

SEQ ID NO: 980065 - protein, 34 aa, Mycobacterium; identical to SEQ ID NO: 372227

SEQ ID NO: 980066 - protein, 17 aa, Mycobacterium
VAIGLFVLPLSGPLHMA

SEQ ID NO: 980067 - protein, 17 aa, Mycobacterium
VAIHWAMASLRSGECDM

SEQ ID NO: 980068 - protein, 17 aa, Mycobacterium
VAIIPLYSLAVLAAFFA

SEQ ID NO: 980069 - protein, 25 aa, Mycobacterium
VAIVVLVLGYRQFWTKVRRGALFKA

SEQ ID NO: 980070 - protein, 27 aa, Mycobacterium
VALAFAVAGFWWFDGYTLVQQRYWQGI

SEQ ID NO: 980071 - protein, 24 aa, Mycobacterium
VALCGVVCFVGFLASYLFNVYVQG

SEQ ID NO: 980072 - protein, 18 aa, Mycobacterium
VALFVYLIIAISQVILRR

SEQ ID NO: 980073 - protein, 18 aa, Mycobacterium
VALLTGTLLLARTPALHS

SEQ ID NO: 980074 - protein, 24 aa, Mycobacterium
VALLTGTLLLARTPALHSVGTVAL

SEQ ID NO: 980075 - protein, 30 aa, Mycobacterium; identical to SEQ ID NO: 372286

SEQ ID NO: 980076 - protein, 24 aa, Mycobacterium
VALRLNTRWVAHVVLLIPTVIAVI

SEQ ID NO: 980077 - protein, 30 aa, Mycobacterium; identical to SEQ ID NO: 372324

SEQ ID NO: 980078 - protein, 19 aa, Mycobacterium
VANLLILGALRVNWALGFQ

SEQ ID NO: 980079 - protein, 25 aa, Mycobacterium
VANMIQPFWLLPLLAIAKLNVRQVM

SEQ ID NO: 980080 - protein, 17 aa, Mycobacterium
VAPLIAMLLILGVYPKP

SEQ ID NO: 980081 - protein, 42 aa, Mycobacterium; identical to SEQ ID NO: 372352

SEQ ID NO: 980082 - protein, 17 aa, Mycobacterium
VAQRQWRWPLGEIDKPF

SEQ ID NO: 980083 - protein, 39 aa, Mycobacterium
VARLLAWRPLVWLGTISYGIYLWHLPIFLALNGERTGWT

SEQ ID NO: 980084 - protein, 36 aa, Mycobacterium; identical to SEQ ID NO: 372401

SEQ ID NO: 980085 - protein, 19 aa, Mycobacterium
VASYSWYYAWTPGTGYLAN

SEQ ID NO: 980086 - protein, 17 aa, Mycobacterium
VATFFRFVARRLDTRPE

SEQ ID NO: 980087 - protein, 17 aa, Mycobacterium
VATFILYEAIRRFKEAP

SEQ ID NO: 980088 - protein, 36 aa, Mycobacterium; identical to SEQ ID NO: 372412

SEQ ID NO: 980089 - protein, 23 aa, Mycobacterium
VATNFAWLFPVLTGLPISQQTWD

SEQ ID NO: 980090 - protein, 19 aa, Mycobacterium
VATQLLLGPVARGAIASRT

SEQ ID NO: 980091 - protein, 19 aa, Mycobacterium
VATQYLQFVAAYRAFDTGV

SEQ ID NO: 980092 - protein, 26 aa, Mycobacterium
VATTALLIMVFGYMRVPAMVGIGQYR

SEQ ID NO: 980093 - protein, 29 aa, Mycobacterium
VAVSFAALVWVFGGLLAAALPVAVGGFAI

SEQ ID NO: 980094 - protein, 28 aa, Mycobacterium
VAVVSLGLWVIFLPSVVRRRLPEKWAAD

SEQ ID NO: 980095 - protein, 19 aa, Mycobacterium
VCLVLFAAVIVWPQVRHAG

SEQ ID NO: 980096 - protein, 22 aa, Mycobacterium
VDAAMIFGFLLWHVIGANSSDD

SEQ ID NO: 980097 - protein, 17 aa, Mycobacterium
VDALLKDMREFTGLLAQ

SEQ ID NO: 980098 - protein, 24 aa, Mycobacterium
VDAQGATRFLPPGALIEVDGTTGE

SEQ ID NO: 980099 - protein, 30 aa, Mycobacterium; identical to SEQ ID NO: 372517

SEQ ID NO: 980100 - protein, 17 aa, Mycobacterium
VDATLVRVLLVPAFMHV

SEQ ID NO: 980101 - protein, 27 aa, Mycobacterium
VDAVICYIGFLFPLWDAKRQTLADKIM

SEQ ID NO: 980102 - protein, 26 aa, Mycobacterium
VDFAIGPPPPALPYLDVDDPGPTDPA

SEQ ID NO: 980103 - protein, 18 aa, Mycobacterium
VDFGGFAPLGWGAVLAAV

SEQ ID NO: 980104 - protein, 23 aa, Mycobacterium
VDKMGMHPVVLDAVLHALGLTAE

SEQ ID NO: 980105 - protein, 23 aa, Mycobacterium
VDPIAEGWFFDRPDLIGADGVHP

SEQ ID NO: 980106 - protein, 30 aa, Mycobacterium
VDRAAQVWLRPRSWLLRRTTTEATVVVEIV

SEQ ID NO: 980107 - protein, 21 aa, Mycobacterium
VDRNIDRLLRRVCPGDIVVLD

SEQ ID NO: 980108 - protein, 22 aa, Mycobacterium
VDSFDGYEYLFWVGCAGAYDDK

SEQ ID NO: 980109 - protein, 18 aa, Mycobacterium
VDWLELLVQVIVAAVGVA

SEQ ID NO: 980110 - protein, 23 aa, Mycobacterium
VEASFYVLLPFLAYLLLVVISRR

SEQ ID NO: 980111 - protein, 22 aa, Mycobacterium
VEEVLRYLPPSNLGALRYAVED

SEQ ID NO: 980112 - protein, 18 aa, Mycobacterium
VEGRSMWAGVRDAVTILV

SEQ ID NO: 980113 - protein, 27 aa, Mycobacterium
VELLKLAVVLALWAAVAGAFVSVLYRR

SEQ ID NO: 980114 - protein, 26 aa, Mycobacterium
VELRPYWTPLFAYAAAFLIAAAHITV

SEQ ID NO: 980115 - protein, 26 aa, Mycobacterium
VERLSWTVVVPLLALVALVLSWGQHI

SEQ ID NO: 980116 - protein, 34 aa, Mycobacterium; identical to SEQ ID NO: 372637

SEQ ID NO: 980117 - protein, 24 aa, Mycobacterium
VETLGWRSVFAVSVPLGAIVLVLT

SEQ ID NO: 980118 - protein, 24 aa, Mycobacterium
VEVGQFIRRLFSFLVRQLDRIAPF

SEQ ID NO: 980119 - protein, 20 aa, Mycobacterium
VFCAFILYFALYSRHQLVAN

SEQ ID NO: 980120 - protein, 17 aa, Mycobacterium
VFDIEIVFLYPWAVSFD

SEQ ID NO: 980121 - protein, 19 aa, Mycobacterium
VFDNLTKFITWTLPTNIGE

SEQ ID NO: 980122 - protein, 17 aa, Mycobacterium
VFDPLLVVAAVIEWILG

SEQ ID NO: 980123 - protein, 26 aa, Mycobacterium
VFFVISGFLITGLLWREVTTTNTVAL

SEQ ID NO: 980124 - protein, 22 aa, Mycobacterium
VFGGSLNWSLVGLGALIGIVVV

SEQ ID NO: 980125 - protein, 39 aa, Mycobacterium; identical to SEQ ID NO: 372688

SEQ ID NO: 980126 - protein, 19 aa, Mycobacterium
VFGQTWVPQALAKRVGHSQ

SEQ ID NO: 980127 - protein, 21 aa, Mycobacterium
VFGTKLLNVMLGTGGDYAGPG

SEQ ID NO: 980128 - protein, 18 aa, Mycobacterium
VFGWQVLPFLIIQGLFGA

SEQ ID NO: 980129 - protein, 17 aa, Mycobacterium
VFIAGFLMHIAVKMPKM

SEQ ID NO: 980130 - protein, 18 aa, Mycobacterium
VFLGIATFAIIRIKRNPR

SEQ ID NO: 980131 - protein, 17 aa, Mycobacterium
VFLNLMQGVLIGLALAI

SEQ ID NO: 980132 - protein, 21 aa, Mycobacterium
VFLVGSGIDLPLIKPTLEAST

SEQ ID NO: 980133 - protein, 17 aa, Mycobacterium
VFLYPWAVSFDALGTFA

SEQ ID NO: 980134 - protein, 18 aa, Mycobacterium
VFPAVFYPGLSPALATIA

SEQ ID NO: 980135 - protein, 17 aa, Mycobacterium
VFSLYAFCAPPHWWWSV

SEQ ID NO: 980136 - protein, 54 aa, Mycobacterium
VFSVVMIIACLFFAVYFMQVTYSLMTFWITTMLALLYGLLGKFTFGVLMLRVEE

SEQ ID NO: 980137 - protein, 19 aa, Mycobacterium
VFVYACVVMLVTFLPAVFL

SEQ ID NO: 980138 - protein, 17 aa, Mycobacterium
VFWAAVTAVLAAWGWFA

SEQ ID NO: 980139 - protein, 24 aa, Mycobacterium
VGAEVPLLMTLLQRGRLAEAADTG

SEQ ID NO: 980140 - protein, 23 aa, Mycobacterium
VGAEWLFTPVLLSQNYHLVHHLH

SEQ ID NO: 980141 - protein, 28 aa, Mycobacterium
VGAIAGATWWRVVQYGVWGAVLGATTQL

SEQ ID NO: 980142 - protein, 30 aa, Mycobacterium; identical to SEQ ID NO: 372782

SEQ ID NO: 980143 - protein, 23 aa, Mycobacterium
VGALVRIPYAMAANWFGGSTWTT

SEQ ID NO: 980144 - protein, 28 aa, Mycobacterium
VGASRWYTQLPFLMEAMLAATLGVVIAI

SEQ ID NO: 980145 - protein, 18 aa, Mycobacterium
VGAVPMLLRARRMAETGP

SEQ ID NO: 980146 - protein, 23 aa, Mycobacterium
VGAYLFTPLFNWFNKRLNAGLSA

SEQ ID NO: 980147 - protein, 19 aa, Mycobacterium
VGCMGMVACWTTCPCAPWQ

SEQ ID NO: 980148 - protein, 30 aa, Mycobacterium; identical to SEQ ID NO: 372813

SEQ ID NO: 980149 - protein, 19 aa, Mycobacterium
VGFLALSAPASWGAPEETD

SEQ ID NO: 980150 - protein, 25 aa, Mycobacterium
VGGAIALRILFGLPLPIGGIITGVI

SEQ ID NO: 980151 - protein, 17 aa, Mycobacterium
VGGALAGLGWWLLRRRT

SEQ ID NO: 980152 - protein, 23 aa, Mycobacterium
VGGLAFLYFLVMSTAALGIGLFV

SEQ ID NO: 980153 - protein, 18 aa, Mycobacterium
VGGLWAWVAPAVHAVVAV

SEQ ID NO: 980154 - protein, 17 aa, Mycobacterium
VGGVGIVLMAIWFHFWQ

SEQ ID NO: 980155 - protein, 33 aa, Mycobacterium
VGGVTVLVVALWRFRWIRLAMISALLATQGSGV

SEQ ID NO: 980156 - protein, 30 aa, Mycobacterium
VGHFTLLHLSLRHGQWWLGSAAALSSFTLQ

SEQ ID NO: 980157 - protein, 26 aa, Mycobacterium
VGIRQHVLAALWWAALAGAAIVAIRL

SEQ ID NO: 980158 - protein, 19 aa, Mycobacterium
VGLALLTLDFRMTVLGASA

SEQ ID NO: 980159 - protein, 25 aa, Mycobacterium
VGLASYLLIGFWYHKASAATAAKKA

SEQ ID NO: 980160 - protein, 20 aa, Mycobacterium
VGLFVMFSRMQGGARMGFGF

SEQ ID NO: 980161 - protein, 26 aa, Mycobacterium
VGLGLALLIMPLIGLWAMVATLRAGF

SEQ ID NO: 980162 - protein, 18 aa, Mycobacterium
VGLGLVLIPVVVAKLWSV

SEQ ID NO: 980163 - protein, 21 aa, Mycobacterium
VGLLIWFWPHLGQENLTIPMT

SEQ ID NO: 980164 - protein, 26 aa, Mycobacterium
VGLRRMKLVALGFLVGATIVFLACRW

SEQ ID NO: 980165 - protein, 31 aa, Mycobacterium
VGLTLLAAIITLWLGLVAHFGEMANGGSANV

SEQ ID NO: 980166 - protein, 27 aa, Mycobacterium
VGMALLSPALVLLLYGLSALPARGTIG

SEQ ID NO: 980167 - protein, 25 aa, Mycobacterium
VGNVILMLGIPLALGSYWGLVIVPP

SEQ ID NO: 980168 - protein, 30 aa, Mycobacterium
VGPFKKGPFRIAMAVGIPIVPIVFRNAEIV

SEQ ID NO: 980169 - protein, 26 aa, Mycobacterium
VGPTIAWYQDFLRYYFLTVETNIDGS

SEQ ID NO: 980170 - protein, 35 aa, Mycobacterium
VGPTPWNQPPPKRNPWPIVAGVAALVFVLIVGGIG

SEQ ID NO: 980171 - protein, 19 aa, Mycobacterium
VGQPVVAVGSPLGLAGTVT

SEQ ID NO: 980172 - protein, 27 aa, Mycobacterium
VGRPWASWMMPKMISPIRTAINTPQPA

SEQ ID NO: 980173 - protein, 23 aa, Mycobacterium
VGSFLFNLIIYTALISFSIWYFW

SEQ ID NO: 980174 - protein, 24 aa, Mycobacterium
VGSLRPSLSWLWPSGLDFGTQMAP

SEQ ID NO: 980175 - protein, 26 aa, Mycobacterium
VGTEPDFLRRWLPGQLLQGIGVGATL

SEQ ID NO: 980176 - protein, 23 aa, Mycobacterium
VGTVFVHWLIFESLYRIGSLCPY

SEQ ID NO: 980177 - protein, 27 aa, Mycobacterium
VGVALTFTFLWFVFVGVGDSDPHFPRA

SEQ ID NO: 980178 - protein, 21 aa, Mycobacterium
VGVGWITATLLPATGTGLASE

SEQ ID NO: 980179 - protein, 24 aa, Mycobacterium
VGVVTLVRMLPSALLAPLAATLAT

SEQ ID NO: 980180 - protein, 28 aa, Mycobacterium
VHAPGRWEWSPLYFKEISWVGSNAFGVE

SEQ ID NO: 980181 - protein, 27 aa, Mycobacterium
VHDETAGLWTLLRIPTLIACGDHDLMT

SEQ ID NO: 980182 - protein, 37 aa, Mycobacterium; identical to SEQ ID NO: 373042

SEQ ID NO: 980183 - protein, 18 aa, Mycobacterium
VHPGPMPMAPQPPATLLQ

SEQ ID NO: 980184 - protein, 22 aa, Mycobacterium
VHSIDYIRPQLFTNSFTPLEVT

SEQ ID NO: 980185 - protein, 17 aa, Mycobacterium
VIALPFFGIVSEVIPVF

SEQ ID NO: 980186 - protein, 17 aa, Mycobacterium
VIATLSLLASISPLVRW

SEQ ID NO: 980187 - protein, 26 aa, Mycobacterium
VIAVFGMRLVFPLTIVWVTAGLDPVR

SEQ ID NO: 980188 - protein, 23 aa, Mycobacterium
VIGIFWMGRRLVSSWWALGLGMI

SEQ ID NO: 980189 - protein, 28 aa, Mycobacterium
VIGLGVAIAFLLIRVIRAPIEARLVSEE

SEQ ID NO: 980190 - protein, 22 aa, Mycobacterium
VIGTFVVPPILKVLRERDAMVA

SEQ ID NO: 980191 - protein, 20 aa, Mycobacterium
VIHAFWVPEFLFKRDVMPNP

SEQ ID NO: 980192 - protein, 18 aa, Mycobacterium
VIILALMSALAALYLGGI

SEQ ID NO: 980193 - protein, 25 aa, Mycobacterium
VIITQHLSAPPPLISARRPELAHLD

SEQ ID NO: 980194 - protein, 42 aa, Mycobacterium
VIKQHPAMVLFVLSPALALLAVIWWLAGAGWAIAAALAVLVV

SEQ ID NO: 980195 - protein, 46 aa, Mycobacterium
VILAIIALQLYDFLWYPYYASYGLLLLPFFTPALSALSVLSALAYL

SEQ ID NO: 980196 - protein, 18 aa, Mycobacterium
VILSIFGFDFDTVGRRKA

SEQ ID NO: 980197 - protein, 30 aa, Mycobacterium
VISDRGYTVFLALLPFLIGTLTLTVRGNTG

SEQ ID NO: 980198 - protein, 25 aa, Mycobacterium
VISRLMLAWVLSTAVPLLAIVLAVV

SEQ ID NO: 980199 - protein, 17 aa, Mycobacterium
VITIVLLIAYRSIAAVV

SEQ ID NO: 980200 - protein, 19 aa, Mycobacterium
VIVGLGIRGYLLALRYLAS

SEQ ID NO: 980201 - protein, 30 aa, Mycobacterium
VKVHWSVLVILWLFTWSLATTLPETAKGYG

SEQ ID NO: 980202 - protein, 25 aa, Mycobacterium
VLAAIWLLHYGNRGWFFPLSIRQVP

SEQ ID NO: 980203 - protein, 24 aa, Mycobacterium
VLALRRVWWLYKLIMSGQPASGRT

SEQ ID NO: 980204 - protein, 18 aa, Mycobacterium
VLALSYRLWKLRQGGTAG

SEQ ID NO: 980205 - protein, 18 aa, Mycobacterium
VLAVALAKNPADRYARCI

SEQ ID NO: 980206 - protein, 18 aa, Mycobacterium
VLCARILLRKVTPGSYPR

SEQ ID NO: 980207 - protein, 19 aa, Mycobacterium
VLCSIYWQRPVPTVHVHAE

SEQ ID NO: 980208 - protein, 20 aa, Mycobacterium
VLDPLPRWVRPDVLSSGDLV

SEQ ID NO: 980209 - protein, 18 aa, Mycobacterium
VLDTLAGQLLEKETLHRP

SEQ ID NO: 980210 - protein, 20 aa, Mycobacterium
VLFAVLVLQFRNPAGLAPAS

SEQ ID NO: 980211 - protein, 25 aa, Mycobacterium
VLGAALIEAMWWLRARALGLRPRVW

SEQ ID NO: 980212 - protein, 26 aa, Mycobacterium
VLGPLRDLFAAIFFLGIGLSVAPKEL

SEQ ID NO: 980213 - protein, 20 aa, Mycobacterium
VLGQRLPGYMVPAAVVVVVA

SEQ ID NO: 980214 - protein, 26 aa, Mycobacterium
VLGSAAAVLVIPWPAGAQLLIRFTGP

SEQ ID NO: 980215 - protein, 17 aa, Mycobacterium
VLGVSWQPALLLGAIVS

SEQ ID NO: 980216 - protein, 17 aa, Mycobacterium
VLIAAFLLTVVTDLKRM

SEQ ID NO: 980217 - protein, 27 aa, Mycobacterium
VLIAGVPWPRHKLFAVIAGLVTVVLVG

SEQ ID NO: 980218 - protein, 17 aa, Mycobacterium
VLIIIVMVSWLLLAVFR

SEQ ID NO: 980219 - protein, 27 aa, Mycobacterium
VLKRMPPWWSTRATPITYWPTPWCGCR

SEQ ID NO: 980220 - protein, 25 aa, Mycobacterium
VLKSSYAQFIFLLSGADHDQMDRVR

SEQ ID NO: 980221 - protein, 28 aa, Mycobacterium
VLLAHPGLPLWLYLVCAAFTGLGGGNYS

SEQ ID NO: 980222 - protein, 17 aa, Mycobacterium
VLLAIRPELQQALGNQN

SEQ ID NO: 980223 - protein, 20 aa, Mycobacterium
VLLALASFLTYCLTSLAFSP

SEQ ID NO: 980224 - protein, 27 aa, Mycobacterium
VLLASAILLLLFLQWRTMPAVIWDVQY

SEQ ID NO: 980225 - protein, 27 aa, Mycobacterium
VLLTAGLSLAVAWPLAAALRAIPGQNI

SEQ ID NO: 980226 - protein, 24 aa, Mycobacterium
VLLVGLAIWLLAGKELGIILSKSM

SEQ ID NO: 980227 - protein, 17 aa, Mycobacterium
VLLYASALAGPALAGVM

SEQ ID NO: 980228 - protein, 18 aa, Mycobacterium
VLLYGPPGTGKTLLARAV

SEQ ID NO: 980229 - protein, 23 aa, Mycobacterium
VLMAFAVYVVISAALYSDIDNQL

SEQ ID NO: 980230 - protein, 18 aa, Mycobacterium
VLNFLIGGLAYLLLSRMS

SEQ ID NO: 980231 - protein, 26 aa, Mycobacterium
VLPAKLILMAIAVICAAAVFSAIVLR

SEQ ID NO: 980232 - protein, 17 aa, Mycobacterium
VLPFLIIQGLFGASLLE

SEQ ID NO: 980233 - protein, 17 aa, Mycobacterium
VLPLTLAGGASVSVLAL

SEQ ID NO: 980234 - protein, 18 aa, Mycobacterium
VLPPNKFPYIPPDSDPDP

SEQ ID NO: 980235 - protein, 33 aa, Mycobacterium; identical to SEQ ID NO: 373453

SEQ ID NO: 980236 - protein, 17 aa, Mycobacterium
VLQHRDATRQRERVAEF

SEQ ID NO: 980237 - protein, 20 aa, Mycobacterium
VLRDTGLAMMVWAIAMSAAL

SEQ ID NO: 980238 - protein, 18 aa, Mycobacterium
VLRMPFYRTLISVGSWAI

SEQ ID NO: 980239 - protein, 27 aa, Mycobacterium
VLSDAPLWITFAVMPAYVVIAFALGSY

SEQ ID NO: 980240 - protein, 20 aa, Mycobacterium
VLSVDWFGVVVLAVWGTLAA

SEQ ID NO: 980241 - protein, 30 aa, Mycobacterium; identical to SEQ ID NO: 373497

SEQ ID NO: 980242 - protein, 28 aa, Mycobacterium
VLVAGDQPWRWFLIGFMVIFHLNILSNL

SEQ ID NO: 980243 - protein, 24 aa, Mycobacterium
VLVAWLMFTWMIARLPRQPGRLGT

SEQ ID NO: 980244 - protein, 20 aa, Mycobacterium
VLVFLAFMVALVGSADLGLS

SEQ ID NO: 980245 - protein, 30 aa, Mycobacterium; identical to SEQ ID NO: 21620

SEQ ID NO: 980246 - protein, 17 aa, Mycobacterium
VLVMAANRLLLPPILGW

SEQ ID NO: 980247 - protein, 20 aa, Mycobacterium
VLVVLPPLLALCGRRLFWPF

SEQ ID NO: 980248 - protein, 20 aa, Mycobacterium
VLVYAWLMPASTVVQAVIGG

SEQ ID NO: 980249 - protein, 27 aa, Mycobacterium
VMAANRLLLPPILGWSLGRALCGITVV

SEQ ID NO: 980250 - protein, 18 aa, Mycobacterium
VMAATFWLLSPLEHRRLP

SEQ ID NO: 980251 - protein, 17 aa, Mycobacterium
VMFIGYLAVFAVVLFMH

SEQ ID NO: 980252 - protein, 18 aa, Mycobacterium
VMFPVLVLALVRFNRQYR

SEQ ID NO: 980253 - protein, 25 aa, Mycobacterium
VMGLPSIFVGFSRQRGLAADGRCKA

SEQ ID NO: 980254 - protein, 30 aa, Mycobacterium
VMGVNFFAPMRMTLALLPRMLARGSGTIVN

SEQ ID NO: 980255 - protein, 22 aa, Mycobacterium
VMHHRTVWTVIAILALFGWPQI

SEQ ID NO: 980256 - protein, 19 aa, Mycobacterium
VMLVSPLLAAAALAQTVGC

SEQ ID NO: 980257 - protein, 18 aa, Mycobacterium
VMPLFPAMLMVWGTARTT

SEQ ID NO: 980258 - protein, 38 aa, Mycobacterium; identical to SEQ ID NO: 373612

SEQ ID NO: 980259 - protein, 25 aa, Mycobacterium
VMSGNFSWLNWLTILLACSAIEQSA

SEQ ID NO: 980260 - protein, 26 aa, Mycobacterium
VMTQLGFATLLLGLMVLAAAAGTDRF

SEQ ID NO: 980261 - protein, 17 aa, Mycobacterium
VMVVIGLTLLVGVVVGF

SEQ ID NO: 980262 - protein, 24 aa, Mycobacterium
VNAAPLPWSFTISTTLPSVSANIM

SEQ ID NO: 980263 - protein, 20 aa, Mycobacterium
VNEALAKLQSWLAGDDPGVL

SEQ ID NO: 980264 - protein, 18 aa, Mycobacterium
VNEMDYVRMWVQAAAVMG

SEQ ID NO: 980265 - protein, 19 aa, Mycobacterium
VNFRDVVAALGMYPGAAPP

SEQ ID NO: 980266 - protein, 29 aa, Mycobacterium
VNISRFRTLLLKWGLMTVLALLTSAVYMA

SEQ ID NO: 980267 - protein, 24 aa, Mycobacterium
VNLMLGLFNLLPGAPLDGGRLVRA

SEQ ID NO: 980268 - protein, 35 aa, Mycobacterium; identical to SEQ ID NO: 373664

SEQ ID NO: 980269 - protein, 18 aa, Mycobacterium
VNRTIWGGMLRCGSTRVA

SEQ ID NO: 980270 - protein, 23 aa, Mycobacterium
VPAHFLTGLNWPTAFLVGAILSP

SEQ ID NO: 980271 - protein, 34 aa, Mycobacterium
VPAVVYPFVIVGLLLMVFLPKLTTVVPAPLVAIV

SEQ ID NO: 980272 - protein, 19 aa, Mycobacterium
VPDLRGAMLLGVALGLMTL

SEQ ID NO: 980273 - protein, 20 aa, Mycobacterium
VPDRLLQRWTGVDLTLDVSG

SEQ ID NO: 980274 - protein, 24 aa, Mycobacterium
VPEEPDMALARRAALASANAPLFA

SEQ ID NO: 980275 - protein, 26 aa, Mycobacterium
VPEYGFWAWLAMLFSAGMGIGLVFYG

SEQ ID NO: 980276 - protein, 17 aa, Mycobacterium
VPGIWVPDTPLSHRNTQ

SEQ ID NO: 980277 - protein, 19 aa, Mycobacterium
VPGLPPPPLIFAEREAPTG

SEQ ID NO: 980278 - protein, 20 aa, Mycobacterium
VPHLLGVPAVVYPFVIVGLL

SEQ ID NO: 980279 - protein, 21 aa, Mycobacterium
VPITERITRFSDKFFEEVWDP

SEQ ID NO: 980280 - protein, 28 aa, Mycobacterium
VPLEAVPPFFRWLAKFEPMHQVFLGVRS

SEQ ID NO: 980281 - protein, 23 aa, Mycobacterium
VPLEWNVFMIFGVLALFVGHADL

SEQ ID NO: 980282 - protein, 25 aa, Mycobacterium
VPLEWNVFMIFGVLWLFVAHAHLGL

SEQ ID NO: 980283 - protein, 26 aa, Mycobacterium
VPNAEPPLWRPVAADGQWLPPGAPGS

SEQ ID NO: 980284 - protein, 26 aa, Mycobacterium
VPNIPGAPWWGAVLIAVSTTALGYAF

SEQ ID NO: 980285 - protein, 25 aa, Mycobacterium
VPNTIYSPLFRKFVEWTEYLCLMPI

SEQ ID NO: 980286 - protein, 26 aa, Mycobacterium
VPPDSTIPIELPFTGLADPHGLAFDS

SEQ ID NO: 980287 - protein, 25 aa, Mycobacterium
VPQGPLPILLTVLGAMLAGACLTVA

SEQ ID NO: 980288 - protein, 17 aa, Mycobacterium
VPRLLAAMVIGVALCGV

SEQ ID NO: 980289 - protein, 26 aa, Mycobacterium
VPSIVAALFIFSLWIATLGFQQSALA

SEQ ID NO: 980290 - protein, 30 aa, Mycobacterium
VPSIVAALFLYALWVGVLGFPRSEFAVSLA

SEQ ID NO: 980291 - protein, 32 aa, Mycobacterium
VPSRIAAVHLFLWGLGTLLFTTLYGLIDIRFI

SEQ ID NO: 980292 - protein, 22 aa, Mycobacterium
VPVAPAVLRVWPVPVVMAVMVA

SEQ ID NO: 980293 - protein, 25 aa, Mycobacterium
VPVRPDLPDVLLPQNYQPPKDLAPP

SEQ ID NO: 980294 - protein, 28 aa, Mycobacterium
VQARPDLPEVLLPQNYQPPPNLAPPPGT

SEQ ID NO: 980295 - protein, 17 aa, Mycobacterium
VQLPAVWLLAAVAVGLF

SEQ ID NO: 980296 - protein, 31 aa, Mycobacterium
VQLRVGLVAATLALVLCGLLASGVAVTSILR

SEQ ID NO: 980297 - protein, 17 aa, Mycobacterium
VQTLIKDGKIVHPTLGV

SEQ ID NO: 980298 - protein, 24 aa, Mycobacterium
VQTRPYRVIAGLVLSFCLVTLTGS

SEQ ID NO: 980299 - protein, 22 aa, Mycobacterium
VRARPWLVPLVAAAGAGMAGVP

SEQ ID NO: 980300 - protein, 30 aa, Mycobacterium
VRDRDLVRPFRMPLWPLPPVLAVVGVVVTL

SEQ ID NO: 980301 - protein, 37 aa, Mycobacterium
VRDVLFGGRVSYLALVILVFIALALGAIGGVIGRKTA

SEQ ID NO: 980302 - protein, 23 aa, Mycobacterium
VREGWAFVAMRLTSTVPIVGGLD

SEQ ID NO: 980303 - protein, 21 aa, Mycobacterium
VRGAMKVAWDKFKGATGKLGA

SEQ ID NO: 980304 - protein, 28 aa, Mycobacterium
VRGWRKIGAAIVRWPGPILIGAVALALV

SEQ ID NO: 980305 - protein, 28 aa, Mycobacterium
VRKVFVLQAFLTLFISFPLQLSAVTGPT

SEQ ID NO: 980306 - protein, 18 aa, Mycobacterium
VRLPRLIGHSRAMDMILT

SEQ ID NO: 980307 - protein, 18 aa, Mycobacterium
VRLVDRALPGKLTLRYRR

SEQ ID NO: 980308 - protein, 35 aa, Mycobacterium; identical to SEQ ID NO: 373918

SEQ ID NO: 980309 - protein, 19 aa, Mycobacterium
VRPVLVGMLVVVPARWAGP

SEQ ID NO: 980310 - protein, 19 aa, Mycobacterium
VRPYGYDETARWVPRLWRR

SEQ ID NO: 980311 - protein, 20 aa, Mycobacterium
VRRIGLLMLRGYLVLACVLV

SEQ ID NO: 980312 - protein, 22 aa, Mycobacterium
VRRWRLQYSRRLRITDSAIVFA

SEQ ID NO: 980313 - protein, 20 aa, Mycobacterium
VRSWTLIPGLAAAGLAIGIC

SEQ ID NO: 980314 - protein, 23 aa, Mycobacterium
VRVGDTWHPVLNLASARLIAGTG

SEQ ID NO: 980315 - protein, 26 aa, Mycobacterium
VSDFPFIAWPPALPVAMWLLAVTSVI

SEQ ID NO: 980316 - protein, 25 aa, Mycobacterium
VSFMQGFPNVLSPRSSLLVLGDGRT

SEQ ID NO: 980317 - protein, 27 aa, Mycobacterium
VSGGWFTITVLVILLVIAVVVAINIAR

SEQ ID NO: 980318 - protein, 24 aa, Mycobacterium
VSGPLLLQYPLYGGIIGLLGYLPS

SEQ ID NO: 980319 - protein, 23 aa, Mycobacterium
VSIALIAVFLLIRAIPSLRANHA

SEQ ID NO: 980320 - protein, 20 aa, Mycobacterium
VSIFRLVRYLAREYLLIFAT

SEQ ID NO: 980321 - protein, 25 aa, Mycobacterium
VSIPSLWQPYVLSVASLTAGGQPSK

SEQ ID NO: 980322 - protein, 21 aa, Mycobacterium
VSIVASLLVLLPAAGMTAAAV

SEQ ID NO: 980323 - protein, 23 aa, Mycobacterium
VSLILIIMLIITRSLVAAVVIVG

SEQ ID NO: 980324 - protein, 17 aa, Mycobacterium
VSLVGVLVLLKTVAYWL

SEQ ID NO: 980325 - protein, 24 aa, Mycobacterium
VSLVIAITIVYFLCNLVARPSQAT

SEQ ID NO: 980326 - protein, 22 aa, Mycobacterium
VSTFLLAWELMAISSLVLVATD

SEQ ID NO: 980327 - protein, 18 aa, Mycobacterium
VSTSLVVFVGFRSSRKSA

SEQ ID NO: 980328 - protein, 17 aa, Mycobacterium
VSVFSWNLAAVLTIGTI

SEQ ID NO: 980329 - protein, 18 aa, Mycobacterium
VSVFSWNLAAVLTIGTIT

SEQ ID NO: 980330 - protein, 20 aa, Mycobacterium
VSWRLAFMVNVPIGLVMIYL

SEQ ID NO: 980331 - protein, 17 aa, Mycobacterium
VSYLALLVGLGFGLLAV

SEQ ID NO: 980332 - protein, 24 aa, Mycobacterium
VTAAILVFIFAWNDLLLALSLTAT

SEQ ID NO: 980333 - protein, 32 aa, Mycobacterium; identical to SEQ ID NO: 374148

SEQ ID NO: 980334 - protein, 24 aa, Mycobacterium
VTASRHAHWLNPEPQHLWGSGDSA

SEQ ID NO: 980335 - protein, 36 aa, Mycobacterium; identical to SEQ ID NO: 374166

SEQ ID NO: 980336 - protein, 28 aa, Mycobacterium
VTFAQPYPAWRELFSNILPAHIVKDVPG

SEQ ID NO: 980337 - protein, 21 aa, Mycobacterium
VTFMLVWLMNHHGWPVATAGI

SEQ ID NO: 980338 - protein, 31 aa, Mycobacterium
VTGILTGVLIVGFIWMLRSAPRRVLASALRE

SEQ ID NO: 980339 - protein, 24 aa, Mycobacterium
VTGLAGWLFGWLAERSGSLAAPMV

SEQ ID NO: 980340 - protein, 21 aa, Mycobacterium
VTIFVFILISNWLSVLPVQYT

SEQ ID NO: 980341 - protein, 30 aa, Mycobacterium
VTIIGALVLPILFLVVLNIVLGNLAYVVTY

SEQ ID NO: 980342 - protein, 23 aa, Mycobacterium
VTKVPLPRWYWVGLTIGVLVGTV

SEQ ID NO: 980343 - protein, 23 aa, Mycobacterium
VTLSMLVALAPLIRVLGSVIAKG

SEQ ID NO: 980344 - protein, 28 aa, Mycobacterium
VTPVTRVFLVLRRVRRVRLVLPVALGAL

SEQ ID NO: 980345 - protein, 24 aa, Mycobacterium
VTSLGLAWWLTPSLAVVMVVYLAM

SEQ ID NO: 980346 - protein, 24 aa, Mycobacterium
VTSLLVLMIFPLLTAALFGLAADR

SEQ ID NO: 980347 - protein, 22 aa, Mycobacterium
VTSVLFLLLGVVSTAAILVAAA

SEQ ID NO: 980348 - protein, 23 aa, Mycobacterium
VTTAYLVMCGFIFVATQYLQFVA

SEQ ID NO: 980349 - protein, 27 aa, Mycobacterium
VTTLGVWLGAGYPVSVALTAAVAVLII

SEQ ID NO: 980350 - protein, 24 aa, Mycobacterium
VTTLPLGVPTPRILRVLRGFEPDV

SEQ ID NO: 980351 - protein, 27 aa, Mycobacterium
VTVLVMVYLLTNLLVDLLYAALDPRIR

SEQ ID NO: 980352 - protein, 22 aa, Mycobacterium
VVAGLLVVIPLYCVGVLASFWA

SEQ ID NO: 980353 - protein, 20 aa, Mycobacterium
VVARGRLMQALPAGGAMVAV

SEQ ID NO: 980354 - protein, 31 aa, Mycobacterium
VVAVALVSALLVGTGWIWSLSGDGLSTATRD

SEQ ID NO: 980355 - protein, 27 aa, Mycobacterium
VVAVLVILGLPFFSVKWGFPDDRVLPA

SEQ ID NO: 980356 - protein, 27 aa, Mycobacterium
VVDALDQYLRLPLRQVMWGDDEGLLNS

SEQ ID NO: 980357 - protein, 17 aa, Mycobacterium
VVDLLLVVPSFVLIAIM

SEQ ID NO: 980358 - protein, 23 aa, Mycobacterium
VVDVTAFQWNWKFGYQKVDFHDH

SEQ ID NO: 980359 - protein, 24 aa, Mycobacterium
VVEGVGLWLLKRWGEYFAVVATSV

SEQ ID NO: 980360 - protein, 18 aa, Mycobacterium
VVFLALGAAFAFGLLPGH

SEQ ID NO: 980361 - protein, 17 aa, Mycobacterium
VVFRLISILISVLVAWL

SEQ ID NO: 980362 - protein, 17 aa, Mycobacterium
VVFTIPSLALFVVLPLI

SEQ ID NO: 980363 - protein, 24 aa, Mycobacterium
VVGAKLVFIVIWLGAATSKLNKHF

SEQ ID NO: 980364 - protein, 27 aa, Mycobacterium
VVGALGILVMVVWVGTALTLSTAASRI

SEQ ID NO: 980365 - protein, 18 aa, Mycobacterium
VVGARPPRPAAFHEWHAM

SEQ ID NO: 980366 - protein, 29 aa, Mycobacterium
VVGDPTLLTMLWQNLIGNAVKFRREDLPP

SEQ ID NO: 980367 - protein, 39 aa, Mycobacterium; identical to SEQ ID NO: 374386

SEQ ID NO: 980368 - protein, 26 aa, Mycobacterium
VVHGWVYFAYLLFTANLAVKVRWPIG

SEQ ID NO: 980369 - protein, 23 aa, Mycobacterium
VVIGAMMIAPLMAPIMGIAACLI

SEQ ID NO: 980370 - protein, 25 aa, Mycobacterium
VVIGIFWMGRRLVSSWWALGLGMIL

SEQ ID NO: 980371 - protein, 20 aa, Mycobacterium
VVIINRLNFALVGLQLAFVL

SEQ ID NO: 980372 - protein, 34 aa, Mycobacterium; identical to SEQ ID NO: 374437

SEQ ID NO: 980373 - protein, 24 aa, Mycobacterium
VVKPTRISKLFILASRSVRRETAS

SEQ ID NO: 980374 - protein, 30 aa, Mycobacterium; identical to SEQ ID NO: 374449

SEQ ID NO: 980375 - protein, 28 aa, Mycobacterium
VVLAVLAFIPLAFLPKWSALTALSQTSS

SEQ ID NO: 980376 - protein, 17 aa, Mycobacterium
VVLFPGAGFVELAIRAG

SEQ ID NO: 980377 - protein, 40 aa, Mycobacterium
VVLFYSTFFLFFFLAELLDTWLWRWVAFLIVFGLMVLTTG

SEQ ID NO: 980378 - protein, 22 aa, Mycobacterium
VVLRPYWTPVVAYTAAILIVAA

SEQ ID NO: 980379 - protein, 30 aa, Mycobacterium; identical to SEQ ID NO: 374494

SEQ ID NO: 980380 - protein, 29 aa, Mycobacterium
VVLTAPFLILLIVLEWIAARKLLTTSAPA

SEQ ID NO: 980381 - protein, 25 aa, Mycobacterium
VVLTVVFIFGLIEYAKRDWLVENGH

SEQ ID NO: 980382 - protein, 19 aa, Mycobacterium
VVLVLVAVVLFGVASLLFG

SEQ ID NO: 980383 - protein, 27 aa, Mycobacterium
VVLVVGAFVYGWFRPAGTIDASSKIVT

SEQ ID NO: 980384 - protein, 17 aa, Mycobacterium
VVLVVLLGMAVLALSYR

SEQ ID NO: 980385 - protein, 19 aa, Mycobacterium
VVPTVALAVPWLTELQRLF

SEQ ID NO: 980386 - protein, 24 aa, Mycobacterium
VVRAIGTVLLVPLIGALFSSTPQQ

SEQ ID NO: 980387 - protein, 29 aa, Mycobacterium
VVRRLPGWPIWFAVLWGAQEWLKSIVPFG

SEQ ID NO: 980388 - protein, 29 aa, Mycobacterium
VVSALTLIFLIMLLLTRSVVAALVIVGTA

SEQ ID NO: 980389 - protein, 20 aa, Mycobacterium
VVTFILALILKYTIGLRLGP

SEQ ID NO: 980390 - protein, 21 aa, Mycobacterium
VVVAIPLFCVGLITAYLAARA

SEQ ID NO: 980391 - protein, 29 aa, Mycobacterium
VVVMVIWWLFFAGLVWVVVLWWAGGVWVV

SEQ ID NO: 980392 - protein, 17 aa, Mycobacterium
VVVPVMLSRLLDAVEKI

SEQ ID NO: 980393 - protein, 32 aa, Mycobacterium; identical to SEQ ID NO: 380361

SEQ ID NO: 980394 - protein, 18 aa, Mycobacterium
VVVRWPGPVLAATIAIAL

SEQ ID NO: 980395 - protein, 27 aa, Mycobacterium
VVVVVVGVIGWRFFGDVLSNRSQTAAA

SEQ ID NO: 980396 - protein, 24 aa, Mycobacterium
VVYIFSLVGYHWLASTPGPLPKPD

SEQ ID NO: 980397 - protein, 28 aa, Mycobacterium
VVYTGAVMMLFLFVLMLIGVDSAESLKE

SEQ ID NO: 980398 - protein, 21 aa, Mycobacterium
VWARFPLPVIPAPGDPTPSAP

SEQ ID NO: 980399 - protein, 30 aa, Mycobacterium
VWEDILGIELYWMVLAMSVILLLAVGSDYN

SEQ ID NO: 980400 - protein, 18 aa, Mycobacterium
VWQHILGLDLNWIAPVFG

SEQ ID NO: 980401 - protein, 18 aa, Mycobacterium
VWSRLPAMVRMVPGPLVA

SEQ ID NO: 980402 - protein, 22 aa, Mycobacterium
VWTQLAYGKQWTWALLGVAVVA

SEQ ID NO: 980403 - protein, 18 aa, Mycobacterium
VWVRVWPAVTAGPGVLGV

SEQ ID NO: 980404 - protein, 19 aa, Mycobacterium
VWYGFGWESLLLETGFLVV

SEQ ID NO: 980405 - protein, 29 aa, Mycobacterium
VYDEPGAAPRWPWVVGVAAILAAISLVVS

SEQ ID NO: 980406 - protein, 26 aa, Mycobacterium
VYDRFAARGYGYGPAFRGLRSVWRRG

SEQ ID NO: 980407 - protein, 17 aa, Mycobacterium
VYGMLLLTTQFLHNVRG

SEQ ID NO: 980408 - protein, 18 aa, Mycobacterium
VYVIDYRDRVLKLPAQSN

SEQ ID NO: 980409 - protein, 29 aa, Mycobacterium
VYYPVSWIMWVWYKLFALVLGPSNFFAWA

SEQ ID NO: 980410 - protein, 26 aa, Mycobacterium
WAAIGFLYLLWLTRGLTRQPPDLAGA

SEQ ID NO: 980411 - protein, 21 aa, Mycobacterium
WADGRTLLLGSPSLLCAEKVK

SEQ ID NO: 980412 - protein, 18 aa, Mycobacterium
WADRVGRRVPLMVDVALY

SEQ ID NO: 980413 - protein, 25 aa, Mycobacterium
WAETTVIIRFWLLTAITCGLGVALF

SEQ ID NO: 980414 - protein, 29 aa, Mycobacterium
WAGFSVGWLYWYFWVIVVGFEAVAGAKVL

SEQ ID NO: 980415 - protein, 30 aa, Mycobacterium; identical to SEQ ID NO: 374754

SEQ ID NO: 980416 - protein, 26 aa, Mycobacterium
WAHYAGWWAFDIGMLVTFGVVAAGLA

SEQ ID NO: 980417 - protein, 19 aa, Mycobacterium
WALFMVTVTYVWKNLGYTC

SEQ ID NO: 980418 - protein, 19 aa, Mycobacterium
WALYVVGPPLEMWLGRLRF

SEQ ID NO: 980419 - protein, 23 aa, Mycobacterium
WATPARWGFATSASTVDLIKLVP

SEQ ID NO: 980420 - protein, 24 aa, Mycobacterium
WDIRNRGVIPPGALPRIRAFVDGS

SEQ ID NO: 980421 - protein, 27 aa, Mycobacterium
WELARPPIWMLVVFLVTAVGAHGLKTL

SEQ ID NO: 980422 - protein, 17 aa, Mycobacterium
WERLAVYWQLASDHGLA

SEQ ID NO: 980423 - protein, 17 aa, Mycobacterium
WGEFGMLPSFNARRHPH

SEQ ID NO: 980424 - protein, 24 aa, Mycobacterium
WGFDQIAWFVPAHWGFAATASTVN

SEQ ID NO: 980425 - protein, 26 aa, Mycobacterium
WGIALLYLCCSGSFLGFAFAFGEVLG

SEQ ID NO: 980426 - protein, 18 aa, Mycobacterium
WGLAVFAVSTWIALPVSA

SEQ ID NO: 980427 - protein, 20 aa, Mycobacterium
WGRKPIFLVAFAVLTACGFL

SEQ ID NO: 980428 - protein, 21 aa, Mycobacterium
WGWRNTPVLRWFVLGAGVGVA

SEQ ID NO: 980429 - protein, 26 aa, Mycobacterium
WHEAHPYLPFVFTGSAAASGGGLGML

SEQ ID NO: 980430 - protein, 22 aa, Mycobacterium
WHKVENVMLVSGFLAAAALGQA

SEQ ID NO: 980431 - protein, 19 aa, Mycobacterium
WILRRLFDRRQCAPRYSWL

SEQ ID NO: 980432 - protein, 24 aa, Mycobacterium
WIPGVPLLWDLIVTLTASWQKIFS

SEQ ID NO: 980433 - protein, 21 aa, Mycobacterium
WIVHAFPVLPIASAVLALHPQ

SEQ ID NO: 980434 - protein, 19 aa, Mycobacterium
WKLGRRLLGRPEPPPRPVA

SEQ ID NO: 980435 - protein, 26 aa, Mycobacterium
WKQSMTVLLMLYPTIMCISYLMTYLQ

SEQ ID NO: 980436 - protein, 20 aa, Mycobacterium
WKVFTSVIFPSLMPALLSGA

SEQ ID NO: 980437 - protein, 19 aa, Mycobacterium
WLAAVNLMLGLFNLLPGAP

SEQ ID NO: 980438 - protein, 18 aa, Mycobacterium
WLAYLLFGALVLVIFRMT

SEQ ID NO: 980439 - protein, 30 aa, Mycobacterium; identical to SEQ ID NO: 374956

SEQ ID NO: 980440 - protein, 19 aa, Mycobacterium
WLDIAVLAVAFIAAVSGWR

SEQ ID NO: 980441 - protein, 22 aa, Mycobacterium
WLENLWILNVIVFVAGLTYFWL

SEQ ID NO: 980442 - protein, 20 aa, Mycobacterium
WLGMLRRDLIPTGYALALIP

SEQ ID NO: 980443 - protein, 18 aa, Mycobacterium
WLGWLAADIVGVLVFCAV

SEQ ID NO: 980444 - protein, 17 aa, Mycobacterium
WLHGNNLGIGYWGKEEE

SEQ ID NO: 980445 - protein, 19 aa, Mycobacterium
WLMQRENVPLSPDPGPPLT

SEQ ID NO: 980446 - protein, 20 aa, Mycobacterium
WLMQRENVPLSPDPGPPLTL

SEQ ID NO: 980447 - protein, 20 aa, Mycobacterium
WLQTELAAARRDPAVDWVIV

SEQ ID NO: 980448 - protein, 18 aa, Mycobacterium
WLVARGWRRPTSVAPTGV

SEQ ID NO: 980449 - protein, 18 aa, Mycobacterium
WLVLIHTVSLFPDGARLW

SEQ ID NO: 980450 - protein, 18 aa, Mycobacterium
WMSLLWAVVFALSIVVRR

SEQ ID NO: 980451 - protein, 30 aa, Mycobacterium
WPKLGAPWYAFWRLLPKIPPWLGLADNAVG

SEQ ID NO: 980452 - protein, 24 aa, Mycobacterium
WPNYRTMRRLLRRDPPAAARWQRF

SEQ ID NO: 980453 - protein, 17 aa, Mycobacterium
WPPGRPTTWLQVSAYRF

SEQ ID NO: 980454 - protein, 33 aa, Mycobacterium
WQGYAAHQWLAAHGPYLIWLEQAAIDSSVTAAQ

SEQ ID NO: 980455 - protein, 17 aa, Mycobacterium
WQTGRSVFWPLAIGLIG

SEQ ID NO: 980456 - protein, 17 aa, Mycobacterium
WQVLPFLIIQGLFGASL

SEQ ID NO: 980457 - protein, 19 aa, Mycobacterium
WRRIGTIVVRWPGPVLVAA

SEQ ID NO: 980458 - protein, 19 aa, Mycobacterium
WSALPVLGSVSLIGRMLRA

SEQ ID NO: 980459 - protein, 30 aa, Mycobacterium
WSFRAMIGFLAIPVLFALLALWLTRGGRIP

SEQ ID NO: 980460 - protein, 25 aa, Mycobacterium
WSKGMLPGVFPVPLAITGNVADWPF

SEQ ID NO: 980461 - protein, 24 aa, Mycobacterium
WSQYQAQVLFTMQVTPATGGPPNG

SEQ ID NO: 980462 - protein, 26 aa, Mycobacterium
WSSFEVVVLALMIMLVCTYYGYNAHG

SEQ ID NO: 980463 - protein, 26 aa, Mycobacterium
WSSPFWQTWDLLLLWLAQLHGGNGLR

SEQ ID NO: 980464 - protein, 28 aa, Mycobacterium
WSWIVGMLVWVWQGILEVAYLGVTVAFL

SEQ ID NO: 980465 - protein, 23 aa, Mycobacterium
WTHHWVWLVPLMIWVLSGPLRDR

SEQ ID NO: 980466 - protein, 26 aa, Mycobacterium
WTPARQRFVWLTLLLAVITLIATPIT

SEQ ID NO: 980467 - protein, 22 aa, Mycobacterium
WVDHIRRPVRFADSVASLEAMG

SEQ ID NO: 980468 - protein, 24 aa, Mycobacterium
WVGPMLVYILLPRLDLGFGPDGQN

SEQ ID NO: 980469 - protein, 26 aa, Mycobacterium
WVHQHGIWPWVVVLTLLVAGAFSVSW

SEQ ID NO: 980470 - protein, 17 aa, Mycobacterium
WVKWYPGVPAYLDQQWV

SEQ ID NO: 980471 - protein, 19 aa, Mycobacterium
WVMISRMIGLLLHKGCYGR

SEQ ID NO: 980472 - protein, 26 aa, Mycobacterium
WVQAQGGAPLWVGYLGAAAEAGMVGA

SEQ ID NO: 980473 - protein, 23 aa, Mycobacterium
WVSIPIATVMLLALALTGSYRRV

SEQ ID NO: 980474 - protein, 31 aa, Mycobacterium
WVTNRFLLDQLSWLTPARWGFAASASTIDTH

SEQ ID NO: 980475 - protein, 24 aa, Mycobacterium
WVTTAVLLVVLIISALNPAAAVVL

SEQ ID NO: 980476 - protein, 17 aa, Mycobacterium
WYYAWTPGTGYLANLLP

SEQ ID NO: 980477 - protein, 19 aa, Mycobacterium
YAGIMFIGLSLAALTLATS

SEQ ID NO: 980478 - protein, 25 aa, Mycobacterium
YATVSGLRLLLVPPLVVIAYEMFAN

SEQ ID NO: 980479 - protein, 21 aa, Mycobacterium
YAVCGVFVFLILRALGELVLH

SEQ ID NO: 980480 - protein, 17 aa, Mycobacterium
YAVMTQLGFATLLLGLM

SEQ ID NO: 980481 - protein, 20 aa, Mycobacterium
YAYEYFIRNNPLRDYAVPIK

SEQ ID NO: 980482 - protein, 23 aa, Mycobacterium
YDHYFRTFLNPTDLVWSFVQCIA

SEQ ID NO: 980483 - protein, 26 aa, Mycobacterium
YDNVAIPLVVILFAGFVVAVMAAAVV

SEQ ID NO: 980484 - protein, 29 aa, Mycobacterium
YFGLPTWLILFLRLLFTAIAIASLWLLYR

SEQ ID NO: 980485 - protein, 21 aa, Mycobacterium
YFMGWSYWFAWIVAGIADLVA

SEQ ID NO: 980486 - protein, 27 aa, Mycobacterium
YFQTLGIPCSVGMLVALLVALTLAPAV

SEQ ID NO: 980487 - protein, 18 aa, Mycobacterium
YFTTRLLERLPLSSYRRP

SEQ ID NO: 980488 - protein, 24 aa, Mycobacterium
YGICGLFVFLILRALGELVLHRPS

SEQ ID NO: 980489 - protein, 29 aa, Mycobacterium
YGKGAFLSQLFAAILRPLGQPANEIIETT

SEQ ID NO: 980490 - protein, 25 aa, Mycobacterium
YGQNVPYPGFGTLAGFLASTSVIVV

SEQ ID NO: 980491 - protein, 23 aa, Mycobacterium
YGRRGWLSAGLILFALTSALAAQ

SEQ ID NO: 980492 - protein, 23 aa, Mycobacterium
YGRRGWLTIGLVIVGASSAVAAS

SEQ ID NO: 980493 - protein, 29 aa, Mycobacterium
YGRRTTALTWALERRAWQLTRRTRRWDPD

SEQ ID NO: 980494 - protein, 24 aa, Mycobacterium
YGTGPGWPTGPYSPGPPPKGPGSK

SEQ ID NO: 980495 - protein, 21 aa, Mycobacterium
YHPSLEQLLVLFPQGTAVTQA

SEQ ID NO: 980496 - protein, 24 aa, Mycobacterium
YILAFSLFIYGLMGLTEPKTAVRG

SEQ ID NO: 980497 - protein, 17 aa, Mycobacterium
YIPWSMTVTPISQSDVG

SEQ ID NO: 980498 - protein, 26 aa, Mycobacterium
YIRPYRRLVAALMALQLISTLASLYL

SEQ ID NO: 980499 - protein, 18 aa, Mycobacterium
YIVGFIALFIVCGAGKGA

SEQ ID NO: 980500 - protein, 17 aa, Mycobacterium
YIYIPFQYLSVVLGAYL

SEQ ID NO: 980501 - protein, 23 aa, Mycobacterium
YKRLSRIVFVPDIPRLPSGKVLR

SEQ ID NO: 980502 - protein, 20 aa, Mycobacterium
YLALPLLAFLARRVPVGARV

SEQ ID NO: 980503 - protein, 27 aa, Mycobacterium
YLAQHPRLPRLDALKILSLDATDDDEF

SEQ ID NO: 980504 - protein, 26 aa, Mycobacterium
YLGAFTLRRIALPASGLYPIATFGLG

SEQ ID NO: 980505 - protein, 17 aa, Mycobacterium
YLGGWRIIRTLGKGLVE

SEQ ID NO: 980506 - protein, 18 aa, Mycobacterium
YLINRRWTFQAAPCGARF

SEQ ID NO: 980507 - protein, 17 aa, Mycobacterium
YLLRAIALTYVFALLVV

SEQ ID NO: 980508 - protein, 17 aa, Mycobacterium
YLLRRALCPGGGQLVGT

SEQ ID NO: 980509 - protein, 19 aa, Mycobacterium
YLVCAVYLVLLAIAGLGAA

SEQ ID NO: 980510 - protein, 24 aa, Mycobacterium
YMANYYRWFATPEAPFGWYYDLLA

SEQ ID NO: 980511 - protein, 18 aa, Mycobacterium
YMMWTEGLARIWPPWEFY

SEQ ID NO: 980512 - protein, 18 aa, Mycobacterium
YMRYPVFLAFDIVGGISW

SEQ ID NO: 980513 - protein, 18 aa, Mycobacterium
YMSALDVALLASSTGRDV

SEQ ID NO: 980514 - protein, 19 aa, Mycobacterium
YMTRVMLMTFFGEKRWAPG

SEQ ID NO: 980515 - protein, 33 aa, Mycobacterium
YNMPLELVLTVTPFLIISVLFYFTVVVQERMLH

SEQ ID NO: 980516 - protein, 24 aa, Mycobacterium
YNNVPGLGLLWRPFRARNGRDFMW

SEQ ID NO: 980517 - protein, 18 aa, Mycobacterium
YNVYFKRGPNDPPEVEVD

SEQ ID NO: 980518 - protein, 26 aa, Mycobacterium
YPEVPKRQWGLPLAATAAAVLMAAAI

SEQ ID NO: 980519 - protein, 27 aa, Mycobacterium
YPGMAAPPVRLLPIDLAPDAVGNLYRG

SEQ ID NO: 980520 - protein, 26 aa, Mycobacterium
YPPNDPALRQPVIYPRGTLAMANAGP

SEQ ID NO: 980521 - protein, 25 aa, Mycobacterium
YPTLSHNFYLWWLAKAGAVGMAVFA

SEQ ID NO: 980522 - protein, 18 aa, Mycobacterium
YRLAMGAPLLAAFLFGCF

SEQ ID NO: 980523 - protein, 24 aa, Mycobacterium
YRPNWSELPIARPAGRRPSTNWVG

SEQ ID NO: 980524 - protein, 24 aa, Mycobacterium
YRRRLLRVTRWDVGLAMIVAGGVN

SEQ ID NO: 980525 - protein, 23 aa, Mycobacterium
YRTTIFAFPVFGFGVIFGAIWAE

SEQ ID NO: 980526 - protein, 27 aa, Mycobacterium
YRTVVLARLRLFGIGIPAAIGLLAGIV

SEQ ID NO: 980527 - protein, 33 aa, Mycobacterium
YRVALPVAVYSWAFGPGLWNAWQQPTAEAIRSA

SEQ ID NO: 980528 - protein, 23 aa, Mycobacterium
YSAGILTYELLTGATPFTGDTAL

SEQ ID NO: 980529 - protein, 28 aa, Mycobacterium
YSGDDALNLPWLAMGAIGFISVIGHLAA

SEQ ID NO: 980530 - protein, 19 aa, Mycobacterium
YSGFRRPGLDLSGRPSGRA

SEQ ID NO: 980531 - protein, 28 aa, Mycobacterium
YSIGAFFVLYGLLVFGLAAIPNLRRAGI

SEQ ID NO: 980532 - protein, 25 aa, Mycobacterium
YSNATWRLWSLPWQAKSPGTHTITV

SEQ ID NO: 980533 - protein, 26 aa, Mycobacterium
YSQPTNWWPPHWYPQNYWTATRQIPF

SEQ ID NO: 980534 - protein, 23 aa, Mycobacterium
YSRNLVLLIGVLGGLVCIGFVAL

SEQ ID NO: 980535 - protein, 21 aa, Mycobacterium
YSSIFFATPLLVTLRERTELV

SEQ ID NO: 980536 - protein, 18 aa, Mycobacterium
YTFIRGREWIRLPAIFGA

SEQ ID NO: 980537 - protein, 23 aa, Mycobacterium
YTLPSMSLLLTGDPPKKCSAANN

SEQ ID NO: 980538 - protein, 24 aa, Mycobacterium
YTLPSMSLLLTGDPPKKCSAANNH

SEQ ID NO: 980539 - protein, 20 aa, Mycobacterium
YVAPWHLSPGRWYTWVIAIV

SEQ ID NO: 980540 - protein, 33 aa, Mycobacterium; identical to SEQ ID NO: 375775

SEQ ID NO: 980541 - protein, 26 aa, Mycobacterium
YVGSVVLLILIYLGFVAGSGAHRGLL

SEQ ID NO: 980542 - protein, 26 aa, Mycobacterium
YVIYQGLTMYLLLAIGWHGGEELAKI

SEQ ID NO: 980543 - protein, 17 aa, Mycobacterium
YVKTYRPDQQVDPAVAR

SEQ ID NO: 980544 - protein, 17 aa, Mycobacterium
YVLHRAWVGPMVLLVLD

SEQ ID NO: 980545 - protein, 19 aa, Mycobacterium
YVLITFWQDHNACVTAPGL

SEQ ID NO: 980546 - protein, 19 aa, Mycobacterium
YVLLIINRDILLNSVLAGI

SEQ ID NO: 980547 - protein, 25 aa, Mycobacterium
YVLSFQVYLALPIQASLLAPGHQSV

SEQ ID NO: 980548 - protein, 23 aa, Mycobacterium
YVNKLLHNVFGFQLPQALSEAPW

SEQ ID NO: 980549 - protein, 33 aa, Mycobacterium
YVQSLGLFGIRNGWWVYLTIYALFIGIHLSGVG

SEQ ID NO: 980550 - protein, 20 aa, Mycobacterium
YVVICSVGIAVAFLGTVLLY

SEQ ID NO: 980551 - protein, 17 aa, Mycobacterium
YVVTFVAMLFTAASYAV

SEQ ID NO: 980552 - protein, 19 aa, Mycobacterium
YYLAAFVVGSAVAWGIVTV

SEQ ID NO: 980553 - protein, 20 aa, Mycobacterium
YYLVIWVTSAYLLTYAAPLL

SEQ ID NO: 980554 - protein, 20 aa, Mycobacterium
YYRYCTYIYIPFQYLSVVLG

SEQ ID NO: 980555 - protein, 18 aa, Mycobacterium
PCVRALLTLLPGSLRWLV

SEQ ID NO: 980556 - protein, 20 aa, Mycobacterium
RALLTLLPGSLRWLVTVDAM

SEQ ID NO: 980557 - protein, 25 aa, Mycobacterium
DHNHLPLTPVPWPPPGTAAIEVDDF

SEQ ID NO: 980558 - protein, 21 aa, Mycobacterium
YGIHPALFDAALHPLLALTQP

SEQ ID NO: 980559 - protein, 20 aa, Mycobacterium
GKILFDLWMANLPILLCAQA

SEQ ID NO: 980560 - protein, 17 aa, Mycobacterium
LLTLLPGSLRWLVTVDA

SEQ ID NO: 980561 - protein, 23 aa, Mycobacterium
PCVRALLTLLPGSLRWLVTVDAM

SEQ ID NO: 980562 - protein, 24 aa, Mycobacterium
SVMVSLAALWRWAGITPDAVIGHS

SEQ ID NO: 980563 - protein, 18 aa, Mycobacterium
ALLTLLPGSLRWLVTVDA

SEQ ID NO: 980564 - protein, 23 aa, Mycobacterium
SLCLIFIIMLIITRAFVAAAVIV

SEQ ID NO: 980565 - protein, 23 aa, Mycobacterium
LAIKPDICFLWDEAWYAFATAVP

SEQ ID NO: 980566 - protein, 17 aa, Mycobacterium
MTIPARWSFPQAASIPV

SEQ ID NO: 980567 - protein, 19 aa, Mycobacterium
AAGMFLAVWLPLDNGLRPE

SEQ ID NO: 980568 - protein, 25 aa, Mycobacterium
ADPYKYFLRFFQRLGFRPAIAVVLA

SEQ ID NO: 980569 - protein, 18 aa, Mycobacterium
AFDQLWRWNSIVALVLSV

SEQ ID NO: 980570 - protein, 19 aa, Mycobacterium
AFQFLLYIVVLDLPTHIVQ

SEQ ID NO: 980571 - protein, 20 aa, Mycobacterium
AGMITLWLGLMADVSQVIDG

SEQ ID NO: 980572 - protein, 17 aa, Mycobacterium
AILLIAIFLLLRAVPSL

SEQ ID NO: 980573 - protein, 22 aa, Mycobacterium
AKLYPLLFLVPLFVLGVRTGRL

SEQ ID NO: 980574 - protein, 18 aa, Mycobacterium
ALCILVMVMWVGTALTIS

SEQ ID NO: 980575 - protein, 19 aa, Mycobacterium
ALLTLLPGSLRWLVTVDAM

SEQ ID NO: 980576 - protein, 24 aa, Mycobacterium
ALQLYDFLWYPYYASYGMLLLPFF

SEQ ID NO: 980577 - protein, 17 aa, Mycobacterium
ATTLVVFQATLLRGCPW

SEQ ID NO: 980578 - protein, 17 aa, Mycobacterium
AVFAGWLWPLWDSRRRT

SEQ ID NO: 980579 - protein, 21 aa, Mycobacterium
AVLRRLLRWVLGPTDPVLAST

SEQ ID NO: 980580 - protein, 29 aa, Mycobacterium
AVMPALMAYPWWFTRSYWLLGIVALVVVV

SEQ ID NO: 980581 - protein, 24 aa, Mycobacterium
AVMTKLRWVLLIVGSLGVAVAAVA

SEQ ID NO: 980582 - protein, 18 aa, Mycobacterium
AWLALLALPLLLTAHRLP

SEQ ID NO: 980583 - protein, 17 aa, Mycobacterium
DARAGFGLLLKEAGYTL

SEQ ID NO: 980584 - protein, 24 aa, Mycobacterium
DHGLWVAFWFFLAQLNLILGAINL

SEQ ID NO: 980585 - protein, 19 aa, Mycobacterium
DIGLFYRYAWQNPSFSNIV

SEQ ID NO: 980586 - protein, 17 aa, Mycobacterium
DMDLFLRIAPELYLKRL

SEQ ID NO: 980587 - protein, 24 aa, Mycobacterium
DNARYLLIRLAVAAALFVPLAHLS

SEQ ID NO: 980588 - protein, 22 aa, Mycobacterium
DRGLWTPWNTYVSPGLPATAIC

SEQ ID NO: 980589 - protein, 21 aa, Mycobacterium
EAVPPFFRWLSEFEPLHQLFL

SEQ ID NO: 980590 - protein, 24 aa, Mycobacterium
EEQYYLVWPLLLIAVTLLLAARAR

SEQ ID NO: 980591 - protein, 24 aa, Mycobacterium
EHSIGWLAISLLGAILVPCRRRYW

SEQ ID NO: 980592 - protein, 18 aa, Mycobacterium
FAIPIVIGMILLVIPLGN

SEQ ID NO: 980593 - protein, 20 aa, Mycobacterium
FEPYRLWQPPLTQPVAIDDL

SEQ ID NO: 980594 - protein, 22 aa, Mycobacterium
FGEYLPMPWLFKRLSKYADRVS

SEQ ID NO: 980595 - protein, 29 aa, Mycobacterium
FGGRVSYLALVILVFIALALGAIGGVIGR

SEQ ID NO: 980596 - protein, 17 aa, Mycobacterium
FGLLLKEAGYTLAAPAD

SEQ ID NO: 980597 - protein, 19 aa, Mycobacterium
FLYELIWNVLVFFALIYVD

SEQ ID NO: 980598 - protein, 26 aa, Mycobacterium
FNANSLIFPYLSLTPCILCVLFSYPI

SEQ ID NO: 980599 - protein, 26 aa, Mycobacterium
FPVVQPWYLLWAIIPLAAWATRTGFR

SEQ ID NO: 980600 - protein, 19 aa, Mycobacterium
FTGYPFLRGALRFGKTGTD

SEQ ID NO: 980601 - protein, 18 aa, Mycobacterium
FTIESRALTFQPKKIRQQ

SEQ ID NO: 980602 - protein, 19 aa, Mycobacterium
GAAFLIAALLLATYTSSRI

SEQ ID NO: 980603 - protein, 21 aa, Mycobacterium
GACIGFLWWNAAPAKIFMGDT

SEQ ID NO: 980604 - protein, 23 aa, Mycobacterium
GASLWWMIGLLVAAGVLGLMVVL

SEQ ID NO: 980605 - protein, 22 aa, Mycobacterium
GAYPMYLDAYPLPQFAIYGAVS

SEQ ID NO: 980606 - protein, 18 aa, Mycobacterium
GCHTMSIDWVAWRGLGFA

SEQ ID NO: 980607 - protein, 20 aa, Mycobacterium
GILPIHLWQARLAPQAKPYR

SEQ ID NO: 980608 - protein, 18 aa, Mycobacterium
GLALLRRASLRQAVADGV

SEQ ID NO: 980609 - protein, 20 aa, Mycobacterium
GLFGVLRWTAVGLVATLVAS

SEQ ID NO: 980610 - protein, 25 aa, Mycobacterium
GLTLPPPHEPKSPHWFLWVVAGASV

SEQ ID NO: 980611 - protein, 20 aa, Mycobacterium
GMNFRFMPELNWTWSYPLVM

SEQ ID NO: 980612 - protein, 29 aa, Mycobacterium
GSILGELLVYVLPLLLLVGLFVMFSRMQG

SEQ ID NO: 980613 - protein, 29 aa, Mycobacterium
GSPGWITQRLWWALLLTAGFWGLLRVAET

SEQ ID NO: 980614 - protein, 17 aa, Mycobacterium
GVLYFYFVLPRWPELIG

SEQ ID NO: 980615 - protein, 17 aa, Mycobacterium
HPRWAWWLTSVPVLREF

SEQ ID NO: 980616 - protein, 22 aa, Mycobacterium
HTTWVLYGIIVVSVLIIAGAVP

SEQ ID NO: 980617 - protein, 19 aa, Mycobacterium
IELVIAVLLLTILMIIYRN

SEQ ID NO: 980618 - protein, 33 aa, Mycobacterium
IGPLEFSGFIAWLMWLVLHLMYLIGFKTKITTL

SEQ ID NO: 980619 - protein, 18 aa, Mycobacterium
ILFCAVPAAYWLFHGSKI

SEQ ID NO: 980620 - protein, 21 aa, Mycobacterium
IMHGIWILLFTIPFAGLVDQI

SEQ ID NO: 980621 - protein, 22 aa, Mycobacterium
ITLTLLVLLVLAGVAIGRWVIR

SEQ ID NO: 980622 - protein, 22 aa, Mycobacterium
IVAALFIFCLWIATLGFQQSAF

SEQ ID NO: 980623 - protein, 18 aa, Mycobacterium
IVTMIVVLLILMALLRSI

SEQ ID NO: 980624 - protein, 24 aa, Mycobacterium
IYNYTWLVLMLPFGIIGVTVLTVV

SEQ ID NO: 980625 - protein, 17 aa, Mycobacterium
IYTLLFVSLVGCLTPRM

SEQ ID NO: 980626 - protein, 22 aa, Mycobacterium
KFGVTPLLLWQFATQHFTNISV

SEQ ID NO: 980627 - protein, 22 aa, Mycobacterium
KSTGHWWWLVAAVAVLLVIVMF

SEQ ID NO: 980628 - protein, 17 aa, Mycobacterium
KVFTAIVPMLLVLALVL

SEQ ID NO: 980629 - protein, 17 aa, Mycobacterium
LAFALFITGLMGLTGPR

SEQ ID NO: 980630 - protein, 19 aa, Mycobacterium
LAFYLPLLSWISSLVGATP

SEQ ID NO: 980631 - protein, 23 aa, Mycobacterium
LAGCLPAVIWWACHRPNRLWWRY

SEQ ID NO: 980632 - protein, 26 aa, Mycobacterium
LALSLYLVYTLLTWAQARLLNVTVQR

SEQ ID NO: 980633 - protein, 17 aa, Mycobacterium
LFFSRWWQLETLYRSNI

SEQ ID NO: 980634 - protein, 17 aa, Mycobacterium
LIALFVFFTAAAGAKFY

SEQ ID NO: 980635 - protein, 18 aa, Mycobacterium
LITLIPTVAFMTAGGSAM

SEQ ID NO: 980636 - protein, 25 aa, Mycobacterium
LIVVLFVPAALPWYYSWPLAVAAPL

SEQ ID NO: 980637 - protein, 18 aa, Mycobacterium
LKLPAVPIPWSILSLFAV

SEQ ID NO: 980638 - protein, 27 aa, Mycobacterium
LLALCLATLWWVVALVLLHGVSPPFLD

SEQ ID NO: 980639 - protein, 17 aa, Mycobacterium
LLIFTLNVLLAQFSAAD

SEQ ID NO: 980640 - protein, 21 aa, Mycobacterium
LLIGLVRWFFQLMYRTTASSN

SEQ ID NO: 980641 - protein, 24 aa, Mycobacterium
LLKLAVILALWAAVAGAFVSVFYR

SEQ ID NO: 980642 - protein, 24 aa, Mycobacterium
LLPNGTFFFVLAIFLVVLGVIGTF

SEQ ID NO: 980643 - protein, 17 aa, Mycobacterium
LLSRIWIPLVILVVLVV

SEQ ID NO: 980644 - protein, 19 aa, Mycobacterium
LLVWWRWHHGFWLSVIYAT

SEQ ID NO: 980645 - protein, 17 aa, Mycobacterium
LMLKLKNGPQAVADAAH

SEQ ID NO: 980646 - protein, 22 aa, Mycobacterium
LMLVFVALIAFVMLLISIRSVF

SEQ ID NO: 980647 - protein, 22 aa, Mycobacterium
LPQWQITLYWRTKGQPLWTNDA

SEQ ID NO: 980648 - protein, 26 aa, Mycobacterium
LQHWPWMLLGYFVITILVVSLIGWWV

SEQ ID NO: 980649 - protein, 21 aa, Mycobacterium
LRDLLKFDFYFADSAAFRANI

SEQ ID NO: 980650 - protein, 30 aa, Mycobacterium
LSGFEHSWFFLFIFIVFGLAAFYVMMQVAR

SEQ ID NO: 980651 - protein, 27 aa, Mycobacterium
LTAWIAAPLLFIGALFGLLLLTGTTVR

SEQ ID NO: 980652 - protein, 17 aa, Mycobacterium
LVIVMFVLLALGWRRRR

SEQ ID NO: 980653 - protein, 18 aa, Mycobacterium
LVLGLIISRVLRPASKLA

SEQ ID NO: 980654 - protein, 23 aa, Mycobacterium
LVLLYSLLYYRVLGLLTAFSLFC

SEQ ID NO: 980655 - protein, 23 aa, Mycobacterium
LYDGTLRFLLWTAALFSALALSL

SEQ ID NO: 980656 - protein, 17 aa, Mycobacterium
LYLAVVVLLLLPIVTFT

SEQ ID NO: 980657 - protein, 19 aa, Mycobacterium
LYQKIWWPSIAWLVLTVAT

SEQ ID NO: 980658 - protein, 19 aa, Mycobacterium
LYVILGWRRVLLIPLTFGL

SEQ ID NO: 980659 - protein, 19 aa, Mycobacterium
LYVSPWLLLLGVALAALTG

SEQ ID NO: 980660 - protein, 22 aa, Mycobacterium
MAAMVSLIWWTSDAQATHSRPA

SEQ ID NO: 980661 - protein, 24 aa, Mycobacterium
MFAQWNWWLPRWLSRALPAVDFDK

SEQ ID NO: 980662 - protein, 17 aa, Mycobacterium
MFLVLFIGVYLLAFLTG

SEQ ID NO: 980663 - protein, 17 aa, Mycobacterium
MWWIVWVFSYVISVVAV

SEQ ID NO: 980664 - protein, 21 aa, Mycobacterium
NPITMLLPLITIGASLMTAQA

SEQ ID NO: 980665 - protein, 24 aa, Mycobacterium
PAWEFYFWHHTIPAPVWVAVIMAL

SEQ ID NO: 980666 - protein, 29 aa, Mycobacterium
PCIILFFHTQYWWAGIALVVLVVILTLVE

SEQ ID NO: 980667 - protein, 17 aa, Mycobacterium
PCVRALLTLLPDSLRWL

SEQ ID NO: 980668 - protein, 17 aa, Mycobacterium
PHSPLFSFFLPDGNEHQ

SEQ ID NO: 980669 - protein, 25 aa, Mycobacterium
PIARLWRGLLLFFSRWWQLETLYRS

SEQ ID NO: 980670 - protein, 21 aa, Mycobacterium
PIKASPRFGLYYTPASELYHD

SEQ ID NO: 980671 - protein, 17 aa, Mycobacterium
PITAVAVWAWWVTGRSP

SEQ ID NO: 980672 - protein, 17 aa, Mycobacterium
PLALMRSLRYRALDLDN

SEQ ID NO: 980673 - protein, 21 aa, Mycobacterium
PLSQWFLLTAAFGSLFMVAGK

SEQ ID NO: 980674 - protein, 27 aa, Mycobacterium
PMDRFHRRLLWPILTLAGEVIGFGARR

SEQ ID NO: 980675 - protein, 19 aa, Mycobacterium
PMMLSPWVLLPTILALQGA

SEQ ID NO: 980676 - protein, 24 aa, Mycobacterium
PVGTRQLLLVNLLTDMFPALSIAV

SEQ ID NO: 980677 - protein, 20 aa, Mycobacterium
QKPIFMWWIVWVFSYVISVV

SEQ ID NO: 980678 - protein, 33 aa, Mycobacterium
QLFRLTYMVLFSIPVLVPMVLWIALSSATIRRT

SEQ ID NO: 980679 - protein, 17 aa, Mycobacterium
QSSWLHLLPSRKEGWGL

SEQ ID NO: 980680 - protein, 25 aa, Mycobacterium
RAGFLMLLWVFIWSVLQILKTDIYA

SEQ ID NO: 980681 - protein, 20 aa, Mycobacterium
RDMFWSLVPLVVGCILLAGM

SEQ ID NO: 980682 - protein, 23 aa, Mycobacterium
RDRLALWSRVLPITFTAVGLITL

SEQ ID NO: 980683 - protein, 17 aa, Mycobacterium
RENVVALAVLWLLNIGE

SEQ ID NO: 980684 - protein, 29 aa, Mycobacterium
RHFHWGWVVALLMMVLALAAIAILGTVLL

SEQ ID NO: 980685 - protein, 17 aa, Mycobacterium
RIALTRSFMTLTSFVAV

SEQ ID NO: 980686 - protein, 17 aa, Mycobacterium
RIAWLLLLGNMVLAAVL

SEQ ID NO: 980687 - protein, 23 aa, Mycobacterium
RLLAPIVVPLIYRAAIATRALID

SEQ ID NO: 980688 - protein, 34 aa, Mycobacterium
RLNRTWLLHLNRQVNWRWVRYSLYLAVVVLLLLP

SEQ ID NO: 980689 - protein, 18 aa, Mycobacterium
RLRLGWPIVPNTVFIAFG

SEQ ID NO: 980690 - protein, 17 aa, Mycobacterium
RPYRRLVAVLMVLQLVS

SEQ ID NO: 980691 - protein, 24 aa, Mycobacterium
RRFRWLVFTGWLLALVPAIYLAMT

SEQ ID NO: 980692 - protein, 25 aa, Mycobacterium
RRQYRPLWVFLLVSVLILLTISGRW

SEQ ID NO: 980693 - protein, 19 aa, Mycobacterium
RYSVYLWALLAMAAARFGL

SEQ ID NO: 980694 - protein, 17 aa, Mycobacterium
SAVWWKALLALVVAVAL

SEQ ID NO: 980695 - protein, 20 aa, Mycobacterium
SFFWLWWTTNLLSGLLALAT

SEQ ID NO: 980696 - protein, 22 aa, Mycobacterium
SIGWAMWFILVCSVLQAIAAVA

SEQ ID NO: 980697 - protein, 18 aa, Mycobacterium
SLYILYIQLLIAALCFAM

SEQ ID NO: 980698 - protein, 25 aa, Mycobacterium
SMGTALVLLFLLALGAIPGALLPQR

SEQ ID NO: 980699 - protein, 18 aa, Mycobacterium
SPTRIRRVLTVSRLLAPI

SEQ ID NO: 980700 - protein, 18 aa, Mycobacterium
SSVLLVWWRWHHGFWLSV

SEQ ID NO: 980701 - protein, 18 aa, Mycobacterium
SVVEIWMLLGSPAVICSM

SEQ ID NO: 980702 - protein, 17 aa, Mycobacterium
SYYRLMLKLKNGPQAVA

SEQ ID NO: 980703 - protein, 17 aa, Mycobacterium
TFVGLRLWHTLFGSADG

SEQ ID NO: 980704 - protein, 26 aa, Mycobacterium
TGGAWLILFMIFNVIWTYAVFRGASV

SEQ ID NO: 980705 - protein, 22 aa, Mycobacterium
TGLRLMLVPVFLVALFAGNGHE

SEQ ID NO: 980706 - protein, 29 aa, Mycobacterium
TIAYTLYLWHWPLLIFWLSYTGHHHANFV

SEQ ID NO: 980707 - protein, 26 aa, Mycobacterium
TKPVWITMLWPLADRPRLSPGAPGGT

SEQ ID NO: 980708 - protein, 24 aa, Mycobacterium
TKRQLFWVSLYYPLTMRVLCNAIM

SEQ ID NO: 980709 - protein, 26 aa, Mycobacterium
TLLLVYRSFITVILLLFTVGIESAVA

SEQ ID NO: 980710 - protein, 17 aa, Mycobacterium
TLVVFQATLLRGCPWAL

SEQ ID NO: 980711 - protein, 17 aa, Mycobacterium
TLVWLYVEILRLLSYLQ

SEQ ID NO: 980712 - protein, 18 aa, Mycobacterium
TRKRIAWLLLLGNMVLAA

SEQ ID NO: 980713 - protein, 18 aa, Mycobacterium
TTLTLIYPTLSLSSWAAG

SEQ ID NO: 980714 - protein, 19 aa, Mycobacterium
TTSPLPMKPILQPSPQAST

SEQ ID NO: 980715 - protein, 18 aa, Mycobacterium
VAALLRRASWWPARPWGN

SEQ ID NO: 980716 - protein, 18 aa, Mycobacterium
VFRFSRILDVAPRLAILL

SEQ ID NO: 980717 - protein, 26 aa, Mycobacterium
VGFAAIVYLVWWYVVPPVCRLMRARR

SEQ ID NO: 980718 - protein, 17 aa, Mycobacterium
VHLDLDPLLPFPRWHEY

SEQ ID NO: 980719 - protein, 26 aa, Mycobacterium
VLGLTLLLIFLFWPWEYKPKEASGSF

SEQ ID NO: 980720 - protein, 17 aa, Mycobacterium
VLILIIVVALVISGLIG

SEQ ID NO: 980721 - protein, 21 aa, Mycobacterium
VLLGWSFFYFSDDTRGYKFVD

SEQ ID NO: 980722 - protein, 21 aa, Mycobacterium
VLLLVLVLWRCFRVAMISALM

SEQ ID NO: 980723 - protein, 23 aa, Mycobacterium
VLVITILIAWRWVPARVARIPGP

SEQ ID NO: 980724 - protein, 23 aa, Mycobacterium
VPEFPWTVLTIVLLIGVLVAAIG

SEQ ID NO: 980725 - protein, 25 aa, Mycobacterium
VSLGIILLALLWYAGLPLRVFITSL

SEQ ID NO: 980726 - protein, 19 aa, Mycobacterium
VTNYWIISHMLPLFRSMQS

SEQ ID NO: 980727 - protein, 19 aa, Mycobacterium
VTWAAWPFHRVALRNARYR

SEQ ID NO: 980728 - protein, 19 aa, Mycobacterium
VVTWAAWPFHRVAIHNARY

SEQ ID NO: 980729 - protein, 28 aa, Mycobacterium
WACHRPNRLWWRYTGWWLLALCLATLWW

SEQ ID NO: 980730 - protein, 17 aa, Mycobacterium
WALLAMAAARFGLGPLR

SEQ ID NO: 980731 - protein, 17 aa, Mycobacterium
WGLIFWSTIFHRKKTTD

SEQ ID NO: 980732 - protein, 18 aa, Mycobacterium
WILIVCLFVTILAGILFQ

SEQ ID NO: 980733 - protein, 27 aa, Mycobacterium
WRHVPAILLMLALLLFTIAMAGPTNDV

SEQ ID NO: 980734 - protein, 20 aa, Mycobacterium
YAFELPFYRLVLSYVFVAVF

SEQ ID NO: 980735 - protein, 25 aa, Mycobacterium
YARNLLRRLIVAALLFVPLADLSTM

SEQ ID NO: 980736 - protein, 22 aa, Mycobacterium
YDDYVYPGQPIWWLARGLEFFQ

SEQ ID NO: 980737 - protein, 17 aa, Mycobacterium
YIRPYRRLVAVLMVLQL

SEQ ID NO: 980738 - protein, 21 aa, Mycobacterium
YLCLVPIFPLALWLMDVYTAI

SEQ ID NO: 980739 - protein, 17 aa, Mycobacterium
YLNIIYFGRGAYGISAA

SEQ ID NO: 980740 - protein, 26 aa, Mycobacterium
YLQMVIVRWLLVRSLVAWFWEEPLRA

SEQ ID NO: 980741 - protein, 25 aa, Mycobacterium
YRVVRRLLFLTPPERIHTLVFAMLR

SEQ ID NO: 980742 - protein, 22 aa, Mycobacterium
YTQIAWLLLTSYLVAAIIALMV

SEQ ID NO: 980743 - protein, 26 aa, Mycobacterium
YYASYGMLLLPFFAPALSVLGTLSVL

SEQ ID NO: 980744 - protein, 25 aa, Mycobacterium
AAINFLLIALVVYFLVVLPYTTIRK

SEQ ID NO: 980745 - protein, 17 aa, Mycobacterium
AAITFVLLFLLTGSVVL

SEQ ID NO: 980746 - protein, 21 aa, Mycobacterium
AAITVPWWFLVAQLPFAGVVF

SEQ ID NO: 980747 - protein, 18 aa, Mycobacterium
AAKTWPWIAAAVAVVVVI

SEQ ID NO: 980748 - protein, 24 aa, Mycobacterium
AALALLGVRRYVFARPPLLGPSGR

SEQ ID NO: 980749 - protein, 20 aa, Mycobacterium
AALFLYALWVGVLGFPRSEF

SEQ ID NO: 980750 - protein, 23 aa, Mycobacterium
AALLALFVLLLGPTLFLLQSWVQ

SEQ ID NO: 980751 - protein, 26 aa, Mycobacterium
AALLGRWFWWPLRVRPRPASYMLGPF

SEQ ID NO: 980752 - protein, 25 aa, Mycobacterium
AALLGRWFWWPLRVRSRPDRGAIQR

SEQ ID NO: 980753 - protein, 23 aa, Mycobacterium
AALPWLWIAILGTPAILISLAGN

SEQ ID NO: 980754 - protein, 22 aa, Mycobacterium
AAQPILPIRLFAAPVFSVCCVL

SEQ ID NO: 980755 - protein, 24 aa, Mycobacterium
AARKRIAWLLLLTNVVLAAFLNAA

SEQ ID NO: 980756 - protein, 25 aa, Mycobacterium
AAVVILLPIVTFTVAYFIVDVPRPG

SEQ ID NO: 980757 - protein, 19 aa, Mycobacterium
AAWWVVVLALTAATMMAAA

SEQ ID NO: 980758 - protein, 18 aa, Mycobacterium
ACGWAFLIWGLYAYLWAF

SEQ ID NO: 980759 - protein, 23 aa, Mycobacterium
ACKAWLLTQPYLVGGTLLVLYAA

SEQ ID NO: 980760 - protein, 19 aa, Mycobacterium
ACLWLMLNLTALTWIRFGV

SEQ ID NO: 980761 - protein, 20 aa, Mycobacterium
ADFDDFWRPIRSYLYWEKHC

SEQ ID NO: 980762 - protein, 25 aa, Mycobacterium
ADRQYAVFLLVLPLLVSLFAHAVPG

SEQ ID NO: 980763 - protein, 23 aa, Mycobacterium
AELAPFLVWALSGGLFPLALGVL

SEQ ID NO: 980764 - protein, 20 aa, Mycobacterium
AFFNIYFCTVTIKINGPAGS

SEQ ID NO: 980765 - protein, 17 aa, Mycobacterium
AGDQPWRWFLIGFMVIF

SEQ ID NO: 980766 - protein, 20 aa, Mycobacterium
AGRTRHPALAALAAVAAGGG

SEQ ID NO: 980767 - protein, 17 aa, Mycobacterium
AGVLWWITDRRPRSRRW

SEQ ID NO: 980768 - protein, 19 aa, Mycobacterium
AHQVWLPPLDRAPALASLL

SEQ ID NO: 980769 - protein, 23 aa, Mycobacterium
AIGAVMPLIPYLLGFGSLSAGLI

SEQ ID NO: 980770 - protein, 23 aa, Mycobacterium
AIGFLYLLWLTRGLTRQPPDLAG

SEQ ID NO: 980771 - protein, 23 aa, Mycobacterium
AIGLALLPISWQLGLAALAGVPL

SEQ ID NO: 980772 - protein, 19 aa, Mycobacterium
AILGFPFIPQAMRHRYFEL

SEQ ID NO: 980773 - protein, 24 aa, Mycobacterium
AIRLGTFLLVCFLGVIGLFAVFGQ

SEQ ID NO: 980774 - protein, 23 aa, Mycobacterium
AITWRLSFLWLAVTGLLLTLALA

SEQ ID NO: 980775 - protein, 19 aa, Mycobacterium
AIWIIGMVAATGLALWIGA

SEQ ID NO: 980776 - protein, 21 aa, Mycobacterium
AKFVLNVYPRYLPLIPENVDA

SEQ ID NO: 980777 - protein, 24 aa, Mycobacterium
ALGLLLMWILSWLTTTPVKVVCAA

SEQ ID NO: 980778 - protein, 17 aa, Mycobacterium
ALIGLVALVFAVVTSNQ

SEQ ID NO: 980779 - protein, 22 aa, Mycobacterium
ALLGRWFWWPRRVPTHAASPPA

SEQ ID NO: 980780 - protein, 38 aa, Mycobacterium
ALQLYDFLWYPYYASYGLLLLPFFTPALSALSVLSALA

SEQ ID NO: 980781 - protein, 17 aa, Mycobacterium
ALRLLLPIAFVLISAGI

SEQ ID NO: 980782 - protein, 24 aa, Mycobacterium
ALTLIFLIMLLLTRSVVAALVIVG

SEQ ID NO: 980783 - protein, 26 aa, Mycobacterium
ALTLLGVRRYVFARPLLLPTTSRLVA

SEQ ID NO: 980784 - protein, 28 aa, Mycobacterium
ALTLLGVRRYVFARPLLLPTTSRLVASG

SEQ ID NO: 980785 - protein, 18 aa, Mycobacterium
ALTMLIAIIVVLWVSRTD

SEQ ID NO: 980786 - protein, 23 aa, Mycobacterium
ALTVWVVGITLRPLRRVAATAAT

SEQ ID NO: 980787 - protein, 23 aa, Mycobacterium
ALVPYIRWPMWLRTIAATVGLAI

SEQ ID NO: 980788 - protein, 25 aa, Mycobacterium
ALVWFPLWFVILGIGWALVRRRPGH

SEQ ID NO: 980789 - protein, 18 aa, Mycobacterium
ALYLLITIAPFAVVAPLI

SEQ ID NO: 980790 - protein, 20 aa, Mycobacterium
AMALFPMYLLKSFAYAGVAV

SEQ ID NO: 980791 - protein, 28 aa, Mycobacterium
AMAYSLYLWHWPLLIFWLSYTGHRHANF

SEQ ID NO: 980792 - protein, 17 aa, Mycobacterium
AMLIYRLISWLFIAAIG

SEQ ID NO: 980793 - protein, 25 aa, Mycobacterium
AMLPALQFRYWQWASLALAAPVIVW

SEQ ID NO: 980794 - protein, 20 aa, Mycobacterium
ANRLLLPPILGWSLGRALCG

SEQ ID NO: 980795 - protein, 19 aa, Mycobacterium
APAPMPWYPTAPAPARPRR

SEQ ID NO: 980796 - protein, 27 aa, Mycobacterium
APESLYPALLGFILLSAVAATLLVAMI

SEQ ID NO: 980797 - protein, 19 aa, Mycobacterium
APFRFAIFHLLVWGTFTIL

SEQ ID NO: 980798 - protein, 24 aa, Mycobacterium
APLFLWETILAIIAFIAKLAEFIY

SEQ ID NO: 980799 - protein, 39 aa, Mycobacterium
APPHSKKFTWHWWWLAAAIPVLLLVVFLVVMAVGLRRRR

SEQ ID NO: 980800 - protein, 26 aa, Mycobacterium
APVGTRQLLLVNLLTDMFPALAVAIT

SEQ ID NO: 980801 - protein, 24 aa, Mycobacterium
APVLDAIKFNYFPFGLNAFNTAEV

SEQ ID NO: 980802 - protein, 22 aa, Mycobacterium
ARAFAVLFLPYSLLGPFAGALM

SEQ ID NO: 980803 - protein, 24 aa, Mycobacterium
ARAFGWLWQVLAATLVAAVFAAAV

SEQ ID NO: 980804 - protein, 19 aa, Mycobacterium
AREGYPAVIWLLLGGNLVV

SEQ ID NO: 980805 - protein, 20 aa, Mycobacterium
ARIARLSIVVKVAALLIVFG

SEQ ID NO: 980806 - protein, 19 aa, Mycobacterium
ARLYPFQVFLDLYGLPLQD

SEQ ID NO: 980807 - protein, 26 aa, Mycobacterium
ARRGRSRLLFGALAILLCLVLGVAIV

SEQ ID NO: 980808 - protein, 17 aa, Mycobacterium
ARRLAWISLAVLVTEGA

SEQ ID NO: 980809 - protein, 33 aa, Mycobacterium
ARWIRRLAIPIMLGWLAIIVLINILVPSLQQVA

SEQ ID NO: 980810 - protein, 26 aa, Mycobacterium
ARWVLSLVGLLLIGYLAAVALQPAIL

SEQ ID NO: 980811 - protein, 23 aa, Mycobacterium
ASFGVAPLLLWQLATRHFTNITV

SEQ ID NO: 980812 - protein, 26 aa, Mycobacterium
ASHGSPWLLPLRWSLVEYYYLKYYIP

SEQ ID NO: 980813 - protein, 25 aa, Mycobacterium
ASSALFFLLIAFVGLYSLVNGRPYV

SEQ ID NO: 980814 - protein, 20 aa, Mycobacterium
ATAFWVCGLLLCLFIGPSQS

SEQ ID NO: 980815 - protein, 17 aa, Mycobacterium
ATTFPWVFLFPAGVLVV

SEQ ID NO: 980816 - protein, 17 aa, Mycobacterium
AVHRRALGLPGVSVAWG

SEQ ID NO: 980817 - protein, 17 aa, Mycobacterium
AVIALVVFLVLVAIYIT

SEQ ID NO: 980818 - protein, 17 aa, Mycobacterium
AVIPLLYRLGELVPALA

SEQ ID NO: 980819 - protein, 21 aa, Mycobacterium
AVLAVIWFWLLKRYIVEGPLE

SEQ ID NO: 980820 - protein, 22 aa, Mycobacterium
AVLAWVVLPSLALLLAITAGVL

SEQ ID NO: 980821 - protein, 17 aa, Mycobacterium
AVLLGRWFWWPQRVRPR

SEQ ID NO: 980822 - protein, 18 aa, Mycobacterium
AVPLILGWVLLIAVLNSV

SEQ ID NO: 980823 - protein, 24 aa, Mycobacterium
AVSWFLRFLLRHSMYWFVGYRVVV

SEQ ID NO: 980824 - protein, 17 aa, Mycobacterium
AWIGWWVALGLAAAIAG

SEQ ID NO: 980825 - protein, 20 aa, Mycobacterium
AWRIGFWSNRWIIFGVAAQA

SEQ ID NO: 980826 - protein, 23 aa, Mycobacterium
AWSWRLLVILAALVALLLVIKKL

SEQ ID NO: 980827 - protein, 25 aa, Mycobacterium
AYDIGLFYRYAWQNPIFADIVATRT

SEQ ID NO: 980828 - protein, 20 aa, Mycobacterium
CLIFIIMLIITRSVVAAAVI

SEQ ID NO: 980829 - protein, 23 aa, Mycobacterium
CSGFWILMFPFMGELDFYHVDRW

SEQ ID NO: 980830 - protein, 23 aa, Mycobacterium
DALDQYLRLPLRQVMWGDDEGLL

SEQ ID NO: 980831 - protein, 17 aa, Mycobacterium
DAWLRLCQTYGWSPGVM

SEQ ID NO: 980832 - protein, 23 aa, Mycobacterium
DDALNLPWLAMGAIGFISVIGHL

SEQ ID NO: 980833 - protein, 17 aa, Mycobacterium
DETAGLWTLLRIPTLIA

SEQ ID NO: 980834 - protein, 22 aa, Mycobacterium
DETKLPFCWRGVSLHAGGAGRV

SEQ ID NO: 980835 - protein, 17 aa, Mycobacterium
DFCFALTALIAASPLLI

SEQ ID NO: 980836 - protein, 21 aa, Mycobacterium
DGFAQVFPEHKYRIVRLLQGR

SEQ ID NO: 980837 - protein, 25 aa, Mycobacterium
DGLYYFFGVLARLAALPSLTPILLP

SEQ ID NO: 980838 - protein, 25 aa, Mycobacterium
DHGLWVAFWFFLAQLNLILGAINLL

SEQ ID NO: 980839 - protein, 23 aa, Mycobacterium
DKLFNPILLLALAALAIGSASTL

SEQ ID NO: 980840 - protein, 19 aa, Mycobacterium
DPPPCNVGFLPPPLIRSPA

SEQ ID NO: 980841 - protein, 17 aa, Mycobacterium
DPVDWWRQLSWLPQRSV

SEQ ID NO: 980842 - protein, 26 aa, Mycobacterium
DQDRYAEAAPLPWYKRAAVVFSLAAA

SEQ ID NO: 980843 - protein, 23 aa, Mycobacterium
DQFYLVWPALIIATAWLLRRIGK

SEQ ID NO: 980844 - protein, 20 aa, Mycobacterium
DQLILNHILTVTPGIDSAEV

SEQ ID NO: 980845 - protein, 26 aa, Mycobacterium
DRGVSWLPFFHDMGLITVLLASVLGH

SEQ ID NO: 980846 - protein, 24 aa, Mycobacterium
DTSAYWVFLLFYVGAALLTWSRYG

SEQ ID NO: 980847 - protein, 24 aa, Mycobacterium
DVHTPWFWCLLALRAVVFTLVMAA

SEQ ID NO: 980848 - protein, 23 aa, Mycobacterium
DVYSLGCALFRLLTGRAPYEDLR

SEQ ID NO: 980849 - protein, 20 aa, Mycobacterium
DWLLAIPWWTQSFVLGLGSF

SEQ ID NO: 980850 - protein, 21 aa, Mycobacterium
EAVPPFFRWLAKFEPMHQVFL

SEQ ID NO: 980851 - protein, 19 aa, Mycobacterium
EERLTLPPIPLQVPPAAPA

SEQ ID NO: 980852 - protein, 18 aa, Mycobacterium
EFDDFWRPMRSYFYWEKH

SEQ ID NO: 980853 - protein, 17 aa, Mycobacterium
EFTEPEMWFLRKAHQLC

SEQ ID NO: 980854 - protein, 22 aa, Mycobacterium
EGRLGWPLWAAYVSVFALTVLV

SEQ ID NO: 980855 - protein, 24 aa, Mycobacterium
EHARHLLIRLAVAAVLFVPLADLS

SEQ ID NO: 980856 - protein, 26 aa, Mycobacterium
EHARTLLRRLLVAAVLFVPLADLSTM

SEQ ID NO: 980857 - protein, 25 aa, Mycobacterium
EHDPTNIRWLLYALGTIAIIVAIQR

SEQ ID NO: 980858 - protein, 24 aa, Mycobacterium
ELVSPLHWYWAVIAAFVVFAGTNS

SEQ ID NO: 980859 - protein, 22 aa, Mycobacterium
EPAHPRWWFVSTTPGRILTIGI

SEQ ID NO: 980860 - protein, 23 aa, Mycobacterium
EPDNYLIWAILTTLFCCLPLGIV

SEQ ID NO: 980861 - protein, 22 aa, Mycobacterium
EQPWTPILIIIIITSVKIGASV

SEQ ID NO: 980862 - protein, 33 aa, Mycobacterium
EQRRNPVLVFLGYFWAPIPWMIEAALVLSLAAR

SEQ ID NO: 980863 - protein, 23 aa, Mycobacterium
EQYYIVWPLLLIAVTLLLAARAR

SEQ ID NO: 980864 - protein, 19 aa, Mycobacterium
ERRRAWLHKLTPGKVVVAV

SEQ ID NO: 980865 - protein, 24 aa, Mycobacterium
ETLPMMLAPWVLLPTILALRATSE

SEQ ID NO: 980866 - protein, 18 aa, Mycobacterium
ETPVWRLVLPFAAMGAGM

SEQ ID NO: 980867 - protein, 17 aa, Mycobacterium
EVLPLVVPVILASLLFA

SEQ ID NO: 980868 - protein, 18 aa, Mycobacterium
EWSPLYFKEISWVGSNAF

SEQ ID NO: 980869 - protein, 17 aa, Mycobacterium
FAPMRMTLALLPRMLAR

SEQ ID NO: 980870 - protein, 17 aa, Mycobacterium
FARPLLLPTTSRLVASG

SEQ ID NO: 980871 - protein, 25 aa, Mycobacterium
FAVEVALFALLRFWGVVPDYVIGHS

SEQ ID NO: 980872 - protein, 21 aa, Mycobacterium
FEPYRLWQPPLTQPVAIDDLV

SEQ ID NO: 980873 - protein, 17 aa, Mycobacterium
FERVITGLLLIIAVGFT

SEQ ID NO: 980874 - protein, 20 aa, Mycobacterium
FFCLLLVYLAATPTLIWQRR

SEQ ID NO: 980875 - protein, 26 aa, Mycobacterium
FFGLALLLVFLFWPWEYKPSGDKGNL

SEQ ID NO: 980876 - protein, 18 aa, Mycobacterium
FFRLKQPALVPPTAWAVP

SEQ ID NO: 980877 - protein, 18 aa, Mycobacterium
FFVALLAGLGLSAAEVPS

SEQ ID NO: 980878 - protein, 19 aa, Mycobacterium
FGCTPVGPLAWGQALLAAA

SEQ ID NO: 980879 - protein, 17 aa, Mycobacterium
FGHFPWWIPLGSLVLPF

SEQ ID NO: 980880 - protein, 18 aa, Mycobacterium
FGLAFWIALAGLTPTGLL

SEQ ID NO: 980881 - protein, 24 aa, Mycobacterium
FIAFDQLWRWNSIVALVLSVLVIL

SEQ ID NO: 980882 - protein, 26 aa, Mycobacterium
FISVLVLWDLFGQLPLPLGVAGHEGS

SEQ ID NO: 980883 - protein, 26 aa, Mycobacterium
FIVWLFSDWRYVFWINIPLTAIAMLM

SEQ ID NO: 980884 - protein, 19 aa, Mycobacterium
FKGHLYIAGRIKDLVIIDG

SEQ ID NO: 980885 - protein, 24 aa, Mycobacterium
FLGLPLNFLLFSLLVVVTASLTVP

SEQ ID NO: 980886 - protein, 19 aa, Mycobacterium
FLHFAKLPAMLFGVGRYTV

SEQ ID NO: 980887 - protein, 17 aa, Mycobacterium
FLIVLLMLRSPVAAAVV

SEQ ID NO: 980888 - protein, 17 aa, Mycobacterium
FLPAILYWESLNTSFRE

SEQ ID NO: 980889 - protein, 18 aa, Mycobacterium
FLSQLFAAILRPLGQPAN

SEQ ID NO: 980890 - protein, 26 aa, Mycobacterium
FLVPNGTFFFVLAIFLVVLAVIGTFV

SEQ ID NO: 980891 - protein, 24 aa, Mycobacterium
FMAYFYSLYLRAGVAQLPWMIGAV

SEQ ID NO: 980892 - protein, 17 aa, Mycobacterium
FNYLFSNPIPYARAGLD

SEQ ID NO: 980893 - protein, 22 aa, Mycobacterium
FPGWGYLLTALAAPIVIWAAWP

SEQ ID NO: 980894 - protein, 19 aa, Mycobacterium
FPWVFLFPAGVLVVILVCA

SEQ ID NO: 980895 - protein, 25 aa, Mycobacterium
FSVGWLYWYFWVIVVGFEAVAGAKV

SEQ ID NO: 980896 - protein, 24 aa, Mycobacterium
FTAVPLLWLLAIDITLILLGALAL

SEQ ID NO: 980897 - protein, 18 aa, Mycobacterium
FTFMTPAAFVRRPGRWIR

SEQ ID NO: 980898 - protein, 25 aa, Mycobacterium
FTRKAIWWSAFRQLLFGSVAVAATY

SEQ ID NO: 980899 - protein, 24 aa, Mycobacterium
FTVIIVMLLLVYRSIITAAIMLTM

SEQ ID NO: 980900 - protein, 19 aa, Mycobacterium
FVLFSFWAFDYAGPGANKL

SEQ ID NO: 980901 - protein, 19 aa, Mycobacterium
FVSMFRPPFAWREYLLQCW

SEQ ID NO: 980902 - protein, 17 aa, Mycobacterium
FYVLFTLVSRNLLSALI

SEQ ID NO: 980903 - protein, 18 aa, Mycobacterium
FYWAVGIAAALPVLVVIL

SEQ ID NO: 980904 - protein, 23 aa, Mycobacterium
GALGILVMVVWVGTALTLSTAAS

SEQ ID NO: 980905 - protein, 24 aa, Mycobacterium
GAPWYAFWRLLPKIPPWLGLADNA

SEQ ID NO: 980906 - protein, 22 aa, Mycobacterium
GARPWLPHFYLGHGVGVNAAEM

SEQ ID NO: 980907 - protein, 17 aa, Mycobacterium
GATIVFLACRWVQAQGG

SEQ ID NO: 980908 - protein, 24 aa, Mycobacterium
GDRPVQVWSLWSTTLRRLAEGHRA

SEQ ID NO: 980909 - protein, 17 aa, Mycobacterium
GDRRSELAPLDRVFAAA

SEQ ID NO: 980910 - protein, 31 aa, Mycobacterium; identical to SEQ ID NO: 377108

SEQ ID NO: 980911 - protein, 33 aa, Mycobacterium; identical to SEQ ID NO: 377123

SEQ ID NO: 980912 - protein, 22 aa, Mycobacterium
GGIALVVVLLVTSWLLAKSMGY

SEQ ID NO: 980913 - protein, 23 aa, Mycobacterium
GGRRPGWVLLTTLLVLAIGASSA

SEQ ID NO: 980914 - protein, 25 aa, Mycobacterium
GGSDPWQLLWQLLQYLWNAYTGFNT

SEQ ID NO: 980915 - protein, 29 aa, Mycobacterium
GGVTVLVVALWRFRWIRLAMISALLATQG

SEQ ID NO: 980916 - protein, 22 aa, Mycobacterium
GHLGFFVLDGWLRPVPVGVVGE

SEQ ID NO: 980917 - protein, 18 aa, Mycobacterium
GIFYLRLPATFGIGTYEV

SEQ ID NO: 980918 - protein, 28 aa, Mycobacterium
GIRFWSRRAWLAWPLGLLASGLTMFFGA

SEQ ID NO: 980919 - protein, 18 aa, Mycobacterium
GIYFSKRQLLARGGIALV

SEQ ID NO: 980920 - protein, 27 aa, Mycobacterium
GLALVLLYSLLYYRVLGLLTALSLIAS

SEQ ID NO: 980921 - protein, 17 aa, Mycobacterium
GLLPLHAWLPRAHPESP

SEQ ID NO: 980922 - protein, 26 aa, Mycobacterium
GLLVEYFWWGAIFLINVPLALLVLLL

SEQ ID NO: 980923 - protein, 20 aa, Mycobacterium
GLSVLIWQDLFGIKIHWIVA

SEQ ID NO: 980924 - protein, 22 aa, Mycobacterium
GLTHLFTMWGFFILLTVYIEAY

SEQ ID NO: 980925 - protein, 23 aa, Mycobacterium
GLTHLFTMWGFFILLTVYIEAYG

SEQ ID NO: 980926 - protein, 29 aa, Mycobacterium
GLTVWIAAPLLFIGALFGLLLLTGTTIRE

SEQ ID NO: 980927 - protein, 40 aa, Mycobacterium
GLVLTIGFLLPWIPVLGVLVLAVVWVLRRKIFSRASGVGH

SEQ ID NO: 980928 - protein, 23 aa, Mycobacterium
GLVWPFVLLPHLGMIRGAAATGI

SEQ ID NO: 980929 - protein, 19 aa, Mycobacterium
GLWTLLRIPTLIACGDHDL

SEQ ID NO: 980930 - protein, 18 aa, Mycobacterium
GMAAPPVRLLPIDLAPDA

SEQ ID NO: 980931 - protein, 22 aa, Mycobacterium
GMNGFFFAAIARIPLGVAVTIE

SEQ ID NO: 980932 - protein, 17 aa, Mycobacterium
GMNLLWTLVLLIPVLYV

SEQ ID NO: 980933 - protein, 18 aa, Mycobacterium
GMNLLWTLVLLIPVLYVN

SEQ ID NO: 980934 - protein, 18 aa, Mycobacterium
GMTLLWTLALLIPVLYVN

SEQ ID NO: 980935 - protein, 24 aa, Mycobacterium
GNRAFWIIAAVFVVGILGAVAAVA

SEQ ID NO: 980936 - protein, 18 aa, Mycobacterium
GPAVLAVLAVLVLIWVLR

SEQ ID NO: 980937 - protein, 17 aa, Mycobacterium
GPLWLIILGFSAGVALL

SEQ ID NO: 980938 - protein, 18 aa, Mycobacterium
GPPPLIPPGGHQGPHGPP

SEQ ID NO: 980939 - protein, 20 aa, Mycobacterium
GPSGIWWAALLGGLVLLAAG

SEQ ID NO: 980940 - protein, 24 aa, Mycobacterium
GPSWLLWSVILLTSGLVLGCSIVF

SEQ ID NO: 980941 - protein, 26 aa, Mycobacterium
GQVSYLALIVLAVIALVIGALGGVIG

SEQ ID NO: 980942 - protein, 21 aa, Mycobacterium
GQVVLPFTGLNFRFAPGGVAV

SEQ ID NO: 980943 - protein, 31 aa, Mycobacterium; identical to SEQ ID NO: 377293

SEQ ID NO: 980944 - protein, 23 aa, Mycobacterium
GSAAAVLVIPWPAGAQLLIRFTG

SEQ ID NO: 980945 - protein, 23 aa, Mycobacterium
GSAVGLIFLWFSMTPSLLPRGPL

SEQ ID NO: 980946 - protein, 21 aa, Mycobacterium
GSLHLWLNLTLLAGVALVVVG

SEQ ID NO: 980947 - protein, 20 aa, Mycobacterium
GTAALGWLWKEQRDNEIAGR

SEQ ID NO: 980948 - protein, 25 aa, Mycobacterium
GTLLGRWFWWPRPLAGQTRKPQMVS

SEQ ID NO: 980949 - protein, 19 aa, Mycobacterium
GTMAIICLILYRSFRHRNW

SEQ ID NO: 980950 - protein, 23 aa, Mycobacterium
GVALWLLLGGFFGLALLLVFLFW

SEQ ID NO: 980951 - protein, 23 aa, Mycobacterium
GVKSAWDLLWRYGGQYVATALAQ

SEQ ID NO: 980952 - protein, 17 aa, Mycobacterium
GVLIFAAILVTGFLWPA

SEQ ID NO: 980953 - protein, 21 aa, Mycobacterium
GVPLLLGALWASGRFARRADK

SEQ ID NO: 980954 - protein, 19 aa, Mycobacterium
GVPVWGFAMLWIALSTALT

SEQ ID NO: 980955 - protein, 18 aa, Mycobacterium
GVPWLLISGPLGSAAESS

SEQ ID NO: 980956 - protein, 23 aa, Mycobacterium
GVVVMLIWWAISPGFFRGRTLRR

SEQ ID NO: 980957 - protein, 23 aa, Mycobacterium
GVYPLYLDAYPLPPFAIYGAVSL

SEQ ID NO: 980958 - protein, 26 aa, Mycobacterium
GWALGYVYFLFWLWVLRPVPVAEQEP

SEQ ID NO: 980959 - protein, 19 aa, Mycobacterium
GWASYLILWVLQACVFWRG

SEQ ID NO: 980960 - protein, 21 aa, Mycobacterium
GWRGIFLINVPIGLAVLAGLR

SEQ ID NO: 980961 - protein, 24 aa, Mycobacterium
HFTLLLVHALRRQFSRVRVFAFID

SEQ ID NO: 980962 - protein, 34 aa, Mycobacterium
HLLQLPAWITQRLWWALLLTIGFWGLLRVAEGLG

SEQ ID NO: 980963 - protein, 27 aa, Mycobacterium
HNLFKPLLLFFYFGFLIPILKVRFEFP

SEQ ID NO: 980964 - protein, 25 aa, Mycobacterium
HNSGAWLVLFMIFNVIWTYVLVRGS

SEQ ID NO: 980965 - protein, 25 aa, Mycobacterium
HPAWHTLILVLLFVAAMWVTYALFM

SEQ ID NO: 980966 - protein, 25 aa, Mycobacterium
HQEAALTWLLLVSVPILALANYWIM

SEQ ID NO: 980967 - protein, 17 aa, Mycobacterium
HRMRCTTTFFGIAALGA

SEQ ID NO: 980968 - protein, 17 aa, Mycobacterium
HRRVLLICTFAIGAATV

SEQ ID NO: 980969 - protein, 25 aa, Mycobacterium
HSTVPLVVAIALSLLAMLLIRQLRR

SEQ ID NO: 980970 - protein, 23 aa, Mycobacterium
HTASAWWFDMAMLAFISLCYVSF

SEQ ID NO: 980971 - protein, 17 aa, Mycobacterium
HTWLLVALPLAGAAILL

SEQ ID NO: 980972 - protein, 25 aa, Mycobacterium
IAAFVVIVLFAWWRGLYLTTILHRR

SEQ ID NO: 980973 - protein, 18 aa, Mycobacterium
IAGRWQLIAFAAPLLGVL

SEQ ID NO: 980974 - protein, 17 aa, Mycobacterium
IALFFWSLAAVLGTYVL

SEQ ID NO: 980975 - protein, 18 aa, Mycobacterium
IALWLPWLIVAGVVFILG

SEQ ID NO: 980976 - protein, 27 aa, Mycobacterium
IATFTVIIVLMLFFFRSVPTVLVLLGV

SEQ ID NO: 980977 - protein, 23 aa, Mycobacterium
IAVPIALPIALPLGIDAYVRGSS

SEQ ID NO: 980978 - protein, 19 aa, Mycobacterium
IAWTTVWCLVLLSLALTVT

SEQ ID NO: 980979 - protein, 18 aa, Mycobacterium
ICVYAFAALWALALAFRR

SEQ ID NO: 980980 - protein, 18 aa, Mycobacterium
IDDYGWQWIFWINVPIGL

SEQ ID NO: 980981 - protein, 19 aa, Mycobacterium
IFGVVLVICVVLIAFGYSG

SEQ ID NO: 980982 - protein, 26 aa, Mycobacterium
IFVLPALIMIGWWSGFPYWTTVAVCG

SEQ ID NO: 980983 - protein, 25 aa, Mycobacterium
IGELTHFFALLLWAAAVLAFFADLP

SEQ ID NO: 980984 - protein, 29 aa, Mycobacterium
IGGFILLIKKIWWPLAVWLLLVVMNVNAG

SEQ ID NO: 980985 - protein, 28 aa, Mycobacterium
IGGPLNVLLWLSYFVMLGLYAVAFGSYG

SEQ ID NO: 980986 - protein, 25 aa, Mycobacterium
IGGTAFVVFFAVALVFYIVTSHQKK

SEQ ID NO: 980987 - protein, 17 aa, Mycobacterium
IGMILLVIPLGNLSFGG

SEQ ID NO: 980988 - protein, 31 aa, Mycobacterium; identical to SEQ ID NO: 377587

SEQ ID NO: 980989 - protein, 32 aa, Mycobacterium
IGVLIFAAILVTGFLWPAWLVTTKLDVNKAQA

SEQ ID NO: 980990 - protein, 27 aa, Mycobacterium
IISDRGYFIFLAILPFVMGSLSMSVPG

SEQ ID NO: 980991 - protein, 18 aa, Mycobacterium
IIVILIQIILVLLEILYS

SEQ ID NO: 980992 - protein, 22 aa, Mycobacterium
ILHGFWVLLFALPFAGLIEQIP

SEQ ID NO: 980993 - protein, 18 aa, Mycobacterium
IPAKLLVTLLVCSILSVA

SEQ ID NO: 980994 - protein, 24 aa, Mycobacterium
IPATLLFFRYYWLRSEPLPSQRPT

SEQ ID NO: 980995 - protein, 23 aa, Mycobacterium
IPIILIWLLLTIAVNVFVPQIEF

SEQ ID NO: 980996 - protein, 24 aa, Mycobacterium
IRMNGWPEAIFRFGLYAFLCATAL

SEQ ID NO: 980997 - protein, 26 aa, Mycobacterium
ISPQTLFFPFVMLLAATALYRGNDNK

SEQ ID NO: 980998 - protein, 25 aa, Mycobacterium
ISSFGWHWIFLVNLPIGLAAFALAA

SEQ ID NO: 980999 - protein, 25 aa, Mycobacterium
ISVLVAWLAVLLFASLAAAPRPWQG

SEQ ID NO: 981000 - protein, 25 aa, Mycobacterium
ITVSTIFFVLFALAVLYAAWLHFAP

SEQ ID NO: 981001 - protein, 19 aa, Mycobacterium
IVMAVFILMLPRLFPGSFE

SEQ ID NO: 981002 - protein, 19 aa, Mycobacterium
IVRWPLPILAVTCAVALVG

SEQ ID NO: 981003 - protein, 23 aa, Mycobacterium
IVVLFVPAALPWYYSWPLAVAAP

SEQ ID NO: 981004 - protein, 25 aa, Mycobacterium
IVWLFSDWRYVFWINIPLTAIAMLM

SEQ ID NO: 981005 - protein, 18 aa, Mycobacterium
IWIMLLSGVVFMALFVYW

SEQ ID NO: 981006 - protein, 24 aa, Mycobacterium
IYKFAVPIALFWLAVCAIIAAFVP

SEQ ID NO: 981007 - protein, 24 aa, Mycobacterium
IYNYTWLVLMLPFGMIGVTVLTVV

SEQ ID NO: 981008 - protein, 35 aa, Mycobacterium; identical to SEQ ID NO: 377766

SEQ ID NO: 981009 - protein, 18 aa, Mycobacterium
KFFTPWGRQFWRITSEYF

SEQ ID NO: 981010 - protein, 40 aa, Mycobacterium
KGALALRLLTIAFFALVYLLPLILWLWRGETTHDRHAAAR

SEQ ID NO: 981011 - protein, 21 aa, Mycobacterium
KGRAFAIVAALLALAAIAVAA

SEQ ID NO: 981012 - protein, 26 aa, Mycobacterium
KIAGIALFLVGLLILSLVYLQFRGDF

SEQ ID NO: 981013 - protein, 20 aa, Mycobacterium
KLSSWLPPGPVAVADYPAVL

SEQ ID NO: 981014 - protein, 21 aa, Mycobacterium
KQFGIFILLFLLLAPVLNQWL

SEQ ID NO: 981015 - protein, 18 aa, Mycobacterium
KRQRFWISLYLPLTMRSL

SEQ ID NO: 981016 - protein, 25 aa, Mycobacterium
KVHWSVLVILWLFTWSLATTLPETA

SEQ ID NO: 981017 - protein, 23 aa, Mycobacterium
KVWGFLFMYFWLRATLPRLRYDQ

SEQ ID NO: 981018 - protein, 17 aa, Mycobacterium
LAFLSIGALIYFLHHLM

SEQ ID NO: 981019 - protein, 26 aa, Mycobacterium
LALALYLIASLLIWGQARLLNVTVQR

SEQ ID NO: 981020 - protein, 18 aa, Mycobacterium
LALLLERFGPVTPPWAVA

SEQ ID NO: 981021 - protein, 19 aa, Mycobacterium
LAQHGPWIAILTAALTALA

SEQ ID NO: 981022 - protein, 23 aa, Mycobacterium
LARAAALLLLGLGFAAVIVIGGW

SEQ ID NO: 981023 - protein, 22 aa, Mycobacterium
LARKGFLSIWSWTFGLVVTEFP

SEQ ID NO: 981024 - protein, 20 aa, Mycobacterium
LARNHRWFLIANYGAARAGA

SEQ ID NO: 981025 - protein, 20 aa, Mycobacterium
LATRLTLITLIPTVAFMTAG

SEQ ID NO: 981026 - protein, 21 aa, Mycobacterium
LATRLTLITLIPTVAFMTAGG

SEQ ID NO: 981027 - protein, 18 aa, Mycobacterium
LAVLVILAALAGSAYMVL

SEQ ID NO: 981028 - protein, 22 aa, Mycobacterium
LAVVVALAAPLGWFGFRVHLAG

SEQ ID NO: 981029 - protein, 23 aa, Mycobacterium
LCLIFVIMLILTRALVGAGVIVG

SEQ ID NO: 981030 - protein, 18 aa, Mycobacterium
LDIVVVFLVTWPLVYLAS

SEQ ID NO: 981031 - protein, 17 aa, Mycobacterium
LDQLSWLTPARWGFAAS

SEQ ID NO: 981032 - protein, 19 aa, Mycobacterium
LDSLLKRFGPLTPPRAVAI

SEQ ID NO: 981033 - protein, 23 aa, Mycobacterium
LEAAALIALWRLLARARQENDEL

SEQ ID NO: 981034 - protein, 25 aa, Mycobacterium
LFPVVQPWYLLWAIIPMAAWATRTG

SEQ ID NO: 981035 - protein, 18 aa, Mycobacterium
LGGLAHRMRCTTTFFGIA

SEQ ID NO: 981036 - protein, 22 aa, Mycobacterium
LGGWLLGFAWPWRPVVCGGRTG

SEQ ID NO: 981037 - protein, 17 aa, Mycobacterium
LGLLLPYTDYKAGESPF

SEQ ID NO: 981038 - protein, 17 aa, Mycobacterium
LGMLLWLAPIGAFGWIA

SEQ ID NO: 981039 - protein, 21 aa, Mycobacterium
LGNWTIFYWGWWISWAPFVGM

SEQ ID NO: 981040 - protein, 18 aa, Mycobacterium
LGPLWYLVGPAPAAGPAI

SEQ ID NO: 981041 - protein, 23 aa, Mycobacterium
LGRGWLVGISAVLLLAAGGIGAG

SEQ ID NO: 981042 - protein, 17 aa, Mycobacterium
LGRWFWWPMRVRTRPAR

SEQ ID NO: 981043 - protein, 29 aa, Mycobacterium
LIFAAILVTGFLWPAWLVTTKLDVNKAQA

SEQ ID NO: 981044 - protein, 19 aa, Mycobacterium
LIFSRYLWAFELTSALLIT

SEQ ID NO: 981045 - protein, 18 aa, Mycobacterium
LILTYRSSVLWLLPLLVI

SEQ ID NO: 981046 - protein, 24 aa, Mycobacterium
LIMLLFVYRSPVTVFLLLVTVGLE

SEQ ID NO: 981047 - protein, 21 aa, Mycobacterium
LIYRLISWLFIAAIGWVVFFF

SEQ ID NO: 981048 - protein, 21 aa, Mycobacterium
LLALYFPLVPLICSLATTLVL

SEQ ID NO: 981049 - protein, 18 aa, Mycobacterium
LLATFAVEMALMFAVPAG

SEQ ID NO: 981050 - protein, 17 aa, Mycobacterium
LLAVFLWLERRTWHPIL

SEQ ID NO: 981051 - protein, 26 aa, Mycobacterium
LLDTLPLLIGWLWPLWDSRRRTFADL

SEQ ID NO: 981052 - protein, 18 aa, Mycobacterium
LLGLGFAAVIVIGGWALS

SEQ ID NO: 981053 - protein, 19 aa, Mycobacterium
LLIMTLLPVLVALDISSRR

SEQ ID NO: 981054 - protein, 20 aa, Mycobacterium
LLSRVPFVVLVIGSLGVGLG

SEQ ID NO: 981055 - protein, 19 aa, Mycobacterium
LLSWMLYVGLLITVADVLI

SEQ ID NO: 981056 - protein, 25 aa, Mycobacterium
LLVIVALVVGLLRYRRRRISLAARP

SEQ ID NO: 981057 - protein, 20 aa, Mycobacterium
LLVLGLFTPLAGAGALAFLM

SEQ ID NO: 981058 - protein, 19 aa, Mycobacterium
LLWISIVATPIVLFALRGL

SEQ ID NO: 981059 - protein, 21 aa, Mycobacterium
LMAIPLWIIIVLPVAKILATS

SEQ ID NO: 981060 - protein, 19 aa, Mycobacterium
LMLPFSWQGVSLHAAGAAR

SEQ ID NO: 981061 - protein, 20 aa, Mycobacterium
LMMTPLIALFFWSLAAVLGT

SEQ ID NO: 981062 - protein, 17 aa, Mycobacterium
LNRLLALQIPPARKVVT

SEQ ID NO: 981063 - protein, 20 aa, Mycobacterium
LPGFGLVTAPLRAGALLAAT

SEQ ID NO: 981064 - protein, 18 aa, Mycobacterium
LPGNLLPDILLIKSARDL

SEQ ID NO: 981065 - protein, 19 aa, Mycobacterium
LPGNLLPDILLIKSARDLR

SEQ ID NO: 981066 - protein, 17 aa, Mycobacterium
LPGSLWWLVTVDAMHTQ

SEQ ID NO: 981067 - protein, 21 aa, Mycobacterium
LPGWPIWFAVLWGAQEWLKSI

SEQ ID NO: 981068 - protein, 17 aa, Mycobacterium
LPPVSLLPRRNPGSSGI

SEQ ID NO: 981069 - protein, 17 aa, Mycobacterium
LPWEVPLIELGLDSLMA

SEQ ID NO: 981070 - protein, 25 aa, Mycobacterium
LQVTSWLLMPISRLLVLLGNALTPG

SEQ ID NO: 981071 - protein, 24 aa, Mycobacterium
LREFRLFFFHRLLMMTPLIALFFW

SEQ ID NO: 981072 - protein, 25 aa, Mycobacterium
LRENVVALTVLWLLNIGEYLQDLTL

SEQ ID NO: 981073 - protein, 18 aa, Mycobacterium
LRGATGVPWLLISGPLGS

SEQ ID NO: 981074 - protein, 19 aa, Mycobacterium
LRLGLNIPYLLLLLAFVVY

SEQ ID NO: 981075 - protein, 22 aa, Mycobacterium
LRNYVLPLGALLLLLVNATGVP

SEQ ID NO: 981076 - protein, 18 aa, Mycobacterium
LRPGWIALALVVIAFTYL

SEQ ID NO: 981077 - protein, 22 aa, Mycobacterium
LRPYWTPLFAYAAAFLIAAAHI

SEQ ID NO: 981078 - protein, 28 aa, Mycobacterium
LSGFAHSWFFLFLLVVAGLIAIYVVLQL

SEQ ID NO: 981079 - protein, 24 aa, Mycobacterium
LSLILLIMMFLTRSLVAALVIVGT

SEQ ID NO: 981080 - protein, 17 aa, Mycobacterium
LSLLWNYAMLWFGFVVP

SEQ ID NO: 981081 - protein, 18 aa, Mycobacterium
LSQWFLLTAAFGSLFMVA

SEQ ID NO: 981082 - protein, 19 aa, Mycobacterium
LSTPIWRLVLPITALGVAI

SEQ ID NO: 981083 - protein, 19 aa, Mycobacterium
LSVLLWQHIIGMPLHWLVI

SEQ ID NO: 981084 - protein, 20 aa, Mycobacterium
LTCWLPVFLGWPIMRWLTKS

SEQ ID NO: 981085 - protein, 20 aa, Mycobacterium
LTHVLYLNYVWGYSLLKAGF

SEQ ID NO: 981086 - protein, 17 aa, Mycobacterium
LTMLWQNLIGNAVKFRR

SEQ ID NO: 981087 - protein, 21 aa, Mycobacterium
LTVTLVWLYIEILRLLSYLQN

SEQ ID NO: 981088 - protein, 20 aa, Mycobacterium
LVAAWWLFGALWHPVRGRLA

SEQ ID NO: 981089 - protein, 18 aa, Mycobacterium
LVAYLYTVLMFAPVLIVL

SEQ ID NO: 981090 - protein, 20 aa, Mycobacterium
LVEYYYLKYYIPRARSRPVV

SEQ ID NO: 981091 - protein, 30 aa, Mycobacterium
LVIADRAYFAFLAILPFILGTLSLTVPGDT

SEQ ID NO: 981092 - protein, 24 aa, Mycobacterium
LVIAIMVAWRWAPAKVAPVPGPLV

SEQ ID NO: 981093 - protein, 18 aa, Mycobacterium
LVIVGWLTLWPFLSWLTT

SEQ ID NO: 981094 - protein, 23 aa, Mycobacterium
LVKALLVLGLWLAGWGAAVLVAR

SEQ ID NO: 981095 - protein, 20 aa, Mycobacterium
LVLNAGWSWLFFRFHRLGAS

SEQ ID NO: 981096 - protein, 27 aa, Mycobacterium
LVMIGFILGWPWWWISACSVLVLLVLE

SEQ ID NO: 981097 - protein, 19 aa, Mycobacterium
LVNFLIVAAWIAVAVIANL

SEQ ID NO: 981098 - protein, 25 aa, Mycobacterium
LVPFGEYFPLRWLVGWITQGTKAAA

SEQ ID NO: 981099 - protein, 21 aa, Mycobacterium
LVPLVWLLWVVIERGWYAVVQ

SEQ ID NO: 981100 - protein, 18 aa, Mycobacterium
LVSTLLVASAWWLFEWEV

SEQ ID NO: 981101 - protein, 30 aa, Mycobacterium; identical to SEQ ID NO: 319730

SEQ ID NO: 981102 - protein, 20 aa, Mycobacterium
LVVPVILASLLFAGGLVPLV

SEQ ID NO: 981103 - protein, 24 aa, Mycobacterium
LVVSLLMLWFATLVQTYLGLTGEV

SEQ ID NO: 981104 - protein, 24 aa, Mycobacterium
LWISLVVLWLFVLVPMLISKREAV

SEQ ID NO: 981105 - protein, 19 aa, Mycobacterium
LWQHLFWFFGHPEVYILAL

SEQ ID NO: 981106 - protein, 18 aa, Mycobacterium
LWSLYALFLGTAGEPGIR

SEQ ID NO: 981107 - protein, 17 aa, Mycobacterium
MANSMFIPRFLFALSFC

SEQ ID NO: 981108 - protein, 35 aa, Mycobacterium; identical to SEQ ID NO: 378532

SEQ ID NO: 981109 - protein, 25 aa, Mycobacterium
MFSQWNWWLPRWLGRILPSVDFDRP

SEQ ID NO: 981110 - protein, 17 aa, Mycobacterium
MGIPLLALAWLFGPRVM

SEQ ID NO: 981111 - protein, 17 aa, Mycobacterium
MIQPFWLLPLLAIAKLN

SEQ ID NO: 981112 - protein, 21 aa, Mycobacterium
MIRMLIIFGIVTVVALVAATT

SEQ ID NO: 981113 - protein, 28 aa, Mycobacterium
MISPQTLFFPFVLLLAATALFRGNDKKM

SEQ ID NO: 981114 - protein, 20 aa, Mycobacterium
MITMIPFGLLLGGLVAFIIF

SEQ ID NO: 981115 - protein, 18 aa, Mycobacterium
MLLLPLLIRMPDTPRWYV

SEQ ID NO: 981116 - protein, 18 aa, Mycobacterium
MLMMPLMMIVMMVGTLAG

SEQ ID NO: 981117 - protein, 26 aa, Mycobacterium
MLVDWASWRWVFLVNIPLGVVAVLAT

SEQ ID NO: 981118 - protein, 18 aa, Mycobacterium
MMFLVLLLAGFGWMISSR

SEQ ID NO: 981119 - protein, 25 aa, Mycobacterium
MQGDGPYILVGWSLGGVLAYACAIG

SEQ ID NO: 981120 - protein, 18 aa, Mycobacterium
MTIPARWSFPQAASIPVV

SEQ ID NO: 981121 - protein, 18 aa, Mycobacterium
MTLTSFVAVLLTGAGYWV

SEQ ID NO: 981122 - protein, 18 aa, Mycobacterium
MVLFVLSPALALLAVIWW

SEQ ID NO: 981123 - protein, 18 aa, Mycobacterium
MYLNVAVAVLGFLAYLAS

SEQ ID NO: 981124 - protein, 19 aa, Mycobacterium
NAFLAPWRLALVPVVSWTI

SEQ ID NO: 981125 - protein, 25 aa, Mycobacterium
NIDNWVRRLFALPAFPDGSADDVLQ

SEQ ID NO: 981126 - protein, 24 aa, Mycobacterium
NKILQFITYLLIPAGLLTIYTQLF

SEQ ID NO: 981127 - protein, 17 aa, Mycobacterium
NLLMRLVWFTPGAGLHR

SEQ ID NO: 981128 - protein, 17 aa, Mycobacterium
NLLTWLLGIPSSSSHAL

SEQ ID NO: 981129 - protein, 19 aa, Mycobacterium
NLPIILIVLLAVFGSLTAA

SEQ ID NO: 981130 - protein, 26 aa, Mycobacterium
NLVGWPTWALILSSPFLLPAALGLAL

SEQ ID NO: 981131 - protein, 18 aa, Mycobacterium
NRMAFLAALLFVMTLCFA

SEQ ID NO: 981132 - protein, 19 aa, Mycobacterium
NRMAFLAALLFVMTLCFAT

SEQ ID NO: 981133 - protein, 35 aa, Mycobacterium
NRRWWRYTAWFMLALLLATLWWLVALTQLRGVSPP

SEQ ID NO: 981134 - protein, 23 aa, Mycobacterium
NTRQLLLVNMLTDALPAAALAVS

SEQ ID NO: 981135 - protein, 22 aa, Mycobacterium
NTYSMDLFLRIAPELYLKRLCV

SEQ ID NO: 981136 - protein, 18 aa, Mycobacterium
NWKWVRRSAYLAAAVVIL

SEQ ID NO: 981137 - protein, 26 aa, Mycobacterium
NYLFPLYASLLTPIWLRILGAKVGRG

SEQ ID NO: 981138 - protein, 21 aa, Mycobacterium
PAFMHVMGRWNWWAPKPLVWL

SEQ ID NO: 981139 - protein, 29 aa, Mycobacterium
PANVSWIVWQLWLAVILVALWKGRRMGPL

SEQ ID NO: 981140 - protein, 24 aa, Mycobacterium
PARWRHWWWGLLLAFVPTHLVISA

SEQ ID NO: 981141 - protein, 22 aa, Mycobacterium
PAVWLNPWRWYSVPRAAAAALT

SEQ ID NO: 981142 - protein, 23 aa, Mycobacterium
PCVRALLTLLPGSLRWLVIVDAM

SEQ ID NO: 981143 - protein, 23 aa, Mycobacterium
PCVRALLTLLPGSLRWLVTVDAI

SEQ ID NO: 981144 - protein, 18 aa, Mycobacterium
PEDLPWEVPLIELGLDSL

SEQ ID NO: 981145 - protein, 18 aa, Mycobacterium
PEMWFLRKAHQLCPAGVV

SEQ ID NO: 981146 - protein, 19 aa, Mycobacterium
PFVLLGVGLLWFGWFGFNA

SEQ ID NO: 981147 - protein, 21 aa, Mycobacterium
PFVMLGAGLLWFGWYGFNAGS

SEQ ID NO: 981148 - protein, 22 aa, Mycobacterium
PGAAPRWPWVVGVAAILAAISL

SEQ ID NO: 981149 - protein, 17 aa, Mycobacterium
PGAPWWGAVLIAVSTTA

SEQ ID NO: 981150 - protein, 17 aa, Mycobacterium
PGLPLWLYLVCAAFTGL

SEQ ID NO: 981151 - protein, 17 aa, Mycobacterium
PGRWEWSPLYFKEISWV

SEQ ID NO: 981152 - protein, 23 aa, Mycobacterium
PGTPTWRRLLDDLSYEPLVSPLR

SEQ ID NO: 981153 - protein, 19 aa, Mycobacterium
PHYAWLLLTIYLAAALVTL

SEQ ID NO: 981154 - protein, 25 aa, Mycobacterium
PKTRIWAAPPLSYPTTRPPGISGGA

SEQ ID NO: 981155 - protein, 17 aa, Mycobacterium
PLFAYAAAFLIAAAHIT

SEQ ID NO: 981156 - protein, 20 aa, Mycobacterium
PLLLAMVLGGLRIHGGMANS

SEQ ID NO: 981157 - protein, 19 aa, Mycobacterium
PLLRLVPLAMSIATLIAMA

SEQ ID NO: 981158 - protein, 22 aa, Mycobacterium
PLSFLVLVWVFGGLLAAALPMA

SEQ ID NO: 981159 - protein, 19 aa, Mycobacterium
PLVALAIIAIVGVVLGAAA

SEQ ID NO: 981160 - protein, 28 aa, Mycobacterium
PNRSWARYLRRGAMPLLLAGALALSAFL

SEQ ID NO: 981161 - protein, 18 aa, Mycobacterium
PPMGSILYWLRPGTIRLP

SEQ ID NO: 981162 - protein, 26 aa, Mycobacterium
PPPEGPKTPRWLWIAAGAAVVLVIGL

SEQ ID NO: 981163 - protein, 21 aa, Mycobacterium
PPWEFYFWHHTIPAPVWVALI

SEQ ID NO: 981164 - protein, 26 aa, Mycobacterium
PQYRSLWVFLLLPVLILLTVSGRWLY

SEQ ID NO: 981165 - protein, 20 aa, Mycobacterium
PRAKLFAALFLILGLVVVGE

SEQ ID NO: 981166 - protein, 17 aa, Mycobacterium
PVFLGWPIMRWLTKSEM

SEQ ID NO: 981167 - protein, 24 aa, Mycobacterium
PVGLAIIVLLIALGIPFLNIKWGY

SEQ ID NO: 981168 - protein, 18 aa, Mycobacterium
PVKASARFGLYYTPSSAL

SEQ ID NO: 981169 - protein, 18 aa, Mycobacterium
PVQFIAGWPFLVGAVQQA

SEQ ID NO: 981170 - protein, 17 aa, Mycobacterium
PVRLLPIDLAPDAVGNL

SEQ ID NO: 981171 - protein, 17 aa, Mycobacterium
PVSIILVVLVMISGGIA

SEQ ID NO: 981172 - protein, 17 aa, Mycobacterium
PVSWIMWVWYKLFALVL

SEQ ID NO: 981173 - protein, 22 aa, Mycobacterium
PVVFLTAFYGLSVLAGLKAGER

SEQ ID NO: 981174 - protein, 23 aa, Mycobacterium
PVVTWAAWPFHRIALRNARHHGA

SEQ ID NO: 981175 - protein, 23 aa, Mycobacterium
QAADWLGYFMLLASFILGATVGG

SEQ ID NO: 981176 - protein, 23 aa, Mycobacterium
QAQGGAPLWVGYLGAAAEAGMVG

SEQ ID NO: 981177 - protein, 24 aa, Mycobacterium
QCGEGWWTSVWFLAFWITGTSMLM

SEQ ID NO: 981178 - protein, 31 aa, Mycobacterium; identical to SEQ ID NO: 379029

SEQ ID NO: 981179 - protein, 18 aa, Mycobacterium
QIIIGYFVGFLAAAPVLT

SEQ ID NO: 981180 - protein, 21 aa, Mycobacterium
QIPLPVILIVSTTVVFGALSH

SEQ ID NO: 981181 - protein, 19 aa, Mycobacterium
QLLVLLIIGGALMGCAASI

SEQ ID NO: 981182 - protein, 24 aa, Mycobacterium
QMLLVTCLPMRCRRRRWPSVPNPA

SEQ ID NO: 981183 - protein, 18 aa, Mycobacterium
QPAQLLVLLIIGGALMGC

SEQ ID NO: 981184 - protein, 17 aa, Mycobacterium
QPGAALAALAALAAKAG

SEQ ID NO: 981185 - protein, 18 aa, Mycobacterium
QRFWFWLSVATLTLNIVL

SEQ ID NO: 981186 - protein, 24 aa, Mycobacterium
QRNWGWVLAIVVIVLALAAIAILG

SEQ ID NO: 981187 - protein, 22 aa, Mycobacterium
QVQLVLMYLYITLRGAIAMVTL

SEQ ID NO: 981188 - protein, 19 aa, Mycobacterium
QVWLRPRSWLLRRTTTEAT

SEQ ID NO: 981189 - protein, 23 aa, Mycobacterium
RALYVILGWRRVLLIPLTFALFT

SEQ ID NO: 981190 - protein, 20 aa, Mycobacterium
RAMFWTVLIYVLVATIISFV

SEQ ID NO: 981191 - protein, 23 aa, Mycobacterium
RARVPMPIIPVSSLLRSHAVTLS

SEQ ID NO: 981192 - protein, 23 aa, Mycobacterium
RDLVRPFRMPLWPLPPVLAVVGV

SEQ ID NO: 981193 - protein, 22 aa, Mycobacterium
RDRLALWSRVLPITFTAIGWVA

SEQ ID NO: 981194 - protein, 25 aa, Mycobacterium
RDTYDAMFDLWFPAALGARAVITEE

SEQ ID NO: 981195 - protein, 18 aa, Mycobacterium
RFPLVVAPRYIPGEPLAD

SEQ ID NO: 981196 - protein, 23 aa, Mycobacterium
RFVLVPIFLYLLFYDGGHQTTFR

SEQ ID NO: 981197 - protein, 17 aa, Mycobacterium
RFYVVFFLALLFVTWHC

SEQ ID NO: 981198 - protein, 17 aa, Mycobacterium
RHVDVFQFFYLVLPLFC

SEQ ID NO: 981199 - protein, 22 aa, Mycobacterium
RITSLVEDLLLLARLDSGRPLE

SEQ ID NO: 981200 - protein, 18 aa, Mycobacterium
RLGIFSLVLMLFSVMIII

SEQ ID NO: 981201 - protein, 19 aa, Mycobacterium
RLLGKMSGLPLGWFTGRGS

SEQ ID NO: 981202 - protein, 21 aa, Mycobacterium
RLRDRSWWSGPGIYLMVDDYD

SEQ ID NO: 981203 - protein, 21 aa, Mycobacterium
RLRVAAFRTLLLSLPPRVLDA

SEQ ID NO: 981204 - protein, 19 aa, Mycobacterium
RLWACISWRRFCKRCGLSA

SEQ ID NO: 981205 - protein, 25 aa, Mycobacterium
RNPRPAIIVVILLVVLTGVVWTVAL

SEQ ID NO: 981206 - protein, 18 aa, Mycobacterium
RNRPGWEWLKWLPHNQHP

SEQ ID NO: 981207 - protein, 17 aa, Mycobacterium
RPAWIGWWVALGLAAAI

SEQ ID NO: 981208 - protein, 23 aa, Mycobacterium
RPSTFLWLIAVTGTLLVINHRMD

SEQ ID NO: 981209 - protein, 25 aa, Mycobacterium
RQFHHPLIYVLLVAGAITAGLQEYI

SEQ ID NO: 981210 - protein, 27 aa, Mycobacterium
RQVTLLRNFLLPLGALLLFLVKASQVP

SEQ ID NO: 981211 - protein, 25 aa, Mycobacterium
RRDRPWLWLLYALVLMVSILININL

SEQ ID NO: 981212 - protein, 18 aa, Mycobacterium
RRFAVLVLLLCLFGSLVV

SEQ ID NO: 981213 - protein, 22 aa, Mycobacterium
RRFRWLVFTGWMLALVPAIYLA

SEQ ID NO: 981214 - protein, 24 aa, Mycobacterium
RRLRWWPVIAYGLLPALALLLAGG

SEQ ID NO: 981215 - protein, 32 aa, Mycobacterium
RRQVRVFLASRLYFVFLTLLPFALDALTLLIP

SEQ ID NO: 981216 - protein, 21 aa, Mycobacterium
RRSELAPLDRVFAAALAKQPN

SEQ ID NO: 981217 - protein, 23 aa, Mycobacterium
RRVHFDLDPLLPFPRWHEHAAVV

SEQ ID NO: 981218 - protein, 27 aa, Mycobacterium
RSGSGWIWWFGGAWLVAAVVGAGVILF

SEQ ID NO: 981219 - protein, 19 aa, Mycobacterium
RSRRGLLRRPKLSTLTAAL

SEQ ID NO: 981220 - protein, 18 aa, Mycobacterium
RTSPPWAFFSLPTRAWEL

SEQ ID NO: 981221 - protein, 22 aa, Mycobacterium
RTTTLTLIYPTLSLPSWSAGSR

SEQ ID NO: 981222 - protein, 24 aa, Mycobacterium
RVALVLLIPVLMYLVMTSSLAVQS

SEQ ID NO: 981223 - protein, 23 aa, Mycobacterium
RVANLELYLIFPLANEQATITLV

SEQ ID NO: 981224 - protein, 17 aa, Mycobacterium
RVHVHVPYWLPSQIGPA

SEQ ID NO: 981225 - protein, 17 aa, Mycobacterium
RWFGWFALLTIPAPFLA

SEQ ID NO: 981226 - protein, 17 aa, Mycobacterium
RWILPLYLFLATLACYA

SEQ ID NO: 981227 - protein, 31 aa, Mycobacterium; identical to SEQ ID NO: 379409

SEQ ID NO: 981228 - protein, 21 aa, Mycobacterium
RWVGVPLYLLLGWVAVWYTAT

SEQ ID NO: 981229 - protein, 17 aa, Mycobacterium
RYSVYVWALLAMVAARM

SEQ ID NO: 981230 - protein, 23 aa, Mycobacterium
SAFTLIPYALVLLGLRVFYAREQ

SEQ ID NO: 981231 - protein, 22 aa, Mycobacterium
SALPFAIWFFLAVEGVPLAAEE

SEQ ID NO: 981232 - protein, 18 aa, Mycobacterium
SATRWLGCLLACALAGAV

SEQ ID NO: 981233 - protein, 23 aa, Mycobacterium
SATTFPWVFLFPAGVLVLILVCA

SEQ ID NO: 981234 - protein, 23 aa, Mycobacterium
SATTFPWVFLFPAGVLVVILVCA

SEQ ID NO: 981235 - protein, 24 aa, Mycobacterium
SGAVAWIIALFYKSIYVGGLINEV

SEQ ID NO: 981236 - protein, 25 aa, Mycobacterium
SGGVSLWWMIGLLAAAGVLGLMVVL

SEQ ID NO: 981237 - protein, 27 aa, Mycobacterium
SGLTMFFGAYPWAGWLAFAATIPVQFI

SEQ ID NO: 981238 - protein, 23 aa, Mycobacterium
SIFPIFMMVGIMMMMFRSVGAGG

SEQ ID NO: 981239 - protein, 22 aa, Mycobacterium
SIPLTVLLIFTLNVLLAQFGAA

SEQ ID NO: 981240 - protein, 30 aa, Mycobacterium
SIPQSLLWISLVVLWLFVLVPMLISKRDVV

SEQ ID NO: 981241 - protein, 23 aa, Mycobacterium
SLCLIFIIMLILTRAFVAAAVIV

SEQ ID NO: 981242 - protein, 20 aa, Mycobacterium
SLLPVLVLLVLWRARRRGPD

SEQ ID NO: 981243 - protein, 20 aa, Mycobacterium
SLLRLPRLPDLVAVPPTLID

SEQ ID NO: 981244 - protein, 24 aa, Mycobacterium
SLNTPYYRLMLKLKGGPEAVADAA

SEQ ID NO: 981245 - protein, 17 aa, Mycobacterium
SPPPPRWVWPPLIAVGG

SEQ ID NO: 981246 - protein, 23 aa, Mycobacterium
SQAVLPALLWTPVATLAATAVYV

SEQ ID NO: 981247 - protein, 17 aa, Mycobacterium
SRLNRLLALQIPPARKV

SEQ ID NO: 981248 - protein, 26 aa, Mycobacterium
SRPQRLFYLLIHLLDPLISLESLYRY

SEQ ID NO: 981249 - protein, 27 aa, Mycobacterium
SRRDPLSIFLILVIVFSLVLAGVIASE

SEQ ID NO: 981250 - protein, 22 aa, Mycobacterium
SRRWWAWMLLAGPGWVIFGAAK

SEQ ID NO: 981251 - protein, 25 aa, Mycobacterium
SSFWFTAIYVLLFVSLVGCLTPRMI

SEQ ID NO: 981252 - protein, 23 aa, Mycobacterium
SSWRLVFLVNIPLGIVAVLVAGR

SEQ ID NO: 981253 - protein, 23 aa, Mycobacterium
SSYGWLVWVFVAMFGVGLIDLVL

SEQ ID NO: 981254 - protein, 19 aa, Mycobacterium
STPRWPWVVGVAAIMAAIA

SEQ ID NO: 981255 - protein, 22 aa, Mycobacterium
STTAWLFDMAMLAALSVVYSAV

SEQ ID NO: 981256 - protein, 25 aa, Mycobacterium
STTQRDWLRRINWKWVRRSAYLAAA

SEQ ID NO: 981257 - protein, 23 aa, Mycobacterium
SVGPWLPLVFLLVHIVVTVPPFP

SEQ ID NO: 981258 - protein, 24 aa, Mycobacterium
SVLVQMMWAMRGIGIWSDVRGTNM

SEQ ID NO: 981259 - protein, 32 aa, Mycobacterium
SVLVWEYLFGIKLYWVVLALAVILLLAVGSDY

SEQ ID NO: 981260 - protein, 20 aa, Mycobacterium
SWAPWIWIMLLSGVVFMALF

SEQ ID NO: 981261 - protein, 20 aa, Mycobacterium
SWFPMWFSYLLLIAVYPAFL

SEQ ID NO: 981262 - protein, 18 aa, Mycobacterium
SWMMPKMISPIRTAINTP

SEQ ID NO: 981263 - protein, 21 aa, Mycobacterium
TAAGMFLAVWLPLNNGLRPEP

SEQ ID NO: 981264 - protein, 24 aa, Mycobacterium
TAALLILLMFLWSAAYSSLFYLVA

SEQ ID NO: 981265 - protein, 23 aa, Mycobacterium
TAAQLLYLRVPALNALFPDYRGS

SEQ ID NO: 981266 - protein, 23 aa, Mycobacterium
TAFAFAPWYFFIARFFTGSGIGG

SEQ ID NO: 981267 - protein, 21 aa, Mycobacterium
TAREWMWAILLAGAVAVIVTA

SEQ ID NO: 981268 - protein, 28 aa, Mycobacterium
TDKPVWITMLWPLADRPRLAPGVPGGTI

SEQ ID NO: 981269 - protein, 24 aa, Mycobacterium
TDPNPPLPAWLTPSPRVPGTGDPD

SEQ ID NO: 981270 - protein, 23 aa, Mycobacterium
TDRIFLDQLSWLTPARWGYAASA

SEQ ID NO: 981271 - protein, 20 aa, Mycobacterium
TFLIFPILGLAIRALVRSWM

SEQ ID NO: 981272 - protein, 20 aa, Mycobacterium
TFLYELIWNLLVFAALIYLD

SEQ ID NO: 981273 - protein, 24 aa, Mycobacterium
TGVLIVGFIWMLRSAPRRVLASAL

SEQ ID NO: 981274 - protein, 22 aa, Mycobacterium
TGWALLVMILIALIVYGIIELI

SEQ ID NO: 981275 - protein, 18 aa, Mycobacterium
THTFALPQWRDAFLAIAN

SEQ ID NO: 981276 - protein, 19 aa, Mycobacterium
TIPIELPFTGLADPHGLAF

SEQ ID NO: 981277 - protein, 17 aa, Mycobacterium
TIVLLAGLLWLVWMDRN

SEQ ID NO: 981278 - protein, 26 aa, Mycobacterium
TKFTLVMTLPWLLAIAAVYVILCWFF

SEQ ID NO: 981279 - protein, 19 aa, Mycobacterium
TLAAFLWSLYALFLGTAGE

SEQ ID NO: 981280 - protein, 17 aa, Mycobacterium
TLALALALYLIASLLIW

SEQ ID NO: 981281 - protein, 24 aa, Mycobacterium
TLAVPIILFWLAVVVLLSVFVPSL

SEQ ID NO: 981282 - protein, 19 aa, Mycobacterium
TLGFLLMPLATRALSFWLN

SEQ ID NO: 981283 - protein, 23 aa, Mycobacterium
TLGWQWIFFVNIPVGIVGLVLAV

SEQ ID NO: 981284 - protein, 23 aa, Mycobacterium
TLLAAIITLWLGLVAHFGEMANG

SEQ ID NO: 981285 - protein, 17 aa, Mycobacterium
TLLGRWFWWPQVVHPRG

SEQ ID NO: 981286 - protein, 17 aa, Mycobacterium
TLLWLVPLAASVLTILL

SEQ ID NO: 981287 - protein, 17 aa, Mycobacterium
TLVLWMLPLLIAPPMYS

SEQ ID NO: 981288 - protein, 23 aa, Mycobacterium
TNLFWAFGYNVAALPLAAFGLLN

SEQ ID NO: 981289 - protein, 18 aa, Mycobacterium
TNRFLLDQLSWLTPARWG

SEQ ID NO: 981290 - protein, 23 aa, Mycobacterium
TNRTLFEVLLYGALLALLVVALV

SEQ ID NO: 981291 - protein, 23 aa, Mycobacterium
TPEFPWTGLTISLLIGVLAAAVG

SEQ ID NO: 981292 - protein, 20 aa, Mycobacterium
TPFRLDHVVNFLATLGLWVA

SEQ ID NO: 981293 - protein, 19 aa, Mycobacterium
TPPPSLFRVAGHRGLRGWQ

SEQ ID NO: 981294 - protein, 25 aa, Mycobacterium
TPSLQRRVILLVVALLAVLLVVLGV

SEQ ID NO: 981295 - protein, 23 aa, Mycobacterium
TQIPLPVILIVSTTVVFGALSHR

SEQ ID NO: 981296 - protein, 22 aa, Mycobacterium
TRVLWITVLIWSVAMALGGISA

SEQ ID NO: 981297 - protein, 27 aa, Mycobacterium
TSATRLYLPMPFFWVGGFGGGILSALF

SEQ ID NO: 981298 - protein, 22 aa, Mycobacterium
TTALLIMVFGYMRVPAMVGIGQ

SEQ ID NO: 981299 - protein, 27 aa, Mycobacterium
TTEWLHVPLLPIPIPIRVPASQAPPSP

SEQ ID NO: 981300 - protein, 23 aa, Mycobacterium
TTTTLLMFLAFGSVVLPIKAAVM

SEQ ID NO: 981301 - protein, 23 aa, Mycobacterium
TTVVSWLPLFHDMGLILGICAPL

SEQ ID NO: 981302 - protein, 21 aa, Mycobacterium
TVFAWLLAVFAVRPFKQLAEQ

SEQ ID NO: 981303 - protein, 22 aa, Mycobacterium
TVFGFLVLVLLLSALNATVFAS

SEQ ID NO: 981304 - protein, 21 aa, Mycobacterium
TVFGLLLLAPPIRAAARPGLT

SEQ ID NO: 981305 - protein, 25 aa, Mycobacterium
TVLSIWQAVLVRRLVRAAVPATVVP

SEQ ID NO: 981306 - protein, 24 aa, Mycobacterium
TVNRYLGLFWAFVGVMLALGGALA

SEQ ID NO: 981307 - protein, 30 aa, Mycobacterium
TVPAIMGLLGRWFWWSPPPFLRASLAGPRR

SEQ ID NO: 981308 - protein, 20 aa, Mycobacterium
TYSLMTFWITTMLALLYGLL

SEQ ID NO: 981309 - protein, 23 aa, Mycobacterium
VAAVVLGVLIWIGHRDEISERVY

SEQ ID NO: 981310 - protein, 25 aa, Mycobacterium
VAHFLPPVLRRLSIFVPPSPSVAES

SEQ ID NO: 981311 - protein, 23 aa, Mycobacterium
VAILWFGGWLIPLLAIWAYWQVF

SEQ ID NO: 981312 - protein, 18 aa, Mycobacterium
VALFAALQRWGLQPDFVM

SEQ ID NO: 981313 - protein, 17 aa, Mycobacterium
VALLWFLGVYLVVLAFV

SEQ ID NO: 981314 - protein, 18 aa, Mycobacterium
VAMFLFAASFFGAGLLFP

SEQ ID NO: 981315 - protein, 27 aa, Mycobacterium
VARLWRWLLVFFSRWWQIETLYRSNQK

SEQ ID NO: 981316 - protein, 17 aa, Mycobacterium
VASLVLVAERRAINQFG

SEQ ID NO: 981317 - protein, 24 aa, Mycobacterium
VAVAIFWIVMRYRASRRRTNALAA

SEQ ID NO: 981318 - protein, 18 aa, Mycobacterium
VAVPPLVPIVVPPVRVPS

SEQ ID NO: 981319 - protein, 22 aa, Mycobacterium
VAYRAWRWWLATAVAFFAVAAL

SEQ ID NO: 981320 - protein, 20 aa, Mycobacterium
VFFVVRFLVLAPLSWLVPPL

SEQ ID NO: 981321 - protein, 18 aa, Mycobacterium
VFLACRWVQAQGGAPLWV

SEQ ID NO: 981322 - protein, 19 aa, Mycobacterium
VFQFFYLVLPLFCGAFEGA

SEQ ID NO: 981323 - protein, 23 aa, Mycobacterium
VGACIGFLWWNAAPAKVFMGDTG

SEQ ID NO: 981324 - protein, 17 aa, Mycobacterium
VGLLLLLVARPLSVVLS

SEQ ID NO: 981325 - protein, 21 aa, Mycobacterium
VGLSLFYWWFHTIDKTLPVFV

SEQ ID NO: 981326 - protein, 23 aa, Mycobacterium
VGPIFLIVYFALDVGSLLSWMLY

SEQ ID NO: 981327 - protein, 24 aa, Mycobacterium
VGTPAMWWLAVPVLLYAAWRMFVR

SEQ ID NO: 981328 - protein, 20 aa, Mycobacterium
VGVIVWGLIFWSATFHRKKK

SEQ ID NO: 981329 - protein, 27 aa, Mycobacterium
VHRPRWSWRRMALVAELVVLLVVAGLF

SEQ ID NO: 981330 - protein, 27 aa, Mycobacterium
VIFIMLLLVYRSPLTVVLLLLTVGAEF

SEQ ID NO: 981331 - protein, 18 aa, Mycobacterium
VIGMILLVIPLGNLSFGG

SEQ ID NO: 981332 - protein, 19 aa, Mycobacterium
VIIKFVMGIPLLALAWLFG

SEQ ID NO: 981333 - protein, 26 aa, Mycobacterium
VKVAALLIVFGFAGLSAYFVWNHGQV

SEQ ID NO: 981334 - protein, 21 aa, Mycobacterium
VLAFVALIAFVMLLISIHSVL

SEQ ID NO: 981335 - protein, 21 aa, Mycobacterium
VLALRRVWWLYKLIMSGQPAS

SEQ ID NO: 981336 - protein, 20 aa, Mycobacterium
VLGMILLVIPLFNLSLGGMS

SEQ ID NO: 981337 - protein, 17 aa, Mycobacterium
VLLFLLTGSVVLPAKAL

SEQ ID NO: 981338 - protein, 19 aa, Mycobacterium
VLLLFLPAILYWESLNTSF

SEQ ID NO: 981339 - protein, 24 aa, Mycobacterium
VLLSPMSFLRRPARWMQLLASHPK

SEQ ID NO: 981340 - protein, 17 aa, Mycobacterium
VLLVLWRARRRGPDDPP

SEQ ID NO: 981341 - protein, 23 aa, Mycobacterium
VLQAYLNIIYFGRGAYGISAASK

SEQ ID NO: 981342 - protein, 28 aa, Mycobacterium
VLSPALALLAVIWWLAGAGWAIAAALAV

SEQ ID NO: 981343 - protein, 18 aa, Mycobacterium
VMSAGWVAVLFALAHWHV

SEQ ID NO: 981344 - protein, 20 aa, Mycobacterium
VMVGFLFLYPAFVAKAHDAN

SEQ ID NO: 981345 - protein, 19 aa, Mycobacterium
VPALPGPPPLIPPGGHQGP

SEQ ID NO: 981346 - protein, 31 aa, Mycobacterium; identical to SEQ ID NO: 346636

SEQ ID NO: 981347 - protein, 17 aa, Mycobacterium
VPIVVPPVRVPSGVDTF

SEQ ID NO: 981348 - protein, 19 aa, Mycobacterium
VPVVFLTALFGLQDLAKIQ

SEQ ID NO: 981349 - protein, 17 aa, Mycobacterium
VRPPPRRPAHRKLVGWL

SEQ ID NO: 981350 - protein, 18 aa, Mycobacterium
VRVMFLMALVFLALGWST

SEQ ID NO: 981351 - protein, 17 aa, Mycobacterium
VSLIGWWALSRLLERMR

SEQ ID NO: 981352 - protein, 25 aa, Mycobacterium
VSMGIILLGLLWYAGLPLRVFMSSF

SEQ ID NO: 981353 - protein, 25 aa, Mycobacterium
VSTYGWRAYALPVLMVLTVVVGYQT

SEQ ID NO: 981354 - protein, 19 aa, Mycobacterium
VSVPILALANYWIMTHMLP

SEQ ID NO: 981355 - protein, 23 aa, Mycobacterium
VTIAAPAYWSGAQLGALRGALLT

SEQ ID NO: 981356 - protein, 24 aa, Mycobacterium
VTLSWLLIIYGFTASVLPVWLLLA

SEQ ID NO: 981357 - protein, 28 aa, Mycobacterium
VTPVLWWIGPFLLYLLLPALDVFFGPDG

SEQ ID NO: 981358 - protein, 27 aa, Mycobacterium
VTVAFLFWEFFIPLLLSLLQGLLGLIG

SEQ ID NO: 981359 - protein, 18 aa, Mycobacterium
VVALLLILTYRSSVLWLL

SEQ ID NO: 981360 - protein, 33 aa, Mycobacterium
VVAVLSMMVWISPLLALITLLTVPLSLLVTRAI

SEQ ID NO: 981361 - protein, 20 aa, Mycobacterium
VVFLVTWPLVYLASKSPRLA

SEQ ID NO: 981362 - protein, 19 aa, Mycobacterium
VVGAFVYGWFRPAGTIDAS

SEQ ID NO: 981363 - protein, 23 aa, Mycobacterium
VVIALVTLLIWWTSDARATVSRP

SEQ ID NO: 981364 - protein, 17 aa, Mycobacterium
VVIWLSLYRWDLLGPLR

SEQ ID NO: 981365 - protein, 17 aa, Mycobacterium
VVPLLLAMVLGGLRIHG

SEQ ID NO: 981366 - protein, 25 aa, Mycobacterium
VVSLGLWVIFLPSVVRRRLPEKWAA

SEQ ID NO: 981367 - protein, 22 aa, Mycobacterium
VVVLGWSFFYFSDDTRGYKPVD

SEQ ID NO: 981368 - protein, 18 aa, Mycobacterium
VYEPLLNRLPADTPMYGF

SEQ ID NO: 981369 - protein, 23 aa, Mycobacterium
WARLTTVFVIDLLILIVASHCPD

SEQ ID NO: 981370 - protein, 22 aa, Mycobacterium
WEFYMALAYFKLAIIAAGIDFR

SEQ ID NO: 981371 - protein, 17 aa, Mycobacterium
WEWIFFVNIPIGLAGLV

SEQ ID NO: 981372 - protein, 18 aa, Mycobacterium
WFALLLQITGAIAVVQVI

SEQ ID NO: 981373 - protein, 21 aa, Mycobacterium
WGEQISLLVFMIFASKGAAGV

SEQ ID NO: 981374 - protein, 19 aa, Mycobacterium
WLHAAVWWKALLALVVAVA

SEQ ID NO: 981375 - protein, 17 aa, Mycobacterium
WLWFAFFCIATVFWTYR

SEQ ID NO: 981376 - protein, 18 aa, Mycobacterium
WMAIMFFAGFLILYSLGV

SEQ ID NO: 981377 - protein, 18 aa, Mycobacterium
WMSMYQAKWWWLLAAMVA

SEQ ID NO: 981378 - protein, 18 aa, Mycobacterium
WNYAMLWFGFVVPPALQI

SEQ ID NO: 981379 - protein, 17 aa, Mycobacterium
WPGLPPAPPPGAPRESG

SEQ ID NO: 981380 - protein, 17 aa, Mycobacterium
WQWIFLINLPIGALTLI

SEQ ID NO: 981381 - protein, 17 aa, Mycobacterium
WRWAFWINLPVSAVVIC

SEQ ID NO: 981382 - protein, 20 aa, Mycobacterium
WVYFAYLLFTANLAVKVRWP

SEQ ID NO: 981383 - protein, 17 aa, Mycobacterium
WWALSRLLERMRGIPDV

SEQ ID NO: 981384 - protein, 17 aa, Mycobacterium
YAGWWAFDIGMLVTFGV

SEQ ID NO: 981385 - protein, 19 aa, Mycobacterium
YDEYPVLPPIGLQAPVPIQ

SEQ ID NO: 981386 - protein, 30 aa, Mycobacterium; identical to SEQ ID NO: 380537

SEQ ID NO: 981387 - protein, 19 aa, Mycobacterium
YHIVKPWRWGYLAVLLVIF

SEQ ID NO: 981388 - protein, 21 aa, Mycobacterium
YILAFSLFIYGLMGLTEPKTA

SEQ ID NO: 981389 - protein, 19 aa, Mycobacterium
YIRPYRRLVAALMALQLIS

SEQ ID NO: 981390 - protein, 17 aa, Mycobacterium
YLQLLVKALLLRGLREL

SEQ ID NO: 981391 - protein, 20 aa, Mycobacterium
YNFFDIFTYAWDSIALLGMD

SEQ ID NO: 981392 - protein, 17 aa, Mycobacterium
YPFVIVGLLLMVFLPKL

SEQ ID NO: 981393 - protein, 19 aa, Mycobacterium
YPYREPLPAPPPGGPPPGP

SEQ ID NO: 981394 - protein, 21 aa, Mycobacterium
YRHIPAMLLALSLVLFTVAMA

SEQ ID NO: 981395 - protein, 18 aa, Mycobacterium
YTVFLALLPFLIGTLTLT

SEQ ID NO: 981396 - protein, 18 aa, Mycobacterium
YVDWLWFGELGYLSVFTT

SEQ ID NO: 981397 - protein, 20 aa, Mycobacterium
YVGSLFLLGLLLPYTDYKAG

SEQ ID NO: 981398 - protein, 23 aa, Mycobacterium
YVLTHVLYLNYVWHYSLLKAGFA

SEQ ID NO: 981399 - protein, 7 aa, Mycobacterium
GQVGPRP

SEQ ID NO: 981400 - protein, 6 aa, Mycobacterium
KGLPDS

SEQ ID NO: 981401 - protein, 6 aa, Mycobacterium
AAAAEA

SEQ ID NO: 981402 - protein, 9 aa, Mycobacterium
LDPTGTGQK

SEQ ID NO: 981403 - protein, 6 aa, Mycobacterium
HFPTEQ

SEQ ID NO: 981404 - protein, 12 aa, Mycobacterium
REAGVGLTGPGG

SEQ ID NO: 981405 - protein, 4 aa, Mycobacterium
QRRL

SEQ ID NO: 981406 - protein, 5 aa, Mycobacterium
LTTGE

SEQ ID NO: 981407 - protein, 8 aa, Mycobacterium
GEGDGESA

SEQ ID NO: 981408 - protein, 8 aa, Mycobacterium
VPSSRDVD

SEQ ID NO: 981409 - protein, 7 aa, Mycobacterium
SKDTVSR

SEQ ID NO: 981410 - protein, 10 aa, Mycobacterium
SQNHEDEAGA

SEQ ID NO: 981411 - protein, 20 aa, Mycobacterium
HDRAGYGSGNSRNGTRSKTV

SEQ ID NO: 981412 - protein, 9 aa, Mycobacterium
PRDRAGTFE

SEQ ID NO: 981413 - protein, 4 aa, Mycobacterium
ADNI

SEQ ID NO: 981414 - protein, 7 aa, Mycobacterium
LSRPARK

SEQ ID NO: 981415 - protein, 8 aa, Mycobacterium
DPAVGGTY

SEQ ID NO: 981416 - protein, 5 aa, Mycobacterium
QAQPT

SEQ ID NO: 981417 - protein, 8 aa, Mycobacterium
RDRAGTFE

SEQ ID NO: 981418 - protein, 6 aa, Mycobacterium
SKDTVS

SEQ ID NO: 981419 - protein, 6 aa, Mycobacterium
ATDQRS

SEQ ID NO: 981420 - protein, 19 aa, Mycobacterium
AGDGGEEDFGYVSAMSSLS

SEQ ID NO: 981421 - protein, 11 aa, Mycobacterium
ANRKSQRNPGA

SEQ ID NO: 981422 - protein, 17 aa, Mycobacterium
HPHPTSPPQHHPNQTSK

SEQ ID NO: 981423 - protein, 7 aa, Mycobacterium
RARRSVK

SEQ ID NO: 981424 - protein, 10 aa, Mycobacterium
SQNHEDGAGA

SEQ ID NO: 981425 - protein, 13 aa, Mycobacterium
DEDRQRPHTGNGA

SEQ ID NO: 981426 - protein, 5 aa, Mycobacterium
GISGT

SEQ ID NO: 981427 - protein, 9 aa, Mycobacterium
HRAHTGNGA

SEQ ID NO: 981428 - protein, 20 aa, Mycobacterium
HDRAGYGNGNSRNGTRSKTV

SEQ ID NO: 981429 - protein, 12 aa, Mycobacterium
DEDRQRPHTGHG

SEQ ID NO: 981430 - protein, 15 aa, Mycobacterium
PAAATDDSRGHGRVK

SEQ ID NO: 981431 - protein, 4 aa, Mycobacterium
ADPA

SEQ ID NO: 981432 - protein, 5 aa, Mycobacterium
AKATA

SEQ ID NO: 981433 - protein, 4 aa, Mycobacterium
ASGV

SEQ ID NO: 981434 - protein, 14 aa, Mycobacterium
EAHGTGTTLGDPIE

SEQ ID NO: 981435 - protein, 5 aa, Mycobacterium
PADRG

SEQ ID NO: 981436 - protein, 8 aa, Mycobacterium
RGLAPDGR

SEQ ID NO: 981437 - protein, 20 aa, Mycobacterium
AINQDGASNGLTAPHGPSQQ

SEQ ID NO: 981438 - protein, 12 aa, Mycobacterium
DPDPDAVGKTYT

SEQ ID NO: 981439 - protein, 7 aa, Mycobacterium
EARRNNH

SEQ ID NO: 981440 - protein, 6 aa, Mycobacterium
EKSNEI

SEQ ID NO: 981441 - protein, 4 aa, Mycobacterium
GRGG

SEQ ID NO: 981442 - protein, 6 aa, Mycobacterium
GRTEEP

SEQ ID NO: 981443 - protein, 5 aa, Mycobacterium
GVASA

SEQ ID NO: 981444 - protein, 6 aa, Mycobacterium
HHTPDQ

SEQ ID NO: 981445 - protein, 12 aa, Mycobacterium
NIGHTQAAAGAA

SEQ ID NO: 981446 - protein, 9 aa, Mycobacterium
NTDHPRTAA

SEQ ID NO: 981447 - protein, 15 aa, Mycobacterium
PAAATDDSRGHGRVE

SEQ ID NO: 981448 - protein, 10 aa, Mycobacterium
PREARAMDPQ

SEQ ID NO: 981449 - protein, 6 aa, Mycobacterium
QPSPHI

SEQ ID NO: 981450 - protein, 4 aa, Mycobacterium
AAGA

SEQ ID NO: 981451 - protein, 7 aa, Mycobacterium
AQNEHPG

SEQ ID NO: 981452 - protein, 6 aa, Mycobacterium
AQTTDH

SEQ ID NO: 981453 - protein, 5 aa, Mycobacterium
ARDNT

SEQ ID NO: 981454 - protein, 6 aa, Mycobacterium
ATGQPV

SEQ ID NO: 981455 - protein, 13 aa, Mycobacterium
DEDRQRPHTRNGA

SEQ ID NO: 981456 - protein, 9 aa, Mycobacterium
DLHTSTTEA

SEQ ID NO: 981457 - protein, 8 aa, Mycobacterium
DTDDMGRQ

SEQ ID NO: 981458 - protein, 14 aa, Mycobacterium
DTVEQAGGGGAAVP

SEQ ID NO: 981459 - protein, 6 aa, Mycobacterium
EPTQQL

SEQ ID NO: 981460 - protein, 6 aa, Mycobacterium
GADEVS

SEQ ID NO: 981461 - protein, 8 aa, Mycobacterium
GDFSGANT

SEQ ID NO: 981462 - protein, 4 aa, Mycobacterium
GGLG

SEQ ID NO: 981463 - protein, 6 aa, Mycobacterium
GGTGTL

SEQ ID NO: 981464 - protein, 10 aa, Mycobacterium
GLSPQQQQQT

SEQ ID NO: 981465 - protein, 14 aa, Mycobacterium
GSPGQGNYAAANTA

SEQ ID NO: 981466 - protein, 13 aa, Mycobacterium
GVKGGGVLQCCEL

SEQ ID NO: 981467 - protein, 11 aa, Mycobacterium
HDNTTTGDEQP

SEQ ID NO: 981468 - protein, 7 aa, Mycobacterium
HPDTTGT

SEQ ID NO: 981469 - protein, 14 aa, Mycobacterium
LTTATGSAPATTAA

SEQ ID NO: 981470 - protein, 6 aa, Mycobacterium
NGPAIG

SEQ ID NO: 981471 - protein, 4 aa, Mycobacterium
PDLD

SEQ ID NO: 981472 - protein, 8 aa, Mycobacterium
PEDTDIDG

SEQ ID NO: 981473 - protein, 15 aa, Mycobacterium
PHPDTTTDTDTDTDA

SEQ ID NO: 981474 - protein, 17 aa, Mycobacterium
PSNEELQAHQASDTAVS

SEQ ID NO: 981475 - protein, 4 aa, Mycobacterium
PTRE

SEQ ID NO: 981476 - protein, 9 aa, Mycobacterium
PWPPPGTAA

SEQ ID NO: 981477 - protein, 8 aa, Mycobacterium
QGYNYGPT

SEQ ID NO: 981478 - protein, 19 aa, Mycobacterium
QPPTNDTDDTNTADTGDQV

SEQ ID NO: 981479 - protein, 6 aa, Mycobacterium
RAGYSS

SEQ ID NO: 981480 - protein, 9 aa, Mycobacterium
RHSSDGALT

SEQ ID NO: 981481 - protein, 7 aa, Mycobacterium
RKDRPDA

SEQ ID NO: 981482 - protein, 6 aa, Mycobacterium
RNNESQ

SEQ ID NO: 981483 - protein, 12 aa, Mycobacterium
RRGPQAHGATDL

SEQ ID NO: 981484 - protein, 5 aa, Mycobacterium
RTGAD

SEQ ID NO: 981485 - protein, 5 aa, Mycobacterium
SDPEA

SEQ ID NO: 981486 - protein, 5 aa, Mycobacterium
SPRTQ

SEQ ID NO: 981487 - protein, 11 aa, Mycobacterium
TDDNTNSDTLT

SEQ ID NO: 981488 - protein, 5 aa, Mycobacterium
TELAE

SEQ ID NO: 981489 - protein, 10 aa, Mycobacterium
TPESISPATA

SEQ ID NO: 981490 - protein, 13 aa, Mycobacterium
TPRRRAASAATDL

SEQ ID NO: 981491 - protein, 9 aa, Mycobacterium
TPVTELTGD

SEQ ID NO: 981492 - protein, 8 aa, Mycobacterium
TSDTTGAP

SEQ ID NO: 981493 - protein, 4 aa, Mycobacterium
VRPG

SEQ ID NO: 981494 - protein, 11 aa, Mycobacterium
VSTSAHDPVPD

SEQ ID NO: 981495 - protein, 4 aa, Mycobacterium
ATGE

SEQ ID NO: 981496 - protein, 9 aa, Mycobacterium
ATTRSHHPH

SEQ ID NO: 981497 - protein, 4 aa, Mycobacterium
DGVT

SEQ ID NO: 981498 - protein, 4 aa, Mycobacterium
DPAA

SEQ ID NO: 981499 - protein, 4 aa, Mycobacterium
ERSS

SEQ ID NO: 981500 - protein, 4 aa, Mycobacterium
FGGS

SEQ ID NO: 981501 - protein, 9 aa, Mycobacterium
GEGDGESAK

SEQ ID NO: 981502 - protein, 8 aa, Mycobacterium
GEGGGESA

SEQ ID NO: 981503 - protein, 4 aa, Mycobacterium
GLPR

SEQ ID NO: 981504 - protein, 19 aa, Mycobacterium
HDRAGYGSGNSRNRTRSKT

SEQ ID NO: 981505 - protein, 11 aa, Mycobacterium
HSENNHDTTDA

SEQ ID NO: 981506 - protein, 4 aa, Mycobacterium
IGPS

SEQ ID NO: 981507 - protein, 4 aa, Mycobacterium
KLPT

SEQ ID NO: 981508 - protein, 4 aa, Mycobacterium
LTQP

SEQ ID NO: 981509 - protein, 5 aa, Mycobacterium
LTTEE

SEQ ID NO: 981510 - protein, 6 aa, Mycobacterium
NNGTHP

SEQ ID NO: 981511 - protein, 4 aa, Mycobacterium
PAGV

SEQ ID NO: 981512 - protein, 8 aa, Mycobacterium
QGSQYPGM

SEQ ID NO: 981513 - protein, 7 aa, Mycobacterium
RRTKNNP

SEQ ID NO: 981514 - protein, 9 aa, Mycobacterium
RSAPGLSAQ

SEQ ID NO: 981515 - protein, 22 aa, Mycobacterium
SYGATNSDDAEGYAMTGGATSV

SEQ ID NO: 981516 - protein, 7 aa, Mycobacterium
TPQGPGK

SEQ ID NO: 981517 - protein, 4 aa, Mycobacterium
VTTG

SEQ ID NO: 981518 - protein, 4 aa, Mycobacterium
AAAD

SEQ ID NO: 981519 - protein, 4 aa, Mycobacterium
AAAE

SEQ ID NO: 981520 - protein, 6 aa, Mycobacterium
AAAELG

SEQ ID NO: 981521 - protein, 6 aa, Mycobacterium
AADEVS

SEQ ID NO: 981522 - protein, 4 aa, Mycobacterium
AAGG

SEQ ID NO: 981523 - protein, 5 aa, Mycobacterium
AAGGY

SEQ ID NO: 981524 - protein, 4 aa, Mycobacterium
AAGV

SEQ ID NO: 981525 - protein, 6 aa, Mycobacterium
AALETT

SEQ ID NO: 981526 - protein, 5 aa, Mycobacterium
AATGL

SEQ ID NO: 981527 - protein, 14 aa, Mycobacterium
AATVASNAAAAQLT

SEQ ID NO: 981528 - protein, 9 aa, Mycobacterium
ADGSHAPEQ

SEQ ID NO: 981529 - protein, 5 aa, Mycobacterium
AGADA

SEQ ID NO: 981530 - protein, 6 aa, Mycobacterium
AGGDKV

SEQ ID NO: 981531 - protein, 6 aa, Mycobacterium
AGTSTG

SEQ ID NO: 981532 - protein, 13 aa, Mycobacterium
AKIAKDRGIGGPV

SEQ ID NO: 981533 - protein, 4 aa, Mycobacterium
ANQT

SEQ ID NO: 981534 - protein, 26 aa, Mycobacterium
ANSHGQKVQRASSSMADTDRSVSSAW

SEQ ID NO: 981535 - protein, 14 aa, Mycobacterium
ANTAALGTKALWLP

SEQ ID NO: 981536 - protein, 4 aa, Mycobacterium
APGA

SEQ ID NO: 981537 - protein, 4 aa, Mycobacterium
APGT

SEQ ID NO: 981538 - protein, 7 aa, Mycobacterium
AQTRREI

SEQ ID NO: 981539 - protein, 17 aa, Mycobacterium
ARQPLGPAAGQHSVGST

SEQ ID NO: 981540 - protein, 4 aa, Mycobacterium
ARRS

SEQ ID NO: 981541 - protein, 4 aa, Mycobacterium
ASAA

SEQ ID NO: 981542 - protein, 11 aa, Mycobacterium
ATADGTGFGEG

SEQ ID NO: 981543 - protein, 4 aa, Mycobacterium
ATEE

SEQ ID NO: 981544 - protein, 4 aa, Mycobacterium
ATSA

SEQ ID NO: 981545 - protein, 4 aa, Mycobacterium
DADA

SEQ ID NO: 981546 - protein, 8 aa, Mycobacterium
DDGRPSQL

SEQ ID NO: 981547 - protein, 13 aa, Mycobacterium
DEDRQRAHTGNGA

SEQ ID NO: 981548 - protein, 4 aa, Mycobacterium
DEPL

SEQ ID NO: 981549 - protein, 4 aa, Mycobacterium
DGAA

SEQ ID NO: 981550 - protein, 4 aa, Mycobacterium
DPGA

SEQ ID NO: 981551 - protein, 23 aa, Mycobacterium
DQLGTAADRYEHQEENSRKILSG

SEQ ID NO: 981552 - protein, 4 aa, Mycobacterium
DSAA

SEQ ID NO: 981553 - protein, 6 aa, Mycobacterium
DSITPD

SEQ ID NO: 981554 - protein, 7 aa, Mycobacterium
DSPNSAG

SEQ ID NO: 981555 - protein, 26 aa, Mycobacterium
DSPQGRASSLESIGRSLSRRNHGRSR

SEQ ID NO: 981556 - protein, 6 aa, Mycobacterium
DVPPTN

SEQ ID NO: 981557 - protein, 4 aa, Mycobacterium
EAGE

SEQ ID NO: 981558 - protein, 9 aa, Mycobacterium
EANKNKAIA

SEQ ID NO: 981559 - protein, 4 aa, Mycobacterium
EEAA

SEQ ID NO: 981560 - protein, 6 aa, Mycobacterium
EEHATA

SEQ ID NO: 981561 - protein, 4 aa, Mycobacterium
EENA

SEQ ID NO: 981562 - protein, 7 aa, Mycobacterium
EGESAAA

SEQ ID NO: 981563 - protein, 9 aa, Mycobacterium
EIAPPAADD

SEQ ID NO: 981564 - protein, 8 aa, Mycobacterium
ELDTPRTR

SEQ ID NO: 981565 - protein, 8 aa, Mycobacterium
ELEDTADK

SEQ ID NO: 981566 - protein, 4 aa, Mycobacterium
ENDR

SEQ ID NO: 981567 - protein, 6 aa, Mycobacterium
ENQAAH

SEQ ID NO: 981568 - protein, 19 aa, Mycobacterium
EPERQPESPVPAAATTETA

SEQ ID NO: 981569 - protein, 4 aa, Mycobacterium
ERAR

SEQ ID NO: 981570 - protein, 16 aa, Mycobacterium
ERVQSKKISKTQAVTS

SEQ ID NO: 981571 - protein, 5 aa, Mycobacterium
ERVTP

SEQ ID NO: 981572 - protein, 4 aa, Mycobacterium
ESGP

SEQ ID NO: 981573 - protein, 4 aa, Mycobacterium
EVPE

SEQ ID NO: 981574 - protein, 12 aa, Mycobacterium
FGESEPELPGMT

SEQ ID NO: 981575 - protein, 6 aa, Mycobacterium
FGISGT

SEQ ID NO: 981576 - protein, 4 aa, Mycobacterium
GADE

SEQ ID NO: 981577 - protein, 17 aa, Mycobacterium
GAGWSGTAQLTSHDTMG

SEQ ID NO: 981578 - protein, 4 aa, Mycobacterium
GAPQ

SEQ ID NO: 981579 - protein, 4 aa, Mycobacterium
GGAE

SEQ ID NO: 981580 - protein, 9 aa, Mycobacterium
GGGGPGVGP

SEQ ID NO: 981581 - protein, 4 aa, Mycobacterium
GGMP

SEQ ID NO: 981582 - protein, 7 aa, Mycobacterium
GGQGSTA

SEQ ID NO: 981583 - protein, 4 aa, Mycobacterium
GGYA

SEQ ID NO: 981584 - protein, 12 aa, Mycobacterium
GNTHESSTGYKT

SEQ ID NO: 981585 - protein, 8 aa, Mycobacterium
GPGSSPIL

SEQ ID NO: 981586 - protein, 10 aa, Mycobacterium
GPPGTGKTTI

SEQ ID NO: 981587 - protein, 8 aa, Mycobacterium
GRGSQWAG

SEQ ID NO: 981588 - protein, 16 aa, Mycobacterium
GRQYQAHASQGATNHQ

SEQ ID NO: 981589 - protein, 7 aa, Mycobacterium
GTDEIST

SEQ ID NO: 981590 - protein, 4 aa, Mycobacterium
GTPP

SEQ ID NO: 981591 - protein, 11 aa, Mycobacterium
HGSDCNDDDES

SEQ ID NO: 981592 - protein, 5 aa, Mycobacterium
HSQGE

SEQ ID NO: 981593 - protein, 8 aa, Mycobacterium
IAAQRGYK

SEQ ID NO: 981594 - protein, 7 aa, Mycobacterium
IKSQVGA

SEQ ID NO: 981595 - protein, 8 aa, Mycobacterium
KDARARGM

SEQ ID NO: 981596 - protein, 8 aa, Mycobacterium
KDTSITGG

SEQ ID NO: 981597 - protein, 5 aa, Mycobacterium
KVGVD

SEQ ID NO: 981598 - protein, 4 aa, Mycobacterium
LPTA

SEQ ID NO: 981599 - protein, 4 aa, Mycobacterium
LRAA

SEQ ID NO: 981600 - protein, 6 aa, Mycobacterium
LSGQGG

SEQ ID NO: 981601 - protein, 10 aa, Mycobacterium
LTAAANTLEG

SEQ ID NO: 981602 - protein, 4 aa, Mycobacterium
MTSY

SEQ ID NO: 981603 - protein, 4 aa, Mycobacterium
NPFP

SEQ ID NO: 981604 - protein, 4 aa, Mycobacterium
NSTR

SEQ ID NO: 981605 - protein, 6 aa, Mycobacterium
NVRDES

SEQ ID NO: 981606 - protein, 7 aa, Mycobacterium
PAQRTHD

SEQ ID NO: 981607 - protein, 4 aa, Mycobacterium
PDAE

SEQ ID NO: 981608 - protein, 4 aa, Mycobacterium
PDGG

SEQ ID NO: 981609 - protein, 10 aa, Mycobacterium
PEGAGPGTKG

SEQ ID NO: 981610 - protein, 4 aa, Mycobacterium
PGDG

SEQ ID NO: 981611 - protein, 5 aa, Mycobacterium
PHNPA

SEQ ID NO: 981612 - protein, 5 aa, Mycobacterium
PLDPE

SEQ ID NO: 981613 - protein, 7 aa, Mycobacterium
PMPGGPM

SEQ ID NO: 981614 - protein, 6 aa, Mycobacterium
PPDTSR

SEQ ID NO: 981615 - protein, 4 aa, Mycobacterium
PQMR

SEQ ID NO: 981616 - protein, 4 aa, Mycobacterium
PSGE

SEQ ID NO: 981617 - protein, 10 aa, Mycobacterium
PTDAPPEPGY

SEQ ID NO: 981618 - protein, 7 aa, Mycobacterium
PTGKAVT

SEQ ID NO: 981619 - protein, 6 aa, Mycobacterium
PTNHLD

SEQ ID NO: 981620 - protein, 4 aa, Mycobacterium
PTTG

SEQ ID NO: 981621 - protein, 4 aa, Mycobacterium
QEHG

SEQ ID NO: 981622 - protein, 6 aa, Mycobacterium
QLDTDN

SEQ ID NO: 981623 - protein, 10 aa, Mycobacterium
QNAASAELTA

SEQ ID NO: 981624 - protein, 13 aa, Mycobacterium
QNSTAIAEKEAEY

SEQ ID NO: 981625 - protein, 26 aa, Mycobacterium
QPPTPDTTQTPNTTTGSDPAVGSDPA

SEQ ID NO: 981626 - protein, 7 aa, Mycobacterium
RGPTLDG

SEQ ID NO: 981627 - protein, 18 aa, Mycobacterium
RHRTDEQGRYTMCVQGDR

SEQ ID NO: 981628 - protein, 5 aa, Mycobacterium
RLTES

SEQ ID NO: 981629 - protein, 4 aa, Mycobacterium
RPAA

SEQ ID NO: 981630 - protein, 4 aa, Mycobacterium
RPET

SEQ ID NO: 981631 - protein, 10 aa, Mycobacterium
RRDTTLGNGT

SEQ ID NO: 981632 - protein, 4 aa, Mycobacterium
RSGE

SEQ ID NO: 981633 - protein, 4 aa, Mycobacterium
RTPT

SEQ ID NO: 981634 - protein, 7 aa, Mycobacterium
SGCGKTT

SEQ ID NO: 981635 - protein, 12 aa, Mycobacterium
SGPGEIPDAEHE

SEQ ID NO: 981636 - protein, 4 aa, Mycobacterium
SGPR

SEQ ID NO: 981637 - protein, 4 aa, Mycobacterium
SGRA

SEQ ID NO: 981638 - protein, 4 aa, Mycobacterium
SLDP

SEQ ID NO: 981639 - protein, 4 aa, Mycobacterium
SLER

SEQ ID NO: 981640 - protein, 12 aa, Mycobacterium
SNMGHTQAAAGV

SEQ ID NO: 981641 - protein, 9 aa, Mycobacterium
SPPQQLPDE

SEQ ID NO: 981642 - protein, 5 aa, Mycobacterium
SPRQT

SEQ ID NO: 981643 - protein, 4 aa, Mycobacterium
SQTL

SEQ ID NO: 981644 - protein, 9 aa, Mycobacterium
SRKKAAAAE

SEQ ID NO: 981645 - protein, 4 aa, Mycobacterium
SSAS

SEQ ID NO: 981646 - protein, 4 aa, Mycobacterium
SSLP

SEQ ID NO: 981647 - protein, 15 aa, Mycobacterium
SSSAYAGTETANHDS

SEQ ID NO: 981648 - protein, 9 aa, Mycobacterium
TAAAQGLQS

SEQ ID NO: 981649 - protein, 5 aa, Mycobacterium
TADTA

SEQ ID NO: 981650 - protein, 4 aa, Mycobacterium
TDPD

SEQ ID NO: 981651 - protein, 5 aa, Mycobacterium
TEAKT

SEQ ID NO: 981652 - protein, 5 aa, Mycobacterium
TETTT

SEQ ID NO: 981653 - protein, 25 aa, Mycobacterium
TGADAPGTNPGTDIAPDPNTGGTNP

SEQ ID NO: 981654 - protein, 4 aa, Mycobacterium
TGEL

SEQ ID NO: 981655 - protein, 4 aa, Mycobacterium
TGFT

SEQ ID NO: 981656 - protein, 4 aa, Mycobacterium
TGGV

SEQ ID NO: 981657 - protein, 5 aa, Mycobacterium
TGGVG

SEQ ID NO: 981658 - protein, 4 aa, Mycobacterium
TGID

SEQ ID NO: 981659 - protein, 19 aa, Mycobacterium
TNSTPTESCRKFAGSCPVY

SEQ ID NO: 981660 - protein, 5 aa, Mycobacterium
TRQLD

SEQ ID NO: 981661 - protein, 6 aa, Mycobacterium
TSENNT

SEQ ID NO: 981662 - protein, 10 aa, Mycobacterium
TSGSTRTPAG

SEQ ID NO: 981663 - protein, 4 aa, Mycobacterium
TSSR

SEQ ID NO: 981664 - protein, 4 aa, Mycobacterium
TVPE

SEQ ID NO: 981665 - protein, 8 aa, Mycobacterium
VAPDHPKI

SEQ ID NO: 981666 - protein, 4 aa, Mycobacterium
VGGE

SEQ ID NO: 981667 - protein, 8 aa, Mycobacterium
VGSEEADK

SEQ ID NO: 981668 - protein, 4 aa, Mycobacterium
VKAG

SEQ ID NO: 981669 - protein, 4 aa, Mycobacterium
VNPS

SEQ ID NO: 981670 - protein, 4 aa, Mycobacterium
VSHT

SEQ ID NO: 981671 - protein, 10 aa, Mycobacterium
YQNRSDRGIA

SEQ ID NO: 981672 - protein, 4 aa, Mycobacterium
AAAA

SEQ ID NO: 981673 - protein, 8 aa, Mycobacterium
AAADEVST

SEQ ID NO: 981674 - protein, 6 aa, Mycobacterium
AAAPGA

SEQ ID NO: 981675 - protein, 9 aa, Mycobacterium
AAEATQRAI

SEQ ID NO: 981676 - protein, 7 aa, Mycobacterium
AAEGETI

SEQ ID NO: 981677 - protein, 6 aa, Mycobacterium
AAEPEP

SEQ ID NO: 981678 - protein, 4 aa, Mycobacterium
AAGE

SEQ ID NO: 981679 - protein, 6 aa, Mycobacterium
AAGPGD

SEQ ID NO: 981680 - protein, 6 aa, Mycobacterium
AAHEPG

SEQ ID NO: 981681 - protein, 5 aa, Mycobacterium
AAKPK

SEQ ID NO: 981682 - protein, 8 aa, Mycobacterium
AAPATVSE

SEQ ID NO: 981683 - protein, 8 aa, Mycobacterium
AAQQNQSP

SEQ ID NO: 981684 - protein, 7 aa, Mycobacterium
AARANDI

SEQ ID NO: 981685 - protein, 12 aa, Mycobacterium
AARPGPTHRDNR

SEQ ID NO: 981686 - protein, 4 aa, Mycobacterium
AASA

SEQ ID NO: 981687 - protein, 6 aa, Mycobacterium
AASASL

SEQ ID NO: 981688 - protein, 9 aa, Mycobacterium
AATGAGHGT

SEQ ID NO: 981689 - protein, 5 aa, Mycobacterium
AATRG

SEQ ID NO: 981690 - protein, 4 aa, Mycobacterium
AAVD

SEQ ID NO: 981691 - protein, 8 aa, Mycobacterium
ACSSGSEA

SEQ ID NO: 981692 - protein, 8 aa, Mycobacterium
ADAEGVTK

SEQ ID NO: 981693 - protein, 4 aa, Mycobacterium
ADDA

SEQ ID NO: 981694 - protein, 11 aa, Mycobacterium
ADDGGSSGRLR

SEQ ID NO: 981695 - protein, 4 aa, Mycobacterium
ADEV

SEQ ID NO: 981696 - protein, 6 aa, Mycobacterium
ADEVST

SEQ ID NO: 981697 - protein, 4 aa, Mycobacterium
ADGP

SEQ ID NO: 981698 - protein, 4 aa, Mycobacterium
ADGT

SEQ ID NO: 981699 - protein, 6 aa, Mycobacterium
ADNQRA

SEQ ID NO: 981700 - protein, 9 aa, Mycobacterium
ADPASARGS

SEQ ID NO: 981701 - protein, 15 aa, Mycobacterium
ADPEGSVYSGGTGRP

SEQ ID NO: 981702 - protein, 6 aa, Mycobacterium
ADRKGG

SEQ ID NO: 981703 - protein, 9 aa, Mycobacterium
ADSETPLSA

SEQ ID NO: 981704 - protein, 7 aa, Mycobacterium
ADTAAAA

SEQ ID NO: 981705 - protein, 8 aa, Mycobacterium
AEADRREG

SEQ ID NO: 981706 - protein, 6 aa, Mycobacterium
AEAERR

SEQ ID NO: 981707 - protein, 6 aa, Mycobacterium
AEAGKQ

SEQ ID NO: 981708 - protein, 6 aa, Mycobacterium
AEAQAE

SEQ ID NO: 981709 - protein, 4 aa, Mycobacterium
AEAR

SEQ ID NO: 981710 - protein, 6 aa, Mycobacterium
AEEDPT

SEQ ID NO: 981711 - protein, 6 aa, Mycobacterium
AEEPRL

SEQ ID NO: 981712 - protein, 5 aa, Mycobacterium
AEGAG

SEQ ID NO: 981713 - protein, 6 aa, Mycobacterium
AEGDAE

SEQ ID NO: 981714 - protein, 6 aa, Mycobacterium
AEHDEM

SEQ ID NO: 981715 - protein, 13 aa, Mycobacterium
AENAARKAQEHGV

SEQ ID NO: 981716 - protein, 7 aa, Mycobacterium
AENGRSW

SEQ ID NO: 981717 - protein, 6 aa, Mycobacterium
AENQTL

SEQ ID NO: 981718 - protein, 5 aa, Mycobacterium
AENYG

SEQ ID NO: 981719 - protein, 6 aa, Mycobacterium
AEPDAL

SEQ ID NO: 981720 - protein, 4 aa, Mycobacterium
AEQI

SEQ ID NO: 981721 - protein, 9 aa, Mycobacterium
AEQKGTGRW

SEQ ID NO: 981722 - protein, 4 aa, Mycobacterium
AEQR

SEQ ID NO: 981723 - protein, 11 aa, Mycobacterium
AEQSDDAQPGV

SEQ ID NO: 981724 - protein, 6 aa, Mycobacterium
AERQEA

SEQ ID NO: 981725 - protein, 4 aa, Mycobacterium
AERR

SEQ ID NO: 981726 - protein, 4 aa, Mycobacterium
AESE

SEQ ID NO: 981727 - protein, 7 aa, Mycobacterium
AESSAPA

SEQ ID NO: 981728 - protein, 20 aa, Mycobacterium
AESTDDAKAETILDEVLAAA

SEQ ID NO: 981729 - protein, 7 aa, Mycobacterium
AGADEVS

SEQ ID NO: 981730 - protein, 5 aa, Mycobacterium
AGADL

SEQ ID NO: 981731 - protein, 8 aa, Mycobacterium
AGAEGADV

SEQ ID NO: 981732 - protein, 4 aa, Mycobacterium
AGDR

SEQ ID NO: 981733 - protein, 7 aa, Mycobacterium
AGEGTQQ

SEQ ID NO: 981734 - protein, 7 aa, Mycobacterium
AGERGTD

SEQ ID NO: 981735 - protein, 4 aa, Mycobacterium
AGES

SEQ ID NO: 981736 - protein, 8 aa, Mycobacterium
AGKTTTTE

SEQ ID NO: 981737 - protein, 8 aa, Mycobacterium
AGLPPATY

SEQ ID NO: 981738 - protein, 7 aa, Mycobacterium
AGPEIGV

SEQ ID NO: 981739 - protein, 9 aa, Mycobacterium
AGPERATEA

SEQ ID NO: 981740 - protein, 6 aa, Mycobacterium
AGPQVG

SEQ ID NO: 981741 - protein, 6 aa, Mycobacterium
AGSEVS

SEQ ID NO: 981742 - protein, 4 aa, Mycobacterium
AGSI

SEQ ID NO: 981743 - protein, 6 aa, Mycobacterium
AGTDRG

SEQ ID NO: 981744 - protein, 5 aa, Mycobacterium
AGTST

SEQ ID NO: 981745 - protein, 4 aa, Mycobacterium
AGVG

SEQ ID NO: 981746 - protein, 7 aa, Mycobacterium
AGVGGAD

SEQ ID NO: 981747 - protein, 4 aa, Mycobacterium
AGVS

SEQ ID NO: 981748 - protein, 5 aa, Mycobacterium
AHGGV

SEQ ID NO: 981749 - protein, 7 aa, Mycobacterium
AHPSLPR

SEQ ID NO: 981750 - protein, 7 aa, Mycobacterium
AIGGTRA

SEQ ID NO: 981751 - protein, 12 aa, Mycobacterium
AKAAGDAVRNGD

SEQ ID NO: 981752 - protein, 4 aa, Mycobacterium
AKAG

SEQ ID NO: 981753 - protein, 8 aa, Mycobacterium
AKAGNPHR

SEQ ID NO: 981754 - protein, 8 aa, Mycobacterium
AKGRGRDM

SEQ ID NO: 981755 - protein, 16 aa, Mycobacterium
AKKTDDVAGDGTTTAT

SEQ ID NO: 981756 - protein, 5 aa, Mycobacterium
AKNDA

SEQ ID NO: 981757 - protein, 6 aa, Mycobacterium
AKNHPS

SEQ ID NO: 981758 - protein, 5 aa, Mycobacterium
AKRRN

SEQ ID NO: 981759 - protein, 7 aa, Mycobacterium
AKTGGRN

SEQ ID NO: 981760 - protein, 4 aa, Mycobacterium
ALES

SEQ ID NO: 981761 - protein, 13 aa, Mycobacterium
ALGPGGLSRERAG

SEQ ID NO: 981762 - protein, 4 aa, Mycobacterium
ALRE

SEQ ID NO: 981763 - protein, 6 aa, Mycobacterium
ALRPGD

SEQ ID NO: 981764 - protein, 5 aa, Mycobacterium
AMENA

SEQ ID NO: 981765 - protein, 5 aa, Mycobacterium
AMKPG

SEQ ID NO: 981766 - protein, 4 aa, Mycobacterium
ANAG

SEQ ID NO: 981767 - protein, 6 aa, Mycobacterium
ANDADE

SEQ ID NO: 981768 - protein, 9 aa, Mycobacterium
ANDGGGSIR

SEQ ID NO: 981769 - protein, 5 aa, Mycobacterium
ANGDK

SEQ ID NO: 981770 - protein, 7 aa, Mycobacterium
ANPTGPI

SEQ ID NO: 981771 - protein, 8 aa, Mycobacterium
ANRNAAGQ

SEQ ID NO: 981772 - protein, 6 aa, Mycobacterium
ANSGAK

SEQ ID NO: 981773 - protein, 4 aa, Mycobacterium
ANTT

SEQ ID NO: 981774 - protein, 7 aa, Mycobacterium
APDIPRE

SEQ ID NO: 981775 - protein, 7 aa, Mycobacterium
APDPDGG

SEQ ID NO: 981776 - protein, 5 aa, Mycobacterium
APEVE

SEQ ID NO: 981777 - protein, 4 aa, Mycobacterium
APGH

SEQ ID NO: 981778 - protein, 7 aa, Mycobacterium
APKPMLP

SEQ ID NO: 981779 - protein, 4 aa, Mycobacterium
APRD

SEQ ID NO: 981780 - protein, 4 aa, Mycobacterium
APRG

SEQ ID NO: 981781 - protein, 4 aa, Mycobacterium
APSK

SEQ ID NO: 981782 - protein, 6 aa, Mycobacterium
APTLGA

SEQ ID NO: 981783 - protein, 6 aa, Mycobacterium
AQAKDA

SEQ ID NO: 981784 - protein, 4 aa, Mycobacterium
AQNG

SEQ ID NO: 981785 - protein, 7 aa, Mycobacterium
AQNTTAE

SEQ ID NO: 981786 - protein, 6 aa, Mycobacterium
AQPGQI

SEQ ID NO: 981787 - protein, 7 aa, Mycobacterium
AQPKYVQ

SEQ ID NO: 981788 - protein, 7 aa, Mycobacterium
AQRRDHR

SEQ ID NO: 981789 - protein, 7 aa, Mycobacterium
AQTEHPG

SEQ ID NO: 981790 - protein, 5 aa, Mycobacterium
ARDRA

SEQ ID NO: 981791 - protein, 6 aa, Mycobacterium
ARDVTG

SEQ ID NO: 981792 - protein, 8 aa, Mycobacterium
ARGKSGRL

SEQ ID NO: 981793 - protein, 5 aa, Mycobacterium
ARGRG

SEQ ID NO: 981794 - protein, 20 aa, Mycobacterium
ARHGGGAFSGKDPSKVDRSA

SEQ ID NO: 981795 - protein, 9 aa, Mycobacterium
ARTRRDGRS

SEQ ID NO: 981796 - protein, 5 aa, Mycobacterium
ARYDA

SEQ ID NO: 981797 - protein, 6 aa, Mycobacterium
ASAASI

SEQ ID NO: 981798 - protein, 8 aa, Mycobacterium
ASATSLDT

SEQ ID NO: 981799 - protein, 7 aa, Mycobacterium
ASDSPYG

SEQ ID NO: 981800 - protein, 4 aa, Mycobacterium
ASGA

SEQ ID NO: 981801 - protein, 7 aa, Mycobacterium
ASGEQDA

SEQ ID NO: 981802 - protein, 5 aa, Mycobacterium
ASGIP

SEQ ID NO: 981803 - protein, 13 aa, Mycobacterium
ASGNIDATRTNPS

SEQ ID NO: 981804 - protein, 7 aa, Mycobacterium
ASNERQV

SEQ ID NO: 981805 - protein, 5 aa, Mycobacterium
ASPGI

SEQ ID NO: 981806 - protein, 8 aa, Mycobacterium
ASRAEQGL

SEQ ID NO: 981807 - protein, 7 aa, Mycobacterium
ASRETVN

SEQ ID NO: 981808 - protein, 7 aa, Mycobacterium
ASSLRKA

SEQ ID NO: 981809 - protein, 10 aa, Mycobacterium
ATADGTGWGE

SEQ ID NO: 981810 - protein, 5 aa, Mycobacterium
ATADT

SEQ ID NO: 981811 - protein, 6 aa, Mycobacterium
ATARPP

SEQ ID NO: 981812 - protein, 4 aa, Mycobacterium
ATDE

SEQ ID NO: 981813 - protein, 4 aa, Mycobacterium
ATER

SEQ ID NO: 981814 - protein, 4 aa, Mycobacterium
ATGR

SEQ ID NO: 981815 - protein, 10 aa, Mycobacterium
ATGTGKSATT

SEQ ID NO: 981816 - protein, 6 aa, Mycobacterium
ATHAPH

SEQ ID NO: 981817 - protein, 6 aa, Mycobacterium
ATPGPH

SEQ ID NO: 981818 - protein, 12 aa, Mycobacterium
ATPPPVRGGKQP

SEQ ID NO: 981819 - protein, 6 aa, Mycobacterium
ATSAST

SEQ ID NO: 981820 - protein, 8 aa, Mycobacterium
ATSRPSAL

SEQ ID NO: 981821 - protein, 4 aa, Mycobacterium
ATTI

SEQ ID NO: 981822 - protein, 4 aa, Mycobacterium
ATTL

SEQ ID NO: 981823 - protein, 9 aa, Mycobacterium
AVGKSTTAR

SEQ ID NO: 981824 - protein, 21 aa, Mycobacterium
AVNQDGASNGLTAPNGPSQQR

SEQ ID NO: 981825 - protein, 7 aa, Mycobacterium
AVPPTGS

SEQ ID NO: 981826 - protein, 6 aa, Mycobacterium
AVQQEK

SEQ ID NO: 981827 - protein, 5 aa, Mycobacterium
AYGGA

SEQ ID NO: 981828 - protein, 4 aa, Mycobacterium
CESG

SEQ ID NO: 981829 - protein, 6 aa, Mycobacterium
CGEGYG

SEQ ID NO: 981830 - protein, 7 aa, Mycobacterium
CGPDGTA

SEQ ID NO: 981831 - protein, 4 aa, Mycobacterium
CGPE

SEQ ID NO: 981832 - protein, 11 aa, Mycobacterium
CKGTGVTTRTR

SEQ ID NO: 981833 - protein, 9 aa, Mycobacterium
CTGKGNDQV

SEQ ID NO: 981834 - protein, 8 aa, Mycobacterium
CTNTSNPE

SEQ ID NO: 981835 - protein, 5 aa, Mycobacterium
CTPGG

SEQ ID NO: 981836 - protein, 6 aa, Mycobacterium
DAAAAD

SEQ ID NO: 981837 - protein, 8 aa, Mycobacterium
DADGSGAA

SEQ ID NO: 981838 - protein, 8 aa, Mycobacterium
DADGTKAG

SEQ ID NO: 981839 - protein, 4 aa, Mycobacterium
DADP

SEQ ID NO: 981840 - protein, 5 aa, Mycobacterium
DAEAY

SEQ ID NO: 981841 - protein, 6 aa, Mycobacterium
DAGPTL

SEQ ID NO: 981842 - protein, 7 aa, Mycobacterium
DAGSGVA

SEQ ID NO: 981843 - protein, 4 aa, Mycobacterium
DAHP

SEQ ID NO: 981844 - protein, 8 aa, Mycobacterium
DATDSAVG

SEQ ID NO: 981845 - protein, 8 aa, Mycobacterium
DDAISTGG

SEQ ID NO: 981846 - protein, 7 aa, Mycobacterium
DDASAND

SEQ ID NO: 981847 - protein, 5 aa, Mycobacterium
DDPAL

SEQ ID NO: 981848 - protein, 4 aa, Mycobacterium
DDPT

SEQ ID NO: 981849 - protein, 4 aa, Mycobacterium
DDRP

SEQ ID NO: 981850 - protein, 7 aa, Mycobacterium
DDTPEGF

SEQ ID NO: 981851 - protein, 7 aa, Mycobacterium
DEAKNRQ

SEQ ID NO: 981852 - protein, 11 aa, Mycobacterium
DEDLPSGDELG

SEQ ID NO: 981853 - protein, 7 aa, Mycobacterium
DEPPGTR

SEQ ID NO: 981854 - protein, 6 aa, Mycobacterium
DEPRKG

SEQ ID NO: 981855 - protein, 4 aa, Mycobacterium
DGDL

SEQ ID NO: 981856 - protein, 5 aa, Mycobacterium
DGDTE

SEQ ID NO: 981857 - protein, 12 aa, Mycobacterium
DGLDELTTTTTS

SEQ ID NO: 981858 - protein, 7 aa, Mycobacterium
DGPAGPG

SEQ ID NO: 981859 - protein, 4 aa, Mycobacterium
DGPD

SEQ ID NO: 981860 - protein, 4 aa, Mycobacterium
DGRI

SEQ ID NO: 981861 - protein, 12 aa, Mycobacterium
DGTPDKSRLGGN

SEQ ID NO: 981862 - protein, 4 aa, Mycobacterium
DGYT

SEQ ID NO: 981863 - protein, 5 aa, Mycobacterium
DHHSR

SEQ ID NO: 981864 - protein, 7 aa, Mycobacterium
DHKGQPT

SEQ ID NO: 981865 - protein, 9 aa, Mycobacterium
DISGPPRAH

SEQ ID NO: 981866 - protein, 6 aa, Mycobacterium
DKGRLT

SEQ ID NO: 981867 - protein, 8 aa, Mycobacterium
DKPNNGDA

SEQ ID NO: 981868 - protein, 4 aa, Mycobacterium
DLGD

SEQ ID NO: 981869 - protein, 10 aa, Mycobacterium
DLQPGSSIMP

SEQ ID NO: 981870 - protein, 7 aa, Mycobacterium
DLSEGGL

SEQ ID NO: 981871 - protein, 10 aa, Mycobacterium
DNAPEERQRG

SEQ ID NO: 981872 - protein, 6 aa, Mycobacterium
DNPDDV

SEQ ID NO: 981873 - protein, 6 aa, Mycobacterium
DNTGAK

SEQ ID NO: 981874 - protein, 4 aa, Mycobacterium
DPAG

SEQ ID NO: 981875 - protein, 13 aa, Mycobacterium
DPGPRTSSATTIT

SEQ ID NO: 981876 - protein, 7 aa, Mycobacterium
DPHSPPE

SEQ ID NO: 981877 - protein, 6 aa, Mycobacterium
DPTPVA

SEQ ID NO: 981878 - protein, 8 aa, Mycobacterium
DPYPTPGH

SEQ ID NO: 981879 - protein, 4 aa, Mycobacterium
DQAS

SEQ ID NO: 981880 - protein, 12 aa, Mycobacterium
DQPNLGGSGGYS

SEQ ID NO: 981881 - protein, 19 aa, Mycobacterium
DRAGYGSGNSRNGTRSKTV

SEQ ID NO: 981882 - protein, 4 aa, Mycobacterium
DRLG

SEQ ID NO: 981883 - protein, 4 aa, Mycobacterium
DRPG

SEQ ID NO: 981884 - protein, 6 aa, Mycobacterium
DRRTTR

SEQ ID NO: 981885 - protein, 7 aa, Mycobacterium
DSAADYA

SEQ ID NO: 981886 - protein, 5 aa, Mycobacterium
DSGIG

SEQ ID NO: 981887 - protein, 9 aa, Mycobacterium
DSTLSRDDG

SEQ ID NO: 981888 - protein, 5 aa, Mycobacterium
DTAKA

SEQ ID NO: 981889 - protein, 5 aa, Mycobacterium
DTDGR

SEQ ID NO: 981890 - protein, 10 aa, Mycobacterium
DTGNGPYGPL

SEQ ID NO: 981891 - protein, 7 aa, Mycobacterium
DTPADLA

SEQ ID NO: 981892 - protein, 10 aa, Mycobacterium
DTPGEADYYR

SEQ ID NO: 981893 - protein, 5 aa, Mycobacterium
DVVPD

SEQ ID NO: 981894 - protein, 8 aa, Mycobacterium
DWGTETGA

SEQ ID NO: 981895 - protein, 4 aa, Mycobacterium
EAAS

SEQ ID NO: 981896 - protein, 5 aa, Mycobacterium
EADAR

SEQ ID NO: 981897 - protein, 4 aa, Mycobacterium
EAEA

SEQ ID NO: 981898 - protein, 5 aa, Mycobacterium
EAETT

SEQ ID NO: 981899 - protein, 7 aa, Mycobacterium
EAGATAD

SEQ ID NO: 981900 - protein, 5 aa, Mycobacterium
EAIGT

SEQ ID NO: 981901 - protein, 12 aa, Mycobacterium
EALGSNGSTSMG

SEQ ID NO: 981902 - protein, 5 aa, Mycobacterium
EAPTH

SEQ ID NO: 981903 - protein, 7 aa, Mycobacterium
EASPGNM

SEQ ID NO: 981904 - protein, 9 aa, Mycobacterium
EDDDELPAG

SEQ ID NO: 981905 - protein, 4 aa, Mycobacterium
EDGA

SEQ ID NO: 981906 - protein, 8 aa, Mycobacterium
EDGAETDL

SEQ ID NO: 981907 - protein, 4 aa, Mycobacterium
EDPL

SEQ ID NO: 981908 - protein, 4 aa, Mycobacterium
EDTI

SEQ ID NO: 981909 - protein, 10 aa, Mycobacterium
EEENPEAAEA

SEQ ID NO: 981910 - protein, 6 aa, Mycobacterium
EEHQGP

SEQ ID NO: 981911 - protein, 4 aa, Mycobacterium
EEPP

SEQ ID NO: 981912 - protein, 10 aa, Mycobacterium
EEYGGQGADS

SEQ ID NO: 981913 - protein, 10 aa, Mycobacterium
EGAEPGTQFT

SEQ ID NO: 981914 - protein, 6 aa, Mycobacterium
EGPKNV

SEQ ID NO: 981915 - protein, 4 aa, Mycobacterium
EGRG

SEQ ID NO: 981916 - protein, 8 aa, Mycobacterium
EGRPSTDA

SEQ ID NO: 981917 - protein, 7 aa, Mycobacterium
EGSEGLR

SEQ ID NO: 981918 - protein, 5 aa, Mycobacterium
EGTAE

SEQ ID NO: 981919 - protein, 4 aa, Mycobacterium
EGTG

SEQ ID NO: 981920 - protein, 8 aa, Mycobacterium
EGTSTITN

SEQ ID NO: 981921 - protein, 5 aa, Mycobacterium
EGVTP

SEQ ID NO: 981922 - protein, 10 aa, Mycobacterium
EHEASDPKLW

SEQ ID NO: 981923 - protein, 6 aa, Mycobacterium
EHPAQR

SEQ ID NO: 981924 - protein, 5 aa, Mycobacterium
EHPRP

SEQ ID NO: 981925 - protein, 4 aa, Mycobacterium
ELGD

SEQ ID NO: 981926 - protein, 4 aa, Mycobacterium
ELPD

SEQ ID NO: 981927 - protein, 7 aa, Mycobacterium
ELPPGGR

SEQ ID NO: 981928 - protein, 9 aa, Mycobacterium
ELQKRSTGR

SEQ ID NO: 981929 - protein, 14 aa, Mycobacterium
ELRGPGKTRALAQS

SEQ ID NO: 981930 - protein, 8 aa, Mycobacterium
ELTPRPST

SEQ ID NO: 981931 - protein, 9 aa, Mycobacterium
EMDEPESRG

SEQ ID NO: 981932 - protein, 9 aa, Mycobacterium
EMSEESRVR

SEQ ID NO: 981933 - protein, 4 aa, Mycobacterium
ENLD

SEQ ID NO: 981934 - protein, 9 aa, Mycobacterium
ENPPAGSVD

SEQ ID NO: 981935 - protein, 6 aa, Mycobacterium
EPAGEE

SEQ ID NO: 981936 - protein, 8 aa, Mycobacterium
EPANQGAW

SEQ ID NO: 981937 - protein, 6 aa, Mycobacterium
EPCTDS

SEQ ID NO: 981938 - protein, 7 aa, Mycobacterium
EPEAPSL

SEQ ID NO: 981939 - protein, 4 aa, Mycobacterium
EPGE

SEQ ID NO: 981940 - protein, 4 aa, Mycobacterium
EPGK

SEQ ID NO: 981941 - protein, 6 aa, Mycobacterium
EPGVGK

SEQ ID NO: 981942 - protein, 11 aa, Mycobacterium
EPKTKSDQEKL

SEQ ID NO: 981943 - protein, 4 aa, Mycobacterium
EPLT

SEQ ID NO: 981944 - protein, 11 aa, Mycobacterium
EPQATPAQTQA

SEQ ID NO: 981945 - protein, 5 aa, Mycobacterium
EPTAA

SEQ ID NO: 981946 - protein, 5 aa, Mycobacterium
EPTRG

SEQ ID NO: 981947 - protein, 12 aa, Mycobacterium
EPTTGLDPRSRQ

SEQ ID NO: 981948 - protein, 4 aa, Mycobacterium
EPVP

SEQ ID NO: 981949 - protein, 11 aa, Mycobacterium
EQLGQGKENAR

SEQ ID NO: 981950 - protein, 6 aa, Mycobacterium
EQPQNQ

SEQ ID NO: 981951 - protein, 7 aa, Mycobacterium
ERAAGNP

SEQ ID NO: 981952 - protein, 5 aa, Mycobacterium
ERAGV

SEQ ID NO: 981953 - protein, 8 aa, Mycobacterium
ERHESRRI

SEQ ID NO: 981954 - protein, 10 aa, Mycobacterium
ERPDAEAAQD

SEQ ID NO: 981955 - protein, 5 aa, Mycobacterium
ERPDN

SEQ ID NO: 981956 - protein, 4 aa, Mycobacterium
ERSA

SEQ ID NO: 981957 - protein, 4 aa, Mycobacterium
ERSD

SEQ ID NO: 981958 - protein, 5 aa, Mycobacterium
ESDWN

SEQ ID NO: 981959 - protein, 9 aa, Mycobacterium
ESGAPGRGN

SEQ ID NO: 981960 - protein, 6 aa, Mycobacterium
ESPPGA

SEQ ID NO: 981961 - protein, 4 aa, Mycobacterium
ESQE

SEQ ID NO: 981962 - protein, 5 aa, Mycobacterium
ESQEA

SEQ ID NO: 981963 - protein, 4 aa, Mycobacterium
ESRA

SEQ ID NO: 981964 - protein, 5 aa, Mycobacterium
ESYGV

SEQ ID NO: 981965 - protein, 5 aa, Mycobacterium
ETAGL

SEQ ID NO: 981966 - protein, 7 aa, Mycobacterium
ETDSGLD

SEQ ID NO: 981967 - protein, 4 aa, Mycobacterium
ETEA

SEQ ID NO: 981968 - protein, 4 aa, Mycobacterium
ETLP

SEQ ID NO: 981969 - protein, 7 aa, Mycobacterium
ETSVGKY

SEQ ID NO: 981970 - protein, 9 aa, Mycobacterium
EVEEDRDED

SEQ ID NO: 981971 - protein, 4 aa, Mycobacterium
FDEQ

SEQ ID NO: 981972 - protein, 4 aa, Mycobacterium
FDGD

SEQ ID NO: 981973 - protein, 8 aa, Mycobacterium
FGAEPNTQ

SEQ ID NO: 981974 - protein, 7 aa, Mycobacterium
FGDGSKL

SEQ ID NO: 981975 - protein, 4 aa, Mycobacterium
FGEQ

SEQ ID NO: 981976 - protein, 9 aa, Mycobacterium
FKDETETDL

SEQ ID NO: 981977 - protein, 6 aa, Mycobacterium
FPESYN

SEQ ID NO: 981978 - protein, 4 aa, Mycobacterium
FQRG

SEQ ID NO: 981979 - protein, 4 aa, Mycobacterium
FRSH

SEQ ID NO: 981980 - protein, 9 aa, Mycobacterium
FRTDSNDSR

SEQ ID NO: 981981 - protein, 11 aa, Mycobacterium
FTGQPGSTVPV

SEQ ID NO: 981982 - protein, 4 aa, Mycobacterium
FTPR

SEQ ID NO: 981983 - protein, 5 aa, Mycobacterium
FTPSW

SEQ ID NO: 981984 - protein, 6 aa, Mycobacterium
GAAGQI

SEQ ID NO: 981985 - protein, 5 aa, Mycobacterium
GAATG

SEQ ID NO: 981986 - protein, 5 aa, Mycobacterium
GADAG

SEQ ID NO: 981987 - protein, 4 aa, Mycobacterium
GAEA

SEQ ID NO: 981988 - protein, 7 aa, Mycobacterium
GAEDYAQ

SEQ ID NO: 981989 - protein, 6 aa, Mycobacterium
GAEGTN

SEQ ID NO: 981990 - protein, 8 aa, Mycobacterium
GAEQIRTG

SEQ ID NO: 981991 - protein, 7 aa, Mycobacterium
GAGERGL

SEQ ID NO: 981992 - protein, 12 aa, Mycobacterium
GAGGAPTASAVT

SEQ ID NO: 981993 - protein, 5 aa, Mycobacterium
GAPMP

SEQ ID NO: 981994 - protein, 13 aa, Mycobacterium
GAQSGIGGGGRYD

SEQ ID NO: 981995 - protein, 4 aa, Mycobacterium
GARR

SEQ ID NO: 981996 - protein, 9 aa, Mycobacterium
GDDPGDPAL

SEQ ID NO: 981997 - protein, 7 aa, Mycobacterium
GDGTQAL

SEQ ID NO: 981998 - protein, 6 aa, Mycobacterium
GDGVGG

SEQ ID NO: 981999 - protein, 4 aa, Mycobacterium
GDLR

SEQ ID NO: 982000 - protein, 4 aa, Mycobacterium
GDNL

SEQ ID NO: 982001 - protein, 5 aa, Mycobacterium
GDPAG

SEQ ID NO: 982002 - protein, 14 aa, Mycobacterium
GDQPAKGFASHGES

SEQ ID NO: 982003 - protein, 6 aa, Mycobacterium
GDRAKN

SEQ ID NO: 982004 - protein, 5 aa, Mycobacterium
GDRGF

SEQ ID NO: 982005 - protein, 14 aa, Mycobacterium
GDSAGGSAKSGRDS

SEQ ID NO: 982006 - protein, 5 aa, Mycobacterium
GDTKT

SEQ ID NO: 982007 - protein, 4 aa, Mycobacterium
GEAA

SEQ ID NO: 982008 - protein, 5 aa, Mycobacterium
GEAGV

SEQ ID NO: 982009 - protein, 5 aa, Mycobacterium
GEEPG

SEQ ID NO: 982010 - protein, 12 aa, Mycobacterium
GEGGGTGTGGAP

SEQ ID NO: 982011 - protein, 5 aa, Mycobacterium
GEGTL

SEQ ID NO: 982012 - protein, 8 aa, Mycobacterium
GEKTSDEA

SEQ ID NO: 982013 - protein, 8 aa, Mycobacterium
GELDSAGA

SEQ ID NO: 982014 - protein, 5 aa, Mycobacterium
GEPDH

SEQ ID NO: 982015 - protein, 6 aa, Mycobacterium
GEPERN

SEQ ID NO: 982016 - protein, 5 aa, Mycobacterium
GEQLG

SEQ ID NO: 982017 - protein, 10 aa, Mycobacterium
GEREGNEPYG

SEQ ID NO: 982018 - protein, 6 aa, Mycobacterium
GERTIP

SEQ ID NO: 982019 - protein, 8 aa, Mycobacterium
GERTREGN

SEQ ID NO: 982020 - protein, 11 aa, Mycobacterium
GESGSGKSAAA

SEQ ID NO: 982021 - protein, 8 aa, Mycobacterium
GETAEHPG

SEQ ID NO: 982022 - protein, 4 aa, Mycobacterium
GGAA

SEQ ID NO: 982023 - protein, 8 aa, Mycobacterium
GGAAYGPA

SEQ ID NO: 982024 - protein, 4 aa, Mycobacterium
GGDA

SEQ ID NO: 982025 - protein, 4 aa, Mycobacterium
GGDP

SEQ ID NO: 982026 - protein, 11 aa, Mycobacterium
GGDRDGNPNVT

SEQ ID NO: 982027 - protein, 6 aa, Mycobacterium
GGGDQW

SEQ ID NO: 982028 - protein, 10 aa, Mycobacterium
GGGEGGHNGL

SEQ ID NO: 982029 - protein, 6 aa, Mycobacterium
GGGSNA

SEQ ID NO: 982030 - protein, 6 aa, Mycobacterium
GGGSTE

SEQ ID NO: 982031 - protein, 4 aa, Mycobacterium
GGHA

SEQ ID NO: 982032 - protein, 5 aa, Mycobacterium
GGHDY

SEQ ID NO: 982033 - protein, 4 aa, Mycobacterium
GGHG

SEQ ID NO: 982034 - protein, 5 aa, Mycobacterium
GGITS

SEQ ID NO: 982035 - protein, 7 aa, Mycobacterium
GGKNVAP

SEQ ID NO: 982036 - protein, 5 aa, Mycobacterium
GGKSP

SEQ ID NO: 982037 - protein, 5 aa, Mycobacterium
GGLAG

SEQ ID NO: 982038 - protein, 9 aa, Mycobacterium
GGLGPTADD

SEQ ID NO: 982039 - protein, 6 aa, Mycobacterium
GGMSDN

SEQ ID NO: 982040 - protein, 4 aa, Mycobacterium
GGPM

SEQ ID NO: 982041 - protein, 7 aa, Mycobacterium
GGPRGGV

SEQ ID NO: 982042 - protein, 5 aa, Mycobacterium
GGPTL

SEQ ID NO: 982043 - protein, 4 aa, Mycobacterium
GGRI

SEQ ID NO: 982044 - protein, 7 aa, Mycobacterium
GGRLSRQ

SEQ ID NO: 982045 - protein, 6 aa, Mycobacterium
GGSARL

SEQ ID NO: 982046 - protein, 4 aa, Mycobacterium
GGSD

SEQ ID NO: 982047 - protein, 5 aa, Mycobacterium
GGSDL

SEQ ID NO: 982048 - protein, 10 aa, Mycobacterium
GGSGALAGHP

SEQ ID NO: 982049 - protein, 6 aa, Mycobacterium
GGYSES

SEQ ID NO: 982050 - protein, 4 aa, Mycobacterium
GHDR

SEQ ID NO: 982051 - protein, 7 aa, Mycobacterium
GIATPAD

SEQ ID NO: 982052 - protein, 4 aa, Mycobacterium
GITR

SEQ ID NO: 982053 - protein, 9 aa, Mycobacterium
GKEGQNARL

SEQ ID NO: 982054 - protein, 22 aa, Mycobacterium
GKFTGSGGNLEQTVTKNNLEAA

SEQ ID NO: 982055 - protein, 5 aa, Mycobacterium
GKHTG

SEQ ID NO: 982056 - protein, 8 aa, Mycobacterium
GKLGSDPA

SEQ ID NO: 982057 - protein, 6 aa, Mycobacterium
GKLPRL

SEQ ID NO: 982058 - protein, 6 aa, Mycobacterium
GKNIHE

SEQ ID NO: 982059 - protein, 4 aa, Mycobacterium
GKPE

SEQ ID NO: 982060 - protein, 7 aa, Mycobacterium
GKRPSVR

SEQ ID NO: 982061 - protein, 12 aa, Mycobacterium
GKRRSNQAENGI

SEQ ID NO: 982062 - protein, 5 aa, Mycobacterium
GLASG

SEQ ID NO: 982063 - protein, 16 aa, Mycobacterium
GLGGADRKIEQALKPG

SEQ ID NO: 982064 - protein, 9 aa, Mycobacterium
GLKPYSRDT

SEQ ID NO: 982065 - protein, 8 aa, Mycobacterium
GLPGAEGR

SEQ ID NO: 982066 - protein, 7 aa, Mycobacterium
GLTPEGE

SEQ ID NO: 982067 - protein, 5 aa, Mycobacterium
GMGRE

SEQ ID NO: 982068 - protein, 11 aa, Mycobacterium
GMTGTAQTEAA

SEQ ID NO: 982069 - protein, 6 aa, Mycobacterium
GNGEQR

SEQ ID NO: 982070 - protein, 4 aa, Mycobacterium
GNGL

SEQ ID NO: 982071 - protein, 9 aa, Mycobacterium
GNNKSVAEL

SEQ ID NO: 982072 - protein, 5 aa, Mycobacterium
GNTNF

SEQ ID NO: 982073 - protein, 4 aa, Mycobacterium
GPEV

SEQ ID NO: 982074 - protein, 10 aa, Mycobacterium
GPFGRNAPAA

SEQ ID NO: 982075 - protein, 9 aa, Mycobacterium
GPNGAGKTT

SEQ ID NO: 982076 - protein, 5 aa, Mycobacterium
GPNLA

SEQ ID NO: 982077 - protein, 8 aa, Mycobacterium
GPPGLGKT

SEQ ID NO: 982078 - protein, 6 aa, Mycobacterium
GPQAED

SEQ ID NO: 982079 - protein, 5 aa, Mycobacterium
GPQGQ

SEQ ID NO: 982080 - protein, 4 aa, Mycobacterium
GPRE

SEQ ID NO: 982081 - protein, 8 aa, Mycobacterium
GPSGTGKS

SEQ ID NO: 982082 - protein, 8 aa, Mycobacterium
GPSRERSI

SEQ ID NO: 982083 - protein, 10 aa, Mycobacterium
GQDGHDRGQK

SEQ ID NO: 982084 - protein, 4 aa, Mycobacterium
GQEG

SEQ ID NO: 982085 - protein, 6 aa, Mycobacterium
GQERPF

SEQ ID NO: 982086 - protein, 4 aa, Mycobacterium
GQHL

SEQ ID NO: 982087 - protein, 4 aa, Mycobacterium
GQPL

SEQ ID NO: 982088 - protein, 4 aa, Mycobacterium
GQPV

SEQ ID NO: 982089 - protein, 9 aa, Mycobacterium
GQTGKTVSP

SEQ ID NO: 982090 - protein, 9 aa, Mycobacterium
GREPTPEEL

SEQ ID NO: 982091 - protein, 8 aa, Mycobacterium
GRGAGPHK

SEQ ID NO: 982092 - protein, 4 aa, Mycobacterium
GRGT

SEQ ID NO: 982093 - protein, 6 aa, Mycobacterium
GRLPST

SEQ ID NO: 982094 - protein, 5 aa, Mycobacterium
GRPPR

SEQ ID NO: 982095 - protein, 4 aa, Mycobacterium
GRQG

SEQ ID NO: 982096 - protein, 7 aa, Mycobacterium
GRSAEQR

SEQ ID NO: 982097 - protein, 13 aa, Mycobacterium
GRSYGDNAQNGGG

SEQ ID NO: 982098 - protein, 12 aa, Mycobacterium
GSAAGNSPIPYN

SEQ ID NO: 982099 - protein, 4 aa, Mycobacterium
GSAG

SEQ ID NO: 982100 - protein, 6 aa, Mycobacterium
GSAGAK

SEQ ID NO: 982101 - protein, 4 aa, Mycobacterium
GSAY

SEQ ID NO: 982102 - protein, 5 aa, Mycobacterium
GSDAY

SEQ ID NO: 982103 - protein, 4 aa, Mycobacterium
GSEL

SEQ ID NO: 982104 - protein, 9 aa, Mycobacterium
GSGDNGGDA

SEQ ID NO: 982105 - protein, 4 aa, Mycobacterium
GSGF

SEQ ID NO: 982106 - protein, 9 aa, Mycobacterium
GSGNGEQIA

SEQ ID NO: 982107 - protein, 7 aa, Mycobacterium
GSHPAQL

SEQ ID NO: 982108 - protein, 4 aa, Mycobacterium
GSID

SEQ ID NO: 982109 - protein, 7 aa, Mycobacterium
GSPEDPG

SEQ ID NO: 982110 - protein, 7 aa, Mycobacterium
GSPEVTN

SEQ ID NO: 982111 - protein, 7 aa, Mycobacterium
GSSSHQK

SEQ ID NO: 982112 - protein, 7 aa, Mycobacterium
GSTGDGI

SEQ ID NO: 982113 - protein, 4 aa, Mycobacterium
GSYT

SEQ ID NO: 982114 - protein, 7 aa, Mycobacterium
GTAEAPG

SEQ ID NO: 982115 - protein, 5 aa, Mycobacterium
GTEIR

SEQ ID NO: 982116 - protein, 12 aa, Mycobacterium
GTFGSRQEEAQR

SEQ ID NO: 982117 - protein, 7 aa, Mycobacterium
GTGGTIT

SEQ ID NO: 982118 - protein, 8 aa, Mycobacterium
GTGGTITG

SEQ ID NO: 982119 - protein, 5 aa, Mycobacterium
GTLGT

SEQ ID NO: 982120 - protein, 10 aa, Mycobacterium
GTNGKTTTTS

SEQ ID NO: 982121 - protein, 6 aa, Mycobacterium
GTPEQL

SEQ ID NO: 982122 - protein, 6 aa, Mycobacterium
GVGKST

SEQ ID NO: 982123 - protein, 4 aa, Mycobacterium
GVGP

SEQ ID NO: 982124 - protein, 5 aa, Mycobacterium
GYDSS

SEQ ID NO: 982125 - protein, 13 aa, Mycobacterium
GYGGSDKPPRGYD

SEQ ID NO: 982126 - protein, 6 aa, Mycobacterium
GYGPGD

SEQ ID NO: 982127 - protein, 6 aa, Mycobacterium
GYNEDE

SEQ ID NO: 982128 - protein, 5 aa, Mycobacterium
GYPPE

SEQ ID NO: 982129 - protein, 5 aa, Mycobacterium
GYPRR

SEQ ID NO: 982130 - protein, 4 aa, Mycobacterium
HAEY

SEQ ID NO: 982131 - protein, 5 aa, Mycobacterium
HAKGE

SEQ ID NO: 982132 - protein, 4 aa, Mycobacterium
HDDP

SEQ ID NO: 982133 - protein, 19 aa, Mycobacterium
HDRAGYGNGNSRNRTRSKT

SEQ ID NO: 982134 - protein, 5 aa, Mycobacterium
HDSLE

SEQ ID NO: 982135 - protein, 15 aa, Mycobacterium
HDTSTLANDPNETEL

SEQ ID NO: 982136 - protein, 5 aa, Mycobacterium
HEDQK

SEQ ID NO: 982137 - protein, 12 aa, Mycobacterium
HEGQGPDHTSGR

SEQ ID NO: 982138 - protein, 8 aa, Mycobacterium
HGEPDEEK

SEQ ID NO: 982139 - protein, 12 aa, Mycobacterium
HGPPGTGKTHTA

SEQ ID NO: 982140 - protein, 10 aa, Mycobacterium
HGTGTPLGDP

SEQ ID NO: 982141 - protein, 5 aa, Mycobacterium
HKPGA

SEQ ID NO: 982142 - protein, 11 aa, Mycobacterium
HKPTFAPNVDG

SEQ ID NO: 982143 - protein, 8 aa, Mycobacterium
HNGAGKST

SEQ ID NO: 982144 - protein, 4 aa, Mycobacterium
HNPA

SEQ ID NO: 982145 - protein, 4 aa, Mycobacterium
HPGR

SEQ ID NO: 982146 - protein, 22 aa, Mycobacterium
HPHPTSPPQHHHPNPNQQKITT

SEQ ID NO: 982147 - protein, 7 aa, Mycobacterium
HPKEEPS

SEQ ID NO: 982148 - protein, 7 aa, Mycobacterium
HPTETRR

SEQ ID NO: 982149 - protein, 6 aa, Mycobacterium
HRSTNF

SEQ ID NO: 982150 - protein, 6 aa, Mycobacterium
HSPEPR

SEQ ID NO: 982151 - protein, 13 aa, Mycobacterium
HSPKGPQATGVRS

SEQ ID NO: 982152 - protein, 7 aa, Mycobacterium
HTPGHTR

SEQ ID NO: 982153 - protein, 5 aa, Mycobacterium
HTPGS

SEQ ID NO: 982154 - protein, 20 aa, Mycobacterium
IARKSENPSITRDVSGEGVQ

SEQ ID NO: 982155 - protein, 4 aa, Mycobacterium
IETE

SEQ ID NO: 982156 - protein, 4 aa, Mycobacterium
IGEG

SEQ ID NO: 982157 - protein, 8 aa, Mycobacterium
IGTGGGQG

SEQ ID NO: 982158 - protein, 4 aa, Mycobacterium
INTR

SEQ ID NO: 982159 - protein, 5 aa, Mycobacterium
IPATR

SEQ ID NO: 982160 - protein, 8 aa, Mycobacterium
IPKTNPEL

SEQ ID NO: 982161 - protein, 10 aa, Mycobacterium
IRPDGRHDAA

SEQ ID NO: 982162 - protein, 25 aa, Mycobacterium
ISGGEEGALNGPSIMPGGPAESYTS

SEQ ID NO: 982163 - protein, 7 aa, Mycobacterium
ISSANGR

SEQ ID NO: 982164 - protein, 4 aa, Mycobacterium
ISTV

SEQ ID NO: 982165 - protein, 6 aa, Mycobacterium
ITDEDA

SEQ ID NO: 982166 - protein, 5 aa, Mycobacterium
IVPPA

SEQ ID NO: 982167 - protein, 7 aa, Mycobacterium
KAEAEEK

SEQ ID NO: 982168 - protein, 10 aa, Mycobacterium
KAHHGRPGTV

SEQ ID NO: 982169 - protein, 4 aa, Mycobacterium
KAIT

SEQ ID NO: 982170 - protein, 4 aa, Mycobacterium
KAND

SEQ ID NO: 982171 - protein, 10 aa, Mycobacterium
KAPNAGPSRD

SEQ ID NO: 982172 - protein, 7 aa, Mycobacterium
KATQEDP

SEQ ID NO: 982173 - protein, 6 aa, Mycobacterium
KCGRPR

SEQ ID NO: 982174 - protein, 5 aa, Mycobacterium
KDDAI

SEQ ID NO: 982175 - protein, 8 aa, Mycobacterium
KDEGGRHT

SEQ ID NO: 982176 - protein, 10 aa, Mycobacterium
KDGRPKPTPI

SEQ ID NO: 982177 - protein, 7 aa, Mycobacterium
KDLTEGI

SEQ ID NO: 982178 - protein, 4 aa, Mycobacterium
KDSI

SEQ ID NO: 982179 - protein, 7 aa, Mycobacterium
KEDKEGR

SEQ ID NO: 982180 - protein, 11 aa, Mycobacterium
KERELPEPDDE

SEQ ID NO: 982181 - protein, 13 aa, Mycobacterium
KEYGSGSSRDWAA

SEQ ID NO: 982182 - protein, 6 aa, Mycobacterium
KGAGLG

SEQ ID NO: 982183 - protein, 10 aa, Mycobacterium
KGAHGSRSSV

SEQ ID NO: 982184 - protein, 10 aa, Mycobacterium
KGASEGAGLG

SEQ ID NO: 982185 - protein, 8 aa, Mycobacterium
KGTSGIDL

SEQ ID NO: 982186 - protein, 7 aa, Mycobacterium
KINEPRF

SEQ ID NO: 982187 - protein, 9 aa, Mycobacterium
KKSIGPDKV

SEQ ID NO: 982188 - protein, 12 aa, Mycobacterium
KLTDFDSNRSGG

SEQ ID NO: 982189 - protein, 7 aa, Mycobacterium
KNDAEEA

SEQ ID NO: 982190 - protein, 7 aa, Mycobacterium
KNFASDG

SEQ ID NO: 982191 - protein, 8 aa, Mycobacterium
KNPESQAQ

SEQ ID NO: 982192 - protein, 8 aa, Mycobacterium
KPGKGPAF

SEQ ID NO: 982193 - protein, 11 aa, Mycobacterium
KPGTTTPHTEF

SEQ ID NO: 982194 - protein, 8 aa, Mycobacterium
KPNVGKSS

SEQ ID NO: 982195 - protein, 8 aa, Mycobacterium
KPSRGRLP

SEQ ID NO: 982196 - protein, 7 aa, Mycobacterium
KPTKGQI

SEQ ID NO: 982197 - protein, 6 aa, Mycobacterium
KQAEAY

SEQ ID NO: 982198 - protein, 7 aa, Mycobacterium
KQARQAA

SEQ ID NO: 982199 - protein, 7 aa, Mycobacterium
KQDSTSA

SEQ ID NO: 982200 - protein, 11 aa, Mycobacterium
KQFEKTAEDPR

SEQ ID NO: 982201 - protein, 8 aa, Mycobacterium
KRENADEK

SEQ ID NO: 982202 - protein, 6 aa, Mycobacterium
KRPDYS

SEQ ID NO: 982203 - protein, 5 aa, Mycobacterium
KRPRE

SEQ ID NO: 982204 - protein, 6 aa, Mycobacterium
KRPYDE

SEQ ID NO: 982205 - protein, 7 aa, Mycobacterium
KRRPGVG

SEQ ID NO: 982206 - protein, 8 aa, Mycobacterium
KSASGGEL

SEQ ID NO: 982207 - protein, 8 aa, Mycobacterium
KSDAVDDE

SEQ ID NO: 982208 - protein, 6 aa, Mycobacterium
KSFGSS

SEQ ID NO: 982209 - protein, 8 aa, Mycobacterium
KSGDPRAA

SEQ ID NO: 982210 - protein, 5 aa, Mycobacterium
KSGTL

SEQ ID NO: 982211 - protein, 4 aa, Mycobacterium
KSLP

SEQ ID NO: 982212 - protein, 6 aa, Mycobacterium
KTAGAA

SEQ ID NO: 982213 - protein, 4 aa, Mycobacterium
KTGA

SEQ ID NO: 982214 - protein, 5 aa, Mycobacterium
KTYGG

SEQ ID NO: 982215 - protein, 5 aa, Mycobacterium
KVNDE

SEQ ID NO: 982216 - protein, 4 aa, Mycobacterium
KVTE

SEQ ID NO: 982217 - protein, 9 aa, Mycobacterium
KYSSPQTDF

SEQ ID NO: 982218 - protein, 6 aa, Mycobacterium
LAATRP

SEQ ID NO: 982219 - protein, 5 aa, Mycobacterium
LAPGD

SEQ ID NO: 982220 - protein, 9 aa, Mycobacterium
LAQPPPGSI

SEQ ID NO: 982221 - protein, 7 aa, Mycobacterium
LARPRTD

SEQ ID NO: 982222 - protein, 7 aa, Mycobacterium
LARSPKV

SEQ ID NO: 982223 - protein, 4 aa, Mycobacterium
LASG

SEQ ID NO: 982224 - protein, 5 aa, Mycobacterium
LASPD

SEQ ID NO: 982225 - protein, 7 aa, Mycobacterium
LDAYERG

SEQ ID NO: 982226 - protein, 4 aa, Mycobacterium
LDSA

SEQ ID NO: 982227 - protein, 22 aa, Mycobacterium
LDTQGVKNRKQARSRYGAKKEK

SEQ ID NO: 982228 - protein, 5 aa, Mycobacterium
LEGEA

SEQ ID NO: 982229 - protein, 7 aa, Mycobacterium
LEGGAGP

SEQ ID NO: 982230 - protein, 4 aa, Mycobacterium
LENG

SEQ ID NO: 982231 - protein, 4 aa, Mycobacterium
LERA

SEQ ID NO: 982232 - protein, 8 aa, Mycobacterium
LGARQGAG

SEQ ID NO: 982233 - protein, 8 aa, Mycobacterium
LGEDGDPL

SEQ ID NO: 982234 - protein, 6 aa, Mycobacterium
LGGPVD

SEQ ID NO: 982235 - protein, 5 aa, Mycobacterium
LGKPP

SEQ ID NO: 982236 - protein, 6 aa, Mycobacterium
LGRQRD

SEQ ID NO: 982237 - protein, 4 aa, Mycobacterium
LGSE

SEQ ID NO: 982238 - protein, 9 aa, Mycobacterium
LGSTSRAPR

SEQ ID NO: 982239 - protein, 7 aa, Mycobacterium
LKPEKDG

SEQ ID NO: 982240 - protein, 6 aa, Mycobacterium
LNPSTG

SEQ ID NO: 982241 - protein, 6 aa, Mycobacterium
LPAGTP

SEQ ID NO: 982242 - protein, 5 aa, Mycobacterium
LPDGT

SEQ ID NO: 982243 - protein, 6 aa, Mycobacterium
LPEDEQ

SEQ ID NO: 982244 - protein, 5 aa, Mycobacterium
LPPSA

SEQ ID NO: 982245 - protein, 6 aa, Mycobacterium
LPSGSP

SEQ ID NO: 982246 - protein, 8 aa, Mycobacterium
LQDPPSDD

SEQ ID NO: 982247 - protein, 5 aa, Mycobacterium
LRKGQ

SEQ ID NO: 982248 - protein, 4 aa, Mycobacterium
LRRK

SEQ ID NO: 982249 - protein, 7 aa, Mycobacterium
LRSPSGV

SEQ ID NO: 982250 - protein, 8 aa, Mycobacterium
LSAGERAD

SEQ ID NO: 982251 - protein, 8 aa, Mycobacterium
LSEDASPA

SEQ ID NO: 982252 - protein, 6 aa, Mycobacterium
LSESER

SEQ ID NO: 982253 - protein, 4 aa, Mycobacterium
LSGE

SEQ ID NO: 982254 - protein, 6 aa, Mycobacterium
LSGPGS

SEQ ID NO: 982255 - protein, 11 aa, Mycobacterium
LSGSANVTTGQ

SEQ ID NO: 982256 - protein, 17 aa, Mycobacterium
LSIGGDDDDVDVPPFMR

SEQ ID NO: 982257 - protein, 6 aa, Mycobacterium
LSPAQL

SEQ ID NO: 982258 - protein, 9 aa, Mycobacterium
LSPASGRPL

SEQ ID NO: 982259 - protein, 7 aa, Mycobacterium
LTDTNNG

SEQ ID NO: 982260 - protein, 15 aa, Mycobacterium
LTGGKEPNKGVNPDE

SEQ ID NO: 982261 - protein, 6 aa, Mycobacterium
LTPAEG

SEQ ID NO: 982262 - protein, 4 aa, Mycobacterium
LTPR

SEQ ID NO: 982263 - protein, 5 aa, Mycobacterium
LTRTG

SEQ ID NO: 982264 - protein, 6 aa, Mycobacterium
MAPGSQ

SEQ ID NO: 982265 - protein, 5 aa, Mycobacterium
MHGPA

SEQ ID NO: 982266 - protein, 7 aa, Mycobacterium
MPGPTGL

SEQ ID NO: 982267 - protein, 13 aa, Mycobacterium
MPNPKTGTVTPDV

SEQ ID NO: 982268 - protein, 6 aa, Mycobacterium
MSKSRG

SEQ ID NO: 982269 - protein, 4 aa, Mycobacterium
NAEG

SEQ ID NO: 982270 - protein, 9 aa, Mycobacterium
NAGSPEVDT

SEQ ID NO: 982271 - protein, 7 aa, Mycobacterium
NANPSAR

SEQ ID NO: 982272 - protein, 7 aa, Mycobacterium
NAPAIAA

SEQ ID NO: 982273 - protein, 6 aa, Mycobacterium
NATESL

SEQ ID NO: 982274 - protein, 7 aa, Mycobacterium
NETSTGV

SEQ ID NO: 982275 - protein, 7 aa, Mycobacterium
NGERTGN

SEQ ID NO: 982276 - protein, 5 aa, Mycobacterium
NGLRP

SEQ ID NO: 982277 - protein, 5 aa, Mycobacterium
NGPEL

SEQ ID NO: 982278 - protein, 10 aa, Mycobacterium
NGPGDPATAD

SEQ ID NO: 982279 - protein, 8 aa, Mycobacterium
NGRRSAES

SEQ ID NO: 982280 - protein, 6 aa, Mycobacterium
NGSGGI

SEQ ID NO: 982281 - protein, 10 aa, Mycobacterium
NHDPLDASSV

SEQ ID NO: 982282 - protein, 7 aa, Mycobacterium
NHYPDDI

SEQ ID NO: 982283 - protein, 7 aa, Mycobacterium
NIEEGGS

SEQ ID NO: 982284 - protein, 13 aa, Mycobacterium
NIGNSAVTSSIAE

SEQ ID NO: 982285 - protein, 5 aa, Mycobacterium
NIPDE

SEQ ID NO: 982286 - protein, 10 aa, Mycobacterium
NKIEPQAPVD

SEQ ID NO: 982287 - protein, 23 aa, Mycobacterium
NKTGYHKRQGHRQQLTVLKVTGI

SEQ ID NO: 982288 - protein, 9 aa, Mycobacterium
NNPAKRVGL

SEQ ID NO: 982289 - protein, 7 aa, Mycobacterium
NNPLSGL

SEQ ID NO: 982290 - protein, 8 aa, Mycobacterium
NNTGEIKS

SEQ ID NO: 982291 - protein, 6 aa, Mycobacterium
NPAGWQ

SEQ ID NO: 982292 - protein, 6 aa, Mycobacterium
NPGDAV

SEQ ID NO: 982293 - protein, 7 aa, Mycobacterium
NPQLPTV

SEQ ID NO: 982294 - protein, 4 aa, Mycobacterium
NPSP

SEQ ID NO: 982295 - protein, 11 aa, Mycobacterium
NPTTSPFGNPI

SEQ ID NO: 982296 - protein, 6 aa, Mycobacterium
NPVTAH

SEQ ID NO: 982297 - protein, 6 aa, Mycobacterium
NRLGTN

SEQ ID NO: 982298 - protein, 4 aa, Mycobacterium
NRPT

SEQ ID NO: 982299 - protein, 5 aa, Mycobacterium
NRTGT

SEQ ID NO: 982300 - protein, 7 aa, Mycobacterium
NRVPPGS

SEQ ID NO: 982301 - protein, 9 aa, Mycobacterium
NSESAEKAA

SEQ ID NO: 982302 - protein, 7 aa, Mycobacterium
NSGPAIA

SEQ ID NO: 982303 - protein, 9 aa, Mycobacterium
NSQSGKGGV

SEQ ID NO: 982304 - protein, 4 aa, Mycobacterium
NTEP

SEQ ID NO: 982305 - protein, 9 aa, Mycobacterium
NTGRFSPET

SEQ ID NO: 982306 - protein, 12 aa, Mycobacterium
NTHEGGTHEEGF

SEQ ID NO: 982307 - protein, 6 aa, Mycobacterium
NTIRAH

SEQ ID NO: 982308 - protein, 22 aa, Mycobacterium
NTTIPTKRSETFTTADDNQPSV

SEQ ID NO: 982309 - protein, 6 aa, Mycobacterium
NYQPGT

SEQ ID NO: 982310 - protein, 4 aa, Mycobacterium
PADV

SEQ ID NO: 982311 - protein, 5 aa, Mycobacterium
PAEGE

SEQ ID NO: 982312 - protein, 4 aa, Mycobacterium
PAGG

SEQ ID NO: 982313 - protein, 15 aa, Mycobacterium
PAGQSWAATAGSGDV

SEQ ID NO: 982314 - protein, 4 aa, Mycobacterium
PAGS

SEQ ID NO: 982315 - protein, 4 aa, Mycobacterium
PALS

SEQ ID NO: 982316 - protein, 5 aa, Mycobacterium
PALSS

SEQ ID NO: 982317 - protein, 5 aa, Mycobacterium
PAQQR

SEQ ID NO: 982318 - protein, 8 aa, Mycobacterium
PASPGTGV

SEQ ID NO: 982319 - protein, 4 aa, Mycobacterium
PDAT

SEQ ID NO: 982320 - protein, 8 aa, Mycobacterium
PDDGGEEV

SEQ ID NO: 982321 - protein, 6 aa, Mycobacterium
PDEDLG

SEQ ID NO: 982322 - protein, 9 aa, Mycobacterium
PDGSDAWDG

SEQ ID NO: 982323 - protein, 9 aa, Mycobacterium
PDNDPRGTR

SEQ ID NO: 982324 - protein, 9 aa, Mycobacterium
PDPDRTLAE

SEQ ID NO: 982325 - protein, 4 aa, Mycobacterium
PDPN

SEQ ID NO: 982326 - protein, 10 aa, Mycobacterium
PDPNGERAGH

SEQ ID NO: 982327 - protein, 4 aa, Mycobacterium
PDRV

SEQ ID NO: 982328 - protein, 4 aa, Mycobacterium
PDVN

SEQ ID NO: 982329 - protein, 10 aa, Mycobacterium
PEAAAGPHDA

SEQ ID NO: 982330 - protein, 6 aa, Mycobacterium
PEDGSA

SEQ ID NO: 982331 - protein, 6 aa, Mycobacterium
PEDTDR

SEQ ID NO: 982332 - protein, 4 aa, Mycobacterium
PEGI

SEQ ID NO: 982333 - protein, 11 aa, Mycobacterium
PEKQARKARET

SEQ ID NO: 982334 - protein, 9 aa, Mycobacterium
PEMKSTGEV

SEQ ID NO: 982335 - protein, 4 aa, Mycobacterium
PENK

SEQ ID NO: 982336 - protein, 11 aa, Mycobacterium
PETVSTDYDTA

SEQ ID NO: 982337 - protein, 7 aa, Mycobacterium
PGAPIDT

SEQ ID NO: 982338 - protein, 4 aa, Mycobacterium
PGAR

SEQ ID NO: 982339 - protein, 4 aa, Mycobacterium
PGEL

SEQ ID NO: 982340 - protein, 4 aa, Mycobacterium
PGEQ

SEQ ID NO: 982341 - protein, 5 aa, Mycobacterium
PGFGG

SEQ ID NO: 982342 - protein, 5 aa, Mycobacterium
PGGES

SEQ ID NO: 982343 - protein, 4 aa, Mycobacterium
PGGV

SEQ ID NO: 982344 - protein, 7 aa, Mycobacterium
PGHTPGS

SEQ ID NO: 982345 - protein, 5 aa, Mycobacterium
PGPTD

SEQ ID NO: 982346 - protein, 15 aa, Mycobacterium
PGPTGEQHVAYLKRP

SEQ ID NO: 982347 - protein, 16 aa, Mycobacterium
PGVQVSSDAAAARSAA

SEQ ID NO: 982348 - protein, 7 aa, Mycobacterium
PGVTRDR

SEQ ID NO: 982349 - protein, 7 aa, Mycobacterium
PHGNGET

SEQ ID NO: 982350 - protein, 10 aa, Mycobacterium
PHTEEPTNWS

SEQ ID NO: 982351 - protein, 6 aa, Mycobacterium
PHYGPP

SEQ ID NO: 982352 - protein, 5 aa, Mycobacterium
PIDQP

SEQ ID NO: 982353 - protein, 9 aa, Mycobacterium
PKSGYPGHA

SEQ ID NO: 982354 - protein, 10 aa, Mycobacterium
PLEATKEGRG

SEQ ID NO: 982355 - protein, 6 aa, Mycobacterium
PNAAPH

SEQ ID NO: 982356 - protein, 5 aa, Mycobacterium
PNAPS

SEQ ID NO: 982357 - protein, 6 aa, Mycobacterium
PNARPP

SEQ ID NO: 982358 - protein, 8 aa, Mycobacterium
PNGAGKTS

SEQ ID NO: 982359 - protein, 8 aa, Mycobacterium
PNGTGKTS

SEQ ID NO: 982360 - protein, 10 aa, Mycobacterium
PNPEEPGATD

SEQ ID NO: 982361 - protein, 4 aa, Mycobacterium
PQLP

SEQ ID NO: 982362 - protein, 20 aa, Mycobacterium
PRDRAGTFEPKTVEKRQRRL

SEQ ID NO: 982363 - protein, 10 aa, Mycobacterium
PREAAAMDPQ

SEQ ID NO: 982364 - protein, 7 aa, Mycobacterium
PRPGTPF

SEQ ID NO: 982365 - protein, 8 aa, Mycobacterium
PRQEDADA

SEQ ID NO: 982366 - protein, 7 aa, Mycobacterium
PRTQSGK

SEQ ID NO: 982367 - protein, 9 aa, Mycobacterium
PSAGGGGKG

SEQ ID NO: 982368 - protein, 8 aa, Mycobacterium
PSGSGKST

SEQ ID NO: 982369 - protein, 6 aa, Mycobacterium
PSGTEP

SEQ ID NO: 982370 - protein, 5 aa, Mycobacterium
PSHSP

SEQ ID NO: 982371 - protein, 4 aa, Mycobacterium
PTDV

SEQ ID NO: 982372 - protein, 8 aa, Mycobacterium
PTGAGKTV

SEQ ID NO: 982373 - protein, 4 aa, Mycobacterium
PTGE

SEQ ID NO: 982374 - protein, 12 aa, Mycobacterium
PTITRSTPEGAR

SEQ ID NO: 982375 - protein, 4 aa, Mycobacterium
PTLD

SEQ ID NO: 982376 - protein, 4 aa, Mycobacterium
PTLR

SEQ ID NO: 982377 - protein, 4 aa, Mycobacterium
PTNP

SEQ ID NO: 982378 - protein, 6 aa, Mycobacterium
PTPKTV

SEQ ID NO: 982379 - protein, 4 aa, Mycobacterium
PTPL

SEQ ID NO: 982380 - protein, 4 aa, Mycobacterium
PTPY

SEQ ID NO: 982381 - protein, 5 aa, Mycobacterium
PTRPR

SEQ ID NO: 982382 - protein, 12 aa, Mycobacterium
PTRSHTGAAQGG

SEQ ID NO: 982383 - protein, 4 aa, Mycobacterium
PTRT

SEQ ID NO: 982384 - protein, 8 aa, Mycobacterium
PTSTGAAK

SEQ ID NO: 982385 - protein, 10 aa, Mycobacterium
PTTAQPPPLA

SEQ ID NO: 982386 - protein, 4 aa, Mycobacterium
PTTV

SEQ ID NO: 982387 - protein, 4 aa, Mycobacterium
PVAG

SEQ ID NO: 982388 - protein, 4 aa, Mycobacterium
PVAP

SEQ ID NO: 982389 - protein, 4 aa, Mycobacterium
PVRG

SEQ ID NO: 982390 - protein, 8 aa, Mycobacterium
PVRSTDGR

SEQ ID NO: 982391 - protein, 4 aa, Mycobacterium
PVSE

SEQ ID NO: 982392 - protein, 6 aa, Mycobacterium
PWTGGS

SEQ ID NO: 982393 - protein, 8 aa, Mycobacterium
PYGEDGTI

SEQ ID NO: 982394 - protein, 7 aa, Mycobacterium
QAASEPV

SEQ ID NO: 982395 - protein, 7 aa, Mycobacterium
QDRTGGF

SEQ ID NO: 982396 - protein, 7 aa, Mycobacterium
QDTAKRT

SEQ ID NO: 982397 - protein, 8 aa, Mycobacterium
QEEGEEPA

SEQ ID NO: 982398 - protein, 9 aa, Mycobacterium
QGKEEFDTE

SEQ ID NO: 982399 - protein, 8 aa, Mycobacterium
QGPGEVTA

SEQ ID NO: 982400 - protein, 7 aa, Mycobacterium
QGQAGDN

SEQ ID NO: 982401 - protein, 10 aa, Mycobacterium
QGSGKTTLAG

SEQ ID NO: 982402 - protein, 13 aa, Mycobacterium
QGTRPPTRTVRGL

SEQ ID NO: 982403 - protein, 7 aa, Mycobacterium
QKGTTIA

SEQ ID NO: 982404 - protein, 6 aa, Mycobacterium
QLKTGR

SEQ ID NO: 982405 - protein, 4 aa, Mycobacterium
QLSG

SEQ ID NO: 982406 - protein, 9 aa, Mycobacterium
QLSRGEDPA

SEQ ID NO: 982407 - protein, 7 aa, Mycobacterium
QNIAGAG

SEQ ID NO: 982408 - protein, 7 aa, Mycobacterium
QPAMPGQ

SEQ ID NO: 982409 - protein, 13 aa, Mycobacterium
QPAPTLSGGEAQR

SEQ ID NO: 982410 - protein, 7 aa, Mycobacterium
QPFPGPG

SEQ ID NO: 982411 - protein, 6 aa, Mycobacterium
QPGALG

SEQ ID NO: 982412 - protein, 7 aa, Mycobacterium
QPSATGR

SEQ ID NO: 982413 - protein, 4 aa, Mycobacterium
QPSS

SEQ ID NO: 982414 - protein, 5 aa, Mycobacterium
QPTDG

SEQ ID NO: 982415 - protein, 6 aa, Mycobacterium
QQEAGR

SEQ ID NO: 982416 - protein, 8 aa, Mycobacterium
QQSGNSPM

SEQ ID NO: 982417 - protein, 12 aa, Mycobacterium
QRAEREKQWRSG

SEQ ID NO: 982418 - protein, 4 aa, Mycobacterium
QRPG

SEQ ID NO: 982419 - protein, 6 aa, Mycobacterium
QSGSDR

SEQ ID NO: 982420 - protein, 5 aa, Mycobacterium
QSKRR

SEQ ID NO: 982421 - protein, 4 aa, Mycobacterium
QSLE

SEQ ID NO: 982422 - protein, 16 aa, Mycobacterium
QSPIGRTPRSNPATYT

SEQ ID NO: 982423 - protein, 4 aa, Mycobacterium
QSPQ

SEQ ID NO: 982424 - protein, 7 aa, Mycobacterium
QTQSEVR

SEQ ID NO: 982425 - protein, 6 aa, Mycobacterium
QTRERA

SEQ ID NO: 982426 - protein, 8 aa, Mycobacterium
RAAQQSWP

SEQ ID NO: 982427 - protein, 6 aa, Mycobacterium
RADDTA

SEQ ID NO: 982428 - protein, 8 aa, Mycobacterium
RAIAGPGT

SEQ ID NO: 982429 - protein, 6 aa, Mycobacterium
RAQYER

SEQ ID NO: 982430 - protein, 6 aa, Mycobacterium
RARDAG

SEQ ID NO: 982431 - protein, 5 aa, Mycobacterium
RATKG

SEQ ID NO: 982432 - protein, 4 aa, Mycobacterium
RDAH

SEQ ID NO: 982433 - protein, 8 aa, Mycobacterium
RDETDVNP

SEQ ID NO: 982434 - protein, 6 aa, Mycobacterium
RDGSER

SEQ ID NO: 982435 - protein, 4 aa, Mycobacterium
RDGY

SEQ ID NO: 982436 - protein, 6 aa, Mycobacterium
RDPRTK

SEQ ID NO: 982437 - protein, 8 aa, Mycobacterium
RDSRANAR

SEQ ID NO: 982438 - protein, 7 aa, Mycobacterium
REALESA

SEQ ID NO: 982439 - protein, 5 aa, Mycobacterium
REEGA

SEQ ID NO: 982440 - protein, 9 aa, Mycobacterium
REKASEGTP

SEQ ID NO: 982441 - protein, 7 aa, Mycobacterium
RFSGGTT

SEQ ID NO: 982442 - protein, 6 aa, Mycobacterium
RGDEIT

SEQ ID NO: 982443 - protein, 8 aa, Mycobacterium
RGEATEQL

SEQ ID NO: 982444 - protein, 14 aa, Mycobacterium
RGGHPTPMSSTKAT

SEQ ID NO: 982445 - protein, 6 aa, Mycobacterium
RGGPAT

SEQ ID NO: 982446 - protein, 8 aa, Mycobacterium
RGGYDGRG

SEQ ID NO: 982447 - protein, 5 aa, Mycobacterium
RGKES

SEQ ID NO: 982448 - protein, 7 aa, Mycobacterium
RGPNAGS

SEQ ID NO: 982449 - protein, 4 aa, Mycobacterium
RGRA

SEQ ID NO: 982450 - protein, 4 aa, Mycobacterium
RGRN

SEQ ID NO: 982451 - protein, 4 aa, Mycobacterium
RGRQ

SEQ ID NO: 982452 - protein, 8 aa, Mycobacterium
RGSGTYAD

SEQ ID NO: 982453 - protein, 6 aa, Mycobacterium
RGSQWA

SEQ ID NO: 982454 - protein, 4 aa, Mycobacterium
RGTR

SEQ ID NO: 982455 - protein, 6 aa, Mycobacterium
RHEQTA

SEQ ID NO: 982456 - protein, 7 aa, Mycobacterium
RHPGTSQ

SEQ ID NO: 982457 - protein, 13 aa, Mycobacterium
RHPSRSQVLRDYL

SEQ ID NO: 982458 - protein, 6 aa, Mycobacterium
RKAHGD

SEQ ID NO: 982459 - protein, 17 aa, Mycobacterium
RKISDGDKLAGRHGNKG

SEQ ID NO: 982460 - protein, 5 aa, Mycobacterium
RKPKF

SEQ ID NO: 982461 - protein, 9 aa, Mycobacterium
RKPTRSPNQ

SEQ ID NO: 982462 - protein, 10 aa, Mycobacterium
RKQAKPGQFD

SEQ ID NO: 982463 - protein, 5 aa, Mycobacterium
RLAAP

SEQ ID NO: 982464 - protein, 11 aa, Mycobacterium
RNGGAMADPGS

SEQ ID NO: 982465 - protein, 7 aa, Mycobacterium
RPDRSTT

SEQ ID NO: 982466 - protein, 8 aa, Mycobacterium
RPERRNAL

SEQ ID NO: 982467 - protein, 13 aa, Mycobacterium
RPGEPPTKESAQT

SEQ ID NO: 982468 - protein, 5 aa, Mycobacterium
RPGYE

SEQ ID NO: 982469 - protein, 20 aa, Mycobacterium
RPLTKKPAETRMGSGKGSPE

SEQ ID NO: 982470 - protein, 4 aa, Mycobacterium
RPRS

SEQ ID NO: 982471 - protein, 6 aa, Mycobacterium
RPSETA

SEQ ID NO: 982472 - protein, 12 aa, Mycobacterium
RPSNPASHRGKG

SEQ ID NO: 982473 - protein, 6 aa, Mycobacterium
RQRREK

SEQ ID NO: 982474 - protein, 9 aa, Mycobacterium
RRAGAQGVG

SEQ ID NO: 982475 - protein, 6 aa, Mycobacterium
RRGELG

SEQ ID NO: 982476 - protein, 4 aa, Mycobacterium
RRGS

SEQ ID NO: 982477 - protein, 9 aa, Mycobacterium
RRNDDEPAE

SEQ ID NO: 982478 - protein, 12 aa, Mycobacterium
RRRASGGPAEQT

SEQ ID NO: 982479 - protein, 6 aa, Mycobacterium
RRSASV

SEQ ID NO: 982480 - protein, 7 aa, Mycobacterium
RRTAEEL

SEQ ID NO: 982481 - protein, 8 aa, Mycobacterium
RSALQNAA

SEQ ID NO: 982482 - protein, 6 aa, Mycobacterium
RSENAT

SEQ ID NO: 982483 - protein, 8 aa, Mycobacterium
RSGETEDT

SEQ ID NO: 982484 - protein, 9 aa, Mycobacterium
RSKTQGRAN

SEQ ID NO: 982485 - protein, 5 aa, Mycobacterium
RSLNA

SEQ ID NO: 982486 - protein, 5 aa, Mycobacterium
RSLPE

SEQ ID NO: 982487 - protein, 7 aa, Mycobacterium
RSPDEFS

SEQ ID NO: 982488 - protein, 5 aa, Mycobacterium
RSPFS

SEQ ID NO: 982489 - protein, 6 aa, Mycobacterium
RSPGGL

SEQ ID NO: 982490 - protein, 6 aa, Mycobacterium
RSSEVA

SEQ ID NO: 982491 - protein, 16 aa, Mycobacterium
RSSGPGGQSVNTTDSA

SEQ ID NO: 982492 - protein, 7 aa, Mycobacterium
RSSVDDR

SEQ ID NO: 982493 - protein, 6 aa, Mycobacterium
RSTGDD

SEQ ID NO: 982494 - protein, 8 aa, Mycobacterium
RTAATDGS

SEQ ID NO: 982495 - protein, 8 aa, Mycobacterium
RTADSSQR

SEQ ID NO: 982496 - protein, 4 aa, Mycobacterium
RTGL

SEQ ID NO: 982497 - protein, 6 aa, Mycobacterium
RTGMGG

SEQ ID NO: 982498 - protein, 4 aa, Mycobacterium
RTGS

SEQ ID NO: 982499 - protein, 18 aa, Mycobacterium
RTNERARLRNKSVKSSLR

SEQ ID NO: 982500 - protein, 4 aa, Mycobacterium
RTRT

SEQ ID NO: 982501 - protein, 8 aa, Mycobacterium
RTVADPGS

SEQ ID NO: 982502 - protein, 15 aa, Mycobacterium
RVSRSSALASKATGF

SEQ ID NO: 982503 - protein, 9 aa, Mycobacterium
RYDRDGDQH

SEQ ID NO: 982504 - protein, 8 aa, Mycobacterium
RYSNTGEG

SEQ ID NO: 982505 - protein, 5 aa, Mycobacterium
RYTGR

SEQ ID NO: 982506 - protein, 6 aa, Mycobacterium
RYTGRG

SEQ ID NO: 982507 - protein, 8 aa, Mycobacterium
SAADRQSD

SEQ ID NO: 982508 - protein, 5 aa, Mycobacterium
SACGK

SEQ ID NO: 982509 - protein, 10 aa, Mycobacterium
SADGLTPREQ

SEQ ID NO: 982510 - protein, 7 aa, Mycobacterium
SADQQAT

SEQ ID NO: 982511 - protein, 5 aa, Mycobacterium
SAGTF

SEQ ID NO: 982512 - protein, 8 aa, Mycobacterium
SAKTGRAV

SEQ ID NO: 982513 - protein, 27 aa, Mycobacterium
SALPNGPKVSHGGALSPRGDWRAPSDM

SEQ ID NO: 982514 - protein, 10 aa, Mycobacterium
SARGDGRSLK

SEQ ID NO: 982515 - protein, 4 aa, Mycobacterium
SARR

SEQ ID NO: 982516 - protein, 4 aa, Mycobacterium
SAYV

SEQ ID NO: 982517 - protein, 6 aa, Mycobacterium
SDPEKR

SEQ ID NO: 982518 - protein, 4 aa, Mycobacterium
SDRA

SEQ ID NO: 982519 - protein, 5 aa, Mycobacterium
SEAEV

SEQ ID NO: 982520 - protein, 4 aa, Mycobacterium
SEAQ

SEQ ID NO: 982521 - protein, 5 aa, Mycobacterium
SEEQL

SEQ ID NO: 982522 - protein, 4 aa, Mycobacterium
SEFD

SEQ ID NO: 982523 - protein, 6 aa, Mycobacterium
SEGKDG

SEQ ID NO: 982524 - protein, 4 aa, Mycobacterium
SEHS

SEQ ID NO: 982525 - protein, 5 aa, Mycobacterium
SENTH

SEQ ID NO: 982526 - protein, 5 aa, Mycobacterium
SEPHA

SEQ ID NO: 982527 - protein, 4 aa, Mycobacterium
SEPV

SEQ ID NO: 982528 - protein, 5 aa, Mycobacterium
SEREA

SEQ ID NO: 982529 - protein, 7 aa, Mycobacterium
SERVQPA

SEQ ID NO: 982530 - protein, 4 aa, Mycobacterium
SFGT

SEQ ID NO: 982531 - protein, 5 aa, Mycobacterium
SGAGN

SEQ ID NO: 982532 - protein, 8 aa, Mycobacterium
SGCGKTTT

SEQ ID NO: 982533 - protein, 6 aa, Mycobacterium
SGDARE

SEQ ID NO: 982534 - protein, 8 aa, Mycobacterium
SGEAKWGQ

SEQ ID NO: 982535 - protein, 7 aa, Mycobacterium
SGGGNRL

SEQ ID NO: 982536 - protein, 4 aa, Mycobacterium
SGIT

SEQ ID NO: 982537 - protein, 6 aa, Mycobacterium
SGLPAD

SEQ ID NO: 982538 - protein, 5 aa, Mycobacterium
SGNAA

SEQ ID NO: 982539 - protein, 6 aa, Mycobacterium
SGPAAM

SEQ ID NO: 982540 - protein, 7 aa, Mycobacterium
SGPAGYT

SEQ ID NO: 982541 - protein, 4 aa, Mycobacterium
SGRP

SEQ ID NO: 982542 - protein, 8 aa, Mycobacterium
SGRRGPQA

SEQ ID NO: 982543 - protein, 4 aa, Mycobacterium
SGRT

SEQ ID NO: 982544 - protein, 7 aa, Mycobacterium
SGSGSSY

SEQ ID NO: 982545 - protein, 10 aa, Mycobacterium
SGSTGSPKAV

SEQ ID NO: 982546 - protein, 7 aa, Mycobacterium
SGTEATM

SEQ ID NO: 982547 - protein, 5 aa, Mycobacterium
SGTEL

SEQ ID NO: 982548 - protein, 7 aa, Mycobacterium
SGTYRGK

SEQ ID NO: 982549 - protein, 8 aa, Mycobacterium
SIGEPGTQ

SEQ ID NO: 982550 - protein, 8 aa, Mycobacterium
SIPAPGLG

SEQ ID NO: 982551 - protein, 11 aa, Mycobacterium
SITDGASSRRN

SEQ ID NO: 982552 - protein, 7 aa, Mycobacterium
SKGAATL

SEQ ID NO: 982553 - protein, 16 aa, Mycobacterium
SKGEAGTGDVSNATTH

SEQ ID NO: 982554 - protein, 7 aa, Mycobacterium
SKITERT

SEQ ID NO: 982555 - protein, 7 aa, Mycobacterium
SKNTVSR

SEQ ID NO: 982556 - protein, 7 aa, Mycobacterium
SKTPVPQ

SEQ ID NO: 982557 - protein, 7 aa, Mycobacterium
SKTQQDA

SEQ ID NO: 982558 - protein, 4 aa, Mycobacterium
SLEA

SEQ ID NO: 982559 - protein, 7 aa, Mycobacterium
SLGSDNA

SEQ ID NO: 982560 - protein, 4 aa, Mycobacterium
SNVP

SEQ ID NO: 982561 - protein, 5 aa, Mycobacterium
SPAPI

SEQ ID NO: 982562 - protein, 10 aa, Mycobacterium
SPDKVEGGMR

SEQ ID NO: 982563 - protein, 8 aa, Mycobacterium
SPEDEDRE

SEQ ID NO: 982564 - protein, 6 aa, Mycobacterium
SPEEPL

SEQ ID NO: 982565 - protein, 6 aa, Mycobacterium
SPFGQG

SEQ ID NO: 982566 - protein, 6 aa, Mycobacterium
SPGGGF

SEQ ID NO: 982567 - protein, 13 aa, Mycobacterium
SPGPGTPERAGAS

SEQ ID NO: 982568 - protein, 9 aa, Mycobacterium
SPGSPAGRR

SEQ ID NO: 982569 - protein, 6 aa, Mycobacterium
SPHPAA

SEQ ID NO: 982570 - protein, 6 aa, Mycobacterium
SPIGTG

SEQ ID NO: 982571 - protein, 4 aa, Mycobacterium
SPNM

SEQ ID NO: 982572 - protein, 9 aa, Mycobacterium
SPPKAGKTT

SEQ ID NO: 982573 - protein, 5 aa, Mycobacterium
SPPPH

SEQ ID NO: 982574 - protein, 4 aa, Mycobacterium
SPSP

SEQ ID NO: 982575 - protein, 6 aa, Mycobacterium
SQGAVS

SEQ ID NO: 982576 - protein, 4 aa, Mycobacterium
SQGE

SEQ ID NO: 982577 - protein, 4 aa, Mycobacterium
SQLR

SEQ ID NO: 982578 - protein, 9 aa, Mycobacterium
SQPDTGEQA

SEQ ID NO: 982579 - protein, 6 aa, Mycobacterium
SQVPDD

SEQ ID NO: 982580 - protein, 4 aa, Mycobacterium
SRDD

SEQ ID NO: 982581 - protein, 11 aa, Mycobacterium
SRGPIDPTASV

SEQ ID NO: 982582 - protein, 11 aa, Mycobacterium
SRHDLGNPGGY

SEQ ID NO: 982583 - protein, 8 aa, Mycobacterium
SRNSSNSV

SEQ ID NO: 982584 - protein, 5 aa, Mycobacterium
SRPCT

SEQ ID NO: 982585 - protein, 6 aa, Mycobacterium
SRRGPH

SEQ ID NO: 982586 - protein, 13 aa, Mycobacterium
SRRTRSSKDVSTA

SEQ ID NO: 982587 - protein, 9 aa, Mycobacterium
SRTPGNGQV

SEQ ID NO: 982588 - protein, 5 aa, Mycobacterium
SRTPV

SEQ ID NO: 982589 - protein, 9 aa, Mycobacterium
SSATTESES

SEQ ID NO: 982590 - protein, 6 aa, Mycobacterium
SSEDAM

SEQ ID NO: 982591 - protein, 8 aa, Mycobacterium
SSEEDEPV

SEQ ID NO: 982592 - protein, 4 aa, Mycobacterium
SSGG

SEQ ID NO: 982593 - protein, 7 aa, Mycobacterium
SSIGSGV

SEQ ID NO: 982594 - protein, 6 aa, Mycobacterium
SSREPY

SEQ ID NO: 982595 - protein, 6 aa, Mycobacterium
STAESH

SEQ ID NO: 982596 - protein, 4 aa, Mycobacterium
STLT

SEQ ID NO: 982597 - protein, 4 aa, Mycobacterium
STPG

SEQ ID NO: 982598 - protein, 9 aa, Mycobacterium
STPTGSTAY

SEQ ID NO: 982599 - protein, 11 aa, Mycobacterium
SVEVADNGRGI

SEQ ID NO: 982600 - protein, 4 aa, Mycobacterium
TACS

SEQ ID NO: 982601 - protein, 7 aa, Mycobacterium
TADLADA

SEQ ID NO: 982602 - protein, 6 aa, Mycobacterium
TADPAH

SEQ ID NO: 982603 - protein, 8 aa, Mycobacterium
TAEEAKDY

SEQ ID NO: 982604 - protein, 6 aa, Mycobacterium
TAEVGD

SEQ ID NO: 982605 - protein, 4 aa, Mycobacterium
TAGT

SEQ ID NO: 982606 - protein, 9 aa, Mycobacterium
TAPTNGAAG

SEQ ID NO: 982607 - protein, 8 aa, Mycobacterium
TATTRDVN

SEQ ID NO: 982608 - protein, 10 aa, Mycobacterium
TAVRDKDGIS

SEQ ID NO: 982609 - protein, 5 aa, Mycobacterium
TDAEG

SEQ ID NO: 982610 - protein, 6 aa, Mycobacterium
TDAESQ

SEQ ID NO: 982611 - protein, 4 aa, Mycobacterium
TDDA

SEQ ID NO: 982612 - protein, 5 aa, Mycobacterium
TDGVG

SEQ ID NO: 982613 - protein, 11 aa, Mycobacterium
TDPNTEGEATA

SEQ ID NO: 982614 - protein, 4 aa, Mycobacterium
TDRP

SEQ ID NO: 982615 - protein, 4 aa, Mycobacterium
TDSM

SEQ ID NO: 982616 - protein, 5 aa, Mycobacterium
TDTGT

SEQ ID NO: 982617 - protein, 7 aa, Mycobacterium
TDYPAAA

SEQ ID NO: 982618 - protein, 5 aa, Mycobacterium
TEAGA

SEQ ID NO: 982619 - protein, 11 aa, Mycobacterium
TEAKVRGYQPG

SEQ ID NO: 982620 - protein, 5 aa, Mycobacterium
TERQR

SEQ ID NO: 982621 - protein, 7 aa, Mycobacterium
TGAAQRA

SEQ ID NO: 982622 - protein, 6 aa, Mycobacterium
TGAKND

SEQ ID NO: 982623 - protein, 4 aa, Mycobacterium
TGAS

SEQ ID NO: 982624 - protein, 5 aa, Mycobacterium
TGEKL

SEQ ID NO: 982625 - protein, 9 aa, Mycobacterium
TGETGTGKT

SEQ ID NO: 982626 - protein, 6 aa, Mycobacterium
TGIGRT

SEQ ID NO: 982627 - protein, 6 aa, Mycobacterium
TGLGSA

SEQ ID NO: 982628 - protein, 5 aa, Mycobacterium
TGLRE

SEQ ID NO: 982629 - protein, 12 aa, Mycobacterium
TGSGTSSNMNTN

SEQ ID NO: 982630 - protein, 11 aa, Mycobacterium
TGVSGSGKSTL

SEQ ID NO: 982631 - protein, 5 aa, Mycobacterium
TGWSE

SEQ ID NO: 982632 - protein, 9 aa, Mycobacterium
THGKTTTTS

SEQ ID NO: 982633 - protein, 10 aa, Mycobacterium
TIAQASPPDM

SEQ ID NO: 982634 - protein, 4 aa, Mycobacterium
TKFH

SEQ ID NO: 982635 - protein, 5 aa, Mycobacterium
TLDPG

SEQ ID NO: 982636 - protein, 9 aa, Mycobacterium
TLPAEPAKT

SEQ ID NO: 982637 - protein, 7 aa, Mycobacterium
TLPNRDG

SEQ ID NO: 982638 - protein, 6 aa, Mycobacterium
TNEGLR

SEQ ID NO: 982639 - protein, 5 aa, Mycobacterium
TNGRI

SEQ ID NO: 982640 - protein, 7 aa, Mycobacterium
TNPGTIG

SEQ ID NO: 982641 - protein, 6 aa, Mycobacterium
TNPPLD

SEQ ID NO: 982642 - protein, 4 aa, Mycobacterium
TNTP

SEQ ID NO: 982643 - protein, 5 aa, Mycobacterium
TPADV

SEQ ID NO: 982644 - protein, 5 aa, Mycobacterium
TPDEL

SEQ ID NO: 982645 - protein, 4 aa, Mycobacterium
TPDQ

SEQ ID NO: 982646 - protein, 4 aa, Mycobacterium
TPEL

SEQ ID NO: 982647 - protein, 5 aa, Mycobacterium
TPGCT

SEQ ID NO: 982648 - protein, 5 aa, Mycobacterium
TPGFG

SEQ ID NO: 982649 - protein, 12 aa, Mycobacterium
TPGHADFGGEVE

SEQ ID NO: 982650 - protein, 7 aa, Mycobacterium
TPGHTAD

SEQ ID NO: 982651 - protein, 4 aa, Mycobacterium
TPHL

SEQ ID NO: 982652 - protein, 5 aa, Mycobacterium
TPTDE

SEQ ID NO: 982653 - protein, 5 aa, Mycobacterium
TPTTV

SEQ ID NO: 982654 - protein, 5 aa, Mycobacterium
TPVPG

SEQ ID NO: 982655 - protein, 10 aa, Mycobacterium
TQAPSGAGYA

SEQ ID NO: 982656 - protein, 4 aa, Mycobacterium
TQGA

SEQ ID NO: 982657 - protein, 11 aa, Mycobacterium
TRFKPAKAKEI

SEQ ID NO: 982658 - protein, 5 aa, Mycobacterium
TRKGE

SEQ ID NO: 982659 - protein, 7 aa, Mycobacterium
TRNGQSL

SEQ ID NO: 982660 - protein, 4 aa, Mycobacterium
TRPD

SEQ ID NO: 982661 - protein, 4 aa, Mycobacterium
TRSR

SEQ ID NO: 982662 - protein, 4 aa, Mycobacterium
TRST

SEQ ID NO: 982663 - protein, 9 aa, Mycobacterium
TSAGRHPDS

SEQ ID NO: 982664 - protein, 9 aa, Mycobacterium
TSAKQDGRN

SEQ ID NO: 982665 - protein, 8 aa, Mycobacterium
TSGPGATN

SEQ ID NO: 982666 - protein, 6 aa, Mycobacterium
TSPQAF

SEQ ID NO: 982667 - protein, 4 aa, Mycobacterium
TSTA

SEQ ID NO: 982668 - protein, 6 aa, Mycobacterium
TSTTKS

SEQ ID NO: 982669 - protein, 4 aa, Mycobacterium
TSYT

SEQ ID NO: 982670 - protein, 7 aa, Mycobacterium
TTENPSF

SEQ ID NO: 982671 - protein, 4 aa, Mycobacterium
TTGT

SEQ ID NO: 982672 - protein, 6 aa, Mycobacterium
TTPEDY

SEQ ID NO: 982673 - protein, 4 aa, Mycobacterium
TTRE

SEQ ID NO: 982674 - protein, 4 aa, Mycobacterium
TTRV

SEQ ID NO: 982675 - protein, 4 aa, Mycobacterium
TVAE

SEQ ID NO: 982676 - protein, 4 aa, Mycobacterium
TVPG

SEQ ID NO: 982677 - protein, 6 aa, Mycobacterium
TVTGTS

SEQ ID NO: 982678 - protein, 7 aa, Mycobacterium
TYEPETS

SEQ ID NO: 982679 - protein, 8 aa, Mycobacterium
TYESPGDL

SEQ ID NO: 982680 - protein, 6 aa, Mycobacterium
TYSTNN

SEQ ID NO: 982681 - protein, 4 aa, Mycobacterium
VADG

SEQ ID NO: 982682 - protein, 13 aa, Mycobacterium
VALPGGDAIGSRP

SEQ ID NO: 982683 - protein, 7 aa, Mycobacterium
VATRSAA

SEQ ID NO: 982684 - protein, 15 aa, Mycobacterium
VDGEPHDTAYDTTTM

SEQ ID NO: 982685 - protein, 5 aa, Mycobacterium
VDGTG

SEQ ID NO: 982686 - protein, 5 aa, Mycobacterium
VDTPI

SEQ ID NO: 982687 - protein, 6 aa, Mycobacterium
VEDPDS

SEQ ID NO: 982688 - protein, 9 aa, Mycobacterium
VEKDPENPT

SEQ ID NO: 982689 - protein, 4 aa, Mycobacterium
VEQG

SEQ ID NO: 982690 - protein, 4 aa, Mycobacterium
VGAT

SEQ ID NO: 982691 - protein, 9 aa, Mycobacterium
VGDDKDKAA

SEQ ID NO: 982692 - protein, 7 aa, Mycobacterium
VGDGAND

SEQ ID NO: 982693 - protein, 7 aa, Mycobacterium
VGEDQRQ

SEQ ID NO: 982694 - protein, 7 aa, Mycobacterium
VGESTDV

SEQ ID NO: 982695 - protein, 8 aa, Mycobacterium
VGGAAAEA

SEQ ID NO: 982696 - protein, 8 aa, Mycobacterium
VGPEGKPL

SEQ ID NO: 982697 - protein, 10 aa, Mycobacterium
VGPNGAGKSS

SEQ ID NO: 982698 - protein, 5 aa, Mycobacterium
VGQSE

SEQ ID NO: 982699 - protein, 8 aa, Mycobacterium
VGRGGDDT

SEQ ID NO: 982700 - protein, 7 aa, Mycobacterium
VGYTPYP

SEQ ID NO: 982701 - protein, 8 aa, Mycobacterium
VKESNPYN

SEQ ID NO: 982702 - protein, 8 aa, Mycobacterium
VKKPETIN

SEQ ID NO: 982703 - protein, 6 aa, Mycobacterium
VKPGRA

SEQ ID NO: 982704 - protein, 7 aa, Mycobacterium
VKSGETH

SEQ ID NO: 982705 - protein, 15 aa, Mycobacterium
VNGPASAVVSGDTTA

SEQ ID NO: 982706 - protein, 4 aa, Mycobacterium
VPDG

SEQ ID NO: 982707 - protein, 5 aa, Mycobacterium
VPEPV

SEQ ID NO: 982708 - protein, 6 aa, Mycobacterium
VPETLK

SEQ ID NO: 982709 - protein, 11 aa, Mycobacterium
VPRGKAPIADV

SEQ ID NO: 982710 - protein, 9 aa, Mycobacterium
VQNEKNTKQ

SEQ ID NO: 982711 - protein, 7 aa, Mycobacterium
VQTADGA

SEQ ID NO: 982712 - protein, 7 aa, Mycobacterium
VQWGPGS

SEQ ID NO: 982713 - protein, 7 aa, Mycobacterium
VREGPAA

SEQ ID NO: 982714 - protein, 4 aa, Mycobacterium
VRES

SEQ ID NO: 982715 - protein, 4 aa, Mycobacterium
VRGG

SEQ ID NO: 982716 - protein, 6 aa, Mycobacterium
VRGNTQ

SEQ ID NO: 982717 - protein, 26 aa, Mycobacterium
VRGQRTKTNARTRKGPKRTIAGKKKA

SEQ ID NO: 982718 - protein, 7 aa, Mycobacterium
VSEAPGY

SEQ ID NO: 982719 - protein, 6 aa, Mycobacterium
VSGEQP

SEQ ID NO: 982720 - protein, 10 aa, Mycobacterium
VSGGRADPAM

SEQ ID NO: 982721 - protein, 4 aa, Mycobacterium
VSGP

SEQ ID NO: 982722 - protein, 10 aa, Mycobacterium
VSPNPGGVGP

SEQ ID NO: 982723 - protein, 9 aa, Mycobacterium
VSVPGAPGV

SEQ ID NO: 982724 - protein, 4 aa, Mycobacterium
VTAE

SEQ ID NO: 982725 - protein, 5 aa, Mycobacterium
VTDGD

SEQ ID NO: 982726 - protein, 7 aa, Mycobacterium
VTEETTG

SEQ ID NO: 982727 - protein, 4 aa, Mycobacterium
VTGE

SEQ ID NO: 982728 - protein, 7 aa, Mycobacterium
VTGGRIP

SEQ ID NO: 982729 - protein, 9 aa, Mycobacterium
VTPAHDPND

SEQ ID NO: 982730 - protein, 7 aa, Mycobacterium
VTPNPGA

SEQ ID NO: 982731 - protein, 5 aa, Mycobacterium
VWTTD

SEQ ID NO: 982732 - protein, 12 aa, Mycobacterium
YDEGDTFDQSAA

SEQ ID NO: 982733 - protein, 12 aa, Mycobacterium
YDPHPAIKAPVA

SEQ ID NO: 982734 - protein, 7 aa, Mycobacterium
YDPNRTA

SEQ ID NO: 982735 - protein, 8 aa, Mycobacterium
YEDPNAAT

SEQ ID NO: 982736 - protein, 9 aa, Mycobacterium
YEEDSRAEV

SEQ ID NO: 982737 - protein, 8 aa, Mycobacterium
YEGEDAAR

SEQ ID NO: 982738 - protein, 6 aa, Mycobacterium
YGTGHT

SEQ ID NO: 982739 - protein, 5 aa, Mycobacterium
YGVRP

SEQ ID NO: 982740 - protein, 8 aa, Mycobacterium
YPGADEAL

SEQ ID NO: 982741 - protein, 5 aa, Mycobacterium
YPGGE

SEQ ID NO: 982742 - protein, 5 aa, Mycobacterium
YPGGK

SEQ ID NO: 982743 - protein, 24 aa, Mycobacterium
YQGKEAAEAGTGGRGGESGSPSTS

SEQ ID NO: 982744 - protein, 6 aa, Mycobacterium
YRGQET

SEQ ID NO: 982745 - protein, 6 aa, Mycobacterium
YRSTQN

SEQ ID NO: 982746 - protein, 9 aa, Mycobacterium
YSPNSPLGG

SEQ ID NO: 982747 - protein, 4 aa, Mycobacterium
YTGS

SEQ ID NO: 982748 - protein, 11 aa, Mycobacterium
AAAAAAPAPLD

SEQ ID NO: 982749 - protein, 8 aa, Mycobacterium
AAAAAKLA

SEQ ID NO: 982750 - protein, 9 aa, Mycobacterium
AAAAEEDEA

SEQ ID NO: 982751 - protein, 8 aa, Mycobacterium
AAAAFSAS

SEQ ID NO: 982752 - protein, 7 aa, Mycobacterium
AAAAGAE

SEQ ID NO: 982753 - protein, 12 aa, Mycobacterium
AAAAGESDPLRG

SEQ ID NO: 982754 - protein, 8 aa, Mycobacterium
AAAAPTTG

SEQ ID NO: 982755 - protein, 17 aa, Mycobacterium
AAAAPVGAGHRMCVQHW

SEQ ID NO: 982756 - protein, 13 aa, Mycobacterium
AAAAQSNAYDDAL

SEQ ID NO: 982757 - protein, 10 aa, Mycobacterium
AAAATSTDTV

SEQ ID NO: 982758 - protein, 6 aa, Mycobacterium
AAADIG

SEQ ID NO: 982759 - protein, 19 aa, Mycobacterium
AAADPRAAAEQLISTLTAT

SEQ ID NO: 982760 - protein, 9 aa, Mycobacterium
AAAEANRTV

SEQ ID NO: 982761 - protein, 6 aa, Mycobacterium
AAAEMR

SEQ ID NO: 982762 - protein, 9 aa, Mycobacterium
AAAEQPVDR

SEQ ID NO: 982763 - protein, 6 aa, Mycobacterium
AAAERA

SEQ ID NO: 982764 - protein, 16 aa, Mycobacterium
AAAERSSGFNPRAGWG

SEQ ID NO: 982765 - protein, 8 aa, Mycobacterium
AAAFGDDP

SEQ ID NO: 982766 - protein, 4 aa, Mycobacterium
AAAG

SEQ ID NO: 982767 - protein, 10 aa, Mycobacterium
AAAGAEQFTQ

SEQ ID NO: 982768 - protein, 10 aa, Mycobacterium
AAAGPSCERY

SEQ ID NO: 982769 - protein, 8 aa, Mycobacterium
AAAGRRSV

SEQ ID NO: 982770 - protein, 8 aa, Mycobacterium
AAAGTPLV

SEQ ID NO: 982771 - protein, 12 aa, Mycobacterium
AAAKSGANAIHP

SEQ ID NO: 982772 - protein, 14 aa, Mycobacterium
AAANAQNNNGLDPE

SEQ ID NO: 982773 - protein, 10 aa, Mycobacterium
AAANDNLADT

SEQ ID NO: 982774 - protein, 9 aa, Mycobacterium
AAANGLQGS

SEQ ID NO: 982775 - protein, 4 aa, Mycobacterium
AAAP

SEQ ID NO: 982776 - protein, 6 aa, Mycobacterium
AAAPEL

SEQ ID NO: 982777 - protein, 11 aa, Mycobacterium
AAAPNDEREAL

SEQ ID NO: 982778 - protein, 6 aa, Mycobacterium
AAAPVS

SEQ ID NO: 982779 - protein, 4 aa, Mycobacterium
AAAQ

SEQ ID NO: 982780 - protein, 9 aa, Mycobacterium
AAAQHRSEK

SEQ ID NO: 982781 - protein, 16 aa, Mycobacterium
AAAQKELASTAAKLAN

SEQ ID NO: 982782 - protein, 7 aa, Mycobacterium
AAARAER

SEQ ID NO: 982783 - protein, 7 aa, Mycobacterium
AAARDPQ

SEQ ID NO: 982784 - protein, 8 aa, Mycobacterium
AAARNPAP

SEQ ID NO: 982785 - protein, 11 aa, Mycobacterium
AAARQSRRAHI

SEQ ID NO: 982786 - protein, 16 aa, Mycobacterium
AAARTQARIDSGRQPV

SEQ ID NO: 982787 - protein, 6 aa, Mycobacterium
AAASGF

SEQ ID NO: 982788 - protein, 10 aa, Mycobacterium
AAASLPAALR

SEQ ID NO: 982789 - protein, 11 aa, Mycobacterium
AAASPSPIPQT

SEQ ID NO: 982790 - protein, 12 aa, Mycobacterium
AAASQAAGRNVG

SEQ ID NO: 982791 - protein, 4 aa, Mycobacterium
AAAT

SEQ ID NO: 982792 - protein, 6 aa, Mycobacterium
AAATDK

SEQ ID NO: 982793 - protein, 12 aa, Mycobacterium
AAATLSGGEAQR

SEQ ID NO: 982794 - protein, 8 aa, Mycobacterium
AAATNSLA

SEQ ID NO: 982795 - protein, 27 aa, Mycobacterium
AAATTDRLHRQKQAGRVRDNVSSNVLQ

SEQ ID NO: 982796 - protein, 17 aa, Mycobacterium
AAATTVEPQNPLPTVRT

SEQ ID NO: 982797 - protein, 5 aa, Mycobacterium
AAATV

SEQ ID NO: 982798 - protein, 7 aa, Mycobacterium
AACDGSL

SEQ ID NO: 982799 - protein, 4 aa, Mycobacterium
AADA

SEQ ID NO: 982800 - protein, 10 aa, Mycobacterium
AADAAAWSNG

SEQ ID NO: 982801 - protein, 11 aa, Mycobacterium
AADAANIPYDD

SEQ ID NO: 982802 - protein, 6 aa, Mycobacterium
AADAAR

SEQ ID NO: 982803 - protein, 6 aa, Mycobacterium
AADAGY

SEQ ID NO: 982804 - protein, 11 aa, Mycobacterium
AADASHAGEYG

SEQ ID NO: 982805 - protein, 5 aa, Mycobacterium
AADAT

SEQ ID NO: 982806 - protein, 5 aa, Mycobacterium
AADAY

SEQ ID NO: 982807 - protein, 4 aa, Mycobacterium
AADD

SEQ ID NO: 982808 - protein, 13 aa, Mycobacterium
AADDDSATGGPDL

SEQ ID NO: 982809 - protein, 8 aa, Mycobacterium
AADDNASK

SEQ ID NO: 982810 - protein, 6 aa, Mycobacterium
AADDSV

SEQ ID NO: 982811 - protein, 11 aa, Mycobacterium
AADEPAAQVTP

SEQ ID NO: 982812 - protein, 9 aa, Mycobacterium
AADGNGGYI

SEQ ID NO: 982813 - protein, 9 aa, Mycobacterium
AADGQQRVS

SEQ ID NO: 982814 - protein, 8 aa, Mycobacterium
AADGQVRA

SEQ ID NO: 982815 - protein, 5 aa, Mycobacterium
AADGR

SEQ ID NO: 982816 - protein, 5 aa, Mycobacterium
AADGS

SEQ ID NO: 982817 - protein, 5 aa, Mycobacterium
AADGV

SEQ ID NO: 982818 - protein, 7 aa, Mycobacterium
AADGYGR

SEQ ID NO: 982819 - protein, 5 aa, Mycobacterium
AADLG

SEQ ID NO: 982820 - protein, 4 aa, Mycobacterium
AADN

SEQ ID NO: 982821 - protein, 6 aa, Mycobacterium
AADNGL

SEQ ID NO: 982822 - protein, 4 aa, Mycobacterium
AADP

SEQ ID NO: 982823 - protein, 7 aa, Mycobacterium
AADPLDP

SEQ ID NO: 982824 - protein, 6 aa, Mycobacterium
AADPRV

SEQ ID NO: 982825 - protein, 14 aa, Mycobacterium
AADPSPPAPPPAIP

SEQ ID NO: 982826 - protein, 6 aa, Mycobacterium
AADQSW

SEQ ID NO: 982827 - protein, 6 aa, Mycobacterium
AADRPA

SEQ ID NO: 982828 - protein, 8 aa, Mycobacterium
AADVTKAG

SEQ ID NO: 982829 - protein, 4 aa, Mycobacterium
AAEA

SEQ ID NO: 982830 - protein, 12 aa, Mycobacterium
AAEAADDLAQEI

SEQ ID NO: 982831 - protein, 10 aa, Mycobacterium
AAEAEKNRKF

SEQ ID NO: 982832 - protein, 7 aa, Mycobacterium
AAEAGWY

SEQ ID NO: 982833 - protein, 11 aa, Mycobacterium
AAEAPSRLGDK

SEQ ID NO: 982834 - protein, 24 aa, Mycobacterium
AAEASGQLKPGGTIVEPTSGNTGV

SEQ ID NO: 982835 - protein, 7 aa, Mycobacterium
AAEDDEL

SEQ ID NO: 982836 - protein, 7 aa, Mycobacterium
AAEEGAL

SEQ ID NO: 982837 - protein, 9 aa, Mycobacterium
AAEESDAEI

SEQ ID NO: 982838 - protein, 6 aa, Mycobacterium
AAEGRL

SEQ ID NO: 982839 - protein, 6 aa, Mycobacterium
AAEGRR

SEQ ID NO: 982840 - protein, 26 aa, Mycobacterium
AAEKELERARQANVQAAATKAAAGAE

SEQ ID NO: 982841 - protein, 7 aa, Mycobacterium
AAEKGGY

SEQ ID NO: 982842 - protein, 4 aa, Mycobacterium
AAEL

SEQ ID NO: 982843 - protein, 4 aa, Mycobacterium
AAEP

SEQ ID NO: 982844 - protein, 6 aa, Mycobacterium
AAEPKV

SEQ ID NO: 982845 - protein, 24 aa, Mycobacterium
AAEQRKQQQAPTSAPSAAAPTPTP

SEQ ID NO: 982846 - protein, 4 aa, Mycobacterium
AAER

SEQ ID NO: 982847 - protein, 5 aa, Mycobacterium
AAERA

SEQ ID NO: 982848 - protein, 10 aa, Mycobacterium
AAESAKQLDD

SEQ ID NO: 982849 - protein, 9 aa, Mycobacterium
AAESTNTFP

SEQ ID NO: 982850 - protein, 9 aa, Mycobacterium
AAETDAERT

SEQ ID NO: 982851 - protein, 11 aa, Mycobacterium
AAETGEDGPAV

SEQ ID NO: 982852 - protein, 6 aa, Mycobacterium
AAFGGR

SEQ ID NO: 982853 - protein, 9 aa, Mycobacterium
AAGAAMATS

SEQ ID NO: 982854 - protein, 11 aa, Mycobacterium
AAGAGAARTTL

SEQ ID NO: 982855 - protein, 8 aa, Mycobacterium
AAGANPLG

SEQ ID NO: 982856 - protein, 5 aa, Mycobacterium
AAGAQ

SEQ ID NO: 982857 - protein, 16 aa, Mycobacterium
AAGASGYTTLASPPTT

SEQ ID NO: 982858 - protein, 10 aa, Mycobacterium
AAGEAAGYPV

SEQ ID NO: 982859 - protein, 7 aa, Mycobacterium
AAGEPPY

SEQ ID NO: 982860 - protein, 6 aa, Mycobacterium
AAGEPS

SEQ ID NO: 982861 - protein, 7 aa, Mycobacterium
AAGERVR

SEQ ID NO: 982862 - protein, 6 aa, Mycobacterium
AAGGEA

SEQ ID NO: 982863 - protein, 10 aa, Mycobacterium
AAGGGTGAGP

SEQ ID NO: 982864 - protein, 6 aa, Mycobacterium
AAGGLG

SEQ ID NO: 982865 - protein, 7 aa, Mycobacterium
AAGGQYA

SEQ ID NO: 982866 - protein, 6 aa, Mycobacterium
AAGGSD

SEQ ID NO: 982867 - protein, 8 aa, Mycobacterium
AAGHDAEQ

SEQ ID NO: 982868 - protein, 21 aa, Mycobacterium
AAGKQAPGVVGQQDGTPGSGT

SEQ ID NO: 982869 - protein, 11 aa, Mycobacterium
AAGNGRSDDVA

SEQ ID NO: 982870 - protein, 4 aa, Mycobacterium
AAGP

SEQ ID NO: 982871 - protein, 10 aa, Mycobacterium
AAGPPGQGAF

SEQ ID NO: 982872 - protein, 7 aa, Mycobacterium
AAGPSEA

SEQ ID NO: 982873 - protein, 5 aa, Mycobacterium
AAGQA

SEQ ID NO: 982874 - protein, 7 aa, Mycobacterium
AAGQGDI

SEQ ID NO: 982875 - protein, 7 aa, Mycobacterium
AAGQKGL

SEQ ID NO: 982876 - protein, 7 aa, Mycobacterium
AAGQPQP

SEQ ID NO: 982877 - protein, 19 aa, Mycobacterium
AAGQSTSGVVAPRDSVVGP

SEQ ID NO: 982878 - protein, 4 aa, Mycobacterium
AAGR

SEQ ID NO: 982879 - protein, 10 aa, Mycobacterium
AAGRNPKLGY

SEQ ID NO: 982880 - protein, 7 aa, Mycobacterium
AAGRSGA

SEQ ID NO: 982881 - protein, 13 aa, Mycobacterium
AAGRTDTGVHATG

SEQ ID NO: 982882 - protein, 5 aa, Mycobacterium
AAGSL

SEQ ID NO: 982883 - protein, 14 aa, Mycobacterium
AAGSPGHNAQDGGT

SEQ ID NO: 982884 - protein, 20 aa, Mycobacterium
AAGTCDNSAIDGYQGNHRTN

SEQ ID NO: 982885 - protein, 9 aa, Mycobacterium
AAGTNEDVS

SEQ ID NO: 982886 - protein, 7 aa, Mycobacterium
AAGTRGV

SEQ ID NO: 982887 - protein, 33 aa, Mycobacterium
AAGTSEDHVPQREPAAGQLGQDDSNGGQVAAVC

SEQ ID NO: 982888 - protein, 8 aa, Mycobacterium
AAGTTVDP

SEQ ID NO: 982889 - protein, 6 aa, Mycobacterium
AAGTVK

SEQ ID NO: 982890 - protein, 7 aa, Mycobacterium
AAGVDAR

SEQ ID NO: 982891 - protein, 7 aa, Mycobacterium
AAGVDPG

SEQ ID NO: 982892 - protein, 24 aa, Mycobacterium
AAGVSPGKLIPGADGVTGGVAPSA

SEQ ID NO: 982893 - protein, 6 aa, Mycobacterium
AAGVTR

SEQ ID NO: 982894 - protein, 9 aa, Mycobacterium
AAHAPQADK

SEQ ID NO: 982895 - protein, 14 aa, Mycobacterium
AAHDADEAAAYPPD

SEQ ID NO: 982896 - protein, 5 aa, Mycobacterium
AAHER

SEQ ID NO: 982897 - protein, 10 aa, Mycobacterium
AAHGANRTGR

SEQ ID NO: 982898 - protein, 7 aa, Mycobacterium
AAHTGGA

SEQ ID NO: 982899 - protein, 11 aa, Mycobacterium
AAIEKQTGRSI

SEQ ID NO: 982900 - protein, 11 aa, Mycobacterium
AAISAGDQSIG

SEQ ID NO: 982901 - protein, 10 aa, Mycobacterium
AAKAGESGDL

SEQ ID NO: 982902 - protein, 12 aa, Mycobacterium
AAKAKGHLEAGA

SEQ ID NO: 982903 - protein, 35 aa, Mycobacterium
AAKAPVRKATTRALAKKAAVKKAPAKKVTAAKRGR

SEQ ID NO: 982904 - protein, 13 aa, Mycobacterium
AAKAQRAGRLGTG

SEQ ID NO: 982905 - protein, 7 aa, Mycobacterium
AAKASIE

SEQ ID NO: 982906 - protein, 8 aa, Mycobacterium
AAKETVVQ

SEQ ID NO: 982907 - protein, 11 aa, Mycobacterium
AAKGMKVAQPS

SEQ ID NO: 982908 - protein, 13 aa, Mycobacterium
AAKIRSEQLRITS

SEQ ID NO: 982909 - protein, 11 aa, Mycobacterium
AAKKDGDTLGG

SEQ ID NO: 982910 - protein, 11 aa, Mycobacterium
AAKQTAKSGAT

SEQ ID NO: 982911 - protein, 7 aa, Mycobacterium
AAKTGNK

SEQ ID NO: 982912 - protein, 7 aa, Mycobacterium
AAKTRLG

SEQ ID NO: 982913 - protein, 10 aa, Mycobacterium
AAKTTEQAPR

SEQ ID NO: 982914 - protein, 22 aa, Mycobacterium
AALADGDAAEPPLRSVGEQQVV

SEQ ID NO: 982915 - protein, 5 aa, Mycobacterium
AALEG

SEQ ID NO: 982916 - protein, 7 aa, Mycobacterium
AALEGTP

SEQ ID NO: 982917 - protein, 10 aa, Mycobacterium
AALESTDDAT

SEQ ID NO: 982918 - protein, 6 aa, Mycobacterium
AALGGG

SEQ ID NO: 982919 - protein, 6 aa, Mycobacterium
AALPPA

SEQ ID NO: 982920 - protein, 7 aa, Mycobacterium
AALQEPR

SEQ ID NO: 982921 - protein, 7 aa, Mycobacterium
AALQSGA

SEQ ID NO: 982922 - protein, 5 aa, Mycobacterium
AALTA

SEQ ID NO: 982923 - protein, 5 aa, Mycobacterium
AAMDG

SEQ ID NO: 982924 - protein, 8 aa, Mycobacterium
AANAESTR

SEQ ID NO: 982925 - protein, 7 aa, Mycobacterium
AANDPQA

SEQ ID NO: 982926 - protein, 8 aa, Mycobacterium
AANEEAAE

SEQ ID NO: 982927 - protein, 12 aa, Mycobacterium
AANFDSGSGNVP

SEQ ID NO: 982928 - protein, 7 aa, Mycobacterium
AANITDS

SEQ ID NO: 982929 - protein, 6 aa, Mycobacterium
AANKRG

SEQ ID NO: 982930 - protein, 10 aa, Mycobacterium
AANPAIANDP

SEQ ID NO: 982931 - protein, 7 aa, Mycobacterium
AANRKQA

SEQ ID NO: 982932 - protein, 6 aa, Mycobacterium
AANRPS

SEQ ID NO: 982933 - protein, 6 aa, Mycobacterium
AANTAA

SEQ ID NO: 982934 - protein, 16 aa, Mycobacterium
AANTRTGMRWVGATAV

SEQ ID NO: 982935 - protein, 4 aa, Mycobacterium
AANV

SEQ ID NO: 982936 - protein, 7 aa, Mycobacterium
AANYPGV

SEQ ID NO: 982937 - protein, 5 aa, Mycobacterium
AAPAG

SEQ ID NO: 982938 - protein, 5 aa, Mycobacterium
AAPER

SEQ ID NO: 982939 - protein, 7 aa, Mycobacterium
AAPESPA

SEQ ID NO: 982940 - protein, 8 aa, Mycobacterium
AAPGATWE

SEQ ID NO: 982941 - protein, 28 aa, Mycobacterium
AAPGHGKRTKPVAPVRRQRQSRIGHTAE

SEQ ID NO: 982942 - protein, 6 aa, Mycobacterium
AAPGIT

SEQ ID NO: 982943 - protein, 9 aa, Mycobacterium
AAPGYPTPN

SEQ ID NO: 982944 - protein, 7 aa, Mycobacterium
AAPHQAA

SEQ ID NO: 982945 - protein, 8 aa, Mycobacterium
AAPKTGGL

SEQ ID NO: 982946 - protein, 9 aa, Mycobacterium
AAPNPAAQA

SEQ ID NO: 982947 - protein, 8 aa, Mycobacterium
AAPPPGHG

SEQ ID NO: 982948 - protein, 22 aa, Mycobacterium
AAPPSPLDVPSDPGLPVVKRQI

SEQ ID NO: 982949 - protein, 8 aa, Mycobacterium
AAPPSQLA

SEQ ID NO: 982950 - protein, 9 aa, Mycobacterium
AAPSFEPQR

SEQ ID NO: 982951 - protein, 11 aa, Mycobacterium
AAPSPRSRRSS

SEQ ID NO: 982952 - protein, 19 aa, Mycobacterium
AAPSRPPGRPLSPRRIGVS

SEQ ID NO: 982953 - protein, 7 aa, Mycobacterium
AAPVAGA

SEQ ID NO: 982954 - protein, 7 aa, Mycobacterium
AAPVGSM

SEQ ID NO: 982955 - protein, 5 aa, Mycobacterium
AAPVQ

SEQ ID NO: 982956 - protein, 9 aa, Mycobacterium
AAQAELRPA

SEQ ID NO: 982957 - protein, 9 aa, Mycobacterium
AAQATAAGR

SEQ ID NO: 982958 - protein, 7 aa, Mycobacterium
AAQEDIP

SEQ ID NO: 982959 - protein, 5 aa, Mycobacterium
AAQGG

SEQ ID NO: 982960 - protein, 6 aa, Mycobacterium
AAQGNF

SEQ ID NO: 982961 - protein, 6 aa, Mycobacterium
AAQGRR

SEQ ID NO: 982962 - protein, 11 aa, Mycobacterium
AAQPGPHYETP

SEQ ID NO: 982963 - protein, 6 aa, Mycobacterium
AAQPRR

SEQ ID NO: 982964 - protein, 4 aa, Mycobacterium
AAQQ

SEQ ID NO: 982965 - protein, 4 aa, Mycobacterium
AAQR

SEQ ID NO: 982966 - protein, 19 aa, Mycobacterium
AAQRAADKKYTDDQAALAD

SEQ ID NO: 982967 - protein, 6 aa, Mycobacterium
AAQRVR

SEQ ID NO: 982968 - protein, 7 aa, Mycobacterium
AAQTGDF

SEQ ID NO: 982969 - protein, 5 aa, Mycobacterium
AAQVH

SEQ ID NO: 982970 - protein, 17 aa, Mycobacterium
AARAELADRERHAVEAD

SEQ ID NO: 982971 - protein, 14 aa, Mycobacterium
AARAEVNLSNTSAQ

SEQ ID NO: 982972 - protein, 5 aa, Mycobacterium
AARAG

SEQ ID NO: 982973 - protein, 8 aa, Mycobacterium
AARARDAG

SEQ ID NO: 982974 - protein, 12 aa, Mycobacterium
AARDDAAIAAMT

SEQ ID NO: 982975 - protein, 7 aa, Mycobacterium
AARDTEI

SEQ ID NO: 982976 - protein, 13 aa, Mycobacterium
AAREKAKELGVDP

SEQ ID NO: 982977 - protein, 17 aa, Mycobacterium
AARENAKSAREVTSSET

SEQ ID NO: 982978 - protein, 6 aa, Mycobacterium
AAREPD

SEQ ID NO: 982979 - protein, 7 aa, Mycobacterium
AARGAGL

SEQ ID NO: 982980 - protein, 6 aa, Mycobacterium
AARGIG

SEQ ID NO: 982981 - protein, 8 aa, Mycobacterium
AARGSKRA

SEQ ID NO: 982982 - protein, 19 aa, Mycobacterium
AARIDARTDPWDPETEPGV

SEQ ID NO: 982983 - protein, 4 aa, Mycobacterium
AARK

SEQ ID NO: 982984 - protein, 6 aa, Mycobacterium
AARNRA

SEQ ID NO: 982985 - protein, 7 aa, Mycobacterium
AARNVSG

SEQ ID NO: 982986 - protein, 5 aa, Mycobacterium
AARPS

SEQ ID NO: 982987 - protein, 7 aa, Mycobacterium
AARSGDA

SEQ ID NO: 982988 - protein, 6 aa, Mycobacterium
AARSLG

SEQ ID NO: 982989 - protein, 14 aa, Mycobacterium
AARSSGSPAGWLSS

SEQ ID NO: 982990 - protein, 7 aa, Mycobacterium
AARSVAG

SEQ ID NO: 982991 - protein, 8 aa, Mycobacterium
AARSVTGT

SEQ ID NO: 982992 - protein, 5 aa, Mycobacterium
AARTW

SEQ ID NO: 982993 - protein, 7 aa, Mycobacterium
AARVSDQ

SEQ ID NO: 982994 - protein, 4 aa, Mycobacterium
AARY

SEQ ID NO: 982995 - protein, 5 aa, Mycobacterium
AASAA

SEQ ID NO: 982996 - protein, 8 aa, Mycobacterium
AASAQGVA

SEQ ID NO: 982997 - protein, 9 aa, Mycobacterium
AASASTQLG

SEQ ID NO: 982998 - protein, 8 aa, Mycobacterium
AASATELQ

SEQ ID NO: 982999 - protein, 13 aa, Mycobacterium
AASDAGRDPMSIT

SEQ ID NO: 983000 - protein, 7 aa, Mycobacterium
AASDDDA

SEQ ID NO: 983001 - protein, 21 aa, Mycobacterium
AASELASRQRAMKSATDNADD

SEQ ID NO: 983002 - protein, 6 aa, Mycobacterium
AASGGY

SEQ ID NO: 983003 - protein, 12 aa, Mycobacterium
AASGSSGHRRCD

SEQ ID NO: 983004 - protein, 9 aa, Mycobacterium
AASIDGRSR

SEQ ID NO: 983005 - protein, 9 aa, Mycobacterium
AASIKTGDL

SEQ ID NO: 983006 - protein, 12 aa, Mycobacterium
AASPVTWPWNVL

SEQ ID NO: 983007 - protein, 12 aa, Mycobacterium
AASRGDLKPVGG

SEQ ID NO: 983008 - protein, 11 aa, Mycobacterium
AASRPKGSSPE

SEQ ID NO: 983009 - protein, 13 aa, Mycobacterium
AASSHVARTSHSP

SEQ ID NO: 983010 - protein, 10 aa, Mycobacterium
AASSSGAPVA

SEQ ID NO: 983011 - protein, 10 aa, Mycobacterium
AASSSRKEQA

SEQ ID NO: 983012 - protein, 18 aa, Mycobacterium
AASSVAGYPTTAGTARLR

SEQ ID NO: 983013 - protein, 7 aa, Mycobacterium
AASSYAT

SEQ ID NO: 983014 - protein, 7 aa, Mycobacterium
AASTAAV

SEQ ID NO: 983015 - protein, 17 aa, Mycobacterium
AASTAVHNEEHAKGTAF

SEQ ID NO: 983016 - protein, 7 aa, Mycobacterium
AASTEAV

SEQ ID NO: 983017 - protein, 14 aa, Mycobacterium
AASTGELAQAAESA

SEQ ID NO: 983018 - protein, 13 aa, Mycobacterium
AASYAPRSCGSAA

SEQ ID NO: 983019 - protein, 8 aa, Mycobacterium
AATATGLP

SEQ ID NO: 983020 - protein, 8 aa, Mycobacterium
AATATNAA

SEQ ID NO: 983021 - protein, 8 aa, Mycobacterium
AATDSPPA

SEQ ID NO: 983022 - protein, 7 aa, Mycobacterium
AATERAR

SEQ ID NO: 983023 - protein, 10 aa, Mycobacterium
AATGSTRTYQ

SEQ ID NO: 983024 - protein, 6 aa, Mycobacterium
AATGVG

SEQ ID NO: 983025 - protein, 6 aa, Mycobacterium
AATGVT

SEQ ID NO: 983026 - protein, 16 aa, Mycobacterium
AATIEPGVGRHADHAL

SEQ ID NO: 983027 - protein, 8 aa, Mycobacterium
AATKPERL

SEQ ID NO: 983028 - protein, 20 aa, Mycobacterium
AATNSTTEETTFLLLARATS

SEQ ID NO: 983029 - protein, 21 aa, Mycobacterium
AATPARADEPTTGSVAGEVID

SEQ ID NO: 983030 - protein, 18 aa, Mycobacterium
AATPARASFAGPDIATRT

SEQ ID NO: 983031 - protein, 9 aa, Mycobacterium
AATPNADRR

SEQ ID NO: 983032 - protein, 5 aa, Mycobacterium
AATPR

SEQ ID NO: 983033 - protein, 15 aa, Mycobacterium
AATPTDAAKKVVPDA

SEQ ID NO: 983034 - protein, 8 aa, Mycobacterium
AATQAVEH

SEQ ID NO: 983035 - protein, 5 aa, Mycobacterium
AATQP

SEQ ID NO: 983036 - protein, 7 aa, Mycobacterium
AATRNGR

SEQ ID NO: 983037 - protein, 5 aa, Mycobacterium
AATST

SEQ ID NO: 983038 - protein, 27 aa, Mycobacterium
AATTTEGLGLTGRGEGLSAIATALVVQ

SEQ ID NO: 983039 - protein, 7 aa, Mycobacterium
AATTTLD

SEQ ID NO: 983040 - protein, 10 aa, Mycobacterium
AAVGGQDATV

SEQ ID NO: 983041 - protein, 6 aa, Mycobacterium
AAVPAN

SEQ ID NO: 983042 - protein, 6 aa, Mycobacterium
AAVPRG

SEQ ID NO: 983043 - protein, 13 aa, Mycobacterium
AAVPSGASTGEYE

SEQ ID NO: 983044 - protein, 10 aa, Mycobacterium
AAVPTAQARE

SEQ ID NO: 983045 - protein, 5 aa, Mycobacterium
AAVQD

SEQ ID NO: 983046 - protein, 6 aa, Mycobacterium
AAVSPG

SEQ ID NO: 983047 - protein, 23 aa, Mycobacterium
AAVSPYGSGALAGSSLGLDPDAM

SEQ ID NO: 983048 - protein, 13 aa, Mycobacterium
AAVTDSEREIRYD

SEQ ID NO: 983049 - protein, 13 aa, Mycobacterium
AAWEGRPLQSVPS

SEQ ID NO: 983050 - protein, 12 aa, Mycobacterium
AAYGLNTAGTPD

SEQ ID NO: 983051 - protein, 10 aa, Mycobacterium
AAYGNEAAVS

SEQ ID NO: 983052 - protein, 7 aa, Mycobacterium
ACEPGRE

SEQ ID NO: 983053 - protein, 5 aa, Mycobacterium
ACGTP

SEQ ID NO: 983054 - protein, 10 aa, Mycobacterium
ACRREAENAQ

SEQ ID NO: 983055 - protein, 8 aa, Mycobacterium
ACSEAGGS

SEQ ID NO: 983056 - protein, 4 aa, Mycobacterium
ACSV

SEQ ID NO: 983057 - protein, 8 aa, Mycobacterium
ADAADSDV

SEQ ID NO: 983058 - protein, 5 aa, Mycobacterium
ADAAR

SEQ ID NO: 983059 - protein, 11 aa, Mycobacterium
ADAATALTDAS

SEQ ID NO: 983060 - protein, 11 aa, Mycobacterium
ADADDDHSYHD

SEQ ID NO: 983061 - protein, 6 aa, Mycobacterium
ADADDV

SEQ ID NO: 983062 - protein, 6 aa, Mycobacterium
ADADGF

SEQ ID NO: 983063 - protein, 8 aa, Mycobacterium
ADADGRGV

SEQ ID NO: 983064 - protein, 12 aa, Mycobacterium
ADAEAASSPGVL

SEQ ID NO: 983065 - protein, 16 aa, Mycobacterium
ADAPNAVAQVSAGKVG

SEQ ID NO: 983066 - protein, 5 aa, Mycobacterium
ADAPR

SEQ ID NO: 983067 - protein, 5 aa, Mycobacterium
ADAPS

SEQ ID NO: 983068 - protein, 20 aa, Mycobacterium
ADAQQDATQVSAESGLQPMT

SEQ ID NO: 983069 - protein, 8 aa, Mycobacterium
ADARTDGH

SEQ ID NO: 983070 - protein, 12 aa, Mycobacterium
ADASGNGAPLSA

SEQ ID NO: 983071 - protein, 9 aa, Mycobacterium
ADATDPTAM

SEQ ID NO: 983072 - protein, 8 aa, Mycobacterium
ADATMTER

SEQ ID NO: 983073 - protein, 4 aa, Mycobacterium
ADAV

SEQ ID NO: 983074 - protein, 5 aa, Mycobacterium
ADAYA

SEQ ID NO: 983075 - protein, 6 aa, Mycobacterium
ADAYPG

SEQ ID NO: 983076 - protein, 12 aa, Mycobacterium
ADDAPSPTGAAT

SEQ ID NO: 983077 - protein, 9 aa, Mycobacterium
ADDDARDRA

SEQ ID NO: 983078 - protein, 9 aa, Mycobacterium
ADDGERSWV

SEQ ID NO: 983079 - protein, 8 aa, Mycobacterium
ADDGRRSG

SEQ ID NO: 983080 - protein, 9 aa, Mycobacterium
ADDNDLEDG

SEQ ID NO: 983081 - protein, 9 aa, Mycobacterium
ADDPAGFGP

SEQ ID NO: 983082 - protein, 9 aa, Mycobacterium
ADDPRRTTT

SEQ ID NO: 983083 - protein, 7 aa, Mycobacterium
ADDRAYK

SEQ ID NO: 983084 - protein, 11 aa, Mycobacterium
ADDRIGDVRGR

SEQ ID NO: 983085 - protein, 8 aa, Mycobacterium
ADDSGRIR

SEQ ID NO: 983086 - protein, 8 aa, Mycobacterium
ADDSMTTA

SEQ ID NO: 983087 - protein, 6 aa, Mycobacterium
ADDTEI

SEQ ID NO: 983088 - protein, 6 aa, Mycobacterium
ADDTLG

SEQ ID NO: 983089 - protein, 13 aa, Mycobacterium
ADDTLGPDRVKPG

SEQ ID NO: 983090 - protein, 7 aa, Mycobacterium
ADDVSDE

SEQ ID NO: 983091 - protein, 12 aa, Mycobacterium
ADDYTDPAPATT

SEQ ID NO: 983092 - protein, 8 aa, Mycobacterium
ADEATKVG

SEQ ID NO: 983093 - protein, 7 aa, Mycobacterium
ADEEDRH

SEQ ID NO: 983094 - protein, 8 aa, Mycobacterium
ADEEVDRG

SEQ ID NO: 983095 - protein, 4 aa, Mycobacterium
ADEF

SEQ ID NO: 983096 - protein, 8 aa, Mycobacterium
ADEKERAE

SEQ ID NO: 983097 - protein, 7 aa, Mycobacterium
ADENEAV

SEQ ID NO: 983098 - protein, 15 aa, Mycobacterium
ADEPAEAAAVGASKA

SEQ ID NO: 983099 - protein, 7 aa, Mycobacterium
ADEPGTI

SEQ ID NO: 983100 - protein, 4 aa, Mycobacterium
ADER

SEQ ID NO: 983101 - protein, 8 aa, Mycobacterium
ADESDGSL

SEQ ID NO: 983102 - protein, 8 aa, Mycobacterium
ADESSRRA

SEQ ID NO: 983103 - protein, 31 aa, Mycobacterium
ADESTRQQHVNDKSYKQRGGHATRHQHGSVH

SEQ ID NO: 983104 - protein, 5 aa, Mycobacterium
ADEVS

SEQ ID NO: 983105 - protein, 7 aa, Mycobacterium
ADFKRPS

SEQ ID NO: 983106 - protein, 6 aa, Mycobacterium
ADGAAI

SEQ ID NO: 983107 - protein, 14 aa, Mycobacterium
ADGAKLGKSTGGGS

SEQ ID NO: 983108 - protein, 16 aa, Mycobacterium
ADGAVRPPDGRETATA

SEQ ID NO: 983109 - protein, 19 aa, Mycobacterium
ADGCQGDPSQQELPDVGDG

SEQ ID NO: 983110 - protein, 5 aa, Mycobacterium
ADGEF

SEQ ID NO: 983111 - protein, 7 aa, Mycobacterium
ADGEHLR

SEQ ID NO: 983112 - protein, 13 aa, Mycobacterium
ADGERACAAEGNA

SEQ ID NO: 983113 - protein, 7 aa, Mycobacterium
ADGERRA

SEQ ID NO: 983114 - protein, 5 aa, Mycobacterium
ADGGE

SEQ ID NO: 983115 - protein, 8 aa, Mycobacterium
ADGGGGSL

SEQ ID NO: 983116 - protein, 47 aa, Mycobacterium
ADGGPTTEATRPKKKVSAKKAAKAVESDAEGAKATKAYALAEGDEQS

SEQ ID NO: 983117 - protein, 10 aa, Mycobacterium
ADGGTRTAAV

SEQ ID NO: 983118 - protein, 5 aa, Mycobacterium
ADGHV

SEQ ID NO: 983119 - protein, 4 aa, Mycobacterium
ADGK

SEQ ID NO: 983120 - protein, 10 aa, Mycobacterium
ADGKAGEAVH

SEQ ID NO: 983121 - protein, 6 aa, Mycobacterium
ADGKLR

SEQ ID NO: 983122 - protein, 8 aa, Mycobacterium
ADGLPGEL

SEQ ID NO: 983123 - protein, 6 aa, Mycobacterium
ADGLQA

SEQ ID NO: 983124 - protein, 8 aa, Mycobacterium
ADGNELAR

SEQ ID NO: 983125 - protein, 6 aa, Mycobacterium
ADGNEP

SEQ ID NO: 983126 - protein, 18 aa, Mycobacterium
ADGNPVHGTFATPAAVLR

SEQ ID NO: 983127 - protein, 8 aa, Mycobacterium
ADGNRPRD

SEQ ID NO: 983128 - protein, 6 aa, Mycobacterium
ADGPAP

SEQ ID NO: 983129 - protein, 8 aa, Mycobacterium
ADGPGDSV

SEQ ID NO: 983130 - protein, 7 aa, Mycobacterium
ADGQHRV

SEQ ID NO: 983131 - protein, 5 aa, Mycobacterium
ADGRR

SEQ ID NO: 983132 - protein, 9 aa, Mycobacterium
ADGSERVLS

SEQ ID NO: 983133 - protein, 10 aa, Mycobacterium
ADGTDSLDDL

SEQ ID NO: 983134 - protein, 6 aa, Mycobacterium
ADGTHS

SEQ ID NO: 983135 - protein, 6 aa, Mycobacterium
ADGTSM

SEQ ID NO: 983136 - protein, 6 aa, Mycobacterium
ADGVDS

SEQ ID NO: 983137 - protein, 5 aa, Mycobacterium
ADGVG

SEQ ID NO: 983138 - protein, 10 aa, Mycobacterium
ADGVRAGRAM

SEQ ID NO: 983139 - protein, 4 aa, Mycobacterium
ADGY

SEQ ID NO: 983140 - protein, 6 aa, Mycobacterium
ADHAGR

SEQ ID NO: 983141 - protein, 7 aa, Mycobacterium
ADHPSTG

SEQ ID NO: 983142 - protein, 12 aa, Mycobacterium
ADHSINRLRLRK

SEQ ID NO: 983143 - protein, 7 aa, Mycobacterium
ADHTYSY

SEQ ID NO: 983144 - protein, 8 aa, Mycobacterium
ADIARAAG

SEQ ID NO: 983145 - protein, 11 aa, Mycobacterium
ADIGEHSNIGA

SEQ ID NO: 983146 - protein, 6 aa, Mycobacterium
ADIKGG

SEQ ID NO: 983147 - protein, 9 aa, Mycobacterium
ADKNYAGAA

SEQ ID NO: 983148 - protein, 22 aa, Mycobacterium
ADKPEKTAAPASDPTGGMGGMD

SEQ ID NO: 983149 - protein, 12 aa, Mycobacterium
ADLAGSNNTTIK

SEQ ID NO: 983150 - protein, 8 aa, Mycobacterium
ADLDKSDH

SEQ ID NO: 983151 - protein, 8 aa, Mycobacterium
ADLEGRGV

SEQ ID NO: 983152 - protein, 6 aa, Mycobacterium
ADLPPA

SEQ ID NO: 983153 - protein, 5 aa, Mycobacterium
ADLSE

SEQ ID NO: 983154 - protein, 7 aa, Mycobacterium
ADLSQDE

SEQ ID NO: 983155 - protein, 8 aa, Mycobacterium
ADNADAVT

SEQ ID NO: 983156 - protein, 6 aa, Mycobacterium
ADNDAV

SEQ ID NO: 983157 - protein, 29 aa, Mycobacterium
ADNDPEKSWSTSATSCGGGCTPTAYSPPG

SEQ ID NO: 983158 - protein, 4 aa, Mycobacterium
ADNL

SEQ ID NO: 983159 - protein, 23 aa, Mycobacterium
ADNNIPNSKEASMSKAKAGRMAS

SEQ ID NO: 983160 - protein, 8 aa, Mycobacterium
ADNVPKIR

SEQ ID NO: 983161 - protein, 5 aa, Mycobacterium
ADPAA

SEQ ID NO: 983162 - protein, 6 aa, Mycobacterium
ADPAKI

SEQ ID NO: 983163 - protein, 5 aa, Mycobacterium
ADPAP

SEQ ID NO: 983164 - protein, 10 aa, Mycobacterium
ADPASTKPGY

SEQ ID NO: 983165 - protein, 7 aa, Mycobacterium
ADPDGVA

SEQ ID NO: 983166 - protein, 6 aa, Mycobacterium
ADPDGY

SEQ ID NO: 983167 - protein, 10 aa, Mycobacterium
ADPDNLARTD

SEQ ID NO: 983168 - protein, 10 aa, Mycobacterium
ADPDNPKALH

SEQ ID NO: 983169 - protein, 8 aa, Mycobacterium
ADPECHKR

SEQ ID NO: 983170 - protein, 6 aa, Mycobacterium
ADPEPQ

SEQ ID NO: 983171 - protein, 6 aa, Mycobacterium
ADPEQL

SEQ ID NO: 983172 - protein, 7 aa, Mycobacterium
ADPGGPV

SEQ ID NO: 983173 - protein, 12 aa, Mycobacterium
ADPGNRGGSTVS

SEQ ID NO: 983174 - protein, 11 aa, Mycobacterium
ADPGRRNEVHR

SEQ ID NO: 983175 - protein, 7 aa, Mycobacterium
ADPKTAA

SEQ ID NO: 983176 - protein, 6 aa, Mycobacterium
ADPKTI

SEQ ID NO: 983177 - protein, 7 aa, Mycobacterium
ADPLPAD

SEQ ID NO: 983178 - protein, 5 aa, Mycobacterium
ADPLQ

SEQ ID NO: 983179 - protein, 7 aa, Mycobacterium
ADPLSTR

SEQ ID NO: 983180 - protein, 16 aa, Mycobacterium
ADPLTASLSGRPAPSI

SEQ ID NO: 983181 - protein, 15 aa, Mycobacterium
ADPNASAGGGAARLT

SEQ ID NO: 983182 - protein, 7 aa, Mycobacterium
ADPNGIN

SEQ ID NO: 983183 - protein, 12 aa, Mycobacterium
ADPPDGNECTPT

SEQ ID NO: 983184 - protein, 9 aa, Mycobacterium
ADPPMTKDA

SEQ ID NO: 983185 - protein, 4 aa, Mycobacterium
ADPQ

SEQ ID NO: 983186 - protein, 10 aa, Mycobacterium
ADPQASLDPM

SEQ ID NO: 983187 - protein, 8 aa, Mycobacterium
ADPSFGGA

SEQ ID NO: 983188 - protein, 8 aa, Mycobacterium
ADPSQQLA

SEQ ID NO: 983189 - protein, 6 aa, Mycobacterium
ADPTAY

SEQ ID NO: 983190 - protein, 14 aa, Mycobacterium
ADPTPDGHGDPLNN

SEQ ID NO: 983191 - protein, 16 aa, Mycobacterium
ADPTSKMSKSASSDAG

SEQ ID NO: 983192 - protein, 4 aa, Mycobacterium
ADPV

SEQ ID NO: 983193 - protein, 6 aa, Mycobacterium
ADQLDG

SEQ ID NO: 983194 - protein, 7 aa, Mycobacterium
ADQRDPA

SEQ ID NO: 983195 - protein, 4 aa, Mycobacterium
ADQS

SEQ ID NO: 983196 - protein, 19 aa, Mycobacterium
ADQSRERMRKRGGGPGPAI

SEQ ID NO: 983197 - protein, 8 aa, Mycobacterium
ADRAGVSK

SEQ ID NO: 983198 - protein, 10 aa, Mycobacterium
ADRAKPAVPF

SEQ ID NO: 983199 - protein, 17 aa, Mycobacterium
ADREAPVAQYCGESGIG

SEQ ID NO: 983200 - protein, 9 aa, Mycobacterium
ADRGEPEAY

SEQ ID NO: 983201 - protein, 8 aa, Mycobacterium
ADRGGLSP

SEQ ID NO: 983202 - protein, 4 aa, Mycobacterium
ADRI

SEQ ID NO: 983203 - protein, 7 aa, Mycobacterium
ADRNGVD

SEQ ID NO: 983204 - protein, 5 aa, Mycobacterium
ADRPA

SEQ ID NO: 983205 - protein, 6 aa, Mycobacterium
ADRPTH

SEQ ID NO: 983206 - protein, 20 aa, Mycobacterium
ADRRSARKRNALAARSRKRI

SEQ ID NO: 983207 - protein, 4 aa, Mycobacterium
ADRS

SEQ ID NO: 983208 - protein, 16 aa, Mycobacterium
ADRSSLRQLHAAITAT

SEQ ID NO: 983209 - protein, 16 aa, Mycobacterium
ADRSSSIPTSVARVLL

SEQ ID NO: 983210 - protein, 12 aa, Mycobacterium
ADRSTLKISITL

SEQ ID NO: 983211 - protein, 6 aa, Mycobacterium
ADRSTV

SEQ ID NO: 983212 - protein, 6 aa, Mycobacterium
ADRVDQ

SEQ ID NO: 983213 - protein, 5 aa, Mycobacterium
ADSGV

SEQ ID NO: 983214 - protein, 20 aa, Mycobacterium
ADSLRNDSAKVTVKDGPWGR

SEQ ID NO: 983215 - protein, 9 aa, Mycobacterium
ADSPPQTVA

SEQ ID NO: 983216 - protein, 5 aa, Mycobacterium
ADSRL

SEQ ID NO: 983217 - protein, 13 aa, Mycobacterium
ADSRPSRGCRSGD

SEQ ID NO: 983218 - protein, 5 aa, Mycobacterium
ADSRY

SEQ ID NO: 983219 - protein, 6 aa, Mycobacterium
ADSSAN

SEQ ID NO: 983220 - protein, 8 aa, Mycobacterium
ADSSFDRA

SEQ ID NO: 983221 - protein, 12 aa, Mycobacterium
ADSSISRDSYGN

SEQ ID NO: 983222 - protein, 9 aa, Mycobacterium
ADSTNPDAQ

SEQ ID NO: 983223 - protein, 12 aa, Mycobacterium
ADSTPPTNWDRP

SEQ ID NO: 983224 - protein, 8 aa, Mycobacterium
ADSYGPYV

SEQ ID NO: 983225 - protein, 8 aa, Mycobacterium
ADTAAAGA

SEQ ID NO: 983226 - protein, 36 aa, Mycobacterium
ADTARRAAISAADSLRAEQKATSKSLGAASAEDRPA

SEQ ID NO: 983227 - protein, 7 aa, Mycobacterium
ADTKERM

SEQ ID NO: 983228 - protein, 4 aa, Mycobacterium
ADTL

SEQ ID NO: 983229 - protein, 8 aa, Mycobacterium
ADTSDPLA

SEQ ID NO: 983230 - protein, 7 aa, Mycobacterium
ADTSPSV

SEQ ID NO: 983231 - protein, 5 aa, Mycobacterium
ADVAV

SEQ ID NO: 983232 - protein, 4 aa, Mycobacterium
ADVG

SEQ ID NO: 983233 - protein, 19 aa, Mycobacterium
ADVKTNKEGHFSASDRDDV

SEQ ID NO: 983234 - protein, 8 aa, Mycobacterium
ADVPGTAA

SEQ ID NO: 983235 - protein, 7 aa, Mycobacterium
ADVVGSD

SEQ ID NO: 983236 - protein, 5 aa, Mycobacterium
ADYDT

SEQ ID NO: 983237 - protein, 4 aa, Mycobacterium
ADYP

SEQ ID NO: 983238 - protein, 7 aa, Mycobacterium
AEAAPTA

SEQ ID NO: 983239 - protein, 8 aa, Mycobacterium
AEADGRRP

SEQ ID NO: 983240 - protein, 5 aa, Mycobacterium
AEAES

SEQ ID NO: 983241 - protein, 4 aa, Mycobacterium
AEAG

SEQ ID NO: 983242 - protein, 7 aa, Mycobacterium
AEAGASV

SEQ ID NO: 983243 - protein, 5 aa, Mycobacterium
AEAGC

SEQ ID NO: 983244 - protein, 6 aa, Mycobacterium
AEAGGG

SEQ ID NO: 983245 - protein, 9 aa, Mycobacterium
AEAGHPPTR

SEQ ID NO: 983246 - protein, 10 aa, Mycobacterium
AEAGQAPEPL

SEQ ID NO: 983247 - protein, 14 aa, Mycobacterium
AEAGRHKSDNVTPW

SEQ ID NO: 983248 - protein, 8 aa, Mycobacterium
AEAGTRSQ

SEQ ID NO: 983249 - protein, 22 aa, Mycobacterium
AEAHAEEDRKRREEADVRNQAE

SEQ ID NO: 983250 - protein, 12 aa, Mycobacterium
AEAHPEGLLEYS

SEQ ID NO: 983251 - protein, 9 aa, Mycobacterium
AEAKRRRRN

SEQ ID NO: 983252 - protein, 7 aa, Mycobacterium
AEANQSA

SEQ ID NO: 983253 - protein, 5 aa, Mycobacterium
AEAPD

SEQ ID NO: 983254 - protein, 27 aa, Mycobacterium
AEARREKESAIDAQDFEKAASLRDREK

SEQ ID NO: 983255 - protein, 4 aa, Mycobacterium
AEAS

SEQ ID NO: 983256 - protein, 4 aa, Mycobacterium
AEAT

SEQ ID NO: 983257 - protein, 7 aa, Mycobacterium
AEDATER

SEQ ID NO: 983258 - protein, 14 aa, Mycobacterium
AEDLQAARATDTLA

SEQ ID NO: 983259 - protein, 9 aa, Mycobacterium
AEDPPARAR

SEQ ID NO: 983260 - protein, 10 aa, Mycobacterium
AEDTRRARTL

SEQ ID NO: 983261 - protein, 6 aa, Mycobacterium
AEDTSE

SEQ ID NO: 983262 - protein, 7 aa, Mycobacterium
AEEAGLI

SEQ ID NO: 983263 - protein, 7 aa, Mycobacterium
AEEAGPA

SEQ ID NO: 983264 - protein, 7 aa, Mycobacterium
AEEARRR

SEQ ID NO: 983265 - protein, 4 aa, Mycobacterium
AEED

SEQ ID NO: 983266 - protein, 6 aa, Mycobacterium
AEEDRL

SEQ ID NO: 983267 - protein, 4 aa, Mycobacterium
AEEF

SEQ ID NO: 983268 - protein, 20 aa, Mycobacterium
AEEISGQADIEELPDDLTSQ

SEQ ID NO: 983269 - protein, 4 aa, Mycobacterium
AEEL

SEQ ID NO: 983270 - protein, 7 aa, Mycobacterium
AEENRHG

SEQ ID NO: 983271 - protein, 4 aa, Mycobacterium
AEEQ

SEQ ID NO: 983272 - protein, 7 aa, Mycobacterium
AEESPLG

SEQ ID NO: 983273 - protein, 7 aa, Mycobacterium
AEETGIR

SEQ ID NO: 983274 - protein, 37 aa, Mycobacterium
AEFDSEIDENAAKQDAESDDPRIAARGRARLRAVGAI

SEQ ID NO: 983275 - protein, 7 aa, Mycobacterium
AEFNRSN

SEQ ID NO: 983276 - protein, 5 aa, Mycobacterium
AEGAM

SEQ ID NO: 983277 - protein, 6 aa, Mycobacterium
AEGAPE

SEQ ID NO: 983278 - protein, 11 aa, Mycobacterium
AEGDIDADTVR

SEQ ID NO: 983279 - protein, 7 aa, Mycobacterium
AEGEDDD

SEQ ID NO: 983280 - protein, 7 aa, Mycobacterium
AEGGNEI

SEQ ID NO: 983281 - protein, 19 aa, Mycobacterium
AEGHRGETGWRAVGLPWKQ

SEQ ID NO: 983282 - protein, 14 aa, Mycobacterium
AEGKATELASREGV

SEQ ID NO: 983283 - protein, 6 aa, Mycobacterium
AEGPVA

SEQ ID NO: 983284 - protein, 19 aa, Mycobacterium
AEGQPVVASTNNAVIATCT

SEQ ID NO: 983285 - protein, 6 aa, Mycobacterium
AEGRGV

SEQ ID NO: 983286 - protein, 6 aa, Mycobacterium
AEGRLS

SEQ ID NO: 983287 - protein, 4 aa, Mycobacterium
AEGS

SEQ ID NO: 983288 - protein, 19 aa, Mycobacterium
AEGTAELTPPAAAPDDDTV

SEQ ID NO: 983289 - protein, 9 aa, Mycobacterium
AEGTASELK

SEQ ID NO: 983290 - protein, 9 aa, Mycobacterium
AEGTPEDVA

SEQ ID NO: 983291 - protein, 10 aa, Mycobacterium
AEHAGITSGV

SEQ ID NO: 983292 - protein, 5 aa, Mycobacterium
AEHIA

SEQ ID NO: 983293 - protein, 5 aa, Mycobacterium
AEHPY

SEQ ID NO: 983294 - protein, 8 aa, Mycobacterium
AEIDPEDL

SEQ ID NO: 983295 - protein, 5 aa, Mycobacterium
AEIEP

SEQ ID NO: 983296 - protein, 9 aa, Mycobacterium
AEIGEGNKL

SEQ ID NO: 983297 - protein, 7 aa, Mycobacterium
AEIGSGE

SEQ ID NO: 983298 - protein, 20 aa, Mycobacterium
AEINSAGDGSGGPAGSIDDE

SEQ ID NO: 983299 - protein, 10 aa, Mycobacterium
AEKASAATEA

SEQ ID NO: 983300 - protein, 9 aa, Mycobacterium
AEKEPEPAT

SEQ ID NO: 983301 - protein, 13 aa, Mycobacterium
AEKPDVGRLEPGH

SEQ ID NO: 983302 - protein, 5 aa, Mycobacterium
AEKPK

SEQ ID NO: 983303 - protein, 12 aa, Mycobacterium
AEKPVGSRARDR

SEQ ID NO: 983304 - protein, 7 aa, Mycobacterium
AEKRKAI

SEQ ID NO: 983305 - protein, 5 aa, Mycobacterium
AEKRP

SEQ ID NO: 983306 - protein, 10 aa, Mycobacterium
AEKRRNPSDD

SEQ ID NO: 983307 - protein, 9 aa, Mycobacterium
AEKSSTEPI

SEQ ID NO: 983308 - protein, 6 aa, Mycobacterium
AEKTNA

SEQ ID NO: 983309 - protein, 10 aa, Mycobacterium
AELAGESDEH

SEQ ID NO: 983310 - protein, 6 aa, Mycobacterium
AELGNP

SEQ ID NO: 983311 - protein, 8 aa, Mycobacterium
AELGYGSD

SEQ ID NO: 983312 - protein, 8 aa, Mycobacterium
AELNESTA

SEQ ID NO: 983313 - protein, 4 aa, Mycobacterium
AELR

SEQ ID NO: 983314 - protein, 16 aa, Mycobacterium
AENEDLPNTTNPDDWA

SEQ ID NO: 983315 - protein, 5 aa, Mycobacterium
AENGL

SEQ ID NO: 983316 - protein, 8 aa, Mycobacterium
AENLPFDN

SEQ ID NO: 983317 - protein, 13 aa, Mycobacterium
AENLPSTNVIWRV

SEQ ID NO: 983318 - protein, 6 aa, Mycobacterium
AEPAGA

SEQ ID NO: 983319 - protein, 7 aa, Mycobacterium
AEPEAVT

SEQ ID NO: 983320 - protein, 8 aa, Mycobacterium
AEPGLPQA

SEQ ID NO: 983321 - protein, 16 aa, Mycobacterium
AEPGRRDLSAPRPDLE

SEQ ID NO: 983322 - protein, 5 aa, Mycobacterium
AEPLV

SEQ ID NO: 983323 - protein, 9 aa, Mycobacterium
AEPNEGSFP

SEQ ID NO: 983324 - protein, 6 aa, Mycobacterium
AEPPVM

SEQ ID NO: 983325 - protein, 10 aa, Mycobacterium
AEPPVPPNFP

SEQ ID NO: 983326 - protein, 10 aa, Mycobacterium
AEPRAPYPHA

SEQ ID NO: 983327 - protein, 5 aa, Mycobacterium
AEPRV

SEQ ID NO: 983328 - protein, 11 aa, Mycobacterium
AEPRYNETTRG

SEQ ID NO: 983329 - protein, 7 aa, Mycobacterium
AEPSIGG

SEQ ID NO: 983330 - protein, 9 aa, Mycobacterium
AEPYEPDPE

SEQ ID NO: 983331 - protein, 6 aa, Mycobacterium
AEPYTA

SEQ ID NO: 983332 - protein, 4 aa, Mycobacterium
AEQA

SEQ ID NO: 983333 - protein, 9 aa, Mycobacterium
AEQAEAAAA

SEQ ID NO: 983334 - protein, 10 aa, Mycobacterium
AEQDKTDWAT

SEQ ID NO: 983335 - protein, 6 aa, Mycobacterium
AEQFAP

SEQ ID NO: 983336 - protein, 5 aa, Mycobacterium
AEQGR

SEQ ID NO: 983337 - protein, 6 aa, Mycobacterium
AEQGRL

SEQ ID NO: 983338 - protein, 10 aa, Mycobacterium
AEQKHSIDDP

SEQ ID NO: 983339 - protein, 10 aa, Mycobacterium
AEQKTTGAET

SEQ ID NO: 983340 - protein, 4 aa, Mycobacterium
AEQL

SEQ ID NO: 983341 - protein, 6 aa, Mycobacterium
AEQPDA

SEQ ID NO: 983342 - protein, 15 aa, Mycobacterium
AEQQISSPGSYRQNS

SEQ ID NO: 983343 - protein, 10 aa, Mycobacterium
AEQRAMPGAG

SEQ ID NO: 983344 - protein, 6 aa, Mycobacterium
AEQRDS

SEQ ID NO: 983345 - protein, 7 aa, Mycobacterium
AEQSVED

SEQ ID NO: 983346 - protein, 4 aa, Mycobacterium
AEQV

SEQ ID NO: 983347 - protein, 4 aa, Mycobacterium
AERA

SEQ ID NO: 983348 - protein, 37 aa, Mycobacterium
AERAGRPAARRRRTDRQVDGKGGINSNSSPTLPTLWV

SEQ ID NO: 983349 - protein, 9 aa, Mycobacterium
AERAGVAEP

SEQ ID NO: 983350 - protein, 30 aa, Mycobacterium
AERAKPRKISVDRGNNGHQTINKTAHEIID

SEQ ID NO: 983351 - protein, 7 aa, Mycobacterium
AERDSGI

SEQ ID NO: 983352 - protein, 7 aa, Mycobacterium
AERGNRI

SEQ ID NO: 983353 - protein, 16 aa, Mycobacterium
AERKRGVAPDTLPATE

SEQ ID NO: 983354 - protein, 10 aa, Mycobacterium
AERLDQGYGP

SEQ ID NO: 983355 - protein, 21 aa, Mycobacterium
AERLPRGADPHTHTKLGRGGL

SEQ ID NO: 983356 - protein, 5 aa, Mycobacterium
AERNL

SEQ ID NO: 983357 - protein, 7 aa, Mycobacterium
AERPGDA

SEQ ID NO: 983358 - protein, 8 aa, Mycobacterium
AERPGDAV

SEQ ID NO: 983359 - protein, 7 aa, Mycobacterium
AERPGHL

SEQ ID NO: 983360 - protein, 10 aa, Mycobacterium
AERPGVDPDR

SEQ ID NO: 983361 - protein, 7 aa, Mycobacterium
AERRSSV

SEQ ID NO: 983362 - protein, 6 aa, Mycobacterium
AERSAQ

SEQ ID NO: 983363 - protein, 7 aa, Mycobacterium
AERSPLC

SEQ ID NO: 983364 - protein, 12 aa, Mycobacterium
AERTAAAIARTL

SEQ ID NO: 983365 - protein, 8 aa, Mycobacterium
AERYEKGQ

SEQ ID NO: 983366 - protein, 5 aa, Mycobacterium
AESAE

SEQ ID NO: 983367 - protein, 6 aa, Mycobacterium
AESAGA

SEQ ID NO: 983368 - protein, 12 aa, Mycobacterium
AESASTSTRTSV

SEQ ID NO: 983369 - protein, 11 aa, Mycobacterium
AESEVQPIGQP

SEQ ID NO: 983370 - protein, 6 aa, Mycobacterium
AESGVS

SEQ ID NO: 983371 - protein, 5 aa, Mycobacterium
AESKM

SEQ ID NO: 983372 - protein, 17 aa, Mycobacterium
AESLNSLAESNLGVESA

SEQ ID NO: 983373 - protein, 6 aa, Mycobacterium
AESNLD

SEQ ID NO: 983374 - protein, 10 aa, Mycobacterium
AESNRQRAHY

SEQ ID NO: 983375 - protein, 16 aa, Mycobacterium
AESPPTKRSPPPNGCR

SEQ ID NO: 983376 - protein, 7 aa, Mycobacterium
AESPQIR

SEQ ID NO: 983377 - protein, 8 aa, Mycobacterium
AESSQSIV

SEQ ID NO: 983378 - protein, 6 aa, Mycobacterium
AESTGE

SEQ ID NO: 983379 - protein, 5 aa, Mycobacterium
AESVW

SEQ ID NO: 983380 - protein, 4 aa, Mycobacterium
AETA

SEQ ID NO: 983381 - protein, 6 aa, Mycobacterium
AETAEE

SEQ ID NO: 983382 - protein, 7 aa, Mycobacterium
AETAGSQ

SEQ ID NO: 983383 - protein, 8 aa, Mycobacterium
AETDRGNA

SEQ ID NO: 983384 - protein, 6 aa, Mycobacterium
AETEGT

SEQ ID NO: 983385 - protein, 19 aa, Mycobacterium
AETESVADVGDRANDPVRV

SEQ ID NO: 983386 - protein, 5 aa, Mycobacterium
AETEV

SEQ ID NO: 983387 - protein, 12 aa, Mycobacterium
AETFTDNTEPHI

SEQ ID NO: 983388 - protein, 12 aa, Mycobacterium
AETGAGQHGVAT

SEQ ID NO: 983389 - protein, 8 aa, Mycobacterium
AETGDASG

SEQ ID NO: 983390 - protein, 7 aa, Mycobacterium
AETGVTR

SEQ ID NO: 983391 - protein, 4 aa, Mycobacterium
AETL

SEQ ID NO: 983392 - protein, 5 aa, Mycobacterium
AETLG

SEQ ID NO: 983393 - protein, 9 aa, Mycobacterium
AETPTSGDV

SEQ ID NO: 983394 - protein, 11 aa, Mycobacterium
AETQRAELDQD

SEQ ID NO: 983395 - protein, 7 aa, Mycobacterium
AETSRIT

SEQ ID NO: 983396 - protein, 12 aa, Mycobacterium
AETTSRTAAYGG

SEQ ID NO: 983397 - protein, 5 aa, Mycobacterium
AEVAA

SEQ ID NO: 983398 - protein, 4 aa, Mycobacterium
AEVE

SEQ ID NO: 983399 - protein, 4 aa, Mycobacterium
AEVP

SEQ ID NO: 983400 - protein, 12 aa, Mycobacterium
AEVRGDDAREAK

SEQ ID NO: 983401 - protein, 8 aa, Mycobacterium
AEVSTGAT

SEQ ID NO: 983402 - protein, 4 aa, Mycobacterium
AEWA

SEQ ID NO: 983403 - protein, 4 aa, Mycobacterium
AEYG

SEQ ID NO: 983404 - protein, 8 aa, Mycobacterium
AEYGDRRP

SEQ ID NO: 983405 - protein, 5 aa, Mycobacterium
AEYRT

SEQ ID NO: 983406 - protein, 13 aa, Mycobacterium
AEYSTAQHALSGE

SEQ ID NO: 983407 - protein, 6 aa, Mycobacterium
AFAGQG

SEQ ID NO: 983408 - protein, 12 aa, Mycobacterium
AFDRDDPRGGEA

SEQ ID NO: 983409 - protein, 7 aa, Mycobacterium
AFGDDKD

SEQ ID NO: 983410 - protein, 13 aa, Mycobacterium
AFGGDASATTSVT

SEQ ID NO: 983411 - protein, 10 aa, Mycobacterium
AFGGGGKGMK

SEQ ID NO: 983412 - protein, 7 aa, Mycobacterium
AFPDSHH

SEQ ID NO: 983413 - protein, 12 aa, Mycobacterium
AFSEAGIGPSRT

SEQ ID NO: 983414 - protein, 8 aa, Mycobacterium
AGAADETV

SEQ ID NO: 983415 - protein, 5 aa, Mycobacterium
AGAAE

SEQ ID NO: 983416 - protein, 10 aa, Mycobacterium
AGAAEDLAAS

SEQ ID NO: 983417 - protein, 5 aa, Mycobacterium
AGAAG

SEQ ID NO: 983418 - protein, 24 aa, Mycobacterium
AGAAWPDAGGVNLKPDSTSQAGHQ

SEQ ID NO: 983419 - protein, 4 aa, Mycobacterium
AGAD

SEQ ID NO: 983420 - protein, 11 aa, Mycobacterium
AGADDVGRAEE

SEQ ID NO: 983421 - protein, 13 aa, Mycobacterium
AGADEAVTVGRQT

SEQ ID NO: 983422 - protein, 5 aa, Mycobacterium
AGADF

SEQ ID NO: 983423 - protein, 4 aa, Mycobacterium
AGAE

SEQ ID NO: 983424 - protein, 11 aa, Mycobacterium
AGAEAAHDTVT

SEQ ID NO: 983425 - protein, 8 aa, Mycobacterium
AGAEADPN

SEQ ID NO: 983426 - protein, 10 aa, Mycobacterium
AGAEEVNDLG

SEQ ID NO: 983427 - protein, 15 aa, Mycobacterium
AGAEIARRSRGTPRI

SEQ ID NO: 983428 - protein, 7 aa, Mycobacterium
AGAETRH

SEQ ID NO: 983429 - protein, 4 aa, Mycobacterium
AGAG

SEQ ID NO: 983430 - protein, 6 aa, Mycobacterium
AGAGAD

SEQ ID NO: 983431 - protein, 11 aa, Mycobacterium
AGAGEGSAIAD

SEQ ID NO: 983432 - protein, 5 aa, Mycobacterium
AGAGG

SEQ ID NO: 983433 - protein, 10 aa, Mycobacterium
AGAGQMPARQ

SEQ ID NO: 983434 - protein, 12 aa, Mycobacterium
AGAGRADNTGSN

SEQ ID NO: 983435 - protein, 22 aa, Mycobacterium
AGAGSSALNDSGADLSEANPTE

SEQ ID NO: 983436 - protein, 5 aa, Mycobacterium
AGAID

SEQ ID NO: 983437 - protein, 12 aa, Mycobacterium
AGALATEASDVA

SEQ ID NO: 983438 - protein, 14 aa, Mycobacterium
AGANDTEKFGADHA

SEQ ID NO: 983439 - protein, 17 aa, Mycobacterium
AGAPCPKTQAAAQSADG

SEQ ID NO: 983440 - protein, 7 aa, Mycobacterium
AGAPSVA

SEQ ID NO: 983441 - protein, 9 aa, Mycobacterium
AGAPTPDDL

SEQ ID NO: 983442 - protein, 4 aa, Mycobacterium
AGAQ

SEQ ID NO: 983443 - protein, 7 aa, Mycobacterium
AGAQGTV

SEQ ID NO: 983444 - protein, 11 aa, Mycobacterium
AGAQNPDRGLY

SEQ ID NO: 983445 - protein, 6 aa, Mycobacterium
AGARAG

SEQ ID NO: 983446 - protein, 8 aa, Mycobacterium
AGARTPSR

SEQ ID NO: 983447 - protein, 6 aa, Mycobacterium
AGASPA

SEQ ID NO: 983448 - protein, 5 aa, Mycobacterium
AGASV

SEQ ID NO: 983449 - protein, 11 aa, Mycobacterium
AGATGESAMDA

SEQ ID NO: 983450 - protein, 9 aa, Mycobacterium
AGATGSRLV

SEQ ID NO: 983451 - protein, 11 aa, Mycobacterium
AGATVTQTDDS

SEQ ID NO: 983452 - protein, 9 aa, Mycobacterium
AGAVDAGGR

SEQ ID NO: 983453 - protein, 8 aa, Mycobacterium
AGAVPSPF

SEQ ID NO: 983454 - protein, 9 aa, Mycobacterium
AGCDPAQFD

SEQ ID NO: 983455 - protein, 8 aa, Mycobacterium
AGCSSTVD

SEQ ID NO: 983456 - protein, 8 aa, Mycobacterium
AGDADGAG

SEQ ID NO: 983457 - protein, 6 aa, Mycobacterium
AGDADL

SEQ ID NO: 983458 - protein, 12 aa, Mycobacterium
AGDAEAVAERRD

SEQ ID NO: 983459 - protein, 8 aa, Mycobacterium
AGDAPSAA

SEQ ID NO: 983460 - protein, 6 aa, Mycobacterium
AGDAYG

SEQ ID NO: 983461 - protein, 6 aa, Mycobacterium
AGDEVS

SEQ ID NO: 983462 - protein, 7 aa, Mycobacterium
AGDGAET

SEQ ID NO: 983463 - protein, 7 aa, Mycobacterium
AGDGITE

SEQ ID NO: 983464 - protein, 7 aa, Mycobacterium
AGDGNTH

SEQ ID NO: 983465 - protein, 6 aa, Mycobacterium
AGDGPV

SEQ ID NO: 983466 - protein, 22 aa, Mycobacterium
AGDGVETGRHAATLTGGLPGAF

SEQ ID NO: 983467 - protein, 6 aa, Mycobacterium
AGDQRS

SEQ ID NO: 983468 - protein, 5 aa, Mycobacterium
AGDRP

SEQ ID NO: 983469 - protein, 12 aa, Mycobacterium
AGDSAGSNISAS

SEQ ID NO: 983470 - protein, 6 aa, Mycobacterium
AGDSGI

SEQ ID NO: 983471 - protein, 7 aa, Mycobacterium
AGDTGLA

SEQ ID NO: 983472 - protein, 9 aa, Mycobacterium
AGDTITGAT

SEQ ID NO: 983473 - protein, 4 aa, Mycobacterium
AGEA

SEQ ID NO: 983474 - protein, 11 aa, Mycobacterium
AGEAKNTYGTG

SEQ ID NO: 983475 - protein, 6 aa, Mycobacterium
AGEDRK

SEQ ID NO: 983476 - protein, 8 aa, Mycobacterium
AGEDSSRG

SEQ ID NO: 983477 - protein, 13 aa, Mycobacterium
AGEEIPQTKEEIR

SEQ ID NO: 983478 - protein, 5 aa, Mycobacterium
AGEGA

SEQ ID NO: 983479 - protein, 8 aa, Mycobacterium
AGEGEPEQ

SEQ ID NO: 983480 - protein, 11 aa, Mycobacterium
AGEGESTTDLA

SEQ ID NO: 983481 - protein, 11 aa, Mycobacterium
AGEGGEVGERQ

SEQ ID NO: 983482 - protein, 17 aa, Mycobacterium
AGEGPTAKRIRPRAQGR

SEQ ID NO: 983483 - protein, 14 aa, Mycobacterium
AGEGVANPDGTLTA

SEQ ID NO: 983484 - protein, 9 aa, Mycobacterium
AGELTDEPE

SEQ ID NO: 983485 - protein, 6 aa, Mycobacterium
AGEPVT

SEQ ID NO: 983486 - protein, 6 aa, Mycobacterium
AGEQRV

SEQ ID NO: 983487 - protein, 9 aa, Mycobacterium
AGERGAKSI

SEQ ID NO: 983488 - protein, 9 aa, Mycobacterium
AGERVPEVD

SEQ ID NO: 983489 - protein, 13 aa, Mycobacterium
AGESDDTSKLTRE

SEQ ID NO: 983490 - protein, 8 aa, Mycobacterium
AGETAGDF

SEQ ID NO: 983491 - protein, 16 aa, Mycobacterium
AGETGGNCELTEPGQT

SEQ ID NO: 983492 - protein, 5 aa, Mycobacterium
AGEVE

SEQ ID NO: 983493 - protein, 5 aa, Mycobacterium
AGEWS

SEQ ID NO: 983494 - protein, 9 aa, Mycobacterium
AGFDPSART

SEQ ID NO: 983495 - protein, 6 aa, Mycobacterium
AGFGPE

SEQ ID NO: 983496 - protein, 8 aa, Mycobacterium
AGFPDTDS

SEQ ID NO: 983497 - protein, 18 aa, Mycobacterium
AGFPKSGLLEGSKHDEIN

SEQ ID NO: 983498 - protein, 9 aa, Mycobacterium
AGFSARGQE

SEQ ID NO: 983499 - protein, 11 aa, Mycobacterium
AGFSRDDAKEA

SEQ ID NO: 983500 - protein, 8 aa, Mycobacterium
AGGAAARP

SEQ ID NO: 983501 - protein, 6 aa, Mycobacterium
AGGAAH

SEQ ID NO: 983502 - protein, 5 aa, Mycobacterium
AGGAD

SEQ ID NO: 983503 - protein, 10 aa, Mycobacterium
AGGADVSPQL

SEQ ID NO: 983504 - protein, 7 aa, Mycobacterium
AGGAGRV

SEQ ID NO: 983505 - protein, 8 aa, Mycobacterium
AGGAPGEV

SEQ ID NO: 983506 - protein, 14 aa, Mycobacterium
AGGAPMYERPPDRR

SEQ ID NO: 983507 - protein, 6 aa, Mycobacterium
AGGAQL

SEQ ID NO: 983508 - protein, 9 aa, Mycobacterium
AGGASEHEC

SEQ ID NO: 983509 - protein, 4 aa, Mycobacterium
AGGD

SEQ ID NO: 983510 - protein, 7 aa, Mycobacterium
AGGDEVS

SEQ ID NO: 983511 - protein, 8 aa, Mycobacterium
AGGDSAGQ

SEQ ID NO: 983512 - protein, 6 aa, Mycobacterium
AGGEIP

SEQ ID NO: 983513 - protein, 14 aa, Mycobacterium
AGGERDPGKRAPMG

SEQ ID NO: 983514 - protein, 8 aa, Mycobacterium
AGGGGRGM

SEQ ID NO: 983515 - protein, 17 aa, Mycobacterium
AGGGHVEPAAEVDPAAA

SEQ ID NO: 983516 - protein, 7 aa, Mycobacterium
AGGGQVT

SEQ ID NO: 983517 - protein, 8 aa, Mycobacterium
AGGGRDDY

SEQ ID NO: 983518 - protein, 5 aa, Mycobacterium
AGGGS

SEQ ID NO: 983519 - protein, 6 aa, Mycobacterium
AGGHDT

SEQ ID NO: 983520 - protein, 4 aa, Mycobacterium
AGGI

SEQ ID NO: 983521 - protein, 6 aa, Mycobacterium
AGGIPN

SEQ ID NO: 983522 - protein, 8 aa, Mycobacterium
AGGKELSE

SEQ ID NO: 983523 - protein, 6 aa, Mycobacterium
AGGLAS

SEQ ID NO: 983524 - protein, 5 aa, Mycobacterium
AGGLR

SEQ ID NO: 983525 - protein, 7 aa, Mycobacterium
AGGPEAG

SEQ ID NO: 983526 - protein, 6 aa, Mycobacterium
AGGPPK

SEQ ID NO: 983527 - protein, 4 aa, Mycobacterium
AGGQ

SEQ ID NO: 983528 - protein, 10 aa, Mycobacterium
AGGQGHYSSA

SEQ ID NO: 983529 - protein, 8 aa, Mycobacterium
AGGQLGSA

SEQ ID NO: 983530 - protein, 23 aa, Mycobacterium
AGGRRVSDERRGKHHHNDGKDGS

SEQ ID NO: 983531 - protein, 8 aa, Mycobacterium
AGGSGTLS

SEQ ID NO: 983532 - protein, 9 aa, Mycobacterium
AGGTESDNL

SEQ ID NO: 983533 - protein, 15 aa, Mycobacterium
AGGYTRDFTKPGAPQ

SEQ ID NO: 983534 - protein, 11 aa, Mycobacterium
AGHASATGRFD

SEQ ID NO: 983535 - protein, 8 aa, Mycobacterium
AGHDPRRF

SEQ ID NO: 983536 - protein, 4 aa, Mycobacterium
AGHH

SEQ ID NO: 983537 - protein, 5 aa, Mycobacterium
AGHPG

SEQ ID NO: 983538 - protein, 13 aa, Mycobacterium
AGHRGRMVGKRGE

SEQ ID NO: 983539 - protein, 4 aa, Mycobacterium
AGHS

SEQ ID NO: 983540 - protein, 7 aa, Mycobacterium
AGHSRET

SEQ ID NO: 983541 - protein, 5 aa, Mycobacterium
AGHTG

SEQ ID NO: 983542 - protein, 6 aa, Mycobacterium
AGHTGL

SEQ ID NO: 983543 - protein, 7 aa, Mycobacterium
AGIAPPR

SEQ ID NO: 983544 - protein, 17 aa, Mycobacterium
AGIDPAGLRGSATGVYT

SEQ ID NO: 983545 - protein, 4 aa, Mycobacterium
AGIP

SEQ ID NO: 983546 - protein, 16 aa, Mycobacterium
AGIPARGGGYRYFTTT

SEQ ID NO: 983547 - protein, 8 aa, Mycobacterium
AGIPKTGR

SEQ ID NO: 983548 - protein, 14 aa, Mycobacterium
AGIPPDSLGNSRTG

SEQ ID NO: 983549 - protein, 5 aa, Mycobacterium
AGISV

SEQ ID NO: 983550 - protein, 4 aa, Mycobacterium
AGKA

SEQ ID NO: 983551 - protein, 6 aa, Mycobacterium
AGKGVD

SEQ ID NO: 983552 - protein, 9 aa, Mycobacterium
AGKIAGSDA

SEQ ID NO: 983553 - protein, 10 aa, Mycobacterium
AGKPAPDSYL

SEQ ID NO: 983554 - protein, 5 aa, Mycobacterium
AGKPD

SEQ ID NO: 983555 - protein, 8 aa, Mycobacterium
AGKPDLAV

SEQ ID NO: 983556 - protein, 14 aa, Mycobacterium
AGKPDQASEPGGGK

SEQ ID NO: 983557 - protein, 5 aa, Mycobacterium
AGKPL

SEQ ID NO: 983558 - protein, 7 aa, Mycobacterium
AGKQGAR

SEQ ID NO: 983559 - protein, 10 aa, Mycobacterium
AGKRAGVDKG

SEQ ID NO: 983560 - protein, 31 aa, Mycobacterium
AGKRSRYRARTDPDRLRDSYERDDGLQQRTG

SEQ ID NO: 983561 - protein, 4 aa, Mycobacterium
AGKS

SEQ ID NO: 983562 - protein, 9 aa, Mycobacterium
AGKSGRSCG

SEQ ID NO: 983563 - protein, 5 aa, Mycobacterium
AGKSL

SEQ ID NO: 983564 - protein, 7 aa, Mycobacterium
AGKYGVR

SEQ ID NO: 983565 - protein, 7 aa, Mycobacterium
AGLATAA

SEQ ID NO: 983566 - protein, 18 aa, Mycobacterium
AGLATGPTVSPPPPDEAS

SEQ ID NO: 983567 - protein, 4 aa, Mycobacterium
AGLD

SEQ ID NO: 983568 - protein, 5 aa, Mycobacterium
AGLDS

SEQ ID NO: 983569 - protein, 14 aa, Mycobacterium
AGLDTGGARQLPRD

SEQ ID NO: 983570 - protein, 9 aa, Mycobacterium
AGLKESHPH

SEQ ID NO: 983571 - protein, 16 aa, Mycobacterium
AGLPPAGVIDLGSRSR

SEQ ID NO: 983572 - protein, 9 aa, Mycobacterium
AGLQPDDEA

SEQ ID NO: 983573 - protein, 4 aa, Mycobacterium
AGLR

SEQ ID NO: 983574 - protein, 5 aa, Mycobacterium
AGLSA

SEQ ID NO: 983575 - protein, 6 aa, Mycobacterium
AGLSDE

SEQ ID NO: 983576 - protein, 8 aa, Mycobacterium
AGLSDTAR

SEQ ID NO: 983577 - protein, 8 aa, Mycobacterium
AGLSPEQI

SEQ ID NO: 983578 - protein, 8 aa, Mycobacterium
AGLTNPAG

SEQ ID NO: 983579 - protein, 9 aa, Mycobacterium
AGMDAGGVE

SEQ ID NO: 983580 - protein, 5 aa, Mycobacterium
AGMGG

SEQ ID NO: 983581 - protein, 7 aa, Mycobacterium
AGMQTSK

SEQ ID NO: 983582 - protein, 8 aa, Mycobacterium
AGMSGGEA

SEQ ID NO: 983583 - protein, 6 aa, Mycobacterium
AGNEIK

SEQ ID NO: 983584 - protein, 12 aa, Mycobacterium
AGNGMAGHTTPA

SEQ ID NO: 983585 - protein, 7 aa, Mycobacterium
AGNGRYA

SEQ ID NO: 983586 - protein, 11 aa, Mycobacterium
AGNKDNNAGTL

SEQ ID NO: 983587 - protein, 4 aa, Mycobacterium
AGNP

SEQ ID NO: 983588 - protein, 5 aa, Mycobacterium
AGNRL

SEQ ID NO: 983589 - protein, 16 aa, Mycobacterium
AGNSPLAADAVTASPY

SEQ ID NO: 983590 - protein, 7 aa, Mycobacterium
AGNYPQI

SEQ ID NO: 983591 - protein, 5 aa, Mycobacterium
AGPAC

SEQ ID NO: 983592 - protein, 17 aa, Mycobacterium
AGPAGSAAATWAARAGN

SEQ ID NO: 983593 - protein, 6 aa, Mycobacterium
AGPAQI

SEQ ID NO: 983594 - protein, 4 aa, Mycobacterium
AGPD

SEQ ID NO: 983595 - protein, 21 aa, Mycobacterium
AGPDHPHSAQQPVPFEIKQVA

SEQ ID NO: 983596 - protein, 8 aa, Mycobacterium
AGPDRAEK

SEQ ID NO: 983597 - protein, 6 aa, Mycobacterium
AGPERM

SEQ ID NO: 983598 - protein, 9 aa, Mycobacterium
AGPESESQR

SEQ ID NO: 983599 - protein, 9 aa, Mycobacterium
AGPGETAGF

SEQ ID NO: 983600 - protein, 12 aa, Mycobacterium
AGPGTPNQPDTH

SEQ ID NO: 983601 - protein, 9 aa, Mycobacterium
AGPGVTNGM

SEQ ID NO: 983602 - protein, 7 aa, Mycobacterium
AGPKDQI

SEQ ID NO: 983603 - protein, 12 aa, Mycobacterium
AGPLAAPDGPLQ

SEQ ID NO: 983604 - protein, 13 aa, Mycobacterium
AGPLSIPGNCGSS

SEQ ID NO: 983605 - protein, 8 aa, Mycobacterium
AGPNAQGP

SEQ ID NO: 983606 - protein, 5 aa, Mycobacterium
AGPNR

SEQ ID NO: 983607 - protein, 14 aa, Mycobacterium
AGPNSAIPHHRPTD

SEQ ID NO: 983608 - protein, 5 aa, Mycobacterium
AGPNV

SEQ ID NO: 983609 - protein, 6 aa, Mycobacterium
AGPPRN

SEQ ID NO: 983610 - protein, 8 aa, Mycobacterium
AGPQARAI

SEQ ID NO: 983611 - protein, 8 aa, Mycobacterium
AGPRLGRD

SEQ ID NO: 983612 - protein, 10 aa, Mycobacterium
AGPSAQQAAS

SEQ ID NO: 983613 - protein, 6 aa, Mycobacterium
AGPSPY

SEQ ID NO: 983614 - protein, 13 aa, Mycobacterium
AGPSSLLKDGAAD

SEQ ID NO: 983615 - protein, 7 aa, Mycobacterium
AGPTEFT

SEQ ID NO: 983616 - protein, 7 aa, Mycobacterium
AGPTEQI

SEQ ID NO: 983617 - protein, 5 aa, Mycobacterium
AGPVF

SEQ ID NO: 983618 - protein, 23 aa, Mycobacterium
AGPYDQDIKPDDFDHPMVDSLHS

SEQ ID NO: 983619 - protein, 6 aa, Mycobacterium
AGPYEA

SEQ ID NO: 983620 - protein, 15 aa, Mycobacterium
AGQANPAPPVGPALG

SEQ ID NO: 983621 - protein, 15 aa, Mycobacterium
AGQGEAGLRGAPSGD

SEQ ID NO: 983622 - protein, 7 aa, Mycobacterium
AGQGVKA

SEQ ID NO: 983623 - protein, 7 aa, Mycobacterium
AGQKSGV

SEQ ID NO: 983624 - protein, 7 aa, Mycobacterium
AGQPLSS

SEQ ID NO: 983625 - protein, 7 aa, Mycobacterium
AGQPNSR

SEQ ID NO: 983626 - protein, 8 aa, Mycobacterium
AGQQHGPA

SEQ ID NO: 983627 - protein, 11 aa, Mycobacterium
AGQSTSVASGR

SEQ ID NO: 983628 - protein, 6 aa, Mycobacterium
AGQVTP

SEQ ID NO: 983629 - protein, 4 aa, Mycobacterium
AGRA

SEQ ID NO: 983630 - protein, 10 aa, Mycobacterium
AGRADPDDTS

SEQ ID NO: 983631 - protein, 7 aa, Mycobacterium
AGRAGQL

SEQ ID NO: 983632 - protein, 9 aa, Mycobacterium
AGRANRARL

SEQ ID NO: 983633 - protein, 7 aa, Mycobacterium
AGRARPR

SEQ ID NO: 983634 - protein, 6 aa, Mycobacterium
AGRDGL

SEQ ID NO: 983635 - protein, 8 aa, Mycobacterium
AGRGNDTG

SEQ ID NO: 983636 - protein, 12 aa, Mycobacterium
AGRLEGKSSLGR

SEQ ID NO: 983637 - protein, 10 aa, Mycobacterium
AGRLERLGSD

SEQ ID NO: 983638 - protein, 13 aa, Mycobacterium
AGRLNPERITEST

SEQ ID NO: 983639 - protein, 5 aa, Mycobacterium
AGRLS

SEQ ID NO: 983640 - protein, 4 aa, Mycobacterium
AGRP

SEQ ID NO: 983641 - protein, 16 aa, Mycobacterium
AGRPAGVRRLGGRDGQ

SEQ ID NO: 983642 - protein, 19 aa, Mycobacterium
AGRPRWGKRHYQNSGTLLE

SEQ ID NO: 983643 - protein, 4 aa, Mycobacterium
AGRQ

SEQ ID NO: 983644 - protein, 4 aa, Mycobacterium
AGRR

SEQ ID NO: 983645 - protein, 12 aa, Mycobacterium
AGRRRVEVAGTT

SEQ ID NO: 983646 - protein, 15 aa, Mycobacterium
AGRRTQPHERPNPSL

SEQ ID NO: 983647 - protein, 6 aa, Mycobacterium
AGRSIS

SEQ ID NO: 983648 - protein, 8 aa, Mycobacterium
AGRSTGRD

SEQ ID NO: 983649 - protein, 12 aa, Mycobacterium
AGRTAITQSLRT

SEQ ID NO: 983650 - protein, 11 aa, Mycobacterium
AGRYAARDCPG

SEQ ID NO: 983651 - protein, 9 aa, Mycobacterium
AGSAPPMGP

SEQ ID NO: 983652 - protein, 9 aa, Mycobacterium
AGSATHDAI

SEQ ID NO: 983653 - protein, 9 aa, Mycobacterium
AGSDATELT

SEQ ID NO: 983654 - protein, 6 aa, Mycobacterium
AGSELR

SEQ ID NO: 983655 - protein, 9 aa, Mycobacterium
AGSEPAQKR

SEQ ID NO: 983656 - protein, 10 aa, Mycobacterium
AGSEYGSAKT

SEQ ID NO: 983657 - protein, 6 aa, Mycobacterium
AGSGAM

SEQ ID NO: 983658 - protein, 8 aa, Mycobacterium
AGSGAMGS

SEQ ID NO: 983659 - protein, 10 aa, Mycobacterium
AGSGGNGCAS

SEQ ID NO: 983660 - protein, 8 aa, Mycobacterium
AGSGKTTV

SEQ ID NO: 983661 - protein, 17 aa, Mycobacterium
AGSGNISLPAAKTGATI

SEQ ID NO: 983662 - protein, 12 aa, Mycobacterium
AGSGTETLLSRH

SEQ ID NO: 983663 - protein, 6 aa, Mycobacterium
AGSGVA

SEQ ID NO: 983664 - protein, 36 aa, Mycobacterium
AGSKANETTEETGDVDSTDTTDWSTAMTDAKNAGVT

SEQ ID NO: 983665 - protein, 4 aa, Mycobacterium
AGSL

SEQ ID NO: 983666 - protein, 5 aa, Mycobacterium
AGSLD

SEQ ID NO: 983667 - protein, 26 aa, Mycobacterium
AGSNDCHSVTPRGENVTSRRFPQLPS

SEQ ID NO: 983668 - protein, 11 aa, Mycobacterium
AGSNIGGITET

SEQ ID NO: 983669 - protein, 8 aa, Mycobacterium
AGSPDTSA

SEQ ID NO: 983670 - protein, 8 aa, Mycobacterium
AGSPQRRQ

SEQ ID NO: 983671 - protein, 10 aa, Mycobacterium
AGSRAHSARS

SEQ ID NO: 983672 - protein, 7 aa, Mycobacterium
AGSRPAT

SEQ ID NO: 983673 - protein, 15 aa, Mycobacterium
AGSSPRVAQPAGDYP

SEQ ID NO: 983674 - protein, 6 aa, Mycobacterium
AGSSPT

SEQ ID NO: 983675 - protein, 19 aa, Mycobacterium
AGSSQNTLSIDSGNDDDDV

SEQ ID NO: 983676 - protein, 6 aa, Mycobacterium
AGSSSV

SEQ ID NO: 983677 - protein, 9 aa, Mycobacterium
AGSSTYPGA

SEQ ID NO: 983678 - protein, 7 aa, Mycobacterium
AGSTMPT

SEQ ID NO: 983679 - protein, 11 aa, Mycobacterium
AGSTPRHAGRL

SEQ ID NO: 983680 - protein, 18 aa, Mycobacterium
AGSTVGQATLHNPSEVKR

SEQ ID NO: 983681 - protein, 8 aa, Mycobacterium
AGSVGRNV

SEQ ID NO: 983682 - protein, 8 aa, Mycobacterium
AGTAAARR

SEQ ID NO: 983683 - protein, 9 aa, Mycobacterium
AGTAGPGIG

SEQ ID NO: 983684 - protein, 9 aa, Mycobacterium
AGTAGYSEK

SEQ ID NO: 983685 - protein, 14 aa, Mycobacterium
AGTAITQGTVLAEI

SEQ ID NO: 983686 - protein, 14 aa, Mycobacterium
AGTARQASSGPATG

SEQ ID NO: 983687 - protein, 19 aa, Mycobacterium
AGTASANRIGSLLADIIAR

SEQ ID NO: 983688 - protein, 6 aa, Mycobacterium
AGTASP

SEQ ID NO: 983689 - protein, 10 aa, Mycobacterium
AGTDEQHPDM

SEQ ID NO: 983690 - protein, 5 aa, Mycobacterium
AGTDH

SEQ ID NO: 983691 - protein, 6 aa, Mycobacterium
AGTEVK

SEQ ID NO: 983692 - protein, 7 aa, Mycobacterium
AGTGGVG

SEQ ID NO: 983693 - protein, 6 aa, Mycobacterium
AGTGIN

SEQ ID NO: 983694 - protein, 7 aa, Mycobacterium
AGTGSLA

SEQ ID NO: 983695 - protein, 5 aa, Mycobacterium
AGTLG

SEQ ID NO: 983696 - protein, 6 aa, Mycobacterium
AGTLGN

SEQ ID NO: 983697 - protein, 10 aa, Mycobacterium
AGTNGKTSVT

SEQ ID NO: 983698 - protein, 10 aa, Mycobacterium
AGTPEARHDE

SEQ ID NO: 983699 - protein, 8 aa, Mycobacterium
AGTPGKRM

SEQ ID NO: 983700 - protein, 5 aa, Mycobacterium
AGTPH

SEQ ID NO: 983701 - protein, 11 aa, Mycobacterium
AGTPPGDDRVG

SEQ ID NO: 983702 - protein, 6 aa, Mycobacterium
AGTPTE

SEQ ID NO: 983703 - protein, 6 aa, Mycobacterium
AGTPVV

SEQ ID NO: 983704 - protein, 8 aa, Mycobacterium
AGTQVGSA

SEQ ID NO: 983705 - protein, 6 aa, Mycobacterium
AGTRPD

SEQ ID NO: 983706 - protein, 7 aa, Mycobacterium
AGTSAGA

SEQ ID NO: 983707 - protein, 7 aa, Mycobacterium
AGTSKPK

SEQ ID NO: 983708 - protein, 13 aa, Mycobacterium
AGVAPHTIRGTQT

SEQ ID NO: 983709 - protein, 12 aa, Mycobacterium
AGVDATKVGSRA

SEQ ID NO: 983710 - protein, 21 aa, Mycobacterium
AGVDGEQPPDRKAGHASADQT

SEQ ID NO: 983711 - protein, 4 aa, Mycobacterium
AGVE

SEQ ID NO: 983712 - protein, 9 aa, Mycobacterium
AGVGSSDRA

SEQ ID NO: 983713 - protein, 13 aa, Mycobacterium
AGVHSAGGPEPVE

SEQ ID NO: 983714 - protein, 5 aa, Mycobacterium
AGVPM

SEQ ID NO: 983715 - protein, 7 aa, Mycobacterium
AGVSPVP

SEQ ID NO: 983716 - protein, 28 aa, Mycobacterium
AGVSYAATADAGPGQCTHPAAGIPADRQ

SEQ ID NO: 983717 - protein, 6 aa, Mycobacterium
AGVTAA

SEQ ID NO: 983718 - protein, 8 aa, Mycobacterium
AGVVGGHD

SEQ ID NO: 983719 - protein, 18 aa, Mycobacterium
AGWSKAGIDEALGGTPMP

SEQ ID NO: 983720 - protein, 18 aa, Mycobacterium
AGYASGDVDTRGGSTIEQ

SEQ ID NO: 983721 - protein, 4 aa, Mycobacterium
AGYE

SEQ ID NO: 983722 - protein, 13 aa, Mycobacterium
AGYPLGPANISEH

SEQ ID NO: 983723 - protein, 11 aa, Mycobacterium
AGYRPDPATGA

SEQ ID NO: 983724 - protein, 6 aa, Mycobacterium
AGYTSD

SEQ ID NO: 983725 - protein, 11 aa, Mycobacterium
AHANGRVSNPV

SEQ ID NO: 983726 - protein, 7 aa, Mycobacterium
AHAREVA

SEQ ID NO: 983727 - protein, 8 aa, Mycobacterium
AHDGDADR

SEQ ID NO: 983728 - protein, 7 aa, Mycobacterium
AHEETGI

SEQ ID NO: 983729 - protein, 9 aa, Mycobacterium
AHEGPTAAR

SEQ ID NO: 983730 - protein, 11 aa, Mycobacterium
AHENGGDDTHL

SEQ ID NO: 983731 - protein, 6 aa, Mycobacterium
AHERPE

SEQ ID NO: 983732 - protein, 9 aa, Mycobacterium
AHGMDSATV

SEQ ID NO: 983733 - protein, 7 aa, Mycobacterium
AHGSYVP

SEQ ID NO: 983734 - protein, 16 aa, Mycobacterium
AHGTATPIGDSAEANA

SEQ ID NO: 983735 - protein, 16 aa, Mycobacterium
AHHTAGRQQRRTGQPA

SEQ ID NO: 983736 - protein, 6 aa, Mycobacterium
AHKDEA

SEQ ID NO: 983737 - protein, 15 aa, Mycobacterium
AHPDNEQIEQALSDT

SEQ ID NO: 983738 - protein, 19 aa, Mycobacterium
AHPDSPSQGGSSKNVAGSA

SEQ ID NO: 983739 - protein, 12 aa, Mycobacterium
AHPGGSRTELTR

SEQ ID NO: 983740 - protein, 5 aa, Mycobacterium
AHPGL

SEQ ID NO: 983741 - protein, 5 aa, Mycobacterium
AHPRE

SEQ ID NO: 983742 - protein, 6 aa, Mycobacterium
AHRDRQ

SEQ ID NO: 983743 - protein, 12 aa, Mycobacterium
AHRESGPQTGKG

SEQ ID NO: 983744 - protein, 13 aa, Mycobacterium
AHRSRRASQQSTA

SEQ ID NO: 983745 - protein, 20 aa, Mycobacterium
AHSDTPAPAGSGSSVYEPYD

SEQ ID NO: 983746 - protein, 7 aa, Mycobacterium
AHSNNGE

SEQ ID NO: 983747 - protein, 11 aa, Mycobacterium
AHTAEAESGTV

SEQ ID NO: 983748 - protein, 7 aa, Mycobacterium
AHTALDG

SEQ ID NO: 983749 - protein, 6 aa, Mycobacterium
AHTGTP

SEQ ID NO: 983750 - protein, 5 aa, Mycobacterium
AHTQP

SEQ ID NO: 983751 - protein, 6 aa, Mycobacterium
AHTSDK

SEQ ID NO: 983752 - protein, 7 aa, Mycobacterium
AHTSTAV

SEQ ID NO: 983753 - protein, 7 aa, Mycobacterium
AIAQNAA

SEQ ID NO: 983754 - protein, 17 aa, Mycobacterium
AIDGAEALRNATETRPD

SEQ ID NO: 983755 - protein, 12 aa, Mycobacterium
AIDGTKNLRRTR

SEQ ID NO: 983756 - protein, 8 aa, Mycobacterium
AIDQADKN

SEQ ID NO: 983757 - protein, 6 aa, Mycobacterium
AIEGGA

SEQ ID NO: 983758 - protein, 10 aa, Mycobacterium
AIGEEDPDFA

SEQ ID NO: 983759 - protein, 9 aa, Mycobacterium
AIGGRGRAG

SEQ ID NO: 983760 - protein, 8 aa, Mycobacterium
AIGPAHQA

SEQ ID NO: 983761 - protein, 11 aa, Mycobacterium
AIGTSSAGIEG

SEQ ID NO: 983762 - protein, 5 aa, Mycobacterium
AILPR

SEQ ID NO: 983763 - protein, 4 aa, Mycobacterium
AINN

SEQ ID NO: 983764 - protein, 11 aa, Mycobacterium
AINRNSASLDE

SEQ ID NO: 983765 - protein, 4 aa, Mycobacterium
AIPA

SEQ ID NO: 983766 - protein, 4 aa, Mycobacterium
AIPD

SEQ ID NO: 983767 - protein, 6 aa, Mycobacterium
AIPDSS

SEQ ID NO: 983768 - protein, 8 aa, Mycobacterium
AIPDTQYD

SEQ ID NO: 983769 - protein, 5 aa, Mycobacterium
AIQAE

SEQ ID NO: 983770 - protein, 5 aa, Mycobacterium
AIQGE

SEQ ID NO: 983771 - protein, 5 aa, Mycobacterium
AIRKN

SEQ ID NO: 983772 - protein, 7 aa, Mycobacterium
AIRPSYG

SEQ ID NO: 983773 - protein, 10 aa, Mycobacterium
AISGSARTAE

SEQ ID NO: 983774 - protein, 9 aa, Mycobacterium
AISRVPADR

SEQ ID NO: 983775 - protein, 12 aa, Mycobacterium
AISSAQARIAAR

SEQ ID NO: 983776 - protein, 8 aa, Mycobacterium
AISTPGRA

SEQ ID NO: 983777 - protein, 4 aa, Mycobacterium
AITP

SEQ ID NO: 983778 - protein, 9 aa, Mycobacterium
AITRPETPI

SEQ ID NO: 983779 - protein, 4 aa, Mycobacterium
AITS

SEQ ID NO: 983780 - protein, 9 aa, Mycobacterium
AKAAFAERE

SEQ ID NO: 983781 - protein, 6 aa, Mycobacterium
AKAAGI

SEQ ID NO: 983782 - protein, 7 aa, Mycobacterium
AKAARSD

SEQ ID NO: 983783 - protein, 6 aa, Mycobacterium
AKADLY

SEQ ID NO: 983784 - protein, 7 aa, Mycobacterium
AKAEFDG

SEQ ID NO: 983785 - protein, 7 aa, Mycobacterium
AKAEGKF

SEQ ID NO: 983786 - protein, 5 aa, Mycobacterium
AKAGI

SEQ ID NO: 983787 - protein, 6 aa, Mycobacterium
AKAGRA

SEQ ID NO: 983788 - protein, 10 aa, Mycobacterium
AKARDAFAAT

SEQ ID NO: 983789 - protein, 24 aa, Mycobacterium
AKAREDHAAQAAEDEATEASEVAG

SEQ ID NO: 983790 - protein, 7 aa, Mycobacterium
AKASQLG

SEQ ID NO: 983791 - protein, 7 aa, Mycobacterium
AKAVPSD

SEQ ID NO: 983792 - protein, 15 aa, Mycobacterium
AKDGGVLRRPGHTEA

SEQ ID NO: 983793 - protein, 25 aa, Mycobacterium
AKDKGTGKENTIKIQEGSGLSKEEI

SEQ ID NO: 983794 - protein, 21 aa, Mycobacterium
AKEAADDAKAKLEATGATVSV

SEQ ID NO: 983795 - protein, 15 aa, Mycobacterium
AKEGRRGEVSLLPDG

SEQ ID NO: 983796 - protein, 4 aa, Mycobacterium
AKEL

SEQ ID NO: 983797 - protein, 9 aa, Mycobacterium
AKELDIDPD

SEQ ID NO: 983798 - protein, 7 aa, Mycobacterium
AKEPRMK

SEQ ID NO: 983799 - protein, 4 aa, Mycobacterium
AKEQ

SEQ ID NO: 983800 - protein, 9 aa, Mycobacterium
AKEQRSNKA

SEQ ID NO: 983801 - protein, 10 aa, Mycobacterium
AKEVADETRR

SEQ ID NO: 983802 - protein, 12 aa, Mycobacterium
AKEVETKEQIAA

SEQ ID NO: 983803 - protein, 12 aa, Mycobacterium
AKFTPAREALDN

SEQ ID NO: 983804 - protein, 8 aa, Mycobacterium
AKGAGISR

SEQ ID NO: 983805 - protein, 18 aa, Mycobacterium
AKGAGKSTALQVIAGLFA

SEQ ID NO: 983806 - protein, 5 aa, Mycobacterium
AKGAS

SEQ ID NO: 983807 - protein, 9 aa, Mycobacterium
AKGGVGKTT

SEQ ID NO: 983808 - protein, 7 aa, Mycobacterium
AKGIDSE

SEQ ID NO: 983809 - protein, 6 aa, Mycobacterium
AKGKAA

SEQ ID NO: 983810 - protein, 14 aa, Mycobacterium
AKGMGSGGAKGCPK

SEQ ID NO: 983811 - protein, 5 aa, Mycobacterium
AKGNT

SEQ ID NO: 983812 - protein, 10 aa, Mycobacterium
AKGPGLNSLG

SEQ ID NO: 983813 - protein, 10 aa, Mycobacterium
AKGSRPMPSA

SEQ ID NO: 983814 - protein, 16 aa, Mycobacterium
AKGYPRAQERDDALST

SEQ ID NO: 983815 - protein, 10 aa, Mycobacterium
AKHGQSPCNG

SEQ ID NO: 983816 - protein, 8 aa, Mycobacterium
AKHGTMQR

SEQ ID NO: 983817 - protein, 7 aa, Mycobacterium
AKHNATV

SEQ ID NO: 983818 - protein, 7 aa, Mycobacterium
AKHTGEN

SEQ ID NO: 983819 - protein, 12 aa, Mycobacterium
AKKRAEATGASV

SEQ ID NO: 983820 - protein, 18 aa, Mycobacterium
AKKTRESLQATAQLTQTH

SEQ ID NO: 983821 - protein, 18 aa, Mycobacterium
AKLAGAQVGTLDTSFFIL

SEQ ID NO: 983822 - protein, 7 aa, Mycobacterium
AKLTNTA

SEQ ID NO: 983823 - protein, 9 aa, Mycobacterium
AKLTTPTDH

SEQ ID NO: 983824 - protein, 10 aa, Mycobacterium
AKMNSAGSTV

SEQ ID NO: 983825 - protein, 9 aa, Mycobacterium
AKNHEPRKA

SEQ ID NO: 983826 - protein, 21 aa, Mycobacterium
AKNRGAHQTAEPTRAGEDAGA

SEQ ID NO: 983827 - protein, 9 aa, Mycobacterium
AKNRGATPD

SEQ ID NO: 983828 - protein, 15 aa, Mycobacterium
AKPAAQQPSWPTDQA

SEQ ID NO: 983829 - protein, 18 aa, Mycobacterium
AKPAGEADPYRDKGSVAG

SEQ ID NO: 983830 - protein, 11 aa, Mycobacterium
AKPGRLVGPDP

SEQ ID NO: 983831 - protein, 6 aa, Mycobacterium
AKPGTR

SEQ ID NO: 983832 - protein, 7 aa, Mycobacterium
AKPKIAD

SEQ ID NO: 983833 - protein, 6 aa, Mycobacterium
AKPTEP

SEQ ID NO: 983834 - protein, 10 aa, Mycobacterium
AKPTPADAAD

SEQ ID NO: 983835 - protein, 8 aa, Mycobacterium
AKPVGADT

SEQ ID NO: 983836 - protein, 10 aa, Mycobacterium
AKQRNSSQTT

SEQ ID NO: 983837 - protein, 4 aa, Mycobacterium
AKQV

SEQ ID NO: 983838 - protein, 9 aa, Mycobacterium
AKRGDIGST

SEQ ID NO: 983839 - protein, 18 aa, Mycobacterium
AKRLGARTTGYDVRPEVA

SEQ ID NO: 983840 - protein, 9 aa, Mycobacterium
AKRLGSDKA

SEQ ID NO: 983841 - protein, 8 aa, Mycobacterium
AKRSAAQQ

SEQ ID NO: 983842 - protein, 10 aa, Mycobacterium
AKRWPGEPRS

SEQ ID NO: 983843 - protein, 9 aa, Mycobacterium
AKSEQPEWA

SEQ ID NO: 983844 - protein, 11 aa, Mycobacterium
AKSGAEQGDPL

SEQ ID NO: 983845 - protein, 17 aa, Mycobacterium
AKSGEPSWPTPWGRGRP

SEQ ID NO: 983846 - protein, 8 aa, Mycobacterium
AKSGTAKL

SEQ ID NO: 983847 - protein, 7 aa, Mycobacterium
AKSRNGA

SEQ ID NO: 983848 - protein, 7 aa, Mycobacterium
AKTDGIR

SEQ ID NO: 983849 - protein, 5 aa, Mycobacterium
AKTDP

SEQ ID NO: 983850 - protein, 6 aa, Mycobacterium
AKTGQH

SEQ ID NO: 983851 - protein, 17 aa, Mycobacterium
AKTLGGAVQAAAGPDQP

SEQ ID NO: 983852 - protein, 6 aa, Mycobacterium
AKTLNT

SEQ ID NO: 983853 - protein, 7 aa, Mycobacterium
AKTLPRQ

SEQ ID NO: 983854 - protein, 8 aa, Mycobacterium
AKTPEGYY

SEQ ID NO: 983855 - protein, 18 aa, Mycobacterium
AKTPQEDRQTNLSRFWST

SEQ ID NO: 983856 - protein, 7 aa, Mycobacterium
AKTPYHY

SEQ ID NO: 983857 - protein, 6 aa, Mycobacterium
AKTRPY

SEQ ID NO: 983858 - protein, 6 aa, Mycobacterium
AKTRRR

SEQ ID NO: 983859 - protein, 4 aa, Mycobacterium
AKTS

SEQ ID NO: 983860 - protein, 7 aa, Mycobacterium
AKTTFSS

SEQ ID NO: 983861 - protein, 4 aa, Mycobacterium
AKVG

SEQ ID NO: 983862 - protein, 8 aa, Mycobacterium
AKVPGSGS

SEQ ID NO: 983863 - protein, 14 aa, Mycobacterium
AKVSKQPRSFDVNQ

SEQ ID NO: 983864 - protein, 14 aa, Mycobacterium
AKYGMADSYDEQGN

SEQ ID NO: 983865 - protein, 22 aa, Mycobacterium
AKYGTSSYARLDSPVDRDQKAR

SEQ ID NO: 983866 - protein, 10 aa, Mycobacterium
ALADDYDAPF

SEQ ID NO: 983867 - protein, 8 aa, Mycobacterium
ALAEAPEA

SEQ ID NO: 983868 - protein, 4 aa, Mycobacterium
ALAG

SEQ ID NO: 983869 - protein, 8 aa, Mycobacterium
ALAKTKPG

SEQ ID NO: 983870 - protein, 20 aa, Mycobacterium
ALAPTRAAQDRFNDELEGNL

SEQ ID NO: 983871 - protein, 16 aa, Mycobacterium
ALAQSPVRRGRHKNIP

SEQ ID NO: 983872 - protein, 8 aa, Mycobacterium
ALASPQVA

SEQ ID NO: 983873 - protein, 10 aa, Mycobacterium
ALATERQQRS

SEQ ID NO: 983874 - protein, 8 aa, Mycobacterium
ALDGSDAP

SEQ ID NO: 983875 - protein, 7 aa, Mycobacterium
ALDPSGE

SEQ ID NO: 983876 - protein, 20 aa, Mycobacterium
ALDTEQEQLATDPTAPPPDQ

SEQ ID NO: 983877 - protein, 20 aa, Mycobacterium
ALEASSDQPSPTAPSQSPQV

SEQ ID NO: 983878 - protein, 7 aa, Mycobacterium
ALEATGN

SEQ ID NO: 983879 - protein, 6 aa, Mycobacterium
ALEGDA

SEQ ID NO: 983880 - protein, 19 aa, Mycobacterium
ALEPGRRFRQPRRSEPDTL

SEQ ID NO: 983881 - protein, 7 aa, Mycobacterium
ALESGEP

SEQ ID NO: 983882 - protein, 6 aa, Mycobacterium
ALGRPH

SEQ ID NO: 983883 - protein, 13 aa, Mycobacterium
ALGSQGGAVLGSS

SEQ ID NO: 983884 - protein, 5 aa, Mycobacterium
ALGSS

SEQ ID NO: 983885 - protein, 6 aa, Mycobacterium
ALGTKD

SEQ ID NO: 983886 - protein, 8 aa, Mycobacterium
ALHERGQV

SEQ ID NO: 983887 - protein, 13 aa, Mycobacterium
ALKGRGGSSWGNQ

SEQ ID NO: 983888 - protein, 12 aa, Mycobacterium
ALKTGSGQQEVA

SEQ ID NO: 983889 - protein, 9 aa, Mycobacterium
ALNADGGHC

SEQ ID NO: 983890 - protein, 6 aa, Mycobacterium
ALNPAQ

SEQ ID NO: 983891 - protein, 15 aa, Mycobacterium
ALPAGTTKAEGWTPD

SEQ ID NO: 983892 - protein, 15 aa, Mycobacterium
ALPAGVEGLKAGQRV

SEQ ID NO: 983893 - protein, 5 aa, Mycobacterium
ALPDA

SEQ ID NO: 983894 - protein, 19 aa, Mycobacterium
ALPDGASTQNLSLDSQGRV

SEQ ID NO: 983895 - protein, 8 aa, Mycobacterium
ALPDGVTA

SEQ ID NO: 983896 - protein, 5 aa, Mycobacterium
ALPGE

SEQ ID NO: 983897 - protein, 8 aa, Mycobacterium
ALPGRGPE

SEQ ID NO: 983898 - protein, 11 aa, Mycobacterium
ALPKQGSRTPW

SEQ ID NO: 983899 - protein, 4 aa, Mycobacterium
ALPN

SEQ ID NO: 983900 - protein, 8 aa, Mycobacterium
ALPNDPTL

SEQ ID NO: 983901 - protein, 13 aa, Mycobacterium
ALPNDSVSQPSYL

SEQ ID NO: 983902 - protein, 5 aa, Mycobacterium
ALPPY

SEQ ID NO: 983903 - protein, 5 aa, Mycobacterium
ALPQT

SEQ ID NO: 983904 - protein, 16 aa, Mycobacterium
ALPQTSSGVRATGDPD

SEQ ID NO: 983905 - protein, 23 aa, Mycobacterium
ALPSEKEIQRRSEAGIGLTSPEL

SEQ ID NO: 983906 - protein, 7 aa, Mycobacterium
ALPSSPV

SEQ ID NO: 983907 - protein, 6 aa, Mycobacterium
ALPSTQ

SEQ ID NO: 983908 - protein, 10 aa, Mycobacterium
ALQASAKEVA

SEQ ID NO: 983909 - protein, 8 aa, Mycobacterium
ALQKAGYG

SEQ ID NO: 983910 - protein, 5 aa, Mycobacterium
ALQTK

SEQ ID NO: 983911 - protein, 7 aa, Mycobacterium
ALQTQEL

SEQ ID NO: 983912 - protein, 15 aa, Mycobacterium
ALRDQQTASDRAKAT

SEQ ID NO: 983913 - protein, 5 aa, Mycobacterium
ALRGS

SEQ ID NO: 983914 - protein, 11 aa, Mycobacterium
ALRQGADSTTV

SEQ ID NO: 983915 - protein, 16 aa, Mycobacterium
ALRRRTSGNNHTKASG

SEQ ID NO: 983916 - protein, 5 aa, Mycobacterium
ALSAP

SEQ ID NO: 983917 - protein, 9 aa, Mycobacterium
ALSDPAAEA

SEQ ID NO: 983918 - protein, 10 aa, Mycobacterium
ALSDRARNGR

SEQ ID NO: 983919 - protein, 6 aa, Mycobacterium
ALSEDK

SEQ ID NO: 983920 - protein, 9 aa, Mycobacterium
ALSGPLADT

SEQ ID NO: 983921 - protein, 9 aa, Mycobacterium
ALSPPSLPD

SEQ ID NO: 983922 - protein, 6 aa, Mycobacterium
ALSPTT

SEQ ID NO: 983923 - protein, 5 aa, Mycobacterium
ALSRE

SEQ ID NO: 983924 - protein, 10 aa, Mycobacterium
ALSSNPQRAP

SEQ ID NO: 983925 - protein, 17 aa, Mycobacterium
ALSSRGIEATIADFARC

SEQ ID NO: 983926 - protein, 5 aa, Mycobacterium
ALSTV

SEQ ID NO: 983927 - protein, 16 aa, Mycobacterium
ALTDDEVARIDGTYHV

SEQ ID NO: 983928 - protein, 8 aa, Mycobacterium
ALTDSTAT

SEQ ID NO: 983929 - protein, 12 aa, Mycobacterium
ALTKRDSSGRVT

SEQ ID NO: 983930 - protein, 5 aa, Mycobacterium
ALTSA

SEQ ID NO: 983931 - protein, 6 aa, Mycobacterium
ALTSEA

SEQ ID NO: 983932 - protein, 15 aa, Mycobacterium
AMGGAPSASIPAAGA

SEQ ID NO: 983933 - protein, 6 aa, Mycobacterium
AMGTQL

SEQ ID NO: 983934 - protein, 5 aa, Mycobacterium
AMKGT

SEQ ID NO: 983935 - protein, 22 aa, Mycobacterium
AMPDPAVKNRIDDSAESGNTKL

SEQ ID NO: 983936 - protein, 6 aa, Mycobacterium
AMPPAA

SEQ ID NO: 983937 - protein, 9 aa, Mycobacterium
AMPSRYGQA

SEQ ID NO: 983938 - protein, 16 aa, Mycobacterium
AMQGRGGDKSYSKDRY

SEQ ID NO: 983939 - protein, 17 aa, Mycobacterium
AMRERSELARKGIARGR

SEQ ID NO: 983940 - protein, 7 aa, Mycobacterium
AMRQPNV

SEQ ID NO: 983941 - protein, 13 aa, Mycobacterium
AMSAPSSGSSKVH

SEQ ID NO: 983942 - protein, 5 aa, Mycobacterium
AMSGP

SEQ ID NO: 983943 - protein, 20 aa, Mycobacterium
AMSKDTKGSGTAAGSAGAAG

SEQ ID NO: 983944 - protein, 8 aa, Mycobacterium
AMTGHGVG

SEQ ID NO: 983945 - protein, 7 aa, Mycobacterium
AMTQKPP

SEQ ID NO: 983946 - protein, 8 aa, Mycobacterium
ANAEGREA

SEQ ID NO: 983947 - protein, 5 aa, Mycobacterium
ANAGH

SEQ ID NO: 983948 - protein, 7 aa, Mycobacterium
ANAIAGS

SEQ ID NO: 983949 - protein, 10 aa, Mycobacterium
ANAIGETDEY

SEQ ID NO: 983950 - protein, 6 aa, Mycobacterium
ANASPV

SEQ ID NO: 983951 - protein, 37 aa, Mycobacterium
ANATNTSAVKGTLPTSTPIDDPRRKAKQHAHTESVHG

SEQ ID NO: 983952 - protein, 12 aa, Mycobacterium
ANDGEPAFRLLS

SEQ ID NO: 983953 - protein, 10 aa, Mycobacterium
ANDGTAGHKA

SEQ ID NO: 983954 - protein, 5 aa, Mycobacterium
ANDGV

SEQ ID NO: 983955 - protein, 4 aa, Mycobacterium
ANDP

SEQ ID NO: 983956 - protein, 12 aa, Mycobacterium
ANDYVGKGLSGG

SEQ ID NO: 983957 - protein, 6 aa, Mycobacterium
ANEANI

SEQ ID NO: 983958 - protein, 10 aa, Mycobacterium
ANEGEVSRFG

SEQ ID NO: 983959 - protein, 22 aa, Mycobacterium
ANEPGGEKAAAKRDKKNIPSAR

SEQ ID NO: 983960 - protein, 7 aa, Mycobacterium
ANEPRIS

SEQ ID NO: 983961 - protein, 7 aa, Mycobacterium
ANGDEVQ

SEQ ID NO: 983962 - protein, 5 aa, Mycobacterium
ANGDR

SEQ ID NO: 983963 - protein, 7 aa, Mycobacterium
ANGERAK

SEQ ID NO: 983964 - protein, 7 aa, Mycobacterium
ANGETSL

SEQ ID NO: 983965 - protein, 9 aa, Mycobacterium
ANGHAGPRR

SEQ ID NO: 983966 - protein, 7 aa, Mycobacterium
ANGISAR

SEQ ID NO: 983967 - protein, 7 aa, Mycobacterium
ANGSNEI

SEQ ID NO: 983968 - protein, 7 aa, Mycobacterium
ANGVPES

SEQ ID NO: 983969 - protein, 11 aa, Mycobacterium
ANGVPVHPNDD

SEQ ID NO: 983970 - protein, 16 aa, Mycobacterium
ANKDPGTVAAAHPSAS

SEQ ID NO: 983971 - protein, 7 aa, Mycobacterium
ANKDTGF

SEQ ID NO: 983972 - protein, 8 aa, Mycobacterium
ANLEQRRD

SEQ ID NO: 983973 - protein, 6 aa, Mycobacterium
ANLETR

SEQ ID NO: 983974 - protein, 13 aa, Mycobacterium
ANLTRNSADFGGS

SEQ ID NO: 983975 - protein, 20 aa, Mycobacterium
ANNGAQSGCGGIQSETRLDQ

SEQ ID NO: 983976 - protein, 9 aa, Mycobacterium
ANNGDSHLN

SEQ ID NO: 983977 - protein, 16 aa, Mycobacterium
ANNNQGNEDPATGGRY

SEQ ID NO: 983978 - protein, 9 aa, Mycobacterium
ANNQERSTR

SEQ ID NO: 983979 - protein, 16 aa, Mycobacterium
ANNYEQQEQASQQVLR

SEQ ID NO: 983980 - protein, 8 aa, Mycobacterium
ANPAAQDL

SEQ ID NO: 983981 - protein, 9 aa, Mycobacterium
ANPDDRATV

SEQ ID NO: 983982 - protein, 27 aa, Mycobacterium
ANPEAHEQPWDKKSYEMPGGTPTSPGL

SEQ ID NO: 983983 - protein, 8 aa, Mycobacterium
ANPEVQEE

SEQ ID NO: 983984 - protein, 8 aa, Mycobacterium
ANPGTITG

SEQ ID NO: 983985 - protein, 6 aa, Mycobacterium
ANPSSL

SEQ ID NO: 983986 - protein, 11 aa, Mycobacterium
ANPSTGIEAGL

SEQ ID NO: 983987 - protein, 5 aa, Mycobacterium
ANPVA

SEQ ID NO: 983988 - protein, 5 aa, Mycobacterium
ANQGE

SEQ ID NO: 983989 - protein, 6 aa, Mycobacterium
ANQHGD

SEQ ID NO: 983990 - protein, 7 aa, Mycobacterium
ANQPEDD

SEQ ID NO: 983991 - protein, 5 aa, Mycobacterium
ANQTY

SEQ ID NO: 983992 - protein, 6 aa, Mycobacterium
ANRAPA

SEQ ID NO: 983993 - protein, 4 aa, Mycobacterium
ANRE

SEQ ID NO: 983994 - protein, 11 aa, Mycobacterium
ANRERQAQITQ

SEQ ID NO: 983995 - protein, 8 aa, Mycobacterium
ANRGGQRT

SEQ ID NO: 983996 - protein, 8 aa, Mycobacterium
ANRKLDDL

SEQ ID NO: 983997 - protein, 13 aa, Mycobacterium
ANRMSKPDESVNA

SEQ ID NO: 983998 - protein, 6 aa, Mycobacterium
ANRNGP

SEQ ID NO: 983999 - protein, 6 aa, Mycobacterium
ANRPRR

SEQ ID NO: 984000 - protein, 12 aa, Mycobacterium
ANRSTDQGNNAM

SEQ ID NO: 984001 - protein, 5 aa, Mycobacterium
ANRTA

SEQ ID NO: 984002 - protein, 5 aa, Mycobacterium
ANRTD

SEQ ID NO: 984003 - protein, 10 aa, Mycobacterium
ANRTSPVASS

SEQ ID NO: 984004 - protein, 7 aa, Mycobacterium
ANSAYHD

SEQ ID NO: 984005 - protein, 10 aa, Mycobacterium
ANSELPDGSV

SEQ ID NO: 984006 - protein, 8 aa, Mycobacterium
ANSGAVGR

SEQ ID NO: 984007 - protein, 9 aa, Mycobacterium
ANSGEPGRR

SEQ ID NO: 984008 - protein, 8 aa, Mycobacterium
ANSGMEAQ

SEQ ID NO: 984009 - protein, 26 aa, Mycobacterium
ANSHGQKVQAAGNNMAQTDSAVGSSW

SEQ ID NO: 984010 - protein, 4 aa, Mycobacterium
ANSL

SEQ ID NO: 984011 - protein, 14 aa, Mycobacterium
ANSLRRAAAAEREV

SEQ ID NO: 984012 - protein, 8 aa, Mycobacterium
ANSPIDEA

SEQ ID NO: 984013 - protein, 5 aa, Mycobacterium
ANSRL

SEQ ID NO: 984014 - protein, 6 aa, Mycobacterium
ANSRNP

SEQ ID NO: 984015 - protein, 7 aa, Mycobacterium
ANSRVRI

SEQ ID NO: 984016 - protein, 6 aa, Mycobacterium
ANSSAA

SEQ ID NO: 984017 - protein, 10 aa, Mycobacterium
ANSVQTTRGI

SEQ ID NO: 984018 - protein, 5 aa, Mycobacterium
ANTEV

SEQ ID NO: 984019 - protein, 12 aa, Mycobacterium
ANTGNDVLWRPG

SEQ ID NO: 984020 - protein, 7 aa, Mycobacterium
ANTLSSY

SEQ ID NO: 984021 - protein, 5 aa, Mycobacterium
ANTNG

SEQ ID NO: 984022 - protein, 8 aa, Mycobacterium
ANTRPQDD

SEQ ID NO: 984023 - protein, 7 aa, Mycobacterium
ANTSRGL

SEQ ID NO: 984024 - protein, 6 aa, Mycobacterium
ANVTQD

SEQ ID NO: 984025 - protein, 11 aa, Mycobacterium
ANYAGRPSPLY

SEQ ID NO: 984026 - protein, 7 aa, Mycobacterium
ANYDESK

SEQ ID NO: 984027 - protein, 12 aa, Mycobacterium
APAADLHSRITA

SEQ ID NO: 984028 - protein, 18 aa, Mycobacterium
APAATGRYRFHAGAAPVT

SEQ ID NO: 984029 - protein, 8 aa, Mycobacterium
APAAVGAA

SEQ ID NO: 984030 - protein, 4 aa, Mycobacterium
APAD

SEQ ID NO: 984031 - protein, 13 aa, Mycobacterium
APADSDIPDAGRT

SEQ ID NO: 984032 - protein, 10 aa, Mycobacterium
APAGPGSSVT

SEQ ID NO: 984033 - protein, 6 aa, Mycobacterium
APAGYT

SEQ ID NO: 984034 - protein, 26 aa, Mycobacterium
APAKSIRQLASDDEVPEPWPVLSVKP

SEQ ID NO: 984035 - protein, 9 aa, Mycobacterium
APALSDKDI

SEQ ID NO: 984036 - protein, 36 aa, Mycobacterium
APAPLAPPPPAEPAPPQPPADNFPPTPGDVPSPLAR

SEQ ID NO: 984037 - protein, 12 aa, Mycobacterium
APAQLDSGQDAL

SEQ ID NO: 984038 - protein, 5 aa, Mycobacterium
APAQS

SEQ ID NO: 984039 - protein, 6 aa, Mycobacterium
APARAA

SEQ ID NO: 984040 - protein, 21 aa, Mycobacterium
APARSQRTQTARMLIKNHRPV

SEQ ID NO: 984041 - protein, 9 aa, Mycobacterium
APASADRSR

SEQ ID NO: 984042 - protein, 4 aa, Mycobacterium
APAT

SEQ ID NO: 984043 - protein, 4 aa, Mycobacterium
APAY

SEQ ID NO: 984044 - protein, 4 aa, Mycobacterium
APDA

SEQ ID NO: 984045 - protein, 13 aa, Mycobacterium
APDAAAREHDPSR

SEQ ID NO: 984046 - protein, 6 aa, Mycobacterium
APDAED

SEQ ID NO: 984047 - protein, 5 aa, Mycobacterium
APDDL

SEQ ID NO: 984048 - protein, 8 aa, Mycobacterium
APDESPRS

SEQ ID NO: 984049 - protein, 6 aa, Mycobacterium
APDGRI

SEQ ID NO: 984050 - protein, 10 aa, Mycobacterium
APDHQNTKKV

SEQ ID NO: 984051 - protein, 6 aa, Mycobacterium
APDIGA

SEQ ID NO: 984052 - protein, 9 aa, Mycobacterium
APDNATPAV

SEQ ID NO: 984053 - protein, 7 aa, Mycobacterium
APDPQLG

SEQ ID NO: 984054 - protein, 9 aa, Mycobacterium
APDPQSAGR

SEQ ID NO: 984055 - protein, 20 aa, Mycobacterium
APDPSAVAGQQTDADGAASA

SEQ ID NO: 984056 - protein, 13 aa, Mycobacterium
APDPVAVPAPGPA

SEQ ID NO: 984057 - protein, 6 aa, Mycobacterium
APDTPP

SEQ ID NO: 984058 - protein, 6 aa, Mycobacterium
APDVPG

SEQ ID NO: 984059 - protein, 6 aa, Mycobacterium
APEAMT

SEQ ID NO: 984060 - protein, 8 aa, Mycobacterium
APENEGFS

SEQ ID NO: 984061 - protein, 8 aa, Mycobacterium
APEPELSR

SEQ ID NO: 984062 - protein, 10 aa, Mycobacterium
APEPGTAPKA

SEQ ID NO: 984063 - protein, 5 aa, Mycobacterium
APERI

SEQ ID NO: 984064 - protein, 7 aa, Mycobacterium
APEVAQD

SEQ ID NO: 984065 - protein, 11 aa, Mycobacterium
APFAGGGDRAA

SEQ ID NO: 984066 - protein, 4 aa, Mycobacterium
APFG

SEQ ID NO: 984067 - protein, 6 aa, Mycobacterium
APFSGA

SEQ ID NO: 984068 - protein, 8 aa, Mycobacterium
APGARTNA

SEQ ID NO: 984069 - protein, 13 aa, Mycobacterium
APGAVAPAPWGRK

SEQ ID NO: 984070 - protein, 11 aa, Mycobacterium
APGDPKTLNSN

SEQ ID NO: 984071 - protein, 6 aa, Mycobacterium
APGGDA

SEQ ID NO: 984072 - protein, 6 aa, Mycobacterium
APGHAD

SEQ ID NO: 984073 - protein, 4 aa, Mycobacterium
APGI

SEQ ID NO: 984074 - protein, 5 aa, Mycobacterium
APGIA

SEQ ID NO: 984075 - protein, 12 aa, Mycobacterium
APGIGTTSAGTL

SEQ ID NO: 984076 - protein, 8 aa, Mycobacterium
APGLAEKG

SEQ ID NO: 984077 - protein, 4 aa, Mycobacterium
APGN

SEQ ID NO: 984078 - protein, 11 aa, Mycobacterium
APGNAGTARLA

SEQ ID NO: 984079 - protein, 6 aa, Mycobacterium
APGQGE

SEQ ID NO: 984080 - protein, 13 aa, Mycobacterium
APGSKSIDLFGTP

SEQ ID NO: 984081 - protein, 6 aa, Mycobacterium
APGSPL

SEQ ID NO: 984082 - protein, 11 aa, Mycobacterium
APGSRTASISY

SEQ ID NO: 984083 - protein, 4 aa, Mycobacterium
APGY

SEQ ID NO: 984084 - protein, 12 aa, Mycobacterium
APHARSAQGSAP

SEQ ID NO: 984085 - protein, 4 aa, Mycobacterium
APIS

SEQ ID NO: 984086 - protein, 15 aa, Mycobacterium
APITPKGELAGETRR

SEQ ID NO: 984087 - protein, 11 aa, Mycobacterium
APLDEASRNQL

SEQ ID NO: 984088 - protein, 5 aa, Mycobacterium
APLDG

SEQ ID NO: 984089 - protein, 7 aa, Mycobacterium
APLDGTA

SEQ ID NO: 984090 - protein, 4 aa, Mycobacterium
APLE

SEQ ID NO: 984091 - protein, 16 aa, Mycobacterium
APLKPPDVKLSCLCLW

SEQ ID NO: 984092 - protein, 17 aa, Mycobacterium
APLSDDTLSPLSLPGVF

SEQ ID NO: 984093 - protein, 4 aa, Mycobacterium
APLT

SEQ ID NO: 984094 - protein, 10 aa, Mycobacterium
APLTQETAQA

SEQ ID NO: 984095 - protein, 4 aa, Mycobacterium
APLV

SEQ ID NO: 984096 - protein, 15 aa, Mycobacterium
APLVPGTPDPVKNAD

SEQ ID NO: 984097 - protein, 13 aa, Mycobacterium
APMATPTDQCTAQ

SEQ ID NO: 984098 - protein, 7 aa, Mycobacterium
APNAPGH

SEQ ID NO: 984099 - protein, 8 aa, Mycobacterium
APPAAAEV

SEQ ID NO: 984100 - protein, 16 aa, Mycobacterium
APPATVAESPALRRGR

SEQ ID NO: 984101 - protein, 8 aa, Mycobacterium
APPESFNN

SEQ ID NO: 984102 - protein, 12 aa, Mycobacterium
APPGLPSAPPVA

SEQ ID NO: 984103 - protein, 7 aa, Mycobacterium
APPGTRR

SEQ ID NO: 984104 - protein, 16 aa, Mycobacterium
APPGYIGHDQGGQLTE

SEQ ID NO: 984105 - protein, 6 aa, Mycobacterium
APPHGG

SEQ ID NO: 984106 - protein, 11 aa, Mycobacterium
APPKDAQSTHR

SEQ ID NO: 984107 - protein, 14 aa, Mycobacterium
APPLPKPQCLENIV

SEQ ID NO: 984108 - protein, 13 aa, Mycobacterium
APPNLARHGYPGR

SEQ ID NO: 984109 - protein, 6 aa, Mycobacterium
APPNLV

SEQ ID NO: 984110 - protein, 14 aa, Mycobacterium
APPPISHITNNSGS

SEQ ID NO: 984111 - protein, 11 aa, Mycobacterium
APPPQETPPRW

SEQ ID NO: 984112 - protein, 4 aa, Mycobacterium
APPS

SEQ ID NO: 984113 - protein, 16 aa, Mycobacterium
APPSTDHIDDNSSSAD

SEQ ID NO: 984114 - protein, 7 aa, Mycobacterium
APPTGRI

SEQ ID NO: 984115 - protein, 16 aa, Mycobacterium
APQGERQTRNLGTVMC

SEQ ID NO: 984116 - protein, 7 aa, Mycobacterium
APQHPSR

SEQ ID NO: 984117 - protein, 19 aa, Mycobacterium
APQIGNTGWNDQDGESRDD

SEQ ID NO: 984118 - protein, 5 aa, Mycobacterium
APQPL

SEQ ID NO: 984119 - protein, 7 aa, Mycobacterium
APQPPTL

SEQ ID NO: 984120 - protein, 12 aa, Mycobacterium
APQWGEGPATVD

SEQ ID NO: 984121 - protein, 13 aa, Mycobacterium
APQYRSSSQNPVY

SEQ ID NO: 984122 - protein, 8 aa, Mycobacterium
APRDATRL

SEQ ID NO: 984123 - protein, 10 aa, Mycobacterium
APRKRNNPDM

SEQ ID NO: 984124 - protein, 8 aa, Mycobacterium
APSALTIR

SEQ ID NO: 984125 - protein, 14 aa, Mycobacterium
APSAYDKRVIFARA

SEQ ID NO: 984126 - protein, 4 aa, Mycobacterium
APSC

SEQ ID NO: 984127 - protein, 22 aa, Mycobacterium
APSEACAPDVPETSPGTGDATV

SEQ ID NO: 984128 - protein, 7 aa, Mycobacterium
APSEQAQ

SEQ ID NO: 984129 - protein, 4 aa, Mycobacterium
APSG

SEQ ID NO: 984130 - protein, 14 aa, Mycobacterium
APSGELKTKPTQHS

SEQ ID NO: 984131 - protein, 8 aa, Mycobacterium
APSGTEEL

SEQ ID NO: 984132 - protein, 6 aa, Mycobacterium
APSGTR

SEQ ID NO: 984133 - protein, 5 aa, Mycobacterium
APSIT

SEQ ID NO: 984134 - protein, 7 aa, Mycobacterium
APSMAPL

SEQ ID NO: 984135 - protein, 11 aa, Mycobacterium
APSPALGGHRG

SEQ ID NO: 984136 - protein, 14 aa, Mycobacterium
APSTGAVTGEPDVV

SEQ ID NO: 984137 - protein, 8 aa, Mycobacterium
APSYPSMS

SEQ ID NO: 984138 - protein, 33 aa, Mycobacterium
APTDAQTKAKYAGEAHEAPEVGTAENKTAATES

SEQ ID NO: 984139 - protein, 5 aa, Mycobacterium
APTDG

SEQ ID NO: 984140 - protein, 6 aa, Mycobacterium
APTEGA

SEQ ID NO: 984141 - protein, 6 aa, Mycobacterium
APTELP

SEQ ID NO: 984142 - protein, 6 aa, Mycobacterium
APTNHQ

SEQ ID NO: 984143 - protein, 6 aa, Mycobacterium
APTPSE

SEQ ID NO: 984144 - protein, 6 aa, Mycobacterium
APTPTM

SEQ ID NO: 984145 - protein, 16 aa, Mycobacterium
APTPVEASYSTADQQR

SEQ ID NO: 984146 - protein, 6 aa, Mycobacterium
APTQRH

SEQ ID NO: 984147 - protein, 5 aa, Mycobacterium
APTQT

SEQ ID NO: 984148 - protein, 4 aa, Mycobacterium
APTR

SEQ ID NO: 984149 - protein, 6 aa, Mycobacterium
APTRRQ

SEQ ID NO: 984150 - protein, 4 aa, Mycobacterium
APTS

SEQ ID NO: 984151 - protein, 6 aa, Mycobacterium
APTSQM

SEQ ID NO: 984152 - protein, 10 aa, Mycobacterium
APTSTAEPAF

SEQ ID NO: 984153 - protein, 5 aa, Mycobacterium
APTVL

SEQ ID NO: 984154 - protein, 16 aa, Mycobacterium
APTWPDRLPDPVNSSV

SEQ ID NO: 984155 - protein, 12 aa, Mycobacterium
APVEECKDKDMT

SEQ ID NO: 984156 - protein, 19 aa, Mycobacterium
APVPEPGRRHRGCWCRCQR

SEQ ID NO: 984157 - protein, 6 aa, Mycobacterium
APVTTN

SEQ ID NO: 984158 - protein, 10 aa, Mycobacterium
APWSAGRTAE

SEQ ID NO: 984159 - protein, 9 aa, Mycobacterium
APYGTSETL

SEQ ID NO: 984160 - protein, 13 aa, Mycobacterium
APYRPGLGDFGFF

SEQ ID NO: 984161 - protein, 4 aa, Mycobacterium
APYV

SEQ ID NO: 984162 - protein, 11 aa, Mycobacterium
AQAAKNGANVD

SEQ ID NO: 984163 - protein, 13 aa, Mycobacterium
AQAATASTARCTT

SEQ ID NO: 984164 - protein, 7 aa, Mycobacterium
AQADDGT

SEQ ID NO: 984165 - protein, 8 aa, Mycobacterium
AQAEAEGL

SEQ ID NO: 984166 - protein, 7 aa, Mycobacterium
AQAERAA

SEQ ID NO: 984167 - protein, 29 aa, Mycobacterium
AQAGITDAEGTPVGGAADAEFHSASCAHA

SEQ ID NO: 984168 - protein, 8 aa, Mycobacterium
AQAPTESI

SEQ ID NO: 984169 - protein, 7 aa, Mycobacterium
AQAQQDI

SEQ ID NO: 984170 - protein, 8 aa, Mycobacterium
AQAQRTAV

SEQ ID NO: 984171 - protein, 20 aa, Mycobacterium
AQARGYDVDKPRNLAKSVTV

SEQ ID NO: 984172 - protein, 8 aa, Mycobacterium
AQASGAFT

SEQ ID NO: 984173 - protein, 10 aa, Mycobacterium
AQASTPAEAV

SEQ ID NO: 984174 - protein, 5 aa, Mycobacterium
AQATR

SEQ ID NO: 984175 - protein, 5 aa, Mycobacterium
AQAVG

SEQ ID NO: 984176 - protein, 5 aa, Mycobacterium
AQAVQ

SEQ ID NO: 984177 - protein, 4 aa, Mycobacterium
AQDA

SEQ ID NO: 984178 - protein, 7 aa, Mycobacterium
AQDPFNN

SEQ ID NO: 984179 - protein, 6 aa, Mycobacterium
AQDPHE

SEQ ID NO: 984180 - protein, 5 aa, Mycobacterium
AQDRQ

SEQ ID NO: 984181 - protein, 6 aa, Mycobacterium
AQEAGA

SEQ ID NO: 984182 - protein, 7 aa, Mycobacterium
AQENRSL

SEQ ID NO: 984183 - protein, 6 aa, Mycobacterium
AQETRR

SEQ ID NO: 984184 - protein, 9 aa, Mycobacterium
AQFNSDNPI

SEQ ID NO: 984185 - protein, 9 aa, Mycobacterium
AQGAPPSAI

SEQ ID NO: 984186 - protein, 6 aa, Mycobacterium
AQGGGT

SEQ ID NO: 984187 - protein, 5 aa, Mycobacterium
AQGLP

SEQ ID NO: 984188 - protein, 12 aa, Mycobacterium
AQGNPQPPSAIL

SEQ ID NO: 984189 - protein, 11 aa, Mycobacterium
AQGYSDSQGIL

SEQ ID NO: 984190 - protein, 18 aa, Mycobacterium
AQHAQSDAVTFRAIGYFP

SEQ ID NO: 984191 - protein, 7 aa, Mycobacterium
AQHPGSA

SEQ ID NO: 984192 - protein, 6 aa, Mycobacterium
AQHRGA

SEQ ID NO: 984193 - protein, 7 aa, Mycobacterium
AQIGSGR

SEQ ID NO: 984194 - protein, 7 aa, Mycobacterium
AQIQPYD

SEQ ID NO: 984195 - protein, 15 aa, Mycobacterium
AQKARESRRNQQQTV

SEQ ID NO: 984196 - protein, 9 aa, Mycobacterium
AQLAGSGIA

SEQ ID NO: 984197 - protein, 5 aa, Mycobacterium
AQLDG

SEQ ID NO: 984198 - protein, 6 aa, Mycobacterium
AQLGAG

SEQ ID NO: 984199 - protein, 10 aa, Mycobacterium
AQLGRSDHGV

SEQ ID NO: 984200 - protein, 7 aa, Mycobacterium
AQLSDLA

SEQ ID NO: 984201 - protein, 18 aa, Mycobacterium
AQNDPRSTYRLGPDDYET

SEQ ID NO: 984202 - protein, 9 aa, Mycobacterium
AQNTGSAPV

SEQ ID NO: 984203 - protein, 10 aa, Mycobacterium
AQNTSTAGIG

SEQ ID NO: 984204 - protein, 8 aa, Mycobacterium
AQPARQDL

SEQ ID NO: 984205 - protein, 28 aa, Mycobacterium
AQPDRTATSVEDTYRASRNQLPHGFLDM

SEQ ID NO: 984206 - protein, 6 aa, Mycobacterium
AQPGCT

SEQ ID NO: 984207 - protein, 17 aa, Mycobacterium
AQPGSNYLDRDFAGPRR

SEQ ID NO: 984208 - protein, 7 aa, Mycobacterium
AQPGTEV

SEQ ID NO: 984209 - protein, 5 aa, Mycobacterium
AQPNV

SEQ ID NO: 984210 - protein, 6 aa, Mycobacterium
AQPPEV

SEQ ID NO: 984211 - protein, 8 aa, Mycobacterium
AQPPGNAA

SEQ ID NO: 984212 - protein, 18 aa, Mycobacterium
AQPSKPTDVSSGPRRKTQ

SEQ ID NO: 984213 - protein, 16 aa, Mycobacterium
AQPVPEGNTVKDDDEL

SEQ ID NO: 984214 - protein, 4 aa, Mycobacterium
AQQA

SEQ ID NO: 984215 - protein, 6 aa, Mycobacterium
AQQGHL

SEQ ID NO: 984216 - protein, 11 aa, Mycobacterium
AQQLNAGESVT

SEQ ID NO: 984217 - protein, 4 aa, Mycobacterium
AQQM

SEQ ID NO: 984218 - protein, 20 aa, Mycobacterium
AQQRASVSDEDLASAAEAGL

SEQ ID NO: 984219 - protein, 5 aa, Mycobacterium
AQQTA

SEQ ID NO: 984220 - protein, 15 aa, Mycobacterium
AQRAGRKALRPGANL

SEQ ID NO: 984221 - protein, 12 aa, Mycobacterium
AQRAQDVAGKTM

SEQ ID NO: 984222 - protein, 5 aa, Mycobacterium
AQRGT

SEQ ID NO: 984223 - protein, 4 aa, Mycobacterium
AQRL

SEQ ID NO: 984224 - protein, 7 aa, Mycobacterium
AQRPPAR

SEQ ID NO: 984225 - protein, 6 aa, Mycobacterium
AQRTPD

SEQ ID NO: 984226 - protein, 14 aa, Mycobacterium
AQRVTSELSHAQGE

SEQ ID NO: 984227 - protein, 17 aa, Mycobacterium
AQSDRALNIPGEDLPGS

SEQ ID NO: 984228 - protein, 9 aa, Mycobacterium
AQSEAYEEA

SEQ ID NO: 984229 - protein, 22 aa, Mycobacterium
AQSEEHGSDSMSQSYNTCGSVA

SEQ ID NO: 984230 - protein, 7 aa, Mycobacterium
AQSEHSG

SEQ ID NO: 984231 - protein, 6 aa, Mycobacterium
AQSGTP

SEQ ID NO: 984232 - protein, 4 aa, Mycobacterium
AQSP

SEQ ID NO: 984233 - protein, 19 aa, Mycobacterium
AQSPTEVDPASYHWSIPAT

SEQ ID NO: 984234 - protein, 7 aa, Mycobacterium
AQSPTKP

SEQ ID NO: 984235 - protein, 5 aa, Mycobacterium
AQSRL

SEQ ID NO: 984236 - protein, 5 aa, Mycobacterium
AQSTV

SEQ ID NO: 984237 - protein, 7 aa, Mycobacterium
AQSVSQR

SEQ ID NO: 984238 - protein, 12 aa, Mycobacterium
AQTADHRILIFV

SEQ ID NO: 984239 - protein, 8 aa, Mycobacterium
AQTAGSAV

SEQ ID NO: 984240 - protein, 6 aa, Mycobacterium
AQTAGV

SEQ ID NO: 984241 - protein, 7 aa, Mycobacterium
AQTDPEA

SEQ ID NO: 984242 - protein, 4 aa, Mycobacterium
AQTI

SEQ ID NO: 984243 - protein, 6 aa, Mycobacterium
AQTTSL

SEQ ID NO: 984244 - protein, 7 aa, Mycobacterium
AQTTTDL

SEQ ID NO: 984245 - protein, 6 aa, Mycobacterium
AQTVGD

SEQ ID NO: 984246 - protein, 12 aa, Mycobacterium
AQVATDAGISPS

SEQ ID NO: 984247 - protein, 5 aa, Mycobacterium
AQVPE

SEQ ID NO: 984248 - protein, 5 aa, Mycobacterium
AQWNE

SEQ ID NO: 984249 - protein, 5 aa, Mycobacterium
AQYES

SEQ ID NO: 984250 - protein, 5 aa, Mycobacterium
AQYGT

SEQ ID NO: 984251 - protein, 8 aa, Mycobacterium
AQYPLADG

SEQ ID NO: 984252 - protein, 7 aa, Mycobacterium
ARAAGAE

SEQ ID NO: 984253 - protein, 6 aa, Mycobacterium
ARAAGE

SEQ ID NO: 984254 - protein, 13 aa, Mycobacterium
ARAALQDAEIDEA

SEQ ID NO: 984255 - protein, 15 aa, Mycobacterium
ARADASRVRSGANRA

SEQ ID NO: 984256 - protein, 21 aa, Mycobacterium
ARADPWDPSSVVTDNSDRDRL

SEQ ID NO: 984257 - protein, 5 aa, Mycobacterium
ARAEG

SEQ ID NO: 984258 - protein, 9 aa, Mycobacterium
ARAERGEPD

SEQ ID NO: 984259 - protein, 6 aa, Mycobacterium
ARAGSA

SEQ ID NO: 984260 - protein, 8 aa, Mycobacterium
ARAPHSVD

SEQ ID NO: 984261 - protein, 15 aa, Mycobacterium
ARAQARQSIKAATDE

SEQ ID NO: 984262 - protein, 5 aa, Mycobacterium
ARARR

SEQ ID NO: 984263 - protein, 18 aa, Mycobacterium
ARASGAARHGSARVTTES

SEQ ID NO: 984264 - protein, 8 aa, Mycobacterium
ARATMSET

SEQ ID NO: 984265 - protein, 11 aa, Mycobacterium
ARATRVQGATV

SEQ ID NO: 984266 - protein, 8 aa, Mycobacterium
ARDADLPR

SEQ ID NO: 984267 - protein, 8 aa, Mycobacterium
ARDCPAAA

SEQ ID NO: 984268 - protein, 9 aa, Mycobacterium
ARDDLPDGG

SEQ ID NO: 984269 - protein, 8 aa, Mycobacterium
ARDGAAAR

SEQ ID NO: 984270 - protein, 10 aa, Mycobacterium
ARDKTGTDPV

SEQ ID NO: 984271 - protein, 4 aa, Mycobacterium
ARDL

SEQ ID NO: 984272 - protein, 4 aa, Mycobacterium
ARDR

SEQ ID NO: 984273 - protein, 7 aa, Mycobacterium
ARDSAPS

SEQ ID NO: 984274 - protein, 9 aa, Mycobacterium
ARDVDDDEH

SEQ ID NO: 984275 - protein, 6 aa, Mycobacterium
AREHNN

SEQ ID NO: 984276 - protein, 7 aa, Mycobacterium
ARENAKP

SEQ ID NO: 984277 - protein, 10 aa, Mycobacterium
AREPRGYGGF

SEQ ID NO: 984278 - protein, 21 aa, Mycobacterium
ARERIGKETTAPAVSDIHQHD

SEQ ID NO: 984279 - protein, 4 aa, Mycobacterium
AREV

SEQ ID NO: 984280 - protein, 4 aa, Mycobacterium
ARGA

SEQ ID NO: 984281 - protein, 8 aa, Mycobacterium
ARGAKATD

SEQ ID NO: 984282 - protein, 17 aa, Mycobacterium
ARGASSAASAASATIDA

SEQ ID NO: 984283 - protein, 6 aa, Mycobacterium
ARGDGG

SEQ ID NO: 984284 - protein, 7 aa, Mycobacterium
ARGDTEQ

SEQ ID NO: 984285 - protein, 5 aa, Mycobacterium
ARGED

SEQ ID NO: 984286 - protein, 16 aa, Mycobacterium
ARGEPAGLGARDTLRT

SEQ ID NO: 984287 - protein, 6 aa, Mycobacterium
ARGFGG

SEQ ID NO: 984288 - protein, 12 aa, Mycobacterium
ARGGKVAGSVSK

SEQ ID NO: 984289 - protein, 9 aa, Mycobacterium
ARGGQESVL

SEQ ID NO: 984290 - protein, 9 aa, Mycobacterium
ARGKALGEA

SEQ ID NO: 984291 - protein, 6 aa, Mycobacterium
ARGNLG

SEQ ID NO: 984292 - protein, 7 aa, Mycobacterium
ARGPGNL

SEQ ID NO: 984293 - protein, 5 aa, Mycobacterium
ARGPM

SEQ ID NO: 984294 - protein, 8 aa, Mycobacterium
ARGRGPVV

SEQ ID NO: 984295 - protein, 7 aa, Mycobacterium
ARGYPKT

SEQ ID NO: 984296 - protein, 16 aa, Mycobacterium
ARHGTSSIDTSPPSAL

SEQ ID NO: 984297 - protein, 5 aa, Mycobacterium
ARHTG

SEQ ID NO: 984298 - protein, 8 aa, Mycobacterium
ARKGDNAP

SEQ ID NO: 984299 - protein, 8 aa, Mycobacterium
ARKVEKAL

SEQ ID NO: 984300 - protein, 10 aa, Mycobacterium
ARLKSTAKCS

SEQ ID NO: 984301 - protein, 10 aa, Mycobacterium
ARMQREQRAK

SEQ ID NO: 984302 - protein, 11 aa, Mycobacterium
ARNATAAEGLD

SEQ ID NO: 984303 - protein, 9 aa, Mycobacterium
ARNDEGRCQ

SEQ ID NO: 984304 - protein, 5 aa, Mycobacterium
ARNDY

SEQ ID NO: 984305 - protein, 7 aa, Mycobacterium
ARNGISD

SEQ ID NO: 984306 - protein, 8 aa, Mycobacterium
ARNGRPLR

SEQ ID NO: 984307 - protein, 17 aa, Mycobacterium
ARNGVGTGISASDRATT

SEQ ID NO: 984308 - protein, 6 aa, Mycobacterium
ARNIRD

SEQ ID NO: 984309 - protein, 6 aa, Mycobacterium
ARNNDK

SEQ ID NO: 984310 - protein, 7 aa, Mycobacterium
ARNPDNG

SEQ ID NO: 984311 - protein, 8 aa, Mycobacterium
ARNPENVQ

SEQ ID NO: 984312 - protein, 7 aa, Mycobacterium
ARNRAVG

SEQ ID NO: 984313 - protein, 4 aa, Mycobacterium
ARPG

SEQ ID NO: 984314 - protein, 7 aa, Mycobacterium
ARPGAVT

SEQ ID NO: 984315 - protein, 18 aa, Mycobacterium
ARPGEPSWSSPFGPGRPG

SEQ ID NO: 984316 - protein, 12 aa, Mycobacterium
ARPGHKASNIMT

SEQ ID NO: 984317 - protein, 13 aa, Mycobacterium
ARPGIPPTHPVRG

SEQ ID NO: 984318 - protein, 6 aa, Mycobacterium
ARPGVT

SEQ ID NO: 984319 - protein, 12 aa, Mycobacterium
ARPGWSRAATAT

SEQ ID NO: 984320 - protein, 6 aa, Mycobacterium
ARPLYD

SEQ ID NO: 984321 - protein, 8 aa, Mycobacterium
ARPQLTPG

SEQ ID NO: 984322 - protein, 6 aa, Mycobacterium
ARPQTY

SEQ ID NO: 984323 - protein, 8 aa, Mycobacterium
ARPSGTED

SEQ ID NO: 984324 - protein, 16 aa, Mycobacterium
ARPTAAGAPGTRVRCW

SEQ ID NO: 984325 - protein, 8 aa, Mycobacterium
ARPTTDRV

SEQ ID NO: 984326 - protein, 13 aa, Mycobacterium
ARPVNGPNSKSEI

SEQ ID NO: 984327 - protein, 5 aa, Mycobacterium
ARQAA

SEQ ID NO: 984328 - protein, 5 aa, Mycobacterium
ARQLP

SEQ ID NO: 984329 - protein, 6 aa, Mycobacterium
ARQQLE

SEQ ID NO: 984330 - protein, 10 aa, Mycobacterium
ARQRDPAQPT

SEQ ID NO: 984331 - protein, 13 aa, Mycobacterium
ARQRGEVVHIIDD

SEQ ID NO: 984332 - protein, 7 aa, Mycobacterium
ARQRLKG

SEQ ID NO: 984333 - protein, 5 aa, Mycobacterium
ARQSI

SEQ ID NO: 984334 - protein, 6 aa, Mycobacterium
ARQTQY

SEQ ID NO: 984335 - protein, 18 aa, Mycobacterium
ARQVAKKRHDRSAPPWQE

SEQ ID NO: 984336 - protein, 5 aa, Mycobacterium
ARQVE

SEQ ID NO: 984337 - protein, 6 aa, Mycobacterium
ARRAEL

SEQ ID NO: 984338 - protein, 8 aa, Mycobacterium
ARRAERSA

SEQ ID NO: 984339 - protein, 7 aa, Mycobacterium
ARRERGD

SEQ ID NO: 984340 - protein, 4 aa, Mycobacterium
ARRG

SEQ ID NO: 984341 - protein, 15 aa, Mycobacterium
ARRGAERLWEQLHDW

SEQ ID NO: 984342 - protein, 4 aa, Mycobacterium
ARRP

SEQ ID NO: 984343 - protein, 7 aa, Mycobacterium
ARRPGNI

SEQ ID NO: 984344 - protein, 7 aa, Mycobacterium
ARRQPAA

SEQ ID NO: 984345 - protein, 11 aa, Mycobacterium
ARRRAGTGAPN

SEQ ID NO: 984346 - protein, 7 aa, Mycobacterium
ARRRPGN

SEQ ID NO: 984347 - protein, 9 aa, Mycobacterium
ARSAKRAIK

SEQ ID NO: 984348 - protein, 24 aa, Mycobacterium
ARSAPPPRGTPVTRTACNGARMAI

SEQ ID NO: 984349 - protein, 7 aa, Mycobacterium
ARSCPGQ

SEQ ID NO: 984350 - protein, 4 aa, Mycobacterium
ARSE

SEQ ID NO: 984351 - protein, 10 aa, Mycobacterium
ARSEPAPGRS

SEQ ID NO: 984352 - protein, 6 aa, Mycobacterium
ARSGVN

SEQ ID NO: 984353 - protein, 9 aa, Mycobacterium
ARSKAARRV

SEQ ID NO: 984354 - protein, 5 aa, Mycobacterium
ARSLK

SEQ ID NO: 984355 - protein, 7 aa, Mycobacterium
ARSPEAW

SEQ ID NO: 984356 - protein, 7 aa, Mycobacterium
ARSQGRK

SEQ ID NO: 984357 - protein, 8 aa, Mycobacterium
ARSRQQAA

SEQ ID NO: 984358 - protein, 7 aa, Mycobacterium
ARSTASR

SEQ ID NO: 984359 - protein, 14 aa, Mycobacterium
ARSVAERRGRAVPT

SEQ ID NO: 984360 - protein, 12 aa, Mycobacterium
ARSYNRESRPPQ

SEQ ID NO: 984361 - protein, 7 aa, Mycobacterium
ARTAGLG

SEQ ID NO: 984362 - protein, 9 aa, Mycobacterium
ARTEAGSGA

SEQ ID NO: 984363 - protein, 7 aa, Mycobacterium
ARTGARP

SEQ ID NO: 984364 - protein, 8 aa, Mycobacterium
ARTGNPMR

SEQ ID NO: 984365 - protein, 12 aa, Mycobacterium
ARTGSRPRLTDD

SEQ ID NO: 984366 - protein, 8 aa, Mycobacterium
ARTHGQLP

SEQ ID NO: 984367 - protein, 13 aa, Mycobacterium
ARTKENDLSVPTR

SEQ ID NO: 984368 - protein, 6 aa, Mycobacterium
ARTKLT

SEQ ID NO: 984369 - protein, 9 aa, Mycobacterium
ARTPDSAVA

SEQ ID NO: 984370 - protein, 5 aa, Mycobacterium
ARTPI

SEQ ID NO: 984371 - protein, 8 aa, Mycobacterium
ARTQGDKW

SEQ ID NO: 984372 - protein, 10 aa, Mycobacterium
ARTRDQLTTA

SEQ ID NO: 984373 - protein, 7 aa, Mycobacterium
ARTSDIP

SEQ ID NO: 984374 - protein, 14 aa, Mycobacterium
ARTSSSLSKLRTAY

SEQ ID NO: 984375 - protein, 13 aa, Mycobacterium
ARTTATSPSGSTA

SEQ ID NO: 984376 - protein, 6 aa, Mycobacterium
ARTTGL

SEQ ID NO: 984377 - protein, 17 aa, Mycobacterium
ARTTSIRGVPGAESYPD

SEQ ID NO: 984378 - protein, 8 aa, Mycobacterium
ARVAGGPD

SEQ ID NO: 984379 - protein, 7 aa, Mycobacterium
ARVETGA

SEQ ID NO: 984380 - protein, 6 aa, Mycobacterium
ARVGHR

SEQ ID NO: 984381 - protein, 4 aa, Mycobacterium
ARVR

SEQ ID NO: 984382 - protein, 27 aa, Mycobacterium
ARWRNSAGEEHAARLGEPLSAEQTARA

SEQ ID NO: 984383 - protein, 14 aa, Mycobacterium
ARYAARNGGPDQLR

SEQ ID NO: 984384 - protein, 6 aa, Mycobacterium
ARYNRE

SEQ ID NO: 984385 - protein, 9 aa, Mycobacterium
ARYRSDQGV

SEQ ID NO: 984386 - protein, 12 aa, Mycobacterium
ARYRVESDGRQA

SEQ ID NO: 984387 - protein, 4 aa, Mycobacterium
ARYS

SEQ ID NO: 984388 - protein, 6 aa, Mycobacterium
ASADPA

SEQ ID NO: 984389 - protein, 9 aa, Mycobacterium
ASADPGRPT

SEQ ID NO: 984390 - protein, 10 aa, Mycobacterium
ASADRDTKIP

SEQ ID NO: 984391 - protein, 7 aa, Mycobacterium
ASAEEKL

SEQ ID NO: 984392 - protein, 10 aa, Mycobacterium
ASAGADTGTL

SEQ ID NO: 984393 - protein, 7 aa, Mycobacterium
ASAGRSR

SEQ ID NO: 984394 - protein, 8 aa, Mycobacterium
ASAGTESK

SEQ ID NO: 984395 - protein, 6 aa, Mycobacterium
ASAINP

SEQ ID NO: 984396 - protein, 4 aa, Mycobacterium
ASAL

SEQ ID NO: 984397 - protein, 16 aa, Mycobacterium
ASAPEARTKIIEPVSL

SEQ ID NO: 984398 - protein, 11 aa, Mycobacterium
ASAPGGDSYTE

SEQ ID NO: 984399 - protein, 9 aa, Mycobacterium
ASAPLHTNG

SEQ ID NO: 984400 - protein, 11 aa, Mycobacterium
ASAQREKTGEV

SEQ ID NO: 984401 - protein, 7 aa, Mycobacterium
ASARATA

SEQ ID NO: 984402 - protein, 8 aa, Mycobacterium
ASARSQKI

SEQ ID NO: 984403 - protein, 5 aa, Mycobacterium
ASATL

SEQ ID NO: 984404 - protein, 6 aa, Mycobacterium
ASATQE

SEQ ID NO: 984405 - protein, 12 aa, Mycobacterium
ASAVSQYGGELS

SEQ ID NO: 984406 - protein, 7 aa, Mycobacterium
ASDADGR

SEQ ID NO: 984407 - protein, 13 aa, Mycobacterium
ASDDMCAEGEFRR

SEQ ID NO: 984408 - protein, 8 aa, Mycobacterium
ASDEPNRA

SEQ ID NO: 984409 - protein, 8 aa, Mycobacterium
ASDGGLET

SEQ ID NO: 984410 - protein, 5 aa, Mycobacterium
ASDLK

SEQ ID NO: 984411 - protein, 4 aa, Mycobacterium
ASDR

SEQ ID NO: 984412 - protein, 17 aa, Mycobacterium
ASDRAELEGISTERAPQ

SEQ ID NO: 984413 - protein, 6 aa, Mycobacterium
ASDSAG

SEQ ID NO: 984414 - protein, 14 aa, Mycobacterium
ASDSDESEDRPGAV

SEQ ID NO: 984415 - protein, 9 aa, Mycobacterium
ASDSWTNAT

SEQ ID NO: 984416 - protein, 10 aa, Mycobacterium
ASECEHARNN

SEQ ID NO: 984417 - protein, 7 aa, Mycobacterium
ASEDPRR

SEQ ID NO: 984418 - protein, 4 aa, Mycobacterium
ASEF

SEQ ID NO: 984419 - protein, 13 aa, Mycobacterium
ASEGVKEEDIRKD

SEQ ID NO: 984420 - protein, 4 aa, Mycobacterium
ASEK

SEQ ID NO: 984421 - protein, 8 aa, Mycobacterium
ASEKQRVA

SEQ ID NO: 984422 - protein, 7 aa, Mycobacterium
ASEQGTH

SEQ ID NO: 984423 - protein, 7 aa, Mycobacterium
ASEQPAS

SEQ ID NO: 984424 - protein, 8 aa, Mycobacterium
ASEQRNQL

SEQ ID NO: 984425 - protein, 5 aa, Mycobacterium
ASERQ

SEQ ID NO: 984426 - protein, 15 aa, Mycobacterium
ASETRKPSRDPQTRA

SEQ ID NO: 984427 - protein, 7 aa, Mycobacterium
ASETRQV

SEQ ID NO: 984428 - protein, 6 aa, Mycobacterium
ASEVGI

SEQ ID NO: 984429 - protein, 6 aa, Mycobacterium
ASGAIG

SEQ ID NO: 984430 - protein, 11 aa, Mycobacterium
ASGDAGGGQRF

SEQ ID NO: 984431 - protein, 13 aa, Mycobacterium
ASGDGGNVASHAP

SEQ ID NO: 984432 - protein, 6 aa, Mycobacterium
ASGDPL

SEQ ID NO: 984433 - protein, 10 aa, Mycobacterium
ASGDVHAGRT

SEQ ID NO: 984434 - protein, 8 aa, Mycobacterium
ASGEKDLA

SEQ ID NO: 984435 - protein, 18 aa, Mycobacterium
ASGEPVSSPAGDSPACKQ

SEQ ID NO: 984436 - protein, 5 aa, Mycobacterium
ASGEV

SEQ ID NO: 984437 - protein, 7 aa, Mycobacterium
ASGGEPL

SEQ ID NO: 984438 - protein, 8 aa, Mycobacterium
ASGGPFRG

SEQ ID NO: 984439 - protein, 9 aa, Mycobacterium
ASGGSVGYD

SEQ ID NO: 984440 - protein, 9 aa, Mycobacterium
ASGGTDAKA

SEQ ID NO: 984441 - protein, 10 aa, Mycobacterium
ASGGVYDTAR

SEQ ID NO: 984442 - protein, 7 aa, Mycobacterium
ASGIGRA

SEQ ID NO: 984443 - protein, 12 aa, Mycobacterium
ASGKGGVGKSTV

SEQ ID NO: 984444 - protein, 23 aa, Mycobacterium
ASGLSAGITDAGLSRGLAGVSGS

SEQ ID NO: 984445 - protein, 8 aa, Mycobacterium
ASGNESIG

SEQ ID NO: 984446 - protein, 6 aa, Mycobacterium
ASGNLG

SEQ ID NO: 984447 - protein, 7 aa, Mycobacterium
ASGPHPF

SEQ ID NO: 984448 - protein, 8 aa, Mycobacterium
ASGQDVPF

SEQ ID NO: 984449 - protein, 4 aa, Mycobacterium
ASGS

SEQ ID NO: 984450 - protein, 13 aa, Mycobacterium
ASGSARDRLIVLL

SEQ ID NO: 984451 - protein, 6 aa, Mycobacterium
ASGSDI

SEQ ID NO: 984452 - protein, 12 aa, Mycobacterium
ASGTKPDIRKLS

SEQ ID NO: 984453 - protein, 7 aa, Mycobacterium
ASGTTSI

SEQ ID NO: 984454 - protein, 5 aa, Mycobacterium
ASGYE

SEQ ID NO: 984455 - protein, 18 aa, Mycobacterium
ASHAEAELAARTEVGLPP

SEQ ID NO: 984456 - protein, 13 aa, Mycobacterium
ASHAGDLAGSPGV

SEQ ID NO: 984457 - protein, 13 aa, Mycobacterium
ASHGGVDDTRELR

SEQ ID NO: 984458 - protein, 4 aa, Mycobacterium
ASHP

SEQ ID NO: 984459 - protein, 8 aa, Mycobacterium
ASHSSQVD

SEQ ID NO: 984460 - protein, 4 aa, Mycobacterium
ASIG

SEQ ID NO: 984461 - protein, 5 aa, Mycobacterium
ASIPP

SEQ ID NO: 984462 - protein, 15 aa, Mycobacterium
ASISRSDTVTTTSAH

SEQ ID NO: 984463 - protein, 15 aa, Mycobacterium
ASITKSTLYRRWWSK

SEQ ID NO: 984464 - protein, 14 aa, Mycobacterium
ASKAKARRAEGSVA

SEQ ID NO: 984465 - protein, 9 aa, Mycobacterium
ASKASGTTV

SEQ ID NO: 984466 - protein, 5 aa, Mycobacterium
ASKEY

SEQ ID NO: 984467 - protein, 12 aa, Mycobacterium
ASKGYRGQRSRL

SEQ ID NO: 984468 - protein, 6 aa, Mycobacterium
ASLADA

SEQ ID NO: 984469 - protein, 9 aa, Mycobacterium
ASLADTQKP

SEQ ID NO: 984470 - protein, 6 aa, Mycobacterium
ASLDSA

SEQ ID NO: 984471 - protein, 6 aa, Mycobacterium
ASLDTA

SEQ ID NO: 984472 - protein, 9 aa, Mycobacterium
ASLEKGPRL

SEQ ID NO: 984473 - protein, 6 aa, Mycobacterium
ASLSDF

SEQ ID NO: 984474 - protein, 6 aa, Mycobacterium
ASLSID

SEQ ID NO: 984475 - protein, 9 aa, Mycobacterium
ASMPAGPDV

SEQ ID NO: 984476 - protein, 5 aa, Mycobacterium
ASMPS

SEQ ID NO: 984477 - protein, 5 aa, Mycobacterium
ASMSR

SEQ ID NO: 984478 - protein, 29 aa, Mycobacterium
ASNGLGASVKRREDTHKMAEANRAFAHYR

SEQ ID NO: 984479 - protein, 7 aa, Mycobacterium
ASNLPTA

SEQ ID NO: 984480 - protein, 6 aa, Mycobacterium
ASNPVR

SEQ ID NO: 984481 - protein, 19 aa, Mycobacterium
ASNRTPRRCSLTRATRSGT

SEQ ID NO: 984482 - protein, 10 aa, Mycobacterium
ASNSQKSRDL

SEQ ID NO: 984483 - protein, 4 aa, Mycobacterium
ASPA

SEQ ID NO: 984484 - protein, 7 aa, Mycobacterium
ASPAARG

SEQ ID NO: 984485 - protein, 5 aa, Mycobacterium
ASPAL

SEQ ID NO: 984486 - protein, 21 aa, Mycobacterium
ASPALPSVTGVGTDATQAIFA

SEQ ID NO: 984487 - protein, 10 aa, Mycobacterium
ASPATDSEWD

SEQ ID NO: 984488 - protein, 10 aa, Mycobacterium
ASPDDWTPPA

SEQ ID NO: 984489 - protein, 6 aa, Mycobacterium
ASPEQL

SEQ ID NO: 984490 - protein, 15 aa, Mycobacterium
ASPGGTGAAKFGGNY

SEQ ID NO: 984491 - protein, 9 aa, Mycobacterium
ASPKLGRAA

SEQ ID NO: 984492 - protein, 12 aa, Mycobacterium
ASPLSAPANRLT

SEQ ID NO: 984493 - protein, 13 aa, Mycobacterium
ASPMYSATPADGV

SEQ ID NO: 984494 - protein, 19 aa, Mycobacterium
ASPQPAVTYRTAGRDCGRG

SEQ ID NO: 984495 - protein, 7 aa, Mycobacterium
ASPRASL

SEQ ID NO: 984496 - protein, 6 aa, Mycobacterium
ASPRQT

SEQ ID NO: 984497 - protein, 7 aa, Mycobacterium
ASPSYEH

SEQ ID NO: 984498 - protein, 4 aa, Mycobacterium
ASPT

SEQ ID NO: 984499 - protein, 37 aa, Mycobacterium
ASPTAKTQQNPAGTPNNSEVSGSSKTQGTRCTATSLT

SEQ ID NO: 984500 - protein, 7 aa, Mycobacterium
ASPVRYG

SEQ ID NO: 984501 - protein, 7 aa, Mycobacterium
ASQATKT

SEQ ID NO: 984502 - protein, 11 aa, Mycobacterium
ASQDEKDREDQ

SEQ ID NO: 984503 - protein, 7 aa, Mycobacterium
ASQFPNR

SEQ ID NO: 984504 - protein, 31 aa, Mycobacterium
ASQHENEAACASSGVSAAAGLANAVSTSHGS

SEQ ID NO: 984505 - protein, 17 aa, Mycobacterium
ASQNDAPVGAPRRFGST

SEQ ID NO: 984506 - protein, 10 aa, Mycobacterium
ASQPNSPHEL

SEQ ID NO: 984507 - protein, 6 aa, Mycobacterium
ASQRAS

SEQ ID NO: 984508 - protein, 5 aa, Mycobacterium
ASQTE

SEQ ID NO: 984509 - protein, 8 aa, Mycobacterium
ASQVQPHA

SEQ ID NO: 984510 - protein, 4 aa, Mycobacterium
ASRA

SEQ ID NO: 984511 - protein, 7 aa, Mycobacterium
ASRATAR

SEQ ID NO: 984512 - protein, 6 aa, Mycobacterium
ASRATY

SEQ ID NO: 984513 - protein, 6 aa, Mycobacterium
ASRDLQ

SEQ ID NO: 984514 - protein, 12 aa, Mycobacterium
ASRGSSLGTGGM

SEQ ID NO: 984515 - protein, 7 aa, Mycobacterium
ASRHITG

SEQ ID NO: 984516 - protein, 13 aa, Mycobacterium
ASRPACSGNAVAS

SEQ ID NO: 984517 - protein, 17 aa, Mycobacterium
ASRPQLPSGPLTSGAAA

SEQ ID NO: 984518 - protein, 19 aa, Mycobacterium
ASRPTPQSSKLGCSQTPSG

SEQ ID NO: 984519 - protein, 7 aa, Mycobacterium
ASRPWAT

SEQ ID NO: 984520 - protein, 13 aa, Mycobacterium
ASRQPSQHLALRE

SEQ ID NO: 984521 - protein, 11 aa, Mycobacterium
ASRRAERGDVV

SEQ ID NO: 984522 - protein, 8 aa, Mycobacterium
ASRRPSTG

SEQ ID NO: 984523 - protein, 9 aa, Mycobacterium
ASRTGGTNI

SEQ ID NO: 984524 - protein, 8 aa, Mycobacterium
ASSAFEQG

SEQ ID NO: 984525 - protein, 8 aa, Mycobacterium
ASSAGAQV

SEQ ID NO: 984526 - protein, 7 aa, Mycobacterium
ASSAVEE

SEQ ID NO: 984527 - protein, 13 aa, Mycobacterium
ASSCDYGTFLLGA

SEQ ID NO: 984528 - protein, 10 aa, Mycobacterium
ASSDGGPDIK

SEQ ID NO: 984529 - protein, 17 aa, Mycobacterium
ASSDVNASNIPAYPGDT

SEQ ID NO: 984530 - protein, 10 aa, Mycobacterium
ASSEAPSARI

SEQ ID NO: 984531 - protein, 11 aa, Mycobacterium
ASSGAKTPVDA

SEQ ID NO: 984532 - protein, 7 aa, Mycobacterium
ASSGARQ

SEQ ID NO: 984533 - protein, 7 aa, Mycobacterium
ASSGPDK

SEQ ID NO: 984534 - protein, 9 aa, Mycobacterium
ASSLPGLSG

SEQ ID NO: 984535 - protein, 8 aa, Mycobacterium
ASSLSGRG

SEQ ID NO: 984536 - protein, 12 aa, Mycobacterium
ASSMSLRSGFGC

SEQ ID NO: 984537 - protein, 14 aa, Mycobacterium
ASSPELMRTGEELG

SEQ ID NO: 984538 - protein, 6 aa, Mycobacterium
ASSPPW

SEQ ID NO: 984539 - protein, 9 aa, Mycobacterium
ASSPYGGEI

SEQ ID NO: 984540 - protein, 7 aa, Mycobacterium
ASSRSRR

SEQ ID NO: 984541 - protein, 4 aa, Mycobacterium
ASSS

SEQ ID NO: 984542 - protein, 9 aa, Mycobacterium
ASSSPLQPY

SEQ ID NO: 984543 - protein, 9 aa, Mycobacterium
ASSTGDLGP

SEQ ID NO: 984544 - protein, 31 aa, Mycobacterium
ASSVSDDHIQKATTRNTNPESWTHDSSTQQQ

SEQ ID NO: 984545 - protein, 10 aa, Mycobacterium
ASTANERELT

SEQ ID NO: 984546 - protein, 8 aa, Mycobacterium
ASTAPDGE

SEQ ID NO: 984547 - protein, 8 aa, Mycobacterium
ASTDGVGT

SEQ ID NO: 984548 - protein, 4 aa, Mycobacterium
ASTE

SEQ ID NO: 984549 - protein, 11 aa, Mycobacterium
ASTEVRSDSTD

SEQ ID NO: 984550 - protein, 4 aa, Mycobacterium
ASTI

SEQ ID NO: 984551 - protein, 8 aa, Mycobacterium
ASTKTNFG

SEQ ID NO: 984552 - protein, 6 aa, Mycobacterium
ASTLGY

SEQ ID NO: 984553 - protein, 7 aa, Mycobacterium
ASTPGKV

SEQ ID NO: 984554 - protein, 94 aa, Mycobacterium
ASTRQGTRSQAGVSAELSTEQFGGQQEPVSAQGSQGMGGSQGMGGMTPASTKSKKDERKKKKYSEGAAAGTDDAERAPIEVQSGGGKRALAQHV

SEQ ID NO: 984555 - protein, 10 aa, Mycobacterium
ASTSRHKAEA

SEQ ID NO: 984556 - protein, 17 aa, Mycobacterium
ASTTPDQLTPEEQLSTD

SEQ ID NO: 984557 - protein, 11 aa, Mycobacterium
ASVADDSGLEA

SEQ ID NO: 984558 - protein, 7 aa, Mycobacterium
ASVPDPE

SEQ ID NO: 984559 - protein, 7 aa, Mycobacterium
ASVPGAA

SEQ ID NO: 984560 - protein, 18 aa, Mycobacterium
ASVRPSRPRRGNDLETEA

SEQ ID NO: 984561 - protein, 7 aa, Mycobacterium
ASVRRAG

SEQ ID NO: 984562 - protein, 10 aa, Mycobacterium
ASVSDPTAQP

SEQ ID NO: 984563 - protein, 10 aa, Mycobacterium
ASVSGGAPLG

SEQ ID NO: 984564 - protein, 9 aa, Mycobacterium
ASWSEPKGG

SEQ ID NO: 984565 - protein, 5 aa, Mycobacterium
ASYGA

SEQ ID NO: 984566 - protein, 8 aa, Mycobacterium
ASYGAREL

SEQ ID NO: 984567 - protein, 11 aa, Mycobacterium
ASYNEDTKEIT

SEQ ID NO: 984568 - protein, 4 aa, Mycobacterium
ASYR

SEQ ID NO: 984569 - protein, 5 aa, Mycobacterium
ATAAV

SEQ ID NO: 984570 - protein, 6 aa, Mycobacterium
ATADPD

SEQ ID NO: 984571 - protein, 12 aa, Mycobacterium
ATADQIGTQTTQ

SEQ ID NO: 984572 - protein, 9 aa, Mycobacterium
ATADRGALE

SEQ ID NO: 984573 - protein, 8 aa, Mycobacterium
ATAEPEER

SEQ ID NO: 984574 - protein, 7 aa, Mycobacterium
ATAESCT

SEQ ID NO: 984575 - protein, 14 aa, Mycobacterium
ATAETNSEPCNLVL

SEQ ID NO: 984576 - protein, 16 aa, Mycobacterium
ATAEVEPGRIGCFGGR

SEQ ID NO: 984577 - protein, 7 aa, Mycobacterium
ATAGAPA

SEQ ID NO: 984578 - protein, 5 aa, Mycobacterium
ATAGE

SEQ ID NO: 984579 - protein, 4 aa, Mycobacterium
ATAK

SEQ ID NO: 984580 - protein, 7 aa, Mycobacterium
ATALGER

SEQ ID NO: 984581 - protein, 15 aa, Mycobacterium
ATAPGTNTATASNRN

SEQ ID NO: 984582 - protein, 10 aa, Mycobacterium
ATAPQRLPSV

SEQ ID NO: 984583 - protein, 11 aa, Mycobacterium
ATAQSADAAGR

SEQ ID NO: 984584 - protein, 10 aa, Mycobacterium
ATAQSAPDEM

SEQ ID NO: 984585 - protein, 4 aa, Mycobacterium
ATAR

SEQ ID NO: 984586 - protein, 7 aa, Mycobacterium
ATARAAK

SEQ ID NO: 984587 - protein, 10 aa, Mycobacterium
ATARRRGSCA

SEQ ID NO: 984588 - protein, 8 aa, Mycobacterium
ATASADPP

SEQ ID NO: 984589 - protein, 6 aa, Mycobacterium
ATASLG

SEQ ID NO: 984590 - protein, 7 aa, Mycobacterium
ATASQPV

SEQ ID NO: 984591 - protein, 40 aa, Mycobacterium
ATASSPDSVLDGPKTSALPHDTAVASTPNAAPTTGNAVIL

SEQ ID NO: 984592 - protein, 7 aa, Mycobacterium
ATATDEQ

SEQ ID NO: 984593 - protein, 24 aa, Mycobacterium
ATATVGPAESVQPSDREERTATPV

SEQ ID NO: 984594 - protein, 7 aa, Mycobacterium
ATAVGRG

SEQ ID NO: 984595 - protein, 14 aa, Mycobacterium
ATAVRGTFSAPADL

SEQ ID NO: 984596 - protein, 17 aa, Mycobacterium
ATDEGKAPAGRVPDMPG

SEQ ID NO: 984597 - protein, 7 aa, Mycobacterium
ATDEVGQ

SEQ ID NO: 984598 - protein, 8 aa, Mycobacterium
ATDGRTAA

SEQ ID NO: 984599 - protein, 8 aa, Mycobacterium
ATDHPDYA

SEQ ID NO: 984600 - protein, 11 aa, Mycobacterium
ATDPEAQQRRE

SEQ ID NO: 984601 - protein, 10 aa, Mycobacterium
ATDPPPGKDR

SEQ ID NO: 984602 - protein, 14 aa, Mycobacterium
ATDSSGKITKRAAD

SEQ ID NO: 984603 - protein, 8 aa, Mycobacterium
ATDSSSEL

SEQ ID NO: 984604 - protein, 6 aa, Mycobacterium
ATDTDT

SEQ ID NO: 984605 - protein, 14 aa, Mycobacterium
ATDTFPNERVEGDQ

SEQ ID NO: 984606 - protein, 10 aa, Mycobacterium
ATDTGSPEAQ

SEQ ID NO: 984607 - protein, 9 aa, Mycobacterium
ATEAGRHSG

SEQ ID NO: 984608 - protein, 6 aa, Mycobacterium
ATEAIG

SEQ ID NO: 984609 - protein, 13 aa, Mycobacterium
ATEARRHTRAETP

SEQ ID NO: 984610 - protein, 6 aa, Mycobacterium
ATEATL

SEQ ID NO: 984611 - protein, 7 aa, Mycobacterium
ATEATTV

SEQ ID NO: 984612 - protein, 5 aa, Mycobacterium
ATECK

SEQ ID NO: 984613 - protein, 9 aa, Mycobacterium
ATEDHNVPT

SEQ ID NO: 984614 - protein, 33 aa, Mycobacterium
ATEEAGHGSSEQPPASSTPSAKATGGSLASDAQ

SEQ ID NO: 984615 - protein, 7 aa, Mycobacterium
ATEGNDG

SEQ ID NO: 984616 - protein, 7 aa, Mycobacterium
ATEGTAP

SEQ ID NO: 984617 - protein, 7 aa, Mycobacterium
ATEGTGL

SEQ ID NO: 984618 - protein, 13 aa, Mycobacterium
ATELQDPRTVAPD

SEQ ID NO: 984619 - protein, 4 aa, Mycobacterium
ATEN

SEQ ID NO: 984620 - protein, 6 aa, Mycobacterium
ATEPLT

SEQ ID NO: 984621 - protein, 8 aa, Mycobacterium
ATEPYAGS

SEQ ID NO: 984622 - protein, 5 aa, Mycobacterium
ATEQR

SEQ ID NO: 984623 - protein, 10 aa, Mycobacterium
ATESESAPLL

SEQ ID NO: 984624 - protein, 7 aa, Mycobacterium
ATETARR

SEQ ID NO: 984625 - protein, 12 aa, Mycobacterium
ATFSDEAARAAA

SEQ ID NO: 984626 - protein, 10 aa, Mycobacterium
ATGAADGYAR

SEQ ID NO: 984627 - protein, 8 aa, Mycobacterium
ATGAPTAV

SEQ ID NO: 984628 - protein, 6 aa, Mycobacterium
ATGASA

SEQ ID NO: 984629 - protein, 7 aa, Mycobacterium
ATGDDSM

SEQ ID NO: 984630 - protein, 7 aa, Mycobacterium
ATGDPEA

SEQ ID NO: 984631 - protein, 5 aa, Mycobacterium
ATGEE

SEQ ID NO: 984632 - protein, 6 aa, Mycobacterium
ATGEQI

SEQ ID NO: 984633 - protein, 5 aa, Mycobacterium
ATGER

SEQ ID NO: 984634 - protein, 6 aa, Mycobacterium
ATGGGR

SEQ ID NO: 984635 - protein, 8 aa, Mycobacterium
ATGGHLGP

SEQ ID NO: 984636 - protein, 21 aa, Mycobacterium
ATGGSGRMYKTTSNAHTLTGD

SEQ ID NO: 984637 - protein, 7 aa, Mycobacterium
ATGGVGQ

SEQ ID NO: 984638 - protein, 9 aa, Mycobacterium
ATGHQRRYQ

SEQ ID NO: 984639 - protein, 5 aa, Mycobacterium
ATGHR

SEQ ID NO: 984640 - protein, 7 aa, Mycobacterium
ATGINEP

SEQ ID NO: 984641 - protein, 7 aa, Mycobacterium
ATGKLER

SEQ ID NO: 984642 - protein, 4 aa, Mycobacterium
ATGL

SEQ ID NO: 984643 - protein, 13 aa, Mycobacterium
ATGLTRGTGNCHS

SEQ ID NO: 984644 - protein, 19 aa, Mycobacterium
ATGNDADSDRYGYRDLDAG

SEQ ID NO: 984645 - protein, 5 aa, Mycobacterium
ATGNV

SEQ ID NO: 984646 - protein, 7 aa, Mycobacterium
ATGPAEM

SEQ ID NO: 984647 - protein, 5 aa, Mycobacterium
ATGPV

SEQ ID NO: 984648 - protein, 7 aa, Mycobacterium
ATGPVSR

SEQ ID NO: 984649 - protein, 5 aa, Mycobacterium
ATGQG

SEQ ID NO: 984650 - protein, 7 aa, Mycobacterium
ATGQQPL

SEQ ID NO: 984651 - protein, 5 aa, Mycobacterium
ATGRD

SEQ ID NO: 984652 - protein, 5 aa, Mycobacterium
ATGRH

SEQ ID NO: 984653 - protein, 7 aa, Mycobacterium
ATGRPLP

SEQ ID NO: 984654 - protein, 12 aa, Mycobacterium
ATGSEMCLRRLV

SEQ ID NO: 984655 - protein, 11 aa, Mycobacterium
ATGSQRYGSGP

SEQ ID NO: 984656 - protein, 6 aa, Mycobacterium
ATGVEA

SEQ ID NO: 984657 - protein, 9 aa, Mycobacterium
ATGVTKQVT

SEQ ID NO: 984658 - protein, 6 aa, Mycobacterium
ATGWSG

SEQ ID NO: 984659 - protein, 8 aa, Mycobacterium
ATGYSTKG

SEQ ID NO: 984660 - protein, 6 aa, Mycobacterium
ATHGSG

SEQ ID NO: 984661 - protein, 10 aa, Mycobacterium
ATHPNYPECH

SEQ ID NO: 984662 - protein, 23 aa, Mycobacterium
ATHPTPGDRAGDQSAPQPTQLPR

SEQ ID NO: 984663 - protein, 7 aa, Mycobacterium
ATHSPRD

SEQ ID NO: 984664 - protein, 17 aa, Mycobacterium
ATHTSRPPRTPHPPEPH

SEQ ID NO: 984665 - protein, 5 aa, Mycobacterium
ATIGP

SEQ ID NO: 984666 - protein, 9 aa, Mycobacterium
ATITGAGPI

SEQ ID NO: 984667 - protein, 6 aa, Mycobacterium
ATKADS

SEQ ID NO: 984668 - protein, 11 aa, Mycobacterium
ATKADSSPNYH

SEQ ID NO: 984669 - protein, 8 aa, Mycobacterium
ATKARAPF

SEQ ID NO: 984670 - protein, 7 aa, Mycobacterium
ATKEKTT

SEQ ID NO: 984671 - protein, 11 aa, Mycobacterium
ATKGASHTQQM

SEQ ID NO: 984672 - protein, 16 aa, Mycobacterium
ATKIDPSDLHASLDCC

SEQ ID NO: 984673 - protein, 5 aa, Mycobacterium
ATKKG

SEQ ID NO: 984674 - protein, 7 aa, Mycobacterium
ATKNPQR

SEQ ID NO: 984675 - protein, 7 aa, Mycobacterium
ATKSSEW

SEQ ID NO: 984676 - protein, 10 aa, Mycobacterium
ATKTGSAVTD

SEQ ID NO: 984677 - protein, 6 aa, Mycobacterium
ATLPEG

SEQ ID NO: 984678 - protein, 10 aa, Mycobacterium
ATLPPGGESF

SEQ ID NO: 984679 - protein, 4 aa, Mycobacterium
ATLS

SEQ ID NO: 984680 - protein, 13 aa, Mycobacterium
ATLTGSEPAGQAV

SEQ ID NO: 984681 - protein, 8 aa, Mycobacterium
ATNNTARA

SEQ ID NO: 984682 - protein, 10 aa, Mycobacterium
ATNPATGKPV

SEQ ID NO: 984683 - protein, 10 aa, Mycobacterium
ATNQDGGTET

SEQ ID NO: 984684 - protein, 7 aa, Mycobacterium
ATNQDVR

SEQ ID NO: 984685 - protein, 9 aa, Mycobacterium
ATNRKARHD

SEQ ID NO: 984686 - protein, 5 aa, Mycobacterium
ATNRY

SEQ ID NO: 984687 - protein, 12 aa, Mycobacterium
ATNSAGPGSPVA

SEQ ID NO: 984688 - protein, 16 aa, Mycobacterium
ATPDGDYQTYKANDGR

SEQ ID NO: 984689 - protein, 5 aa, Mycobacterium
ATPFG

SEQ ID NO: 984690 - protein, 15 aa, Mycobacterium
ATPGPYELSQSGGEF

SEQ ID NO: 984691 - protein, 9 aa, Mycobacterium
ATPGSGKTT

SEQ ID NO: 984692 - protein, 7 aa, Mycobacterium
ATPPAEL

SEQ ID NO: 984693 - protein, 17 aa, Mycobacterium
ATPPTQRPHRRASPPCR

SEQ ID NO: 984694 - protein, 8 aa, Mycobacterium
ATPPVGPD

SEQ ID NO: 984695 - protein, 18 aa, Mycobacterium
ATPQTAVPDSSSAAAPQL

SEQ ID NO: 984696 - protein, 28 aa, Mycobacterium
ATPVSGGDRKSSEAERSGAPLRKSSEVV

SEQ ID NO: 984697 - protein, 25 aa, Mycobacterium
ATQAASKVGGEASAPGGSNSTDDVV

SEQ ID NO: 984698 - protein, 9 aa, Mycobacterium
ATQDHPDGL

SEQ ID NO: 984699 - protein, 9 aa, Mycobacterium
ATQGHTQSL

SEQ ID NO: 984700 - protein, 9 aa, Mycobacterium
ATQGSGAWP

SEQ ID NO: 984701 - protein, 7 aa, Mycobacterium
ATQHVDQ

SEQ ID NO: 984702 - protein, 7 aa, Mycobacterium
ATQKTDA

SEQ ID NO: 984703 - protein, 5 aa, Mycobacterium
ATQLR

SEQ ID NO: 984704 - protein, 6 aa, Mycobacterium
ATQRNN

SEQ ID NO: 984705 - protein, 15 aa, Mycobacterium
ATQRRKINRLLNMAG

SEQ ID NO: 984706 - protein, 4 aa, Mycobacterium
ATQS

SEQ ID NO: 984707 - protein, 9 aa, Mycobacterium
ATQSVGDET

SEQ ID NO: 984708 - protein, 8 aa, Mycobacterium
ATQTDDQH

SEQ ID NO: 984709 - protein, 7 aa, Mycobacterium
ATRGAEM

SEQ ID NO: 984710 - protein, 24 aa, Mycobacterium
ATRGATTETIPPTRRDRWRRTSGI

SEQ ID NO: 984711 - protein, 20 aa, Mycobacterium
ATRGNGRFSTGEVGERIAAA

SEQ ID NO: 984712 - protein, 16 aa, Mycobacterium
ATRLGLSSTREVLDGL

SEQ ID NO: 984713 - protein, 6 aa, Mycobacterium
ATRPPT

SEQ ID NO: 984714 - protein, 8 aa, Mycobacterium
ATRQEALA

SEQ ID NO: 984715 - protein, 5 aa, Mycobacterium
ATRQH

SEQ ID NO: 984716 - protein, 6 aa, Mycobacterium
ATRQTT

SEQ ID NO: 984717 - protein, 14 aa, Mycobacterium
ATRRRSALDCTLKF

SEQ ID NO: 984718 - protein, 6 aa, Mycobacterium
ATRSGQ

SEQ ID NO: 984719 - protein, 14 aa, Mycobacterium
ATRSSRQDSTGYDR

SEQ ID NO: 984720 - protein, 15 aa, Mycobacterium
ATRVEPSDYEPVSGD

SEQ ID NO: 984721 - protein, 9 aa, Mycobacterium
ATRVEQRTD

SEQ ID NO: 984722 - protein, 18 aa, Mycobacterium
ATSAKGSITEDPGPDLAS

SEQ ID NO: 984723 - protein, 5 aa, Mycobacterium
ATSEA

SEQ ID NO: 984724 - protein, 9 aa, Mycobacterium
ATSGAGGLP

SEQ ID NO: 984725 - protein, 7 aa, Mycobacterium
ATSGDAA

SEQ ID NO: 984726 - protein, 17 aa, Mycobacterium
ATSGGARYAAAKAANAL

SEQ ID NO: 984727 - protein, 10 aa, Mycobacterium
ATSGGATTEP

SEQ ID NO: 984728 - protein, 7 aa, Mycobacterium
ATSITGS

SEQ ID NO: 984729 - protein, 6 aa, Mycobacterium
ATSNRH

SEQ ID NO: 984730 - protein, 12 aa, Mycobacterium
ATSNTSPEQLGE

SEQ ID NO: 984731 - protein, 10 aa, Mycobacterium
ATSPAPGRAN

SEQ ID NO: 984732 - protein, 13 aa, Mycobacterium
ATSPGNPLRTGLP

SEQ ID NO: 984733 - protein, 10 aa, Mycobacterium
ATSPWPTDDA

SEQ ID NO: 984734 - protein, 8 aa, Mycobacterium
ATSREGKA

SEQ ID NO: 984735 - protein, 14 aa, Mycobacterium
ATSSTPDSNGISRR

SEQ ID NO: 984736 - protein, 4 aa, Mycobacterium
ATTA

SEQ ID NO: 984737 - protein, 10 aa, Mycobacterium
ATTAGSRDVP

SEQ ID NO: 984738 - protein, 5 aa, Mycobacterium
ATTAR

SEQ ID NO: 984739 - protein, 5 aa, Mycobacterium
ATTAS

SEQ ID NO: 984740 - protein, 6 aa, Mycobacterium
ATTELS

SEQ ID NO: 984741 - protein, 9 aa, Mycobacterium
ATTPAPARN

SEQ ID NO: 984742 - protein, 25 aa, Mycobacterium
ATTPIERPLPRSLEPQNRMNRAALS

SEQ ID NO: 984743 - protein, 11 aa, Mycobacterium
ATTPKAPVGVR

SEQ ID NO: 984744 - protein, 12 aa, Mycobacterium
ATTREPRPDEMD

SEQ ID NO: 984745 - protein, 12 aa, Mycobacterium
ATTRSGALTGPL

SEQ ID NO: 984746 - protein, 10 aa, Mycobacterium
ATTSKLDEER

SEQ ID NO: 984747 - protein, 10 aa, Mycobacterium
ATTSRPQKAQ

SEQ ID NO: 984748 - protein, 6 aa, Mycobacterium
ATTSTG

SEQ ID NO: 984749 - protein, 21 aa, Mycobacterium
ATTTDHQQNRVSPADTILYIL

SEQ ID NO: 984750 - protein, 7 aa, Mycobacterium
ATTVTDR

SEQ ID NO: 984751 - protein, 22 aa, Mycobacterium
ATVASPGNRSDDTIDLGAVLGP

SEQ ID NO: 984752 - protein, 5 aa, Mycobacterium
ATVEQ

SEQ ID NO: 984753 - protein, 6 aa, Mycobacterium
ATVGEI

SEQ ID NO: 984754 - protein, 14 aa, Mycobacterium
ATVGSPGQGNYSAA

SEQ ID NO: 984755 - protein, 14 aa, Mycobacterium
ATVTGSPRIGPRRE

SEQ ID NO: 984756 - protein, 9 aa, Mycobacterium
ATVTTNAKA

SEQ ID NO: 984757 - protein, 7 aa, Mycobacterium
ATWAADN

SEQ ID NO: 984758 - protein, 4 aa, Mycobacterium
ATYH

SEQ ID NO: 984759 - protein, 8 aa, Mycobacterium
ATYPNPPV

SEQ ID NO: 984760 - protein, 9 aa, Mycobacterium
AVAASEASV

SEQ ID NO: 984761 - protein, 6 aa, Mycobacterium
AVAEDD

SEQ ID NO: 984762 - protein, 6 aa, Mycobacterium
AVAEGA

SEQ ID NO: 984763 - protein, 10 aa, Mycobacterium
AVAGRDADDI

SEQ ID NO: 984764 - protein, 23 aa, Mycobacterium
AVAQTQPSEYAQYSAAATAAGPV

SEQ ID NO: 984765 - protein, 9 aa, Mycobacterium
AVASATANK

SEQ ID NO: 984766 - protein, 5 aa, Mycobacterium
AVATA

SEQ ID NO: 984767 - protein, 9 aa, Mycobacterium
AVATNKQLE

SEQ ID NO: 984768 - protein, 4 aa, Mycobacterium
AVDA

SEQ ID NO: 984769 - protein, 6 aa, Mycobacterium
AVDNDT

SEQ ID NO: 984770 - protein, 6 aa, Mycobacterium
AVDNGH

SEQ ID NO: 984771 - protein, 7 aa, Mycobacterium
AVDPPTM

SEQ ID NO: 984772 - protein, 5 aa, Mycobacterium
AVDRG

SEQ ID NO: 984773 - protein, 8 aa, Mycobacterium
AVDSDQDV

SEQ ID NO: 984774 - protein, 15 aa, Mycobacterium
AVDSNGYDPDSGQLL

SEQ ID NO: 984775 - protein, 6 aa, Mycobacterium
AVEAGE

SEQ ID NO: 984776 - protein, 14 aa, Mycobacterium
AVEAQPAEGAGEQV

SEQ ID NO: 984777 - protein, 9 aa, Mycobacterium
AVEATATAD

SEQ ID NO: 984778 - protein, 7 aa, Mycobacterium
AVEIPNG

SEQ ID NO: 984779 - protein, 13 aa, Mycobacterium
AVEPGQPLDQQER

SEQ ID NO: 984780 - protein, 7 aa, Mycobacterium
AVGAGTA

SEQ ID NO: 984781 - protein, 4 aa, Mycobacterium
AVGG

SEQ ID NO: 984782 - protein, 14 aa, Mycobacterium
AVGGPDDPEFHPPR

SEQ ID NO: 984783 - protein, 11 aa, Mycobacterium
AVGKSQGLTPR

SEQ ID NO: 984784 - protein, 6 aa, Mycobacterium
AVGQRR

SEQ ID NO: 984785 - protein, 16 aa, Mycobacterium
AVGRPTKSTPNDPHRL

SEQ ID NO: 984786 - protein, 16 aa, Mycobacterium
AVGSNTGTVRGSPAPR

SEQ ID NO: 984787 - protein, 6 aa, Mycobacterium
AVGSVA

SEQ ID NO: 984788 - protein, 5 aa, Mycobacterium
AVGTD

SEQ ID NO: 984789 - protein, 19 aa, Mycobacterium
AVHRGGRVHTGHSRKMTAT

SEQ ID NO: 984790 - protein, 8 aa, Mycobacterium
AVKPSYGL

SEQ ID NO: 984791 - protein, 7 aa, Mycobacterium
AVNDPGN

SEQ ID NO: 984792 - protein, 4 aa, Mycobacterium
AVNH

SEQ ID NO: 984793 - protein, 21 aa, Mycobacterium
AVNHDGRSNGLIAPNQDAQAD

SEQ ID NO: 984794 - protein, 14 aa, Mycobacterium
AVPDENRLAAEENV

SEQ ID NO: 984795 - protein, 7 aa, Mycobacterium
AVPDNPV

SEQ ID NO: 984796 - protein, 6 aa, Mycobacterium
AVPELA

SEQ ID NO: 984797 - protein, 7 aa, Mycobacterium
AVPESYT

SEQ ID NO: 984798 - protein, 12 aa, Mycobacterium
AVPPDDPDSYYS

SEQ ID NO: 984799 - protein, 7 aa, Mycobacterium
AVPRGLG

SEQ ID NO: 984800 - protein, 8 aa, Mycobacterium
AVPRVDRG

SEQ ID NO: 984801 - protein, 7 aa, Mycobacterium
AVPSSTY

SEQ ID NO: 984802 - protein, 4 aa, Mycobacterium
AVPT

SEQ ID NO: 984803 - protein, 5 aa, Mycobacterium
AVPTT

SEQ ID NO: 984804 - protein, 5 aa, Mycobacterium
AVPTV

SEQ ID NO: 984805 - protein, 8 aa, Mycobacterium
AVQGPNAV

SEQ ID NO: 984806 - protein, 13 aa, Mycobacterium
AVQKAGNGHPGTA

SEQ ID NO: 984807 - protein, 7 aa, Mycobacterium
AVRGGAA

SEQ ID NO: 984808 - protein, 7 aa, Mycobacterium
AVSATQV

SEQ ID NO: 984809 - protein, 7 aa, Mycobacterium
AVSERAS

SEQ ID NO: 984810 - protein, 15 aa, Mycobacterium
AVSGPLEGVTQPAEE

SEQ ID NO: 984811 - protein, 7 aa, Mycobacterium
AVSGRNY

SEQ ID NO: 984812 - protein, 7 aa, Mycobacterium
AVSGSDH

SEQ ID NO: 984813 - protein, 7 aa, Mycobacterium
AVSGSGP

SEQ ID NO: 984814 - protein, 19 aa, Mycobacterium
AVSIDQKSTNRNPRSTVGT

SEQ ID NO: 984815 - protein, 29 aa, Mycobacterium
AVSPEKAFNTEPAPAHDHGGAVTDYEPGR

SEQ ID NO: 984816 - protein, 14 aa, Mycobacterium
AVSSPRPGTAAGLS

SEQ ID NO: 984817 - protein, 7 aa, Mycobacterium
AVSTPKG

SEQ ID NO: 984818 - protein, 9 aa, Mycobacterium
AVTAAPDGF

SEQ ID NO: 984819 - protein, 26 aa, Mycobacterium
AVTAESPQTRSQPQQGDQPADGRNGQ

SEQ ID NO: 984820 - protein, 4 aa, Mycobacterium
AVTG

SEQ ID NO: 984821 - protein, 5 aa, Mycobacterium
AVTGG

SEQ ID NO: 984822 - protein, 13 aa, Mycobacterium
AVTGRVQNNGQSC

SEQ ID NO: 984823 - protein, 5 aa, Mycobacterium
AVTPA

SEQ ID NO: 984824 - protein, 7 aa, Mycobacterium
AVTSPLA

SEQ ID NO: 984825 - protein, 5 aa, Mycobacterium
AVTVR

SEQ ID NO: 984826 - protein, 7 aa, Mycobacterium
AWAATDS

SEQ ID NO: 984827 - protein, 5 aa, Mycobacterium
AWEEP

SEQ ID NO: 984828 - protein, 8 aa, Mycobacterium
AWGGANGA

SEQ ID NO: 984829 - protein, 23 aa, Mycobacterium
AWKPDQYANPAGPASHYETTGPE

SEQ ID NO: 984830 - protein, 16 aa, Mycobacterium
AWNGAPESAPAALAAR

SEQ ID NO: 984831 - protein, 16 aa, Mycobacterium
AWPAADGLDEVTPPEI

SEQ ID NO: 984832 - protein, 4 aa, Mycobacterium
AWPE

SEQ ID NO: 984833 - protein, 11 aa, Mycobacterium
AWQENGKQSID

SEQ ID NO: 984834 - protein, 6 aa, Mycobacterium
AWQNGK

SEQ ID NO: 984835 - protein, 10 aa, Mycobacterium
AWTQNESEQR

SEQ ID NO: 984836 - protein, 5 aa, Mycobacterium
AWTRG

SEQ ID NO: 984837 - protein, 5 aa, Mycobacterium
AYAEG

SEQ ID NO: 984838 - protein, 15 aa, Mycobacterium
AYAGAADGVGFSEGG

SEQ ID NO: 984839 - protein, 12 aa, Mycobacterium
AYDEEARRGLER

SEQ ID NO: 984840 - protein, 13 aa, Mycobacterium
AYDGSTAGHDDAE

SEQ ID NO: 984841 - protein, 27 aa, Mycobacterium
AYEENKVERLGAEAARPHRVTHRKLTR

SEQ ID NO: 984842 - protein, 8 aa, Mycobacterium
AYEKERVN

SEQ ID NO: 984843 - protein, 11 aa, Mycobacterium
AYGAQGLPDGT

SEQ ID NO: 984844 - protein, 11 aa, Mycobacterium
AYGEDDMATAD

SEQ ID NO: 984845 - protein, 12 aa, Mycobacterium
AYGEPPEGRRDR

SEQ ID NO: 984846 - protein, 7 aa, Mycobacterium
AYGHGAT

SEQ ID NO: 984847 - protein, 7 aa, Mycobacterium
AYGHPSN

SEQ ID NO: 984848 - protein, 17 aa, Mycobacterium
AYGNRSDRLARVKRHNS

SEQ ID NO: 984849 - protein, 7 aa, Mycobacterium
AYGPDTQ

SEQ ID NO: 984850 - protein, 5 aa, Mycobacterium
AYGPE

SEQ ID NO: 984851 - protein, 6 aa, Mycobacterium
AYGQSK

SEQ ID NO: 984852 - protein, 10 aa, Mycobacterium
AYGREGEGCR

SEQ ID NO: 984853 - protein, 9 aa, Mycobacterium
AYGTGPCPG

SEQ ID NO: 984854 - protein, 16 aa, Mycobacterium
AYNDNPLNKPISVDPV

SEQ ID NO: 984855 - protein, 14 aa, Mycobacterium
AYNNANGIDPQPLR

SEQ ID NO: 984856 - protein, 12 aa, Mycobacterium
AYNNASPASGRI

SEQ ID NO: 984857 - protein, 12 aa, Mycobacterium
AYPAQQASYQIP

SEQ ID NO: 984858 - protein, 5 aa, Mycobacterium
AYPAR

SEQ ID NO: 984859 - protein, 7 aa, Mycobacterium
AYPPPDI

SEQ ID NO: 984860 - protein, 14 aa, Mycobacterium
AYPSTLGYKGYPKS

SEQ ID NO: 984861 - protein, 6 aa, Mycobacterium
AYQGRG

SEQ ID NO: 984862 - protein, 6 aa, Mycobacterium
AYQQGL

SEQ ID NO: 984863 - protein, 5 aa, Mycobacterium
AYRQA

SEQ ID NO: 984864 - protein, 8 aa, Mycobacterium
AYSDSYND

SEQ ID NO: 984865 - protein, 5 aa, Mycobacterium
AYTES

SEQ ID NO: 984866 - protein, 6 aa, Mycobacterium
AYTGDI

SEQ ID NO: 984867 - protein, 11 aa, Mycobacterium
AYYTDDHTVPG

SEQ ID NO: 984868 - protein, 7 aa, Mycobacterium
CADEPYR

SEQ ID NO: 984869 - protein, 15 aa, Mycobacterium
CAGPGSSSATLPEPV

SEQ ID NO: 984870 - protein, 6 aa, Mycobacterium
CAGPKK

SEQ ID NO: 984871 - protein, 15 aa, Mycobacterium
CANQRRRELQSSLDQ

SEQ ID NO: 984872 - protein, 14 aa, Mycobacterium
CAPARTPRRRRTVT

SEQ ID NO: 984873 - protein, 11 aa, Mycobacterium
CAPPGNAPTQA

SEQ ID NO: 984874 - protein, 5 aa, Mycobacterium
CAPQS

SEQ ID NO: 984875 - protein, 10 aa, Mycobacterium
CAQGTTATPC

SEQ ID NO: 984876 - protein, 5 aa, Mycobacterium
CARSK

SEQ ID NO: 984877 - protein, 4 aa, Mycobacterium
CASG

SEQ ID NO: 984878 - protein, 7 aa, Mycobacterium
CASGSEA

SEQ ID NO: 984879 - protein, 7 aa, Mycobacterium
CASPRRR

SEQ ID NO: 984880 - protein, 11 aa, Mycobacterium
CATSAGVQGNA

SEQ ID NO: 984881 - protein, 17 aa, Mycobacterium
CCTPPAATYPAIAPKFT

SEQ ID NO: 984882 - protein, 6 aa, Mycobacterium
CDASTL

SEQ ID NO: 984883 - protein, 5 aa, Mycobacterium
CDDAP

SEQ ID NO: 984884 - protein, 6 aa, Mycobacterium
CDGSGV

SEQ ID NO: 984885 - protein, 5 aa, Mycobacterium
CDNRP

SEQ ID NO: 984886 - protein, 7 aa, Mycobacterium
CDNSDDV

SEQ ID NO: 984887 - protein, 5 aa, Mycobacterium
CDPDE

SEQ ID NO: 984888 - protein, 12 aa, Mycobacterium
CDPRTSVPPGSV

SEQ ID NO: 984889 - protein, 15 aa, Mycobacterium
CDQRTADTTSAGVDR

SEQ ID NO: 984890 - protein, 8 aa, Mycobacterium
CDRNATRT

SEQ ID NO: 984891 - protein, 6 aa, Mycobacterium
CDSGPL

SEQ ID NO: 984892 - protein, 8 aa, Mycobacterium
CEARTGAP

SEQ ID NO: 984893 - protein, 11 aa, Mycobacterium
CEGRSADVSRD

SEQ ID NO: 984894 - protein, 6 aa, Mycobacterium
CEPVED

SEQ ID NO: 984895 - protein, 8 aa, Mycobacterium
CEQDGWNA

SEQ ID NO: 984896 - protein, 15 aa, Mycobacterium
CESGGNWSINTGNGY

SEQ ID NO: 984897 - protein, 11 aa, Mycobacterium
CFGRSSPMGYP

SEQ ID NO: 984898 - protein, 6 aa, Mycobacterium
CGAASD

SEQ ID NO: 984899 - protein, 4 aa, Mycobacterium
CGAD

SEQ ID NO: 984900 - protein, 9 aa, Mycobacterium
CGAKAGGQY

SEQ ID NO: 984901 - protein, 20 aa, Mycobacterium
CGATEGPYGFTGTSNSFASG

SEQ ID NO: 984902 - protein, 8 aa, Mycobacterium
CGATGAQD

SEQ ID NO: 984903 - protein, 12 aa, Mycobacterium
CGDGKPETEAVE

SEQ ID NO: 984904 - protein, 9 aa, Mycobacterium
CGDGLTPRA

SEQ ID NO: 984905 - protein, 13 aa, Mycobacterium
CGDLTTNQDGVQE

SEQ ID NO: 984906 - protein, 5 aa, Mycobacterium
CGEAD

SEQ ID NO: 984907 - protein, 15 aa, Mycobacterium
CGELGSTGQSGGSNR

SEQ ID NO: 984908 - protein, 10 aa, Mycobacterium
CGGAGGNIED

SEQ ID NO: 984909 - protein, 14 aa, Mycobacterium
CGGPPIAAATHDQL

SEQ ID NO: 984910 - protein, 10 aa, Mycobacterium
CGGRGEVQTV

SEQ ID NO: 984911 - protein, 8 aa, Mycobacterium
CGGTPLRS

SEQ ID NO: 984912 - protein, 5 aa, Mycobacterium
CGPAG

SEQ ID NO: 984913 - protein, 6 aa, Mycobacterium
CGPEQF

SEQ ID NO: 984914 - protein, 19 aa, Mycobacterium
CGPGEEPKLIDNGDTTYDG

SEQ ID NO: 984915 - protein, 15 aa, Mycobacterium
CGPQRQPDQLLDGSS

SEQ ID NO: 984916 - protein, 4 aa, Mycobacterium
CGRA

SEQ ID NO: 984917 - protein, 17 aa, Mycobacterium
CGSGDDAGQYGPRSSQT

SEQ ID NO: 984918 - protein, 7 aa, Mycobacterium
CGSGTAT

SEQ ID NO: 984919 - protein, 4 aa, Mycobacterium
CGSR

SEQ ID NO: 984920 - protein, 10 aa, Mycobacterium
CGTKTTDPRL

SEQ ID NO: 984921 - protein, 4 aa, Mycobacterium
CGTQ

SEQ ID NO: 984922 - protein, 6 aa, Mycobacterium
CHEPDR

SEQ ID NO: 984923 - protein, 13 aa, Mycobacterium
CHGGGNTTAYPEG

SEQ ID NO: 984924 - protein, 11 aa, Mycobacterium
CKGGAARMSAE

SEQ ID NO: 984925 - protein, 16 aa, Mycobacterium
CKGIPDGVRQKVDRGQ

SEQ ID NO: 984926 - protein, 12 aa, Mycobacterium
CKQAHPNKYVLH

SEQ ID NO: 984927 - protein, 24 aa, Mycobacterium
CLPDRSGQKSPVDQCRPPGSDDCC

SEQ ID NO: 984928 - protein, 7 aa, Mycobacterium
CNASRAA

SEQ ID NO: 984929 - protein, 11 aa, Mycobacterium
CNDGTVPRGER

SEQ ID NO: 984930 - protein, 8 aa, Mycobacterium
CNVPPERL

SEQ ID NO: 984931 - protein, 10 aa, Mycobacterium
CPAPATTDSD

SEQ ID NO: 984932 - protein, 4 aa, Mycobacterium
CPED

SEQ ID NO: 984933 - protein, 7 aa, Mycobacterium
CPEPPAR

SEQ ID NO: 984934 - protein, 13 aa, Mycobacterium
CPGEDWTRVAGVV

SEQ ID NO: 984935 - protein, 5 aa, Mycobacterium
CPNCT

SEQ ID NO: 984936 - protein, 6 aa, Mycobacterium
CPPETT

SEQ ID NO: 984937 - protein, 6 aa, Mycobacterium
CPTGGI

SEQ ID NO: 984938 - protein, 5 aa, Mycobacterium
CQAER

SEQ ID NO: 984939 - protein, 10 aa, Mycobacterium
CQPGNAGPAV

SEQ ID NO: 984940 - protein, 9 aa, Mycobacterium
CQPPKTVSP

SEQ ID NO: 984941 - protein, 16 aa, Mycobacterium
CQSDPALAKGLSTHNG

SEQ ID NO: 984942 - protein, 5 aa, Mycobacterium
CQTER

SEQ ID NO: 984943 - protein, 9 aa, Mycobacterium
CRAGERNKL

SEQ ID NO: 984944 - protein, 7 aa, Mycobacterium
CRGEPGY

SEQ ID NO: 984945 - protein, 19 aa, Mycobacterium
CRGSTGPSSLARDGKPWGS

SEQ ID NO: 984946 - protein, 14 aa, Mycobacterium
CRHTPGAGNKTAAN

SEQ ID NO: 984947 - protein, 6 aa, Mycobacterium
CRPNGR

SEQ ID NO: 984948 - protein, 8 aa, Mycobacterium
CRPQSGTD

SEQ ID NO: 984949 - protein, 8 aa, Mycobacterium
CRPRKSLG

SEQ ID NO: 984950 - protein, 9 aa, Mycobacterium
CRSDKLNGL

SEQ ID NO: 984951 - protein, 6 aa, Mycobacterium
CRSGRF

SEQ ID NO: 984952 - protein, 4 aa, Mycobacterium
CRTR

SEQ ID NO: 984953 - protein, 5 aa, Mycobacterium
CSAPV

SEQ ID NO: 984954 - protein, 7 aa, Mycobacterium
CSDTARS

SEQ ID NO: 984955 - protein, 12 aa, Mycobacterium
CSENQNDAPNAA

SEQ ID NO: 984956 - protein, 10 aa, Mycobacterium
CSGAARVAAG

SEQ ID NO: 984957 - protein, 6 aa, Mycobacterium
CSGDPV

SEQ ID NO: 984958 - protein, 6 aa, Mycobacterium
CSGQSR

SEQ ID NO: 984959 - protein, 20 aa, Mycobacterium
CSGQTPMPATEQGKGLSLDV

SEQ ID NO: 984960 - protein, 19 aa, Mycobacterium
CSKSGAPYRCTCGVAMMPV

SEQ ID NO: 984961 - protein, 6 aa, Mycobacterium
CSPDSF

SEQ ID NO: 984962 - protein, 5 aa, Mycobacterium
CSSGT

SEQ ID NO: 984963 - protein, 6 aa, Mycobacterium
CSTGPW

SEQ ID NO: 984964 - protein, 4 aa, Mycobacterium
CSTN

SEQ ID NO: 984965 - protein, 6 aa, Mycobacterium
CTATGY

SEQ ID NO: 984966 - protein, 13 aa, Mycobacterium
CTGTGYSKQQSTR

SEQ ID NO: 984967 - protein, 4 aa, Mycobacterium
CTLR

SEQ ID NO: 984968 - protein, 16 aa, Mycobacterium
CTNPGSGEIDLGVLFY

SEQ ID NO: 984969 - protein, 5 aa, Mycobacterium
CTPST

SEQ ID NO: 984970 - protein, 13 aa, Mycobacterium
CTSEEPAQFGCRH

SEQ ID NO: 984971 - protein, 10 aa, Mycobacterium
CTSGDVGDVT

SEQ ID NO: 984972 - protein, 20 aa, Mycobacterium
CTSTRSASAKPIKLPQPATC

SEQ ID NO: 984973 - protein, 18 aa, Mycobacterium
CTTRNQRRAARLQDSYDR

SEQ ID NO: 984974 - protein, 16 aa, Mycobacterium
DAAAARREYLDETGGR

SEQ ID NO: 984975 - protein, 8 aa, Mycobacterium
DAAALNAT

SEQ ID NO: 984976 - protein, 10 aa, Mycobacterium
DAAANEEIEG

SEQ ID NO: 984977 - protein, 5 aa, Mycobacterium
DAAAR

SEQ ID NO: 984978 - protein, 7 aa, Mycobacterium
DAAEAIS

SEQ ID NO: 984979 - protein, 17 aa, Mycobacterium
DAAGDYMDSDHMYLNTE

SEQ ID NO: 984980 - protein, 18 aa, Mycobacterium
DAAGLAEGRYGAGKNNSG

SEQ ID NO: 984981 - protein, 9 aa, Mycobacterium
DAAGPGVSS

SEQ ID NO: 984982 - protein, 7 aa, Mycobacterium
DAAHPDA

SEQ ID NO: 984983 - protein, 4 aa, Mycobacterium
DAAK

SEQ ID NO: 984984 - protein, 5 aa, Mycobacterium
DAAPD

SEQ ID NO: 984985 - protein, 7 aa, Mycobacterium
DAAPGDI

SEQ ID NO: 984986 - protein, 6 aa, Mycobacterium
DAARRA

SEQ ID NO: 984987 - protein, 7 aa, Mycobacterium
DAARSLG

SEQ ID NO: 984988 - protein, 6 aa, Mycobacterium
DAATAR

SEQ ID NO: 984989 - protein, 8 aa, Mycobacterium
DAATGALP

SEQ ID NO: 984990 - protein, 5 aa, Mycobacterium
DAATT

SEQ ID NO: 984991 - protein, 4 aa, Mycobacterium
DACG

SEQ ID NO: 984992 - protein, 6 aa, Mycobacterium
DADEET

SEQ ID NO: 984993 - protein, 6 aa, Mycobacterium
DADGKF

SEQ ID NO: 984994 - protein, 13 aa, Mycobacterium
DADGSVDTAAATR

SEQ ID NO: 984995 - protein, 7 aa, Mycobacterium
DADHYKA

SEQ ID NO: 984996 - protein, 5 aa, Mycobacterium
DADIP

SEQ ID NO: 984997 - protein, 8 aa, Mycobacterium
DADPLSQQ

SEQ ID NO: 984998 - protein, 4 aa, Mycobacterium
DADQ

SEQ ID NO: 984999 - protein, 5 aa, Mycobacterium
DADTE

SEQ ID NO: 985000 - protein, 27 aa, Mycobacterium
DADVDRPGSGLRDPGTLGGDRDVWVFT

SEQ ID NO: 985001 - protein, 23 aa, Mycobacterium
DAEAEGYKLPGRRSASALSCLSS

SEQ ID NO: 985002 - protein, 22 aa, Mycobacterium
DAEGEYATADAVGQKLGAPVEP

SEQ ID NO: 985003 - protein, 9 aa, Mycobacterium
DAEKNTEEM

SEQ ID NO: 985004 - protein, 17 aa, Mycobacterium
DAENERTYGEFSTREGE

SEQ ID NO: 985005 - protein, 5 aa, Mycobacterium
DAENR

SEQ ID NO: 985006 - protein, 5 aa, Mycobacterium
DAERL

SEQ ID NO: 985007 - protein, 11 aa, Mycobacterium
DAESATAAPWQ

SEQ ID NO: 985008 - protein, 7 aa, Mycobacterium
DAESDEV

SEQ ID NO: 985009 - protein, 7 aa, Mycobacterium
DAESDHH

SEQ ID NO: 985010 - protein, 8 aa, Mycobacterium
DAESPAAL

SEQ ID NO: 985011 - protein, 6 aa, Mycobacterium
DAGAGL

SEQ ID NO: 985012 - protein, 5 aa, Mycobacterium
DAGEP

SEQ ID NO: 985013 - protein, 11 aa, Mycobacterium
DAGEYQETSLR

SEQ ID NO: 985014 - protein, 28 aa, Mycobacterium
DAGGADNDAGGCSTREPTASTGACGTSS

SEQ ID NO: 985015 - protein, 17 aa, Mycobacterium
DAGGDADHLDEARQQTY

SEQ ID NO: 985016 - protein, 6 aa, Mycobacterium
DAGGQV

SEQ ID NO: 985017 - protein, 7 aa, Mycobacterium
DAGGYKA

SEQ ID NO: 985018 - protein, 7 aa, Mycobacterium
DAGPQAG

SEQ ID NO: 985019 - protein, 4 aa, Mycobacterium
DAGR

SEQ ID NO: 985020 - protein, 14 aa, Mycobacterium
DAGRATAARAGDAI

SEQ ID NO: 985021 - protein, 14 aa, Mycobacterium
DAGRRNPAVTAQAA

SEQ ID NO: 985022 - protein, 4 aa, Mycobacterium
DAGV

SEQ ID NO: 985023 - protein, 5 aa, Mycobacterium
DAGVG

SEQ ID NO: 985024 - protein, 13 aa, Mycobacterium
DAGVTSLSAELGR

SEQ ID NO: 985025 - protein, 5 aa, Mycobacterium
DAHGR

SEQ ID NO: 985026 - protein, 12 aa, Mycobacterium
DAHRKAHECDPL

SEQ ID NO: 985027 - protein, 9 aa, Mycobacterium
DAHTTPSQH

SEQ ID NO: 985028 - protein, 13 aa, Mycobacterium
DAIPGELDDAQDV

SEQ ID NO: 985029 - protein, 13 aa, Mycobacterium
DAIPGGNVKRGDV

SEQ ID NO: 985030 - protein, 13 aa, Mycobacterium
DAIPTQVTPATYD

SEQ ID NO: 985031 - protein, 9 aa, Mycobacterium
DAIRDGAGE

SEQ ID NO: 985032 - protein, 10 aa, Mycobacterium
DAIRKSGFDG

SEQ ID NO: 985033 - protein, 12 aa, Mycobacterium
DAISDSLGAARI

SEQ ID NO: 985034 - protein, 9 aa, Mycobacterium
DAKETKELG

SEQ ID NO: 985035 - protein, 23 aa, Mycobacterium
DAKQQTKEYKCNSRPDRADTTGS

SEQ ID NO: 985036 - protein, 16 aa, Mycobacterium
DALDRTRNSLPDNGNL

SEQ ID NO: 985037 - protein, 6 aa, Mycobacterium
DALDTR

SEQ ID NO: 985038 - protein, 17 aa, Mycobacterium
DALGDEDNKDENHNGAN

SEQ ID NO: 985039 - protein, 6 aa, Mycobacterium
DALRDG

SEQ ID NO: 985040 - protein, 8 aa, Mycobacterium
DANGGWSV

SEQ ID NO: 985041 - protein, 6 aa, Mycobacterium
DANLPG

SEQ ID NO: 985042 - protein, 12 aa, Mycobacterium
DANNDGVASPDN

SEQ ID NO: 985043 - protein, 5 aa, Mycobacterium
DANRA

SEQ ID NO: 985044 - protein, 28 aa, Mycobacterium
DANTDTEPPRRSWPRPTGSDRTTRRCPA

SEQ ID NO: 985045 - protein, 12 aa, Mycobacterium
DAPAQAGAESVV

SEQ ID NO: 985046 - protein, 4 aa, Mycobacterium
DAPQ

SEQ ID NO: 985047 - protein, 4 aa, Mycobacterium
DAPR

SEQ ID NO: 985048 - protein, 10 aa, Mycobacterium
DAQAQAGALP

SEQ ID NO: 985049 - protein, 5 aa, Mycobacterium
DAQPC

SEQ ID NO: 985050 - protein, 14 aa, Mycobacterium
DAQPRYSAARRDAV

SEQ ID NO: 985051 - protein, 5 aa, Mycobacterium
DAQRL

SEQ ID NO: 985052 - protein, 13 aa, Mycobacterium
DAQRQATKEAGQI

SEQ ID NO: 985053 - protein, 5 aa, Mycobacterium
DAQTG

SEQ ID NO: 985054 - protein, 6 aa, Mycobacterium
DAQTPT

SEQ ID NO: 985055 - protein, 29 aa, Mycobacterium
DAQTRSEVQSRQAQEKADALQAEAERKHS

SEQ ID NO: 985056 - protein, 19 aa, Mycobacterium
DARDTKLGAEEITRDIPNV

SEQ ID NO: 985057 - protein, 7 aa, Mycobacterium
DAREESI

SEQ ID NO: 985058 - protein, 7 aa, Mycobacterium
DARHGGS

SEQ ID NO: 985059 - protein, 7 aa, Mycobacterium
DARHPPV

SEQ ID NO: 985060 - protein, 5 aa, Mycobacterium
DARRL

SEQ ID NO: 985061 - protein, 8 aa, Mycobacterium
DARSGDGV

SEQ ID NO: 985062 - protein, 9 aa, Mycobacterium
DASARAEGY

SEQ ID NO: 985063 - protein, 4 aa, Mycobacterium
DASD

SEQ ID NO: 985064 - protein, 7 aa, Mycobacterium
DASGNPY

SEQ ID NO: 985065 - protein, 9 aa, Mycobacterium
DASKQVTKL

SEQ ID NO: 985066 - protein, 7 aa, Mycobacterium
DASLDDA

SEQ ID NO: 985067 - protein, 17 aa, Mycobacterium
DASLNQATSDADGYRRR

SEQ ID NO: 985068 - protein, 11 aa, Mycobacterium
DASPHDVSQGP

SEQ ID NO: 985069 - protein, 10 aa, Mycobacterium
DASPSQREIR

SEQ ID NO: 985070 - protein, 8 aa, Mycobacterium
DASQAVSG

SEQ ID NO: 985071 - protein, 7 aa, Mycobacterium
DASRSSI

SEQ ID NO: 985072 - protein, 11 aa, Mycobacterium
DASWARKTAAV

SEQ ID NO: 985073 - protein, 5 aa, Mycobacterium
DATAT

SEQ ID NO: 985074 - protein, 6 aa, Mycobacterium
DATDAA

SEQ ID NO: 985075 - protein, 11 aa, Mycobacterium
DATGDKATMPS

SEQ ID NO: 985076 - protein, 8 aa, Mycobacterium
DATLSPAA

SEQ ID NO: 985077 - protein, 4 aa, Mycobacterium
DATP

SEQ ID NO: 985078 - protein, 7 aa, Mycobacterium
DATSERI

SEQ ID NO: 985079 - protein, 7 aa, Mycobacterium
DATTAVA

SEQ ID NO: 985080 - protein, 7 aa, Mycobacterium
DATTSVT

SEQ ID NO: 985081 - protein, 12 aa, Mycobacterium
DAVGRLGTGRRY

SEQ ID NO: 985082 - protein, 6 aa, Mycobacterium
DAVNYG

SEQ ID NO: 985083 - protein, 22 aa, Mycobacterium
DAVPPSEDFGRQPPQDLAAEQS

SEQ ID NO: 985084 - protein, 5 aa, Mycobacterium
DAVRD

SEQ ID NO: 985085 - protein, 7 aa, Mycobacterium
DAVRDGN

SEQ ID NO: 985086 - protein, 7 aa, Mycobacterium
DAVTTAA

SEQ ID NO: 985087 - protein, 10 aa, Mycobacterium
DAYNGAGGHN

SEQ ID NO: 985088 - protein, 7 aa, Mycobacterium
DAYPQLA

SEQ ID NO: 985089 - protein, 11 aa, Mycobacterium
DAYSGTGNAHS

SEQ ID NO: 985090 - protein, 9 aa, Mycobacterium
DCETATGAA

SEQ ID NO: 985091 - protein, 15 aa, Mycobacterium
DCGAEAESVPCSKRQ

SEQ ID NO: 985092 - protein, 4 aa, Mycobacterium
DCGS

SEQ ID NO: 985093 - protein, 19 aa, Mycobacterium
DCGTDTDENYGEPLTGEYQ

SEQ ID NO: 985094 - protein, 8 aa, Mycobacterium
DCRQTARR

SEQ ID NO: 985095 - protein, 11 aa, Mycobacterium
DCRSTDPRSSE

SEQ ID NO: 985096 - protein, 8 aa, Mycobacterium
DCSVTRSS

SEQ ID NO: 985097 - protein, 12 aa, Mycobacterium
DCVAGSSGADVS

SEQ ID NO: 985098 - protein, 11 aa, Mycobacterium
DDAARAGPIGV

SEQ ID NO: 985099 - protein, 9 aa, Mycobacterium
DDADRTRLD

SEQ ID NO: 985100 - protein, 10 aa, Mycobacterium
DDADTRAAVT

SEQ ID NO: 985101 - protein, 10 aa, Mycobacterium
DDAGKAAAMR

SEQ ID NO: 985102 - protein, 14 aa, Mycobacterium
DDAHEREQRDRYAR

SEQ ID NO: 985103 - protein, 8 aa, Mycobacterium
DDAPTGTR

SEQ ID NO: 985104 - protein, 9 aa, Mycobacterium
DDCDTVDPW

SEQ ID NO: 985105 - protein, 4 aa, Mycobacterium
DDCT

SEQ ID NO: 985106 - protein, 4 aa, Mycobacterium
DDDA

SEQ ID NO: 985107 - protein, 8 aa, Mycobacterium
DDDGLETE

SEQ ID NO: 985108 - protein, 8 aa, Mycobacterium
DDDNPTQV

SEQ ID NO: 985109 - protein, 26 aa, Mycobacterium
DDDPAALQQYADNGVATVSAATATQQ

SEQ ID NO: 985110 - protein, 4 aa, Mycobacterium
DDDR

SEQ ID NO: 985111 - protein, 4 aa, Mycobacterium
DDDY

SEQ ID NO: 985112 - protein, 6 aa, Mycobacterium
DDEAAG

SEQ ID NO: 985113 - protein, 6 aa, Mycobacterium
DDEDGR

SEQ ID NO: 985114 - protein, 13 aa, Mycobacterium
DDEGDGDASIYAR

SEQ ID NO: 985115 - protein, 6 aa, Mycobacterium
DDEMSQ

SEQ ID NO: 985116 - protein, 6 aa, Mycobacterium
DDENRF

SEQ ID NO: 985117 - protein, 5 aa, Mycobacterium
DDERR

SEQ ID NO: 985118 - protein, 8 aa, Mycobacterium
DDESGDAE

SEQ ID NO: 985119 - protein, 4 aa, Mycobacterium
DDET

SEQ ID NO: 985120 - protein, 4 aa, Mycobacterium
DDEV

SEQ ID NO: 985121 - protein, 8 aa, Mycobacterium
DDEVAQHP

SEQ ID NO: 985122 - protein, 6 aa, Mycobacterium
DDEWED

SEQ ID NO: 985123 - protein, 16 aa, Mycobacterium
DDGDSSDLLGLSAESA

SEQ ID NO: 985124 - protein, 4 aa, Mycobacterium
DDGE

SEQ ID NO: 985125 - protein, 8 aa, Mycobacterium
DDGHLTNS

SEQ ID NO: 985126 - protein, 7 aa, Mycobacterium
DDGMHGS

SEQ ID NO: 985127 - protein, 7 aa, Mycobacterium
DDGPAHV

SEQ ID NO: 985128 - protein, 6 aa, Mycobacterium
DDGQID

SEQ ID NO: 985129 - protein, 9 aa, Mycobacterium
DDGQPRTLD

SEQ ID NO: 985130 - protein, 5 aa, Mycobacterium
DDGRF

SEQ ID NO: 985131 - protein, 8 aa, Mycobacterium
DDGTRRTY

SEQ ID NO: 985132 - protein, 11 aa, Mycobacterium
DDHDERGHPRE

SEQ ID NO: 985133 - protein, 8 aa, Mycobacterium
DDHPTHYN

SEQ ID NO: 985134 - protein, 7 aa, Mycobacterium
DDHSPTF

SEQ ID NO: 985135 - protein, 8 aa, Mycobacterium
DDIERTGA

SEQ ID NO: 985136 - protein, 10 aa, Mycobacterium
DDIKAGKAGL

SEQ ID NO: 985137 - protein, 4 aa, Mycobacterium
DDIP

SEQ ID NO: 985138 - protein, 15 aa, Mycobacterium
DDKFSNSNQARQHSV

SEQ ID NO: 985139 - protein, 6 aa, Mycobacterium
DDKQLD

SEQ ID NO: 985140 - protein, 6 aa, Mycobacterium
DDKSYP

SEQ ID NO: 985141 - protein, 10 aa, Mycobacterium
DDKYDGSQNI

SEQ ID NO: 985142 - protein, 14 aa, Mycobacterium
DDLADGPDAVDRDQ

SEQ ID NO: 985143 - protein, 8 aa, Mycobacterium
DDLAGAEE

SEQ ID NO: 985144 - protein, 7 aa, Mycobacterium
DDLEDDD

SEQ ID NO: 985145 - protein, 8 aa, Mycobacterium
DDLEEPDQ

SEQ ID NO: 985146 - protein, 8 aa, Mycobacterium
DDLKPGDL

SEQ ID NO: 985147 - protein, 4 aa, Mycobacterium
DDLP

SEQ ID NO: 985148 - protein, 22 aa, Mycobacterium
DDLPGSQVSARRGGNPNPAPST

SEQ ID NO: 985149 - protein, 4 aa, Mycobacterium
DDLS

SEQ ID NO: 985150 - protein, 5 aa, Mycobacterium
DDLTG

SEQ ID NO: 985151 - protein, 12 aa, Mycobacterium
DDNPRGEDPAAI

SEQ ID NO: 985152 - protein, 6 aa, Mycobacterium
DDPDWA

SEQ ID NO: 985153 - protein, 13 aa, Mycobacterium
DDPGAAALARRTA

SEQ ID NO: 985154 - protein, 5 aa, Mycobacterium
DDPLG

SEQ ID NO: 985155 - protein, 17 aa, Mycobacterium
DDPQPGWYDTESGELVD

SEQ ID NO: 985156 - protein, 6 aa, Mycobacterium
DDPSLA

SEQ ID NO: 985157 - protein, 5 aa, Mycobacterium
DDQAE

SEQ ID NO: 985158 - protein, 4 aa, Mycobacterium
DDQI

SEQ ID NO: 985159 - protein, 8 aa, Mycobacterium
DDQPTGNC

SEQ ID NO: 985160 - protein, 7 aa, Mycobacterium
DDQSEGM

SEQ ID NO: 985161 - protein, 8 aa, Mycobacterium
DDQSERMA

SEQ ID NO: 985162 - protein, 4 aa, Mycobacterium
DDRD

SEQ ID NO: 985163 - protein, 9 aa, Mycobacterium
DDRKTTARR

SEQ ID NO: 985164 - protein, 5 aa, Mycobacterium
DDRRL

SEQ ID NO: 985165 - protein, 9 aa, Mycobacterium
DDRTEFNTR

SEQ ID NO: 985166 - protein, 8 aa, Mycobacterium
DDSAAEVE

SEQ ID NO: 985167 - protein, 32 aa, Mycobacterium
DDSATVPAAPADAGAAQEFGSGTAPADAATAS

SEQ ID NO: 985168 - protein, 18 aa, Mycobacterium
DDSDSALDYARRNAEGTA

SEQ ID NO: 985169 - protein, 5 aa, Mycobacterium
DDSGA

SEQ ID NO: 985170 - protein, 6 aa, Mycobacterium
DDSGNF

SEQ ID NO: 985171 - protein, 9 aa, Mycobacterium
DDSNSKVNK

SEQ ID NO: 985172 - protein, 10 aa, Mycobacterium
DDSPNPGAAV

SEQ ID NO: 985173 - protein, 6 aa, Mycobacterium
DDSRAA

SEQ ID NO: 985174 - protein, 14 aa, Mycobacterium
DDSSRKVAALCGFP

SEQ ID NO: 985175 - protein, 10 aa, Mycobacterium
DDSTSPTNLC

SEQ ID NO: 985176 - protein, 8 aa, Mycobacterium
DDSTSVPT

SEQ ID NO: 985177 - protein, 9 aa, Mycobacterium
DDTDEGPDA

SEQ ID NO: 985178 - protein, 5 aa, Mycobacterium
DDTFR

SEQ ID NO: 985179 - protein, 31 aa, Mycobacterium
DDTNQRGGERSSENLGHDDDAGDGKGNKRGV

SEQ ID NO: 985180 - protein, 4 aa, Mycobacterium
DDTT

SEQ ID NO: 985181 - protein, 4 aa, Mycobacterium
DDVA

SEQ ID NO: 985182 - protein, 8 aa, Mycobacterium
DDVDAGAR

SEQ ID NO: 985183 - protein, 37 aa, Mycobacterium
DDVDQEDFDTDEEDDLDDDEELDDEEDLGDDDEELDL

SEQ ID NO: 985184 - protein, 8 aa, Mycobacterium
DDVDSVEV

SEQ ID NO: 985185 - protein, 4 aa, Mycobacterium
DDVP

SEQ ID NO: 985186 - protein, 7 aa, Mycobacterium
DDVPEDV

SEQ ID NO: 985187 - protein, 8 aa, Mycobacterium
DDVQPGDV

SEQ ID NO: 985188 - protein, 7 aa, Mycobacterium
DDVRGVE

SEQ ID NO: 985189 - protein, 15 aa, Mycobacterium
DDYRDSEGVDTRNYG

SEQ ID NO: 985190 - protein, 4 aa, Mycobacterium
DEAA

SEQ ID NO: 985191 - protein, 11 aa, Mycobacterium
DEAAATRAEEF

SEQ ID NO: 985192 - protein, 12 aa, Mycobacterium
DEAANKAAELAR

SEQ ID NO: 985193 - protein, 5 aa, Mycobacterium
DEADR

SEQ ID NO: 985194 - protein, 6 aa, Mycobacterium
DEAEAV

SEQ ID NO: 985195 - protein, 23 aa, Mycobacterium
DEAGLAETSRGDGGHGSSGGHAS

SEQ ID NO: 985196 - protein, 7 aa, Mycobacterium
DEAGSVG

SEQ ID NO: 985197 - protein, 6 aa, Mycobacterium
DEANKP

SEQ ID NO: 985198 - protein, 13 aa, Mycobacterium
DEAPEAGATFEDN

SEQ ID NO: 985199 - protein, 5 aa, Mycobacterium
DEASD

SEQ ID NO: 985200 - protein, 8 aa, Mycobacterium
DEATGPGD

SEQ ID NO: 985201 - protein, 8 aa, Mycobacterium
DEATTDEH

SEQ ID NO: 985202 - protein, 4 aa, Mycobacterium
DEAW

SEQ ID NO: 985203 - protein, 21 aa, Mycobacterium
DEDCTNAGRGPPDPPPARARV

SEQ ID NO: 985204 - protein, 7 aa, Mycobacterium
DEDFPKR

SEQ ID NO: 985205 - protein, 9 aa, Mycobacterium
DEDGQTIES

SEQ ID NO: 985206 - protein, 6 aa, Mycobacterium
DEDIER

SEQ ID NO: 985207 - protein, 8 aa, Mycobacterium
DEDRENEG

SEQ ID NO: 985208 - protein, 11 aa, Mycobacterium
DEDTDDDIRAS

SEQ ID NO: 985209 - protein, 7 aa, Mycobacterium
DEDTDEV

SEQ ID NO: 985210 - protein, 9 aa, Mycobacterium
DEDTRRRAE

SEQ ID NO: 985211 - protein, 4 aa, Mycobacterium
DEEA

SEQ ID NO: 985212 - protein, 4 aa, Mycobacterium
DEEE

SEQ ID NO: 985213 - protein, 5 aa, Mycobacterium
DEEER

SEQ ID NO: 985214 - protein, 10 aa, Mycobacterium
DEEKLDKESV

SEQ ID NO: 985215 - protein, 4 aa, Mycobacterium
DEEQ

SEQ ID NO: 985216 - protein, 5 aa, Mycobacterium
DEERD

SEQ ID NO: 985217 - protein, 17 aa, Mycobacterium
DEETDKRVRISKRNGKD

SEQ ID NO: 985218 - protein, 7 aa, Mycobacterium
DEETHEA

SEQ ID NO: 985219 - protein, 22 aa, Mycobacterium
DEGFSIGPKEKKLGIKGSPTTE

SEQ ID NO: 985220 - protein, 13 aa, Mycobacterium
DEGLSAGSGLLRH

SEQ ID NO: 985221 - protein, 7 aa, Mycobacterium
DEGPRTK

SEQ ID NO: 985222 - protein, 10 aa, Mycobacterium
DEHCAPPKPV

SEQ ID NO: 985223 - protein, 6 aa, Mycobacterium
DEHGRP

SEQ ID NO: 985224 - protein, 6 aa, Mycobacterium
DEHGWY

SEQ ID NO: 985225 - protein, 6 aa, Mycobacterium
DEHPGA

SEQ ID NO: 985226 - protein, 5 aa, Mycobacterium
DEHRR

SEQ ID NO: 985227 - protein, 14 aa, Mycobacterium
DEHVDDGTGSDTPK

SEQ ID NO: 985228 - protein, 7 aa, Mycobacterium
DEIEPFS

SEQ ID NO: 985229 - protein, 4 aa, Mycobacterium
DEIS

SEQ ID NO: 985230 - protein, 8 aa, Mycobacterium
DEKPLIPD

SEQ ID NO: 985231 - protein, 6 aa, Mycobacterium
DEKWGA

SEQ ID NO: 985232 - protein, 5 aa, Mycobacterium
DELPA

SEQ ID NO: 985233 - protein, 5 aa, Mycobacterium
DELTA

SEQ ID NO: 985234 - protein, 11 aa, Mycobacterium
DEMRKSNAQHN

SEQ ID NO: 985235 - protein, 16 aa, Mycobacterium
DENDEEVGGAVREDEV

SEQ ID NO: 985236 - protein, 13 aa, Mycobacterium
DENETVTARTRAA

SEQ ID NO: 985237 - protein, 9 aa, Mycobacterium
DENNPTVRS

SEQ ID NO: 985238 - protein, 4 aa, Mycobacterium
DENR

SEQ ID NO: 985239 - protein, 8 aa, Mycobacterium
DENSAAAR

SEQ ID NO: 985240 - protein, 18 aa, Mycobacterium
DEPEAAHTAEAQDVDDVS

SEQ ID NO: 985241 - protein, 8 aa, Mycobacterium
DEPSPRVD

SEQ ID NO: 985242 - protein, 26 aa, Mycobacterium
DEPTRFTESTPYNPSSPYSATKAAGD

SEQ ID NO: 985243 - protein, 5 aa, Mycobacterium
DEPTV

SEQ ID NO: 985244 - protein, 7 aa, Mycobacterium
DEQGGSV

SEQ ID NO: 985245 - protein, 11 aa, Mycobacterium
DEQGQARTVEK

SEQ ID NO: 985246 - protein, 4 aa, Mycobacterium
DEQI

SEQ ID NO: 985247 - protein, 4 aa, Mycobacterium
DEQL

SEQ ID NO: 985248 - protein, 4 aa, Mycobacterium
DEQR

SEQ ID NO: 985249 - protein, 6 aa, Mycobacterium
DEQRQS

SEQ ID NO: 985250 - protein, 9 aa, Mycobacterium
DEQSAADVN

SEQ ID NO: 985251 - protein, 10 aa, Mycobacterium
DEQVQASTEV

SEQ ID NO: 985252 - protein, 5 aa, Mycobacterium
DERAE

SEQ ID NO: 985253 - protein, 8 aa, Mycobacterium
DERASQQT

SEQ ID NO: 985254 - protein, 4 aa, Mycobacterium
DERE

SEQ ID NO: 985255 - protein, 5 aa, Mycobacterium
DERGL

SEQ ID NO: 985256 - protein, 11 aa, Mycobacterium
DERLRSGTSLA

SEQ ID NO: 985257 - protein, 5 aa, Mycobacterium
DERLT

SEQ ID NO: 985258 - protein, 8 aa, Mycobacterium
DESATLPG

SEQ ID NO: 985259 - protein, 5 aa, Mycobacterium
DESEA

SEQ ID NO: 985260 - protein, 7 aa, Mycobacterium
DESFSDE

SEQ ID NO: 985261 - protein, 10 aa, Mycobacterium
DESGDQLTEE

SEQ ID NO: 985262 - protein, 8 aa, Mycobacterium
DESGETDL

SEQ ID NO: 985263 - protein, 14 aa, Mycobacterium
DESGGPVPYDGETV

SEQ ID NO: 985264 - protein, 12 aa, Mycobacterium
DESGPCAESGMS

SEQ ID NO: 985265 - protein, 9 aa, Mycobacterium
DESGTTDNF

SEQ ID NO: 985266 - protein, 11 aa, Mycobacterium
DESIRKADDPL

SEQ ID NO: 985267 - protein, 6 aa, Mycobacterium
DESSPN

SEQ ID NO: 985268 - protein, 12 aa, Mycobacterium
DESSTQRSRSAA

SEQ ID NO: 985269 - protein, 8 aa, Mycobacterium
DESTGRGI

SEQ ID NO: 985270 - protein, 4 aa, Mycobacterium
DETA

SEQ ID NO: 985271 - protein, 19 aa, Mycobacterium
DETEPGGRNSDESANPAAH

SEQ ID NO: 985272 - protein, 6 aa, Mycobacterium
DETGCK

SEQ ID NO: 985273 - protein, 5 aa, Mycobacterium
DETGS

SEQ ID NO: 985274 - protein, 26 aa, Mycobacterium
DETSPLGPSPMGHRTGDEHAAAVEHH

SEQ ID NO: 985275 - protein, 16 aa, Mycobacterium
DETTIVEGAGDTDAIA

SEQ ID NO: 985276 - protein, 6 aa, Mycobacterium
DEVAGR

SEQ ID NO: 985277 - protein, 6 aa, Mycobacterium
DEVDKQ

SEQ ID NO: 985278 - protein, 5 aa, Mycobacterium
DEVGA

SEQ ID NO: 985279 - protein, 9 aa, Mycobacterium
DEVSRRDGS

SEQ ID NO: 985280 - protein, 21 aa, Mycobacterium
DEYSIDSKAAAKELDADAGPV

SEQ ID NO: 985281 - protein, 18 aa, Mycobacterium
DEYTGKCTEMPDSPEESV

SEQ ID NO: 985282 - protein, 4 aa, Mycobacterium
DEYV

SEQ ID NO: 985283 - protein, 4 aa, Mycobacterium
DFAG

SEQ ID NO: 985284 - protein, 23 aa, Mycobacterium
DFASPTVSAPLEDGQTANPAQTA

SEQ ID NO: 985285 - protein, 5 aa, Mycobacterium
DFDER

SEQ ID NO: 985286 - protein, 10 aa, Mycobacterium
DFESASPALQ

SEQ ID NO: 985287 - protein, 4 aa, Mycobacterium
DFGG

SEQ ID NO: 985288 - protein, 25 aa, Mycobacterium
DFGSGANRVAPRPYEPTDETGPLGV

SEQ ID NO: 985289 - protein, 6 aa, Mycobacterium
DFGSYA

SEQ ID NO: 985290 - protein, 4 aa, Mycobacterium
DFGY

SEQ ID NO: 985291 - protein, 11 aa, Mycobacterium
DFIPPAPRYTT

SEQ ID NO: 985292 - protein, 13 aa, Mycobacterium
DFLGPGDPVPGRL

SEQ ID NO: 985293 - protein, 4 aa, Mycobacterium
DFNR

SEQ ID NO: 985294 - protein, 6 aa, Mycobacterium
DFPDDR

SEQ ID NO: 985295 - protein, 19 aa, Mycobacterium
DFPQLPPAPDDYPTFPDKS

SEQ ID NO: 985296 - protein, 10 aa, Mycobacterium
DFPRGGPERR

SEQ ID NO: 985297 - protein, 5 aa, Mycobacterium
DFSDN

SEQ ID NO: 985298 - protein, 11 aa, Mycobacterium
DFSGEGTRLRD

SEQ ID NO: 985299 - protein, 6 aa, Mycobacterium
DGAAKR

SEQ ID NO: 985300 - protein, 7 aa, Mycobacterium
DGAEHSR

SEQ ID NO: 985301 - protein, 8 aa, Mycobacterium
DGAGARIQ

SEQ ID NO: 985302 - protein, 9 aa, Mycobacterium
DGAGDAGFE

SEQ ID NO: 985303 - protein, 8 aa, Mycobacterium
DGAHSADD

SEQ ID NO: 985304 - protein, 6 aa, Mycobacterium
DGAKQH

SEQ ID NO: 985305 - protein, 9 aa, Mycobacterium
DGAKSDGKL

SEQ ID NO: 985306 - protein, 6 aa, Mycobacterium
DGANNM

SEQ ID NO: 985307 - protein, 7 aa, Mycobacterium
DGAPGLD

SEQ ID NO: 985308 - protein, 6 aa, Mycobacterium
DGARQR

SEQ ID NO: 985309 - protein, 8 aa, Mycobacterium
DGASPVVG

SEQ ID NO: 985310 - protein, 12 aa, Mycobacterium
DGATSGPKTGRV

SEQ ID NO: 985311 - protein, 10 aa, Mycobacterium
DGCAGHSDGD

SEQ ID NO: 985312 - protein, 9 aa, Mycobacterium
DGDARGGAA

SEQ ID NO: 985313 - protein, 14 aa, Mycobacterium
DGDCGSAPATPVDA

SEQ ID NO: 985314 - protein, 6 aa, Mycobacterium
DGDCPP

SEQ ID NO: 985315 - protein, 6 aa, Mycobacterium
DGDHGY

SEQ ID NO: 985316 - protein, 15 aa, Mycobacterium
DGDIEEGVTSEASSL

SEQ ID NO: 985317 - protein, 4 aa, Mycobacterium
DGDM

SEQ ID NO: 985318 - protein, 14 aa, Mycobacterium
DGDRVNEKAPKDRD

SEQ ID NO: 985319 - protein, 15 aa, Mycobacterium
DGELGKDGAVATSSA

SEQ ID NO: 985320 - protein, 7 aa, Mycobacterium
DGEQRAA

SEQ ID NO: 985321 - protein, 4 aa, Mycobacterium
DGER

SEQ ID NO: 985322 - protein, 8 aa, Mycobacterium
DGERNGLD

SEQ ID NO: 985323 - protein, 7 aa, Mycobacterium
DGEYAAA

SEQ ID NO: 985324 - protein, 4 aa, Mycobacterium
DGGA

SEQ ID NO: 985325 - protein, 18 aa, Mycobacterium
DGGATADGRTGAMAGPGD

SEQ ID NO: 985326 - protein, 5 aa, Mycobacterium
DGGDA

SEQ ID NO: 985327 - protein, 9 aa, Mycobacterium
DGGDGQEKE

SEQ ID NO: 985328 - protein, 18 aa, Mycobacterium
DGGDPLRPATPGLRSPQV

SEQ ID NO: 985329 - protein, 11 aa, Mycobacterium
DGGGSNDAVAK

SEQ ID NO: 985330 - protein, 6 aa, Mycobacterium
DGGGTL

SEQ ID NO: 985331 - protein, 4 aa, Mycobacterium
DGGM

SEQ ID NO: 985332 - protein, 4 aa, Mycobacterium
DGGN

SEQ ID NO: 985333 - protein, 6 aa, Mycobacterium
DGGNSR

SEQ ID NO: 985334 - protein, 6 aa, Mycobacterium
DGGPSM

SEQ ID NO: 985335 - protein, 6 aa, Mycobacterium
DGGRGY

SEQ ID NO: 985336 - protein, 5 aa, Mycobacterium
DGGVA

SEQ ID NO: 985337 - protein, 4 aa, Mycobacterium
DGHT

SEQ ID NO: 985338 - protein, 6 aa, Mycobacterium
DGIGGV

SEQ ID NO: 985339 - protein, 7 aa, Mycobacterium
DGIPQDT

SEQ ID NO: 985340 - protein, 5 aa, Mycobacterium
DGISA

SEQ ID NO: 985341 - protein, 6 aa, Mycobacterium
DGITKK

SEQ ID NO: 985342 - protein, 16 aa, Mycobacterium
DGKEAEQRAASSVKDK

SEQ ID NO: 985343 - protein, 7 aa, Mycobacterium
DGKRPLV

SEQ ID NO: 985344 - protein, 23 aa, Mycobacterium
DGKRPQTGVNGPVGKGPRGDDAW

SEQ ID NO: 985345 - protein, 9 aa, Mycobacterium
DGLAADTAN

SEQ ID NO: 985346 - protein, 5 aa, Mycobacterium
DGLAE

SEQ ID NO: 985347 - protein, 8 aa, Mycobacterium
DGLAPELR

SEQ ID NO: 985348 - protein, 13 aa, Mycobacterium
DGLASRSANTPYE

SEQ ID NO: 985349 - protein, 9 aa, Mycobacterium
DGLDSAGYA

SEQ ID NO: 985350 - protein, 6 aa, Mycobacterium
DGLEQP

SEQ ID NO: 985351 - protein, 4 aa, Mycobacterium
DGLG

SEQ ID NO: 985352 - protein, 4 aa, Mycobacterium
DGLP

SEQ ID NO: 985353 - protein, 4 aa, Mycobacterium
DGLT

SEQ ID NO: 985354 - protein, 16 aa, Mycobacterium
DGMGDARSATVAKQIA

SEQ ID NO: 985355 - protein, 5 aa, Mycobacterium
DGNER

SEQ ID NO: 985356 - protein, 8 aa, Mycobacterium
DGNLSPNL

SEQ ID NO: 985357 - protein, 4 aa, Mycobacterium
DGNP

SEQ ID NO: 985358 - protein, 7 aa, Mycobacterium
DGPAYDT

SEQ ID NO: 985359 - protein, 10 aa, Mycobacterium
DGPCTENGEM

SEQ ID NO: 985360 - protein, 6 aa, Mycobacterium
DGPDRT

SEQ ID NO: 985361 - protein, 5 aa, Mycobacterium
DGPEL

SEQ ID NO: 985362 - protein, 15 aa, Mycobacterium
DGPEVSTLIAEHRLK

SEQ ID NO: 985363 - protein, 9 aa, Mycobacterium
DGPGLGGRT

SEQ ID NO: 985364 - protein, 12 aa, Mycobacterium
DGPGNMDGPKKA

SEQ ID NO: 985365 - protein, 6 aa, Mycobacterium
DGPGTV

SEQ ID NO: 985366 - protein, 4 aa, Mycobacterium
DGPI

SEQ ID NO: 985367 - protein, 7 aa, Mycobacterium
DGPRDAQ

SEQ ID NO: 985368 - protein, 11 aa, Mycobacterium
DGPRPDTSANV

SEQ ID NO: 985369 - protein, 7 aa, Mycobacterium
DGPTLPE

SEQ ID NO: 985370 - protein, 8 aa, Mycobacterium
DGPVGGEV

SEQ ID NO: 985371 - protein, 9 aa, Mycobacterium
DGPVRGNGK

SEQ ID NO: 985372 - protein, 14 aa, Mycobacterium
DGPVTAAPATTDTG

SEQ ID NO: 985373 - protein, 8 aa, Mycobacterium
DGQARPAA

SEQ ID NO: 985374 - protein, 4 aa, Mycobacterium
DGQF

SEQ ID NO: 985375 - protein, 13 aa, Mycobacterium
DGQQRYRTSGVPK

SEQ ID NO: 985376 - protein, 16 aa, Mycobacterium
DGRAPVLRSGAKNGSM

SEQ ID NO: 985377 - protein, 8 aa, Mycobacterium
DGRGGRAT

SEQ ID NO: 985378 - protein, 8 aa, Mycobacterium
DGRGLPQG

SEQ ID NO: 985379 - protein, 11 aa, Mycobacterium
DGRGPGTPPAT

SEQ ID NO: 985380 - protein, 9 aa, Mycobacterium
DGRHRSSHR

SEQ ID NO: 985381 - protein, 8 aa, Mycobacterium
DGRKGGLI

SEQ ID NO: 985382 - protein, 5 aa, Mycobacterium
DGRLP

SEQ ID NO: 985383 - protein, 11 aa, Mycobacterium
DGRNPPAKGSR

SEQ ID NO: 985384 - protein, 4 aa, Mycobacterium
DGRP

SEQ ID NO: 985385 - protein, 6 aa, Mycobacterium
DGRRKS

SEQ ID NO: 985386 - protein, 22 aa, Mycobacterium
DGRRQQGVGNDIGPNPPGEGAE

SEQ ID NO: 985387 - protein, 7 aa, Mycobacterium
DGRRTAT

SEQ ID NO: 985388 - protein, 6 aa, Mycobacterium
DGRSGC

SEQ ID NO: 985389 - protein, 16 aa, Mycobacterium
DGRVGEVAKAAAAAGI

SEQ ID NO: 985390 - protein, 5 aa, Mycobacterium
DGRVQ

SEQ ID NO: 985391 - protein, 8 aa, Mycobacterium
DGRVTTHP

SEQ ID NO: 985392 - protein, 7 aa, Mycobacterium
DGRYGPY

SEQ ID NO: 985393 - protein, 5 aa, Mycobacterium
DGRYS

SEQ ID NO: 985394 - protein, 10 aa, Mycobacterium
DGSADGTGEI

SEQ ID NO: 985395 - protein, 5 aa, Mycobacterium
DGSAL

SEQ ID NO: 985396 - protein, 5 aa, Mycobacterium
DGSAM

SEQ ID NO: 985397 - protein, 8 aa, Mycobacterium
DGSAVANG

SEQ ID NO: 985398 - protein, 8 aa, Mycobacterium
DGSDEEWQ

SEQ ID NO: 985399 - protein, 9 aa, Mycobacterium
DGSDGGDGY

SEQ ID NO: 985400 - protein, 6 aa, Mycobacterium
DGSDSI

SEQ ID NO: 985401 - protein, 10 aa, Mycobacterium
DGSDSSLRAV

SEQ ID NO: 985402 - protein, 8 aa, Mycobacterium
DGSEPTEP

SEQ ID NO: 985403 - protein, 13 aa, Mycobacterium
DGSGPRGQANRTV

SEQ ID NO: 985404 - protein, 16 aa, Mycobacterium
DGSGQSKVAAEWNNQV

SEQ ID NO: 985405 - protein, 10 aa, Mycobacterium
DGSGRTYQLR

SEQ ID NO: 985406 - protein, 5 aa, Mycobacterium
DGSHE

SEQ ID NO: 985407 - protein, 8 aa, Mycobacterium
DGSPASEL

SEQ ID NO: 985408 - protein, 5 aa, Mycobacterium
DGSSI

SEQ ID NO: 985409 - protein, 6 aa, Mycobacterium
DGSSIE

SEQ ID NO: 985410 - protein, 8 aa, Mycobacterium
DGSTSPSA

SEQ ID NO: 985411 - protein, 8 aa, Mycobacterium
DGSVSMPG

SEQ ID NO: 985412 - protein, 8 aa, Mycobacterium
DGSYGVPE

SEQ ID NO: 985413 - protein, 11 aa, Mycobacterium
DGTAKQRTTIG

SEQ ID NO: 985414 - protein, 7 aa, Mycobacterium
DGTALGL

SEQ ID NO: 985415 - protein, 17 aa, Mycobacterium
DGTEDYWSDEYRDLIEL

SEQ ID NO: 985416 - protein, 5 aa, Mycobacterium
DGTEL

SEQ ID NO: 985417 - protein, 13 aa, Mycobacterium
DGTEVATSPLATE

SEQ ID NO: 985418 - protein, 5 aa, Mycobacterium
DGTGQ

SEQ ID NO: 985419 - protein, 5 aa, Mycobacterium
DGTKN

SEQ ID NO: 985420 - protein, 4 aa, Mycobacterium
DGTL

SEQ ID NO: 985421 - protein, 9 aa, Mycobacterium
DGTLGGPVA

SEQ ID NO: 985422 - protein, 4 aa, Mycobacterium
DGTQ

SEQ ID NO: 985423 - protein, 13 aa, Mycobacterium
DGTREFSTAGRTD

SEQ ID NO: 985424 - protein, 14 aa, Mycobacterium
DGTRLRPDPETYAG

SEQ ID NO: 985425 - protein, 7 aa, Mycobacterium
DGTTGAV

SEQ ID NO: 985426 - protein, 4 aa, Mycobacterium
DGTV

SEQ ID NO: 985427 - protein, 9 aa, Mycobacterium
DGTVAASAV

SEQ ID NO: 985428 - protein, 7 aa, Mycobacterium
DGVNSAL

SEQ ID NO: 985429 - protein, 6 aa, Mycobacterium
DGVNTE

SEQ ID NO: 985430 - protein, 10 aa, Mycobacterium
DGVPVTTPTR

SEQ ID NO: 985431 - protein, 15 aa, Mycobacterium
DGVRSTRFANPTPKG

SEQ ID NO: 985432 - protein, 17 aa, Mycobacterium
DGVTALDDRGAGLDHPS

SEQ ID NO: 985433 - protein, 5 aa, Mycobacterium
DGWNP

SEQ ID NO: 985434 - protein, 5 aa, Mycobacterium
DGWNR

SEQ ID NO: 985435 - protein, 10 aa, Mycobacterium
DGWTESSGAT

SEQ ID NO: 985436 - protein, 8 aa, Mycobacterium
DGYPGEPD

SEQ ID NO: 985437 - protein, 6 aa, Mycobacterium
DGYPTD

SEQ ID NO: 985438 - protein, 15 aa, Mycobacterium
DGYTSPGRAKETAQD

SEQ ID NO: 985439 - protein, 9 aa, Mycobacterium
DGYVRGEGA

SEQ ID NO: 985440 - protein, 7 aa, Mycobacterium
DGYYQTG

SEQ ID NO: 985441 - protein, 6 aa, Mycobacterium
DHAAAG

SEQ ID NO: 985442 - protein, 9 aa, Mycobacterium
DHAEHARRN

SEQ ID NO: 985443 - protein, 8 aa, Mycobacterium
DHAPEAGR

SEQ ID NO: 985444 - protein, 8 aa, Mycobacterium
DHAPHADH

SEQ ID NO: 985445 - protein, 7 aa, Mycobacterium
DHASTDG

SEQ ID NO: 985446 - protein, 7 aa, Mycobacterium
DHDTSGL

SEQ ID NO: 985447 - protein, 13 aa, Mycobacterium
DHFSDRSALPTYN

SEQ ID NO: 985448 - protein, 8 aa, Mycobacterium
DHGDPAGA

SEQ ID NO: 985449 - protein, 25 aa, Mycobacterium
DHGNRTHSHCGRSSLTHTDGTGASR

SEQ ID NO: 985450 - protein, 8 aa, Mycobacterium
DHIGDSRT

SEQ ID NO: 985451 - protein, 7 aa, Mycobacterium
DHLRSGG

SEQ ID NO: 985452 - protein, 9 aa, Mycobacterium
DHNPIHTDR

SEQ ID NO: 985453 - protein, 9 aa, Mycobacterium
DHPGAPPVG

SEQ ID NO: 985454 - protein, 6 aa, Mycobacterium
DHPGFP

SEQ ID NO: 985455 - protein, 6 aa, Mycobacterium
DHPPHE

SEQ ID NO: 985456 - protein, 19 aa, Mycobacterium
DHPSGTAGLHGKSTWNRTI

SEQ ID NO: 985457 - protein, 7 aa, Mycobacterium
DHPVGAG

SEQ ID NO: 985458 - protein, 22 aa, Mycobacterium
DHQDNQGTQQTDYVCSGPPEAL

SEQ ID NO: 985459 - protein, 17 aa, Mycobacterium
DHRNEDRYNQDPRCQAA

SEQ ID NO: 985460 - protein, 12 aa, Mycobacterium
DHRSDGAADPGD

SEQ ID NO: 985461 - protein, 8 aa, Mycobacterium
DHSDTDTV

SEQ ID NO: 985462 - protein, 19 aa, Mycobacterium
DHSGPVPDLSSSALSELTA

SEQ ID NO: 985463 - protein, 6 aa, Mycobacterium
DHTDGT

SEQ ID NO: 985464 - protein, 6 aa, Mycobacterium
DHTGPS

SEQ ID NO: 985465 - protein, 5 aa, Mycobacterium
DHTGV

SEQ ID NO: 985466 - protein, 30 aa, Mycobacterium
DHTKTKPKINNTPANATTPGLVNRMVLTGR

SEQ ID NO: 985467 - protein, 8 aa, Mycobacterium
DIAGGAND

SEQ ID NO: 985468 - protein, 4 aa, Mycobacterium
DIDE

SEQ ID NO: 985469 - protein, 8 aa, Mycobacterium
DIDESHEI

SEQ ID NO: 985470 - protein, 16 aa, Mycobacterium
DIDNDGSAVASEQILP

SEQ ID NO: 985471 - protein, 8 aa, Mycobacterium
DIDPEETA

SEQ ID NO: 985472 - protein, 10 aa, Mycobacterium
DIEGRDEFRG

SEQ ID NO: 985473 - protein, 41 aa, Mycobacterium
DIEPGETEDGEATAATKTDEASTDDDEEIVEPTEKDKASGD

SEQ ID NO: 985474 - protein, 6 aa, Mycobacterium
DIEPGS

SEQ ID NO: 985475 - protein, 12 aa, Mycobacterium
DIGDGVDGDKIG

SEQ ID NO: 985476 - protein, 6 aa, Mycobacterium
DIGERL

SEQ ID NO: 985477 - protein, 13 aa, Mycobacterium
DIGGTWRDNSYPG

SEQ ID NO: 985478 - protein, 9 aa, Mycobacterium
DIGQPASVR

SEQ ID NO: 985479 - protein, 5 aa, Mycobacterium
DIPDT

SEQ ID NO: 985480 - protein, 5 aa, Mycobacterium
DIPGE

SEQ ID NO: 985481 - protein, 7 aa, Mycobacterium
DIPKTET

SEQ ID NO: 985482 - protein, 19 aa, Mycobacterium
DIRDSRSRLYPGIAAHHGL

SEQ ID NO: 985483 - protein, 5 aa, Mycobacterium
DIRGR

SEQ ID NO: 985484 - protein, 11 aa, Mycobacterium
DIRSPGVGAQE

SEQ ID NO: 985485 - protein, 9 aa, Mycobacterium
DISAKGGSM

SEQ ID NO: 985486 - protein, 9 aa, Mycobacterium
DISEPGTAD

SEQ ID NO: 985487 - protein, 8 aa, Mycobacterium
DISSGELR

SEQ ID NO: 985488 - protein, 9 aa, Mycobacterium
DISSTGEQI

SEQ ID NO: 985489 - protein, 7 aa, Mycobacterium
DITGSLD

SEQ ID NO: 985490 - protein, 4 aa, Mycobacterium
DITP

SEQ ID NO: 985491 - protein, 5 aa, Mycobacterium
DITTR

SEQ ID NO: 985492 - protein, 6 aa, Mycobacterium
DIYDAS

SEQ ID NO: 985493 - protein, 5 aa, Mycobacterium
DIYGD

SEQ ID NO: 985494 - protein, 9 aa, Mycobacterium
DKCSYTKSR

SEQ ID NO: 985495 - protein, 6 aa, Mycobacterium
DKDAEV

SEQ ID NO: 985496 - protein, 15 aa, Mycobacterium
DKDEYPAAAAIERRC

SEQ ID NO: 985497 - protein, 8 aa, Mycobacterium
DKEADNAG

SEQ ID NO: 985498 - protein, 5 aa, Mycobacterium
DKEGA

SEQ ID NO: 985499 - protein, 7 aa, Mycobacterium
DKFTRSG

SEQ ID NO: 985500 - protein, 7 aa, Mycobacterium
DKGEREQ

SEQ ID NO: 985501 - protein, 8 aa, Mycobacterium
DKGKSFNS

SEQ ID NO: 985502 - protein, 15 aa, Mycobacterium
DKGSVGEQQFGPLEA

SEQ ID NO: 985503 - protein, 8 aa, Mycobacterium
DKGTATFS

SEQ ID NO: 985504 - protein, 8 aa, Mycobacterium
DKGYGGRT

SEQ ID NO: 985505 - protein, 7 aa, Mycobacterium
DKHGTAY

SEQ ID NO: 985506 - protein, 14 aa, Mycobacterium
DKKAFTGAAADQVD

SEQ ID NO: 985507 - protein, 7 aa, Mycobacterium
DKLPNVG

SEQ ID NO: 985508 - protein, 9 aa, Mycobacterium
DKLSHYSDR

SEQ ID NO: 985509 - protein, 6 aa, Mycobacterium
DKNELR

SEQ ID NO: 985510 - protein, 5 aa, Mycobacterium
DKPAV

SEQ ID NO: 985511 - protein, 6 aa, Mycobacterium
DKPGVA

SEQ ID NO: 985512 - protein, 6 aa, Mycobacterium
DKPGVL

SEQ ID NO: 985513 - protein, 12 aa, Mycobacterium
DKPIYGPSRNPH

SEQ ID NO: 985514 - protein, 5 aa, Mycobacterium
DKPKQ

SEQ ID NO: 985515 - protein, 4 aa, Mycobacterium
DKPV

SEQ ID NO: 985516 - protein, 7 aa, Mycobacterium
DKQGIPY

SEQ ID NO: 985517 - protein, 5 aa, Mycobacterium
DKQTV

SEQ ID NO: 985518 - protein, 8 aa, Mycobacterium
DKRPQVQA

SEQ ID NO: 985519 - protein, 4 aa, Mycobacterium
DKRT

SEQ ID NO: 985520 - protein, 14 aa, Mycobacterium
DKSTAVKIHGYCVA

SEQ ID NO: 985521 - protein, 10 aa, Mycobacterium
DKTTAAAAPL

SEQ ID NO: 985522 - protein, 8 aa, Mycobacterium
DKVATSPV

SEQ ID NO: 985523 - protein, 5 aa, Mycobacterium
DKVAV

SEQ ID NO: 985524 - protein, 6 aa, Mycobacterium
DKVETV

SEQ ID NO: 985525 - protein, 7 aa, Mycobacterium
DKYTQGV

SEQ ID NO: 985526 - protein, 18 aa, Mycobacterium
DLAEQVKAAETTQAETAA

SEQ ID NO: 985527 - protein, 12 aa, Mycobacterium
DLASGTSSRSSK

SEQ ID NO: 985528 - protein, 6 aa, Mycobacterium
DLATAA

SEQ ID NO: 985529 - protein, 11 aa, Mycobacterium
DLATDGKLAGA

SEQ ID NO: 985530 - protein, 8 aa, Mycobacterium
DLATEPTA

SEQ ID NO: 985531 - protein, 10 aa, Mycobacterium
DLDAQSPAAD

SEQ ID NO: 985532 - protein, 13 aa, Mycobacterium
DLDATSKAQLERG

SEQ ID NO: 985533 - protein, 13 aa, Mycobacterium
DLDEEAAAAAERA

SEQ ID NO: 985534 - protein, 10 aa, Mycobacterium
DLDPRTVDTS

SEQ ID NO: 985535 - protein, 7 aa, Mycobacterium
DLDRNPV

SEQ ID NO: 985536 - protein, 8 aa, Mycobacterium
DLDSREAI

SEQ ID NO: 985537 - protein, 8 aa, Mycobacterium
DLDTPKAI

SEQ ID NO: 985538 - protein, 9 aa, Mycobacterium
DLEPVAPSR

SEQ ID NO: 985539 - protein, 5 aa, Mycobacterium
DLGEA

SEQ ID NO: 985540 - protein, 5 aa, Mycobacterium
DLGEE

SEQ ID NO: 985541 - protein, 6 aa, Mycobacterium
DLGGDR

SEQ ID NO: 985542 - protein, 11 aa, Mycobacterium
DLGGNPEKVNP

SEQ ID NO: 985543 - protein, 9 aa, Mycobacterium
DLGNTPQRV

SEQ ID NO: 985544 - protein, 4 aa, Mycobacterium
DLKG

SEQ ID NO: 985545 - protein, 9 aa, Mycobacterium
DLKGGVNER

SEQ ID NO: 985546 - protein, 19 aa, Mycobacterium
DLNGPAENFHRGADDNKSG

SEQ ID NO: 985547 - protein, 6 aa, Mycobacterium
DLNGTR

SEQ ID NO: 985548 - protein, 5 aa, Mycobacterium
DLPAA

SEQ ID NO: 985549 - protein, 11 aa, Mycobacterium
DLPAEAEELRT

SEQ ID NO: 985550 - protein, 7 aa, Mycobacterium
DLPEPKM

SEQ ID NO: 985551 - protein, 4 aa, Mycobacterium
DLPG

SEQ ID NO: 985552 - protein, 11 aa, Mycobacterium
DLPGGARSGLR

SEQ ID NO: 985553 - protein, 12 aa, Mycobacterium
DLPGSSRSSLPE

SEQ ID NO: 985554 - protein, 9 aa, Mycobacterium
DLQEDKEPV

SEQ ID NO: 985555 - protein, 13 aa, Mycobacterium
DLQGIGSSVCAAQ

SEQ ID NO: 985556 - protein, 34 aa, Mycobacterium
DLRGVARSKVTSLSGVRGRDQSYRTRYSMWSQPT

SEQ ID NO: 985557 - protein, 16 aa, Mycobacterium
DLRSARPRCDPDVRPT

SEQ ID NO: 985558 - protein, 5 aa, Mycobacterium
DLRTR

SEQ ID NO: 985559 - protein, 7 aa, Mycobacterium
DLSGDAF

SEQ ID NO: 985560 - protein, 4 aa, Mycobacterium
DLSR

SEQ ID NO: 985561 - protein, 6 aa, Mycobacterium
DLTARQ

SEQ ID NO: 985562 - protein, 8 aa, Mycobacterium
DLTDAESA

SEQ ID NO: 985563 - protein, 14 aa, Mycobacterium
DLTDTVDETPTPLP

SEQ ID NO: 985564 - protein, 4 aa, Mycobacterium
DLTE

SEQ ID NO: 985565 - protein, 5 aa, Mycobacterium
DLTPG

SEQ ID NO: 985566 - protein, 8 aa, Mycobacterium
DLTPQQPT

SEQ ID NO: 985567 - protein, 14 aa, Mycobacterium
DLTQPHSDHPGETE

SEQ ID NO: 985568 - protein, 5 aa, Mycobacterium
DLTTP

SEQ ID NO: 985569 - protein, 4 aa, Mycobacterium
DLVD

SEQ ID NO: 985570 - protein, 6 aa, Mycobacterium
DMGAPM

SEQ ID NO: 985571 - protein, 5 aa, Mycobacterium
DMKSG

SEQ ID NO: 985572 - protein, 6 aa, Mycobacterium
DNADAK

SEQ ID NO: 985573 - protein, 12 aa, Mycobacterium
DNADDAPETRSE

SEQ ID NO: 985574 - protein, 23 aa, Mycobacterium
DNADKTLAAAHATAAEIAANPPL

SEQ ID NO: 985575 - protein, 4 aa, Mycobacterium
DNAE

SEQ ID NO: 985576 - protein, 8 aa, Mycobacterium
DNAEAAGF

SEQ ID NO: 985577 - protein, 7 aa, Mycobacterium
DNATSNI

SEQ ID NO: 985578 - protein, 4 aa, Mycobacterium
DNDE

SEQ ID NO: 985579 - protein, 6 aa, Mycobacterium
DNEDID

SEQ ID NO: 985580 - protein, 17 aa, Mycobacterium
DNEDQNDLIGTSRANAA

SEQ ID NO: 985581 - protein, 7 aa, Mycobacterium
DNEHDEA

SEQ ID NO: 985582 - protein, 9 aa, Mycobacterium
DNERGRNAP

SEQ ID NO: 985583 - protein, 41 aa, Mycobacterium
DNFGNIPPERYSQVNGTPGPDATTISTGDAGKRVACGVIGA

SEQ ID NO: 985584 - protein, 6 aa, Mycobacterium
DNGDVD

SEQ ID NO: 985585 - protein, 17 aa, Mycobacterium
DNGGSAIGEFEVAILNI

SEQ ID NO: 985586 - protein, 4 aa, Mycobacterium
DNGP

SEQ ID NO: 985587 - protein, 7 aa, Mycobacterium
DNGPETY

SEQ ID NO: 985588 - protein, 8 aa, Mycobacterium
DNGSPRAL

SEQ ID NO: 985589 - protein, 11 aa, Mycobacterium
DNGSTDGTPQV

SEQ ID NO: 985590 - protein, 11 aa, Mycobacterium
DNGVNGGVGAA

SEQ ID NO: 985591 - protein, 6 aa, Mycobacterium
DNHTGS

SEQ ID NO: 985592 - protein, 15 aa, Mycobacterium
DNKPIDLGHDPGSVP

SEQ ID NO: 985593 - protein, 6 aa, Mycobacterium
DNLPSY

SEQ ID NO: 985594 - protein, 7 aa, Mycobacterium
DNLRKGA

SEQ ID NO: 985595 - protein, 8 aa, Mycobacterium
DNLRPNSH

SEQ ID NO: 985596 - protein, 4 aa, Mycobacterium
DNML

SEQ ID NO: 985597 - protein, 12 aa, Mycobacterium
DNNAALSQTNTD

SEQ ID NO: 985598 - protein, 9 aa, Mycobacterium
DNNGNGARV

SEQ ID NO: 985599 - protein, 7 aa, Mycobacterium
DNNNPEV

SEQ ID NO: 985600 - protein, 6 aa, Mycobacterium
DNPALA

SEQ ID NO: 985601 - protein, 9 aa, Mycobacterium
DNPEAQESV

SEQ ID NO: 985602 - protein, 7 aa, Mycobacterium
DNPIEKM

SEQ ID NO: 985603 - protein, 27 aa, Mycobacterium
DNPLNSLGHSDTSWSTEEFAPREKTVA

SEQ ID NO: 985604 - protein, 6 aa, Mycobacterium
DNPPAF

SEQ ID NO: 985605 - protein, 6 aa, Mycobacterium
DNPSAV

SEQ ID NO: 985606 - protein, 7 aa, Mycobacterium
DNPTLTA

SEQ ID NO: 985607 - protein, 8 aa, Mycobacterium
DNPTNITA

SEQ ID NO: 985608 - protein, 4 aa, Mycobacterium
DNPY

SEQ ID NO: 985609 - protein, 9 aa, Mycobacterium
DNRDSGGSN

SEQ ID NO: 985610 - protein, 18 aa, Mycobacterium
DNRKSPSRKAGELDNRGS

SEQ ID NO: 985611 - protein, 9 aa, Mycobacterium
DNRNRAAGE

SEQ ID NO: 985612 - protein, 8 aa, Mycobacterium
DNRPDLTE

SEQ ID NO: 985613 - protein, 4 aa, Mycobacterium
DNRR

SEQ ID NO: 985614 - protein, 6 aa, Mycobacterium
DNRRRH

SEQ ID NO: 985615 - protein, 9 aa, Mycobacterium
DNSVSATTG

SEQ ID NO: 985616 - protein, 6 aa, Mycobacterium
DNTRLS

SEQ ID NO: 985617 - protein, 9 aa, Mycobacterium
DNVKTKDLA

SEQ ID NO: 985618 - protein, 7 aa, Mycobacterium
DNWSTDV

SEQ ID NO: 985619 - protein, 6 aa, Mycobacterium
DPADAA

SEQ ID NO: 985620 - protein, 13 aa, Mycobacterium
DPADEVNGRPHGM

SEQ ID NO: 985621 - protein, 6 aa, Mycobacterium
DPADLT

SEQ ID NO: 985622 - protein, 4 aa, Mycobacterium
DPAE

SEQ ID NO: 985623 - protein, 11 aa, Mycobacterium
DPAEIGKNRHA

SEQ ID NO: 985624 - protein, 5 aa, Mycobacterium
DPAGG

SEQ ID NO: 985625 - protein, 6 aa, Mycobacterium
DPAGIP

SEQ ID NO: 985626 - protein, 6 aa, Mycobacterium
DPAGVQ

SEQ ID NO: 985627 - protein, 5 aa, Mycobacterium
DPAIT

SEQ ID NO: 985628 - protein, 7 aa, Mycobacterium
DPANRRR

SEQ ID NO: 985629 - protein, 32 aa, Mycobacterium
DPANSTPMVGRKSESGGRRSKRSKKNRSDETA

SEQ ID NO: 985630 - protein, 4 aa, Mycobacterium
DPAR

SEQ ID NO: 985631 - protein, 9 aa, Mycobacterium
DPARQQDEL

SEQ ID NO: 985632 - protein, 5 aa, Mycobacterium
DPART

SEQ ID NO: 985633 - protein, 8 aa, Mycobacterium
DPASHVDS

SEQ ID NO: 985634 - protein, 7 aa, Mycobacterium
DPASQEG

SEQ ID NO: 985635 - protein, 8 aa, Mycobacterium
DPASVEAK

SEQ ID NO: 985636 - protein, 18 aa, Mycobacterium
DPATAGVAADEGTASNAT

SEQ ID NO: 985637 - protein, 13 aa, Mycobacterium
DPATPSDTDPDVL

SEQ ID NO: 985638 - protein, 12 aa, Mycobacterium
DPATVSKPLQPE

SEQ ID NO: 985639 - protein, 4 aa, Mycobacterium
DPAV

SEQ ID NO: 985640 - protein, 9 aa, Mycobacterium
DPDAAQQRA

SEQ ID NO: 985641 - protein, 6 aa, Mycobacterium
DPDADR

SEQ ID NO: 985642 - protein, 11 aa, Mycobacterium
DPDAEPGASPF

SEQ ID NO: 985643 - protein, 7 aa, Mycobacterium
DPDAPTL

SEQ ID NO: 985644 - protein, 8 aa, Mycobacterium
DPDASLGA

SEQ ID NO: 985645 - protein, 7 aa, Mycobacterium
DPDEAVA

SEQ ID NO: 985646 - protein, 8 aa, Mycobacterium
DPDEPTYD

SEQ ID NO: 985647 - protein, 7 aa, Mycobacterium
DPDGRTV

SEQ ID NO: 985648 - protein, 12 aa, Mycobacterium
DPDGSYGEPEEI

SEQ ID NO: 985649 - protein, 8 aa, Mycobacterium
DPDIDEAY

SEQ ID NO: 985650 - protein, 9 aa, Mycobacterium
DPDKVYGET

SEQ ID NO: 985651 - protein, 8 aa, Mycobacterium
DPDNSEQL

SEQ ID NO: 985652 - protein, 12 aa, Mycobacterium
DPDPDAEGKTYT

SEQ ID NO: 985653 - protein, 8 aa, Mycobacterium
DPDPEGPL

SEQ ID NO: 985654 - protein, 10 aa, Mycobacterium
DPDPLTPGRM

SEQ ID NO: 985655 - protein, 8 aa, Mycobacterium
DPDRDKPS

SEQ ID NO: 985656 - protein, 9 aa, Mycobacterium
DPDRETKGR

SEQ ID NO: 985657 - protein, 9 aa, Mycobacterium
DPDTARIDP

SEQ ID NO: 985658 - protein, 4 aa, Mycobacterium
DPDV

SEQ ID NO: 985659 - protein, 4 aa, Mycobacterium
DPED

SEQ ID NO: 985660 - protein, 9 aa, Mycobacterium
DPEGQLGSV

SEQ ID NO: 985661 - protein, 5 aa, Mycobacterium
DPELP

SEQ ID NO: 985662 - protein, 11 aa, Mycobacterium
DPEPGVPGRSV

SEQ ID NO: 985663 - protein, 27 aa, Mycobacterium
DPETIEARTDPWDPDSAPTRAQTEAAR

SEQ ID NO: 985664 - protein, 6 aa, Mycobacterium
DPEVDP

SEQ ID NO: 985665 - protein, 17 aa, Mycobacterium
DPEVTEKPSGDDLKSGK

SEQ ID NO: 985666 - protein, 13 aa, Mycobacterium
DPFADDPCDPSAA

SEQ ID NO: 985667 - protein, 5 aa, Mycobacterium
DPFDP

SEQ ID NO: 985668 - protein, 4 aa, Mycobacterium
DPGD

SEQ ID NO: 985669 - protein, 6 aa, Mycobacterium
DPGLDG

SEQ ID NO: 985670 - protein, 8 aa, Mycobacterium
DPGPGDEH

SEQ ID NO: 985671 - protein, 11 aa, Mycobacterium
DPGQRDDYQRR

SEQ ID NO: 985672 - protein, 8 aa, Mycobacterium
DPGSRGAM

SEQ ID NO: 985673 - protein, 5 aa, Mycobacterium
DPGSV

SEQ ID NO: 985674 - protein, 8 aa, Mycobacterium
DPGTGKSS

SEQ ID NO: 985675 - protein, 6 aa, Mycobacterium
DPGTGR

SEQ ID NO: 985676 - protein, 5 aa, Mycobacterium
DPHAN

SEQ ID NO: 985677 - protein, 9 aa, Mycobacterium
DPHGGYGHP

SEQ ID NO: 985678 - protein, 8 aa, Mycobacterium
DPHNKAGR

SEQ ID NO: 985679 - protein, 8 aa, Mycobacterium
DPHNKPGR

SEQ ID NO: 985680 - protein, 5 aa, Mycobacterium
DPHVA

SEQ ID NO: 985681 - protein, 5 aa, Mycobacterium
DPIEA

SEQ ID NO: 985682 - protein, 7 aa, Mycobacterium
DPIGTAP

SEQ ID NO: 985683 - protein, 5 aa, Mycobacterium
DPKGL

SEQ ID NO: 985684 - protein, 4 aa, Mycobacterium
DPLA

SEQ ID NO: 985685 - protein, 8 aa, Mycobacterium
DPLEPTQA

SEQ ID NO: 985686 - protein, 27 aa, Mycobacterium
DPLPLENNQNTQSSGMTPTTTPTPKKA

SEQ ID NO: 985687 - protein, 5 aa, Mycobacterium
DPLPT

SEQ ID NO: 985688 - protein, 8 aa, Mycobacterium
DPLSEDDW

SEQ ID NO: 985689 - protein, 8 aa, Mycobacterium
DPMDNGQV

SEQ ID NO: 985690 - protein, 4 aa, Mycobacterium
DPNA

SEQ ID NO: 985691 - protein, 6 aa, Mycobacterium
DPNFQA

SEQ ID NO: 985692 - protein, 18 aa, Mycobacterium
DPNGGGPTVADTASSASF

SEQ ID NO: 985693 - protein, 6 aa, Mycobacterium
DPNKAF

SEQ ID NO: 985694 - protein, 13 aa, Mycobacterium
DPNNQNMYADSAR

SEQ ID NO: 985695 - protein, 7 aa, Mycobacterium
DPNPDAL

SEQ ID NO: 985696 - protein, 13 aa, Mycobacterium
DPNPPGPDSDYRT

SEQ ID NO: 985697 - protein, 8 aa, Mycobacterium
DPNVQAPV

SEQ ID NO: 985698 - protein, 8 aa, Mycobacterium
DPPATRQA

SEQ ID NO: 985699 - protein, 14 aa, Mycobacterium
DPPPFTPPPQQNMH

SEQ ID NO: 985700 - protein, 8 aa, Mycobacterium
DPPPHGPE

SEQ ID NO: 985701 - protein, 5 aa, Mycobacterium
DPPPL

SEQ ID NO: 985702 - protein, 11 aa, Mycobacterium
DPPPLSNPKDH

SEQ ID NO: 985703 - protein, 8 aa, Mycobacterium
DPPPRTGL

SEQ ID NO: 985704 - protein, 7 aa, Mycobacterium
DPPPSFA

SEQ ID NO: 985705 - protein, 4 aa, Mycobacterium
DPPV

SEQ ID NO: 985706 - protein, 4 aa, Mycobacterium
DPPY

SEQ ID NO: 985707 - protein, 19 aa, Mycobacterium
DPQGNASTALGISNRQSRV

SEQ ID NO: 985708 - protein, 6 aa, Mycobacterium
DPQRLQ

SEQ ID NO: 985709 - protein, 6 aa, Mycobacterium
DPQTAA

SEQ ID NO: 985710 - protein, 5 aa, Mycobacterium
DPRAR

SEQ ID NO: 985711 - protein, 8 aa, Mycobacterium
DPRDVGRT

SEQ ID NO: 985712 - protein, 9 aa, Mycobacterium
DPRERPSFT

SEQ ID NO: 985713 - protein, 12 aa, Mycobacterium
DPRETSKVDDER

SEQ ID NO: 985714 - protein, 4 aa, Mycobacterium
DPRL

SEQ ID NO: 985715 - protein, 9 aa, Mycobacterium
DPRLNTQQS

SEQ ID NO: 985716 - protein, 5 aa, Mycobacterium
DPRLR

SEQ ID NO: 985717 - protein, 6 aa, Mycobacterium
DPRMSA

SEQ ID NO: 985718 - protein, 22 aa, Mycobacterium
DPRTMATRGEDESRDSDEPSLT

SEQ ID NO: 985719 - protein, 9 aa, Mycobacterium
DPSAQGRGL

SEQ ID NO: 985720 - protein, 21 aa, Mycobacterium
DPSLTLTRDGSRDVVSNARPV

SEQ ID NO: 985721 - protein, 7 aa, Mycobacterium
DPSSGAY

SEQ ID NO: 985722 - protein, 10 aa, Mycobacterium
DPSTDADRLA

SEQ ID NO: 985723 - protein, 5 aa, Mycobacterium
DPSTG

SEQ ID NO: 985724 - protein, 12 aa, Mycobacterium
DPSVAYPRRSNL

SEQ ID NO: 985725 - protein, 4 aa, Mycobacterium
DPSW

SEQ ID NO: 985726 - protein, 4 aa, Mycobacterium
DPTA

SEQ ID NO: 985727 - protein, 10 aa, Mycobacterium
DPTDVTTATQ

SEQ ID NO: 985728 - protein, 5 aa, Mycobacterium
DPTIA

SEQ ID NO: 985729 - protein, 5 aa, Mycobacterium
DPTIG

SEQ ID NO: 985730 - protein, 9 aa, Mycobacterium
DPTNAPDYS

SEQ ID NO: 985731 - protein, 7 aa, Mycobacterium
DPTNDQL

SEQ ID NO: 985732 - protein, 7 aa, Mycobacterium
DPTNDVE

SEQ ID NO: 985733 - protein, 12 aa, Mycobacterium
DPTRFNPQSCEQ

SEQ ID NO: 985734 - protein, 13 aa, Mycobacterium
DPTTGQPTKIAAP

SEQ ID NO: 985735 - protein, 6 aa, Mycobacterium
DPVANE

SEQ ID NO: 985736 - protein, 26 aa, Mycobacterium
DPVDAAELEDSARNAPLTRPRPGHAD

SEQ ID NO: 985737 - protein, 10 aa, Mycobacterium
DPVDVPNSRP

SEQ ID NO: 985738 - protein, 4 aa, Mycobacterium
DPVE

SEQ ID NO: 985739 - protein, 14 aa, Mycobacterium
DPVGSSVPDDAETF

SEQ ID NO: 985740 - protein, 6 aa, Mycobacterium
DPVPAA

SEQ ID NO: 985741 - protein, 6 aa, Mycobacterium
DPVPES

SEQ ID NO: 985742 - protein, 4 aa, Mycobacterium
DPVR

SEQ ID NO: 985743 - protein, 7 aa, Mycobacterium
DPVRTAT

SEQ ID NO: 985744 - protein, 5 aa, Mycobacterium
DPYAG

SEQ ID NO: 985745 - protein, 6 aa, Mycobacterium
DPYGGW

SEQ ID NO: 985746 - protein, 4 aa, Mycobacterium
DPYN

SEQ ID NO: 985747 - protein, 7 aa, Mycobacterium
DPYYGDH

SEQ ID NO: 985748 - protein, 9 aa, Mycobacterium
DQAAASRAD

SEQ ID NO: 985749 - protein, 11 aa, Mycobacterium
DQAEDSDSRQA

SEQ ID NO: 985750 - protein, 8 aa, Mycobacterium
DQAERDQL

SEQ ID NO: 985751 - protein, 21 aa, Mycobacterium
DQAFEKRPYPPGQHGRARIKE

SEQ ID NO: 985752 - protein, 6 aa, Mycobacterium
DQAHSL

SEQ ID NO: 985753 - protein, 18 aa, Mycobacterium
DQASGELAQLPDGPSRDA

SEQ ID NO: 985754 - protein, 9 aa, Mycobacterium
DQCSATRAN

SEQ ID NO: 985755 - protein, 15 aa, Mycobacterium
DQDELAAASHRNMAS

SEQ ID NO: 985756 - protein, 12 aa, Mycobacterium
DQDRGLSAGEKR

SEQ ID NO: 985757 - protein, 6 aa, Mycobacterium
DQDTGE

SEQ ID NO: 985758 - protein, 12 aa, Mycobacterium
DQEAAGISGSEF

SEQ ID NO: 985759 - protein, 8 aa, Mycobacterium
DQEPVREN

SEQ ID NO: 985760 - protein, 4 aa, Mycobacterium
DQFP

SEQ ID NO: 985761 - protein, 29 aa, Mycobacterium
DQGDVTQSIGRTGSDLDDAVGESSNSPIE

SEQ ID NO: 985762 - protein, 4 aa, Mycobacterium
DQGS

SEQ ID NO: 985763 - protein, 9 aa, Mycobacterium
DQGSDSIEV

SEQ ID NO: 985764 - protein, 12 aa, Mycobacterium
DQINATKAVEYS

SEQ ID NO: 985765 - protein, 7 aa, Mycobacterium
DQIPSEM

SEQ ID NO: 985766 - protein, 6 aa, Mycobacterium
DQITGH

SEQ ID NO: 985767 - protein, 11 aa, Mycobacterium
DQKIQVGQDDL

SEQ ID NO: 985768 - protein, 5 aa, Mycobacterium
DQLDR

SEQ ID NO: 985769 - protein, 4 aa, Mycobacterium
DQLR

SEQ ID NO: 985770 - protein, 16 aa, Mycobacterium
DQNDTNLLSPEGKSHR

SEQ ID NO: 985771 - protein, 13 aa, Mycobacterium
DQPDNPSNDVQGK

SEQ ID NO: 985772 - protein, 10 aa, Mycobacterium
DQPGHSHDQL

SEQ ID NO: 985773 - protein, 6 aa, Mycobacterium
DQPGLG

SEQ ID NO: 985774 - protein, 6 aa, Mycobacterium
DQPGRL

SEQ ID NO: 985775 - protein, 4 aa, Mycobacterium
DQPI

SEQ ID NO: 985776 - protein, 9 aa, Mycobacterium
DQPLADTAN

SEQ ID NO: 985777 - protein, 7 aa, Mycobacterium
DQPPGDW

SEQ ID NO: 985778 - protein, 4 aa, Mycobacterium
DQPY

SEQ ID NO: 985779 - protein, 7 aa, Mycobacterium
DQQAHAA

SEQ ID NO: 985780 - protein, 8 aa, Mycobacterium
DQQAPNAV

SEQ ID NO: 985781 - protein, 20 aa, Mycobacterium
DQQPPSTLRSIEGDPERHQN

SEQ ID NO: 985782 - protein, 13 aa, Mycobacterium
DQQQAQQEGSRSA

SEQ ID NO: 985783 - protein, 8 aa, Mycobacterium
DQQSDQLA

SEQ ID NO: 985784 - protein, 4 aa, Mycobacterium
DQRA

SEQ ID NO: 985785 - protein, 7 aa, Mycobacterium
DQRKETA

SEQ ID NO: 985786 - protein, 18 aa, Mycobacterium
DQRNITSITTDRRRRSEI

SEQ ID NO: 985787 - protein, 14 aa, Mycobacterium
DQRPGTKKCGHQGG

SEQ ID NO: 985788 - protein, 17 aa, Mycobacterium
DQRRTDVTTALGPGATV

SEQ ID NO: 985789 - protein, 8 aa, Mycobacterium
DQSDADGL

SEQ ID NO: 985790 - protein, 9 aa, Mycobacterium
DQSVNGDSP

SEQ ID NO: 985791 - protein, 7 aa, Mycobacterium
DQTAARA

SEQ ID NO: 985792 - protein, 7 aa, Mycobacterium
DQTEAMT

SEQ ID NO: 985793 - protein, 7 aa, Mycobacterium
DQTTPET

SEQ ID NO: 985794 - protein, 11 aa, Mycobacterium
DQVASTASDDE

SEQ ID NO: 985795 - protein, 10 aa, Mycobacterium
DQVDSRDDQR

SEQ ID NO: 985796 - protein, 5 aa, Mycobacterium
DQVGD

SEQ ID NO: 985797 - protein, 13 aa, Mycobacterium
DQVPVDADENCVW

SEQ ID NO: 985798 - protein, 10 aa, Mycobacterium
DQVSGRSAAD

SEQ ID NO: 985799 - protein, 16 aa, Mycobacterium
DQWGDVDDSSADAGRR

SEQ ID NO: 985800 - protein, 17 aa, Mycobacterium
DQYGTATEVDDLGGGAQ

SEQ ID NO: 985801 - protein, 7 aa, Mycobacterium
DRAAQLA

SEQ ID NO: 985802 - protein, 6 aa, Mycobacterium
DRAEKG

SEQ ID NO: 985803 - protein, 13 aa, Mycobacterium
DRAGSDLVISLVT

SEQ ID NO: 985804 - protein, 7 aa, Mycobacterium
DRAQTGV

SEQ ID NO: 985805 - protein, 17 aa, Mycobacterium
DRARRASLAAAGAGGVG

SEQ ID NO: 985806 - protein, 4 aa, Mycobacterium
DRAS

SEQ ID NO: 985807 - protein, 22 aa, Mycobacterium
DRASSAETNDNRCVQNDRVSLA

SEQ ID NO: 985808 - protein, 8 aa, Mycobacterium
DRCSPSDV

SEQ ID NO: 985809 - protein, 9 aa, Mycobacterium
DRDAAGAKI

SEQ ID NO: 985810 - protein, 4 aa, Mycobacterium
DRDE

SEQ ID NO: 985811 - protein, 6 aa, Mycobacterium
DRDELQ

SEQ ID NO: 985812 - protein, 4 aa, Mycobacterium
DRDG

SEQ ID NO: 985813 - protein, 7 aa, Mycobacterium
DRDGGYT

SEQ ID NO: 985814 - protein, 8 aa, Mycobacterium
DRDGRGEV

SEQ ID NO: 985815 - protein, 9 aa, Mycobacterium
DRDHGHGDR

SEQ ID NO: 985816 - protein, 6 aa, Mycobacterium
DRDTMS

SEQ ID NO: 985817 - protein, 6 aa, Mycobacterium
DREAAD

SEQ ID NO: 985818 - protein, 4 aa, Mycobacterium
DREV

SEQ ID NO: 985819 - protein, 7 aa, Mycobacterium
DRGATIG

SEQ ID NO: 985820 - protein, 16 aa, Mycobacterium
DRGDRSVTLRPEGTAG

SEQ ID NO: 985821 - protein, 7 aa, Mycobacterium
DRGGAAI

SEQ ID NO: 985822 - protein, 8 aa, Mycobacterium
DRGISNDN

SEQ ID NO: 985823 - protein, 14 aa, Mycobacterium
DRGPLRGTRIDHRL

SEQ ID NO: 985824 - protein, 6 aa, Mycobacterium
DRGQAV

SEQ ID NO: 985825 - protein, 10 aa, Mycobacterium
DRGQTAKREA

SEQ ID NO: 985826 - protein, 7 aa, Mycobacterium
DRGRGPV

SEQ ID NO: 985827 - protein, 9 aa, Mycobacterium
DRGRHARSA

SEQ ID NO: 985828 - protein, 26 aa, Mycobacterium
DRGRLSDDIATPNQRSNRLSRDKRRG

SEQ ID NO: 985829 - protein, 19 aa, Mycobacterium
DRGTEDEKVELTSEIAKDR

SEQ ID NO: 985830 - protein, 11 aa, Mycobacterium
DRGTGAAEAIK

SEQ ID NO: 985831 - protein, 15 aa, Mycobacterium
DRGTQLQRARAGEIT

SEQ ID NO: 985832 - protein, 7 aa, Mycobacterium
DRGTWTP

SEQ ID NO: 985833 - protein, 4 aa, Mycobacterium
DRGY

SEQ ID NO: 985834 - protein, 12 aa, Mycobacterium
DRGYVQKKGSAL

SEQ ID NO: 985835 - protein, 16 aa, Mycobacterium
DRHGDQGGRRPNRDTM

SEQ ID NO: 985836 - protein, 6 aa, Mycobacterium
DRHGGP

SEQ ID NO: 985837 - protein, 13 aa, Mycobacterium
DRIPGAAALGETL

SEQ ID NO: 985838 - protein, 4 aa, Mycobacterium
DRKL

SEQ ID NO: 985839 - protein, 14 aa, Mycobacterium
DRKPKDLSGGQRQR

SEQ ID NO: 985840 - protein, 8 aa, Mycobacterium
DRKQFGES

SEQ ID NO: 985841 - protein, 4 aa, Mycobacterium
DRKT

SEQ ID NO: 985842 - protein, 6 aa, Mycobacterium
DRKTAL

SEQ ID NO: 985843 - protein, 8 aa, Mycobacterium
DRKTGKTA

SEQ ID NO: 985844 - protein, 11 aa, Mycobacterium
DRLEHNLPNSG

SEQ ID NO: 985845 - protein, 5 aa, Mycobacterium
DRLGQ

SEQ ID NO: 985846 - protein, 10 aa, Mycobacterium
DRLKRGGTNL

SEQ ID NO: 985847 - protein, 20 aa, Mycobacterium
DRLPERACGRDGGKPRRKHT

SEQ ID NO: 985848 - protein, 10 aa, Mycobacterium
DRLSNREIGE

SEQ ID NO: 985849 - protein, 8 aa, Mycobacterium
DRLTEGAA

SEQ ID NO: 985850 - protein, 4 aa, Mycobacterium
DRNA

SEQ ID NO: 985851 - protein, 7 aa, Mycobacterium
DRNLPGS

SEQ ID NO: 985852 - protein, 6 aa, Mycobacterium
DRNLQT

SEQ ID NO: 985853 - protein, 9 aa, Mycobacterium
DRNPQWAPT

SEQ ID NO: 985854 - protein, 23 aa, Mycobacterium
DRNPSPESLDAAQDKIKAALTQL

SEQ ID NO: 985855 - protein, 5 aa, Mycobacterium
DRNQQ

SEQ ID NO: 985856 - protein, 8 aa, Mycobacterium
DRNTVEQG

SEQ ID NO: 985857 - protein, 12 aa, Mycobacterium
DRPADRGVGQGI

SEQ ID NO: 985858 - protein, 9 aa, Mycobacterium
DRPDERAHR

SEQ ID NO: 985859 - protein, 10 aa, Mycobacterium
DRPDLSRPRL

SEQ ID NO: 985860 - protein, 8 aa, Mycobacterium
DRPEDRWA

SEQ ID NO: 985861 - protein, 9 aa, Mycobacterium
DRPEGFAEA

SEQ ID NO: 985862 - protein, 7 aa, Mycobacterium
DRPGKAK

SEQ ID NO: 985863 - protein, 18 aa, Mycobacterium
DRPGNRTGSKEHEHTVKS

SEQ ID NO: 985864 - protein, 7 aa, Mycobacterium
DRPGSLG

SEQ ID NO: 985865 - protein, 8 aa, Mycobacterium
DRPPDRRS

SEQ ID NO: 985866 - protein, 7 aa, Mycobacterium
DRPSDGT

SEQ ID NO: 985867 - protein, 6 aa, Mycobacterium
DRPYTT

SEQ ID NO: 985868 - protein, 8 aa, Mycobacterium
DRQAEPSI

SEQ ID NO: 985869 - protein, 7 aa, Mycobacterium
DRQDPRF

SEQ ID NO: 985870 - protein, 10 aa, Mycobacterium
DRQEADRLST

SEQ ID NO: 985871 - protein, 11 aa, Mycobacterium
DRQEGAASYEA

SEQ ID NO: 985872 - protein, 13 aa, Mycobacterium
DRQPGSSKGDALA

SEQ ID NO: 985873 - protein, 6 aa, Mycobacterium
DRQTGD

SEQ ID NO: 985874 - protein, 4 aa, Mycobacterium
DRRA

SEQ ID NO: 985875 - protein, 9 aa, Mycobacterium
DRRGAPTFS

SEQ ID NO: 985876 - protein, 15 aa, Mycobacterium
DRRNTPTGARRQDLP

SEQ ID NO: 985877 - protein, 6 aa, Mycobacterium
DRRRGE

SEQ ID NO: 985878 - protein, 6 aa, Mycobacterium
DRRTTM

SEQ ID NO: 985879 - protein, 12 aa, Mycobacterium
DRSAAAGDPCGV

SEQ ID NO: 985880 - protein, 11 aa, Mycobacterium
DRSALDDPVRR

SEQ ID NO: 985881 - protein, 5 aa, Mycobacterium
DRSDQ

SEQ ID NO: 985882 - protein, 4 aa, Mycobacterium
DRSG

SEQ ID NO: 985883 - protein, 5 aa, Mycobacterium
DRSGR

SEQ ID NO: 985884 - protein, 6 aa, Mycobacterium
DRSGVA

SEQ ID NO: 985885 - protein, 11 aa, Mycobacterium
DRSKAEAGDTN

SEQ ID NO: 985886 - protein, 5 aa, Mycobacterium
DRSQP

SEQ ID NO: 985887 - protein, 6 aa, Mycobacterium
DRSRYL

SEQ ID NO: 985888 - protein, 6 aa, Mycobacterium
DRSTGL

SEQ ID NO: 985889 - protein, 20 aa, Mycobacterium
DRSTKKEVKQVKPANADIGS

SEQ ID NO: 985890 - protein, 6 aa, Mycobacterium
DRSTVA

SEQ ID NO: 985891 - protein, 15 aa, Mycobacterium
DRSYTTPDGGELTLP

SEQ ID NO: 985892 - protein, 5 aa, Mycobacterium
DRTEA

SEQ ID NO: 985893 - protein, 10 aa, Mycobacterium
DRTGDEIHTS

SEQ ID NO: 985894 - protein, 6 aa, Mycobacterium
DRTGEQ

SEQ ID NO: 985895 - protein, 15 aa, Mycobacterium
DRTGSSAKDAIDTAE

SEQ ID NO: 985896 - protein, 6 aa, Mycobacterium
DRTPPR

SEQ ID NO: 985897 - protein, 8 aa, Mycobacterium
DRTPTADR

SEQ ID NO: 985898 - protein, 8 aa, Mycobacterium
DRTRHQVS

SEQ ID NO: 985899 - protein, 9 aa, Mycobacterium
DRTYRPDGQ

SEQ ID NO: 985900 - protein, 9 aa, Mycobacterium
DRVPPGPGQ

SEQ ID NO: 985901 - protein, 5 aa, Mycobacterium
DRVTG

SEQ ID NO: 985902 - protein, 12 aa, Mycobacterium
DRWAPPYAEAGA

SEQ ID NO: 985903 - protein, 5 aa, Mycobacterium
DRYTT

SEQ ID NO: 985904 - protein, 11 aa, Mycobacterium
DSAAGLSSPRI

SEQ ID NO: 985905 - protein, 5 aa, Mycobacterium
DSAAT

SEQ ID NO: 985906 - protein, 9 aa, Mycobacterium
DSAATIRTT

SEQ ID NO: 985907 - protein, 13 aa, Mycobacterium
DSAAVDPVRGSMS

SEQ ID NO: 985908 - protein, 13 aa, Mycobacterium
DSADSDKQVDAHY

SEQ ID NO: 985909 - protein, 4 aa, Mycobacterium
DSAG

SEQ ID NO: 985910 - protein, 8 aa, Mycobacterium
DSALTDRV

SEQ ID NO: 985911 - protein, 8 aa, Mycobacterium
DSANGANV

SEQ ID NO: 985912 - protein, 11 aa, Mycobacterium
DSASAYGNKMT

SEQ ID NO: 985913 - protein, 7 aa, Mycobacterium
DSASGSA

SEQ ID NO: 985914 - protein, 5 aa, Mycobacterium
DSASI

SEQ ID NO: 985915 - protein, 17 aa, Mycobacterium
DSATAEVTSKEDNYSGV

SEQ ID NO: 985916 - protein, 8 aa, Mycobacterium
DSATVADA

SEQ ID NO: 985917 - protein, 6 aa, Mycobacterium
DSDASV

SEQ ID NO: 985918 - protein, 8 aa, Mycobacterium
DSDGELPA

SEQ ID NO: 985919 - protein, 13 aa, Mycobacterium
DSDGLYDHQPPLV

SEQ ID NO: 985920 - protein, 8 aa, Mycobacterium
DSDGVNST

SEQ ID NO: 985921 - protein, 14 aa, Mycobacterium
DSDKGDDLAATPYA

SEQ ID NO: 985922 - protein, 6 aa, Mycobacterium
DSDRNQ

SEQ ID NO: 985923 - protein, 6 aa, Mycobacterium
DSDSFN

SEQ ID NO: 985924 - protein, 9 aa, Mycobacterium
DSEADGTAL

SEQ ID NO: 985925 - protein, 5 aa, Mycobacterium
DSEAL

SEQ ID NO: 985926 - protein, 5 aa, Mycobacterium
DSEGI

SEQ ID NO: 985927 - protein, 6 aa, Mycobacterium
DSEPDQ

SEQ ID NO: 985928 - protein, 14 aa, Mycobacterium
DSETGNGRLKSERE

SEQ ID NO: 985929 - protein, 8 aa, Mycobacterium
DSETGQTV

SEQ ID NO: 985930 - protein, 6 aa, Mycobacterium
DSFAPD

SEQ ID NO: 985931 - protein, 22 aa, Mycobacterium
DSGAQAWLGPGPSADSAPDGLP

SEQ ID NO: 985932 - protein, 16 aa, Mycobacterium
DSGDGSDWDRTKDAAF

SEQ ID NO: 985933 - protein, 7 aa, Mycobacterium
DSGERRL

SEQ ID NO: 985934 - protein, 13 aa, Mycobacterium
DSGFTVEPDGQGG

SEQ ID NO: 985935 - protein, 4 aa, Mycobacterium
DSGK

SEQ ID NO: 985936 - protein, 5 aa, Mycobacterium
DSGPW

SEQ ID NO: 985937 - protein, 9 aa, Mycobacterium
DSGQTRSQE

SEQ ID NO: 985938 - protein, 9 aa, Mycobacterium
DSGVETGSV

SEQ ID NO: 985939 - protein, 17 aa, Mycobacterium
DSGYAEESDPAARTARL

SEQ ID NO: 985940 - protein, 7 aa, Mycobacterium
DSGYSTL

SEQ ID NO: 985941 - protein, 16 aa, Mycobacterium
DSHITGPAGPGHPTPG

SEQ ID NO: 985942 - protein, 7 aa, Mycobacterium
DSHRRKQ

SEQ ID NO: 985943 - protein, 10 aa, Mycobacterium
DSHTLDNEHR

SEQ ID NO: 985944 - protein, 11 aa, Mycobacterium
DSIAREELTTA

SEQ ID NO: 985945 - protein, 10 aa, Mycobacterium
DSIESTATTL

SEQ ID NO: 985946 - protein, 7 aa, Mycobacterium
DSIPEGP

SEQ ID NO: 985947 - protein, 14 aa, Mycobacterium
DSITDGQPLATPQI

SEQ ID NO: 985948 - protein, 9 aa, Mycobacterium
DSKATNPHA

SEQ ID NO: 985949 - protein, 21 aa, Mycobacterium
DSKDEAGSGRDRHANLGSGQI

SEQ ID NO: 985950 - protein, 7 aa, Mycobacterium
DSKSLAE

SEQ ID NO: 985951 - protein, 7 aa, Mycobacterium
DSKYQEA

SEQ ID NO: 985952 - protein, 8 aa, Mycobacterium
DSLDAEYA

SEQ ID NO: 985953 - protein, 10 aa, Mycobacterium
DSLGPETSKR

SEQ ID NO: 985954 - protein, 14 aa, Mycobacterium
DSLSSAPQLAGYPR

SEQ ID NO: 985955 - protein, 17 aa, Mycobacterium
DSNGGHERKSQPTAGTL

SEQ ID NO: 985956 - protein, 7 aa, Mycobacterium
DSNKTQI

SEQ ID NO: 985957 - protein, 7 aa, Mycobacterium
DSNVRND

SEQ ID NO: 985958 - protein, 11 aa, Mycobacterium
DSPGGKEQVAK

SEQ ID NO: 985959 - protein, 6 aa, Mycobacterium
DSPNAI

SEQ ID NO: 985960 - protein, 14 aa, Mycobacterium
DSPNGSGDGNGDHL

SEQ ID NO: 985961 - protein, 13 aa, Mycobacterium
DSPRELDPSRYER

SEQ ID NO: 985962 - protein, 7 aa, Mycobacterium
DSPRTTV

SEQ ID NO: 985963 - protein, 16 aa, Mycobacterium
DSQASNDQLEKVLSYI

SEQ ID NO: 985964 - protein, 7 aa, Mycobacterium
DSQYDSN

SEQ ID NO: 985965 - protein, 10 aa, Mycobacterium
DSRADERDQP

SEQ ID NO: 985966 - protein, 11 aa, Mycobacterium
DSRDPDPRAAD

SEQ ID NO: 985967 - protein, 8 aa, Mycobacterium
DSRGNPTV

SEQ ID NO: 985968 - protein, 6 aa, Mycobacterium
DSRITG

SEQ ID NO: 985969 - protein, 9 aa, Mycobacterium
DSRKADQMV

SEQ ID NO: 985970 - protein, 6 aa, Mycobacterium
DSRLTA

SEQ ID NO: 985971 - protein, 22 aa, Mycobacterium
DSRTADPQRRESPYECPATPIL

SEQ ID NO: 985972 - protein, 6 aa, Mycobacterium
DSSGIT

SEQ ID NO: 985973 - protein, 9 aa, Mycobacterium
DSSGLSVNN

SEQ ID NO: 985974 - protein, 10 aa, Mycobacterium
DSSKPTSRRR

SEQ ID NO: 985975 - protein, 16 aa, Mycobacterium
DSSNDELVSADASAGY

SEQ ID NO: 985976 - protein, 11 aa, Mycobacterium
DSSPASDLATA

SEQ ID NO: 985977 - protein, 10 aa, Mycobacterium
DSSRPWKDEA

SEQ ID NO: 985978 - protein, 5 aa, Mycobacterium
DSSRR

SEQ ID NO: 985979 - protein, 9 aa, Mycobacterium
DSSSNQPGK

SEQ ID NO: 985980 - protein, 6 aa, Mycobacterium
DSSSWR

SEQ ID NO: 985981 - protein, 6 aa, Mycobacterium
DSTFDS

SEQ ID NO: 985982 - protein, 14 aa, Mycobacterium
DSTGADYDSALAGA

SEQ ID NO: 985983 - protein, 5 aa, Mycobacterium
DSTIG

SEQ ID NO: 985984 - protein, 8 aa, Mycobacterium
DSTPVPTT

SEQ ID NO: 985985 - protein, 19 aa, Mycobacterium
DSTTLSESAINAARTQARQ

SEQ ID NO: 985986 - protein, 13 aa, Mycobacterium
DSTVTPRSLVNGI

SEQ ID NO: 985987 - protein, 7 aa, Mycobacterium
DSVESAV

SEQ ID NO: 985988 - protein, 9 aa, Mycobacterium
DSVPGLGAH

SEQ ID NO: 985989 - protein, 7 aa, Mycobacterium
DSVSERV

SEQ ID NO: 985990 - protein, 5 aa, Mycobacterium
DSVSG

SEQ ID NO: 985991 - protein, 9 aa, Mycobacterium
DSWGGADPA

SEQ ID NO: 985992 - protein, 23 aa, Mycobacterium
DSYERDDDLQQRTGLSGNFRQCT

SEQ ID NO: 985993 - protein, 16 aa, Mycobacterium
DSYSTPASGASRFGRV

SEQ ID NO: 985994 - protein, 5 aa, Mycobacterium
DTACS

SEQ ID NO: 985995 - protein, 6 aa, Mycobacterium
DTADGL

SEQ ID NO: 985996 - protein, 5 aa, Mycobacterium
DTAGN

SEQ ID NO: 985997 - protein, 5 aa, Mycobacterium
DTANA

SEQ ID NO: 985998 - protein, 4 aa, Mycobacterium
DTAP

SEQ ID NO: 985999 - protein, 6 aa, Mycobacterium
DTAPAT

SEQ ID NO: 986000 - protein, 10 aa, Mycobacterium
DTASELPDGQ

SEQ ID NO: 986001 - protein, 6 aa, Mycobacterium
DTAVGT

SEQ ID NO: 986002 - protein, 11 aa, Mycobacterium
DTDADRDSEES

SEQ ID NO: 986003 - protein, 24 aa, Mycobacterium
DTDPELEPEPENVSDASAALPAES

SEQ ID NO: 986004 - protein, 11 aa, Mycobacterium
DTDQIPENNSG

SEQ ID NO: 986005 - protein, 7 aa, Mycobacterium
DTDSHPR

SEQ ID NO: 986006 - protein, 9 aa, Mycobacterium
DTDSKDSTR

SEQ ID NO: 986007 - protein, 5 aa, Mycobacterium
DTDTQ

SEQ ID NO: 986008 - protein, 9 aa, Mycobacterium
DTELEENPY

SEQ ID NO: 986009 - protein, 4 aa, Mycobacterium
DTEN

SEQ ID NO: 986010 - protein, 6 aa, Mycobacterium
DTENTD

SEQ ID NO: 986011 - protein, 10 aa, Mycobacterium
DTEPYRKLGR

SEQ ID NO: 986012 - protein, 10 aa, Mycobacterium
DTERASGFRY

SEQ ID NO: 986013 - protein, 7 aa, Mycobacterium
DTERTNL

SEQ ID NO: 986014 - protein, 4 aa, Mycobacterium
DTES

SEQ ID NO: 986015 - protein, 8 aa, Mycobacterium
DTESQRAA

SEQ ID NO: 986016 - protein, 6 aa, Mycobacterium
DTETER

SEQ ID NO: 986017 - protein, 5 aa, Mycobacterium
DTGAG

SEQ ID NO: 986018 - protein, 7 aa, Mycobacterium
DTGAPLR

SEQ ID NO: 986019 - protein, 4 aa, Mycobacterium
DTGD

SEQ ID NO: 986020 - protein, 9 aa, Mycobacterium
DTGDPRTFS

SEQ ID NO: 986021 - protein, 9 aa, Mycobacterium
DTGDTGSVV

SEQ ID NO: 986022 - protein, 9 aa, Mycobacterium
DTGGHDGVP

SEQ ID NO: 986023 - protein, 7 aa, Mycobacterium
DTGGTVA

SEQ ID NO: 986024 - protein, 9 aa, Mycobacterium
DTGHGGDSH

SEQ ID NO: 986025 - protein, 4 aa, Mycobacterium
DTGK

SEQ ID NO: 986026 - protein, 9 aa, Mycobacterium
DTGNVYEKD

SEQ ID NO: 986027 - protein, 11 aa, Mycobacterium
DTGSRWKADEA

SEQ ID NO: 986028 - protein, 4 aa, Mycobacterium
DTGV

SEQ ID NO: 986029 - protein, 11 aa, Mycobacterium
DTIAGPASPVA

SEQ ID NO: 986030 - protein, 7 aa, Mycobacterium
DTIPGTA

SEQ ID NO: 986031 - protein, 9 aa, Mycobacterium
DTKAQRDKL

SEQ ID NO: 986032 - protein, 18 aa, Mycobacterium
DTKPDLTPVTDADRAVEA

SEQ ID NO: 986033 - protein, 7 aa, Mycobacterium
DTLSERS

SEQ ID NO: 986034 - protein, 8 aa, Mycobacterium
DTLTNAAG

SEQ ID NO: 986035 - protein, 7 aa, Mycobacterium
DTNPAAV

SEQ ID NO: 986036 - protein, 5 aa, Mycobacterium
DTNRE

SEQ ID NO: 986037 - protein, 5 aa, Mycobacterium
DTPAG

SEQ ID NO: 986038 - protein, 4 aa, Mycobacterium
DTPD

SEQ ID NO: 986039 - protein, 4 aa, Mycobacterium
DTPE

SEQ ID NO: 986040 - protein, 7 aa, Mycobacterium
DTPGDID

SEQ ID NO: 986041 - protein, 5 aa, Mycobacterium
DTPGE

SEQ ID NO: 986042 - protein, 13 aa, Mycobacterium
DTPGRDDRKQRER

SEQ ID NO: 986043 - protein, 10 aa, Mycobacterium
DTPHTRPVPV

SEQ ID NO: 986044 - protein, 7 aa, Mycobacterium
DTPREEL

SEQ ID NO: 986045 - protein, 6 aa, Mycobacterium
DTPSRG

SEQ ID NO: 986046 - protein, 6 aa, Mycobacterium
DTQNED

SEQ ID NO: 986047 - protein, 9 aa, Mycobacterium
DTRAPQFRD

SEQ ID NO: 986048 - protein, 4 aa, Mycobacterium
DTRE

SEQ ID NO: 986049 - protein, 11 aa, Mycobacterium
DTRIETSEGTV

SEQ ID NO: 986050 - protein, 4 aa, Mycobacterium
DTRP

SEQ ID NO: 986051 - protein, 6 aa, Mycobacterium
DTRPGL

SEQ ID NO: 986052 - protein, 7 aa, Mycobacterium
DTRPRNV

SEQ ID NO: 986053 - protein, 22 aa, Mycobacterium
DTRQSEGREDSGGNSWCGGPTG

SEQ ID NO: 986054 - protein, 6 aa, Mycobacterium
DTRRDA

SEQ ID NO: 986055 - protein, 5 aa, Mycobacterium
DTRSG

SEQ ID NO: 986056 - protein, 6 aa, Mycobacterium
DTRSTS

SEQ ID NO: 986057 - protein, 16 aa, Mycobacterium
DTSCGNLADRAGRFSE

SEQ ID NO: 986058 - protein, 10 aa, Mycobacterium
DTSGRGEGDS

SEQ ID NO: 986059 - protein, 10 aa, Mycobacterium
DTSGTAVPVD

SEQ ID NO: 986060 - protein, 5 aa, Mycobacterium
DTSPI

SEQ ID NO: 986061 - protein, 10 aa, Mycobacterium
DTSTTGASAL

SEQ ID NO: 986062 - protein, 6 aa, Mycobacterium
DTTAPA

SEQ ID NO: 986063 - protein, 7 aa, Mycobacterium
DTTRADV

SEQ ID NO: 986064 - protein, 5 aa, Mycobacterium
DTTRI

SEQ ID NO: 986065 - protein, 8 aa, Mycobacterium
DTTSDSVA

SEQ ID NO: 986066 - protein, 6 aa, Mycobacterium
DTTVRD

SEQ ID NO: 986067 - protein, 9 aa, Mycobacterium
DTVASCSDE

SEQ ID NO: 986068 - protein, 4 aa, Mycobacterium
DTVD

SEQ ID NO: 986069 - protein, 6 aa, Mycobacterium
DTVDDS

SEQ ID NO: 986070 - protein, 7 aa, Mycobacterium
DTVDGNQ

SEQ ID NO: 986071 - protein, 5 aa, Mycobacterium
DTVPK

SEQ ID NO: 986072 - protein, 19 aa, Mycobacterium
DTVRAKDADLQRFRGKLIG

SEQ ID NO: 986073 - protein, 4 aa, Mycobacterium
DTVT

SEQ ID NO: 986074 - protein, 13 aa, Mycobacterium
DTWSERKLTDGDF

SEQ ID NO: 986075 - protein, 14 aa, Mycobacterium
DTYIEKDSSINDDV

SEQ ID NO: 986076 - protein, 4 aa, Mycobacterium
DVAA

SEQ ID NO: 986077 - protein, 4 aa, Mycobacterium
DVAG

SEQ ID NO: 986078 - protein, 8 aa, Mycobacterium
DVAGDTSD

SEQ ID NO: 986079 - protein, 8 aa, Mycobacterium
DVAGGSAD

SEQ ID NO: 986080 - protein, 6 aa, Mycobacterium
DVAPDS

SEQ ID NO: 986081 - protein, 10 aa, Mycobacterium
DVAPQNNRLP

SEQ ID NO: 986082 - protein, 8 aa, Mycobacterium
DVAPRTPT

SEQ ID NO: 986083 - protein, 4 aa, Mycobacterium
DVAR

SEQ ID NO: 986084 - protein, 8 aa, Mycobacterium
DVDERDRP

SEQ ID NO: 986085 - protein, 14 aa, Mycobacterium
DVDGEGLAQTEGQL

SEQ ID NO: 986086 - protein, 6 aa, Mycobacterium
DVDGQH

SEQ ID NO: 986087 - protein, 4 aa, Mycobacterium
DVDP

SEQ ID NO: 986088 - protein, 7 aa, Mycobacterium
DVDPNEV

SEQ ID NO: 986089 - protein, 5 aa, Mycobacterium
DVDSS

SEQ ID NO: 986090 - protein, 9 aa, Mycobacterium
DVDSVDKAV

SEQ ID NO: 986091 - protein, 7 aa, Mycobacterium
DVDTQAR

SEQ ID NO: 986092 - protein, 7 aa, Mycobacterium
DVDVDRK

SEQ ID NO: 986093 - protein, 9 aa, Mycobacterium
DVEGTETEV

SEQ ID NO: 986094 - protein, 9 aa, Mycobacterium
DVGAEEAEQ

SEQ ID NO: 986095 - protein, 7 aa, Mycobacterium
DVGEEPA

SEQ ID NO: 986096 - protein, 9 aa, Mycobacterium
DVGGGPGAL

SEQ ID NO: 986097 - protein, 5 aa, Mycobacterium
DVGGQ

SEQ ID NO: 986098 - protein, 6 aa, Mycobacterium
DVGGQH

SEQ ID NO: 986099 - protein, 4 aa, Mycobacterium
DVGR

SEQ ID NO: 986100 - protein, 8 aa, Mycobacterium
DVHGRGGV

SEQ ID NO: 986101 - protein, 4 aa, Mycobacterium
DVIG

SEQ ID NO: 986102 - protein, 5 aa, Mycobacterium
DVISE

SEQ ID NO: 986103 - protein, 8 aa, Mycobacterium
DVKGARKD

SEQ ID NO: 986104 - protein, 24 aa, Mycobacterium
DVPDGPSGLAGLPVSGGADRAEQE

SEQ ID NO: 986105 - protein, 6 aa, Mycobacterium
DVPEGG

SEQ ID NO: 986106 - protein, 8 aa, Mycobacterium
DVPENEHD

SEQ ID NO: 986107 - protein, 6 aa, Mycobacterium
DVPESL

SEQ ID NO: 986108 - protein, 8 aa, Mycobacterium
DVPESLRD

SEQ ID NO: 986109 - protein, 7 aa, Mycobacterium
DVPGDVR

SEQ ID NO: 986110 - protein, 13 aa, Mycobacterium
DVPGNCARSSQQL

SEQ ID NO: 986111 - protein, 6 aa, Mycobacterium
DVPPDH

SEQ ID NO: 986112 - protein, 14 aa, Mycobacterium
DVPQTSETDGSRSE

SEQ ID NO: 986113 - protein, 10 aa, Mycobacterium
DVPTATSVRA

SEQ ID NO: 986114 - protein, 13 aa, Mycobacterium
DVPTQMARDGVAS

SEQ ID NO: 986115 - protein, 9 aa, Mycobacterium
DVPYGGGPG

SEQ ID NO: 986116 - protein, 7 aa, Mycobacterium
DVQGVPD

SEQ ID NO: 986117 - protein, 5 aa, Mycobacterium
DVRGR

SEQ ID NO: 986118 - protein, 12 aa, Mycobacterium
DVRQSKVGDTVT

SEQ ID NO: 986119 - protein, 7 aa, Mycobacterium
DVSDDRM

SEQ ID NO: 986120 - protein, 5 aa, Mycobacterium
DVSES

SEQ ID NO: 986121 - protein, 6 aa, Mycobacterium
DVSGSN

SEQ ID NO: 986122 - protein, 13 aa, Mycobacterium
DVTDGLEKAAARG

SEQ ID NO: 986123 - protein, 8 aa, Mycobacterium
DVTGEEVS

SEQ ID NO: 986124 - protein, 15 aa, Mycobacterium
DVTGPHHPSKLAAKI

SEQ ID NO: 986125 - protein, 14 aa, Mycobacterium
DVTGTSKGKGFSGT

SEQ ID NO: 986126 - protein, 9 aa, Mycobacterium
DVTNRTPAV

SEQ ID NO: 986127 - protein, 5 aa, Mycobacterium
DVTPL

SEQ ID NO: 986128 - protein, 17 aa, Mycobacterium
DVTPQPHNGCRPPKRRR

SEQ ID NO: 986129 - protein, 23 aa, Mycobacterium
DVTTGTWSTDGAYDSQDYAETEQ

SEQ ID NO: 986130 - protein, 6 aa, Mycobacterium
DVVGTE

SEQ ID NO: 986131 - protein, 14 aa, Mycobacterium
DVVPATADISSQLT

SEQ ID NO: 986132 - protein, 5 aa, Mycobacterium
DVYGN

SEQ ID NO: 986133 - protein, 10 aa, Mycobacterium
DWDPSQATLA

SEQ ID NO: 986134 - protein, 5 aa, Mycobacterium
DWELD

SEQ ID NO: 986135 - protein, 4 aa, Mycobacterium
DWPG

SEQ ID NO: 986136 - protein, 5 aa, Mycobacterium
DWPGT

SEQ ID NO: 986137 - protein, 17 aa, Mycobacterium
DWSNAEAAGMSVVFATT

SEQ ID NO: 986138 - protein, 7 aa, Mycobacterium
DWTPGSS

SEQ ID NO: 986139 - protein, 6 aa, Mycobacterium
DYAPTS

SEQ ID NO: 986140 - protein, 6 aa, Mycobacterium
DYASQD

SEQ ID NO: 986141 - protein, 5 aa, Mycobacterium
DYDPD

SEQ ID NO: 986142 - protein, 8 aa, Mycobacterium
DYEQHPLP

SEQ ID NO: 986143 - protein, 7 aa, Mycobacterium
DYFPPDS

SEQ ID NO: 986144 - protein, 4 aa, Mycobacterium
DYGL

SEQ ID NO: 986145 - protein, 8 aa, Mycobacterium
DYPGVGPE

SEQ ID NO: 986146 - protein, 5 aa, Mycobacterium
DYPGY

SEQ ID NO: 986147 - protein, 11 aa, Mycobacterium
DYRDRSPASDQ

SEQ ID NO: 986148 - protein, 5 aa, Mycobacterium
DYRGQ

SEQ ID NO: 986149 - protein, 18 aa, Mycobacterium
DYRKSTDNAAIHVVQQCY

SEQ ID NO: 986150 - protein, 8 aa, Mycobacterium
DYRSTPQV

SEQ ID NO: 986151 - protein, 15 aa, Mycobacterium
DYSANRAKHDIPQAR

SEQ ID NO: 986152 - protein, 9 aa, Mycobacterium
DYSQRTPKK

SEQ ID NO: 986153 - protein, 16 aa, Mycobacterium
DYSTSTEPPQDRHLRL

SEQ ID NO: 986154 - protein, 5 aa, Mycobacterium
DYVPE

SEQ ID NO: 986155 - protein, 8 aa, Mycobacterium
EAAAAVAA

SEQ ID NO: 986156 - protein, 6 aa, Mycobacterium
EAADAA

SEQ ID NO: 986157 - protein, 9 aa, Mycobacterium
EAADGQEAV

SEQ ID NO: 986158 - protein, 18 aa, Mycobacterium
EAAEKAKIELSSSQSTSV

SEQ ID NO: 986159 - protein, 7 aa, Mycobacterium
EAARGAG

SEQ ID NO: 986160 - protein, 15 aa, Mycobacterium
EAARHGRNELPPTIR

SEQ ID NO: 986161 - protein, 8 aa, Mycobacterium
EAASQIRS

SEQ ID NO: 986162 - protein, 8 aa, Mycobacterium
EAAVQDGQ

SEQ ID NO: 986163 - protein, 5 aa, Mycobacterium
EADAE

SEQ ID NO: 986164 - protein, 11 aa, Mycobacterium
EADAQALPFGD

SEQ ID NO: 986165 - protein, 5 aa, Mycobacterium
EADEL

SEQ ID NO: 986166 - protein, 7 aa, Mycobacterium
EADFGGT

SEQ ID NO: 986167 - protein, 5 aa, Mycobacterium
EADVV

SEQ ID NO: 986168 - protein, 10 aa, Mycobacterium
EAEDGGSQTY

SEQ ID NO: 986169 - protein, 5 aa, Mycobacterium
EAEEL

SEQ ID NO: 986170 - protein, 21 aa, Mycobacterium
EAEGAKADARRKFRDGGEREM

SEQ ID NO: 986171 - protein, 4 aa, Mycobacterium
EAEN

SEQ ID NO: 986172 - protein, 9 aa, Mycobacterium
EAENKPAAV

SEQ ID NO: 986173 - protein, 9 aa, Mycobacterium
EAETPAEYK

SEQ ID NO: 986174 - protein, 7 aa, Mycobacterium
EAFGEPI

SEQ ID NO: 986175 - protein, 10 aa, Mycobacterium
EAGADSMPVR

SEQ ID NO: 986176 - protein, 7 aa, Mycobacterium
EAGAGGL

SEQ ID NO: 986177 - protein, 9 aa, Mycobacterium
EAGAGSGAL

SEQ ID NO: 986178 - protein, 8 aa, Mycobacterium
EAGARIGD

SEQ ID NO: 986179 - protein, 7 aa, Mycobacterium
EAGATPS

SEQ ID NO: 986180 - protein, 22 aa, Mycobacterium
EAGDTAAGLPGMSSSGAGRTGV

SEQ ID NO: 986181 - protein, 9 aa, Mycobacterium
EAGELSSNT

SEQ ID NO: 986182 - protein, 7 aa, Mycobacterium
EAGHRSK

SEQ ID NO: 986183 - protein, 7 aa, Mycobacterium
EAGLSKR

SEQ ID NO: 986184 - protein, 5 aa, Mycobacterium
EAGLV

SEQ ID NO: 986185 - protein, 7 aa, Mycobacterium
EAGPRVR

SEQ ID NO: 986186 - protein, 5 aa, Mycobacterium
EAGPV

SEQ ID NO: 986187 - protein, 16 aa, Mycobacterium
EAGQSWSTTATGPTEV

SEQ ID NO: 986188 - protein, 12 aa, Mycobacterium
EAGQVDPTGVGD

SEQ ID NO: 986189 - protein, 11 aa, Mycobacterium
EAGSHGKDTRG

SEQ ID NO: 986190 - protein, 7 aa, Mycobacterium
EAGTFPA

SEQ ID NO: 986191 - protein, 11 aa, Mycobacterium
EAGVTTYSTDE

SEQ ID NO: 986192 - protein, 12 aa, Mycobacterium
EAGYGYPEAGQT

SEQ ID NO: 986193 - protein, 6 aa, Mycobacterium
EAHKSF

SEQ ID NO: 986194 - protein, 11 aa, Mycobacterium
EAIARTKTELP

SEQ ID NO: 986195 - protein, 13 aa, Mycobacterium
EAIDETERRRAKQ

SEQ ID NO: 986196 - protein, 4 aa, Mycobacterium
EAIN

SEQ ID NO: 986197 - protein, 4 aa, Mycobacterium
EAKA

SEQ ID NO: 986198 - protein, 8 aa, Mycobacterium
EAKGRNGV

SEQ ID NO: 986199 - protein, 8 aa, Mycobacterium
EALDEPGV

SEQ ID NO: 986200 - protein, 6 aa, Mycobacterium
EALEPA

SEQ ID NO: 986201 - protein, 10 aa, Mycobacterium
EALGARHRQA

SEQ ID NO: 986202 - protein, 16 aa, Mycobacterium
EALPGPFSPSSSSVTV

SEQ ID NO: 986203 - protein, 6 aa, Mycobacterium
EALRDS

SEQ ID NO: 986204 - protein, 12 aa, Mycobacterium
EALSQATRESLE

SEQ ID NO: 986205 - protein, 6 aa, Mycobacterium
EAMSAE

SEQ ID NO: 986206 - protein, 6 aa, Mycobacterium
EANGND

SEQ ID NO: 986207 - protein, 29 aa, Mycobacterium
EANGPGRTPVMGSTGGAHRIESAKAGALT

SEQ ID NO: 986208 - protein, 12 aa, Mycobacterium
EANRARSRTLHL

SEQ ID NO: 986209 - protein, 22 aa, Mycobacterium
EANRSVGEVTDTGRGRHTSTQS

SEQ ID NO: 986210 - protein, 17 aa, Mycobacterium
EANVTASVDSSGFRFRA

SEQ ID NO: 986211 - protein, 5 aa, Mycobacterium
EAPAP

SEQ ID NO: 986212 - protein, 7 aa, Mycobacterium
EAPARAY

SEQ ID NO: 986213 - protein, 4 aa, Mycobacterium
EAPD

SEQ ID NO: 986214 - protein, 10 aa, Mycobacterium
EAPHGKLAEG

SEQ ID NO: 986215 - protein, 4 aa, Mycobacterium
EAPK

SEQ ID NO: 986216 - protein, 6 aa, Mycobacterium
EAPLSE

SEQ ID NO: 986217 - protein, 5 aa, Mycobacterium
EAPLT

SEQ ID NO: 986218 - protein, 6 aa, Mycobacterium
EAPPWV

SEQ ID NO: 986219 - protein, 6 aa, Mycobacterium
EAPSPL

SEQ ID NO: 986220 - protein, 6 aa, Mycobacterium
EAPTRV

SEQ ID NO: 986221 - protein, 4 aa, Mycobacterium
EAPV

SEQ ID NO: 986222 - protein, 5 aa, Mycobacterium
EAQIS

SEQ ID NO: 986223 - protein, 57 aa, Mycobacterium
EAQPPATPKPSLLPRPMSSPPEAPRPSANQHSRHARRGHHHRDETQQANPASATEPM

SEQ ID NO: 986224 - protein, 8 aa, Mycobacterium
EAQPTRRS

SEQ ID NO: 986225 - protein, 9 aa, Mycobacterium
EAQQQSKGR

SEQ ID NO: 986226 - protein, 4 aa, Mycobacterium
EARA

SEQ ID NO: 986227 - protein, 5 aa, Mycobacterium
EARHN

SEQ ID NO: 986228 - protein, 7 aa, Mycobacterium
EARKSRK

SEQ ID NO: 986229 - protein, 10 aa, Mycobacterium
EARPSGKKVS

SEQ ID NO: 986230 - protein, 10 aa, Mycobacterium
EARSDNAGPV

SEQ ID NO: 986231 - protein, 14 aa, Mycobacterium
EASATGSQRTGHSH

SEQ ID NO: 986232 - protein, 10 aa, Mycobacterium
EASDGVRSLQ

SEQ ID NO: 986233 - protein, 24 aa, Mycobacterium
EASGAGGYARELTADERAQQQKAL

SEQ ID NO: 986234 - protein, 19 aa, Mycobacterium
EASGTAAAGETAEADAQRI

SEQ ID NO: 986235 - protein, 9 aa, Mycobacterium
EASHRGGPG

SEQ ID NO: 986236 - protein, 4 aa, Mycobacterium
EAST

SEQ ID NO: 986237 - protein, 7 aa, Mycobacterium
EASVQGV

SEQ ID NO: 986238 - protein, 13 aa, Mycobacterium
EATASKASRDRQS

SEQ ID NO: 986239 - protein, 7 aa, Mycobacterium
EATDDTY

SEQ ID NO: 986240 - protein, 8 aa, Mycobacterium
EATDNPVG

SEQ ID NO: 986241 - protein, 14 aa, Mycobacterium
EATEAALKQAGALT

SEQ ID NO: 986242 - protein, 6 aa, Mycobacterium
EATEFT

SEQ ID NO: 986243 - protein, 5 aa, Mycobacterium
EATHR

SEQ ID NO: 986244 - protein, 7 aa, Mycobacterium
EATNSVK

SEQ ID NO: 986245 - protein, 5 aa, Mycobacterium
EATPR

SEQ ID NO: 986246 - protein, 4 aa, Mycobacterium
EATV

SEQ ID NO: 986247 - protein, 9 aa, Mycobacterium
EAVDVQEAG

SEQ ID NO: 986248 - protein, 6 aa, Mycobacterium
EAVEAG

SEQ ID NO: 986249 - protein, 4 aa, Mycobacterium
EAVQ

SEQ ID NO: 986250 - protein, 8 aa, Mycobacterium
EAVQTGDE

SEQ ID NO: 986251 - protein, 6 aa, Mycobacterium
ECQTAT

SEQ ID NO: 986252 - protein, 12 aa, Mycobacterium
ECSGSSGSEPLT

SEQ ID NO: 986253 - protein, 8 aa, Mycobacterium
ECSSNTAV

SEQ ID NO: 986254 - protein, 4 aa, Mycobacterium
EDAD

SEQ ID NO: 986255 - protein, 6 aa, Mycobacterium
EDAGYI

SEQ ID NO: 986256 - protein, 8 aa, Mycobacterium
EDALATND

SEQ ID NO: 986257 - protein, 9 aa, Mycobacterium
EDALDPIND

SEQ ID NO: 986258 - protein, 4 aa, Mycobacterium
EDAP

SEQ ID NO: 986259 - protein, 7 aa, Mycobacterium
EDAPEFG

SEQ ID NO: 986260 - protein, 8 aa, Mycobacterium
EDAPERLD

SEQ ID NO: 986261 - protein, 9 aa, Mycobacterium
EDASPKRCT

SEQ ID NO: 986262 - protein, 18 aa, Mycobacterium
EDASSGSAGQTQPFPVSS

SEQ ID NO: 986263 - protein, 6 aa, Mycobacterium
EDAVKA

SEQ ID NO: 986264 - protein, 5 aa, Mycobacterium
EDCSG

SEQ ID NO: 986265 - protein, 9 aa, Mycobacterium
EDDCPPPAY

SEQ ID NO: 986266 - protein, 6 aa, Mycobacterium
EDDGGS

SEQ ID NO: 986267 - protein, 14 aa, Mycobacterium
EDDIKTRTNEWDMV

SEQ ID NO: 986268 - protein, 9 aa, Mycobacterium
EDDPRRTVA

SEQ ID NO: 986269 - protein, 17 aa, Mycobacterium
EDDVTAVRAGLANLWKE

SEQ ID NO: 986270 - protein, 24 aa, Mycobacterium
EDESEALRQARKDAELTASADSVR

SEQ ID NO: 986271 - protein, 5 aa, Mycobacterium
EDEYQ

SEQ ID NO: 986272 - protein, 4 aa, Mycobacterium
EDFE

SEQ ID NO: 986273 - protein, 7 aa, Mycobacterium
EDFGSTP

SEQ ID NO: 986274 - protein, 4 aa, Mycobacterium
EDFT

SEQ ID NO: 986275 - protein, 12 aa, Mycobacterium
EDGKTVPQGEPG

SEQ ID NO: 986276 - protein, 6 aa, Mycobacterium
EDGREY

SEQ ID NO: 986277 - protein, 9 aa, Mycobacterium
EDGRTGASN

SEQ ID NO: 986278 - protein, 16 aa, Mycobacterium
EDGSPVRGVSGGTARL

SEQ ID NO: 986279 - protein, 8 aa, Mycobacterium
EDGTQTVT

SEQ ID NO: 986280 - protein, 6 aa, Mycobacterium
EDGVRS

SEQ ID NO: 986281 - protein, 6 aa, Mycobacterium
EDIRNT

SEQ ID NO: 986282 - protein, 15 aa, Mycobacterium
EDKASRNKSRTRYQD

SEQ ID NO: 986283 - protein, 7 aa, Mycobacterium
EDKGMRD

SEQ ID NO: 986284 - protein, 7 aa, Mycobacterium
EDKSADV

SEQ ID NO: 986285 - protein, 4 aa, Mycobacterium
EDLD

SEQ ID NO: 986286 - protein, 5 aa, Mycobacterium
EDLGD

SEQ ID NO: 986287 - protein, 6 aa, Mycobacterium
EDLPAD

SEQ ID NO: 986288 - protein, 15 aa, Mycobacterium
EDLPAHGEAVRRRFA

SEQ ID NO: 986289 - protein, 6 aa, Mycobacterium
EDNGPD

SEQ ID NO: 986290 - protein, 8 aa, Mycobacterium
EDNLTAKD

SEQ ID NO: 986291 - protein, 4 aa, Mycobacterium
EDNT

SEQ ID NO: 986292 - protein, 4 aa, Mycobacterium
EDNV

SEQ ID NO: 986293 - protein, 5 aa, Mycobacterium
EDPAR

SEQ ID NO: 986294 - protein, 6 aa, Mycobacterium
EDPEYD

SEQ ID NO: 986295 - protein, 8 aa, Mycobacterium
EDPNRDPV

SEQ ID NO: 986296 - protein, 5 aa, Mycobacterium
EDPPM

SEQ ID NO: 986297 - protein, 4 aa, Mycobacterium
EDQL

SEQ ID NO: 986298 - protein, 18 aa, Mycobacterium
EDQTGHRDTLRNSGADTV

SEQ ID NO: 986299 - protein, 27 aa, Mycobacterium
EDQYYSPDFGQATGAAVPLDDYGYSDY

SEQ ID NO: 986300 - protein, 9 aa, Mycobacterium
EDREGETVD

SEQ ID NO: 986301 - protein, 6 aa, Mycobacterium
EDRGAF

SEQ ID NO: 986302 - protein, 11 aa, Mycobacterium
EDRHRAHTGHG

SEQ ID NO: 986303 - protein, 5 aa, Mycobacterium
EDRSV

SEQ ID NO: 986304 - protein, 6 aa, Mycobacterium
EDRTEV

SEQ ID NO: 986305 - protein, 9 aa, Mycobacterium
EDSAKARSA

SEQ ID NO: 986306 - protein, 4 aa, Mycobacterium
EDSE

SEQ ID NO: 986307 - protein, 12 aa, Mycobacterium
EDSGAVTIAASA

SEQ ID NO: 986308 - protein, 6 aa, Mycobacterium
EDSGCD

SEQ ID NO: 986309 - protein, 10 aa, Mycobacterium
EDTSTYDGDH

SEQ ID NO: 986310 - protein, 4 aa, Mycobacterium
EDTT

SEQ ID NO: 986311 - protein, 5 aa, Mycobacterium
EDVAD

SEQ ID NO: 986312 - protein, 5 aa, Mycobacterium
EDVDG

SEQ ID NO: 986313 - protein, 6 aa, Mycobacterium
EDVRRS

SEQ ID NO: 986314 - protein, 4 aa, Mycobacterium
EDVT

SEQ ID NO: 986315 - protein, 11 aa, Mycobacterium
EDYKTTELTPG

SEQ ID NO: 986316 - protein, 6 aa, Mycobacterium
EDYTQQ

SEQ ID NO: 986317 - protein, 5 aa, Mycobacterium
EEACG

SEQ ID NO: 986318 - protein, 13 aa, Mycobacterium
EEAGIGSARCDAE

SEQ ID NO: 986319 - protein, 10 aa, Mycobacterium
EEAQRAKRDL

SEQ ID NO: 986320 - protein, 13 aa, Mycobacterium
EEAQRTHQELTQQ

SEQ ID NO: 986321 - protein, 7 aa, Mycobacterium
EEARAAL

SEQ ID NO: 986322 - protein, 6 aa, Mycobacterium
EEARGV

SEQ ID NO: 986323 - protein, 11 aa, Mycobacterium
EEDEASKERLE

SEQ ID NO: 986324 - protein, 6 aa, Mycobacterium
EEDPVK

SEQ ID NO: 986325 - protein, 9 aa, Mycobacterium
EEDSRGRTS

SEQ ID NO: 986326 - protein, 4 aa, Mycobacterium
EEEF

SEQ ID NO: 986327 - protein, 12 aa, Mycobacterium
EEERSVNGPDCG

SEQ ID NO: 986328 - protein, 4 aa, Mycobacterium
EEEV

SEQ ID NO: 986329 - protein, 7 aa, Mycobacterium
EEFEGRG

SEQ ID NO: 986330 - protein, 5 aa, Mycobacterium
EEFGD

SEQ ID NO: 986331 - protein, 8 aa, Mycobacterium
EEFSGDLG

SEQ ID NO: 986332 - protein, 7 aa, Mycobacterium
EEGDDTV

SEQ ID NO: 986333 - protein, 13 aa, Mycobacterium
EEGIAGVEQIIDK

SEQ ID NO: 986334 - protein, 6 aa, Mycobacterium
EEGKEG

SEQ ID NO: 986335 - protein, 11 aa, Mycobacterium
EEGYQSVGSGS

SEQ ID NO: 986336 - protein, 9 aa, Mycobacterium
EEHGGSYGS

SEQ ID NO: 986337 - protein, 4 aa, Mycobacterium
EEID

SEQ ID NO: 986338 - protein, 4 aa, Mycobacterium
EEIE

SEQ ID NO: 986339 - protein, 5 aa, Mycobacterium
EEIEP

SEQ ID NO: 986340 - protein, 13 aa, Mycobacterium
EEKPATPKSQYAV

SEQ ID NO: 986341 - protein, 13 aa, Mycobacterium
EEKSTESSAPHKV

SEQ ID NO: 986342 - protein, 4 aa, Mycobacterium
EELA

SEQ ID NO: 986343 - protein, 5 aa, Mycobacterium
EELGQ

SEQ ID NO: 986344 - protein, 7 aa, Mycobacterium
EENAVGG

SEQ ID NO: 986345 - protein, 8 aa, Mycobacterium
EENNNLQR

SEQ ID NO: 986346 - protein, 7 aa, Mycobacterium
EEPAGPV

SEQ ID NO: 986347 - protein, 6 aa, Mycobacterium
EEPFAS

SEQ ID NO: 986348 - protein, 6 aa, Mycobacterium
EEPPSS

SEQ ID NO: 986349 - protein, 15 aa, Mycobacterium
EEPTYEDSIDDRSKV

SEQ ID NO: 986350 - protein, 15 aa, Mycobacterium
EEQGVPPEKLAGTIQ

SEQ ID NO: 986351 - protein, 8 aa, Mycobacterium
EEQRVPNN

SEQ ID NO: 986352 - protein, 9 aa, Mycobacterium
EEQSRSALV

SEQ ID NO: 986353 - protein, 11 aa, Mycobacterium
EERAAAAASGM

SEQ ID NO: 986354 - protein, 13 aa, Mycobacterium
EERADKVEKQFQR

SEQ ID NO: 986355 - protein, 9 aa, Mycobacterium
EERPTSSAR

SEQ ID NO: 986356 - protein, 7 aa, Mycobacterium
EERRTTL

SEQ ID NO: 986357 - protein, 6 aa, Mycobacterium
EERYGV

SEQ ID NO: 986358 - protein, 9 aa, Mycobacterium
EESGAARAE

SEQ ID NO: 986359 - protein, 12 aa, Mycobacterium
EETARNVLPEEE

SEQ ID NO: 986360 - protein, 12 aa, Mycobacterium
EETKKAASFDTF

SEQ ID NO: 986361 - protein, 7 aa, Mycobacterium
EETPLEQ

SEQ ID NO: 986362 - protein, 11 aa, Mycobacterium
EEVGNGDGPDC

SEQ ID NO: 986363 - protein, 14 aa, Mycobacterium
EEVTADGRSDRGNF

SEQ ID NO: 986364 - protein, 8 aa, Mycobacterium
EEWTPRTS

SEQ ID NO: 986365 - protein, 5 aa, Mycobacterium
EEYSR

SEQ ID NO: 986366 - protein, 6 aa, Mycobacterium
EFDEDA

SEQ ID NO: 986367 - protein, 8 aa, Mycobacterium
EFDGGTER

SEQ ID NO: 986368 - protein, 37 aa, Mycobacterium
EFDGKPLKSVARGEVDLESEEEKTAHEAERKEQEQNF

SEQ ID NO: 986369 - protein, 8 aa, Mycobacterium
EFDPERAG

SEQ ID NO: 986370 - protein, 7 aa, Mycobacterium
EFESENR

SEQ ID NO: 986371 - protein, 5 aa, Mycobacterium
EFGKD

SEQ ID NO: 986372 - protein, 4 aa, Mycobacterium
EFGS

SEQ ID NO: 986373 - protein, 4 aa, Mycobacterium
EFHD

SEQ ID NO: 986374 - protein, 8 aa, Mycobacterium
EFSDSGAV

SEQ ID NO: 986375 - protein, 4 aa, Mycobacterium
EFSG

SEQ ID NO: 986376 - protein, 15 aa, Mycobacterium
EFSTPMGSSTSSHCR

SEQ ID NO: 986377 - protein, 15 aa, Mycobacterium
EGAATGSVDVSEGNR

SEQ ID NO: 986378 - protein, 7 aa, Mycobacterium
EGADGVE

SEQ ID NO: 986379 - protein, 4 aa, Mycobacterium
EGAI

SEQ ID NO: 986380 - protein, 4 aa, Mycobacterium
EGAL

SEQ ID NO: 986381 - protein, 7 aa, Mycobacterium
EGARSHG

SEQ ID NO: 986382 - protein, 8 aa, Mycobacterium
EGDQIGKG

SEQ ID NO: 986383 - protein, 9 aa, Mycobacterium
EGDQVTATP

SEQ ID NO: 986384 - protein, 8 aa, Mycobacterium
EGDSHRDA

SEQ ID NO: 986385 - protein, 7 aa, Mycobacterium
EGDTVEL

SEQ ID NO: 986386 - protein, 13 aa, Mycobacterium
EGEAGQSFDTPFG

SEQ ID NO: 986387 - protein, 7 aa, Mycobacterium
EGEGRSV

SEQ ID NO: 986388 - protein, 5 aa, Mycobacterium
EGEGV

SEQ ID NO: 986389 - protein, 5 aa, Mycobacterium
EGEIE

SEQ ID NO: 986390 - protein, 7 aa, Mycobacterium
EGEKDHA

SEQ ID NO: 986391 - protein, 9 aa, Mycobacterium
EGENGEPQL

SEQ ID NO: 986392 - protein, 4 aa, Mycobacterium
EGEP

SEQ ID NO: 986393 - protein, 10 aa, Mycobacterium
EGEPDDPDGM

SEQ ID NO: 986394 - protein, 13 aa, Mycobacterium
EGESETIDDDTDA

SEQ ID NO: 986395 - protein, 5 aa, Mycobacterium
EGFSD

SEQ ID NO: 986396 - protein, 5 aa, Mycobacterium
EGGAH

SEQ ID NO: 986397 - protein, 10 aa, Mycobacterium
EGGALENPAK

SEQ ID NO: 986398 - protein, 6 aa, Mycobacterium
EGGAPA

SEQ ID NO: 986399 - protein, 9 aa, Mycobacterium
EGGATGQPW

SEQ ID NO: 986400 - protein, 4 aa, Mycobacterium
EGGG

SEQ ID NO: 986401 - protein, 14 aa, Mycobacterium
EGGKITGERETDEG

SEQ ID NO: 986402 - protein, 7 aa, Mycobacterium
EGGLPSA

SEQ ID NO: 986403 - protein, 8 aa, Mycobacterium
EGGPRPNH

SEQ ID NO: 986404 - protein, 11 aa, Mycobacterium
EGGPSRNHPRT

SEQ ID NO: 986405 - protein, 7 aa, Mycobacterium
EGGQRVA

SEQ ID NO: 986406 - protein, 15 aa, Mycobacterium
EGGRTVGAGRVVKII

SEQ ID NO: 986407 - protein, 5 aa, Mycobacterium
EGGTI

SEQ ID NO: 986408 - protein, 8 aa, Mycobacterium
EGHGTGTM

SEQ ID NO: 986409 - protein, 16 aa, Mycobacterium
EGHKLSKDEFGSFQSL

SEQ ID NO: 986410 - protein, 14 aa, Mycobacterium
EGHTETADGRSIER

SEQ ID NO: 986411 - protein, 9 aa, Mycobacterium
EGIAEGREH

SEQ ID NO: 986412 - protein, 4 aa, Mycobacterium
EGKA

SEQ ID NO: 986413 - protein, 4 aa, Mycobacterium
EGKQ

SEQ ID NO: 986414 - protein, 6 aa, Mycobacterium
EGKQRP

SEQ ID NO: 986415 - protein, 5 aa, Mycobacterium
EGKTP

SEQ ID NO: 986416 - protein, 10 aa, Mycobacterium
EGKTVGETTR

SEQ ID NO: 986417 - protein, 5 aa, Mycobacterium
EGLDQ

SEQ ID NO: 986418 - protein, 6 aa, Mycobacterium
EGLPDG

SEQ ID NO: 986419 - protein, 13 aa, Mycobacterium
EGMAGKDIDPRVK

SEQ ID NO: 986420 - protein, 4 aa, Mycobacterium
EGMP

SEQ ID NO: 986421 - protein, 4 aa, Mycobacterium
EGNT

SEQ ID NO: 986422 - protein, 7 aa, Mycobacterium
EGPDYAA

SEQ ID NO: 986423 - protein, 20 aa, Mycobacterium
EGPEVGGPYGPYRQSQRTDI

SEQ ID NO: 986424 - protein, 6 aa, Mycobacterium
EGPGAE

SEQ ID NO: 986425 - protein, 13 aa, Mycobacterium
EGPGITDEARTGA

SEQ ID NO: 986426 - protein, 9 aa, Mycobacterium
EGPKGGPGM

SEQ ID NO: 986427 - protein, 8 aa, Mycobacterium
EGPQDGSV

SEQ ID NO: 986428 - protein, 6 aa, Mycobacterium
EGPSEA

SEQ ID NO: 986429 - protein, 4 aa, Mycobacterium
EGPT

SEQ ID NO: 986430 - protein, 5 aa, Mycobacterium
EGPTI

SEQ ID NO: 986431 - protein, 4 aa, Mycobacterium
EGQA

SEQ ID NO: 986432 - protein, 10 aa, Mycobacterium
EGQKVNAQHI

SEQ ID NO: 986433 - protein, 6 aa, Mycobacterium
EGQREV

SEQ ID NO: 986434 - protein, 16 aa, Mycobacterium
EGQRPHGENIESDRTF

SEQ ID NO: 986435 - protein, 5 aa, Mycobacterium
EGQTV

SEQ ID NO: 986436 - protein, 7 aa, Mycobacterium
EGRAGEQ

SEQ ID NO: 986437 - protein, 9 aa, Mycobacterium
EGRAKRDDT

SEQ ID NO: 986438 - protein, 7 aa, Mycobacterium
EGRDPYP

SEQ ID NO: 986439 - protein, 9 aa, Mycobacterium
EGRGMTTDA

SEQ ID NO: 986440 - protein, 7 aa, Mycobacterium
EGRGSRL

SEQ ID NO: 986441 - protein, 4 aa, Mycobacterium
EGRK

SEQ ID NO: 986442 - protein, 5 aa, Mycobacterium
EGRKP

SEQ ID NO: 986443 - protein, 8 aa, Mycobacterium
EGRSTEDV

SEQ ID NO: 986444 - protein, 11 aa, Mycobacterium
EGSAADNQASM

SEQ ID NO: 986445 - protein, 8 aa, Mycobacterium
EGSADPHE

SEQ ID NO: 986446 - protein, 8 aa, Mycobacterium
EGSAGNSF

SEQ ID NO: 986447 - protein, 9 aa, Mycobacterium
EGSHVGGGA

SEQ ID NO: 986448 - protein, 7 aa, Mycobacterium
EGSISED

SEQ ID NO: 986449 - protein, 6 aa, Mycobacterium
EGSKRV

SEQ ID NO: 986450 - protein, 13 aa, Mycobacterium
EGSNIVGRGQDAQ

SEQ ID NO: 986451 - protein, 11 aa, Mycobacterium
EGSRRSAPEQK

SEQ ID NO: 986452 - protein, 4 aa, Mycobacterium
EGTA

SEQ ID NO: 986453 - protein, 5 aa, Mycobacterium
EGTFT

SEQ ID NO: 986454 - protein, 6 aa, Mycobacterium
EGTGTL

SEQ ID NO: 986455 - protein, 4 aa, Mycobacterium
EGTN

SEQ ID NO: 986456 - protein, 11 aa, Mycobacterium
EGTNTEGVARG

SEQ ID NO: 986457 - protein, 4 aa, Mycobacterium
EGTP

SEQ ID NO: 986458 - protein, 8 aa, Mycobacterium
EGTPPGLP

SEQ ID NO: 986459 - protein, 7 aa, Mycobacterium
EGTPQRL

SEQ ID NO: 986460 - protein, 9 aa, Mycobacterium
EGVHPDQEY

SEQ ID NO: 986461 - protein, 7 aa, Mycobacterium
EGVPETP

SEQ ID NO: 986462 - protein, 6 aa, Mycobacterium
EGVREG

SEQ ID NO: 986463 - protein, 7 aa, Mycobacterium
EGVSADA

SEQ ID NO: 986464 - protein, 6 aa, Mycobacterium
EGYGRL

SEQ ID NO: 986465 - protein, 4 aa, Mycobacterium
EHAD

SEQ ID NO: 986466 - protein, 11 aa, Mycobacterium
EHAKARGAKPL

SEQ ID NO: 986467 - protein, 5 aa, Mycobacterium
EHDEN

SEQ ID NO: 986468 - protein, 4 aa, Mycobacterium
EHDG

SEQ ID NO: 986469 - protein, 13 aa, Mycobacterium
EHDGQSQFRTRKH

SEQ ID NO: 986470 - protein, 18 aa, Mycobacterium
EHELGTKGPGQDGPGRET

SEQ ID NO: 986471 - protein, 10 aa, Mycobacterium
EHERIAGGVD

SEQ ID NO: 986472 - protein, 5 aa, Mycobacterium
EHGAP

SEQ ID NO: 986473 - protein, 8 aa, Mycobacterium
EHGASAED

SEQ ID NO: 986474 - protein, 4 aa, Mycobacterium
EHGG

SEQ ID NO: 986475 - protein, 6 aa, Mycobacterium
EHGGDD

SEQ ID NO: 986476 - protein, 9 aa, Mycobacterium
EHGGDRSAD

SEQ ID NO: 986477 - protein, 12 aa, Mycobacterium
EHGGPGGRQLPA

SEQ ID NO: 986478 - protein, 7 aa, Mycobacterium
EHGNERV

SEQ ID NO: 986479 - protein, 8 aa, Mycobacterium
EHGSEGNF

SEQ ID NO: 986480 - protein, 9 aa, Mycobacterium
EHGSGTKHT

SEQ ID NO: 986481 - protein, 6 aa, Mycobacterium
EHGSPA

SEQ ID NO: 986482 - protein, 7 aa, Mycobacterium
EHGYPTV

SEQ ID NO: 986483 - protein, 11 aa, Mycobacterium
EHHHQSRSRAG

SEQ ID NO: 986484 - protein, 4 aa, Mycobacterium
EHMG

SEQ ID NO: 986485 - protein, 15 aa, Mycobacterium
EHNDDGTVRKPGQDY

SEQ ID NO: 986486 - protein, 4 aa, Mycobacterium
EHNL

SEQ ID NO: 986487 - protein, 4 aa, Mycobacterium
EHNT

SEQ ID NO: 986488 - protein, 4 aa, Mycobacterium
EHPA

SEQ ID NO: 986489 - protein, 7 aa, Mycobacterium
EHPSTAR

SEQ ID NO: 986490 - protein, 20 aa, Mycobacterium
EHQTYTVRTTEGYEITGTSN

SEQ ID NO: 986491 - protein, 8 aa, Mycobacterium
EHRGNETV

SEQ ID NO: 986492 - protein, 12 aa, Mycobacterium
EHRKTYGDTSRL

SEQ ID NO: 986493 - protein, 7 aa, Mycobacterium
EHRQQRV

SEQ ID NO: 986494 - protein, 9 aa, Mycobacterium
EHRRSTGAT

SEQ ID NO: 986495 - protein, 13 aa, Mycobacterium
EHRSTISPYLVKH

SEQ ID NO: 986496 - protein, 14 aa, Mycobacterium
EHSHPGGGLPSYPH

SEQ ID NO: 986497 - protein, 11 aa, Mycobacterium
EHTARASLVGS

SEQ ID NO: 986498 - protein, 5 aa, Mycobacterium
EHTDS

SEQ ID NO: 986499 - protein, 6 aa, Mycobacterium
EHTDVE

SEQ ID NO: 986500 - protein, 10 aa, Mycobacterium
EHTKKKESEI

SEQ ID NO: 986501 - protein, 8 aa, Mycobacterium
EIAGAPND

SEQ ID NO: 986502 - protein, 11 aa, Mycobacterium
EIANGNEQRTN

SEQ ID NO: 986503 - protein, 17 aa, Mycobacterium
EIAPHAADVDQRARFPE

SEQ ID NO: 986504 - protein, 15 aa, Mycobacterium
EIAQGSTEGRPRRKF

SEQ ID NO: 986505 - protein, 11 aa, Mycobacterium
EIAQSRAVGDG

SEQ ID NO: 986506 - protein, 10 aa, Mycobacterium
EIDAGPTNNW

SEQ ID NO: 986507 - protein, 6 aa, Mycobacterium
EIGKSS

SEQ ID NO: 986508 - protein, 11 aa, Mycobacterium
EIGPYGSSRTR

SEQ ID NO: 986509 - protein, 7 aa, Mycobacterium
EIGSGSV

SEQ ID NO: 986510 - protein, 8 aa, Mycobacterium
EIKGKGKV

SEQ ID NO: 986511 - protein, 8 aa, Mycobacterium
EINGSDMA

SEQ ID NO: 986512 - protein, 10 aa, Mycobacterium
EIQKTPPEPM

SEQ ID NO: 986513 - protein, 5 aa, Mycobacterium
EISGT

SEQ ID NO: 986514 - protein, 23 aa, Mycobacterium
EISPRKVNKPVTGQYNSAGVNPR

SEQ ID NO: 986515 - protein, 19 aa, Mycobacterium
EITAPNTDDGVARVLERWW

SEQ ID NO: 986516 - protein, 5 aa, Mycobacterium
EITAR

SEQ ID NO: 986517 - protein, 4 aa, Mycobacterium
EITE

SEQ ID NO: 986518 - protein, 4 aa, Mycobacterium
EITG

SEQ ID NO: 986519 - protein, 5 aa, Mycobacterium
EITGG

SEQ ID NO: 986520 - protein, 8 aa, Mycobacterium
EITPQTSV

SEQ ID NO: 986521 - protein, 11 aa, Mycobacterium
EITTGPLGQGL

SEQ ID NO: 986522 - protein, 5 aa, Mycobacterium
EIYEA

SEQ ID NO: 986523 - protein, 8 aa, Mycobacterium
EKAAGPRR

SEQ ID NO: 986524 - protein, 7 aa, Mycobacterium
EKAGFTV

SEQ ID NO: 986525 - protein, 5 aa, Mycobacterium
EKAMR

SEQ ID NO: 986526 - protein, 5 aa, Mycobacterium
EKANA

SEQ ID NO: 986527 - protein, 6 aa, Mycobacterium
EKAQQL

SEQ ID NO: 986528 - protein, 29 aa, Mycobacterium
EKDSKGSKGAQNPKGARDSKNSKSYGEST

SEQ ID NO: 986529 - protein, 10 aa, Mycobacterium
EKDTKLGHEA

SEQ ID NO: 986530 - protein, 13 aa, Mycobacterium
EKEARNHKERKPI

SEQ ID NO: 986531 - protein, 10 aa, Mycobacterium
EKEAVDGIKG

SEQ ID NO: 986532 - protein, 23 aa, Mycobacterium
EKFTRQEQDEFAARSHQKAAAAW

SEQ ID NO: 986533 - protein, 15 aa, Mycobacterium
EKGDRYGPPERARQA

SEQ ID NO: 986534 - protein, 5 aa, Mycobacterium
EKGTE

SEQ ID NO: 986535 - protein, 4 aa, Mycobacterium
EKHR

SEQ ID NO: 986536 - protein, 13 aa, Mycobacterium
EKLDTANHEAART

SEQ ID NO: 986537 - protein, 11 aa, Mycobacterium
EKLGQDSQALG

SEQ ID NO: 986538 - protein, 6 aa, Mycobacterium
EKMRQA

SEQ ID NO: 986539 - protein, 10 aa, Mycobacterium
EKNKLERSLG

SEQ ID NO: 986540 - protein, 7 aa, Mycobacterium
EKNQSAA

SEQ ID NO: 986541 - protein, 7 aa, Mycobacterium
EKPAKAR

SEQ ID NO: 986542 - protein, 7 aa, Mycobacterium
EKPEAVD

SEQ ID NO: 986543 - protein, 9 aa, Mycobacterium
EKPGAPDLS

SEQ ID NO: 986544 - protein, 9 aa, Mycobacterium
EKPTAESVT

SEQ ID NO: 986545 - protein, 12 aa, Mycobacterium
EKQKEGKKRMKT

SEQ ID NO: 986546 - protein, 4 aa, Mycobacterium
EKRG

SEQ ID NO: 986547 - protein, 5 aa, Mycobacterium
EKRGK

SEQ ID NO: 986548 - protein, 5 aa, Mycobacterium
EKRIN

SEQ ID NO: 986549 - protein, 7 aa, Mycobacterium
EKRPYRH

SEQ ID NO: 986550 - protein, 5 aa, Mycobacterium
EKRRT

SEQ ID NO: 986551 - protein, 18 aa, Mycobacterium
EKSAEFAEHGNRVYLPLT

SEQ ID NO: 986552 - protein, 7 aa, Mycobacterium
EKTRRGL

SEQ ID NO: 986553 - protein, 6 aa, Mycobacterium
EKTSQW

SEQ ID NO: 986554 - protein, 9 aa, Mycobacterium
EKYGDDRRT

SEQ ID NO: 986555 - protein, 9 aa, Mycobacterium
EKYGGSGYG

SEQ ID NO: 986556 - protein, 19 aa, Mycobacterium
ELAAGKSFGEVESTKSVSD

SEQ ID NO: 986557 - protein, 6 aa, Mycobacterium
ELAGDK

SEQ ID NO: 986558 - protein, 8 aa, Mycobacterium
ELAQGSVQ

SEQ ID NO: 986559 - protein, 7 aa, Mycobacterium
ELDDEGQ

SEQ ID NO: 986560 - protein, 9 aa, Mycobacterium
ELDDESAAE

SEQ ID NO: 986561 - protein, 6 aa, Mycobacterium
ELDGEG

SEQ ID NO: 986562 - protein, 17 aa, Mycobacterium
ELDSSNRQIREAAERAA

SEQ ID NO: 986563 - protein, 5 aa, Mycobacterium
ELEDP

SEQ ID NO: 986564 - protein, 10 aa, Mycobacterium
ELENTSDQAL

SEQ ID NO: 986565 - protein, 6 aa, Mycobacterium
ELETQR

SEQ ID NO: 986566 - protein, 10 aa, Mycobacterium
ELGDDATARQ

SEQ ID NO: 986567 - protein, 7 aa, Mycobacterium
ELGDEPE

SEQ ID NO: 986568 - protein, 6 aa, Mycobacterium
ELGGNR

SEQ ID NO: 986569 - protein, 6 aa, Mycobacterium
ELGNEG

SEQ ID NO: 986570 - protein, 8 aa, Mycobacterium
ELGPDGKD

SEQ ID NO: 986571 - protein, 4 aa, Mycobacterium
ELGQ

SEQ ID NO: 986572 - protein, 27 aa, Mycobacterium
ELGQRGSAAPVDSNADAGGFDQFNRGN

SEQ ID NO: 986573 - protein, 7 aa, Mycobacterium
ELGRRDD

SEQ ID NO: 986574 - protein, 18 aa, Mycobacterium
ELGRRDRPSTSPSQSRVS

SEQ ID NO: 986575 - protein, 17 aa, Mycobacterium
ELGSERGPGSLAGYLRL

SEQ ID NO: 986576 - protein, 8 aa, Mycobacterium
ELNGGSKV

SEQ ID NO: 986577 - protein, 5 aa, Mycobacterium
ELPAA

SEQ ID NO: 986578 - protein, 15 aa, Mycobacterium
ELPAGVGNDGELPAG

SEQ ID NO: 986579 - protein, 6 aa, Mycobacterium
ELPDGS

SEQ ID NO: 986580 - protein, 13 aa, Mycobacterium
ELPEASRTARGQH

SEQ ID NO: 986581 - protein, 6 aa, Mycobacterium
ELPGER

SEQ ID NO: 986582 - protein, 10 aa, Mycobacterium
ELPGGRERLQ

SEQ ID NO: 986583 - protein, 13 aa, Mycobacterium
ELPGRPRLSRKVL

SEQ ID NO: 986584 - protein, 16 aa, Mycobacterium
ELPPEEAADIPQAPTQ

SEQ ID NO: 986585 - protein, 12 aa, Mycobacterium
ELPTSAKIQEPL

SEQ ID NO: 986586 - protein, 5 aa, Mycobacterium
ELQPG

SEQ ID NO: 986587 - protein, 7 aa, Mycobacterium
ELREETR

SEQ ID NO: 986588 - protein, 4 aa, Mycobacterium
ELRP

SEQ ID NO: 986589 - protein, 8 aa, Mycobacterium
ELRSGRAR

SEQ ID NO: 986590 - protein, 8 aa, Mycobacterium
ELRSKPGD

SEQ ID NO: 986591 - protein, 15 aa, Mycobacterium
ELSAASGALNADGVA

SEQ ID NO: 986592 - protein, 6 aa, Mycobacterium
ELSDAG

SEQ ID NO: 986593 - protein, 6 aa, Mycobacterium
ELSDAS

SEQ ID NO: 986594 - protein, 13 aa, Mycobacterium
ELSETQPDEAADA

SEQ ID NO: 986595 - protein, 14 aa, Mycobacterium
ELSGAAGAHGRAGD

SEQ ID NO: 986596 - protein, 9 aa, Mycobacterium
ELSGRAESV

SEQ ID NO: 986597 - protein, 7 aa, Mycobacterium
ELSPTRD

SEQ ID NO: 986598 - protein, 13 aa, Mycobacterium
ELSRQAEQTTEAV

SEQ ID NO: 986599 - protein, 30 aa, Mycobacterium
ELSSTGAADPGQLDGDDRVSEDSWDEDAWR

SEQ ID NO: 986600 - protein, 10 aa, Mycobacterium
ELSTDDSPGF

SEQ ID NO: 986601 - protein, 5 aa, Mycobacterium
ELTAT

SEQ ID NO: 986602 - protein, 6 aa, Mycobacterium
ELTDDE

SEQ ID NO: 986603 - protein, 13 aa, Mycobacterium
ELTDHDVPSGRRR

SEQ ID NO: 986604 - protein, 7 aa, Mycobacterium
ELTEASA

SEQ ID NO: 986605 - protein, 4 aa, Mycobacterium
ELTP

SEQ ID NO: 986606 - protein, 5 aa, Mycobacterium
ELTPA

SEQ ID NO: 986607 - protein, 5 aa, Mycobacterium
ELTPQ

SEQ ID NO: 986608 - protein, 4 aa, Mycobacterium
ELTS

SEQ ID NO: 986609 - protein, 7 aa, Mycobacterium
ELTTPDH

SEQ ID NO: 986610 - protein, 4 aa, Mycobacterium
EMAY

SEQ ID NO: 986611 - protein, 7 aa, Mycobacterium
EMNTRGV

SEQ ID NO: 986612 - protein, 23 aa, Mycobacterium
EMQTENQAQASALETPMQNPTVV

SEQ ID NO: 986613 - protein, 8 aa, Mycobacterium
EMRGATAP

SEQ ID NO: 986614 - protein, 6 aa, Mycobacterium
EMSADG

SEQ ID NO: 986615 - protein, 6 aa, Mycobacterium
EMSDAT

SEQ ID NO: 986616 - protein, 5 aa, Mycobacterium
EMSDD

SEQ ID NO: 986617 - protein, 5 aa, Mycobacterium
EMTSD

SEQ ID NO: 986618 - protein, 8 aa, Mycobacterium
ENAEHPIE

SEQ ID NO: 986619 - protein, 11 aa, Mycobacterium
ENAKEKPQEGT

SEQ ID NO: 986620 - protein, 4 aa, Mycobacterium
ENAS

SEQ ID NO: 986621 - protein, 8 aa, Mycobacterium
ENDGATAW

SEQ ID NO: 986622 - protein, 9 aa, Mycobacterium
ENDPRRPVT

SEQ ID NO: 986623 - protein, 8 aa, Mycobacterium
ENDTVATN

SEQ ID NO: 986624 - protein, 6 aa, Mycobacterium
ENEIEP

SEQ ID NO: 986625 - protein, 15 aa, Mycobacterium
ENEQPDGQQAAHSDG

SEQ ID NO: 986626 - protein, 7 aa, Mycobacterium
ENFEPAP

SEQ ID NO: 986627 - protein, 11 aa, Mycobacterium
ENFKTRGGLTT

SEQ ID NO: 986628 - protein, 18 aa, Mycobacterium
ENGATQVSSTNDPDEGEA

SEQ ID NO: 986629 - protein, 21 aa, Mycobacterium
ENGEYLAKTGSEIGVTTGRRR

SEQ ID NO: 986630 - protein, 6 aa, Mycobacterium
ENGHNN

SEQ ID NO: 986631 - protein, 7 aa, Mycobacterium
ENGRGSQ

SEQ ID NO: 986632 - protein, 4 aa, Mycobacterium
ENGS

SEQ ID NO: 986633 - protein, 5 aa, Mycobacterium
ENGSE

SEQ ID NO: 986634 - protein, 14 aa, Mycobacterium
ENGVGTVAAGVSKA

SEQ ID NO: 986635 - protein, 8 aa, Mycobacterium
ENHRGGTV

SEQ ID NO: 986636 - protein, 9 aa, Mycobacterium
ENIPGTGPV

SEQ ID NO: 986637 - protein, 38 aa, Mycobacterium
ENLPGGVYAPSSGGYAEPAGRDYDYGQPGAANDYSQPV

SEQ ID NO: 986638 - protein, 8 aa, Mycobacterium
ENLPSTGG

SEQ ID NO: 986639 - protein, 7 aa, Mycobacterium
ENNGTPR

SEQ ID NO: 986640 - protein, 13 aa, Mycobacterium
ENPAESGSGTHNA

SEQ ID NO: 986641 - protein, 16 aa, Mycobacterium
ENPANPAIHAATTAEE

SEQ ID NO: 986642 - protein, 7 aa, Mycobacterium
ENPDMSD

SEQ ID NO: 986643 - protein, 5 aa, Mycobacterium
ENPRV

SEQ ID NO: 986644 - protein, 4 aa, Mycobacterium
ENPY

SEQ ID NO: 986645 - protein, 12 aa, Mycobacterium
ENRALRPGGGVI

SEQ ID NO: 986646 - protein, 8 aa, Mycobacterium
ENREDLTE

SEQ ID NO: 986647 - protein, 10 aa, Mycobacterium
ENRETAVQPG

SEQ ID NO: 986648 - protein, 10 aa, Mycobacterium
ENSTAAPPLT

SEQ ID NO: 986649 - protein, 21 aa, Mycobacterium
ENTALERVDPAKDADGLHPTN

SEQ ID NO: 986650 - protein, 8 aa, Mycobacterium
ENTGTSFA

SEQ ID NO: 986651 - protein, 11 aa, Mycobacterium
ENTLQRGQAGL

SEQ ID NO: 986652 - protein, 6 aa, Mycobacterium
ENTPFD

SEQ ID NO: 986653 - protein, 10 aa, Mycobacterium
ENVAESLTRG

SEQ ID NO: 986654 - protein, 7 aa, Mycobacterium
ENVDGAP

SEQ ID NO: 986655 - protein, 5 aa, Mycobacterium
ENYDE

SEQ ID NO: 986656 - protein, 5 aa, Mycobacterium
ENYPG

SEQ ID NO: 986657 - protein, 17 aa, Mycobacterium
EPAEELRSAQSPQETAS

SEQ ID NO: 986658 - protein, 4 aa, Mycobacterium
EPAF

SEQ ID NO: 986659 - protein, 4 aa, Mycobacterium
EPAS

SEQ ID NO: 986660 - protein, 14 aa, Mycobacterium
EPATGGSTPVGGGR

SEQ ID NO: 986661 - protein, 5 aa, Mycobacterium
EPATT

SEQ ID NO: 986662 - protein, 20 aa, Mycobacterium
EPDAGSDAASVKTRATRVDG

SEQ ID NO: 986663 - protein, 21 aa, Mycobacterium
EPDAGSDVGAGRTKAVHQEDD

SEQ ID NO: 986664 - protein, 5 aa, Mycobacterium
EPDDV

SEQ ID NO: 986665 - protein, 18 aa, Mycobacterium
EPDPTSTSSRCSTPAENL

SEQ ID NO: 986666 - protein, 10 aa, Mycobacterium
EPDSGLDPVR

SEQ ID NO: 986667 - protein, 4 aa, Mycobacterium
EPEE

SEQ ID NO: 986668 - protein, 4 aa, Mycobacterium
EPEL

SEQ ID NO: 986669 - protein, 6 aa, Mycobacterium
EPERDQ

SEQ ID NO: 986670 - protein, 8 aa, Mycobacterium
EPETDLDD

SEQ ID NO: 986671 - protein, 7 aa, Mycobacterium
EPFTPED

SEQ ID NO: 986672 - protein, 8 aa, Mycobacterium
EPGATDTE

SEQ ID NO: 986673 - protein, 5 aa, Mycobacterium
EPGER

SEQ ID NO: 986674 - protein, 20 aa, Mycobacterium
EPGFGSDSAAVSTTATLDGD

SEQ ID NO: 986675 - protein, 15 aa, Mycobacterium
EPGGRPDAAEPGPSM

SEQ ID NO: 986676 - protein, 15 aa, Mycobacterium
EPGIDTCSGRWCRSH

SEQ ID NO: 986677 - protein, 5 aa, Mycobacterium
EPGRT

SEQ ID NO: 986678 - protein, 7 aa, Mycobacterium
EPGVGKT

SEQ ID NO: 986679 - protein, 7 aa, Mycobacterium
EPGYGDE

SEQ ID NO: 986680 - protein, 4 aa, Mycobacterium
EPHG

SEQ ID NO: 986681 - protein, 14 aa, Mycobacterium
EPHGGGSAVTSTLC

SEQ ID NO: 986682 - protein, 8 aa, Mycobacterium
EPHGLSTE

SEQ ID NO: 986683 - protein, 14 aa, Mycobacterium
EPKDVQAVERTREF

SEQ ID NO: 986684 - protein, 8 aa, Mycobacterium
EPKGKERF

SEQ ID NO: 986685 - protein, 5 aa, Mycobacterium
EPKPD

SEQ ID NO: 986686 - protein, 9 aa, Mycobacterium
EPKPVRNIT

SEQ ID NO: 986687 - protein, 17 aa, Mycobacterium
EPKRAGRQSTSPPPLRE

SEQ ID NO: 986688 - protein, 13 aa, Mycobacterium
EPLADSTASQARR

SEQ ID NO: 986689 - protein, 5 aa, Mycobacterium
EPLGR

SEQ ID NO: 986690 - protein, 6 aa, Mycobacterium
EPLPVR

SEQ ID NO: 986691 - protein, 16 aa, Mycobacterium
EPLRPGKAEQSNSGYR

SEQ ID NO: 986692 - protein, 4 aa, Mycobacterium
EPME

SEQ ID NO: 986693 - protein, 4 aa, Mycobacterium
EPMP

SEQ ID NO: 986694 - protein, 16 aa, Mycobacterium
EPMTGSELATVLESLN

SEQ ID NO: 986695 - protein, 7 aa, Mycobacterium
EPNLQPG

SEQ ID NO: 986696 - protein, 14 aa, Mycobacterium
EPPFPGPGINPGRS

SEQ ID NO: 986697 - protein, 15 aa, Mycobacterium
EPPVGSNADDLNDKK

SEQ ID NO: 986698 - protein, 12 aa, Mycobacterium
EPRASSTSHSIE

SEQ ID NO: 986699 - protein, 22 aa, Mycobacterium
EPREAEQLPIPPPAYASTELGQ

SEQ ID NO: 986700 - protein, 6 aa, Mycobacterium
EPRHPF

SEQ ID NO: 986701 - protein, 9 aa, Mycobacterium
EPRPDAEQR

SEQ ID NO: 986702 - protein, 6 aa, Mycobacterium
EPRQPT

SEQ ID NO: 986703 - protein, 6 aa, Mycobacterium
EPRRHR

SEQ ID NO: 986704 - protein, 4 aa, Mycobacterium
EPSA

SEQ ID NO: 986705 - protein, 7 aa, Mycobacterium
EPSCGDG

SEQ ID NO: 986706 - protein, 4 aa, Mycobacterium
EPSY

SEQ ID NO: 986707 - protein, 23 aa, Mycobacterium
EPTCHDPDSGGHFGGPDGYGGRY

SEQ ID NO: 986708 - protein, 8 aa, Mycobacterium
EPTEREGV

SEQ ID NO: 986709 - protein, 9 aa, Mycobacterium
EPTESESLA

SEQ ID NO: 986710 - protein, 13 aa, Mycobacterium
EPTGNLDPDTSKD

SEQ ID NO: 986711 - protein, 4 aa, Mycobacterium
EPTI

SEQ ID NO: 986712 - protein, 10 aa, Mycobacterium
EPTLAPDEDA

SEQ ID NO: 986713 - protein, 7 aa, Mycobacterium
EPTNDLD

SEQ ID NO: 986714 - protein, 8 aa, Mycobacterium
EPTPGPFE

SEQ ID NO: 986715 - protein, 8 aa, Mycobacterium
EPTSGNTG

SEQ ID NO: 986716 - protein, 5 aa, Mycobacterium
EPTTA

SEQ ID NO: 986717 - protein, 6 aa, Mycobacterium
EPTTNQ

SEQ ID NO: 986718 - protein, 16 aa, Mycobacterium
EPYPQPPEPENFDPDG

SEQ ID NO: 986719 - protein, 11 aa, Mycobacterium
EPYQGAATGVG

SEQ ID NO: 986720 - protein, 7 aa, Mycobacterium
EQAISQA

SEQ ID NO: 986721 - protein, 24 aa, Mycobacterium
EQALANASADRASQIRTVDRSERI

SEQ ID NO: 986722 - protein, 7 aa, Mycobacterium
EQANGAS

SEQ ID NO: 986723 - protein, 4 aa, Mycobacterium
EQCG

SEQ ID NO: 986724 - protein, 6 aa, Mycobacterium
EQDPDT

SEQ ID NO: 986725 - protein, 8 aa, Mycobacterium
EQERGITI

SEQ ID NO: 986726 - protein, 18 aa, Mycobacterium
EQFERQARKALAAGRIQE

SEQ ID NO: 986727 - protein, 32 aa, Mycobacterium
EQFTEEEASTIGAESDTDAEDWEHRSKAEGVK

SEQ ID NO: 986728 - protein, 13 aa, Mycobacterium
EQGAGHAASGYAH

SEQ ID NO: 986729 - protein, 8 aa, Mycobacterium
EQGESRDL

SEQ ID NO: 986730 - protein, 16 aa, Mycobacterium
EQGGLDPASLAGSSTA

SEQ ID NO: 986731 - protein, 5 aa, Mycobacterium
EQGIS

SEQ ID NO: 986732 - protein, 6 aa, Mycobacterium
EQGKAA

SEQ ID NO: 986733 - protein, 8 aa, Mycobacterium
EQGRCPGY

SEQ ID NO: 986734 - protein, 5 aa, Mycobacterium
EQGTI

SEQ ID NO: 986735 - protein, 5 aa, Mycobacterium
EQHER

SEQ ID NO: 986736 - protein, 13 aa, Mycobacterium
EQHIRRDKATSNI

SEQ ID NO: 986737 - protein, 4 aa, Mycobacterium
EQLH

SEQ ID NO: 986738 - protein, 8 aa, Mycobacterium
EQNCSTST

SEQ ID NO: 986739 - protein, 18 aa, Mycobacterium
EQNRRSHPLQGEQTLAEG

SEQ ID NO: 986740 - protein, 9 aa, Mycobacterium
EQNTQAPAV

SEQ ID NO: 986741 - protein, 5 aa, Mycobacterium
EQPCC

SEQ ID NO: 986742 - protein, 19 aa, Mycobacterium
EQPDDADNPLQAAYCTAKY

SEQ ID NO: 986743 - protein, 11 aa, Mycobacterium
EQPDGGAVKIG

SEQ ID NO: 986744 - protein, 7 aa, Mycobacterium
EQPHVPE

SEQ ID NO: 986745 - protein, 6 aa, Mycobacterium
EQPKRT

SEQ ID NO: 986746 - protein, 8 aa, Mycobacterium
EQQRPLSE

SEQ ID NO: 986747 - protein, 10 aa, Mycobacterium
EQQRRGAGLR

SEQ ID NO: 986748 - protein, 7 aa, Mycobacterium
EQQTDRF

SEQ ID NO: 986749 - protein, 5 aa, Mycobacterium
EQREE

SEQ ID NO: 986750 - protein, 10 aa, Mycobacterium
EQRGDAEVDV

SEQ ID NO: 986751 - protein, 6 aa, Mycobacterium
EQRIPS

SEQ ID NO: 986752 - protein, 23 aa, Mycobacterium
EQRQLGKEAQDANREVFEYDNRI

SEQ ID NO: 986753 - protein, 10 aa, Mycobacterium
EQSAAGGAGV

SEQ ID NO: 986754 - protein, 13 aa, Mycobacterium
EQSAKAGYTTQAR

SEQ ID NO: 986755 - protein, 20 aa, Mycobacterium
EQTDAAVGALPGLSQPAAKA

SEQ ID NO: 986756 - protein, 9 aa, Mycobacterium
EQTGELTPT

SEQ ID NO: 986757 - protein, 12 aa, Mycobacterium
EQTSELDDARRR

SEQ ID NO: 986758 - protein, 12 aa, Mycobacterium
EQVGGRSDPTKL

SEQ ID NO: 986759 - protein, 13 aa, Mycobacterium
EQVKGTPQKAKPQ

SEQ ID NO: 986760 - protein, 4 aa, Mycobacterium
EQWT

SEQ ID NO: 986761 - protein, 5 aa, Mycobacterium
EQYGS

SEQ ID NO: 986762 - protein, 4 aa, Mycobacterium
ERAD

SEQ ID NO: 986763 - protein, 12 aa, Mycobacterium
ERADQQADTTAY

SEQ ID NO: 986764 - protein, 11 aa, Mycobacterium
ERAEAETEELR

SEQ ID NO: 986765 - protein, 7 aa, Mycobacterium
ERANGQD

SEQ ID NO: 986766 - protein, 4 aa, Mycobacterium
ERAQ

SEQ ID NO: 986767 - protein, 9 aa, Mycobacterium
ERAQREARL

SEQ ID NO: 986768 - protein, 7 aa, Mycobacterium
ERAQREL

SEQ ID NO: 986769 - protein, 10 aa, Mycobacterium
ERARGTEVSA

SEQ ID NO: 986770 - protein, 7 aa, Mycobacterium
ERARQRR

SEQ ID NO: 986771 - protein, 7 aa, Mycobacterium
ERARTEA

SEQ ID NO: 986772 - protein, 16 aa, Mycobacterium
ERARTRPTDSATVASL

SEQ ID NO: 986773 - protein, 4 aa, Mycobacterium
ERAV

SEQ ID NO: 986774 - protein, 12 aa, Mycobacterium
ERDGRTDPFGQE

SEQ ID NO: 986775 - protein, 6 aa, Mycobacterium
ERDGYS

SEQ ID NO: 986776 - protein, 4 aa, Mycobacterium
ERDP

SEQ ID NO: 986777 - protein, 19 aa, Mycobacterium
ERDPPSRPRSPQPIPQDLS

SEQ ID NO: 986778 - protein, 6 aa, Mycobacterium
ERDRGK

SEQ ID NO: 986779 - protein, 7 aa, Mycobacterium
ERDTSVL

SEQ ID NO: 986780 - protein, 11 aa, Mycobacterium
EREARRTEKIT

SEQ ID NO: 986781 - protein, 8 aa, Mycobacterium
EREGEKDL

SEQ ID NO: 986782 - protein, 6 aa, Mycobacterium
EREIAS

SEQ ID NO: 986783 - protein, 4 aa, Mycobacterium
EREQ

SEQ ID NO: 986784 - protein, 11 aa, Mycobacterium
ERERAAKRLGP

SEQ ID NO: 986785 - protein, 10 aa, Mycobacterium
ERESSDTTID

SEQ ID NO: 986786 - protein, 9 aa, Mycobacterium
ERESSSPLD

SEQ ID NO: 986787 - protein, 13 aa, Mycobacterium
ERFPKGEHRSVAD

SEQ ID NO: 986788 - protein, 10 aa, Mycobacterium
ERFTRDDYGD

SEQ ID NO: 986789 - protein, 7 aa, Mycobacterium
ERGAGRV

SEQ ID NO: 986790 - protein, 8 aa, Mycobacterium
ERGAGVPA

SEQ ID NO: 986791 - protein, 9 aa, Mycobacterium
ERGEGLSRD

SEQ ID NO: 986792 - protein, 26 aa, Mycobacterium
ERGEGTTKEDYEIRGPLPRKNIDTGM

SEQ ID NO: 986793 - protein, 8 aa, Mycobacterium
ERGGDRVR

SEQ ID NO: 986794 - protein, 9 aa, Mycobacterium
ERGKIRARR

SEQ ID NO: 986795 - protein, 10 aa, Mycobacterium
ERGPAATSIR

SEQ ID NO: 986796 - protein, 16 aa, Mycobacterium
ERGQANELSNRTEGGR

SEQ ID NO: 986797 - protein, 22 aa, Mycobacterium
ERGSSREEFEAEARSAAERDVT

SEQ ID NO: 986798 - protein, 17 aa, Mycobacterium
ERGVSAGKVTERERDSA

SEQ ID NO: 986799 - protein, 6 aa, Mycobacterium
ERGYGY

SEQ ID NO: 986800 - protein, 4 aa, Mycobacterium
ERHK

SEQ ID NO: 986801 - protein, 4 aa, Mycobacterium
ERIS

SEQ ID NO: 986802 - protein, 6 aa, Mycobacterium
ERKDGA

SEQ ID NO: 986803 - protein, 7 aa, Mycobacterium
ERKLGGG

SEQ ID NO: 986804 - protein, 5 aa, Mycobacterium
ERLGP

SEQ ID NO: 986805 - protein, 11 aa, Mycobacterium
ERMGRSALKKN

SEQ ID NO: 986806 - protein, 10 aa, Mycobacterium
ERNEQDPERL

SEQ ID NO: 986807 - protein, 5 aa, Mycobacterium
ERNGV

SEQ ID NO: 986808 - protein, 9 aa, Mycobacterium
ERPASLGES

SEQ ID NO: 986809 - protein, 8 aa, Mycobacterium
ERPDSGGV

SEQ ID NO: 986810 - protein, 6 aa, Mycobacterium
ERPDSR

SEQ ID NO: 986811 - protein, 9 aa, Mycobacterium
ERPEEVTDM

SEQ ID NO: 986812 - protein, 6 aa, Mycobacterium
ERPGGY

SEQ ID NO: 986813 - protein, 6 aa, Mycobacterium
ERPRGV

SEQ ID NO: 986814 - protein, 4 aa, Mycobacterium
ERPT

SEQ ID NO: 986815 - protein, 9 aa, Mycobacterium
ERPYEAPNY

SEQ ID NO: 986816 - protein, 4 aa, Mycobacterium
ERQE

SEQ ID NO: 986817 - protein, 4 aa, Mycobacterium
ERQR

SEQ ID NO: 986818 - protein, 5 aa, Mycobacterium
ERRAH

SEQ ID NO: 986819 - protein, 4 aa, Mycobacterium
ERRD

SEQ ID NO: 986820 - protein, 18 aa, Mycobacterium
ERREEALEAGKDAMAREV

SEQ ID NO: 986821 - protein, 5 aa, Mycobacterium
ERRNE

SEQ ID NO: 986822 - protein, 6 aa, Mycobacterium
ERRPAT

SEQ ID NO: 986823 - protein, 5 aa, Mycobacterium
ERRRM

SEQ ID NO: 986824 - protein, 8 aa, Mycobacterium
ERRTEDGQ

SEQ ID NO: 986825 - protein, 18 aa, Mycobacterium
ERRTKSGALTLPGRDTYA

SEQ ID NO: 986826 - protein, 10 aa, Mycobacterium
ERRTYHDEGD

SEQ ID NO: 986827 - protein, 8 aa, Mycobacterium
ERSEEERE

SEQ ID NO: 986828 - protein, 7 aa, Mycobacterium
ERSGATR

SEQ ID NO: 986829 - protein, 10 aa, Mycobacterium
ERSPDLSGSR

SEQ ID NO: 986830 - protein, 7 aa, Mycobacterium
ERSPEEL

SEQ ID NO: 986831 - protein, 16 aa, Mycobacterium
ERSPGYAGSTDRPART

SEQ ID NO: 986832 - protein, 9 aa, Mycobacterium
ERSSTPIAG

SEQ ID NO: 986833 - protein, 4 aa, Mycobacterium
ERTA

SEQ ID NO: 986834 - protein, 6 aa, Mycobacterium
ERTANT

SEQ ID NO: 986835 - protein, 8 aa, Mycobacterium
ERTGANDR

SEQ ID NO: 986836 - protein, 8 aa, Mycobacterium
ERTGETRV

SEQ ID NO: 986837 - protein, 11 aa, Mycobacterium
ERTKARKAQHR

SEQ ID NO: 986838 - protein, 5 aa, Mycobacterium
ERTRD

SEQ ID NO: 986839 - protein, 11 aa, Mycobacterium
ERTRSATCRDG

SEQ ID NO: 986840 - protein, 8 aa, Mycobacterium
ERTTGAVK

SEQ ID NO: 986841 - protein, 8 aa, Mycobacterium
ERTTHRAQ

SEQ ID NO: 986842 - protein, 6 aa, Mycobacterium
ERVSTE

SEQ ID NO: 986843 - protein, 13 aa, Mycobacterium
ERWESRDETSAAL

SEQ ID NO: 986844 - protein, 4 aa, Mycobacterium
ERYM

SEQ ID NO: 986845 - protein, 8 aa, Mycobacterium
ERYPGDAG

SEQ ID NO: 986846 - protein, 8 aa, Mycobacterium
ERYQDPRC

SEQ ID NO: 986847 - protein, 4 aa, Mycobacterium
ERYS

SEQ ID NO: 986848 - protein, 8 aa, Mycobacterium
ESAAGAAS

SEQ ID NO: 986849 - protein, 5 aa, Mycobacterium
ESAFA

SEQ ID NO: 986850 - protein, 6 aa, Mycobacterium
ESAGNW

SEQ ID NO: 986851 - protein, 4 aa, Mycobacterium
ESAL

SEQ ID NO: 986852 - protein, 8 aa, Mycobacterium
ESANPVPR

SEQ ID NO: 986853 - protein, 4 aa, Mycobacterium
ESAP

SEQ ID NO: 986854 - protein, 10 aa, Mycobacterium
ESARQFATRS

SEQ ID NO: 986855 - protein, 29 aa, Mycobacterium
ESASAAATTVELGNPGDPGGDLAEPWSLA

SEQ ID NO: 986856 - protein, 11 aa, Mycobacterium
ESATSINNVTA

SEQ ID NO: 986857 - protein, 6 aa, Mycobacterium
ESATSP

SEQ ID NO: 986858 - protein, 4 aa, Mycobacterium
ESCP

SEQ ID NO: 986859 - protein, 6 aa, Mycobacterium
ESDAAD

SEQ ID NO: 986860 - protein, 7 aa, Mycobacterium
ESDGDGY

SEQ ID NO: 986861 - protein, 6 aa, Mycobacterium
ESDHCG

SEQ ID NO: 986862 - protein, 4 aa, Mycobacterium
ESDT

SEQ ID NO: 986863 - protein, 5 aa, Mycobacterium
ESEGE

SEQ ID NO: 986864 - protein, 16 aa, Mycobacterium
ESEITSCPAHGSTAKP

SEQ ID NO: 986865 - protein, 4 aa, Mycobacterium
ESEM

SEQ ID NO: 986866 - protein, 11 aa, Mycobacterium
ESENRQSAGPV

SEQ ID NO: 986867 - protein, 11 aa, Mycobacterium
ESEPESSDQWQ

SEQ ID NO: 986868 - protein, 11 aa, Mycobacterium
ESESDRRRARE

SEQ ID NO: 986869 - protein, 6 aa, Mycobacterium
ESETGI

SEQ ID NO: 986870 - protein, 5 aa, Mycobacterium
ESEVG

SEQ ID NO: 986871 - protein, 7 aa, Mycobacterium
ESEVTAD

SEQ ID NO: 986872 - protein, 7 aa, Mycobacterium
ESFAERG

SEQ ID NO: 986873 - protein, 6 aa, Mycobacterium
ESGADD

SEQ ID NO: 986874 - protein, 19 aa, Mycobacterium
ESGADTGRSAAASITTLGS

SEQ ID NO: 986875 - protein, 15 aa, Mycobacterium
ESGAGVQIIEHAVGT

SEQ ID NO: 986876 - protein, 12 aa, Mycobacterium
ESGGGSGTANIK

SEQ ID NO: 986877 - protein, 6 aa, Mycobacterium
ESGGHL

SEQ ID NO: 986878 - protein, 7 aa, Mycobacterium
ESGPSIA

SEQ ID NO: 986879 - protein, 8 aa, Mycobacterium
ESGPSSGL

SEQ ID NO: 986880 - protein, 7 aa, Mycobacterium
ESGSGLE

SEQ ID NO: 986881 - protein, 5 aa, Mycobacterium
ESGTV

SEQ ID NO: 986882 - protein, 7 aa, Mycobacterium
ESGYDRD

SEQ ID NO: 986883 - protein, 8 aa, Mycobacterium
ESHGTGTV

SEQ ID NO: 986884 - protein, 7 aa, Mycobacterium
ESIGRSV

SEQ ID NO: 986885 - protein, 11 aa, Mycobacterium
ESIPAPVRETD

SEQ ID NO: 986886 - protein, 5 aa, Mycobacterium
ESIRH

SEQ ID NO: 986887 - protein, 20 aa, Mycobacterium
ESITPNSSEPQARTEANDGL

SEQ ID NO: 986888 - protein, 5 aa, Mycobacterium
ESKEE

SEQ ID NO: 986889 - protein, 14 aa, Mycobacterium
ESKEQARTEWAGEP

SEQ ID NO: 986890 - protein, 7 aa, Mycobacterium
ESKQTLH

SEQ ID NO: 986891 - protein, 9 aa, Mycobacterium
ESKRAVDRR

SEQ ID NO: 986892 - protein, 4 aa, Mycobacterium
ESKT

SEQ ID NO: 986893 - protein, 11 aa, Mycobacterium
ESKVAAAGTPI

SEQ ID NO: 986894 - protein, 6 aa, Mycobacterium
ESLQQQ

SEQ ID NO: 986895 - protein, 18 aa, Mycobacterium
ESLSTGQAKTCTSGNGTS

SEQ ID NO: 986896 - protein, 6 aa, Mycobacterium
ESLTPG

SEQ ID NO: 986897 - protein, 5 aa, Mycobacterium
ESLVA

SEQ ID NO: 986898 - protein, 7 aa, Mycobacterium
ESMDPAR

SEQ ID NO: 986899 - protein, 35 aa, Mycobacterium
ESMSRQVGGRAGGSGGGVGLRGPGETKIETDRRRI

SEQ ID NO: 986900 - protein, 15 aa, Mycobacterium
ESNARARGRARAKVR

SEQ ID NO: 986901 - protein, 8 aa, Mycobacterium
ESNRSRQV

SEQ ID NO: 986902 - protein, 4 aa, Mycobacterium
ESNT

SEQ ID NO: 986903 - protein, 6 aa, Mycobacterium
ESNTSG

SEQ ID NO: 986904 - protein, 7 aa, Mycobacterium
ESPLRDA

SEQ ID NO: 986905 - protein, 13 aa, Mycobacterium
ESQKLTDEAADSL

SEQ ID NO: 986906 - protein, 5 aa, Mycobacterium
ESRAA

SEQ ID NO: 986907 - protein, 4 aa, Mycobacterium
ESRE

SEQ ID NO: 986908 - protein, 6 aa, Mycobacterium
ESRERL

SEQ ID NO: 986909 - protein, 11 aa, Mycobacterium
ESRERRSDQQL

SEQ ID NO: 986910 - protein, 7 aa, Mycobacterium
ESRLHPS

SEQ ID NO: 986911 - protein, 8 aa, Mycobacterium
ESRNATHQ

SEQ ID NO: 986912 - protein, 9 aa, Mycobacterium
ESRPTRTEL

SEQ ID NO: 986913 - protein, 9 aa, Mycobacterium
ESRQMAREQ

SEQ ID NO: 986914 - protein, 8 aa, Mycobacterium
ESRRIDPA

SEQ ID NO: 986915 - protein, 7 aa, Mycobacterium
ESRRPDT

SEQ ID NO: 986916 - protein, 9 aa, Mycobacterium
ESRTVTAGH

SEQ ID NO: 986917 - protein, 5 aa, Mycobacterium
ESRVD

SEQ ID NO: 986918 - protein, 13 aa, Mycobacterium
ESSSVLATGSVVG

SEQ ID NO: 986919 - protein, 8 aa, Mycobacterium
ESSVDPVN

SEQ ID NO: 986920 - protein, 11 aa, Mycobacterium
ESTGSPEVDPD

SEQ ID NO: 986921 - protein, 5 aa, Mycobacterium
ESTPN

SEQ ID NO: 986922 - protein, 11 aa, Mycobacterium
ESTREDRKAAY

SEQ ID NO: 986923 - protein, 9 aa, Mycobacterium
ESTTADQLK

SEQ ID NO: 986924 - protein, 6 aa, Mycobacterium
ESTVGP

SEQ ID NO: 986925 - protein, 21 aa, Mycobacterium
ESVDPAVDADSDVAAWPATLN

SEQ ID NO: 986926 - protein, 10 aa, Mycobacterium
ESVRGKVGEA

SEQ ID NO: 986927 - protein, 8 aa, Mycobacterium
ESVSGVGE

SEQ ID NO: 986928 - protein, 6 aa, Mycobacterium
ESVSPG

SEQ ID NO: 986929 - protein, 8 aa, Mycobacterium
ESVTEGTV

SEQ ID NO: 986930 - protein, 8 aa, Mycobacterium
ESWPPNAA

SEQ ID NO: 986931 - protein, 6 aa, Mycobacterium
ESYEHG

SEQ ID NO: 986932 - protein, 9 aa, Mycobacterium
ESYKVTGTA

SEQ ID NO: 986933 - protein, 5 aa, Mycobacterium
ETAAE

SEQ ID NO: 986934 - protein, 11 aa, Mycobacterium
ETAARRTDDIA

SEQ ID NO: 986935 - protein, 5 aa, Mycobacterium
ETADA

SEQ ID NO: 986936 - protein, 7 aa, Mycobacterium
ETADEVR

SEQ ID NO: 986937 - protein, 9 aa, Mycobacterium
ETADRGNIS

SEQ ID NO: 986938 - protein, 14 aa, Mycobacterium
ETAGRRGADGRLPI

SEQ ID NO: 986939 - protein, 5 aa, Mycobacterium
ETAHR

SEQ ID NO: 986940 - protein, 8 aa, Mycobacterium
ETAKKLRT

SEQ ID NO: 986941 - protein, 4 aa, Mycobacterium
ETAR

SEQ ID NO: 986942 - protein, 14 aa, Mycobacterium
ETATVASYQRTAAA

SEQ ID NO: 986943 - protein, 5 aa, Mycobacterium
ETCGT

SEQ ID NO: 986944 - protein, 4 aa, Mycobacterium
ETDD

SEQ ID NO: 986945 - protein, 8 aa, Mycobacterium
ETDRGGKI

SEQ ID NO: 986946 - protein, 4 aa, Mycobacterium
ETDT

SEQ ID NO: 986947 - protein, 9 aa, Mycobacterium
ETEPPESLV

SEQ ID NO: 986948 - protein, 12 aa, Mycobacterium
ETGARINEQPVV

SEQ ID NO: 986949 - protein, 5 aa, Mycobacterium
ETGLP

SEQ ID NO: 986950 - protein, 8 aa, Mycobacterium
ETGPDSER

SEQ ID NO: 986951 - protein, 7 aa, Mycobacterium
ETGQPGL

SEQ ID NO: 986952 - protein, 10 aa, Mycobacterium
ETGSFPSPSQ

SEQ ID NO: 986953 - protein, 6 aa, Mycobacterium
ETGSTG

SEQ ID NO: 986954 - protein, 8 aa, Mycobacterium
ETGTNGQH

SEQ ID NO: 986955 - protein, 5 aa, Mycobacterium
ETGTY

SEQ ID NO: 986956 - protein, 31 aa, Mycobacterium
ETGYAKRTKTDLYRSQKRGGKGVQGAGLKQD

SEQ ID NO: 986957 - protein, 5 aa, Mycobacterium
ETKGG

SEQ ID NO: 986958 - protein, 7 aa, Mycobacterium
ETKTQTV

SEQ ID NO: 986959 - protein, 4 aa, Mycobacterium
ETLD

SEQ ID NO: 986960 - protein, 7 aa, Mycobacterium
ETLDPSA

SEQ ID NO: 986961 - protein, 4 aa, Mycobacterium
ETLG

SEQ ID NO: 986962 - protein, 40 aa, Mycobacterium
ETLPNSSSGSPSTNVRRRRHRRKPTEVAENGLDKNLAVQA

SEQ ID NO: 986963 - protein, 9 aa, Mycobacterium
ETLPPTEPR

SEQ ID NO: 986964 - protein, 5 aa, Mycobacterium
ETLRG

SEQ ID NO: 986965 - protein, 21 aa, Mycobacterium
ETLRGESERAERDGDLAKAAE

SEQ ID NO: 986966 - protein, 6 aa, Mycobacterium
ETLSTQ

SEQ ID NO: 986967 - protein, 9 aa, Mycobacterium
ETNGEPVTA

SEQ ID NO: 986968 - protein, 9 aa, Mycobacterium
ETPDLGEYA

SEQ ID NO: 986969 - protein, 8 aa, Mycobacterium
ETPEGPNI

SEQ ID NO: 986970 - protein, 16 aa, Mycobacterium
ETPEPPAPTARSGNCV

SEQ ID NO: 986971 - protein, 6 aa, Mycobacterium
ETPLSN

SEQ ID NO: 986972 - protein, 16 aa, Mycobacterium
ETPPASHSAPNTLARV

SEQ ID NO: 986973 - protein, 7 aa, Mycobacterium
ETQATRP

SEQ ID NO: 986974 - protein, 8 aa, Mycobacterium
ETQDSSKC

SEQ ID NO: 986975 - protein, 6 aa, Mycobacterium
ETQMPA

SEQ ID NO: 986976 - protein, 4 aa, Mycobacterium
ETQQ

SEQ ID NO: 986977 - protein, 11 aa, Mycobacterium
ETQTSPAANGV

SEQ ID NO: 986978 - protein, 5 aa, Mycobacterium
ETRPD

SEQ ID NO: 986979 - protein, 9 aa, Mycobacterium
ETRTKGGNA

SEQ ID NO: 986980 - protein, 10 aa, Mycobacterium
ETRYEGPTGI

SEQ ID NO: 986981 - protein, 7 aa, Mycobacterium
ETSPREY

SEQ ID NO: 986982 - protein, 7 aa, Mycobacterium
ETSRTFG

SEQ ID NO: 986983 - protein, 7 aa, Mycobacterium
ETSSAKQ

SEQ ID NO: 986984 - protein, 6 aa, Mycobacterium
ETSTSS

SEQ ID NO: 986985 - protein, 13 aa, Mycobacterium
ETSVASPPEVASS

SEQ ID NO: 986986 - protein, 12 aa, Mycobacterium
ETTAHRLSTLQR

SEQ ID NO: 986987 - protein, 10 aa, Mycobacterium
ETTALGSAYA

SEQ ID NO: 986988 - protein, 8 aa, Mycobacterium
ETTPDRLT

SEQ ID NO: 986989 - protein, 11 aa, Mycobacterium
ETTSDLGGYKD

SEQ ID NO: 986990 - protein, 6 aa, Mycobacterium
ETTSIE

SEQ ID NO: 986991 - protein, 8 aa, Mycobacterium
ETTTEEMR

SEQ ID NO: 986992 - protein, 10 aa, Mycobacterium
ETTYSVDETS

SEQ ID NO: 986993 - protein, 6 aa, Mycobacterium
ETVEQR

SEQ ID NO: 986994 - protein, 25 aa, Mycobacterium
ETVKSTQPGLRPPRRTRPPRDRTVM

SEQ ID NO: 986995 - protein, 7 aa, Mycobacterium
ETYDGAD

SEQ ID NO: 986996 - protein, 6 aa, Mycobacterium
ETYKNT

SEQ ID NO: 986997 - protein, 5 aa, Mycobacterium
EVARG

SEQ ID NO: 986998 - protein, 14 aa, Mycobacterium
EVARPEAHDDEEAD

SEQ ID NO: 986999 - protein, 11 aa, Mycobacterium
EVASGTAAPVV

SEQ ID NO: 987000 - protein, 17 aa, Mycobacterium
EVATQPAQGPPEQTGQL

SEQ ID NO: 987001 - protein, 8 aa, Mycobacterium
EVDDDGNV

SEQ ID NO: 987002 - protein, 13 aa, Mycobacterium
EVDDQSRTRAALR

SEQ ID NO: 987003 - protein, 7 aa, Mycobacterium
EVDNPTG

SEQ ID NO: 987004 - protein, 17 aa, Mycobacterium
EVDPSDVDKTRGVGCPR

SEQ ID NO: 987005 - protein, 7 aa, Mycobacterium
EVEAGDP

SEQ ID NO: 987006 - protein, 15 aa, Mycobacterium
EVEATSNGRPISSAG

SEQ ID NO: 987007 - protein, 6 aa, Mycobacterium
EVEPAS

SEQ ID NO: 987008 - protein, 12 aa, Mycobacterium
EVERRRELTGGR

SEQ ID NO: 987009 - protein, 8 aa, Mycobacterium
EVGDRDGV

SEQ ID NO: 987010 - protein, 11 aa, Mycobacterium
EVGDRDTNDPV

SEQ ID NO: 987011 - protein, 15 aa, Mycobacterium
EVGEAGKATDIANAT

SEQ ID NO: 987012 - protein, 7 aa, Mycobacterium
EVGPDDI

SEQ ID NO: 987013 - protein, 13 aa, Mycobacterium
EVGSTSDRGARSN

SEQ ID NO: 987014 - protein, 13 aa, Mycobacterium
EVHGTASPGKHQK

SEQ ID NO: 987015 - protein, 8 aa, Mycobacterium
EVKRRDRA

SEQ ID NO: 987016 - protein, 8 aa, Mycobacterium
EVNAEQQK

SEQ ID NO: 987017 - protein, 16 aa, Mycobacterium
EVPANVSKEIIAKATG

SEQ ID NO: 987018 - protein, 5 aa, Mycobacterium
EVPDS

SEQ ID NO: 987019 - protein, 12 aa, Mycobacterium
EVPEGLGDRGGF

SEQ ID NO: 987020 - protein, 6 aa, Mycobacterium
EVPGLE

SEQ ID NO: 987021 - protein, 4 aa, Mycobacterium
EVPL

SEQ ID NO: 987022 - protein, 4 aa, Mycobacterium
EVPP

SEQ ID NO: 987023 - protein, 6 aa, Mycobacterium
EVPPDR

SEQ ID NO: 987024 - protein, 17 aa, Mycobacterium
EVPPQNSNTDDRNELTD

SEQ ID NO: 987025 - protein, 8 aa, Mycobacterium
EVPPTSRH

SEQ ID NO: 987026 - protein, 5 aa, Mycobacterium
EVPTG

SEQ ID NO: 987027 - protein, 11 aa, Mycobacterium
EVRRGAPSANL

SEQ ID NO: 987028 - protein, 6 aa, Mycobacterium
EVSAGL

SEQ ID NO: 987029 - protein, 7 aa, Mycobacterium
EVSHGPS

SEQ ID NO: 987030 - protein, 9 aa, Mycobacterium
EVSSDRAGL

SEQ ID NO: 987031 - protein, 10 aa, Mycobacterium
EVSTDDVEAE

SEQ ID NO: 987032 - protein, 6 aa, Mycobacterium
EVTART

SEQ ID NO: 987033 - protein, 7 aa, Mycobacterium
EVTGEDP

SEQ ID NO: 987034 - protein, 8 aa, Mycobacterium
EVTQRERG

SEQ ID NO: 987035 - protein, 11 aa, Mycobacterium
EVTTYGSGGHH

SEQ ID NO: 987036 - protein, 6 aa, Mycobacterium
EWGQPN

SEQ ID NO: 987037 - protein, 7 aa, Mycobacterium
EWTGRSI

SEQ ID NO: 987038 - protein, 4 aa, Mycobacterium
EYED

SEQ ID NO: 987039 - protein, 4 aa, Mycobacterium
EYET

SEQ ID NO: 987040 - protein, 7 aa, Mycobacterium
EYGEKHS

SEQ ID NO: 987041 - protein, 7 aa, Mycobacterium
EYGKTPA

SEQ ID NO: 987042 - protein, 4 aa, Mycobacterium
EYGT

SEQ ID NO: 987043 - protein, 4 aa, Mycobacterium
EYHA

SEQ ID NO: 987044 - protein, 10 aa, Mycobacterium
EYKNRDIGSG

SEQ ID NO: 987045 - protein, 8 aa, Mycobacterium
EYPASGRG

SEQ ID NO: 987046 - protein, 5 aa, Mycobacterium
EYPDT

SEQ ID NO: 987047 - protein, 5 aa, Mycobacterium
EYPHQ

SEQ ID NO: 987048 - protein, 6 aa, Mycobacterium
EYPNLA

SEQ ID NO: 987049 - protein, 10 aa, Mycobacterium
EYRDNAMDGA

SEQ ID NO: 987050 - protein, 4 aa, Mycobacterium
EYSH

SEQ ID NO: 987051 - protein, 9 aa, Mycobacterium
FAAEPDAKR

SEQ ID NO: 987052 - protein, 10 aa, Mycobacterium
FADGGYGLDP

SEQ ID NO: 987053 - protein, 10 aa, Mycobacterium
FADLPGSALA

SEQ ID NO: 987054 - protein, 5 aa, Mycobacterium
FADPE

SEQ ID NO: 987055 - protein, 10 aa, Mycobacterium
FAEGDRNPPV

SEQ ID NO: 987056 - protein, 9 aa, Mycobacterium
FAERETPKS

SEQ ID NO: 987057 - protein, 19 aa, Mycobacterium
FAGARDSGLSCSVIMVACW

SEQ ID NO: 987058 - protein, 9 aa, Mycobacterium
FAGGTPKGV

SEQ ID NO: 987059 - protein, 11 aa, Mycobacterium
FAGHPEQGGWT

SEQ ID NO: 987060 - protein, 10 aa, Mycobacterium
FAGNGGAGCL

SEQ ID NO: 987061 - protein, 15 aa, Mycobacterium
FAGPEGSNGEFDTPI

SEQ ID NO: 987062 - protein, 12 aa, Mycobacterium
FAPGQVGSSAMP

SEQ ID NO: 987063 - protein, 7 aa, Mycobacterium
FAPPPTE

SEQ ID NO: 987064 - protein, 6 aa, Mycobacterium
FAPTRT

SEQ ID NO: 987065 - protein, 7 aa, Mycobacterium
FAQSSKL

SEQ ID NO: 987066 - protein, 18 aa, Mycobacterium
FARNSSRENRELAGENSS

SEQ ID NO: 987067 - protein, 12 aa, Mycobacterium
FARTGARRSRED

SEQ ID NO: 987068 - protein, 7 aa, Mycobacterium
FASGNPV

SEQ ID NO: 987069 - protein, 7 aa, Mycobacterium
FASPNLA

SEQ ID NO: 987070 - protein, 22 aa, Mycobacterium
FASPTPSAQKLPVNPSTLRILT

SEQ ID NO: 987071 - protein, 7 aa, Mycobacterium
FATTPRM

SEQ ID NO: 987072 - protein, 19 aa, Mycobacterium
FDDAGAIGRRYRRQDEVGT

SEQ ID NO: 987073 - protein, 13 aa, Mycobacterium
FDDQGAKYDGDGN

SEQ ID NO: 987074 - protein, 11 aa, Mycobacterium
FDEQRKPDADL

SEQ ID NO: 987075 - protein, 8 aa, Mycobacterium
FDEVSPVG

SEQ ID NO: 987076 - protein, 5 aa, Mycobacterium
FDGGT

SEQ ID NO: 987077 - protein, 10 aa, Mycobacterium
FDGNDDAVNA

SEQ ID NO: 987078 - protein, 9 aa, Mycobacterium
FDGPAQDNT

SEQ ID NO: 987079 - protein, 11 aa, Mycobacterium
FDNQSRRQTSF

SEQ ID NO: 987080 - protein, 7 aa, Mycobacterium
FDPDSNE

SEQ ID NO: 987081 - protein, 8 aa, Mycobacterium
FDPEKTAQ

SEQ ID NO: 987082 - protein, 10 aa, Mycobacterium
FDPIPGNDAT

SEQ ID NO: 987083 - protein, 6 aa, Mycobacterium
FDPKEA

SEQ ID NO: 987084 - protein, 11 aa, Mycobacterium
FDRPPSDHTSV

SEQ ID NO: 987085 - protein, 12 aa, Mycobacterium
FDRPQAPHLNGQ

SEQ ID NO: 987086 - protein, 6 aa, Mycobacterium
FDRSGA

SEQ ID NO: 987087 - protein, 4 aa, Mycobacterium
FDSD

SEQ ID NO: 987088 - protein, 9 aa, Mycobacterium
FDSRSNGSF

SEQ ID NO: 987089 - protein, 8 aa, Mycobacterium
FDTASTIS

SEQ ID NO: 987090 - protein, 4 aa, Mycobacterium
FEAQ

SEQ ID NO: 987091 - protein, 9 aa, Mycobacterium
FEARTPDAL

SEQ ID NO: 987092 - protein, 8 aa, Mycobacterium
FEATGKSV

SEQ ID NO: 987093 - protein, 13 aa, Mycobacterium
FEDSQPTTHDQPT

SEQ ID NO: 987094 - protein, 5 aa, Mycobacterium
FEETA

SEQ ID NO: 987095 - protein, 6 aa, Mycobacterium
FEIPED

SEQ ID NO: 987096 - protein, 8 aa, Mycobacterium
FEPDPDFP

SEQ ID NO: 987097 - protein, 6 aa, Mycobacterium
FEPGAK

SEQ ID NO: 987098 - protein, 12 aa, Mycobacterium
FEPPKAGRPALS

SEQ ID NO: 987099 - protein, 11 aa, Mycobacterium
FETDKGKWTKI

SEQ ID NO: 987100 - protein, 6 aa, Mycobacterium
FGAGAP

SEQ ID NO: 987101 - protein, 7 aa, Mycobacterium
FGATSTV

SEQ ID NO: 987102 - protein, 10 aa, Mycobacterium
FGDNGSGMHT

SEQ ID NO: 987103 - protein, 9 aa, Mycobacterium
FGDPSGYHG

SEQ ID NO: 987104 - protein, 4 aa, Mycobacterium
FGDR

SEQ ID NO: 987105 - protein, 7 aa, Mycobacterium
FGEEAGA

SEQ ID NO: 987106 - protein, 7 aa, Mycobacterium
FGEGSRS

SEQ ID NO: 987107 - protein, 20 aa, Mycobacterium
FGEPADSVAIGDGVRVSLLK

SEQ ID NO: 987108 - protein, 36 aa, Mycobacterium
FGFSSGNDSPNDESGRDKHGKNGPDSGSSGSDPLAS

SEQ ID NO: 987109 - protein, 4 aa, Mycobacterium
FGGG

SEQ ID NO: 987110 - protein, 7 aa, Mycobacterium
FGGKGMR

SEQ ID NO: 987111 - protein, 8 aa, Mycobacterium
FGGPGRSA

SEQ ID NO: 987112 - protein, 7 aa, Mycobacterium
FGGPPGV

SEQ ID NO: 987113 - protein, 14 aa, Mycobacterium
FGGPTADELLLRGL

SEQ ID NO: 987114 - protein, 11 aa, Mycobacterium
FGGPTITNDGV

SEQ ID NO: 987115 - protein, 7 aa, Mycobacterium
FGGSGRD

SEQ ID NO: 987116 - protein, 11 aa, Mycobacterium
FGGVGESGIGA

SEQ ID NO: 987117 - protein, 6 aa, Mycobacterium
FGLGGT

SEQ ID NO: 987118 - protein, 9 aa, Mycobacterium
FGNQPGRWP

SEQ ID NO: 987119 - protein, 19 aa, Mycobacterium
FGNTGDGNIGFGNTGDGNI

SEQ ID NO: 987120 - protein, 5 aa, Mycobacterium
FGPPV

SEQ ID NO: 987121 - protein, 12 aa, Mycobacterium
FGPQSPKSLSLR

SEQ ID NO: 987122 - protein, 4 aa, Mycobacterium
FGPY

SEQ ID NO: 987123 - protein, 4 aa, Mycobacterium
FGRR

SEQ ID NO: 987124 - protein, 6 aa, Mycobacterium
FGSADG

SEQ ID NO: 987125 - protein, 28 aa, Mycobacterium
FGSARRGESGVGRATGAGQVARWAAGRA

SEQ ID NO: 987126 - protein, 8 aa, Mycobacterium
FGSDKPDL

SEQ ID NO: 987127 - protein, 8 aa, Mycobacterium
FGSGQQVT

SEQ ID NO: 987128 - protein, 31 aa, Mycobacterium
FGSPGSTFGMRTGDRAGTLGRARQHQPDGAG

SEQ ID NO: 987129 - protein, 9 aa, Mycobacterium
FGSPQQGLQ

SEQ ID NO: 987130 - protein, 16 aa, Mycobacterium
FGTAPNPGSQLPYTQV

SEQ ID NO: 987131 - protein, 11 aa, Mycobacterium
FGTDAADRAVE

SEQ ID NO: 987132 - protein, 9 aa, Mycobacterium
FGTQEGGAM

SEQ ID NO: 987133 - protein, 19 aa, Mycobacterium
FGVEPDKRPQACRRAVAVL

SEQ ID NO: 987134 - protein, 5 aa, Mycobacterium
FGVGG

SEQ ID NO: 987135 - protein, 7 aa, Mycobacterium
FGVSGTN

SEQ ID NO: 987136 - protein, 10 aa, Mycobacterium
FHPPTGPGVR

SEQ ID NO: 987137 - protein, 12 aa, Mycobacterium
FHQGESSAAFQS

SEQ ID NO: 987138 - protein, 11 aa, Mycobacterium
FHSDDDPLQLS

SEQ ID NO: 987139 - protein, 5 aa, Mycobacterium
FKAAG

SEQ ID NO: 987140 - protein, 5 aa, Mycobacterium
FKARP

SEQ ID NO: 987141 - protein, 5 aa, Mycobacterium
FKRAG

SEQ ID NO: 987142 - protein, 11 aa, Mycobacterium
FKSGSSQPPLQ

SEQ ID NO: 987143 - protein, 6 aa, Mycobacterium
FKSYRG

SEQ ID NO: 987144 - protein, 7 aa, Mycobacterium
FNDGRSI

SEQ ID NO: 987145 - protein, 5 aa, Mycobacterium
FNGPE

SEQ ID NO: 987146 - protein, 6 aa, Mycobacterium
FNIPTQ

SEQ ID NO: 987147 - protein, 12 aa, Mycobacterium
FNPASLSDPTAI

SEQ ID NO: 987148 - protein, 11 aa, Mycobacterium
FNSGGSSKDRI

SEQ ID NO: 987149 - protein, 9 aa, Mycobacterium
FNSSSGFDE

SEQ ID NO: 987150 - protein, 4 aa, Mycobacterium
FNWP

SEQ ID NO: 987151 - protein, 9 aa, Mycobacterium
FPDAGKPWT

SEQ ID NO: 987152 - protein, 8 aa, Mycobacterium
FPEGKQWR

SEQ ID NO: 987153 - protein, 6 aa, Mycobacterium
FPERDT

SEQ ID NO: 987154 - protein, 7 aa, Mycobacterium
FPGQQGG

SEQ ID NO: 987155 - protein, 8 aa, Mycobacterium
FPGSKHKG

SEQ ID NO: 987156 - protein, 7 aa, Mycobacterium
FPGTDPA

SEQ ID NO: 987157 - protein, 13 aa, Mycobacterium
FPPASITGTPKLR

SEQ ID NO: 987158 - protein, 13 aa, Mycobacterium
FPPDAAAREHDPS

SEQ ID NO: 987159 - protein, 4 aa, Mycobacterium
FPPE

SEQ ID NO: 987160 - protein, 11 aa, Mycobacterium
FPPGNRPGQPL

SEQ ID NO: 987161 - protein, 8 aa, Mycobacterium
FPPNDPHR

SEQ ID NO: 987162 - protein, 11 aa, Mycobacterium
FPPPPRKFRSG

SEQ ID NO: 987163 - protein, 8 aa, Mycobacterium
FPSASQTD

SEQ ID NO: 987164 - protein, 9 aa, Mycobacterium
FPSDARDYG

SEQ ID NO: 987165 - protein, 7 aa, Mycobacterium
FPSGEGL

SEQ ID NO: 987166 - protein, 6 aa, Mycobacterium
FPTDRG

SEQ ID NO: 987167 - protein, 19 aa, Mycobacterium
FPTGATPQVSLASFQGKVL

SEQ ID NO: 987168 - protein, 5 aa, Mycobacterium
FPTSR

SEQ ID NO: 987169 - protein, 9 aa, Mycobacterium
FQDGGPGCG

SEQ ID NO: 987170 - protein, 9 aa, Mycobacterium
FQPATPTFL

SEQ ID NO: 987171 - protein, 11 aa, Mycobacterium
FQTRSTKPGGR

SEQ ID NO: 987172 - protein, 10 aa, Mycobacterium
FRADRQPEFT

SEQ ID NO: 987173 - protein, 10 aa, Mycobacterium
FRERGGPQTN

SEQ ID NO: 987174 - protein, 11 aa, Mycobacterium
FRGPHNDTRLT

SEQ ID NO: 987175 - protein, 17 aa, Mycobacterium
FRPDRSHAKSARSVAET

SEQ ID NO: 987176 - protein, 10 aa, Mycobacterium
FRPHRQAGVS

SEQ ID NO: 987177 - protein, 10 aa, Mycobacterium
FRTGPERASH

SEQ ID NO: 987178 - protein, 5 aa, Mycobacterium
FSDAT

SEQ ID NO: 987179 - protein, 10 aa, Mycobacterium
FSDSADRNEV

SEQ ID NO: 987180 - protein, 4 aa, Mycobacterium
FSDT

SEQ ID NO: 987181 - protein, 9 aa, Mycobacterium
FSDTRTATR

SEQ ID NO: 987182 - protein, 8 aa, Mycobacterium
FSEAAEPS

SEQ ID NO: 987183 - protein, 10 aa, Mycobacterium
FSEADPVNHR

SEQ ID NO: 987184 - protein, 6 aa, Mycobacterium
FSEPEL

SEQ ID NO: 987185 - protein, 10 aa, Mycobacterium
FSFPSGVSRA

SEQ ID NO: 987186 - protein, 5 aa, Mycobacterium
FSGDE

SEQ ID NO: 987187 - protein, 10 aa, Mycobacterium
FSGDEKTKRL

SEQ ID NO: 987188 - protein, 10 aa, Mycobacterium
FSGENGATYE

SEQ ID NO: 987189 - protein, 8 aa, Mycobacterium
FSGEPADV

SEQ ID NO: 987190 - protein, 15 aa, Mycobacterium
FSGKNVPANGVPDVL

SEQ ID NO: 987191 - protein, 9 aa, Mycobacterium
FSGPGGDAE

SEQ ID NO: 987192 - protein, 7 aa, Mycobacterium
FSGSARH

SEQ ID NO: 987193 - protein, 8 aa, Mycobacterium
FSKKDGMD

SEQ ID NO: 987194 - protein, 6 aa, Mycobacterium
FSKNYT

SEQ ID NO: 987195 - protein, 17 aa, Mycobacterium
FSNPTEKATEDYISGRF

SEQ ID NO: 987196 - protein, 5 aa, Mycobacterium
FSNSP

SEQ ID NO: 987197 - protein, 10 aa, Mycobacterium
FSPGRDTSIN

SEQ ID NO: 987198 - protein, 6 aa, Mycobacterium
FSPGTP

SEQ ID NO: 987199 - protein, 4 aa, Mycobacterium
FSQK

SEQ ID NO: 987200 - protein, 10 aa, Mycobacterium
FSRPDPRRRA

SEQ ID NO: 987201 - protein, 10 aa, Mycobacterium
FSSASTDHIP

SEQ ID NO: 987202 - protein, 4 aa, Mycobacterium
FSSR

SEQ ID NO: 987203 - protein, 14 aa, Mycobacterium
FSSRRAAKRGRDIR

SEQ ID NO: 987204 - protein, 11 aa, Mycobacterium
FSTAAATSRQF

SEQ ID NO: 987205 - protein, 10 aa, Mycobacterium
FSTAADSNAF

SEQ ID NO: 987206 - protein, 6 aa, Mycobacterium
FTDPDR

SEQ ID NO: 987207 - protein, 6 aa, Mycobacterium
FTEGNT

SEQ ID NO: 987208 - protein, 5 aa, Mycobacterium
FTGQP

SEQ ID NO: 987209 - protein, 13 aa, Mycobacterium
FTGRPAPAPPTLG

SEQ ID NO: 987210 - protein, 6 aa, Mycobacterium
FTGSNG

SEQ ID NO: 987211 - protein, 9 aa, Mycobacterium
FTGSSAGGL

SEQ ID NO: 987212 - protein, 4 aa, Mycobacterium
FTKP

SEQ ID NO: 987213 - protein, 11 aa, Mycobacterium
FTPEQKARNVD

SEQ ID NO: 987214 - protein, 13 aa, Mycobacterium
FTQADEHGHIYVR

SEQ ID NO: 987215 - protein, 8 aa, Mycobacterium
FTQSPKDL

SEQ ID NO: 987216 - protein, 7 aa, Mycobacterium
FTSAGAD

SEQ ID NO: 987217 - protein, 8 aa, Mycobacterium
FTSEHGGD

SEQ ID NO: 987218 - protein, 8 aa, Mycobacterium
FTSPQSAP

SEQ ID NO: 987219 - protein, 10 aa, Mycobacterium
FTTADSAVDG

SEQ ID NO: 987220 - protein, 18 aa, Mycobacterium
FTTDEIDDRPGANGWLQL

SEQ ID NO: 987221 - protein, 5 aa, Mycobacterium
FTTED

SEQ ID NO: 987222 - protein, 5 aa, Mycobacterium
FTTTD

SEQ ID NO: 987223 - protein, 7 aa, Mycobacterium
FVGKNGR

SEQ ID NO: 987224 - protein, 4 aa, Mycobacterium
FVSG

SEQ ID NO: 987225 - protein, 4 aa, Mycobacterium
FYDD

SEQ ID NO: 987226 - protein, 47 aa, Mycobacterium
FYRTDSRESGEKSNSSSNGSSKSDSGSSSGSSDKSNSSSAPAVATAP

SEQ ID NO: 987227 - protein, 11 aa, Mycobacterium
GAAAKATSPEV

SEQ ID NO: 987228 - protein, 15 aa, Mycobacterium
GAADPLDAQGAGDQG

SEQ ID NO: 987229 - protein, 9 aa, Mycobacterium
GAADSTLEQ

SEQ ID NO: 987230 - protein, 8 aa, Mycobacterium
GAAEGAID

SEQ ID NO: 987231 - protein, 6 aa, Mycobacterium
GAAGNR

SEQ ID NO: 987232 - protein, 7 aa, Mycobacterium
GAAKERG

SEQ ID NO: 987233 - protein, 4 aa, Mycobacterium
GAAP

SEQ ID NO: 987234 - protein, 8 aa, Mycobacterium
GAAQKALE

SEQ ID NO: 987235 - protein, 9 aa, Mycobacterium
GAAQSESLA

SEQ ID NO: 987236 - protein, 11 aa, Mycobacterium
GAARESGPTFD

SEQ ID NO: 987237 - protein, 14 aa, Mycobacterium
GAASGGSGCLACTR

SEQ ID NO: 987238 - protein, 8 aa, Mycobacterium
GAASPKET

SEQ ID NO: 987239 - protein, 14 aa, Mycobacterium
GAASSAAPRAYRAA

SEQ ID NO: 987240 - protein, 5 aa, Mycobacterium
GAAST

SEQ ID NO: 987241 - protein, 4 aa, Mycobacterium
GAAT

SEQ ID NO: 987242 - protein, 15 aa, Mycobacterium
GAATESDGSPNRGYK

SEQ ID NO: 987243 - protein, 8 aa, Mycobacterium
GAATEVEL

SEQ ID NO: 987244 - protein, 10 aa, Mycobacterium
GAATLRTAKS

SEQ ID NO: 987245 - protein, 9 aa, Mycobacterium
GAATPGAAV

SEQ ID NO: 987246 - protein, 17 aa, Mycobacterium
GAATSPADGLIKYPCSG

SEQ ID NO: 987247 - protein, 12 aa, Mycobacterium
GAATSVAERVGG

SEQ ID NO: 987248 - protein, 10 aa, Mycobacterium
GAAVSTDHPH

SEQ ID NO: 987249 - protein, 4 aa, Mycobacterium
GACH

SEQ ID NO: 987250 - protein, 7 aa, Mycobacterium
GADDVSA

SEQ ID NO: 987251 - protein, 8 aa, Mycobacterium
GADEADAL

SEQ ID NO: 987252 - protein, 6 aa, Mycobacterium
GADEIS

SEQ ID NO: 987253 - protein, 5 aa, Mycobacterium
GADEV

SEQ ID NO: 987254 - protein, 7 aa, Mycobacterium
GADEVSA

SEQ ID NO: 987255 - protein, 10 aa, Mycobacterium
GADEYPGKPW

SEQ ID NO: 987256 - protein, 12 aa, Mycobacterium
GADGFSDIFSLR

SEQ ID NO: 987257 - protein, 8 aa, Mycobacterium
GADLSGEE

SEQ ID NO: 987258 - protein, 9 aa, Mycobacterium
GADPTDMGM

SEQ ID NO: 987259 - protein, 13 aa, Mycobacterium
GADQRGGSPNFPA

SEQ ID NO: 987260 - protein, 4 aa, Mycobacterium
GADR

SEQ ID NO: 987261 - protein, 7 aa, Mycobacterium
GADRPDI

SEQ ID NO: 987262 - protein, 6 aa, Mycobacterium
GADSNG

SEQ ID NO: 987263 - protein, 8 aa, Mycobacterium
GADTGKLT

SEQ ID NO: 987264 - protein, 9 aa, Mycobacterium
GADTNPTAN

SEQ ID NO: 987265 - protein, 4 aa, Mycobacterium
GADV

SEQ ID NO: 987266 - protein, 5 aa, Mycobacterium
GAEAV

SEQ ID NO: 987267 - protein, 8 aa, Mycobacterium
GAEAVENS

SEQ ID NO: 987268 - protein, 8 aa, Mycobacterium
GAEDAVPA

SEQ ID NO: 987269 - protein, 5 aa, Mycobacterium
GAEEL

SEQ ID NO: 987270 - protein, 17 aa, Mycobacterium
GAEEVANTDRRSGGVWA

SEQ ID NO: 987271 - protein, 12 aa, Mycobacterium
GAEGAAEVTESR

SEQ ID NO: 987272 - protein, 8 aa, Mycobacterium
GAEGEHVT

SEQ ID NO: 987273 - protein, 6 aa, Mycobacterium
GAEGLT

SEQ ID NO: 987274 - protein, 5 aa, Mycobacterium
GAEPD

SEQ ID NO: 987275 - protein, 9 aa, Mycobacterium
GAEPVDPAD

SEQ ID NO: 987276 - protein, 6 aa, Mycobacterium
GAEQHS

SEQ ID NO: 987277 - protein, 4 aa, Mycobacterium
GAER

SEQ ID NO: 987278 - protein, 6 aa, Mycobacterium
GAESGD

SEQ ID NO: 987279 - protein, 11 aa, Mycobacterium
GAFDPATMGTV

SEQ ID NO: 987280 - protein, 6 aa, Mycobacterium
GAFPPD

SEQ ID NO: 987281 - protein, 12 aa, Mycobacterium
GAFSERSASFTL

SEQ ID NO: 987282 - protein, 9 aa, Mycobacterium
GAGATGLGK

SEQ ID NO: 987283 - protein, 7 aa, Mycobacterium
GAGEGAL

SEQ ID NO: 987284 - protein, 4 aa, Mycobacterium
GAGG

SEQ ID NO: 987285 - protein, 13 aa, Mycobacterium
GAGGQGDALILRA

SEQ ID NO: 987286 - protein, 10 aa, Mycobacterium
GAGKSTIGRR

SEQ ID NO: 987287 - protein, 6 aa, Mycobacterium
GAGKTT

SEQ ID NO: 987288 - protein, 7 aa, Mycobacterium
GAGLGAG

SEQ ID NO: 987289 - protein, 8 aa, Mycobacterium
GAGNRVGD

SEQ ID NO: 987290 - protein, 6 aa, Mycobacterium
GAGNRY

SEQ ID NO: 987291 - protein, 11 aa, Mycobacterium
GAGPDASAANA

SEQ ID NO: 987292 - protein, 14 aa, Mycobacterium
GAGPLELPEAGSYD

SEQ ID NO: 987293 - protein, 11 aa, Mycobacterium
GAGQPAGPDRP

SEQ ID NO: 987294 - protein, 5 aa, Mycobacterium
GAGQV

SEQ ID NO: 987295 - protein, 14 aa, Mycobacterium
GAGRRFSATTQRSL

SEQ ID NO: 987296 - protein, 6 aa, Mycobacterium
GAGSEF

SEQ ID NO: 987297 - protein, 7 aa, Mycobacterium
GAGSGIG

SEQ ID NO: 987298 - protein, 8 aa, Mycobacterium
GAGSSSLA

SEQ ID NO: 987299 - protein, 7 aa, Mycobacterium
GAGSSVS

SEQ ID NO: 987300 - protein, 10 aa, Mycobacterium
GAGSTPGPKA

SEQ ID NO: 987301 - protein, 9 aa, Mycobacterium
GAGSYDTAH

SEQ ID NO: 987302 - protein, 14 aa, Mycobacterium
GAGTDAANSTAAAH

SEQ ID NO: 987303 - protein, 25 aa, Mycobacterium
GAGTPCALGSAKSNMGHSTASAGTV

SEQ ID NO: 987304 - protein, 6 aa, Mycobacterium
GAGVAR

SEQ ID NO: 987305 - protein, 8 aa, Mycobacterium
GAGVGARA

SEQ ID NO: 987306 - protein, 12 aa, Mycobacterium
GAGVTSSPIKGT

SEQ ID NO: 987307 - protein, 6 aa, Mycobacterium
GAGYAD

SEQ ID NO: 987308 - protein, 17 aa, Mycobacterium
GAGYLSGGRAAAMHGGA

SEQ ID NO: 987309 - protein, 7 aa, Mycobacterium
GAHADTA

SEQ ID NO: 987310 - protein, 17 aa, Mycobacterium
GAHGGTVTASDDAANEL

SEQ ID NO: 987311 - protein, 4 aa, Mycobacterium
GAHQ

SEQ ID NO: 987312 - protein, 6 aa, Mycobacterium
GAIPDR

SEQ ID NO: 987313 - protein, 4 aa, Mycobacterium
GAIR

SEQ ID NO: 987314 - protein, 14 aa, Mycobacterium
GAIRSQQASYTSHP

SEQ ID NO: 987315 - protein, 8 aa, Mycobacterium
GAKAPRLI

SEQ ID NO: 987316 - protein, 15 aa, Mycobacterium
GAKARQAKSKARLQR

SEQ ID NO: 987317 - protein, 4 aa, Mycobacterium
GAKD

SEQ ID NO: 987318 - protein, 16 aa, Mycobacterium
GAKDVGKRAERATAEG

SEQ ID NO: 987319 - protein, 8 aa, Mycobacterium
GAKEEELQ

SEQ ID NO: 987320 - protein, 7 aa, Mycobacterium
GAKGPVR

SEQ ID NO: 987321 - protein, 5 aa, Mycobacterium
GAKNT

SEQ ID NO: 987322 - protein, 7 aa, Mycobacterium
GAKPAAV

SEQ ID NO: 987323 - protein, 8 aa, Mycobacterium
GAKPVPGS

SEQ ID NO: 987324 - protein, 6 aa, Mycobacterium
GAKQGM

SEQ ID NO: 987325 - protein, 10 aa, Mycobacterium
GAKSVPAQKH

SEQ ID NO: 987326 - protein, 7 aa, Mycobacterium
GAKVSGS

SEQ ID NO: 987327 - protein, 13 aa, Mycobacterium
GALADDKATTAYA

SEQ ID NO: 987328 - protein, 6 aa, Mycobacterium
GALGAS

SEQ ID NO: 987329 - protein, 9 aa, Mycobacterium
GALSNSGTT

SEQ ID NO: 987330 - protein, 4 aa, Mycobacterium
GALT

SEQ ID NO: 987331 - protein, 18 aa, Mycobacterium
GALTEAGKAVAPGVTTDE

SEQ ID NO: 987332 - protein, 9 aa, Mycobacterium
GANDSEIDG

SEQ ID NO: 987333 - protein, 9 aa, Mycobacterium
GANHVPTDE

SEQ ID NO: 987334 - protein, 4 aa, Mycobacterium
GANP

SEQ ID NO: 987335 - protein, 5 aa, Mycobacterium
GANPH

SEQ ID NO: 987336 - protein, 8 aa, Mycobacterium
GANQRRSA

SEQ ID NO: 987337 - protein, 7 aa, Mycobacterium
GANSGPV

SEQ ID NO: 987338 - protein, 8 aa, Mycobacterium
GANTGLGY

SEQ ID NO: 987339 - protein, 13 aa, Mycobacterium
GANYTEDVDSIRS

SEQ ID NO: 987340 - protein, 17 aa, Mycobacterium
GAPAAGEAGEAAEEQSE

SEQ ID NO: 987341 - protein, 14 aa, Mycobacterium
GAPADRDFGPSIVA

SEQ ID NO: 987342 - protein, 7 aa, Mycobacterium
GAPAKVV

SEQ ID NO: 987343 - protein, 8 aa, Mycobacterium
GAPDDRRL

SEQ ID NO: 987344 - protein, 10 aa, Mycobacterium
GAPDHSRGAF

SEQ ID NO: 987345 - protein, 8 aa, Mycobacterium
GAPDMGPH

SEQ ID NO: 987346 - protein, 11 aa, Mycobacterium
GAPDTQRGLTP

SEQ ID NO: 987347 - protein, 9 aa, Mycobacterium
GAPEGPDDG

SEQ ID NO: 987348 - protein, 9 aa, Mycobacterium
GAPGDTPVA

SEQ ID NO: 987349 - protein, 7 aa, Mycobacterium
GAPIGTT

SEQ ID NO: 987350 - protein, 9 aa, Mycobacterium
GAPKFSPSA

SEQ ID NO: 987351 - protein, 7 aa, Mycobacterium
GAPLDPG

SEQ ID NO: 987352 - protein, 13 aa, Mycobacterium
GAPLHDGAALSGS

SEQ ID NO: 987353 - protein, 10 aa, Mycobacterium
GAPLQPGQQD

SEQ ID NO: 987354 - protein, 18 aa, Mycobacterium
GAPPGYVGYEEGGQLTEK

SEQ ID NO: 987355 - protein, 6 aa, Mycobacterium
GAPQQR

SEQ ID NO: 987356 - protein, 5 aa, Mycobacterium
GAPQT

SEQ ID NO: 987357 - protein, 5 aa, Mycobacterium
GAPRA

SEQ ID NO: 987358 - protein, 43 aa, Mycobacterium
GAPSEAAAAAPAPRPEPKAQPEPAASSQPAAPAQQPSGAATAT

SEQ ID NO: 987359 - protein, 7 aa, Mycobacterium
GAPSGAY

SEQ ID NO: 987360 - protein, 7 aa, Mycobacterium
GAPSTLD

SEQ ID NO: 987361 - protein, 10 aa, Mycobacterium
GAPTITNDGV

SEQ ID NO: 987362 - protein, 4 aa, Mycobacterium
GAQD

SEQ ID NO: 987363 - protein, 16 aa, Mycobacterium
GAQDISDTDLAGRYET

SEQ ID NO: 987364 - protein, 14 aa, Mycobacterium
GAQEALSIAESLPS

SEQ ID NO: 987365 - protein, 28 aa, Mycobacterium
GAQGSRGVPSRKSATTGSRQVLLQCLRR

SEQ ID NO: 987366 - protein, 4 aa, Mycobacterium
GAQH

SEQ ID NO: 987367 - protein, 5 aa, Mycobacterium
GAQNQ

SEQ ID NO: 987368 - protein, 10 aa, Mycobacterium
GAQQPNGYTE

SEQ ID NO: 987369 - protein, 7 aa, Mycobacterium
GAQSNYI

SEQ ID NO: 987370 - protein, 13 aa, Mycobacterium
GAQSSDIAQGVNT

SEQ ID NO: 987371 - protein, 4 aa, Mycobacterium
GARA

SEQ ID NO: 987372 - protein, 6 aa, Mycobacterium
GARAQE

SEQ ID NO: 987373 - protein, 8 aa, Mycobacterium
GARAVQPT

SEQ ID NO: 987374 - protein, 8 aa, Mycobacterium
GARDADDV

SEQ ID NO: 987375 - protein, 13 aa, Mycobacterium
GAREFEDLPAKAR

SEQ ID NO: 987376 - protein, 15 aa, Mycobacterium
GAREQPLAGVSGASV

SEQ ID NO: 987377 - protein, 10 aa, Mycobacterium
GARGEPTAQD

SEQ ID NO: 987378 - protein, 4 aa, Mycobacterium
GARI

SEQ ID NO: 987379 - protein, 19 aa, Mycobacterium
GARKGLADTALRTADSGYL

SEQ ID NO: 987380 - protein, 6 aa, Mycobacterium
GARLAE

SEQ ID NO: 987381 - protein, 9 aa, Mycobacterium
GARLQSGQP

SEQ ID NO: 987382 - protein, 7 aa, Mycobacterium
GARPGGF

SEQ ID NO: 987383 - protein, 7 aa, Mycobacterium
GARPPTF

SEQ ID NO: 987384 - protein, 15 aa, Mycobacterium
GARSDGHDHAASAIA

SEQ ID NO: 987385 - protein, 9 aa, Mycobacterium
GARSPLGRK

SEQ ID NO: 987386 - protein, 12 aa, Mycobacterium
GARTAVRRQQTL

SEQ ID NO: 987387 - protein, 7 aa, Mycobacterium
GARTSQF

SEQ ID NO: 987388 - protein, 9 aa, Mycobacterium
GASEYEING

SEQ ID NO: 987389 - protein, 13 aa, Mycobacterium
GASGITPPQADLD

SEQ ID NO: 987390 - protein, 9 aa, Mycobacterium
GASHDDPAA

SEQ ID NO: 987391 - protein, 7 aa, Mycobacterium
GASKVTD

SEQ ID NO: 987392 - protein, 16 aa, Mycobacterium
GASLPLDNKPPGDSGV

SEQ ID NO: 987393 - protein, 10 aa, Mycobacterium
GASNDEIQAA

SEQ ID NO: 987394 - protein, 4 aa, Mycobacterium
GASP

SEQ ID NO: 987395 - protein, 9 aa, Mycobacterium
GASPPAAVQ

SEQ ID NO: 987396 - protein, 14 aa, Mycobacterium
GASQAWSKLSPLNL

SEQ ID NO: 987397 - protein, 18 aa, Mycobacterium
GASSTGISRKLPDTERQR

SEQ ID NO: 987398 - protein, 17 aa, Mycobacterium
GASTAEAQDRAGTDVAE

SEQ ID NO: 987399 - protein, 7 aa, Mycobacterium
GASTDEV

SEQ ID NO: 987400 - protein, 7 aa, Mycobacterium
GASTGGF

SEQ ID NO: 987401 - protein, 8 aa, Mycobacterium
GASTHGAR

SEQ ID NO: 987402 - protein, 7 aa, Mycobacterium
GASVDAE

SEQ ID NO: 987403 - protein, 4 aa, Mycobacterium
GATA

SEQ ID NO: 987404 - protein, 8 aa, Mycobacterium
GATAPYNN

SEQ ID NO: 987405 - protein, 11 aa, Mycobacterium
GATDAALSETV

SEQ ID NO: 987406 - protein, 9 aa, Mycobacterium
GATDADEAA

SEQ ID NO: 987407 - protein, 10 aa, Mycobacterium
GATDKVTKSS

SEQ ID NO: 987408 - protein, 11 aa, Mycobacterium
GATEPAGGDHA

SEQ ID NO: 987409 - protein, 14 aa, Mycobacterium
GATEPLTGYREPKP

SEQ ID NO: 987410 - protein, 4 aa, Mycobacterium
GATG

SEQ ID NO: 987411 - protein, 12 aa, Mycobacterium
GATGLTDKQIRG

SEQ ID NO: 987412 - protein, 5 aa, Mycobacterium
GATIG

SEQ ID NO: 987413 - protein, 9 aa, Mycobacterium
GATKANRRR

SEQ ID NO: 987414 - protein, 5 aa, Mycobacterium
GATPR

SEQ ID NO: 987415 - protein, 6 aa, Mycobacterium
GATPRA

SEQ ID NO: 987416 - protein, 8 aa, Mycobacterium
GATTDSYV

SEQ ID NO: 987417 - protein, 5 aa, Mycobacterium
GATTI

SEQ ID NO: 987418 - protein, 4 aa, Mycobacterium
GAVE

SEQ ID NO: 987419 - protein, 8 aa, Mycobacterium
GAVEGGQV

SEQ ID NO: 987420 - protein, 4 aa, Mycobacterium
GAVG

SEQ ID NO: 987421 - protein, 10 aa, Mycobacterium
GAVGTGELTP

SEQ ID NO: 987422 - protein, 5 aa, Mycobacterium
GAVHR

SEQ ID NO: 987423 - protein, 20 aa, Mycobacterium
GAVNGHSNNGNDDETSTTPT

SEQ ID NO: 987424 - protein, 6 aa, Mycobacterium
GAVQSM

SEQ ID NO: 987425 - protein, 12 aa, Mycobacterium
GAYASPDQAAEQ

SEQ ID NO: 987426 - protein, 15 aa, Mycobacterium
GAYGEEAAAEITVVL

SEQ ID NO: 987427 - protein, 16 aa, Mycobacterium
GAYRPLDNGRMVRSSV

SEQ ID NO: 987428 - protein, 10 aa, Mycobacterium
GCDHDTQRYR

SEQ ID NO: 987429 - protein, 8 aa, Mycobacterium
GCPSGEVQ

SEQ ID NO: 987430 - protein, 6 aa, Mycobacterium
GCPSSL

SEQ ID NO: 987431 - protein, 7 aa, Mycobacterium
GCQSEGF

SEQ ID NO: 987432 - protein, 7 aa, Mycobacterium
GCSGQTT

SEQ ID NO: 987433 - protein, 11 aa, Mycobacterium
GCSNINGTAAT

SEQ ID NO: 987434 - protein, 13 aa, Mycobacterium
GCTLDGKSDNEQW

SEQ ID NO: 987435 - protein, 8 aa, Mycobacterium
GDAARDAK

SEQ ID NO: 987436 - protein, 16 aa, Mycobacterium
GDAKDITGDQNLTVEQ

SEQ ID NO: 987437 - protein, 5 aa, Mycobacterium
GDARR

SEQ ID NO: 987438 - protein, 6 aa, Mycobacterium
GDATDA

SEQ ID NO: 987439 - protein, 7 aa, Mycobacterium
GDATKSD

SEQ ID NO: 987440 - protein, 17 aa, Mycobacterium
GDATMTAGNSTSLTDGA

SEQ ID NO: 987441 - protein, 15 aa, Mycobacterium
GDATTGLDLPPPAAL

SEQ ID NO: 987442 - protein, 7 aa, Mycobacterium
GDAVRGD

SEQ ID NO: 987443 - protein, 13 aa, Mycobacterium
GDDAERSDEVERR

SEQ ID NO: 987444 - protein, 5 aa, Mycobacterium
GDDEG

SEQ ID NO: 987445 - protein, 7 aa, Mycobacterium
GDDGDGM

SEQ ID NO: 987446 - protein, 21 aa, Mycobacterium
GDDGELTPQRANLNGTLTPDE

SEQ ID NO: 987447 - protein, 9 aa, Mycobacterium
GDDGSRSAE

SEQ ID NO: 987448 - protein, 5 aa, Mycobacterium
GDDMQ

SEQ ID NO: 987449 - protein, 36 aa, Mycobacterium
GDDNAARAALTAAPVNDIPTTHNTAEPASRPQPTTF

SEQ ID NO: 987450 - protein, 6 aa, Mycobacterium
GDDPEA

SEQ ID NO: 987451 - protein, 9 aa, Mycobacterium
GDDPGSHAY

SEQ ID NO: 987452 - protein, 11 aa, Mycobacterium
GDDPLDAPDSV

SEQ ID NO: 987453 - protein, 7 aa, Mycobacterium
GDDPQTV

SEQ ID NO: 987454 - protein, 7 aa, Mycobacterium
GDDRMTD

SEQ ID NO: 987455 - protein, 9 aa, Mycobacterium
GDDSERLAG

SEQ ID NO: 987456 - protein, 4 aa, Mycobacterium
GDDV

SEQ ID NO: 987457 - protein, 12 aa, Mycobacterium
GDEEQLRSQAGG

SEQ ID NO: 987458 - protein, 6 aa, Mycobacterium
GDEFGG

SEQ ID NO: 987459 - protein, 10 aa, Mycobacterium
GDEGKGKVTD

SEQ ID NO: 987460 - protein, 12 aa, Mycobacterium
GDEKNPGTTAEV

SEQ ID NO: 987461 - protein, 8 aa, Mycobacterium
GDEPLKRK

SEQ ID NO: 987462 - protein, 10 aa, Mycobacterium
GDERNKSGGV

SEQ ID NO: 987463 - protein, 7 aa, Mycobacterium
GDETDLR

SEQ ID NO: 987464 - protein, 5 aa, Mycobacterium
GDETG

SEQ ID NO: 987465 - protein, 12 aa, Mycobacterium
GDETKAIAAIFA

SEQ ID NO: 987466 - protein, 4 aa, Mycobacterium
GDFQ

SEQ ID NO: 987467 - protein, 9 aa, Mycobacterium
GDFTPDTVD

SEQ ID NO: 987468 - protein, 7 aa, Mycobacterium
GDGADIG

SEQ ID NO: 987469 - protein, 6 aa, Mycobacterium
GDGAGS

SEQ ID NO: 987470 - protein, 8 aa, Mycobacterium
GDGATAVR

SEQ ID NO: 987471 - protein, 12 aa, Mycobacterium
GDGAYGEAKSAL

SEQ ID NO: 987472 - protein, 10 aa, Mycobacterium
GDGAYTGAGT

SEQ ID NO: 987473 - protein, 5 aa, Mycobacterium
GDGDL

SEQ ID NO: 987474 - protein, 16 aa, Mycobacterium
GDGFGAGPRVAMLPGT

SEQ ID NO: 987475 - protein, 11 aa, Mycobacterium
GDGGSSEAKEP

SEQ ID NO: 987476 - protein, 8 aa, Mycobacterium
GDGLAGPK

SEQ ID NO: 987477 - protein, 4 aa, Mycobacterium
GDGP

SEQ ID NO: 987478 - protein, 6 aa, Mycobacterium
GDGQQH

SEQ ID NO: 987479 - protein, 6 aa, Mycobacterium
GDGRAF

SEQ ID NO: 987480 - protein, 8 aa, Mycobacterium
GDGTCRPQ

SEQ ID NO: 987481 - protein, 7 aa, Mycobacterium
GDGTDAD

SEQ ID NO: 987482 - protein, 7 aa, Mycobacterium
GDGTHTR

SEQ ID NO: 987483 - protein, 10 aa, Mycobacterium
GDHAELSGTE

SEQ ID NO: 987484 - protein, 11 aa, Mycobacterium
GDHEGALTNAG

SEQ ID NO: 987485 - protein, 7 aa, Mycobacterium
GDHEHRI

SEQ ID NO: 987486 - protein, 5 aa, Mycobacterium
GDHGD

SEQ ID NO: 987487 - protein, 5 aa, Mycobacterium
GDIPK

SEQ ID NO: 987488 - protein, 16 aa, Mycobacterium
GDISRGGVNVTAPGAV

SEQ ID NO: 987489 - protein, 6 aa, Mycobacterium
GDKAGS

SEQ ID NO: 987490 - protein, 4 aa, Mycobacterium
GDKE

SEQ ID NO: 987491 - protein, 9 aa, Mycobacterium
GDKEYRDFA

SEQ ID NO: 987492 - protein, 8 aa, Mycobacterium
GDKGEPCW

SEQ ID NO: 987493 - protein, 7 aa, Mycobacterium
GDKGEVD

SEQ ID NO: 987494 - protein, 8 aa, Mycobacterium
GDKKTRAG

SEQ ID NO: 987495 - protein, 9 aa, Mycobacterium
GDKTSAGAA

SEQ ID NO: 987496 - protein, 8 aa, Mycobacterium
GDLEREKG

SEQ ID NO: 987497 - protein, 10 aa, Mycobacterium
GDLGSSAARK

SEQ ID NO: 987498 - protein, 7 aa, Mycobacterium
GDLPPGV

SEQ ID NO: 987499 - protein, 14 aa, Mycobacterium
GDLTEEVNKDGKTF

SEQ ID NO: 987500 - protein, 11 aa, Mycobacterium
GDLYGGNEPAR

SEQ ID NO: 987501 - protein, 7 aa, Mycobacterium
GDMSRKR

SEQ ID NO: 987502 - protein, 7 aa, Mycobacterium
GDNAEHG

SEQ ID NO: 987503 - protein, 8 aa, Mycobacterium
GDNAGTVE

SEQ ID NO: 987504 - protein, 6 aa, Mycobacterium
GDNDRL

SEQ ID NO: 987505 - protein, 10 aa, Mycobacterium
GDNLAHPKAV

SEQ ID NO: 987506 - protein, 7 aa, Mycobacterium
GDNPWPA

SEQ ID NO: 987507 - protein, 4 aa, Mycobacterium
GDNQ

SEQ ID NO: 987508 - protein, 12 aa, Mycobacterium
GDNSLPTRPWWT

SEQ ID NO: 987509 - protein, 6 aa, Mycobacterium
GDNTNI

SEQ ID NO: 987510 - protein, 4 aa, Mycobacterium
GDPD

SEQ ID NO: 987511 - protein, 5 aa, Mycobacterium
GDPET

SEQ ID NO: 987512 - protein, 17 aa, Mycobacterium
GDPMENAAASPSGFGGF

SEQ ID NO: 987513 - protein, 20 aa, Mycobacterium
GDPPEGAEWTTGGVSFGSAG

SEQ ID NO: 987514 - protein, 8 aa, Mycobacterium
GDPRAEHR

SEQ ID NO: 987515 - protein, 7 aa, Mycobacterium
GDPRLSA

SEQ ID NO: 987516 - protein, 19 aa, Mycobacterium
GDPSDGLPGVSGIDEKTTA

SEQ ID NO: 987517 - protein, 5 aa, Mycobacterium
GDPST

SEQ ID NO: 987518 - protein, 9 aa, Mycobacterium
GDPSVPSGV

SEQ ID NO: 987519 - protein, 10 aa, Mycobacterium
GDPTELSEER

SEQ ID NO: 987520 - protein, 15 aa, Mycobacterium
GDPTLSAASPDQSTW

SEQ ID NO: 987521 - protein, 9 aa, Mycobacterium
GDPTNVDIP

SEQ ID NO: 987522 - protein, 8 aa, Mycobacterium
GDPTPHAV

SEQ ID NO: 987523 - protein, 4 aa, Mycobacterium
GDPV

SEQ ID NO: 987524 - protein, 7 aa, Mycobacterium
GDQAATI

SEQ ID NO: 987525 - protein, 7 aa, Mycobacterium
GDQSGYV

SEQ ID NO: 987526 - protein, 18 aa, Mycobacterium
GDQTNTSGPRAGRNDGVP

SEQ ID NO: 987527 - protein, 12 aa, Mycobacterium
GDRAHDSATPQF

SEQ ID NO: 987528 - protein, 9 aa, Mycobacterium
GDRAPQADV

SEQ ID NO: 987529 - protein, 6 aa, Mycobacterium
GDRESE

SEQ ID NO: 987530 - protein, 10 aa, Mycobacterium
GDRGAASREV

SEQ ID NO: 987531 - protein, 6 aa, Mycobacterium
GDRLGK

SEQ ID NO: 987532 - protein, 8 aa, Mycobacterium
GDRRMSEL

SEQ ID NO: 987533 - protein, 10 aa, Mycobacterium
GDRRSTQGNM

SEQ ID NO: 987534 - protein, 8 aa, Mycobacterium
GDRVTHDK

SEQ ID NO: 987535 - protein, 7 aa, Mycobacterium
GDSAGGY

SEQ ID NO: 987536 - protein, 8 aa, Mycobacterium
GDSASSPA

SEQ ID NO: 987537 - protein, 4 aa, Mycobacterium
GDSE

SEQ ID NO: 987538 - protein, 11 aa, Mycobacterium
GDSEGVGSEAA

SEQ ID NO: 987539 - protein, 9 aa, Mycobacterium
GDSFPDTGI

SEQ ID NO: 987540 - protein, 4 aa, Mycobacterium
GDSM

SEQ ID NO: 987541 - protein, 11 aa, Mycobacterium
GDSPFRLSGGQ

SEQ ID NO: 987542 - protein, 22 aa, Mycobacterium
GDSPPCSAGQSEQNASHGMAHE

SEQ ID NO: 987543 - protein, 7 aa, Mycobacterium
GDSRSVD

SEQ ID NO: 987544 - protein, 7 aa, Mycobacterium
GDSTGGY

SEQ ID NO: 987545 - protein, 9 aa, Mycobacterium
GDSVQADEP

SEQ ID NO: 987546 - protein, 4 aa, Mycobacterium
GDTA

SEQ ID NO: 987547 - protein, 16 aa, Mycobacterium
GDTAPALPVPPPQEVA

SEQ ID NO: 987548 - protein, 5 aa, Mycobacterium
GDTDR

SEQ ID NO: 987549 - protein, 6 aa, Mycobacterium
GDTGIS

SEQ ID NO: 987550 - protein, 8 aa, Mycobacterium
GDTGYAKS

SEQ ID NO: 987551 - protein, 17 aa, Mycobacterium
GDTQSTWSRVSYAVVRH

SEQ ID NO: 987552 - protein, 16 aa, Mycobacterium
GDTSEQFADWPPLPTA

SEQ ID NO: 987553 - protein, 8 aa, Mycobacterium
GDTSGIDE

SEQ ID NO: 987554 - protein, 9 aa, Mycobacterium
GDVDPDRTW

SEQ ID NO: 987555 - protein, 5 aa, Mycobacterium
GDVEP

SEQ ID NO: 987556 - protein, 7 aa, Mycobacterium
GDVNDED

SEQ ID NO: 987557 - protein, 12 aa, Mycobacterium
GDVRPITYRIPT

SEQ ID NO: 987558 - protein, 8 aa, Mycobacterium
GDVTGPDS

SEQ ID NO: 987559 - protein, 13 aa, Mycobacterium
GDVVERGLDRHMG

SEQ ID NO: 987560 - protein, 18 aa, Mycobacterium
GDWGTAQQAPQSHRSYAS

SEQ ID NO: 987561 - protein, 4 aa, Mycobacterium
GDWT

SEQ ID NO: 987562 - protein, 9 aa, Mycobacterium
GDYASATKH

SEQ ID NO: 987563 - protein, 6 aa, Mycobacterium
GDYGTY

SEQ ID NO: 987564 - protein, 6 aa, Mycobacterium
GEAAET

SEQ ID NO: 987565 - protein, 8 aa, Mycobacterium
GEAETMTP

SEQ ID NO: 987566 - protein, 14 aa, Mycobacterium
GEAPTTASWGAANR

SEQ ID NO: 987567 - protein, 5 aa, Mycobacterium
GEAST

SEQ ID NO: 987568 - protein, 5 aa, Mycobacterium
GEDAG

SEQ ID NO: 987569 - protein, 7 aa, Mycobacterium
GEDAGRN

SEQ ID NO: 987570 - protein, 9 aa, Mycobacterium
GEDEPAARL

SEQ ID NO: 987571 - protein, 4 aa, Mycobacterium
GEDF

SEQ ID NO: 987572 - protein, 4 aa, Mycobacterium
GEDH

SEQ ID NO: 987573 - protein, 9 aa, Mycobacterium
GEDLGDPEI

SEQ ID NO: 987574 - protein, 4 aa, Mycobacterium
GEDP

SEQ ID NO: 987575 - protein, 16 aa, Mycobacterium
GEDPDREGLADTPARV

SEQ ID NO: 987576 - protein, 6 aa, Mycobacterium
GEDPHQ

SEQ ID NO: 987577 - protein, 9 aa, Mycobacterium
GEDSITEHD

SEQ ID NO: 987578 - protein, 8 aa, Mycobacterium
GEDSRIGA

SEQ ID NO: 987579 - protein, 11 aa, Mycobacterium
GEDVDTNGVDV

SEQ ID NO: 987580 - protein, 7 aa, Mycobacterium
GEEATTV

SEQ ID NO: 987581 - protein, 11 aa, Mycobacterium
GEEESGSPSLG

SEQ ID NO: 987582 - protein, 6 aa, Mycobacterium
GEEGEV

SEQ ID NO: 987583 - protein, 6 aa, Mycobacterium
GEERQG

SEQ ID NO: 987584 - protein, 5 aa, Mycobacterium
GEFSG

SEQ ID NO: 987585 - protein, 9 aa, Mycobacterium
GEFSSRPSA

SEQ ID NO: 987586 - protein, 15 aa, Mycobacterium
GEFVDEKAKGKYTDT

SEQ ID NO: 987587 - protein, 5 aa, Mycobacterium
GEFVE

SEQ ID NO: 987588 - protein, 4 aa, Mycobacterium
GEGA

SEQ ID NO: 987589 - protein, 10 aa, Mycobacterium
GEGDDADARI

SEQ ID NO: 987590 - protein, 12 aa, Mycobacterium
GEGEGRGPNGDY

SEQ ID NO: 987591 - protein, 4 aa, Mycobacterium
GEGG

SEQ ID NO: 987592 - protein, 10 aa, Mycobacterium
GEGGGQQVAE

SEQ ID NO: 987593 - protein, 11 aa, Mycobacterium
GEGGVRVTNDS

SEQ ID NO: 987594 - protein, 5 aa, Mycobacterium
GEGKR

SEQ ID NO: 987595 - protein, 9 aa, Mycobacterium
GEGKWTDSA

SEQ ID NO: 987596 - protein, 16 aa, Mycobacterium
GEGNSTADTASPGSPW

SEQ ID NO: 987597 - protein, 6 aa, Mycobacterium
GEGPSA

SEQ ID NO: 987598 - protein, 10 aa, Mycobacterium
GEGQHQDTGA

SEQ ID NO: 987599 - protein, 7 aa, Mycobacterium
GEGRTAL

SEQ ID NO: 987600 - protein, 8 aa, Mycobacterium
GEGTGATA

SEQ ID NO: 987601 - protein, 15 aa, Mycobacterium
GEGTKKLSKREPQSN

SEQ ID NO: 987602 - protein, 11 aa, Mycobacterium
GEGVAAKSLDS

SEQ ID NO: 987603 - protein, 9 aa, Mycobacterium
GEGVTGHQI

SEQ ID NO: 987604 - protein, 13 aa, Mycobacterium
GEGVTTGKRDQRD

SEQ ID NO: 987605 - protein, 8 aa, Mycobacterium
GEHPERLD

SEQ ID NO: 987606 - protein, 4 aa, Mycobacterium
GEIA

SEQ ID NO: 987607 - protein, 13 aa, Mycobacterium
GEIAGARAAAAAG

SEQ ID NO: 987608 - protein, 20 aa, Mycobacterium
GEIEAADAADGGVRRVEIPP

SEQ ID NO: 987609 - protein, 5 aa, Mycobacterium
GEIER

SEQ ID NO: 987610 - protein, 9 aa, Mycobacterium
GEIESVSSA

SEQ ID NO: 987611 - protein, 4 aa, Mycobacterium
GEIG

SEQ ID NO: 987612 - protein, 10 aa, Mycobacterium
GEINTVTGNE

SEQ ID NO: 987613 - protein, 9 aa, Mycobacterium
GEIQPGVTA

SEQ ID NO: 987614 - protein, 5 aa, Mycobacterium
GEITY

SEQ ID NO: 987615 - protein, 8 aa, Mycobacterium
GEKADDPL

SEQ ID NO: 987616 - protein, 9 aa, Mycobacterium
GEKAKQPIA

SEQ ID NO: 987617 - protein, 8 aa, Mycobacterium
GEKMSKSL

SEQ ID NO: 987618 - protein, 9 aa, Mycobacterium
GEKMSKSVG

SEQ ID NO: 987619 - protein, 17 aa, Mycobacterium
GEKSKDDSFARVRIALG

SEQ ID NO: 987620 - protein, 6 aa, Mycobacterium
GEKYPD

SEQ ID NO: 987621 - protein, 7 aa, Mycobacterium
GELGERN

SEQ ID NO: 987622 - protein, 5 aa, Mycobacterium
GELHG

SEQ ID NO: 987623 - protein, 4 aa, Mycobacterium
GELR

SEQ ID NO: 987624 - protein, 16 aa, Mycobacterium
GELSESGPSAPPRSDG

SEQ ID NO: 987625 - protein, 12 aa, Mycobacterium
GELTGSGRITTE

SEQ ID NO: 987626 - protein, 6 aa, Mycobacterium
GELVSR

SEQ ID NO: 987627 - protein, 4 aa, Mycobacterium
GENA

SEQ ID NO: 987628 - protein, 11 aa, Mycobacterium
GENIPEPGIPE

SEQ ID NO: 987629 - protein, 8 aa, Mycobacterium
GENPHQQA

SEQ ID NO: 987630 - protein, 11 aa, Mycobacterium
GEPDESGEEKI

SEQ ID NO: 987631 - protein, 8 aa, Mycobacterium
GEPGQPLD

SEQ ID NO: 987632 - protein, 8 aa, Mycobacterium
GEPGTGFK

SEQ ID NO: 987633 - protein, 32 aa, Mycobacterium
GEPGVGGLSEQDPEYDEFSNPDAWRTRRSSDT

SEQ ID NO: 987634 - protein, 8 aa, Mycobacterium
GEPIGPKA

SEQ ID NO: 987635 - protein, 13 aa, Mycobacterium
GEPLRDSSLAATY

SEQ ID NO: 987636 - protein, 12 aa, Mycobacterium
GEPLWPGWAEPV

SEQ ID NO: 987637 - protein, 10 aa, Mycobacterium
GEPPEATEER

SEQ ID NO: 987638 - protein, 7 aa, Mycobacterium
GEPQLGG

SEQ ID NO: 987639 - protein, 6 aa, Mycobacterium
GEPQPE

SEQ ID NO: 987640 - protein, 10 aa, Mycobacterium
GEPQQNPGRP

SEQ ID NO: 987641 - protein, 7 aa, Mycobacterium
GEPRYGD

SEQ ID NO: 987642 - protein, 4 aa, Mycobacterium
GEPT

SEQ ID NO: 987643 - protein, 9 aa, Mycobacterium
GEPTDVGNR

SEQ ID NO: 987644 - protein, 7 aa, Mycobacterium
GEPTGGY

SEQ ID NO: 987645 - protein, 4 aa, Mycobacterium
GEPV

SEQ ID NO: 987646 - protein, 9 aa, Mycobacterium
GEPVDAAKA

SEQ ID NO: 987647 - protein, 7 aa, Mycobacterium
GEQAPGL

SEQ ID NO: 987648 - protein, 9 aa, Mycobacterium
GEQHGGVKP

SEQ ID NO: 987649 - protein, 13 aa, Mycobacterium
GEQHPAATVTSKG

SEQ ID NO: 987650 - protein, 4 aa, Mycobacterium
GEQL

SEQ ID NO: 987651 - protein, 15 aa, Mycobacterium
GEQTTEKTSRTWTSM

SEQ ID NO: 987652 - protein, 4 aa, Mycobacterium
GEQY

SEQ ID NO: 987653 - protein, 4 aa, Mycobacterium
GERA

SEQ ID NO: 987654 - protein, 6 aa, Mycobacterium
GERAEN

SEQ ID NO: 987655 - protein, 4 aa, Mycobacterium
GERD

SEQ ID NO: 987656 - protein, 4 aa, Mycobacterium
GERG

SEQ ID NO: 987657 - protein, 6 aa, Mycobacterium
GERGTG

SEQ ID NO: 987658 - protein, 5 aa, Mycobacterium
GERLR

SEQ ID NO: 987659 - protein, 6 aa, Mycobacterium
GERRLK

SEQ ID NO: 987660 - protein, 5 aa, Mycobacterium
GERTN

SEQ ID NO: 987661 - protein, 4 aa, Mycobacterium
GERV

SEQ ID NO: 987662 - protein, 6 aa, Mycobacterium
GESADY

SEQ ID NO: 987663 - protein, 8 aa, Mycobacterium
GESDPGLI

SEQ ID NO: 987664 - protein, 5 aa, Mycobacterium
GESFP

SEQ ID NO: 987665 - protein, 13 aa, Mycobacterium
GESGSGKAAAPAT

SEQ ID NO: 987666 - protein, 11 aa, Mycobacterium
GESGSGKSTTL

SEQ ID NO: 987667 - protein, 10 aa, Mycobacterium
GESPRGAEAM

SEQ ID NO: 987668 - protein, 7 aa, Mycobacterium
GESRQQV

SEQ ID NO: 987669 - protein, 4 aa, Mycobacterium
GETE

SEQ ID NO: 987670 - protein, 10 aa, Mycobacterium
GETEAKTNAV

SEQ ID NO: 987671 - protein, 4 aa, Mycobacterium
GETL

SEQ ID NO: 987672 - protein, 14 aa, Mycobacterium
GETNTGGADKSSIL

SEQ ID NO: 987673 - protein, 14 aa, Mycobacterium
GETSLDEAKPLLGK

SEQ ID NO: 987674 - protein, 11 aa, Mycobacterium
GEVGNAEQANI

SEQ ID NO: 987675 - protein, 8 aa, Mycobacterium
GEVGSGKT

SEQ ID NO: 987676 - protein, 5 aa, Mycobacterium
GEVPS

SEQ ID NO: 987677 - protein, 6 aa, Mycobacterium
GEVSEP

SEQ ID NO: 987678 - protein, 6 aa, Mycobacterium
GEVSET

SEQ ID NO: 987679 - protein, 15 aa, Mycobacterium
GEWPSGIRSTQTPRA

SEQ ID NO: 987680 - protein, 6 aa, Mycobacterium
GEYDER

SEQ ID NO: 987681 - protein, 6 aa, Mycobacterium
GEYKSA

SEQ ID NO: 987682 - protein, 13 aa, Mycobacterium
GFAATGGASVVPN

SEQ ID NO: 987683 - protein, 13 aa, Mycobacterium
GFAPAAEDSSGSI

SEQ ID NO: 987684 - protein, 21 aa, Mycobacterium
GFARPRRRRAAGRPAGPPIHV

SEQ ID NO: 987685 - protein, 7 aa, Mycobacterium
GFGENTA

SEQ ID NO: 987686 - protein, 5 aa, Mycobacterium
GFGRT

SEQ ID NO: 987687 - protein, 7 aa, Mycobacterium
GFKPGAD

SEQ ID NO: 987688 - protein, 15 aa, Mycobacterium
GFNTRRSRIWLTEFG

SEQ ID NO: 987689 - protein, 5 aa, Mycobacterium
GFPTE

SEQ ID NO: 987690 - protein, 13 aa, Mycobacterium
GFRGQGASHGAQA

SEQ ID NO: 987691 - protein, 7 aa, Mycobacterium
GFRNDGH

SEQ ID NO: 987692 - protein, 6 aa, Mycobacterium
GFSDAK

SEQ ID NO: 987693 - protein, 12 aa, Mycobacterium
GFSEDPKALEPA

SEQ ID NO: 987694 - protein, 15 aa, Mycobacterium
GFSEQPKYENAAKIA

SEQ ID NO: 987695 - protein, 11 aa, Mycobacterium
GFSPGQNHQGG

SEQ ID NO: 987696 - protein, 5 aa, Mycobacterium
GFTGR

SEQ ID NO: 987697 - protein, 13 aa, Mycobacterium
GFTPAPPAEHGEC

SEQ ID NO: 987698 - protein, 8 aa, Mycobacterium
GFVRGEGA

SEQ ID NO: 987699 - protein, 10 aa, Mycobacterium
GGAAQPRRTL

SEQ ID NO: 987700 - protein, 8 aa, Mycobacterium
GGAENATQ

SEQ ID NO: 987701 - protein, 5 aa, Mycobacterium
GGAET

SEQ ID NO: 987702 - protein, 4 aa, Mycobacterium
GGAG

SEQ ID NO: 987703 - protein, 6 aa, Mycobacterium
GGAGDS

SEQ ID NO: 987704 - protein, 8 aa, Mycobacterium
GGAGKPRR

SEQ ID NO: 987705 - protein, 5 aa, Mycobacterium
GGAGL

SEQ ID NO: 987706 - protein, 6 aa, Mycobacterium
GGAGMR

SEQ ID NO: 987707 - protein, 24 aa, Mycobacterium
GGAGQYAATKATNTLPLQTGEQEA

SEQ ID NO: 987708 - protein, 9 aa, Mycobacterium
GGAGSIPEL

SEQ ID NO: 987709 - protein, 11 aa, Mycobacterium
GGAGSSDATLT

SEQ ID NO: 987710 - protein, 10 aa, Mycobacterium
GGAGTTAASL

SEQ ID NO: 987711 - protein, 5 aa, Mycobacterium
GGAGY

SEQ ID NO: 987712 - protein, 4 aa, Mycobacterium
GGAL

SEQ ID NO: 987713 - protein, 5 aa, Mycobacterium
GGANQ

SEQ ID NO: 987714 - protein, 5 aa, Mycobacterium
GGAPG

SEQ ID NO: 987715 - protein, 9 aa, Mycobacterium
GGAPQVNAA

SEQ ID NO: 987716 - protein, 6 aa, Mycobacterium
GGAPRR

SEQ ID NO: 987717 - protein, 11 aa, Mycobacterium
GGARGRDGAQG

SEQ ID NO: 987718 - protein, 5 aa, Mycobacterium
GGARV

SEQ ID NO: 987719 - protein, 10 aa, Mycobacterium
GGASGMGRAT

SEQ ID NO: 987720 - protein, 9 aa, Mycobacterium
GGASLDGAQ

SEQ ID NO: 987721 - protein, 4 aa, Mycobacterium
GGAT

SEQ ID NO: 987722 - protein, 26 aa, Mycobacterium
GGAVGSNGIPQLGNTIGSNSASRRSV

SEQ ID NO: 987723 - protein, 7 aa, Mycobacterium
GGCPRTV

SEQ ID NO: 987724 - protein, 7 aa, Mycobacterium
GGCSGAV

SEQ ID NO: 987725 - protein, 5 aa, Mycobacterium
GGCTT

SEQ ID NO: 987726 - protein, 10 aa, Mycobacterium
GGDAEERAAD

SEQ ID NO: 987727 - protein, 6 aa, Mycobacterium
GGDAPA

SEQ ID NO: 987728 - protein, 10 aa, Mycobacterium
GGDAQTNAAK

SEQ ID NO: 987729 - protein, 5 aa, Mycobacterium
GGDAT

SEQ ID NO: 987730 - protein, 5 aa, Mycobacterium
GGDDD

SEQ ID NO: 987731 - protein, 6 aa, Mycobacterium
GGDDDT

SEQ ID NO: 987732 - protein, 7 aa, Mycobacterium
GGDDEDL

SEQ ID NO: 987733 - protein, 5 aa, Mycobacterium
GGDEA

SEQ ID NO: 987734 - protein, 5 aa, Mycobacterium
GGDEG

SEQ ID NO: 987735 - protein, 9 aa, Mycobacterium
GGDHNPIHT

SEQ ID NO: 987736 - protein, 6 aa, Mycobacterium
GGDITR

SEQ ID NO: 987737 - protein, 5 aa, Mycobacterium
GGDMD

SEQ ID NO: 987738 - protein, 10 aa, Mycobacterium
GGDPEQLASA

SEQ ID NO: 987739 - protein, 15 aa, Mycobacterium
GGDPTGTGRGGPGYK

SEQ ID NO: 987740 - protein, 5 aa, Mycobacterium
GGDPV

SEQ ID NO: 987741 - protein, 7 aa, Mycobacterium
GGDPVAD

SEQ ID NO: 987742 - protein, 6 aa, Mycobacterium
GGDSVA

SEQ ID NO: 987743 - protein, 7 aa, Mycobacterium
GGDTAKE

SEQ ID NO: 987744 - protein, 7 aa, Mycobacterium
GGDTGAD

SEQ ID NO: 987745 - protein, 6 aa, Mycobacterium
GGDTGW

SEQ ID NO: 987746 - protein, 9 aa, Mycobacterium
GGEESTGAS

SEQ ID NO: 987747 - protein, 4 aa, Mycobacterium
GGEG

SEQ ID NO: 987748 - protein, 8 aa, Mycobacterium
GGEHTSSL

SEQ ID NO: 987749 - protein, 11 aa, Mycobacterium
GGELPSQPDIV

SEQ ID NO: 987750 - protein, 10 aa, Mycobacterium
GGELSDDDLE

SEQ ID NO: 987751 - protein, 7 aa, Mycobacterium
GGESRDL

SEQ ID NO: 987752 - protein, 18 aa, Mycobacterium
GGESSNTLIPDHRSGSSL

SEQ ID NO: 987753 - protein, 16 aa, Mycobacterium
GGESTRPGAIRTDPRV

SEQ ID NO: 987754 - protein, 6 aa, Mycobacterium
GGESYN

SEQ ID NO: 987755 - protein, 5 aa, Mycobacterium
GGEYG

SEQ ID NO: 987756 - protein, 4 aa, Mycobacterium
GGFP

SEQ ID NO: 987757 - protein, 10 aa, Mycobacterium
GGFRGKADRT

SEQ ID NO: 987758 - protein, 8 aa, Mycobacterium
GGFTDAHR

SEQ ID NO: 987759 - protein, 9 aa, Mycobacterium
GGGAATDVA

SEQ ID NO: 987760 - protein, 7 aa, Mycobacterium
GGGAPSL

SEQ ID NO: 987761 - protein, 7 aa, Mycobacterium
GGGASAE

SEQ ID NO: 987762 - protein, 7 aa, Mycobacterium
GGGAVSQ

SEQ ID NO: 987763 - protein, 9 aa, Mycobacterium
GGGAVTSPG

SEQ ID NO: 987764 - protein, 8 aa, Mycobacterium
GGGDSAME

SEQ ID NO: 987765 - protein, 5 aa, Mycobacterium
GGGFQ

SEQ ID NO: 987766 - protein, 23 aa, Mycobacterium
GGGGTPSAGLGVPTTTQLPPGPW

SEQ ID NO: 987767 - protein, 11 aa, Mycobacterium
GGGGYPAARAG

SEQ ID NO: 987768 - protein, 5 aa, Mycobacterium
GGGLA

SEQ ID NO: 987769 - protein, 5 aa, Mycobacterium
GGGLS

SEQ ID NO: 987770 - protein, 9 aa, Mycobacterium
GGGPAPRPI

SEQ ID NO: 987771 - protein, 6 aa, Mycobacterium
GGGPQI

SEQ ID NO: 987772 - protein, 10 aa, Mycobacterium
GGGPSGQAGA

SEQ ID NO: 987773 - protein, 14 aa, Mycobacterium
GGGQSGGGQQLSHG

SEQ ID NO: 987774 - protein, 4 aa, Mycobacterium
GGGS

SEQ ID NO: 987775 - protein, 9 aa, Mycobacterium
GGGSPRDTL

SEQ ID NO: 987776 - protein, 13 aa, Mycobacterium
GGGSSAVGGVEPR

SEQ ID NO: 987777 - protein, 6 aa, Mycobacterium
GGGSVE

SEQ ID NO: 987778 - protein, 6 aa, Mycobacterium
GGGTNI

SEQ ID NO: 987779 - protein, 5 aa, Mycobacterium
GGGVS

SEQ ID NO: 987780 - protein, 7 aa, Mycobacterium
GGGVTGR

SEQ ID NO: 987781 - protein, 4 aa, Mycobacterium
GGHQ

SEQ ID NO: 987782 - protein, 15 aa, Mycobacterium
GGHTSQVNVTDAGHA

SEQ ID NO: 987783 - protein, 10 aa, Mycobacterium
GGHTWPGGKQ

SEQ ID NO: 987784 - protein, 4 aa, Mycobacterium
GGHV

SEQ ID NO: 987785 - protein, 7 aa, Mycobacterium
GGISRKA

SEQ ID NO: 987786 - protein, 6 aa, Mycobacterium
GGISTL

SEQ ID NO: 987787 - protein, 13 aa, Mycobacterium
GGITADSDPDAEL

SEQ ID NO: 987788 - protein, 10 aa, Mycobacterium
GGKAGTGKSA

SEQ ID NO: 987789 - protein, 8 aa, Mycobacterium
GGKDPGTL

SEQ ID NO: 987790 - protein, 15 aa, Mycobacterium
GGKFGGKDSGYNVSG

SEQ ID NO: 987791 - protein, 5 aa, Mycobacterium
GGKGY

SEQ ID NO: 987792 - protein, 10 aa, Mycobacterium
GGKSQGAYAA

SEQ ID NO: 987793 - protein, 6 aa, Mycobacterium
GGKYTT

SEQ ID NO: 987794 - protein, 4 aa, Mycobacterium
GGLD

SEQ ID NO: 987795 - protein, 6 aa, Mycobacterium
GGLDST

SEQ ID NO: 987796 - protein, 7 aa, Mycobacterium
GGLPTNE

SEQ ID NO: 987797 - protein, 11 aa, Mycobacterium
GGLSGDPDKAD

SEQ ID NO: 987798 - protein, 4 aa, Mycobacterium
GGLT

SEQ ID NO: 987799 - protein, 11 aa, Mycobacterium
GGMGDRPSASG

SEQ ID NO: 987800 - protein, 9 aa, Mycobacterium
GGNAKAWGD

SEQ ID NO: 987801 - protein, 8 aa, Mycobacterium
GGNGTYAP

SEQ ID NO: 987802 - protein, 8 aa, Mycobacterium
GGNSAGNL

SEQ ID NO: 987803 - protein, 8 aa, Mycobacterium
GGNSYYRG

SEQ ID NO: 987804 - protein, 9 aa, Mycobacterium
GGNTDLGRT

SEQ ID NO: 987805 - protein, 4 aa, Mycobacterium
GGPA

SEQ ID NO: 987806 - protein, 15 aa, Mycobacterium
GGPASVYTEGAPQLD

SEQ ID NO: 987807 - protein, 6 aa, Mycobacterium
GGPAYA

SEQ ID NO: 987808 - protein, 6 aa, Mycobacterium
GGPDGM

SEQ ID NO: 987809 - protein, 9 aa, Mycobacterium
GGPDGPEQV

SEQ ID NO: 987810 - protein, 14 aa, Mycobacterium
GGPEVAKYAGRAGE

SEQ ID NO: 987811 - protein, 7 aa, Mycobacterium
GGPGEGA

SEQ ID NO: 987812 - protein, 7 aa, Mycobacterium
GGPPEQV

SEQ ID NO: 987813 - protein, 8 aa, Mycobacterium
GGPRDQKV

SEQ ID NO: 987814 - protein, 98 aa, Mycobacterium
GGPRPPRTGVPRPGGGRPGAPVGGRSDAGGGNYRGGGVGALPGGGSGGFRGRPGGGGHGGGGRPGQRGGAAGAFGRPGGAPRRGRKSKRQKRQEYDSM

SEQ ID NO: 987815 - protein, 7 aa, Mycobacterium
GGPRTGA

SEQ ID NO: 987816 - protein, 13 aa, Mycobacterium
GGPRTNSDIDHPV

SEQ ID NO: 987817 - protein, 13 aa, Mycobacterium
GGPSGSGLASPDG

SEQ ID NO: 987818 - protein, 4 aa, Mycobacterium
GGPT

SEQ ID NO: 987819 - protein, 6 aa, Mycobacterium
GGPTLT

SEQ ID NO: 987820 - protein, 6 aa, Mycobacterium
GGPVHS

SEQ ID NO: 987821 - protein, 6 aa, Mycobacterium
GGQDLS

SEQ ID NO: 987822 - protein, 15 aa, Mycobacterium
GGQERDIRSGTPGVA

SEQ ID NO: 987823 - protein, 8 aa, Mycobacterium
GGQESMTK

SEQ ID NO: 987824 - protein, 8 aa, Mycobacterium
GGQVENTA

SEQ ID NO: 987825 - protein, 4 aa, Mycobacterium
GGRA

SEQ ID NO: 987826 - protein, 9 aa, Mycobacterium
GGRAGGHHS

SEQ ID NO: 987827 - protein, 13 aa, Mycobacterium
GGRCEACTGDGTI

SEQ ID NO: 987828 - protein, 23 aa, Mycobacterium
GGRDPLGIGAPKRLRQATQTRHI

SEQ ID NO: 987829 - protein, 10 aa, Mycobacterium
GGRGVGSADN

SEQ ID NO: 987830 - protein, 20 aa, Mycobacterium
GGRINTDAMDNSAGVDCSDH

SEQ ID NO: 987831 - protein, 5 aa, Mycobacterium
GGRPM

SEQ ID NO: 987832 - protein, 5 aa, Mycobacterium
GGRSI

SEQ ID NO: 987833 - protein, 26 aa, Mycobacterium
GGRSNSGEGGEDVNRFEPDPNGDWRR

SEQ ID NO: 987834 - protein, 12 aa, Mycobacterium
GGRTEIAEATRE

SEQ ID NO: 987835 - protein, 6 aa, Mycobacterium
GGSAEC

SEQ ID NO: 987836 - protein, 5 aa, Mycobacterium
GGSAG

SEQ ID NO: 987837 - protein, 10 aa, Mycobacterium
GGSAQKDNAM

SEQ ID NO: 987838 - protein, 5 aa, Mycobacterium
GGSAV

SEQ ID NO: 987839 - protein, 9 aa, Mycobacterium
GGSDQPGMA

SEQ ID NO: 987840 - protein, 6 aa, Mycobacterium
GGSDQW

SEQ ID NO: 987841 - protein, 4 aa, Mycobacterium
GGSG

SEQ ID NO: 987842 - protein, 10 aa, Mycobacterium
GGSGAGKTAF

SEQ ID NO: 987843 - protein, 5 aa, Mycobacterium
GGSLE

SEQ ID NO: 987844 - protein, 15 aa, Mycobacterium
GGSLELSNGVDEEPE

SEQ ID NO: 987845 - protein, 7 aa, Mycobacterium
GGSMGGA

SEQ ID NO: 987846 - protein, 12 aa, Mycobacterium
GGSRHRPDDDRH

SEQ ID NO: 987847 - protein, 15 aa, Mycobacterium
GGSRRDRVHRTRTPA

SEQ ID NO: 987848 - protein, 4 aa, Mycobacterium
GGSS

SEQ ID NO: 987849 - protein, 6 aa, Mycobacterium
GGSSAG

SEQ ID NO: 987850 - protein, 6 aa, Mycobacterium
GGSSGI

SEQ ID NO: 987851 - protein, 8 aa, Mycobacterium
GGSSIKGG

SEQ ID NO: 987852 - protein, 14 aa, Mycobacterium
GGTAAKADHRHRVL

SEQ ID NO: 987853 - protein, 8 aa, Mycobacterium
GGTAGYNA

SEQ ID NO: 987854 - protein, 4 aa, Mycobacterium
GGTD

SEQ ID NO: 987855 - protein, 9 aa, Mycobacterium
GGTDSDDCE

SEQ ID NO: 987856 - protein, 5 aa, Mycobacterium
GGTER

SEQ ID NO: 987857 - protein, 6 aa, Mycobacterium
GGTGAL

SEQ ID NO: 987858 - protein, 17 aa, Mycobacterium
GGTGHPGDPGRHIASAL

SEQ ID NO: 987859 - protein, 11 aa, Mycobacterium
GGTGKTGALPF

SEQ ID NO: 987860 - protein, 5 aa, Mycobacterium
GGTGL

SEQ ID NO: 987861 - protein, 15 aa, Mycobacterium
GGTGRETGKRHPTIG

SEQ ID NO: 987862 - protein, 16 aa, Mycobacterium
GGTGVTPRDVAPEATR

SEQ ID NO: 987863 - protein, 14 aa, Mycobacterium
GGTHDKNQPGSCAR

SEQ ID NO: 987864 - protein, 23 aa, Mycobacterium
GGTISTSTDHDGVRRPAYSGTEL

SEQ ID NO: 987865 - protein, 10 aa, Mycobacterium
GGTPAQVENA

SEQ ID NO: 987866 - protein, 26 aa, Mycobacterium
GGTPPPYPGWPDHSHTEAVSRLTESA

SEQ ID NO: 987867 - protein, 5 aa, Mycobacterium
GGTRC

SEQ ID NO: 987868 - protein, 10 aa, Mycobacterium
GGTSEVTRNQ

SEQ ID NO: 987869 - protein, 5 aa, Mycobacterium
GGTTY

SEQ ID NO: 987870 - protein, 7 aa, Mycobacterium
GGTVSET

SEQ ID NO: 987871 - protein, 8 aa, Mycobacterium
GGVDDRDR

SEQ ID NO: 987872 - protein, 6 aa, Mycobacterium
GGVDSA

SEQ ID NO: 987873 - protein, 11 aa, Mycobacterium
GGVDSTALYPP

SEQ ID NO: 987874 - protein, 10 aa, Mycobacterium
GGVDTTSDVP

SEQ ID NO: 987875 - protein, 12 aa, Mycobacterium
GGVGEDITGGLP

SEQ ID NO: 987876 - protein, 5 aa, Mycobacterium
GGVGK

SEQ ID NO: 987877 - protein, 21 aa, Mycobacterium
GGVGKSTLAAATAVRDAGEGR

SEQ ID NO: 987878 - protein, 7 aa, Mycobacterium
GGVNNPE

SEQ ID NO: 987879 - protein, 14 aa, Mycobacterium
GGVPPGYGSGAAQA

SEQ ID NO: 987880 - protein, 13 aa, Mycobacterium
GGVQQSTAALSTT

SEQ ID NO: 987881 - protein, 15 aa, Mycobacterium
GGVRPGLTEREVGRE

SEQ ID NO: 987882 - protein, 4 aa, Mycobacterium
GGVS

SEQ ID NO: 987883 - protein, 10 aa, Mycobacterium
GGVTETGNRT

SEQ ID NO: 987884 - protein, 10 aa, Mycobacterium
GGVTGGDDAA

SEQ ID NO: 987885 - protein, 9 aa, Mycobacterium
GGVTGSAAD

SEQ ID NO: 987886 - protein, 8 aa, Mycobacterium
GGVTSMER

SEQ ID NO: 987887 - protein, 12 aa, Mycobacterium
GGVVADSNGPYE

SEQ ID NO: 987888 - protein, 4 aa, Mycobacterium
GGWN

SEQ ID NO: 987889 - protein, 12 aa, Mycobacterium
GGWPPRCSATRD

SEQ ID NO: 987890 - protein, 6 aa, Mycobacterium
GGYLPG

SEQ ID NO: 987891 - protein, 16 aa, Mycobacterium
GGYRGLRGSHTEGDEF

SEQ ID NO: 987892 - protein, 6 aa, Mycobacterium
GGYTYG

SEQ ID NO: 987893 - protein, 13 aa, Mycobacterium
GHDGGTGATPLTS

SEQ ID NO: 987894 - protein, 14 aa, Mycobacterium
GHDLPGNRGCPGRP

SEQ ID NO: 987895 - protein, 5 aa, Mycobacterium
GHDNH

SEQ ID NO: 987896 - protein, 6 aa, Mycobacterium
GHDPRD

SEQ ID NO: 987897 - protein, 8 aa, Mycobacterium
GHDPTLPR

SEQ ID NO: 987898 - protein, 7 aa, Mycobacterium
GHEPDNP

SEQ ID NO: 987899 - protein, 14 aa, Mycobacterium
GHGAADWSKRPLPS

SEQ ID NO: 987900 - protein, 8 aa, Mycobacterium
GHGASPQV

SEQ ID NO: 987901 - protein, 6 aa, Mycobacterium
GHGDAP

SEQ ID NO: 987902 - protein, 7 aa, Mycobacterium
GHGGGAS

SEQ ID NO: 987903 - protein, 8 aa, Mycobacterium
GHGGGASY

SEQ ID NO: 987904 - protein, 7 aa, Mycobacterium
GHGGRNV

SEQ ID NO: 987905 - protein, 7 aa, Mycobacterium
GHGNPDG

SEQ ID NO: 987906 - protein, 5 aa, Mycobacterium
GHGRS

SEQ ID NO: 987907 - protein, 8 aa, Mycobacterium
GHGRSAGK

SEQ ID NO: 987908 - protein, 12 aa, Mycobacterium
GHGSGGQTGRSG

SEQ ID NO: 987909 - protein, 13 aa, Mycobacterium
GHGTGTTLGDPIE

SEQ ID NO: 987910 - protein, 9 aa, Mycobacterium
GHGVQRPND

SEQ ID NO: 987911 - protein, 5 aa, Mycobacterium
GHHAT

SEQ ID NO: 987912 - protein, 4 aa, Mycobacterium
GHIG

SEQ ID NO: 987913 - protein, 6 aa, Mycobacterium
GHKENS

SEQ ID NO: 987914 - protein, 12 aa, Mycobacterium
GHKHRDALGDQI

SEQ ID NO: 987915 - protein, 4 aa, Mycobacterium
GHNQ

SEQ ID NO: 987916 - protein, 4 aa, Mycobacterium
GHPD

SEQ ID NO: 987917 - protein, 14 aa, Mycobacterium
GHPQIRHPNRRNPQ

SEQ ID NO: 987918 - protein, 9 aa, Mycobacterium
GHQNPGHPC

SEQ ID NO: 987919 - protein, 4 aa, Mycobacterium
GHQS

SEQ ID NO: 987920 - protein, 9 aa, Mycobacterium
GHSDESDSE

SEQ ID NO: 987921 - protein, 10 aa, Mycobacterium
GHSERSGEVI

SEQ ID NO: 987922 - protein, 9 aa, Mycobacterium
GHSTGRDPV

SEQ ID NO: 987923 - protein, 5 aa, Mycobacterium
GHSVP

SEQ ID NO: 987924 - protein, 7 aa, Mycobacterium
GHTAAPH

SEQ ID NO: 987925 - protein, 5 aa, Mycobacterium
GHTDG

SEQ ID NO: 987926 - protein, 13 aa, Mycobacterium
GHTEPAQSNAVGR

SEQ ID NO: 987927 - protein, 8 aa, Mycobacterium
GHTGAMKP

SEQ ID NO: 987928 - protein, 6 aa, Mycobacterium
GHTGGH

SEQ ID NO: 987929 - protein, 8 aa, Mycobacterium
GHTSAESY

SEQ ID NO: 987930 - protein, 4 aa, Mycobacterium
GHVE

SEQ ID NO: 987931 - protein, 25 aa, Mycobacterium
GHYSGAAALGNAKGYKYSHDDPDGV

SEQ ID NO: 987932 - protein, 5 aa, Mycobacterium
GIARD

SEQ ID NO: 987933 - protein, 18 aa, Mycobacterium
GIASPDECRVEHAQTPWM

SEQ ID NO: 987934 - protein, 20 aa, Mycobacterium
GIATQKDAHDESEMAGAPQA

SEQ ID NO: 987935 - protein, 5 aa, Mycobacterium
GIATR

SEQ ID NO: 987936 - protein, 5 aa, Mycobacterium
GIDAT

SEQ ID NO: 987937 - protein, 10 aa, Mycobacterium
GIDPQRGWGH

SEQ ID NO: 987938 - protein, 5 aa, Mycobacterium
GIDRR

SEQ ID NO: 987939 - protein, 7 aa, Mycobacterium
GIDSSTV

SEQ ID NO: 987940 - protein, 11 aa, Mycobacterium
GIDVTQATLSR

SEQ ID NO: 987941 - protein, 14 aa, Mycobacterium
GIDYESAEASFQPS

SEQ ID NO: 987942 - protein, 6 aa, Mycobacterium
GIEHSE

SEQ ID NO: 987943 - protein, 12 aa, Mycobacterium
GIEPSEITPEKS

SEQ ID NO: 987944 - protein, 12 aa, Mycobacterium
GIEQQGGRNPVH

SEQ ID NO: 987945 - protein, 5 aa, Mycobacterium
GIGAD

SEQ ID NO: 987946 - protein, 14 aa, Mycobacterium
GIGAKSTGMASTST

SEQ ID NO: 987947 - protein, 13 aa, Mycobacterium
GIGATENTEGFTT

SEQ ID NO: 987948 - protein, 5 aa, Mycobacterium
GIGDT

SEQ ID NO: 987949 - protein, 7 aa, Mycobacterium
GIGEEQA

SEQ ID NO: 987950 - protein, 28 aa, Mycobacterium
GIGHDGQRSTCPGARTEVAEPEVSRYRA

SEQ ID NO: 987951 - protein, 7 aa, Mycobacterium
GIGLPDE

SEQ ID NO: 987952 - protein, 4 aa, Mycobacterium
GIGM

SEQ ID NO: 987953 - protein, 19 aa, Mycobacterium
GIGSSLGAANAAAATPTTT

SEQ ID NO: 987954 - protein, 7 aa, Mycobacterium
GIGSSRE

SEQ ID NO: 987955 - protein, 12 aa, Mycobacterium
GIGTPEKAAEYL

SEQ ID NO: 987956 - protein, 8 aa, Mycobacterium
GIHSGDSA

SEQ ID NO: 987957 - protein, 7 aa, Mycobacterium
GIKDSLS

SEQ ID NO: 987958 - protein, 8 aa, Mycobacterium
GIKDTSDQ

SEQ ID NO: 987959 - protein, 13 aa, Mycobacterium
GINADTIEQAAEA

SEQ ID NO: 987960 - protein, 9 aa, Mycobacterium
GINDSLGHD

SEQ ID NO: 987961 - protein, 10 aa, Mycobacterium
GINGGGAPIQ

SEQ ID NO: 987962 - protein, 6 aa, Mycobacterium
GINPDD

SEQ ID NO: 987963 - protein, 16 aa, Mycobacterium
GIPDPEPATGDSPYWA

SEQ ID NO: 987964 - protein, 9 aa, Mycobacterium
GIPGTGTAT

SEQ ID NO: 987965 - protein, 15 aa, Mycobacterium
GIPNIAEASKLDADE

SEQ ID NO: 987966 - protein, 8 aa, Mycobacterium
GIPNPGFS

SEQ ID NO: 987967 - protein, 18 aa, Mycobacterium
GIPTAQPLTAETAAGLPG

SEQ ID NO: 987968 - protein, 7 aa, Mycobacterium
GIQDELD

SEQ ID NO: 987969 - protein, 4 aa, Mycobacterium
GIRG

SEQ ID NO: 987970 - protein, 5 aa, Mycobacterium
GIRPG

SEQ ID NO: 987971 - protein, 7 aa, Mycobacterium
GISAGNN

SEQ ID NO: 987972 - protein, 18 aa, Mycobacterium
GISDLSGGQFGPAVTGRR

SEQ ID NO: 987973 - protein, 10 aa, Mycobacterium
GISKAADAVS

SEQ ID NO: 987974 - protein, 23 aa, Mycobacterium
GISPPQSSPTGTPAVYQEVGNPT

SEQ ID NO: 987975 - protein, 7 aa, Mycobacterium
GISREGS

SEQ ID NO: 987976 - protein, 4 aa, Mycobacterium
GITA

SEQ ID NO: 987977 - protein, 5 aa, Mycobacterium
GITAA

SEQ ID NO: 987978 - protein, 7 aa, Mycobacterium
GITANDS

SEQ ID NO: 987979 - protein, 8 aa, Mycobacterium
GITAPAEL

SEQ ID NO: 987980 - protein, 13 aa, Mycobacterium
GITDTGDFAIVAI

SEQ ID NO: 987981 - protein, 8 aa, Mycobacterium
GITGKPLN

SEQ ID NO: 987982 - protein, 6 aa, Mycobacterium
GITGPE

SEQ ID NO: 987983 - protein, 12 aa, Mycobacterium
GITGSDGPSHNG

SEQ ID NO: 987984 - protein, 7 aa, Mycobacterium
GKAGCTT

SEQ ID NO: 987985 - protein, 9 aa, Mycobacterium
GKAPADSRE

SEQ ID NO: 987986 - protein, 9 aa, Mycobacterium
GKASVSGAV

SEQ ID NO: 987987 - protein, 9 aa, Mycobacterium
GKATAVDGT

SEQ ID NO: 987988 - protein, 4 aa, Mycobacterium
GKDG

SEQ ID NO: 987989 - protein, 11 aa, Mycobacterium
GKDIDATRAEK

SEQ ID NO: 987990 - protein, 15 aa, Mycobacterium
GKDYRGDRFDCSAVS

SEQ ID NO: 987991 - protein, 10 aa, Mycobacterium
GKEEESAQTF

SEQ ID NO: 987992 - protein, 11 aa, Mycobacterium
GKEGVEPQSEQ

SEQ ID NO: 987993 - protein, 4 aa, Mycobacterium
GKEI

SEQ ID NO: 987994 - protein, 8 aa, Mycobacterium
GKELRRGA

SEQ ID NO: 987995 - protein, 10 aa, Mycobacterium
GKEVDRSPAD

SEQ ID NO: 987996 - protein, 22 aa, Mycobacterium
GKFTSDESHTLARARVGQLLPS

SEQ ID NO: 987997 - protein, 7 aa, Mycobacterium
GKGAGHE

SEQ ID NO: 987998 - protein, 15 aa, Mycobacterium
GKGCAEAAKGQGARV

SEQ ID NO: 987999 - protein, 5 aa, Mycobacterium
GKGDY

SEQ ID NO: 988000 - protein, 8 aa, Mycobacterium
GKGGKQRL

SEQ ID NO: 988001 - protein, 7 aa, Mycobacterium
GKGKRIA

SEQ ID NO: 988002 - protein, 10 aa, Mycobacterium
GKGQVGPGGV

SEQ ID NO: 988003 - protein, 7 aa, Mycobacterium
GKGSNAM

SEQ ID NO: 988004 - protein, 7 aa, Mycobacterium
GKIDGDA

SEQ ID NO: 988005 - protein, 10 aa, Mycobacterium
GKIGESGVPA

SEQ ID NO: 988006 - protein, 4 aa, Mycobacterium
GKIQ

SEQ ID NO: 988007 - protein, 6 aa, Mycobacterium
GKKIAR

SEQ ID NO: 988008 - protein, 6 aa, Mycobacterium
GKKQAE

SEQ ID NO: 988009 - protein, 7 aa, Mycobacterium
GKKQIYG

SEQ ID NO: 988010 - protein, 18 aa, Mycobacterium
GKLRGPTRSEDSAEIDPA

SEQ ID NO: 988011 - protein, 7 aa, Mycobacterium
GKLRKNG

SEQ ID NO: 988012 - protein, 8 aa, Mycobacterium
GKNASGCA

SEQ ID NO: 988013 - protein, 10 aa, Mycobacterium
GKPATRRHEL

SEQ ID NO: 988014 - protein, 10 aa, Mycobacterium
GKPIAVTPAH

SEQ ID NO: 988015 - protein, 6 aa, Mycobacterium
GKPIEA

SEQ ID NO: 988016 - protein, 15 aa, Mycobacterium
GKPLLSQAGDLTPAV

SEQ ID NO: 988017 - protein, 7 aa, Mycobacterium
GKPLNQP

SEQ ID NO: 988018 - protein, 5 aa, Mycobacterium
GKPLP

SEQ ID NO: 988019 - protein, 4 aa, Mycobacterium
GKPR

SEQ ID NO: 988020 - protein, 9 aa, Mycobacterium
GKPRPGDYR

SEQ ID NO: 988021 - protein, 12 aa, Mycobacterium
GKPRSEWPADTI

SEQ ID NO: 988022 - protein, 4 aa, Mycobacterium
GKPV

SEQ ID NO: 988023 - protein, 7 aa, Mycobacterium
GKQGRFR

SEQ ID NO: 988024 - protein, 14 aa, Mycobacterium
GKQYEGYAAQGVDQ

SEQ ID NO: 988025 - protein, 8 aa, Mycobacterium
GKRFESRQ

SEQ ID NO: 988026 - protein, 8 aa, Mycobacterium
GKRPDRPG

SEQ ID NO: 988027 - protein, 5 aa, Mycobacterium
GKRPV

SEQ ID NO: 988028 - protein, 4 aa, Mycobacterium
GKRS

SEQ ID NO: 988029 - protein, 41 aa, Mycobacterium
GKRTGKDGASRTLTEPADPEATELPAASEPDSEEVDELEGP

SEQ ID NO: 988030 - protein, 8 aa, Mycobacterium
GKRTLSEE

SEQ ID NO: 988031 - protein, 15 aa, Mycobacterium
GKSGWDAELTHSIDL

SEQ ID NO: 988032 - protein, 12 aa, Mycobacterium
GKSLKNSVSPDE

SEQ ID NO: 988033 - protein, 12 aa, Mycobacterium
GKSPDDIDESAP

SEQ ID NO: 988034 - protein, 7 aa, Mycobacterium
GKSPGGI

SEQ ID NO: 988035 - protein, 6 aa, Mycobacterium
GKSTLA

SEQ ID NO: 988036 - protein, 19 aa, Mycobacterium
GKTAASADKVRGGYYTPAP

SEQ ID NO: 988037 - protein, 7 aa, Mycobacterium
GKTASRV

SEQ ID NO: 988038 - protein, 9 aa, Mycobacterium
GKTDRYARD

SEQ ID NO: 988039 - protein, 6 aa, Mycobacterium
GKTEQA

SEQ ID NO: 988040 - protein, 18 aa, Mycobacterium
GKTLPATPIPVADDSADP

SEQ ID NO: 988041 - protein, 8 aa, Mycobacterium
GKTLSDPN

SEQ ID NO: 988042 - protein, 6 aa, Mycobacterium
GKTPPC

SEQ ID NO: 988043 - protein, 4 aa, Mycobacterium
GKTV

SEQ ID NO: 988044 - protein, 8 aa, Mycobacterium
GKTVEGRS

SEQ ID NO: 988045 - protein, 20 aa, Mycobacterium
GKVDSGSQVINATKGKKERL

SEQ ID NO: 988046 - protein, 5 aa, Mycobacterium
GLAAS

SEQ ID NO: 988047 - protein, 5 aa, Mycobacterium
GLAGS

SEQ ID NO: 988048 - protein, 11 aa, Mycobacterium
GLAGSSGLLSG

SEQ ID NO: 988049 - protein, 8 aa, Mycobacterium
GLAPMNPA

SEQ ID NO: 988050 - protein, 6 aa, Mycobacterium
GLAPNI

SEQ ID NO: 988051 - protein, 15 aa, Mycobacterium
GLARASAAIDSGAAE

SEQ ID NO: 988052 - protein, 5 aa, Mycobacterium
GLAST

SEQ ID NO: 988053 - protein, 16 aa, Mycobacterium
GLATELEARGNDLSDP

SEQ ID NO: 988054 - protein, 20 aa, Mycobacterium
GLDADTKPLSTSYRLRSNQA

SEQ ID NO: 988055 - protein, 17 aa, Mycobacterium
GLDGASDVRRLAGDDRV

SEQ ID NO: 988056 - protein, 11 aa, Mycobacterium
GLDGGAPAIGG

SEQ ID NO: 988057 - protein, 7 aa, Mycobacterium
GLDPDVR

SEQ ID NO: 988058 - protein, 6 aa, Mycobacterium
GLDTKD

SEQ ID NO: 988059 - protein, 8 aa, Mycobacterium
GLEAGADD

SEQ ID NO: 988060 - protein, 4 aa, Mycobacterium
GLEP

SEQ ID NO: 988061 - protein, 4 aa, Mycobacterium
GLES

SEQ ID NO: 988062 - protein, 12 aa, Mycobacterium
GLESPTIAPLAE

SEQ ID NO: 988063 - protein, 4 aa, Mycobacterium
GLGA

SEQ ID NO: 988064 - protein, 9 aa, Mycobacterium
GLGAPSTDR

SEQ ID NO: 988065 - protein, 11 aa, Mycobacterium
GLGEDGPTHQP

SEQ ID NO: 988066 - protein, 7 aa, Mycobacterium
GLGGAER

SEQ ID NO: 988067 - protein, 6 aa, Mycobacterium
GLGGGL

SEQ ID NO: 988068 - protein, 8 aa, Mycobacterium
GLGGSTWR

SEQ ID NO: 988069 - protein, 10 aa, Mycobacterium
GLGGTFGGNP

SEQ ID NO: 988070 - protein, 6 aa, Mycobacterium
GLGHDE

SEQ ID NO: 988071 - protein, 5 aa, Mycobacterium
GLGHQ

SEQ ID NO: 988072 - protein, 4 aa, Mycobacterium
GLGK

SEQ ID NO: 988073 - protein, 5 aa, Mycobacterium
GLGNG

SEQ ID NO: 988074 - protein, 7 aa, Mycobacterium
GLGPDEV

SEQ ID NO: 988075 - protein, 12 aa, Mycobacterium
GLGPDSSYSVPG

SEQ ID NO: 988076 - protein, 8 aa, Mycobacterium
GLGPMRDN

SEQ ID NO: 988077 - protein, 4 aa, Mycobacterium
GLGQ

SEQ ID NO: 988078 - protein, 4 aa, Mycobacterium
GLGR

SEQ ID NO: 988079 - protein, 5 aa, Mycobacterium
GLGRG

SEQ ID NO: 988080 - protein, 12 aa, Mycobacterium
GLGRPQHRSESR

SEQ ID NO: 988081 - protein, 8 aa, Mycobacterium
GLGRRRSD

SEQ ID NO: 988082 - protein, 17 aa, Mycobacterium
GLGRYSSSRGARPSGPV

SEQ ID NO: 988083 - protein, 11 aa, Mycobacterium
GLGSDTSPRDV

SEQ ID NO: 988084 - protein, 5 aa, Mycobacterium
GLGSR

SEQ ID NO: 988085 - protein, 16 aa, Mycobacterium
GLGTPDPAETYSNSPH

SEQ ID NO: 988086 - protein, 10 aa, Mycobacterium
GLHRTEGHKM

SEQ ID NO: 988087 - protein, 7 aa, Mycobacterium
GLPAGTA

SEQ ID NO: 988088 - protein, 13 aa, Mycobacterium
GLPAPKYGTATTF

SEQ ID NO: 988089 - protein, 5 aa, Mycobacterium
GLPAY

SEQ ID NO: 988090 - protein, 8 aa, Mycobacterium
GLPDGAQR

SEQ ID NO: 988091 - protein, 11 aa, Mycobacterium
GLPDRKDVKDG

SEQ ID NO: 988092 - protein, 4 aa, Mycobacterium
GLPE

SEQ ID NO: 988093 - protein, 9 aa, Mycobacterium
GLPEDDPVL

SEQ ID NO: 988094 - protein, 7 aa, Mycobacterium
GLPEVPS

SEQ ID NO: 988095 - protein, 12 aa, Mycobacterium
GLPGLAGLPAKS

SEQ ID NO: 988096 - protein, 13 aa, Mycobacterium
GLPGVGTRRAPDL

SEQ ID NO: 988097 - protein, 13 aa, Mycobacterium
GLPKGDPPPPLPD

SEQ ID NO: 988098 - protein, 15 aa, Mycobacterium
GLPLPSRAHDGDAGV

SEQ ID NO: 988099 - protein, 4 aa, Mycobacterium
GLPP

SEQ ID NO: 988100 - protein, 5 aa, Mycobacterium
GLPPT

SEQ ID NO: 988101 - protein, 7 aa, Mycobacterium
GLPPVAA

SEQ ID NO: 988102 - protein, 8 aa, Mycobacterium
GLPRDDEL

SEQ ID NO: 988103 - protein, 7 aa, Mycobacterium
GLPRKSD

SEQ ID NO: 988104 - protein, 4 aa, Mycobacterium
GLPS

SEQ ID NO: 988105 - protein, 7 aa, Mycobacterium
GLPTDTE

SEQ ID NO: 988106 - protein, 5 aa, Mycobacterium
GLQGD

SEQ ID NO: 988107 - protein, 8 aa, Mycobacterium
GLQPMPAP

SEQ ID NO: 988108 - protein, 10 aa, Mycobacterium
GLQPSHNPQV

SEQ ID NO: 988109 - protein, 9 aa, Mycobacterium
GLQSKQSKL

SEQ ID NO: 988110 - protein, 7 aa, Mycobacterium
GLQYSGD

SEQ ID NO: 988111 - protein, 6 aa, Mycobacterium
GLRDDE

SEQ ID NO: 988112 - protein, 28 aa, Mycobacterium
GLRDGTGERREPPVVSATTGDRRLARNR

SEQ ID NO: 988113 - protein, 4 aa, Mycobacterium
GLRP

SEQ ID NO: 988114 - protein, 16 aa, Mycobacterium
GLRPGSIADANDTAQF

SEQ ID NO: 988115 - protein, 5 aa, Mycobacterium
GLRTA

SEQ ID NO: 988116 - protein, 11 aa, Mycobacterium
GLSGATSGLSQ

SEQ ID NO: 988117 - protein, 20 aa, Mycobacterium
GLSGKANRLPDELSGGEQQR

SEQ ID NO: 988118 - protein, 7 aa, Mycobacterium
GLSGPSL

SEQ ID NO: 988119 - protein, 6 aa, Mycobacterium
GLSGSQ

SEQ ID NO: 988120 - protein, 16 aa, Mycobacterium
GLSPSRGAARRTIDEG

SEQ ID NO: 988121 - protein, 6 aa, Mycobacterium
GLSSGK

SEQ ID NO: 988122 - protein, 12 aa, Mycobacterium
GLSSLKNSPIQA

SEQ ID NO: 988123 - protein, 17 aa, Mycobacterium
GLTAGDGGKTCRRRCRR

SEQ ID NO: 988124 - protein, 10 aa, Mycobacterium
GLTATEQRAV

SEQ ID NO: 988125 - protein, 7 aa, Mycobacterium
GLTETSA

SEQ ID NO: 988126 - protein, 13 aa, Mycobacterium
GLTETYPAGLGDN

SEQ ID NO: 988127 - protein, 7 aa, Mycobacterium
GLTPIGT

SEQ ID NO: 988128 - protein, 12 aa, Mycobacterium
GLTPRDTRRIPT

SEQ ID NO: 988129 - protein, 12 aa, Mycobacterium
GLTSGQDQRATD

SEQ ID NO: 988130 - protein, 9 aa, Mycobacterium
GLTSTSSVA

SEQ ID NO: 988131 - protein, 10 aa, Mycobacterium
GLTTRRRAEH

SEQ ID NO: 988132 - protein, 5 aa, Mycobacterium
GLTVD

SEQ ID NO: 988133 - protein, 9 aa, Mycobacterium
GMAADGATE

SEQ ID NO: 988134 - protein, 4 aa, Mycobacterium
GMAN

SEQ ID NO: 988135 - protein, 14 aa, Mycobacterium
GMDPVGDDVGTPTV

SEQ ID NO: 988136 - protein, 5 aa, Mycobacterium
GMEPG

SEQ ID NO: 988137 - protein, 9 aa, Mycobacterium
GMGGDGAEF

SEQ ID NO: 988138 - protein, 10 aa, Mycobacterium
GMGGSQRLTR

SEQ ID NO: 988139 - protein, 15 aa, Mycobacterium
GMGYPPAEADQAEQM

SEQ ID NO: 988140 - protein, 16 aa, Mycobacterium
GMPAPREAMACALAGL

SEQ ID NO: 988141 - protein, 13 aa, Mycobacterium
GMPGRYLRNLAGN

SEQ ID NO: 988142 - protein, 4 aa, Mycobacterium
GMSG

SEQ ID NO: 988143 - protein, 5 aa, Mycobacterium
GMTEP

SEQ ID NO: 988144 - protein, 6 aa, Mycobacterium
GNAGNI

SEQ ID NO: 988145 - protein, 5 aa, Mycobacterium
GNALP

SEQ ID NO: 988146 - protein, 5 aa, Mycobacterium
GNAMT

SEQ ID NO: 988147 - protein, 15 aa, Mycobacterium
GNASPAQQLDSSTDT

SEQ ID NO: 988148 - protein, 7 aa, Mycobacterium
GNAVYPS

SEQ ID NO: 988149 - protein, 6 aa, Mycobacterium
GNDALD

SEQ ID NO: 988150 - protein, 8 aa, Mycobacterium
GNDDDNHL

SEQ ID NO: 988151 - protein, 37 aa, Mycobacterium
GNDDQADTSDAEPGNPRAATNSSQGSNKDRDPIAHCS

SEQ ID NO: 988152 - protein, 6 aa, Mycobacterium
GNDGNT

SEQ ID NO: 988153 - protein, 7 aa, Mycobacterium
GNDPQRQ

SEQ ID NO: 988154 - protein, 5 aa, Mycobacterium
GNEEA

SEQ ID NO: 988155 - protein, 14 aa, Mycobacterium
GNELGSATELPRPK

SEQ ID NO: 988156 - protein, 8 aa, Mycobacterium
GNEQEHTK

SEQ ID NO: 988157 - protein, 28 aa, Mycobacterium
GNERRPDQACAPEPATVDPGPPTRPAHN

SEQ ID NO: 988158 - protein, 10 aa, Mycobacterium
GNESTDGVGG

SEQ ID NO: 988159 - protein, 5 aa, Mycobacterium
GNGAQ

SEQ ID NO: 988160 - protein, 7 aa, Mycobacterium
GNGDEQL

SEQ ID NO: 988161 - protein, 6 aa, Mycobacterium
GNGDSL

SEQ ID NO: 988162 - protein, 16 aa, Mycobacterium
GNGGWRGVDSDIRWLL

SEQ ID NO: 988163 - protein, 7 aa, Mycobacterium
GNGKTYG

SEQ ID NO: 988164 - protein, 14 aa, Mycobacterium
GNGLKDPDTALKDM

SEQ ID NO: 988165 - protein, 9 aa, Mycobacterium
GNGSISKGG

SEQ ID NO: 988166 - protein, 14 aa, Mycobacterium
GNGSSSRNHYKYPR

SEQ ID NO: 988167 - protein, 6 aa, Mycobacterium
GNGVDP

SEQ ID NO: 988168 - protein, 5 aa, Mycobacterium
GNIAG

SEQ ID NO: 988169 - protein, 18 aa, Mycobacterium
GNKQAATGVSSANGLTSP

SEQ ID NO: 988170 - protein, 8 aa, Mycobacterium
GNLDGQTD

SEQ ID NO: 988171 - protein, 4 aa, Mycobacterium
GNLG

SEQ ID NO: 988172 - protein, 10 aa, Mycobacterium
GNLPSTRQRA

SEQ ID NO: 988173 - protein, 5 aa, Mycobacterium
GNLTK

SEQ ID NO: 988174 - protein, 7 aa, Mycobacterium
GNNDIKP

SEQ ID NO: 988175 - protein, 5 aa, Mycobacterium
GNNDV

SEQ ID NO: 988176 - protein, 5 aa, Mycobacterium
GNNKV

SEQ ID NO: 988177 - protein, 4 aa, Mycobacterium
GNNQ

SEQ ID NO: 988178 - protein, 8 aa, Mycobacterium
GNNVGEGR

SEQ ID NO: 988179 - protein, 15 aa, Mycobacterium
GNPASHRDDSHSPDL

SEQ ID NO: 988180 - protein, 4 aa, Mycobacterium
GNPE

SEQ ID NO: 988181 - protein, 9 aa, Mycobacterium
GNPGASLAG

SEQ ID NO: 988182 - protein, 11 aa, Mycobacterium
GNPGKNYGRTR

SEQ ID NO: 988183 - protein, 9 aa, Mycobacterium
GNPSLGAVS

SEQ ID NO: 988184 - protein, 12 aa, Mycobacterium
GNPTKSTPVLYA

SEQ ID NO: 988185 - protein, 13 aa, Mycobacterium
GNQIEPAKFTEDS

SEQ ID NO: 988186 - protein, 8 aa, Mycobacterium
GNQRATGV

SEQ ID NO: 988187 - protein, 15 aa, Mycobacterium
GNRASSSLSGGADTL

SEQ ID NO: 988188 - protein, 4 aa, Mycobacterium
GNRN

SEQ ID NO: 988189 - protein, 10 aa, Mycobacterium
GNRNFEGRIN

SEQ ID NO: 988190 - protein, 13 aa, Mycobacterium
GNRPTSRKPTTSI

SEQ ID NO: 988191 - protein, 15 aa, Mycobacterium
GNRQLPEQVPQHQTG

SEQ ID NO: 988192 - protein, 10 aa, Mycobacterium
GNSGPLPEEI

SEQ ID NO: 988193 - protein, 7 aa, Mycobacterium
GNSRAPG

SEQ ID NO: 988194 - protein, 5 aa, Mycobacterium
GNTEP

SEQ ID NO: 988195 - protein, 11 aa, Mycobacterium
GNTGGQGGLPS

SEQ ID NO: 988196 - protein, 9 aa, Mycobacterium
GNTHPPSAI

SEQ ID NO: 988197 - protein, 7 aa, Mycobacterium
GNTPESV

SEQ ID NO: 988198 - protein, 4 aa, Mycobacterium
GNTT

SEQ ID NO: 988199 - protein, 7 aa, Mycobacterium
GNVLPSR

SEQ ID NO: 988200 - protein, 5 aa, Mycobacterium
GPAAD

SEQ ID NO: 988201 - protein, 6 aa, Mycobacterium
GPAAGA

SEQ ID NO: 988202 - protein, 8 aa, Mycobacterium
GPAGTGKT

SEQ ID NO: 988203 - protein, 6 aa, Mycobacterium
GPAGWG

SEQ ID NO: 988204 - protein, 9 aa, Mycobacterium
GPAKSSRAL

SEQ ID NO: 988205 - protein, 16 aa, Mycobacterium
GPAPLRAGDELPVGDH

SEQ ID NO: 988206 - protein, 18 aa, Mycobacterium
GPASVRSRRSFERIRLLS

SEQ ID NO: 988207 - protein, 14 aa, Mycobacterium
GPATALTSDDHGTA

SEQ ID NO: 988208 - protein, 16 aa, Mycobacterium
GPAVGSPTDVDPGTAL

SEQ ID NO: 988209 - protein, 5 aa, Mycobacterium
GPAVS

SEQ ID NO: 988210 - protein, 23 aa, Mycobacterium
GPAYNTDSPWGYTPKGATGVPTR

SEQ ID NO: 988211 - protein, 15 aa, Mycobacterium
GPDETPPEGWQQDPD

SEQ ID NO: 988212 - protein, 5 aa, Mycobacterium
GPDGE

SEQ ID NO: 988213 - protein, 4 aa, Mycobacterium
GPDL

SEQ ID NO: 988214 - protein, 18 aa, Mycobacterium
GPDLGGRLRAGRSRNDQV

SEQ ID NO: 988215 - protein, 7 aa, Mycobacterium
GPDPKLS

SEQ ID NO: 988216 - protein, 9 aa, Mycobacterium
GPDYPDKSR

SEQ ID NO: 988217 - protein, 8 aa, Mycobacterium
GPEDGSMP

SEQ ID NO: 988218 - protein, 12 aa, Mycobacterium
GPEFGPEGGPIV

SEQ ID NO: 988219 - protein, 12 aa, Mycobacterium
GPEGGAQGGTVV

SEQ ID NO: 988220 - protein, 7 aa, Mycobacterium
GPEKPGL

SEQ ID NO: 988221 - protein, 8 aa, Mycobacterium
GPELTPVT

SEQ ID NO: 988222 - protein, 5 aa, Mycobacterium
GPEPL

SEQ ID NO: 988223 - protein, 6 aa, Mycobacterium
GPEQVA

SEQ ID NO: 988224 - protein, 15 aa, Mycobacterium
GPESGPPDGGAPDDA

SEQ ID NO: 988225 - protein, 10 aa, Mycobacterium
GPESSGKTTV

SEQ ID NO: 988226 - protein, 5 aa, Mycobacterium
GPESV

SEQ ID NO: 988227 - protein, 7 aa, Mycobacterium
GPGAAVP

SEQ ID NO: 988228 - protein, 5 aa, Mycobacterium
GPGAE

SEQ ID NO: 988229 - protein, 10 aa, Mycobacterium
GPGAGEHGGQ

SEQ ID NO: 988230 - protein, 4 aa, Mycobacterium
GPGE

SEQ ID NO: 988231 - protein, 15 aa, Mycobacterium
GPGGHKLDDDTEDQI

SEQ ID NO: 988232 - protein, 12 aa, Mycobacterium
GPGGKTALGDDC

SEQ ID NO: 988233 - protein, 10 aa, Mycobacterium
GPGGSLTGSA

SEQ ID NO: 988234 - protein, 5 aa, Mycobacterium
GPGGY

SEQ ID NO: 988235 - protein, 9 aa, Mycobacterium
GPGHGEAAT

SEQ ID NO: 988236 - protein, 9 aa, Mycobacterium
GPGKGNAMG

SEQ ID NO: 988237 - protein, 6 aa, Mycobacterium
GPGPFT

SEQ ID NO: 988238 - protein, 11 aa, Mycobacterium
GPGPIDVAEGD

SEQ ID NO: 988239 - protein, 5 aa, Mycobacterium
GPGQV

SEQ ID NO: 988240 - protein, 6 aa, Mycobacterium
GPGSGE

SEQ ID NO: 988241 - protein, 12 aa, Mycobacterium
GPGSRMRSDTPK

SEQ ID NO: 988242 - protein, 6 aa, Mycobacterium
GPGTHA

SEQ ID NO: 988243 - protein, 5 aa, Mycobacterium
GPGVR

SEQ ID NO: 988244 - protein, 13 aa, Mycobacterium
GPHAGEGGGKNCG

SEQ ID NO: 988245 - protein, 21 aa, Mycobacterium
GPHGVAGTGRLTTPSLVVGNN

SEQ ID NO: 988246 - protein, 9 aa, Mycobacterium
GPHRATQKA

SEQ ID NO: 988247 - protein, 6 aa, Mycobacterium
GPIAPD

SEQ ID NO: 988248 - protein, 4 aa, Mycobacterium
GPLD

SEQ ID NO: 988249 - protein, 8 aa, Mycobacterium
GPLGAGKT

SEQ ID NO: 988250 - protein, 11 aa, Mycobacterium
GPLPSNPDEDD

SEQ ID NO: 988251 - protein, 10 aa, Mycobacterium
GPMGDAGLTG

SEQ ID NO: 988252 - protein, 5 aa, Mycobacterium
GPNDD

SEQ ID NO: 988253 - protein, 11 aa, Mycobacterium
GPNGAGKTTTV

SEQ ID NO: 988254 - protein, 10 aa, Mycobacterium
GPNGSGKSTL

SEQ ID NO: 988255 - protein, 6 aa, Mycobacterium
GPNKDR

SEQ ID NO: 988256 - protein, 34 aa, Mycobacterium
GPNPATTVADQSPVVSQNDQNLPPRWTQGEVGEE

SEQ ID NO: 988257 - protein, 7 aa, Mycobacterium
GPPGCGK

SEQ ID NO: 988258 - protein, 8 aa, Mycobacterium
GPPGCGKT

SEQ ID NO: 988259 - protein, 8 aa, Mycobacterium
GPPGSGRS

SEQ ID NO: 988260 - protein, 12 aa, Mycobacterium
GPPGTGKTSVAR

SEQ ID NO: 988261 - protein, 9 aa, Mycobacterium
GPPNPAKDY

SEQ ID NO: 988262 - protein, 7 aa, Mycobacterium
GPPSELQ

SEQ ID NO: 988263 - protein, 6 aa, Mycobacterium
GPQASA

SEQ ID NO: 988264 - protein, 13 aa, Mycobacterium
GPQQCPDTLTTGH

SEQ ID NO: 988265 - protein, 4 aa, Mycobacterium
GPRA

SEQ ID NO: 988266 - protein, 7 aa, Mycobacterium
GPRDEVT

SEQ ID NO: 988267 - protein, 12 aa, Mycobacterium
GPRGCGKTSSAR

SEQ ID NO: 988268 - protein, 6 aa, Mycobacterium
GPRGPR

SEQ ID NO: 988269 - protein, 5 aa, Mycobacterium
GPRRA

SEQ ID NO: 988270 - protein, 6 aa, Mycobacterium
GPRRKG

SEQ ID NO: 988271 - protein, 8 aa, Mycobacterium
GPRSARSF

SEQ ID NO: 988272 - protein, 12 aa, Mycobacterium
GPRTYSSQRGHP

SEQ ID NO: 988273 - protein, 4 aa, Mycobacterium
GPSA

SEQ ID NO: 988274 - protein, 9 aa, Mycobacterium
GPSDLRANW

SEQ ID NO: 988275 - protein, 8 aa, Mycobacterium
GPSGCGKT

SEQ ID NO: 988276 - protein, 12 aa, Mycobacterium
GPSGVGKTELSK

SEQ ID NO: 988277 - protein, 8 aa, Mycobacterium
GPSLGNST

SEQ ID NO: 988278 - protein, 21 aa, Mycobacterium
GPSSSTKNSTTSGNTAVTTQV

SEQ ID NO: 988279 - protein, 10 aa, Mycobacterium
GPSYTRPPTW

SEQ ID NO: 988280 - protein, 7 aa, Mycobacterium
GPTAARA

SEQ ID NO: 988281 - protein, 6 aa, Mycobacterium
GPTAGY

SEQ ID NO: 988282 - protein, 9 aa, Mycobacterium
GPTEPTPQQ

SEQ ID NO: 988283 - protein, 12 aa, Mycobacterium
GPTGGLPADDPR

SEQ ID NO: 988284 - protein, 5 aa, Mycobacterium
GPTGR

SEQ ID NO: 988285 - protein, 6 aa, Mycobacterium
GPTNSE

SEQ ID NO: 988286 - protein, 8 aa, Mycobacterium
GPTPATRK

SEQ ID NO: 988287 - protein, 9 aa, Mycobacterium
GPTTAANGL

SEQ ID NO: 988288 - protein, 8 aa, Mycobacterium
GPVDNDAE

SEQ ID NO: 988289 - protein, 7 aa, Mycobacterium
GPVDPSG

SEQ ID NO: 988290 - protein, 7 aa, Mycobacterium
GPVKPTA

SEQ ID NO: 988291 - protein, 4 aa, Mycobacterium
GPVP

SEQ ID NO: 988292 - protein, 9 aa, Mycobacterium
GPVSLGKTQ

SEQ ID NO: 988293 - protein, 6 aa, Mycobacterium
GPVTGT

SEQ ID NO: 988294 - protein, 6 aa, Mycobacterium
GPVTNG

SEQ ID NO: 988295 - protein, 17 aa, Mycobacterium
GPVYRDPPARHRNGETM

SEQ ID NO: 988296 - protein, 17 aa, Mycobacterium
GPYKASNHARQHVPNHY

SEQ ID NO: 988297 - protein, 7 aa, Mycobacterium
GQAAYNS

SEQ ID NO: 988298 - protein, 24 aa, Mycobacterium
GQADPGGALTDSGPSSAAPTGVGG

SEQ ID NO: 988299 - protein, 10 aa, Mycobacterium
GQANPEKERF

SEQ ID NO: 988300 - protein, 5 aa, Mycobacterium
GQAPA

SEQ ID NO: 988301 - protein, 6 aa, Mycobacterium
GQARKA

SEQ ID NO: 988302 - protein, 8 aa, Mycobacterium
GQARTGMG

SEQ ID NO: 988303 - protein, 7 aa, Mycobacterium
GQATETF

SEQ ID NO: 988304 - protein, 18 aa, Mycobacterium
GQATITHSGDVDRIAAAD

SEQ ID NO: 988305 - protein, 7 aa, Mycobacterium
GQCPPRQ

SEQ ID NO: 988306 - protein, 12 aa, Mycobacterium
GQCRKAAEITGN

SEQ ID NO: 988307 - protein, 9 aa, Mycobacterium
GQDGNYSEE

SEQ ID NO: 988308 - protein, 33 aa, Mycobacterium
GQDPGDLAKLSQANTMGWGEEARKVNNAISLCV

SEQ ID NO: 988309 - protein, 11 aa, Mycobacterium
GQENEDVITEQ

SEQ ID NO: 988310 - protein, 7 aa, Mycobacterium
GQGAQRI

SEQ ID NO: 988311 - protein, 15 aa, Mycobacterium
GQGAQRRSRQPPESY

SEQ ID NO: 988312 - protein, 7 aa, Mycobacterium
GQGGEDM

SEQ ID NO: 988313 - protein, 6 aa, Mycobacterium
GQGGVA

SEQ ID NO: 988314 - protein, 4 aa, Mycobacterium
GQGI

SEQ ID NO: 988315 - protein, 5 aa, Mycobacterium
GQGIS

SEQ ID NO: 988316 - protein, 4 aa, Mycobacterium
GQGL

SEQ ID NO: 988317 - protein, 10 aa, Mycobacterium
GQGQQAPSGH

SEQ ID NO: 988318 - protein, 10 aa, Mycobacterium
GQGRGTELGF

SEQ ID NO: 988319 - protein, 11 aa, Mycobacterium
GQGRVDNDATV

SEQ ID NO: 988320 - protein, 7 aa, Mycobacterium
GQGSQRL

SEQ ID NO: 988321 - protein, 9 aa, Mycobacterium
GQGSSRTPR

SEQ ID NO: 988322 - protein, 7 aa, Mycobacterium
GQGTAVS

SEQ ID NO: 988323 - protein, 8 aa, Mycobacterium
GQHGDLAS

SEQ ID NO: 988324 - protein, 13 aa, Mycobacterium
GQHSASIGSAGCA

SEQ ID NO: 988325 - protein, 26 aa, Mycobacterium
GQIANGGYVSGAESSSYVGEDLSHIA

SEQ ID NO: 988326 - protein, 5 aa, Mycobacterium
GQIPP

SEQ ID NO: 988327 - protein, 13 aa, Mycobacterium
GQKPEVRKARKSI

SEQ ID NO: 988328 - protein, 8 aa, Mycobacterium
GQLNNNRR

SEQ ID NO: 988329 - protein, 4 aa, Mycobacterium
GQLV

SEQ ID NO: 988330 - protein, 4 aa, Mycobacterium
GQND

SEQ ID NO: 988331 - protein, 12 aa, Mycobacterium
GQPAHPSQSVEH

SEQ ID NO: 988332 - protein, 11 aa, Mycobacterium
GQPAKNQAVTN

SEQ ID NO: 988333 - protein, 7 aa, Mycobacterium
GQPASWR

SEQ ID NO: 988334 - protein, 6 aa, Mycobacterium
GQPGAA

SEQ ID NO: 988335 - protein, 8 aa, Mycobacterium
GQPIPTTY

SEQ ID NO: 988336 - protein, 7 aa, Mycobacterium
GQPLPST

SEQ ID NO: 988337 - protein, 6 aa, Mycobacterium
GQPPVT

SEQ ID NO: 988338 - protein, 17 aa, Mycobacterium
GQPSQIDGHFAGLRRWA

SEQ ID NO: 988339 - protein, 9 aa, Mycobacterium
GQQDTRPHG

SEQ ID NO: 988340 - protein, 22 aa, Mycobacterium
GQQGDNSSQLKWDKESGQVIRS

SEQ ID NO: 988341 - protein, 6 aa, Mycobacterium
GQQPTF

SEQ ID NO: 988342 - protein, 5 aa, Mycobacterium
GQQQR

SEQ ID NO: 988343 - protein, 4 aa, Mycobacterium
GQRG

SEQ ID NO: 988344 - protein, 21 aa, Mycobacterium
GQRGYGLPATLTDSEANAIRS

SEQ ID NO: 988345 - protein, 6 aa, Mycobacterium
GQRHKV

SEQ ID NO: 988346 - protein, 4 aa, Mycobacterium
GQRL

SEQ ID NO: 988347 - protein, 15 aa, Mycobacterium
GQRNKYEVDHKTGRV

SEQ ID NO: 988348 - protein, 11 aa, Mycobacterium
GQRPDKDSMNN

SEQ ID NO: 988349 - protein, 7 aa, Mycobacterium
GQRSADK

SEQ ID NO: 988350 - protein, 5 aa, Mycobacterium
GQSFY

SEQ ID NO: 988351 - protein, 12 aa, Mycobacterium
GQSGEGQVAHGS

SEQ ID NO: 988352 - protein, 5 aa, Mycobacterium
GQSSF

SEQ ID NO: 988353 - protein, 7 aa, Mycobacterium
GQSSQLN

SEQ ID NO: 988354 - protein, 6 aa, Mycobacterium
GQSSRH

SEQ ID NO: 988355 - protein, 8 aa, Mycobacterium
GQSTMTVP

SEQ ID NO: 988356 - protein, 8 aa, Mycobacterium
GQTGLASA

SEQ ID NO: 988357 - protein, 5 aa, Mycobacterium
GQTMA

SEQ ID NO: 988358 - protein, 6 aa, Mycobacterium
GQTPLG

SEQ ID NO: 988359 - protein, 5 aa, Mycobacterium
GQTTP

SEQ ID NO: 988360 - protein, 12 aa, Mycobacterium
GQTTSTEDAEGE

SEQ ID NO: 988361 - protein, 8 aa, Mycobacterium
GQVPDGKD

SEQ ID NO: 988362 - protein, 10 aa, Mycobacterium
GQVTRDNTEV

SEQ ID NO: 988363 - protein, 12 aa, Mycobacterium
GQYAKPRSADVD

SEQ ID NO: 988364 - protein, 6 aa, Mycobacterium
GQYGYP

SEQ ID NO: 988365 - protein, 6 aa, Mycobacterium
GRAAAA

SEQ ID NO: 988366 - protein, 6 aa, Mycobacterium
GRAADD

SEQ ID NO: 988367 - protein, 4 aa, Mycobacterium
GRAD

SEQ ID NO: 988368 - protein, 16 aa, Mycobacterium
GRADAGPPSATRDHAD

SEQ ID NO: 988369 - protein, 8 aa, Mycobacterium
GRAGQRRW

SEQ ID NO: 988370 - protein, 8 aa, Mycobacterium
GRAHNGSV

SEQ ID NO: 988371 - protein, 5 aa, Mycobacterium
GRAPD

SEQ ID NO: 988372 - protein, 9 aa, Mycobacterium
GRAPSRDTY

SEQ ID NO: 988373 - protein, 5 aa, Mycobacterium
GRAQR

SEQ ID NO: 988374 - protein, 9 aa, Mycobacterium
GRASGASKL

SEQ ID NO: 988375 - protein, 13 aa, Mycobacterium
GRAYPYEGNYSTY

SEQ ID NO: 988376 - protein, 14 aa, Mycobacterium
GRDDDGDLAGGRGL

SEQ ID NO: 988377 - protein, 10 aa, Mycobacterium
GRDDDRGTET

SEQ ID NO: 988378 - protein, 19 aa, Mycobacterium
GRDDSKLTTRSYTRVRSHC

SEQ ID NO: 988379 - protein, 20 aa, Mycobacterium
GRDEAEAEVQRSVERFKAGG

SEQ ID NO: 988380 - protein, 12 aa, Mycobacterium
GRDRHPVDINVS

SEQ ID NO: 988381 - protein, 10 aa, Mycobacterium
GRDSAAALSG

SEQ ID NO: 988382 - protein, 9 aa, Mycobacterium
GRDSRSDVL

SEQ ID NO: 988383 - protein, 10 aa, Mycobacterium
GRDTAGMPRA

SEQ ID NO: 988384 - protein, 8 aa, Mycobacterium
GRDTPLDA

SEQ ID NO: 988385 - protein, 7 aa, Mycobacterium
GREAAAD

SEQ ID NO: 988386 - protein, 4 aa, Mycobacterium
GRED

SEQ ID NO: 988387 - protein, 6 aa, Mycobacterium
GREPRG

SEQ ID NO: 988388 - protein, 19 aa, Mycobacterium
GRERPKDGILGEEYGGTIT

SEQ ID NO: 988389 - protein, 19 aa, Mycobacterium
GRESIATPTRRRSVDRKRE

SEQ ID NO: 988390 - protein, 8 aa, Mycobacterium
GREVTQSA

SEQ ID NO: 988391 - protein, 4 aa, Mycobacterium
GREY

SEQ ID NO: 988392 - protein, 7 aa, Mycobacterium
GRFATSD

SEQ ID NO: 988393 - protein, 9 aa, Mycobacterium
GRGEPADAV

SEQ ID NO: 988394 - protein, 5 aa, Mycobacterium
GRGGD

SEQ ID NO: 988395 - protein, 22 aa, Mycobacterium
GRGGGKADLAQGSGKDPTGIDA

SEQ ID NO: 988396 - protein, 6 aa, Mycobacterium
GRGGVR

SEQ ID NO: 988397 - protein, 7 aa, Mycobacterium
GRGIGPE

SEQ ID NO: 988398 - protein, 6 aa, Mycobacterium
GRGLPR

SEQ ID NO: 988399 - protein, 10 aa, Mycobacterium
GRGRPADRPA

SEQ ID NO: 988400 - protein, 9 aa, Mycobacterium
GRGSGARSI

SEQ ID NO: 988401 - protein, 9 aa, Mycobacterium
GRGSVTPQF

SEQ ID NO: 988402 - protein, 10 aa, Mycobacterium
GRGTETPEAI

SEQ ID NO: 988403 - protein, 6 aa, Mycobacterium
GRHESL

SEQ ID NO: 988404 - protein, 7 aa, Mycobacterium
GRHHTER

SEQ ID NO: 988405 - protein, 4 aa, Mycobacterium
GRIG

SEQ ID NO: 988406 - protein, 12 aa, Mycobacterium
GRIRSAHSSVDR

SEQ ID NO: 988407 - protein, 5 aa, Mycobacterium
GRLDR

SEQ ID NO: 988408 - protein, 18 aa, Mycobacterium
GRLEESLDDSKKLSAKGR

SEQ ID NO: 988409 - protein, 4 aa, Mycobacterium
GRLG

SEQ ID NO: 988410 - protein, 10 aa, Mycobacterium
GRLGGAEMSR

SEQ ID NO: 988411 - protein, 5 aa, Mycobacterium
GRLPD

SEQ ID NO: 988412 - protein, 19 aa, Mycobacterium
GRLPQTGKVGADVSLGEGK

SEQ ID NO: 988413 - protein, 9 aa, Mycobacterium
GRLTDGDTL

SEQ ID NO: 988414 - protein, 11 aa, Mycobacterium
GRLTDGQGRTV

SEQ ID NO: 988415 - protein, 12 aa, Mycobacterium
GRLTDGQGRTVD

SEQ ID NO: 988416 - protein, 8 aa, Mycobacterium
GRMGNDRV

SEQ ID NO: 988417 - protein, 5 aa, Mycobacterium
GRMTV

SEQ ID NO: 988418 - protein, 4 aa, Mycobacterium
GRNF

SEQ ID NO: 988419 - protein, 10 aa, Mycobacterium
GRNGAGKTTT

SEQ ID NO: 988420 - protein, 7 aa, Mycobacterium
GRNGDDL

SEQ ID NO: 988421 - protein, 7 aa, Mycobacterium
GRNKPND

SEQ ID NO: 988422 - protein, 10 aa, Mycobacterium
GRNSPQGLAA

SEQ ID NO: 988423 - protein, 4 aa, Mycobacterium
GRPA

SEQ ID NO: 988424 - protein, 32 aa, Mycobacterium
GRPDDPTLAGAKSPGSGRPGDYKDFAITSDPM

SEQ ID NO: 988425 - protein, 6 aa, Mycobacterium
GRPFTS

SEQ ID NO: 988426 - protein, 4 aa, Mycobacterium
GRPG

SEQ ID NO: 988427 - protein, 7 aa, Mycobacterium
GRPLQSD

SEQ ID NO: 988428 - protein, 29 aa, Mycobacterium
GRPPRRNAQCAQSTQPSKPQSTALADTSA

SEQ ID NO: 988429 - protein, 13 aa, Mycobacterium
GRPPTLRAPRRRV

SEQ ID NO: 988430 - protein, 4 aa, Mycobacterium
GRPQ

SEQ ID NO: 988431 - protein, 11 aa, Mycobacterium
GRPRSRPQSAI

SEQ ID NO: 988432 - protein, 15 aa, Mycobacterium
GRPRSSRCGVALTLP

SEQ ID NO: 988433 - protein, 14 aa, Mycobacterium
GRPSPEDIDPNTKF

SEQ ID NO: 988434 - protein, 11 aa, Mycobacterium
GRPTGRKDPAS

SEQ ID NO: 988435 - protein, 5 aa, Mycobacterium
GRPTP

SEQ ID NO: 988436 - protein, 6 aa, Mycobacterium
GRPVST

SEQ ID NO: 988437 - protein, 9 aa, Mycobacterium
GRQARSNRS

SEQ ID NO: 988438 - protein, 5 aa, Mycobacterium
GRQEV

SEQ ID NO: 988439 - protein, 7 aa, Mycobacterium
GRQGGSR

SEQ ID NO: 988440 - protein, 13 aa, Mycobacterium
GRQPVAKAGKSMA

SEQ ID NO: 988441 - protein, 30 aa, Mycobacterium
GRQSAPPRKSTGRINGGPALTLGKRDAEQT

SEQ ID NO: 988442 - protein, 14 aa, Mycobacterium
GRQSGRFSDPARYG

SEQ ID NO: 988443 - protein, 4 aa, Mycobacterium
GRQV

SEQ ID NO: 988444 - protein, 8 aa, Mycobacterium
GRRFAGGA

SEQ ID NO: 988445 - protein, 8 aa, Mycobacterium
GRRGASVS

SEQ ID NO: 988446 - protein, 6 aa, Mycobacterium
GRRGEL

SEQ ID NO: 988447 - protein, 5 aa, Mycobacterium
GRRGG

SEQ ID NO: 988448 - protein, 6 aa, Mycobacterium
GRRGGQ

SEQ ID NO: 988449 - protein, 7 aa, Mycobacterium
GRRGGVT

SEQ ID NO: 988450 - protein, 14 aa, Mycobacterium
GRRHQTRSVTTDED

SEQ ID NO: 988451 - protein, 15 aa, Mycobacterium
GRRLPGRCSASGTVH

SEQ ID NO: 988452 - protein, 10 aa, Mycobacterium
GRRPKLYGTG

SEQ ID NO: 988453 - protein, 9 aa, Mycobacterium
GRRSATVDG

SEQ ID NO: 988454 - protein, 10 aa, Mycobacterium
GRRSINANRA

SEQ ID NO: 988455 - protein, 7 aa, Mycobacterium
GRRSKPT

SEQ ID NO: 988456 - protein, 15 aa, Mycobacterium
GRRSSDSVVSRPPGR

SEQ ID NO: 988457 - protein, 7 aa, Mycobacterium
GRRTVSK

SEQ ID NO: 988458 - protein, 28 aa, Mycobacterium
GRRVGGRRRGRSNSGRGRGAIDREQSAA

SEQ ID NO: 988459 - protein, 4 aa, Mycobacterium
GRSD

SEQ ID NO: 988460 - protein, 6 aa, Mycobacterium
GRSDES

SEQ ID NO: 988461 - protein, 14 aa, Mycobacterium
GRSDLEKVRQATEA

SEQ ID NO: 988462 - protein, 11 aa, Mycobacterium
GRSGAADRRAH

SEQ ID NO: 988463 - protein, 8 aa, Mycobacterium
GRSGEPFP

SEQ ID NO: 988464 - protein, 8 aa, Mycobacterium
GRSGRLKG

SEQ ID NO: 988465 - protein, 5 aa, Mycobacterium
GRSGY

SEQ ID NO: 988466 - protein, 7 aa, Mycobacterium
GRSIRRP

SEQ ID NO: 988467 - protein, 9 aa, Mycobacterium
GRSLPDSTA

SEQ ID NO: 988468 - protein, 5 aa, Mycobacterium
GRSLS

SEQ ID NO: 988469 - protein, 7 aa, Mycobacterium
GRSNEHA

SEQ ID NO: 988470 - protein, 17 aa, Mycobacterium
GRSNRDGHRARVVTPAN

SEQ ID NO: 988471 - protein, 12 aa, Mycobacterium
GRSRRRKSWARS

SEQ ID NO: 988472 - protein, 6 aa, Mycobacterium
GRSSGA

SEQ ID NO: 988473 - protein, 10 aa, Mycobacterium
GRSSPSDDVT

SEQ ID NO: 988474 - protein, 5 aa, Mycobacterium
GRSTA

SEQ ID NO: 988475 - protein, 7 aa, Mycobacterium
GRSTQTV

SEQ ID NO: 988476 - protein, 7 aa, Mycobacterium
GRTAPSV

SEQ ID NO: 988477 - protein, 5 aa, Mycobacterium
GRTGE

SEQ ID NO: 988478 - protein, 6 aa, Mycobacterium
GRTGRV

SEQ ID NO: 988479 - protein, 10 aa, Mycobacterium
GRTLSDSGET

SEQ ID NO: 988480 - protein, 6 aa, Mycobacterium
GRTPEQ

SEQ ID NO: 988481 - protein, 10 aa, Mycobacterium
GRTRDDVDEA

SEQ ID NO: 988482 - protein, 25 aa, Mycobacterium
GRTRKRPSTPRGAVSAARRTVSIAD

SEQ ID NO: 988483 - protein, 8 aa, Mycobacterium
GRTTSTSM

SEQ ID NO: 988484 - protein, 7 aa, Mycobacterium
GRTVSGN

SEQ ID NO: 988485 - protein, 8 aa, Mycobacterium
GRTYAAAP

SEQ ID NO: 988486 - protein, 5 aa, Mycobacterium
GRVAD

SEQ ID NO: 988487 - protein, 8 aa, Mycobacterium
GRVAREEM

SEQ ID NO: 988488 - protein, 6 aa, Mycobacterium
GRVDAR

SEQ ID NO: 988489 - protein, 15 aa, Mycobacterium
GRVGEGGEEGFSDGA

SEQ ID NO: 988490 - protein, 9 aa, Mycobacterium
GRVGELDQS

SEQ ID NO: 988491 - protein, 17 aa, Mycobacterium
GRVNPEPSAKAEQTNEL

SEQ ID NO: 988492 - protein, 6 aa, Mycobacterium
GRVRAR

SEQ ID NO: 988493 - protein, 6 aa, Mycobacterium
GRVRGQ

SEQ ID NO: 988494 - protein, 8 aa, Mycobacterium
GRVSSTDL

SEQ ID NO: 988495 - protein, 6 aa, Mycobacterium
GRWANQ

SEQ ID NO: 988496 - protein, 17 aa, Mycobacterium
GRWRDSGMRGTAPRRRQ

SEQ ID NO: 988497 - protein, 7 aa, Mycobacterium
GRYDEAS

SEQ ID NO: 988498 - protein, 16 aa, Mycobacterium
GRYGAGSGGHCGDPRC

SEQ ID NO: 988499 - protein, 16 aa, Mycobacterium
GRYGTSSGDDGEAAHG

SEQ ID NO: 988500 - protein, 5 aa, Mycobacterium
GRYNE

SEQ ID NO: 988501 - protein, 8 aa, Mycobacterium
GSAAGSDL

SEQ ID NO: 988502 - protein, 7 aa, Mycobacterium
GSAATIG

SEQ ID NO: 988503 - protein, 8 aa, Mycobacterium
GSADDLAA

SEQ ID NO: 988504 - protein, 14 aa, Mycobacterium
GSADEVPRACSSHA

SEQ ID NO: 988505 - protein, 9 aa, Mycobacterium
GSADGASNW

SEQ ID NO: 988506 - protein, 12 aa, Mycobacterium
GSAGNRDERGWE

SEQ ID NO: 988507 - protein, 9 aa, Mycobacterium
GSAGQPARK

SEQ ID NO: 988508 - protein, 25 aa, Mycobacterium
GSAGSYARIPAGSPSAARPRRVGRS

SEQ ID NO: 988509 - protein, 9 aa, Mycobacterium
GSAKSGNLT

SEQ ID NO: 988510 - protein, 16 aa, Mycobacterium
GSAPDIAGQGIADPTA

SEQ ID NO: 988511 - protein, 13 aa, Mycobacterium
GSAPIAARKSLPS

SEQ ID NO: 988512 - protein, 5 aa, Mycobacterium
GSAPM

SEQ ID NO: 988513 - protein, 27 aa, Mycobacterium
GSAPRATNPEVDSANSAALAGSIKNRH

SEQ ID NO: 988514 - protein, 9 aa, Mycobacterium
GSAREATDA

SEQ ID NO: 988515 - protein, 5 aa, Mycobacterium
GSAVE

SEQ ID NO: 988516 - protein, 7 aa, Mycobacterium
GSAYGLA

SEQ ID NO: 988517 - protein, 8 aa, Mycobacterium
GSCGRGRE

SEQ ID NO: 988518 - protein, 15 aa, Mycobacterium
GSDAGGTRTTSRLEN

SEQ ID NO: 988519 - protein, 8 aa, Mycobacterium
GSDANPLA

SEQ ID NO: 988520 - protein, 9 aa, Mycobacterium
GSDDRIGET

SEQ ID NO: 988521 - protein, 8 aa, Mycobacterium
GSDEDLSQ

SEQ ID NO: 988522 - protein, 14 aa, Mycobacterium
GSDGKLKTLGTIPH

SEQ ID NO: 988523 - protein, 16 aa, Mycobacterium
GSDGRVGTAGDRANLD

SEQ ID NO: 988524 - protein, 9 aa, Mycobacterium
GSDPEFRAR

SEQ ID NO: 988525 - protein, 7 aa, Mycobacterium
GSDPKGF

SEQ ID NO: 988526 - protein, 7 aa, Mycobacterium
GSDPMGG

SEQ ID NO: 988527 - protein, 6 aa, Mycobacterium
GSDPNW

SEQ ID NO: 988528 - protein, 8 aa, Mycobacterium
GSDSGLTI

SEQ ID NO: 988529 - protein, 18 aa, Mycobacterium
GSDSTASAQREIALWFPG

SEQ ID NO: 988530 - protein, 10 aa, Mycobacterium
GSDVDAAAGF

SEQ ID NO: 988531 - protein, 9 aa, Mycobacterium
GSECTTEGC

SEQ ID NO: 988532 - protein, 7 aa, Mycobacterium
GSEGDFE

SEQ ID NO: 988533 - protein, 16 aa, Mycobacterium
GSEIPYQSAVGQDDRG

SEQ ID NO: 988534 - protein, 13 aa, Mycobacterium
GSEPIGSMGADTP

SEQ ID NO: 988535 - protein, 4 aa, Mycobacterium
GSES

SEQ ID NO: 988536 - protein, 7 aa, Mycobacterium
GSEVSGQ

SEQ ID NO: 988537 - protein, 12 aa, Mycobacterium
GSFPEDDTVPGS

SEQ ID NO: 988538 - protein, 6 aa, Mycobacterium
GSGAGA

SEQ ID NO: 988539 - protein, 7 aa, Mycobacterium
GSGAGKL

SEQ ID NO: 988540 - protein, 8 aa, Mycobacterium
GSGAGLPG

SEQ ID NO: 988541 - protein, 5 aa, Mycobacterium
GSGAL

SEQ ID NO: 988542 - protein, 6 aa, Mycobacterium
GSGAPL

SEQ ID NO: 988543 - protein, 7 aa, Mycobacterium
GSGAVSG

SEQ ID NO: 988544 - protein, 9 aa, Mycobacterium
GSGDITTAR

SEQ ID NO: 988545 - protein, 9 aa, Mycobacterium
GSGEKKTIP

SEQ ID NO: 988546 - protein, 5 aa, Mycobacterium
GSGEV

SEQ ID NO: 988547 - protein, 19 aa, Mycobacterium
GSGGMTADQAHVSGSKALV

SEQ ID NO: 988548 - protein, 12 aa, Mycobacterium
GSGGQTAVANVA

SEQ ID NO: 988549 - protein, 9 aa, Mycobacterium
GSGGTAPAA

SEQ ID NO: 988550 - protein, 7 aa, Mycobacterium
GSGKDFS

SEQ ID NO: 988551 - protein, 5 aa, Mycobacterium
GSGMS

SEQ ID NO: 988552 - protein, 8 aa, Mycobacterium
GSGNAGAA

SEQ ID NO: 988553 - protein, 13 aa, Mycobacterium
GSGNGQRTRYPCV

SEQ ID NO: 988554 - protein, 10 aa, Mycobacterium
GSGPAGLAAA

SEQ ID NO: 988555 - protein, 7 aa, Mycobacterium
GSGPGYA

SEQ ID NO: 988556 - protein, 16 aa, Mycobacterium
GSGPTSHSVEFACCPS

SEQ ID NO: 988557 - protein, 10 aa, Mycobacterium
GSGQPSEQVY

SEQ ID NO: 988558 - protein, 6 aa, Mycobacterium
GSGRNK

SEQ ID NO: 988559 - protein, 5 aa, Mycobacterium
GSGRT

SEQ ID NO: 988560 - protein, 4 aa, Mycobacterium
GSGV

SEQ ID NO: 988561 - protein, 12 aa, Mycobacterium
GSGWPYRKLLTS

SEQ ID NO: 988562 - protein, 8 aa, Mycobacterium
GSGYGGNA

SEQ ID NO: 988563 - protein, 12 aa, Mycobacterium
GSHAGDAAVDSH

SEQ ID NO: 988564 - protein, 10 aa, Mycobacterium
GSHQDAINKG

SEQ ID NO: 988565 - protein, 17 aa, Mycobacterium
GSHSESEYQTRDRHHPT

SEQ ID NO: 988566 - protein, 8 aa, Mycobacterium
GSHSPGGF

SEQ ID NO: 988567 - protein, 8 aa, Mycobacterium
GSIAPEEL

SEQ ID NO: 988568 - protein, 4 aa, Mycobacterium
GSIE

SEQ ID NO: 988569 - protein, 6 aa, Mycobacterium
GSIGTT

SEQ ID NO: 988570 - protein, 6 aa, Mycobacterium
GSINDE

SEQ ID NO: 988571 - protein, 4 aa, Mycobacterium
GSIP

SEQ ID NO: 988572 - protein, 4 aa, Mycobacterium
GSIR

SEQ ID NO: 988573 - protein, 9 aa, Mycobacterium
GSISAEAHE

SEQ ID NO: 988574 - protein, 9 aa, Mycobacterium
GSITAGEIS

SEQ ID NO: 988575 - protein, 7 aa, Mycobacterium
GSKEHAK

SEQ ID NO: 988576 - protein, 9 aa, Mycobacterium
GSKSRGFRG

SEQ ID NO: 988577 - protein, 7 aa, Mycobacterium
GSKTRLV

SEQ ID NO: 988578 - protein, 16 aa, Mycobacterium
GSKVGPRAKLVGQHPR

SEQ ID NO: 988579 - protein, 7 aa, Mycobacterium
GSKVSDK

SEQ ID NO: 988580 - protein, 11 aa, Mycobacterium
GSLFNRGTQGT

SEQ ID NO: 988581 - protein, 5 aa, Mycobacterium
GSLSV

SEQ ID NO: 988582 - protein, 6 aa, Mycobacterium
GSLTTQ

SEQ ID NO: 988583 - protein, 13 aa, Mycobacterium
GSLVGTSSPRRAA

SEQ ID NO: 988584 - protein, 15 aa, Mycobacterium
GSNGQKMSKSLRNYP

SEQ ID NO: 988585 - protein, 5 aa, Mycobacterium
GSNGR

SEQ ID NO: 988586 - protein, 14 aa, Mycobacterium
GSNHDEVAYRDGQR

SEQ ID NO: 988587 - protein, 6 aa, Mycobacterium
GSNPAW

SEQ ID NO: 988588 - protein, 11 aa, Mycobacterium
GSNTAKHTTGY

SEQ ID NO: 988589 - protein, 5 aa, Mycobacterium
GSNVA

SEQ ID NO: 988590 - protein, 9 aa, Mycobacterium
GSPASWTSA

SEQ ID NO: 988591 - protein, 7 aa, Mycobacterium
GSPDLEG

SEQ ID NO: 988592 - protein, 10 aa, Mycobacterium
GSPDTAETVE

SEQ ID NO: 988593 - protein, 10 aa, Mycobacterium
GSPEAGCSEP

SEQ ID NO: 988594 - protein, 5 aa, Mycobacterium
GSPEL

SEQ ID NO: 988595 - protein, 17 aa, Mycobacterium
GSPGGAAKVGMAENDPQ

SEQ ID NO: 988596 - protein, 20 aa, Mycobacterium
GSPLGRTRDAAPGAPPDRPV

SEQ ID NO: 988597 - protein, 7 aa, Mycobacterium
GSPLSKI

SEQ ID NO: 988598 - protein, 6 aa, Mycobacterium
GSPPSV

SEQ ID NO: 988599 - protein, 4 aa, Mycobacterium
GSPQ

SEQ ID NO: 988600 - protein, 25 aa, Mycobacterium
GSPVGPGTGWPGDLATPRTPVAADA

SEQ ID NO: 988601 - protein, 7 aa, Mycobacterium
GSPVVAT

SEQ ID NO: 988602 - protein, 17 aa, Mycobacterium
GSQAYEGNMTSLRSTSP

SEQ ID NO: 988603 - protein, 6 aa, Mycobacterium
GSQDAG

SEQ ID NO: 988604 - protein, 5 aa, Mycobacterium
GSQGA

SEQ ID NO: 988605 - protein, 6 aa, Mycobacterium
GSQGYA

SEQ ID NO: 988606 - protein, 6 aa, Mycobacterium
GSQPDL

SEQ ID NO: 988607 - protein, 5 aa, Mycobacterium
GSQRL

SEQ ID NO: 988608 - protein, 4 aa, Mycobacterium
GSRA

SEQ ID NO: 988609 - protein, 10 aa, Mycobacterium
GSRDEGATVA

SEQ ID NO: 988610 - protein, 7 aa, Mycobacterium
GSRESME

SEQ ID NO: 988611 - protein, 14 aa, Mycobacterium
GSRGPDAKSYGALS

SEQ ID NO: 988612 - protein, 4 aa, Mycobacterium
GSRI

SEQ ID NO: 988613 - protein, 6 aa, Mycobacterium
GSRNAP

SEQ ID NO: 988614 - protein, 4 aa, Mycobacterium
GSRQ

SEQ ID NO: 988615 - protein, 10 aa, Mycobacterium
GSRRPERPSV

SEQ ID NO: 988616 - protein, 4 aa, Mycobacterium
GSRV

SEQ ID NO: 988617 - protein, 9 aa, Mycobacterium
GSRYRGDFE

SEQ ID NO: 988618 - protein, 18 aa, Mycobacterium
GSSASRGPIGRVRPGSDS

SEQ ID NO: 988619 - protein, 7 aa, Mycobacterium
GSSEIQK

SEQ ID NO: 988620 - protein, 7 aa, Mycobacterium
GSSEVGQ

SEQ ID NO: 988621 - protein, 13 aa, Mycobacterium
GSSFGDAARAAQN

SEQ ID NO: 988622 - protein, 4 aa, Mycobacterium
GSSL

SEQ ID NO: 988623 - protein, 9 aa, Mycobacterium
GSSNESANR

SEQ ID NO: 988624 - protein, 7 aa, Mycobacterium
GSSPEAL

SEQ ID NO: 988625 - protein, 7 aa, Mycobacterium
GSSRRRV

SEQ ID NO: 988626 - protein, 8 aa, Mycobacterium
GSSRRYAS

SEQ ID NO: 988627 - protein, 16 aa, Mycobacterium
GSSTENSAYGPTRNPW

SEQ ID NO: 988628 - protein, 7 aa, Mycobacterium
GSSTKSI

SEQ ID NO: 988629 - protein, 7 aa, Mycobacterium
GSSTNDY

SEQ ID NO: 988630 - protein, 7 aa, Mycobacterium
GSSVPYS

SEQ ID NO: 988631 - protein, 8 aa, Mycobacterium
GSTGPGTY

SEQ ID NO: 988632 - protein, 5 aa, Mycobacterium
GSTLR

SEQ ID NO: 988633 - protein, 11 aa, Mycobacterium
GSTRGATTSDE

SEQ ID NO: 988634 - protein, 18 aa, Mycobacterium
GSTRNDSTPGNPVMSAPS

SEQ ID NO: 988635 - protein, 9 aa, Mycobacterium
GSTRSINAG

SEQ ID NO: 988636 - protein, 7 aa, Mycobacterium
GSTRVTT

SEQ ID NO: 988637 - protein, 12 aa, Mycobacterium
GSVEKDGSPDLD

SEQ ID NO: 988638 - protein, 14 aa, Mycobacterium
GSVGDTVEVKDGYG

SEQ ID NO: 988639 - protein, 10 aa, Mycobacterium
GSVGGTYPSP

SEQ ID NO: 988640 - protein, 4 aa, Mycobacterium
GSVH

SEQ ID NO: 988641 - protein, 12 aa, Mycobacterium
GSVNRGNAAQAV

SEQ ID NO: 988642 - protein, 4 aa, Mycobacterium
GSVP

SEQ ID NO: 988643 - protein, 4 aa, Mycobacterium
GSVQ

SEQ ID NO: 988644 - protein, 20 aa, Mycobacterium
GSVSSRAARGGTAPSQAAKQ

SEQ ID NO: 988645 - protein, 6 aa, Mycobacterium
GSVSVH

SEQ ID NO: 988646 - protein, 9 aa, Mycobacterium
GSVTGASEG

SEQ ID NO: 988647 - protein, 10 aa, Mycobacterium
GSYEPGPTAA

SEQ ID NO: 988648 - protein, 5 aa, Mycobacterium
GSYTN

SEQ ID NO: 988649 - protein, 10 aa, Mycobacterium
GTAEENAVGA

SEQ ID NO: 988650 - protein, 15 aa, Mycobacterium
GTAGNGVGWAGTDGA

SEQ ID NO: 988651 - protein, 27 aa, Mycobacterium
GTAGRKSRLSEDDTKRPLDKQGRAQAE

SEQ ID NO: 988652 - protein, 13 aa, Mycobacterium
GTAMTADKQLGPV

SEQ ID NO: 988653 - protein, 4 aa, Mycobacterium
GTAP

SEQ ID NO: 988654 - protein, 5 aa, Mycobacterium
GTAPL

SEQ ID NO: 988655 - protein, 11 aa, Mycobacterium
GTASTAALDRR

SEQ ID NO: 988656 - protein, 7 aa, Mycobacterium
GTATFGP

SEQ ID NO: 988657 - protein, 8 aa, Mycobacterium
GTATPGGK

SEQ ID NO: 988658 - protein, 15 aa, Mycobacterium
GTAVGTGLNAPDGFG

SEQ ID NO: 988659 - protein, 13 aa, Mycobacterium
GTAVSTAELSKSG

SEQ ID NO: 988660 - protein, 9 aa, Mycobacterium
GTDDEGKPD

SEQ ID NO: 988661 - protein, 6 aa, Mycobacterium
GTDEHG

SEQ ID NO: 988662 - protein, 8 aa, Mycobacterium
GTDGGTDA

SEQ ID NO: 988663 - protein, 14 aa, Mycobacterium
GTDKVARSMFALAR

SEQ ID NO: 988664 - protein, 10 aa, Mycobacterium
GTDPAAPASV

SEQ ID NO: 988665 - protein, 6 aa, Mycobacterium
GTDPGK

SEQ ID NO: 988666 - protein, 9 aa, Mycobacterium
GTDSEARAD

SEQ ID NO: 988667 - protein, 4 aa, Mycobacterium
GTDT

SEQ ID NO: 988668 - protein, 8 aa, Mycobacterium
GTDTGHQA

SEQ ID NO: 988669 - protein, 7 aa, Mycobacterium
GTDTMEE

SEQ ID NO: 988670 - protein, 6 aa, Mycobacterium
GTDVQQ

SEQ ID NO: 988671 - protein, 7 aa, Mycobacterium
GTEDQAI

SEQ ID NO: 988672 - protein, 12 aa, Mycobacterium
GTEGPYTGTGGA

SEQ ID NO: 988673 - protein, 19 aa, Mycobacterium
GTEGRQGKLDTAEAEREHA

SEQ ID NO: 988674 - protein, 10 aa, Mycobacterium
GTEGTELQEK

SEQ ID NO: 988675 - protein, 5 aa, Mycobacterium
GTEIG

SEQ ID NO: 988676 - protein, 12 aa, Mycobacterium
GTEVTKHKVGDR

SEQ ID NO: 988677 - protein, 10 aa, Mycobacterium
GTGAGQQGLT

SEQ ID NO: 988678 - protein, 11 aa, Mycobacterium
GTGAKQPPMPG

SEQ ID NO: 988679 - protein, 6 aa, Mycobacterium
GTGAQL

SEQ ID NO: 988680 - protein, 5 aa, Mycobacterium
GTGEP

SEQ ID NO: 988681 - protein, 5 aa, Mycobacterium
GTGES

SEQ ID NO: 988682 - protein, 12 aa, Mycobacterium
GTGLTGDTITLM

SEQ ID NO: 988683 - protein, 7 aa, Mycobacterium
GTGMAGS

SEQ ID NO: 988684 - protein, 8 aa, Mycobacterium
GTGPVQGS

SEQ ID NO: 988685 - protein, 5 aa, Mycobacterium
GTGRY

SEQ ID NO: 988686 - protein, 5 aa, Mycobacterium
GTGSR

SEQ ID NO: 988687 - protein, 5 aa, Mycobacterium
GTGTP

SEQ ID NO: 988688 - protein, 13 aa, Mycobacterium
GTGTTERGELDRQ

SEQ ID NO: 988689 - protein, 10 aa, Mycobacterium
GTHKRTGERR

SEQ ID NO: 988690 - protein, 5 aa, Mycobacterium
GTHPG

SEQ ID NO: 988691 - protein, 7 aa, Mycobacterium
GTIDPDH

SEQ ID NO: 988692 - protein, 6 aa, Mycobacterium
GTIPDD

SEQ ID NO: 988693 - protein, 20 aa, Mycobacterium
GTIPKTPSGKLRRASSVTLV

SEQ ID NO: 988694 - protein, 9 aa, Mycobacterium
GTITGEHGV

SEQ ID NO: 988695 - protein, 17 aa, Mycobacterium
GTKPPFTGEYTDTKPQV

SEQ ID NO: 988696 - protein, 7 aa, Mycobacterium
GTKYDQA

SEQ ID NO: 988697 - protein, 8 aa, Mycobacterium
GTLPEPKH

SEQ ID NO: 988698 - protein, 6 aa, Mycobacterium
GTLPLT

SEQ ID NO: 988699 - protein, 9 aa, Mycobacterium
GTLSGAPKV

SEQ ID NO: 988700 - protein, 10 aa, Mycobacterium
GTLSGGEKTR

SEQ ID NO: 988701 - protein, 8 aa, Mycobacterium
GTLSGNPV

SEQ ID NO: 988702 - protein, 12 aa, Mycobacterium
GTNSTGLASPEK

SEQ ID NO: 988703 - protein, 4 aa, Mycobacterium
GTNT

SEQ ID NO: 988704 - protein, 15 aa, Mycobacterium
GTNTSPLAGKVSGHK

SEQ ID NO: 988705 - protein, 6 aa, Mycobacterium
GTNYPG

SEQ ID NO: 988706 - protein, 9 aa, Mycobacterium
GTPAAKHSE

SEQ ID NO: 988707 - protein, 12 aa, Mycobacterium
GTPAGVGPVEDG

SEQ ID NO: 988708 - protein, 10 aa, Mycobacterium
GTPALATRGF

SEQ ID NO: 988709 - protein, 5 aa, Mycobacterium
GTPCA

SEQ ID NO: 988710 - protein, 6 aa, Mycobacterium
GTPEDF

SEQ ID NO: 988711 - protein, 6 aa, Mycobacterium
GTPEEV

SEQ ID NO: 988712 - protein, 12 aa, Mycobacterium
GTPFRSDDKPIP

SEQ ID NO: 988713 - protein, 6 aa, Mycobacterium
GTPGGH

SEQ ID NO: 988714 - protein, 9 aa, Mycobacterium
GTPGTSAPL

SEQ ID NO: 988715 - protein, 13 aa, Mycobacterium
GTPITGGDETMPY

SEQ ID NO: 988716 - protein, 10 aa, Mycobacterium
GTPPGTVGST

SEQ ID NO: 988717 - protein, 15 aa, Mycobacterium
GTPRWAANIRARSYR

SEQ ID NO: 988718 - protein, 24 aa, Mycobacterium
GTPTPNHDGPNGQVSSERASQEVR

SEQ ID NO: 988719 - protein, 19 aa, Mycobacterium
GTPTYADANWTKQEAGTDR

SEQ ID NO: 988720 - protein, 6 aa, Mycobacterium
GTPVDP

SEQ ID NO: 988721 - protein, 16 aa, Mycobacterium
GTQASVPPQGGRKHPH

SEQ ID NO: 988722 - protein, 15 aa, Mycobacterium
GTQPRSMSTPSTDTC

SEQ ID NO: 988723 - protein, 20 aa, Mycobacterium
GTREGTSVRGGPLGNLNEGA

SEQ ID NO: 988724 - protein, 4 aa, Mycobacterium
GTRF

SEQ ID NO: 988725 - protein, 7 aa, Mycobacterium
GTRGKRY

SEQ ID NO: 988726 - protein, 5 aa, Mycobacterium
GTRPE

SEQ ID NO: 988727 - protein, 5 aa, Mycobacterium
GTRPY

SEQ ID NO: 988728 - protein, 10 aa, Mycobacterium
GTRSSRPDHE

SEQ ID NO: 988729 - protein, 9 aa, Mycobacterium
GTSAGGSLA

SEQ ID NO: 988730 - protein, 7 aa, Mycobacterium
GTSAGRV

SEQ ID NO: 988731 - protein, 7 aa, Mycobacterium
GTSARPA

SEQ ID NO: 988732 - protein, 8 aa, Mycobacterium
GTSGIGSH

SEQ ID NO: 988733 - protein, 13 aa, Mycobacterium
GTSGPVEVSSQRD

SEQ ID NO: 988734 - protein, 4 aa, Mycobacterium
GTSN

SEQ ID NO: 988735 - protein, 7 aa, Mycobacterium
GTSPEAI

SEQ ID NO: 988736 - protein, 10 aa, Mycobacterium
GTSPRSRTSH

SEQ ID NO: 988737 - protein, 6 aa, Mycobacterium
GTSPSE

SEQ ID NO: 988738 - protein, 7 aa, Mycobacterium
GTSRGLE

SEQ ID NO: 988739 - protein, 8 aa, Mycobacterium
GTSSLPEE

SEQ ID NO: 988740 - protein, 8 aa, Mycobacterium
GTSSSGFA

SEQ ID NO: 988741 - protein, 4 aa, Mycobacterium
GTST

SEQ ID NO: 988742 - protein, 5 aa, Mycobacterium
GTSVG

SEQ ID NO: 988743 - protein, 32 aa, Mycobacterium
GTSVRQQSSAPDRIEAPDAAATPQEQARSRWR

SEQ ID NO: 988744 - protein, 9 aa, Mycobacterium
GTSYSTHNE

SEQ ID NO: 988745 - protein, 13 aa, Mycobacterium
GTTASTEEITDTA

SEQ ID NO: 988746 - protein, 14 aa, Mycobacterium
GTTGESPTTTDDEK

SEQ ID NO: 988747 - protein, 6 aa, Mycobacterium
GTTGLP

SEQ ID NO: 988748 - protein, 6 aa, Mycobacterium
GTTLPD

SEQ ID NO: 988749 - protein, 6 aa, Mycobacterium
GTTPDH

SEQ ID NO: 988750 - protein, 11 aa, Mycobacterium
GTTPSGQTIPG

SEQ ID NO: 988751 - protein, 4 aa, Mycobacterium
GTTQ

SEQ ID NO: 988752 - protein, 6 aa, Mycobacterium
GTTQKV

SEQ ID NO: 988753 - protein, 8 aa, Mycobacterium
GTTRRDDG

SEQ ID NO: 988754 - protein, 6 aa, Mycobacterium
GTTTPH

SEQ ID NO: 988755 - protein, 4 aa, Mycobacterium
GTTY

SEQ ID NO: 988756 - protein, 11 aa, Mycobacterium
GTVAGRPDDGC

SEQ ID NO: 988757 - protein, 14 aa, Mycobacterium
GTVASQTRAVGGRA

SEQ ID NO: 988758 - protein, 6 aa, Mycobacterium
GTVDGS

SEQ ID NO: 988759 - protein, 4 aa, Mycobacterium
GTVF

SEQ ID NO: 988760 - protein, 9 aa, Mycobacterium
GTVGDIESQ

SEQ ID NO: 988761 - protein, 15 aa, Mycobacterium
GTVGNASSLHTSGRV

SEQ ID NO: 988762 - protein, 11 aa, Mycobacterium
GTVGTDGSQPL

SEQ ID NO: 988763 - protein, 10 aa, Mycobacterium
GTVNGEGGEI

SEQ ID NO: 988764 - protein, 12 aa, Mycobacterium
GTVSEHSATRNA

SEQ ID NO: 988765 - protein, 10 aa, Mycobacterium
GTVTATTSVR

SEQ ID NO: 988766 - protein, 23 aa, Mycobacterium
GTWASHGGGEYAPSAQLATREQQ

SEQ ID NO: 988767 - protein, 14 aa, Mycobacterium
GTWSNDSVSCPRSG

SEQ ID NO: 988768 - protein, 13 aa, Mycobacterium
GTYAPTLEFTRWV

SEQ ID NO: 988769 - protein, 11 aa, Mycobacterium
GTYEGREKELG

SEQ ID NO: 988770 - protein, 5 aa, Mycobacterium
GTYPG

SEQ ID NO: 988771 - protein, 7 aa, Mycobacterium
GTYRENG

SEQ ID NO: 988772 - protein, 8 aa, Mycobacterium
GTYTARRA

SEQ ID NO: 988773 - protein, 6 aa, Mycobacterium
GVAGGT

SEQ ID NO: 988774 - protein, 8 aa, Mycobacterium
GVAGNPPY

SEQ ID NO: 988775 - protein, 4 aa, Mycobacterium
GVAN

SEQ ID NO: 988776 - protein, 5 aa, Mycobacterium
GVAPD

SEQ ID NO: 988777 - protein, 10 aa, Mycobacterium
GVAPDTIPAE

SEQ ID NO: 988778 - protein, 14 aa, Mycobacterium
GVAQAEKAAARKAL

SEQ ID NO: 988779 - protein, 13 aa, Mycobacterium
GVARRGSVTDLSP

SEQ ID NO: 988780 - protein, 9 aa, Mycobacterium
GVASGGAGH

SEQ ID NO: 988781 - protein, 7 aa, Mycobacterium
GVASPKA

SEQ ID NO: 988782 - protein, 10 aa, Mycobacterium
GVATPQQTDQ

SEQ ID NO: 988783 - protein, 7 aa, Mycobacterium
GVDATGE

SEQ ID NO: 988784 - protein, 9 aa, Mycobacterium
GVDAVGNRT

SEQ ID NO: 988785 - protein, 10 aa, Mycobacterium
GVDIEAGDRS

SEQ ID NO: 988786 - protein, 7 aa, Mycobacterium
GVDPTTV

SEQ ID NO: 988787 - protein, 17 aa, Mycobacterium
GVDRKDYNSFGSRRGNH

SEQ ID NO: 988788 - protein, 10 aa, Mycobacterium
GVDTDQRTIP

SEQ ID NO: 988789 - protein, 6 aa, Mycobacterium
GVEAVK

SEQ ID NO: 988790 - protein, 10 aa, Mycobacterium
GVEDDASKAQ

SEQ ID NO: 988791 - protein, 18 aa, Mycobacterium
GVEEASEHIPTSTDELRS

SEQ ID NO: 988792 - protein, 6 aa, Mycobacterium
GVEELG

SEQ ID NO: 988793 - protein, 12 aa, Mycobacterium
GVEETQAAGPAV

SEQ ID NO: 988794 - protein, 22 aa, Mycobacterium
GVEPSSIEQAGAQAGYPAPPLQ

SEQ ID NO: 988795 - protein, 9 aa, Mycobacterium
GVEPTDNPL

SEQ ID NO: 988796 - protein, 11 aa, Mycobacterium
GVEQEKNGIIK

SEQ ID NO: 988797 - protein, 29 aa, Mycobacterium
GVETSPQNRAANTALPSKPKNFPMSQWEL

SEQ ID NO: 988798 - protein, 4 aa, Mycobacterium
GVFQ

SEQ ID NO: 988799 - protein, 4 aa, Mycobacterium
GVGA

SEQ ID NO: 988800 - protein, 12 aa, Mycobacterium
GVGAAAENGEAL

SEQ ID NO: 988801 - protein, 12 aa, Mycobacterium
GVGAATARNDAV

SEQ ID NO: 988802 - protein, 16 aa, Mycobacterium
GVGDGDAGSDRDVPRV

SEQ ID NO: 988803 - protein, 5 aa, Mycobacterium
GVGGD

SEQ ID NO: 988804 - protein, 8 aa, Mycobacterium
GVGGGSLN

SEQ ID NO: 988805 - protein, 5 aa, Mycobacterium
GVGGR

SEQ ID NO: 988806 - protein, 9 aa, Mycobacterium
GVGGTDSQD

SEQ ID NO: 988807 - protein, 12 aa, Mycobacterium
GVGKGVAEPHKT

SEQ ID NO: 988808 - protein, 8 aa, Mycobacterium
GVGSGATG

SEQ ID NO: 988809 - protein, 12 aa, Mycobacterium
GVGSSRGGPPWG

SEQ ID NO: 988810 - protein, 5 aa, Mycobacterium
GVGTT

SEQ ID NO: 988811 - protein, 5 aa, Mycobacterium
GVHPN

SEQ ID NO: 988812 - protein, 19 aa, Mycobacterium
GVHSESEGMGTARRVIILR

SEQ ID NO: 988813 - protein, 6 aa, Mycobacterium
GVKDTI

SEQ ID NO: 988814 - protein, 6 aa, Mycobacterium
GVKGEL

SEQ ID NO: 988815 - protein, 6 aa, Mycobacterium
GVKRQE

SEQ ID NO: 988816 - protein, 5 aa, Mycobacterium
GVMPQ

SEQ ID NO: 988817 - protein, 16 aa, Mycobacterium
GVPGSVHRAAAGADQS

SEQ ID NO: 988818 - protein, 11 aa, Mycobacterium
GVPGVGKSTAI

SEQ ID NO: 988819 - protein, 4 aa, Mycobacterium
GVPK

SEQ ID NO: 988820 - protein, 6 aa, Mycobacterium
GVPNSG

SEQ ID NO: 988821 - protein, 7 aa, Mycobacterium
GVPPRTM

SEQ ID NO: 988822 - protein, 5 aa, Mycobacterium
GVPSR

SEQ ID NO: 988823 - protein, 9 aa, Mycobacterium
GVPTGGKDD

SEQ ID NO: 988824 - protein, 9 aa, Mycobacterium
GVPTPGLPF

SEQ ID NO: 988825 - protein, 12 aa, Mycobacterium
GVPTRRRERRST

SEQ ID NO: 988826 - protein, 5 aa, Mycobacterium
GVQAG

SEQ ID NO: 988827 - protein, 18 aa, Mycobacterium
GVQAGRSAEPISRDEGRW

SEQ ID NO: 988828 - protein, 7 aa, Mycobacterium
GVQPPPC

SEQ ID NO: 988829 - protein, 6 aa, Mycobacterium
GVRHPR

SEQ ID NO: 988830 - protein, 9 aa, Mycobacterium
GVRPADGSG

SEQ ID NO: 988831 - protein, 6 aa, Mycobacterium
GVRPGD

SEQ ID NO: 988832 - protein, 13 aa, Mycobacterium
GVRPKKSHNYKGS

SEQ ID NO: 988833 - protein, 19 aa, Mycobacterium
GVRRGKADSISITSVVSVD

SEQ ID NO: 988834 - protein, 9 aa, Mycobacterium
GVRRTRSKF

SEQ ID NO: 988835 - protein, 9 aa, Mycobacterium
GVRTSRSEI

SEQ ID NO: 988836 - protein, 4 aa, Mycobacterium
GVSA

SEQ ID NO: 988837 - protein, 8 aa, Mycobacterium
GVSDQRAA

SEQ ID NO: 988838 - protein, 9 aa, Mycobacterium
GVSGSEDSF

SEQ ID NO: 988839 - protein, 8 aa, Mycobacterium
GVSNDTQV

SEQ ID NO: 988840 - protein, 16 aa, Mycobacterium
GVSPLTPDHVNPERPW

SEQ ID NO: 988841 - protein, 21 aa, Mycobacterium
GVSQDTRDITTLGRGGSDTTA

SEQ ID NO: 988842 - protein, 4 aa, Mycobacterium
GVSR

SEQ ID NO: 988843 - protein, 9 aa, Mycobacterium
GVTAPAGFQ

SEQ ID NO: 988844 - protein, 7 aa, Mycobacterium
GVTASRA

SEQ ID NO: 988845 - protein, 16 aa, Mycobacterium
GVTATKRAGLIETARA

SEQ ID NO: 988846 - protein, 29 aa, Mycobacterium
GVTGRSRCTPERGTLAPDRQCTSRSTNTF

SEQ ID NO: 988847 - protein, 10 aa, Mycobacterium
GVTNPEGKRK

SEQ ID NO: 988848 - protein, 11 aa, Mycobacterium
GVTPTADRREV

SEQ ID NO: 988849 - protein, 9 aa, Mycobacterium
GVTSGASVP

SEQ ID NO: 988850 - protein, 13 aa, Mycobacterium
GVVPEPSEFTSAD

SEQ ID NO: 988851 - protein, 12 aa, Mycobacterium
GVVPPAEVDDSA

SEQ ID NO: 988852 - protein, 10 aa, Mycobacterium
GWPGRTSKTT

SEQ ID NO: 988853 - protein, 10 aa, Mycobacterium
GWPSDDGSEF

SEQ ID NO: 988854 - protein, 9 aa, Mycobacterium
GWPSNVGPL

SEQ ID NO: 988855 - protein, 5 aa, Mycobacterium
GWQPG

SEQ ID NO: 988856 - protein, 7 aa, Mycobacterium
GWRPGDP

SEQ ID NO: 988857 - protein, 12 aa, Mycobacterium
GWTKPEATMINS

SEQ ID NO: 988858 - protein, 10 aa, Mycobacterium
GWTKQTDEAA

SEQ ID NO: 988859 - protein, 17 aa, Mycobacterium
GYADRGDTFATAVRAAI

SEQ ID NO: 988860 - protein, 9 aa, Mycobacterium
GYAERPALG

SEQ ID NO: 988861 - protein, 6 aa, Mycobacterium
GYAPNG

SEQ ID NO: 988862 - protein, 10 aa, Mycobacterium
GYAPTTPVGI

SEQ ID NO: 988863 - protein, 6 aa, Mycobacterium
GYATPT

SEQ ID NO: 988864 - protein, 8 aa, Mycobacterium
GYEGSQTA

SEQ ID NO: 988865 - protein, 6 aa, Mycobacterium
GYENKV

SEQ ID NO: 988866 - protein, 12 aa, Mycobacterium
GYEPDKESTNNH

SEQ ID NO: 988867 - protein, 6 aa, Mycobacterium
GYEPED

SEQ ID NO: 988868 - protein, 4 aa, Mycobacterium
GYER

SEQ ID NO: 988869 - protein, 8 aa, Mycobacterium
GYGGYGAL

SEQ ID NO: 988870 - protein, 18 aa, Mycobacterium
GYGNRNNGARTVREYGAS

SEQ ID NO: 988871 - protein, 5 aa, Mycobacterium
GYGPP

SEQ ID NO: 988872 - protein, 4 aa, Mycobacterium
GYGR

SEQ ID NO: 988873 - protein, 8 aa, Mycobacterium
GYHQDRGP

SEQ ID NO: 988874 - protein, 7 aa, Mycobacterium
GYHRRED

SEQ ID NO: 988875 - protein, 8 aa, Mycobacterium
GYNTPKRV

SEQ ID NO: 988876 - protein, 8 aa, Mycobacterium
GYPDSTIG

SEQ ID NO: 988877 - protein, 8 aa, Mycobacterium
GYPGAPGQ

SEQ ID NO: 988878 - protein, 8 aa, Mycobacterium
GYPGDRDD

SEQ ID NO: 988879 - protein, 12 aa, Mycobacterium
GYPGQGTAESAG

SEQ ID NO: 988880 - protein, 22 aa, Mycobacterium
GYPPAQGPARRAQQYAGTDRQV

SEQ ID NO: 988881 - protein, 4 aa, Mycobacterium
GYPS

SEQ ID NO: 988882 - protein, 5 aa, Mycobacterium
GYQPE

SEQ ID NO: 988883 - protein, 6 aa, Mycobacterium
GYQPTL

SEQ ID NO: 988884 - protein, 14 aa, Mycobacterium
GYQRAADEADVGDA

SEQ ID NO: 988885 - protein, 30 aa, Mycobacterium
GYRDAGEQAVKAEQTSAKSAADAKHAADQA

SEQ ID NO: 988886 - protein, 4 aa, Mycobacterium
GYRE

SEQ ID NO: 988887 - protein, 11 aa, Mycobacterium
GYRRRTDPKDL

SEQ ID NO: 988888 - protein, 8 aa, Mycobacterium
GYSGPLDE

SEQ ID NO: 988889 - protein, 4 aa, Mycobacterium
GYSN

SEQ ID NO: 988890 - protein, 4 aa, Mycobacterium
GYSS

SEQ ID NO: 988891 - protein, 12 aa, Mycobacterium
GYTERDYTAIET

SEQ ID NO: 988892 - protein, 7 aa, Mycobacterium
GYTGEQG

SEQ ID NO: 988893 - protein, 13 aa, Mycobacterium
GYTGGGTPNATYR

SEQ ID NO: 988894 - protein, 8 aa, Mycobacterium
GYTGSPTI

SEQ ID NO: 988895 - protein, 13 aa, Mycobacterium
GYTGSRGGRAVCN

SEQ ID NO: 988896 - protein, 20 aa, Mycobacterium
GYYGNTRDRVVDENDRAGTG

SEQ ID NO: 988897 - protein, 6 aa, Mycobacterium
GYYGPP

SEQ ID NO: 988898 - protein, 8 aa, Mycobacterium
HAAGATLK

SEQ ID NO: 988899 - protein, 8 aa, Mycobacterium
HAEADRLR

SEQ ID NO: 988900 - protein, 5 aa, Mycobacterium
HAEIE

SEQ ID NO: 988901 - protein, 9 aa, Mycobacterium
HAETADDRT

SEQ ID NO: 988902 - protein, 10 aa, Mycobacterium
HAETKDHHPD

SEQ ID NO: 988903 - protein, 8 aa, Mycobacterium
HAFGTGGV

SEQ ID NO: 988904 - protein, 9 aa, Mycobacterium
HAGEKEKAA

SEQ ID NO: 988905 - protein, 13 aa, Mycobacterium
HAGHSANPVAAGS

SEQ ID NO: 988906 - protein, 7 aa, Mycobacterium
HAGISGR

SEQ ID NO: 988907 - protein, 8 aa, Mycobacterium
HAGTLDPM

SEQ ID NO: 988908 - protein, 7 aa, Mycobacterium
HAKEQKA

SEQ ID NO: 988909 - protein, 6 aa, Mycobacterium
HAKNAG

SEQ ID NO: 988910 - protein, 6 aa, Mycobacterium
HALSGA

SEQ ID NO: 988911 - protein, 5 aa, Mycobacterium
HAPGE

SEQ ID NO: 988912 - protein, 9 aa, Mycobacterium
HAPSGLVGG

SEQ ID NO: 988913 - protein, 29 aa, Mycobacterium
HAQSDKADQKTEEADPNSDAIDEEVDEAA

SEQ ID NO: 988914 - protein, 17 aa, Mycobacterium
HARGENTQKKFSRVNEQ

SEQ ID NO: 988915 - protein, 5 aa, Mycobacterium
HARGH

SEQ ID NO: 988916 - protein, 5 aa, Mycobacterium
HARSN

SEQ ID NO: 988917 - protein, 9 aa, Mycobacterium
HARSTGPYS

SEQ ID NO: 988918 - protein, 5 aa, Mycobacterium
HARTT

SEQ ID NO: 988919 - protein, 8 aa, Mycobacterium
HASEAASR

SEQ ID NO: 988920 - protein, 5 aa, Mycobacterium
HASRN

SEQ ID NO: 988921 - protein, 9 aa, Mycobacterium
HASSGVGGD

SEQ ID NO: 988922 - protein, 11 aa, Mycobacterium
HASTSVTVNRK

SEQ ID NO: 988923 - protein, 31 aa, Mycobacterium
HATARDERSTKRQDVGGDRRSLCGQNKNPVL

SEQ ID NO: 988924 - protein, 10 aa, Mycobacterium
HATGTQVGDL

SEQ ID NO: 988925 - protein, 6 aa, Mycobacterium
HATPSQ

SEQ ID NO: 988926 - protein, 8 aa, Mycobacterium
HAYTGGSD

SEQ ID NO: 988927 - protein, 9 aa, Mycobacterium
HCKKTTVSG

SEQ ID NO: 988928 - protein, 9 aa, Mycobacterium
HCTDPAKNQ

SEQ ID NO: 988929 - protein, 10 aa, Mycobacterium
HDAAEARGRS

SEQ ID NO: 988930 - protein, 8 aa, Mycobacterium
HDAEPAEG

SEQ ID NO: 988931 - protein, 5 aa, Mycobacterium
HDAPG

SEQ ID NO: 988932 - protein, 6 aa, Mycobacterium
HDAPPV

SEQ ID NO: 988933 - protein, 11 aa, Mycobacterium
HDARDSTSVEA

SEQ ID NO: 988934 - protein, 17 aa, Mycobacterium
HDCDASSNGCVGRGVAG

SEQ ID NO: 988935 - protein, 7 aa, Mycobacterium
HDDDGNV

SEQ ID NO: 988936 - protein, 6 aa, Mycobacterium
HDDGIG

SEQ ID NO: 988937 - protein, 13 aa, Mycobacterium
HDDQRVRGKGLSM

SEQ ID NO: 988938 - protein, 6 aa, Mycobacterium
HDEAAA

SEQ ID NO: 988939 - protein, 13 aa, Mycobacterium
HDEGDSKIGRPRQ

SEQ ID NO: 988940 - protein, 4 aa, Mycobacterium
HDGA

SEQ ID NO: 988941 - protein, 15 aa, Mycobacterium
HDGDTALDDLDGTDP

SEQ ID NO: 988942 - protein, 6 aa, Mycobacterium
HDGDTL

SEQ ID NO: 988943 - protein, 7 aa, Mycobacterium
HDGESDL

SEQ ID NO: 988944 - protein, 7 aa, Mycobacterium
HDGQETT

SEQ ID NO: 988945 - protein, 7 aa, Mycobacterium
HDGTLPA

SEQ ID NO: 988946 - protein, 6 aa, Mycobacterium
HDHAQP

SEQ ID NO: 988947 - protein, 4 aa, Mycobacterium
HDHR

SEQ ID NO: 988948 - protein, 9 aa, Mycobacterium
HDNEVKEDR

SEQ ID NO: 988949 - protein, 12 aa, Mycobacterium
HDPGAAKALDPQ

SEQ ID NO: 988950 - protein, 7 aa, Mycobacterium
HDPHGPD

SEQ ID NO: 988951 - protein, 9 aa, Mycobacterium
HDPYGRTAH

SEQ ID NO: 988952 - protein, 5 aa, Mycobacterium
HDRPR

SEQ ID NO: 988953 - protein, 7 aa, Mycobacterium
HDRSEAK

SEQ ID NO: 988954 - protein, 9 aa, Mycobacterium
HDRTDGHIA

SEQ ID NO: 988955 - protein, 12 aa, Mycobacterium
HDSRHRQNTEEN

SEQ ID NO: 988956 - protein, 10 aa, Mycobacterium
HDSRRTFSTT

SEQ ID NO: 988957 - protein, 10 aa, Mycobacterium
HDSSRRAASV

SEQ ID NO: 988958 - protein, 26 aa, Mycobacterium
HDSTATSAIGVQTGRSTGAKKPSKVV

SEQ ID NO: 988959 - protein, 12 aa, Mycobacterium
HDSTRKPVTSDR

SEQ ID NO: 988960 - protein, 9 aa, Mycobacterium
HDTLDNEDT

SEQ ID NO: 988961 - protein, 11 aa, Mycobacterium
HDTLTGLPNRT

SEQ ID NO: 988962 - protein, 11 aa, Mycobacterium
HDTSGDGESDD

SEQ ID NO: 988963 - protein, 7 aa, Mycobacterium
HEAAGTA

SEQ ID NO: 988964 - protein, 7 aa, Mycobacterium
HEATERG

SEQ ID NO: 988965 - protein, 15 aa, Mycobacterium
HEDRRKASGRRVPQQ

SEQ ID NO: 988966 - protein, 9 aa, Mycobacterium
HEGAPGQQE

SEQ ID NO: 988967 - protein, 6 aa, Mycobacterium
HEHRDK

SEQ ID NO: 988968 - protein, 5 aa, Mycobacterium
HEPAA

SEQ ID NO: 988969 - protein, 5 aa, Mycobacterium
HEPKE

SEQ ID NO: 988970 - protein, 7 aa, Mycobacterium
HEPRSSL

SEQ ID NO: 988971 - protein, 4 aa, Mycobacterium
HEQG

SEQ ID NO: 988972 - protein, 7 aa, Mycobacterium
HERNQSG

SEQ ID NO: 988973 - protein, 8 aa, Mycobacterium
HERNRRQR

SEQ ID NO: 988974 - protein, 19 aa, Mycobacterium
HESRPDKTIPRSGSIAPQR

SEQ ID NO: 988975 - protein, 11 aa, Mycobacterium
HESTTAADVNY

SEQ ID NO: 988976 - protein, 6 aa, Mycobacterium
HETGQP

SEQ ID NO: 988977 - protein, 6 aa, Mycobacterium
HETSAG

SEQ ID NO: 988978 - protein, 16 aa, Mycobacterium
HETTNELDTPIGAAAE

SEQ ID NO: 988979 - protein, 11 aa, Mycobacterium
HEVGTGGQGEI

SEQ ID NO: 988980 - protein, 5 aa, Mycobacterium
HFPGQ

SEQ ID NO: 988981 - protein, 11 aa, Mycobacterium
HFSHEEAPEEI

SEQ ID NO: 988982 - protein, 5 aa, Mycobacterium
HFSSA

SEQ ID NO: 988983 - protein, 11 aa, Mycobacterium
HGAESEPVEEE

SEQ ID NO: 988984 - protein, 5 aa, Mycobacterium
HGAID

SEQ ID NO: 988985 - protein, 13 aa, Mycobacterium
HGARNSPDDMPPG

SEQ ID NO: 988986 - protein, 5 aa, Mycobacterium
HGDRG

SEQ ID NO: 988987 - protein, 6 aa, Mycobacterium
HGDRNT

SEQ ID NO: 988988 - protein, 5 aa, Mycobacterium
HGDTL

SEQ ID NO: 988989 - protein, 7 aa, Mycobacterium
HGDTNAT

SEQ ID NO: 988990 - protein, 10 aa, Mycobacterium
HGDVGDPRRP

SEQ ID NO: 988991 - protein, 21 aa, Mycobacterium
HGFESTAPDGTHHQNDAAEAT

SEQ ID NO: 988992 - protein, 4 aa, Mycobacterium
HGFS

SEQ ID NO: 988993 - protein, 16 aa, Mycobacterium
HGGASDVVGGGTAHAH

SEQ ID NO: 988994 - protein, 17 aa, Mycobacterium
HGGDYGPDSPMARSTKR

SEQ ID NO: 988995 - protein, 8 aa, Mycobacterium
HGGRPPVG

SEQ ID NO: 988996 - protein, 8 aa, Mycobacterium
HGGRQLDR

SEQ ID NO: 988997 - protein, 5 aa, Mycobacterium
HGKPS

SEQ ID NO: 988998 - protein, 5 aa, Mycobacterium
HGKTT

SEQ ID NO: 988999 - protein, 7 aa, Mycobacterium
HGKTTLT

SEQ ID NO: 989000 - protein, 8 aa, Mycobacterium
HGLDHREN

SEQ ID NO: 989001 - protein, 7 aa, Mycobacterium
HGLDTEE

SEQ ID NO: 989002 - protein, 4 aa, Mycobacterium
HGNP

SEQ ID NO: 989003 - protein, 9 aa, Mycobacterium
HGNPTQPGV

SEQ ID NO: 989004 - protein, 22 aa, Mycobacterium
HGPAPTRAERFGPETIQTPATG

SEQ ID NO: 989005 - protein, 5 aa, Mycobacterium
HGPGI

SEQ ID NO: 989006 - protein, 17 aa, Mycobacterium
HGQNPQTAYDGSRFPLD

SEQ ID NO: 989007 - protein, 10 aa, Mycobacterium
HGQSNGRRDT

SEQ ID NO: 989008 - protein, 5 aa, Mycobacterium
HGRAA

SEQ ID NO: 989009 - protein, 4 aa, Mycobacterium
HGRE

SEQ ID NO: 989010 - protein, 6 aa, Mycobacterium
HGRGGF

SEQ ID NO: 989011 - protein, 18 aa, Mycobacterium
HGRPTDRNAHPHRDATGK

SEQ ID NO: 989012 - protein, 4 aa, Mycobacterium
HGRR

SEQ ID NO: 989013 - protein, 11 aa, Mycobacterium
HGSGARPGISP

SEQ ID NO: 989014 - protein, 17 aa, Mycobacterium
HGSSAAENSTAHASGIP

SEQ ID NO: 989015 - protein, 12 aa, Mycobacterium
HGTATTLGDPIE

SEQ ID NO: 989016 - protein, 7 aa, Mycobacterium
HGTDDPL

SEQ ID NO: 989017 - protein, 6 aa, Mycobacterium
HGTDEL

SEQ ID NO: 989018 - protein, 10 aa, Mycobacterium
HGTGTPIGDP

SEQ ID NO: 989019 - protein, 11 aa, Mycobacterium
HGTGTPVGDPI

SEQ ID NO: 989020 - protein, 6 aa, Mycobacterium
HGTGTV

SEQ ID NO: 989021 - protein, 5 aa, Mycobacterium
HGVPA

SEQ ID NO: 989022 - protein, 13 aa, Mycobacterium
HGVSDSIARSGGL

SEQ ID NO: 989023 - protein, 13 aa, Mycobacterium
HHEETFRVLQTAG

SEQ ID NO: 989024 - protein, 9 aa, Mycobacterium
HHGGPSASS

SEQ ID NO: 989025 - protein, 27 aa, Mycobacterium
HHRTSNQSCRAGTDTPPNRSHPLNRPV

SEQ ID NO: 989026 - protein, 14 aa, Mycobacterium
HHTPGRFRPPRRSR

SEQ ID NO: 989027 - protein, 13 aa, Mycobacterium
HIEQGETAEQTAI

SEQ ID NO: 989028 - protein, 8 aa, Mycobacterium
HKAGGQDT

SEQ ID NO: 989029 - protein, 7 aa, Mycobacterium
HKDPRDG

SEQ ID NO: 989030 - protein, 9 aa, Mycobacterium
HKEVGRLGS

SEQ ID NO: 989031 - protein, 11 aa, Mycobacterium
HKGASDGDAVD

SEQ ID NO: 989032 - protein, 10 aa, Mycobacterium
HKKQTGGSGQ

SEQ ID NO: 989033 - protein, 7 aa, Mycobacterium
HKPHNAG

SEQ ID NO: 989034 - protein, 9 aa, Mycobacterium
HKRSGADVV

SEQ ID NO: 989035 - protein, 8 aa, Mycobacterium
HKRTEEAL

SEQ ID NO: 989036 - protein, 4 aa, Mycobacterium
HKTS

SEQ ID NO: 989037 - protein, 13 aa, Mycobacterium
HKVGDRVGGVSRN

SEQ ID NO: 989038 - protein, 7 aa, Mycobacterium
HLADPGY

SEQ ID NO: 989039 - protein, 11 aa, Mycobacterium
HLEGQARQRER

SEQ ID NO: 989040 - protein, 8 aa, Mycobacterium
HLGGGSLT

SEQ ID NO: 989041 - protein, 22 aa, Mycobacterium
HLGQSEPEVHRDRNGARTAAKG

SEQ ID NO: 989042 - protein, 6 aa, Mycobacterium
HLNGEQ

SEQ ID NO: 989043 - protein, 23 aa, Mycobacterium
HLPNSSNQHRDGVERSFPAPAAR

SEQ ID NO: 989044 - protein, 14 aa, Mycobacterium
HLPQEQSQRPGHIP

SEQ ID NO: 989045 - protein, 5 aa, Mycobacterium
HLQSA

SEQ ID NO: 989046 - protein, 8 aa, Mycobacterium
HLRSSDRS

SEQ ID NO: 989047 - protein, 14 aa, Mycobacterium
HLSKRDATAPNLDD

SEQ ID NO: 989048 - protein, 10 aa, Mycobacterium
HLSTGGGASL

SEQ ID NO: 989049 - protein, 5 aa, Mycobacterium
HMQSE

SEQ ID NO: 989050 - protein, 12 aa, Mycobacterium
HMRPDTSKEGLA

SEQ ID NO: 989051 - protein, 7 aa, Mycobacterium
HNATSAA

SEQ ID NO: 989052 - protein, 9 aa, Mycobacterium
HNDRGTAVA

SEQ ID NO: 989053 - protein, 5 aa, Mycobacterium
HNHPE

SEQ ID NO: 989054 - protein, 8 aa, Mycobacterium
HNNHPETE

SEQ ID NO: 989055 - protein, 9 aa, Mycobacterium
HNPAGANAL

SEQ ID NO: 989056 - protein, 7 aa, Mycobacterium
HNPTGSV

SEQ ID NO: 989057 - protein, 6 aa, Mycobacterium
HNQTSR

SEQ ID NO: 989058 - protein, 11 aa, Mycobacterium
HNVAAQATTLG

SEQ ID NO: 989059 - protein, 5 aa, Mycobacterium
HPAAL

SEQ ID NO: 989060 - protein, 8 aa, Mycobacterium
HPAATKAD

SEQ ID NO: 989061 - protein, 10 aa, Mycobacterium
HPADEHRRAS

SEQ ID NO: 989062 - protein, 8 aa, Mycobacterium
HPAGGHHQ

SEQ ID NO: 989063 - protein, 11 aa, Mycobacterium
HPANTGKPEFA

SEQ ID NO: 989064 - protein, 17 aa, Mycobacterium
HPATTTHRAMGPEGRAA

SEQ ID NO: 989065 - protein, 12 aa, Mycobacterium
HPDAAAEYEVGQ

SEQ ID NO: 989066 - protein, 4 aa, Mycobacterium
HPDC

SEQ ID NO: 989067 - protein, 5 aa, Mycobacterium
HPDEA

SEQ ID NO: 989068 - protein, 30 aa, Mycobacterium
HPDGQETTAYSRAKRRVQTTGGHGDHETTF

SEQ ID NO: 989069 - protein, 9 aa, Mycobacterium
HPDHDGEDV

SEQ ID NO: 989070 - protein, 8 aa, Mycobacterium
HPDHTDGI

SEQ ID NO: 989071 - protein, 16 aa, Mycobacterium
HPECGHTAQFGYHRMA

SEQ ID NO: 989072 - protein, 19 aa, Mycobacterium
HPEKSGDAGATLLSNWLGE

SEQ ID NO: 989073 - protein, 7 aa, Mycobacterium
HPEQSTD

SEQ ID NO: 989074 - protein, 12 aa, Mycobacterium
HPEYSAPECTDP

SEQ ID NO: 989075 - protein, 5 aa, Mycobacterium
HPGDK

SEQ ID NO: 989076 - protein, 5 aa, Mycobacterium
HPGET

SEQ ID NO: 989077 - protein, 6 aa, Mycobacterium
HPGGAS

SEQ ID NO: 989078 - protein, 6 aa, Mycobacterium
HPGGPK

SEQ ID NO: 989079 - protein, 8 aa, Mycobacterium
HPGPDSPE

SEQ ID NO: 989080 - protein, 6 aa, Mycobacterium
HPGPVP

SEQ ID NO: 989081 - protein, 36 aa, Mycobacterium
HPHGGGEGKTSGGRHPVSPWGKPEGRTRKPNKSSNK

SEQ ID NO: 989082 - protein, 19 aa, Mycobacterium
HPHPTSPPQHHHPKTGKSP

SEQ ID NO: 989083 - protein, 21 aa, Mycobacterium
HPHPTSPPQHHHPNQTNYDDF

SEQ ID NO: 989084 - protein, 18 aa, Mycobacterium
HPHPTSPPQHHHPNQTSK

SEQ ID NO: 989085 - protein, 19 aa, Mycobacterium
HPHPTTTPPPKPKLFDPRL

SEQ ID NO: 989086 - protein, 19 aa, Mycobacterium
HPHPTTTPPPKPNQQKITT

SEQ ID NO: 989087 - protein, 6 aa, Mycobacterium
HPLPAR

SEQ ID NO: 989088 - protein, 15 aa, Mycobacterium
HPLRRDTRSERPRTP

SEQ ID NO: 989089 - protein, 5 aa, Mycobacterium
HPLTP

SEQ ID NO: 989090 - protein, 13 aa, Mycobacterium
HPMPAGDGEFGND

SEQ ID NO: 989091 - protein, 9 aa, Mycobacterium
HPNAAESEC

SEQ ID NO: 989092 - protein, 11 aa, Mycobacterium
HPNSVNGTDLR

SEQ ID NO: 989093 - protein, 15 aa, Mycobacterium
HPQEQWAPSRGALVS

SEQ ID NO: 989094 - protein, 19 aa, Mycobacterium
HPQHQTRPRPTLATPETDI

SEQ ID NO: 989095 - protein, 15 aa, Mycobacterium
HPRDGATTDATHVKS

SEQ ID NO: 989096 - protein, 5 aa, Mycobacterium
HPRDL

SEQ ID NO: 989097 - protein, 22 aa, Mycobacterium
HPRSTAEAFPGLARTAALVRLV

SEQ ID NO: 989098 - protein, 4 aa, Mycobacterium
HPRT

SEQ ID NO: 989099 - protein, 7 aa, Mycobacterium
HPSETVR

SEQ ID NO: 989100 - protein, 8 aa, Mycobacterium
HPTAFRPR

SEQ ID NO: 989101 - protein, 5 aa, Mycobacterium
HPTEI

SEQ ID NO: 989102 - protein, 6 aa, Mycobacterium
HPTESY

SEQ ID NO: 989103 - protein, 20 aa, Mycobacterium
HPTKSPGGTRGSKAPLPSQQ

SEQ ID NO: 989104 - protein, 4 aa, Mycobacterium
HPTL

SEQ ID NO: 989105 - protein, 12 aa, Mycobacterium
HPTVSTLPSGMP

SEQ ID NO: 989106 - protein, 8 aa, Mycobacterium
HPVQGEAA

SEQ ID NO: 989107 - protein, 8 aa, Mycobacterium
HPVTGGYP

SEQ ID NO: 989108 - protein, 6 aa, Mycobacterium
HPYEEP

SEQ ID NO: 989109 - protein, 11 aa, Mycobacterium
HPYTREEAAYP

SEQ ID NO: 989110 - protein, 6 aa, Mycobacterium
HQASSL

SEQ ID NO: 989111 - protein, 7 aa, Mycobacterium
HQDGGVE

SEQ ID NO: 989112 - protein, 5 aa, Mycobacterium
HQGAA

SEQ ID NO: 989113 - protein, 11 aa, Mycobacterium
HQNEAAIRAAD

SEQ ID NO: 989114 - protein, 6 aa, Mycobacterium
HQPDRG

SEQ ID NO: 989115 - protein, 10 aa, Mycobacterium
HQQDYAELQG

SEQ ID NO: 989116 - protein, 8 aa, Mycobacterium
HQQQGGHP

SEQ ID NO: 989117 - protein, 15 aa, Mycobacterium
HQRAEIPTVQRDSGR

SEQ ID NO: 989118 - protein, 10 aa, Mycobacterium
HQREVQKSSD

SEQ ID NO: 989119 - protein, 12 aa, Mycobacterium
HQRNSDVFDSER

SEQ ID NO: 989120 - protein, 10 aa, Mycobacterium
HQRPDGSVRV

SEQ ID NO: 989121 - protein, 4 aa, Mycobacterium
HQRR

SEQ ID NO: 989122 - protein, 11 aa, Mycobacterium
HQSAATPNGTQ

SEQ ID NO: 989123 - protein, 10 aa, Mycobacterium
HQSGEGNDGN

SEQ ID NO: 989124 - protein, 17 aa, Mycobacterium
HQSGGPKKCNTFDATNL

SEQ ID NO: 989125 - protein, 9 aa, Mycobacterium
HQSRPIASR

SEQ ID NO: 989126 - protein, 8 aa, Mycobacterium
HQSTEPGH

SEQ ID NO: 989127 - protein, 5 aa, Mycobacterium
HQWPT

SEQ ID NO: 989128 - protein, 8 aa, Mycobacterium
HRAHTGHG

SEQ ID NO: 989129 - protein, 4 aa, Mycobacterium
HRAI

SEQ ID NO: 989130 - protein, 12 aa, Mycobacterium
HRDSGPRPPTQL

SEQ ID NO: 989131 - protein, 5 aa, Mycobacterium
HRDTT

SEQ ID NO: 989132 - protein, 23 aa, Mycobacterium
HREDRYRRSTYDVEDTTGHPAQT

SEQ ID NO: 989133 - protein, 34 aa, Mycobacterium
HRGAKTRASARHPEVPGAGSVQDIDATGDTDGSP

SEQ ID NO: 989134 - protein, 11 aa, Mycobacterium
HRGAREVQRPA

SEQ ID NO: 989135 - protein, 6 aa, Mycobacterium
HRGGST

SEQ ID NO: 989136 - protein, 7 aa, Mycobacterium
HRGRAGS

SEQ ID NO: 989137 - protein, 28 aa, Mycobacterium
HRGRRDPVRVGGSDGADAGASRFGGAGR

SEQ ID NO: 989138 - protein, 8 aa, Mycobacterium
HRGTEPAA

SEQ ID NO: 989139 - protein, 13 aa, Mycobacterium
HRGYDSDHPRVQG

SEQ ID NO: 989140 - protein, 7 aa, Mycobacterium
HRHSPDE

SEQ ID NO: 989141 - protein, 18 aa, Mycobacterium
HRKGRNNYSTAAPTDVGS

SEQ ID NO: 989142 - protein, 9 aa, Mycobacterium
HRNGPTKTV

SEQ ID NO: 989143 - protein, 4 aa, Mycobacterium
HRNR

SEQ ID NO: 989144 - protein, 25 aa, Mycobacterium
HRNRPKPAFATGSYASSRPGAASEA

SEQ ID NO: 989145 - protein, 19 aa, Mycobacterium
HRPAIQQSGVGDVSRSQSA

SEQ ID NO: 989146 - protein, 10 aa, Mycobacterium
HRQTSSGTVS

SEQ ID NO: 989147 - protein, 6 aa, Mycobacterium
HRRAAS

SEQ ID NO: 989148 - protein, 4 aa, Mycobacterium
HRRN

SEQ ID NO: 989149 - protein, 23 aa, Mycobacterium
HRRPGKRWADPSTVTWPTTNATR

SEQ ID NO: 989150 - protein, 14 aa, Mycobacterium
HRRPGSIGGCATPA

SEQ ID NO: 989151 - protein, 6 aa, Mycobacterium
HRSEPG

SEQ ID NO: 989152 - protein, 6 aa, Mycobacterium
HRSMGA

SEQ ID NO: 989153 - protein, 6 aa, Mycobacterium
HRSSHG

SEQ ID NO: 989154 - protein, 5 aa, Mycobacterium
HRTPA

SEQ ID NO: 989155 - protein, 9 aa, Mycobacterium
HRTPDSAGT

SEQ ID NO: 989156 - protein, 6 aa, Mycobacterium
HRVGPE

SEQ ID NO: 989157 - protein, 9 aa, Mycobacterium
HSAASGLGA

SEQ ID NO: 989158 - protein, 8 aa, Mycobacterium
HSANPSAP

SEQ ID NO: 989159 - protein, 9 aa, Mycobacterium
HSASEAVSG

SEQ ID NO: 989160 - protein, 7 aa, Mycobacterium
HSDVSYT

SEQ ID NO: 989161 - protein, 12 aa, Mycobacterium
HSGAPNIAPHDV

SEQ ID NO: 989162 - protein, 6 aa, Mycobacterium
HSGAPW

SEQ ID NO: 989163 - protein, 8 aa, Mycobacterium
HSGETVQT

SEQ ID NO: 989164 - protein, 10 aa, Mycobacterium
HSGHTNHTRT

SEQ ID NO: 989165 - protein, 7 aa, Mycobacterium
HSGPSRA

SEQ ID NO: 989166 - protein, 7 aa, Mycobacterium
HSGQGRT

SEQ ID NO: 989167 - protein, 9 aa, Mycobacterium
HSGRSRSGR

SEQ ID NO: 989168 - protein, 15 aa, Mycobacterium
HSGTTSPVARQWPLI

SEQ ID NO: 989169 - protein, 21 aa, Mycobacterium
HSGYRPTENRGGHTQRCSRQR

SEQ ID NO: 989170 - protein, 15 aa, Mycobacterium
HSKDGVAANSSFHPV

SEQ ID NO: 989171 - protein, 6 aa, Mycobacterium
HSLATP

SEQ ID NO: 989172 - protein, 6 aa, Mycobacterium
HSLEEE

SEQ ID NO: 989173 - protein, 13 aa, Mycobacterium
HSLRPNSPANSMT

SEQ ID NO: 989174 - protein, 6 aa, Mycobacterium
HSPMAG

SEQ ID NO: 989175 - protein, 6 aa, Mycobacterium
HSQGEI

SEQ ID NO: 989176 - protein, 5 aa, Mycobacterium
HSRDS

SEQ ID NO: 989177 - protein, 4 aa, Mycobacterium
HSRG

SEQ ID NO: 989178 - protein, 4 aa, Mycobacterium
HSTH

SEQ ID NO: 989179 - protein, 5 aa, Mycobacterium
HSVTP

SEQ ID NO: 989180 - protein, 9 aa, Mycobacterium
HSYHGRNDR

SEQ ID NO: 989181 - protein, 16 aa, Mycobacterium
HTAGRLQTNIVTLYSI

SEQ ID NO: 989182 - protein, 19 aa, Mycobacterium
HTAGTAGSHQTYSTAGTPQ

SEQ ID NO: 989183 - protein, 10 aa, Mycobacterium
HTATAGSDSL

SEQ ID NO: 989184 - protein, 10 aa, Mycobacterium
HTDEESASEV

SEQ ID NO: 989185 - protein, 4 aa, Mycobacterium
HTDG

SEQ ID NO: 989186 - protein, 4 aa, Mycobacterium
HTDH

SEQ ID NO: 989187 - protein, 6 aa, Mycobacterium
HTDHRP

SEQ ID NO: 989188 - protein, 8 aa, Mycobacterium
HTDRRAGP

SEQ ID NO: 989189 - protein, 8 aa, Mycobacterium
HTDSPNLR

SEQ ID NO: 989190 - protein, 24 aa, Mycobacterium
HTEPGLQGDRSSAGTKPATLETGA

SEQ ID NO: 989191 - protein, 6 aa, Mycobacterium
HTEYTA

SEQ ID NO: 989192 - protein, 4 aa, Mycobacterium
HTGG

SEQ ID NO: 989193 - protein, 11 aa, Mycobacterium
HTGGNSSGIVD

SEQ ID NO: 989194 - protein, 5 aa, Mycobacterium
HTGKP

SEQ ID NO: 989195 - protein, 10 aa, Mycobacterium
HTGPVHEGDT

SEQ ID NO: 989196 - protein, 6 aa, Mycobacterium
HTKGPK

SEQ ID NO: 989197 - protein, 9 aa, Mycobacterium
HTKSDGNPV

SEQ ID NO: 989198 - protein, 9 aa, Mycobacterium
HTPGEGRVT

SEQ ID NO: 989199 - protein, 4 aa, Mycobacterium
HTPP

SEQ ID NO: 989200 - protein, 11 aa, Mycobacterium
HTRLDDSSDTA

SEQ ID NO: 989201 - protein, 6 aa, Mycobacterium
HTRPDD

SEQ ID NO: 989202 - protein, 7 aa, Mycobacterium
HTRPTIG

SEQ ID NO: 989203 - protein, 6 aa, Mycobacterium
HTRSGV

SEQ ID NO: 989204 - protein, 10 aa, Mycobacterium
HTRTDRTKDV

SEQ ID NO: 989205 - protein, 8 aa, Mycobacterium
HTSGSRPA

SEQ ID NO: 989206 - protein, 4 aa, Mycobacterium
HTSR

SEQ ID NO: 989207 - protein, 6 aa, Mycobacterium
HTSRTG

SEQ ID NO: 989208 - protein, 34 aa, Mycobacterium
HTSSGGSIYGTPSQYPTPETVPTDPTSPYAAGKV

SEQ ID NO: 989209 - protein, 8 aa, Mycobacterium
HTTAADEP

SEQ ID NO: 989210 - protein, 8 aa, Mycobacterium
HTVGEDPL

SEQ ID NO: 989211 - protein, 11 aa, Mycobacterium
HVGDDPDCGGH

SEQ ID NO: 989212 - protein, 14 aa, Mycobacterium
HVGFKGSRKSTPFA

SEQ ID NO: 989213 - protein, 20 aa, Mycobacterium
HVPGKEDEEIVRKPSTDEPL

SEQ ID NO: 989214 - protein, 10 aa, Mycobacterium
HVRETAPEAI

SEQ ID NO: 989215 - protein, 9 aa, Mycobacterium
HVRTGSDTK

SEQ ID NO: 989216 - protein, 19 aa, Mycobacterium
HVSDSSWGKRDADGEVRAS

SEQ ID NO: 989217 - protein, 8 aa, Mycobacterium
HVSDSYSQ

SEQ ID NO: 989218 - protein, 5 aa, Mycobacterium
HYDRS

SEQ ID NO: 989219 - protein, 7 aa, Mycobacterium
HYPEDIE

SEQ ID NO: 989220 - protein, 14 aa, Mycobacterium
HYRGPFGDAEGELE

SEQ ID NO: 989221 - protein, 8 aa, Mycobacterium
HYSSNAGF

SEQ ID NO: 989222 - protein, 20 aa, Mycobacterium
HYTPGSAVSARATFAGATRG

SEQ ID NO: 989223 - protein, 11 aa, Mycobacterium
IAAERQGKPVE

SEQ ID NO: 989224 - protein, 10 aa, Mycobacterium
IAAGAEPRPF

SEQ ID NO: 989225 - protein, 5 aa, Mycobacterium
IAAGR

SEQ ID NO: 989226 - protein, 6 aa, Mycobacterium
IAANPT

SEQ ID NO: 989227 - protein, 13 aa, Mycobacterium
IAAPSRGTPEGPW

SEQ ID NO: 989228 - protein, 13 aa, Mycobacterium
IADGNAAAFGDMP

SEQ ID NO: 989229 - protein, 6 aa, Mycobacterium
IADGYH

SEQ ID NO: 989230 - protein, 16 aa, Mycobacterium
IADPAKLAQAYEDGGA

SEQ ID NO: 989231 - protein, 8 aa, Mycobacterium
IAEAEGAA

SEQ ID NO: 989232 - protein, 7 aa, Mycobacterium
IAEGSGA

SEQ ID NO: 989233 - protein, 6 aa, Mycobacterium
IAEKVG

SEQ ID NO: 989234 - protein, 4 aa, Mycobacterium
IAEP

SEQ ID NO: 989235 - protein, 9 aa, Mycobacterium
IAERKGSLN

SEQ ID NO: 989236 - protein, 16 aa, Mycobacterium
IAETKKADLNANDIDA

SEQ ID NO: 989237 - protein, 5 aa, Mycobacterium
IAGAE

SEQ ID NO: 989238 - protein, 6 aa, Mycobacterium
IAGHGA

SEQ ID NO: 989239 - protein, 15 aa, Mycobacterium
IAGNRGQTNYATAKA

SEQ ID NO: 989240 - protein, 8 aa, Mycobacterium
IAGQKVTP

SEQ ID NO: 989241 - protein, 7 aa, Mycobacterium
IAGQPEV

SEQ ID NO: 989242 - protein, 10 aa, Mycobacterium
IAGSSGDGDD

SEQ ID NO: 989243 - protein, 13 aa, Mycobacterium
IAGTGGDGANTVN

SEQ ID NO: 989244 - protein, 7 aa, Mycobacterium
IAIESEE

SEQ ID NO: 989245 - protein, 7 aa, Mycobacterium
IAPEPRQ

SEQ ID NO: 989246 - protein, 5 aa, Mycobacterium
IAPPK

SEQ ID NO: 989247 - protein, 6 aa, Mycobacterium
IAPSKD

SEQ ID NO: 989248 - protein, 6 aa, Mycobacterium
IARPEA

SEQ ID NO: 989249 - protein, 10 aa, Mycobacterium
IASGSDEKRF

SEQ ID NO: 989250 - protein, 16 aa, Mycobacterium
IASNGGISRGAPTGFT

SEQ ID NO: 989251 - protein, 8 aa, Mycobacterium
IASPPPVP

SEQ ID NO: 989252 - protein, 7 aa, Mycobacterium
IASRRAA

SEQ ID NO: 989253 - protein, 6 aa, Mycobacterium
IASSGS

SEQ ID NO: 989254 - protein, 9 aa, Mycobacterium
IATDGARKC

SEQ ID NO: 989255 - protein, 4 aa, Mycobacterium
IATG

SEQ ID NO: 989256 - protein, 11 aa, Mycobacterium
IATGATAKASC

SEQ ID NO: 989257 - protein, 20 aa, Mycobacterium
IATGTDSTGVRDQHHDAQDW

SEQ ID NO: 989258 - protein, 30 aa, Mycobacterium
IATPAPAPRAESVPSRPTPARKEANGAPYV

SEQ ID NO: 989259 - protein, 11 aa, Mycobacterium
IATRSARAEES

SEQ ID NO: 989260 - protein, 14 aa, Mycobacterium
IATTGRLSSTEPNL

SEQ ID NO: 989261 - protein, 15 aa, Mycobacterium
IATTPYTSEPVCSTQ

SEQ ID NO: 989262 - protein, 21 aa, Mycobacterium
IAVTEAGASFPYRKDPDDKNI

SEQ ID NO: 989263 - protein, 25 aa, Mycobacterium
IAYNGSEVGNIGGVNATNDPWQGCP

SEQ ID NO: 989264 - protein, 11 aa, Mycobacterium
IDAAEAERSGL

SEQ ID NO: 989265 - protein, 20 aa, Mycobacterium
IDASKTLQDEITNSAAASLA

SEQ ID NO: 989266 - protein, 5 aa, Mycobacterium
IDEDS

SEQ ID NO: 989267 - protein, 8 aa, Mycobacterium
IDENSRAA

SEQ ID NO: 989268 - protein, 10 aa, Mycobacterium
IDEPVQPLED

SEQ ID NO: 989269 - protein, 24 aa, Mycobacterium
IDESGTAHEAHQGRRTTVKQQRTS

SEQ ID NO: 989270 - protein, 4 aa, Mycobacterium
IDET

SEQ ID NO: 989271 - protein, 4 aa, Mycobacterium
IDGA

SEQ ID NO: 989272 - protein, 6 aa, Mycobacterium
IDGDRT

SEQ ID NO: 989273 - protein, 9 aa, Mycobacterium
IDGEAGPTE

SEQ ID NO: 989274 - protein, 6 aa, Mycobacterium
IDGEGR

SEQ ID NO: 989275 - protein, 7 aa, Mycobacterium
IDGGDDL

SEQ ID NO: 989276 - protein, 7 aa, Mycobacterium
IDGNDYP

SEQ ID NO: 989277 - protein, 4 aa, Mycobacterium
IDGP

SEQ ID NO: 989278 - protein, 15 aa, Mycobacterium
IDGPATAKISNGTFT

SEQ ID NO: 989279 - protein, 12 aa, Mycobacterium
IDGPGVENGSVT

SEQ ID NO: 989280 - protein, 7 aa, Mycobacterium
IDGSLPE

SEQ ID NO: 989281 - protein, 6 aa, Mycobacterium
IDGSPV

SEQ ID NO: 989282 - protein, 17 aa, Mycobacterium
IDGSQRTPVTSPEPSLA

SEQ ID NO: 989283 - protein, 9 aa, Mycobacterium
IDGSVAPTL

SEQ ID NO: 989284 - protein, 4 aa, Mycobacterium
IDGT

SEQ ID NO: 989285 - protein, 14 aa, Mycobacterium
IDKEGADPAKIRGQ

SEQ ID NO: 989286 - protein, 9 aa, Mycobacterium
IDKSTEKTL

SEQ ID NO: 989287 - protein, 10 aa, Mycobacterium
IDNEASDKAA

SEQ ID NO: 989288 - protein, 16 aa, Mycobacterium
IDNPNANGSCACGDSF

SEQ ID NO: 989289 - protein, 4 aa, Mycobacterium
IDNS

SEQ ID NO: 989290 - protein, 10 aa, Mycobacterium
IDPARRGETL

SEQ ID NO: 989291 - protein, 7 aa, Mycobacterium
IDPEPMA

SEQ ID NO: 989292 - protein, 4 aa, Mycobacterium
IDPS

SEQ ID NO: 989293 - protein, 16 aa, Mycobacterium
IDQAEEELAERSTPTT

SEQ ID NO: 989294 - protein, 10 aa, Mycobacterium
IDQAKRETTL

SEQ ID NO: 989295 - protein, 9 aa, Mycobacterium
IDRGPAKGT

SEQ ID NO: 989296 - protein, 11 aa, Mycobacterium
IDRPDEMSPYA

SEQ ID NO: 989297 - protein, 7 aa, Mycobacterium
IDRPQAT

SEQ ID NO: 989298 - protein, 6 aa, Mycobacterium
IDRTGR

SEQ ID NO: 989299 - protein, 6 aa, Mycobacterium
IDSAAN

SEQ ID NO: 989300 - protein, 9 aa, Mycobacterium
IDSPQSQAA

SEQ ID NO: 989301 - protein, 6 aa, Mycobacterium
IDSSSL

SEQ ID NO: 989302 - protein, 8 aa, Mycobacterium
IDSTADGI

SEQ ID NO: 989303 - protein, 4 aa, Mycobacterium
IDTD

SEQ ID NO: 989304 - protein, 17 aa, Mycobacterium
IDTEGRNTEARSDLDSA

SEQ ID NO: 989305 - protein, 6 aa, Mycobacterium
IDTTGA

SEQ ID NO: 989306 - protein, 12 aa, Mycobacterium
IEAANGASHKYP

SEQ ID NO: 989307 - protein, 9 aa, Mycobacterium
IEAAQQTFE

SEQ ID NO: 989308 - protein, 9 aa, Mycobacterium
IEADSDRDR

SEQ ID NO: 989309 - protein, 17 aa, Mycobacterium
IECSTGSACTSGVPQPS

SEQ ID NO: 989310 - protein, 4 aa, Mycobacterium
IEDV

SEQ ID NO: 989311 - protein, 7 aa, Mycobacterium
IEEPAKA

SEQ ID NO: 989312 - protein, 5 aa, Mycobacterium
IEGQK

SEQ ID NO: 989313 - protein, 7 aa, Mycobacterium
IEGTPVT

SEQ ID NO: 989314 - protein, 7 aa, Mycobacterium
IEHQSSG

SEQ ID NO: 989315 - protein, 11 aa, Mycobacterium
IEIGPSPAEAD

SEQ ID NO: 989316 - protein, 5 aa, Mycobacterium
IENDA

SEQ ID NO: 989317 - protein, 6 aa, Mycobacterium
IENGAR

SEQ ID NO: 989318 - protein, 17 aa, Mycobacterium
IENGGKPGSIVLASSSK

SEQ ID NO: 989319 - protein, 6 aa, Mycobacterium
IENTGA

SEQ ID NO: 989320 - protein, 7 aa, Mycobacterium
IEPGGNV

SEQ ID NO: 989321 - protein, 6 aa, Mycobacterium
IEPNEG

SEQ ID NO: 989322 - protein, 8 aa, Mycobacterium
IEPPPSYL

SEQ ID NO: 989323 - protein, 9 aa, Mycobacterium
IEPRGGEAD

SEQ ID NO: 989324 - protein, 16 aa, Mycobacterium
IEPRTGRHLDNSPEAF

SEQ ID NO: 989325 - protein, 5 aa, Mycobacterium
IEPTG

SEQ ID NO: 989326 - protein, 9 aa, Mycobacterium
IERYGSTES

SEQ ID NO: 989327 - protein, 4 aa, Mycobacterium
IESG

SEQ ID NO: 989328 - protein, 7 aa, Mycobacterium
IESGEPI

SEQ ID NO: 989329 - protein, 6 aa, Mycobacterium
IESNSG

SEQ ID NO: 989330 - protein, 4 aa, Mycobacterium
IEST

SEQ ID NO: 989331 - protein, 7 aa, Mycobacterium
IETEQRA

SEQ ID NO: 989332 - protein, 6 aa, Mycobacterium
IETETG

SEQ ID NO: 989333 - protein, 6 aa, Mycobacterium
IETYKE

SEQ ID NO: 989334 - protein, 8 aa, Mycobacterium
IGADPNKV

SEQ ID NO: 989335 - protein, 11 aa, Mycobacterium
IGAKSSPPRTL

SEQ ID NO: 989336 - protein, 13 aa, Mycobacterium
IGASARTDRLDVT

SEQ ID NO: 989337 - protein, 5 aa, Mycobacterium
IGDNS

SEQ ID NO: 989338 - protein, 9 aa, Mycobacterium
IGDPTTNAA

SEQ ID NO: 989339 - protein, 17 aa, Mycobacterium
IGDSPDDCQHIRRVQLT

SEQ ID NO: 989340 - protein, 8 aa, Mycobacterium
IGEGGNLG

SEQ ID NO: 989341 - protein, 7 aa, Mycobacterium
IGELGKK

SEQ ID NO: 989342 - protein, 4 aa, Mycobacterium
IGGA

SEQ ID NO: 989343 - protein, 7 aa, Mycobacterium
IGGARNA

SEQ ID NO: 989344 - protein, 6 aa, Mycobacterium
IGGEDA

SEQ ID NO: 989345 - protein, 5 aa, Mycobacterium
IGGES

SEQ ID NO: 989346 - protein, 10 aa, Mycobacterium
IGGKNAAEVV

SEQ ID NO: 989347 - protein, 4 aa, Mycobacterium
IGGL

SEQ ID NO: 989348 - protein, 14 aa, Mycobacterium
IGGRGIRVDVVDTD

SEQ ID NO: 989349 - protein, 8 aa, Mycobacterium
IGGTPEGI

SEQ ID NO: 989350 - protein, 7 aa, Mycobacterium
IGGYGNS

SEQ ID NO: 989351 - protein, 8 aa, Mycobacterium
IGLADSTA

SEQ ID NO: 989352 - protein, 17 aa, Mycobacterium
IGLGTNDPTRSGFENAA

SEQ ID NO: 989353 - protein, 5 aa, Mycobacterium
IGNGR

SEQ ID NO: 989354 - protein, 12 aa, Mycobacterium
IGNGVADVEALV

SEQ ID NO: 989355 - protein, 8 aa, Mycobacterium
IGNGVGDD

SEQ ID NO: 989356 - protein, 6 aa, Mycobacterium
IGNTTA

SEQ ID NO: 989357 - protein, 5 aa, Mycobacterium
IGPAS

SEQ ID NO: 989358 - protein, 4 aa, Mycobacterium
IGPE

SEQ ID NO: 989359 - protein, 7 aa, Mycobacterium
IGPGGSG

SEQ ID NO: 989360 - protein, 7 aa, Mycobacterium
IGPGSHA

SEQ ID NO: 989361 - protein, 8 aa, Mycobacterium
IGPGTPYR

SEQ ID NO: 989362 - protein, 9 aa, Mycobacterium
IGPPADPEC

SEQ ID NO: 989363 - protein, 6 aa, Mycobacterium
IGPPIT

SEQ ID NO: 989364 - protein, 11 aa, Mycobacterium
IGPRGRQGSPA

SEQ ID NO: 989365 - protein, 8 aa, Mycobacterium
IGPRPDAP

SEQ ID NO: 989366 - protein, 6 aa, Mycobacterium
IGPRPG

SEQ ID NO: 989367 - protein, 9 aa, Mycobacterium
IGPRPTTPF

SEQ ID NO: 989368 - protein, 5 aa, Mycobacterium
IGQDT

SEQ ID NO: 989369 - protein, 15 aa, Mycobacterium
IGQGDPASQPQAQNV

SEQ ID NO: 989370 - protein, 8 aa, Mycobacterium
IGQTERGL

SEQ ID NO: 989371 - protein, 10 aa, Mycobacterium
IGRGGRTATA

SEQ ID NO: 989372 - protein, 7 aa, Mycobacterium
IGRGTHP

SEQ ID NO: 989373 - protein, 8 aa, Mycobacterium
IGRPSTYS

SEQ ID NO: 989374 - protein, 16 aa, Mycobacterium
IGRTARQRTTTYALRG

SEQ ID NO: 989375 - protein, 14 aa, Mycobacterium
IGSDTGGSIRQPAA

SEQ ID NO: 989376 - protein, 5 aa, Mycobacterium
IGSPT

SEQ ID NO: 989377 - protein, 9 aa, Mycobacterium
IGSSGKGSE

SEQ ID NO: 989378 - protein, 5 aa, Mycobacterium
IGSVD

SEQ ID NO: 989379 - protein, 13 aa, Mycobacterium
IGTDGQSTQGGYS

SEQ ID NO: 989380 - protein, 7 aa, Mycobacterium
IGTERDV

SEQ ID NO: 989381 - protein, 4 aa, Mycobacterium
IGTN

SEQ ID NO: 989382 - protein, 7 aa, Mycobacterium
IGTNAAA

SEQ ID NO: 989383 - protein, 10 aa, Mycobacterium
IGTPKTNAAP

SEQ ID NO: 989384 - protein, 50 aa, Mycobacterium
IGTSDAKIGGEKQTGSGQKVSLDAQKTYMRRSTNTVNYSDELPLAQSIKY

SEQ ID NO: 989385 - protein, 6 aa, Mycobacterium
IGTSPL

SEQ ID NO: 989386 - protein, 7 aa, Mycobacterium
IGTTSDA

SEQ ID NO: 989387 - protein, 10 aa, Mycobacterium
IGVGQSSTHY

SEQ ID NO: 989388 - protein, 5 aa, Mycobacterium
IGYEE

SEQ ID NO: 989389 - protein, 14 aa, Mycobacterium
IHAPDNTSRTLASR

SEQ ID NO: 989390 - protein, 5 aa, Mycobacterium
IHGRS

SEQ ID NO: 989391 - protein, 5 aa, Mycobacterium
IHPTG

SEQ ID NO: 989392 - protein, 4 aa, Mycobacterium
IHRE

SEQ ID NO: 989393 - protein, 9 aa, Mycobacterium
IHRGTGARG

SEQ ID NO: 989394 - protein, 20 aa, Mycobacterium
IKATPGSLRGQADSITPGVR

SEQ ID NO: 989395 - protein, 5 aa, Mycobacterium
IKEGD

SEQ ID NO: 989396 - protein, 12 aa, Mycobacterium
IKEGQKVKRTGD

SEQ ID NO: 989397 - protein, 12 aa, Mycobacterium
IKHSPNRGRTTL

SEQ ID NO: 989398 - protein, 4 aa, Mycobacterium
IKNR

SEQ ID NO: 989399 - protein, 5 aa, Mycobacterium
IKNRT

SEQ ID NO: 989400 - protein, 11 aa, Mycobacterium
IKRGQAARNAK

SEQ ID NO: 989401 - protein, 8 aa, Mycobacterium
IKTGNERA

SEQ ID NO: 989402 - protein, 7 aa, Mycobacterium
IKTNRGI

SEQ ID NO: 989403 - protein, 14 aa, Mycobacterium
IKTTEPKARALRPY

SEQ ID NO: 989404 - protein, 8 aa, Mycobacterium
ILDSGGRV

SEQ ID NO: 989405 - protein, 5 aa, Mycobacterium
ILPQQ

SEQ ID NO: 989406 - protein, 14 aa, Mycobacterium
ILPQQQEVADTDGL

SEQ ID NO: 989407 - protein, 5 aa, Mycobacterium
ILSPN

SEQ ID NO: 989408 - protein, 10 aa, Mycobacterium
ILTGTPPSTL

SEQ ID NO: 989409 - protein, 6 aa, Mycobacterium
INDPTA

SEQ ID NO: 989410 - protein, 9 aa, Mycobacterium
INDQSEKAS

SEQ ID NO: 989411 - protein, 16 aa, Mycobacterium
INGEETEISGVGNGPL

SEQ ID NO: 989412 - protein, 16 aa, Mycobacterium
INGGSVEDAKKRPEFG

SEQ ID NO: 989413 - protein, 7 aa, Mycobacterium
INNDGSM

SEQ ID NO: 989414 - protein, 4 aa, Mycobacterium
INNR

SEQ ID NO: 989415 - protein, 12 aa, Mycobacterium
INPAHTRSKLTE

SEQ ID NO: 989416 - protein, 5 aa, Mycobacterium
INPGT

SEQ ID NO: 989417 - protein, 5 aa, Mycobacterium
INPRE

SEQ ID NO: 989418 - protein, 12 aa, Mycobacterium
INRGSSGAGKDS

SEQ ID NO: 989419 - protein, 10 aa, Mycobacterium
INRGTDSLIG

SEQ ID NO: 989420 - protein, 12 aa, Mycobacterium
INSSGEKIYPEE

SEQ ID NO: 989421 - protein, 16 aa, Mycobacterium
INSSPVNLAAPGETTF

SEQ ID NO: 989422 - protein, 11 aa, Mycobacterium
INTTTGDRVRK

SEQ ID NO: 989423 - protein, 4 aa, Mycobacterium
IPAD

SEQ ID NO: 989424 - protein, 14 aa, Mycobacterium
IPAKTSEKSKNSTP

SEQ ID NO: 989425 - protein, 10 aa, Mycobacterium
IPANRPGRAI

SEQ ID NO: 989426 - protein, 9 aa, Mycobacterium
IPASSLRGE

SEQ ID NO: 989427 - protein, 5 aa, Mycobacterium
IPASV

SEQ ID NO: 989428 - protein, 8 aa, Mycobacterium
IPDAEKQR

SEQ ID NO: 989429 - protein, 11 aa, Mycobacterium
IPDDPSSIDST

SEQ ID NO: 989430 - protein, 4 aa, Mycobacterium
IPDE

SEQ ID NO: 989431 - protein, 5 aa, Mycobacterium
IPGAA

SEQ ID NO: 989432 - protein, 6 aa, Mycobacterium
IPGAAR

SEQ ID NO: 989433 - protein, 8 aa, Mycobacterium
IPGEGHNL

SEQ ID NO: 989434 - protein, 10 aa, Mycobacterium
IPGKANRSAY

SEQ ID NO: 989435 - protein, 4 aa, Mycobacterium
IPGP

SEQ ID NO: 989436 - protein, 15 aa, Mycobacterium
IPGRDGSVAAEEVGT

SEQ ID NO: 989437 - protein, 5 aa, Mycobacterium
IPGRE

SEQ ID NO: 989438 - protein, 15 aa, Mycobacterium
IPGTPEYSIRGGDVF

SEQ ID NO: 989439 - protein, 11 aa, Mycobacterium
IPGTTGVHSSG

SEQ ID NO: 989440 - protein, 4 aa, Mycobacterium
IPGY

SEQ ID NO: 989441 - protein, 18 aa, Mycobacterium
IPKSADQGTCRSRLASPS

SEQ ID NO: 989442 - protein, 19 aa, Mycobacterium
IPNDGGRVVDPSRGRPMPG

SEQ ID NO: 989443 - protein, 9 aa, Mycobacterium
IPPAPRGVP

SEQ ID NO: 989444 - protein, 5 aa, Mycobacterium
IPPDD

SEQ ID NO: 989445 - protein, 6 aa, Mycobacterium
IPPNRS

SEQ ID NO: 989446 - protein, 28 aa, Mycobacterium
IPQSKGDSLQFTEDEGIRANTSAESLAG

SEQ ID NO: 989447 - protein, 9 aa, Mycobacterium
IPRGEEAGK

SEQ ID NO: 989448 - protein, 6 aa, Mycobacterium
IPRPGP

SEQ ID NO: 989449 - protein, 18 aa, Mycobacterium
IPSDGEEKLQSTEAKVGP

SEQ ID NO: 989450 - protein, 11 aa, Mycobacterium
IPSESRAEARI

SEQ ID NO: 989451 - protein, 7 aa, Mycobacterium
IPSGSGP

SEQ ID NO: 989452 - protein, 4 aa, Mycobacterium
IPTA

SEQ ID NO: 989453 - protein, 6 aa, Mycobacterium
IPTDRQ

SEQ ID NO: 989454 - protein, 11 aa, Mycobacterium
IPTGNSANFAA

SEQ ID NO: 989455 - protein, 11 aa, Mycobacterium
IPTGSVTDLTA

SEQ ID NO: 989456 - protein, 5 aa, Mycobacterium
IPTNS

SEQ ID NO: 989457 - protein, 13 aa, Mycobacterium
IPTPQRPEPIPDV

SEQ ID NO: 989458 - protein, 37 aa, Mycobacterium
IPTPTPMPAPAASTAPVVTPPGPPPVTAPPSVTGAGV

SEQ ID NO: 989459 - protein, 6 aa, Mycobacterium
IPTQND

SEQ ID NO: 989460 - protein, 4 aa, Mycobacterium
IPTY

SEQ ID NO: 989461 - protein, 7 aa, Mycobacterium
IPYHGTD

SEQ ID NO: 989462 - protein, 19 aa, Mycobacterium
IQAASTPDEIFQLIDSELC

SEQ ID NO: 989463 - protein, 9 aa, Mycobacterium
IQAATGRPL

SEQ ID NO: 989464 - protein, 4 aa, Mycobacterium
IQAQ

SEQ ID NO: 989465 - protein, 6 aa, Mycobacterium
IQGGGS

SEQ ID NO: 989466 - protein, 10 aa, Mycobacterium
IQPAPATKTG

SEQ ID NO: 989467 - protein, 4 aa, Mycobacterium
IQPG

SEQ ID NO: 989468 - protein, 7 aa, Mycobacterium
IQPPGAD

SEQ ID NO: 989469 - protein, 7 aa, Mycobacterium
IQPPRPL

SEQ ID NO: 989470 - protein, 7 aa, Mycobacterium
IQPTPDN

SEQ ID NO: 989471 - protein, 5 aa, Mycobacterium
IQQAT

SEQ ID NO: 989472 - protein, 9 aa, Mycobacterium
IQRGEDRQR

SEQ ID NO: 989473 - protein, 14 aa, Mycobacterium
IQTGDGIDRRTKKS

SEQ ID NO: 989474 - protein, 4 aa, Mycobacterium
IRAG

SEQ ID NO: 989475 - protein, 10 aa, Mycobacterium
IRAPSGGNLQ

SEQ ID NO: 989476 - protein, 4 aa, Mycobacterium
IRED

SEQ ID NO: 989477 - protein, 12 aa, Mycobacterium
IREGYGKSEQFD

SEQ ID NO: 989478 - protein, 7 aa, Mycobacterium
IRGEPPK

SEQ ID NO: 989479 - protein, 18 aa, Mycobacterium
IRGSDSVRQYPFGTGNVA

SEQ ID NO: 989480 - protein, 8 aa, Mycobacterium
IRGSDTAA

SEQ ID NO: 989481 - protein, 7 aa, Mycobacterium
IRKEGKI

SEQ ID NO: 989482 - protein, 5 aa, Mycobacterium
IRKTK

SEQ ID NO: 989483 - protein, 6 aa, Mycobacterium
IRNTDS

SEQ ID NO: 989484 - protein, 4 aa, Mycobacterium
IRPG

SEQ ID NO: 989485 - protein, 16 aa, Mycobacterium
IRPPPKTTATSFKHYI

SEQ ID NO: 989486 - protein, 4 aa, Mycobacterium
IRPR

SEQ ID NO: 989487 - protein, 78 aa, Mycobacterium
IRPREEASSALRTKDIDNESTGLTYSGPSEDGSTQVQLNSGGGQKTPAGIPVGASRRERREAARRRGRGAKPSRSVKK

SEQ ID NO: 989488 - protein, 24 aa, Mycobacterium
IRRNTTPIATHQGHRHSSGGGNSS

SEQ ID NO: 989489 - protein, 17 aa, Mycobacterium
IRRTRAGLKDPKRPSGS

SEQ ID NO: 989490 - protein, 6 aa, Mycobacterium
IRSDSD

SEQ ID NO: 989491 - protein, 9 aa, Mycobacterium
IRSDTGRCT

SEQ ID NO: 989492 - protein, 9 aa, Mycobacterium
IRTPDDDGS

SEQ ID NO: 989493 - protein, 6 aa, Mycobacterium
IRTSES

SEQ ID NO: 989494 - protein, 7 aa, Mycobacterium
IRTTRGP

SEQ ID NO: 989495 - protein, 8 aa, Mycobacterium
ISAGKAIN

SEQ ID NO: 989496 - protein, 9 aa, Mycobacterium
ISAKKDEPE

SEQ ID NO: 989497 - protein, 13 aa, Mycobacterium
ISAPDKIAVLEEF

SEQ ID NO: 989498 - protein, 7 aa, Mycobacterium
ISAPQGL

SEQ ID NO: 989499 - protein, 7 aa, Mycobacterium
ISARRAE

SEQ ID NO: 989500 - protein, 9 aa, Mycobacterium
ISDGDDSLA

SEQ ID NO: 989501 - protein, 7 aa, Mycobacterium
ISDPDER

SEQ ID NO: 989502 - protein, 7 aa, Mycobacterium
ISDPRNL

SEQ ID NO: 989503 - protein, 8 aa, Mycobacterium
ISDVRQGK

SEQ ID NO: 989504 - protein, 9 aa, Mycobacterium
ISEPGNAGT

SEQ ID NO: 989505 - protein, 12 aa, Mycobacterium
ISGAGRAAKTKL

SEQ ID NO: 989506 - protein, 11 aa, Mycobacterium
ISGGGKRSTTR

SEQ ID NO: 989507 - protein, 23 aa, Mycobacterium
ISGGPSSNRAARCRRGADTTWPG

SEQ ID NO: 989508 - protein, 17 aa, Mycobacterium
ISGLPNNPAKLDTLAPR

SEQ ID NO: 989509 - protein, 6 aa, Mycobacterium
ISGPAV

SEQ ID NO: 989510 - protein, 8 aa, Mycobacterium
ISGPTDQI

SEQ ID NO: 989511 - protein, 10 aa, Mycobacterium
ISGSGPLRPA

SEQ ID NO: 989512 - protein, 7 aa, Mycobacterium
ISHTPSG

SEQ ID NO: 989513 - protein, 9 aa, Mycobacterium
ISKDRLAKG

SEQ ID NO: 989514 - protein, 6 aa, Mycobacterium
ISKEGL

SEQ ID NO: 989515 - protein, 5 aa, Mycobacterium
ISNRS

SEQ ID NO: 989516 - protein, 15 aa, Mycobacterium
ISPDSYSTQPLRADL

SEQ ID NO: 989517 - protein, 10 aa, Mycobacterium
ISPGTQPGSV

SEQ ID NO: 989518 - protein, 10 aa, Mycobacterium
ISPNSRNAAL

SEQ ID NO: 989519 - protein, 6 aa, Mycobacterium
ISPSGK

SEQ ID NO: 989520 - protein, 7 aa, Mycobacterium
ISQAGGR

SEQ ID NO: 989521 - protein, 11 aa, Mycobacterium
ISQGQKDKSKF

SEQ ID NO: 989522 - protein, 4 aa, Mycobacterium
ISQT

SEQ ID NO: 989523 - protein, 8 aa, Mycobacterium
ISRQTPQQ

SEQ ID NO: 989524 - protein, 25 aa, Mycobacterium
ISRTHTPQTEPRISHPSSPCSPSGT

SEQ ID NO: 989525 - protein, 6 aa, Mycobacterium
ISSDDV

SEQ ID NO: 989526 - protein, 5 aa, Mycobacterium
ISSDE

SEQ ID NO: 989527 - protein, 4 aa, Mycobacterium
ISSG

SEQ ID NO: 989528 - protein, 6 aa, Mycobacterium
ISSGED

SEQ ID NO: 989529 - protein, 14 aa, Mycobacterium
ISSPSDPTANPILT

SEQ ID NO: 989530 - protein, 7 aa, Mycobacterium
ISTEEAK

SEQ ID NO: 989531 - protein, 9 aa, Mycobacterium
ISTPDAPSI

SEQ ID NO: 989532 - protein, 6 aa, Mycobacterium
ISTPEQ

SEQ ID NO: 989533 - protein, 29 aa, Mycobacterium
ISTRTRHGVPGLNTDTPDPKDVKYGRDSS

SEQ ID NO: 989534 - protein, 9 aa, Mycobacterium
ISTSGVDDE

SEQ ID NO: 989535 - protein, 6 aa, Mycobacterium
ISTSRM

SEQ ID NO: 989536 - protein, 11 aa, Mycobacterium
ISYEGQGCSIS

SEQ ID NO: 989537 - protein, 7 aa, Mycobacterium
ITAIGNR

SEQ ID NO: 989538 - protein, 9 aa, Mycobacterium
ITAPETVTG

SEQ ID NO: 989539 - protein, 5 aa, Mycobacterium
ITAPR

SEQ ID NO: 989540 - protein, 7 aa, Mycobacterium
ITASTRD

SEQ ID NO: 989541 - protein, 5 aa, Mycobacterium
ITDAD

SEQ ID NO: 989542 - protein, 6 aa, Mycobacterium
ITDERA

SEQ ID NO: 989543 - protein, 8 aa, Mycobacterium
ITDKSQID

SEQ ID NO: 989544 - protein, 5 aa, Mycobacterium
ITDNA

SEQ ID NO: 989545 - protein, 6 aa, Mycobacterium
ITDNST

SEQ ID NO: 989546 - protein, 8 aa, Mycobacterium
ITDPSGAS

SEQ ID NO: 989547 - protein, 9 aa, Mycobacterium
ITDTRSRAT

SEQ ID NO: 989548 - protein, 13 aa, Mycobacterium
ITERQKQVLLDIY

SEQ ID NO: 989549 - protein, 14 aa, Mycobacterium
ITGDRVFEPYQRIT

SEQ ID NO: 989550 - protein, 5 aa, Mycobacterium
ITGED

SEQ ID NO: 989551 - protein, 6 aa, Mycobacterium
ITGGSE

SEQ ID NO: 989552 - protein, 4 aa, Mycobacterium
ITGN

SEQ ID NO: 989553 - protein, 11 aa, Mycobacterium
ITGNDEKPFRL

SEQ ID NO: 989554 - protein, 11 aa, Mycobacterium
ITGPTAPSWRK

SEQ ID NO: 989555 - protein, 13 aa, Mycobacterium
ITGTDTGSGGQAD

SEQ ID NO: 989556 - protein, 8 aa, Mycobacterium
ITGTSSSI

SEQ ID NO: 989557 - protein, 7 aa, Mycobacterium
ITKNSKV

SEQ ID NO: 989558 - protein, 4 aa, Mycobacterium
ITLT

SEQ ID NO: 989559 - protein, 9 aa, Mycobacterium
ITNDPRSIT

SEQ ID NO: 989560 - protein, 6 aa, Mycobacterium
ITNPPI

SEQ ID NO: 989561 - protein, 17 aa, Mycobacterium
ITNSVPAADKADHGNPR

SEQ ID NO: 989562 - protein, 6 aa, Mycobacterium
ITPDDT

SEQ ID NO: 989563 - protein, 4 aa, Mycobacterium
ITPE

SEQ ID NO: 989564 - protein, 18 aa, Mycobacterium
ITPRTRSTIAAGTRISTC

SEQ ID NO: 989565 - protein, 8 aa, Mycobacterium
ITPSDTRR

SEQ ID NO: 989566 - protein, 12 aa, Mycobacterium
ITPTVQPAAAGT

SEQ ID NO: 989567 - protein, 11 aa, Mycobacterium
ITQTSANDQTH

SEQ ID NO: 989568 - protein, 16 aa, Mycobacterium
ITRADGADDKATGVKM

SEQ ID NO: 989569 - protein, 9 aa, Mycobacterium
ITREPRREP

SEQ ID NO: 989570 - protein, 28 aa, Mycobacterium
ITRGDATEECLGGARNGQGVRNDVARLA

SEQ ID NO: 989571 - protein, 9 aa, Mycobacterium
ITRTKPEKA

SEQ ID NO: 989572 - protein, 23 aa, Mycobacterium
ITRTTEHDKQAPPGHRVPDQPGL

SEQ ID NO: 989573 - protein, 4 aa, Mycobacterium
ITSD

SEQ ID NO: 989574 - protein, 13 aa, Mycobacterium
ITSDIGNGHGPVD

SEQ ID NO: 989575 - protein, 6 aa, Mycobacterium
ITSDTA

SEQ ID NO: 989576 - protein, 11 aa, Mycobacterium
ITSPDEPKYDA

SEQ ID NO: 989577 - protein, 9 aa, Mycobacterium
ITSPRGMTR

SEQ ID NO: 989578 - protein, 10 aa, Mycobacterium
ITSPTTPPLQ

SEQ ID NO: 989579 - protein, 27 aa, Mycobacterium
ITSTDATADTPRTSPPSDTAGTTSRHR

SEQ ID NO: 989580 - protein, 7 aa, Mycobacterium
ITTAGKD

SEQ ID NO: 989581 - protein, 8 aa, Mycobacterium
ITTGPGGF

SEQ ID NO: 989582 - protein, 8 aa, Mycobacterium
ITYGTNNE

SEQ ID NO: 989583 - protein, 17 aa, Mycobacterium
IVAESDPDDEVDETTAK

SEQ ID NO: 989584 - protein, 11 aa, Mycobacterium
IYGGTKSAWDY

SEQ ID NO: 989585 - protein, 19 aa, Mycobacterium
IYGSERALAPRSGSTGEDD

SEQ ID NO: 989586 - protein, 10 aa, Mycobacterium
IYPGHGDDTV

SEQ ID NO: 989587 - protein, 6 aa, Mycobacterium
IYTSGE

SEQ ID NO: 989588 - protein, 8 aa, Mycobacterium
KAAAAGRP

SEQ ID NO: 989589 - protein, 8 aa, Mycobacterium
KAAADSAE

SEQ ID NO: 989590 - protein, 8 aa, Mycobacterium
KAAAQAQP

SEQ ID NO: 989591 - protein, 6 aa, Mycobacterium
KAADRR

SEQ ID NO: 989592 - protein, 7 aa, Mycobacterium
KAADSLD

SEQ ID NO: 989593 - protein, 6 aa, Mycobacterium
KAAGAA

SEQ ID NO: 989594 - protein, 11 aa, Mycobacterium
KAAKAGDGSIN

SEQ ID NO: 989595 - protein, 14 aa, Mycobacterium
KAANEDGTFKSDEQ

SEQ ID NO: 989596 - protein, 9 aa, Mycobacterium
KAAQRRTVR

SEQ ID NO: 989597 - protein, 9 aa, Mycobacterium
KAATQDLSG

SEQ ID NO: 989598 - protein, 15 aa, Mycobacterium
KAAVTGNGAANKAQV

SEQ ID NO: 989599 - protein, 13 aa, Mycobacterium
KADPDLTSSAFAS

SEQ ID NO: 989600 - protein, 9 aa, Mycobacterium
KADTGLNRN

SEQ ID NO: 989601 - protein, 6 aa, Mycobacterium
KADTRR

SEQ ID NO: 989602 - protein, 5 aa, Mycobacterium
KADTV

SEQ ID NO: 989603 - protein, 14 aa, Mycobacterium
KAEAGAGTEAPLPE

SEQ ID NO: 989604 - protein, 10 aa, Mycobacterium
KAEELAKSDK

SEQ ID NO: 989605 - protein, 12 aa, Mycobacterium
KAEIAQKVSETA

SEQ ID NO: 989606 - protein, 8 aa, Mycobacterium
KAEPPSVP

SEQ ID NO: 989607 - protein, 19 aa, Mycobacterium
KAERLTTQGRKDAKLQKRL

SEQ ID NO: 989608 - protein, 10 aa, Mycobacterium
KAFPDSADDE

SEQ ID NO: 989609 - protein, 10 aa, Mycobacterium
KAGELSANGK

SEQ ID NO: 989610 - protein, 6 aa, Mycobacterium
KAGEQL

SEQ ID NO: 989611 - protein, 11 aa, Mycobacterium
KAGGTRGISSP

SEQ ID NO: 989612 - protein, 16 aa, Mycobacterium
KAGKAGARDRADDLAR

SEQ ID NO: 989613 - protein, 8 aa, Mycobacterium
KAGLPTPV

SEQ ID NO: 989614 - protein, 13 aa, Mycobacterium
KAGNAQRPEDPTL

SEQ ID NO: 989615 - protein, 7 aa, Mycobacterium
KAGQANV

SEQ ID NO: 989616 - protein, 7 aa, Mycobacterium
KAGQDSE

SEQ ID NO: 989617 - protein, 16 aa, Mycobacterium
KAGSDRDHAEAATDGL

SEQ ID NO: 989618 - protein, 8 aa, Mycobacterium
KAGTDGSG

SEQ ID NO: 989619 - protein, 4 aa, Mycobacterium
KAGY

SEQ ID NO: 989620 - protein, 7 aa, Mycobacterium
KAHADSM

SEQ ID NO: 989621 - protein, 10 aa, Mycobacterium
KAHGMGDPSG

SEQ ID NO: 989622 - protein, 4 aa, Mycobacterium
KAHS

SEQ ID NO: 989623 - protein, 4 aa, Mycobacterium
KAIQ

SEQ ID NO: 989624 - protein, 14 aa, Mycobacterium
KAISNPAAASPTLP

SEQ ID NO: 989625 - protein, 7 aa, Mycobacterium
KAKAGGL

SEQ ID NO: 989626 - protein, 8 aa, Mycobacterium
KAKGGETI

SEQ ID NO: 989627 - protein, 27 aa, Mycobacterium
KAKKSSVPNGNIERARKRGAGEEVGGA

SEQ ID NO: 989628 - protein, 6 aa, Mycobacterium
KAKTAP

SEQ ID NO: 989629 - protein, 9 aa, Mycobacterium
KAKTDEFKQ

SEQ ID NO: 989630 - protein, 5 aa, Mycobacterium
KALEK

SEQ ID NO: 989631 - protein, 14 aa, Mycobacterium
KALERGRTTQEKSD

SEQ ID NO: 989632 - protein, 5 aa, Mycobacterium
KALNA

SEQ ID NO: 989633 - protein, 7 aa, Mycobacterium
KALPDTS

SEQ ID NO: 989634 - protein, 8 aa, Mycobacterium
KALQSATT

SEQ ID NO: 989635 - protein, 8 aa, Mycobacterium
KALSAAAA

SEQ ID NO: 989636 - protein, 5 aa, Mycobacterium
KANDI

SEQ ID NO: 989637 - protein, 5 aa, Mycobacterium
KANER

SEQ ID NO: 989638 - protein, 7 aa, Mycobacterium
KANVAPS

SEQ ID NO: 989639 - protein, 5 aa, Mycobacterium
KAPAV

SEQ ID NO: 989640 - protein, 8 aa, Mycobacterium
KAPGFGDR

SEQ ID NO: 989641 - protein, 19 aa, Mycobacterium
KAPGHNSVPPEFKECTALR

SEQ ID NO: 989642 - protein, 5 aa, Mycobacterium
KAPTV

SEQ ID NO: 989643 - protein, 7 aa, Mycobacterium
KARDHRS

SEQ ID NO: 989644 - protein, 8 aa, Mycobacterium
KAREVRDT

SEQ ID NO: 989645 - protein, 9 aa, Mycobacterium
KARGNGVPG

SEQ ID NO: 989646 - protein, 8 aa, Mycobacterium
KARISTPV

SEQ ID NO: 989647 - protein, 10 aa, Mycobacterium
KARRNEAASA

SEQ ID NO: 989648 - protein, 9 aa, Mycobacterium
KARTRGAGH

SEQ ID NO: 989649 - protein, 9 aa, Mycobacterium
KARYGDSPA

SEQ ID NO: 989650 - protein, 8 aa, Mycobacterium
KASGGIRT

SEQ ID NO: 989651 - protein, 13 aa, Mycobacterium
KASRSSDFTTAPA

SEQ ID NO: 989652 - protein, 6 aa, Mycobacterium
KASTQM

SEQ ID NO: 989653 - protein, 4 aa, Mycobacterium
KATG

SEQ ID NO: 989654 - protein, 9 aa, Mycobacterium
KATGVEEVG

SEQ ID NO: 989655 - protein, 10 aa, Mycobacterium
KATGYRPSAS

SEQ ID NO: 989656 - protein, 12 aa, Mycobacterium
KAVAAGGQLSST

SEQ ID NO: 989657 - protein, 8 aa, Mycobacterium
KAVRPSYG

SEQ ID NO: 989658 - protein, 7 aa, Mycobacterium
KAVRTDG

SEQ ID NO: 989659 - protein, 4 aa, Mycobacterium
KAYG

SEQ ID NO: 989660 - protein, 7 aa, Mycobacterium
KAYQGDP

SEQ ID NO: 989661 - protein, 4 aa, Mycobacterium
KAYR

SEQ ID NO: 989662 - protein, 7 aa, Mycobacterium
KAYTEVD

SEQ ID NO: 989663 - protein, 17 aa, Mycobacterium
KCEPSSAGPTGGAPGDF

SEQ ID NO: 989664 - protein, 10 aa, Mycobacterium
KCKGEDAKVS

SEQ ID NO: 989665 - protein, 4 aa, Mycobacterium
KDAC

SEQ ID NO: 989666 - protein, 5 aa, Mycobacterium
KDAGE

SEQ ID NO: 989667 - protein, 9 aa, Mycobacterium
KDAGIDPRT

SEQ ID NO: 989668 - protein, 13 aa, Mycobacterium
KDALTADPAARAN

SEQ ID NO: 989669 - protein, 7 aa, Mycobacterium
KDANSSM

SEQ ID NO: 989670 - protein, 6 aa, Mycobacterium
KDCRGR

SEQ ID NO: 989671 - protein, 6 aa, Mycobacterium
KDELTA

SEQ ID NO: 989672 - protein, 7 aa, Mycobacterium
KDGDLRA

SEQ ID NO: 989673 - protein, 22 aa, Mycobacterium
KDGEAGEDEVSRAEKDLDKTTH

SEQ ID NO: 989674 - protein, 6 aa, Mycobacterium
KDGGAI

SEQ ID NO: 989675 - protein, 4 aa, Mycobacterium
KDGI

SEQ ID NO: 989676 - protein, 4 aa, Mycobacterium
KDGQ

SEQ ID NO: 989677 - protein, 7 aa, Mycobacterium
KDGQFQE

SEQ ID NO: 989678 - protein, 7 aa, Mycobacterium
KDGTIAK

SEQ ID NO: 989679 - protein, 5 aa, Mycobacterium
KDGVE

SEQ ID NO: 989680 - protein, 9 aa, Mycobacterium
KDKGAKGKV

SEQ ID NO: 989681 - protein, 6 aa, Mycobacterium
KDKHTV

SEQ ID NO: 989682 - protein, 10 aa, Mycobacterium
KDLDPAARQP

SEQ ID NO: 989683 - protein, 5 aa, Mycobacterium
KDLPG

SEQ ID NO: 989684 - protein, 10 aa, Mycobacterium
KDLPTADDPR

SEQ ID NO: 989685 - protein, 6 aa, Mycobacterium
KDPELS

SEQ ID NO: 989686 - protein, 13 aa, Mycobacterium
KDPVGHKGARLTT

SEQ ID NO: 989687 - protein, 8 aa, Mycobacterium
KDQTRGGA

SEQ ID NO: 989688 - protein, 9 aa, Mycobacterium
KDRAAELGL

SEQ ID NO: 989689 - protein, 6 aa, Mycobacterium
KDRNTP

SEQ ID NO: 989690 - protein, 6 aa, Mycobacterium
KDRPEL

SEQ ID NO: 989691 - protein, 7 aa, Mycobacterium
KDRRGRS

SEQ ID NO: 989692 - protein, 7 aa, Mycobacterium
KDSITGA

SEQ ID NO: 989693 - protein, 15 aa, Mycobacterium
KDSPDSFDPSEVAGY

SEQ ID NO: 989694 - protein, 9 aa, Mycobacterium
KDSPVTGTE

SEQ ID NO: 989695 - protein, 5 aa, Mycobacterium
KDSRE

SEQ ID NO: 989696 - protein, 8 aa, Mycobacterium
KDSSSGRI

SEQ ID NO: 989697 - protein, 7 aa, Mycobacterium
KDTGAID

SEQ ID NO: 989698 - protein, 8 aa, Mycobacterium
KDTSGDPV

SEQ ID NO: 989699 - protein, 14 aa, Mycobacterium
KDTTTGDTLADPNN

SEQ ID NO: 989700 - protein, 9 aa, Mycobacterium
KDVKSYNDI

SEQ ID NO: 989701 - protein, 5 aa, Mycobacterium
KDVPA

SEQ ID NO: 989702 - protein, 7 aa, Mycobacterium
KDVYDDA

SEQ ID NO: 989703 - protein, 8 aa, Mycobacterium
KEADAGRA

SEQ ID NO: 989704 - protein, 15 aa, Mycobacterium
KEAPTTGYETIGADT

SEQ ID NO: 989705 - protein, 9 aa, Mycobacterium
KECRRPDGS

SEQ ID NO: 989706 - protein, 4 aa, Mycobacterium
KEDF

SEQ ID NO: 989707 - protein, 5 aa, Mycobacterium
KEDRT

SEQ ID NO: 989708 - protein, 4 aa, Mycobacterium
KEES

SEQ ID NO: 989709 - protein, 5 aa, Mycobacterium
KEGFL

SEQ ID NO: 989710 - protein, 5 aa, Mycobacterium
KEGIQ

SEQ ID NO: 989711 - protein, 6 aa, Mycobacterium
KEGNER

SEQ ID NO: 989712 - protein, 10 aa, Mycobacterium
KEHPAKPMSV

SEQ ID NO: 989713 - protein, 8 aa, Mycobacterium
KEHRGSVP

SEQ ID NO: 989714 - protein, 7 aa, Mycobacterium
KEKDEAV

SEQ ID NO: 989715 - protein, 6 aa, Mycobacterium
KELGHE

SEQ ID NO: 989716 - protein, 12 aa, Mycobacterium
KENSQDVAAGQR

SEQ ID NO: 989717 - protein, 7 aa, Mycobacterium
KEPIGSR

SEQ ID NO: 989718 - protein, 8 aa, Mycobacterium
KEPNIASK

SEQ ID NO: 989719 - protein, 17 aa, Mycobacterium
KEQRETENGSRVPEDTL

SEQ ID NO: 989720 - protein, 7 aa, Mycobacterium
KERAGTR

SEQ ID NO: 989721 - protein, 17 aa, Mycobacterium
KERAHAAGAKNVEERPV

SEQ ID NO: 989722 - protein, 17 aa, Mycobacterium
KERREGDVLGRNQSGKA

SEQ ID NO: 989723 - protein, 8 aa, Mycobacterium
KERRGEYL

SEQ ID NO: 989724 - protein, 4 aa, Mycobacterium
KERT

SEQ ID NO: 989725 - protein, 7 aa, Mycobacterium
KESSYAS

SEQ ID NO: 989726 - protein, 11 aa, Mycobacterium
KESYAENASLT

SEQ ID NO: 989727 - protein, 16 aa, Mycobacterium
KETAAGGLALAVNIVE

SEQ ID NO: 989728 - protein, 6 aa, Mycobacterium
KETVQD

SEQ ID NO: 989729 - protein, 4 aa, Mycobacterium
KEYP

SEQ ID NO: 989730 - protein, 6 aa, Mycobacterium
KFAPDF

SEQ ID NO: 989731 - protein, 9 aa, Mycobacterium
KFGDGEPLL

SEQ ID NO: 989732 - protein, 13 aa, Mycobacterium
KFGGDSLGETRRN

SEQ ID NO: 989733 - protein, 6 aa, Mycobacterium
KFGSTG

SEQ ID NO: 989734 - protein, 7 aa, Mycobacterium
KFQGGQA

SEQ ID NO: 989735 - protein, 17 aa, Mycobacterium
KFRDRVAKTSQQVGENG

SEQ ID NO: 989736 - protein, 13 aa, Mycobacterium
KFSNTNPRTSPEY

SEQ ID NO: 989737 - protein, 7 aa, Mycobacterium
KGAAAGQ

SEQ ID NO: 989738 - protein, 12 aa, Mycobacterium
KGAEYPLQPDEL

SEQ ID NO: 989739 - protein, 7 aa, Mycobacterium
KGAGKWP

SEQ ID NO: 989740 - protein, 8 aa, Mycobacterium
KGAKNPVY

SEQ ID NO: 989741 - protein, 8 aa, Mycobacterium
KGAPMPAP

SEQ ID NO: 989742 - protein, 12 aa, Mycobacterium
KGASVGDKTVEQ

SEQ ID NO: 989743 - protein, 8 aa, Mycobacterium
KGDDPRNI

SEQ ID NO: 989744 - protein, 15 aa, Mycobacterium
KGDPTLNATELLKTS

SEQ ID NO: 989745 - protein, 6 aa, Mycobacterium
KGDSVT

SEQ ID NO: 989746 - protein, 13 aa, Mycobacterium
KGELTPADGYAGT

SEQ ID NO: 989747 - protein, 4 aa, Mycobacterium
KGEN

SEQ ID NO: 989748 - protein, 14 aa, Mycobacterium
KGFDASAPFYGTPL

SEQ ID NO: 989749 - protein, 10 aa, Mycobacterium
KGGAGKTTVT

SEQ ID NO: 989750 - protein, 6 aa, Mycobacterium
KGGAMK

SEQ ID NO: 989751 - protein, 8 aa, Mycobacterium
KGGDYLAD

SEQ ID NO: 989752 - protein, 11 aa, Mycobacterium
KGGGGKTTIHH

SEQ ID NO: 989753 - protein, 5 aa, Mycobacterium
KGGLY

SEQ ID NO: 989754 - protein, 11 aa, Mycobacterium
KGGPCSTPELG

SEQ ID NO: 989755 - protein, 7 aa, Mycobacterium
KGGTLNS

SEQ ID NO: 989756 - protein, 8 aa, Mycobacterium
KGGVGTAS

SEQ ID NO: 989757 - protein, 15 aa, Mycobacterium
KGHETGQRGAAETCP

SEQ ID NO: 989758 - protein, 7 aa, Mycobacterium
KGKAQIG

SEQ ID NO: 989759 - protein, 7 aa, Mycobacterium
KGKFTAR

SEQ ID NO: 989760 - protein, 7 aa, Mycobacterium
KGKVGST

SEQ ID NO: 989761 - protein, 7 aa, Mycobacterium
KGLGRKG

SEQ ID NO: 989762 - protein, 13 aa, Mycobacterium
KGLPPIGSGLASG

SEQ ID NO: 989763 - protein, 7 aa, Mycobacterium
KGLTKDT

SEQ ID NO: 989764 - protein, 12 aa, Mycobacterium
KGMTSRDLTENV

SEQ ID NO: 989765 - protein, 13 aa, Mycobacterium
KGNKQRTAPFGVP

SEQ ID NO: 989766 - protein, 7 aa, Mycobacterium
KGPDFPT

SEQ ID NO: 989767 - protein, 8 aa, Mycobacterium
KGPDQQKL

SEQ ID NO: 989768 - protein, 26 aa, Mycobacterium
KGPERSKNQRAEQRRDRYGKPKRGRC

SEQ ID NO: 989769 - protein, 9 aa, Mycobacterium
KGPGATSIP

SEQ ID NO: 989770 - protein, 8 aa, Mycobacterium
KGPKGTLD

SEQ ID NO: 989771 - protein, 8 aa, Mycobacterium
KGPMGTGQ

SEQ ID NO: 989772 - protein, 10 aa, Mycobacterium
KGQYSPTSEM

SEQ ID NO: 989773 - protein, 5 aa, Mycobacterium
KGRDA

SEQ ID NO: 989774 - protein, 11 aa, Mycobacterium
KGRGRADDTDD

SEQ ID NO: 989775 - protein, 23 aa, Mycobacterium
KGRRDKIGKVKTAALKGNPQRRG

SEQ ID NO: 989776 - protein, 5 aa, Mycobacterium
KGSLR

SEQ ID NO: 989777 - protein, 11 aa, Mycobacterium
KGSPESPLSYS

SEQ ID NO: 989778 - protein, 10 aa, Mycobacterium
KGSTSGNTQH

SEQ ID NO: 989779 - protein, 9 aa, Mycobacterium
KGTAGAAVQ

SEQ ID NO: 989780 - protein, 21 aa, Mycobacterium
KGTDFRPANRLPAENVTHWDI

SEQ ID NO: 989781 - protein, 8 aa, Mycobacterium
KGTGNAEL

SEQ ID NO: 989782 - protein, 7 aa, Mycobacterium
KGTPTCP

SEQ ID NO: 989783 - protein, 6 aa, Mycobacterium
KGTRLR

SEQ ID NO: 989784 - protein, 14 aa, Mycobacterium
KGTSETPITSRPTG

SEQ ID NO: 989785 - protein, 12 aa, Mycobacterium
KGVDGDVNKSAT

SEQ ID NO: 989786 - protein, 7 aa, Mycobacterium
KGVEEAR

SEQ ID NO: 989787 - protein, 8 aa, Mycobacterium
KGVNQAGY

SEQ ID NO: 989788 - protein, 11 aa, Mycobacterium
KGYTRGDPYGN

SEQ ID NO: 989789 - protein, 16 aa, Mycobacterium
KHAQPPATKFVSNIPN

SEQ ID NO: 989790 - protein, 34 aa, Mycobacterium
KHDDDYGAADQGTKKTKKGRRASASQGPKPRTGS

SEQ ID NO: 989791 - protein, 5 aa, Mycobacterium
KHDTV

SEQ ID NO: 989792 - protein, 5 aa, Mycobacterium
KHGDR

SEQ ID NO: 989793 - protein, 8 aa, Mycobacterium
KHGQAGPF

SEQ ID NO: 989794 - protein, 7 aa, Mycobacterium
KHGTVSG

SEQ ID NO: 989795 - protein, 14 aa, Mycobacterium
KHGVQPSESVESDQ

SEQ ID NO: 989796 - protein, 8 aa, Mycobacterium
KHIDGQGR

SEQ ID NO: 989797 - protein, 6 aa, Mycobacterium
KHKRPG

SEQ ID NO: 989798 - protein, 5 aa, Mycobacterium
KHNET

SEQ ID NO: 989799 - protein, 9 aa, Mycobacterium
KHNGLSDRQ

SEQ ID NO: 989800 - protein, 8 aa, Mycobacterium
KHSDESNL

SEQ ID NO: 989801 - protein, 5 aa, Mycobacterium
KHWKT

SEQ ID NO: 989802 - protein, 10 aa, Mycobacterium
KIAPSGGGHL

SEQ ID NO: 989803 - protein, 8 aa, Mycobacterium
KIDANPAA

SEQ ID NO: 989804 - protein, 9 aa, Mycobacterium
KIEADPANP

SEQ ID NO: 989805 - protein, 12 aa, Mycobacterium
KIGQPKAGATTA

SEQ ID NO: 989806 - protein, 11 aa, Mycobacterium
KIGRRSPDGRE

SEQ ID NO: 989807 - protein, 6 aa, Mycobacterium
KIGSDD

SEQ ID NO: 989808 - protein, 5 aa, Mycobacterium
KIGSG

SEQ ID NO: 989809 - protein, 12 aa, Mycobacterium
KIGTTGRGIGPC

SEQ ID NO: 989810 - protein, 8 aa, Mycobacterium
KIKDNRDD

SEQ ID NO: 989811 - protein, 12 aa, Mycobacterium
KIKKGPDDQDEP

SEQ ID NO: 989812 - protein, 4 aa, Mycobacterium
KIPE

SEQ ID NO: 989813 - protein, 6 aa, Mycobacterium
KIPGRG

SEQ ID NO: 989814 - protein, 7 aa, Mycobacterium
KIRSTGE

SEQ ID NO: 989815 - protein, 13 aa, Mycobacterium
KISEGEGGEITPT

SEQ ID NO: 989816 - protein, 7 aa, Mycobacterium
KISGNQG

SEQ ID NO: 989817 - protein, 6 aa, Mycobacterium
KISPRE

SEQ ID NO: 989818 - protein, 6 aa, Mycobacterium
KKAAAE

SEQ ID NO: 989819 - protein, 8 aa, Mycobacterium
KKAAAGEI

SEQ ID NO: 989820 - protein, 27 aa, Mycobacterium
KKAAAPARKAPAKKAPAKKAPAKKVTQ

SEQ ID NO: 989821 - protein, 5 aa, Mycobacterium
KKAAG

SEQ ID NO: 989822 - protein, 14 aa, Mycobacterium
KKAEATLRKQFGCQ

SEQ ID NO: 989823 - protein, 9 aa, Mycobacterium
KKAGGPNLD

SEQ ID NO: 989824 - protein, 5 aa, Mycobacterium
KKAMP

SEQ ID NO: 989825 - protein, 14 aa, Mycobacterium
KKAPFSRRPLAGPR

SEQ ID NO: 989826 - protein, 6 aa, Mycobacterium
KKATSY

SEQ ID NO: 989827 - protein, 4 aa, Mycobacterium
KKCE

SEQ ID NO: 989828 - protein, 14 aa, Mycobacterium
KKDRTTKRGDVGNH

SEQ ID NO: 989829 - protein, 4 aa, Mycobacterium
KKEV

SEQ ID NO: 989830 - protein, 16 aa, Mycobacterium
KKGKQAHPNAKTDAMF

SEQ ID NO: 989831 - protein, 23 aa, Mycobacterium
KKGLSTGLGDEGGFAPEVAGTTA

SEQ ID NO: 989832 - protein, 8 aa, Mycobacterium
KKGTLHNR

SEQ ID NO: 989833 - protein, 11 aa, Mycobacterium
KKINKEDGIQR

SEQ ID NO: 989834 - protein, 7 aa, Mycobacterium
KKISDDD

SEQ ID NO: 989835 - protein, 5 aa, Mycobacterium
KKKVR

SEQ ID NO: 989836 - protein, 17 aa, Mycobacterium
KKLHDKRQDMARRDAQR

SEQ ID NO: 989837 - protein, 9 aa, Mycobacterium
KKLRGDARE

SEQ ID NO: 989838 - protein, 4 aa, Mycobacterium
KKLS

SEQ ID NO: 989839 - protein, 12 aa, Mycobacterium
KKLTNMRSSTAN

SEQ ID NO: 989840 - protein, 7 aa, Mycobacterium
KKMEDGL

SEQ ID NO: 989841 - protein, 11 aa, Mycobacterium
KKNRRNDPDRM

SEQ ID NO: 989842 - protein, 4 aa, Mycobacterium
KKNT

SEQ ID NO: 989843 - protein, 26 aa, Mycobacterium
KKPKPRKRGGHTGAATSGDAVTAPMQ

SEQ ID NO: 989844 - protein, 21 aa, Mycobacterium
KKPPQFTTSVQDQNPGARNSA

SEQ ID NO: 989845 - protein, 9 aa, Mycobacterium
KKPVKTGCA

SEQ ID NO: 989846 - protein, 14 aa, Mycobacterium
KKQAQESVAAEATR

SEQ ID NO: 989847 - protein, 6 aa, Mycobacterium
KKRRTV

SEQ ID NO: 989848 - protein, 7 aa, Mycobacterium
KKSHPSG

SEQ ID NO: 989849 - protein, 6 aa, Mycobacterium
KKSLAE

SEQ ID NO: 989850 - protein, 6 aa, Mycobacterium
KKSVGQ

SEQ ID NO: 989851 - protein, 6 aa, Mycobacterium
KKVTES

SEQ ID NO: 989852 - protein, 11 aa, Mycobacterium
KKYKSLARPAL

SEQ ID NO: 989853 - protein, 8 aa, Mycobacterium
KKYTAQEI

SEQ ID NO: 989854 - protein, 11 aa, Mycobacterium
KLAASTGVPED

SEQ ID NO: 989855 - protein, 14 aa, Mycobacterium
KLANPSPGTPEGPW

SEQ ID NO: 989856 - protein, 7 aa, Mycobacterium
KLAPKEP

SEQ ID NO: 989857 - protein, 10 aa, Mycobacterium
KLASGDVNKV

SEQ ID NO: 989858 - protein, 4 aa, Mycobacterium
KLDG

SEQ ID NO: 989859 - protein, 10 aa, Mycobacterium
KLDGDTAAKM

SEQ ID NO: 989860 - protein, 8 aa, Mycobacterium
KLDGISSE

SEQ ID NO: 989861 - protein, 6 aa, Mycobacterium
KLEDGT

SEQ ID NO: 989862 - protein, 12 aa, Mycobacterium
KLGADRDDVDSA

SEQ ID NO: 989863 - protein, 5 aa, Mycobacterium
KLGEG

SEQ ID NO: 989864 - protein, 10 aa, Mycobacterium
KLGRSDQARR

SEQ ID NO: 989865 - protein, 13 aa, Mycobacterium
KLGSDRRQATAAV

SEQ ID NO: 989866 - protein, 16 aa, Mycobacterium
KLKVDSRDGSYLGRVN

SEQ ID NO: 989867 - protein, 4 aa, Mycobacterium
KLPH

SEQ ID NO: 989868 - protein, 6 aa, Mycobacterium
KLPPSI

SEQ ID NO: 989869 - protein, 7 aa, Mycobacterium
KLPQNDR

SEQ ID NO: 989870 - protein, 5 aa, Mycobacterium
KLPSG

SEQ ID NO: 989871 - protein, 7 aa, Mycobacterium
KLPTQST

SEQ ID NO: 989872 - protein, 5 aa, Mycobacterium
KLQSG

SEQ ID NO: 989873 - protein, 16 aa, Mycobacterium
KLRPKIDDHDYETKKS

SEQ ID NO: 989874 - protein, 22 aa, Mycobacterium
KLSKASGAGSEVSPDVTQRDDA

SEQ ID NO: 989875 - protein, 6 aa, Mycobacterium
KLSRQI

SEQ ID NO: 989876 - protein, 6 aa, Mycobacterium
KLSSGD

SEQ ID NO: 989877 - protein, 10 aa, Mycobacterium
KLSSGQDTTQ

SEQ ID NO: 989878 - protein, 21 aa, Mycobacterium
KLSTGGPLEPTTMKWSGNAAK

SEQ ID NO: 989879 - protein, 9 aa, Mycobacterium
KLSTPGRPV

SEQ ID NO: 989880 - protein, 28 aa, Mycobacterium
KLTATTNTEPVQHRQPPQTMPMPKNNST

SEQ ID NO: 989881 - protein, 12 aa, Mycobacterium
KLTESGTSVTSQ

SEQ ID NO: 989882 - protein, 9 aa, Mycobacterium
KLTKDQAEY

SEQ ID NO: 989883 - protein, 16 aa, Mycobacterium
KMAATATKTTTDRRWR

SEQ ID NO: 989884 - protein, 7 aa, Mycobacterium
KMPQRGV

SEQ ID NO: 989885 - protein, 5 aa, Mycobacterium
KMPVS

SEQ ID NO: 989886 - protein, 8 aa, Mycobacterium
KMSAAAEQ

SEQ ID NO: 989887 - protein, 21 aa, Mycobacterium
KMYGADGRAKDTKAVNPESTF

SEQ ID NO: 989888 - protein, 13 aa, Mycobacterium
KNAEQDASNVSAA

SEQ ID NO: 989889 - protein, 6 aa, Mycobacterium
KNAGNP

SEQ ID NO: 989890 - protein, 8 aa, Mycobacterium
KNAKLDNS

SEQ ID NO: 989891 - protein, 9 aa, Mycobacterium
KNDQPTGTF

SEQ ID NO: 989892 - protein, 6 aa, Mycobacterium
KNEYPG

SEQ ID NO: 989893 - protein, 8 aa, Mycobacterium
KNFGHSDD

SEQ ID NO: 989894 - protein, 11 aa, Mycobacterium
KNFSDAERSRL

SEQ ID NO: 989895 - protein, 7 aa, Mycobacterium
KNGLTED

SEQ ID NO: 989896 - protein, 9 aa, Mycobacterium
KNHHSAGSF

SEQ ID NO: 989897 - protein, 7 aa, Mycobacterium
KNKGVQP

SEQ ID NO: 989898 - protein, 6 aa, Mycobacterium
KNLDAS

SEQ ID NO: 989899 - protein, 12 aa, Mycobacterium
KNLKDTAASEGL

SEQ ID NO: 989900 - protein, 4 aa, Mycobacterium
KNNE

SEQ ID NO: 989901 - protein, 12 aa, Mycobacterium
KNPSSTNESNSV

SEQ ID NO: 989902 - protein, 6 aa, Mycobacterium
KNQHAR

SEQ ID NO: 989903 - protein, 8 aa, Mycobacterium
KNQNTYRR

SEQ ID NO: 989904 - protein, 10 aa, Mycobacterium
KNQSGSAAVN

SEQ ID NO: 989905 - protein, 19 aa, Mycobacterium
KNQTAQTQKSFDQMNSPHS

SEQ ID NO: 989906 - protein, 7 aa, Mycobacterium
KNQVSRL

SEQ ID NO: 989907 - protein, 5 aa, Mycobacterium
KNRNN

SEQ ID NO: 989908 - protein, 13 aa, Mycobacterium
KNRRSHRSSGAAA

SEQ ID NO: 989909 - protein, 7 aa, Mycobacterium
KNRSATL

SEQ ID NO: 989910 - protein, 10 aa, Mycobacterium
KNSTIGTGAK

SEQ ID NO: 989911 - protein, 14 aa, Mycobacterium
KNTGSITKVYMQAT

SEQ ID NO: 989912 - protein, 19 aa, Mycobacterium
KNTRACPATLGEQKSDEFH

SEQ ID NO: 989913 - protein, 8 aa, Mycobacterium
KNTRRTPC

SEQ ID NO: 989914 - protein, 4 aa, Mycobacterium
KNTS

SEQ ID NO: 989915 - protein, 9 aa, Mycobacterium
KNYDGSWTE

SEQ ID NO: 989916 - protein, 7 aa, Mycobacterium
KNYGKGS

SEQ ID NO: 989917 - protein, 12 aa, Mycobacterium
KPAGIKVQTSDI

SEQ ID NO: 989918 - protein, 6 aa, Mycobacterium
KPALRA

SEQ ID NO: 989919 - protein, 8 aa, Mycobacterium
KPAQPGSY

SEQ ID NO: 989920 - protein, 6 aa, Mycobacterium
KPARVT

SEQ ID NO: 989921 - protein, 10 aa, Mycobacterium
KPATETPLTA

SEQ ID NO: 989922 - protein, 8 aa, Mycobacterium
KPDENHEG

SEQ ID NO: 989923 - protein, 14 aa, Mycobacterium
KPDLQNTLMAVPRS

SEQ ID NO: 989924 - protein, 14 aa, Mycobacterium
KPDTTQRKSRIRSG

SEQ ID NO: 989925 - protein, 11 aa, Mycobacterium
KPEDAQRRELG

SEQ ID NO: 989926 - protein, 10 aa, Mycobacterium
KPEETQRTFG

SEQ ID NO: 989927 - protein, 7 aa, Mycobacterium
KPEPLGG

SEQ ID NO: 989928 - protein, 8 aa, Mycobacterium
KPEQTART

SEQ ID NO: 989929 - protein, 7 aa, Mycobacterium
KPERRRG

SEQ ID NO: 989930 - protein, 13 aa, Mycobacterium
KPFAASAPRIGAP

SEQ ID NO: 989931 - protein, 25 aa, Mycobacterium
KPFKKEAAMDNARDATSIYGGCGLM

SEQ ID NO: 989932 - protein, 6 aa, Mycobacterium
KPGDLQ

SEQ ID NO: 989933 - protein, 5 aa, Mycobacterium
KPGTQ

SEQ ID NO: 989934 - protein, 11 aa, Mycobacterium
KPGVRNYDGSW

SEQ ID NO: 989935 - protein, 5 aa, Mycobacterium
KPHGF

SEQ ID NO: 989936 - protein, 28 aa, Mycobacterium
KPHRESTDNPLGGNPATMTQTEQDDTEK

SEQ ID NO: 989937 - protein, 7 aa, Mycobacterium
KPIADPV

SEQ ID NO: 989938 - protein, 8 aa, Mycobacterium
KPIDNQTL

SEQ ID NO: 989939 - protein, 13 aa, Mycobacterium
KPISGIPAGCTDT

SEQ ID NO: 989940 - protein, 13 aa, Mycobacterium
KPKAEDAPSTFAA

SEQ ID NO: 989941 - protein, 8 aa, Mycobacterium
KPKDKLPL

SEQ ID NO: 989942 - protein, 16 aa, Mycobacterium
KPLGGPDGGNGGRGGS

SEQ ID NO: 989943 - protein, 16 aa, Mycobacterium
KPLKPPGTPDDPDKTF

SEQ ID NO: 989944 - protein, 6 aa, Mycobacterium
KPLPSD

SEQ ID NO: 989945 - protein, 6 aa, Mycobacterium
KPLRGM

SEQ ID NO: 989946 - protein, 9 aa, Mycobacterium
KPLSAAERR

SEQ ID NO: 989947 - protein, 8 aa, Mycobacterium
KPMSPTAG

SEQ ID NO: 989948 - protein, 5 aa, Mycobacterium
KPNQA

SEQ ID NO: 989949 - protein, 13 aa, Mycobacterium
KPNTLGNSRMLLV

SEQ ID NO: 989950 - protein, 6 aa, Mycobacterium
KPPMEP

SEQ ID NO: 989951 - protein, 12 aa, Mycobacterium
KPPSFEELEPRT

SEQ ID NO: 989952 - protein, 11 aa, Mycobacterium
KPQARTLATDR

SEQ ID NO: 989953 - protein, 5 aa, Mycobacterium
KPQVV

SEQ ID NO: 989954 - protein, 5 aa, Mycobacterium
KPRHV

SEQ ID NO: 989955 - protein, 8 aa, Mycobacterium
KPRQGALA

SEQ ID NO: 989956 - protein, 5 aa, Mycobacterium
KPRQV

SEQ ID NO: 989957 - protein, 10 aa, Mycobacterium
KPSHSQNAAA

SEQ ID NO: 989958 - protein, 9 aa, Mycobacterium
KPSSSKGRY

SEQ ID NO: 989959 - protein, 28 aa, Mycobacterium
KPSTRTRRLDGHTRVSANDTQRVNSLLN

SEQ ID NO: 989960 - protein, 7 aa, Mycobacterium
KPSYGHG

SEQ ID NO: 989961 - protein, 8 aa, Mycobacterium
KPTDIQQA

SEQ ID NO: 989962 - protein, 4 aa, Mycobacterium
KPTG

SEQ ID NO: 989963 - protein, 5 aa, Mycobacterium
KPTME

SEQ ID NO: 989964 - protein, 5 aa, Mycobacterium
KPTSD

SEQ ID NO: 989965 - protein, 14 aa, Mycobacterium
KPTSSLDPTMTEKI

SEQ ID NO: 989966 - protein, 9 aa, Mycobacterium
KPWRERTTG

SEQ ID NO: 989967 - protein, 6 aa, Mycobacterium
KQAAND

SEQ ID NO: 989968 - protein, 10 aa, Mycobacterium
KQAEEATDQV

SEQ ID NO: 989969 - protein, 6 aa, Mycobacterium
KQAPVA

SEQ ID NO: 989970 - protein, 11 aa, Mycobacterium
KQARDTQRSRR

SEQ ID NO: 989971 - protein, 8 aa, Mycobacterium
KQAVTPAD

SEQ ID NO: 989972 - protein, 8 aa, Mycobacterium
KQEFPSSE

SEQ ID NO: 989973 - protein, 15 aa, Mycobacterium
KQFPPGWRSSQHHAA

SEQ ID NO: 989974 - protein, 22 aa, Mycobacterium
KQGAQNKPHSVATPAADPHNCG

SEQ ID NO: 989975 - protein, 23 aa, Mycobacterium
KQGIDNRNAKKITKAHPRREVQG

SEQ ID NO: 989976 - protein, 7 aa, Mycobacterium
KQGRSVP

SEQ ID NO: 989977 - protein, 6 aa, Mycobacterium
KQGTDL

SEQ ID NO: 989978 - protein, 12 aa, Mycobacterium
KQHSESRNIWLI

SEQ ID NO: 989979 - protein, 15 aa, Mycobacterium
KQINNERGCADGYVC

SEQ ID NO: 989980 - protein, 6 aa, Mycobacterium
KQKARF

SEQ ID NO: 989981 - protein, 8 aa, Mycobacterium
KQKVGQIS

SEQ ID NO: 989982 - protein, 10 aa, Mycobacterium
KQMGSALTDG

SEQ ID NO: 989983 - protein, 20 aa, Mycobacterium
KQMNIGSEGKAETGRFHITC

SEQ ID NO: 989984 - protein, 7 aa, Mycobacterium
KQNPEAA

SEQ ID NO: 989985 - protein, 6 aa, Mycobacterium
KQPAYT

SEQ ID NO: 989986 - protein, 9 aa, Mycobacterium
KQPEDGTQH

SEQ ID NO: 989987 - protein, 6 aa, Mycobacterium
KQRGHR

SEQ ID NO: 989988 - protein, 9 aa, Mycobacterium
KQRLTDSVE

SEQ ID NO: 989989 - protein, 21 aa, Mycobacterium
KQRNSKAADAAIGDLTTDPDL

SEQ ID NO: 989990 - protein, 21 aa, Mycobacterium
KQRTPKAAFDYTDGAAEDELS

SEQ ID NO: 989991 - protein, 12 aa, Mycobacterium
KQTSSQVSSGSL

SEQ ID NO: 989992 - protein, 11 aa, Mycobacterium
KQTYGSPRITT

SEQ ID NO: 989993 - protein, 7 aa, Mycobacterium
KQVPSAV

SEQ ID NO: 989994 - protein, 4 aa, Mycobacterium
KQYK

SEQ ID NO: 989995 - protein, 7 aa, Mycobacterium
KRANADQ

SEQ ID NO: 989996 - protein, 9 aa, Mycobacterium
KRASPSVGS

SEQ ID NO: 989997 - protein, 9 aa, Mycobacterium
KRDGRPQLS

SEQ ID NO: 989998 - protein, 6 aa, Mycobacterium
KRDSEW

SEQ ID NO: 989999 - protein, 6 aa, Mycobacterium
KRDTVG

SEQ ID NO: 990000 - protein, 15 aa, Mycobacterium
KREYEASLNRAQSEC

SEQ ID NO: 990001 - protein, 10 aa, Mycobacterium
KRFGEGRKRA

SEQ ID NO: 990002 - protein, 11 aa, Mycobacterium
KRFRRTGTGKI

SEQ ID NO: 990003 - protein, 11 aa, Mycobacterium
KRFSDQRTRAV

SEQ ID NO: 990004 - protein, 10 aa, Mycobacterium
KRGDSDAEAM

SEQ ID NO: 990005 - protein, 35 aa, Mycobacterium
KRGEALAPGSPESLAAEADRNKETERKARHERSKR

SEQ ID NO: 990006 - protein, 9 aa, Mycobacterium
KRGEGAEFD

SEQ ID NO: 990007 - protein, 10 aa, Mycobacterium
KRGEPEGDQV

SEQ ID NO: 990008 - protein, 8 aa, Mycobacterium
KRGGGPSL

SEQ ID NO: 990009 - protein, 12 aa, Mycobacterium
KRGKDSRPLTTE

SEQ ID NO: 990010 - protein, 7 aa, Mycobacterium
KRGLDTK

SEQ ID NO: 990011 - protein, 5 aa, Mycobacterium
KRGRE

SEQ ID NO: 990012 - protein, 16 aa, Mycobacterium
KRGRKTVNIVAVGLTA

SEQ ID NO: 990013 - protein, 7 aa, Mycobacterium
KRGSAKR

SEQ ID NO: 990014 - protein, 10 aa, Mycobacterium
KRKDREMPQG

SEQ ID NO: 990015 - protein, 5 aa, Mycobacterium
KRKGK

SEQ ID NO: 990016 - protein, 7 aa, Mycobacterium
KRKTRKA

SEQ ID NO: 990017 - protein, 14 aa, Mycobacterium
KRLPPADLTTAQVR

SEQ ID NO: 990018 - protein, 4 aa, Mycobacterium
KRLQ

SEQ ID NO: 990019 - protein, 16 aa, Mycobacterium
KRLTQGMQTPHPESGK

SEQ ID NO: 990020 - protein, 8 aa, Mycobacterium
KRNRGGKI

SEQ ID NO: 990021 - protein, 4 aa, Mycobacterium
KRPF

SEQ ID NO: 990022 - protein, 8 aa, Mycobacterium
KRPQVQER

SEQ ID NO: 990023 - protein, 13 aa, Mycobacterium
KRPRGRPCNDVVV

SEQ ID NO: 990024 - protein, 5 aa, Mycobacterium
KRQPM

SEQ ID NO: 990025 - protein, 7 aa, Mycobacterium
KRQTDRR

SEQ ID NO: 990026 - protein, 5 aa, Mycobacterium
KRRDE

SEQ ID NO: 990027 - protein, 7 aa, Mycobacterium
KRRPPGQ

SEQ ID NO: 990028 - protein, 5 aa, Mycobacterium
KRRSG

SEQ ID NO: 990029 - protein, 6 aa, Mycobacterium
KRSGNV

SEQ ID NO: 990030 - protein, 10 aa, Mycobacterium
KRSGYGRELS

SEQ ID NO: 990031 - protein, 5 aa, Mycobacterium
KRSRH

SEQ ID NO: 990032 - protein, 13 aa, Mycobacterium
KRSSPARPVSPKS

SEQ ID NO: 990033 - protein, 12 aa, Mycobacterium
KRSTVSAARNIP

SEQ ID NO: 990034 - protein, 14 aa, Mycobacterium
KRTAQKVTNELNER

SEQ ID NO: 990035 - protein, 11 aa, Mycobacterium
KRTSRSELESV

SEQ ID NO: 990036 - protein, 16 aa, Mycobacterium
KRVGEGDTGPNTGGMG

SEQ ID NO: 990037 - protein, 6 aa, Mycobacterium
KRVPGS

SEQ ID NO: 990038 - protein, 17 aa, Mycobacterium
KRWTPTWGEDQRAAAYA

SEQ ID NO: 990039 - protein, 7 aa, Mycobacterium
KRYDTPW

SEQ ID NO: 990040 - protein, 8 aa, Mycobacterium
KRYGKRKV

SEQ ID NO: 990041 - protein, 6 aa, Mycobacterium
KRYQDQ

SEQ ID NO: 990042 - protein, 9 aa, Mycobacterium
KSAAAAAQV

SEQ ID NO: 990043 - protein, 10 aa, Mycobacterium
KSAEALSAQA

SEQ ID NO: 990044 - protein, 9 aa, Mycobacterium
KSAPTVAGL

SEQ ID NO: 990045 - protein, 11 aa, Mycobacterium
KSAQTQVEQQN

SEQ ID NO: 990046 - protein, 5 aa, Mycobacterium
KSASF

SEQ ID NO: 990047 - protein, 12 aa, Mycobacterium
KSDDPGDTGEEQ

SEQ ID NO: 990048 - protein, 7 aa, Mycobacterium
KSDSIEP

SEQ ID NO: 990049 - protein, 10 aa, Mycobacterium
KSDSPSTIAV

SEQ ID NO: 990050 - protein, 13 aa, Mycobacterium
KSEIATQLNRNDD

SEQ ID NO: 990051 - protein, 17 aa, Mycobacterium
KSFSSDADGYTRSEGGG

SEQ ID NO: 990052 - protein, 6 aa, Mycobacterium
KSFTGE

SEQ ID NO: 990053 - protein, 6 aa, Mycobacterium
KSGADY

SEQ ID NO: 990054 - protein, 6 aa, Mycobacterium
KSGARL

SEQ ID NO: 990055 - protein, 9 aa, Mycobacterium
KSGARSADM

SEQ ID NO: 990056 - protein, 10 aa, Mycobacterium
KSGEGGEESA

SEQ ID NO: 990057 - protein, 8 aa, Mycobacterium
KSGEGRYV

SEQ ID NO: 990058 - protein, 11 aa, Mycobacterium
KSGENHAQDDV

SEQ ID NO: 990059 - protein, 7 aa, Mycobacterium
KSGNADM

SEQ ID NO: 990060 - protein, 6 aa, Mycobacterium
KSGNEL

SEQ ID NO: 990061 - protein, 11 aa, Mycobacterium
KSGRFRSSEEL

SEQ ID NO: 990062 - protein, 10 aa, Mycobacterium
KSGSALGAQA

SEQ ID NO: 990063 - protein, 6 aa, Mycobacterium
KSHAAG

SEQ ID NO: 990064 - protein, 5 aa, Mycobacterium
KSHGL

SEQ ID NO: 990065 - protein, 19 aa, Mycobacterium
KSHPAGDGGKALNPTGGAV

SEQ ID NO: 990066 - protein, 7 aa, Mycobacterium
KSHPGPV

SEQ ID NO: 990067 - protein, 8 aa, Mycobacterium
KSHPSGGD

SEQ ID NO: 990068 - protein, 10 aa, Mycobacterium
KSKAHKSRYV

SEQ ID NO: 990069 - protein, 11 aa, Mycobacterium
KSKDEVSEDEY

SEQ ID NO: 990070 - protein, 4 aa, Mycobacterium
KSLA

SEQ ID NO: 990071 - protein, 6 aa, Mycobacterium
KSLRSR

SEQ ID NO: 990072 - protein, 9 aa, Mycobacterium
KSMENRGSP

SEQ ID NO: 990073 - protein, 12 aa, Mycobacterium
KSMPYKSGFGPF

SEQ ID NO: 990074 - protein, 10 aa, Mycobacterium
KSNEDARARL

SEQ ID NO: 990075 - protein, 7 aa, Mycobacterium
KSNIATG

SEQ ID NO: 990076 - protein, 7 aa, Mycobacterium
KSNKEFG

SEQ ID NO: 990077 - protein, 15 aa, Mycobacterium
KSPGEIADNRAQRET

SEQ ID NO: 990078 - protein, 10 aa, Mycobacterium
KSQAALTQQA

SEQ ID NO: 990079 - protein, 6 aa, Mycobacterium
KSQDHS

SEQ ID NO: 990080 - protein, 17 aa, Mycobacterium
KSQSPGGFQDPNAESVR

SEQ ID NO: 990081 - protein, 14 aa, Mycobacterium
KSQTAAYGSLPTQG

SEQ ID NO: 990082 - protein, 8 aa, Mycobacterium
KSRGFPAK

SEQ ID NO: 990083 - protein, 6 aa, Mycobacterium
KSRSAV

SEQ ID NO: 990084 - protein, 8 aa, Mycobacterium
KSRTRGYA

SEQ ID NO: 990085 - protein, 20 aa, Mycobacterium
KSRVQGADLTQMTDKTAPRV

SEQ ID NO: 990086 - protein, 10 aa, Mycobacterium
KSSDPAQRAA

SEQ ID NO: 990087 - protein, 7 aa, Mycobacterium
KSSSETL

SEQ ID NO: 990088 - protein, 7 aa, Mycobacterium
KSTPDGL

SEQ ID NO: 990089 - protein, 12 aa, Mycobacterium
KSTQNRAGIEQT

SEQ ID NO: 990090 - protein, 5 aa, Mycobacterium
KSVAG

SEQ ID NO: 990091 - protein, 10 aa, Mycobacterium
KSVDPDTKSV

SEQ ID NO: 990092 - protein, 15 aa, Mycobacterium
KSVTTFGPYSPGQAV

SEQ ID NO: 990093 - protein, 6 aa, Mycobacterium
KSVVTA

SEQ ID NO: 990094 - protein, 12 aa, Mycobacterium
KSWDNGLGNSLS

SEQ ID NO: 990095 - protein, 6 aa, Mycobacterium
KSYGGA

SEQ ID NO: 990096 - protein, 10 aa, Mycobacterium
KSYGTQGTEC

SEQ ID NO: 990097 - protein, 5 aa, Mycobacterium
KSYLP

SEQ ID NO: 990098 - protein, 7 aa, Mycobacterium
KSYQPTI

SEQ ID NO: 990099 - protein, 9 aa, Mycobacterium
KTAAALKNS

SEQ ID NO: 990100 - protein, 12 aa, Mycobacterium
KTAEAFAQDPDA

SEQ ID NO: 990101 - protein, 5 aa, Mycobacterium
KTAID

SEQ ID NO: 990102 - protein, 7 aa, Mycobacterium
KTANKYS

SEQ ID NO: 990103 - protein, 7 aa, Mycobacterium
KTATGLS

SEQ ID NO: 990104 - protein, 4 aa, Mycobacterium
KTAV

SEQ ID NO: 990105 - protein, 8 aa, Mycobacterium
KTDRPDAR

SEQ ID NO: 990106 - protein, 5 aa, Mycobacterium
KTDTV

SEQ ID NO: 990107 - protein, 9 aa, Mycobacterium
KTEADGESR

SEQ ID NO: 990108 - protein, 9 aa, Mycobacterium
KTFDSGDPK

SEQ ID NO: 990109 - protein, 10 aa, Mycobacterium
KTFGISGDAS

SEQ ID NO: 990110 - protein, 7 aa, Mycobacterium
KTFTAPA

SEQ ID NO: 990111 - protein, 15 aa, Mycobacterium
KTGEANGPLTNSRTG

SEQ ID NO: 990112 - protein, 11 aa, Mycobacterium
KTGKAPPAAQA

SEQ ID NO: 990113 - protein, 5 aa, Mycobacterium
KTGPY

SEQ ID NO: 990114 - protein, 7 aa, Mycobacterium
KTGSLTA

SEQ ID NO: 990115 - protein, 4 aa, Mycobacterium
KTHG

SEQ ID NO: 990116 - protein, 6 aa, Mycobacterium
KTIDND

SEQ ID NO: 990117 - protein, 18 aa, Mycobacterium
KTIGGNGRHALARWFGHV

SEQ ID NO: 990118 - protein, 13 aa, Mycobacterium
KTIQTKEKAAGAA

SEQ ID NO: 990119 - protein, 5 aa, Mycobacterium
KTKLG

SEQ ID NO: 990120 - protein, 4 aa, Mycobacterium
KTKP

SEQ ID NO: 990121 - protein, 5 aa, Mycobacterium
KTKTN

SEQ ID NO: 990122 - protein, 8 aa, Mycobacterium
KTLGESAG

SEQ ID NO: 990123 - protein, 12 aa, Mycobacterium
KTLNDHDSVGKN

SEQ ID NO: 990124 - protein, 5 aa, Mycobacterium
KTLPG

SEQ ID NO: 990125 - protein, 9 aa, Mycobacterium
KTNTPRNFA

SEQ ID NO: 990126 - protein, 7 aa, Mycobacterium
KTPARVA

SEQ ID NO: 990127 - protein, 6 aa, Mycobacterium
KTPPAA

SEQ ID NO: 990128 - protein, 14 aa, Mycobacterium
KTPPSTPVLWMGGG

SEQ ID NO: 990129 - protein, 5 aa, Mycobacterium
KTPPT

SEQ ID NO: 990130 - protein, 10 aa, Mycobacterium
KTPSTKSAKE

SEQ ID NO: 990131 - protein, 10 aa, Mycobacterium
KTQDPPTDQI

SEQ ID NO: 990132 - protein, 14 aa, Mycobacterium
KTRAITDGKPLHAE

SEQ ID NO: 990133 - protein, 37 aa, Mycobacterium
KTRINATAKRHSRCQKGRTDREQQKSPSTSIHQTVTP

SEQ ID NO: 990134 - protein, 7 aa, Mycobacterium
KTRKSEG

SEQ ID NO: 990135 - protein, 8 aa, Mycobacterium
KTRRPSVC

SEQ ID NO: 990136 - protein, 10 aa, Mycobacterium
KTRSVDEVSA

SEQ ID NO: 990137 - protein, 6 aa, Mycobacterium
KTSCPR

SEQ ID NO: 990138 - protein, 15 aa, Mycobacterium
KTSGPALPALLGRSP

SEQ ID NO: 990139 - protein, 8 aa, Mycobacterium
KTSRAGEC

SEQ ID NO: 990140 - protein, 13 aa, Mycobacterium
KTTDQLPGPGRQL

SEQ ID NO: 990141 - protein, 5 aa, Mycobacterium
KTTFG

SEQ ID NO: 990142 - protein, 5 aa, Mycobacterium
KTTHE

SEQ ID NO: 990143 - protein, 21 aa, Mycobacterium
KTTMTEQPTGPTKTRTRSEDI

SEQ ID NO: 990144 - protein, 5 aa, Mycobacterium
KTTPY

SEQ ID NO: 990145 - protein, 11 aa, Mycobacterium
KTTSNSPSDDL

SEQ ID NO: 990146 - protein, 6 aa, Mycobacterium
KTVQRV

SEQ ID NO: 990147 - protein, 11 aa, Mycobacterium
KTVRPKTLNQK

SEQ ID NO: 990148 - protein, 51 aa, Mycobacterium
KTVTSEADRARRVAAASAKAAQAQEKPAQEEEVEATSDEVAYTSEPDKAAE

SEQ ID NO: 990149 - protein, 5 aa, Mycobacterium
KTWQR

SEQ ID NO: 990150 - protein, 14 aa, Mycobacterium
KTYEDPDKGFQESD

SEQ ID NO: 990151 - protein, 6 aa, Mycobacterium
KTYGKG

SEQ ID NO: 990152 - protein, 6 aa, Mycobacterium
KTYNAG

SEQ ID NO: 990153 - protein, 6 aa, Mycobacterium
KTYPLT

SEQ ID NO: 990154 - protein, 5 aa, Mycobacterium
KVADE

SEQ ID NO: 990155 - protein, 7 aa, Mycobacterium
KVADNGD

SEQ ID NO: 990156 - protein, 14 aa, Mycobacterium
KVAEPGQNLADDVD

SEQ ID NO: 990157 - protein, 5 aa, Mycobacterium
KVARL

SEQ ID NO: 990158 - protein, 6 aa, Mycobacterium
KVATTQ

SEQ ID NO: 990159 - protein, 10 aa, Mycobacterium
KVDAQQPGDY

SEQ ID NO: 990160 - protein, 13 aa, Mycobacterium
KVDGEKGESDASA

SEQ ID NO: 990161 - protein, 4 aa, Mycobacterium
KVDI

SEQ ID NO: 990162 - protein, 8 aa, Mycobacterium
KVEDGKTD

SEQ ID NO: 990163 - protein, 13 aa, Mycobacterium
KVEGGNTAPGGID

SEQ ID NO: 990164 - protein, 10 aa, Mycobacterium
KVESISDNGS

SEQ ID NO: 990165 - protein, 15 aa, Mycobacterium
KVGETRSYTVPNGNT

SEQ ID NO: 990166 - protein, 6 aa, Mycobacterium
KVGNEG

SEQ ID NO: 990167 - protein, 7 aa, Mycobacterium
KVGYPKK

SEQ ID NO: 990168 - protein, 12 aa, Mycobacterium
KVKEEAGQEAAE

SEQ ID NO: 990169 - protein, 52 aa, Mycobacterium
KVNKASRSGGGGGGFGSGSRQAPAQMSGGVGDDPWGSAPTSGSFGVGDEEPP

SEQ ID NO: 990170 - protein, 16 aa, Mycobacterium
KVPARLSGVEDSDLAT

SEQ ID NO: 990171 - protein, 9 aa, Mycobacterium
KVPHGESGK

SEQ ID NO: 990172 - protein, 7 aa, Mycobacterium
KVPKDRL

SEQ ID NO: 990173 - protein, 6 aa, Mycobacterium
KVPSTA

SEQ ID NO: 990174 - protein, 8 aa, Mycobacterium
KVPVQDGE

SEQ ID NO: 990175 - protein, 8 aa, Mycobacterium
KVQPQGKK

SEQ ID NO: 990176 - protein, 9 aa, Mycobacterium
KVRQRSRTT

SEQ ID NO: 990177 - protein, 7 aa, Mycobacterium
KVSDTYG

SEQ ID NO: 990178 - protein, 7 aa, Mycobacterium
KVSEDKR

SEQ ID NO: 990179 - protein, 8 aa, Mycobacterium
KVSPPFKQ

SEQ ID NO: 990180 - protein, 8 aa, Mycobacterium
KVTSDELG

SEQ ID NO: 990181 - protein, 6 aa, Mycobacterium
KVTYDN

SEQ ID NO: 990182 - protein, 10 aa, Mycobacterium
KWPPGFPEDK

SEQ ID NO: 990183 - protein, 11 aa, Mycobacterium
KWSPDSGETIG

SEQ ID NO: 990184 - protein, 23 aa, Mycobacterium
KYAKDKKLLKDKDPNLTGDDIRE

SEQ ID NO: 990185 - protein, 15 aa, Mycobacterium
KYDPPIGPDGQHGPD

SEQ ID NO: 990186 - protein, 6 aa, Mycobacterium
KYFSSQ

SEQ ID NO: 990187 - protein, 6 aa, Mycobacterium
KYGDTE

SEQ ID NO: 990188 - protein, 4 aa, Mycobacterium
KYGE

SEQ ID NO: 990189 - protein, 4 aa, Mycobacterium
KYPE

SEQ ID NO: 990190 - protein, 16 aa, Mycobacterium
KYPESGAIQLLDKGFF

SEQ ID NO: 990191 - protein, 9 aa, Mycobacterium
KYPHPPGAS

SEQ ID NO: 990192 - protein, 12 aa, Mycobacterium
KYQRGQRVAYTL

SEQ ID NO: 990193 - protein, 6 aa, Mycobacterium
KYRGEF

SEQ ID NO: 990194 - protein, 15 aa, Mycobacterium
KYRRRSSAISRVYGA

SEQ ID NO: 990195 - protein, 5 aa, Mycobacterium
KYSAS

SEQ ID NO: 990196 - protein, 6 aa, Mycobacterium
KYTEDE

SEQ ID NO: 990197 - protein, 6 aa, Mycobacterium
LAAAGA

SEQ ID NO: 990198 - protein, 5 aa, Mycobacterium
LAAAS

SEQ ID NO: 990199 - protein, 8 aa, Mycobacterium
LAADPAAR

SEQ ID NO: 990200 - protein, 20 aa, Mycobacterium
LAADPDVAEKIRGGKVAAAG

SEQ ID NO: 990201 - protein, 13 aa, Mycobacterium
LAAEPGGKDYGVP

SEQ ID NO: 990202 - protein, 22 aa, Mycobacterium
LAAERGVSAEITTGSESPNHRS

SEQ ID NO: 990203 - protein, 4 aa, Mycobacterium
LAAG

SEQ ID NO: 990204 - protein, 8 aa, Mycobacterium
LAAGASTT

SEQ ID NO: 990205 - protein, 6 aa, Mycobacterium
LAAGEQ

SEQ ID NO: 990206 - protein, 5 aa, Mycobacterium
LAAGR

SEQ ID NO: 990207 - protein, 6 aa, Mycobacterium
LAAGRQ

SEQ ID NO: 990208 - protein, 17 aa, Mycobacterium
LAAPGEQLSRAPTANHG

SEQ ID NO: 990209 - protein, 6 aa, Mycobacterium
LAATGR

SEQ ID NO: 990210 - protein, 7 aa, Mycobacterium
LAATGTN

SEQ ID NO: 990211 - protein, 11 aa, Mycobacterium
LADEKNPESLD

SEQ ID NO: 990212 - protein, 4 aa, Mycobacterium
LADG

SEQ ID NO: 990213 - protein, 7 aa, Mycobacterium
LADGLTH

SEQ ID NO: 990214 - protein, 11 aa, Mycobacterium
LADGSEYRGRY

SEQ ID NO: 990215 - protein, 10 aa, Mycobacterium
LADGSTEKIG

SEQ ID NO: 990216 - protein, 8 aa, Mycobacterium
LADGTEVG

SEQ ID NO: 990217 - protein, 13 aa, Mycobacterium
LADPDALLRQWLR

SEQ ID NO: 990218 - protein, 7 aa, Mycobacterium
LADPEHA

SEQ ID NO: 990219 - protein, 19 aa, Mycobacterium
LADQITRKPVNPSENSASD

SEQ ID NO: 990220 - protein, 8 aa, Mycobacterium
LADQKERL

SEQ ID NO: 990221 - protein, 15 aa, Mycobacterium
LADQSSDEAVWPRMT

SEQ ID NO: 990222 - protein, 9 aa, Mycobacterium
LADTGLPAE

SEQ ID NO: 990223 - protein, 18 aa, Mycobacterium
LADTPEKGRKRSVQKGSA

SEQ ID NO: 990224 - protein, 12 aa, Mycobacterium
LAEANVSTPSVN

SEQ ID NO: 990225 - protein, 5 aa, Mycobacterium
LAEDE

SEQ ID NO: 990226 - protein, 7 aa, Mycobacterium
LAEDEDV

SEQ ID NO: 990227 - protein, 18 aa, Mycobacterium
LAEEEGVAAPAAMVSPET

SEQ ID NO: 990228 - protein, 6 aa, Mycobacterium
LAERAD

SEQ ID NO: 990229 - protein, 9 aa, Mycobacterium
LAERRSEPW

SEQ ID NO: 990230 - protein, 16 aa, Mycobacterium
LAGAADGIAEIASQHE

SEQ ID NO: 990231 - protein, 7 aa, Mycobacterium
LAGEGAM

SEQ ID NO: 990232 - protein, 6 aa, Mycobacterium
LAGETG

SEQ ID NO: 990233 - protein, 13 aa, Mycobacterium
LAGGEADDAERRL

SEQ ID NO: 990234 - protein, 34 aa, Mycobacterium
LAGGGGPPGPGTTLTGTSRGISGGFNDGGPASGS

SEQ ID NO: 990235 - protein, 9 aa, Mycobacterium
LAGGPTARK

SEQ ID NO: 990236 - protein, 9 aa, Mycobacterium
LAGGRREQP

SEQ ID NO: 990237 - protein, 12 aa, Mycobacterium
LAGLSTDLTNRL

SEQ ID NO: 990238 - protein, 8 aa, Mycobacterium
LAGQGSRL

SEQ ID NO: 990239 - protein, 7 aa, Mycobacterium
LAGRDPH

SEQ ID NO: 990240 - protein, 7 aa, Mycobacterium
LAGSGGM

SEQ ID NO: 990241 - protein, 13 aa, Mycobacterium
LAKETSSTRQDAT

SEQ ID NO: 990242 - protein, 8 aa, Mycobacterium
LAKGGTSF

SEQ ID NO: 990243 - protein, 8 aa, Mycobacterium
LAKGYRNP

SEQ ID NO: 990244 - protein, 4 aa, Mycobacterium
LAKH

SEQ ID NO: 990245 - protein, 8 aa, Mycobacterium
LAKPTSNL

SEQ ID NO: 990246 - protein, 16 aa, Mycobacterium
LAKSGYGCYLSELLER

SEQ ID NO: 990247 - protein, 5 aa, Mycobacterium
LAKSK

SEQ ID NO: 990248 - protein, 9 aa, Mycobacterium
LANADYGSA

SEQ ID NO: 990249 - protein, 6 aa, Mycobacterium
LANAGS

SEQ ID NO: 990250 - protein, 9 aa, Mycobacterium
LANGATAEE

SEQ ID NO: 990251 - protein, 11 aa, Mycobacterium
LANSGSADRAA

SEQ ID NO: 990252 - protein, 6 aa, Mycobacterium
LANTER

SEQ ID NO: 990253 - protein, 9 aa, Mycobacterium
LAPAGRGLT

SEQ ID NO: 990254 - protein, 9 aa, Mycobacterium
LAPAQLPAQ

SEQ ID NO: 990255 - protein, 13 aa, Mycobacterium
LAPASTENERTSV

SEQ ID NO: 990256 - protein, 7 aa, Mycobacterium
LAPDGAV

SEQ ID NO: 990257 - protein, 5 aa, Mycobacterium
LAPDI

SEQ ID NO: 990258 - protein, 7 aa, Mycobacterium
LAPDRDG

SEQ ID NO: 990259 - protein, 9 aa, Mycobacterium
LAPEQPPTA

SEQ ID NO: 990260 - protein, 4 aa, Mycobacterium
LAPG

SEQ ID NO: 990261 - protein, 11 aa, Mycobacterium
LAPGDDEHGTI

SEQ ID NO: 990262 - protein, 7 aa, Mycobacterium
LAPGGRC

SEQ ID NO: 990263 - protein, 7 aa, Mycobacterium
LAPGHDT

SEQ ID NO: 990264 - protein, 6 aa, Mycobacterium
LAPGQR

SEQ ID NO: 990265 - protein, 4 aa, Mycobacterium
LAPN

SEQ ID NO: 990266 - protein, 22 aa, Mycobacterium
LAPQAATASMTTGRRFGGGEAA

SEQ ID NO: 990267 - protein, 7 aa, Mycobacterium
LAPRTPT

SEQ ID NO: 990268 - protein, 15 aa, Mycobacterium
LAPSDASELKARAEA

SEQ ID NO: 990269 - protein, 7 aa, Mycobacterium
LAPTSED

SEQ ID NO: 990270 - protein, 14 aa, Mycobacterium
LAPTTGALAAGGDA

SEQ ID NO: 990271 - protein, 10 aa, Mycobacterium
LAQQTKSPAI

SEQ ID NO: 990272 - protein, 11 aa, Mycobacterium
LAQRTLRGRPA

SEQ ID NO: 990273 - protein, 6 aa, Mycobacterium
LARAEP

SEQ ID NO: 990274 - protein, 6 aa, Mycobacterium
LARGEL

SEQ ID NO: 990275 - protein, 5 aa, Mycobacterium
LARGQ

SEQ ID NO: 990276 - protein, 6 aa, Mycobacterium
LARPNR

SEQ ID NO: 990277 - protein, 7 aa, Mycobacterium
LARPTST

SEQ ID NO: 990278 - protein, 8 aa, Mycobacterium
LARTGDRD

SEQ ID NO: 990279 - protein, 6 aa, Mycobacterium
LASAAQ

SEQ ID NO: 990280 - protein, 5 aa, Mycobacterium
LASAS

SEQ ID NO: 990281 - protein, 11 aa, Mycobacterium
LASDTDPTLTE

SEQ ID NO: 990282 - protein, 4 aa, Mycobacterium
LASE

SEQ ID NO: 990283 - protein, 36 aa, Mycobacterium
LASEPLAASANVAPNFTSAPRRPCQHRKQPTSATRG

SEQ ID NO: 990284 - protein, 8 aa, Mycobacterium
LASGAGQP

SEQ ID NO: 990285 - protein, 15 aa, Mycobacterium
LASGKLGNKPTDRET

SEQ ID NO: 990286 - protein, 12 aa, Mycobacterium
LASGPGGANGEE

SEQ ID NO: 990287 - protein, 12 aa, Mycobacterium
LASGRRDTAAQL

SEQ ID NO: 990288 - protein, 7 aa, Mycobacterium
LASNTQC

SEQ ID NO: 990289 - protein, 8 aa, Mycobacterium
LASNTSSI

SEQ ID NO: 990290 - protein, 17 aa, Mycobacterium
LASSESSVETARGSDDR

SEQ ID NO: 990291 - protein, 9 aa, Mycobacterium
LASTAASNL

SEQ ID NO: 990292 - protein, 7 aa, Mycobacterium
LASTERV

SEQ ID NO: 990293 - protein, 13 aa, Mycobacterium
LASTGGPGPYAEA

SEQ ID NO: 990294 - protein, 6 aa, Mycobacterium
LASTTA

SEQ ID NO: 990295 - protein, 6 aa, Mycobacterium
LASYDG

SEQ ID NO: 990296 - protein, 5 aa, Mycobacterium
LATEM

SEQ ID NO: 990297 - protein, 7 aa, Mycobacterium
LATERSE

SEQ ID NO: 990298 - protein, 18 aa, Mycobacterium
LATPDQGFTKSQDACNAS

SEQ ID NO: 990299 - protein, 6 aa, Mycobacterium
LATRTE

SEQ ID NO: 990300 - protein, 8 aa, Mycobacterium
LATSPNTA

SEQ ID NO: 990301 - protein, 4 aa, Mycobacterium
LATT

SEQ ID NO: 990302 - protein, 11 aa, Mycobacterium
LCTPDSPTQLV

SEQ ID NO: 990303 - protein, 8 aa, Mycobacterium
LDAAESAE

SEQ ID NO: 990304 - protein, 13 aa, Mycobacterium
LDADGNPVTTEGT

SEQ ID NO: 990305 - protein, 20 aa, Mycobacterium
LDAEEATERAARRAQRAKVA

SEQ ID NO: 990306 - protein, 9 aa, Mycobacterium
LDAGADDYL

SEQ ID NO: 990307 - protein, 5 aa, Mycobacterium
LDAGR

SEQ ID NO: 990308 - protein, 5 aa, Mycobacterium
LDAGY

SEQ ID NO: 990309 - protein, 15 aa, Mycobacterium
LDAQPDGELPSFGSP

SEQ ID NO: 990310 - protein, 17 aa, Mycobacterium
LDARLGEDDATDNDYSE

SEQ ID NO: 990311 - protein, 10 aa, Mycobacterium
LDASGSQPYC

SEQ ID NO: 990312 - protein, 8 aa, Mycobacterium
LDDATAQR

SEQ ID NO: 990313 - protein, 6 aa, Mycobacterium
LDDDEP

SEQ ID NO: 990314 - protein, 5 aa, Mycobacterium
LDDGS

SEQ ID NO: 990315 - protein, 8 aa, Mycobacterium
LDDQSGTA

SEQ ID NO: 990316 - protein, 12 aa, Mycobacterium
LDDSRPNNNLPV

SEQ ID NO: 990317 - protein, 10 aa, Mycobacterium
LDEARAKDDH

SEQ ID NO: 990318 - protein, 4 aa, Mycobacterium
LDEE

SEQ ID NO: 990319 - protein, 9 aa, Mycobacterium
LDEGTAAAE

SEQ ID NO: 990320 - protein, 10 aa, Mycobacterium
LDENADPKVQ

SEQ ID NO: 990321 - protein, 12 aa, Mycobacterium
LDEPAAAPETVR

SEQ ID NO: 990322 - protein, 5 aa, Mycobacterium
LDGDL

SEQ ID NO: 990323 - protein, 8 aa, Mycobacterium
LDGGRKKW

SEQ ID NO: 990324 - protein, 4 aa, Mycobacterium
LDGI

SEQ ID NO: 990325 - protein, 5 aa, Mycobacterium
LDGID

SEQ ID NO: 990326 - protein, 6 aa, Mycobacterium
LDGIPS

SEQ ID NO: 990327 - protein, 8 aa, Mycobacterium
LDGPTTAK

SEQ ID NO: 990328 - protein, 27 aa, Mycobacterium
LDGRPLSTDTVTRPATSYAAAAPDNTI

SEQ ID NO: 990329 - protein, 11 aa, Mycobacterium
LDGRPTDLPGM

SEQ ID NO: 990330 - protein, 5 aa, Mycobacterium
LDGSE

SEQ ID NO: 990331 - protein, 9 aa, Mycobacterium
LDGSTEQPI

SEQ ID NO: 990332 - protein, 18 aa, Mycobacterium
LDGTPGPHGGSAVATNGR

SEQ ID NO: 990333 - protein, 7 aa, Mycobacterium
LDKDPTV

SEQ ID NO: 990334 - protein, 20 aa, Mycobacterium
LDKGKDAAARITATSAQNNV

SEQ ID NO: 990335 - protein, 20 aa, Mycobacterium
LDLQSGRVRTGQSKELRTTI

SEQ ID NO: 990336 - protein, 4 aa, Mycobacterium
LDPA

SEQ ID NO: 990337 - protein, 16 aa, Mycobacterium
LDPAAETEVVPQTEKP

SEQ ID NO: 990338 - protein, 6 aa, Mycobacterium
LDPAEV

SEQ ID NO: 990339 - protein, 10 aa, Mycobacterium
LDPAGEKAQV

SEQ ID NO: 990340 - protein, 6 aa, Mycobacterium
LDPANS

SEQ ID NO: 990341 - protein, 11 aa, Mycobacterium
LDPATLAGSAT

SEQ ID NO: 990342 - protein, 8 aa, Mycobacterium
LDPDARRR

SEQ ID NO: 990343 - protein, 8 aa, Mycobacterium
LDPDHGGV

SEQ ID NO: 990344 - protein, 6 aa, Mycobacterium
LDPDRD

SEQ ID NO: 990345 - protein, 7 aa, Mycobacterium
LDPDSKT

SEQ ID NO: 990346 - protein, 6 aa, Mycobacterium
LDPHGL

SEQ ID NO: 990347 - protein, 8 aa, Mycobacterium
LDPPTARE

SEQ ID NO: 990348 - protein, 4 aa, Mycobacterium
LDPR

SEQ ID NO: 990349 - protein, 8 aa, Mycobacterium
LDPSEDNQ

SEQ ID NO: 990350 - protein, 9 aa, Mycobacterium
LDPTPQRGL

SEQ ID NO: 990351 - protein, 5 aa, Mycobacterium
LDPTT

SEQ ID NO: 990352 - protein, 11 aa, Mycobacterium
LDPVETPDEYE

SEQ ID NO: 990353 - protein, 6 aa, Mycobacterium
LDQQRS

SEQ ID NO: 990354 - protein, 11 aa, Mycobacterium
LDRAPTASELG

SEQ ID NO: 990355 - protein, 10 aa, Mycobacterium
LDRDGDKLDL

SEQ ID NO: 990356 - protein, 18 aa, Mycobacterium
LDRGNSDGRTPGSGGPVD

SEQ ID NO: 990357 - protein, 11 aa, Mycobacterium
LDRSRAKGLSR

SEQ ID NO: 990358 - protein, 8 aa, Mycobacterium
LDRTSTGV

SEQ ID NO: 990359 - protein, 6 aa, Mycobacterium
LDRYEN

SEQ ID NO: 990360 - protein, 11 aa, Mycobacterium
LDSDSGAAGLS

SEQ ID NO: 990361 - protein, 6 aa, Mycobacterium
LDSEAR

SEQ ID NO: 990362 - protein, 4 aa, Mycobacterium
LDSK

SEQ ID NO: 990363 - protein, 5 aa, Mycobacterium
LDSRA

SEQ ID NO: 990364 - protein, 6 aa, Mycobacterium
LDTART

SEQ ID NO: 990365 - protein, 13 aa, Mycobacterium
LDTGTRANNRNEY

SEQ ID NO: 990366 - protein, 8 aa, Mycobacterium
LDTPDEVR

SEQ ID NO: 990367 - protein, 7 aa, Mycobacterium
LDTTPVR

SEQ ID NO: 990368 - protein, 18 aa, Mycobacterium
LDVDEDESDSEADLDSAD

SEQ ID NO: 990369 - protein, 14 aa, Mycobacterium
LDVPAKVDDDVADE

SEQ ID NO: 990370 - protein, 8 aa, Mycobacterium
LEAAQGLP

SEQ ID NO: 990371 - protein, 15 aa, Mycobacterium
LEAAQKGKSYSEKLE

SEQ ID NO: 990372 - protein, 8 aa, Mycobacterium
LEANSGPR

SEQ ID NO: 990373 - protein, 9 aa, Mycobacterium
LEATGGSDQ

SEQ ID NO: 990374 - protein, 31 aa, Mycobacterium
LEDAPDYTAATAALNRAKGTLRSKVGAGTGV

SEQ ID NO: 990375 - protein, 14 aa, Mycobacterium
LEDPRGGGDNPLRE

SEQ ID NO: 990376 - protein, 8 aa, Mycobacterium
LEDPYEKI

SEQ ID NO: 990377 - protein, 8 aa, Mycobacterium
LEDRGVDT

SEQ ID NO: 990378 - protein, 7 aa, Mycobacterium
LEDRHRE

SEQ ID NO: 990379 - protein, 7 aa, Mycobacterium
LEDSDDV

SEQ ID NO: 990380 - protein, 4 aa, Mycobacterium
LEEA

SEQ ID NO: 990381 - protein, 5 aa, Mycobacterium
LEEED

SEQ ID NO: 990382 - protein, 7 aa, Mycobacterium
LEEGGAM

SEQ ID NO: 990383 - protein, 14 aa, Mycobacterium
LEEPSIVNGTTTDP

SEQ ID NO: 990384 - protein, 5 aa, Mycobacterium
LEERD

SEQ ID NO: 990385 - protein, 6 aa, Mycobacterium
LEESNE

SEQ ID NO: 990386 - protein, 4 aa, Mycobacterium
LEGA

SEQ ID NO: 990387 - protein, 7 aa, Mycobacterium
LEGEMGD

SEQ ID NO: 990388 - protein, 5 aa, Mycobacterium
LEGET

SEQ ID NO: 990389 - protein, 19 aa, Mycobacterium
LEGISDENAAAAGKTTRQN

SEQ ID NO: 990390 - protein, 5 aa, Mycobacterium
LEGSD

SEQ ID NO: 990391 - protein, 11 aa, Mycobacterium
LEKDNTVGTDE

SEQ ID NO: 990392 - protein, 6 aa, Mycobacterium
LEKIGD

SEQ ID NO: 990393 - protein, 9 aa, Mycobacterium
LELSTDGLE

SEQ ID NO: 990394 - protein, 16 aa, Mycobacterium
LENGADVARSRRGASV

SEQ ID NO: 990395 - protein, 10 aa, Mycobacterium
LENRNDDDAI

SEQ ID NO: 990396 - protein, 5 aa, Mycobacterium
LEPEY

SEQ ID NO: 990397 - protein, 4 aa, Mycobacterium
LEPQ

SEQ ID NO: 990398 - protein, 11 aa, Mycobacterium
LEPTGSGKTTV

SEQ ID NO: 990399 - protein, 12 aa, Mycobacterium
LEQQKGKLADSA

SEQ ID NO: 990400 - protein, 6 aa, Mycobacterium
LEQTTL

SEQ ID NO: 990401 - protein, 11 aa, Mycobacterium
LERDQRTNEIK

SEQ ID NO: 990402 - protein, 12 aa, Mycobacterium
LERNAGRVRGQR

SEQ ID NO: 990403 - protein, 19 aa, Mycobacterium
LERPDGLGPRLPLNVNDTA

SEQ ID NO: 990404 - protein, 14 aa, Mycobacterium
LERQPADPVYPTIR

SEQ ID NO: 990405 - protein, 16 aa, Mycobacterium
LERRQKSRQTRASRDA

SEQ ID NO: 990406 - protein, 19 aa, Mycobacterium
LERSRASQQDRVRRQQSQR

SEQ ID NO: 990407 - protein, 12 aa, Mycobacterium
LERSRSIGVSPV

SEQ ID NO: 990408 - protein, 12 aa, Mycobacterium
LERVTPEQAGVH

SEQ ID NO: 990409 - protein, 8 aa, Mycobacterium
LESAGGHG

SEQ ID NO: 990410 - protein, 9 aa, Mycobacterium
LESEGRGHA

SEQ ID NO: 990411 - protein, 7 aa, Mycobacterium
LESGPTV

SEQ ID NO: 990412 - protein, 12 aa, Mycobacterium
LESNRAKAIEVT

SEQ ID NO: 990413 - protein, 9 aa, Mycobacterium
LESNRPQLA

SEQ ID NO: 990414 - protein, 6 aa, Mycobacterium
LESSID

SEQ ID NO: 990415 - protein, 10 aa, Mycobacterium
LESSTDPQEL

SEQ ID NO: 990416 - protein, 14 aa, Mycobacterium
LETPTPAVNTGAVP

SEQ ID NO: 990417 - protein, 6 aa, Mycobacterium
LFGPTT

SEQ ID NO: 990418 - protein, 19 aa, Mycobacterium
LGAAGGGAVRAKSTPTDPV

SEQ ID NO: 990419 - protein, 9 aa, Mycobacterium
LGAARSALT

SEQ ID NO: 990420 - protein, 19 aa, Mycobacterium
LGAAVGASRAAVDSGYYPG

SEQ ID NO: 990421 - protein, 4 aa, Mycobacterium
LGAE

SEQ ID NO: 990422 - protein, 8 aa, Mycobacterium
LGAEPNRR

SEQ ID NO: 990423 - protein, 7 aa, Mycobacterium
LGAEPRD

SEQ ID NO: 990424 - protein, 15 aa, Mycobacterium
LGAERPSLAEWRERG

SEQ ID NO: 990425 - protein, 13 aa, Mycobacterium
LGAESPDGDWSAV

SEQ ID NO: 990426 - protein, 18 aa, Mycobacterium
LGAGGTGKGTAGALRSVT

SEQ ID NO: 990427 - protein, 13 aa, Mycobacterium
LGAGRGGKDSPLV

SEQ ID NO: 990428 - protein, 4 aa, Mycobacterium
LGAH

SEQ ID NO: 990429 - protein, 6 aa, Mycobacterium
LGAIDE

SEQ ID NO: 990430 - protein, 8 aa, Mycobacterium
LGDAAESA

SEQ ID NO: 990431 - protein, 9 aa, Mycobacterium
LGDAARYAG

SEQ ID NO: 990432 - protein, 7 aa, Mycobacterium
LGDADQY

SEQ ID NO: 990433 - protein, 9 aa, Mycobacterium
LGDDPSRCR

SEQ ID NO: 990434 - protein, 9 aa, Mycobacterium
LGDGDGLRT

SEQ ID NO: 990435 - protein, 6 aa, Mycobacterium
LGDGGQ

SEQ ID NO: 990436 - protein, 10 aa, Mycobacterium
LGDGGRGYRR

SEQ ID NO: 990437 - protein, 5 aa, Mycobacterium
LGDPH

SEQ ID NO: 990438 - protein, 7 aa, Mycobacterium
LGDQRPG

SEQ ID NO: 990439 - protein, 20 aa, Mycobacterium
LGDQVRKAKYAQQAEKIRDA

SEQ ID NO: 990440 - protein, 10 aa, Mycobacterium
LGDRSDNDPL

SEQ ID NO: 990441 - protein, 6 aa, Mycobacterium
LGDSNI

SEQ ID NO: 990442 - protein, 17 aa, Mycobacterium
LGDSPRRACINRNARRP

SEQ ID NO: 990443 - protein, 13 aa, Mycobacterium
LGDTASREDVVIT

SEQ ID NO: 990444 - protein, 12 aa, Mycobacterium
LGDTHARTRTGA

SEQ ID NO: 990445 - protein, 4 aa, Mycobacterium
LGEA

SEQ ID NO: 990446 - protein, 7 aa, Mycobacterium
LGEASEV

SEQ ID NO: 990447 - protein, 17 aa, Mycobacterium
LGEGGYIGREDAANLTA

SEQ ID NO: 990448 - protein, 4 aa, Mycobacterium
LGEM

SEQ ID NO: 990449 - protein, 10 aa, Mycobacterium
LGENRPVGDG

SEQ ID NO: 990450 - protein, 5 aa, Mycobacterium
LGEPF

SEQ ID NO: 990451 - protein, 10 aa, Mycobacterium
LGEQRSAETD

SEQ ID NO: 990452 - protein, 15 aa, Mycobacterium
LGERQRKALLEKFGS

SEQ ID NO: 990453 - protein, 5 aa, Mycobacterium
LGERT

SEQ ID NO: 990454 - protein, 11 aa, Mycobacterium
LGESDSGRAHA

SEQ ID NO: 990455 - protein, 4 aa, Mycobacterium
LGET

SEQ ID NO: 990456 - protein, 7 aa, Mycobacterium
LGETDAV

SEQ ID NO: 990457 - protein, 5 aa, Mycobacterium
LGGAD

SEQ ID NO: 990458 - protein, 21 aa, Mycobacterium
LGGDEKKFPGEISGGMRKRAG

SEQ ID NO: 990459 - protein, 15 aa, Mycobacterium
LGGDKHQQARCGGYT

SEQ ID NO: 990460 - protein, 7 aa, Mycobacterium
LGGDSLS

SEQ ID NO: 990461 - protein, 14 aa, Mycobacterium
LGGEDEVTVYAGTG

SEQ ID NO: 990462 - protein, 6 aa, Mycobacterium
LGGHPQ

SEQ ID NO: 990463 - protein, 13 aa, Mycobacterium
LGGNSFRVLKSTK

SEQ ID NO: 990464 - protein, 8 aa, Mycobacterium
LGGPAQTI

SEQ ID NO: 990465 - protein, 8 aa, Mycobacterium
LGGQTALN

SEQ ID NO: 990466 - protein, 18 aa, Mycobacterium
LGGRAGDPAARDAEVTAV

SEQ ID NO: 990467 - protein, 5 aa, Mycobacterium
LGGRQ

SEQ ID NO: 990468 - protein, 5 aa, Mycobacterium
LGGRW

SEQ ID NO: 990469 - protein, 11 aa, Mycobacterium
LGGVDSQAKYG

SEQ ID NO: 990470 - protein, 5 aa, Mycobacterium
LGHPD

SEQ ID NO: 990471 - protein, 13 aa, Mycobacterium
LGKAGGTIGRNNS

SEQ ID NO: 990472 - protein, 7 aa, Mycobacterium
LGNDTAA

SEQ ID NO: 990473 - protein, 7 aa, Mycobacterium
LGNGGTA

SEQ ID NO: 990474 - protein, 9 aa, Mycobacterium
LGNGPISYG

SEQ ID NO: 990475 - protein, 8 aa, Mycobacterium
LGNKTARK

SEQ ID NO: 990476 - protein, 10 aa, Mycobacterium
LGNTIPETGY

SEQ ID NO: 990477 - protein, 9 aa, Mycobacterium
LGPAATPLG

SEQ ID NO: 990478 - protein, 9 aa, Mycobacterium
LGPADPTAD

SEQ ID NO: 990479 - protein, 6 aa, Mycobacterium
LGPART

SEQ ID NO: 990480 - protein, 5 aa, Mycobacterium
LGPDE

SEQ ID NO: 990481 - protein, 5 aa, Mycobacterium
LGPED

SEQ ID NO: 990482 - protein, 15 aa, Mycobacterium
LGPGDDAAVVTASDG

SEQ ID NO: 990483 - protein, 5 aa, Mycobacterium
LGPGN

SEQ ID NO: 990484 - protein, 6 aa, Mycobacterium
LGPGSY

SEQ ID NO: 990485 - protein, 6 aa, Mycobacterium
LGPIDR

SEQ ID NO: 990486 - protein, 6 aa, Mycobacterium
LGPQDA

SEQ ID NO: 990487 - protein, 5 aa, Mycobacterium
LGPRG

SEQ ID NO: 990488 - protein, 4 aa, Mycobacterium
LGPS

SEQ ID NO: 990489 - protein, 4 aa, Mycobacterium
LGPT

SEQ ID NO: 990490 - protein, 6 aa, Mycobacterium
LGPTEP

SEQ ID NO: 990491 - protein, 10 aa, Mycobacterium
LGQDPELAAG

SEQ ID NO: 990492 - protein, 8 aa, Mycobacterium
LGQDTHDR

SEQ ID NO: 990493 - protein, 16 aa, Mycobacterium
LGQPIDGRGDIEAEAR

SEQ ID NO: 990494 - protein, 5 aa, Mycobacterium
LGQVT

SEQ ID NO: 990495 - protein, 18 aa, Mycobacterium
LGREATDEELAAESGIPI

SEQ ID NO: 990496 - protein, 5 aa, Mycobacterium
LGREP

SEQ ID NO: 990497 - protein, 14 aa, Mycobacterium
LGRGHGPVSPLFQR

SEQ ID NO: 990498 - protein, 11 aa, Mycobacterium
LGRGPVVATTE

SEQ ID NO: 990499 - protein, 7 aa, Mycobacterium
LGRGQRV

SEQ ID NO: 990500 - protein, 19 aa, Mycobacterium
LGRLGRREPDVYGSTTHEQ

SEQ ID NO: 990501 - protein, 8 aa, Mycobacterium
LGRPAEAD

SEQ ID NO: 990502 - protein, 4 aa, Mycobacterium
LGRR

SEQ ID NO: 990503 - protein, 7 aa, Mycobacterium
LGRSAAG

SEQ ID NO: 990504 - protein, 5 aa, Mycobacterium
LGRSN

SEQ ID NO: 990505 - protein, 9 aa, Mycobacterium
LGRTPLGTQ

SEQ ID NO: 990506 - protein, 7 aa, Mycobacterium
LGSGGLR

SEQ ID NO: 990507 - protein, 5 aa, Mycobacterium
LGSGR

SEQ ID NO: 990508 - protein, 6 aa, Mycobacterium
LGSGTA

SEQ ID NO: 990509 - protein, 13 aa, Mycobacterium
LGSRGPKESKYAQ

SEQ ID NO: 990510 - protein, 6 aa, Mycobacterium
LGSSGG

SEQ ID NO: 990511 - protein, 17 aa, Mycobacterium
LGSSPQLYATHSPLTLC

SEQ ID NO: 990512 - protein, 10 aa, Mycobacterium
LGTDPTSGKP

SEQ ID NO: 990513 - protein, 6 aa, Mycobacterium
LGTEPG

SEQ ID NO: 990514 - protein, 5 aa, Mycobacterium
LGTGS

SEQ ID NO: 990515 - protein, 5 aa, Mycobacterium
LGTGY

SEQ ID NO: 990516 - protein, 7 aa, Mycobacterium
LGTKGKL

SEQ ID NO: 990517 - protein, 16 aa, Mycobacterium
LGTNPRKSTKIGTGER

SEQ ID NO: 990518 - protein, 7 aa, Mycobacterium
LGTPKQR

SEQ ID NO: 990519 - protein, 7 aa, Mycobacterium
LGTPPAR

SEQ ID NO: 990520 - protein, 13 aa, Mycobacterium
LGTPTDDGFARQA

SEQ ID NO: 990521 - protein, 10 aa, Mycobacterium
LGTSDISKPV

SEQ ID NO: 990522 - protein, 6 aa, Mycobacterium
LGTTNS

SEQ ID NO: 990523 - protein, 5 aa, Mycobacterium
LGVDT

SEQ ID NO: 990524 - protein, 13 aa, Mycobacterium
LGVNAKAREVRGA

SEQ ID NO: 990525 - protein, 9 aa, Mycobacterium
LGVRGGGRG

SEQ ID NO: 990526 - protein, 4 aa, Mycobacterium
LHED

SEQ ID NO: 990527 - protein, 10 aa, Mycobacterium
LHNPDSEANT

SEQ ID NO: 990528 - protein, 5 aa, Mycobacterium
LHRTG

SEQ ID NO: 990529 - protein, 5 aa, Mycobacterium
LHTGG

SEQ ID NO: 990530 - protein, 7 aa, Mycobacterium
LIPGNEE

SEQ ID NO: 990531 - protein, 23 aa, Mycobacterium
LISEGGGVYSREQKAIPTSPQVR

SEQ ID NO: 990532 - protein, 7 aa, Mycobacterium
LKASGHD

SEQ ID NO: 990533 - protein, 9 aa, Mycobacterium
LKDDLKSTV

SEQ ID NO: 990534 - protein, 4 aa, Mycobacterium
LKDG

SEQ ID NO: 990535 - protein, 9 aa, Mycobacterium
LKDGRPVFT

SEQ ID NO: 990536 - protein, 13 aa, Mycobacterium
LKEAEDALRDYQG

SEQ ID NO: 990537 - protein, 7 aa, Mycobacterium
LKEPRES

SEQ ID NO: 990538 - protein, 8 aa, Mycobacterium
LKERKTLR

SEQ ID NO: 990539 - protein, 6 aa, Mycobacterium
LKGRSG

SEQ ID NO: 990540 - protein, 9 aa, Mycobacterium
LKNQTYNTP

SEQ ID NO: 990541 - protein, 5 aa, Mycobacterium
LKPES

SEQ ID NO: 990542 - protein, 8 aa, Mycobacterium
LKPGNPDG

SEQ ID NO: 990543 - protein, 9 aa, Mycobacterium
LKPTEPKVP

SEQ ID NO: 990544 - protein, 6 aa, Mycobacterium
LKQAKL

SEQ ID NO: 990545 - protein, 13 aa, Mycobacterium
LKQGSTGQHLPPA

SEQ ID NO: 990546 - protein, 33 aa, Mycobacterium
LKQRARQKASTSDPASRATLGARGTGSSENTSV

SEQ ID NO: 990547 - protein, 8 aa, Mycobacterium
LKRATEGY

SEQ ID NO: 990548 - protein, 9 aa, Mycobacterium
LKSAEPTVS

SEQ ID NO: 990549 - protein, 9 aa, Mycobacterium
LKSATGLTL

SEQ ID NO: 990550 - protein, 8 aa, Mycobacterium
LLGSGGPA

SEQ ID NO: 990551 - protein, 13 aa, Mycobacterium
LLGSPGQGAYAAA

SEQ ID NO: 990552 - protein, 11 aa, Mycobacterium
LLPGKKAAPQF

SEQ ID NO: 990553 - protein, 6 aa, Mycobacterium
LNAKNI

SEQ ID NO: 990554 - protein, 8 aa, Mycobacterium
LNANPDCT

SEQ ID NO: 990555 - protein, 8 aa, Mycobacterium
LNARNGER

SEQ ID NO: 990556 - protein, 7 aa, Mycobacterium
LNASTRL

SEQ ID NO: 990557 - protein, 11 aa, Mycobacterium
LNDDGSIEEAW

SEQ ID NO: 990558 - protein, 9 aa, Mycobacterium
LNDEKHPNS

SEQ ID NO: 990559 - protein, 9 aa, Mycobacterium
LNDKEDKSK

SEQ ID NO: 990560 - protein, 6 aa, Mycobacterium
LNDPKV

SEQ ID NO: 990561 - protein, 8 aa, Mycobacterium
LNDSNRKT

SEQ ID NO: 990562 - protein, 9 aa, Mycobacterium
LNGAPRSRL

SEQ ID NO: 990563 - protein, 16 aa, Mycobacterium
LNGESNTDDEATNDST

SEQ ID NO: 990564 - protein, 4 aa, Mycobacterium
LNGR

SEQ ID NO: 990565 - protein, 4 aa, Mycobacterium
LNGT

SEQ ID NO: 990566 - protein, 13 aa, Mycobacterium
LNGYSTPRSGSTT

SEQ ID NO: 990567 - protein, 8 aa, Mycobacterium
LNHTGSHK

SEQ ID NO: 990568 - protein, 12 aa, Mycobacterium
LNKDTNGNQDEA

SEQ ID NO: 990569 - protein, 7 aa, Mycobacterium
LNKSDTV

SEQ ID NO: 990570 - protein, 9 aa, Mycobacterium
LNNPAPEVQ

SEQ ID NO: 990571 - protein, 10 aa, Mycobacterium
LNPPPANTYD

SEQ ID NO: 990572 - protein, 7 aa, Mycobacterium
LNPQQRQ

SEQ ID NO: 990573 - protein, 12 aa, Mycobacterium
LNPTLAHSSGDV

SEQ ID NO: 990574 - protein, 25 aa, Mycobacterium
LNRNDDLANVGADAVASASDPTGQW

SEQ ID NO: 990575 - protein, 24 aa, Mycobacterium
LNRSGGNYTKTDDEANQLLSSKMN

SEQ ID NO: 990576 - protein, 6 aa, Mycobacterium
LNSASL

SEQ ID NO: 990577 - protein, 5 aa, Mycobacterium
LNSQE

SEQ ID NO: 990578 - protein, 14 aa, Mycobacterium
LNSTNGTTVNNAPV

SEQ ID NO: 990579 - protein, 11 aa, Mycobacterium
LNTEGTCGGLG

SEQ ID NO: 990580 - protein, 18 aa, Mycobacterium
LNVNGSSLAAGHPFAATG

SEQ ID NO: 990581 - protein, 10 aa, Mycobacterium
LPAADPDRYA

SEQ ID NO: 990582 - protein, 8 aa, Mycobacterium
LPAAEAAA

SEQ ID NO: 990583 - protein, 24 aa, Mycobacterium
LPADTSQEAGASARNAAPSRPLAS

SEQ ID NO: 990584 - protein, 11 aa, Mycobacterium
LPAGAGSMDAT

SEQ ID NO: 990585 - protein, 5 aa, Mycobacterium
LPAGR

SEQ ID NO: 990586 - protein, 5 aa, Mycobacterium
LPAGV

SEQ ID NO: 990587 - protein, 6 aa, Mycobacterium
LPAGVT

SEQ ID NO: 990588 - protein, 4 aa, Mycobacterium
LPAP

SEQ ID NO: 990589 - protein, 16 aa, Mycobacterium
LPAPEDSTGTRATPDP

SEQ ID NO: 990590 - protein, 8 aa, Mycobacterium
LPAPTYRH

SEQ ID NO: 990591 - protein, 12 aa, Mycobacterium
LPAPVKPSSLPL

SEQ ID NO: 990592 - protein, 5 aa, Mycobacterium
LPAQG

SEQ ID NO: 990593 - protein, 9 aa, Mycobacterium
LPARGNRVY

SEQ ID NO: 990594 - protein, 5 aa, Mycobacterium
LPASP

SEQ ID NO: 990595 - protein, 7 aa, Mycobacterium
LPATDVE

SEQ ID NO: 990596 - protein, 5 aa, Mycobacterium
LPATG

SEQ ID NO: 990597 - protein, 10 aa, Mycobacterium
LPAVTGRSEP

SEQ ID NO: 990598 - protein, 5 aa, Mycobacterium
LPDDY

SEQ ID NO: 990599 - protein, 7 aa, Mycobacterium
LPDGETA

SEQ ID NO: 990600 - protein, 14 aa, Mycobacterium
LPDGVAAGSAEERA

SEQ ID NO: 990601 - protein, 5 aa, Mycobacterium
LPDGW

SEQ ID NO: 990602 - protein, 5 aa, Mycobacterium
LPDKD

SEQ ID NO: 990603 - protein, 8 aa, Mycobacterium
LPDNAASF

SEQ ID NO: 990604 - protein, 5 aa, Mycobacterium
LPDPR

SEQ ID NO: 990605 - protein, 8 aa, Mycobacterium
LPDQTGTL

SEQ ID NO: 990606 - protein, 6 aa, Mycobacterium
LPDRGL

SEQ ID NO: 990607 - protein, 4 aa, Mycobacterium
LPDT

SEQ ID NO: 990608 - protein, 4 aa, Mycobacterium
LPEA

SEQ ID NO: 990609 - protein, 9 aa, Mycobacterium
LPEAPSAAQ

SEQ ID NO: 990610 - protein, 19 aa, Mycobacterium
LPEASPARNQTGAAPTHRE

SEQ ID NO: 990611 - protein, 11 aa, Mycobacterium
LPEDGSNSSLG

SEQ ID NO: 990612 - protein, 10 aa, Mycobacterium
LPEEAKSMAS

SEQ ID NO: 990613 - protein, 4 aa, Mycobacterium
LPEG

SEQ ID NO: 990614 - protein, 13 aa, Mycobacterium
LPEGSKSRPKAFE

SEQ ID NO: 990615 - protein, 6 aa, Mycobacterium
LPEGSV

SEQ ID NO: 990616 - protein, 4 aa, Mycobacterium
LPEP

SEQ ID NO: 990617 - protein, 11 aa, Mycobacterium
LPERLRSGAGV

SEQ ID NO: 990618 - protein, 8 aa, Mycobacterium
LPESDGRL

SEQ ID NO: 990619 - protein, 18 aa, Mycobacterium
LPETDPGVLSELVSFIHS

SEQ ID NO: 990620 - protein, 8 aa, Mycobacterium
LPGAAQRA

SEQ ID NO: 990621 - protein, 8 aa, Mycobacterium
LPGASGRI

SEQ ID NO: 990622 - protein, 26 aa, Mycobacterium
LPGDPDFGDPLSTAGEGGPRAAARAA

SEQ ID NO: 990623 - protein, 8 aa, Mycobacterium
LPGESGAS

SEQ ID NO: 990624 - protein, 11 aa, Mycobacterium
LPGIGPKSAQR

SEQ ID NO: 990625 - protein, 19 aa, Mycobacterium
LPGNNPFGADITGLYQIRP

SEQ ID NO: 990626 - protein, 14 aa, Mycobacterium
LPGNRSDIRERSTT

SEQ ID NO: 990627 - protein, 6 aa, Mycobacterium
LPGPDT

SEQ ID NO: 990628 - protein, 8 aa, Mycobacterium
LPGPLATA

SEQ ID NO: 990629 - protein, 4 aa, Mycobacterium
LPGQ

SEQ ID NO: 990630 - protein, 4 aa, Mycobacterium
LPGR

SEQ ID NO: 990631 - protein, 14 aa, Mycobacterium
LPGRGMLRIDYIVC

SEQ ID NO: 990632 - protein, 15 aa, Mycobacterium
LPGRRPGRIVLLRSR

SEQ ID NO: 990633 - protein, 19 aa, Mycobacterium
LPGRRYAGAKAAQVMVRPD

SEQ ID NO: 990634 - protein, 14 aa, Mycobacterium
LPGRTKLSDGTEHE

SEQ ID NO: 990635 - protein, 23 aa, Mycobacterium
LPGSAAPPATDRRRDGFARRSGQ

SEQ ID NO: 990636 - protein, 11 aa, Mycobacterium
LPGSESEKMGP

SEQ ID NO: 990637 - protein, 8 aa, Mycobacterium
LPGTSSLD

SEQ ID NO: 990638 - protein, 15 aa, Mycobacterium
LPGYKPNTKPHNRQI

SEQ ID NO: 990639 - protein, 9 aa, Mycobacterium
LPHGTGKTA

SEQ ID NO: 990640 - protein, 16 aa, Mycobacterium
LPHSSQALARGGQPVS

SEQ ID NO: 990641 - protein, 10 aa, Mycobacterium
LPKATSLSTR

SEQ ID NO: 990642 - protein, 10 aa, Mycobacterium
LPKEEAEERL

SEQ ID NO: 990643 - protein, 8 aa, Mycobacterium
LPKGAQAA

SEQ ID NO: 990644 - protein, 5 aa, Mycobacterium
LPKGY

SEQ ID NO: 990645 - protein, 4 aa, Mycobacterium
LPMG

SEQ ID NO: 990646 - protein, 10 aa, Mycobacterium
LPMQTDEDGR

SEQ ID NO: 990647 - protein, 7 aa, Mycobacterium
LPNIGGE

SEQ ID NO: 990648 - protein, 11 aa, Mycobacterium
LPNQQTPNQLG

SEQ ID NO: 990649 - protein, 6 aa, Mycobacterium
LPPEAR

SEQ ID NO: 990650 - protein, 9 aa, Mycobacterium
LPPERIQRR

SEQ ID NO: 990651 - protein, 19 aa, Mycobacterium
LPPGMGKPGQAGGQGTGQY

SEQ ID NO: 990652 - protein, 9 aa, Mycobacterium
LPPGPAYYS

SEQ ID NO: 990653 - protein, 15 aa, Mycobacterium
LPPGPQKRFGESRLG

SEQ ID NO: 990654 - protein, 24 aa, Mycobacterium
LPPGTRATTQGRSVGRSTGIHGAT

SEQ ID NO: 990655 - protein, 5 aa, Mycobacterium
LPPHE

SEQ ID NO: 990656 - protein, 5 aa, Mycobacterium
LPPNG

SEQ ID NO: 990657 - protein, 6 aa, Mycobacterium
LPPQND

SEQ ID NO: 990658 - protein, 9 aa, Mycobacterium
LPPQQLTGK

SEQ ID NO: 990659 - protein, 12 aa, Mycobacterium
LPPSAEPRATGH

SEQ ID NO: 990660 - protein, 11 aa, Mycobacterium
LPPSATGKVSF

SEQ ID NO: 990661 - protein, 6 aa, Mycobacterium
LPPSVS

SEQ ID NO: 990662 - protein, 20 aa, Mycobacterium
LPPTDPRYVDGSPGSQVPSV

SEQ ID NO: 990663 - protein, 7 aa, Mycobacterium
LPPTSKL

SEQ ID NO: 990664 - protein, 13 aa, Mycobacterium
LPPVGDVTQPGRQ

SEQ ID NO: 990665 - protein, 16 aa, Mycobacterium
LPQDAEALRAAKTEPL

SEQ ID NO: 990666 - protein, 8 aa, Mycobacterium
LPQDQDPD

SEQ ID NO: 990667 - protein, 8 aa, Mycobacterium
LPQDSPEL

SEQ ID NO: 990668 - protein, 4 aa, Mycobacterium
LPQG

SEQ ID NO: 990669 - protein, 14 aa, Mycobacterium
LPQNQAKKTTAGGT

SEQ ID NO: 990670 - protein, 14 aa, Mycobacterium
LPQPDSPSVFEAIL

SEQ ID NO: 990671 - protein, 14 aa, Mycobacterium
LPQRAAGLGSDPVA

SEQ ID NO: 990672 - protein, 6 aa, Mycobacterium
LPQREA

SEQ ID NO: 990673 - protein, 4 aa, Mycobacterium
LPQS

SEQ ID NO: 990674 - protein, 9 aa, Mycobacterium
LPRGRQPIT

SEQ ID NO: 990675 - protein, 9 aa, Mycobacterium
LPRKEIASG

SEQ ID NO: 990676 - protein, 7 aa, Mycobacterium
LPRPQTQ

SEQ ID NO: 990677 - protein, 7 aa, Mycobacterium
LPRQPQH

SEQ ID NO: 990678 - protein, 6 aa, Mycobacterium
LPRRRL

SEQ ID NO: 990679 - protein, 7 aa, Mycobacterium
LPSEPHD

SEQ ID NO: 990680 - protein, 4 aa, Mycobacterium
LPSG

SEQ ID NO: 990681 - protein, 12 aa, Mycobacterium
LPSGKDLDDPAS

SEQ ID NO: 990682 - protein, 7 aa, Mycobacterium
LPSGMQD

SEQ ID NO: 990683 - protein, 8 aa, Mycobacterium
LPSHPGHE

SEQ ID NO: 990684 - protein, 12 aa, Mycobacterium
LPSPEQAAEAEA

SEQ ID NO: 990685 - protein, 6 aa, Mycobacterium
LPSPGH

SEQ ID NO: 990686 - protein, 8 aa, Mycobacterium
LPSPGPVS

SEQ ID NO: 990687 - protein, 15 aa, Mycobacterium
LPSPPRGYTPASPHW

SEQ ID NO: 990688 - protein, 10 aa, Mycobacterium
LPSRQPDELS

SEQ ID NO: 990689 - protein, 7 aa, Mycobacterium
LPSSPSC

SEQ ID NO: 990690 - protein, 8 aa, Mycobacterium
LPSSPWHE

SEQ ID NO: 990691 - protein, 5 aa, Mycobacterium
LPSTH

SEQ ID NO: 990692 - protein, 5 aa, Mycobacterium
LPTAA

SEQ ID NO: 990693 - protein, 9 aa, Mycobacterium
LPTDGRRTV

SEQ ID NO: 990694 - protein, 9 aa, Mycobacterium
LPTEQRRRN

SEQ ID NO: 990695 - protein, 8 aa, Mycobacterium
LPTGSTPV

SEQ ID NO: 990696 - protein, 27 aa, Mycobacterium
LPTKPAKAVHSRYGHSGRMGLAGSSSV

SEQ ID NO: 990697 - protein, 8 aa, Mycobacterium
LPTQAEDW

SEQ ID NO: 990698 - protein, 5 aa, Mycobacterium
LPTRQ

SEQ ID NO: 990699 - protein, 5 aa, Mycobacterium
LPTSD

SEQ ID NO: 990700 - protein, 7 aa, Mycobacterium
LPTSDKL

SEQ ID NO: 990701 - protein, 21 aa, Mycobacterium
LPTSEQAAAEAEMFSNNILRQ

SEQ ID NO: 990702 - protein, 6 aa, Mycobacterium
LPTSLD

SEQ ID NO: 990703 - protein, 24 aa, Mycobacterium
LPTTVTQTTSAWPTREQLLRPIAL

SEQ ID NO: 990704 - protein, 4 aa, Mycobacterium
LPTW

SEQ ID NO: 990705 - protein, 9 aa, Mycobacterium
LPVDTDPDL

SEQ ID NO: 990706 - protein, 7 aa, Mycobacterium
LPVTTDA

SEQ ID NO: 990707 - protein, 9 aa, Mycobacterium
LPYSSRSKR

SEQ ID NO: 990708 - protein, 12 aa, Mycobacterium
LQAASSAGNPEI

SEQ ID NO: 990709 - protein, 7 aa, Mycobacterium
LQADISD

SEQ ID NO: 990710 - protein, 5 aa, Mycobacterium
LQAGQ

SEQ ID NO: 990711 - protein, 6 aa, Mycobacterium
LQDNNT

SEQ ID NO: 990712 - protein, 12 aa, Mycobacterium
LQEPPEDSNGRH

SEQ ID NO: 990713 - protein, 12 aa, Mycobacterium
LQGDPVSSRPDA

SEQ ID NO: 990714 - protein, 5 aa, Mycobacterium
LQGNN

SEQ ID NO: 990715 - protein, 9 aa, Mycobacterium
LQGQEGDRG

SEQ ID NO: 990716 - protein, 9 aa, Mycobacterium
LQGTTGGEY

SEQ ID NO: 990717 - protein, 19 aa, Mycobacterium
LQNAQGVATAYNEVSGEQL

SEQ ID NO: 990718 - protein, 4 aa, Mycobacterium
LQPA

SEQ ID NO: 990719 - protein, 8 aa, Mycobacterium
LQPDPEDL

SEQ ID NO: 990720 - protein, 6 aa, Mycobacterium
LQPGPV

SEQ ID NO: 990721 - protein, 10 aa, Mycobacterium
LQPGSAGLGR

SEQ ID NO: 990722 - protein, 12 aa, Mycobacterium
LQPGSPAYRYLL

SEQ ID NO: 990723 - protein, 12 aa, Mycobacterium
LQPNAGSQGEYA

SEQ ID NO: 990724 - protein, 5 aa, Mycobacterium
LQPND

SEQ ID NO: 990725 - protein, 34 aa, Mycobacterium
LQPPEAGAGHADDVSGAEQLPATLAETAATWSHN

SEQ ID NO: 990726 - protein, 12 aa, Mycobacterium
LQPSDGPQPGDE

SEQ ID NO: 990727 - protein, 6 aa, Mycobacterium
LQQERE

SEQ ID NO: 990728 - protein, 7 aa, Mycobacterium
LQQPVGA

SEQ ID NO: 990729 - protein, 13 aa, Mycobacterium
LQRAQETAAPIAE

SEQ ID NO: 990730 - protein, 7 aa, Mycobacterium
LQRDSDD

SEQ ID NO: 990731 - protein, 7 aa, Mycobacterium
LQRSGLS

SEQ ID NO: 990732 - protein, 11 aa, Mycobacterium
LQSAERDAERQ

SEQ ID NO: 990733 - protein, 16 aa, Mycobacterium
LQSDSAAVAETARKQA

SEQ ID NO: 990734 - protein, 9 aa, Mycobacterium
LQSSAIQRK

SEQ ID NO: 990735 - protein, 4 aa, Mycobacterium
LQTV

SEQ ID NO: 990736 - protein, 7 aa, Mycobacterium
LQVPSEE

SEQ ID NO: 990737 - protein, 14 aa, Mycobacterium
LRAARASSVLDGGP

SEQ ID NO: 990738 - protein, 6 aa, Mycobacterium
LRAQTA

SEQ ID NO: 990739 - protein, 8 aa, Mycobacterium
LRAQTRNQ

SEQ ID NO: 990740 - protein, 8 aa, Mycobacterium
LRDEQPTV

SEQ ID NO: 990741 - protein, 9 aa, Mycobacterium
LRDGPGGEL

SEQ ID NO: 990742 - protein, 11 aa, Mycobacterium
LRDPGAPVPAH

SEQ ID NO: 990743 - protein, 8 aa, Mycobacterium
LRDTDEVM

SEQ ID NO: 990744 - protein, 11 aa, Mycobacterium
LRDTRNGMSIP

SEQ ID NO: 990745 - protein, 6 aa, Mycobacterium
LRDTSI

SEQ ID NO: 990746 - protein, 13 aa, Mycobacterium
LREGEDEDLERAA

SEQ ID NO: 990747 - protein, 4 aa, Mycobacterium
LREH

SEQ ID NO: 990748 - protein, 5 aa, Mycobacterium
LREPR

SEQ ID NO: 990749 - protein, 13 aa, Mycobacterium
LRESSGARARGTG

SEQ ID NO: 990750 - protein, 20 aa, Mycobacterium
LRGDPSDNLPGIPGVGEKTA

SEQ ID NO: 990751 - protein, 13 aa, Mycobacterium
LRGGATRLQPSGR

SEQ ID NO: 990752 - protein, 15 aa, Mycobacterium
LRGQSRPSHPARRGL

SEQ ID NO: 990753 - protein, 4 aa, Mycobacterium
LRHT

SEQ ID NO: 990754 - protein, 12 aa, Mycobacterium
LRIPTPTGATND

SEQ ID NO: 990755 - protein, 17 aa, Mycobacterium
LRKPGPLQAMLDAVFWF

SEQ ID NO: 990756 - protein, 6 aa, Mycobacterium
LRNGEA

SEQ ID NO: 990757 - protein, 18 aa, Mycobacterium
LRPAANSFEAQAARDGLV

SEQ ID NO: 990758 - protein, 8 aa, Mycobacterium
LRPAEKDA

SEQ ID NO: 990759 - protein, 15 aa, Mycobacterium
LRPAYSNADAARQVA

SEQ ID NO: 990760 - protein, 4 aa, Mycobacterium
LRPE

SEQ ID NO: 990761 - protein, 5 aa, Mycobacterium
LRPEA

SEQ ID NO: 990762 - protein, 5 aa, Mycobacterium
LRPED

SEQ ID NO: 990763 - protein, 9 aa, Mycobacterium
LRPEGRNGE

SEQ ID NO: 990764 - protein, 25 aa, Mycobacterium
LRPGDSILGEEGGGPADLTATPADT

SEQ ID NO: 990765 - protein, 5 aa, Mycobacterium
LRPGG

SEQ ID NO: 990766 - protein, 7 aa, Mycobacterium
LRPGGIG

SEQ ID NO: 990767 - protein, 5 aa, Mycobacterium
LRPGQ

SEQ ID NO: 990768 - protein, 7 aa, Mycobacterium
LRPGTRY

SEQ ID NO: 990769 - protein, 13 aa, Mycobacterium
LRPKDYSEARTIG

SEQ ID NO: 990770 - protein, 5 aa, Mycobacterium
LRPPK

SEQ ID NO: 990771 - protein, 5 aa, Mycobacterium
LRPRG

SEQ ID NO: 990772 - protein, 8 aa, Mycobacterium
LRPSNKVG

SEQ ID NO: 990773 - protein, 8 aa, Mycobacterium
LRPTTPNN

SEQ ID NO: 990774 - protein, 8 aa, Mycobacterium
LRQGSQAR

SEQ ID NO: 990775 - protein, 30 aa, Mycobacterium
LRRAQRGSADPRCARRNRHRGNHQSDQFGA

SEQ ID NO: 990776 - protein, 11 aa, Mycobacterium
LRRDPNRPRAV

SEQ ID NO: 990777 - protein, 12 aa, Mycobacterium
LRREKDDVTEVR

SEQ ID NO: 990778 - protein, 6 aa, Mycobacterium
LRRGSD

SEQ ID NO: 990779 - protein, 11 aa, Mycobacterium
LRRKVGQASGH

SEQ ID NO: 990780 - protein, 18 aa, Mycobacterium
LRRRGKTNTDKQRCASGV

SEQ ID NO: 990781 - protein, 7 aa, Mycobacterium
LRSAATR

SEQ ID NO: 990782 - protein, 12 aa, Mycobacterium
LRSGDVTTATDS

SEQ ID NO: 990783 - protein, 9 aa, Mycobacterium
LRSPDGAVL

SEQ ID NO: 990784 - protein, 18 aa, Mycobacterium
LRSPDKKFPSPEIRARLV

SEQ ID NO: 990785 - protein, 11 aa, Mycobacterium
LRSPPKSMRTS

SEQ ID NO: 990786 - protein, 5 aa, Mycobacterium
LRSPR

SEQ ID NO: 990787 - protein, 9 aa, Mycobacterium
LRSQADAAG

SEQ ID NO: 990788 - protein, 4 aa, Mycobacterium
LRSS

SEQ ID NO: 990789 - protein, 6 aa, Mycobacterium
LRSSAG

SEQ ID NO: 990790 - protein, 5 aa, Mycobacterium
LRSSS

SEQ ID NO: 990791 - protein, 4 aa, Mycobacterium
LRTA

SEQ ID NO: 990792 - protein, 4 aa, Mycobacterium
LRTE

SEQ ID NO: 990793 - protein, 18 aa, Mycobacterium
LRTEYPEPSYASRESTKS

SEQ ID NO: 990794 - protein, 4 aa, Mycobacterium
LRTG

SEQ ID NO: 990795 - protein, 7 aa, Mycobacterium
LRTGASP

SEQ ID NO: 990796 - protein, 5 aa, Mycobacterium
LRTPG

SEQ ID NO: 990797 - protein, 6 aa, Mycobacterium
LRTPTR

SEQ ID NO: 990798 - protein, 8 aa, Mycobacterium
LRTTTAPV

SEQ ID NO: 990799 - protein, 10 aa, Mycobacterium
LRTTTNNRQR

SEQ ID NO: 990800 - protein, 16 aa, Mycobacterium
LSAADPGPGDVPTSAS

SEQ ID NO: 990801 - protein, 18 aa, Mycobacterium
LSAEQAKWARKAIDNEGL

SEQ ID NO: 990802 - protein, 16 aa, Mycobacterium
LSAESDYDTDSDSRNV

SEQ ID NO: 990803 - protein, 6 aa, Mycobacterium
LSAGES

SEQ ID NO: 990804 - protein, 10 aa, Mycobacterium
LSAGSGSPGF

SEQ ID NO: 990805 - protein, 4 aa, Mycobacterium
LSAP

SEQ ID NO: 990806 - protein, 5 aa, Mycobacterium
LSAQA

SEQ ID NO: 990807 - protein, 10 aa, Mycobacterium
LSASDRLKAT

SEQ ID NO: 990808 - protein, 20 aa, Mycobacterium
LSATHSSTGAQLQVKSEDQQ

SEQ ID NO: 990809 - protein, 5 aa, Mycobacterium
LSDGG

SEQ ID NO: 990810 - protein, 9 aa, Mycobacterium
LSDKNGRIA

SEQ ID NO: 990811 - protein, 14 aa, Mycobacterium
LSDPPKLKKQEKHD

SEQ ID NO: 990812 - protein, 4 aa, Mycobacterium
LSDQ

SEQ ID NO: 990813 - protein, 8 aa, Mycobacterium
LSDSSAPL

SEQ ID NO: 990814 - protein, 9 aa, Mycobacterium
LSDYTADDT

SEQ ID NO: 990815 - protein, 9 aa, Mycobacterium
LSEDDSHSR

SEQ ID NO: 990816 - protein, 8 aa, Mycobacterium
LSEEDKQL

SEQ ID NO: 990817 - protein, 7 aa, Mycobacterium
LSEGTVK

SEQ ID NO: 990818 - protein, 7 aa, Mycobacterium
LSEPATE

SEQ ID NO: 990819 - protein, 6 aa, Mycobacterium
LSEPTR

SEQ ID NO: 990820 - protein, 5 aa, Mycobacterium
LSEQH

SEQ ID NO: 990821 - protein, 9 aa, Mycobacterium
LSETGRAQV

SEQ ID NO: 990822 - protein, 5 aa, Mycobacterium
LSGAA

SEQ ID NO: 990823 - protein, 18 aa, Mycobacterium
LSGDRRTYQQEPGNAREA

SEQ ID NO: 990824 - protein, 17 aa, Mycobacterium
LSGEGTSYYTDTFNQQP

SEQ ID NO: 990825 - protein, 4 aa, Mycobacterium
LSGG

SEQ ID NO: 990826 - protein, 8 aa, Mycobacterium
LSGGAKEQ

SEQ ID NO: 990827 - protein, 8 aa, Mycobacterium
LSGGERNR

SEQ ID NO: 990828 - protein, 7 aa, Mycobacterium
LSGGERQ

SEQ ID NO: 990829 - protein, 8 aa, Mycobacterium
LSGGGTQV

SEQ ID NO: 990830 - protein, 16 aa, Mycobacterium
LSGGKAVAEVGTGAGV

SEQ ID NO: 990831 - protein, 9 aa, Mycobacterium
LSGPGQQLT

SEQ ID NO: 990832 - protein, 6 aa, Mycobacterium
LSGQGT

SEQ ID NO: 990833 - protein, 8 aa, Mycobacterium
LSGRPDTL

SEQ ID NO: 990834 - protein, 12 aa, Mycobacterium
LSGSEEDETAWR

SEQ ID NO: 990835 - protein, 9 aa, Mycobacterium
LSGSGKSSL

SEQ ID NO: 990836 - protein, 19 aa, Mycobacterium
LSGTPATPGDIDSAYERPN

SEQ ID NO: 990837 - protein, 7 aa, Mycobacterium
LSKQRGR

SEQ ID NO: 990838 - protein, 7 aa, Mycobacterium
LSKRGGG

SEQ ID NO: 990839 - protein, 6 aa, Mycobacterium
LSKTYG

SEQ ID NO: 990840 - protein, 7 aa, Mycobacterium
LSNGGQA

SEQ ID NO: 990841 - protein, 15 aa, Mycobacterium
LSNQKYTDLTARYGR

SEQ ID NO: 990842 - protein, 12 aa, Mycobacterium
LSNWRTDGAPVT

SEQ ID NO: 990843 - protein, 6 aa, Mycobacterium
LSPAPQ

SEQ ID NO: 990844 - protein, 5 aa, Mycobacterium
LSPAQ

SEQ ID NO: 990845 - protein, 4 aa, Mycobacterium
LSPD

SEQ ID NO: 990846 - protein, 8 aa, Mycobacterium
LSPDAPAL

SEQ ID NO: 990847 - protein, 6 aa, Mycobacterium
LSPDEL

SEQ ID NO: 990848 - protein, 7 aa, Mycobacterium
LSPGADI

SEQ ID NO: 990849 - protein, 5 aa, Mycobacterium
LSPGE

SEQ ID NO: 990850 - protein, 8 aa, Mycobacterium
LSPGLKRS

SEQ ID NO: 990851 - protein, 13 aa, Mycobacterium
LSPITSVAGRKGY

SEQ ID NO: 990852 - protein, 9 aa, Mycobacterium
LSPKQFDGV

SEQ ID NO: 990853 - protein, 4 aa, Mycobacterium
LSPN

SEQ ID NO: 990854 - protein, 9 aa, Mycobacterium
LSPNADENH

SEQ ID NO: 990855 - protein, 8 aa, Mycobacterium
LSPPAAER

SEQ ID NO: 990856 - protein, 7 aa, Mycobacterium
LSPSDID

SEQ ID NO: 990857 - protein, 6 aa, Mycobacterium
LSPYTP

SEQ ID NO: 990858 - protein, 9 aa, Mycobacterium
LSQGGPTPF

SEQ ID NO: 990859 - protein, 8 aa, Mycobacterium
LSQNEGVN

SEQ ID NO: 990860 - protein, 10 aa, Mycobacterium
LSRAGDGPFN

SEQ ID NO: 990861 - protein, 5 aa, Mycobacterium
LSRAS

SEQ ID NO: 990862 - protein, 6 aa, Mycobacterium
LSRRGR

SEQ ID NO: 990863 - protein, 4 aa, Mycobacterium
LSRS

SEQ ID NO: 990864 - protein, 11 aa, Mycobacterium
LSSDGHGGGLP

SEQ ID NO: 990865 - protein, 12 aa, Mycobacterium
LSSPDYREAAQR

SEQ ID NO: 990866 - protein, 6 aa, Mycobacterium
LSSPKQ

SEQ ID NO: 990867 - protein, 5 aa, Mycobacterium
LSSRH

SEQ ID NO: 990868 - protein, 7 aa, Mycobacterium
LSSRQRR

SEQ ID NO: 990869 - protein, 8 aa, Mycobacterium
LSSSDRAR

SEQ ID NO: 990870 - protein, 5 aa, Mycobacterium
LSSTA

SEQ ID NO: 990871 - protein, 7 aa, Mycobacterium
LSSTPRQ

SEQ ID NO: 990872 - protein, 16 aa, Mycobacterium
LSTDGDLADVTTELDD

SEQ ID NO: 990873 - protein, 5 aa, Mycobacterium
LSTDH

SEQ ID NO: 990874 - protein, 9 aa, Mycobacterium
LSTDKPESV

SEQ ID NO: 990875 - protein, 5 aa, Mycobacterium
LSTDT

SEQ ID NO: 990876 - protein, 33 aa, Mycobacterium
LSTGGTAAFPGGTPASIATNQASDVHVVEKSLG

SEQ ID NO: 990877 - protein, 5 aa, Mycobacterium
LSTKA

SEQ ID NO: 990878 - protein, 13 aa, Mycobacterium
LSTLPKPTSPSAT

SEQ ID NO: 990879 - protein, 5 aa, Mycobacterium
LSTNP

SEQ ID NO: 990880 - protein, 6 aa, Mycobacterium
LSTSGI

SEQ ID NO: 990881 - protein, 10 aa, Mycobacterium
LSTSKRPADL

SEQ ID NO: 990882 - protein, 16 aa, Mycobacterium
LSTSLSSAGPVESRGD

SEQ ID NO: 990883 - protein, 10 aa, Mycobacterium
LSTTALPGAS

SEQ ID NO: 990884 - protein, 9 aa, Mycobacterium
LSVSPSTVT

SEQ ID NO: 990885 - protein, 4 aa, Mycobacterium
LSYE

SEQ ID NO: 990886 - protein, 14 aa, Mycobacterium
LSYSPQSDGTLSPE

SEQ ID NO: 990887 - protein, 15 aa, Mycobacterium
LTAAPQSGSQASPWN

SEQ ID NO: 990888 - protein, 8 aa, Mycobacterium
LTAEDPHR

SEQ ID NO: 990889 - protein, 15 aa, Mycobacterium
LTAGAAKRDPTLGPP

SEQ ID NO: 990890 - protein, 17 aa, Mycobacterium
LTAGAHAATGGAQAALD

SEQ ID NO: 990891 - protein, 17 aa, Mycobacterium
LTANDPQFAAAKPDPAV

SEQ ID NO: 990892 - protein, 16 aa, Mycobacterium
LTASASATHDRLGGPG

SEQ ID NO: 990893 - protein, 7 aa, Mycobacterium
LTASEKQ

SEQ ID NO: 990894 - protein, 13 aa, Mycobacterium
LTATRPVEKLWTV

SEQ ID NO: 990895 - protein, 9 aa, Mycobacterium
LTDAAARVE

SEQ ID NO: 990896 - protein, 24 aa, Mycobacterium
LTDEQRAAALEKAAAARRARAELK

SEQ ID NO: 990897 - protein, 13 aa, Mycobacterium
LTDKGRAEAVRSG

SEQ ID NO: 990898 - protein, 5 aa, Mycobacterium
LTDPA

SEQ ID NO: 990899 - protein, 7 aa, Mycobacterium
LTDPDDM

SEQ ID NO: 990900 - protein, 17 aa, Mycobacterium
LTEDEIGEYSGERKEIR

SEQ ID NO: 990901 - protein, 8 aa, Mycobacterium
LTEDETAR

SEQ ID NO: 990902 - protein, 8 aa, Mycobacterium
LTEERRRE

SEQ ID NO: 990903 - protein, 8 aa, Mycobacterium
LTEQRNDV

SEQ ID NO: 990904 - protein, 5 aa, Mycobacterium
LTERG

SEQ ID NO: 990905 - protein, 10 aa, Mycobacterium
LTESGRTPGL

SEQ ID NO: 990906 - protein, 6 aa, Mycobacterium
LTGADT

SEQ ID NO: 990907 - protein, 10 aa, Mycobacterium
LTGDEATGAN

SEQ ID NO: 990908 - protein, 9 aa, Mycobacterium
LTGELEGRH

SEQ ID NO: 990909 - protein, 10 aa, Mycobacterium
LTGERGRYAC

SEQ ID NO: 990910 - protein, 4 aa, Mycobacterium
LTGG

SEQ ID NO: 990911 - protein, 17 aa, Mycobacterium
LTGGTDPVEKAAPGTIR

SEQ ID NO: 990912 - protein, 7 aa, Mycobacterium
LTGKDRS

SEQ ID NO: 990913 - protein, 7 aa, Mycobacterium
LTGQHSA

SEQ ID NO: 990914 - protein, 14 aa, Mycobacterium
LTGQPAKQAAFEPL

SEQ ID NO: 990915 - protein, 14 aa, Mycobacterium
LTGQVSGKLVRLTL

SEQ ID NO: 990916 - protein, 5 aa, Mycobacterium
LTGRT

SEQ ID NO: 990917 - protein, 15 aa, Mycobacterium
LTHADEDSECDELSR

SEQ ID NO: 990918 - protein, 8 aa, Mycobacterium
LTKDSRKK

SEQ ID NO: 990919 - protein, 16 aa, Mycobacterium
LTKPERQLGTVRAVIP

SEQ ID NO: 990920 - protein, 9 aa, Mycobacterium
LTKPTRPDL

SEQ ID NO: 990921 - protein, 11 aa, Mycobacterium
LTKSARGEYEI

SEQ ID NO: 990922 - protein, 4 aa, Mycobacterium
LTNV

SEQ ID NO: 990923 - protein, 5 aa, Mycobacterium
LTPAE

SEQ ID NO: 990924 - protein, 7 aa, Mycobacterium
LTPDEAA

SEQ ID NO: 990925 - protein, 5 aa, Mycobacterium
LTPDK

SEQ ID NO: 990926 - protein, 4 aa, Mycobacterium
LTPG

SEQ ID NO: 990927 - protein, 6 aa, Mycobacterium
LTPNGL

SEQ ID NO: 990928 - protein, 15 aa, Mycobacterium
LTPPPMSSSCNREES

SEQ ID NO: 990929 - protein, 9 aa, Mycobacterium
LTPPPQPNR

SEQ ID NO: 990930 - protein, 8 aa, Mycobacterium
LTPQNQSL

SEQ ID NO: 990931 - protein, 7 aa, Mycobacterium
LTPSLSE

SEQ ID NO: 990932 - protein, 9 aa, Mycobacterium
LTPTPNAAG

SEQ ID NO: 990933 - protein, 6 aa, Mycobacterium
LTPTQG

SEQ ID NO: 990934 - protein, 7 aa, Mycobacterium
LTPTSDR

SEQ ID NO: 990935 - protein, 22 aa, Mycobacterium
LTPTTAYHADASPDDFGGVLVV

SEQ ID NO: 990936 - protein, 5 aa, Mycobacterium
LTPVT

SEQ ID NO: 990937 - protein, 4 aa, Mycobacterium
LTQA

SEQ ID NO: 990938 - protein, 8 aa, Mycobacterium
LTQVGSSG

SEQ ID NO: 990939 - protein, 16 aa, Mycobacterium
LTRATTRGDGRTGEDV

SEQ ID NO: 990940 - protein, 6 aa, Mycobacterium
LTRPAF

SEQ ID NO: 990941 - protein, 4 aa, Mycobacterium
LTSD

SEQ ID NO: 990942 - protein, 9 aa, Mycobacterium
LTSEEERAQ

SEQ ID NO: 990943 - protein, 12 aa, Mycobacterium
LTSEVARTSASH

SEQ ID NO: 990944 - protein, 5 aa, Mycobacterium
LTSPE

SEQ ID NO: 990945 - protein, 18 aa, Mycobacterium
LTSSPQRCSPCWRIRPTA

SEQ ID NO: 990946 - protein, 9 aa, Mycobacterium
LTSTSNCTT

SEQ ID NO: 990947 - protein, 7 aa, Mycobacterium
LTTESGA

SEQ ID NO: 990948 - protein, 31 aa, Mycobacterium
LTTNTEKQALDRAGLPTSAEDKGAQAAAAAL

SEQ ID NO: 990949 - protein, 7 aa, Mycobacterium
LTTPRSD

SEQ ID NO: 990950 - protein, 12 aa, Mycobacterium
LTTPSPDRATVA

SEQ ID NO: 990951 - protein, 12 aa, Mycobacterium
LTTRPDSPKPAS

SEQ ID NO: 990952 - protein, 11 aa, Mycobacterium
LTTRSEEIHRA

SEQ ID NO: 990953 - protein, 9 aa, Mycobacterium
LTTSAPDGT

SEQ ID NO: 990954 - protein, 13 aa, Mycobacterium
LTVGSGDHHRRTA

SEQ ID NO: 990955 - protein, 29 aa, Mycobacterium
LVEEGKNPFANPRNSAAGSLRQKDPAVTA

SEQ ID NO: 990956 - protein, 7 aa, Mycobacterium
LVETSRK

SEQ ID NO: 990957 - protein, 10 aa, Mycobacterium
LVGNERSQHE

SEQ ID NO: 990958 - protein, 10 aa, Mycobacterium
LVRPSSGRAV

SEQ ID NO: 990959 - protein, 9 aa, Mycobacterium
LVSGPVTTT

SEQ ID NO: 990960 - protein, 11 aa, Mycobacterium
LVSGSDAKESR

SEQ ID NO: 990961 - protein, 12 aa, Mycobacterium
LWPGAGPDQFDS

SEQ ID NO: 990962 - protein, 29 aa, Mycobacterium
LYAESGGQIADAGTISGIGAGASSRAAVT

SEQ ID NO: 990963 - protein, 5 aa, Mycobacterium
LYGPD

SEQ ID NO: 990964 - protein, 4 aa, Mycobacterium
LYPG

SEQ ID NO: 990965 - protein, 4 aa, Mycobacterium
LYPP

SEQ ID NO: 990966 - protein, 6 aa, Mycobacterium
LYSGAS

SEQ ID NO: 990967 - protein, 5 aa, Mycobacterium
LYSKQ

SEQ ID NO: 990968 - protein, 8 aa, Mycobacterium
LYSTAAPL

SEQ ID NO: 990969 - protein, 7 aa, Mycobacterium
MAAAGES

SEQ ID NO: 990970 - protein, 20 aa, Mycobacterium
MADGPAHPAPSADELNNAPL

SEQ ID NO: 990971 - protein, 4 aa, Mycobacterium
MAED

SEQ ID NO: 990972 - protein, 8 aa, Mycobacterium
MAKSGTAH

SEQ ID NO: 990973 - protein, 7 aa, Mycobacterium
MAKTGAT

SEQ ID NO: 990974 - protein, 8 aa, Mycobacterium
MAPPSTKA

SEQ ID NO: 990975 - protein, 8 aa, Mycobacterium
MARESSRC

SEQ ID NO: 990976 - protein, 9 aa, Mycobacterium
MARQHPSPR

SEQ ID NO: 990977 - protein, 4 aa, Mycobacterium
MASD

SEQ ID NO: 990978 - protein, 7 aa, Mycobacterium
MASGGTR

SEQ ID NO: 990979 - protein, 12 aa, Mycobacterium
MATKEATTSPSV

SEQ ID NO: 990980 - protein, 7 aa, Mycobacterium
MDGPTSA

SEQ ID NO: 990981 - protein, 9 aa, Mycobacterium
MDQKNTLDR

SEQ ID NO: 990982 - protein, 9 aa, Mycobacterium
MDREGRPRS

SEQ ID NO: 990983 - protein, 11 aa, Mycobacterium
MDRTGTGTRSL

SEQ ID NO: 990984 - protein, 7 aa, Mycobacterium
MDSGQQV

SEQ ID NO: 990985 - protein, 19 aa, Mycobacterium
MDSRSTTWSSYNEKHNKAN

SEQ ID NO: 990986 - protein, 17 aa, Mycobacterium
MDTHADKALETLRARST

SEQ ID NO: 990987 - protein, 6 aa, Mycobacterium
MDYPGT

SEQ ID NO: 990988 - protein, 9 aa, Mycobacterium
MEDAEAHAY

SEQ ID NO: 990989 - protein, 7 aa, Mycobacterium
MEDARKT

SEQ ID NO: 990990 - protein, 19 aa, Mycobacterium
MEEDTGKLTHLGSETGRIY

SEQ ID NO: 990991 - protein, 5 aa, Mycobacterium
MEGAQ

SEQ ID NO: 990992 - protein, 9 aa, Mycobacterium
MENANENIN

SEQ ID NO: 990993 - protein, 7 aa, Mycobacterium
MEPEQSD

SEQ ID NO: 990994 - protein, 12 aa, Mycobacterium
MEQTESEQMKER

SEQ ID NO: 990995 - protein, 13 aa, Mycobacterium
MEQTGGFEGRTKK

SEQ ID NO: 990996 - protein, 12 aa, Mycobacterium
MERPGLDYLDLS

SEQ ID NO: 990997 - protein, 20 aa, Mycobacterium
MESNGKSTRADGTPVTTNTG

SEQ ID NO: 990998 - protein, 7 aa, Mycobacterium
MGARKSP

SEQ ID NO: 990999 - protein, 5 aa, Mycobacterium
MGATE

SEQ ID NO: 991000 - protein, 7 aa, Mycobacterium
MGDTTDD

SEQ ID NO: 991001 - protein, 21 aa, Mycobacterium
MGEDGEQGRGGVSRKGGVAVP

SEQ ID NO: 991002 - protein, 6 aa, Mycobacterium
MGESAA

SEQ ID NO: 991003 - protein, 6 aa, Mycobacterium
MGESFS

SEQ ID NO: 991004 - protein, 12 aa, Mycobacterium
MGGKKLSAASAA

SEQ ID NO: 991005 - protein, 9 aa, Mycobacterium
MGKKKREVL

SEQ ID NO: 991006 - protein, 11 aa, Mycobacterium
MGPGTKLPTLG

SEQ ID NO: 991007 - protein, 5 aa, Mycobacterium
MGRGQ

SEQ ID NO: 991008 - protein, 7 aa, Mycobacterium
MGRSAGA

SEQ ID NO: 991009 - protein, 19 aa, Mycobacterium
MGRTNANDSIHIRRRVIHP

SEQ ID NO: 991010 - protein, 19 aa, Mycobacterium
MGSEQTAAAEGKVGTVRRD

SEQ ID NO: 991011 - protein, 15 aa, Mycobacterium
MGSRVESPVRTGAVR

SEQ ID NO: 991012 - protein, 23 aa, Mycobacterium
MGTEKGSDHCSETTRSGSPVVTV

SEQ ID NO: 991013 - protein, 14 aa, Mycobacterium
MGTGGELAIDWPVS

SEQ ID NO: 991014 - protein, 11 aa, Mycobacterium
MGTGMGGGTSI

SEQ ID NO: 991015 - protein, 6 aa, Mycobacterium
MKDGQD

SEQ ID NO: 991016 - protein, 9 aa, Mycobacterium
MKKDSKKKY

SEQ ID NO: 991017 - protein, 4 aa, Mycobacterium
MKNS

SEQ ID NO: 991018 - protein, 7 aa, Mycobacterium
MKPPENP

SEQ ID NO: 991019 - protein, 6 aa, Mycobacterium
MKPSAP

SEQ ID NO: 991020 - protein, 38 aa, Mycobacterium
MKPSGESHSDSCGERSGEIRNEPDAAVPSGDAVLGGSA

SEQ ID NO: 991021 - protein, 21 aa, Mycobacterium
MKQTEVGRSPRHLRDIGRGYG

SEQ ID NO: 991022 - protein, 6 aa, Mycobacterium
MKTEPA

SEQ ID NO: 991023 - protein, 8 aa, Mycobacterium
MKTGEGKT

SEQ ID NO: 991024 - protein, 5 aa, Mycobacterium
MLPPG

SEQ ID NO: 991025 - protein, 11 aa, Mycobacterium
MNAGDDAQAAA

SEQ ID NO: 991026 - protein, 4 aa, Mycobacterium
MPAE

SEQ ID NO: 991027 - protein, 4 aa, Mycobacterium
MPDD

SEQ ID NO: 991028 - protein, 4 aa, Mycobacterium
MPDR

SEQ ID NO: 991029 - protein, 6 aa, Mycobacterium
MPGEEV

SEQ ID NO: 991030 - protein, 8 aa, Mycobacterium
MPGLPPLS

SEQ ID NO: 991031 - protein, 4 aa, Mycobacterium
MPHT

SEQ ID NO: 991032 - protein, 6 aa, Mycobacterium
MPLPQH

SEQ ID NO: 991033 - protein, 7 aa, Mycobacterium
MPNGAAA

SEQ ID NO: 991034 - protein, 6 aa, Mycobacterium
MPPNPA

SEQ ID NO: 991035 - protein, 6 aa, Mycobacterium
MPPSER

SEQ ID NO: 991036 - protein, 4 aa, Mycobacterium
MPRW

SEQ ID NO: 991037 - protein, 12 aa, Mycobacterium
MPSSPAAGSLHL

SEQ ID NO: 991038 - protein, 8 aa, Mycobacterium
MPTPDSKP

SEQ ID NO: 991039 - protein, 7 aa, Mycobacterium
MQTGTHP

SEQ ID NO: 991040 - protein, 15 aa, Mycobacterium
MRETRGVPEGADSIE

SEQ ID NO: 991041 - protein, 13 aa, Mycobacterium
MRGQQVESLVTSS

SEQ ID NO: 991042 - protein, 16 aa, Mycobacterium
MRPTAPPPTPPTYMAG

SEQ ID NO: 991043 - protein, 13 aa, Mycobacterium
MRPYGSTSRVQTR

SEQ ID NO: 991044 - protein, 14 aa, Mycobacterium
MRQPNEMIDEARRP

SEQ ID NO: 991045 - protein, 8 aa, Mycobacterium
MRQREDRD

SEQ ID NO: 991046 - protein, 14 aa, Mycobacterium
MRRDPATFGDQPER

SEQ ID NO: 991047 - protein, 6 aa, Mycobacterium
MSAASR

SEQ ID NO: 991048 - protein, 49 aa, Mycobacterium
MSAKAADELAEEPVEPEVEPDDEDGADSATAQANNSDDTEDESRTAGDT

SEQ ID NO: 991049 - protein, 4 aa, Mycobacterium
MSAP

SEQ ID NO: 991050 - protein, 9 aa, Mycobacterium
MSDDRGRPC

SEQ ID NO: 991051 - protein, 9 aa, Mycobacterium
MSDSDNRDT

SEQ ID NO: 991052 - protein, 21 aa, Mycobacterium
MSEDERRALKRRNTRTKARSG

SEQ ID NO: 991053 - protein, 12 aa, Mycobacterium
MSEEKDESTMAE

SEQ ID NO: 991054 - protein, 7 aa, Mycobacterium
MSETAGG

SEQ ID NO: 991055 - protein, 5 aa, Mycobacterium
MSGAG

SEQ ID NO: 991056 - protein, 7 aa, Mycobacterium
MSGSNIR

SEQ ID NO: 991057 - protein, 13 aa, Mycobacterium
MSGYQETLTDPSY

SEQ ID NO: 991058 - protein, 9 aa, Mycobacterium
MSKNEPEDY

SEQ ID NO: 991059 - protein, 13 aa, Mycobacterium
MSPEGPPPPKAFG

SEQ ID NO: 991060 - protein, 6 aa, Mycobacterium
MSPETG

SEQ ID NO: 991061 - protein, 4 aa, Mycobacterium
MSRF

SEQ ID NO: 991062 - protein, 8 aa, Mycobacterium
MSRGEHQS

SEQ ID NO: 991063 - protein, 6 aa, Mycobacterium
MSRQRS

SEQ ID NO: 991064 - protein, 10 aa, Mycobacterium
MSRSATRMAK

SEQ ID NO: 991065 - protein, 10 aa, Mycobacterium
MSSPSTTSSW

SEQ ID NO: 991066 - protein, 9 aa, Mycobacterium
MSTNASWTP

SEQ ID NO: 991067 - protein, 7 aa, Mycobacterium
MSVRPEK

SEQ ID NO: 991068 - protein, 7 aa, Mycobacterium
MTGPADD

SEQ ID NO: 991069 - protein, 12 aa, Mycobacterium
MTIGQTTLTEGD

SEQ ID NO: 991070 - protein, 5 aa, Mycobacterium
MTLNT

SEQ ID NO: 991071 - protein, 12 aa, Mycobacterium
MTNRQDSEFGRS

SEQ ID NO: 991072 - protein, 18 aa, Mycobacterium
MTPPAGAASPEIRSTSRL

SEQ ID NO: 991073 - protein, 11 aa, Mycobacterium
MTQGSAGRPIV

SEQ ID NO: 991074 - protein, 10 aa, Mycobacterium
MTSGPALERA

SEQ ID NO: 991075 - protein, 8 aa, Mycobacterium
MTTDGQRS

SEQ ID NO: 991076 - protein, 4 aa, Mycobacterium
MTTQ

SEQ ID NO: 991077 - protein, 13 aa, Mycobacterium
MYETGAGGSAPKH

SEQ ID NO: 991078 - protein, 7 aa, Mycobacterium
MYSGPGG

SEQ ID NO: 991079 - protein, 15 aa, Mycobacterium
NAAAGYRYSVEARSG

SEQ ID NO: 991080 - protein, 9 aa, Mycobacterium
NAADDARAA

SEQ ID NO: 991081 - protein, 8 aa, Mycobacterium
NAAGHTGE

SEQ ID NO: 991082 - protein, 5 aa, Mycobacterium
NAANS

SEQ ID NO: 991083 - protein, 28 aa, Mycobacterium
NAAPEPDLRATAKRAINDVRRGVVAVDA

SEQ ID NO: 991084 - protein, 14 aa, Mycobacterium
NAASAKKDAELQAN

SEQ ID NO: 991085 - protein, 6 aa, Mycobacterium
NAASRC

SEQ ID NO: 991086 - protein, 10 aa, Mycobacterium
NAATENQRGQ

SEQ ID NO: 991087 - protein, 8 aa, Mycobacterium
NAATGEYE

SEQ ID NO: 991088 - protein, 6 aa, Mycobacterium
NADGSV

SEQ ID NO: 991089 - protein, 6 aa, Mycobacterium
NADGTL

SEQ ID NO: 991090 - protein, 4 aa, Mycobacterium
NADN

SEQ ID NO: 991091 - protein, 7 aa, Mycobacterium
NADPERI

SEQ ID NO: 991092 - protein, 13 aa, Mycobacterium
NAEATLEEAQENK

SEQ ID NO: 991093 - protein, 14 aa, Mycobacterium
NAEGRRLPTASMCL

SEQ ID NO: 991094 - protein, 6 aa, Mycobacterium
NAEHTG

SEQ ID NO: 991095 - protein, 4 aa, Mycobacterium
NAEP

SEQ ID NO: 991096 - protein, 8 aa, Mycobacterium
NAFEDTAE

SEQ ID NO: 991097 - protein, 12 aa, Mycobacterium
NAGDGTHEHPTQ

SEQ ID NO: 991098 - protein, 5 aa, Mycobacterium
NAGGA

SEQ ID NO: 991099 - protein, 9 aa, Mycobacterium
NAGGPRKVS

SEQ ID NO: 991100 - protein, 5 aa, Mycobacterium
NAGHR

SEQ ID NO: 991101 - protein, 7 aa, Mycobacterium
NAGKAGL

SEQ ID NO: 991102 - protein, 6 aa, Mycobacterium
NAGLSA

SEQ ID NO: 991103 - protein, 8 aa, Mycobacterium
NAGLSSAD

SEQ ID NO: 991104 - protein, 5 aa, Mycobacterium
NAGND

SEQ ID NO: 991105 - protein, 12 aa, Mycobacterium
NAGNFSSIGSAD

SEQ ID NO: 991106 - protein, 9 aa, Mycobacterium
NAGPGTNGS

SEQ ID NO: 991107 - protein, 13 aa, Mycobacterium
NAGSVQPNHPDMA

SEQ ID NO: 991108 - protein, 7 aa, Mycobacterium
NAHQTRE

SEQ ID NO: 991109 - protein, 10 aa, Mycobacterium
NAKAATDRPS

SEQ ID NO: 991110 - protein, 15 aa, Mycobacterium
NAKDAKKQSAHGATV

SEQ ID NO: 991111 - protein, 6 aa, Mycobacterium
NAKRYA

SEQ ID NO: 991112 - protein, 9 aa, Mycobacterium
NAKSPQAQR

SEQ ID NO: 991113 - protein, 8 aa, Mycobacterium
NALDDPEP

SEQ ID NO: 991114 - protein, 6 aa, Mycobacterium
NAMTGE

SEQ ID NO: 991115 - protein, 14 aa, Mycobacterium
NANGTDTGLPDDEF

SEQ ID NO: 991116 - protein, 13 aa, Mycobacterium
NANIGQDKDIPHI

SEQ ID NO: 991117 - protein, 7 aa, Mycobacterium
NANKPAN

SEQ ID NO: 991118 - protein, 4 aa, Mycobacterium
NAPA

SEQ ID NO: 991119 - protein, 9 aa, Mycobacterium
NAPDGTQVA

SEQ ID NO: 991120 - protein, 7 aa, Mycobacterium
NAPDHPL

SEQ ID NO: 991121 - protein, 4 aa, Mycobacterium
NAPE

SEQ ID NO: 991122 - protein, 4 aa, Mycobacterium
NAPG

SEQ ID NO: 991123 - protein, 9 aa, Mycobacterium
NAPIQGSAA

SEQ ID NO: 991124 - protein, 8 aa, Mycobacterium
NAPLESNA

SEQ ID NO: 991125 - protein, 17 aa, Mycobacterium
NAPTDPHDAEKIPVTTD

SEQ ID NO: 991126 - protein, 6 aa, Mycobacterium
NAQCTP

SEQ ID NO: 991127 - protein, 7 aa, Mycobacterium
NAQGYSR

SEQ ID NO: 991128 - protein, 14 aa, Mycobacterium
NAQPVAVGERANPA

SEQ ID NO: 991129 - protein, 12 aa, Mycobacterium
NAQTPIERKPPW

SEQ ID NO: 991130 - protein, 13 aa, Mycobacterium
NARAAAELGSAAD

SEQ ID NO: 991131 - protein, 6 aa, Mycobacterium
NARAAW

SEQ ID NO: 991132 - protein, 7 aa, Mycobacterium
NARAGIA

SEQ ID NO: 991133 - protein, 15 aa, Mycobacterium
NARKAGTNVTHEDKH

SEQ ID NO: 991134 - protein, 5 aa, Mycobacterium
NARWG

SEQ ID NO: 991135 - protein, 16 aa, Mycobacterium
NASALSGATVSDATQG

SEQ ID NO: 991136 - protein, 6 aa, Mycobacterium
NASDAL

SEQ ID NO: 991137 - protein, 12 aa, Mycobacterium
NASDEVKESIAD

SEQ ID NO: 991138 - protein, 7 aa, Mycobacterium
NASEKAA

SEQ ID NO: 991139 - protein, 7 aa, Mycobacterium
NASGRDL

SEQ ID NO: 991140 - protein, 12 aa, Mycobacterium
NASGSERDEDGS

SEQ ID NO: 991141 - protein, 6 aa, Mycobacterium
NASPQG

SEQ ID NO: 991142 - protein, 14 aa, Mycobacterium
NATDSDRGQSLPAT

SEQ ID NO: 991143 - protein, 8 aa, Mycobacterium
NATDTSDL

SEQ ID NO: 991144 - protein, 10 aa, Mycobacterium
NATGDKAPLA

SEQ ID NO: 991145 - protein, 7 aa, Mycobacterium
NATGHPS

SEQ ID NO: 991146 - protein, 7 aa, Mycobacterium
NATGPEY

SEQ ID NO: 991147 - protein, 9 aa, Mycobacterium
NATNSIDPL

SEQ ID NO: 991148 - protein, 7 aa, Mycobacterium
NATPSAL

SEQ ID NO: 991149 - protein, 7 aa, Mycobacterium
NAVDEAG

SEQ ID NO: 991150 - protein, 7 aa, Mycobacterium
NCDPDEV

SEQ ID NO: 991151 - protein, 11 aa, Mycobacterium
NCGRDAAQPGS

SEQ ID NO: 991152 - protein, 4 aa, Mycobacterium
NCQA

SEQ ID NO: 991153 - protein, 17 aa, Mycobacterium
NCRDEELTATLAVVGLS

SEQ ID NO: 991154 - protein, 9 aa, Mycobacterium
NCSNNYGPY

SEQ ID NO: 991155 - protein, 7 aa, Mycobacterium
NCSVSSA

SEQ ID NO: 991156 - protein, 10 aa, Mycobacterium
NDAGPTGRAA

SEQ ID NO: 991157 - protein, 6 aa, Mycobacterium
NDAPIR

SEQ ID NO: 991158 - protein, 8 aa, Mycobacterium
NDARRDGD

SEQ ID NO: 991159 - protein, 5 aa, Mycobacterium
NDDDF

SEQ ID NO: 991160 - protein, 9 aa, Mycobacterium
NDDKSDTET

SEQ ID NO: 991161 - protein, 9 aa, Mycobacterium
NDDPTELGL

SEQ ID NO: 991162 - protein, 6 aa, Mycobacterium
NDDSPT

SEQ ID NO: 991163 - protein, 13 aa, Mycobacterium
NDDTRLSDESTIA

SEQ ID NO: 991164 - protein, 7 aa, Mycobacterium
NDDYDNE

SEQ ID NO: 991165 - protein, 4 aa, Mycobacterium
NDEG

SEQ ID NO: 991166 - protein, 15 aa, Mycobacterium
NDENQPPGSRDIPEN

SEQ ID NO: 991167 - protein, 13 aa, Mycobacterium
NDENTGIPVILAH

SEQ ID NO: 991168 - protein, 14 aa, Mycobacterium
NDFPTAELVKVTGG

SEQ ID NO: 991169 - protein, 6 aa, Mycobacterium
NDGASD

SEQ ID NO: 991170 - protein, 9 aa, Mycobacterium
NDGEALARQ

SEQ ID NO: 991171 - protein, 5 aa, Mycobacterium
NDGIR

SEQ ID NO: 991172 - protein, 10 aa, Mycobacterium
NDHSRTPGVA

SEQ ID NO: 991173 - protein, 9 aa, Mycobacterium
NDIDTRSGD

SEQ ID NO: 991174 - protein, 7 aa, Mycobacterium
NDKGKIE

SEQ ID NO: 991175 - protein, 10 aa, Mycobacterium
NDLSSSQGAH

SEQ ID NO: 991176 - protein, 8 aa, Mycobacterium
NDLSSTDM

SEQ ID NO: 991177 - protein, 11 aa, Mycobacterium
NDLTSTARPQV

SEQ ID NO: 991178 - protein, 23 aa, Mycobacterium
NDMSARDQQRADGQWTRAKGHDT

SEQ ID NO: 991179 - protein, 4 aa, Mycobacterium
NDNI

SEQ ID NO: 991180 - protein, 7 aa, Mycobacterium
NDNQDQL

SEQ ID NO: 991181 - protein, 5 aa, Mycobacterium
NDPAA

SEQ ID NO: 991182 - protein, 6 aa, Mycobacterium
NDPAAG

SEQ ID NO: 991183 - protein, 8 aa, Mycobacterium
NDPSRSAN

SEQ ID NO: 991184 - protein, 5 aa, Mycobacterium
NDQRL

SEQ ID NO: 991185 - protein, 29 aa, Mycobacterium
NDRREEGDLRENGGYHAAREEQGQQEARI

SEQ ID NO: 991186 - protein, 9 aa, Mycobacterium
NDRVSSGDF

SEQ ID NO: 991187 - protein, 10 aa, Mycobacterium
NDSGGARIQD

SEQ ID NO: 991188 - protein, 10 aa, Mycobacterium
NDSNSPRLSG

SEQ ID NO: 991189 - protein, 5 aa, Mycobacterium
NDSSP

SEQ ID NO: 991190 - protein, 17 aa, Mycobacterium
NDSVTKSKFDNKYGTRH

SEQ ID NO: 991191 - protein, 11 aa, Mycobacterium
NDTPVASASIG

SEQ ID NO: 991192 - protein, 5 aa, Mycobacterium
NDTQI

SEQ ID NO: 991193 - protein, 6 aa, Mycobacterium
NDTRYT

SEQ ID NO: 991194 - protein, 7 aa, Mycobacterium
NDVPPGA

SEQ ID NO: 991195 - protein, 11 aa, Mycobacterium
NDYADRKNNRQ

SEQ ID NO: 991196 - protein, 4 aa, Mycobacterium
NDYV

SEQ ID NO: 991197 - protein, 7 aa, Mycobacterium
NEAEGTA

SEQ ID NO: 991198 - protein, 8 aa, Mycobacterium
NEAQGKAV

SEQ ID NO: 991199 - protein, 18 aa, Mycobacterium
NEATGSVASVDTRPFSES

SEQ ID NO: 991200 - protein, 8 aa, Mycobacterium
NEDNKNLD

SEQ ID NO: 991201 - protein, 5 aa, Mycobacterium
NEDSR

SEQ ID NO: 991202 - protein, 4 aa, Mycobacterium
NEEH

SEQ ID NO: 991203 - protein, 7 aa, Mycobacterium
NEEQRDG

SEQ ID NO: 991204 - protein, 6 aa, Mycobacterium
NEEQTI

SEQ ID NO: 991205 - protein, 11 aa, Mycobacterium
NEGADSTHSPE

SEQ ID NO: 991206 - protein, 9 aa, Mycobacterium
NEGAPGRGP

SEQ ID NO: 991207 - protein, 5 aa, Mycobacterium
NEGGT

SEQ ID NO: 991208 - protein, 4 aa, Mycobacterium
NEGI

SEQ ID NO: 991209 - protein, 7 aa, Mycobacterium
NEGMTIT

SEQ ID NO: 991210 - protein, 9 aa, Mycobacterium
NEGNLPSGY

SEQ ID NO: 991211 - protein, 4 aa, Mycobacterium
NEHE

SEQ ID NO: 991212 - protein, 9 aa, Mycobacterium
NEHNLPGSR

SEQ ID NO: 991213 - protein, 11 aa, Mycobacterium
NEHSVTSGTED

SEQ ID NO: 991214 - protein, 5 aa, Mycobacterium
NEHTD

SEQ ID NO: 991215 - protein, 9 aa, Mycobacterium
NEKSQLQNK

SEQ ID NO: 991216 - protein, 6 aa, Mycobacterium
NELPPG

SEQ ID NO: 991217 - protein, 4 aa, Mycobacterium
NENA

SEQ ID NO: 991218 - protein, 10 aa, Mycobacterium
NENPHPPTKA

SEQ ID NO: 991219 - protein, 7 aa, Mycobacterium
NEPSLGD

SEQ ID NO: 991220 - protein, 18 aa, Mycobacterium
NEPSLTKEAFAKNPKRGL

SEQ ID NO: 991221 - protein, 13 aa, Mycobacterium
NEPSPAKPATPMP

SEQ ID NO: 991222 - protein, 5 aa, Mycobacterium
NEQLT

SEQ ID NO: 991223 - protein, 8 aa, Mycobacterium
NEQRKADN

SEQ ID NO: 991224 - protein, 11 aa, Mycobacterium
NEQTESLGPQS

SEQ ID NO: 991225 - protein, 11 aa, Mycobacterium
NERSQLQNKTR

SEQ ID NO: 991226 - protein, 7 aa, Mycobacterium
NESKASL

SEQ ID NO: 991227 - protein, 6 aa, Mycobacterium
NESSPI

SEQ ID NO: 991228 - protein, 18 aa, Mycobacterium
NESTADQAAEKLSSKKVR

SEQ ID NO: 991229 - protein, 10 aa, Mycobacterium
NESTAPSNAE

SEQ ID NO: 991230 - protein, 6 aa, Mycobacterium
NESTAR

SEQ ID NO: 991231 - protein, 4 aa, Mycobacterium
NESV

SEQ ID NO: 991232 - protein, 6 aa, Mycobacterium
NEVPRD

SEQ ID NO: 991233 - protein, 11 aa, Mycobacterium
NEYEVGNPTAV

SEQ ID NO: 991234 - protein, 5 aa, Mycobacterium
NEYQP

SEQ ID NO: 991235 - protein, 4 aa, Mycobacterium
NFDE

SEQ ID NO: 991236 - protein, 5 aa, Mycobacterium
NFDEA

SEQ ID NO: 991237 - protein, 5 aa, Mycobacterium
NFDGQ

SEQ ID NO: 991238 - protein, 14 aa, Mycobacterium
NFEEAAAPCTEKRP

SEQ ID NO: 991239 - protein, 5 aa, Mycobacterium
NFNPE

SEQ ID NO: 991240 - protein, 15 aa, Mycobacterium
NGAAGDPAHEAVGRG

SEQ ID NO: 991241 - protein, 9 aa, Mycobacterium
NGALADRQP

SEQ ID NO: 991242 - protein, 14 aa, Mycobacterium
NGANGAPGQNGADG

SEQ ID NO: 991243 - protein, 17 aa, Mycobacterium
NGANGAPGTGANGGDGG

SEQ ID NO: 991244 - protein, 11 aa, Mycobacterium
NGAQHVQHRDG

SEQ ID NO: 991245 - protein, 5 aa, Mycobacterium
NGARD

SEQ ID NO: 991246 - protein, 11 aa, Mycobacterium
NGARQVPGRHT

SEQ ID NO: 991247 - protein, 7 aa, Mycobacterium
NGCAEDR

SEQ ID NO: 991248 - protein, 5 aa, Mycobacterium
NGDEL

SEQ ID NO: 991249 - protein, 6 aa, Mycobacterium
NGDLVD

SEQ ID NO: 991250 - protein, 4 aa, Mycobacterium
NGDV

SEQ ID NO: 991251 - protein, 14 aa, Mycobacterium
NGDVAGKAQSLAEA

SEQ ID NO: 991252 - protein, 12 aa, Mycobacterium
NGERADRLRSYA

SEQ ID NO: 991253 - protein, 7 aa, Mycobacterium
NGESGYF

SEQ ID NO: 991254 - protein, 4 aa, Mycobacterium
NGEV

SEQ ID NO: 991255 - protein, 7 aa, Mycobacterium
NGEYGEV

SEQ ID NO: 991256 - protein, 5 aa, Mycobacterium
NGFSG

SEQ ID NO: 991257 - protein, 18 aa, Mycobacterium
NGGAASSGGHGAGAKSPS

SEQ ID NO: 991258 - protein, 10 aa, Mycobacterium
NGGANDLGGT

SEQ ID NO: 991259 - protein, 6 aa, Mycobacterium
NGGATA

SEQ ID NO: 991260 - protein, 4 aa, Mycobacterium
NGGF

SEQ ID NO: 991261 - protein, 4 aa, Mycobacterium
NGGH

SEQ ID NO: 991262 - protein, 12 aa, Mycobacterium
NGGKDFVNMTGP

SEQ ID NO: 991263 - protein, 6 aa, Mycobacterium
NGGKST

SEQ ID NO: 991264 - protein, 16 aa, Mycobacterium
NGGMKGNGGQLAGTSG

SEQ ID NO: 991265 - protein, 14 aa, Mycobacterium
NGGRSKRRCPKEIN

SEQ ID NO: 991266 - protein, 9 aa, Mycobacterium
NGGSVQESV

SEQ ID NO: 991267 - protein, 12 aa, Mycobacterium
NGGVDGNTGTAW

SEQ ID NO: 991268 - protein, 7 aa, Mycobacterium
NGIDEQR

SEQ ID NO: 991269 - protein, 5 aa, Mycobacterium
NGKPE

SEQ ID NO: 991270 - protein, 9 aa, Mycobacterium
NGKTPKTVH

SEQ ID NO: 991271 - protein, 4 aa, Mycobacterium
NGLP

SEQ ID NO: 991272 - protein, 4 aa, Mycobacterium
NGND

SEQ ID NO: 991273 - protein, 5 aa, Mycobacterium
NGPAE

SEQ ID NO: 991274 - protein, 7 aa, Mycobacterium
NGPAIEA

SEQ ID NO: 991275 - protein, 6 aa, Mycobacterium
NGPDLT

SEQ ID NO: 991276 - protein, 21 aa, Mycobacterium
NGPGEARDADLGVASGNGKGQ

SEQ ID NO: 991277 - protein, 9 aa, Mycobacterium
NGPSDNPFG

SEQ ID NO: 991278 - protein, 5 aa, Mycobacterium
NGQDT

SEQ ID NO: 991279 - protein, 6 aa, Mycobacterium
NGQPAR

SEQ ID NO: 991280 - protein, 5 aa, Mycobacterium
NGQQY

SEQ ID NO: 991281 - protein, 7 aa, Mycobacterium
NGQSAPV

SEQ ID NO: 991282 - protein, 6 aa, Mycobacterium
NGQSIR

SEQ ID NO: 991283 - protein, 12 aa, Mycobacterium
NGQTGVSCPPRD

SEQ ID NO: 991284 - protein, 5 aa, Mycobacterium
NGRDI

SEQ ID NO: 991285 - protein, 10 aa, Mycobacterium
NGRDSAAQRL

SEQ ID NO: 991286 - protein, 4 aa, Mycobacterium
NGRE

SEQ ID NO: 991287 - protein, 19 aa, Mycobacterium
NGRMAKPQEPARGDLPASD

SEQ ID NO: 991288 - protein, 6 aa, Mycobacterium
NGRPVS

SEQ ID NO: 991289 - protein, 18 aa, Mycobacterium
NGRRGRPVTGPGNRPLKS

SEQ ID NO: 991290 - protein, 10 aa, Mycobacterium
NGRSYAPTIG

SEQ ID NO: 991291 - protein, 19 aa, Mycobacterium
NGRTSVPGASIKPEVDQIH

SEQ ID NO: 991292 - protein, 16 aa, Mycobacterium
NGRVQQAEHNSNGTRI

SEQ ID NO: 991293 - protein, 8 aa, Mycobacterium
NGSDPVPG

SEQ ID NO: 991294 - protein, 10 aa, Mycobacterium
NGSEPVSPAS

SEQ ID NO: 991295 - protein, 7 aa, Mycobacterium
NGSGVTV

SEQ ID NO: 991296 - protein, 4 aa, Mycobacterium
NGSL

SEQ ID NO: 991297 - protein, 15 aa, Mycobacterium
NGSPIPRWLRFVLVS

SEQ ID NO: 991298 - protein, 9 aa, Mycobacterium
NGTAQQRDR

SEQ ID NO: 991299 - protein, 12 aa, Mycobacterium
NGTFSDSPRAPM

SEQ ID NO: 991300 - protein, 12 aa, Mycobacterium
NGTGRLESRLDK

SEQ ID NO: 991301 - protein, 4 aa, Mycobacterium
NGTL

SEQ ID NO: 991302 - protein, 13 aa, Mycobacterium
NGTPSELGGTNVP

SEQ ID NO: 991303 - protein, 11 aa, Mycobacterium
NGTRTRAGQPL

SEQ ID NO: 991304 - protein, 4 aa, Mycobacterium
NGTT

SEQ ID NO: 991305 - protein, 11 aa, Mycobacterium
NGWPTTDPDHH

SEQ ID NO: 991306 - protein, 7 aa, Mycobacterium
NHDERNE

SEQ ID NO: 991307 - protein, 14 aa, Mycobacterium
NHLAGPPDDPRIPE

SEQ ID NO: 991308 - protein, 5 aa, Mycobacterium
NHPTL

SEQ ID NO: 991309 - protein, 7 aa, Mycobacterium
NHRKGDK

SEQ ID NO: 991310 - protein, 7 aa, Mycobacterium
NHRSHQT

SEQ ID NO: 991311 - protein, 8 aa, Mycobacterium
NHSPDDIE

SEQ ID NO: 991312 - protein, 10 aa, Mycobacterium
NHSPDDIEGT

SEQ ID NO: 991313 - protein, 6 aa, Mycobacterium
NHYPQD

SEQ ID NO: 991314 - protein, 5 aa, Mycobacterium
NHYQS

SEQ ID NO: 991315 - protein, 12 aa, Mycobacterium
NIAPEVSKPNSA

SEQ ID NO: 991316 - protein, 12 aa, Mycobacterium
NIDSTGTGIQHR

SEQ ID NO: 991317 - protein, 5 aa, Mycobacterium
NIGDN

SEQ ID NO: 991318 - protein, 20 aa, Mycobacterium
NIGPTERSAIDVPNDSASTV

SEQ ID NO: 991319 - protein, 4 aa, Mycobacterium
NIPP

SEQ ID NO: 991320 - protein, 7 aa, Mycobacterium
NIPPPAG

SEQ ID NO: 991321 - protein, 4 aa, Mycobacterium
NISR

SEQ ID NO: 991322 - protein, 4 aa, Mycobacterium
NITD

SEQ ID NO: 991323 - protein, 7 aa, Mycobacterium
NITEPRV

SEQ ID NO: 991324 - protein, 6 aa, Mycobacterium
NKARPI

SEQ ID NO: 991325 - protein, 7 aa, Mycobacterium
NKDEEAP

SEQ ID NO: 991326 - protein, 12 aa, Mycobacterium
NKENPVETASAG

SEQ ID NO: 991327 - protein, 8 aa, Mycobacterium
NKGTKTRI

SEQ ID NO: 991328 - protein, 7 aa, Mycobacterium
NKLPGQP

SEQ ID NO: 991329 - protein, 9 aa, Mycobacterium
NKNAAKLRG

SEQ ID NO: 991330 - protein, 8 aa, Mycobacterium
NKNQKGRV

SEQ ID NO: 991331 - protein, 10 aa, Mycobacterium
NKTAGDAEKL

SEQ ID NO: 991332 - protein, 8 aa, Mycobacterium
NKVGTDGV

SEQ ID NO: 991333 - protein, 10 aa, Mycobacterium
NLAESRNEAV

SEQ ID NO: 991334 - protein, 7 aa, Mycobacterium
NLAETST

SEQ ID NO: 991335 - protein, 7 aa, Mycobacterium
NLDADTA

SEQ ID NO: 991336 - protein, 12 aa, Mycobacterium
NLDEGEPYGLPG

SEQ ID NO: 991337 - protein, 11 aa, Mycobacterium
NLGSGGSEEQV

SEQ ID NO: 991338 - protein, 7 aa, Mycobacterium
NLGYGTA

SEQ ID NO: 991339 - protein, 24 aa, Mycobacterium
NLPGYQDSGDRKRPGSALFKRGSY

SEQ ID NO: 991340 - protein, 7 aa, Mycobacterium
NLPPATI

SEQ ID NO: 991341 - protein, 7 aa, Mycobacterium
NLPSRCE

SEQ ID NO: 991342 - protein, 10 aa, Mycobacterium
NLPTPSGNTF

SEQ ID NO: 991343 - protein, 8 aa, Mycobacterium
NLQRDPDE

SEQ ID NO: 991344 - protein, 9 aa, Mycobacterium
NLRGKSPYG

SEQ ID NO: 991345 - protein, 10 aa, Mycobacterium
NLRPEGRNGP

SEQ ID NO: 991346 - protein, 8 aa, Mycobacterium
NLRRSARA

SEQ ID NO: 991347 - protein, 5 aa, Mycobacterium
NLSKG

SEQ ID NO: 991348 - protein, 5 aa, Mycobacterium
NLTPQ

SEQ ID NO: 991349 - protein, 7 aa, Mycobacterium
NLTTATA

SEQ ID NO: 991350 - protein, 7 aa, Mycobacterium
NMAGRGT

SEQ ID NO: 991351 - protein, 10 aa, Mycobacterium
NMGHTQAAAG

SEQ ID NO: 991352 - protein, 4 aa, Mycobacterium
NMGQ

SEQ ID NO: 991353 - protein, 13 aa, Mycobacterium
NMPSGTAQRPGDV

SEQ ID NO: 991354 - protein, 11 aa, Mycobacterium
NNAAALAAKQT

SEQ ID NO: 991355 - protein, 5 aa, Mycobacterium
NNAAE

SEQ ID NO: 991356 - protein, 15 aa, Mycobacterium
NNDGPELRSRLPERA

SEQ ID NO: 991357 - protein, 7 aa, Mycobacterium
NNDTVGA

SEQ ID NO: 991358 - protein, 4 aa, Mycobacterium
NNER

SEQ ID NO: 991359 - protein, 4 aa, Mycobacterium
NNFP

SEQ ID NO: 991360 - protein, 6 aa, Mycobacterium
NNFPDV

SEQ ID NO: 991361 - protein, 21 aa, Mycobacterium
NNGDDDTPSGDSDGFCRPLSL

SEQ ID NO: 991362 - protein, 7 aa, Mycobacterium
NNGGPLD

SEQ ID NO: 991363 - protein, 8 aa, Mycobacterium
NNGLSASE

SEQ ID NO: 991364 - protein, 5 aa, Mycobacterium
NNHEN

SEQ ID NO: 991365 - protein, 15 aa, Mycobacterium
NNITRTGDHETGPVR

SEQ ID NO: 991366 - protein, 10 aa, Mycobacterium
NNPDGSPTGG

SEQ ID NO: 991367 - protein, 9 aa, Mycobacterium
NNPPTDTRA

SEQ ID NO: 991368 - protein, 5 aa, Mycobacterium
NNRAH

SEQ ID NO: 991369 - protein, 6 aa, Mycobacterium
NNSTRW

SEQ ID NO: 991370 - protein, 13 aa, Mycobacterium
NNTASASAVGAGN

SEQ ID NO: 991371 - protein, 6 aa, Mycobacterium
NNYPDT

SEQ ID NO: 991372 - protein, 4 aa, Mycobacterium
NPAA

SEQ ID NO: 991373 - protein, 21 aa, Mycobacterium
NPAGASGTSAAPKSVRASDRD

SEQ ID NO: 991374 - protein, 9 aa, Mycobacterium
NPAGCNPAG

SEQ ID NO: 991375 - protein, 12 aa, Mycobacterium
NPAKTLAASVSG

SEQ ID NO: 991376 - protein, 11 aa, Mycobacterium
NPAPGTSEGPW

SEQ ID NO: 991377 - protein, 6 aa, Mycobacterium
NPAPTP

SEQ ID NO: 991378 - protein, 8 aa, Mycobacterium
NPASGESS

SEQ ID NO: 991379 - protein, 7 aa, Mycobacterium
NPATTVP

SEQ ID NO: 991380 - protein, 4 aa, Mycobacterium
NPAV

SEQ ID NO: 991381 - protein, 4 aa, Mycobacterium
NPCD

SEQ ID NO: 991382 - protein, 5 aa, Mycobacterium
NPDAQ

SEQ ID NO: 991383 - protein, 11 aa, Mycobacterium
NPDDPTGYQGR

SEQ ID NO: 991384 - protein, 15 aa, Mycobacterium
NPDPRRRFSSAEEMS

SEQ ID NO: 991385 - protein, 5 aa, Mycobacterium
NPDQA

SEQ ID NO: 991386 - protein, 4 aa, Mycobacterium
NPDR

SEQ ID NO: 991387 - protein, 6 aa, Mycobacterium
NPDTSS

SEQ ID NO: 991388 - protein, 219 aa, Mycobacterium
NPDVEPRPTVNDPVRTQSNQAFSAEPGVPPMTDNSSYRGGQGQGRPSDDYYGRPQDDPRGADPQGGQDPRGCYPPKPGSYPQQAGHPPLHRPDQGGYPGQGGYEDQRAYHDQGQGGYPSPYEQRPATPGGYGSQGHDQGYRPGSYGPPSGGQPGYGGYGDYGRGPARPDEGSYTPSGFPAPPEQRVAYPDQGGGYDQGYQHSGLGYGREDYGRQEYTQY

SEQ ID NO: 991389 - protein, 19 aa, Mycobacterium
NPECEEDIKAETAATPRCV

SEQ ID NO: 991390 - protein, 13 aa, Mycobacterium
NPEFTAELPDGSG

SEQ ID NO: 991391 - protein, 16 aa, Mycobacterium
NPERQTGSPYLRSTAP

SEQ ID NO: 991392 - protein, 6 aa, Mycobacterium
NPERTR

SEQ ID NO: 991393 - protein, 6 aa, Mycobacterium
NPFRPR

SEQ ID NO: 991394 - protein, 5 aa, Mycobacterium
NPGEV

SEQ ID NO: 991395 - protein, 4 aa, Mycobacterium
NPGP

SEQ ID NO: 991396 - protein, 10 aa, Mycobacterium
NPGSPTDRRH

SEQ ID NO: 991397 - protein, 6 aa, Mycobacterium
NPGTSE

SEQ ID NO: 991398 - protein, 8 aa, Mycobacterium
NPGVGGNR

SEQ ID NO: 991399 - protein, 6 aa, Mycobacterium
NPGVRA

SEQ ID NO: 991400 - protein, 8 aa, Mycobacterium
NPHDSSTA

SEQ ID NO: 991401 - protein, 5 aa, Mycobacterium
NPIEH

SEQ ID NO: 991402 - protein, 6 aa, Mycobacterium
NPITRE

SEQ ID NO: 991403 - protein, 8 aa, Mycobacterium
NPKEVGAD

SEQ ID NO: 991404 - protein, 6 aa, Mycobacterium
NPKLRR

SEQ ID NO: 991405 - protein, 14 aa, Mycobacterium
NPKQASVAYPATSY

SEQ ID NO: 991406 - protein, 5 aa, Mycobacterium
NPLAD

SEQ ID NO: 991407 - protein, 9 aa, Mycobacterium
NPLPSRPAA

SEQ ID NO: 991408 - protein, 21 aa, Mycobacterium
NPLSGDKQMTYNDSRAEGTRA

SEQ ID NO: 991409 - protein, 4 aa, Mycobacterium
NPMV

SEQ ID NO: 991410 - protein, 7 aa, Mycobacterium
NPNGSTQ

SEQ ID NO: 991411 - protein, 7 aa, Mycobacterium
NPPEITD

SEQ ID NO: 991412 - protein, 6 aa, Mycobacterium
NPPRTV

SEQ ID NO: 991413 - protein, 13 aa, Mycobacterium
NPQSRVGATTEAQ

SEQ ID NO: 991414 - protein, 8 aa, Mycobacterium
NPRASRTV

SEQ ID NO: 991415 - protein, 6 aa, Mycobacterium
NPRPED

SEQ ID NO: 991416 - protein, 11 aa, Mycobacterium
NPRPTNPEGKM

SEQ ID NO: 991417 - protein, 5 aa, Mycobacterium
NPRYK

SEQ ID NO: 991418 - protein, 7 aa, Mycobacterium
NPSAEDL

SEQ ID NO: 991419 - protein, 6 aa, Mycobacterium
NPSARQ

SEQ ID NO: 991420 - protein, 5 aa, Mycobacterium
NPSDD

SEQ ID NO: 991421 - protein, 9 aa, Mycobacterium
NPSDWPEGK

SEQ ID NO: 991422 - protein, 5 aa, Mycobacterium
NPSGA

SEQ ID NO: 991423 - protein, 5 aa, Mycobacterium
NPSNY

SEQ ID NO: 991424 - protein, 11 aa, Mycobacterium
NPSPGTPDGPW

SEQ ID NO: 991425 - protein, 7 aa, Mycobacterium
NPSRSLQ

SEQ ID NO: 991426 - protein, 5 aa, Mycobacterium
NPSSY

SEQ ID NO: 991427 - protein, 4 aa, Mycobacterium
NPTA

SEQ ID NO: 991428 - protein, 6 aa, Mycobacterium
NPTGVT

SEQ ID NO: 991429 - protein, 14 aa, Mycobacterium
NPTPEEALRPPTRC

SEQ ID NO: 991430 - protein, 4 aa, Mycobacterium
NPTQ

SEQ ID NO: 991431 - protein, 14 aa, Mycobacterium
NPTSGSEWDASPKV

SEQ ID NO: 991432 - protein, 6 aa, Mycobacterium
NPTTGG

SEQ ID NO: 991433 - protein, 4 aa, Mycobacterium
NPTV

SEQ ID NO: 991434 - protein, 6 aa, Mycobacterium
NPTVNS

SEQ ID NO: 991435 - protein, 5 aa, Mycobacterium
NPTVS

SEQ ID NO: 991436 - protein, 7 aa, Mycobacterium
NPVPKLE

SEQ ID NO: 991437 - protein, 12 aa, Mycobacterium
NQAAEHSSTIMP

SEQ ID NO: 991438 - protein, 6 aa, Mycobacterium
NQAAHV

SEQ ID NO: 991439 - protein, 16 aa, Mycobacterium
NQAANKKSALARTLNK

SEQ ID NO: 991440 - protein, 8 aa, Mycobacterium
NQAATEDA

SEQ ID NO: 991441 - protein, 9 aa, Mycobacterium
NQAGNVKVG

SEQ ID NO: 991442 - protein, 6 aa, Mycobacterium
NQASAN

SEQ ID NO: 991443 - protein, 12 aa, Mycobacterium
NQDGEKMRNATA

SEQ ID NO: 991444 - protein, 15 aa, Mycobacterium
NQDHPSVVSTATSPV

SEQ ID NO: 991445 - protein, 7 aa, Mycobacterium
NQDNAYI

SEQ ID NO: 991446 - protein, 18 aa, Mycobacterium
NQHAPGVVNPADAPPEPG

SEQ ID NO: 991447 - protein, 14 aa, Mycobacterium
NQHGSRHAARDQPA

SEQ ID NO: 991448 - protein, 15 aa, Mycobacterium
NQKGGVVKMTTVVSL

SEQ ID NO: 991449 - protein, 6 aa, Mycobacterium
NQLGRA

SEQ ID NO: 991450 - protein, 5 aa, Mycobacterium
NQLPD

SEQ ID NO: 991451 - protein, 16 aa, Mycobacterium
NQLRGRAGRQGDPGSS

SEQ ID NO: 991452 - protein, 17 aa, Mycobacterium
NQLRGRSGRQGDPGESR

SEQ ID NO: 991453 - protein, 4 aa, Mycobacterium
NQNT

SEQ ID NO: 991454 - protein, 16 aa, Mycobacterium
NQPTPEQIFDRIAIRV

SEQ ID NO: 991455 - protein, 7 aa, Mycobacterium
NQQIDYK

SEQ ID NO: 991456 - protein, 5 aa, Mycobacterium
NQRPI

SEQ ID NO: 991457 - protein, 9 aa, Mycobacterium
NQSGRRGRV

SEQ ID NO: 991458 - protein, 15 aa, Mycobacterium
NQYSQTAQKMAINVK

SEQ ID NO: 991459 - protein, 9 aa, Mycobacterium
NRANPIEGK

SEQ ID NO: 991460 - protein, 8 aa, Mycobacterium
NRAPAKVQ

SEQ ID NO: 991461 - protein, 13 aa, Mycobacterium
NRASEVVANGSAQ

SEQ ID NO: 991462 - protein, 9 aa, Mycobacterium
NRASRRSMR

SEQ ID NO: 991463 - protein, 9 aa, Mycobacterium
NRDETKAPH

SEQ ID NO: 991464 - protein, 11 aa, Mycobacterium
NRDNKRGNKWR

SEQ ID NO: 991465 - protein, 21 aa, Mycobacterium
NRDPAVYSRPDEFDPDRPSSR

SEQ ID NO: 991466 - protein, 5 aa, Mycobacterium
NRDRR

SEQ ID NO: 991467 - protein, 12 aa, Mycobacterium
NREAQRGRLKTA

SEQ ID NO: 991468 - protein, 8 aa, Mycobacterium
NREQGAAV

SEQ ID NO: 991469 - protein, 14 aa, Mycobacterium
NRGEQLVNESRECR

SEQ ID NO: 991470 - protein, 5 aa, Mycobacterium
NRGGT

SEQ ID NO: 991471 - protein, 13 aa, Mycobacterium
NRGSLVRGGVVVR

SEQ ID NO: 991472 - protein, 5 aa, Mycobacterium
NRKDD

SEQ ID NO: 991473 - protein, 21 aa, Mycobacterium
NRKESRGGHAREDYPHRDDTN

SEQ ID NO: 991474 - protein, 7 aa, Mycobacterium
NRKSAKL

SEQ ID NO: 991475 - protein, 5 aa, Mycobacterium
NRLTP

SEQ ID NO: 991476 - protein, 26 aa, Mycobacterium
NRNAELRNQDGAPQPRSCADRARNCH

SEQ ID NO: 991477 - protein, 8 aa, Mycobacterium
NRPAKDNA

SEQ ID NO: 991478 - protein, 7 aa, Mycobacterium
NRPGQLA

SEQ ID NO: 991479 - protein, 13 aa, Mycobacterium
NRPISKSDAVEGT

SEQ ID NO: 991480 - protein, 13 aa, Mycobacterium
NRPKIGPRRTEAQ

SEQ ID NO: 991481 - protein, 4 aa, Mycobacterium
NRPR

SEQ ID NO: 991482 - protein, 13 aa, Mycobacterium
NRQSAISQVHRVR

SEQ ID NO: 991483 - protein, 9 aa, Mycobacterium
NRRAPGPHD

SEQ ID NO: 991484 - protein, 13 aa, Mycobacterium
NRRAPTAAVPICV

SEQ ID NO: 991485 - protein, 12 aa, Mycobacterium
NRRKSRRYRQSY

SEQ ID NO: 991486 - protein, 6 aa, Mycobacterium
NRRPLV

SEQ ID NO: 991487 - protein, 8 aa, Mycobacterium
NRRQNRRC

SEQ ID NO: 991488 - protein, 19 aa, Mycobacterium
NRRQVNDSLATMKSKSALA

SEQ ID NO: 991489 - protein, 11 aa, Mycobacterium
NRRTSDYTTTL

SEQ ID NO: 991490 - protein, 17 aa, Mycobacterium
NRRYGLDTEAGETMRPQ

SEQ ID NO: 991491 - protein, 12 aa, Mycobacterium
NRSGEKISPERV

SEQ ID NO: 991492 - protein, 16 aa, Mycobacterium
NRSGGLEGGMTNGQPL

SEQ ID NO: 991493 - protein, 14 aa, Mycobacterium
NRSPEQRTDKKPML

SEQ ID NO: 991494 - protein, 7 aa, Mycobacterium
NRSQRTP

SEQ ID NO: 991495 - protein, 10 aa, Mycobacterium
NRSSGKQGYA

SEQ ID NO: 991496 - protein, 15 aa, Mycobacterium
NRSSVKAFTDSEAWF

SEQ ID NO: 991497 - protein, 9 aa, Mycobacterium
NRTPPKTQA

SEQ ID NO: 991498 - protein, 23 aa, Mycobacterium
NRTPRSANDPSKTNAASASSYGN

SEQ ID NO: 991499 - protein, 13 aa, Mycobacterium
NRVATAGLDHFVS

SEQ ID NO: 991500 - protein, 11 aa, Mycobacterium
NRYPEPSPDAT

SEQ ID NO: 991501 - protein, 11 aa, Mycobacterium
NSAATNEADPT

SEQ ID NO: 991502 - protein, 5 aa, Mycobacterium
NSADK

SEQ ID NO: 991503 - protein, 13 aa, Mycobacterium
NSAEFEPATPDPV

SEQ ID NO: 991504 - protein, 5 aa, Mycobacterium
NSAEG

SEQ ID NO: 991505 - protein, 21 aa, Mycobacterium
NSAGIGAAYARQSRGQTDQHD

SEQ ID NO: 991506 - protein, 6 aa, Mycobacterium
NSARTY

SEQ ID NO: 991507 - protein, 9 aa, Mycobacterium
NSCTSDDGE

SEQ ID NO: 991508 - protein, 8 aa, Mycobacterium
NSDGATGF

SEQ ID NO: 991509 - protein, 6 aa, Mycobacterium
NSDGTV

SEQ ID NO: 991510 - protein, 7 aa, Mycobacterium
NSDLRQR

SEQ ID NO: 991511 - protein, 7 aa, Mycobacterium
NSDPIYP

SEQ ID NO: 991512 - protein, 4 aa, Mycobacterium
NSEA

SEQ ID NO: 991513 - protein, 12 aa, Mycobacterium
NSEGSRTTPSTV

SEQ ID NO: 991514 - protein, 7 aa, Mycobacterium
NSELPPI

SEQ ID NO: 991515 - protein, 6 aa, Mycobacterium
NSENSV

SEQ ID NO: 991516 - protein, 16 aa, Mycobacterium
NSFSDGGRYLDPDDAV

SEQ ID NO: 991517 - protein, 4 aa, Mycobacterium
NSGA

SEQ ID NO: 991518 - protein, 6 aa, Mycobacterium
NSGERW

SEQ ID NO: 991519 - protein, 8 aa, Mycobacterium
NSGFGPGT

SEQ ID NO: 991520 - protein, 5 aa, Mycobacterium
NSGGC

SEQ ID NO: 991521 - protein, 15 aa, Mycobacterium
NSGGSRPDGIGKTPI

SEQ ID NO: 991522 - protein, 10 aa, Mycobacterium
NSGKKQRGEP

SEQ ID NO: 991523 - protein, 6 aa, Mycobacterium
NSGRLD

SEQ ID NO: 991524 - protein, 9 aa, Mycobacterium
NSGTNNTGI

SEQ ID NO: 991525 - protein, 29 aa, Mycobacterium
NSGTSSPECAGRAAGSDQGNAGQTKPRSP

SEQ ID NO: 991526 - protein, 6 aa, Mycobacterium
NSHALG

SEQ ID NO: 991527 - protein, 14 aa, Mycobacterium
NSHDGSRGTAAGRS

SEQ ID NO: 991528 - protein, 6 aa, Mycobacterium
NSHGLS

SEQ ID NO: 991529 - protein, 5 aa, Mycobacterium
NSHTG

SEQ ID NO: 991530 - protein, 10 aa, Mycobacterium
NSISSSTASS

SEQ ID NO: 991531 - protein, 7 aa, Mycobacterium
NSLYTSN

SEQ ID NO: 991532 - protein, 5 aa, Mycobacterium
NSNHR

SEQ ID NO: 991533 - protein, 17 aa, Mycobacterium
NSNPARFDQKKADAVNA

SEQ ID NO: 991534 - protein, 6 aa, Mycobacterium
NSNTEP

SEQ ID NO: 991535 - protein, 4 aa, Mycobacterium
NSNW

SEQ ID NO: 991536 - protein, 10 aa, Mycobacterium
NSPEDAAKQR

SEQ ID NO: 991537 - protein, 11 aa, Mycobacterium
NSPETTTGGKA

SEQ ID NO: 991538 - protein, 9 aa, Mycobacterium
NSPFDGQAA

SEQ ID NO: 991539 - protein, 9 aa, Mycobacterium
NSPGGSISA

SEQ ID NO: 991540 - protein, 11 aa, Mycobacterium
NSPGGSVTASE

SEQ ID NO: 991541 - protein, 13 aa, Mycobacterium
NSPGTVDAGYRGE

SEQ ID NO: 991542 - protein, 10 aa, Mycobacterium
NSPKPPPERI

SEQ ID NO: 991543 - protein, 7 aa, Mycobacterium
NSPPQQR

SEQ ID NO: 991544 - protein, 6 aa, Mycobacterium
NSPRAV

SEQ ID NO: 991545 - protein, 7 aa, Mycobacterium
NSQDTPK

SEQ ID NO: 991546 - protein, 4 aa, Mycobacterium
NSQP

SEQ ID NO: 991547 - protein, 8 aa, Mycobacterium
NSRDELQA

SEQ ID NO: 991548 - protein, 5 aa, Mycobacterium
NSRDI

SEQ ID NO: 991549 - protein, 18 aa, Mycobacterium
NSRGKESRCTDNAAATVT

SEQ ID NO: 991550 - protein, 13 aa, Mycobacterium
NSRPTRAEASDVA

SEQ ID NO: 991551 - protein, 8 aa, Mycobacterium
NSRVRAEQ

SEQ ID NO: 991552 - protein, 4 aa, Mycobacterium
NSSA

SEQ ID NO: 991553 - protein, 13 aa, Mycobacterium
NSSASKSKVIADS

SEQ ID NO: 991554 - protein, 10 aa, Mycobacterium
NSSKSEPSTM

SEQ ID NO: 991555 - protein, 7 aa, Mycobacterium
NSSTPEV

SEQ ID NO: 991556 - protein, 17 aa, Mycobacterium
NSSWPISDGQAGPRRAA

SEQ ID NO: 991557 - protein, 5 aa, Mycobacterium
NSTEL

SEQ ID NO: 991558 - protein, 6 aa, Mycobacterium
NSTRGA

SEQ ID NO: 991559 - protein, 6 aa, Mycobacterium
NSTRTR

SEQ ID NO: 991560 - protein, 7 aa, Mycobacterium
NSTYVRK

SEQ ID NO: 991561 - protein, 5 aa, Mycobacterium
NSVAR

SEQ ID NO: 991562 - protein, 8 aa, Mycobacterium
NSVASGRI

SEQ ID NO: 991563 - protein, 8 aa, Mycobacterium
NSVDDGDN

SEQ ID NO: 991564 - protein, 6 aa, Mycobacterium
NSVGPQ

SEQ ID NO: 991565 - protein, 7 aa, Mycobacterium
NSYGTLG

SEQ ID NO: 991566 - protein, 8 aa, Mycobacterium
NTAAEDAV

SEQ ID NO: 991567 - protein, 13 aa, Mycobacterium
NTAEQNAANEGKS

SEQ ID NO: 991568 - protein, 10 aa, Mycobacterium
NTAESENLQI

SEQ ID NO: 991569 - protein, 4 aa, Mycobacterium
NTAG

SEQ ID NO: 991570 - protein, 8 aa, Mycobacterium
NTAGGDHA

SEQ ID NO: 991571 - protein, 7 aa, Mycobacterium
NTARNSV

SEQ ID NO: 991572 - protein, 18 aa, Mycobacterium
NTDLEGSPQLVNSDPYGA

SEQ ID NO: 991573 - protein, 9 aa, Mycobacterium
NTDSAIEPK

SEQ ID NO: 991574 - protein, 13 aa, Mycobacterium
NTDTRTSATSDSS

SEQ ID NO: 991575 - protein, 7 aa, Mycobacterium
NTEISGE

SEQ ID NO: 991576 - protein, 17 aa, Mycobacterium
NTELGDFRGPGTTTLED

SEQ ID NO: 991577 - protein, 6 aa, Mycobacterium
NTEPHI

SEQ ID NO: 991578 - protein, 8 aa, Mycobacterium
NTGAAAGI

SEQ ID NO: 991579 - protein, 5 aa, Mycobacterium
NTGAG

SEQ ID NO: 991580 - protein, 6 aa, Mycobacterium
NTGLGH

SEQ ID NO: 991581 - protein, 6 aa, Mycobacterium
NTGRPY

SEQ ID NO: 991582 - protein, 9 aa, Mycobacterium
NTGSEEAGQ

SEQ ID NO: 991583 - protein, 6 aa, Mycobacterium
NTHQNN

SEQ ID NO: 991584 - protein, 5 aa, Mycobacterium
NTPAI

SEQ ID NO: 991585 - protein, 8 aa, Mycobacterium
NTPCSSSR

SEQ ID NO: 991586 - protein, 4 aa, Mycobacterium
NTPL

SEQ ID NO: 991587 - protein, 4 aa, Mycobacterium
NTPP

SEQ ID NO: 991588 - protein, 7 aa, Mycobacterium
NTQATTE

SEQ ID NO: 991589 - protein, 13 aa, Mycobacterium
NTRDEPHADADRY

SEQ ID NO: 991590 - protein, 11 aa, Mycobacterium
NTSDVYGQANS

SEQ ID NO: 991591 - protein, 7 aa, Mycobacterium
NTSENRS

SEQ ID NO: 991592 - protein, 9 aa, Mycobacterium
NTTADATYS

SEQ ID NO: 991593 - protein, 10 aa, Mycobacterium
NTTPVADSPV

SEQ ID NO: 991594 - protein, 9 aa, Mycobacterium
NTTTGEETT

SEQ ID NO: 991595 - protein, 6 aa, Mycobacterium
NTVSQG

SEQ ID NO: 991596 - protein, 13 aa, Mycobacterium
NTWEGQAASAALG

SEQ ID NO: 991597 - protein, 7 aa, Mycobacterium
NVAAART

SEQ ID NO: 991598 - protein, 8 aa, Mycobacterium
NVAESEEL

SEQ ID NO: 991599 - protein, 11 aa, Mycobacterium
NVAESTSLDGG

SEQ ID NO: 991600 - protein, 7 aa, Mycobacterium
NVATNAG

SEQ ID NO: 991601 - protein, 5 aa, Mycobacterium
NVDDP

SEQ ID NO: 991602 - protein, 10 aa, Mycobacterium
NVDGAESNEL

SEQ ID NO: 991603 - protein, 12 aa, Mycobacterium
NVDGKGASYGAH

SEQ ID NO: 991604 - protein, 8 aa, Mycobacterium
NVEGGNKQ

SEQ ID NO: 991605 - protein, 17 aa, Mycobacterium
NVGGGRTGGLILRAAGR

SEQ ID NO: 991606 - protein, 7 aa, Mycobacterium
NVGGLPD

SEQ ID NO: 991607 - protein, 6 aa, Mycobacterium
NVGGTE

SEQ ID NO: 991608 - protein, 9 aa, Mycobacterium
NVGKPQVAY

SEQ ID NO: 991609 - protein, 9 aa, Mycobacterium
NVGSPHGPR

SEQ ID NO: 991610 - protein, 4 aa, Mycobacterium
NVIP

SEQ ID NO: 991611 - protein, 5 aa, Mycobacterium
NVNGG

SEQ ID NO: 991612 - protein, 16 aa, Mycobacterium
NVPSEAKAPYDPDHAD

SEQ ID NO: 991613 - protein, 11 aa, Mycobacterium
NVREAEAGGIT

SEQ ID NO: 991614 - protein, 5 aa, Mycobacterium
NVSGQ

SEQ ID NO: 991615 - protein, 9 aa, Mycobacterium
NVSSPGGAF

SEQ ID NO: 991616 - protein, 12 aa, Mycobacterium
NVSTPGGLRVLL

SEQ ID NO: 991617 - protein, 9 aa, Mycobacterium
NVTDPSKIA

SEQ ID NO: 991618 - protein, 5 aa, Mycobacterium
NVTGA

SEQ ID NO: 991619 - protein, 7 aa, Mycobacterium
NVTGEPA

SEQ ID NO: 991620 - protein, 7 aa, Mycobacterium
NVTTARE

SEQ ID NO: 991621 - protein, 8 aa, Mycobacterium
NWFGPTAA

SEQ ID NO: 991622 - protein, 16 aa, Mycobacterium
NWPGSNRIAGLCRSPL

SEQ ID NO: 991623 - protein, 9 aa, Mycobacterium
NWRSPADKQ

SEQ ID NO: 991624 - protein, 5 aa, Mycobacterium
NYDET

SEQ ID NO: 991625 - protein, 6 aa, Mycobacterium
NYDPRA

SEQ ID NO: 991626 - protein, 10 aa, Mycobacterium
NYGPGDPNLA

SEQ ID NO: 991627 - protein, 7 aa, Mycobacterium
NYGTDDP

SEQ ID NO: 991628 - protein, 8 aa, Mycobacterium
NYPNGATA

SEQ ID NO: 991629 - protein, 7 aa, Mycobacterium
NYPRRPR

SEQ ID NO: 991630 - protein, 14 aa, Mycobacterium
NYQQGQRSASWAKD

SEQ ID NO: 991631 - protein, 6 aa, Mycobacterium
NYRGSM

SEQ ID NO: 991632 - protein, 4 aa, Mycobacterium
NYSA

SEQ ID NO: 991633 - protein, 16 aa, Mycobacterium
PAAADNSVDATAARDF

SEQ ID NO: 991634 - protein, 9 aa, Mycobacterium
PAADPVSLQ

SEQ ID NO: 991635 - protein, 4 aa, Mycobacterium
PAAG

SEQ ID NO: 991636 - protein, 4 aa, Mycobacterium
PAAL

SEQ ID NO: 991637 - protein, 6 aa, Mycobacterium
PAASLD

SEQ ID NO: 991638 - protein, 18 aa, Mycobacterium
PAASPVLSGGQKGPHPIQ

SEQ ID NO: 991639 - protein, 27 aa, Mycobacterium
PAATTSGVASSYSSRKSLTIFLDQILD

SEQ ID NO: 991640 - protein, 4 aa, Mycobacterium
PACR

SEQ ID NO: 991641 - protein, 6 aa, Mycobacterium
PACTHG

SEQ ID NO: 991642 - protein, 4 aa, Mycobacterium
PADA

SEQ ID NO: 991643 - protein, 9 aa, Mycobacterium
PADANETAY

SEQ ID NO: 991644 - protein, 6 aa, Mycobacterium
PADDGR

SEQ ID NO: 991645 - protein, 5 aa, Mycobacterium
PADDR

SEQ ID NO: 991646 - protein, 4 aa, Mycobacterium
PADE

SEQ ID NO: 991647 - protein, 4 aa, Mycobacterium
PADG

SEQ ID NO: 991648 - protein, 7 aa, Mycobacterium
PADHPIP

SEQ ID NO: 991649 - protein, 11 aa, Mycobacterium
PADLTDPSERV

SEQ ID NO: 991650 - protein, 9 aa, Mycobacterium
PADPRRSGQ

SEQ ID NO: 991651 - protein, 9 aa, Mycobacterium
PADRSTDGA

SEQ ID NO: 991652 - protein, 4 aa, Mycobacterium
PADT

SEQ ID NO: 991653 - protein, 5 aa, Mycobacterium
PADTP

SEQ ID NO: 991654 - protein, 4 aa, Mycobacterium
PAEA

SEQ ID NO: 991655 - protein, 18 aa, Mycobacterium
PAEAAGTESTDRLTGTHR

SEQ ID NO: 991656 - protein, 45 aa, Mycobacterium
PAEASGTVGTPRKAQVKRRKTDRDGDKSGTSAQAAKAARTSNSVQ

SEQ ID NO: 991657 - protein, 9 aa, Mycobacterium
PAEETGPER

SEQ ID NO: 991658 - protein, 7 aa, Mycobacterium
PAENAEY

SEQ ID NO: 991659 - protein, 4 aa, Mycobacterium
PAEP

SEQ ID NO: 991660 - protein, 7 aa, Mycobacterium
PAEPGHV

SEQ ID NO: 991661 - protein, 7 aa, Mycobacterium
PAEQTPA

SEQ ID NO: 991662 - protein, 11 aa, Mycobacterium
PAESANVQPLT

SEQ ID NO: 991663 - protein, 8 aa, Mycobacterium
PAFSPGDT

SEQ ID NO: 991664 - protein, 4 aa, Mycobacterium
PAGA

SEQ ID NO: 991665 - protein, 6 aa, Mycobacterium
PAGASF

SEQ ID NO: 991666 - protein, 14 aa, Mycobacterium
PAGATEGETNRTIE

SEQ ID NO: 991667 - protein, 8 aa, Mycobacterium
PAGDNKFS

SEQ ID NO: 991668 - protein, 6 aa, Mycobacterium
PAGDPV

SEQ ID NO: 991669 - protein, 9 aa, Mycobacterium
PAGDSAALA

SEQ ID NO: 991670 - protein, 5 aa, Mycobacterium
PAGFT

SEQ ID NO: 991671 - protein, 6 aa, Mycobacterium
PAGLTE

SEQ ID NO: 991672 - protein, 4 aa, Mycobacterium
PAGQ

SEQ ID NO: 991673 - protein, 27 aa, Mycobacterium
PAGQAQGTPLSAKSNKGKGRYYTAGFA

SEQ ID NO: 991674 - protein, 11 aa, Mycobacterium
PAGSTDQFGPG

SEQ ID NO: 991675 - protein, 10 aa, Mycobacterium
PAGSTTPPRG

SEQ ID NO: 991676 - protein, 15 aa, Mycobacterium
PAGVSRSNWRYPLIS

SEQ ID NO: 991677 - protein, 6 aa, Mycobacterium
PAGYGA

SEQ ID NO: 991678 - protein, 9 aa, Mycobacterium
PAHEEGGER

SEQ ID NO: 991679 - protein, 4 aa, Mycobacterium
PAHG

SEQ ID NO: 991680 - protein, 8 aa, Mycobacterium
PAIASNSS

SEQ ID NO: 991681 - protein, 4 aa, Mycobacterium
PAIT

SEQ ID NO: 991682 - protein, 7 aa, Mycobacterium
PAKARKA

SEQ ID NO: 991683 - protein, 7 aa, Mycobacterium
PAKGLTH

SEQ ID NO: 991684 - protein, 7 aa, Mycobacterium
PAKQVNS

SEQ ID NO: 991685 - protein, 9 aa, Mycobacterium
PAKTPKQKW

SEQ ID NO: 991686 - protein, 9 aa, Mycobacterium
PALARNRGS

SEQ ID NO: 991687 - protein, 15 aa, Mycobacterium
PALATTATAQRARRL

SEQ ID NO: 991688 - protein, 8 aa, Mycobacterium
PALIGDNN

SEQ ID NO: 991689 - protein, 5 aa, Mycobacterium
PALPA

SEQ ID NO: 991690 - protein, 6 aa, Mycobacterium
PALRAD

SEQ ID NO: 991691 - protein, 4 aa, Mycobacterium
PALT

SEQ ID NO: 991692 - protein, 8 aa, Mycobacterium
PAMRRARS

SEQ ID NO: 991693 - protein, 5 aa, Mycobacterium
PANAK

SEQ ID NO: 991694 - protein, 7 aa, Mycobacterium
PANGPAR

SEQ ID NO: 991695 - protein, 7 aa, Mycobacterium
PANRSAL

SEQ ID NO: 991696 - protein, 11 aa, Mycobacterium
PANSEPRTGLS

SEQ ID NO: 991697 - protein, 5 aa, Mycobacterium
PANSS

SEQ ID NO: 991698 - protein, 7 aa, Mycobacterium
PANVSRR

SEQ ID NO: 991699 - protein, 5 aa, Mycobacterium
PANYE

SEQ ID NO: 991700 - protein, 4 aa, Mycobacterium
PAPA

SEQ ID NO: 991701 - protein, 7 aa, Mycobacterium
PAPAQGA

SEQ ID NO: 991702 - protein, 6 aa, Mycobacterium
PAPASD

SEQ ID NO: 991703 - protein, 4 aa, Mycobacterium
PAPG

SEQ ID NO: 991704 - protein, 7 aa, Mycobacterium
PAPLGTP

SEQ ID NO: 991705 - protein, 7 aa, Mycobacterium
PAPLPCT

SEQ ID NO: 991706 - protein, 18 aa, Mycobacterium
PAPLSTGVKARSARGPIA

SEQ ID NO: 991707 - protein, 7 aa, Mycobacterium
PAPQVSP

SEQ ID NO: 991708 - protein, 6 aa, Mycobacterium
PAPSKY

SEQ ID NO: 991709 - protein, 15 aa, Mycobacterium
PAPVVPSGPRPEDIS

SEQ ID NO: 991710 - protein, 9 aa, Mycobacterium
PAQARRDIA

SEQ ID NO: 991711 - protein, 7 aa, Mycobacterium
PAQHAQI

SEQ ID NO: 991712 - protein, 6 aa, Mycobacterium
PAQLRG

SEQ ID NO: 991713 - protein, 5 aa, Mycobacterium
PAQVA

SEQ ID NO: 991714 - protein, 5 aa, Mycobacterium
PARAR

SEQ ID NO: 991715 - protein, 9 aa, Mycobacterium
PARGGSSIG

SEQ ID NO: 991716 - protein, 28 aa, Mycobacterium
PARGNRRSAVGNHRTTLKQKTPVSEKPQ

SEQ ID NO: 991717 - protein, 18 aa, Mycobacterium
PARHRSNGFSSAKDVSST

SEQ ID NO: 991718 - protein, 7 aa, Mycobacterium
PARLPGT

SEQ ID NO: 991719 - protein, 7 aa, Mycobacterium
PARPNSP

SEQ ID NO: 991720 - protein, 5 aa, Mycobacterium
PASAT

SEQ ID NO: 991721 - protein, 15 aa, Mycobacterium
PASDADYADLLSLLK

SEQ ID NO: 991722 - protein, 8 aa, Mycobacterium
PASDDRCE

SEQ ID NO: 991723 - protein, 13 aa, Mycobacterium
PASDQAVPPLPVG

SEQ ID NO: 991724 - protein, 9 aa, Mycobacterium
PASEDATFT

SEQ ID NO: 991725 - protein, 4 aa, Mycobacterium
PASG

SEQ ID NO: 991726 - protein, 7 aa, Mycobacterium
PASGLGA

SEQ ID NO: 991727 - protein, 22 aa, Mycobacterium
PASGRLTGTDSGAGRLPEAEEI

SEQ ID NO: 991728 - protein, 10 aa, Mycobacterium
PASGSCGDTR

SEQ ID NO: 991729 - protein, 7 aa, Mycobacterium
PASLPPI

SEQ ID NO: 991730 - protein, 8 aa, Mycobacterium
PASPDVSL

SEQ ID NO: 991731 - protein, 4 aa, Mycobacterium
PASR

SEQ ID NO: 991732 - protein, 15 aa, Mycobacterium
PASSITSSRSTSPLL

SEQ ID NO: 991733 - protein, 18 aa, Mycobacterium
PASTAAITSTFANTSAPR

SEQ ID NO: 991734 - protein, 6 aa, Mycobacterium
PASTVS

SEQ ID NO: 991735 - protein, 11 aa, Mycobacterium
PASVADDFTRP

SEQ ID NO: 991736 - protein, 5 aa, Mycobacterium
PASYT

SEQ ID NO: 991737 - protein, 5 aa, Mycobacterium
PATDQ

SEQ ID NO: 991738 - protein, 6 aa, Mycobacterium
PATDRV

SEQ ID NO: 991739 - protein, 13 aa, Mycobacterium
PATGSSFRKIHRC

SEQ ID NO: 991740 - protein, 7 aa, Mycobacterium
PATGTPA

SEQ ID NO: 991741 - protein, 6 aa, Mycobacterium
PATGWD

SEQ ID NO: 991742 - protein, 7 aa, Mycobacterium
PATHDSN

SEQ ID NO: 991743 - protein, 13 aa, Mycobacterium
PATPATVTPDNQL

SEQ ID NO: 991744 - protein, 6 aa, Mycobacterium
PATPTT

SEQ ID NO: 991745 - protein, 7 aa, Mycobacterium
PATREQR

SEQ ID NO: 991746 - protein, 4 aa, Mycobacterium
PATS

SEQ ID NO: 991747 - protein, 9 aa, Mycobacterium
PATTSSAIG

SEQ ID NO: 991748 - protein, 15 aa, Mycobacterium
PATTTSKSSTAWAPR

SEQ ID NO: 991749 - protein, 6 aa, Mycobacterium
PATTYT

SEQ ID NO: 991750 - protein, 5 aa, Mycobacterium
PAVAA

SEQ ID NO: 991751 - protein, 9 aa, Mycobacterium
PAVERERAE

SEQ ID NO: 991752 - protein, 4 aa, Mycobacterium
PAVG

SEQ ID NO: 991753 - protein, 12 aa, Mycobacterium
PAVGGVPAEAAS

SEQ ID NO: 991754 - protein, 8 aa, Mycobacterium
PAVKPSTA

SEQ ID NO: 991755 - protein, 4 aa, Mycobacterium
PAVR

SEQ ID NO: 991756 - protein, 6 aa, Mycobacterium
PAVRSA

SEQ ID NO: 991757 - protein, 33 aa, Mycobacterium
PAVTSPVISTSPVPTPVNSEQFGPVTATAPGTS

SEQ ID NO: 991758 - protein, 8 aa, Mycobacterium
PAYRGRGV

SEQ ID NO: 991759 - protein, 20 aa, Mycobacterium
PAYTTAPGGPPSRSRWYDRR

SEQ ID NO: 991760 - protein, 8 aa, Mycobacterium
PCPEEGSH

SEQ ID NO: 991761 - protein, 5 aa, Mycobacterium
PCPGR

SEQ ID NO: 991762 - protein, 7 aa, Mycobacterium
PCSPTQA

SEQ ID NO: 991763 - protein, 7 aa, Mycobacterium
PCTGTGM

SEQ ID NO: 991764 - protein, 23 aa, Mycobacterium
PCTHRPDGQANGWPAVSAAEPRI

SEQ ID NO: 991765 - protein, 14 aa, Mycobacterium
PDAAARGVVDASED

SEQ ID NO: 991766 - protein, 9 aa, Mycobacterium
PDAEAGKDL

SEQ ID NO: 991767 - protein, 8 aa, Mycobacterium
PDAERDGD

SEQ ID NO: 991768 - protein, 8 aa, Mycobacterium
PDAETGTG

SEQ ID NO: 991769 - protein, 7 aa, Mycobacterium
PDAGNAH

SEQ ID NO: 991770 - protein, 5 aa, Mycobacterium
PDAGT

SEQ ID NO: 991771 - protein, 11 aa, Mycobacterium
PDAKPAATGLE

SEQ ID NO: 991772 - protein, 11 aa, Mycobacterium
PDAKPITADNE

SEQ ID NO: 991773 - protein, 5 aa, Mycobacterium
PDALR

SEQ ID NO: 991774 - protein, 12 aa, Mycobacterium
PDANPDNSAGER

SEQ ID NO: 991775 - protein, 5 aa, Mycobacterium
PDAQP

SEQ ID NO: 991776 - protein, 21 aa, Mycobacterium
PDASEKELAAASKKIRDDPRS

SEQ ID NO: 991777 - protein, 14 aa, Mycobacterium
PDDADSEPSPPLAK

SEQ ID NO: 991778 - protein, 8 aa, Mycobacterium
PDDDPPPI

SEQ ID NO: 991779 - protein, 11 aa, Mycobacterium
PDDESLSNGAT

SEQ ID NO: 991780 - protein, 5 aa, Mycobacterium
PDDPN

SEQ ID NO: 991781 - protein, 10 aa, Mycobacterium
PDDPNREDAV

SEQ ID NO: 991782 - protein, 9 aa, Mycobacterium
PDDPPGRRR

SEQ ID NO: 991783 - protein, 14 aa, Mycobacterium
PDDPRVLNTGLAVA

SEQ ID NO: 991784 - protein, 5 aa, Mycobacterium
PDDSG

SEQ ID NO: 991785 - protein, 17 aa, Mycobacterium
PDDYDRVPADEPNPEQI

SEQ ID NO: 991786 - protein, 5 aa, Mycobacterium
PDEAA

SEQ ID NO: 991787 - protein, 5 aa, Mycobacterium
PDEGA

SEQ ID NO: 991788 - protein, 12 aa, Mycobacterium
PDEGRVGYTDLW

SEQ ID NO: 991789 - protein, 7 aa, Mycobacterium
PDERRSA

SEQ ID NO: 991790 - protein, 10 aa, Mycobacterium
PDESTAVPLT

SEQ ID NO: 991791 - protein, 6 aa, Mycobacterium
PDEYSS

SEQ ID NO: 991792 - protein, 4 aa, Mycobacterium
PDFA

SEQ ID NO: 991793 - protein, 12 aa, Mycobacterium
PDFGTPTSRAEA

SEQ ID NO: 991794 - protein, 4 aa, Mycobacterium
PDFI

SEQ ID NO: 991795 - protein, 11 aa, Mycobacterium
PDGATAGSGIE

SEQ ID NO: 991796 - protein, 6 aa, Mycobacterium
PDGDGL

SEQ ID NO: 991797 - protein, 9 aa, Mycobacterium
PDGDKAPAA

SEQ ID NO: 991798 - protein, 12 aa, Mycobacterium
PDGGADAEDAKP

SEQ ID NO: 991799 - protein, 28 aa, Mycobacterium
PDGQWTASPQKGQQVRDHQESLMERHRS

SEQ ID NO: 991800 - protein, 10 aa, Mycobacterium
PDGSSSWADP

SEQ ID NO: 991801 - protein, 5 aa, Mycobacterium
PDGTP

SEQ ID NO: 991802 - protein, 12 aa, Mycobacterium
PDGTQTPGRTVA

SEQ ID NO: 991803 - protein, 4 aa, Mycobacterium
PDGW

SEQ ID NO: 991804 - protein, 21 aa, Mycobacterium
PDGYDKSWADGRGASPADRRH

SEQ ID NO: 991805 - protein, 13 aa, Mycobacterium
PDHGRPLEVGEPA

SEQ ID NO: 991806 - protein, 5 aa, Mycobacterium
PDHTR

SEQ ID NO: 991807 - protein, 12 aa, Mycobacterium
PDINPDEAAQAK

SEQ ID NO: 991808 - protein, 5 aa, Mycobacterium
PDIPG

SEQ ID NO: 991809 - protein, 4 aa, Mycobacterium
PDIT

SEQ ID NO: 991810 - protein, 7 aa, Mycobacterium
PDKSTVT

SEQ ID NO: 991811 - protein, 8 aa, Mycobacterium
PDLPPGDR

SEQ ID NO: 991812 - protein, 9 aa, Mycobacterium
PDMEDDDEL

SEQ ID NO: 991813 - protein, 5 aa, Mycobacterium
PDNPV

SEQ ID NO: 991814 - protein, 13 aa, Mycobacterium
PDNRSKVTTTRSR

SEQ ID NO: 991815 - protein, 7 aa, Mycobacterium
PDPDAAV

SEQ ID NO: 991816 - protein, 7 aa, Mycobacterium
PDPDKPV

SEQ ID NO: 991817 - protein, 7 aa, Mycobacterium
PDPDPGD

SEQ ID NO: 991818 - protein, 7 aa, Mycobacterium
PDPEIHP

SEQ ID NO: 991819 - protein, 20 aa, Mycobacterium
PDPEPHGAITPQGRPGGKPW

SEQ ID NO: 991820 - protein, 4 aa, Mycobacterium
PDPI

SEQ ID NO: 991821 - protein, 5 aa, Mycobacterium
PDPIS

SEQ ID NO: 991822 - protein, 7 aa, Mycobacterium
PDPQGDV

SEQ ID NO: 991823 - protein, 8 aa, Mycobacterium
PDPQYAPG

SEQ ID NO: 991824 - protein, 11 aa, Mycobacterium
PDPRTGDGGLT

SEQ ID NO: 991825 - protein, 9 aa, Mycobacterium
PDPSSPDVQ

SEQ ID NO: 991826 - protein, 29 aa, Mycobacterium
PDQLAPGERCAATSNRNFEGRQGKGGRTH

SEQ ID NO: 991827 - protein, 14 aa, Mycobacterium
PDQLDTAGDNPANW

SEQ ID NO: 991828 - protein, 7 aa, Mycobacterium
PDQPQPF

SEQ ID NO: 991829 - protein, 4 aa, Mycobacterium
PDQR

SEQ ID NO: 991830 - protein, 4 aa, Mycobacterium
PDRL

SEQ ID NO: 991831 - protein, 8 aa, Mycobacterium
PDRSEGDL

SEQ ID NO: 991832 - protein, 5 aa, Mycobacterium
PDRSV

SEQ ID NO: 991833 - protein, 8 aa, Mycobacterium
PDRTDPRW

SEQ ID NO: 991834 - protein, 17 aa, Mycobacterium
PDRTLTEDDASAARDAA

SEQ ID NO: 991835 - protein, 16 aa, Mycobacterium
PDRYDGFTGAHRIDLN

SEQ ID NO: 991836 - protein, 10 aa, Mycobacterium
PDSLPAADEI

SEQ ID NO: 991837 - protein, 9 aa, Mycobacterium
PDSPNQPYD

SEQ ID NO: 991838 - protein, 15 aa, Mycobacterium
PDSPTRFPAEQEPEH

SEQ ID NO: 991839 - protein, 4 aa, Mycobacterium
PDST

SEQ ID NO: 991840 - protein, 5 aa, Mycobacterium
PDTDH

SEQ ID NO: 991841 - protein, 5 aa, Mycobacterium
PDTGT

SEQ ID NO: 991842 - protein, 7 aa, Mycobacterium
PDTGVSR

SEQ ID NO: 991843 - protein, 7 aa, Mycobacterium
PDTSSLG

SEQ ID NO: 991844 - protein, 5 aa, Mycobacterium
PDTTL

SEQ ID NO: 991845 - protein, 11 aa, Mycobacterium
PDVAERINTTR

SEQ ID NO: 991846 - protein, 27 aa, Mycobacterium
PDVGDVEPGDRDAREPGKLVSLRQLLA

SEQ ID NO: 991847 - protein, 6 aa, Mycobacterium
PDVGGV

SEQ ID NO: 991848 - protein, 7 aa, Mycobacterium
PDYGQLS

SEQ ID NO: 991849 - protein, 12 aa, Mycobacterium
PDYPQDPKSYQE

SEQ ID NO: 991850 - protein, 9 aa, Mycobacterium
PEAEPTRRY

SEQ ID NO: 991851 - protein, 18 aa, Mycobacterium
PEAPSGRTTADAYDEFTE

SEQ ID NO: 991852 - protein, 9 aa, Mycobacterium
PEATGTDTF

SEQ ID NO: 991853 - protein, 5 aa, Mycobacterium
PEAVR

SEQ ID NO: 991854 - protein, 8 aa, Mycobacterium
PEDGDEEA

SEQ ID NO: 991855 - protein, 4 aa, Mycobacterium
PEDI

SEQ ID NO: 991856 - protein, 10 aa, Mycobacterium
PEDVPPQNIR

SEQ ID NO: 991857 - protein, 6 aa, Mycobacterium
PEEAQT

SEQ ID NO: 991858 - protein, 7 aa, Mycobacterium
PEEQRAA

SEQ ID NO: 991859 - protein, 7 aa, Mycobacterium
PEEQRQA

SEQ ID NO: 991860 - protein, 9 aa, Mycobacterium
PEERSEMRR

SEQ ID NO: 991861 - protein, 9 aa, Mycobacterium
PEEYGEPYR

SEQ ID NO: 991862 - protein, 9 aa, Mycobacterium
PEGGIAPDE

SEQ ID NO: 991863 - protein, 17 aa, Mycobacterium
PEGGPTIGSQVSSLIWA

SEQ ID NO: 991864 - protein, 4 aa, Mycobacterium
PEGL

SEQ ID NO: 991865 - protein, 5 aa, Mycobacterium
PEGSQ

SEQ ID NO: 991866 - protein, 19 aa, Mycobacterium
PEGTRSPDGRLYKGKTGVA

SEQ ID NO: 991867 - protein, 4 aa, Mycobacterium
PEHD

SEQ ID NO: 991868 - protein, 6 aa, Mycobacterium
PEHGPG

SEQ ID NO: 991869 - protein, 4 aa, Mycobacterium
PEIA

SEQ ID NO: 991870 - protein, 5 aa, Mycobacterium
PEISG

SEQ ID NO: 991871 - protein, 13 aa, Mycobacterium
PEITKPDKDGDAL

SEQ ID NO: 991872 - protein, 18 aa, Mycobacterium
PEKALGDINNAKSRPDEY

SEQ ID NO: 991873 - protein, 11 aa, Mycobacterium
PEKGGSTREAK

SEQ ID NO: 991874 - protein, 9 aa, Mycobacterium
PEKKSTVTE

SEQ ID NO: 991875 - protein, 16 aa, Mycobacterium
PELHSNPAEARKAGRR

SEQ ID NO: 991876 - protein, 17 aa, Mycobacterium
PELPQGQPVSSAPYGSA

SEQ ID NO: 991877 - protein, 5 aa, Mycobacterium
PENGL

SEQ ID NO: 991878 - protein, 8 aa, Mycobacterium
PEPPSVDA

SEQ ID NO: 991879 - protein, 9 aa, Mycobacterium
PEPPYGKGV

SEQ ID NO: 991880 - protein, 6 aa, Mycobacterium
PEPSGI

SEQ ID NO: 991881 - protein, 9 aa, Mycobacterium
PEPTGLDAA

SEQ ID NO: 991882 - protein, 4 aa, Mycobacterium
PEQQ

SEQ ID NO: 991883 - protein, 9 aa, Mycobacterium
PEQSEDNAF

SEQ ID NO: 991884 - protein, 11 aa, Mycobacterium
PERDTQTKTGR

SEQ ID NO: 991885 - protein, 6 aa, Mycobacterium
PERQRH

SEQ ID NO: 991886 - protein, 5 aa, Mycobacterium
PERTQ

SEQ ID NO: 991887 - protein, 7 aa, Mycobacterium
PERTSMP

SEQ ID NO: 991888 - protein, 4 aa, Mycobacterium
PERV

SEQ ID NO: 991889 - protein, 5 aa, Mycobacterium
PESAG

SEQ ID NO: 991890 - protein, 10 aa, Mycobacterium
PESGEFDTDA

SEQ ID NO: 991891 - protein, 20 aa, Mycobacterium
PESGTPAAVGYAQESGISYG

SEQ ID NO: 991892 - protein, 8 aa, Mycobacterium
PESPDDAA

SEQ ID NO: 991893 - protein, 12 aa, Mycobacterium
PESPIGKTDPVG

SEQ ID NO: 991894 - protein, 12 aa, Mycobacterium
PESRYDDAAAFF

SEQ ID NO: 991895 - protein, 19 aa, Mycobacterium
PESSLPGEWPYRRGGDALR

SEQ ID NO: 991896 - protein, 7 aa, Mycobacterium
PESSRRA

SEQ ID NO: 991897 - protein, 12 aa, Mycobacterium
PESSVRADFILL

SEQ ID NO: 991898 - protein, 14 aa, Mycobacterium
PESTGGPATATGRE

SEQ ID NO: 991899 - protein, 4 aa, Mycobacterium
PETA

SEQ ID NO: 991900 - protein, 18 aa, Mycobacterium
PETCGSKSMTPTSLGGTP

SEQ ID NO: 991901 - protein, 7 aa, Mycobacterium
PEVKPGV

SEQ ID NO: 991902 - protein, 6 aa, Mycobacterium
PEVPES

SEQ ID NO: 991903 - protein, 5 aa, Mycobacterium
PEVPG

SEQ ID NO: 991904 - protein, 12 aa, Mycobacterium
PEVPTRPGKGEA

SEQ ID NO: 991905 - protein, 5 aa, Mycobacterium
PEYNQ

SEQ ID NO: 991906 - protein, 8 aa, Mycobacterium
PFAASKSS

SEQ ID NO: 991907 - protein, 5 aa, Mycobacterium
PFDRD

SEQ ID NO: 991908 - protein, 10 aa, Mycobacterium
PFPKPLSRTR

SEQ ID NO: 991909 - protein, 12 aa, Mycobacterium
PFPSDIQTAENL

SEQ ID NO: 991910 - protein, 9 aa, Mycobacterium
PFSGEDDRD

SEQ ID NO: 991911 - protein, 6 aa, Mycobacterium
PFSRGE

SEQ ID NO: 991912 - protein, 19 aa, Mycobacterium
PFSTGETGRVGSPKRREIG

SEQ ID NO: 991913 - protein, 13 aa, Mycobacterium
PFTPEQHTHREAE

SEQ ID NO: 991914 - protein, 14 aa, Mycobacterium
PGAAAAAVAARHRE

SEQ ID NO: 991915 - protein, 22 aa, Mycobacterium
PGAADSDVVDTRELAELQAAFG

SEQ ID NO: 991916 - protein, 9 aa, Mycobacterium
PGADGMSGA

SEQ ID NO: 991917 - protein, 10 aa, Mycobacterium
PGADGRVTGL

SEQ ID NO: 991918 - protein, 10 aa, Mycobacterium
PGADPTLTTT

SEQ ID NO: 991919 - protein, 4 aa, Mycobacterium
PGAE

SEQ ID NO: 991920 - protein, 6 aa, Mycobacterium
PGAGRV

SEQ ID NO: 991921 - protein, 7 aa, Mycobacterium
PGAPAGQ

SEQ ID NO: 991922 - protein, 9 aa, Mycobacterium
PGAPPSLAG

SEQ ID NO: 991923 - protein, 9 aa, Mycobacterium
PGASAGRGL

SEQ ID NO: 991924 - protein, 10 aa, Mycobacterium
PGASDTARFD

SEQ ID NO: 991925 - protein, 12 aa, Mycobacterium
PGASGSSRAERL

SEQ ID NO: 991926 - protein, 14 aa, Mycobacterium
PGASPQAGGVSDPV

SEQ ID NO: 991927 - protein, 31 aa, Mycobacterium
PGASSGSPVDSSVDSATVEGVRGGESQTEAT

SEQ ID NO: 991928 - protein, 13 aa, Mycobacterium
PGASTVAVDHRPQ

SEQ ID NO: 991929 - protein, 16 aa, Mycobacterium
PGCGGSCERAPPTQGT

SEQ ID NO: 991930 - protein, 29 aa, Mycobacterium
PGDAVRRSEAPTRSSNTSSTAESPRKVLA

SEQ ID NO: 991931 - protein, 9 aa, Mycobacterium
PGDRRAARA

SEQ ID NO: 991932 - protein, 8 aa, Mycobacterium
PGDTERSL

SEQ ID NO: 991933 - protein, 10 aa, Mycobacterium
PGDTLPSGSR

SEQ ID NO: 991934 - protein, 14 aa, Mycobacterium
PGDVADSAPRSGPD

SEQ ID NO: 991935 - protein, 13 aa, Mycobacterium
PGDVRPTVGVPNK

SEQ ID NO: 991936 - protein, 5 aa, Mycobacterium
PGEGI

SEQ ID NO: 991937 - protein, 8 aa, Mycobacterium
PGEPPYLR

SEQ ID NO: 991938 - protein, 14 aa, Mycobacterium
PGERRDASVKSSSA

SEQ ID NO: 991939 - protein, 8 aa, Mycobacterium
PGETEEDF

SEQ ID NO: 991940 - protein, 7 aa, Mycobacterium
PGFAPTT

SEQ ID NO: 991941 - protein, 4 aa, Mycobacterium
PGFG

SEQ ID NO: 991942 - protein, 7 aa, Mycobacterium
PGFGKSV

SEQ ID NO: 991943 - protein, 22 aa, Mycobacterium
PGFSGITDPLPSRQRGAHRPRR

SEQ ID NO: 991944 - protein, 19 aa, Mycobacterium
PGGASSATAEINAAGGRSM

SEQ ID NO: 991945 - protein, 5 aa, Mycobacterium
PGGCA

SEQ ID NO: 991946 - protein, 6 aa, Mycobacterium
PGGEGR

SEQ ID NO: 991947 - protein, 8 aa, Mycobacterium
PGGESTTI

SEQ ID NO: 991948 - protein, 8 aa, Mycobacterium
PGGGGVTR

SEQ ID NO: 991949 - protein, 11 aa, Mycobacterium
PGGGSGTGGVN

SEQ ID NO: 991950 - protein, 15 aa, Mycobacterium
PGGPARISAGARLGG

SEQ ID NO: 991951 - protein, 4 aa, Mycobacterium
PGGQ

SEQ ID NO: 991952 - protein, 9 aa, Mycobacterium
PGGQGDDVV

SEQ ID NO: 991953 - protein, 18 aa, Mycobacterium
PGGSVRDAEVTAAATKAG

SEQ ID NO: 991954 - protein, 7 aa, Mycobacterium
PGGVGKT

SEQ ID NO: 991955 - protein, 8 aa, Mycobacterium
PGGVNSPV

SEQ ID NO: 991956 - protein, 7 aa, Mycobacterium
PGGWTEA

SEQ ID NO: 991957 - protein, 13 aa, Mycobacterium
PGHADNELAGTAD

SEQ ID NO: 991958 - protein, 4 aa, Mycobacterium
PGHE

SEQ ID NO: 991959 - protein, 21 aa, Mycobacterium
PGHGNSTTIGAERRFNPFLEG

SEQ ID NO: 991960 - protein, 7 aa, Mycobacterium
PGHGPDL

SEQ ID NO: 991961 - protein, 4 aa, Mycobacterium
PGHP

SEQ ID NO: 991962 - protein, 6 aa, Mycobacterium
PGHPHD

SEQ ID NO: 991963 - protein, 15 aa, Mycobacterium
PGHPLSGKRRVPTTA

SEQ ID NO: 991964 - protein, 4 aa, Mycobacterium
PGIE

SEQ ID NO: 991965 - protein, 6 aa, Mycobacterium
PGIENS

SEQ ID NO: 991966 - protein, 9 aa, Mycobacterium
PGIGKRGAE

SEQ ID NO: 991967 - protein, 16 aa, Mycobacterium
PGIRATADPADALRGA

SEQ ID NO: 991968 - protein, 14 aa, Mycobacterium
PGISEGIQQADEGP

SEQ ID NO: 991969 - protein, 7 aa, Mycobacterium
PGISTQI

SEQ ID NO: 991970 - protein, 8 aa, Mycobacterium
PGKPAPRL

SEQ ID NO: 991971 - protein, 9 aa, Mycobacterium
PGKRDEGLG

SEQ ID NO: 991972 - protein, 16 aa, Mycobacterium
PGKRNISIRPTDDRTI

SEQ ID NO: 991973 - protein, 12 aa, Mycobacterium
PGLESAQREEVA

SEQ ID NO: 991974 - protein, 10 aa, Mycobacterium
PGLGVRPAKQ

SEQ ID NO: 991975 - protein, 5 aa, Mycobacterium
PGLHR

SEQ ID NO: 991976 - protein, 7 aa, Mycobacterium
PGLPPAT

SEQ ID NO: 991977 - protein, 13 aa, Mycobacterium
PGLPRSTDSAVIC

SEQ ID NO: 991978 - protein, 5 aa, Mycobacterium
PGLPS

SEQ ID NO: 991979 - protein, 7 aa, Mycobacterium
PGLQEKP

SEQ ID NO: 991980 - protein, 11 aa, Mycobacterium
PGLQSERTART

SEQ ID NO: 991981 - protein, 40 aa, Mycobacterium
PGMGRKSATRKSKGGKGKKRARGPTSPKVRSPFGPARPGM

SEQ ID NO: 991982 - protein, 9 aa, Mycobacterium
PGMSRDPPY

SEQ ID NO: 991983 - protein, 13 aa, Mycobacterium
PGMTSQDQQPAHN

SEQ ID NO: 991984 - protein, 7 aa, Mycobacterium
PGNQAPL

SEQ ID NO: 991985 - protein, 8 aa, Mycobacterium
PGNRPTTS

SEQ ID NO: 991986 - protein, 6 aa, Mycobacterium
PGNSAN

SEQ ID NO: 991987 - protein, 8 aa, Mycobacterium
PGNSDPAV

SEQ ID NO: 991988 - protein, 9 aa, Mycobacterium
PGPCGPSSE

SEQ ID NO: 991989 - protein, 7 aa, Mycobacterium
PGPGATV

SEQ ID NO: 991990 - protein, 15 aa, Mycobacterium
PGPPPARTGTDRTSA

SEQ ID NO: 991991 - protein, 15 aa, Mycobacterium
PGPTAGRTDSSGHPF

SEQ ID NO: 991992 - protein, 9 aa, Mycobacterium
PGPTDRHRH

SEQ ID NO: 991993 - protein, 4 aa, Mycobacterium
PGPV

SEQ ID NO: 991994 - protein, 15 aa, Mycobacterium
PGPVRTELPDHDEAS

SEQ ID NO: 991995 - protein, 11 aa, Mycobacterium
PGQAPPLGAEG

SEQ ID NO: 991996 - protein, 7 aa, Mycobacterium
PGQDTYQ

SEQ ID NO: 991997 - protein, 7 aa, Mycobacterium
PGQRAMG

SEQ ID NO: 991998 - protein, 9 aa, Mycobacterium
PGQRDGYGL

SEQ ID NO: 991999 - protein, 10 aa, Mycobacterium
PGQRFDGGQG

SEQ ID NO: 992000 - protein, 5 aa, Mycobacterium
PGQRS

SEQ ID NO: 992001 - protein, 4 aa, Mycobacterium
PGRG

SEQ ID NO: 992002 - protein, 10 aa, Mycobacterium
PGRGGADRGL

SEQ ID NO: 992003 - protein, 9 aa, Mycobacterium
PGRGTQPTA

SEQ ID NO: 992004 - protein, 11 aa, Mycobacterium
PGRRAAGRAEV

SEQ ID NO: 992005 - protein, 7 aa, Mycobacterium
PGRRARV

SEQ ID NO: 992006 - protein, 4 aa, Mycobacterium
PGRT

SEQ ID NO: 992007 - protein, 15 aa, Mycobacterium
PGRVAARGEAGNQGR

SEQ ID NO: 992008 - protein, 13 aa, Mycobacterium
PGRWDEDGAKRIP

SEQ ID NO: 992009 - protein, 4 aa, Mycobacterium
PGSE

SEQ ID NO: 992010 - protein, 35 aa, Mycobacterium
PGSGNATAASKEQRVTDMDSGRQEDQTSDEVTVET

SEQ ID NO: 992011 - protein, 7 aa, Mycobacterium
PGSGPLL

SEQ ID NO: 992012 - protein, 9 aa, Mycobacterium
PGSGRETAI

SEQ ID NO: 992013 - protein, 14 aa, Mycobacterium
PGSIPTTTSGKVRR

SEQ ID NO: 992014 - protein, 9 aa, Mycobacterium
PGSPNRGMF

SEQ ID NO: 992015 - protein, 6 aa, Mycobacterium
PGSRFD

SEQ ID NO: 992016 - protein, 5 aa, Mycobacterium
PGSTP

SEQ ID NO: 992017 - protein, 12 aa, Mycobacterium
PGTALPGADGAD

SEQ ID NO: 992018 - protein, 19 aa, Mycobacterium
PGTALSKANPRSPHTGDPE

SEQ ID NO: 992019 - protein, 7 aa, Mycobacterium
PGTARRT

SEQ ID NO: 992020 - protein, 8 aa, Mycobacterium
PGTDINPN

SEQ ID NO: 992021 - protein, 7 aa, Mycobacterium
PGTEGFS

SEQ ID NO: 992022 - protein, 7 aa, Mycobacterium
PGTEQEY

SEQ ID NO: 992023 - protein, 12 aa, Mycobacterium
PGTNWKSNPNAM

SEQ ID NO: 992024 - protein, 6 aa, Mycobacterium
PGTPMR

SEQ ID NO: 992025 - protein, 8 aa, Mycobacterium
PGTRPRNR

SEQ ID NO: 992026 - protein, 5 aa, Mycobacterium
PGTSR

SEQ ID NO: 992027 - protein, 5 aa, Mycobacterium
PGVEP

SEQ ID NO: 992028 - protein, 5 aa, Mycobacterium
PGVGS

SEQ ID NO: 992029 - protein, 6 aa, Mycobacterium
PGVKED

SEQ ID NO: 992030 - protein, 7 aa, Mycobacterium
PGVPNAE

SEQ ID NO: 992031 - protein, 8 aa, Mycobacterium
PGWGSEQP

SEQ ID NO: 992032 - protein, 4 aa, Mycobacterium
PGWL

SEQ ID NO: 992033 - protein, 5 aa, Mycobacterium
PGYKY

SEQ ID NO: 992034 - protein, 5 aa, Mycobacterium
PGYPK

SEQ ID NO: 992035 - protein, 15 aa, Mycobacterium
PHDDHDDGSGKYRSR

SEQ ID NO: 992036 - protein, 4 aa, Mycobacterium
PHDP

SEQ ID NO: 992037 - protein, 4 aa, Mycobacterium
PHEA

SEQ ID NO: 992038 - protein, 13 aa, Mycobacterium
PHEPAGDQPAAID

SEQ ID NO: 992039 - protein, 8 aa, Mycobacterium
PHGGDATA

SEQ ID NO: 992040 - protein, 10 aa, Mycobacterium
PHGIATSRRG

SEQ ID NO: 992041 - protein, 4 aa, Mycobacterium
PHHP

SEQ ID NO: 992042 - protein, 7 aa, Mycobacterium
PHHPTDS

SEQ ID NO: 992043 - protein, 15 aa, Mycobacterium
PHHTESTVTGGTSLN

SEQ ID NO: 992044 - protein, 18 aa, Mycobacterium
PHIPAPGGAGFPAGDDAL

SEQ ID NO: 992045 - protein, 5 aa, Mycobacterium
PHIPT

SEQ ID NO: 992046 - protein, 19 aa, Mycobacterium
PHKTSSRRVEVRSPDSACN

SEQ ID NO: 992047 - protein, 22 aa, Mycobacterium
PHLPPGAGTPPFSLTPLSTTSG

SEQ ID NO: 992048 - protein, 5 aa, Mycobacterium
PHNSG

SEQ ID NO: 992049 - protein, 17 aa, Mycobacterium
PHPAAGKSQIGRASNSG

SEQ ID NO: 992050 - protein, 16 aa, Mycobacterium
PHPGASPDSGPGDPVA

SEQ ID NO: 992051 - protein, 5 aa, Mycobacterium
PHPGL

SEQ ID NO: 992052 - protein, 14 aa, Mycobacterium
PHPGLAGDDQQDRG

SEQ ID NO: 992053 - protein, 12 aa, Mycobacterium
PHPQGDPDAPTR

SEQ ID NO: 992054 - protein, 5 aa, Mycobacterium
PHPTI

SEQ ID NO: 992055 - protein, 6 aa, Mycobacterium
PHPTSR

SEQ ID NO: 992056 - protein, 15 aa, Mycobacterium
PHRAAPRDVVEICRQ

SEQ ID NO: 992057 - protein, 11 aa, Mycobacterium
PHSEGRPGEEQ

SEQ ID NO: 992058 - protein, 4 aa, Mycobacterium
PHTE

SEQ ID NO: 992059 - protein, 6 aa, Mycobacterium
PHTGSS

SEQ ID NO: 992060 - protein, 5 aa, Mycobacterium
PHYDQ

SEQ ID NO: 992061 - protein, 11 aa, Mycobacterium
PIAADKNQVRT

SEQ ID NO: 992062 - protein, 12 aa, Mycobacterium
PIEGAGVRAPQI

SEQ ID NO: 992063 - protein, 5 aa, Mycobacterium
PIEPT

SEQ ID NO: 992064 - protein, 126 aa, Mycobacterium
PIEVDDDSCADDDVESGDDSDVGDDEEQPDRPANRRRRRGRRGRGRGRGEQGGSDVQSDDVDGAVDSTESEDFDGQDFDESEDTEIGYDESGSSEAGNRRRRRRRRRKSGVGEDEGCAPDDPPNTV

SEQ ID NO: 992065 - protein, 5 aa, Mycobacterium
PIGEE

SEQ ID NO: 992066 - protein, 5 aa, Mycobacterium
PIGGY

SEQ ID NO: 992067 - protein, 22 aa, Mycobacterium
PIGPSAGTVPATRSGACSDIGA

SEQ ID NO: 992068 - protein, 12 aa, Mycobacterium
PIGQGPGKIAKV

SEQ ID NO: 992069 - protein, 6 aa, Mycobacterium
PIGRGQ

SEQ ID NO: 992070 - protein, 16 aa, Mycobacterium
PIKPGDSGGPVVNSRG

SEQ ID NO: 992071 - protein, 6 aa, Mycobacterium
PINDSR

SEQ ID NO: 992072 - protein, 48 aa, Mycobacterium
PIPDPAAPEAKAKLKPVPTNSTQRKSTSKPAAKKTTRRRTATTELQGT

SEQ ID NO: 992073 - protein, 6 aa, Mycobacterium
PIPKPG

SEQ ID NO: 992074 - protein, 4 aa, Mycobacterium
PIPR

SEQ ID NO: 992075 - protein, 11 aa, Mycobacterium
PIRGESENLAP

SEQ ID NO: 992076 - protein, 8 aa, Mycobacterium
PIRPPQRL

SEQ ID NO: 992077 - protein, 5 aa, Mycobacterium
PITNG

SEQ ID NO: 992078 - protein, 7 aa, Mycobacterium
PITPTAS

SEQ ID NO: 992079 - protein, 8 aa, Mycobacterium
PKADGGGA

SEQ ID NO: 992080 - protein, 7 aa, Mycobacterium
PKAERSE

SEQ ID NO: 992081 - protein, 4 aa, Mycobacterium
PKAG

SEQ ID NO: 992082 - protein, 18 aa, Mycobacterium
PKAGTDGVTPLGHSQSGS

SEQ ID NO: 992083 - protein, 7 aa, Mycobacterium
PKAINSL

SEQ ID NO: 992084 - protein, 14 aa, Mycobacterium
PKDLATKQAAASVG

SEQ ID NO: 992085 - protein, 7 aa, Mycobacterium
PKDLTQV

SEQ ID NO: 992086 - protein, 4 aa, Mycobacterium
PKER

SEQ ID NO: 992087 - protein, 9 aa, Mycobacterium
PKFGATKRR

SEQ ID NO: 992088 - protein, 17 aa, Mycobacterium
PKFRTGGYVSTFVESAT

SEQ ID NO: 992089 - protein, 16 aa, Mycobacterium
PKGARQAKPIDAVHEI

SEQ ID NO: 992090 - protein, 8 aa, Mycobacterium
PKGAVGNT

SEQ ID NO: 992091 - protein, 6 aa, Mycobacterium
PKGPGY

SEQ ID NO: 992092 - protein, 9 aa, Mycobacterium
PKGSTTEVT

SEQ ID NO: 992093 - protein, 4 aa, Mycobacterium
PKGV

SEQ ID NO: 992094 - protein, 6 aa, Mycobacterium
PKHDVS

SEQ ID NO: 992095 - protein, 9 aa, Mycobacterium
PKKAGKNLT

SEQ ID NO: 992096 - protein, 6 aa, Mycobacterium
PKKPGV

SEQ ID NO: 992097 - protein, 10 aa, Mycobacterium
PKKSEISKRV

SEQ ID NO: 992098 - protein, 6 aa, Mycobacterium
PKLDPQ

SEQ ID NO: 992099 - protein, 10 aa, Mycobacterium
PKLSAGRVQS

SEQ ID NO: 992100 - protein, 10 aa, Mycobacterium
PKLSDTTASY

SEQ ID NO: 992101 - protein, 10 aa, Mycobacterium
PKNAVNAARD

SEQ ID NO: 992102 - protein, 8 aa, Mycobacterium
PKNEPTFS

SEQ ID NO: 992103 - protein, 4 aa, Mycobacterium
PKNT

SEQ ID NO: 992104 - protein, 13 aa, Mycobacterium
PKQSRDVTLREIY

SEQ ID NO: 992105 - protein, 10 aa, Mycobacterium
PKRNGPVGGA

SEQ ID NO: 992106 - protein, 5 aa, Mycobacterium
PKRYE

SEQ ID NO: 992107 - protein, 7 aa, Mycobacterium
PKSAQPV

SEQ ID NO: 992108 - protein, 7 aa, Mycobacterium
PKSIDDS

SEQ ID NO: 992109 - protein, 8 aa, Mycobacterium
PKSTTKDG

SEQ ID NO: 992110 - protein, 34 aa, Mycobacterium
PKTGGGVDPLTDAPASITAQQRKESGIDTKPKEV

SEQ ID NO: 992111 - protein, 13 aa, Mycobacterium
PKTGKPGHVPPAE

SEQ ID NO: 992112 - protein, 9 aa, Mycobacterium
PKTPETAGL

SEQ ID NO: 992113 - protein, 10 aa, Mycobacterium
PLAAAEVEGA

SEQ ID NO: 992114 - protein, 8 aa, Mycobacterium
PLAGAATQ

SEQ ID NO: 992115 - protein, 10 aa, Mycobacterium
PLAQSAEALG

SEQ ID NO: 992116 - protein, 8 aa, Mycobacterium
PLASSSTI

SEQ ID NO: 992117 - protein, 7 aa, Mycobacterium
PLDDQAT

SEQ ID NO: 992118 - protein, 4 aa, Mycobacterium
PLDE

SEQ ID NO: 992119 - protein, 13 aa, Mycobacterium
PLDGKAHSVAPSD

SEQ ID NO: 992120 - protein, 8 aa, Mycobacterium
PLDGPGVT

SEQ ID NO: 992121 - protein, 5 aa, Mycobacterium
PLDPA

SEQ ID NO: 992122 - protein, 10 aa, Mycobacterium
PLDRDAGAGA

SEQ ID NO: 992123 - protein, 10 aa, Mycobacterium
PLEAAGSLRT

SEQ ID NO: 992124 - protein, 53 aa, Mycobacterium
PLEGPAVKRGVATSAAKKAAIKKAPVKKALAKKAATKAPAKKAVKAPAKKITT

SEQ ID NO: 992125 - protein, 8 aa, Mycobacterium
PLGEGSDH

SEQ ID NO: 992126 - protein, 12 aa, Mycobacterium
PLGNARNVVVMV

SEQ ID NO: 992127 - protein, 5 aa, Mycobacterium
PLGPR

SEQ ID NO: 992128 - protein, 12 aa, Mycobacterium
PLGQPLDASRRL

SEQ ID NO: 992129 - protein, 7 aa, Mycobacterium
PLGRDGR

SEQ ID NO: 992130 - protein, 11 aa, Mycobacterium
PLGTNDPAARM

SEQ ID NO: 992131 - protein, 4 aa, Mycobacterium
PLHG

SEQ ID NO: 992132 - protein, 24 aa, Mycobacterium
PLHTPERVRAGGGDRATADAHAGG

SEQ ID NO: 992133 - protein, 8 aa, Mycobacterium
PLKGARIS

SEQ ID NO: 992134 - protein, 27 aa, Mycobacterium
PLLPPPSQPPGREPVSRRHKSLIISAA

SEQ ID NO: 992135 - protein, 47 aa, Mycobacterium
PLNDEADSSIDKAPRQRGSNPAAGGPHGGSGVRDGHPSDGVSRTWRW

SEQ ID NO: 992136 - protein, 7 aa, Mycobacterium
PLNGEGI

SEQ ID NO: 992137 - protein, 5 aa, Mycobacterium
PLNPD

SEQ ID NO: 992138 - protein, 19 aa, Mycobacterium
PLNSNDAGGSARATGGGRV

SEQ ID NO: 992139 - protein, 17 aa, Mycobacterium
PLPATVEGASSDAGRTP

SEQ ID NO: 992140 - protein, 29 aa, Mycobacterium
PLPGASSGLPAGSGEQLSNACAAALVVQP

SEQ ID NO: 992141 - protein, 5 aa, Mycobacterium
PLPGG

SEQ ID NO: 992142 - protein, 10 aa, Mycobacterium
PLPGGETAND

SEQ ID NO: 992143 - protein, 7 aa, Mycobacterium
PLPPEGA

SEQ ID NO: 992144 - protein, 5 aa, Mycobacterium
PLPPL

SEQ ID NO: 992145 - protein, 5 aa, Mycobacterium
PLPPN

SEQ ID NO: 992146 - protein, 21 aa, Mycobacterium
PLPPRRKQGDRVSSAALITAT

SEQ ID NO: 992147 - protein, 17 aa, Mycobacterium
PLPTTTIGSYPQTSAIR

SEQ ID NO: 992148 - protein, 5 aa, Mycobacterium
PLQNR

SEQ ID NO: 992149 - protein, 12 aa, Mycobacterium
PLRGGSELRPVS

SEQ ID NO: 992150 - protein, 8 aa, Mycobacterium
PLRGSKAH

SEQ ID NO: 992151 - protein, 9 aa, Mycobacterium
PLRSSRRGP

SEQ ID NO: 992152 - protein, 9 aa, Mycobacterium
PLRTEGADL

SEQ ID NO: 992153 - protein, 8 aa, Mycobacterium
PLSGDDVA

SEQ ID NO: 992154 - protein, 9 aa, Mycobacterium
PLSGIGPEQ

SEQ ID NO: 992155 - protein, 7 aa, Mycobacterium
PLSPKSE

SEQ ID NO: 992156 - protein, 19 aa, Mycobacterium
PLSRHGSAIEAARRAITRL

SEQ ID NO: 992157 - protein, 14 aa, Mycobacterium
PLSRQAEVARRAAT

SEQ ID NO: 992158 - protein, 8 aa, Mycobacterium
PLSSGSAK

SEQ ID NO: 992159 - protein, 11 aa, Mycobacterium
PLTGSPAGLSE

SEQ ID NO: 992160 - protein, 6 aa, Mycobacterium
PLTPQQ

SEQ ID NO: 992161 - protein, 10 aa, Mycobacterium
PLTTSSSVLG

SEQ ID NO: 992162 - protein, 16 aa, Mycobacterium
PMGSDGGAMGLDPATN

SEQ ID NO: 992163 - protein, 9 aa, Mycobacterium
PMQGRGGKG

SEQ ID NO: 992164 - protein, 8 aa, Mycobacterium
PNAAGGTN

SEQ ID NO: 992165 - protein, 4 aa, Mycobacterium
PNAE

SEQ ID NO: 992166 - protein, 6 aa, Mycobacterium
PNANET

SEQ ID NO: 992167 - protein, 13 aa, Mycobacterium
PNAVQAGSLNRPG

SEQ ID NO: 992168 - protein, 8 aa, Mycobacterium
PNCNPTEV

SEQ ID NO: 992169 - protein, 17 aa, Mycobacterium
PNDDSHACSSGVGQTRA

SEQ ID NO: 992170 - protein, 39 aa, Mycobacterium
PNDSSIDVNADPTSARRNTGGRRRAANALPTHSTPAPQS

SEQ ID NO: 992171 - protein, 9 aa, Mycobacterium
PNDSVSDAT

SEQ ID NO: 992172 - protein, 22 aa, Mycobacterium
PNDVQHEKGLATTQRFPMLLKP

SEQ ID NO: 992173 - protein, 13 aa, Mycobacterium
PNEDAEVSKEIEK

SEQ ID NO: 992174 - protein, 9 aa, Mycobacterium
PNEQTARAA

SEQ ID NO: 992175 - protein, 4 aa, Mycobacterium
PNEV

SEQ ID NO: 992176 - protein, 4 aa, Mycobacterium
PNGE

SEQ ID NO: 992177 - protein, 4 aa, Mycobacterium
PNGH

SEQ ID NO: 992178 - protein, 4 aa, Mycobacterium
PNGT

SEQ ID NO: 992179 - protein, 4 aa, Mycobacterium
PNGV

SEQ ID NO: 992180 - protein, 19 aa, Mycobacterium
PNGVAQTQTMTGLLSSRPQ

SEQ ID NO: 992181 - protein, 7 aa, Mycobacterium
PNGVGKT

SEQ ID NO: 992182 - protein, 16 aa, Mycobacterium
PNKGQHDQRPRQGESY

SEQ ID NO: 992183 - protein, 8 aa, Mycobacterium
PNLNESRA

SEQ ID NO: 992184 - protein, 8 aa, Mycobacterium
PNNPTGAV

SEQ ID NO: 992185 - protein, 11 aa, Mycobacterium
PNNVDPTACTD

SEQ ID NO: 992186 - protein, 6 aa, Mycobacterium
PNPFTA

SEQ ID NO: 992187 - protein, 4 aa, Mycobacterium
PNPH

SEQ ID NO: 992188 - protein, 7 aa, Mycobacterium
PNPMQTR

SEQ ID NO: 992189 - protein, 15 aa, Mycobacterium
PNPVGSLAPPDGSVV

SEQ ID NO: 992190 - protein, 4 aa, Mycobacterium
PNQA

SEQ ID NO: 992191 - protein, 7 aa, Mycobacterium
PNRPNDI

SEQ ID NO: 992192 - protein, 4 aa, Mycobacterium
PNRV

SEQ ID NO: 992193 - protein, 6 aa, Mycobacterium
PNSGLA

SEQ ID NO: 992194 - protein, 4 aa, Mycobacterium
PNSL

SEQ ID NO: 992195 - protein, 6 aa, Mycobacterium
PNTLGT

SEQ ID NO: 992196 - protein, 18 aa, Mycobacterium
PNWEPRSKELATRAASGA

SEQ ID NO: 992197 - protein, 10 aa, Mycobacterium
PNWQTGPLPT

SEQ ID NO: 992198 - protein, 8 aa, Mycobacterium
PPAAQESY

SEQ ID NO: 992199 - protein, 7 aa, Mycobacterium
PPAGALT

SEQ ID NO: 992200 - protein, 4 aa, Mycobacterium
PPAL

SEQ ID NO: 992201 - protein, 7 aa, Mycobacterium
PPAPGYN

SEQ ID NO: 992202 - protein, 5 aa, Mycobacterium
PPAPL

SEQ ID NO: 992203 - protein, 18 aa, Mycobacterium
PPCASAKVNATTSGVSNS

SEQ ID NO: 992204 - protein, 12 aa, Mycobacterium
PPCSSKTATTEA

SEQ ID NO: 992205 - protein, 5 aa, Mycobacterium
PPDAH

SEQ ID NO: 992206 - protein, 6 aa, Mycobacterium
PPDPSS

SEQ ID NO: 992207 - protein, 14 aa, Mycobacterium
PPDSNEGVKRLEVL

SEQ ID NO: 992208 - protein, 6 aa, Mycobacterium
PPDSVE

SEQ ID NO: 992209 - protein, 6 aa, Mycobacterium
PPEAQD

SEQ ID NO: 992210 - protein, 6 aa, Mycobacterium
PPEEPF

SEQ ID NO: 992211 - protein, 10 aa, Mycobacterium
PPEGAESVDI

SEQ ID NO: 992212 - protein, 17 aa, Mycobacterium
PPEVDPPKEVFAVPPAS

SEQ ID NO: 992213 - protein, 23 aa, Mycobacterium
PPEVNRGAYSGNPEAAQSILRRR

SEQ ID NO: 992214 - protein, 5 aa, Mycobacterium
PPFAN

SEQ ID NO: 992215 - protein, 16 aa, Mycobacterium
PPFGPKGGLEAAARAA

SEQ ID NO: 992216 - protein, 9 aa, Mycobacterium
PPGAEDPKL

SEQ ID NO: 992217 - protein, 7 aa, Mycobacterium
PPGANPL

SEQ ID NO: 992218 - protein, 5 aa, Mycobacterium
PPGCG

SEQ ID NO: 992219 - protein, 6 aa, Mycobacterium
PPGEIG

SEQ ID NO: 992220 - protein, 8 aa, Mycobacterium
PPGPAGRR

SEQ ID NO: 992221 - protein, 10 aa, Mycobacterium
PPGSGSVSVQ

SEQ ID NO: 992222 - protein, 5 aa, Mycobacterium
PPGTG

SEQ ID NO: 992223 - protein, 7 aa, Mycobacterium
PPGTGDI

SEQ ID NO: 992224 - protein, 10 aa, Mycobacterium
PPHTPHPAEP

SEQ ID NO: 992225 - protein, 9 aa, Mycobacterium
PPIDEPDTY

SEQ ID NO: 992226 - protein, 4 aa, Mycobacterium
PPLA

SEQ ID NO: 992227 - protein, 5 aa, Mycobacterium
PPLPA

SEQ ID NO: 992228 - protein, 16 aa, Mycobacterium
PPLPTGDAAADRDAMR

SEQ ID NO: 992229 - protein, 9 aa, Mycobacterium
PPLSGEPVV

SEQ ID NO: 992230 - protein, 19 aa, Mycobacterium
PPLTSSITQSSHNDRERSS

SEQ ID NO: 992231 - protein, 19 aa, Mycobacterium
PPNRYTQDEAISAPTEFAG

SEQ ID NO: 992232 - protein, 6 aa, Mycobacterium
PPNVTG

SEQ ID NO: 992233 - protein, 17 aa, Mycobacterium
PPPDEPVTNLSGGERRR

SEQ ID NO: 992234 - protein, 5 aa, Mycobacterium
PPPEL

SEQ ID NO: 992235 - protein, 7 aa, Mycobacterium
PPPGDVG

SEQ ID NO: 992236 - protein, 5 aa, Mycobacterium
PPPLD

SEQ ID NO: 992237 - protein, 11 aa, Mycobacterium
PPPNQFPPANT

SEQ ID NO: 992238 - protein, 7 aa, Mycobacterium
PPQSRTN

SEQ ID NO: 992239 - protein, 11 aa, Mycobacterium
PPRARKPQRRV

SEQ ID NO: 992240 - protein, 5 aa, Mycobacterium
PPRKK

SEQ ID NO: 992241 - protein, 10 aa, Mycobacterium
PPRNDPRDAV

SEQ ID NO: 992242 - protein, 13 aa, Mycobacterium
PPRNTEIDGERGT

SEQ ID NO: 992243 - protein, 11 aa, Mycobacterium
PPRRLESPPPI

SEQ ID NO: 992244 - protein, 10 aa, Mycobacterium
PPSAEAALAG

SEQ ID NO: 992245 - protein, 6 aa, Mycobacterium
PPSEAA

SEQ ID NO: 992246 - protein, 6 aa, Mycobacterium
PPSEAL

SEQ ID NO: 992247 - protein, 7 aa, Mycobacterium
PPSHTRG

SEQ ID NO: 992248 - protein, 24 aa, Mycobacterium
PPSPDGGPRRPPQHTSKAVAPRLS

SEQ ID NO: 992249 - protein, 17 aa, Mycobacterium
PPSPQPDDHPDTVRHLG

SEQ ID NO: 992250 - protein, 4 aa, Mycobacterium
PPSQ

SEQ ID NO: 992251 - protein, 7 aa, Mycobacterium
PPTNPTT

SEQ ID NO: 992252 - protein, 6 aa, Mycobacterium
PPTTAD

SEQ ID NO: 992253 - protein, 10 aa, Mycobacterium
PPTVPAGTSR

SEQ ID NO: 992254 - protein, 7 aa, Mycobacterium
PPTVPGW

SEQ ID NO: 992255 - protein, 5 aa, Mycobacterium
PPVGE

SEQ ID NO: 992256 - protein, 5 aa, Mycobacterium
PPVGQ

SEQ ID NO: 992257 - protein, 4 aa, Mycobacterium
PPVP

SEQ ID NO: 992258 - protein, 4 aa, Mycobacterium
PPVS

SEQ ID NO: 992259 - protein, 5 aa, Mycobacterium
PPVTV

SEQ ID NO: 992260 - protein, 6 aa, Mycobacterium
PPWKTR

SEQ ID NO: 992261 - protein, 5 aa, Mycobacterium
PPYAI

SEQ ID NO: 992262 - protein, 6 aa, Mycobacterium
PPYETA

SEQ ID NO: 992263 - protein, 15 aa, Mycobacterium
PPYPLSRGRPGTIAD

SEQ ID NO: 992264 - protein, 7 aa, Mycobacterium
PPYSTPA

SEQ ID NO: 992265 - protein, 7 aa, Mycobacterium
PPYVPDD

SEQ ID NO: 992266 - protein, 10 aa, Mycobacterium
PQAGSHDERV

SEQ ID NO: 992267 - protein, 8 aa, Mycobacterium
PQAPIPQQ

SEQ ID NO: 992268 - protein, 10 aa, Mycobacterium
PQDAPTGGDP

SEQ ID NO: 992269 - protein, 4 aa, Mycobacterium
PQDI

SEQ ID NO: 992270 - protein, 7 aa, Mycobacterium
PQDPKVG

SEQ ID NO: 992271 - protein, 16 aa, Mycobacterium
PQFGPDSSAQHRRSGA

SEQ ID NO: 992272 - protein, 13 aa, Mycobacterium
PQFSTAPTDHDGV

SEQ ID NO: 992273 - protein, 11 aa, Mycobacterium
PQGDEKPTDLH

SEQ ID NO: 992274 - protein, 11 aa, Mycobacterium
PQGDGQGDPDF

SEQ ID NO: 992275 - protein, 13 aa, Mycobacterium
PQGESASSLGLDG

SEQ ID NO: 992276 - protein, 10 aa, Mycobacterium
PQGTASDLTD

SEQ ID NO: 992277 - protein, 6 aa, Mycobacterium
PQHDNA

SEQ ID NO: 992278 - protein, 5 aa, Mycobacterium
PQHDY

SEQ ID NO: 992279 - protein, 5 aa, Mycobacterium
PQHRG

SEQ ID NO: 992280 - protein, 4 aa, Mycobacterium
PQIS

SEQ ID NO: 992281 - protein, 9 aa, Mycobacterium
PQKPAGHPV

SEQ ID NO: 992282 - protein, 4 aa, Mycobacterium
PQLA

SEQ ID NO: 992283 - protein, 18 aa, Mycobacterium
PQMGQNPASSRSRRNRTA

SEQ ID NO: 992284 - protein, 4 aa, Mycobacterium
PQNG

SEQ ID NO: 992285 - protein, 7 aa, Mycobacterium
PQPAATS

SEQ ID NO: 992286 - protein, 5 aa, Mycobacterium
PQPAR

SEQ ID NO: 992287 - protein, 4 aa, Mycobacterium
PQPG

SEQ ID NO: 992288 - protein, 23 aa, Mycobacterium
PQPRSRPADGSEIPSTSAEAKAM

SEQ ID NO: 992289 - protein, 5 aa, Mycobacterium
PQPRT

SEQ ID NO: 992290 - protein, 14 aa, Mycobacterium
PQPTDYGLGGSTGV

SEQ ID NO: 992291 - protein, 7 aa, Mycobacterium
PQPVDPE

SEQ ID NO: 992292 - protein, 18 aa, Mycobacterium
PQQLPQVSQGTHPEPVNT

SEQ ID NO: 992293 - protein, 8 aa, Mycobacterium
PQRAPDMP

SEQ ID NO: 992294 - protein, 23 aa, Mycobacterium
PQREPVPPVGLPPDVEDWRTAKL

SEQ ID NO: 992295 - protein, 5 aa, Mycobacterium
PQRSM

SEQ ID NO: 992296 - protein, 5 aa, Mycobacterium
PQSGS

SEQ ID NO: 992297 - protein, 13 aa, Mycobacterium
PQSRSGKTANNVP

SEQ ID NO: 992298 - protein, 10 aa, Mycobacterium
PQSSKDAAAA

SEQ ID NO: 992299 - protein, 36 aa, Mycobacterium
PQSSPDPVPDGSPRPKQQPQQAQAEQAQQPQQQIML

SEQ ID NO: 992300 - protein, 13 aa, Mycobacterium
PQSWKAPTLRSDA

SEQ ID NO: 992301 - protein, 4 aa, Mycobacterium
PQSY

SEQ ID NO: 992302 - protein, 4 aa, Mycobacterium
PQTD

SEQ ID NO: 992303 - protein, 5 aa, Mycobacterium
PQTEE

SEQ ID NO: 992304 - protein, 11 aa, Mycobacterium
PQTVAEHSNNE

SEQ ID NO: 992305 - protein, 5 aa, Mycobacterium
PQVTS

SEQ ID NO: 992306 - protein, 4 aa, Mycobacterium
PQWN

SEQ ID NO: 992307 - protein, 4 aa, Mycobacterium
PQYN

SEQ ID NO: 992308 - protein, 6 aa, Mycobacterium
PQYQPM

SEQ ID NO: 992309 - protein, 15 aa, Mycobacterium
PRAEDSAEGPAGESR

SEQ ID NO: 992310 - protein, 13 aa, Mycobacterium
PRAKDIEKAARDA

SEQ ID NO: 992311 - protein, 6 aa, Mycobacterium
PRAKTK

SEQ ID NO: 992312 - protein, 13 aa, Mycobacterium
PRANGASSKSCSC

SEQ ID NO: 992313 - protein, 13 aa, Mycobacterium
PRASDESLPDDAQ

SEQ ID NO: 992314 - protein, 14 aa, Mycobacterium
PRASSQPGAASLPD

SEQ ID NO: 992315 - protein, 22 aa, Mycobacterium
PRATDANDPSDADRTRASARHP

SEQ ID NO: 992316 - protein, 7 aa, Mycobacterium
PRATTSH

SEQ ID NO: 992317 - protein, 14 aa, Mycobacterium
PRDAATAASSVESC

SEQ ID NO: 992318 - protein, 7 aa, Mycobacterium
PRDKTDL

SEQ ID NO: 992319 - protein, 8 aa, Mycobacterium
PRDLEAGT

SEQ ID NO: 992320 - protein, 18 aa, Mycobacterium
PRDQDKDATGSAGVDPDG

SEQ ID NO: 992321 - protein, 9 aa, Mycobacterium
PRDRADTFE

SEQ ID NO: 992322 - protein, 10 aa, Mycobacterium
PRDTTFPQNS

SEQ ID NO: 992323 - protein, 10 aa, Mycobacterium
PREASAMDPQ

SEQ ID NO: 992324 - protein, 7 aa, Mycobacterium
PREKHSP

SEQ ID NO: 992325 - protein, 4 aa, Mycobacterium
PRGA

SEQ ID NO: 992326 - protein, 5 aa, Mycobacterium
PRGMY

SEQ ID NO: 992327 - protein, 7 aa, Mycobacterium
PRGREVS

SEQ ID NO: 992328 - protein, 15 aa, Mycobacterium
PRGRTVHGESLANRR

SEQ ID NO: 992329 - protein, 5 aa, Mycobacterium
PRKAR

SEQ ID NO: 992330 - protein, 8 aa, Mycobacterium
PRKKNAEL

SEQ ID NO: 992331 - protein, 13 aa, Mycobacterium
PRKPSRTERRDKS

SEQ ID NO: 992332 - protein, 10 aa, Mycobacterium
PRKQLKPPIE

SEQ ID NO: 992333 - protein, 9 aa, Mycobacterium
PRKSSARRT

SEQ ID NO: 992334 - protein, 9 aa, Mycobacterium
PRKSVSGSL

SEQ ID NO: 992335 - protein, 4 aa, Mycobacterium
PRLD

SEQ ID NO: 992336 - protein, 9 aa, Mycobacterium
PRMPPRPRD

SEQ ID NO: 992337 - protein, 8 aa, Mycobacterium
PRNLSETL

SEQ ID NO: 992338 - protein, 16 aa, Mycobacterium
PRNRVKQTAASHQSPC

SEQ ID NO: 992339 - protein, 7 aa, Mycobacterium
PRNTDGE

SEQ ID NO: 992340 - protein, 7 aa, Mycobacterium
PRPEESR

SEQ ID NO: 992341 - protein, 14 aa, Mycobacterium
PRPPDARAASTPWP

SEQ ID NO: 992342 - protein, 5 aa, Mycobacterium
PRPVP

SEQ ID NO: 992343 - protein, 9 aa, Mycobacterium
PRQGAPATG

SEQ ID NO: 992344 - protein, 7 aa, Mycobacterium
PRQSPGG

SEQ ID NO: 992345 - protein, 17 aa, Mycobacterium
PRRAHRTTANWSPPQVG

SEQ ID NO: 992346 - protein, 23 aa, Mycobacterium
PRRARLPTPQHRRPYRPLQRPNL

SEQ ID NO: 992347 - protein, 15 aa, Mycobacterium
PRRDGIDAASEIASK

SEQ ID NO: 992348 - protein, 7 aa, Mycobacterium
PRRGIGK

SEQ ID NO: 992349 - protein, 5 aa, Mycobacterium
PRRGR

SEQ ID NO: 992350 - protein, 7 aa, Mycobacterium
PRRTDEV

SEQ ID NO: 992351 - protein, 12 aa, Mycobacterium
PRRWGAGATVSR

SEQ ID NO: 992352 - protein, 10 aa, Mycobacterium
PRSDKNAWSE

SEQ ID NO: 992353 - protein, 8 aa, Mycobacterium
PRSKPNLS

SEQ ID NO: 992354 - protein, 6 aa, Mycobacterium
PRSLEQ

SEQ ID NO: 992355 - protein, 8 aa, Mycobacterium
PRSPDEQR

SEQ ID NO: 992356 - protein, 7 aa, Mycobacterium
PRSPIRP

SEQ ID NO: 992357 - protein, 10 aa, Mycobacterium
PRSRGGDHSW

SEQ ID NO: 992358 - protein, 8 aa, Mycobacterium
PRSRLPDA

SEQ ID NO: 992359 - protein, 23 aa, Mycobacterium
PRSSEAAGDRAGRGQDRSSSSRI

SEQ ID NO: 992360 - protein, 5 aa, Mycobacterium
PRSSG

SEQ ID NO: 992361 - protein, 7 aa, Mycobacterium
PRSTNGK

SEQ ID NO: 992362 - protein, 20 aa, Mycobacterium
PRTGSRSVAVPPEQAPVYRR

SEQ ID NO: 992363 - protein, 4 aa, Mycobacterium
PRTI

SEQ ID NO: 992364 - protein, 5 aa, Mycobacterium
PRTKR

SEQ ID NO: 992365 - protein, 8 aa, Mycobacterium
PRTNKRTE

SEQ ID NO: 992366 - protein, 5 aa, Mycobacterium
PRTVA

SEQ ID NO: 992367 - protein, 4 aa, Mycobacterium
PRVD

SEQ ID NO: 992368 - protein, 7 aa, Mycobacterium
PRVNPEA

SEQ ID NO: 992369 - protein, 10 aa, Mycobacterium
PRVPSTDEIA

SEQ ID NO: 992370 - protein, 15 aa, Mycobacterium
PRVQTGNDHGGGDTL

SEQ ID NO: 992371 - protein, 4 aa, Mycobacterium
PRWE

SEQ ID NO: 992372 - protein, 8 aa, Mycobacterium
PSADDPTS

SEQ ID NO: 992373 - protein, 8 aa, Mycobacterium
PSADRAST

SEQ ID NO: 992374 - protein, 5 aa, Mycobacterium
PSAEP

SEQ ID NO: 992375 - protein, 8 aa, Mycobacterium
PSAGKSSL

SEQ ID NO: 992376 - protein, 11 aa, Mycobacterium
PSAGSGGSATV

SEQ ID NO: 992377 - protein, 11 aa, Mycobacterium
PSAHSPYSESR

SEQ ID NO: 992378 - protein, 4 aa, Mycobacterium
PSAI

SEQ ID NO: 992379 - protein, 18 aa, Mycobacterium
PSALGGPDQRTTRTALAT

SEQ ID NO: 992380 - protein, 13 aa, Mycobacterium
PSALPSCTPPLRM

SEQ ID NO: 992381 - protein, 6 aa, Mycobacterium
PSAMRS

SEQ ID NO: 992382 - protein, 8 aa, Mycobacterium
PSAPPEGA

SEQ ID NO: 992383 - protein, 12 aa, Mycobacterium
PSAVDKPVAPYS

SEQ ID NO: 992384 - protein, 10 aa, Mycobacterium
PSAVPKTSTF

SEQ ID NO: 992385 - protein, 7 aa, Mycobacterium
PSDEQIK

SEQ ID NO: 992386 - protein, 16 aa, Mycobacterium
PSDIRAQGGVSRMSDP

SEQ ID NO: 992387 - protein, 9 aa, Mycobacterium
PSDKYSQGG

SEQ ID NO: 992388 - protein, 5 aa, Mycobacterium
PSDSV

SEQ ID NO: 992389 - protein, 14 aa, Mycobacterium
PSDTRLHQATVAVN

SEQ ID NO: 992390 - protein, 20 aa, Mycobacterium
PSELRSGRRRGHLRVLPDPS

SEQ ID NO: 992391 - protein, 6 aa, Mycobacterium
PSERGR

SEQ ID NO: 992392 - protein, 9 aa, Mycobacterium
PSGCGKTTS

SEQ ID NO: 992393 - protein, 5 aa, Mycobacterium
PSGDV

SEQ ID NO: 992394 - protein, 21 aa, Mycobacterium
PSGEPGVVKTAPKLDDGTPFP

SEQ ID NO: 992395 - protein, 14 aa, Mycobacterium
PSGGGVRASRLRWL

SEQ ID NO: 992396 - protein, 11 aa, Mycobacterium
PSGLSSDDDLP

SEQ ID NO: 992397 - protein, 15 aa, Mycobacterium
PSGLTDEQAITAATA

SEQ ID NO: 992398 - protein, 17 aa, Mycobacterium
PSGPDLSKNLDPERGRR

SEQ ID NO: 992399 - protein, 4 aa, Mycobacterium
PSGQ

SEQ ID NO: 992400 - protein, 4 aa, Mycobacterium
PSGR

SEQ ID NO: 992401 - protein, 6 aa, Mycobacterium
PSGRDS

SEQ ID NO: 992402 - protein, 7 aa, Mycobacterium
PSGRRRQ

SEQ ID NO: 992403 - protein, 4 aa, Mycobacterium
PSGS

SEQ ID NO: 992404 - protein, 9 aa, Mycobacterium
PSGVEDGQR

SEQ ID NO: 992405 - protein, 7 aa, Mycobacterium
PSGVGDG

SEQ ID NO: 992406 - protein, 13 aa, Mycobacterium
PSGVKRRRRRRWQ

SEQ ID NO: 992407 - protein, 4 aa, Mycobacterium
PSGW

SEQ ID NO: 992408 - protein, 32 aa, Mycobacterium
PSHQSTPANNTDTASENQRYGRDRSPKQQHTR

SEQ ID NO: 992409 - protein, 12 aa, Mycobacterium
PSIEQGNNDSHA

SEQ ID NO: 992410 - protein, 11 aa, Mycobacterium
PSISGPKRPQD

SEQ ID NO: 992411 - protein, 6 aa, Mycobacterium
PSITTA

SEQ ID NO: 992412 - protein, 13 aa, Mycobacterium
PSKDAARIEGSKA

SEQ ID NO: 992413 - protein, 6 aa, Mycobacterium
PSKPAV

SEQ ID NO: 992414 - protein, 7 aa, Mycobacterium
PSLASKT

SEQ ID NO: 992415 - protein, 5 aa, Mycobacterium
PSLAT

SEQ ID NO: 992416 - protein, 8 aa, Mycobacterium
PSLDSGPV

SEQ ID NO: 992417 - protein, 15 aa, Mycobacterium
PSLHGDTALGRPVGD

SEQ ID NO: 992418 - protein, 11 aa, Mycobacterium
PSLPTGIAPTG

SEQ ID NO: 992419 - protein, 10 aa, Mycobacterium
PSLQGRGAPT

SEQ ID NO: 992420 - protein, 4 aa, Mycobacterium
PSNQ

SEQ ID NO: 992421 - protein, 4 aa, Mycobacterium
PSNR

SEQ ID NO: 992422 - protein, 4 aa, Mycobacterium
PSPA

SEQ ID NO: 992423 - protein, 13 aa, Mycobacterium
PSPATPELPPDTR

SEQ ID NO: 992424 - protein, 4 aa, Mycobacterium
PSPD

SEQ ID NO: 992425 - protein, 11 aa, Mycobacterium
PSPKGDPEAPL

SEQ ID NO: 992426 - protein, 9 aa, Mycobacterium
PSPLSHEDR

SEQ ID NO: 992427 - protein, 19 aa, Mycobacterium
PSPLSSSTNCDAQAAAAAV

SEQ ID NO: 992428 - protein, 4 aa, Mycobacterium
PSPN

SEQ ID NO: 992429 - protein, 9 aa, Mycobacterium
PSPQSIRDL

SEQ ID NO: 992430 - protein, 5 aa, Mycobacterium
PSPRP

SEQ ID NO: 992431 - protein, 7 aa, Mycobacterium
PSPTTRE

SEQ ID NO: 992432 - protein, 6 aa, Mycobacterium
PSPVPH

SEQ ID NO: 992433 - protein, 13 aa, Mycobacterium
PSQGGRTGWIRRT

SEQ ID NO: 992434 - protein, 11 aa, Mycobacterium
PSQIGLPDDEV

SEQ ID NO: 992435 - protein, 10 aa, Mycobacterium
PSQKDVTDTI

SEQ ID NO: 992436 - protein, 4 aa, Mycobacterium
PSQP

SEQ ID NO: 992437 - protein, 10 aa, Mycobacterium
PSQPGERNRV

SEQ ID NO: 992438 - protein, 4 aa, Mycobacterium
PSQT

SEQ ID NO: 992439 - protein, 5 aa, Mycobacterium
PSRDD

SEQ ID NO: 992440 - protein, 4 aa, Mycobacterium
PSRH

SEQ ID NO: 992441 - protein, 4 aa, Mycobacterium
PSRL

SEQ ID NO: 992442 - protein, 22 aa, Mycobacterium
PSRLTSPRCTSTGNPKAYMTTT

SEQ ID NO: 992443 - protein, 6 aa, Mycobacterium
PSRNNA

SEQ ID NO: 992444 - protein, 10 aa, Mycobacterium
PSRRSPRSGM

SEQ ID NO: 992445 - protein, 12 aa, Mycobacterium
PSRVAGKPAPRL

SEQ ID NO: 992446 - protein, 10 aa, Mycobacterium
PSSGGQGVYD

SEQ ID NO: 992447 - protein, 9 aa, Mycobacterium
PSSHESACL

SEQ ID NO: 992448 - protein, 14 aa, Mycobacterium
PSSLSRKTVDTMPS

SEQ ID NO: 992449 - protein, 12 aa, Mycobacterium
PSSNTVSTANEL

SEQ ID NO: 992450 - protein, 7 aa, Mycobacterium
PSSRNVS

SEQ ID NO: 992451 - protein, 4 aa, Mycobacterium
PSSS

SEQ ID NO: 992452 - protein, 16 aa, Mycobacterium
PSSVRTGGSILGDKTR

SEQ ID NO: 992453 - protein, 13 aa, Mycobacterium
PSSYSPPSALTSQ

SEQ ID NO: 992454 - protein, 16 aa, Mycobacterium
PSTAEKIATQRLSLLS

SEQ ID NO: 992455 - protein, 7 aa, Mycobacterium
PSTAPAI

SEQ ID NO: 992456 - protein, 7 aa, Mycobacterium
PSTARGV

SEQ ID NO: 992457 - protein, 8 aa, Mycobacterium
PSTGSAKI

SEQ ID NO: 992458 - protein, 14 aa, Mycobacterium
PSTLTTPASSSRLI

SEQ ID NO: 992459 - protein, 5 aa, Mycobacterium
PSTPW

SEQ ID NO: 992460 - protein, 14 aa, Mycobacterium
PSTTEDGSKSSQSA

SEQ ID NO: 992461 - protein, 17 aa, Mycobacterium
PSTTGVPSRYNDSSLPL

SEQ ID NO: 992462 - protein, 4 aa, Mycobacterium
PSTV

SEQ ID NO: 992463 - protein, 8 aa, Mycobacterium
PSVDPPLD

SEQ ID NO: 992464 - protein, 6 aa, Mycobacterium
PSVEDT

SEQ ID NO: 992465 - protein, 7 aa, Mycobacterium
PSVSPVP

SEQ ID NO: 992466 - protein, 12 aa, Mycobacterium
PSVSRSEPAKVT

SEQ ID NO: 992467 - protein, 16 aa, Mycobacterium
PSVSTESVDPVDPESG

SEQ ID NO: 992468 - protein, 4 aa, Mycobacterium
PSYG

SEQ ID NO: 992469 - protein, 5 aa, Mycobacterium
PSYSE

SEQ ID NO: 992470 - protein, 6 aa, Mycobacterium
PTAADN

SEQ ID NO: 992471 - protein, 7 aa, Mycobacterium
PTADYRQ

SEQ ID NO: 992472 - protein, 7 aa, Mycobacterium
PTAGMDT

SEQ ID NO: 992473 - protein, 8 aa, Mycobacterium
PTAPFGPY

SEQ ID NO: 992474 - protein, 19 aa, Mycobacterium
PTASRNTAGGGLVSNWLPP

SEQ ID NO: 992475 - protein, 23 aa, Mycobacterium
PTATDAKGGAQPPPLGPPASDVV

SEQ ID NO: 992476 - protein, 8 aa, Mycobacterium
PTAYTPVN

SEQ ID NO: 992477 - protein, 14 aa, Mycobacterium
PTDRRQYSEDTATN

SEQ ID NO: 992478 - protein, 7 aa, Mycobacterium
PTDTDFG

SEQ ID NO: 992479 - protein, 5 aa, Mycobacterium
PTDVE

SEQ ID NO: 992480 - protein, 4 aa, Mycobacterium
PTDY

SEQ ID NO: 992481 - protein, 19 aa, Mycobacterium
PTELRKANKLGELPTNQLV

SEQ ID NO: 992482 - protein, 5 aa, Mycobacterium
PTEWT

SEQ ID NO: 992483 - protein, 11 aa, Mycobacterium
PTGADSKAKGL

SEQ ID NO: 992484 - protein, 7 aa, Mycobacterium
PTGCGRR

SEQ ID NO: 992485 - protein, 9 aa, Mycobacterium
PTGDPTDLK

SEQ ID NO: 992486 - protein, 7 aa, Mycobacterium
PTGHGNP

SEQ ID NO: 992487 - protein, 10 aa, Mycobacterium
PTGPQGRVSV

SEQ ID NO: 992488 - protein, 22 aa, Mycobacterium
PTGPVDADSGPATYGPQMGNTA

SEQ ID NO: 992489 - protein, 8 aa, Mycobacterium
PTGQHDST

SEQ ID NO: 992490 - protein, 5 aa, Mycobacterium
PTGRI

SEQ ID NO: 992491 - protein, 15 aa, Mycobacterium
PTGRRAARRARRGYA

SEQ ID NO: 992492 - protein, 12 aa, Mycobacterium
PTGYSENKNNEM

SEQ ID NO: 992493 - protein, 12 aa, Mycobacterium
PTHEKTVNANSR

SEQ ID NO: 992494 - protein, 5 aa, Mycobacterium
PTHNS

SEQ ID NO: 992495 - protein, 5 aa, Mycobacterium
PTKAL

SEQ ID NO: 992496 - protein, 4 aa, Mycobacterium
PTKL

SEQ ID NO: 992497 - protein, 4 aa, Mycobacterium
PTLA

SEQ ID NO: 992498 - protein, 15 aa, Mycobacterium
PTLPTLPDETGTLPS

SEQ ID NO: 992499 - protein, 8 aa, Mycobacterium
PTMRTPPD

SEQ ID NO: 992500 - protein, 10 aa, Mycobacterium
PTMSGQDSLG

SEQ ID NO: 992501 - protein, 4 aa, Mycobacterium
PTMT

SEQ ID NO: 992502 - protein, 5 aa, Mycobacterium
PTNGV

SEQ ID NO: 992503 - protein, 12 aa, Mycobacterium
PTNNLDPASRKQ

SEQ ID NO: 992504 - protein, 8 aa, Mycobacterium
PTNPATDI

SEQ ID NO: 992505 - protein, 8 aa, Mycobacterium
PTNPNDTG

SEQ ID NO: 992506 - protein, 4 aa, Mycobacterium
PTPA

SEQ ID NO: 992507 - protein, 10 aa, Mycobacterium
PTPAACGRTP

SEQ ID NO: 992508 - protein, 6 aa, Mycobacterium
PTPDPQ

SEQ ID NO: 992509 - protein, 12 aa, Mycobacterium
PTPLASAGVDES

SEQ ID NO: 992510 - protein, 5 aa, Mycobacterium
PTPLQ

SEQ ID NO: 992511 - protein, 6 aa, Mycobacterium
PTPPEL

SEQ ID NO: 992512 - protein, 5 aa, Mycobacterium
PTPRP

SEQ ID NO: 992513 - protein, 6 aa, Mycobacterium
PTPRTD

SEQ ID NO: 992514 - protein, 6 aa, Mycobacterium
PTPTAV

SEQ ID NO: 992515 - protein, 13 aa, Mycobacterium
PTPTKPDRPAPGL

SEQ ID NO: 992516 - protein, 4 aa, Mycobacterium
PTQA

SEQ ID NO: 992517 - protein, 5 aa, Mycobacterium
PTQAL

SEQ ID NO: 992518 - protein, 5 aa, Mycobacterium
PTQGS

SEQ ID NO: 992519 - protein, 5 aa, Mycobacterium
PTRAM

SEQ ID NO: 992520 - protein, 15 aa, Mycobacterium
PTRANSLTSAARAKI

SEQ ID NO: 992521 - protein, 6 aa, Mycobacterium
PTRAYG

SEQ ID NO: 992522 - protein, 14 aa, Mycobacterium
PTRCRSAGVGATGP

SEQ ID NO: 992523 - protein, 5 aa, Mycobacterium
PTRDA

SEQ ID NO: 992524 - protein, 18 aa, Mycobacterium
PTRNINNNYANGYGNSKW

SEQ ID NO: 992525 - protein, 5 aa, Mycobacterium
PTRPV

SEQ ID NO: 992526 - protein, 5 aa, Mycobacterium
PTRTR

SEQ ID NO: 992527 - protein, 6 aa, Mycobacterium
PTRTSR

SEQ ID NO: 992528 - protein, 13 aa, Mycobacterium
PTRTYSCACFRTK

SEQ ID NO: 992529 - protein, 5 aa, Mycobacterium
PTSET

SEQ ID NO: 992530 - protein, 6 aa, Mycobacterium
PTSGNA

SEQ ID NO: 992531 - protein, 10 aa, Mycobacterium
PTSLTGTSSV

SEQ ID NO: 992532 - protein, 8 aa, Mycobacterium
PTSNIHSA

SEQ ID NO: 992533 - protein, 6 aa, Mycobacterium
PTSRSA

SEQ ID NO: 992534 - protein, 8 aa, Mycobacterium
PTSSPKSI

SEQ ID NO: 992535 - protein, 6 aa, Mycobacterium
PTTADG

SEQ ID NO: 992536 - protein, 4 aa, Mycobacterium
PTTC

SEQ ID NO: 992537 - protein, 11 aa, Mycobacterium
PTTERSPAGVR

SEQ ID NO: 992538 - protein, 4 aa, Mycobacterium
PTTH

SEQ ID NO: 992539 - protein, 8 aa, Mycobacterium
PTTQDEEL

SEQ ID NO: 992540 - protein, 5 aa, Mycobacterium
PTTRG

SEQ ID NO: 992541 - protein, 11 aa, Mycobacterium
PTTRHAEFDNG

SEQ ID NO: 992542 - protein, 16 aa, Mycobacterium
PTTRNRQGNDQGTSYR

SEQ ID NO: 992543 - protein, 21 aa, Mycobacterium
PTTRPSRREPYAGRSKTRSAW

SEQ ID NO: 992544 - protein, 5 aa, Mycobacterium
PTTVT

SEQ ID NO: 992545 - protein, 4 aa, Mycobacterium
PTVP

SEQ ID NO: 992546 - protein, 5 aa, Mycobacterium
PTYQQ

SEQ ID NO: 992547 - protein, 25 aa, Mycobacterium
PVANRSASATHASIGQASRQFKTND

SEQ ID NO: 992548 - protein, 10 aa, Mycobacterium
PVAPTESTNL

SEQ ID NO: 992549 - protein, 16 aa, Mycobacterium
PVAQERAEQMRPSEPP

SEQ ID NO: 992550 - protein, 4 aa, Mycobacterium
PVCS

SEQ ID NO: 992551 - protein, 7 aa, Mycobacterium
PVDAGDR

SEQ ID NO: 992552 - protein, 5 aa, Mycobacterium
PVDAK

SEQ ID NO: 992553 - protein, 10 aa, Mycobacterium
PVDPAVSADF

SEQ ID NO: 992554 - protein, 10 aa, Mycobacterium
PVDPIETDED

SEQ ID NO: 992555 - protein, 5 aa, Mycobacterium
PVDSN

SEQ ID NO: 992556 - protein, 8 aa, Mycobacterium
PVEHTASG

SEQ ID NO: 992557 - protein, 4 aa, Mycobacterium
PVET

SEQ ID NO: 992558 - protein, 10 aa, Mycobacterium
PVGDQGGDIA

SEQ ID NO: 992559 - protein, 5 aa, Mycobacterium
PVGEG

SEQ ID NO: 992560 - protein, 21 aa, Mycobacterium
PVGRSELEGQEADGAQGAKEG

SEQ ID NO: 992561 - protein, 7 aa, Mycobacterium
PVGTDPR

SEQ ID NO: 992562 - protein, 7 aa, Mycobacterium
PVKDGTA

SEQ ID NO: 992563 - protein, 18 aa, Mycobacterium
PVKTPAHASWPNKATSAI

SEQ ID NO: 992564 - protein, 6 aa, Mycobacterium
PVNADD

SEQ ID NO: 992565 - protein, 14 aa, Mycobacterium
PVNHDNSTPAQPFT

SEQ ID NO: 992566 - protein, 7 aa, Mycobacterium
PVPDSSD

SEQ ID NO: 992567 - protein, 4 aa, Mycobacterium
PVPG

SEQ ID NO: 992568 - protein, 9 aa, Mycobacterium
PVPGGDNPN

SEQ ID NO: 992569 - protein, 4 aa, Mycobacterium
PVPN

SEQ ID NO: 992570 - protein, 6 aa, Mycobacterium
PVPQRR

SEQ ID NO: 992571 - protein, 16 aa, Mycobacterium
PVPSDTANLREGANLN

SEQ ID NO: 992572 - protein, 7 aa, Mycobacterium
PVPSRGD

SEQ ID NO: 992573 - protein, 5 aa, Mycobacterium
PVPVG

SEQ ID NO: 992574 - protein, 12 aa, Mycobacterium
PVPVNTDDGRSV

SEQ ID NO: 992575 - protein, 10 aa, Mycobacterium
PVPYSHEPNR

SEQ ID NO: 992576 - protein, 4 aa, Mycobacterium
PVRE

SEQ ID NO: 992577 - protein, 4 aa, Mycobacterium
PVRR

SEQ ID NO: 992578 - protein, 5 aa, Mycobacterium
PVRRT

SEQ ID NO: 992579 - protein, 7 aa, Mycobacterium
PVSAESA

SEQ ID NO: 992580 - protein, 8 aa, Mycobacterium
PVSDTPGL

SEQ ID NO: 992581 - protein, 5 aa, Mycobacterium
PVSGP

SEQ ID NO: 992582 - protein, 9 aa, Mycobacterium
PVSGTVSAV

SEQ ID NO: 992583 - protein, 11 aa, Mycobacterium
PVSNDLPSWGT

SEQ ID NO: 992584 - protein, 9 aa, Mycobacterium
PVSNPEQQR

SEQ ID NO: 992585 - protein, 13 aa, Mycobacterium
PVSQHATRLETEG

SEQ ID NO: 992586 - protein, 19 aa, Mycobacterium
PVSSSPVSMHTSRLQALVR

SEQ ID NO: 992587 - protein, 27 aa, Mycobacterium
PVSTAQNPRSAARPAYSALSGRQSVAA

SEQ ID NO: 992588 - protein, 6 aa, Mycobacterium
PVTAGG

SEQ ID NO: 992589 - protein, 4 aa, Mycobacterium
PVTG

SEQ ID NO: 992590 - protein, 5 aa, Mycobacterium
PVTGL

SEQ ID NO: 992591 - protein, 29 aa, Mycobacterium
PVTLPASEAPIPPPPTDPTDPPSNGVQPN

SEQ ID NO: 992592 - protein, 8 aa, Mycobacterium
PVTPDPAR

SEQ ID NO: 992593 - protein, 10 aa, Mycobacterium
PVTQERAEAR

SEQ ID NO: 992594 - protein, 11 aa, Mycobacterium
PVTSTPDGLRH

SEQ ID NO: 992595 - protein, 8 aa, Mycobacterium
PVVSDGQH

SEQ ID NO: 992596 - protein, 21 aa, Mycobacterium
PWGPDKISDDGREQLRALGFT

SEQ ID NO: 992597 - protein, 8 aa, Mycobacterium
PWGRSADA

SEQ ID NO: 992598 - protein, 5 aa, Mycobacterium
PWRGD

SEQ ID NO: 992599 - protein, 10 aa, Mycobacterium
PWSEAQRHQR

SEQ ID NO: 992600 - protein, 20 aa, Mycobacterium
PWSRPSLARSGHPPRYTTAA

SEQ ID NO: 992601 - protein, 13 aa, Mycobacterium
PWSTEQDHTEARP

SEQ ID NO: 992602 - protein, 16 aa, Mycobacterium
PYASKKTLPRQLRIMV

SEQ ID NO: 992603 - protein, 5 aa, Mycobacterium
PYDDG

SEQ ID NO: 992604 - protein, 8 aa, Mycobacterium
PYDPTESQ

SEQ ID NO: 992605 - protein, 11 aa, Mycobacterium
PYGNSGPRIDG

SEQ ID NO: 992606 - protein, 11 aa, Mycobacterium
PYGTPEEPKGV

SEQ ID NO: 992607 - protein, 5 aa, Mycobacterium
PYPIS

SEQ ID NO: 992608 - protein, 4 aa, Mycobacterium
PYPP

SEQ ID NO: 992609 - protein, 9 aa, Mycobacterium
PYQPEISQG

SEQ ID NO: 992610 - protein, 5 aa, Mycobacterium
PYRPS

SEQ ID NO: 992611 - protein, 5 aa, Mycobacterium
PYRQE

SEQ ID NO: 992612 - protein, 14 aa, Mycobacterium
PYSDPGMDGPTIAR

SEQ ID NO: 992613 - protein, 12 aa, Mycobacterium
PYSRDPRNIARK

SEQ ID NO: 992614 - protein, 11 aa, Mycobacterium
PYSTSSAVKTS

SEQ ID NO: 992615 - protein, 4 aa, Mycobacterium
PYTL

SEQ ID NO: 992616 - protein, 4 aa, Mycobacterium
PYTN

SEQ ID NO: 992617 - protein, 4 aa, Mycobacterium
PYTT

SEQ ID NO: 992618 - protein, 22 aa, Mycobacterium
QAAAGGRGGLGNAALASRTRKV

SEQ ID NO: 992619 - protein, 4 aa, Mycobacterium
QAAD

SEQ ID NO: 992620 - protein, 18 aa, Mycobacterium
QAAEAAGVPTAQLARRNS

SEQ ID NO: 992621 - protein, 8 aa, Mycobacterium
QAAEPSPL

SEQ ID NO: 992622 - protein, 19 aa, Mycobacterium
QAAFPGGASDPTDDGPVAT

SEQ ID NO: 992623 - protein, 13 aa, Mycobacterium
QAAGTRTVGTSVS

SEQ ID NO: 992624 - protein, 15 aa, Mycobacterium
QAAPEQTSDPGPGVQ

SEQ ID NO: 992625 - protein, 6 aa, Mycobacterium
QAAPLG

SEQ ID NO: 992626 - protein, 5 aa, Mycobacterium
QADNT

SEQ ID NO: 992627 - protein, 9 aa, Mycobacterium
QADQGHLQP

SEQ ID NO: 992628 - protein, 11 aa, Mycobacterium
QAEEYGSHDKT

SEQ ID NO: 992629 - protein, 7 aa, Mycobacterium
QAEGGSV

SEQ ID NO: 992630 - protein, 4 aa, Mycobacterium
QAEL

SEQ ID NO: 992631 - protein, 5 aa, Mycobacterium
QAELD

SEQ ID NO: 992632 - protein, 8 aa, Mycobacterium
QAERPQDY

SEQ ID NO: 992633 - protein, 13 aa, Mycobacterium
QAESGANVVGPSG

SEQ ID NO: 992634 - protein, 7 aa, Mycobacterium
QAGDEAT

SEQ ID NO: 992635 - protein, 15 aa, Mycobacterium
QAGEKGRDSKREPVE

SEQ ID NO: 992636 - protein, 4 aa, Mycobacterium
QAGG

SEQ ID NO: 992637 - protein, 5 aa, Mycobacterium
QAGKW

SEQ ID NO: 992638 - protein, 7 aa, Mycobacterium
QAGPRAR

SEQ ID NO: 992639 - protein, 5 aa, Mycobacterium
QAGQA

SEQ ID NO: 992640 - protein, 8 aa, Mycobacterium
QAGQPPRL

SEQ ID NO: 992641 - protein, 6 aa, Mycobacterium
QAGTGC

SEQ ID NO: 992642 - protein, 8 aa, Mycobacterium
QAHDAPRG

SEQ ID NO: 992643 - protein, 9 aa, Mycobacterium
QAHGSGPAY

SEQ ID NO: 992644 - protein, 14 aa, Mycobacterium
QAHPELKSRPTRPH

SEQ ID NO: 992645 - protein, 12 aa, Mycobacterium
QAHPSTKQAVEG

SEQ ID NO: 992646 - protein, 6 aa, Mycobacterium
QAIRAG

SEQ ID NO: 992647 - protein, 6 aa, Mycobacterium
QAKPYE

SEQ ID NO: 992648 - protein, 10 aa, Mycobacterium
QAKSGYPATP

SEQ ID NO: 992649 - protein, 11 aa, Mycobacterium
QALGNKKGIRR

SEQ ID NO: 992650 - protein, 6 aa, Mycobacterium
QANEDY

SEQ ID NO: 992651 - protein, 8 aa, Mycobacterium
QANGDTPV

SEQ ID NO: 992652 - protein, 10 aa, Mycobacterium
QANKDGRRAY

SEQ ID NO: 992653 - protein, 10 aa, Mycobacterium
QANQLPADPD

SEQ ID NO: 992654 - protein, 14 aa, Mycobacterium
QANSAKPGRPPTGM

SEQ ID NO: 992655 - protein, 4 aa, Mycobacterium
QANW

SEQ ID NO: 992656 - protein, 13 aa, Mycobacterium
QAPAFSLPDADGR

SEQ ID NO: 992657 - protein, 16 aa, Mycobacterium
QAPENSGKDSPAVSKV

SEQ ID NO: 992658 - protein, 7 aa, Mycobacterium
QAPGPIT

SEQ ID NO: 992659 - protein, 4 aa, Mycobacterium
QAPK

SEQ ID NO: 992660 - protein, 9 aa, Mycobacterium
QAPTGSNSQ

SEQ ID NO: 992661 - protein, 5 aa, Mycobacterium
QAQRL

SEQ ID NO: 992662 - protein, 13 aa, Mycobacterium
QAQVDRGLDKSGV

SEQ ID NO: 992663 - protein, 9 aa, Mycobacterium
QARAEPHRA

SEQ ID NO: 992664 - protein, 8 aa, Mycobacterium
QARANPDA

SEQ ID NO: 992665 - protein, 33 aa, Mycobacterium
QARERGEQVTSPAPMPYDRATQERRAKRAEREL

SEQ ID NO: 992666 - protein, 14 aa, Mycobacterium
QARGTKYPDEVQRE

SEQ ID NO: 992667 - protein, 10 aa, Mycobacterium
QARKDGYTST

SEQ ID NO: 992668 - protein, 21 aa, Mycobacterium
QARSFTGSQAGVITTGTHGNA

SEQ ID NO: 992669 - protein, 4 aa, Mycobacterium
QART

SEQ ID NO: 992670 - protein, 8 aa, Mycobacterium
QARTRGGY

SEQ ID NO: 992671 - protein, 4 aa, Mycobacterium
QASA

SEQ ID NO: 992672 - protein, 14 aa, Mycobacterium
QASGCSSQPQLSRE

SEQ ID NO: 992673 - protein, 17 aa, Mycobacterium
QASGNTDQAAIPSKAPR

SEQ ID NO: 992674 - protein, 9 aa, Mycobacterium
QASPPTDLS

SEQ ID NO: 992675 - protein, 18 aa, Mycobacterium
QATATGDVSKAAEYNNGA

SEQ ID NO: 992676 - protein, 16 aa, Mycobacterium
QATGYKGLACNFRRLV

SEQ ID NO: 992677 - protein, 10 aa, Mycobacterium
QAVSGSGLAG

SEQ ID NO: 992678 - protein, 8 aa, Mycobacterium
QCGSSQQA

SEQ ID NO: 992679 - protein, 13 aa, Mycobacterium
QCGTSSGHVPEAA

SEQ ID NO: 992680 - protein, 9 aa, Mycobacterium
QDAGADTVD

SEQ ID NO: 992681 - protein, 17 aa, Mycobacterium
QDAIADNDDDAIRLNYI

SEQ ID NO: 992682 - protein, 11 aa, Mycobacterium
QDAPPAPEPLS

SEQ ID NO: 992683 - protein, 4 aa, Mycobacterium
QDDF

SEQ ID NO: 992684 - protein, 21 aa, Mycobacterium
QDDLDQASDFGCSTSVANVNL

SEQ ID NO: 992685 - protein, 12 aa, Mycobacterium
QDEEQQGGTGTW

SEQ ID NO: 992686 - protein, 7 aa, Mycobacterium
QDEGSQL

SEQ ID NO: 992687 - protein, 18 aa, Mycobacterium
QDEPGHDEVQIADIRRGG

SEQ ID NO: 992688 - protein, 6 aa, Mycobacterium
QDERGY

SEQ ID NO: 992689 - protein, 6 aa, Mycobacterium
QDEWSG

SEQ ID NO: 992690 - protein, 7 aa, Mycobacterium
QDGDGTN

SEQ ID NO: 992691 - protein, 8 aa, Mycobacterium
QDGGRRRV

SEQ ID NO: 992692 - protein, 7 aa, Mycobacterium
QDGLART

SEQ ID NO: 992693 - protein, 5 aa, Mycobacterium
QDGNV

SEQ ID NO: 992694 - protein, 4 aa, Mycobacterium
QDHA

SEQ ID NO: 992695 - protein, 6 aa, Mycobacterium
QDHRPV

SEQ ID NO: 992696 - protein, 6 aa, Mycobacterium
QDLSQH

SEQ ID NO: 992697 - protein, 5 aa, Mycobacterium
QDNPD

SEQ ID NO: 992698 - protein, 10 aa, Mycobacterium
QDPHNTDCRY

SEQ ID NO: 992699 - protein, 4 aa, Mycobacterium
QDPI

SEQ ID NO: 992700 - protein, 9 aa, Mycobacterium
QDPTGTGEA

SEQ ID NO: 992701 - protein, 23 aa, Mycobacterium
QDPTWERSGHTDLGRARYWVPIP

SEQ ID NO: 992702 - protein, 4 aa, Mycobacterium
QDQL

SEQ ID NO: 992703 - protein, 4 aa, Mycobacterium
QDQR

SEQ ID NO: 992704 - protein, 5 aa, Mycobacterium
QDRAS

SEQ ID NO: 992705 - protein, 11 aa, Mycobacterium
QDRHSAEVAPL

SEQ ID NO: 992706 - protein, 8 aa, Mycobacterium
QDRPRGTG

SEQ ID NO: 992707 - protein, 5 aa, Mycobacterium
QDRRL

SEQ ID NO: 992708 - protein, 17 aa, Mycobacterium
QDTADQLTSTAKVESDK

SEQ ID NO: 992709 - protein, 9 aa, Mycobacterium
QDTGVPRAG

SEQ ID NO: 992710 - protein, 8 aa, Mycobacterium
QDVDGGLV

SEQ ID NO: 992711 - protein, 4 aa, Mycobacterium
QDVT

SEQ ID NO: 992712 - protein, 12 aa, Mycobacterium
QDWDPEQSQLSD

SEQ ID NO: 992713 - protein, 7 aa, Mycobacterium
QDYGIET

SEQ ID NO: 992714 - protein, 9 aa, Mycobacterium
QEADNSLSR

SEQ ID NO: 992715 - protein, 8 aa, Mycobacterium
QEAMSGPR

SEQ ID NO: 992716 - protein, 5 aa, Mycobacterium
QEAPG

SEQ ID NO: 992717 - protein, 9 aa, Mycobacterium
QEDDTVEVG

SEQ ID NO: 992718 - protein, 7 aa, Mycobacterium
QEDGEDV

SEQ ID NO: 992719 - protein, 8 aa, Mycobacterium
QEEDQRAF

SEQ ID NO: 992720 - protein, 19 aa, Mycobacterium
QEGDDVLGDDGQPPITAKD

SEQ ID NO: 992721 - protein, 10 aa, Mycobacterium
QEGIKEQQRL

SEQ ID NO: 992722 - protein, 6 aa, Mycobacterium
QEGKTA

SEQ ID NO: 992723 - protein, 7 aa, Mycobacterium
QEGVNEG

SEQ ID NO: 992724 - protein, 13 aa, Mycobacterium
QEGVVDDGGRRVG

SEQ ID NO: 992725 - protein, 6 aa, Mycobacterium
QEKARR

SEQ ID NO: 992726 - protein, 17 aa, Mycobacterium
QELRDNGVSDKALADPA

SEQ ID NO: 992727 - protein, 10 aa, Mycobacterium
QELTGQRRAT

SEQ ID NO: 992728 - protein, 22 aa, Mycobacterium
QENINAPGPCRATVNNNLVFDN

SEQ ID NO: 992729 - protein, 4 aa, Mycobacterium
QENM

SEQ ID NO: 992730 - protein, 12 aa, Mycobacterium
QENPPARSALRA

SEQ ID NO: 992731 - protein, 8 aa, Mycobacterium
QENTQGTV

SEQ ID NO: 992732 - protein, 11 aa, Mycobacterium
QEPDDVESAGR

SEQ ID NO: 992733 - protein, 20 aa, Mycobacterium
QEPPLNEEKTVRGNVEEGLG

SEQ ID NO: 992734 - protein, 4 aa, Mycobacterium
QERL

SEQ ID NO: 992735 - protein, 7 aa, Mycobacterium
QERSSGD

SEQ ID NO: 992736 - protein, 7 aa, Mycobacterium
QERTRHI

SEQ ID NO: 992737 - protein, 13 aa, Mycobacterium
QESGTTRPIDPWG

SEQ ID NO: 992738 - protein, 6 aa, Mycobacterium
QETSDL

SEQ ID NO: 992739 - protein, 4 aa, Mycobacterium
QEVS

SEQ ID NO: 992740 - protein, 7 aa, Mycobacterium
QFARNGA

SEQ ID NO: 992741 - protein, 5 aa, Mycobacterium
QFEEQ

SEQ ID NO: 992742 - protein, 12 aa, Mycobacterium
QFGDQIRDAAEA

SEQ ID NO: 992743 - protein, 10 aa, Mycobacterium
QFPDTDRPAL

SEQ ID NO: 992744 - protein, 29 aa, Mycobacterium
QFRRNKPVSLKNTADKALTPGTDGATSTV

SEQ ID NO: 992745 - protein, 4 aa, Mycobacterium
QGAA

SEQ ID NO: 992746 - protein, 8 aa, Mycobacterium
QGAAIQTG

SEQ ID NO: 992747 - protein, 14 aa, Mycobacterium
QGAKPGEGGQLPGR

SEQ ID NO: 992748 - protein, 4 aa, Mycobacterium
QGAL

SEQ ID NO: 992749 - protein, 9 aa, Mycobacterium
QGASAAVQG

SEQ ID NO: 992750 - protein, 8 aa, Mycobacterium
QGASAERI

SEQ ID NO: 992751 - protein, 8 aa, Mycobacterium
QGATTKRL

SEQ ID NO: 992752 - protein, 6 aa, Mycobacterium
QGATYG

SEQ ID NO: 992753 - protein, 9 aa, Mycobacterium
QGAYSGAGT

SEQ ID NO: 992754 - protein, 9 aa, Mycobacterium
QGDNHRQAG

SEQ ID NO: 992755 - protein, 14 aa, Mycobacterium
QGDPDPKHIEAIDV

SEQ ID NO: 992756 - protein, 16 aa, Mycobacterium
QGDPSAVPVGVVAPPD

SEQ ID NO: 992757 - protein, 10 aa, Mycobacterium
QGDTASKAAG

SEQ ID NO: 992758 - protein, 7 aa, Mycobacterium
QGDTREH

SEQ ID NO: 992759 - protein, 10 aa, Mycobacterium
QGEATEATGT

SEQ ID NO: 992760 - protein, 9 aa, Mycobacterium
QGENPTVTN

SEQ ID NO: 992761 - protein, 7 aa, Mycobacterium
QGEPELA

SEQ ID NO: 992762 - protein, 4 aa, Mycobacterium
QGEQ

SEQ ID NO: 992763 - protein, 13 aa, Mycobacterium
QGEVGPGGGPAGD

SEQ ID NO: 992764 - protein, 10 aa, Mycobacterium
QGGGENTTAR

SEQ ID NO: 992765 - protein, 5 aa, Mycobacterium
QGGGF

SEQ ID NO: 992766 - protein, 8 aa, Mycobacterium
QGGNNAGH

SEQ ID NO: 992767 - protein, 9 aa, Mycobacterium
QGGQGPGTV

SEQ ID NO: 992768 - protein, 4 aa, Mycobacterium
QGHQ

SEQ ID NO: 992769 - protein, 4 aa, Mycobacterium
QGHT

SEQ ID NO: 992770 - protein, 14 aa, Mycobacterium
QGIADAYKTGRGSI

SEQ ID NO: 992771 - protein, 9 aa, Mycobacterium
QGIEPPRPL

SEQ ID NO: 992772 - protein, 8 aa, Mycobacterium
QGKDGKRS

SEQ ID NO: 992773 - protein, 8 aa, Mycobacterium
QGKDLRPE

SEQ ID NO: 992774 - protein, 14 aa, Mycobacterium
QGKGTNGDSAPIPC

SEQ ID NO: 992775 - protein, 6 aa, Mycobacterium
QGKSSV

SEQ ID NO: 992776 - protein, 13 aa, Mycobacterium
QGLGADSTAGAAV

SEQ ID NO: 992777 - protein, 23 aa, Mycobacterium
QGLSQGDVVESGANADIKPGNNL

SEQ ID NO: 992778 - protein, 14 aa, Mycobacterium
QGNFGSPGNDPPAA

SEQ ID NO: 992779 - protein, 14 aa, Mycobacterium
QGNSTESPEEAGAI

SEQ ID NO: 992780 - protein, 15 aa, Mycobacterium
QGPAGAYQLLWHTAA

SEQ ID NO: 992781 - protein, 8 aa, Mycobacterium
QGPAQLGG

SEQ ID NO: 992782 - protein, 8 aa, Mycobacterium
QGPRSTDV

SEQ ID NO: 992783 - protein, 7 aa, Mycobacterium
QGPTARW

SEQ ID NO: 992784 - protein, 14 aa, Mycobacterium
QGQLDTELSELGRA

SEQ ID NO: 992785 - protein, 4 aa, Mycobacterium
QGRA

SEQ ID NO: 992786 - protein, 4 aa, Mycobacterium
QGRG

SEQ ID NO: 992787 - protein, 12 aa, Mycobacterium
QGRGGDAEQTVA

SEQ ID NO: 992788 - protein, 4 aa, Mycobacterium
QGRI

SEQ ID NO: 992789 - protein, 5 aa, Mycobacterium
QGSGF

SEQ ID NO: 992790 - protein, 5 aa, Mycobacterium
QGSGH

SEQ ID NO: 992791 - protein, 10 aa, Mycobacterium
QGSGRGPPRH

SEQ ID NO: 992792 - protein, 6 aa, Mycobacterium
QGSQWA

SEQ ID NO: 992793 - protein, 7 aa, Mycobacterium
QGSQWAG

SEQ ID NO: 992794 - protein, 10 aa, Mycobacterium
QGSTRTKERE

SEQ ID NO: 992795 - protein, 4 aa, Mycobacterium
QGSV

SEQ ID NO: 992796 - protein, 13 aa, Mycobacterium
QGTGEGATFPRST

SEQ ID NO: 992797 - protein, 20 aa, Mycobacterium
QGTKEYSTQNASGGPSGPFY

SEQ ID NO: 992798 - protein, 8 aa, Mycobacterium
QGVQPSSA

SEQ ID NO: 992799 - protein, 14 aa, Mycobacterium
QGVRRPAGTPLGAP

SEQ ID NO: 992800 - protein, 16 aa, Mycobacterium
QGWDPADVDNGYTAPI

SEQ ID NO: 992801 - protein, 6 aa, Mycobacterium
QGWQEA

SEQ ID NO: 992802 - protein, 6 aa, Mycobacterium
QGYAPT

SEQ ID NO: 992803 - protein, 7 aa, Mycobacterium
QHDGAPG

SEQ ID NO: 992804 - protein, 8 aa, Mycobacterium
QHDGARPT

SEQ ID NO: 992805 - protein, 23 aa, Mycobacterium
QHDQPEDDVDGGGYYRHHLHLHQ

SEQ ID NO: 992806 - protein, 9 aa, Mycobacterium
QHDRQNEKD

SEQ ID NO: 992807 - protein, 4 aa, Mycobacterium
QHDT

SEQ ID NO: 992808 - protein, 14 aa, Mycobacterium
QHEGDGGEGSKPVI

SEQ ID NO: 992809 - protein, 17 aa, Mycobacterium
QHHPRQRGIASGGTKVN

SEQ ID NO: 992810 - protein, 30 aa, Mycobacterium
QHNADQESALGRKETKRRGGQQANDEIIQK

SEQ ID NO: 992811 - protein, 15 aa, Mycobacterium
QHQTPRAAFQTTPET

SEQ ID NO: 992812 - protein, 5 aa, Mycobacterium
QHREM

SEQ ID NO: 992813 - protein, 5 aa, Mycobacterium
QHRGT

SEQ ID NO: 992814 - protein, 5 aa, Mycobacterium
QHRNG

SEQ ID NO: 992815 - protein, 7 aa, Mycobacterium
QHRPTKS

SEQ ID NO: 992816 - protein, 7 aa, Mycobacterium
QHRRHGR

SEQ ID NO: 992817 - protein, 8 aa, Mycobacterium
QHTAPSDI

SEQ ID NO: 992818 - protein, 5 aa, Mycobacterium
QHTPE

SEQ ID NO: 992819 - protein, 7 aa, Mycobacterium
QHTSDST

SEQ ID NO: 992820 - protein, 10 aa, Mycobacterium
QIDADAPGAR

SEQ ID NO: 992821 - protein, 4 aa, Mycobacterium
QIGN

SEQ ID NO: 992822 - protein, 9 aa, Mycobacterium
QIGTPDELY

SEQ ID NO: 992823 - protein, 4 aa, Mycobacterium
QIKE

SEQ ID NO: 992824 - protein, 6 aa, Mycobacterium
QIPTGF

SEQ ID NO: 992825 - protein, 4 aa, Mycobacterium
QIQP

SEQ ID NO: 992826 - protein, 7 aa, Mycobacterium
QISNDDV

SEQ ID NO: 992827 - protein, 16 aa, Mycobacterium
QISQTATQEPAVNGNR

SEQ ID NO: 992828 - protein, 4 aa, Mycobacterium
QITK

SEQ ID NO: 992829 - protein, 15 aa, Mycobacterium
QITVDGDKGEVRQGN

SEQ ID NO: 992830 - protein, 7 aa, Mycobacterium
QKAKGLD

SEQ ID NO: 992831 - protein, 13 aa, Mycobacterium
QKANTTSGAPLTV

SEQ ID NO: 992832 - protein, 10 aa, Mycobacterium
QKARQSGAAI

SEQ ID NO: 992833 - protein, 9 aa, Mycobacterium
QKDAPPLPV

SEQ ID NO: 992834 - protein, 11 aa, Mycobacterium
QKDEGSMAQTD

SEQ ID NO: 992835 - protein, 13 aa, Mycobacterium
QKDHTEVDRGAEY

SEQ ID NO: 992836 - protein, 12 aa, Mycobacterium
QKGGVGKTTTAV

SEQ ID NO: 992837 - protein, 7 aa, Mycobacterium
QKGRQVS

SEQ ID NO: 992838 - protein, 4 aa, Mycobacterium
QKKV

SEQ ID NO: 992839 - protein, 10 aa, Mycobacterium
QKPEKPLHGS

SEQ ID NO: 992840 - protein, 8 aa, Mycobacterium
QKPFPSPC

SEQ ID NO: 992841 - protein, 6 aa, Mycobacterium
QKPGAL

SEQ ID NO: 992842 - protein, 5 aa, Mycobacterium
QKPGL

SEQ ID NO: 992843 - protein, 6 aa, Mycobacterium
QKSIDE

SEQ ID NO: 992844 - protein, 6 aa, Mycobacterium
QKSSNG

SEQ ID NO: 992845 - protein, 6 aa, Mycobacterium
QKTGVR

SEQ ID NO: 992846 - protein, 5 aa, Mycobacterium
QKTHP

SEQ ID NO: 992847 - protein, 9 aa, Mycobacterium
QKTQTAAAI

SEQ ID NO: 992848 - protein, 6 aa, Mycobacterium
QKTSED

SEQ ID NO: 992849 - protein, 7 aa, Mycobacterium
QKTTYDL

SEQ ID NO: 992850 - protein, 4 aa, Mycobacterium
QKTW

SEQ ID NO: 992851 - protein, 8 aa, Mycobacterium
QLADGDEH

SEQ ID NO: 992852 - protein, 14 aa, Mycobacterium
QLAEQKATQKGCGP

SEQ ID NO: 992853 - protein, 5 aa, Mycobacterium
QLAGP

SEQ ID NO: 992854 - protein, 13 aa, Mycobacterium
QLAPRDDVERRKA

SEQ ID NO: 992855 - protein, 7 aa, Mycobacterium
QLAPTDK

SEQ ID NO: 992856 - protein, 10 aa, Mycobacterium
QLASRGNTQI

SEQ ID NO: 992857 - protein, 20 aa, Mycobacterium
QLDGNQTDAVQRVGRFAHLG

SEQ ID NO: 992858 - protein, 14 aa, Mycobacterium
QLGPETGSDAADPD

SEQ ID NO: 992859 - protein, 6 aa, Mycobacterium
QLGPGQ

SEQ ID NO: 992860 - protein, 7 aa, Mycobacterium
QLGREGV

SEQ ID NO: 992861 - protein, 6 aa, Mycobacterium
QLGSAR

SEQ ID NO: 992862 - protein, 5 aa, Mycobacterium
QLGST

SEQ ID NO: 992863 - protein, 4 aa, Mycobacterium
QLIP

SEQ ID NO: 992864 - protein, 6 aa, Mycobacterium
QLKGSN

SEQ ID NO: 992865 - protein, 7 aa, Mycobacterium
QLPADPA

SEQ ID NO: 992866 - protein, 38 aa, Mycobacterium
QLPAGRRAVDRPGHRSGTAPPAAGQRSPDVSNHHRQQS

SEQ ID NO: 992867 - protein, 5 aa, Mycobacterium
QLPDG

SEQ ID NO: 992868 - protein, 8 aa, Mycobacterium
QLPGNPTV

SEQ ID NO: 992869 - protein, 6 aa, Mycobacterium
QLPIED

SEQ ID NO: 992870 - protein, 18 aa, Mycobacterium
QLPPNPPAASKSPLPPMP

SEQ ID NO: 992871 - protein, 28 aa, Mycobacterium
QLPRSPTRATSLDDVGDASRVTMPTREH

SEQ ID NO: 992872 - protein, 7 aa, Mycobacterium
QLPSGYN

SEQ ID NO: 992873 - protein, 18 aa, Mycobacterium
QLQGGSADHGHATPGSHR

SEQ ID NO: 992874 - protein, 4 aa, Mycobacterium
QLRA

SEQ ID NO: 992875 - protein, 25 aa, Mycobacterium
QLRATRASIATSPGQLAINMSGALS

SEQ ID NO: 992876 - protein, 4 aa, Mycobacterium
QLRD

SEQ ID NO: 992877 - protein, 7 aa, Mycobacterium
QLRNEGR

SEQ ID NO: 992878 - protein, 15 aa, Mycobacterium
QLRSGSDEDETGWRD

SEQ ID NO: 992879 - protein, 11 aa, Mycobacterium
QLSEDTEGPGA

SEQ ID NO: 992880 - protein, 13 aa, Mycobacterium
QLSGQREPGPAAS

SEQ ID NO: 992881 - protein, 7 aa, Mycobacterium
QLSQSID

SEQ ID NO: 992882 - protein, 7 aa, Mycobacterium
QLTEPDM

SEQ ID NO: 992883 - protein, 9 aa, Mycobacterium
QMADARGTT

SEQ ID NO: 992884 - protein, 21 aa, Mycobacterium
QMAGRGTDIRLGGSDESDHDR

SEQ ID NO: 992885 - protein, 5 aa, Mycobacterium
QMPDG

SEQ ID NO: 992886 - protein, 5 aa, Mycobacterium
QNAAS

SEQ ID NO: 992887 - protein, 10 aa, Mycobacterium
QNADDTSTVP

SEQ ID NO: 992888 - protein, 10 aa, Mycobacterium
QNEDTSYFEE

SEQ ID NO: 992889 - protein, 29 aa, Mycobacterium
QNEQLQKRTAAQQASSTPDRTSGAPASVH

SEQ ID NO: 992890 - protein, 9 aa, Mycobacterium
QNEVPGATD

SEQ ID NO: 992891 - protein, 10 aa, Mycobacterium
QNFASADKTV

SEQ ID NO: 992892 - protein, 9 aa, Mycobacterium
QNGGNGSPA

SEQ ID NO: 992893 - protein, 9 aa, Mycobacterium
QNGVPDGET

SEQ ID NO: 992894 - protein, 14 aa, Mycobacterium
QNHSPSYNLRSIDM

SEQ ID NO: 992895 - protein, 6 aa, Mycobacterium
QNIKSA

SEQ ID NO: 992896 - protein, 19 aa, Mycobacterium
QNLDQQRTPYPDYIALPYE

SEQ ID NO: 992897 - protein, 12 aa, Mycobacterium
QNLRDSRITPTE

SEQ ID NO: 992898 - protein, 8 aa, Mycobacterium
QNPEDAKE

SEQ ID NO: 992899 - protein, 5 aa, Mycobacterium
QNPGQ

SEQ ID NO: 992900 - protein, 4 aa, Mycobacterium
QNRQ

SEQ ID NO: 992901 - protein, 6 aa, Mycobacterium
QNSDVH

SEQ ID NO: 992902 - protein, 4 aa, Mycobacterium
QNSF

SEQ ID NO: 992903 - protein, 6 aa, Mycobacterium
QNTFAE

SEQ ID NO: 992904 - protein, 11 aa, Mycobacterium
QNWESGDPKRQ

SEQ ID NO: 992905 - protein, 6 aa, Mycobacterium
QNYAAE

SEQ ID NO: 992906 - protein, 9 aa, Mycobacterium
QPAAAGRRL

SEQ ID NO: 992907 - protein, 8 aa, Mycobacterium
QPAKDKIA

SEQ ID NO: 992908 - protein, 15 aa, Mycobacterium
QPAPEYPEGDTRGER

SEQ ID NO: 992909 - protein, 10 aa, Mycobacterium
QPDGGDNRPD

SEQ ID NO: 992910 - protein, 5 aa, Mycobacterium
QPDHP

SEQ ID NO: 992911 - protein, 11 aa, Mycobacterium
QPEGSKSELAA

SEQ ID NO: 992912 - protein, 6 aa, Mycobacterium
QPETGV

SEQ ID NO: 992913 - protein, 13 aa, Mycobacterium
QPETTPTPISVRP

SEQ ID NO: 992914 - protein, 4 aa, Mycobacterium
QPGA

SEQ ID NO: 992915 - protein, 11 aa, Mycobacterium
QPGAASRSVTL

SEQ ID NO: 992916 - protein, 4 aa, Mycobacterium
QPGD

SEQ ID NO: 992917 - protein, 5 aa, Mycobacterium
QPGDR

SEQ ID NO: 992918 - protein, 7 aa, Mycobacterium
QPGDYRR

SEQ ID NO: 992919 - protein, 5 aa, Mycobacterium
QPGGM

SEQ ID NO: 992920 - protein, 13 aa, Mycobacterium
QPGPDEITTADLI

SEQ ID NO: 992921 - protein, 6 aa, Mycobacterium
QPGRFG

SEQ ID NO: 992922 - protein, 11 aa, Mycobacterium
QPGSRDDASEI

SEQ ID NO: 992923 - protein, 5 aa, Mycobacterium
QPGTA

SEQ ID NO: 992924 - protein, 9 aa, Mycobacterium
QPKADLAAT

SEQ ID NO: 992925 - protein, 10 aa, Mycobacterium
QPKETQMTFD

SEQ ID NO: 992926 - protein, 4 aa, Mycobacterium
QPKL

SEQ ID NO: 992927 - protein, 8 aa, Mycobacterium
QPKTGAVG

SEQ ID NO: 992928 - protein, 4 aa, Mycobacterium
QPLA

SEQ ID NO: 992929 - protein, 11 aa, Mycobacterium
QPLAPAAAAEH

SEQ ID NO: 992930 - protein, 12 aa, Mycobacterium
QPLDEEDTRPQQ

SEQ ID NO: 992931 - protein, 13 aa, Mycobacterium
QPLGGKAQFGGQR

SEQ ID NO: 992932 - protein, 16 aa, Mycobacterium
QPLQTRSMPDSGPSTF

SEQ ID NO: 992933 - protein, 9 aa, Mycobacterium
QPNPLDGDI

SEQ ID NO: 992934 - protein, 8 aa, Mycobacterium
QPPGAVNG

SEQ ID NO: 992935 - protein, 22 aa, Mycobacterium
QPPTPNPTQTPEDCSPAQSPCA

SEQ ID NO: 992936 - protein, 13 aa, Mycobacterium
QPQRETKTSKRLS

SEQ ID NO: 992937 - protein, 12 aa, Mycobacterium
QPRALGDAGDRL

SEQ ID NO: 992938 - protein, 11 aa, Mycobacterium
QPRDKAPIADD

SEQ ID NO: 992939 - protein, 8 aa, Mycobacterium
QPRHPDDW

SEQ ID NO: 992940 - protein, 12 aa, Mycobacterium
QPRVGKKAAHRR

SEQ ID NO: 992941 - protein, 4 aa, Mycobacterium
QPSA

SEQ ID NO: 992942 - protein, 10 aa, Mycobacterium
QPSADERFQG

SEQ ID NO: 992943 - protein, 24 aa, Mycobacterium
QPSEIEGADPVKSSSKRREHNKRR

SEQ ID NO: 992944 - protein, 11 aa, Mycobacterium
QPSNTSSNLEP

SEQ ID NO: 992945 - protein, 15 aa, Mycobacterium
QPSSKYSRQSVLQEA

SEQ ID NO: 992946 - protein, 7 aa, Mycobacterium
QPTDEDQ

SEQ ID NO: 992947 - protein, 6 aa, Mycobacterium
QPTLIN

SEQ ID NO: 992948 - protein, 4 aa, Mycobacterium
QPTT

SEQ ID NO: 992949 - protein, 28 aa, Mycobacterium
QPTTIGQAPPTTALSSIGSGGGLCTDPV

SEQ ID NO: 992950 - protein, 5 aa, Mycobacterium
QPVNR

SEQ ID NO: 992951 - protein, 4 aa, Mycobacterium
QPVQ

SEQ ID NO: 992952 - protein, 15 aa, Mycobacterium
QPWPAESAGDRVRRA

SEQ ID NO: 992953 - protein, 5 aa, Mycobacterium
QPYEY

SEQ ID NO: 992954 - protein, 10 aa, Mycobacterium
QQAAAEGHSL

SEQ ID NO: 992955 - protein, 13 aa, Mycobacterium
QQAAGTSTPEKVS

SEQ ID NO: 992956 - protein, 4 aa, Mycobacterium
QQAV

SEQ ID NO: 992957 - protein, 7 aa, Mycobacterium
QQEAGKV

SEQ ID NO: 992958 - protein, 10 aa, Mycobacterium
QQEPSTTASP

SEQ ID NO: 992959 - protein, 6 aa, Mycobacterium
QQGTGA

SEQ ID NO: 992960 - protein, 6 aa, Mycobacterium
QQHVTG

SEQ ID NO: 992961 - protein, 6 aa, Mycobacterium
QQKDSF

SEQ ID NO: 992962 - protein, 7 aa, Mycobacterium
QQLTRAG

SEQ ID NO: 992963 - protein, 11 aa, Mycobacterium
QQNAEDPAYRP

SEQ ID NO: 992964 - protein, 7 aa, Mycobacterium
QQPPNQL

SEQ ID NO: 992965 - protein, 16 aa, Mycobacterium
QQPRRAAVSSYGMSGT

SEQ ID NO: 992966 - protein, 4 aa, Mycobacterium
QQPS

SEQ ID NO: 992967 - protein, 7 aa, Mycobacterium
QQQNGGA

SEQ ID NO: 992968 - protein, 6 aa, Mycobacterium
QQQPNR

SEQ ID NO: 992969 - protein, 5 aa, Mycobacterium
QQQRC

SEQ ID NO: 992970 - protein, 10 aa, Mycobacterium
QQRAATPAYD

SEQ ID NO: 992971 - protein, 9 aa, Mycobacterium
QQRDEDGLG

SEQ ID NO: 992972 - protein, 11 aa, Mycobacterium
QQRGMERTRSD

SEQ ID NO: 992973 - protein, 12 aa, Mycobacterium
QQRKDGGNRPVS

SEQ ID NO: 992974 - protein, 7 aa, Mycobacterium
QQRSPDL

SEQ ID NO: 992975 - protein, 8 aa, Mycobacterium
QQSGVQTE

SEQ ID NO: 992976 - protein, 19 aa, Mycobacterium
QQTHEENFSAASDEALGDI

SEQ ID NO: 992977 - protein, 6 aa, Mycobacterium
QQTMDN

SEQ ID NO: 992978 - protein, 4 aa, Mycobacterium
QQVS

SEQ ID NO: 992979 - protein, 10 aa, Mycobacterium
QQVTDPENWT

SEQ ID NO: 992980 - protein, 15 aa, Mycobacterium
QQYPENAGQRGQRPM

SEQ ID NO: 992981 - protein, 4 aa, Mycobacterium
QRAA

SEQ ID NO: 992982 - protein, 46 aa, Mycobacterium
QRAAARQGTHSTKTRGDVSGGGRKPYRQKGTGRARQGSMRAPQFTG

SEQ ID NO: 992983 - protein, 7 aa, Mycobacterium
QRAADEI

SEQ ID NO: 992984 - protein, 6 aa, Mycobacterium
QRAATL

SEQ ID NO: 992985 - protein, 10 aa, Mycobacterium
QRADIARSTV

SEQ ID NO: 992986 - protein, 4 aa, Mycobacterium
QRAE

SEQ ID NO: 992987 - protein, 6 aa, Mycobacterium
QRAEAA

SEQ ID NO: 992988 - protein, 13 aa, Mycobacterium
QRAKVDAAARKQA

SEQ ID NO: 992989 - protein, 7 aa, Mycobacterium
QRARGIA

SEQ ID NO: 992990 - protein, 24 aa, Mycobacterium
QRARTGRAYNSVSRGGGTGSSPSA

SEQ ID NO: 992991 - protein, 6 aa, Mycobacterium
QRATAE

SEQ ID NO: 992992 - protein, 13 aa, Mycobacterium
QRATQIGATHDAT

SEQ ID NO: 992993 - protein, 8 aa, Mycobacterium
QRDADDTV

SEQ ID NO: 992994 - protein, 6 aa, Mycobacterium
QRDDAL

SEQ ID NO: 992995 - protein, 27 aa, Mycobacterium
QRDPTAAGKRHGAQAAAARPQSDIKDK

SEQ ID NO: 992996 - protein, 7 aa, Mycobacterium
QRECSPE

SEQ ID NO: 992997 - protein, 7 aa, Mycobacterium
QREPERK

SEQ ID NO: 992998 - protein, 8 aa, Mycobacterium
QRFSTAND

SEQ ID NO: 992999 - protein, 9 aa, Mycobacterium
QRGGTPTAF

SEQ ID NO: 993000 - protein, 9 aa, Mycobacterium
QRGLAADGR

SEQ ID NO: 993001 - protein, 8 aa, Mycobacterium
QRGSELGN

SEQ ID NO: 993002 - protein, 6 aa, Mycobacterium
QRGSPF

SEQ ID NO: 993003 - protein, 8 aa, Mycobacterium
QRGTIPTD

SEQ ID NO: 993004 - protein, 14 aa, Mycobacterium
QRHASQLRRSGDPY

SEQ ID NO: 993005 - protein, 4 aa, Mycobacterium
QRKF

SEQ ID NO: 993006 - protein, 7 aa, Mycobacterium
QRLDTGS

SEQ ID NO: 993007 - protein, 9 aa, Mycobacterium
QRNHTDSMR

SEQ ID NO: 993008 - protein, 26 aa, Mycobacterium
QRNRHTMSSRTQAPSIQTVDYGAKFV

SEQ ID NO: 993009 - protein, 5 aa, Mycobacterium
QRNRS

SEQ ID NO: 993010 - protein, 4 aa, Mycobacterium
QRPA

SEQ ID NO: 993011 - protein, 9 aa, Mycobacterium
QRPAKDGWR

SEQ ID NO: 993012 - protein, 10 aa, Mycobacterium
QRPDESTPSI

SEQ ID NO: 993013 - protein, 5 aa, Mycobacterium
QRPGS

SEQ ID NO: 993014 - protein, 7 aa, Mycobacterium
QRPGVGV

SEQ ID NO: 993015 - protein, 23 aa, Mycobacterium
QRPPGGTTTYTDTAVRGSRLRAG

SEQ ID NO: 993016 - protein, 5 aa, Mycobacterium
QRPPV

SEQ ID NO: 993017 - protein, 6 aa, Mycobacterium
QRPQGT

SEQ ID NO: 993018 - protein, 8 aa, Mycobacterium
QRRKTSRN

SEQ ID NO: 993019 - protein, 16 aa, Mycobacterium
QRRRDDAVPRLTGAVV

SEQ ID NO: 993020 - protein, 21 aa, Mycobacterium
QRSDSAGRSKGKQHCPLATAK

SEQ ID NO: 993021 - protein, 13 aa, Mycobacterium
QRSFETREGEKRT

SEQ ID NO: 993022 - protein, 5 aa, Mycobacterium
QRSGV

SEQ ID NO: 993023 - protein, 8 aa, Mycobacterium
QRSTDDVG

SEQ ID NO: 993024 - protein, 6 aa, Mycobacterium
QRSVKG

SEQ ID NO: 993025 - protein, 6 aa, Mycobacterium
QRTAAT

SEQ ID NO: 993026 - protein, 4 aa, Mycobacterium
QRTK

SEQ ID NO: 993027 - protein, 8 aa, Mycobacterium
QRTLPNER

SEQ ID NO: 993028 - protein, 8 aa, Mycobacterium
QRTSAISE

SEQ ID NO: 993029 - protein, 7 aa, Mycobacterium
QRVGGAA

SEQ ID NO: 993030 - protein, 7 aa, Mycobacterium
QRVPSNE

SEQ ID NO: 993031 - protein, 8 aa, Mycobacterium
QRWEGSSK

SEQ ID NO: 993032 - protein, 14 aa, Mycobacterium
QRYGDDKETIEQKH

SEQ ID NO: 993033 - protein, 5 aa, Mycobacterium
QSAAG

SEQ ID NO: 993034 - protein, 8 aa, Mycobacterium
QSAAGGKG

SEQ ID NO: 993035 - protein, 9 aa, Mycobacterium
QSAAPVESV

SEQ ID NO: 993036 - protein, 6 aa, Mycobacterium
QSADGM

SEQ ID NO: 993037 - protein, 8 aa, Mycobacterium
QSAKTGML

SEQ ID NO: 993038 - protein, 5 aa, Mycobacterium
QSARV

SEQ ID NO: 993039 - protein, 6 aa, Mycobacterium
QSAYDI

SEQ ID NO: 993040 - protein, 4 aa, Mycobacterium
QSDI

SEQ ID NO: 993041 - protein, 5 aa, Mycobacterium
QSDKV

SEQ ID NO: 993042 - protein, 8 aa, Mycobacterium
QSDLNEPL

SEQ ID NO: 993043 - protein, 7 aa, Mycobacterium
QSERPSV

SEQ ID NO: 993044 - protein, 5 aa, Mycobacterium
QSESQ

SEQ ID NO: 993045 - protein, 7 aa, Mycobacterium
QSGDTVR

SEQ ID NO: 993046 - protein, 15 aa, Mycobacterium
QSGGDPRRPGKNGEL

SEQ ID NO: 993047 - protein, 5 aa, Mycobacterium
QSGGG

SEQ ID NO: 993048 - protein, 7 aa, Mycobacterium
QSGHQPI

SEQ ID NO: 993049 - protein, 23 aa, Mycobacterium
QSGLRANSGSTSSVVVTTQRRHA

SEQ ID NO: 993050 - protein, 4 aa, Mycobacterium
QSGR

SEQ ID NO: 993051 - protein, 17 aa, Mycobacterium
QSGSLNSGTQGRESPMA

SEQ ID NO: 993052 - protein, 9 aa, Mycobacterium
QSGVAPGQL

SEQ ID NO: 993053 - protein, 5 aa, Mycobacterium
QSGVQ

SEQ ID NO: 993054 - protein, 14 aa, Mycobacterium
QSIADTDESGTRLR

SEQ ID NO: 993055 - protein, 4 aa, Mycobacterium
QSIN

SEQ ID NO: 993056 - protein, 6 aa, Mycobacterium
QSKQVA

SEQ ID NO: 993057 - protein, 4 aa, Mycobacterium
QSLG

SEQ ID NO: 993058 - protein, 10 aa, Mycobacterium
QSLPAPQAAA

SEQ ID NO: 993059 - protein, 10 aa, Mycobacterium
QSLPGKAIES

SEQ ID NO: 993060 - protein, 7 aa, Mycobacterium
QSLPGSE

SEQ ID NO: 993061 - protein, 5 aa, Mycobacterium
QSLQT

SEQ ID NO: 993062 - protein, 10 aa, Mycobacterium
QSLRSEQEVR

SEQ ID NO: 993063 - protein, 7 aa, Mycobacterium
QSNDFSL

SEQ ID NO: 993064 - protein, 10 aa, Mycobacterium
QSNPAHDPFE

SEQ ID NO: 993065 - protein, 4 aa, Mycobacterium
QSPM

SEQ ID NO: 993066 - protein, 10 aa, Mycobacterium
QSQSSGGPAL

SEQ ID NO: 993067 - protein, 4 aa, Mycobacterium
QSQV

SEQ ID NO: 993068 - protein, 28 aa, Mycobacterium
QSRGSGGNGGTDSNDCLTPGDTGEPGGF

SEQ ID NO: 993069 - protein, 8 aa, Mycobacterium
QSRIDSAT

SEQ ID NO: 993070 - protein, 9 aa, Mycobacterium
QSRPEDRRT

SEQ ID NO: 993071 - protein, 8 aa, Mycobacterium
QSRSGPPY

SEQ ID NO: 993072 - protein, 13 aa, Mycobacterium
QSSPLERLRSASQ

SEQ ID NO: 993073 - protein, 5 aa, Mycobacterium
QSSQR

SEQ ID NO: 993074 - protein, 15 aa, Mycobacterium
QSSRGSLVAAAGDPG

SEQ ID NO: 993075 - protein, 5 aa, Mycobacterium
QSTAT

SEQ ID NO: 993076 - protein, 7 aa, Mycobacterium
QSTSGPL

SEQ ID NO: 993077 - protein, 4 aa, Mycobacterium
QSVP

SEQ ID NO: 993078 - protein, 25 aa, Mycobacterium
QSYGNVEGRLDTRPPGASLTPFGRD

SEQ ID NO: 993079 - protein, 5 aa, Mycobacterium
QTARA

SEQ ID NO: 993080 - protein, 5 aa, Mycobacterium
QTARN

SEQ ID NO: 993081 - protein, 10 aa, Mycobacterium
QTASKAGSGF

SEQ ID NO: 993082 - protein, 17 aa, Mycobacterium
QTDAEKRAAVETTPARK

SEQ ID NO: 993083 - protein, 8 aa, Mycobacterium
QTDEPDLV

SEQ ID NO: 993084 - protein, 9 aa, Mycobacterium
QTDKPETAV

SEQ ID NO: 993085 - protein, 9 aa, Mycobacterium
QTEAAANGC

SEQ ID NO: 993086 - protein, 7 aa, Mycobacterium
QTEGRPR

SEQ ID NO: 993087 - protein, 4 aa, Mycobacterium
QTEL

SEQ ID NO: 993088 - protein, 7 aa, Mycobacterium
QTEVSSR

SEQ ID NO: 993089 - protein, 6 aa, Mycobacterium
QTGAPL

SEQ ID NO: 993090 - protein, 6 aa, Mycobacterium
QTGFAR

SEQ ID NO: 993091 - protein, 5 aa, Mycobacterium
QTGGK

SEQ ID NO: 993092 - protein, 23 aa, Mycobacterium
QTGGPAALPPLPPSLPRRQSQTH

SEQ ID NO: 993093 - protein, 10 aa, Mycobacterium
QTGKANGDNI

SEQ ID NO: 993094 - protein, 6 aa, Mycobacterium
QTGMGT

SEQ ID NO: 993095 - protein, 8 aa, Mycobacterium
QTGRARNV

SEQ ID NO: 993096 - protein, 6 aa, Mycobacterium
QTGSTE

SEQ ID NO: 993097 - protein, 5 aa, Mycobacterium
QTGSV

SEQ ID NO: 993098 - protein, 7 aa, Mycobacterium
QTGVTSA

SEQ ID NO: 993099 - protein, 5 aa, Mycobacterium
QTHVS

SEQ ID NO: 993100 - protein, 12 aa, Mycobacterium
QTIGDEGDSQLG

SEQ ID NO: 993101 - protein, 8 aa, Mycobacterium
QTKKQGND

SEQ ID NO: 993102 - protein, 15 aa, Mycobacterium
QTLASRSRAGDLPRG

SEQ ID NO: 993103 - protein, 5 aa, Mycobacterium
QTMAG

SEQ ID NO: 993104 - protein, 5 aa, Mycobacterium
QTPKV

SEQ ID NO: 993105 - protein, 5 aa, Mycobacterium
QTPNV

SEQ ID NO: 993106 - protein, 4 aa, Mycobacterium
QTPS

SEQ ID NO: 993107 - protein, 9 aa, Mycobacterium
QTPSGPVTT

SEQ ID NO: 993108 - protein, 5 aa, Mycobacterium
QTRIS

SEQ ID NO: 993109 - protein, 9 aa, Mycobacterium
QTRSAERLD

SEQ ID NO: 993110 - protein, 4 aa, Mycobacterium
QTRY

SEQ ID NO: 993111 - protein, 8 aa, Mycobacterium
QTSRRPPL

SEQ ID NO: 993112 - protein, 5 aa, Mycobacterium
QTTLT

SEQ ID NO: 993113 - protein, 9 aa, Mycobacterium
QTTTKTTVT

SEQ ID NO: 993114 - protein, 6 aa, Mycobacterium
QTTVEG

SEQ ID NO: 993115 - protein, 6 aa, Mycobacterium
QTVEGE

SEQ ID NO: 993116 - protein, 11 aa, Mycobacterium
QTVERRGTQPL

SEQ ID NO: 993117 - protein, 9 aa, Mycobacterium
QTVSEARAL

SEQ ID NO: 993118 - protein, 5 aa, Mycobacterium
QTVSG

SEQ ID NO: 993119 - protein, 12 aa, Mycobacterium
QTVSQPCGRNQH

SEQ ID NO: 993120 - protein, 14 aa, Mycobacterium
QTWPASALGPQQRA

SEQ ID NO: 993121 - protein, 7 aa, Mycobacterium
QTYEPSR

SEQ ID NO: 993122 - protein, 4 aa, Mycobacterium
QVAA

SEQ ID NO: 993123 - protein, 10 aa, Mycobacterium
QVAPDASEQQ

SEQ ID NO: 993124 - protein, 5 aa, Mycobacterium
QVDGH

SEQ ID NO: 993125 - protein, 4 aa, Mycobacterium
QVDP

SEQ ID NO: 993126 - protein, 5 aa, Mycobacterium
QVDQD

SEQ ID NO: 993127 - protein, 25 aa, Mycobacterium
QVEGAPHDGTPSAPQEPDEDTVTVP

SEQ ID NO: 993128 - protein, 8 aa, Mycobacterium
QVGADGID

SEQ ID NO: 993129 - protein, 10 aa, Mycobacterium
QVGAPGAARA

SEQ ID NO: 993130 - protein, 4 aa, Mycobacterium
QVGN

SEQ ID NO: 993131 - protein, 5 aa, Mycobacterium
QVGSW

SEQ ID NO: 993132 - protein, 9 aa, Mycobacterium
QVHGQGGGG

SEQ ID NO: 993133 - protein, 15 aa, Mycobacterium
QVKPPRLGRQRHVCW

SEQ ID NO: 993134 - protein, 26 aa, Mycobacterium
QVNRRTAGLSATRYKGAKLALIDLDK

SEQ ID NO: 993135 - protein, 18 aa, Mycobacterium
QVPIDRTDADTAEAALNT

SEQ ID NO: 993136 - protein, 15 aa, Mycobacterium
QVRGRGAESAAPLGV

SEQ ID NO: 993137 - protein, 18 aa, Mycobacterium
QVRSAGRRSTHRRRRPGI

SEQ ID NO: 993138 - protein, 5 aa, Mycobacterium
QVRTG

SEQ ID NO: 993139 - protein, 8 aa, Mycobacterium
QVRTNAAE

SEQ ID NO: 993140 - protein, 8 aa, Mycobacterium
QVSDADSA

SEQ ID NO: 993141 - protein, 6 aa, Mycobacterium
QVSQPG

SEQ ID NO: 993142 - protein, 7 aa, Mycobacterium
QVTQPGD

SEQ ID NO: 993143 - protein, 5 aa, Mycobacterium
QWRQP

SEQ ID NO: 993144 - protein, 11 aa, Mycobacterium
QYEHGYDTAPV

SEQ ID NO: 993145 - protein, 6 aa, Mycobacterium
QYGPGH

SEQ ID NO: 993146 - protein, 6 aa, Mycobacterium
QYPDSS

SEQ ID NO: 993147 - protein, 4 aa, Mycobacterium
QYPP

SEQ ID NO: 993148 - protein, 6 aa, Mycobacterium
QYQSSV

SEQ ID NO: 993149 - protein, 13 aa, Mycobacterium
QYRDDAKGPSASV

SEQ ID NO: 993150 - protein, 12 aa, Mycobacterium
QYRQRGNLPTGA

SEQ ID NO: 993151 - protein, 18 aa, Mycobacterium
QYSEESAVDTALETNRPL

SEQ ID NO: 993152 - protein, 14 aa, Mycobacterium
QYTEDTDCNPTLPL

SEQ ID NO: 993153 - protein, 7 aa, Mycobacterium
QYYANPE

SEQ ID NO: 993154 - protein, 9 aa, Mycobacterium
RAAAEAGGY

SEQ ID NO: 993155 - protein, 11 aa, Mycobacterium
RAAAKQLRSDY

SEQ ID NO: 993156 - protein, 13 aa, Mycobacterium
RAAAQAKKAVEQN

SEQ ID NO: 993157 - protein, 7 aa, Mycobacterium
RAADADV

SEQ ID NO: 993158 - protein, 11 aa, Mycobacterium
RAADGTGWGEG

SEQ ID NO: 993159 - protein, 6 aa, Mycobacterium
RAAEAE

SEQ ID NO: 993160 - protein, 7 aa, Mycobacterium
RAAELAT

SEQ ID NO: 993161 - protein, 5 aa, Mycobacterium
RAAEP

SEQ ID NO: 993162 - protein, 10 aa, Mycobacterium
RAAETDRPDA

SEQ ID NO: 993163 - protein, 23 aa, Mycobacterium
RAAETKATDAPSRTWSARLAVYS

SEQ ID NO: 993164 - protein, 4 aa, Mycobacterium
RAAG

SEQ ID NO: 993165 - protein, 5 aa, Mycobacterium
RAAGA

SEQ ID NO: 993166 - protein, 11 aa, Mycobacterium
RAAGEPHGRPR

SEQ ID NO: 993167 - protein, 16 aa, Mycobacterium
RAAGEQMRDAVAYLAA

SEQ ID NO: 993168 - protein, 6 aa, Mycobacterium
RAAGPI

SEQ ID NO: 993169 - protein, 12 aa, Mycobacterium
RAAGRVDGVRPG

SEQ ID NO: 993170 - protein, 7 aa, Mycobacterium
RAAGTHK

SEQ ID NO: 993171 - protein, 10 aa, Mycobacterium
RAAKPGSPVC

SEQ ID NO: 993172 - protein, 7 aa, Mycobacterium
RAALSGA

SEQ ID NO: 993173 - protein, 8 aa, Mycobacterium
RAAPNAEV

SEQ ID NO: 993174 - protein, 5 aa, Mycobacterium
RAARA

SEQ ID NO: 993175 - protein, 12 aa, Mycobacterium
RAARRASGARNR

SEQ ID NO: 993176 - protein, 6 aa, Mycobacterium
RAASIG

SEQ ID NO: 993177 - protein, 4 aa, Mycobacterium
RAAV

SEQ ID NO: 993178 - protein, 21 aa, Mycobacterium
RAAYPLQSAPAEKAAQPSLPH

SEQ ID NO: 993179 - protein, 16 aa, Mycobacterium
RADAEASDAAVEESTE

SEQ ID NO: 993180 - protein, 5 aa, Mycobacterium
RADAT

SEQ ID NO: 993181 - protein, 11 aa, Mycobacterium
RADDRPAAKQR

SEQ ID NO: 993182 - protein, 4 aa, Mycobacterium
RADG

SEQ ID NO: 993183 - protein, 5 aa, Mycobacterium
RADGA

SEQ ID NO: 993184 - protein, 5 aa, Mycobacterium
RADNR

SEQ ID NO: 993185 - protein, 7 aa, Mycobacterium
RADPDTV

SEQ ID NO: 993186 - protein, 5 aa, Mycobacterium
RADPF

SEQ ID NO: 993187 - protein, 5 aa, Mycobacterium
RADQD

SEQ ID NO: 993188 - protein, 22 aa, Mycobacterium
RADRPCGSTIGPLASARTGIPT

SEQ ID NO: 993189 - protein, 6 aa, Mycobacterium
RADSGL

SEQ ID NO: 993190 - protein, 4 aa, Mycobacterium
RADT

SEQ ID NO: 993191 - protein, 6 aa, Mycobacterium
RADVAG

SEQ ID NO: 993192 - protein, 8 aa, Mycobacterium
RAEAAQQL

SEQ ID NO: 993193 - protein, 7 aa, Mycobacterium
RAEADRI

SEQ ID NO: 993194 - protein, 9 aa, Mycobacterium
RAEGSEEKR

SEQ ID NO: 993195 - protein, 9 aa, Mycobacterium
RAEGTEFRS

SEQ ID NO: 993196 - protein, 13 aa, Mycobacterium
RAELPPDRGVESD

SEQ ID NO: 993197 - protein, 12 aa, Mycobacterium
RAEPDRDYPRPV

SEQ ID NO: 993198 - protein, 13 aa, Mycobacterium
RAEQIRRGGSGME

SEQ ID NO: 993199 - protein, 15 aa, Mycobacterium
RAERDTASGRSAGGK

SEQ ID NO: 993200 - protein, 9 aa, Mycobacterium
RAERTQSEL

SEQ ID NO: 993201 - protein, 9 aa, Mycobacterium
RAETPEQEQ

SEQ ID NO: 993202 - protein, 9 aa, Mycobacterium
RAGAPDEQS

SEQ ID NO: 993203 - protein, 7 aa, Mycobacterium
RAGAQGR

SEQ ID NO: 993204 - protein, 4 aa, Mycobacterium
RAGC

SEQ ID NO: 993205 - protein, 6 aa, Mycobacterium
RAGDGV

SEQ ID NO: 993206 - protein, 5 aa, Mycobacterium
RAGDS

SEQ ID NO: 993207 - protein, 13 aa, Mycobacterium
RAGEGATTLAADP

SEQ ID NO: 993208 - protein, 7 aa, Mycobacterium
RAGEGVS

SEQ ID NO: 993209 - protein, 4 aa, Mycobacterium
RAGG

SEQ ID NO: 993210 - protein, 4 aa, Mycobacterium
RAGK

SEQ ID NO: 993211 - protein, 25 aa, Mycobacterium
RAGKTISWQPTPATCEKVSQAPVSS

SEQ ID NO: 993212 - protein, 9 aa, Mycobacterium
RAGPGVSEL

SEQ ID NO: 993213 - protein, 19 aa, Mycobacterium
RAGRADQSIDRDAVQRQQC

SEQ ID NO: 993214 - protein, 5 aa, Mycobacterium
RAGRI

SEQ ID NO: 993215 - protein, 19 aa, Mycobacterium
RAGRSIVSDRRRKGRRTLT

SEQ ID NO: 993216 - protein, 16 aa, Mycobacterium
RAGSADAAGSDQPTLG

SEQ ID NO: 993217 - protein, 5 aa, Mycobacterium
RAGTD

SEQ ID NO: 993218 - protein, 23 aa, Mycobacterium
RAGTRGESAGPEQEWVYELPVHP

SEQ ID NO: 993219 - protein, 7 aa, Mycobacterium
RAGVGAG

SEQ ID NO: 993220 - protein, 7 aa, Mycobacterium
RAGVSDK

SEQ ID NO: 993221 - protein, 4 aa, Mycobacterium
RAHG

SEQ ID NO: 993222 - protein, 6 aa, Mycobacterium
RAHGGS

SEQ ID NO: 993223 - protein, 6 aa, Mycobacterium
RAHRPV

SEQ ID NO: 993224 - protein, 9 aa, Mycobacterium
RAHSTYRRT

SEQ ID NO: 993225 - protein, 17 aa, Mycobacterium
RAHVSDSKELTANPPPM

SEQ ID NO: 993226 - protein, 6 aa, Mycobacterium
RAIPRS

SEQ ID NO: 993227 - protein, 8 aa, Mycobacterium
RAKATQVA

SEQ ID NO: 993228 - protein, 8 aa, Mycobacterium
RAKHGQRG

SEQ ID NO: 993229 - protein, 8 aa, Mycobacterium
RAKKNAIK

SEQ ID NO: 993230 - protein, 14 aa, Mycobacterium
RAKRDAPGLDASGL

SEQ ID NO: 993231 - protein, 25 aa, Mycobacterium
RAKRTAGPTDTVPDTAIADPGGQLV

SEQ ID NO: 993232 - protein, 4 aa, Mycobacterium
RAKV

SEQ ID NO: 993233 - protein, 11 aa, Mycobacterium
RALDPSAGKPL

SEQ ID NO: 993234 - protein, 7 aa, Mycobacterium
RAMTQAG

SEQ ID NO: 993235 - protein, 5 aa, Mycobacterium
RANDI

SEQ ID NO: 993236 - protein, 11 aa, Mycobacterium
RANKNNVDPKR

SEQ ID NO: 993237 - protein, 7 aa, Mycobacterium
RANRDQL

SEQ ID NO: 993238 - protein, 4 aa, Mycobacterium
RAPE

SEQ ID NO: 993239 - protein, 6 aa, Mycobacterium
RAPIGG

SEQ ID NO: 993240 - protein, 6 aa, Mycobacterium
RAPLGR

SEQ ID NO: 993241 - protein, 4 aa, Mycobacterium
RAPN

SEQ ID NO: 993242 - protein, 18 aa, Mycobacterium
RAPRPYDPENEDTNHADN

SEQ ID NO: 993243 - protein, 21 aa, Mycobacterium
RAPRSSSRSIPTARCFAVGWA

SEQ ID NO: 993244 - protein, 6 aa, Mycobacterium
RAPSDE

SEQ ID NO: 993245 - protein, 8 aa, Mycobacterium
RAQDDYNG

SEQ ID NO: 993246 - protein, 7 aa, Mycobacterium
RAQDPAT

SEQ ID NO: 993247 - protein, 5 aa, Mycobacterium
RAQGV

SEQ ID NO: 993248 - protein, 26 aa, Mycobacterium
RAQSIREGLGNPTGMGMDEGRVPDRI

SEQ ID NO: 993249 - protein, 13 aa, Mycobacterium
RAQTRPRTTFDGY

SEQ ID NO: 993250 - protein, 7 aa, Mycobacterium
RARDALG

SEQ ID NO: 993251 - protein, 11 aa, Mycobacterium
RARDGKLTAED

SEQ ID NO: 993252 - protein, 8 aa, Mycobacterium
RARDRGKP

SEQ ID NO: 993253 - protein, 17 aa, Mycobacterium
RARDTGSLVSDRPGTIT

SEQ ID NO: 993254 - protein, 16 aa, Mycobacterium
RAREHGDLDSGPLKSV

SEQ ID NO: 993255 - protein, 6 aa, Mycobacterium
RARFGR

SEQ ID NO: 993256 - protein, 12 aa, Mycobacterium
RARIERRTSESD

SEQ ID NO: 993257 - protein, 6 aa, Mycobacterium
RARQIN

SEQ ID NO: 993258 - protein, 7 aa, Mycobacterium
RARQRAR

SEQ ID NO: 993259 - protein, 16 aa, Mycobacterium
RARSGNLKPEELSGGT

SEQ ID NO: 993260 - protein, 28 aa, Mycobacterium
RARTAELRQAPHAAAEPAPTQHLTRPDG

SEQ ID NO: 993261 - protein, 7 aa, Mycobacterium
RARTESS

SEQ ID NO: 993262 - protein, 7 aa, Mycobacterium
RARTGPA

SEQ ID NO: 993263 - protein, 11 aa, Mycobacterium
RASAAERDVTT

SEQ ID NO: 993264 - protein, 7 aa, Mycobacterium
RASDATA

SEQ ID NO: 993265 - protein, 12 aa, Mycobacterium
RASDFNSRSAAL

SEQ ID NO: 993266 - protein, 21 aa, Mycobacterium
RASDSNRGARGHRHPGHNVLC

SEQ ID NO: 993267 - protein, 11 aa, Mycobacterium
RASGDREERSK

SEQ ID NO: 993268 - protein, 13 aa, Mycobacterium
RASKMSRSNPEAR

SEQ ID NO: 993269 - protein, 9 aa, Mycobacterium
RASKTLEGN

SEQ ID NO: 993270 - protein, 7 aa, Mycobacterium
RASRGGT

SEQ ID NO: 993271 - protein, 6 aa, Mycobacterium
RASRNF

SEQ ID NO: 993272 - protein, 17 aa, Mycobacterium
RASRQKARAARRLGFEV

SEQ ID NO: 993273 - protein, 7 aa, Mycobacterium
RASVKSE

SEQ ID NO: 993274 - protein, 5 aa, Mycobacterium
RATAN

SEQ ID NO: 993275 - protein, 6 aa, Mycobacterium
RATEEA

SEQ ID NO: 993276 - protein, 9 aa, Mycobacterium
RATEGTKIP

SEQ ID NO: 993277 - protein, 5 aa, Mycobacterium
RATGA

SEQ ID NO: 993278 - protein, 7 aa, Mycobacterium
RATGTLE

SEQ ID NO: 993279 - protein, 13 aa, Mycobacterium
RATLGNMSPEFGS

SEQ ID NO: 993280 - protein, 5 aa, Mycobacterium
RATPG

SEQ ID NO: 993281 - protein, 15 aa, Mycobacterium
RATSGDNHLGGDDWD

SEQ ID NO: 993282 - protein, 4 aa, Mycobacterium
RATT

SEQ ID NO: 993283 - protein, 12 aa, Mycobacterium
RAVAGETVLADL

SEQ ID NO: 993284 - protein, 9 aa, Mycobacterium
RAVAGPGPL

SEQ ID NO: 993285 - protein, 5 aa, Mycobacterium
RAVQE

SEQ ID NO: 993286 - protein, 6 aa, Mycobacterium
RAYEPQ

SEQ ID NO: 993287 - protein, 19 aa, Mycobacterium
RCEDGDTLRCGDRNAAVTE

SEQ ID NO: 993288 - protein, 6 aa, Mycobacterium
RCGEQG

SEQ ID NO: 993289 - protein, 10 aa, Mycobacterium
RCGSTDLGSL

SEQ ID NO: 993290 - protein, 8 aa, Mycobacterium
RCGSTGDR

SEQ ID NO: 993291 - protein, 21 aa, Mycobacterium
RCSPDYTSPVSEPFSEGSVSD

SEQ ID NO: 993292 - protein, 11 aa, Mycobacterium
RCTESSSELID

SEQ ID NO: 993293 - protein, 4 aa, Mycobacterium
RDAA

SEQ ID NO: 993294 - protein, 20 aa, Mycobacterium
RDAAARALDGTRRSGSADPL

SEQ ID NO: 993295 - protein, 5 aa, Mycobacterium
RDADL

SEQ ID NO: 993296 - protein, 4 aa, Mycobacterium
RDAG

SEQ ID NO: 993297 - protein, 10 aa, Mycobacterium
RDAGKVHASD

SEQ ID NO: 993298 - protein, 15 aa, Mycobacterium
RDAGPTRNSRHRHHP

SEQ ID NO: 993299 - protein, 7 aa, Mycobacterium
RDAHADA

SEQ ID NO: 993300 - protein, 10 aa, Mycobacterium
RDAKERKRVT

SEQ ID NO: 993301 - protein, 6 aa, Mycobacterium
RDAMTQ

SEQ ID NO: 993302 - protein, 5 aa, Mycobacterium
RDASL

SEQ ID NO: 993303 - protein, 7 aa, Mycobacterium
RDDAARN

SEQ ID NO: 993304 - protein, 19 aa, Mycobacterium
RDDATRYPTEFSGGQKQRI

SEQ ID NO: 993305 - protein, 9 aa, Mycobacterium
RDDDPEDAL

SEQ ID NO: 993306 - protein, 4 aa, Mycobacterium
RDDE

SEQ ID NO: 993307 - protein, 19 aa, Mycobacterium
RDDLQTARELAAGDESFAD

SEQ ID NO: 993308 - protein, 10 aa, Mycobacterium
RDDSTNPRPF

SEQ ID NO: 993309 - protein, 7 aa, Mycobacterium
RDDYGPD

SEQ ID NO: 993310 - protein, 8 aa, Mycobacterium
RDEGAGER

SEQ ID NO: 993311 - protein, 8 aa, Mycobacterium
RDEHAEAP

SEQ ID NO: 993312 - protein, 6 aa, Mycobacterium
RDEHGE

SEQ ID NO: 993313 - protein, 11 aa, Mycobacterium
RDELAGASMPT

SEQ ID NO: 993314 - protein, 4 aa, Mycobacterium
RDEM

SEQ ID NO: 993315 - protein, 6 aa, Mycobacterium
RDERGV

SEQ ID NO: 993316 - protein, 8 aa, Mycobacterium
RDESDPTL

SEQ ID NO: 993317 - protein, 4 aa, Mycobacterium
RDET

SEQ ID NO: 993318 - protein, 6 aa, Mycobacterium
RDETTR

SEQ ID NO: 993319 - protein, 15 aa, Mycobacterium
RDGDGRYGGKGVKRA

SEQ ID NO: 993320 - protein, 14 aa, Mycobacterium
RDGDRSQRWLGSVG

SEQ ID NO: 993321 - protein, 10 aa, Mycobacterium
RDGEIDPSVP

SEQ ID NO: 993322 - protein, 9 aa, Mycobacterium
RDGEVTRRQ

SEQ ID NO: 993323 - protein, 6 aa, Mycobacterium
RDGGDE

SEQ ID NO: 993324 - protein, 16 aa, Mycobacterium
RDGGDVGEVTWLSRGV

SEQ ID NO: 993325 - protein, 5 aa, Mycobacterium
RDGKI

SEQ ID NO: 993326 - protein, 13 aa, Mycobacterium
RDGKPVASAATGM

SEQ ID NO: 993327 - protein, 5 aa, Mycobacterium
RDGLT

SEQ ID NO: 993328 - protein, 6 aa, Mycobacterium
RDGMSI

SEQ ID NO: 993329 - protein, 8 aa, Mycobacterium
RDGPGSAI

SEQ ID NO: 993330 - protein, 29 aa, Mycobacterium
RDGRDAVADEIAASNAAVASRRSDPRLHN

SEQ ID NO: 993331 - protein, 14 aa, Mycobacterium
RDGRGSTLNEALHT

SEQ ID NO: 993332 - protein, 6 aa, Mycobacterium
RDGSDA

SEQ ID NO: 993333 - protein, 11 aa, Mycobacterium
RDGTKLAAETY

SEQ ID NO: 993334 - protein, 11 aa, Mycobacterium
RDGVSSSIGHG

SEQ ID NO: 993335 - protein, 8 aa, Mycobacterium
RDHPDDTV

SEQ ID NO: 993336 - protein, 13 aa, Mycobacterium
RDHPDFPEAAARL

SEQ ID NO: 993337 - protein, 8 aa, Mycobacterium
RDLAQPGD

SEQ ID NO: 993338 - protein, 15 aa, Mycobacterium
RDLDGELDAKQRTQL

SEQ ID NO: 993339 - protein, 4 aa, Mycobacterium
RDLS

SEQ ID NO: 993340 - protein, 9 aa, Mycobacterium
RDNTSTVPG

SEQ ID NO: 993341 - protein, 11 aa, Mycobacterium
RDPDGSVYPSA

SEQ ID NO: 993342 - protein, 14 aa, Mycobacterium
RDPDTGEPGQWTEP

SEQ ID NO: 993343 - protein, 17 aa, Mycobacterium
RDPEKAAQIREKDDAMD

SEQ ID NO: 993344 - protein, 9 aa, Mycobacterium
RDPGVPDGR

SEQ ID NO: 993345 - protein, 4 aa, Mycobacterium
RDPH

SEQ ID NO: 993346 - protein, 12 aa, Mycobacterium
RDPLTRHVRAAA

SEQ ID NO: 993347 - protein, 6 aa, Mycobacterium
RDPNDF

SEQ ID NO: 993348 - protein, 5 aa, Mycobacterium
RDPQL

SEQ ID NO: 993349 - protein, 5 aa, Mycobacterium
RDPQV

SEQ ID NO: 993350 - protein, 9 aa, Mycobacterium
RDPRAGATE

SEQ ID NO: 993351 - protein, 9 aa, Mycobacterium
RDPRASGEM

SEQ ID NO: 993352 - protein, 7 aa, Mycobacterium
RDPRDAA

SEQ ID NO: 993353 - protein, 15 aa, Mycobacterium
RDQADKPAATNSYPA

SEQ ID NO: 993354 - protein, 4 aa, Mycobacterium
RDQG

SEQ ID NO: 993355 - protein, 11 aa, Mycobacterium
RDQLRTKARTG

SEQ ID NO: 993356 - protein, 9 aa, Mycobacterium
RDQPDRSTV

SEQ ID NO: 993357 - protein, 4 aa, Mycobacterium
RDQT

SEQ ID NO: 993358 - protein, 4 aa, Mycobacterium
RDRA

SEQ ID NO: 993359 - protein, 7 aa, Mycobacterium
RDREVRR

SEQ ID NO: 993360 - protein, 5 aa, Mycobacterium
RDRFQ

SEQ ID NO: 993361 - protein, 29 aa, Mycobacterium
RDRHSRSAFAPPSLPRRHSGELLHAFQHP

SEQ ID NO: 993362 - protein, 9 aa, Mycobacterium
RDRNAHTDP

SEQ ID NO: 993363 - protein, 6 aa, Mycobacterium
RDRNGP

SEQ ID NO: 993364 - protein, 5 aa, Mycobacterium
RDRPD

SEQ ID NO: 993365 - protein, 9 aa, Mycobacterium
RDRRARKGE

SEQ ID NO: 993366 - protein, 11 aa, Mycobacterium
RDRRPLSPSLR

SEQ ID NO: 993367 - protein, 8 aa, Mycobacterium
RDRRSATE

SEQ ID NO: 993368 - protein, 11 aa, Mycobacterium
RDRRTKRGSRV

SEQ ID NO: 993369 - protein, 6 aa, Mycobacterium
RDRSDA

SEQ ID NO: 993370 - protein, 12 aa, Mycobacterium
RDSDSGRVSVVY

SEQ ID NO: 993371 - protein, 10 aa, Mycobacterium
RDSEDGAVTE

SEQ ID NO: 993372 - protein, 6 aa, Mycobacterium
RDSEID

SEQ ID NO: 993373 - protein, 4 aa, Mycobacterium
RDSG

SEQ ID NO: 993374 - protein, 7 aa, Mycobacterium
RDSGPIA

SEQ ID NO: 993375 - protein, 6 aa, Mycobacterium
RDSNRH

SEQ ID NO: 993376 - protein, 5 aa, Mycobacterium
RDTCT

SEQ ID NO: 993377 - protein, 4 aa, Mycobacterium
RDTD

SEQ ID NO: 993378 - protein, 6 aa, Mycobacterium
RDTDGK

SEQ ID NO: 993379 - protein, 6 aa, Mycobacterium
RDTGAD

SEQ ID NO: 993380 - protein, 4 aa, Mycobacterium
RDTI

SEQ ID NO: 993381 - protein, 7 aa, Mycobacterium
RDTKGYG

SEQ ID NO: 993382 - protein, 5 aa, Mycobacterium
RDTNR

SEQ ID NO: 993383 - protein, 4 aa, Mycobacterium
RDTQ

SEQ ID NO: 993384 - protein, 17 aa, Mycobacterium
RDTSLAVPNKTSTSYPV

SEQ ID NO: 993385 - protein, 9 aa, Mycobacterium
RDTTGADGA

SEQ ID NO: 993386 - protein, 6 aa, Mycobacterium
RDVDPA

SEQ ID NO: 993387 - protein, 21 aa, Mycobacterium
RDVGLSSRTDSTEQPCPSQPL

SEQ ID NO: 993388 - protein, 32 aa, Mycobacterium
RDVQRRGSPTNQTANNASKQCGRHPDNRQASF

SEQ ID NO: 993389 - protein, 7 aa, Mycobacterium
RDVRTGS

SEQ ID NO: 993390 - protein, 4 aa, Mycobacterium
RDYD

SEQ ID NO: 993391 - protein, 7 aa, Mycobacterium
RDYPDTT

SEQ ID NO: 993392 - protein, 5 aa, Mycobacterium
RDYTD

SEQ ID NO: 993393 - protein, 8 aa, Mycobacterium
REAAEPGE

SEQ ID NO: 993394 - protein, 31 aa, Mycobacterium
READDTDTVQVGGSGRNVSRGRRAQSEPVRS

SEQ ID NO: 993395 - protein, 4 aa, Mycobacterium
REAE

SEQ ID NO: 993396 - protein, 5 aa, Mycobacterium
REAHG

SEQ ID NO: 993397 - protein, 10 aa, Mycobacterium
REAIGDPTAH

SEQ ID NO: 993398 - protein, 9 aa, Mycobacterium
REATSIDPQ

SEQ ID NO: 993399 - protein, 8 aa, Mycobacterium
REATYRGV

SEQ ID NO: 993400 - protein, 5 aa, Mycobacterium
REDEA

SEQ ID NO: 993401 - protein, 8 aa, Mycobacterium
REDGREGD

SEQ ID NO: 993402 - protein, 10 aa, Mycobacterium
REDTDGSESV

SEQ ID NO: 993403 - protein, 7 aa, Mycobacterium
REDVERG

SEQ ID NO: 993404 - protein, 5 aa, Mycobacterium
REEPN

SEQ ID NO: 993405 - protein, 8 aa, Mycobacterium
REEVAADN

SEQ ID NO: 993406 - protein, 6 aa, Mycobacterium
REFPGD

SEQ ID NO: 993407 - protein, 23 aa, Mycobacterium
REGFGESATTATLGDPQIRDEEV

SEQ ID NO: 993408 - protein, 12 aa, Mycobacterium
REGGYADPRYGL

SEQ ID NO: 993409 - protein, 24 aa, Mycobacterium
REGNSDRRAPKAVKEYARNNPHSM

SEQ ID NO: 993410 - protein, 13 aa, Mycobacterium
RELAERDQPPSMK

SEQ ID NO: 993411 - protein, 9 aa, Mycobacterium
RELGSRSIT

SEQ ID NO: 993412 - protein, 4 aa, Mycobacterium
RELT

SEQ ID NO: 993413 - protein, 15 aa, Mycobacterium
RELTASDETAQTNSL

SEQ ID NO: 993414 - protein, 8 aa, Mycobacterium
RENADNRL

SEQ ID NO: 993415 - protein, 6 aa, Mycobacterium
RENSMG

SEQ ID NO: 993416 - protein, 22 aa, Mycobacterium
REPGREYAEDIETGSAAAALGG

SEQ ID NO: 993417 - protein, 4 aa, Mycobacterium
REPI

SEQ ID NO: 993418 - protein, 18 aa, Mycobacterium
REPRGPWGPGRLAEASDA

SEQ ID NO: 993419 - protein, 8 aa, Mycobacterium
REQAEDAI

SEQ ID NO: 993420 - protein, 10 aa, Mycobacterium
REQLTAPGNS

SEQ ID NO: 993421 - protein, 12 aa, Mycobacterium
REQLTGDEAHER

SEQ ID NO: 993422 - protein, 14 aa, Mycobacterium
REQSGPVDSGAIGR

SEQ ID NO: 993423 - protein, 6 aa, Mycobacterium
REQSMP

SEQ ID NO: 993424 - protein, 8 aa, Mycobacterium
REQSRPEL

SEQ ID NO: 993425 - protein, 21 aa, Mycobacterium
RERAEETRIDTRSRVEESRAR

SEQ ID NO: 993426 - protein, 4 aa, Mycobacterium
RERI

SEQ ID NO: 993427 - protein, 5 aa, Mycobacterium
RERLT

SEQ ID NO: 993428 - protein, 9 aa, Mycobacterium
RERQGTKRP

SEQ ID NO: 993429 - protein, 8 aa, Mycobacterium
RERRRGVG

SEQ ID NO: 993430 - protein, 5 aa, Mycobacterium
RERYD

SEQ ID NO: 993431 - protein, 9 aa, Mycobacterium
RESAAGAAI

SEQ ID NO: 993432 - protein, 9 aa, Mycobacterium
RESGDDVGG

SEQ ID NO: 993433 - protein, 8 aa, Mycobacterium
RESGGAIA

SEQ ID NO: 993434 - protein, 10 aa, Mycobacterium
RESGSLEQDA

SEQ ID NO: 993435 - protein, 4 aa, Mycobacterium
RESH

SEQ ID NO: 993436 - protein, 5 aa, Mycobacterium
RESHR

SEQ ID NO: 993437 - protein, 12 aa, Mycobacterium
RETAPPAGPGLV

SEQ ID NO: 993438 - protein, 4 aa, Mycobacterium
RETE

SEQ ID NO: 993439 - protein, 6 aa, Mycobacterium
RETFEE

SEQ ID NO: 993440 - protein, 7 aa, Mycobacterium
RETGDIA

SEQ ID NO: 993441 - protein, 5 aa, Mycobacterium
RETGK

SEQ ID NO: 993442 - protein, 4 aa, Mycobacterium
RETI

SEQ ID NO: 993443 - protein, 4 aa, Mycobacterium
RETT

SEQ ID NO: 993444 - protein, 4 aa, Mycobacterium
REVA

SEQ ID NO: 993445 - protein, 10 aa, Mycobacterium
REVTATTHHQ

SEQ ID NO: 993446 - protein, 6 aa, Mycobacterium
REVTSA

SEQ ID NO: 993447 - protein, 12 aa, Mycobacterium
RFEGTSGDGGDV

SEQ ID NO: 993448 - protein, 14 aa, Mycobacterium
RFGGHTRDHGKAPV

SEQ ID NO: 993449 - protein, 5 aa, Mycobacterium
RFGPD

SEQ ID NO: 993450 - protein, 5 aa, Mycobacterium
RFGPG

SEQ ID NO: 993451 - protein, 11 aa, Mycobacterium
RFPDGPPNGYV

SEQ ID NO: 993452 - protein, 7 aa, Mycobacterium
RFPESEL

SEQ ID NO: 993453 - protein, 22 aa, Mycobacterium
RFPTEPPAAPLPGHTDGTSPRA

SEQ ID NO: 993454 - protein, 6 aa, Mycobacterium
RFRDGT

SEQ ID NO: 993455 - protein, 20 aa, Mycobacterium
RFRQPGHAEFEDRAATDPLE

SEQ ID NO: 993456 - protein, 12 aa, Mycobacterium
RFSESQSSCVTP

SEQ ID NO: 993457 - protein, 17 aa, Mycobacterium
RFSRTTPDRPRSPAASV

SEQ ID NO: 993458 - protein, 6 aa, Mycobacterium
RFTDHN

SEQ ID NO: 993459 - protein, 5 aa, Mycobacterium
RGAAA

SEQ ID NO: 993460 - protein, 9 aa, Mycobacterium
RGAARHAGQ

SEQ ID NO: 993461 - protein, 7 aa, Mycobacterium
RGADGGV

SEQ ID NO: 993462 - protein, 6 aa, Mycobacterium
RGADLG

SEQ ID NO: 993463 - protein, 9 aa, Mycobacterium
RGAEIGPGV

SEQ ID NO: 993464 - protein, 5 aa, Mycobacterium
RGAGA

SEQ ID NO: 993465 - protein, 5 aa, Mycobacterium
RGAGG

SEQ ID NO: 993466 - protein, 15 aa, Mycobacterium
RGAGSGLSGGATALD

SEQ ID NO: 993467 - protein, 4 aa, Mycobacterium
RGAQ

SEQ ID NO: 993468 - protein, 14 aa, Mycobacterium
RGAQGAEPRSGDGA

SEQ ID NO: 993469 - protein, 6 aa, Mycobacterium
RGAREP

SEQ ID NO: 993470 - protein, 13 aa, Mycobacterium
RGATATSSSETIA

SEQ ID NO: 993471 - protein, 14 aa, Mycobacterium
RGAVRDTSAGDEGQ

SEQ ID NO: 993472 - protein, 8 aa, Mycobacterium
RGDDQNAV

SEQ ID NO: 993473 - protein, 4 aa, Mycobacterium
RGDG

SEQ ID NO: 993474 - protein, 8 aa, Mycobacterium
RGDGTHRV

SEQ ID NO: 993475 - protein, 9 aa, Mycobacterium
RGDPDSGVA

SEQ ID NO: 993476 - protein, 7 aa, Mycobacterium
RGDPRGH

SEQ ID NO: 993477 - protein, 9 aa, Mycobacterium
RGDRGSLDH

SEQ ID NO: 993478 - protein, 9 aa, Mycobacterium
RGDTGPELL

SEQ ID NO: 993479 - protein, 5 aa, Mycobacterium
RGDTT

SEQ ID NO: 993480 - protein, 5 aa, Mycobacterium
RGEAA

SEQ ID NO: 993481 - protein, 7 aa, Mycobacterium
RGEAAKQ

SEQ ID NO: 993482 - protein, 12 aa, Mycobacterium
RGEDVTASDPEY

SEQ ID NO: 993483 - protein, 7 aa, Mycobacterium
RGEGYQS

SEQ ID NO: 993484 - protein, 5 aa, Mycobacterium
RGEIA

SEQ ID NO: 993485 - protein, 6 aa, Mycobacterium
RGELDE

SEQ ID NO: 993486 - protein, 7 aa, Mycobacterium
RGELQDQ

SEQ ID NO: 993487 - protein, 4 aa, Mycobacterium
RGEM

SEQ ID NO: 993488 - protein, 6 aa, Mycobacterium
RGEPCR

SEQ ID NO: 993489 - protein, 13 aa, Mycobacterium
RGEQSGPTQLTQP

SEQ ID NO: 993490 - protein, 29 aa, Mycobacterium
RGERADGGESIAAPEDELASRRKHRDRKI

SEQ ID NO: 993491 - protein, 6 aa, Mycobacterium
RGESLN

SEQ ID NO: 993492 - protein, 22 aa, Mycobacterium
RGETADVGKKHCRGAPRAPTPT

SEQ ID NO: 993493 - protein, 16 aa, Mycobacterium
RGFCSGADQKFTAPVP

SEQ ID NO: 993494 - protein, 5 aa, Mycobacterium
RGFTA

SEQ ID NO: 993495 - protein, 7 aa, Mycobacterium
RGFTGDL

SEQ ID NO: 993496 - protein, 4 aa, Mycobacterium
RGGA

SEQ ID NO: 993497 - protein, 10 aa, Mycobacterium
RGGAGRTWQP

SEQ ID NO: 993498 - protein, 5 aa, Mycobacterium
RGGAT

SEQ ID NO: 993499 - protein, 12 aa, Mycobacterium
RGGDDDSEISDG

SEQ ID NO: 993500 - protein, 5 aa, Mycobacterium
RGGFH

SEQ ID NO: 993501 - protein, 4 aa, Mycobacterium
RGGG

SEQ ID NO: 993502 - protein, 5 aa, Mycobacterium
RGGGF

SEQ ID NO: 993503 - protein, 4 aa, Mycobacterium
RGGL

SEQ ID NO: 993504 - protein, 8 aa, Mycobacterium
RGGLTPKH

SEQ ID NO: 993505 - protein, 16 aa, Mycobacterium
RGGMQNNVGLELRVSG

SEQ ID NO: 993506 - protein, 24 aa, Mycobacterium
RGGQPVTGHPTNNPSADSLATNGK

SEQ ID NO: 993507 - protein, 14 aa, Mycobacterium
RGGTARTQTGSIKL

SEQ ID NO: 993508 - protein, 8 aa, Mycobacterium
RGGTPDEV

SEQ ID NO: 993509 - protein, 14 aa, Mycobacterium
RGGTVGRGGGPSYQ

SEQ ID NO: 993510 - protein, 4 aa, Mycobacterium
RGGV

SEQ ID NO: 993511 - protein, 21 aa, Mycobacterium
RGGVARGRQTGLSRGGGVRGV

SEQ ID NO: 993512 - protein, 11 aa, Mycobacterium
RGGVPGTRETD

SEQ ID NO: 993513 - protein, 8 aa, Mycobacterium
RGGYGDEH

SEQ ID NO: 993514 - protein, 6 aa, Mycobacterium
RGHADE

SEQ ID NO: 993515 - protein, 28 aa, Mycobacterium
RGHLPGDPSPFINDNSPELVNGDSLLFG

SEQ ID NO: 993516 - protein, 13 aa, Mycobacterium
RGHNEGDDPSMTN

SEQ ID NO: 993517 - protein, 5 aa, Mycobacterium
RGIAQ

SEQ ID NO: 993518 - protein, 6 aa, Mycobacterium
RGIGRD

SEQ ID NO: 993519 - protein, 4 aa, Mycobacterium
RGIQ

SEQ ID NO: 993520 - protein, 7 aa, Mycobacterium
RGITPAA

SEQ ID NO: 993521 - protein, 7 aa, Mycobacterium
RGKEAHE

SEQ ID NO: 993522 - protein, 14 aa, Mycobacterium
RGKEAIEGDRVPRA

SEQ ID NO: 993523 - protein, 9 aa, Mycobacterium
RGKLNPAPI

SEQ ID NO: 993524 - protein, 6 aa, Mycobacterium
RGKTRL

SEQ ID NO: 993525 - protein, 5 aa, Mycobacterium
RGKWD

SEQ ID NO: 993526 - protein, 4 aa, Mycobacterium
RGLA

SEQ ID NO: 993527 - protein, 7 aa, Mycobacterium
RGLEPDK

SEQ ID NO: 993528 - protein, 5 aa, Mycobacterium
RGLGE

SEQ ID NO: 993529 - protein, 12 aa, Mycobacterium
RGLQGDKKVRSV

SEQ ID NO: 993530 - protein, 6 aa, Mycobacterium
RGLSAG

SEQ ID NO: 993531 - protein, 9 aa, Mycobacterium
RGMADQSRT

SEQ ID NO: 993532 - protein, 4 aa, Mycobacterium
RGMG

SEQ ID NO: 993533 - protein, 7 aa, Mycobacterium
RGNGQWT

SEQ ID NO: 993534 - protein, 7 aa, Mycobacterium
RGNRGAV

SEQ ID NO: 993535 - protein, 6 aa, Mycobacterium
RGNRGS

SEQ ID NO: 993536 - protein, 13 aa, Mycobacterium
RGNSIHGNWEYST

SEQ ID NO: 993537 - protein, 5 aa, Mycobacterium
RGNTW

SEQ ID NO: 993538 - protein, 13 aa, Mycobacterium
RGPADDPQVTDDG

SEQ ID NO: 993539 - protein, 5 aa, Mycobacterium
RGPAE

SEQ ID NO: 993540 - protein, 6 aa, Mycobacterium
RGPDAT

SEQ ID NO: 993541 - protein, 6 aa, Mycobacterium
RGPDER

SEQ ID NO: 993542 - protein, 9 aa, Mycobacterium
RGPGSTPLW

SEQ ID NO: 993543 - protein, 5 aa, Mycobacterium
RGPLQ

SEQ ID NO: 993544 - protein, 11 aa, Mycobacterium
RGPLTNEEATA

SEQ ID NO: 993545 - protein, 5 aa, Mycobacterium
RGPQV

SEQ ID NO: 993546 - protein, 8 aa, Mycobacterium
RGPSGQAE

SEQ ID NO: 993547 - protein, 7 aa, Mycobacterium
RGPTGFI

SEQ ID NO: 993548 - protein, 19 aa, Mycobacterium
RGPTGVIGTNKKDSQDTVD

SEQ ID NO: 993549 - protein, 8 aa, Mycobacterium
RGPVGSDQ

SEQ ID NO: 993550 - protein, 5 aa, Mycobacterium
RGPVN

SEQ ID NO: 993551 - protein, 7 aa, Mycobacterium
RGQAGIT

SEQ ID NO: 993552 - protein, 7 aa, Mycobacterium
RGQEAAG

SEQ ID NO: 993553 - protein, 8 aa, Mycobacterium
RGRAGHGS

SEQ ID NO: 993554 - protein, 16 aa, Mycobacterium
RGRARSVTGIAPAGGW

SEQ ID NO: 993555 - protein, 8 aa, Mycobacterium
RGRASAEQ

SEQ ID NO: 993556 - protein, 4 aa, Mycobacterium
RGRG

SEQ ID NO: 993557 - protein, 5 aa, Mycobacterium
RGRRL

SEQ ID NO: 993558 - protein, 6 aa, Mycobacterium
RGRSYR

SEQ ID NO: 993559 - protein, 4 aa, Mycobacterium
RGRT

SEQ ID NO: 993560 - protein, 6 aa, Mycobacterium
RGRTDA

SEQ ID NO: 993561 - protein, 6 aa, Mycobacterium
RGSDVD

SEQ ID NO: 993562 - protein, 4 aa, Mycobacterium
RGSE

SEQ ID NO: 993563 - protein, 6 aa, Mycobacterium
RGSELG

SEQ ID NO: 993564 - protein, 34 aa, Mycobacterium
RGSKTTRTRVGRGEASKGKTAGRGTKGTKARKQV

SEQ ID NO: 993565 - protein, 10 aa, Mycobacterium
RGSLDCGESD

SEQ ID NO: 993566 - protein, 9 aa, Mycobacterium
RGSNRTGGD

SEQ ID NO: 993567 - protein, 14 aa, Mycobacterium
RGSRKAEEAAESAR

SEQ ID NO: 993568 - protein, 10 aa, Mycobacterium
RGSSPGGDLA

SEQ ID NO: 993569 - protein, 12 aa, Mycobacterium
RGSSSAAKSNQA

SEQ ID NO: 993570 - protein, 16 aa, Mycobacterium
RGSYSHPGSPNSPDVW

SEQ ID NO: 993571 - protein, 8 aa, Mycobacterium
RGTAAKER

SEQ ID NO: 993572 - protein, 8 aa, Mycobacterium
RGTAETAG

SEQ ID NO: 993573 - protein, 6 aa, Mycobacterium
RGTARR

SEQ ID NO: 993574 - protein, 12 aa, Mycobacterium
RGTDGSPDRKGV

SEQ ID NO: 993575 - protein, 5 aa, Mycobacterium
RGTDI

SEQ ID NO: 993576 - protein, 17 aa, Mycobacterium
RGTDKDRKNPTKLRERA

SEQ ID NO: 993577 - protein, 13 aa, Mycobacterium
RGTGGLANAVGRS

SEQ ID NO: 993578 - protein, 5 aa, Mycobacterium
RGTGI

SEQ ID NO: 993579 - protein, 17 aa, Mycobacterium
RGTKAKIRDTRKTLPGL

SEQ ID NO: 993580 - protein, 19 aa, Mycobacterium
RGTQRGRIRSGDRALEGAQ

SEQ ID NO: 993581 - protein, 7 aa, Mycobacterium
RGTTGHD

SEQ ID NO: 993582 - protein, 23 aa, Mycobacterium
RGVAETDARARIAAQASDEERRA

SEQ ID NO: 993583 - protein, 4 aa, Mycobacterium
RGVD

SEQ ID NO: 993584 - protein, 14 aa, Mycobacterium
RGVGETRSCGTGTV

SEQ ID NO: 993585 - protein, 9 aa, Mycobacterium
RGVHPGDPY

SEQ ID NO: 993586 - protein, 5 aa, Mycobacterium
RGVNR

SEQ ID NO: 993587 - protein, 4 aa, Mycobacterium
RGVP

SEQ ID NO: 993588 - protein, 11 aa, Mycobacterium
RGVPKRSGGHG

SEQ ID NO: 993589 - protein, 13 aa, Mycobacterium
RGWRADNTDIDGV

SEQ ID NO: 993590 - protein, 5 aa, Mycobacterium
RGYAY

SEQ ID NO: 993591 - protein, 6 aa, Mycobacterium
RGYDST

SEQ ID NO: 993592 - protein, 6 aa, Mycobacterium
RGYSQT

SEQ ID NO: 993593 - protein, 7 aa, Mycobacterium
RHADPGS

SEQ ID NO: 993594 - protein, 5 aa, Mycobacterium
RHAPN

SEQ ID NO: 993595 - protein, 4 aa, Mycobacterium
RHAR

SEQ ID NO: 993596 - protein, 5 aa, Mycobacterium
RHARG

SEQ ID NO: 993597 - protein, 8 aa, Mycobacterium
RHDPNDTA

SEQ ID NO: 993598 - protein, 14 aa, Mycobacterium
RHDQPYKESYGMAS

SEQ ID NO: 993599 - protein, 21 aa, Mycobacterium
RHDRAGYGSGNSRNGTRSKTV

SEQ ID NO: 993600 - protein, 10 aa, Mycobacterium
RHDSSDKIEA

SEQ ID NO: 993601 - protein, 9 aa, Mycobacterium
RHEEVDQRR

SEQ ID NO: 993602 - protein, 29 aa, Mycobacterium
RHEKPVQPNLPDNAGKIAAAPRQTLGAQL

SEQ ID NO: 993603 - protein, 6 aa, Mycobacterium
RHPAVQ

SEQ ID NO: 993604 - protein, 7 aa, Mycobacterium
RHPGETA

SEQ ID NO: 993605 - protein, 16 aa, Mycobacterium
RHPGRTKAWLQNNGRT

SEQ ID NO: 993606 - protein, 6 aa, Mycobacterium
RHPQRG

SEQ ID NO: 993607 - protein, 5 aa, Mycobacterium
RHPYG

SEQ ID NO: 993608 - protein, 12 aa, Mycobacterium
RHQKSEGRLDSP

SEQ ID NO: 993609 - protein, 6 aa, Mycobacterium
RHQQTL

SEQ ID NO: 993610 - protein, 10 aa, Mycobacterium
RHRAHTGNGA

SEQ ID NO: 993611 - protein, 11 aa, Mycobacterium
RHRESDAALVG

SEQ ID NO: 993612 - protein, 9 aa, Mycobacterium
RHRGSDAAC

SEQ ID NO: 993613 - protein, 11 aa, Mycobacterium
RHRPANPTQCS

SEQ ID NO: 993614 - protein, 17 aa, Mycobacterium
RHRSNNAPGLDTQLQQA

SEQ ID NO: 993615 - protein, 9 aa, Mycobacterium
RHSATSSLL

SEQ ID NO: 993616 - protein, 11 aa, Mycobacterium
RHSESDYEPTR

SEQ ID NO: 993617 - protein, 6 aa, Mycobacterium
RHSGGL

SEQ ID NO: 993618 - protein, 8 aa, Mycobacterium
RHSGGPPL

SEQ ID NO: 993619 - protein, 5 aa, Mycobacterium
RIAQE

SEQ ID NO: 993620 - protein, 8 aa, Mycobacterium
RIASSAQL

SEQ ID NO: 993621 - protein, 6 aa, Mycobacterium
RIGPGQ

SEQ ID NO: 993622 - protein, 14 aa, Mycobacterium
RINPQVNATQHVNR

SEQ ID NO: 993623 - protein, 12 aa, Mycobacterium
RIPADRSNWGDV

SEQ ID NO: 993624 - protein, 7 aa, Mycobacterium
RIPNTGI

SEQ ID NO: 993625 - protein, 12 aa, Mycobacterium
RIPPANAERGER

SEQ ID NO: 993626 - protein, 7 aa, Mycobacterium
RIPPGSL

SEQ ID NO: 993627 - protein, 11 aa, Mycobacterium
RIPPNTGNAIR

SEQ ID NO: 993628 - protein, 8 aa, Mycobacterium
RIPTGHEE

SEQ ID NO: 993629 - protein, 6 aa, Mycobacterium
RIPTRH

SEQ ID NO: 993630 - protein, 23 aa, Mycobacterium
RIQPTTVKSRRSRTPALDAGREL

SEQ ID NO: 993631 - protein, 8 aa, Mycobacterium
RIRPGKAQ

SEQ ID NO: 993632 - protein, 8 aa, Mycobacterium
RIRSDRPP

SEQ ID NO: 993633 - protein, 8 aa, Mycobacterium
RIRTDSAI

SEQ ID NO: 993634 - protein, 17 aa, Mycobacterium
RISESRAEGASDDASWV

SEQ ID NO: 993635 - protein, 9 aa, Mycobacterium
RISGKKGER

SEQ ID NO: 993636 - protein, 13 aa, Mycobacterium
RISGSSNDEWVDG

SEQ ID NO: 993637 - protein, 10 aa, Mycobacterium
RISGTSPDGY

SEQ ID NO: 993638 - protein, 20 aa, Mycobacterium
RISPAKNPLAQIQLGANWIG

SEQ ID NO: 993639 - protein, 10 aa, Mycobacterium
RITPGSGEKR

SEQ ID NO: 993640 - protein, 4 aa, Mycobacterium
RITS

SEQ ID NO: 993641 - protein, 11 aa, Mycobacterium
RITSTRGRSIT

SEQ ID NO: 993642 - protein, 21 aa, Mycobacterium
RKAAEEPVEVPERSDVPSDVE

SEQ ID NO: 993643 - protein, 20 aa, Mycobacterium
RKAGETAATRWSSDGEATYT

SEQ ID NO: 993644 - protein, 5 aa, Mycobacterium
RKAGH

SEQ ID NO: 993645 - protein, 8 aa, Mycobacterium
RKAKEQQL

SEQ ID NO: 993646 - protein, 22 aa, Mycobacterium
RKAKVEGIPDTESAVTPDLLED

SEQ ID NO: 993647 - protein, 9 aa, Mycobacterium
RKAPNRGTD

SEQ ID NO: 993648 - protein, 21 aa, Mycobacterium
RKDDRYPAGSARFARSGPGRR

SEQ ID NO: 993649 - protein, 6 aa, Mycobacterium
RKDGGL

SEQ ID NO: 993650 - protein, 8 aa, Mycobacterium
RKEDTEER

SEQ ID NO: 993651 - protein, 8 aa, Mycobacterium
RKEIHESA

SEQ ID NO: 993652 - protein, 6 aa, Mycobacterium
RKETGV

SEQ ID NO: 993653 - protein, 7 aa, Mycobacterium
RKEVTPA

SEQ ID NO: 993654 - protein, 17 aa, Mycobacterium
RKGDTDAYSLSREEVAE

SEQ ID NO: 993655 - protein, 7 aa, Mycobacterium
RKGQAVG

SEQ ID NO: 993656 - protein, 7 aa, Mycobacterium
RKGQTVR

SEQ ID NO: 993657 - protein, 7 aa, Mycobacterium
RKGRMEE

SEQ ID NO: 993658 - protein, 5 aa, Mycobacterium
RKHRI

SEQ ID NO: 993659 - protein, 14 aa, Mycobacterium
RKHSRYKPPNPARE

SEQ ID NO: 993660 - protein, 8 aa, Mycobacterium
RKITSSSW

SEQ ID NO: 993661 - protein, 18 aa, Mycobacterium
RKKAGLSGYPSRAESEHD

SEQ ID NO: 993662 - protein, 16 aa, Mycobacterium
RKKGYGTAALRKSRSE

SEQ ID NO: 993663 - protein, 17 aa, Mycobacterium
RKLNTAKIATSADPEPI

SEQ ID NO: 993664 - protein, 10 aa, Mycobacterium
RKMSKSRGNV

SEQ ID NO: 993665 - protein, 8 aa, Mycobacterium
RKNSLEDS

SEQ ID NO: 993666 - protein, 9 aa, Mycobacterium
RKPDGGWGE

SEQ ID NO: 993667 - protein, 13 aa, Mycobacterium
RKPEDTGGTFSAA

SEQ ID NO: 993668 - protein, 7 aa, Mycobacterium
RKPEHAA

SEQ ID NO: 993669 - protein, 32 aa, Mycobacterium
RKPGAITTTSAVRGQFKTDAASRAEALGLILR

SEQ ID NO: 993670 - protein, 9 aa, Mycobacterium
RKPRTDPAF

SEQ ID NO: 993671 - protein, 7 aa, Mycobacterium
RKPRTLA

SEQ ID NO: 993672 - protein, 13 aa, Mycobacterium
RKPSQLSGGQRQR

SEQ ID NO: 993673 - protein, 11 aa, Mycobacterium
RKPSTEPDLAK

SEQ ID NO: 993674 - protein, 14 aa, Mycobacterium
RKQPHPSPIIPPRG

SEQ ID NO: 993675 - protein, 4 aa, Mycobacterium
RKRM

SEQ ID NO: 993676 - protein, 9 aa, Mycobacterium
RKRNPDLDE

SEQ ID NO: 993677 - protein, 29 aa, Mycobacterium
RKRPGSAAAQAAEKASTRTGKQSQQKSEP

SEQ ID NO: 993678 - protein, 7 aa, Mycobacterium
RKRRQPV

SEQ ID NO: 993679 - protein, 13 aa, Mycobacterium
RKSATDLGGLPGK

SEQ ID NO: 993680 - protein, 9 aa, Mycobacterium
RKSDAGQQV

SEQ ID NO: 993681 - protein, 7 aa, Mycobacterium
RKSGALP

SEQ ID NO: 993682 - protein, 10 aa, Mycobacterium
RKSLTLDPQR

SEQ ID NO: 993683 - protein, 7 aa, Mycobacterium
RKTDATD

SEQ ID NO: 993684 - protein, 7 aa, Mycobacterium
RKTLNDD

SEQ ID NO: 993685 - protein, 17 aa, Mycobacterium
RKTQRAHAPYDVVEALA

SEQ ID NO: 993686 - protein, 6 aa, Mycobacterium
RKTTVP

SEQ ID NO: 993687 - protein, 4 aa, Mycobacterium
RKWT

SEQ ID NO: 993688 - protein, 5 aa, Mycobacterium
RLAAG

SEQ ID NO: 993689 - protein, 12 aa, Mycobacterium
RLAGEERAPAPT

SEQ ID NO: 993690 - protein, 16 aa, Mycobacterium
RLASEKNGVMICTDCT

SEQ ID NO: 993691 - protein, 9 aa, Mycobacterium
RLDATQGTR

SEQ ID NO: 993692 - protein, 15 aa, Mycobacterium
RLDKPGGGLSGGQQQ

SEQ ID NO: 993693 - protein, 7 aa, Mycobacterium
RLEERAE

SEQ ID NO: 993694 - protein, 13 aa, Mycobacterium
RLEQSGPTVSQTV

SEQ ID NO: 993695 - protein, 5 aa, Mycobacterium
RLEST

SEQ ID NO: 993696 - protein, 4 aa, Mycobacterium
RLET

SEQ ID NO: 993697 - protein, 7 aa, Mycobacterium
RLETGPH

SEQ ID NO: 993698 - protein, 12 aa, Mycobacterium
RLGARPSKATIL

SEQ ID NO: 993699 - protein, 7 aa, Mycobacterium
RLGARRP

SEQ ID NO: 993700 - protein, 5 aa, Mycobacterium
RLGDA

SEQ ID NO: 993701 - protein, 12 aa, Mycobacterium
RLGGVGGAQVRS

SEQ ID NO: 993702 - protein, 6 aa, Mycobacterium
RLGPDL

SEQ ID NO: 993703 - protein, 4 aa, Mycobacterium
RLGQ

SEQ ID NO: 993704 - protein, 9 aa, Mycobacterium
RLGQPPSGY

SEQ ID NO: 993705 - protein, 4 aa, Mycobacterium
RLGT

SEQ ID NO: 993706 - protein, 18 aa, Mycobacterium
RLGVGSDTVRTNANADAW

SEQ ID NO: 993707 - protein, 9 aa, Mycobacterium
RLNSAGLED

SEQ ID NO: 993708 - protein, 4 aa, Mycobacterium
RLPD

SEQ ID NO: 993709 - protein, 6 aa, Mycobacterium
RLPDEA

SEQ ID NO: 993710 - protein, 7 aa, Mycobacterium
RLPDGGF

SEQ ID NO: 993711 - protein, 6 aa, Mycobacterium
RLPDKA

SEQ ID NO: 993712 - protein, 13 aa, Mycobacterium
RLPPPATESETLA

SEQ ID NO: 993713 - protein, 22 aa, Mycobacterium
RLPSEETRRPNAPGVTGTRCTA

SEQ ID NO: 993714 - protein, 12 aa, Mycobacterium
RLQRRTASAVSS

SEQ ID NO: 993715 - protein, 22 aa, Mycobacterium
RLRRGKDRRKVHYGDKTPVSVA

SEQ ID NO: 993716 - protein, 8 aa, Mycobacterium
RLSDQELR

SEQ ID NO: 993717 - protein, 10 aa, Mycobacterium
RLSENGPPPV

SEQ ID NO: 993718 - protein, 12 aa, Mycobacterium
RLSERAEGTITA

SEQ ID NO: 993719 - protein, 14 aa, Mycobacterium
RLSGEVTVGGAKNS

SEQ ID NO: 993720 - protein, 9 aa, Mycobacterium
RLSGGQQQR

SEQ ID NO: 993721 - protein, 7 aa, Mycobacterium
RLSPPAK

SEQ ID NO: 993722 - protein, 8 aa, Mycobacterium
RLSPRTAT

SEQ ID NO: 993723 - protein, 20 aa, Mycobacterium
RLSSSGQLAPVTGFSSDSPI

SEQ ID NO: 993724 - protein, 10 aa, Mycobacterium
RLTETKGKLN

SEQ ID NO: 993725 - protein, 12 aa, Mycobacterium
RLTGKSKDEVNT

SEQ ID NO: 993726 - protein, 5 aa, Mycobacterium
RLTGR

SEQ ID NO: 993727 - protein, 9 aa, Mycobacterium
RLTGSKDAP

SEQ ID NO: 993728 - protein, 10 aa, Mycobacterium
RLTPRSNTRQ

SEQ ID NO: 993729 - protein, 9 aa, Mycobacterium
RLTPTGKDS

SEQ ID NO: 993730 - protein, 6 aa, Mycobacterium
RMGPEY

SEQ ID NO: 993731 - protein, 27 aa, Mycobacterium
RNAEPVLSSKNDLDLNPTTLPSVNGSD

SEQ ID NO: 993732 - protein, 9 aa, Mycobacterium
RNAKAAVEE

SEQ ID NO: 993733 - protein, 4 aa, Mycobacterium
RNCN

SEQ ID NO: 993734 - protein, 9 aa, Mycobacterium
RNDTDGVNA

SEQ ID NO: 993735 - protein, 8 aa, Mycobacterium
RNEADVPS

SEQ ID NO: 993736 - protein, 11 aa, Mycobacterium
RNEDGKNITKD

SEQ ID NO: 993737 - protein, 5 aa, Mycobacterium
RNEIT

SEQ ID NO: 993738 - protein, 5 aa, Mycobacterium
RNGFE

SEQ ID NO: 993739 - protein, 6 aa, Mycobacterium
RNGGER

SEQ ID NO: 993740 - protein, 23 aa, Mycobacterium
RNGHNVSTRGRIPADVIDAFHAA

SEQ ID NO: 993741 - protein, 10 aa, Mycobacterium
RNGKGQKKLR

SEQ ID NO: 993742 - protein, 6 aa, Mycobacterium
RNGNEV

SEQ ID NO: 993743 - protein, 5 aa, Mycobacterium
RNGVA

SEQ ID NO: 993744 - protein, 5 aa, Mycobacterium
RNNNQ

SEQ ID NO: 993745 - protein, 5 aa, Mycobacterium
RNNPR

SEQ ID NO: 993746 - protein, 9 aa, Mycobacterium
RNNRETGEA

SEQ ID NO: 993747 - protein, 7 aa, Mycobacterium
RNNTATA

SEQ ID NO: 993748 - protein, 8 aa, Mycobacterium
RNPDKASR

SEQ ID NO: 993749 - protein, 6 aa, Mycobacterium
RNPDMA

SEQ ID NO: 993750 - protein, 5 aa, Mycobacterium
RNPEI

SEQ ID NO: 993751 - protein, 11 aa, Mycobacterium
RNPENTERTFG

SEQ ID NO: 993752 - protein, 19 aa, Mycobacterium
RNPWDTDYTAGASSSGSGA

SEQ ID NO: 993753 - protein, 20 aa, Mycobacterium
RNQHSVNANDVTELATSATE

SEQ ID NO: 993754 - protein, 6 aa, Mycobacterium
RNRITG

SEQ ID NO: 993755 - protein, 10 aa, Mycobacterium
RNRNEITAEE

SEQ ID NO: 993756 - protein, 5 aa, Mycobacterium
RNRPL

SEQ ID NO: 993757 - protein, 8 aa, Mycobacterium
RNSAKSKR

SEQ ID NO: 993758 - protein, 9 aa, Mycobacterium
RNSDEQMAP

SEQ ID NO: 993759 - protein, 21 aa, Mycobacterium
RNSHPPGVITPDAKGIYYSRF

SEQ ID NO: 993760 - protein, 6 aa, Mycobacterium
RNSPKQ

SEQ ID NO: 993761 - protein, 7 aa, Mycobacterium
RNSTPGV

SEQ ID NO: 993762 - protein, 4 aa, Mycobacterium
RNSV

SEQ ID NO: 993763 - protein, 11 aa, Mycobacterium
RNTAKRAGHDW

SEQ ID NO: 993764 - protein, 9 aa, Mycobacterium
RNTGEESYI

SEQ ID NO: 993765 - protein, 6 aa, Mycobacterium
RNTRDG

SEQ ID NO: 993766 - protein, 11 aa, Mycobacterium
RNYMNESGQQV

SEQ ID NO: 993767 - protein, 6 aa, Mycobacterium
RPADCT

SEQ ID NO: 993768 - protein, 12 aa, Mycobacterium
RPADGSCANCGG

SEQ ID NO: 993769 - protein, 4 aa, Mycobacterium
RPAL

SEQ ID NO: 993770 - protein, 6 aa, Mycobacterium
RPANTL

SEQ ID NO: 993771 - protein, 11 aa, Mycobacterium
RPAPERVPAGH

SEQ ID NO: 993772 - protein, 29 aa, Mycobacterium
RPATGHKSTGSRRRQHKPPEDRQYRPNIS

SEQ ID NO: 993773 - protein, 6 aa, Mycobacterium
RPATQH

SEQ ID NO: 993774 - protein, 7 aa, Mycobacterium
RPATSLA

SEQ ID NO: 993775 - protein, 14 aa, Mycobacterium
RPAVYAPKSALGHS

SEQ ID NO: 993776 - protein, 19 aa, Mycobacterium
RPDAASGRRGKPEPSPVAR

SEQ ID NO: 993777 - protein, 9 aa, Mycobacterium
RPDAGEALS

SEQ ID NO: 993778 - protein, 14 aa, Mycobacterium
RPDANAARLRSSAR

SEQ ID NO: 993779 - protein, 11 aa, Mycobacterium
RPDEVAARRGL

SEQ ID NO: 993780 - protein, 5 aa, Mycobacterium
RPDIP

SEQ ID NO: 993781 - protein, 6 aa, Mycobacterium
RPDLDG

SEQ ID NO: 993782 - protein, 11 aa, Mycobacterium
RPDNERRNRSL

SEQ ID NO: 993783 - protein, 4 aa, Mycobacterium
RPDQ

SEQ ID NO: 993784 - protein, 4 aa, Mycobacterium
RPDR

SEQ ID NO: 993785 - protein, 14 aa, Mycobacterium
RPDRLGSGDVGANT

SEQ ID NO: 993786 - protein, 6 aa, Mycobacterium
RPDRMS

SEQ ID NO: 993787 - protein, 21 aa, Mycobacterium
RPDRRIRRQRGKSDPIDAEAA

SEQ ID NO: 993788 - protein, 10 aa, Mycobacterium
RPDSSRGRPV

SEQ ID NO: 993789 - protein, 14 aa, Mycobacterium
RPDSTLAGRSVHGT

SEQ ID NO: 993790 - protein, 4 aa, Mycobacterium
RPDT

SEQ ID NO: 993791 - protein, 11 aa, Mycobacterium
RPEATAEAFDE

SEQ ID NO: 993792 - protein, 14 aa, Mycobacterium
RPEGNANAEIPTGD

SEQ ID NO: 993793 - protein, 19 aa, Mycobacterium
RPEVSTYRRSPRAPAPGAS

SEQ ID NO: 993794 - protein, 5 aa, Mycobacterium
RPEVT

SEQ ID NO: 993795 - protein, 10 aa, Mycobacterium
RPFLPPPAPR

SEQ ID NO: 993796 - protein, 6 aa, Mycobacterium
RPFSRT

SEQ ID NO: 993797 - protein, 7 aa, Mycobacterium
RPGDPLD

SEQ ID NO: 993798 - protein, 34 aa, Mycobacterium
RPGDPSILTPSPASDTDTVTVTNQTSTAWPLENN

SEQ ID NO: 993799 - protein, 5 aa, Mycobacterium
RPGET

SEQ ID NO: 993800 - protein, 4 aa, Mycobacterium
RPGG

SEQ ID NO: 993801 - protein, 16 aa, Mycobacterium
RPGGGAKLARSAGSSI

SEQ ID NO: 993802 - protein, 11 aa, Mycobacterium
RPGGLTMPSED

SEQ ID NO: 993803 - protein, 8 aa, Mycobacterium
RPGGNKQQ

SEQ ID NO: 993804 - protein, 19 aa, Mycobacterium
RPGGRLSDAITQSSCRGSA

SEQ ID NO: 993805 - protein, 8 aa, Mycobacterium
RPGKFGGD

SEQ ID NO: 993806 - protein, 10 aa, Mycobacterium
RPGPEFRPSE

SEQ ID NO: 993807 - protein, 6 aa, Mycobacterium
RPGPEV

SEQ ID NO: 993808 - protein, 11 aa, Mycobacterium
RPGPLRQAERR

SEQ ID NO: 993809 - protein, 10 aa, Mycobacterium
RPGQMTSYET

SEQ ID NO: 993810 - protein, 6 aa, Mycobacterium
RPGSEA

SEQ ID NO: 993811 - protein, 8 aa, Mycobacterium
RPGSGTVR

SEQ ID NO: 993812 - protein, 15 aa, Mycobacterium
RPGTSLHDPGKLATA

SEQ ID NO: 993813 - protein, 6 aa, Mycobacterium
RPGVGK

SEQ ID NO: 993814 - protein, 5 aa, Mycobacterium
RPGWR

SEQ ID NO: 993815 - protein, 6 aa, Mycobacterium
RPGYEL

SEQ ID NO: 993816 - protein, 10 aa, Mycobacterium
RPHAPTGKQW

SEQ ID NO: 993817 - protein, 6 aa, Mycobacterium
RPHDPP

SEQ ID NO: 993818 - protein, 5 aa, Mycobacterium
RPHEN

SEQ ID NO: 993819 - protein, 5 aa, Mycobacterium
RPIAT

SEQ ID NO: 993820 - protein, 5 aa, Mycobacterium
RPKPL

SEQ ID NO: 993821 - protein, 4 aa, Mycobacterium
RPKV

SEQ ID NO: 993822 - protein, 6 aa, Mycobacterium
RPLPGF

SEQ ID NO: 993823 - protein, 6 aa, Mycobacterium
RPLSAT

SEQ ID NO: 993824 - protein, 9 aa, Mycobacterium
RPLSPQRAR

SEQ ID NO: 993825 - protein, 4 aa, Mycobacterium
RPMQ

SEQ ID NO: 993826 - protein, 6 aa, Mycobacterium
RPNELP

SEQ ID NO: 993827 - protein, 4 aa, Mycobacterium
RPNI

SEQ ID NO: 993828 - protein, 7 aa, Mycobacterium
RPNPFPK

SEQ ID NO: 993829 - protein, 11 aa, Mycobacterium
RPNTGKSTLTN

SEQ ID NO: 993830 - protein, 8 aa, Mycobacterium
RPNVGKST

SEQ ID NO: 993831 - protein, 9 aa, Mycobacterium
RPPGREAYP

SEQ ID NO: 993832 - protein, 7 aa, Mycobacterium
RPPGSDR

SEQ ID NO: 993833 - protein, 8 aa, Mycobacterium
RPPSPEQI

SEQ ID NO: 993834 - protein, 7 aa, Mycobacterium
RPPTNAM

SEQ ID NO: 993835 - protein, 6 aa, Mycobacterium
RPPTVR

SEQ ID NO: 993836 - protein, 7 aa, Mycobacterium
RPQAGRC

SEQ ID NO: 993837 - protein, 6 aa, Mycobacterium
RPQDGA

SEQ ID NO: 993838 - protein, 4 aa, Mycobacterium
RPQN

SEQ ID NO: 993839 - protein, 6 aa, Mycobacterium
RPQSAQ

SEQ ID NO: 993840 - protein, 7 aa, Mycobacterium
RPQSRRI

SEQ ID NO: 993841 - protein, 6 aa, Mycobacterium
RPRCGP

SEQ ID NO: 993842 - protein, 9 aa, Mycobacterium
RPRGPGMER

SEQ ID NO: 993843 - protein, 7 aa, Mycobacterium
RPRNASS

SEQ ID NO: 993844 - protein, 8 aa, Mycobacterium
RPRRAGSD

SEQ ID NO: 993845 - protein, 7 aa, Mycobacterium
RPRSVVG

SEQ ID NO: 993846 - protein, 4 aa, Mycobacterium
RPSC

SEQ ID NO: 993847 - protein, 4 aa, Mycobacterium
RPSF

SEQ ID NO: 993848 - protein, 7 aa, Mycobacterium
RPSGRDA

SEQ ID NO: 993849 - protein, 7 aa, Mycobacterium
RPSGTHD

SEQ ID NO: 993850 - protein, 4 aa, Mycobacterium
RPSP

SEQ ID NO: 993851 - protein, 6 aa, Mycobacterium
RPSPAT

SEQ ID NO: 993852 - protein, 18 aa, Mycobacterium
RPSPTSGTLGGVTKATRE

SEQ ID NO: 993853 - protein, 6 aa, Mycobacterium
RPSQKG

SEQ ID NO: 993854 - protein, 6 aa, Mycobacterium
RPSSAR

SEQ ID NO: 993855 - protein, 12 aa, Mycobacterium
RPSSIRSGASKR

SEQ ID NO: 993856 - protein, 4 aa, Mycobacterium
RPSV

SEQ ID NO: 993857 - protein, 4 aa, Mycobacterium
RPSW

SEQ ID NO: 993858 - protein, 15 aa, Mycobacterium
RPTAARSRSRSCSAP

SEQ ID NO: 993859 - protein, 13 aa, Mycobacterium
RPTCEASPGRPGD

SEQ ID NO: 993860 - protein, 13 aa, Mycobacterium
RPTEHGIDDPGGV

SEQ ID NO: 993861 - protein, 10 aa, Mycobacterium
RPTGRGGERE

SEQ ID NO: 993862 - protein, 5 aa, Mycobacterium
RPTRN

SEQ ID NO: 993863 - protein, 5 aa, Mycobacterium
RPTTE

SEQ ID NO: 993864 - protein, 6 aa, Mycobacterium
RPTTMS

SEQ ID NO: 993865 - protein, 17 aa, Mycobacterium
RPVDSDQRPSIGCGIKW

SEQ ID NO: 993866 - protein, 4 aa, Mycobacterium
RPVE

SEQ ID NO: 993867 - protein, 59 aa, Mycobacterium
RPVKDQRSAASTKARRAEASKTAGRAPAKKAGASSGATKMPPKKASVKTSEASETKGGS

SEQ ID NO: 993868 - protein, 9 aa, Mycobacterium
RPVQQRANQ

SEQ ID NO: 993869 - protein, 4 aa, Mycobacterium
RPVR

SEQ ID NO: 993870 - protein, 5 aa, Mycobacterium
RPVRG

SEQ ID NO: 993871 - protein, 6 aa, Mycobacterium
RPVTPA

SEQ ID NO: 993872 - protein, 4 aa, Mycobacterium
RPYD

SEQ ID NO: 993873 - protein, 4 aa, Mycobacterium
RPYS

SEQ ID NO: 993874 - protein, 6 aa, Mycobacterium
RQAAEK

SEQ ID NO: 993875 - protein, 9 aa, Mycobacterium
RQAAGLAGT

SEQ ID NO: 993876 - protein, 6 aa, Mycobacterium
RQAEQV

SEQ ID NO: 993877 - protein, 15 aa, Mycobacterium
RQDATAEETVAAIAS

SEQ ID NO: 993878 - protein, 13 aa, Mycobacterium
RQDKKHRGREPIS

SEQ ID NO: 993879 - protein, 12 aa, Mycobacterium
RQDLRGDRGVGR

SEQ ID NO: 993880 - protein, 7 aa, Mycobacterium
RQEPQTV

SEQ ID NO: 993881 - protein, 4 aa, Mycobacterium
RQEV

SEQ ID NO: 993882 - protein, 12 aa, Mycobacterium
RQFDDGKECKSE

SEQ ID NO: 993883 - protein, 5 aa, Mycobacterium
RQGDR

SEQ ID NO: 993884 - protein, 8 aa, Mycobacterium
RQGGGIRE

SEQ ID NO: 993885 - protein, 17 aa, Mycobacterium
RQGGRRDVQWGCRRSGE

SEQ ID NO: 993886 - protein, 7 aa, Mycobacterium
RQGLGAD

SEQ ID NO: 993887 - protein, 5 aa, Mycobacterium
RQGSA

SEQ ID NO: 993888 - protein, 9 aa, Mycobacterium
RQIAEADAS

SEQ ID NO: 993889 - protein, 4 aa, Mycobacterium
RQIE

SEQ ID NO: 993890 - protein, 5 aa, Mycobacterium
RQKAN

SEQ ID NO: 993891 - protein, 8 aa, Mycobacterium
RQKAQSAQ

SEQ ID NO: 993892 - protein, 10 aa, Mycobacterium
RQKARTSQGT

SEQ ID NO: 993893 - protein, 6 aa, Mycobacterium
RQKNRQ

SEQ ID NO: 993894 - protein, 4 aa, Mycobacterium
RQLG

SEQ ID NO: 993895 - protein, 10 aa, Mycobacterium
RQLPSEGTTC

SEQ ID NO: 993896 - protein, 6 aa, Mycobacterium
RQLRGR

SEQ ID NO: 993897 - protein, 18 aa, Mycobacterium
RQLSEPESVDRALNALAQ

SEQ ID NO: 993898 - protein, 8 aa, Mycobacterium
RQMSGGGT

SEQ ID NO: 993899 - protein, 5 aa, Mycobacterium
RQNRS

SEQ ID NO: 993900 - protein, 16 aa, Mycobacterium
RQPDESSAFVHALGQT

SEQ ID NO: 993901 - protein, 8 aa, Mycobacterium
RQPDTVDS

SEQ ID NO: 993902 - protein, 13 aa, Mycobacterium
RQPEAAKAMGVTT

SEQ ID NO: 993903 - protein, 8 aa, Mycobacterium
RQPTVSPE

SEQ ID NO: 993904 - protein, 7 aa, Mycobacterium
RQQDGFA

SEQ ID NO: 993905 - protein, 4 aa, Mycobacterium
RQQR

SEQ ID NO: 993906 - protein, 6 aa, Mycobacterium
RQRAQH

SEQ ID NO: 993907 - protein, 4 aa, Mycobacterium
RQRG

SEQ ID NO: 993908 - protein, 19 aa, Mycobacterium
RQRMAKEETDRIIARLAGL

SEQ ID NO: 993909 - protein, 24 aa, Mycobacterium
RQRPERMGVSPSRYYAGQRLMLPA

SEQ ID NO: 993910 - protein, 4 aa, Mycobacterium
RQRR

SEQ ID NO: 993911 - protein, 4 aa, Mycobacterium
RQRW

SEQ ID NO: 993912 - protein, 8 aa, Mycobacterium
RQSDSESQ

SEQ ID NO: 993913 - protein, 5 aa, Mycobacterium
RQSPL

SEQ ID NO: 993914 - protein, 8 aa, Mycobacterium
RQSSRTAE

SEQ ID NO: 993915 - protein, 7 aa, Mycobacterium
RQTDPYT

SEQ ID NO: 993916 - protein, 4 aa, Mycobacterium
RQVT

SEQ ID NO: 993917 - protein, 6 aa, Mycobacterium
RQYRTS

SEQ ID NO: 993918 - protein, 16 aa, Mycobacterium
RRAARVARNPRTGETV

SEQ ID NO: 993919 - protein, 8 aa, Mycobacterium
RRAATAAH

SEQ ID NO: 993920 - protein, 5 aa, Mycobacterium
RRADQ

SEQ ID NO: 993921 - protein, 8 aa, Mycobacterium
RRAEVSQA

SEQ ID NO: 993922 - protein, 25 aa, Mycobacterium
RRAGGTHQRTIDPSAGNPLSSKTSM

SEQ ID NO: 993923 - protein, 6 aa, Mycobacterium
RRAGYG

SEQ ID NO: 993924 - protein, 4 aa, Mycobacterium
RRAL

SEQ ID NO: 993925 - protein, 14 aa, Mycobacterium
RRANVGKSKRALAA

SEQ ID NO: 993926 - protein, 19 aa, Mycobacterium
RRAPATSDGEGADGEEQVT

SEQ ID NO: 993927 - protein, 35 aa, Mycobacterium
RRARGPVKRPAKKARKVPAKKAARLAPARGISQSP

SEQ ID NO: 993928 - protein, 8 aa, Mycobacterium
RRARGRKV

SEQ ID NO: 993929 - protein, 16 aa, Mycobacterium
RRARPAQETADEAGDG

SEQ ID NO: 993930 - protein, 15 aa, Mycobacterium
RRARSASGTIVDLVL

SEQ ID NO: 993931 - protein, 8 aa, Mycobacterium
RRATGSAA

SEQ ID NO: 993932 - protein, 4 aa, Mycobacterium
RRAY

SEQ ID NO: 993933 - protein, 8 aa, Mycobacterium
RRDAANRL

SEQ ID NO: 993934 - protein, 11 aa, Mycobacterium
RRDESTAQASQ

SEQ ID NO: 993935 - protein, 4 aa, Mycobacterium
RRDG

SEQ ID NO: 993936 - protein, 11 aa, Mycobacterium
RRDGKHATTEV

SEQ ID NO: 993937 - protein, 6 aa, Mycobacterium
RRDGRE

SEQ ID NO: 993938 - protein, 4 aa, Mycobacterium
RRDH

SEQ ID NO: 993939 - protein, 12 aa, Mycobacterium
RRDNKSTSFAGG

SEQ ID NO: 993940 - protein, 19 aa, Mycobacterium
RRDRPDPSTYIGSGKAAEL

SEQ ID NO: 993941 - protein, 7 aa, Mycobacterium
RRDRTGY

SEQ ID NO: 993942 - protein, 8 aa, Mycobacterium
RRDTDGYG

SEQ ID NO: 993943 - protein, 8 aa, Mycobacterium
RRDVTGRQ

SEQ ID NO: 993944 - protein, 9 aa, Mycobacterium
RREGAREGR

SEQ ID NO: 993945 - protein, 7 aa, Mycobacterium
RREGYDP

SEQ ID NO: 993946 - protein, 13 aa, Mycobacterium
RRENFGKPDMRGS

SEQ ID NO: 993947 - protein, 8 aa, Mycobacterium
RRERPSEM

SEQ ID NO: 993948 - protein, 19 aa, Mycobacterium
RRERQPQPRLPIVEHALPD

SEQ ID NO: 993949 - protein, 8 aa, Mycobacterium
RRESADWQ

SEQ ID NO: 993950 - protein, 6 aa, Mycobacterium
RRFNGS

SEQ ID NO: 993951 - protein, 4 aa, Mycobacterium
RRGA

SEQ ID NO: 993952 - protein, 10 aa, Mycobacterium
RRGDRAEGAV

SEQ ID NO: 993953 - protein, 10 aa, Mycobacterium
RRGDTPLPVR

SEQ ID NO: 993954 - protein, 7 aa, Mycobacterium
RRGEIDG

SEQ ID NO: 993955 - protein, 19 aa, Mycobacterium
RRGGADIQSDPLSRVTSKA

SEQ ID NO: 993956 - protein, 6 aa, Mycobacterium
RRGGID

SEQ ID NO: 993957 - protein, 5 aa, Mycobacterium
RRGGL

SEQ ID NO: 993958 - protein, 7 aa, Mycobacterium
RRGMGRA

SEQ ID NO: 993959 - protein, 7 aa, Mycobacterium
RRGPAHS

SEQ ID NO: 993960 - protein, 7 aa, Mycobacterium
RRGSGDI

SEQ ID NO: 993961 - protein, 7 aa, Mycobacterium
RRGSGYG

SEQ ID NO: 993962 - protein, 10 aa, Mycobacterium
RRGTEADRIR

SEQ ID NO: 993963 - protein, 8 aa, Mycobacterium
RRGTPGED

SEQ ID NO: 993964 - protein, 4 aa, Mycobacterium
RRHD

SEQ ID NO: 993965 - protein, 4 aa, Mycobacterium
RRHP

SEQ ID NO: 993966 - protein, 19 aa, Mycobacterium
RRIAEETAKAAGKPEQSLP

SEQ ID NO: 993967 - protein, 9 aa, Mycobacterium
RRIATGPEQ

SEQ ID NO: 993968 - protein, 7 aa, Mycobacterium
RRIEESR

SEQ ID NO: 993969 - protein, 12 aa, Mycobacterium
RRIGPKQTGVDE

SEQ ID NO: 993970 - protein, 7 aa, Mycobacterium
RRKEKAL

SEQ ID NO: 993971 - protein, 6 aa, Mycobacterium
RRKQRP

SEQ ID NO: 993972 - protein, 17 aa, Mycobacterium
RRLEQSRGEHHKLPGNL

SEQ ID NO: 993973 - protein, 7 aa, Mycobacterium
RRLRQKT

SEQ ID NO: 993974 - protein, 15 aa, Mycobacterium
RRLTEANDSPAGEAC

SEQ ID NO: 993975 - protein, 5 aa, Mycobacterium
RRNAK

SEQ ID NO: 993976 - protein, 10 aa, Mycobacterium
RRNDDKLSVP

SEQ ID NO: 993977 - protein, 8 aa, Mycobacterium
RRPAAGDG

SEQ ID NO: 993978 - protein, 6 aa, Mycobacterium
RRPARS

SEQ ID NO: 993979 - protein, 5 aa, Mycobacterium
RRPDP

SEQ ID NO: 993980 - protein, 26 aa, Mycobacterium
RRPDPYKGKGVRYEGEQIRRKVGKTG

SEQ ID NO: 993981 - protein, 7 aa, Mycobacterium
RRPENTG

SEQ ID NO: 993982 - protein, 7 aa, Mycobacterium
RRPERRR

SEQ ID NO: 993983 - protein, 6 aa, Mycobacterium
RRPPEL

SEQ ID NO: 993984 - protein, 17 aa, Mycobacterium
RRPPSVERNGHQTTNYQ

SEQ ID NO: 993985 - protein, 17 aa, Mycobacterium
RRPQRKCTGSEPGGQKP

SEQ ID NO: 993986 - protein, 8 aa, Mycobacterium
RRPRPGDK

SEQ ID NO: 993987 - protein, 20 aa, Mycobacterium
RRPSGTDPCTHPTSDEISEG

SEQ ID NO: 993988 - protein, 7 aa, Mycobacterium
RRPTDTE

SEQ ID NO: 993989 - protein, 9 aa, Mycobacterium
RRPTGSGGA

SEQ ID NO: 993990 - protein, 6 aa, Mycobacterium
RRPVNP

SEQ ID NO: 993991 - protein, 4 aa, Mycobacterium
RRQQ

SEQ ID NO: 993992 - protein, 5 aa, Mycobacterium
RRQSE

SEQ ID NO: 993993 - protein, 6 aa, Mycobacterium
RRRATA

SEQ ID NO: 993994 - protein, 7 aa, Mycobacterium
RRRDPAS

SEQ ID NO: 993995 - protein, 7 aa, Mycobacterium
RRREAGT

SEQ ID NO: 993996 - protein, 6 aa, Mycobacterium
RRRENL

SEQ ID NO: 993997 - protein, 18 aa, Mycobacterium
RRRGASSAWSSRASPGDW

SEQ ID NO: 993998 - protein, 7 aa, Mycobacterium
RRRGNNI

SEQ ID NO: 993999 - protein, 10 aa, Mycobacterium
RRRGPAPMGP

SEQ ID NO: 994000 - protein, 7 aa, Mycobacterium
RRRGYRP

SEQ ID NO: 994001 - protein, 4 aa, Mycobacterium
RRRI

SEQ ID NO: 994002 - protein, 26 aa, Mycobacterium
RRRPQTHSGTRCQTRRAQPATSEVGE

SEQ ID NO: 994003 - protein, 7 aa, Mycobacterium
RRRQVKS

SEQ ID NO: 994004 - protein, 4 aa, Mycobacterium
RRRR

SEQ ID NO: 994005 - protein, 19 aa, Mycobacterium
RRRSRDVAEVRSTHAAGGG

SEQ ID NO: 994006 - protein, 10 aa, Mycobacterium
RRRSSRPHPC

SEQ ID NO: 994007 - protein, 4 aa, Mycobacterium
RRRV

SEQ ID NO: 994008 - protein, 16 aa, Mycobacterium
RRSAPAQLKEVSADGR

SEQ ID NO: 994009 - protein, 6 aa, Mycobacterium
RRSAQA

SEQ ID NO: 994010 - protein, 6 aa, Mycobacterium
RRSDAI

SEQ ID NO: 994011 - protein, 10 aa, Mycobacterium
RRSDGTSELR

SEQ ID NO: 994012 - protein, 4 aa, Mycobacterium
RRSG

SEQ ID NO: 994013 - protein, 9 aa, Mycobacterium
RRSGPKLSG

SEQ ID NO: 994014 - protein, 12 aa, Mycobacterium
RRSGSLNNKEIR

SEQ ID NO: 994015 - protein, 4 aa, Mycobacterium
RRSH

SEQ ID NO: 994016 - protein, 5 aa, Mycobacterium
RRSRT

SEQ ID NO: 994017 - protein, 4 aa, Mycobacterium
RRST

SEQ ID NO: 994018 - protein, 7 aa, Mycobacterium
RRTCRTR

SEQ ID NO: 994019 - protein, 10 aa, Mycobacterium
RRTGRTATVT

SEQ ID NO: 994020 - protein, 6 aa, Mycobacterium
RRTNNN

SEQ ID NO: 994021 - protein, 21 aa, Mycobacterium
RRTPGSTSSADHRNATRTEPR

SEQ ID NO: 994022 - protein, 9 aa, Mycobacterium
RRTSDADIA

SEQ ID NO: 994023 - protein, 8 aa, Mycobacterium
RRVGGATY

SEQ ID NO: 994024 - protein, 10 aa, Mycobacterium
RRVGTYSGGM

SEQ ID NO: 994025 - protein, 9 aa, Mycobacterium
RRVNTTEGL

SEQ ID NO: 994026 - protein, 5 aa, Mycobacterium
RRWSG

SEQ ID NO: 994027 - protein, 5 aa, Mycobacterium
RRYAN

SEQ ID NO: 994028 - protein, 12 aa, Mycobacterium
RRYSGRGNPALN

SEQ ID NO: 994029 - protein, 21 aa, Mycobacterium
RSAAVTLPSGGVARAGADGVD

SEQ ID NO: 994030 - protein, 15 aa, Mycobacterium
RSADAPNADGPTNLR

SEQ ID NO: 994031 - protein, 17 aa, Mycobacterium
RSAERSSQTEPNSPLSD

SEQ ID NO: 994032 - protein, 7 aa, Mycobacterium
RSAGEDL

SEQ ID NO: 994033 - protein, 19 aa, Mycobacterium
RSAGGGDLTANVTLAEGPP

SEQ ID NO: 994034 - protein, 8 aa, Mycobacterium
RSAGLSLE

SEQ ID NO: 994035 - protein, 7 aa, Mycobacterium
RSALAAG

SEQ ID NO: 994036 - protein, 15 aa, Mycobacterium
RSAPSTFRCLPRWSP

SEQ ID NO: 994037 - protein, 5 aa, Mycobacterium
RSAQL

SEQ ID NO: 994038 - protein, 16 aa, Mycobacterium
RSARNGVLTSVLMTFG

SEQ ID NO: 994039 - protein, 22 aa, Mycobacterium
RSASATQSDNKLAESRTASNIG

SEQ ID NO: 994040 - protein, 5 aa, Mycobacterium
RSASL

SEQ ID NO: 994041 - protein, 6 aa, Mycobacterium
RSASNA

SEQ ID NO: 994042 - protein, 9 aa, Mycobacterium
RSASRHPAI

SEQ ID NO: 994043 - protein, 11 aa, Mycobacterium
RSAVGDAELGE

SEQ ID NO: 994044 - protein, 7 aa, Mycobacterium
RSCPGQT

SEQ ID NO: 994045 - protein, 10 aa, Mycobacterium
RSDAAREPTL

SEQ ID NO: 994046 - protein, 9 aa, Mycobacterium
RSDAATTEV

SEQ ID NO: 994047 - protein, 13 aa, Mycobacterium
RSDETGAKSVRNL

SEQ ID NO: 994048 - protein, 9 aa, Mycobacterium
RSDGDARWP

SEQ ID NO: 994049 - protein, 15 aa, Mycobacterium
RSDGRDDAAVRSASA

SEQ ID NO: 994050 - protein, 4 aa, Mycobacterium
RSDN

SEQ ID NO: 994051 - protein, 4 aa, Mycobacterium
RSDS

SEQ ID NO: 994052 - protein, 5 aa, Mycobacterium
RSDSD

SEQ ID NO: 994053 - protein, 5 aa, Mycobacterium
RSDTC

SEQ ID NO: 994054 - protein, 14 aa, Mycobacterium
RSDTVTAGAVTGGV

SEQ ID NO: 994055 - protein, 8 aa, Mycobacterium
RSEARKGR

SEQ ID NO: 994056 - protein, 10 aa, Mycobacterium
RSEEAQLTRD

SEQ ID NO: 994057 - protein, 8 aa, Mycobacterium
RSEHTRRA

SEQ ID NO: 994058 - protein, 4 aa, Mycobacterium
RSER

SEQ ID NO: 994059 - protein, 7 aa, Mycobacterium
RSERSPV

SEQ ID NO: 994060 - protein, 6 aa, Mycobacterium
RSETKT

SEQ ID NO: 994061 - protein, 10 aa, Mycobacterium
RSFGGGPVGV

SEQ ID NO: 994062 - protein, 10 aa, Mycobacterium
RSGAGSNTVH

SEQ ID NO: 994063 - protein, 5 aa, Mycobacterium
RSGAK

SEQ ID NO: 994064 - protein, 13 aa, Mycobacterium
RSGAPACEQWDPS

SEQ ID NO: 994065 - protein, 4 aa, Mycobacterium
RSGD

SEQ ID NO: 994066 - protein, 6 aa, Mycobacterium
RSGDRV

SEQ ID NO: 994067 - protein, 13 aa, Mycobacterium
RSGEWTGATGKRI

SEQ ID NO: 994068 - protein, 6 aa, Mycobacterium
RSGGYA

SEQ ID NO: 994069 - protein, 8 aa, Mycobacterium
RSGHDDEM

SEQ ID NO: 994070 - protein, 36 aa, Mycobacterium
RSGINRHAESTMSKLTTPPAPAGAAFDTANRSKCSR

SEQ ID NO: 994071 - protein, 15 aa, Mycobacterium
RSGLPEDVNVPSGEA

SEQ ID NO: 994072 - protein, 14 aa, Mycobacterium
RSGNRTNPSSATIS

SEQ ID NO: 994073 - protein, 8 aa, Mycobacterium
RSGPPGCN

SEQ ID NO: 994074 - protein, 11 aa, Mycobacterium
RSGRCERTRHG

SEQ ID NO: 994075 - protein, 8 aa, Mycobacterium
RSGRELAE

SEQ ID NO: 994076 - protein, 9 aa, Mycobacterium
RSGRMTDDD

SEQ ID NO: 994077 - protein, 5 aa, Mycobacterium
RSGRR

SEQ ID NO: 994078 - protein, 10 aa, Mycobacterium
RSGSTTISTG

SEQ ID NO: 994079 - protein, 8 aa, Mycobacterium
RSGTDISV

SEQ ID NO: 994080 - protein, 5 aa, Mycobacterium
RSGTE

SEQ ID NO: 994081 - protein, 8 aa, Mycobacterium
RSGTLAEP

SEQ ID NO: 994082 - protein, 8 aa, Mycobacterium
RSGTLTPA

SEQ ID NO: 994083 - protein, 7 aa, Mycobacterium
RSGTYSH

SEQ ID NO: 994084 - protein, 9 aa, Mycobacterium
RSGVTPTAV

SEQ ID NO: 994085 - protein, 10 aa, Mycobacterium
RSGYADRDDL

SEQ ID NO: 994086 - protein, 6 aa, Mycobacterium
RSGYAP

SEQ ID NO: 994087 - protein, 6 aa, Mycobacterium
RSGYKY

SEQ ID NO: 994088 - protein, 6 aa, Mycobacterium
RSHPGV

SEQ ID NO: 994089 - protein, 7 aa, Mycobacterium
RSHQSLA

SEQ ID NO: 994090 - protein, 11 aa, Mycobacterium
RSHSPHRAPEQ

SEQ ID NO: 994091 - protein, 10 aa, Mycobacterium
RSHSSGSLNS

SEQ ID NO: 994092 - protein, 7 aa, Mycobacterium
RSIPGVT

SEQ ID NO: 994093 - protein, 4 aa, Mycobacterium
RSIT

SEQ ID NO: 994094 - protein, 10 aa, Mycobacterium
RSKAEIDTTD

SEQ ID NO: 994095 - protein, 8 aa, Mycobacterium
RSKAPTTD

SEQ ID NO: 994096 - protein, 11 aa, Mycobacterium
RSKRSKRMTAS

SEQ ID NO: 994097 - protein, 7 aa, Mycobacterium
RSKSNVQ

SEQ ID NO: 994098 - protein, 8 aa, Mycobacterium
RSKYASGE

SEQ ID NO: 994099 - protein, 4 aa, Mycobacterium
RSLE

SEQ ID NO: 994100 - protein, 14 aa, Mycobacterium
RSLKRGSKKGNVEK

SEQ ID NO: 994101 - protein, 11 aa, Mycobacterium
RSLNPVDPEDA

SEQ ID NO: 994102 - protein, 7 aa, Mycobacterium
RSLQDGT

SEQ ID NO: 994103 - protein, 5 aa, Mycobacterium
RSLRR

SEQ ID NO: 994104 - protein, 11 aa, Mycobacterium
RSLTGSASYAV

SEQ ID NO: 994105 - protein, 15 aa, Mycobacterium
RSLTPGQGVGMISDD

SEQ ID NO: 994106 - protein, 6 aa, Mycobacterium
RSMNTS

SEQ ID NO: 994107 - protein, 4 aa, Mycobacterium
RSND

SEQ ID NO: 994108 - protein, 23 aa, Mycobacterium
RSNHGTCANQSPIVDAGDRVEAG

SEQ ID NO: 994109 - protein, 10 aa, Mycobacterium
RSNPDGNRTE

SEQ ID NO: 994110 - protein, 6 aa, Mycobacterium
RSNTRA

SEQ ID NO: 994111 - protein, 5 aa, Mycobacterium
RSPDV

SEQ ID NO: 994112 - protein, 15 aa, Mycobacterium
RSPRNRDGCSEKSSA

SEQ ID NO: 994113 - protein, 34 aa, Mycobacterium
RSPTHGYGRSRFEEGYGRYEGRDYSDLRGDPTGY

SEQ ID NO: 994114 - protein, 8 aa, Mycobacterium
RSQARATE

SEQ ID NO: 994115 - protein, 9 aa, Mycobacterium
RSQDDPSGM

SEQ ID NO: 994116 - protein, 15 aa, Mycobacterium
RSQGGSLIDVVPLTL

SEQ ID NO: 994117 - protein, 8 aa, Mycobacterium
RSQGNEDA

SEQ ID NO: 994118 - protein, 5 aa, Mycobacterium
RSQMS

SEQ ID NO: 994119 - protein, 11 aa, Mycobacterium
RSQPNPKARQT

SEQ ID NO: 994120 - protein, 12 aa, Mycobacterium
RSREQAAQIGGY

SEQ ID NO: 994121 - protein, 10 aa, Mycobacterium
RSRKVSEGRV

SEQ ID NO: 994122 - protein, 10 aa, Mycobacterium
RSRPALHDQA

SEQ ID NO: 994123 - protein, 8 aa, Mycobacterium
RSRPDPRA

SEQ ID NO: 994124 - protein, 15 aa, Mycobacterium
RSRRGGRGSMIPASG

SEQ ID NO: 994125 - protein, 14 aa, Mycobacterium
RSRRSTGLSDAIGR

SEQ ID NO: 994126 - protein, 8 aa, Mycobacterium
RSRSPGLA

SEQ ID NO: 994127 - protein, 13 aa, Mycobacterium
RSRSVGAPSAPFT

SEQ ID NO: 994128 - protein, 16 aa, Mycobacterium
RSRTSADVGWRRRQCS

SEQ ID NO: 994129 - protein, 5 aa, Mycobacterium
RSSAA

SEQ ID NO: 994130 - protein, 10 aa, Mycobacterium
RSSDVAPESV

SEQ ID NO: 994131 - protein, 16 aa, Mycobacterium
RSSGKGGQGVNTTDSA

SEQ ID NO: 994132 - protein, 9 aa, Mycobacterium
RSSGLSRWQ

SEQ ID NO: 994133 - protein, 6 aa, Mycobacterium
RSSRDR

SEQ ID NO: 994134 - protein, 7 aa, Mycobacterium
RSSTAAA

SEQ ID NO: 994135 - protein, 6 aa, Mycobacterium
RSSTFD

SEQ ID NO: 994136 - protein, 14 aa, Mycobacterium
RSSVAGYSDSPTVE

SEQ ID NO: 994137 - protein, 7 aa, Mycobacterium
RSTAAWK

SEQ ID NO: 994138 - protein, 4 aa, Mycobacterium
RSTF

SEQ ID NO: 994139 - protein, 6 aa, Mycobacterium
RSTFDD

SEQ ID NO: 994140 - protein, 8 aa, Mycobacterium
RSTGRPVT

SEQ ID NO: 994141 - protein, 10 aa, Mycobacterium
RSTGRPYPGS

SEQ ID NO: 994142 - protein, 5 aa, Mycobacterium
RSTRE

SEQ ID NO: 994143 - protein, 24 aa, Mycobacterium
RSTRTRSHRGKRGELLPRAATSSL

SEQ ID NO: 994144 - protein, 6 aa, Mycobacterium
RSTSEL

SEQ ID NO: 994145 - protein, 11 aa, Mycobacterium
RSTTDLSQRIR

SEQ ID NO: 994146 - protein, 4 aa, Mycobacterium
RSTV

SEQ ID NO: 994147 - protein, 15 aa, Mycobacterium
RSTVKANARSGTRQD

SEQ ID NO: 994148 - protein, 4 aa, Mycobacterium
RSVA

SEQ ID NO: 994149 - protein, 12 aa, Mycobacterium
RSVADDIRAAET

SEQ ID NO: 994150 - protein, 16 aa, Mycobacterium
RSVGRAGRSRPSGTVA

SEQ ID NO: 994151 - protein, 9 aa, Mycobacterium
RSVGRGRHQ

SEQ ID NO: 994152 - protein, 9 aa, Mycobacterium
RSVKSTGSA

SEQ ID NO: 994153 - protein, 13 aa, Mycobacterium
RSVPKNGDAAPLP

SEQ ID NO: 994154 - protein, 7 aa, Mycobacterium
RSYPGTT

SEQ ID NO: 994155 - protein, 21 aa, Mycobacterium
RSYTKGATVRGAQDERPEAGE

SEQ ID NO: 994156 - protein, 7 aa, Mycobacterium
RSYTRKP

SEQ ID NO: 994157 - protein, 14 aa, Mycobacterium
RTAASRQAGRHFGS

SEQ ID NO: 994158 - protein, 11 aa, Mycobacterium
RTADDTDTSER

SEQ ID NO: 994159 - protein, 19 aa, Mycobacterium
RTADRLAAGDMGRYADAKE

SEQ ID NO: 994160 - protein, 18 aa, Mycobacterium
RTAGAKAGIGVKPGTPLN

SEQ ID NO: 994161 - protein, 7 aa, Mycobacterium
RTAGGTE

SEQ ID NO: 994162 - protein, 7 aa, Mycobacterium
RTAGQRN

SEQ ID NO: 994163 - protein, 4 aa, Mycobacterium
RTAH

SEQ ID NO: 994164 - protein, 13 aa, Mycobacterium
RTAHGDEDHSGPL

SEQ ID NO: 994165 - protein, 8 aa, Mycobacterium
RTANGYTP

SEQ ID NO: 994166 - protein, 16 aa, Mycobacterium
RTAVATAKRAAQERRL

SEQ ID NO: 994167 - protein, 4 aa, Mycobacterium
RTDA

SEQ ID NO: 994168 - protein, 9 aa, Mycobacterium
RTDDPASRF

SEQ ID NO: 994169 - protein, 12 aa, Mycobacterium
RTDEGLPTVGCP

SEQ ID NO: 994170 - protein, 12 aa, Mycobacterium
RTDFPGGNSDEM

SEQ ID NO: 994171 - protein, 8 aa, Mycobacterium
RTDQGPAR

SEQ ID NO: 994172 - protein, 6 aa, Mycobacterium
RTDRAS

SEQ ID NO: 994173 - protein, 6 aa, Mycobacterium
RTEDVE

SEQ ID NO: 994174 - protein, 5 aa, Mycobacterium
RTEGR

SEQ ID NO: 994175 - protein, 12 aa, Mycobacterium
RTEKSAVGLGLG

SEQ ID NO: 994176 - protein, 7 aa, Mycobacterium
RTEPDSR

SEQ ID NO: 994177 - protein, 11 aa, Mycobacterium
RTEPPHPGARY

SEQ ID NO: 994178 - protein, 13 aa, Mycobacterium
RTEPPNTRIMKRA

SEQ ID NO: 994179 - protein, 6 aa, Mycobacterium
RTEPSF

SEQ ID NO: 994180 - protein, 13 aa, Mycobacterium
RTEQEADRALKAG

SEQ ID NO: 994181 - protein, 4 aa, Mycobacterium
RTES

SEQ ID NO: 994182 - protein, 13 aa, Mycobacterium
RTETDNVPEDSLE

SEQ ID NO: 994183 - protein, 7 aa, Mycobacterium
RTEYGTR

SEQ ID NO: 994184 - protein, 4 aa, Mycobacterium
RTGA

SEQ ID NO: 994185 - protein, 7 aa, Mycobacterium
RTGDDEI

SEQ ID NO: 994186 - protein, 6 aa, Mycobacterium
RTGDGI

SEQ ID NO: 994187 - protein, 7 aa, Mycobacterium
RTGDYGT

SEQ ID NO: 994188 - protein, 4 aa, Mycobacterium
RTGE

SEQ ID NO: 994189 - protein, 8 aa, Mycobacterium
RTGEEPEQ

SEQ ID NO: 994190 - protein, 8 aa, Mycobacterium
RTGERYPD

SEQ ID NO: 994191 - protein, 4 aa, Mycobacterium
RTGG

SEQ ID NO: 994192 - protein, 5 aa, Mycobacterium
RTGGY

SEQ ID NO: 994193 - protein, 7 aa, Mycobacterium
RTGPTVA

SEQ ID NO: 994194 - protein, 11 aa, Mycobacterium
RTGQRPTETAL

SEQ ID NO: 994195 - protein, 16 aa, Mycobacterium
RTGQTGQSSESSELAD

SEQ ID NO: 994196 - protein, 10 aa, Mycobacterium
RTGRAGRSGK

SEQ ID NO: 994197 - protein, 10 aa, Mycobacterium
RTGRAGRTGV

SEQ ID NO: 994198 - protein, 8 aa, Mycobacterium
RTGRFTSP

SEQ ID NO: 994199 - protein, 9 aa, Mycobacterium
RTGRTPTVI

SEQ ID NO: 994200 - protein, 11 aa, Mycobacterium
RTGRVDQAEEL

SEQ ID NO: 994201 - protein, 12 aa, Mycobacterium
RTGTGKDETFND

SEQ ID NO: 994202 - protein, 7 aa, Mycobacterium
RTGWASP

SEQ ID NO: 994203 - protein, 4 aa, Mycobacterium
RTHG

SEQ ID NO: 994204 - protein, 11 aa, Mycobacterium
RTHGTSSTIGA

SEQ ID NO: 994205 - protein, 16 aa, Mycobacterium
RTHSGATLPRGTDTVA

SEQ ID NO: 994206 - protein, 5 aa, Mycobacterium
RTHTS

SEQ ID NO: 994207 - protein, 8 aa, Mycobacterium
RTINGEQK

SEQ ID NO: 994208 - protein, 18 aa, Mycobacterium
RTIPSRGPRPKPHSGNSQ

SEQ ID NO: 994209 - protein, 7 aa, Mycobacterium
RTKANGA

SEQ ID NO: 994210 - protein, 9 aa, Mycobacterium
RTKLADQVA

SEQ ID NO: 994211 - protein, 10 aa, Mycobacterium
RTKPDDAAES

SEQ ID NO: 994212 - protein, 16 aa, Mycobacterium
RTKPPRFALTPSRPTA

SEQ ID NO: 994213 - protein, 4 aa, Mycobacterium
RTKQ

SEQ ID NO: 994214 - protein, 7 aa, Mycobacterium
RTKTPIQ

SEQ ID NO: 994215 - protein, 18 aa, Mycobacterium
RTLETREANYYSRSRAEQ

SEQ ID NO: 994216 - protein, 4 aa, Mycobacterium
RTLG

SEQ ID NO: 994217 - protein, 10 aa, Mycobacterium
RTLQRTKSEH

SEQ ID NO: 994218 - protein, 8 aa, Mycobacterium
RTLTSGSK

SEQ ID NO: 994219 - protein, 8 aa, Mycobacterium
RTNAGRQI

SEQ ID NO: 994220 - protein, 9 aa, Mycobacterium
RTNANGSKV

SEQ ID NO: 994221 - protein, 19 aa, Mycobacterium
RTNGYKRSALLGPKDDDTE

SEQ ID NO: 994222 - protein, 5 aa, Mycobacterium
RTNRN

SEQ ID NO: 994223 - protein, 12 aa, Mycobacterium
RTNRSHPVAADP

SEQ ID NO: 994224 - protein, 9 aa, Mycobacterium
RTNSESIVG

SEQ ID NO: 994225 - protein, 8 aa, Mycobacterium
RTNTGESV

SEQ ID NO: 994226 - protein, 7 aa, Mycobacterium
RTPANAE

SEQ ID NO: 994227 - protein, 9 aa, Mycobacterium
RTPEGRIDQ

SEQ ID NO: 994228 - protein, 9 aa, Mycobacterium
RTPEYGEPP

SEQ ID NO: 994229 - protein, 6 aa, Mycobacterium
RTPGDL

SEQ ID NO: 994230 - protein, 7 aa, Mycobacterium
RTPGRSW

SEQ ID NO: 994231 - protein, 10 aa, Mycobacterium
RTPNGAVSGE

SEQ ID NO: 994232 - protein, 8 aa, Mycobacterium
RTPPGAAD

SEQ ID NO: 994233 - protein, 53 aa, Mycobacterium
RTPRAAGRSASFDNGVNGTGSADIKGIDGSTRLEAKRQRRRDGRDAGRRRSSV

SEQ ID NO: 994234 - protein, 13 aa, Mycobacterium
RTPRGKQKNGSLH

SEQ ID NO: 994235 - protein, 9 aa, Mycobacterium
RTPRGRVAT

SEQ ID NO: 994236 - protein, 9 aa, Mycobacterium
RTPSDAPVS

SEQ ID NO: 994237 - protein, 8 aa, Mycobacterium
RTPSGYRL

SEQ ID NO: 994238 - protein, 11 aa, Mycobacterium
RTPSRGYGSSG

SEQ ID NO: 994239 - protein, 12 aa, Mycobacterium
RTPTRDRSGVTI

SEQ ID NO: 994240 - protein, 4 aa, Mycobacterium
RTQE

SEQ ID NO: 994241 - protein, 8 aa, Mycobacterium
RTQNRSSG

SEQ ID NO: 994242 - protein, 14 aa, Mycobacterium
RTRAGDAHAARQCP

SEQ ID NO: 994243 - protein, 5 aa, Mycobacterium
RTRAN

SEQ ID NO: 994244 - protein, 19 aa, Mycobacterium
RTRDPAQYLTTAGTRWRSA

SEQ ID NO: 994245 - protein, 11 aa, Mycobacterium
RTRLRPGTTAP

SEQ ID NO: 994246 - protein, 7 aa, Mycobacterium
RTRQPFQ

SEQ ID NO: 994247 - protein, 20 aa, Mycobacterium
RTRRRCGTTKPNKSARKAPD

SEQ ID NO: 994248 - protein, 5 aa, Mycobacterium
RTRSA

SEQ ID NO: 994249 - protein, 5 aa, Mycobacterium
RTRSN

SEQ ID NO: 994250 - protein, 5 aa, Mycobacterium
RTRSV

SEQ ID NO: 994251 - protein, 5 aa, Mycobacterium
RTRTS

SEQ ID NO: 994252 - protein, 4 aa, Mycobacterium
RTRV

SEQ ID NO: 994253 - protein, 5 aa, Mycobacterium
RTSAE

SEQ ID NO: 994254 - protein, 12 aa, Mycobacterium
RTSDAPAAPASI

SEQ ID NO: 994255 - protein, 8 aa, Mycobacterium
RTSDDDMA

SEQ ID NO: 994256 - protein, 9 aa, Mycobacterium
RTSDDDMNG

SEQ ID NO: 994257 - protein, 9 aa, Mycobacterium
RTSPAGARY

SEQ ID NO: 994258 - protein, 15 aa, Mycobacterium
RTSPDRLREDAGCTS

SEQ ID NO: 994259 - protein, 14 aa, Mycobacterium
RTSQTGQQDRRTAV

SEQ ID NO: 994260 - protein, 5 aa, Mycobacterium
RTSTG

SEQ ID NO: 994261 - protein, 4 aa, Mycobacterium
RTSY

SEQ ID NO: 994262 - protein, 5 aa, Mycobacterium
RTTDK

SEQ ID NO: 994263 - protein, 5 aa, Mycobacterium
RTTHP

SEQ ID NO: 994264 - protein, 6 aa, Mycobacterium
RTTKLG

SEQ ID NO: 994265 - protein, 18 aa, Mycobacterium
RTTNGSPSDSERAAIANN

SEQ ID NO: 994266 - protein, 7 aa, Mycobacterium
RTTPSGF

SEQ ID NO: 994267 - protein, 6 aa, Mycobacterium
RTTRCP

SEQ ID NO: 994268 - protein, 4 aa, Mycobacterium
RTTS

SEQ ID NO: 994269 - protein, 5 aa, Mycobacterium
RTTSV

SEQ ID NO: 994270 - protein, 12 aa, Mycobacterium
RTTTPGPVSDYT

SEQ ID NO: 994271 - protein, 5 aa, Mycobacterium
RTTYR

SEQ ID NO: 994272 - protein, 5 aa, Mycobacterium
RTVGV

SEQ ID NO: 994273 - protein, 19 aa, Mycobacterium
RTVPGSKYAALNDTGNDEL

SEQ ID NO: 994274 - protein, 7 aa, Mycobacterium
RTVPPER

SEQ ID NO: 994275 - protein, 27 aa, Mycobacterium
RTVPTGSARTPSGWEATTHGGYRGTGI

SEQ ID NO: 994276 - protein, 5 aa, Mycobacterium
RTVSR

SEQ ID NO: 994277 - protein, 6 aa, Mycobacterium
RTWGGG

SEQ ID NO: 994278 - protein, 9 aa, Mycobacterium
RTYEDQDSV

SEQ ID NO: 994279 - protein, 8 aa, Mycobacterium
RTYKPYGP

SEQ ID NO: 994280 - protein, 14 aa, Mycobacterium
RTYRNQVHAHCPHI

SEQ ID NO: 994281 - protein, 10 aa, Mycobacterium
RVASAADAQE

SEQ ID NO: 994282 - protein, 25 aa, Mycobacterium
RVASPGERPADGASGLAVYTVGGLM

SEQ ID NO: 994283 - protein, 20 aa, Mycobacterium
RVASRRRAGYRVDGSRQHPS

SEQ ID NO: 994284 - protein, 6 aa, Mycobacterium
RVDDDG

SEQ ID NO: 994285 - protein, 7 aa, Mycobacterium
RVDDPGL

SEQ ID NO: 994286 - protein, 4 aa, Mycobacterium
RVDE

SEQ ID NO: 994287 - protein, 7 aa, Mycobacterium
RVDPQSD

SEQ ID NO: 994288 - protein, 6 aa, Mycobacterium
RVEDEE

SEQ ID NO: 994289 - protein, 14 aa, Mycobacterium
RVEGKRITAGSPRI

SEQ ID NO: 994290 - protein, 8 aa, Mycobacterium
RVGAENNG

SEQ ID NO: 994291 - protein, 7 aa, Mycobacterium
RVGGAAQ

SEQ ID NO: 994292 - protein, 12 aa, Mycobacterium
RVGGGDPVGNPT

SEQ ID NO: 994293 - protein, 15 aa, Mycobacterium
RVGNQDSSAPTVAAT

SEQ ID NO: 994294 - protein, 4 aa, Mycobacterium
RVGQ

SEQ ID NO: 994295 - protein, 4 aa, Mycobacterium
RVGS

SEQ ID NO: 994296 - protein, 11 aa, Mycobacterium
RVGTPNEVATE

SEQ ID NO: 994297 - protein, 23 aa, Mycobacterium
RVGTRTPGKRGKPVSNKGRRQRY

SEQ ID NO: 994298 - protein, 7 aa, Mycobacterium
RVKHGKT

SEQ ID NO: 994299 - protein, 20 aa, Mycobacterium
RVNADTAAGGIRTRRWNQNI

SEQ ID NO: 994300 - protein, 9 aa, Mycobacterium
RVNKNGIPW

SEQ ID NO: 994301 - protein, 11 aa, Mycobacterium
RVNPPLRETAD

SEQ ID NO: 994302 - protein, 10 aa, Mycobacterium
RVNQQPASHS

SEQ ID NO: 994303 - protein, 12 aa, Mycobacterium
RVPARSGRQHEQ

SEQ ID NO: 994304 - protein, 6 aa, Mycobacterium
RVPEGH

SEQ ID NO: 994305 - protein, 13 aa, Mycobacterium
RVPGGSGGGSAAA

SEQ ID NO: 994306 - protein, 7 aa, Mycobacterium
RVPGLNA

SEQ ID NO: 994307 - protein, 12 aa, Mycobacterium
RVPNNREREQLR

SEQ ID NO: 994308 - protein, 6 aa, Mycobacterium
RVPTRL

SEQ ID NO: 994309 - protein, 12 aa, Mycobacterium
RVQEAGAAMRRS

SEQ ID NO: 994310 - protein, 4 aa, Mycobacterium
RVRG

SEQ ID NO: 994311 - protein, 8 aa, Mycobacterium
RVRRTSSR

SEQ ID NO: 994312 - protein, 8 aa, Mycobacterium
RVRTPTTT

SEQ ID NO: 994313 - protein, 11 aa, Mycobacterium
RVSPEQLTGAQ

SEQ ID NO: 994314 - protein, 7 aa, Mycobacterium
RVSSGDL

SEQ ID NO: 994315 - protein, 10 aa, Mycobacterium
RVSTTNPQVA

SEQ ID NO: 994316 - protein, 8 aa, Mycobacterium
RVTSSPAL

SEQ ID NO: 994317 - protein, 13 aa, Mycobacterium
RVTTHATGIGNTE

SEQ ID NO: 994318 - protein, 7 aa, Mycobacterium
RVTTRPC

SEQ ID NO: 994319 - protein, 5 aa, Mycobacterium
RVVGQ

SEQ ID NO: 994320 - protein, 5 aa, Mycobacterium
RWPGP

SEQ ID NO: 994321 - protein, 6 aa, Mycobacterium
RWPRAG

SEQ ID NO: 994322 - protein, 4 aa, Mycobacterium
RWTE

SEQ ID NO: 994323 - protein, 5 aa, Mycobacterium
RYAEA

SEQ ID NO: 994324 - protein, 21 aa, Mycobacterium
RYAGPAGRDWTTSDLAGKRIA

SEQ ID NO: 994325 - protein, 7 aa, Mycobacterium
RYATGAQ

SEQ ID NO: 994326 - protein, 6 aa, Mycobacterium
RYGRPR

SEQ ID NO: 994327 - protein, 5 aa, Mycobacterium
RYHTT

SEQ ID NO: 994328 - protein, 7 aa, Mycobacterium
RYLPPRN

SEQ ID NO: 994329 - protein, 10 aa, Mycobacterium
RYPDQPTSVP

SEQ ID NO: 994330 - protein, 13 aa, Mycobacterium
RYPEAAKYTPGAI

SEQ ID NO: 994331 - protein, 10 aa, Mycobacterium
RYPPDGVSAE

SEQ ID NO: 994332 - protein, 8 aa, Mycobacterium
RYPSSANV

SEQ ID NO: 994333 - protein, 4 aa, Mycobacterium
RYPT

SEQ ID NO: 994334 - protein, 8 aa, Mycobacterium
RYQKPASN

SEQ ID NO: 994335 - protein, 11 aa, Mycobacterium
RYRDASGKPQI

SEQ ID NO: 994336 - protein, 9 aa, Mycobacterium
RYRPSDAPL

SEQ ID NO: 994337 - protein, 5 aa, Mycobacterium
RYSDT

SEQ ID NO: 994338 - protein, 4 aa, Mycobacterium
RYSP

SEQ ID NO: 994339 - protein, 9 aa, Mycobacterium
RYSRDRNTL

SEQ ID NO: 994340 - protein, 7 aa, Mycobacterium
RYVPEKD

SEQ ID NO: 994341 - protein, 7 aa, Mycobacterium
SAAAERW

SEQ ID NO: 994342 - protein, 12 aa, Mycobacterium
SAADKYAGQNRK

SEQ ID NO: 994343 - protein, 17 aa, Mycobacterium
SAAEALDETANRVGGTT

SEQ ID NO: 994344 - protein, 9 aa, Mycobacterium
SAAETGSHD

SEQ ID NO: 994345 - protein, 4 aa, Mycobacterium
SAAF

SEQ ID NO: 994346 - protein, 7 aa, Mycobacterium
SAAGGRV

SEQ ID NO: 994347 - protein, 11 aa, Mycobacterium
SAAGKRLQNEC

SEQ ID NO: 994348 - protein, 8 aa, Mycobacterium
SAAGMDKE

SEQ ID NO: 994349 - protein, 6 aa, Mycobacterium
SAAGTT

SEQ ID NO: 994350 - protein, 5 aa, Mycobacterium
SAAHD

SEQ ID NO: 994351 - protein, 28 aa, Mycobacterium
SAAKARQQDKERADFDGSDYFKEFRSRI

SEQ ID NO: 994352 - protein, 17 aa, Mycobacterium
SAAKPGTAGKHHRLMRS

SEQ ID NO: 994353 - protein, 6 aa, Mycobacterium
SAAPAG

SEQ ID NO: 994354 - protein, 9 aa, Mycobacterium
SAARDEISA

SEQ ID NO: 994355 - protein, 6 aa, Mycobacterium
SAARDV

SEQ ID NO: 994356 - protein, 5 aa, Mycobacterium
SAATI

SEQ ID NO: 994357 - protein, 6 aa, Mycobacterium
SADAKF

SEQ ID NO: 994358 - protein, 7 aa, Mycobacterium
SADEKDA

SEQ ID NO: 994359 - protein, 6 aa, Mycobacterium
SADENL

SEQ ID NO: 994360 - protein, 6 aa, Mycobacterium
SADGTV

SEQ ID NO: 994361 - protein, 16 aa, Mycobacterium
SADHDQTNQLADLSMG

SEQ ID NO: 994362 - protein, 17 aa, Mycobacterium
SADLTEGLSAAVAERKS

SEQ ID NO: 994363 - protein, 7 aa, Mycobacterium
SADPGPV

SEQ ID NO: 994364 - protein, 9 aa, Mycobacterium
SADRARRRE

SEQ ID NO: 994365 - protein, 46 aa, Mycobacterium
SADSYTDTEVTNQAIGATSEAANPANVPQSSVDDNDLGMGRKGSNF

SEQ ID NO: 994366 - protein, 4 aa, Mycobacterium
SADY

SEQ ID NO: 994367 - protein, 9 aa, Mycobacterium
SAEATEQGG

SEQ ID NO: 994368 - protein, 8 aa, Mycobacterium
SAEDHATK

SEQ ID NO: 994369 - protein, 6 aa, Mycobacterium
SAEDPL

SEQ ID NO: 994370 - protein, 9 aa, Mycobacterium
SAEGDRTGA

SEQ ID NO: 994371 - protein, 46 aa, Mycobacterium
SAELSDAKGQPQATQTSDNKPTSPTQLGGSTPGVSRPGASASSRTD

SEQ ID NO: 994372 - protein, 12 aa, Mycobacterium
SAERDPAGCTDD

SEQ ID NO: 994373 - protein, 24 aa, Mycobacterium
SAFPRHAKANTDQHGTVAPTHGQH

SEQ ID NO: 994374 - protein, 8 aa, Mycobacterium
SAFSGEHE

SEQ ID NO: 994375 - protein, 7 aa, Mycobacterium
SAGATAL

SEQ ID NO: 994376 - protein, 7 aa, Mycobacterium
SAGCLGQ

SEQ ID NO: 994377 - protein, 7 aa, Mycobacterium
SAGDKKI

SEQ ID NO: 994378 - protein, 7 aa, Mycobacterium
SAGESRV

SEQ ID NO: 994379 - protein, 13 aa, Mycobacterium
SAGGQVLSEDGRH

SEQ ID NO: 994380 - protein, 12 aa, Mycobacterium
SAGHDSGSDPEL

SEQ ID NO: 994381 - protein, 14 aa, Mycobacterium
SAGIPSQASASRPH

SEQ ID NO: 994382 - protein, 6 aa, Mycobacterium
SAGISR

SEQ ID NO: 994383 - protein, 16 aa, Mycobacterium
SAGKAKRSANGAGDGV

SEQ ID NO: 994384 - protein, 5 aa, Mycobacterium
SAGKE

SEQ ID NO: 994385 - protein, 13 aa, Mycobacterium
SAGKTDDSRVRGW

SEQ ID NO: 994386 - protein, 8 aa, Mycobacterium
SAGNHAQG

SEQ ID NO: 994387 - protein, 7 aa, Mycobacterium
SAGNTGH

SEQ ID NO: 994388 - protein, 17 aa, Mycobacterium
SAGPAHPDLEVGQGQRL

SEQ ID NO: 994389 - protein, 24 aa, Mycobacterium
SAGPEASDGRDVDESLDLIAIAVR

SEQ ID NO: 994390 - protein, 7 aa, Mycobacterium
SAGPGEA

SEQ ID NO: 994391 - protein, 8 aa, Mycobacterium
SAGPSQPS

SEQ ID NO: 994392 - protein, 11 aa, Mycobacterium
SAGQGSRGPSK

SEQ ID NO: 994393 - protein, 9 aa, Mycobacterium
SAGRHTDPI

SEQ ID NO: 994394 - protein, 11 aa, Mycobacterium
SAGSSQDTSTY

SEQ ID NO: 994395 - protein, 5 aa, Mycobacterium
SAGTK

SEQ ID NO: 994396 - protein, 4 aa, Mycobacterium
SAGV

SEQ ID NO: 994397 - protein, 11 aa, Mycobacterium
SAGVRRPRGDI

SEQ ID NO: 994398 - protein, 9 aa, Mycobacterium
SAGYGPGHD

SEQ ID NO: 994399 - protein, 6 aa, Mycobacterium
SAHAGA

SEQ ID NO: 994400 - protein, 10 aa, Mycobacterium
SAHGTNAASA

SEQ ID NO: 994401 - protein, 6 aa, Mycobacterium
SAHGYT

SEQ ID NO: 994402 - protein, 11 aa, Mycobacterium
SAHIEKSDALR

SEQ ID NO: 994403 - protein, 4 aa, Mycobacterium
SAHS

SEQ ID NO: 994404 - protein, 5 aa, Mycobacterium
SAKDV

SEQ ID NO: 994405 - protein, 6 aa, Mycobacterium
SAKGVE

SEQ ID NO: 994406 - protein, 23 aa, Mycobacterium
SAKQALKTLEGTKDGSAPENPYT

SEQ ID NO: 994407 - protein, 9 aa, Mycobacterium
SALDGHKSL

SEQ ID NO: 994408 - protein, 11 aa, Mycobacterium
SALDPSEGYRI

SEQ ID NO: 994409 - protein, 11 aa, Mycobacterium
SALGADHEQRH

SEQ ID NO: 994410 - protein, 6 aa, Mycobacterium
SALGGR

SEQ ID NO: 994411 - protein, 11 aa, Mycobacterium
SALGKKASTTP

SEQ ID NO: 994412 - protein, 13 aa, Mycobacterium
SALGPSGKRPGVI

SEQ ID NO: 994413 - protein, 8 aa, Mycobacterium
SALKETSQ

SEQ ID NO: 994414 - protein, 4 aa, Mycobacterium
SALP

SEQ ID NO: 994415 - protein, 23 aa, Mycobacterium
SALPHTAKGSLDRRAVAEQFAHR

SEQ ID NO: 994416 - protein, 8 aa, Mycobacterium
SALSGPPL

SEQ ID NO: 994417 - protein, 6 aa, Mycobacterium
SANDVY

SEQ ID NO: 994418 - protein, 5 aa, Mycobacterium
SANHD

SEQ ID NO: 994419 - protein, 21 aa, Mycobacterium
SANMTDHQNPLASTSPCIRYP

SEQ ID NO: 994420 - protein, 21 aa, Mycobacterium
SANVSGQPAAVDVDGARGQLG

SEQ ID NO: 994421 - protein, 8 aa, Mycobacterium
SAPATDPD

SEQ ID NO: 994422 - protein, 8 aa, Mycobacterium
SAPDDTHA

SEQ ID NO: 994423 - protein, 7 aa, Mycobacterium
SAPEAIA

SEQ ID NO: 994424 - protein, 6 aa, Mycobacterium
SAPFTD

SEQ ID NO: 994425 - protein, 7 aa, Mycobacterium
SAPGPGW

SEQ ID NO: 994426 - protein, 8 aa, Mycobacterium
SAPGRSEI

SEQ ID NO: 994427 - protein, 7 aa, Mycobacterium
SAPLAKR

SEQ ID NO: 994428 - protein, 15 aa, Mycobacterium
SAPLAPSPQHPRIPR

SEQ ID NO: 994429 - protein, 5 aa, Mycobacterium
SAPPR

SEQ ID NO: 994430 - protein, 7 aa, Mycobacterium
SAPPVEE

SEQ ID NO: 994431 - protein, 8 aa, Mycobacterium
SAPTEAKT

SEQ ID NO: 994432 - protein, 6 aa, Mycobacterium
SAPTGA

SEQ ID NO: 994433 - protein, 6 aa, Mycobacterium
SAPVPV

SEQ ID NO: 994434 - protein, 4 aa, Mycobacterium
SAQA

SEQ ID NO: 994435 - protein, 18 aa, Mycobacterium
SAQPTMGADSPNSTEATD

SEQ ID NO: 994436 - protein, 15 aa, Mycobacterium
SAQQLGDAVSKHAPD

SEQ ID NO: 994437 - protein, 8 aa, Mycobacterium
SAQQYEDE

SEQ ID NO: 994438 - protein, 9 aa, Mycobacterium
SAQRATGEF

SEQ ID NO: 994439 - protein, 12 aa, Mycobacterium
SAQSTDKRVNLT

SEQ ID NO: 994440 - protein, 4 aa, Mycobacterium
SAQT

SEQ ID NO: 994441 - protein, 8 aa, Mycobacterium
SAQTPGEI

SEQ ID NO: 994442 - protein, 12 aa, Mycobacterium
SARAELEAAETV

SEQ ID NO: 994443 - protein, 20 aa, Mycobacterium
SARAERRAIPSKGLTGTGYD

SEQ ID NO: 994444 - protein, 13 aa, Mycobacterium
SARDLNKSGNTVF

SEQ ID NO: 994445 - protein, 10 aa, Mycobacterium
SARDSSNPRP

SEQ ID NO: 994446 - protein, 4 aa, Mycobacterium
SARE

SEQ ID NO: 994447 - protein, 11 aa, Mycobacterium
SARERSEEIGA

SEQ ID NO: 994448 - protein, 13 aa, Mycobacterium
SARPAWKPRTLPT

SEQ ID NO: 994449 - protein, 12 aa, Mycobacterium
SARPRRAGGADC

SEQ ID NO: 994450 - protein, 4 aa, Mycobacterium
SARQ

SEQ ID NO: 994451 - protein, 5 aa, Mycobacterium
SARSK

SEQ ID NO: 994452 - protein, 15 aa, Mycobacterium
SARSRRLAAAKARAT

SEQ ID NO: 994453 - protein, 7 aa, Mycobacterium
SARTPTA

SEQ ID NO: 994454 - protein, 13 aa, Mycobacterium
SARVPEKAIGYSK

SEQ ID NO: 994455 - protein, 12 aa, Mycobacterium
SARVTSSDPEFT

SEQ ID NO: 994456 - protein, 14 aa, Mycobacterium
SARYDGPPPGSEDL

SEQ ID NO: 994457 - protein, 17 aa, Mycobacterium
SASAGADSASRTSRSSA

SEQ ID NO: 994458 - protein, 12 aa, Mycobacterium
SASAGAQAPVDS

SEQ ID NO: 994459 - protein, 7 aa, Mycobacterium
SASAIDA

SEQ ID NO: 994460 - protein, 22 aa, Mycobacterium
SASEANPQIPGSTPAHRLRSAP

SEQ ID NO: 994461 - protein, 7 aa, Mycobacterium
SASEGGF

SEQ ID NO: 994462 - protein, 10 aa, Mycobacterium
SASGRSASYR

SEQ ID NO: 994463 - protein, 8 aa, Mycobacterium
SASKYGLR

SEQ ID NO: 994464 - protein, 5 aa, Mycobacterium
SASLP

SEQ ID NO: 994465 - protein, 7 aa, Mycobacterium
SASRDEL

SEQ ID NO: 994466 - protein, 8 aa, Mycobacterium
SASVSERN

SEQ ID NO: 994467 - protein, 4 aa, Mycobacterium
SATA

SEQ ID NO: 994468 - protein, 11 aa, Mycobacterium
SATADITDPRG

SEQ ID NO: 994469 - protein, 17 aa, Mycobacterium
SATASTCSRSTEEIGQT

SEQ ID NO: 994470 - protein, 8 aa, Mycobacterium
SATDAESA

SEQ ID NO: 994471 - protein, 6 aa, Mycobacterium
SATDRL

SEQ ID NO: 994472 - protein, 8 aa, Mycobacterium
SATEDAID

SEQ ID NO: 994473 - protein, 9 aa, Mycobacterium
SATHQGPAG

SEQ ID NO: 994474 - protein, 5 aa, Mycobacterium
SATNT

SEQ ID NO: 994475 - protein, 6 aa, Mycobacterium
SATPIT

SEQ ID NO: 994476 - protein, 7 aa, Mycobacterium
SATPKRA

SEQ ID NO: 994477 - protein, 9 aa, Mycobacterium
SATPTAAGR

SEQ ID NO: 994478 - protein, 21 aa, Mycobacterium
SATQAATNDRDSADLVTAATL

SEQ ID NO: 994479 - protein, 5 aa, Mycobacterium
SATQV

SEQ ID NO: 994480 - protein, 6 aa, Mycobacterium
SATQYP

SEQ ID NO: 994481 - protein, 7 aa, Mycobacterium
SATSDST

SEQ ID NO: 994482 - protein, 15 aa, Mycobacterium
SATSITSRAVSTRAI

SEQ ID NO: 994483 - protein, 9 aa, Mycobacterium
SATTDDEGR

SEQ ID NO: 994484 - protein, 8 aa, Mycobacterium
SATTGGKK

SEQ ID NO: 994485 - protein, 5 aa, Mycobacterium
SAVAG

SEQ ID NO: 994486 - protein, 7 aa, Mycobacterium
SAVGAGT

SEQ ID NO: 994487 - protein, 16 aa, Mycobacterium
SAVNQDGAPNGPSQQR

SEQ ID NO: 994488 - protein, 19 aa, Mycobacterium
SAVNQDGASNGLTAPNGLA

SEQ ID NO: 994489 - protein, 19 aa, Mycobacterium
SAVNQDGRSNGVTAPNTAA

SEQ ID NO: 994490 - protein, 12 aa, Mycobacterium
SAVPAPYGALNV

SEQ ID NO: 994491 - protein, 21 aa, Mycobacterium
SAVQSTGRGLLGSSSGGHVTA

SEQ ID NO: 994492 - protein, 9 aa, Mycobacterium
SAVTDGYRH

SEQ ID NO: 994493 - protein, 14 aa, Mycobacterium
SAVTDTRWVVVGVT

SEQ ID NO: 994494 - protein, 5 aa, Mycobacterium
SAVTE

SEQ ID NO: 994495 - protein, 10 aa, Mycobacterium
SAWSQPASTI

SEQ ID NO: 994496 - protein, 39 aa, Mycobacterium
SCAEGRVDQAATQLAQSTKAVAKESQTAPGWTGARGTPT

SEQ ID NO: 994497 - protein, 8 aa, Mycobacterium
SCAPPDVQ

SEQ ID NO: 994498 - protein, 5 aa, Mycobacterium
SCGLP

SEQ ID NO: 994499 - protein, 8 aa, Mycobacterium
SCNDPAAR

SEQ ID NO: 994500 - protein, 6 aa, Mycobacterium
SCPPGQ

SEQ ID NO: 994501 - protein, 22 aa, Mycobacterium
SCQAQSGTRAARGQLPAYNPNY

SEQ ID NO: 994502 - protein, 8 aa, Mycobacterium
SCRQGTTR

SEQ ID NO: 994503 - protein, 10 aa, Mycobacterium
SCSGRAPRSQ

SEQ ID NO: 994504 - protein, 4 aa, Mycobacterium
SCTP

SEQ ID NO: 994505 - protein, 8 aa, Mycobacterium
SDAETAVG

SEQ ID NO: 994506 - protein, 5 aa, Mycobacterium
SDAGH

SEQ ID NO: 994507 - protein, 20 aa, Mycobacterium
SDAKSQVDRMASEARQHSER

SEQ ID NO: 994508 - protein, 9 aa, Mycobacterium
SDAPADEVV

SEQ ID NO: 994509 - protein, 13 aa, Mycobacterium
SDAPVPEHAIYRP

SEQ ID NO: 994510 - protein, 8 aa, Mycobacterium
SDATTREA

SEQ ID NO: 994511 - protein, 11 aa, Mycobacterium
SDAVKAKTAAV

SEQ ID NO: 994512 - protein, 8 aa, Mycobacterium
SDCDFGKG

SEQ ID NO: 994513 - protein, 7 aa, Mycobacterium
SDDHTVA

SEQ ID NO: 994514 - protein, 8 aa, Mycobacterium
SDDPDYPR

SEQ ID NO: 994515 - protein, 7 aa, Mycobacterium
SDDPGLA

SEQ ID NO: 994516 - protein, 10 aa, Mycobacterium
SDDPGSSARI

SEQ ID NO: 994517 - protein, 7 aa, Mycobacterium
SDDTVGR

SEQ ID NO: 994518 - protein, 7 aa, Mycobacterium
SDEAGTS

SEQ ID NO: 994519 - protein, 6 aa, Mycobacterium
SDEEIK

SEQ ID NO: 994520 - protein, 13 aa, Mycobacterium
SDELGHAGTDEAK

SEQ ID NO: 994521 - protein, 8 aa, Mycobacterium
SDEQRTKL

SEQ ID NO: 994522 - protein, 5 aa, Mycobacterium
SDEVT

SEQ ID NO: 994523 - protein, 5 aa, Mycobacterium
SDGDR

SEQ ID NO: 994524 - protein, 9 aa, Mycobacterium
SDGGGDQLP

SEQ ID NO: 994525 - protein, 4 aa, Mycobacterium
SDGI

SEQ ID NO: 994526 - protein, 4 aa, Mycobacterium
SDGK

SEQ ID NO: 994527 - protein, 8 aa, Mycobacterium
SDGKPAYI

SEQ ID NO: 994528 - protein, 9 aa, Mycobacterium
SDGKPTRIG

SEQ ID NO: 994529 - protein, 8 aa, Mycobacterium
SDGKTQVT

SEQ ID NO: 994530 - protein, 6 aa, Mycobacterium
SDGLPN

SEQ ID NO: 994531 - protein, 9 aa, Mycobacterium
SDGNAATQW

SEQ ID NO: 994532 - protein, 11 aa, Mycobacterium
SDGQPLPPDTV

SEQ ID NO: 994533 - protein, 4 aa, Mycobacterium
SDGR

SEQ ID NO: 994534 - protein, 8 aa, Mycobacterium
SDGRPHAL

SEQ ID NO: 994535 - protein, 10 aa, Mycobacterium
SDGSEADYTY

SEQ ID NO: 994536 - protein, 7 aa, Mycobacterium
SDGSSFG

SEQ ID NO: 994537 - protein, 10 aa, Mycobacterium
SDGSSVPARR

SEQ ID NO: 994538 - protein, 11 aa, Mycobacterium
SDGTLSSGRTL

SEQ ID NO: 994539 - protein, 4 aa, Mycobacterium
SDGV

SEQ ID NO: 994540 - protein, 17 aa, Mycobacterium
SDGVCSSTHPLRTNDPD

SEQ ID NO: 994541 - protein, 12 aa, Mycobacterium
SDIAGVGRGCAF

SEQ ID NO: 994542 - protein, 8 aa, Mycobacterium
SDISEAAY

SEQ ID NO: 994543 - protein, 7 aa, Mycobacterium
SDKAYSK

SEQ ID NO: 994544 - protein, 15 aa, Mycobacterium
SDKEEEDRRKKIRGG

SEQ ID NO: 994545 - protein, 5 aa, Mycobacterium
SDKNP

SEQ ID NO: 994546 - protein, 5 aa, Mycobacterium
SDKPY

SEQ ID NO: 994547 - protein, 5 aa, Mycobacterium
SDKSV

SEQ ID NO: 994548 - protein, 6 aa, Mycobacterium
SDLAPA

SEQ ID NO: 994549 - protein, 9 aa, Mycobacterium
SDLARRGPG

SEQ ID NO: 994550 - protein, 13 aa, Mycobacterium
SDLDRQESKEKTG

SEQ ID NO: 994551 - protein, 7 aa, Mycobacterium
SDLEPGT

SEQ ID NO: 994552 - protein, 12 aa, Mycobacterium
SDLGVNPSNDGT

SEQ ID NO: 994553 - protein, 5 aa, Mycobacterium
SDLPW

SEQ ID NO: 994554 - protein, 6 aa, Mycobacterium
SDLSGP

SEQ ID NO: 994555 - protein, 8 aa, Mycobacterium
SDNGASVA

SEQ ID NO: 994556 - protein, 7 aa, Mycobacterium
SDPAFQD

SEQ ID NO: 994557 - protein, 5 aa, Mycobacterium
SDPDG

SEQ ID NO: 994558 - protein, 6 aa, Mycobacterium
SDPGQP

SEQ ID NO: 994559 - protein, 15 aa, Mycobacterium
SDPGSAPKPTGDPSV

SEQ ID NO: 994560 - protein, 4 aa, Mycobacterium
SDPL

SEQ ID NO: 994561 - protein, 5 aa, Mycobacterium
SDPLS

SEQ ID NO: 994562 - protein, 11 aa, Mycobacterium
SDPPGLTPLPE

SEQ ID NO: 994563 - protein, 10 aa, Mycobacterium
SDPPTPEEVA

SEQ ID NO: 994564 - protein, 9 aa, Mycobacterium
SDPSDVARV

SEQ ID NO: 994565 - protein, 5 aa, Mycobacterium
SDPTV

SEQ ID NO: 994566 - protein, 13 aa, Mycobacterium
SDPVKRKEYDETR

SEQ ID NO: 994567 - protein, 4 aa, Mycobacterium
SDQE

SEQ ID NO: 994568 - protein, 7 aa, Mycobacterium
SDQGLVD

SEQ ID NO: 994569 - protein, 7 aa, Mycobacterium
SDQNQRN

SEQ ID NO: 994570 - protein, 15 aa, Mycobacterium
SDQPAADVQRAGGPG

SEQ ID NO: 994571 - protein, 11 aa, Mycobacterium
SDRDEAPATEQ

SEQ ID NO: 994572 - protein, 6 aa, Mycobacterium
SDRGIE

SEQ ID NO: 994573 - protein, 9 aa, Mycobacterium
SDRPPKQLA

SEQ ID NO: 994574 - protein, 8 aa, Mycobacterium
SDRPTKVF

SEQ ID NO: 994575 - protein, 10 aa, Mycobacterium
SDRQSRRGSV

SEQ ID NO: 994576 - protein, 7 aa, Mycobacterium
SDRSDRV

SEQ ID NO: 994577 - protein, 6 aa, Mycobacterium
SDRSHT

SEQ ID NO: 994578 - protein, 4 aa, Mycobacterium
SDRT

SEQ ID NO: 994579 - protein, 4 aa, Mycobacterium
SDRW

SEQ ID NO: 994580 - protein, 11 aa, Mycobacterium
SDSASSARQLS

SEQ ID NO: 994581 - protein, 12 aa, Mycobacterium
SDSITNALGGPG

SEQ ID NO: 994582 - protein, 7 aa, Mycobacterium
SDSLQDS

SEQ ID NO: 994583 - protein, 10 aa, Mycobacterium
SDSNKDGGYL

SEQ ID NO: 994584 - protein, 7 aa, Mycobacterium
SDSPVGK

SEQ ID NO: 994585 - protein, 7 aa, Mycobacterium
SDTAEAP

SEQ ID NO: 994586 - protein, 7 aa, Mycobacterium
SDTAEFG

SEQ ID NO: 994587 - protein, 6 aa, Mycobacterium
SDTDTE

SEQ ID NO: 994588 - protein, 8 aa, Mycobacterium
SDTRLAPK

SEQ ID NO: 994589 - protein, 19 aa, Mycobacterium
SDTSEPEDADSLTQSMPTR

SEQ ID NO: 994590 - protein, 19 aa, Mycobacterium
SDTTRYGTSPAQSSSKYHA

SEQ ID NO: 994591 - protein, 14 aa, Mycobacterium
SDVAGASARRGLSE

SEQ ID NO: 994592 - protein, 6 aa, Mycobacterium
SDVETS

SEQ ID NO: 994593 - protein, 6 aa, Mycobacterium
SDVLPE

SEQ ID NO: 994594 - protein, 11 aa, Mycobacterium
SDVPPRDAAER

SEQ ID NO: 994595 - protein, 17 aa, Mycobacterium
SDYTKSGKLPGTDVREG

SEQ ID NO: 994596 - protein, 9 aa, Mycobacterium
SEAARRYER

SEQ ID NO: 994597 - protein, 6 aa, Mycobacterium
SEADAI

SEQ ID NO: 994598 - protein, 9 aa, Mycobacterium
SEAGARSEI

SEQ ID NO: 994599 - protein, 20 aa, Mycobacterium
SEAGPTYGRAPSAPLRGQWL

SEQ ID NO: 994600 - protein, 4 aa, Mycobacterium
SEAR

SEQ ID NO: 994601 - protein, 10 aa, Mycobacterium
SEASRARQLA

SEQ ID NO: 994602 - protein, 7 aa, Mycobacterium
SEATHAD

SEQ ID NO: 994603 - protein, 8 aa, Mycobacterium
SEDDARVS

SEQ ID NO: 994604 - protein, 4 aa, Mycobacterium
SEDE

SEQ ID NO: 994605 - protein, 7 aa, Mycobacterium
SEDGARV

SEQ ID NO: 994606 - protein, 4 aa, Mycobacterium
SEDN

SEQ ID NO: 994607 - protein, 11 aa, Mycobacterium
SEDPAGLAEPD

SEQ ID NO: 994608 - protein, 13 aa, Mycobacterium
SEDTSGPSAVAGL

SEQ ID NO: 994609 - protein, 5 aa, Mycobacterium
SEDVR

SEQ ID NO: 994610 - protein, 8 aa, Mycobacterium
SEEAHDDR

SEQ ID NO: 994611 - protein, 5 aa, Mycobacterium
SEEGV

SEQ ID NO: 994612 - protein, 6 aa, Mycobacterium
SEEISS

SEQ ID NO: 994613 - protein, 5 aa, Mycobacterium
SEELK

SEQ ID NO: 994614 - protein, 7 aa, Mycobacterium
SEELRTG

SEQ ID NO: 994615 - protein, 5 aa, Mycobacterium
SEETG

SEQ ID NO: 994616 - protein, 7 aa, Mycobacterium
SEFPDRA

SEQ ID NO: 994617 - protein, 7 aa, Mycobacterium
SEGKGLS

SEQ ID NO: 994618 - protein, 7 aa, Mycobacterium
SEGPLPQ

SEQ ID NO: 994619 - protein, 15 aa, Mycobacterium
SEGQRIKPPPLQSNN

SEQ ID NO: 994620 - protein, 11 aa, Mycobacterium
SEIDKAGAELA

SEQ ID NO: 994621 - protein, 10 aa, Mycobacterium
SEIDPAALRT

SEQ ID NO: 994622 - protein, 5 aa, Mycobacterium
SEIGK

SEQ ID NO: 994623 - protein, 6 aa, Mycobacterium
SEIGRG

SEQ ID NO: 994624 - protein, 10 aa, Mycobacterium
SEIGSGSVPQ

SEQ ID NO: 994625 - protein, 17 aa, Mycobacterium
SEIPETMPDPDTDNEGC

SEQ ID NO: 994626 - protein, 4 aa, Mycobacterium
SEKI

SEQ ID NO: 994627 - protein, 5 aa, Mycobacterium
SEKLT

SEQ ID NO: 994628 - protein, 4 aa, Mycobacterium
SEKP

SEQ ID NO: 994629 - protein, 4 aa, Mycobacterium
SELA

SEQ ID NO: 994630 - protein, 24 aa, Mycobacterium
SELAGEASIDPGAQAGSGGHPRGR

SEQ ID NO: 994631 - protein, 8 aa, Mycobacterium
SELDGSLG

SEQ ID NO: 994632 - protein, 4 aa, Mycobacterium
SELG

SEQ ID NO: 994633 - protein, 19 aa, Mycobacterium
SELGSEAQRERHKRILNGP

SEQ ID NO: 994634 - protein, 4 aa, Mycobacterium
SELN

SEQ ID NO: 994635 - protein, 11 aa, Mycobacterium
SELRTKEGQDL

SEQ ID NO: 994636 - protein, 9 aa, Mycobacterium
SELSPHGKR

SEQ ID NO: 994637 - protein, 5 aa, Mycobacterium
SENDR

SEQ ID NO: 994638 - protein, 8 aa, Mycobacterium
SENETPEL

SEQ ID NO: 994639 - protein, 7 aa, Mycobacterium
SENNGYT

SEQ ID NO: 994640 - protein, 7 aa, Mycobacterium
SENPARI

SEQ ID NO: 994641 - protein, 18 aa, Mycobacterium
SENPEAAANVQARLETES

SEQ ID NO: 994642 - protein, 6 aa, Mycobacterium
SENTDG

SEQ ID NO: 994643 - protein, 6 aa, Mycobacterium
SEPAGV

SEQ ID NO: 994644 - protein, 7 aa, Mycobacterium
SEPGRSR

SEQ ID NO: 994645 - protein, 6 aa, Mycobacterium
SEPKNA

SEQ ID NO: 994646 - protein, 9 aa, Mycobacterium
SEPLTGQDQ

SEQ ID NO: 994647 - protein, 4 aa, Mycobacterium
SEPM

SEQ ID NO: 994648 - protein, 15 aa, Mycobacterium
SEPPQWPPAEAPEHQ

SEQ ID NO: 994649 - protein, 18 aa, Mycobacterium
SEPQFEGQTKTKLGNTEV

SEQ ID NO: 994650 - protein, 5 aa, Mycobacterium
SEPTY

SEQ ID NO: 994651 - protein, 7 aa, Mycobacterium
SEPYATR

SEQ ID NO: 994652 - protein, 6 aa, Mycobacterium
SEQIPA

SEQ ID NO: 994653 - protein, 7 aa, Mycobacterium
SEQSQQY

SEQ ID NO: 994654 - protein, 15 aa, Mycobacterium
SERAAKALSDTVTPT

SEQ ID NO: 994655 - protein, 22 aa, Mycobacterium
SEREAGSDAASMRTRAKADGDD

SEQ ID NO: 994656 - protein, 12 aa, Mycobacterium
SERERRRLKRGV

SEQ ID NO: 994657 - protein, 12 aa, Mycobacterium
SERGTKLPTAQR

SEQ ID NO: 994658 - protein, 5 aa, Mycobacterium
SERID

SEQ ID NO: 994659 - protein, 7 aa, Mycobacterium
SERIGRP

SEQ ID NO: 994660 - protein, 5 aa, Mycobacterium
SERIH

SEQ ID NO: 994661 - protein, 11 aa, Mycobacterium
SERQRATTDAR

SEQ ID NO: 994662 - protein, 4 aa, Mycobacterium
SERT

SEQ ID NO: 994663 - protein, 4 aa, Mycobacterium
SESA

SEQ ID NO: 994664 - protein, 4 aa, Mycobacterium
SESD

SEQ ID NO: 994665 - protein, 9 aa, Mycobacterium
SESEADQAR

SEQ ID NO: 994666 - protein, 4 aa, Mycobacterium
SESP

SEQ ID NO: 994667 - protein, 10 aa, Mycobacterium
SESPKDIADK

SEQ ID NO: 994668 - protein, 15 aa, Mycobacterium
SESPTTRPQCGCTAI

SEQ ID NO: 994669 - protein, 4 aa, Mycobacterium
SEST

SEQ ID NO: 994670 - protein, 11 aa, Mycobacterium
SESTSAHNRTH

SEQ ID NO: 994671 - protein, 10 aa, Mycobacterium
SETDMAGSDV

SEQ ID NO: 994672 - protein, 6 aa, Mycobacterium
SETHRR

SEQ ID NO: 994673 - protein, 10 aa, Mycobacterium
SETKASEGVI

SEQ ID NO: 994674 - protein, 14 aa, Mycobacterium
SETNTDAHLGNLHP

SEQ ID NO: 994675 - protein, 7 aa, Mycobacterium
SETSRLG

SEQ ID NO: 994676 - protein, 4 aa, Mycobacterium
SETY

SEQ ID NO: 994677 - protein, 6 aa, Mycobacterium
SEVAAA

SEQ ID NO: 994678 - protein, 22 aa, Mycobacterium
SEVEAPHHRARQSGRWLVPANQ

SEQ ID NO: 994679 - protein, 4 aa, Mycobacterium
SEVR

SEQ ID NO: 994680 - protein, 10 aa, Mycobacterium
SEVTDTEGKA

SEQ ID NO: 994681 - protein, 4 aa, Mycobacterium
SEYA

SEQ ID NO: 994682 - protein, 13 aa, Mycobacterium
SEYDESTGIPLPG

SEQ ID NO: 994683 - protein, 7 aa, Mycobacterium
SEYDPEL

SEQ ID NO: 994684 - protein, 4 aa, Mycobacterium
SEYS

SEQ ID NO: 994685 - protein, 8 aa, Mycobacterium
SFAGETSD

SEQ ID NO: 994686 - protein, 13 aa, Mycobacterium
SFAPAHPARRPPW

SEQ ID NO: 994687 - protein, 26 aa, Mycobacterium
SFAPNPARTANYEATKDLPPTTGDDS

SEQ ID NO: 994688 - protein, 5 aa, Mycobacterium
SFAPP

SEQ ID NO: 994689 - protein, 21 aa, Mycobacterium
SFASSGLAKPPEAAAHPAVPP

SEQ ID NO: 994690 - protein, 6 aa, Mycobacterium
SFDEKR

SEQ ID NO: 994691 - protein, 8 aa, Mycobacterium
SFEDPRTR

SEQ ID NO: 994692 - protein, 4 aa, Mycobacterium
SFEG

SEQ ID NO: 994693 - protein, 11 aa, Mycobacterium
SFGAPTPAETQ

SEQ ID NO: 994694 - protein, 9 aa, Mycobacterium
SFGGGGADV

SEQ ID NO: 994695 - protein, 12 aa, Mycobacterium
SFGPPSISTDEY

SEQ ID NO: 994696 - protein, 14 aa, Mycobacterium
SFGTATPAGSEEEA

SEQ ID NO: 994697 - protein, 5 aa, Mycobacterium
SFKDP

SEQ ID NO: 994698 - protein, 10 aa, Mycobacterium
SFNPANSVKD

SEQ ID NO: 994699 - protein, 4 aa, Mycobacterium
SFNQ

SEQ ID NO: 994700 - protein, 7 aa, Mycobacterium
SFNSPGE

SEQ ID NO: 994701 - protein, 12 aa, Mycobacterium
SFNSTQGFWPVS

SEQ ID NO: 994702 - protein, 6 aa, Mycobacterium
SFPEDN

SEQ ID NO: 994703 - protein, 12 aa, Mycobacterium
SFPEVPATERAE

SEQ ID NO: 994704 - protein, 13 aa, Mycobacterium
SFPNHEANPLDPA

SEQ ID NO: 994705 - protein, 21 aa, Mycobacterium
SFPQQGHSVPSVTQAAAAASG

SEQ ID NO: 994706 - protein, 6 aa, Mycobacterium
SFQETT

SEQ ID NO: 994707 - protein, 14 aa, Mycobacterium
SFRSSDNRGGANGD

SEQ ID NO: 994708 - protein, 12 aa, Mycobacterium
SFSEGSVSYAEA

SEQ ID NO: 994709 - protein, 6 aa, Mycobacterium
SFSGTE

SEQ ID NO: 994710 - protein, 12 aa, Mycobacterium
SFTSGDDRLDSQ

SEQ ID NO: 994711 - protein, 19 aa, Mycobacterium
SFTVGSKRVQERTAGGSGR

SEQ ID NO: 994712 - protein, 4 aa, Mycobacterium
SGAA

SEQ ID NO: 994713 - protein, 12 aa, Mycobacterium
SGAAYSPESARR

SEQ ID NO: 994714 - protein, 11 aa, Mycobacterium
SGAEPGAGETR

SEQ ID NO: 994715 - protein, 7 aa, Mycobacterium
SGAGATV

SEQ ID NO: 994716 - protein, 19 aa, Mycobacterium
SGAGGNIGIGGAPQTGKTT

SEQ ID NO: 994717 - protein, 9 aa, Mycobacterium
SGAGGVDAA

SEQ ID NO: 994718 - protein, 10 aa, Mycobacterium
SGAGRGTAAK

SEQ ID NO: 994719 - protein, 4 aa, Mycobacterium
SGAK

SEQ ID NO: 994720 - protein, 16 aa, Mycobacterium
SGAKIGSKGRPLPGAG

SEQ ID NO: 994721 - protein, 16 aa, Mycobacterium
SGALSEQVAHSDATEQ

SEQ ID NO: 994722 - protein, 5 aa, Mycobacterium
SGAMP

SEQ ID NO: 994723 - protein, 7 aa, Mycobacterium
SGANGLV

SEQ ID NO: 994724 - protein, 19 aa, Mycobacterium
SGANPKPVGSCAHGERPQR

SEQ ID NO: 994725 - protein, 6 aa, Mycobacterium
SGAPEW

SEQ ID NO: 994726 - protein, 5 aa, Mycobacterium
SGATD

SEQ ID NO: 994727 - protein, 15 aa, Mycobacterium
SGATDAKQLSDLQPE

SEQ ID NO: 994728 - protein, 10 aa, Mycobacterium
SGATGNFTQT

SEQ ID NO: 994729 - protein, 9 aa, Mycobacterium
SGATSQRPV

SEQ ID NO: 994730 - protein, 24 aa, Mycobacterium
SGAVNSAPRAAANPHYDGDVPGMS

SEQ ID NO: 994731 - protein, 12 aa, Mycobacterium
SGDAEAQASAVA

SEQ ID NO: 994732 - protein, 10 aa, Mycobacterium
SGDDPSKVDE

SEQ ID NO: 994733 - protein, 5 aa, Mycobacterium
SGDGN

SEQ ID NO: 994734 - protein, 7 aa, Mycobacterium
SGDGTYV

SEQ ID NO: 994735 - protein, 7 aa, Mycobacterium
SGDNTAA

SEQ ID NO: 994736 - protein, 4 aa, Mycobacterium
SGDR

SEQ ID NO: 994737 - protein, 8 aa, Mycobacterium
SGDTGSCD

SEQ ID NO: 994738 - protein, 7 aa, Mycobacterium
SGDTPLL

SEQ ID NO: 994739 - protein, 6 aa, Mycobacterium
SGEATV

SEQ ID NO: 994740 - protein, 4 aa, Mycobacterium
SGEE

SEQ ID NO: 994741 - protein, 7 aa, Mycobacterium
SGEFENR

SEQ ID NO: 994742 - protein, 10 aa, Mycobacterium
SGEKTAGERF

SEQ ID NO: 994743 - protein, 4 aa, Mycobacterium
SGEL

SEQ ID NO: 994744 - protein, 7 aa, Mycobacterium
SGEPARL

SEQ ID NO: 994745 - protein, 12 aa, Mycobacterium
SGETGDFRPNPS

SEQ ID NO: 994746 - protein, 7 aa, Mycobacterium
SGEYAAT

SEQ ID NO: 994747 - protein, 31 aa, Mycobacterium
SGFGSTVASSEPGEPWLPPSPVPVRENSPAK

SEQ ID NO: 994748 - protein, 6 aa, Mycobacterium
SGGAGA

SEQ ID NO: 994749 - protein, 22 aa, Mycobacterium
SGGANACTGPAGFQDAHTTAEA

SEQ ID NO: 994750 - protein, 16 aa, Mycobacterium
SGGASCSSATASTLTI

SEQ ID NO: 994751 - protein, 6 aa, Mycobacterium
SGGEAP

SEQ ID NO: 994752 - protein, 6 aa, Mycobacterium
SGGEKS

SEQ ID NO: 994753 - protein, 7 aa, Mycobacterium
SGGGVIR

SEQ ID NO: 994754 - protein, 7 aa, Mycobacterium
SGGIGGA

SEQ ID NO: 994755 - protein, 4 aa, Mycobacterium
SGGL

SEQ ID NO: 994756 - protein, 8 aa, Mycobacterium
SGGLADEV

SEQ ID NO: 994757 - protein, 5 aa, Mycobacterium
SGGPE

SEQ ID NO: 994758 - protein, 7 aa, Mycobacterium
SGGQRRR

SEQ ID NO: 994759 - protein, 11 aa, Mycobacterium
SGGRCSCGGGQ

SEQ ID NO: 994760 - protein, 7 aa, Mycobacterium
SGGSDSL

SEQ ID NO: 994761 - protein, 9 aa, Mycobacterium
SGGSGRRLS

SEQ ID NO: 994762 - protein, 4 aa, Mycobacterium
SGGV

SEQ ID NO: 994763 - protein, 12 aa, Mycobacterium
SGGYAKRTSIEE

SEQ ID NO: 994764 - protein, 11 aa, Mycobacterium
SGHGRGSNHAA

SEQ ID NO: 994765 - protein, 23 aa, Mycobacterium
SGHLKSPAQKTAAEKIGSKAASK

SEQ ID NO: 994766 - protein, 8 aa, Mycobacterium
SGHPLERE

SEQ ID NO: 994767 - protein, 22 aa, Mycobacterium
SGHSAFPPAESARSPTPASSRM

SEQ ID NO: 994768 - protein, 7 aa, Mycobacterium
SGHSSGR

SEQ ID NO: 994769 - protein, 11 aa, Mycobacterium
SGHTDEQDDAL

SEQ ID NO: 994770 - protein, 12 aa, Mycobacterium
SGIAAASYASAN

SEQ ID NO: 994771 - protein, 15 aa, Mycobacterium
SGIAGPGGGTAEKPI

SEQ ID NO: 994772 - protein, 5 aa, Mycobacterium
SGIEV

SEQ ID NO: 994773 - protein, 19 aa, Mycobacterium
SGIGESDGGESGSSDEDGR

SEQ ID NO: 994774 - protein, 5 aa, Mycobacterium
SGIRK

SEQ ID NO: 994775 - protein, 12 aa, Mycobacterium
SGISTSGRASEL

SEQ ID NO: 994776 - protein, 16 aa, Mycobacterium
SGITDADLAKEPDFSA

SEQ ID NO: 994777 - protein, 10 aa, Mycobacterium
SGITDPAHER

SEQ ID NO: 994778 - protein, 5 aa, Mycobacterium
SGITG

SEQ ID NO: 994779 - protein, 10 aa, Mycobacterium
SGKDEFESIE

SEQ ID NO: 994780 - protein, 4 aa, Mycobacterium
SGKL

SEQ ID NO: 994781 - protein, 4 aa, Mycobacterium
SGKT

SEQ ID NO: 994782 - protein, 9 aa, Mycobacterium
SGKTGEGVS

SEQ ID NO: 994783 - protein, 13 aa, Mycobacterium
SGKTGTTEAHRSS

SEQ ID NO: 994784 - protein, 16 aa, Mycobacterium
SGLAETLRDAQASIPG

SEQ ID NO: 994785 - protein, 22 aa, Mycobacterium
SGLDDRSARARVREQIPDADTQ

SEQ ID NO: 994786 - protein, 6 aa, Mycobacterium
SGLEAD

SEQ ID NO: 994787 - protein, 5 aa, Mycobacterium
SGLGI

SEQ ID NO: 994788 - protein, 9 aa, Mycobacterium
SGLHSNGYS

SEQ ID NO: 994789 - protein, 22 aa, Mycobacterium
SGLLTDRQAARQGVGGEVLAYV

SEQ ID NO: 994790 - protein, 10 aa, Mycobacterium
SGLPAGHGLN

SEQ ID NO: 994791 - protein, 5 aa, Mycobacterium
SGLPG

SEQ ID NO: 994792 - protein, 12 aa, Mycobacterium
SGLRRPANGDTP

SEQ ID NO: 994793 - protein, 7 aa, Mycobacterium
SGLSQER

SEQ ID NO: 994794 - protein, 5 aa, Mycobacterium
SGLSS

SEQ ID NO: 994795 - protein, 7 aa, Mycobacterium
SGLTERQ

SEQ ID NO: 994796 - protein, 5 aa, Mycobacterium
SGMAA

SEQ ID NO: 994797 - protein, 13 aa, Mycobacterium
SGMAHSDEEVGRM

SEQ ID NO: 994798 - protein, 10 aa, Mycobacterium
SGNAAVADEQ

SEQ ID NO: 994799 - protein, 23 aa, Mycobacterium
SGNPPTRERIQSPTDRARYDDTT

SEQ ID NO: 994800 - protein, 4 aa, Mycobacterium
SGNQ

SEQ ID NO: 994801 - protein, 15 aa, Mycobacterium
SGNRTMSADDPEAVE

SEQ ID NO: 994802 - protein, 5 aa, Mycobacterium
SGPAR

SEQ ID NO: 994803 - protein, 10 aa, Mycobacterium
SGPDAGRTSR

SEQ ID NO: 994804 - protein, 15 aa, Mycobacterium
SGPEGPVAATLRRPL

SEQ ID NO: 994805 - protein, 7 aa, Mycobacterium
SGPERAQ

SEQ ID NO: 994806 - protein, 7 aa, Mycobacterium
SGPGSAP

SEQ ID NO: 994807 - protein, 19 aa, Mycobacterium
SGPGSEPGESRVYQPGDDV

SEQ ID NO: 994808 - protein, 5 aa, Mycobacterium
SGPIG

SEQ ID NO: 994809 - protein, 6 aa, Mycobacterium
SGPLTG

SEQ ID NO: 994810 - protein, 8 aa, Mycobacterium
SGPNRIGQ

SEQ ID NO: 994811 - protein, 8 aa, Mycobacterium
SGPQAAVS

SEQ ID NO: 994812 - protein, 5 aa, Mycobacterium
SGPQV

SEQ ID NO: 994813 - protein, 18 aa, Mycobacterium
SGPSHTRGTPPNVVETDS

SEQ ID NO: 994814 - protein, 23 aa, Mycobacterium
SGQAVSGSATATARIVRLRAHSD

SEQ ID NO: 994815 - protein, 12 aa, Mycobacterium
SGQDTKRGTFSQ

SEQ ID NO: 994816 - protein, 15 aa, Mycobacterium
SGQIKTGAPARSERV

SEQ ID NO: 994817 - protein, 7 aa, Mycobacterium
SGQLDPD

SEQ ID NO: 994818 - protein, 7 aa, Mycobacterium
SGQLEGS

SEQ ID NO: 994819 - protein, 8 aa, Mycobacterium
SGQPRAVS

SEQ ID NO: 994820 - protein, 6 aa, Mycobacterium
SGQPVY

SEQ ID NO: 994821 - protein, 23 aa, Mycobacterium
SGQRSSTATSRPCTSACGLCHRY

SEQ ID NO: 994822 - protein, 4 aa, Mycobacterium
SGQT

SEQ ID NO: 994823 - protein, 9 aa, Mycobacterium
SGQTSITTI

SEQ ID NO: 994824 - protein, 23 aa, Mycobacterium
SGRAGIASTEQPADGAVPTGDNL

SEQ ID NO: 994825 - protein, 8 aa, Mycobacterium
SGRCTAKE

SEQ ID NO: 994826 - protein, 20 aa, Mycobacterium
SGRGDKDIEAAAKWFGLLGT

SEQ ID NO: 994827 - protein, 8 aa, Mycobacterium
SGRGLERT

SEQ ID NO: 994828 - protein, 6 aa, Mycobacterium
SGRGQD

SEQ ID NO: 994829 - protein, 31 aa, Mycobacterium
SGRGTDARLESTDPVGTAERKVARHQRHKHG

SEQ ID NO: 994830 - protein, 6 aa, Mycobacterium
SGRKPC

SEQ ID NO: 994831 - protein, 7 aa, Mycobacterium
SGRSQAT

SEQ ID NO: 994832 - protein, 17 aa, Mycobacterium
SGRSTNEITEQQIRDAA

SEQ ID NO: 994833 - protein, 7 aa, Mycobacterium
SGRTGVS

SEQ ID NO: 994834 - protein, 7 aa, Mycobacterium
SGRVDQR

SEQ ID NO: 994835 - protein, 14 aa, Mycobacterium
SGRVSGVTEPGDRS

SEQ ID NO: 994836 - protein, 24 aa, Mycobacterium
SGSAKKDAKGAVSTAAAAEAGGLE

SEQ ID NO: 994837 - protein, 12 aa, Mycobacterium
SGSDGAHPTQLP

SEQ ID NO: 994838 - protein, 4 aa, Mycobacterium
SGSL

SEQ ID NO: 994839 - protein, 11 aa, Mycobacterium
SGSPITIGRAE

SEQ ID NO: 994840 - protein, 5 aa, Mycobacterium
SGSPM

SEQ ID NO: 994841 - protein, 10 aa, Mycobacterium
SGSQRTIPAG

SEQ ID NO: 994842 - protein, 7 aa, Mycobacterium
SGSRAGD

SEQ ID NO: 994843 - protein, 23 aa, Mycobacterium
SGSSTRFQAGLPNNGSMSRGSAT

SEQ ID NO: 994844 - protein, 9 aa, Mycobacterium
SGSTDETEI

SEQ ID NO: 994845 - protein, 6 aa, Mycobacterium
SGSTEF

SEQ ID NO: 994846 - protein, 10 aa, Mycobacterium
SGSTGAPKGA

SEQ ID NO: 994847 - protein, 10 aa, Mycobacterium
SGSTGRPKGV

SEQ ID NO: 994848 - protein, 6 aa, Mycobacterium
SGSVSV

SEQ ID NO: 994849 - protein, 13 aa, Mycobacterium
SGTAEPDPELTEK

SEQ ID NO: 994850 - protein, 7 aa, Mycobacterium
SGTAVAN

SEQ ID NO: 994851 - protein, 4 aa, Mycobacterium
SGTD

SEQ ID NO: 994852 - protein, 10 aa, Mycobacterium
SGTDGPGLEA

SEQ ID NO: 994853 - protein, 14 aa, Mycobacterium
SGTEAGRAAAQASV

SEQ ID NO: 994854 - protein, 7 aa, Mycobacterium
SGTEIGT

SEQ ID NO: 994855 - protein, 6 aa, Mycobacterium
SGTEPK

SEQ ID NO: 994856 - protein, 7 aa, Mycobacterium
SGTEPST

SEQ ID NO: 994857 - protein, 8 aa, Mycobacterium
SGTGGVGQ

SEQ ID NO: 994858 - protein, 5 aa, Mycobacterium
SGTGN

SEQ ID NO: 994859 - protein, 17 aa, Mycobacterium
SGTHRGDAAQRRTSQDA

SEQ ID NO: 994860 - protein, 4 aa, Mycobacterium
SGTL

SEQ ID NO: 994861 - protein, 8 aa, Mycobacterium
SGTTGEPK

SEQ ID NO: 994862 - protein, 9 aa, Mycobacterium
SGTTGPPKG

SEQ ID NO: 994863 - protein, 9 aa, Mycobacterium
SGTTGRPKG

SEQ ID NO: 994864 - protein, 10 aa, Mycobacterium
SGTTGRPKGC

SEQ ID NO: 994865 - protein, 11 aa, Mycobacterium
SGTTGRPKGCQ

SEQ ID NO: 994866 - protein, 4 aa, Mycobacterium
SGTV

SEQ ID NO: 994867 - protein, 5 aa, Mycobacterium
SGVAG

SEQ ID NO: 994868 - protein, 6 aa, Mycobacterium
SGVDED

SEQ ID NO: 994869 - protein, 5 aa, Mycobacterium
SGVIE

SEQ ID NO: 994870 - protein, 5 aa, Mycobacterium
SGVNR

SEQ ID NO: 994871 - protein, 5 aa, Mycobacterium
SGVPD

SEQ ID NO: 994872 - protein, 16 aa, Mycobacterium
SGVPGQANYAASKSGL

SEQ ID NO: 994873 - protein, 15 aa, Mycobacterium
SGVQAELANTRAASL

SEQ ID NO: 994874 - protein, 12 aa, Mycobacterium
SGVQPARLHSRV

SEQ ID NO: 994875 - protein, 7 aa, Mycobacterium
SGVRGPA

SEQ ID NO: 994876 - protein, 26 aa, Mycobacterium
SGVRSRPETPLSANSGAKGLSPIDEE

SEQ ID NO: 994877 - protein, 9 aa, Mycobacterium
SGVSLSSKD

SEQ ID NO: 994878 - protein, 5 aa, Mycobacterium
SGVSP

SEQ ID NO: 994879 - protein, 8 aa, Mycobacterium
SGYPGGLR

SEQ ID NO: 994880 - protein, 5 aa, Mycobacterium
SGYSD

SEQ ID NO: 994881 - protein, 19 aa, Mycobacterium
SGYSDPAGTHFAQLIAPLG

SEQ ID NO: 994882 - protein, 6 aa, Mycobacterium
SGYVRP

SEQ ID NO: 994883 - protein, 8 aa, Mycobacterium
SHAEWSPA

SEQ ID NO: 994884 - protein, 5 aa, Mycobacterium
SHATE

SEQ ID NO: 994885 - protein, 12 aa, Mycobacterium
SHDATRDAVAEK

SEQ ID NO: 994886 - protein, 4 aa, Mycobacterium
SHDR

SEQ ID NO: 994887 - protein, 6 aa, Mycobacterium
SHDTLT

SEQ ID NO: 994888 - protein, 13 aa, Mycobacterium
SHDVGRGRGGIGT

SEQ ID NO: 994889 - protein, 27 aa, Mycobacterium
SHFDSGAAAGPKVAAGGGVSTDDTPGA

SEQ ID NO: 994890 - protein, 8 aa, Mycobacterium
SHGNDPLT

SEQ ID NO: 994891 - protein, 6 aa, Mycobacterium
SHGRGA

SEQ ID NO: 994892 - protein, 9 aa, Mycobacterium
SHGSVSTIG

SEQ ID NO: 994893 - protein, 10 aa, Mycobacterium
SHIPQDNATT

SEQ ID NO: 994894 - protein, 7 aa, Mycobacterium
SHNHPSY

SEQ ID NO: 994895 - protein, 9 aa, Mycobacterium
SHNPPTDNG

SEQ ID NO: 994896 - protein, 7 aa, Mycobacterium
SHNPQED

SEQ ID NO: 994897 - protein, 9 aa, Mycobacterium
SHPDALPAD

SEQ ID NO: 994898 - protein, 9 aa, Mycobacterium
SHPPNPKAT

SEQ ID NO: 994899 - protein, 10 aa, Mycobacterium
SHPSKNPLRT

SEQ ID NO: 994900 - protein, 9 aa, Mycobacterium
SHPSVVPDR

SEQ ID NO: 994901 - protein, 14 aa, Mycobacterium
SHRNLRGSGHHRNQ

SEQ ID NO: 994902 - protein, 7 aa, Mycobacterium
SHRQAPV

SEQ ID NO: 994903 - protein, 5 aa, Mycobacterium
SHRQQ

SEQ ID NO: 994904 - protein, 5 aa, Mycobacterium
SHRVG

SEQ ID NO: 994905 - protein, 5 aa, Mycobacterium
SHSAQ

SEQ ID NO: 994906 - protein, 5 aa, Mycobacterium
SHSDK

SEQ ID NO: 994907 - protein, 6 aa, Mycobacterium
SHSGSL

SEQ ID NO: 994908 - protein, 14 aa, Mycobacterium
SHSHRRTSRRWDPN

SEQ ID NO: 994909 - protein, 9 aa, Mycobacterium
SHSTPRAGD

SEQ ID NO: 994910 - protein, 7 aa, Mycobacterium
SHTPQVE

SEQ ID NO: 994911 - protein, 8 aa, Mycobacterium
SHTSTHGA

SEQ ID NO: 994912 - protein, 5 aa, Mycobacterium
SIAER

SEQ ID NO: 994913 - protein, 7 aa, Mycobacterium
SIAKTDT

SEQ ID NO: 994914 - protein, 10 aa, Mycobacterium
SIAPPDPDGQ

SEQ ID NO: 994915 - protein, 19 aa, Mycobacterium
SIDDRTRLERNPCTFDFTG

SEQ ID NO: 994916 - protein, 5 aa, Mycobacterium
SIDGL

SEQ ID NO: 994917 - protein, 6 aa, Mycobacterium
SIEGDT

SEQ ID NO: 994918 - protein, 7 aa, Mycobacterium
SIGGRGS

SEQ ID NO: 994919 - protein, 5 aa, Mycobacterium
SIGPG

SEQ ID NO: 994920 - protein, 4 aa, Mycobacterium
SIGQ

SEQ ID NO: 994921 - protein, 9 aa, Mycobacterium
SIHPTSDTH

SEQ ID NO: 994922 - protein, 4 aa, Mycobacterium
SIKP

SEQ ID NO: 994923 - protein, 8 aa, Mycobacterium
SIPATSPV

SEQ ID NO: 994924 - protein, 13 aa, Mycobacterium
SIPITTSGKVRRS

SEQ ID NO: 994925 - protein, 14 aa, Mycobacterium
SIPITTSGKVRRST

SEQ ID NO: 994926 - protein, 5 aa, Mycobacterium
SIPPS

SEQ ID NO: 994927 - protein, 7 aa, Mycobacterium
SIPPYAG

SEQ ID NO: 994928 - protein, 4 aa, Mycobacterium
SIPT

SEQ ID NO: 994929 - protein, 10 aa, Mycobacterium
SIPTRTPNTM

SEQ ID NO: 994930 - protein, 12 aa, Mycobacterium
SIPVTTSGKVRR

SEQ ID NO: 994931 - protein, 4 aa, Mycobacterium
SIQR

SEQ ID NO: 994932 - protein, 18 aa, Mycobacterium
SIQSGPGGISADVGPDVP

SEQ ID NO: 994933 - protein, 7 aa, Mycobacterium
SISDGAD

SEQ ID NO: 994934 - protein, 21 aa, Mycobacterium
SISGAEVGCQGEVGSAASMAA

SEQ ID NO: 994935 - protein, 14 aa, Mycobacterium
SISPNSYNTARVDP

SEQ ID NO: 994936 - protein, 6 aa, Mycobacterium
SITASG

SEQ ID NO: 994937 - protein, 4 aa, Mycobacterium
SKAD

SEQ ID NO: 994938 - protein, 4 aa, Mycobacterium
SKAE

SEQ ID NO: 994939 - protein, 5 aa, Mycobacterium
SKASG

SEQ ID NO: 994940 - protein, 16 aa, Mycobacterium
SKASGPLACGSCPVHG

SEQ ID NO: 994941 - protein, 19 aa, Mycobacterium
SKEIDQATRDRNVRRRARE

SEQ ID NO: 994942 - protein, 6 aa, Mycobacterium
SKESLR

SEQ ID NO: 994943 - protein, 10 aa, Mycobacterium
SKFSRPNDRR

SEQ ID NO: 994944 - protein, 13 aa, Mycobacterium
SKGKVDPGETAPM

SEQ ID NO: 994945 - protein, 4 aa, Mycobacterium
SKGS

SEQ ID NO: 994946 - protein, 12 aa, Mycobacterium
SKIKATVEGRPK

SEQ ID NO: 994947 - protein, 7 aa, Mycobacterium
SKLAGEQ

SEQ ID NO: 994948 - protein, 5 aa, Mycobacterium
SKLPG

SEQ ID NO: 994949 - protein, 5 aa, Mycobacterium
SKLPR

SEQ ID NO: 994950 - protein, 15 aa, Mycobacterium
SKLVSPDTPLQPGQI

SEQ ID NO: 994951 - protein, 8 aa, Mycobacterium
SKPERAPT

SEQ ID NO: 994952 - protein, 5 aa, Mycobacterium
SKPGL

SEQ ID NO: 994953 - protein, 8 aa, Mycobacterium
SKPISPAQ

SEQ ID NO: 994954 - protein, 11 aa, Mycobacterium
SKPNPRTATNA

SEQ ID NO: 994955 - protein, 10 aa, Mycobacterium
SKPSSPTRSL

SEQ ID NO: 994956 - protein, 4 aa, Mycobacterium
SKPV

SEQ ID NO: 994957 - protein, 12 aa, Mycobacterium
SKQDDDTGRTAG

SEQ ID NO: 994958 - protein, 12 aa, Mycobacterium
SKQGNGEPNPSW

SEQ ID NO: 994959 - protein, 6 aa, Mycobacterium
SKQIQT

SEQ ID NO: 994960 - protein, 6 aa, Mycobacterium
SKQKPY

SEQ ID NO: 994961 - protein, 6 aa, Mycobacterium
SKRAGL

SEQ ID NO: 994962 - protein, 16 aa, Mycobacterium
SKRPGTPAAELGGQLP

SEQ ID NO: 994963 - protein, 9 aa, Mycobacterium
SKRPRGSQL

SEQ ID NO: 994964 - protein, 5 aa, Mycobacterium
SKRQR

SEQ ID NO: 994965 - protein, 5 aa, Mycobacterium
SKSAA

SEQ ID NO: 994966 - protein, 12 aa, Mycobacterium
SKSAHTATSVAL

SEQ ID NO: 994967 - protein, 7 aa, Mycobacterium
SKSGKTR

SEQ ID NO: 994968 - protein, 6 aa, Mycobacterium
SKSGTV

SEQ ID NO: 994969 - protein, 14 aa, Mycobacterium
SKSLTSLTAAETEL

SEQ ID NO: 994970 - protein, 9 aa, Mycobacterium
SKSRDAETI

SEQ ID NO: 994971 - protein, 9 aa, Mycobacterium
SKSSSLAGY

SEQ ID NO: 994972 - protein, 8 aa, Mycobacterium
SKTRDAEA

SEQ ID NO: 994973 - protein, 22 aa, Mycobacterium
SKVPDSSMEVNDAEWTTNYSPI

SEQ ID NO: 994974 - protein, 16 aa, Mycobacterium
SLAARGERAVTAERML

SEQ ID NO: 994975 - protein, 5 aa, Mycobacterium
SLAEG

SEQ ID NO: 994976 - protein, 5 aa, Mycobacterium
SLAGD

SEQ ID NO: 994977 - protein, 7 aa, Mycobacterium
SLAGTQE

SEQ ID NO: 994978 - protein, 5 aa, Mycobacterium
SLAPA

SEQ ID NO: 994979 - protein, 14 aa, Mycobacterium
SLAPTTTKAAESAF

SEQ ID NO: 994980 - protein, 6 aa, Mycobacterium
SLATDS

SEQ ID NO: 994981 - protein, 9 aa, Mycobacterium
SLDQGGPCA

SEQ ID NO: 994982 - protein, 4 aa, Mycobacterium
SLDT

SEQ ID NO: 994983 - protein, 7 aa, Mycobacterium
SLEGGKQ

SEQ ID NO: 994984 - protein, 5 aa, Mycobacterium
SLGDE

SEQ ID NO: 994985 - protein, 8 aa, Mycobacterium
SLGGEQSG

SEQ ID NO: 994986 - protein, 12 aa, Mycobacterium
SLGGPETHHKKS

SEQ ID NO: 994987 - protein, 6 aa, Mycobacterium
SLGHSR

SEQ ID NO: 994988 - protein, 11 aa, Mycobacterium
SLGQRATSDWE

SEQ ID NO: 994989 - protein, 13 aa, Mycobacterium
SLGRGGAAEDGVS

SEQ ID NO: 994990 - protein, 21 aa, Mycobacterium
SLGSNGTASPTVVTLPSKTGT

SEQ ID NO: 994991 - protein, 4 aa, Mycobacterium
SLGT

SEQ ID NO: 994992 - protein, 15 aa, Mycobacterium
SLHTPEDEDVPDTGA

SEQ ID NO: 994993 - protein, 5 aa, Mycobacterium
SLPGE

SEQ ID NO: 994994 - protein, 14 aa, Mycobacterium
SLPGGRLRNDEDMT

SEQ ID NO: 994995 - protein, 18 aa, Mycobacterium
SLPPDTVAGIPSSATSVA

SEQ ID NO: 994996 - protein, 6 aa, Mycobacterium
SLPPEF

SEQ ID NO: 994997 - protein, 9 aa, Mycobacterium
SLPPETTSF

SEQ ID NO: 994998 - protein, 6 aa, Mycobacterium
SLPRMN

SEQ ID NO: 994999 - protein, 31 aa, Mycobacterium
SLPRSAGGQVARRGQLEKPGVHRPPVPGQLA

SEQ ID NO: 995000 - protein, 9 aa, Mycobacterium
SLPSASGSL

SEQ ID NO: 995001 - protein, 7 aa, Mycobacterium
SLPSPLN

SEQ ID NO: 995002 - protein, 5 aa, Mycobacterium
SLPSQ

SEQ ID NO: 995003 - protein, 7 aa, Mycobacterium
SLPSRTQ

SEQ ID NO: 995004 - protein, 14 aa, Mycobacterium
SLPSSPGVTGAAAA

SEQ ID NO: 995005 - protein, 12 aa, Mycobacterium
SLQPAESVNPGV

SEQ ID NO: 995006 - protein, 11 aa, Mycobacterium
SLQPDDNARHR

SEQ ID NO: 995007 - protein, 17 aa, Mycobacterium
SLQPQAGPALTQDKTFD

SEQ ID NO: 995008 - protein, 8 aa, Mycobacterium
SLQTLGGS

SEQ ID NO: 995009 - protein, 24 aa, Mycobacterium
SLREDQGRTIAPDCPPPQQDGNPR

SEQ ID NO: 995010 - protein, 8 aa, Mycobacterium
SLREGHAS

SEQ ID NO: 995011 - protein, 5 aa, Mycobacterium
SLRGE

SEQ ID NO: 995012 - protein, 8 aa, Mycobacterium
SLRGSATG

SEQ ID NO: 995013 - protein, 24 aa, Mycobacterium
SLRPRPESSLTTNGVGLTRKCWHS

SEQ ID NO: 995014 - protein, 8 aa, Mycobacterium
SLRPRSAV

SEQ ID NO: 995015 - protein, 23 aa, Mycobacterium
SLRRTRKRRPDLSGARFVWGLGL

SEQ ID NO: 995016 - protein, 17 aa, Mycobacterium
SLRSAGGFDTVHHRPYR

SEQ ID NO: 995017 - protein, 15 aa, Mycobacterium
SLRSGASSPTVFAAE

SEQ ID NO: 995018 - protein, 17 aa, Mycobacterium
SLRTGPSRLPHFIDTLP

SEQ ID NO: 995019 - protein, 5 aa, Mycobacterium
SLSAC

SEQ ID NO: 995020 - protein, 5 aa, Mycobacterium
SLSAG

SEQ ID NO: 995021 - protein, 18 aa, Mycobacterium
SLSAQNREPTIGGVEVGL

SEQ ID NO: 995022 - protein, 4 aa, Mycobacterium
SLSD

SEQ ID NO: 995023 - protein, 7 aa, Mycobacterium
SLSDSTL

SEQ ID NO: 995024 - protein, 17 aa, Mycobacterium
SLSGPLNLTGPAPVTNA

SEQ ID NO: 995025 - protein, 4 aa, Mycobacterium
SLSH

SEQ ID NO: 995026 - protein, 7 aa, Mycobacterium
SLSPAEA

SEQ ID NO: 995027 - protein, 8 aa, Mycobacterium
SLTARNSK

SEQ ID NO: 995028 - protein, 9 aa, Mycobacterium
SLTDKPVKG

SEQ ID NO: 995029 - protein, 11 aa, Mycobacterium
SLTEPGRSSAL

SEQ ID NO: 995030 - protein, 18 aa, Mycobacterium
SLTGEQRTQIEEVTNEAV

SEQ ID NO: 995031 - protein, 10 aa, Mycobacterium
SLTGHAKGGA

SEQ ID NO: 995032 - protein, 10 aa, Mycobacterium
SLTGIDGSGL

SEQ ID NO: 995033 - protein, 6 aa, Mycobacterium
SLTGTT

SEQ ID NO: 995034 - protein, 6 aa, Mycobacterium
SLTPER

SEQ ID NO: 995035 - protein, 4 aa, Mycobacterium
SLTS

SEQ ID NO: 995036 - protein, 9 aa, Mycobacterium
SLYEGTTAI

SEQ ID NO: 995037 - protein, 4 aa, Mycobacterium
SMAT

SEQ ID NO: 995038 - protein, 10 aa, Mycobacterium
SMGQENDGLD

SEQ ID NO: 995039 - protein, 9 aa, Mycobacterium
SMHASGRVD

SEQ ID NO: 995040 - protein, 9 aa, Mycobacterium
SMKPQTTRH

SEQ ID NO: 995041 - protein, 5 aa, Mycobacterium
SMPPE

SEQ ID NO: 995042 - protein, 12 aa, Mycobacterium
SMRSSSASTATL

SEQ ID NO: 995043 - protein, 6 aa, Mycobacterium
SMSANG

SEQ ID NO: 995044 - protein, 8 aa, Mycobacterium
SNAAYSAA

SEQ ID NO: 995045 - protein, 6 aa, Mycobacterium
SNADEL

SEQ ID NO: 995046 - protein, 7 aa, Mycobacterium
SNAEAEG

SEQ ID NO: 995047 - protein, 5 aa, Mycobacterium
SNAPL

SEQ ID NO: 995048 - protein, 8 aa, Mycobacterium
SNAPWPPE

SEQ ID NO: 995049 - protein, 5 aa, Mycobacterium
SNAQA

SEQ ID NO: 995050 - protein, 6 aa, Mycobacterium
SNARSN

SEQ ID NO: 995051 - protein, 8 aa, Mycobacterium
SNASSTMR

SEQ ID NO: 995052 - protein, 6 aa, Mycobacterium
SNAVTG

SEQ ID NO: 995053 - protein, 5 aa, Mycobacterium
SNDCG

SEQ ID NO: 995054 - protein, 6 aa, Mycobacterium
SNDFRP

SEQ ID NO: 995055 - protein, 7 aa, Mycobacterium
SNDNGGG

SEQ ID NO: 995056 - protein, 5 aa, Mycobacterium
SNEFT

SEQ ID NO: 995057 - protein, 8 aa, Mycobacterium
SNESAAVG

SEQ ID NO: 995058 - protein, 39 aa, Mycobacterium
SNGEWGKGIGKTFKGGVGEGAKGNDGTSAAVKSTEGSIT

SEQ ID NO: 995059 - protein, 8 aa, Mycobacterium
SNHYPDDI

SEQ ID NO: 995060 - protein, 29 aa, Mycobacterium
SNKAFKTTGCQPWQQTSNTTVSTDLPGPI

SEQ ID NO: 995061 - protein, 6 aa, Mycobacterium
SNKARA

SEQ ID NO: 995062 - protein, 4 aa, Mycobacterium
SNKP

SEQ ID NO: 995063 - protein, 15 aa, Mycobacterium
SNLAKDGPVHSQSQG

SEQ ID NO: 995064 - protein, 11 aa, Mycobacterium
SNLKTALPEAN

SEQ ID NO: 995065 - protein, 6 aa, Mycobacterium
SNLNGH

SEQ ID NO: 995066 - protein, 7 aa, Mycobacterium
SNLQTGA

SEQ ID NO: 995067 - protein, 19 aa, Mycobacterium
SNNFTDAPRYSKPVPHGSI

SEQ ID NO: 995068 - protein, 13 aa, Mycobacterium
SNNLSGDELVWIV

SEQ ID NO: 995069 - protein, 7 aa, Mycobacterium
SNNTQQE

SEQ ID NO: 995070 - protein, 12 aa, Mycobacterium
SNNVGTGELSDE

SEQ ID NO: 995071 - protein, 6 aa, Mycobacterium
SNPATI

SEQ ID NO: 995072 - protein, 10 aa, Mycobacterium
SNPDSSGIDM

SEQ ID NO: 995073 - protein, 15 aa, Mycobacterium
SNPQPEIYSTKSTNY

SEQ ID NO: 995074 - protein, 19 aa, Mycobacterium
SNPSRRVNPDADVISHMRY

SEQ ID NO: 995075 - protein, 4 aa, Mycobacterium
SNQF

SEQ ID NO: 995076 - protein, 16 aa, Mycobacterium
SNQGASTLGFGHVGRS

SEQ ID NO: 995077 - protein, 10 aa, Mycobacterium
SNQKDKAAEI

SEQ ID NO: 995078 - protein, 10 aa, Mycobacterium
SNRDRSTKLK

SEQ ID NO: 995079 - protein, 6 aa, Mycobacterium
SNREDM

SEQ ID NO: 995080 - protein, 5 aa, Mycobacterium
SNREK

SEQ ID NO: 995081 - protein, 4 aa, Mycobacterium
SNRV

SEQ ID NO: 995082 - protein, 15 aa, Mycobacterium
SNSASSSARFNHSDA

SEQ ID NO: 995083 - protein, 11 aa, Mycobacterium
SNSSATMSRPD

SEQ ID NO: 995084 - protein, 6 aa, Mycobacterium
SNSVPE

SEQ ID NO: 995085 - protein, 7 aa, Mycobacterium
SNTKRLP

SEQ ID NO: 995086 - protein, 6 aa, Mycobacterium
SNTRGN

SEQ ID NO: 995087 - protein, 8 aa, Mycobacterium
SNTSSNIV

SEQ ID NO: 995088 - protein, 10 aa, Mycobacterium
SNVDQSPVNP

SEQ ID NO: 995089 - protein, 7 aa, Mycobacterium
SNVDTDQ

SEQ ID NO: 995090 - protein, 11 aa, Mycobacterium
SNVEDQGSDRV

SEQ ID NO: 995091 - protein, 4 aa, Mycobacterium
SNVM

SEQ ID NO: 995092 - protein, 30 aa, Mycobacterium
SNVTTAINQTNDRPASGHQYQDGLQNTSTT

SEQ ID NO: 995093 - protein, 5 aa, Mycobacterium
SNVVE

SEQ ID NO: 995094 - protein, 5 aa, Mycobacterium
SPADE

SEQ ID NO: 995095 - protein, 34 aa, Mycobacterium
SPAEHPYGSASAGSKYQGQRGPTPSRSYENFIKN

SEQ ID NO: 995096 - protein, 4 aa, Mycobacterium
SPAK

SEQ ID NO: 995097 - protein, 6 aa, Mycobacterium
SPAPCT

SEQ ID NO: 995098 - protein, 14 aa, Mycobacterium
SPAPSCIGAEPVVI

SEQ ID NO: 995099 - protein, 6 aa, Mycobacterium
SPARGA

SEQ ID NO: 995100 - protein, 4 aa, Mycobacterium
SPAS

SEQ ID NO: 995101 - protein, 6 aa, Mycobacterium
SPASGY

SEQ ID NO: 995102 - protein, 8 aa, Mycobacterium
SPATPSSI

SEQ ID NO: 995103 - protein, 8 aa, Mycobacterium
SPATPTTA

SEQ ID NO: 995104 - protein, 8 aa, Mycobacterium
SPAVAKRA

SEQ ID NO: 995105 - protein, 11 aa, Mycobacterium
SPCRPDGTPSS

SEQ ID NO: 995106 - protein, 4 aa, Mycobacterium
SPCS

SEQ ID NO: 995107 - protein, 8 aa, Mycobacterium
SPDADTAD

SEQ ID NO: 995108 - protein, 24 aa, Mycobacterium
SPDARAATCPAHTPRTGKPPPAQM

SEQ ID NO: 995109 - protein, 6 aa, Mycobacterium
SPDENS

SEQ ID NO: 995110 - protein, 6 aa, Mycobacterium
SPDERY

SEQ ID NO: 995111 - protein, 5 aa, Mycobacterium
SPDGN

SEQ ID NO: 995112 - protein, 13 aa, Mycobacterium
SPDGRNRGSSSLR

SEQ ID NO: 995113 - protein, 6 aa, Mycobacterium
SPDPLT

SEQ ID NO: 995114 - protein, 7 aa, Mycobacterium
SPDSGRV

SEQ ID NO: 995115 - protein, 35 aa, Mycobacterium
SPDSQPAPDAQSSKLATPQAAAEPTPGMGAPNAAA

SEQ ID NO: 995116 - protein, 9 aa, Mycobacterium
SPEDRPALK

SEQ ID NO: 995117 - protein, 13 aa, Mycobacterium
SPEEAAERRVTGS

SEQ ID NO: 995118 - protein, 8 aa, Mycobacterium
SPEGDDHT

SEQ ID NO: 995119 - protein, 12 aa, Mycobacterium
SPEPKASAGLGV

SEQ ID NO: 995120 - protein, 6 aa, Mycobacterium
SPESGF

SEQ ID NO: 995121 - protein, 10 aa, Mycobacterium
SPESYTGTEL

SEQ ID NO: 995122 - protein, 24 aa, Mycobacterium
SPFGTPSQSSQSNDLSATSLTQQL

SEQ ID NO: 995123 - protein, 11 aa, Mycobacterium
SPFPNTPAGQC

SEQ ID NO: 995124 - protein, 4 aa, Mycobacterium
SPGD

SEQ ID NO: 995125 - protein, 9 aa, Mycobacterium
SPGDDLTTS

SEQ ID NO: 995126 - protein, 4 aa, Mycobacterium
SPGI

SEQ ID NO: 995127 - protein, 6 aa, Mycobacterium
SPGMAR

SEQ ID NO: 995128 - protein, 6 aa, Mycobacterium
SPGPSI

SEQ ID NO: 995129 - protein, 6 aa, Mycobacterium
SPGRPI

SEQ ID NO: 995130 - protein, 10 aa, Mycobacterium
SPHPSPLSAS

SEQ ID NO: 995131 - protein, 17 aa, Mycobacterium
SPIGRERKTEELSRASV

SEQ ID NO: 995132 - protein, 17 aa, Mycobacterium
SPIPPNTPNIRDDASDR

SEQ ID NO: 995133 - protein, 6 aa, Mycobacterium
SPISTE

SEQ ID NO: 995134 - protein, 5 aa, Mycobacterium
SPITG

SEQ ID NO: 995135 - protein, 8 aa, Mycobacterium
SPKARDLA

SEQ ID NO: 995136 - protein, 6 aa, Mycobacterium
SPKGSA

SEQ ID NO: 995137 - protein, 7 aa, Mycobacterium
SPKTTAD

SEQ ID NO: 995138 - protein, 4 aa, Mycobacterium
SPLA

SEQ ID NO: 995139 - protein, 13 aa, Mycobacterium
SPLAQPGIGDAGG

SEQ ID NO: 995140 - protein, 9 aa, Mycobacterium
SPLGTGGGI

SEQ ID NO: 995141 - protein, 4 aa, Mycobacterium
SPLH

SEQ ID NO: 995142 - protein, 12 aa, Mycobacterium
SPLQRAYDTAAT

SEQ ID NO: 995143 - protein, 6 aa, Mycobacterium
SPLSAL

SEQ ID NO: 995144 - protein, 12 aa, Mycobacterium
SPMSKPAYTSPR

SEQ ID NO: 995145 - protein, 4 aa, Mycobacterium
SPNA

SEQ ID NO: 995146 - protein, 4 aa, Mycobacterium
SPNG

SEQ ID NO: 995147 - protein, 14 aa, Mycobacterium
SPNGGDKPTGGLAT

SEQ ID NO: 995148 - protein, 22 aa, Mycobacterium
SPNLDVENKSNIRLTDAPSTAY

SEQ ID NO: 995149 - protein, 6 aa, Mycobacterium
SPNRRE

SEQ ID NO: 995150 - protein, 9 aa, Mycobacterium
SPPARSEYR

SEQ ID NO: 995151 - protein, 16 aa, Mycobacterium
SPPMTGTGTLGVSSPR

SEQ ID NO: 995152 - protein, 7 aa, Mycobacterium
SPPNANS

SEQ ID NO: 995153 - protein, 5 aa, Mycobacterium
SPPPL

SEQ ID NO: 995154 - protein, 9 aa, Mycobacterium
SPPQFTSGG

SEQ ID NO: 995155 - protein, 5 aa, Mycobacterium
SPPQY

SEQ ID NO: 995156 - protein, 21 aa, Mycobacterium
SPPTIEPAQPADSPPVSQKPV

SEQ ID NO: 995157 - protein, 5 aa, Mycobacterium
SPQDI

SEQ ID NO: 995158 - protein, 6 aa, Mycobacterium
SPQLSY

SEQ ID NO: 995159 - protein, 6 aa, Mycobacterium
SPQPTD

SEQ ID NO: 995160 - protein, 4 aa, Mycobacterium
SPQQ

SEQ ID NO: 995161 - protein, 14 aa, Mycobacterium
SPQSTVIGGATETV

SEQ ID NO: 995162 - protein, 8 aa, Mycobacterium
SPRAGRGD

SEQ ID NO: 995163 - protein, 5 aa, Mycobacterium
SPREE

SEQ ID NO: 995164 - protein, 16 aa, Mycobacterium
SPRQRTTLAEPGPVPA

SEQ ID NO: 995165 - protein, 16 aa, Mycobacterium
SPRRRPGRDNAEQTPS

SEQ ID NO: 995166 - protein, 6 aa, Mycobacterium
SPRYDA

SEQ ID NO: 995167 - protein, 5 aa, Mycobacterium
SPSDV

SEQ ID NO: 995168 - protein, 8 aa, Mycobacterium
SPSNPTGQ

SEQ ID NO: 995169 - protein, 7 aa, Mycobacterium
SPSRAAD

SEQ ID NO: 995170 - protein, 14 aa, Mycobacterium
SPSRASGGGRRYSQ

SEQ ID NO: 995171 - protein, 7 aa, Mycobacterium
SPSRSTF

SEQ ID NO: 995172 - protein, 12 aa, Mycobacterium
SPSSDGTRMQEG

SEQ ID NO: 995173 - protein, 6 aa, Mycobacterium
SPTDHA

SEQ ID NO: 995174 - protein, 15 aa, Mycobacterium
SPTETCGLNDRTDLP

SEQ ID NO: 995175 - protein, 6 aa, Mycobacterium
SPTGVP

SEQ ID NO: 995176 - protein, 5 aa, Mycobacterium
SPTKF

SEQ ID NO: 995177 - protein, 19 aa, Mycobacterium
SPTKGGSNIAVAAAKEAGR

SEQ ID NO: 995178 - protein, 4 aa, Mycobacterium
SPTR

SEQ ID NO: 995179 - protein, 6 aa, Mycobacterium
SPTSGS

SEQ ID NO: 995180 - protein, 13 aa, Mycobacterium
SPTSTVVGGDTQA

SEQ ID NO: 995181 - protein, 5 aa, Mycobacterium
SPYGA

SEQ ID NO: 995182 - protein, 8 aa, Mycobacterium
SPYRTPQT

SEQ ID NO: 995183 - protein, 4 aa, Mycobacterium
SPYV

SEQ ID NO: 995184 - protein, 5 aa, Mycobacterium
SQAGV

SEQ ID NO: 995185 - protein, 9 aa, Mycobacterium
SQAQPDDVS

SEQ ID NO: 995186 - protein, 8 aa, Mycobacterium
SQARNPKS

SEQ ID NO: 995187 - protein, 16 aa, Mycobacterium
SQATPSQSRQGSDHAA

SEQ ID NO: 995188 - protein, 9 aa, Mycobacterium
SQDPQRGAW

SEQ ID NO: 995189 - protein, 7 aa, Mycobacterium
SQEAEMQ

SEQ ID NO: 995190 - protein, 11 aa, Mycobacterium
SQEKAAAAWSG

SEQ ID NO: 995191 - protein, 13 aa, Mycobacterium
SQFGDDGVVEGEA

SEQ ID NO: 995192 - protein, 8 aa, Mycobacterium
SQGAPEDL

SEQ ID NO: 995193 - protein, 7 aa, Mycobacterium
SQIATTG

SEQ ID NO: 995194 - protein, 7 aa, Mycobacterium
SQIGEDC

SEQ ID NO: 995195 - protein, 4 aa, Mycobacterium
SQLH

SEQ ID NO: 995196 - protein, 9 aa, Mycobacterium
SQLKSDRAR

SEQ ID NO: 995197 - protein, 10 aa, Mycobacterium
SQLQPSQPDC

SEQ ID NO: 995198 - protein, 11 aa, Mycobacterium
SQMTQRRDEPA

SEQ ID NO: 995199 - protein, 12 aa, Mycobacterium
SQNRGSKSTIVP

SEQ ID NO: 995200 - protein, 6 aa, Mycobacterium
SQPEAQ

SEQ ID NO: 995201 - protein, 7 aa, Mycobacterium
SQPGARS

SEQ ID NO: 995202 - protein, 12 aa, Mycobacterium
SQPLDTDKNGKA

SEQ ID NO: 995203 - protein, 22 aa, Mycobacterium
SQQHRDSGNSRHTGNNQRGQEG

SEQ ID NO: 995204 - protein, 8 aa, Mycobacterium
SQQKSDRL

SEQ ID NO: 995205 - protein, 7 aa, Mycobacterium
SQQYGVD

SEQ ID NO: 995206 - protein, 5 aa, Mycobacterium
SQREI

SEQ ID NO: 995207 - protein, 14 aa, Mycobacterium
SQRHPELSCTENDA

SEQ ID NO: 995208 - protein, 4 aa, Mycobacterium
SQRP

SEQ ID NO: 995209 - protein, 7 aa, Mycobacterium
SQRVRNR

SEQ ID NO: 995210 - protein, 10 aa, Mycobacterium
SQSGETADTL

SEQ ID NO: 995211 - protein, 6 aa, Mycobacterium
SQSGPL

SEQ ID NO: 995212 - protein, 9 aa, Mycobacterium
SQSTKARRM

SEQ ID NO: 995213 - protein, 6 aa, Mycobacterium
SQTQRD

SEQ ID NO: 995214 - protein, 6 aa, Mycobacterium
SQTSAG

SEQ ID NO: 995215 - protein, 15 aa, Mycobacterium
SQTTYGTVDKVIVDW

SEQ ID NO: 995216 - protein, 10 aa, Mycobacterium
SRADGRTQLP

SEQ ID NO: 995217 - protein, 5 aa, Mycobacterium
SRAFD

SEQ ID NO: 995218 - protein, 13 aa, Mycobacterium
SRAGTGASGSGTT

SEQ ID NO: 995219 - protein, 4 aa, Mycobacterium
SRAK

SEQ ID NO: 995220 - protein, 4 aa, Mycobacterium
SRAR

SEQ ID NO: 995221 - protein, 5 aa, Mycobacterium
SRARR

SEQ ID NO: 995222 - protein, 12 aa, Mycobacterium
SRARRSSGPNGK

SEQ ID NO: 995223 - protein, 28 aa, Mycobacterium
SRASPSWYERSAESVDNHSVRPNPTPRE

SEQ ID NO: 995224 - protein, 39 aa, Mycobacterium
SRATDEQRRRRERVNAERKATALRTQAAKMGAKATKAVA

SEQ ID NO: 995225 - protein, 7 aa, Mycobacterium
SRAVGPG

SEQ ID NO: 995226 - protein, 13 aa, Mycobacterium
SRDGKLDLWGALS

SEQ ID NO: 995227 - protein, 23 aa, Mycobacterium
SRDGPSRSYLGGRSVPAKSLGSF

SEQ ID NO: 995228 - protein, 5 aa, Mycobacterium
SRDLS

SEQ ID NO: 995229 - protein, 5 aa, Mycobacterium
SRDPV

SEQ ID NO: 995230 - protein, 6 aa, Mycobacterium
SREDTV

SEQ ID NO: 995231 - protein, 7 aa, Mycobacterium
SREEKSS

SEQ ID NO: 995232 - protein, 8 aa, Mycobacterium
SREGNAYL

SEQ ID NO: 995233 - protein, 7 aa, Mycobacterium
SREPDDG

SEQ ID NO: 995234 - protein, 6 aa, Mycobacterium
SREPIG

SEQ ID NO: 995235 - protein, 7 aa, Mycobacterium
SREPRAY

SEQ ID NO: 995236 - protein, 6 aa, Mycobacterium
SREQQR

SEQ ID NO: 995237 - protein, 6 aa, Mycobacterium
SRFEPE

SEQ ID NO: 995238 - protein, 6 aa, Mycobacterium
SRFEQT

SEQ ID NO: 995239 - protein, 10 aa, Mycobacterium
SRFGERGARV

SEQ ID NO: 995240 - protein, 5 aa, Mycobacterium
SRGAA

SEQ ID NO: 995241 - protein, 28 aa, Mycobacterium
SRGAQRQADEIRRARETKAMRDREHANE

SEQ ID NO: 995242 - protein, 9 aa, Mycobacterium
SRGEGHARS

SEQ ID NO: 995243 - protein, 6 aa, Mycobacterium
SRGEPH

SEQ ID NO: 995244 - protein, 8 aa, Mycobacterium
SRGESARH

SEQ ID NO: 995245 - protein, 8 aa, Mycobacterium
SRGGGDGV

SEQ ID NO: 995246 - protein, 5 aa, Mycobacterium
SRGGS

SEQ ID NO: 995247 - protein, 7 aa, Mycobacterium
SRGNNRK

SEQ ID NO: 995248 - protein, 8 aa, Mycobacterium
SRGQPAKR

SEQ ID NO: 995249 - protein, 5 aa, Mycobacterium
SRGRI

SEQ ID NO: 995250 - protein, 24 aa, Mycobacterium
SRGRIDKSTAELADERMAVKQLGL

SEQ ID NO: 995251 - protein, 12 aa, Mycobacterium
SRGTIEGDEDVL

SEQ ID NO: 995252 - protein, 14 aa, Mycobacterium
SRHGQVDSVDMEAK

SEQ ID NO: 995253 - protein, 7 aa, Mycobacterium
SRHPGEQ

SEQ ID NO: 995254 - protein, 9 aa, Mycobacterium
SRHTGKDAA

SEQ ID NO: 995255 - protein, 6 aa, Mycobacterium
SRIGEQ

SEQ ID NO: 995256 - protein, 7 aa, Mycobacterium
SRIGRSR

SEQ ID NO: 995257 - protein, 10 aa, Mycobacterium
SRKNLGGAGG

SEQ ID NO: 995258 - protein, 11 aa, Mycobacterium
SRKTAPKDNGL

SEQ ID NO: 995259 - protein, 16 aa, Mycobacterium
SRKTGSKIEFGRRKPF

SEQ ID NO: 995260 - protein, 7 aa, Mycobacterium
SRKTRDR

SEQ ID NO: 995261 - protein, 12 aa, Mycobacterium
SRLAKNPKNARK

SEQ ID NO: 995262 - protein, 22 aa, Mycobacterium
SRLARTANPDPMDLEMLQTLLK

SEQ ID NO: 995263 - protein, 9 aa, Mycobacterium
SRLDGSPLR

SEQ ID NO: 995264 - protein, 6 aa, Mycobacterium
SRLDPH

SEQ ID NO: 995265 - protein, 8 aa, Mycobacterium
SRLGEQLR

SEQ ID NO: 995266 - protein, 4 aa, Mycobacterium
SRME

SEQ ID NO: 995267 - protein, 5 aa, Mycobacterium
SRMTQ

SEQ ID NO: 995268 - protein, 5 aa, Mycobacterium
SRNGE

SEQ ID NO: 995269 - protein, 7 aa, Mycobacterium
SRNPSTR

SEQ ID NO: 995270 - protein, 8 aa, Mycobacterium
SRNQDEVE

SEQ ID NO: 995271 - protein, 12 aa, Mycobacterium
SRNSRGQARYGR

SEQ ID NO: 995272 - protein, 8 aa, Mycobacterium
SRPADGTM

SEQ ID NO: 995273 - protein, 24 aa, Mycobacterium
SRPAESGDETSQAVEPKVEEVSVH

SEQ ID NO: 995274 - protein, 7 aa, Mycobacterium
SRPDWPA

SEQ ID NO: 995275 - protein, 7 aa, Mycobacterium
SRPEPGL

SEQ ID NO: 995276 - protein, 8 aa, Mycobacterium
SRPGKTGM

SEQ ID NO: 995277 - protein, 5 aa, Mycobacterium
SRPHG

SEQ ID NO: 995278 - protein, 5 aa, Mycobacterium
SRPHP

SEQ ID NO: 995279 - protein, 4 aa, Mycobacterium
SRPI

SEQ ID NO: 995280 - protein, 9 aa, Mycobacterium
SRPPVRPMA

SEQ ID NO: 995281 - protein, 17 aa, Mycobacterium
SRPVPNRRTSTSADTMT

SEQ ID NO: 995282 - protein, 5 aa, Mycobacterium
SRPYA

SEQ ID NO: 995283 - protein, 5 aa, Mycobacterium
SRQAR

SEQ ID NO: 995284 - protein, 7 aa, Mycobacterium
SRQDHGL

SEQ ID NO: 995285 - protein, 4 aa, Mycobacterium
SRQI

SEQ ID NO: 995286 - protein, 7 aa, Mycobacterium
SRQSGLV

SEQ ID NO: 995287 - protein, 21 aa, Mycobacterium
SRRAGTGPDTPAEGHGSRIDH

SEQ ID NO: 995288 - protein, 6 aa, Mycobacterium
SRRDAD

SEQ ID NO: 995289 - protein, 7 aa, Mycobacterium
SRREPGA

SEQ ID NO: 995290 - protein, 10 aa, Mycobacterium
SRRGAGPSMK

SEQ ID NO: 995291 - protein, 6 aa, Mycobacterium
SRRGQI

SEQ ID NO: 995292 - protein, 23 aa, Mycobacterium
SRRIRETADLGPRRRLTGGEKLK

SEQ ID NO: 995293 - protein, 16 aa, Mycobacterium
SRRRQIEDPGDATQSK

SEQ ID NO: 995294 - protein, 10 aa, Mycobacterium
SRRVDKPSAI

SEQ ID NO: 995295 - protein, 5 aa, Mycobacterium
SRRYG

SEQ ID NO: 995296 - protein, 12 aa, Mycobacterium
SRSAAPIPSAAP

SEQ ID NO: 995297 - protein, 10 aa, Mycobacterium
SRSAGPPPVV

SEQ ID NO: 995298 - protein, 21 aa, Mycobacterium
SRSALQPLEPGGTNQTDLATE

SEQ ID NO: 995299 - protein, 13 aa, Mycobacterium
SRSAPNPQAQETI

SEQ ID NO: 995300 - protein, 6 aa, Mycobacterium
SRSCER

SEQ ID NO: 995301 - protein, 7 aa, Mycobacterium
SRSDTYP

SEQ ID NO: 995302 - protein, 4 aa, Mycobacterium
SRSE

SEQ ID NO: 995303 - protein, 8 aa, Mycobacterium
SRSGTELT

SEQ ID NO: 995304 - protein, 12 aa, Mycobacterium
SRSPRSTRSTMS

SEQ ID NO: 995305 - protein, 15 aa, Mycobacterium
SRSRAYTLGSFGGSE

SEQ ID NO: 995306 - protein, 7 aa, Mycobacterium
SRSSAKW

SEQ ID NO: 995307 - protein, 15 aa, Mycobacterium
SRSTDDTDRAWFGRS

SEQ ID NO: 995308 - protein, 23 aa, Mycobacterium
SRTDRDRGVADHDPEAVRAFFAR

SEQ ID NO: 995309 - protein, 5 aa, Mycobacterium
SRTEM

SEQ ID NO: 995310 - protein, 6 aa, Mycobacterium
SRTESD

SEQ ID NO: 995311 - protein, 8 aa, Mycobacterium
SRTGSAER

SEQ ID NO: 995312 - protein, 14 aa, Mycobacterium
SRTPGGRQSRKPSR

SEQ ID NO: 995313 - protein, 16 aa, Mycobacterium
SRTQNERSQQCSNDYD

SEQ ID NO: 995314 - protein, 7 aa, Mycobacterium
SRTQSAL

SEQ ID NO: 995315 - protein, 8 aa, Mycobacterium
SRTSVPGI

SEQ ID NO: 995316 - protein, 4 aa, Mycobacterium
SRVE

SEQ ID NO: 995317 - protein, 8 aa, Mycobacterium
SRVPPTRA

SEQ ID NO: 995318 - protein, 13 aa, Mycobacterium
SRVRRGRPKGFVT

SEQ ID NO: 995319 - protein, 5 aa, Mycobacterium
SRYAP

SEQ ID NO: 995320 - protein, 16 aa, Mycobacterium
SSAAKNKVDDKPEELY

SEQ ID NO: 995321 - protein, 8 aa, Mycobacterium
SSADDFER

SEQ ID NO: 995322 - protein, 30 aa, Mycobacterium
SSADEQQHDSSHDGPAHPGEPPYDAQSYDH

SEQ ID NO: 995323 - protein, 12 aa, Mycobacterium
SSADFSATRATT

SEQ ID NO: 995324 - protein, 9 aa, Mycobacterium
SSADQTVPA

SEQ ID NO: 995325 - protein, 8 aa, Mycobacterium
SSAEETAK

SEQ ID NO: 995326 - protein, 8 aa, Mycobacterium
SSAEKNTL

SEQ ID NO: 995327 - protein, 4 aa, Mycobacterium
SSAL

SEQ ID NO: 995328 - protein, 5 aa, Mycobacterium
SSALG

SEQ ID NO: 995329 - protein, 5 aa, Mycobacterium
SSALR

SEQ ID NO: 995330 - protein, 13 aa, Mycobacterium
SSAMCTSSPSHGV

SEQ ID NO: 995331 - protein, 12 aa, Mycobacterium
SSAMTTDPQRRL

SEQ ID NO: 995332 - protein, 16 aa, Mycobacterium
SSANFPDRDSPSAMDP

SEQ ID NO: 995333 - protein, 24 aa, Mycobacterium
SSAPATSGTNPSTEIPGSLGSYVG

SEQ ID NO: 995334 - protein, 10 aa, Mycobacterium
SSASASLLTT

SEQ ID NO: 995335 - protein, 7 aa, Mycobacterium
SSASPTM

SEQ ID NO: 995336 - protein, 9 aa, Mycobacterium
SSATAREEL

SEQ ID NO: 995337 - protein, 11 aa, Mycobacterium
SSATGGGVATG

SEQ ID NO: 995338 - protein, 6 aa, Mycobacterium
SSATIR

SEQ ID NO: 995339 - protein, 7 aa, Mycobacterium
SSAWRRD

SEQ ID NO: 995340 - protein, 14 aa, Mycobacterium
SSDEELGRSASRLS

SEQ ID NO: 995341 - protein, 16 aa, Mycobacterium
SSDEGVRRVRDNQQCS

SEQ ID NO: 995342 - protein, 6 aa, Mycobacterium
SSDGAA

SEQ ID NO: 995343 - protein, 5 aa, Mycobacterium
SSDGL

SEQ ID NO: 995344 - protein, 4 aa, Mycobacterium
SSDP

SEQ ID NO: 995345 - protein, 8 aa, Mycobacterium
SSDPALDE

SEQ ID NO: 995346 - protein, 10 aa, Mycobacterium
SSDPIDHDRP

SEQ ID NO: 995347 - protein, 8 aa, Mycobacterium
SSDSHPGK

SEQ ID NO: 995348 - protein, 12 aa, Mycobacterium
SSDSPANGDDSV

SEQ ID NO: 995349 - protein, 9 aa, Mycobacterium
SSEASRADL

SEQ ID NO: 995350 - protein, 7 aa, Mycobacterium
SSEDAIG

SEQ ID NO: 995351 - protein, 17 aa, Mycobacterium
SSEIAATELAPATTLGA

SEQ ID NO: 995352 - protein, 10 aa, Mycobacterium
SSELGGPDAP

SEQ ID NO: 995353 - protein, 4 aa, Mycobacterium
SSEM

SEQ ID NO: 995354 - protein, 8 aa, Mycobacterium
SSEPVDSD

SEQ ID NO: 995355 - protein, 9 aa, Mycobacterium
SSESDAGVD

SEQ ID NO: 995356 - protein, 10 aa, Mycobacterium
SSFRAETYGE

SEQ ID NO: 995357 - protein, 5 aa, Mycobacterium
SSFRE

SEQ ID NO: 995358 - protein, 4 aa, Mycobacterium
SSFS

SEQ ID NO: 995359 - protein, 6 aa, Mycobacterium
SSGATE

SEQ ID NO: 995360 - protein, 10 aa, Mycobacterium
SSGDTPAGFE

SEQ ID NO: 995361 - protein, 14 aa, Mycobacterium
SSGFNGQPSVVNGA

SEQ ID NO: 995362 - protein, 7 aa, Mycobacterium
SSGGLSL

SEQ ID NO: 995363 - protein, 4 aa, Mycobacterium
SSGH

SEQ ID NO: 995364 - protein, 5 aa, Mycobacterium
SSGIP

SEQ ID NO: 995365 - protein, 14 aa, Mycobacterium
SSGKPGQDPNAGRY

SEQ ID NO: 995366 - protein, 8 aa, Mycobacterium
SSGKQADH

SEQ ID NO: 995367 - protein, 13 aa, Mycobacterium
SSGLISNRASTGG

SEQ ID NO: 995368 - protein, 4 aa, Mycobacterium
SSGP

SEQ ID NO: 995369 - protein, 24 aa, Mycobacterium
SSGPTMSRRSDLDGADLIVRRCAG

SEQ ID NO: 995370 - protein, 7 aa, Mycobacterium
SSGRPGA

SEQ ID NO: 995371 - protein, 16 aa, Mycobacterium
SSGVPNRQILIVQAIH

SEQ ID NO: 995372 - protein, 6 aa, Mycobacterium
SSGVTE

SEQ ID NO: 995373 - protein, 8 aa, Mycobacterium
SSGYDTEV

SEQ ID NO: 995374 - protein, 9 aa, Mycobacterium
SSHASTALS

SEQ ID NO: 995375 - protein, 10 aa, Mycobacterium
SSHGRGGRGY

SEQ ID NO: 995376 - protein, 4 aa, Mycobacterium
SSHH

SEQ ID NO: 995377 - protein, 9 aa, Mycobacterium
SSHPFSAGP

SEQ ID NO: 995378 - protein, 16 aa, Mycobacterium
SSIDGRSAAADGSSRW

SEQ ID NO: 995379 - protein, 4 aa, Mycobacterium
SSKA

SEQ ID NO: 995380 - protein, 12 aa, Mycobacterium
SSKDRSRAAEQT

SEQ ID NO: 995381 - protein, 7 aa, Mycobacterium
SSKLTAA

SEQ ID NO: 995382 - protein, 7 aa, Mycobacterium
SSKSIRG

SEQ ID NO: 995383 - protein, 14 aa, Mycobacterium
SSLLGTPGQGAYAA

SEQ ID NO: 995384 - protein, 11 aa, Mycobacterium
SSLPSARESDY

SEQ ID NO: 995385 - protein, 10 aa, Mycobacterium
SSLQDNPLDP

SEQ ID NO: 995386 - protein, 5 aa, Mycobacterium
SSLRK

SEQ ID NO: 995387 - protein, 8 aa, Mycobacterium
SSLTPHEA

SEQ ID NO: 995388 - protein, 6 aa, Mycobacterium
SSMPVP

SEQ ID NO: 995389 - protein, 7 aa, Mycobacterium
SSNKHSD

SEQ ID NO: 995390 - protein, 18 aa, Mycobacterium
SSNLPSSGCGSSGRAGYL

SEQ ID NO: 995391 - protein, 6 aa, Mycobacterium
SSNPDA

SEQ ID NO: 995392 - protein, 28 aa, Mycobacterium
SSNRRPKWANAASPVTGLPGADYAFTSR

SEQ ID NO: 995393 - protein, 14 aa, Mycobacterium
SSPPDGSDLVTQAQ

SEQ ID NO: 995394 - protein, 25 aa, Mycobacterium
SSPPQTVYTNSKTAARLNVYITGYR

SEQ ID NO: 995395 - protein, 7 aa, Mycobacterium
SSPRDAG

SEQ ID NO: 995396 - protein, 7 aa, Mycobacterium
SSPTLNR

SEQ ID NO: 995397 - protein, 8 aa, Mycobacterium
SSPTRSTT

SEQ ID NO: 995398 - protein, 15 aa, Mycobacterium
SSPTVSAPVPPQLGT

SEQ ID NO: 995399 - protein, 8 aa, Mycobacterium
SSQANVTG

SEQ ID NO: 995400 - protein, 7 aa, Mycobacterium
SSQGIEP

SEQ ID NO: 995401 - protein, 5 aa, Mycobacterium
SSQGK

SEQ ID NO: 995402 - protein, 6 aa, Mycobacterium
SSQLED

SEQ ID NO: 995403 - protein, 7 aa, Mycobacterium
SSQRKPL

SEQ ID NO: 995404 - protein, 13 aa, Mycobacterium
SSQRTESTGAPGG

SEQ ID NO: 995405 - protein, 8 aa, Mycobacterium
SSRDGRPV

SEQ ID NO: 995406 - protein, 13 aa, Mycobacterium
SSRDRSVRDDFIQ

SEQ ID NO: 995407 - protein, 28 aa, Mycobacterium
SSRGHAGCNAGSYADTKPVNAVAVGAGR

SEQ ID NO: 995408 - protein, 11 aa, Mycobacterium
SSRQAKPPVEY

SEQ ID NO: 995409 - protein, 14 aa, Mycobacterium
SSRQHRVPDHAPSR

SEQ ID NO: 995410 - protein, 7 aa, Mycobacterium
SSRRDYR

SEQ ID NO: 995411 - protein, 18 aa, Mycobacterium
SSRRKQAAKQARQLAEGR

SEQ ID NO: 995412 - protein, 7 aa, Mycobacterium
SSRSGEL

SEQ ID NO: 995413 - protein, 22 aa, Mycobacterium
SSRSKSAGMPAYPASAADGAVG

SEQ ID NO: 995414 - protein, 6 aa, Mycobacterium
SSRTVT

SEQ ID NO: 995415 - protein, 6 aa, Mycobacterium
SSRVSE

SEQ ID NO: 995416 - protein, 29 aa, Mycobacterium
SSSAPQDRGTDVDNTRGQAEEDEKQKEPE

SEQ ID NO: 995417 - protein, 12 aa, Mycobacterium
SSSGVSSLRGSE

SEQ ID NO: 995418 - protein, 8 aa, Mycobacterium
SSSLHTGQ

SEQ ID NO: 995419 - protein, 16 aa, Mycobacterium
SSSLTSSQTQWHRSMP

SEQ ID NO: 995420 - protein, 7 aa, Mycobacterium
SSSNENP

SEQ ID NO: 995421 - protein, 18 aa, Mycobacterium
SSSPARSLRSLAPAYGDV

SEQ ID NO: 995422 - protein, 8 aa, Mycobacterium
SSSTNTRD

SEQ ID NO: 995423 - protein, 14 aa, Mycobacterium
SSSVVETESLEPSV

SEQ ID NO: 995424 - protein, 14 aa, Mycobacterium
SSSYAEELEEVAEH

SEQ ID NO: 995425 - protein, 4 aa, Mycobacterium
SSTA

SEQ ID NO: 995426 - protein, 8 aa, Mycobacterium
SSTGEYTG

SEQ ID NO: 995427 - protein, 16 aa, Mycobacterium
SSTGRSGALGCGQGAA

SEQ ID NO: 995428 - protein, 15 aa, Mycobacterium
SSTKGFITGRSTTRL

SEQ ID NO: 995429 - protein, 8 aa, Mycobacterium
SSTLTEED

SEQ ID NO: 995430 - protein, 6 aa, Mycobacterium
SSTPHR

SEQ ID NO: 995431 - protein, 5 aa, Mycobacterium
SSTPI

SEQ ID NO: 995432 - protein, 6 aa, Mycobacterium
SSTSRS

SEQ ID NO: 995433 - protein, 6 aa, Mycobacterium
SSVASG

SEQ ID NO: 995434 - protein, 10 aa, Mycobacterium
SSVDPDHASR

SEQ ID NO: 995435 - protein, 8 aa, Mycobacterium
SSVEKQTQ

SEQ ID NO: 995436 - protein, 4 aa, Mycobacterium
SSVG

SEQ ID NO: 995437 - protein, 6 aa, Mycobacterium
SSVRSR

SEQ ID NO: 995438 - protein, 5 aa, Mycobacterium
SSVVR

SEQ ID NO: 995439 - protein, 6 aa, Mycobacterium
SSWDDY

SEQ ID NO: 995440 - protein, 11 aa, Mycobacterium
SSWGEWPSEDI

SEQ ID NO: 995441 - protein, 10 aa, Mycobacterium
SSYADKPGTV

SEQ ID NO: 995442 - protein, 15 aa, Mycobacterium
SSYVGKNGNSPASSC

SEQ ID NO: 995443 - protein, 22 aa, Mycobacterium
STAAVSSQPGGRAAKPANNDPW

SEQ ID NO: 995444 - protein, 11 aa, Mycobacterium
STADNTVNTDT

SEQ ID NO: 995445 - protein, 15 aa, Mycobacterium
STAGGEPDVRLDIIS

SEQ ID NO: 995446 - protein, 23 aa, Mycobacterium
STAGQTSQSRSRRSTRPSGDDRE

SEQ ID NO: 995447 - protein, 6 aa, Mycobacterium
STALTG

SEQ ID NO: 995448 - protein, 4 aa, Mycobacterium
STAN

SEQ ID NO: 995449 - protein, 4 aa, Mycobacterium
STAR

SEQ ID NO: 995450 - protein, 4 aa, Mycobacterium
STAV

SEQ ID NO: 995451 - protein, 4 aa, Mycobacterium
STAW

SEQ ID NO: 995452 - protein, 6 aa, Mycobacterium
STAYSQ

SEQ ID NO: 995453 - protein, 14 aa, Mycobacterium
STCNGSGVINRNQG

SEQ ID NO: 995454 - protein, 9 aa, Mycobacterium
STCSAGSLT

SEQ ID NO: 995455 - protein, 10 aa, Mycobacterium
STDASGRYTR

SEQ ID NO: 995456 - protein, 11 aa, Mycobacterium
STDCRQRVEQR

SEQ ID NO: 995457 - protein, 6 aa, Mycobacterium
STDGDV

SEQ ID NO: 995458 - protein, 11 aa, Mycobacterium
STDGPKGQFSD

SEQ ID NO: 995459 - protein, 15 aa, Mycobacterium
STDKVDTEIPSPAAG

SEQ ID NO: 995460 - protein, 12 aa, Mycobacterium
STDRAGRPRDRT

SEQ ID NO: 995461 - protein, 9 aa, Mycobacterium
STEAKLGEK

SEQ ID NO: 995462 - protein, 12 aa, Mycobacterium
STEAPNRQSVRR

SEQ ID NO: 995463 - protein, 7 aa, Mycobacterium
STEDFPI

SEQ ID NO: 995464 - protein, 7 aa, Mycobacterium
STEDGRV

SEQ ID NO: 995465 - protein, 5 aa, Mycobacterium
STEEF

SEQ ID NO: 995466 - protein, 12 aa, Mycobacterium
STEKQAASWDEL

SEQ ID NO: 995467 - protein, 9 aa, Mycobacterium
STENLPSLA

SEQ ID NO: 995468 - protein, 10 aa, Mycobacterium
STEQANAAAL

SEQ ID NO: 995469 - protein, 9 aa, Mycobacterium
STESLDTHE

SEQ ID NO: 995470 - protein, 9 aa, Mycobacterium
STESPLATK

SEQ ID NO: 995471 - protein, 4 aa, Mycobacterium
STET

SEQ ID NO: 995472 - protein, 15 aa, Mycobacterium
STEVSASTLAIWSAR

SEQ ID NO: 995473 - protein, 9 aa, Mycobacterium
STFDGTAKR

SEQ ID NO: 995474 - protein, 8 aa, Mycobacterium
STFGGNPV

SEQ ID NO: 995475 - protein, 4 aa, Mycobacterium
STFR

SEQ ID NO: 995476 - protein, 5 aa, Mycobacterium
STGAR

SEQ ID NO: 995477 - protein, 12 aa, Mycobacterium
STGDIVSSAPDL

SEQ ID NO: 995478 - protein, 4 aa, Mycobacterium
STGE

SEQ ID NO: 995479 - protein, 12 aa, Mycobacterium
STGFHPAGGASV

SEQ ID NO: 995480 - protein, 8 aa, Mycobacterium
STGGAEIS

SEQ ID NO: 995481 - protein, 8 aa, Mycobacterium
STGGGDTI

SEQ ID NO: 995482 - protein, 19 aa, Mycobacterium
STGGGSAHKSTALDGKTQA

SEQ ID NO: 995483 - protein, 5 aa, Mycobacterium
STGIG

SEQ ID NO: 995484 - protein, 7 aa, Mycobacterium
STGKGSY

SEQ ID NO: 995485 - protein, 6 aa, Mycobacterium
STGKMH

SEQ ID NO: 995486 - protein, 10 aa, Mycobacterium
STGNLRRPID

SEQ ID NO: 995487 - protein, 16 aa, Mycobacterium
STGNTSASAAAYAARA

SEQ ID NO: 995488 - protein, 15 aa, Mycobacterium
STGPGIDHDDLDDLP

SEQ ID NO: 995489 - protein, 8 aa, Mycobacterium
STGRDGVK

SEQ ID NO: 995490 - protein, 8 aa, Mycobacterium
STGRPTGE

SEQ ID NO: 995491 - protein, 7 aa, Mycobacterium
STGTQQW

SEQ ID NO: 995492 - protein, 17 aa, Mycobacterium
STGVYTSAQRGDTESAH

SEQ ID NO: 995493 - protein, 11 aa, Mycobacterium
STHSDEEPTTL

SEQ ID NO: 995494 - protein, 23 aa, Mycobacterium
STIDTPRTETNNERCGNNKALTG

SEQ ID NO: 995495 - protein, 12 aa, Mycobacterium
STISSSAATTPY

SEQ ID NO: 995496 - protein, 7 aa, Mycobacterium
STKAGLD

SEQ ID NO: 995497 - protein, 14 aa, Mycobacterium
STKGLTVKADPSMG

SEQ ID NO: 995498 - protein, 5 aa, Mycobacterium
STKLQ

SEQ ID NO: 995499 - protein, 18 aa, Mycobacterium
STKTTPTATKHYTDDSSY

SEQ ID NO: 995500 - protein, 6 aa, Mycobacterium
STLDGN

SEQ ID NO: 995501 - protein, 6 aa, Mycobacterium
STLQTK

SEQ ID NO: 995502 - protein, 4 aa, Mycobacterium
STLS

SEQ ID NO: 995503 - protein, 8 aa, Mycobacterium
STMPPSKL

SEQ ID NO: 995504 - protein, 6 aa, Mycobacterium
STNWGK

SEQ ID NO: 995505 - protein, 6 aa, Mycobacterium
STPDAE

SEQ ID NO: 995506 - protein, 6 aa, Mycobacterium
STPDPL

SEQ ID NO: 995507 - protein, 13 aa, Mycobacterium
STPEEVARQAADN

SEQ ID NO: 995508 - protein, 11 aa, Mycobacterium
STPETNGETNR

SEQ ID NO: 995509 - protein, 5 aa, Mycobacterium
STPGL

SEQ ID NO: 995510 - protein, 6 aa, Mycobacterium
STPGLR

SEQ ID NO: 995511 - protein, 32 aa, Mycobacterium
STPKPAKTAGEKITDEGDGGNQIVQYLVAQKI

SEQ ID NO: 995512 - protein, 16 aa, Mycobacterium
STPNTPDRHRNFQIIE

SEQ ID NO: 995513 - protein, 9 aa, Mycobacterium
STPRDVTNV

SEQ ID NO: 995514 - protein, 5 aa, Mycobacterium
STPRV

SEQ ID NO: 995515 - protein, 7 aa, Mycobacterium
STPTDNR

SEQ ID NO: 995516 - protein, 6 aa, Mycobacterium
STPTRE

SEQ ID NO: 995517 - protein, 7 aa, Mycobacterium
STPVSEI

SEQ ID NO: 995518 - protein, 13 aa, Mycobacterium
STQLGRDETLQDT

SEQ ID NO: 995519 - protein, 6 aa, Mycobacterium
STQQQG

SEQ ID NO: 995520 - protein, 6 aa, Mycobacterium
STQRVR

SEQ ID NO: 995521 - protein, 4 aa, Mycobacterium
STRA

SEQ ID NO: 995522 - protein, 32 aa, Mycobacterium
STRAAGAGGGSAAAGTRYRPDQKPTASDYGIV

SEQ ID NO: 995523 - protein, 8 aa, Mycobacterium
STREHENY

SEQ ID NO: 995524 - protein, 6 aa, Mycobacterium
STRMPA

SEQ ID NO: 995525 - protein, 18 aa, Mycobacterium
STRNDDPEGASRPFDKNR

SEQ ID NO: 995526 - protein, 6 aa, Mycobacterium
STRRNV

SEQ ID NO: 995527 - protein, 11 aa, Mycobacterium
STRSDHREQAQ

SEQ ID NO: 995528 - protein, 38 aa, Mycobacterium
STRTPHYATDDDADDIPGARVEKGEETAEVDKFEALSP

SEQ ID NO: 995529 - protein, 6 aa, Mycobacterium
STRTRV

SEQ ID NO: 995530 - protein, 7 aa, Mycobacterium
STRTSEI

SEQ ID NO: 995531 - protein, 26 aa, Mycobacterium
STSARTYATAEANAVQTNAGKFGEQT

SEQ ID NO: 995532 - protein, 11 aa, Mycobacterium
STSGDERSSVR

SEQ ID NO: 995533 - protein, 16 aa, Mycobacterium
STSGNRRHFVVSNQNS

SEQ ID NO: 995534 - protein, 27 aa, Mycobacterium
STSLGPLSSSAGKRTLGEHQHLMADVR

SEQ ID NO: 995535 - protein, 16 aa, Mycobacterium
STSPAANPMRLRFSPQ

SEQ ID NO: 995536 - protein, 5 aa, Mycobacterium
STSPP

SEQ ID NO: 995537 - protein, 7 aa, Mycobacterium
STSRPQV

SEQ ID NO: 995538 - protein, 13 aa, Mycobacterium
STSTFRLNLWTTA

SEQ ID NO: 995539 - protein, 16 aa, Mycobacterium
STSTLNPYTNPEGALA

SEQ ID NO: 995540 - protein, 7 aa, Mycobacterium
STSTRTA

SEQ ID NO: 995541 - protein, 12 aa, Mycobacterium
STSTSLNRSGIG

SEQ ID NO: 995542 - protein, 4 aa, Mycobacterium
STTA

SEQ ID NO: 995543 - protein, 11 aa, Mycobacterium
STTAAPVSATQ

SEQ ID NO: 995544 - protein, 8 aa, Mycobacterium
STTAQASS

SEQ ID NO: 995545 - protein, 22 aa, Mycobacterium
STTATDGNDRPTEPVVIDSITI

SEQ ID NO: 995546 - protein, 6 aa, Mycobacterium
STTLAE

SEQ ID NO: 995547 - protein, 13 aa, Mycobacterium
STTNSAHTTSGHF

SEQ ID NO: 995548 - protein, 9 aa, Mycobacterium
STTPESASL

SEQ ID NO: 995549 - protein, 9 aa, Mycobacterium
STTQYASDG

SEQ ID NO: 995550 - protein, 12 aa, Mycobacterium
STTRIAEGVNNG

SEQ ID NO: 995551 - protein, 9 aa, Mycobacterium
STTTEPPPV

SEQ ID NO: 995552 - protein, 19 aa, Mycobacterium
STTYAPAPQRFEAGTPMTS

SEQ ID NO: 995553 - protein, 12 aa, Mycobacterium
STVDDAAGEAYD

SEQ ID NO: 995554 - protein, 10 aa, Mycobacterium
STVDPQVSED

SEQ ID NO: 995555 - protein, 6 aa, Mycobacterium
STVDSN

SEQ ID NO: 995556 - protein, 8 aa, Mycobacterium
STVENGRD

SEQ ID NO: 995557 - protein, 9 aa, Mycobacterium
STVQEITGG

SEQ ID NO: 995558 - protein, 7 aa, Mycobacterium
STYASSA

SEQ ID NO: 995559 - protein, 10 aa, Mycobacterium
STYDGSGTTI

SEQ ID NO: 995560 - protein, 5 aa, Mycobacterium
STYGH

SEQ ID NO: 995561 - protein, 10 aa, Mycobacterium
SVADSSQSAV

SEQ ID NO: 995562 - protein, 5 aa, Mycobacterium
SVAPP

SEQ ID NO: 995563 - protein, 12 aa, Mycobacterium
SVARGGGRTSYR

SEQ ID NO: 995564 - protein, 11 aa, Mycobacterium
SVARPAGQPQH

SEQ ID NO: 995565 - protein, 4 aa, Mycobacterium
SVAS

SEQ ID NO: 995566 - protein, 7 aa, Mycobacterium
SVASDEV

SEQ ID NO: 995567 - protein, 6 aa, Mycobacterium
SVASGR

SEQ ID NO: 995568 - protein, 7 aa, Mycobacterium
SVATPKY

SEQ ID NO: 995569 - protein, 6 aa, Mycobacterium
SVDEPD

SEQ ID NO: 995570 - protein, 9 aa, Mycobacterium
SVDHPAHGA

SEQ ID NO: 995571 - protein, 11 aa, Mycobacterium
SVDPQPGEDNA

SEQ ID NO: 995572 - protein, 5 aa, Mycobacterium
SVDRN

SEQ ID NO: 995573 - protein, 14 aa, Mycobacterium
SVEASTVAASTGPQ

SEQ ID NO: 995574 - protein, 18 aa, Mycobacterium
SVEDQRDADLEARAQKLE

SEQ ID NO: 995575 - protein, 5 aa, Mycobacterium
SVEEG

SEQ ID NO: 995576 - protein, 14 aa, Mycobacterium
SVEENTSDAAVVSL

SEQ ID NO: 995577 - protein, 8 aa, Mycobacterium
SVEPGRDP

SEQ ID NO: 995578 - protein, 5 aa, Mycobacterium
SVEQL

SEQ ID NO: 995579 - protein, 8 aa, Mycobacterium
SVEQRGAA

SEQ ID NO: 995580 - protein, 11 aa, Mycobacterium
SVERTSTGDAV

SEQ ID NO: 995581 - protein, 7 aa, Mycobacterium
SVESRSI

SEQ ID NO: 995582 - protein, 16 aa, Mycobacterium
SVGESRAQEASTKAAE

SEQ ID NO: 995583 - protein, 7 aa, Mycobacterium
SVGNDTA

SEQ ID NO: 995584 - protein, 23 aa, Mycobacterium
SVGNGDAMMSPSGTGIHKVDVKI

SEQ ID NO: 995585 - protein, 5 aa, Mycobacterium
SVGSL

SEQ ID NO: 995586 - protein, 12 aa, Mycobacterium
SVKGVTEETTTG

SEQ ID NO: 995587 - protein, 12 aa, Mycobacterium
SVLGTKKAEAIG

SEQ ID NO: 995588 - protein, 26 aa, Mycobacterium
SVNTSNRKGKCKRTRTGFGRRKNTKR

SEQ ID NO: 995589 - protein, 12 aa, Mycobacterium
SVPAAGGADTLP

SEQ ID NO: 995590 - protein, 5 aa, Mycobacterium
SVPAG

SEQ ID NO: 995591 - protein, 8 aa, Mycobacterium
SVPDPISR

SEQ ID NO: 995592 - protein, 4 aa, Mycobacterium
SVPG

SEQ ID NO: 995593 - protein, 7 aa, Mycobacterium
SVPGAGD

SEQ ID NO: 995594 - protein, 7 aa, Mycobacterium
SVPGRHY

SEQ ID NO: 995595 - protein, 7 aa, Mycobacterium
SVPRPGT

SEQ ID NO: 995596 - protein, 13 aa, Mycobacterium
SVPSGSTRRHQKQ

SEQ ID NO: 995597 - protein, 27 aa, Mycobacterium
SVQPPPASSESPRAPMPVSAPPRSPAA

SEQ ID NO: 995598 - protein, 15 aa, Mycobacterium
SVRAGVRDGRRRLQR

SEQ ID NO: 995599 - protein, 22 aa, Mycobacterium
SVRDTRGQEVDRNAANRSRGDK

SEQ ID NO: 995600 - protein, 7 aa, Mycobacterium
SVRESDQ

SEQ ID NO: 995601 - protein, 15 aa, Mycobacterium
SVRTAVSAGAVRPNQ

SEQ ID NO: 995602 - protein, 4 aa, Mycobacterium
SVSA

SEQ ID NO: 995603 - protein, 5 aa, Mycobacterium
SVSER

SEQ ID NO: 995604 - protein, 18 aa, Mycobacterium
SVSIQQGPPGSANTFDRR

SEQ ID NO: 995605 - protein, 7 aa, Mycobacterium
SVSKRPA

SEQ ID NO: 995606 - protein, 8 aa, Mycobacterium
SVSPSNCA

SEQ ID NO: 995607 - protein, 10 aa, Mycobacterium
SVTDEYRQRS

SEQ ID NO: 995608 - protein, 8 aa, Mycobacterium
SVTDGNRQ

SEQ ID NO: 995609 - protein, 7 aa, Mycobacterium
SVTGEDV

SEQ ID NO: 995610 - protein, 5 aa, Mycobacterium
SVTGG

SEQ ID NO: 995611 - protein, 5 aa, Mycobacterium
SVTGT

SEQ ID NO: 995612 - protein, 17 aa, Mycobacterium
SVTIPNTNGRVNGSRNE

SEQ ID NO: 995613 - protein, 8 aa, Mycobacterium
SVTPDAGR

SEQ ID NO: 995614 - protein, 10 aa, Mycobacterium
SVTSNTRADA

SEQ ID NO: 995615 - protein, 8 aa, Mycobacterium
SVTTSGDR

SEQ ID NO: 995616 - protein, 11 aa, Mycobacterium
SVVGPDSPASG

SEQ ID NO: 995617 - protein, 8 aa, Mycobacterium
SVVKSSTG

SEQ ID NO: 995618 - protein, 6 aa, Mycobacterium
SWDPGA

SEQ ID NO: 995619 - protein, 6 aa, Mycobacterium
SWDRHP

SEQ ID NO: 995620 - protein, 16 aa, Mycobacterium
SWKDKDYTRIRLQVRH

SEQ ID NO: 995621 - protein, 5 aa, Mycobacterium
SWNDP

SEQ ID NO: 995622 - protein, 13 aa, Mycobacterium
SWNQGVGEQHAPS

SEQ ID NO: 995623 - protein, 9 aa, Mycobacterium
SWPQSSQLA

SEQ ID NO: 995624 - protein, 8 aa, Mycobacterium
SWPTGGLT

SEQ ID NO: 995625 - protein, 17 aa, Mycobacterium
SWQSRGYGDTRLELAEL

SEQ ID NO: 995626 - protein, 12 aa, Mycobacterium
SWSELGDQVQDA

SEQ ID NO: 995627 - protein, 19 aa, Mycobacterium
SWSTGSSIMPQKKNPDIAE

SEQ ID NO: 995628 - protein, 10 aa, Mycobacterium
SWTNHDPRRN

SEQ ID NO: 995629 - protein, 7 aa, Mycobacterium
SWTSETP

SEQ ID NO: 995630 - protein, 6 aa, Mycobacterium
SYADNP

SEQ ID NO: 995631 - protein, 11 aa, Mycobacterium
SYAEEAGVKSA

SEQ ID NO: 995632 - protein, 6 aa, Mycobacterium
SYAPGA

SEQ ID NO: 995633 - protein, 15 aa, Mycobacterium
SYDYGDGAIQSRGGG

SEQ ID NO: 995634 - protein, 8 aa, Mycobacterium
SYESARRP

SEQ ID NO: 995635 - protein, 6 aa, Mycobacterium
SYGPGE

SEQ ID NO: 995636 - protein, 18 aa, Mycobacterium
SYGSRDTGGLQGYGLTGT

SEQ ID NO: 995637 - protein, 10 aa, Mycobacterium
SYHPDSATLT

SEQ ID NO: 995638 - protein, 11 aa, Mycobacterium
SYIKPGSDPIH

SEQ ID NO: 995639 - protein, 6 aa, Mycobacterium
SYPTAL

SEQ ID NO: 995640 - protein, 21 aa, Mycobacterium
SYRGSHGDVREAPETSRVNPN

SEQ ID NO: 995641 - protein, 11 aa, Mycobacterium
SYRSGTGKPIA

SEQ ID NO: 995642 - protein, 9 aa, Mycobacterium
SYSASKGGV

SEQ ID NO: 995643 - protein, 17 aa, Mycobacterium
SYSNPEQYTNSEETRLS

SEQ ID NO: 995644 - protein, 16 aa, Mycobacterium
SYTEGRLERIDAGQAS

SEQ ID NO: 995645 - protein, 19 aa, Mycobacterium
SYTTPGTARDYNPDSNESL

SEQ ID NO: 995646 - protein, 4 aa, Mycobacterium
TAAA

SEQ ID NO: 995647 - protein, 17 aa, Mycobacterium
TAAAESLRDQHEDAAGA

SEQ ID NO: 995648 - protein, 8 aa, Mycobacterium
TAAAKGKE

SEQ ID NO: 995649 - protein, 11 aa, Mycobacterium
TAAALGESREA

SEQ ID NO: 995650 - protein, 11 aa, Mycobacterium
TAADGREGSTH

SEQ ID NO: 995651 - protein, 9 aa, Mycobacterium
TAADGSVSA

SEQ ID NO: 995652 - protein, 5 aa, Mycobacterium
TAAEG

SEQ ID NO: 995653 - protein, 9 aa, Mycobacterium
TAAGAVRTN

SEQ ID NO: 995654 - protein, 8 aa, Mycobacterium
TAAGGGQV

SEQ ID NO: 995655 - protein, 11 aa, Mycobacterium
TAAGRDAGAEV

SEQ ID NO: 995656 - protein, 9 aa, Mycobacterium
TAAGSGCAA

SEQ ID NO: 995657 - protein, 5 aa, Mycobacterium
TAAHA

SEQ ID NO: 995658 - protein, 15 aa, Mycobacterium
TAAMRSTTPINTTPI

SEQ ID NO: 995659 - protein, 8 aa, Mycobacterium
TAANQDGH

SEQ ID NO: 995660 - protein, 6 aa, Mycobacterium
TAAPAL

SEQ ID NO: 995661 - protein, 11 aa, Mycobacterium
TAAPDNATPLG

SEQ ID NO: 995662 - protein, 8 aa, Mycobacterium
TAAPDVRD

SEQ ID NO: 995663 - protein, 14 aa, Mycobacterium
TAAQGTQASQNIST

SEQ ID NO: 995664 - protein, 11 aa, Mycobacterium
TAAQRYSGTAD

SEQ ID NO: 995665 - protein, 7 aa, Mycobacterium
TAARSSA

SEQ ID NO: 995666 - protein, 6 aa, Mycobacterium
TAATDN

SEQ ID NO: 995667 - protein, 4 aa, Mycobacterium
TADA

SEQ ID NO: 995668 - protein, 7 aa, Mycobacterium
TADAGHA

SEQ ID NO: 995669 - protein, 8 aa, Mycobacterium
TADDAVDK

SEQ ID NO: 995670 - protein, 8 aa, Mycobacterium
TADDDNRR

SEQ ID NO: 995671 - protein, 13 aa, Mycobacterium
TADELRKAAEGYL

SEQ ID NO: 995672 - protein, 10 aa, Mycobacterium
TADGKEIGGR

SEQ ID NO: 995673 - protein, 5 aa, Mycobacterium
TADGP

SEQ ID NO: 995674 - protein, 8 aa, Mycobacterium
TADGPALE

SEQ ID NO: 995675 - protein, 4 aa, Mycobacterium
TADT

SEQ ID NO: 995676 - protein, 25 aa, Mycobacterium
TADVAGAAKSGPVQPMGDRGSVSPV

SEQ ID NO: 995677 - protein, 8 aa, Mycobacterium
TAEASRVA

SEQ ID NO: 995678 - protein, 14 aa, Mycobacterium
TAEATVAEAQQRAD

SEQ ID NO: 995679 - protein, 18 aa, Mycobacterium
TAEEGRKDDIAFLREKTS

SEQ ID NO: 995680 - protein, 14 aa, Mycobacterium
TAEEIAAEGTPAEV

SEQ ID NO: 995681 - protein, 5 aa, Mycobacterium
TAEER

SEQ ID NO: 995682 - protein, 4 aa, Mycobacterium
TAEG

SEQ ID NO: 995683 - protein, 8 aa, Mycobacterium
TAEGQTYQ

SEQ ID NO: 995684 - protein, 14 aa, Mycobacterium
TAEPGGTNQTGLAT

SEQ ID NO: 995685 - protein, 4 aa, Mycobacterium
TAER

SEQ ID NO: 995686 - protein, 8 aa, Mycobacterium
TAERQASQ

SEQ ID NO: 995687 - protein, 7 aa, Mycobacterium
TAESTAW

SEQ ID NO: 995688 - protein, 17 aa, Mycobacterium
TAETATRDLEKAELDDD

SEQ ID NO: 995689 - protein, 8 aa, Mycobacterium
TAFTDGGQ

SEQ ID NO: 995690 - protein, 10 aa, Mycobacterium
TAGAAGSFAG

SEQ ID NO: 995691 - protein, 7 aa, Mycobacterium
TAGAAVT

SEQ ID NO: 995692 - protein, 6 aa, Mycobacterium
TAGADR

SEQ ID NO: 995693 - protein, 5 aa, Mycobacterium
TAGAS

SEQ ID NO: 995694 - protein, 8 aa, Mycobacterium
TAGCRSAA

SEQ ID NO: 995695 - protein, 4 aa, Mycobacterium
TAGE

SEQ ID NO: 995696 - protein, 8 aa, Mycobacterium
TAGEAPTH

SEQ ID NO: 995697 - protein, 6 aa, Mycobacterium
TAGELD

SEQ ID NO: 995698 - protein, 7 aa, Mycobacterium
TAGEPLT

SEQ ID NO: 995699 - protein, 12 aa, Mycobacterium
TAGGRNSRRGNH

SEQ ID NO: 995700 - protein, 8 aa, Mycobacterium
TAGGTTEN

SEQ ID NO: 995701 - protein, 8 aa, Mycobacterium
TAGIGSTA

SEQ ID NO: 995702 - protein, 17 aa, Mycobacterium
TAGKSTTTLTATTPHNV

SEQ ID NO: 995703 - protein, 5 aa, Mycobacterium
TAGLD

SEQ ID NO: 995704 - protein, 4 aa, Mycobacterium
TAGN

SEQ ID NO: 995705 - protein, 8 aa, Mycobacterium
TAGNPTKR

SEQ ID NO: 995706 - protein, 10 aa, Mycobacterium
TAGPGRPPKS

SEQ ID NO: 995707 - protein, 4 aa, Mycobacterium
TAGR

SEQ ID NO: 995708 - protein, 17 aa, Mycobacterium
TAGRTTLTGEGLQHADG

SEQ ID NO: 995709 - protein, 12 aa, Mycobacterium
TAGTHPSCPKPA

SEQ ID NO: 995710 - protein, 14 aa, Mycobacterium
TAGTLDANGPQTPW

SEQ ID NO: 995711 - protein, 7 aa, Mycobacterium
TAHGGPH

SEQ ID NO: 995712 - protein, 4 aa, Mycobacterium
TAHT

SEQ ID NO: 995713 - protein, 8 aa, Mycobacterium
TAIEEQSP

SEQ ID NO: 995714 - protein, 16 aa, Mycobacterium
TAISANQRGAQAGGIV

SEQ ID NO: 995715 - protein, 8 aa, Mycobacterium
TAISPSSR

SEQ ID NO: 995716 - protein, 7 aa, Mycobacterium
TAKADAV

SEQ ID NO: 995717 - protein, 10 aa, Mycobacterium
TAKDSRTTAD

SEQ ID NO: 995718 - protein, 8 aa, Mycobacterium
TAKEQNVP

SEQ ID NO: 995719 - protein, 8 aa, Mycobacterium
TAKFGQPE

SEQ ID NO: 995720 - protein, 6 aa, Mycobacterium
TAKPYF

SEQ ID NO: 995721 - protein, 4 aa, Mycobacterium
TALA

SEQ ID NO: 995722 - protein, 9 aa, Mycobacterium
TALDAQSKY

SEQ ID NO: 995723 - protein, 4 aa, Mycobacterium
TALE

SEQ ID NO: 995724 - protein, 9 aa, Mycobacterium
TALGKTSQR

SEQ ID NO: 995725 - protein, 12 aa, Mycobacterium
TALGSYADPDWA

SEQ ID NO: 995726 - protein, 11 aa, Mycobacterium
TALGTGRGEEL

SEQ ID NO: 995727 - protein, 5 aa, Mycobacterium
TALKD

SEQ ID NO: 995728 - protein, 12 aa, Mycobacterium
TALTEAGYVGED

SEQ ID NO: 995729 - protein, 6 aa, Mycobacterium
TAMTTY

SEQ ID NO: 995730 - protein, 8 aa, Mycobacterium
TANHRDEL

SEQ ID NO: 995731 - protein, 7 aa, Mycobacterium
TANPSHL

SEQ ID NO: 995732 - protein, 6 aa, Mycobacterium
TANPTV

SEQ ID NO: 995733 - protein, 6 aa, Mycobacterium
TAPAPM

SEQ ID NO: 995734 - protein, 6 aa, Mycobacterium
TAPARA

SEQ ID NO: 995735 - protein, 9 aa, Mycobacterium
TAPEFGEQD

SEQ ID NO: 995736 - protein, 10 aa, Mycobacterium
TAPEGKTMGH

SEQ ID NO: 995737 - protein, 19 aa, Mycobacterium
TAPEQLTDPNIDGPYDQSP

SEQ ID NO: 995738 - protein, 10 aa, Mycobacterium
TAPESKVPPA

SEQ ID NO: 995739 - protein, 12 aa, Mycobacterium
TAPEYSRSSEYC

SEQ ID NO: 995740 - protein, 6 aa, Mycobacterium
TAPGEL

SEQ ID NO: 995741 - protein, 9 aa, Mycobacterium
TAPGLSDES

SEQ ID NO: 995742 - protein, 7 aa, Mycobacterium
TAPGRRS

SEQ ID NO: 995743 - protein, 8 aa, Mycobacterium
TAPKSNAV

SEQ ID NO: 995744 - protein, 7 aa, Mycobacterium
TAPPAVA

SEQ ID NO: 995745 - protein, 7 aa, Mycobacterium
TAPPDLR

SEQ ID NO: 995746 - protein, 7 aa, Mycobacterium
TAPSATL

SEQ ID NO: 995747 - protein, 20 aa, Mycobacterium
TAPSGKQGMGNNRDGAAGAD

SEQ ID NO: 995748 - protein, 17 aa, Mycobacterium
TAPSQLCSGQTAERLPR

SEQ ID NO: 995749 - protein, 18 aa, Mycobacterium
TAPSSNGAPQIHATYVAH

SEQ ID NO: 995750 - protein, 12 aa, Mycobacterium
TAPYGVQPNQAR

SEQ ID NO: 995751 - protein, 5 aa, Mycobacterium
TAQAD

SEQ ID NO: 995752 - protein, 6 aa, Mycobacterium
TAQAGG

SEQ ID NO: 995753 - protein, 6 aa, Mycobacterium
TAQASS

SEQ ID NO: 995754 - protein, 5 aa, Mycobacterium
TAQDG

SEQ ID NO: 995755 - protein, 6 aa, Mycobacterium
TAQEAI

SEQ ID NO: 995756 - protein, 7 aa, Mycobacterium
TAQHPDA

SEQ ID NO: 995757 - protein, 14 aa, Mycobacterium
TAREGDTESAIDAQ

SEQ ID NO: 995758 - protein, 10 aa, Mycobacterium
TARKAARIGV

SEQ ID NO: 995759 - protein, 4 aa, Mycobacterium
TARL

SEQ ID NO: 995760 - protein, 5 aa, Mycobacterium
TARQA

SEQ ID NO: 995761 - protein, 36 aa, Mycobacterium
TARQSQDLPDEAEPSNVPPPPGRWARRKPDAAARLE

SEQ ID NO: 995762 - protein, 14 aa, Mycobacterium
TARQVRQAGRQTKG

SEQ ID NO: 995763 - protein, 7 aa, Mycobacterium
TARRRHP

SEQ ID NO: 995764 - protein, 25 aa, Mycobacterium
TARTSDKYTRSKHTYPKSGQSHAPI

SEQ ID NO: 995765 - protein, 7 aa, Mycobacterium
TARVGGP

SEQ ID NO: 995766 - protein, 5 aa, Mycobacterium
TASAA

SEQ ID NO: 995767 - protein, 14 aa, Mycobacterium
TASDERIAAVVARL

SEQ ID NO: 995768 - protein, 6 aa, Mycobacterium
TASGPA

SEQ ID NO: 995769 - protein, 14 aa, Mycobacterium
TASGTDGRRSGMLP

SEQ ID NO: 995770 - protein, 8 aa, Mycobacterium
TASRERVD

SEQ ID NO: 995771 - protein, 6 aa, Mycobacterium
TASRIE

SEQ ID NO: 995772 - protein, 14 aa, Mycobacterium
TASSGKVSDMVLER

SEQ ID NO: 995773 - protein, 5 aa, Mycobacterium
TASSQ

SEQ ID NO: 995774 - protein, 9 aa, Mycobacterium
TASSSGRAT

SEQ ID NO: 995775 - protein, 10 aa, Mycobacterium
TASYYQETSP

SEQ ID NO: 995776 - protein, 8 aa, Mycobacterium
TATAELSQ

SEQ ID NO: 995777 - protein, 16 aa, Mycobacterium
TATAKAGLSELANMAT

SEQ ID NO: 995778 - protein, 9 aa, Mycobacterium
TATALREDT

SEQ ID NO: 995779 - protein, 9 aa, Mycobacterium
TATAQSDKC

SEQ ID NO: 995780 - protein, 8 aa, Mycobacterium
TATDDVDG

SEQ ID NO: 995781 - protein, 6 aa, Mycobacterium
TATGNK

SEQ ID NO: 995782 - protein, 13 aa, Mycobacterium
TATLKSGERRGVG

SEQ ID NO: 995783 - protein, 10 aa, Mycobacterium
TATPQVETDS

SEQ ID NO: 995784 - protein, 4 aa, Mycobacterium
TATQ

SEQ ID NO: 995785 - protein, 9 aa, Mycobacterium
TATRNGARG

SEQ ID NO: 995786 - protein, 8 aa, Mycobacterium
TATSGADP

SEQ ID NO: 995787 - protein, 7 aa, Mycobacterium
TATTPEV

SEQ ID NO: 995788 - protein, 7 aa, Mycobacterium
TATTTDI

SEQ ID NO: 995789 - protein, 7 aa, Mycobacterium
TATTTLA

SEQ ID NO: 995790 - protein, 4 aa, Mycobacterium
TATV

SEQ ID NO: 995791 - protein, 11 aa, Mycobacterium
TAVDADDKVRG

SEQ ID NO: 995792 - protein, 7 aa, Mycobacterium
TAVGGDP

SEQ ID NO: 995793 - protein, 9 aa, Mycobacterium
TAVSGGSDF

SEQ ID NO: 995794 - protein, 6 aa, Mycobacterium
TAVTAH

SEQ ID NO: 995795 - protein, 15 aa, Mycobacterium
TAYADAAEARGTWDS

SEQ ID NO: 995796 - protein, 10 aa, Mycobacterium
TAYGTSGTVY

SEQ ID NO: 995797 - protein, 6 aa, Mycobacterium
TAYRPA

SEQ ID NO: 995798 - protein, 5 aa, Mycobacterium
TCKTD

SEQ ID NO: 995799 - protein, 25 aa, Mycobacterium
TCNVGHDTGSPCSPDHGPNDNEFTS

SEQ ID NO: 995800 - protein, 15 aa, Mycobacterium
TCPASDPGKLSFTNN

SEQ ID NO: 995801 - protein, 5 aa, Mycobacterium
TCPES

SEQ ID NO: 995802 - protein, 37 aa, Mycobacterium
TCPETDGTVNPATAVPGIANRAATNDRMDSIAIVNGN

SEQ ID NO: 995803 - protein, 23 aa, Mycobacterium
TCPPGQPGGWSMKSNNGPEERRR

SEQ ID NO: 995804 - protein, 9 aa, Mycobacterium
TCRPDNTLA

SEQ ID NO: 995805 - protein, 5 aa, Mycobacterium
TCSPG

SEQ ID NO: 995806 - protein, 4 aa, Mycobacterium
TCTG

SEQ ID NO: 995807 - protein, 7 aa, Mycobacterium
TCTPRTK

SEQ ID NO: 995808 - protein, 4 aa, Mycobacterium
TDAA

SEQ ID NO: 995809 - protein, 5 aa, Mycobacterium
TDAAI

SEQ ID NO: 995810 - protein, 8 aa, Mycobacterium
TDAASPTI

SEQ ID NO: 995811 - protein, 15 aa, Mycobacterium
TDADSSLSAEASKNL

SEQ ID NO: 995812 - protein, 6 aa, Mycobacterium
TDAEAA

SEQ ID NO: 995813 - protein, 7 aa, Mycobacterium
TDAEAAN

SEQ ID NO: 995814 - protein, 6 aa, Mycobacterium
TDAEVE

SEQ ID NO: 995815 - protein, 6 aa, Mycobacterium
TDAGKG

SEQ ID NO: 995816 - protein, 6 aa, Mycobacterium
TDAGSI

SEQ ID NO: 995817 - protein, 10 aa, Mycobacterium
TDAGSNKATA

SEQ ID NO: 995818 - protein, 6 aa, Mycobacterium
TDAGTG

SEQ ID NO: 995819 - protein, 10 aa, Mycobacterium
TDAGVPHQIP

SEQ ID NO: 995820 - protein, 4 aa, Mycobacterium
TDAH

SEQ ID NO: 995821 - protein, 5 aa, Mycobacterium
TDAVP

SEQ ID NO: 995822 - protein, 8 aa, Mycobacterium
TDAYERGR

SEQ ID NO: 995823 - protein, 14 aa, Mycobacterium
TDCTNTASLQQQAE

SEQ ID NO: 995824 - protein, 8 aa, Mycobacterium
TDDAAPTD

SEQ ID NO: 995825 - protein, 7 aa, Mycobacterium
TDDAGAA

SEQ ID NO: 995826 - protein, 5 aa, Mycobacterium
TDDDA

SEQ ID NO: 995827 - protein, 6 aa, Mycobacterium
TDDDAV

SEQ ID NO: 995828 - protein, 6 aa, Mycobacterium
TDDEAR

SEQ ID NO: 995829 - protein, 8 aa, Mycobacterium
TDDQSERV

SEQ ID NO: 995830 - protein, 15 aa, Mycobacterium
TDDTGHETSGSYAID

SEQ ID NO: 995831 - protein, 5 aa, Mycobacterium
TDDVG

SEQ ID NO: 995832 - protein, 16 aa, Mycobacterium
TDEALRPMGRATSGVQ

SEQ ID NO: 995833 - protein, 6 aa, Mycobacterium
TDERSL

SEQ ID NO: 995834 - protein, 4 aa, Mycobacterium
TDEV

SEQ ID NO: 995835 - protein, 9 aa, Mycobacterium
TDGDREGEA

SEQ ID NO: 995836 - protein, 15 aa, Mycobacterium
TDGDVAAIATDHPPS

SEQ ID NO: 995837 - protein, 14 aa, Mycobacterium
TDGETNASLRKGDD

SEQ ID NO: 995838 - protein, 22 aa, Mycobacterium
TDGIQVRSNRGVAGIDGTVSTA

SEQ ID NO: 995839 - protein, 9 aa, Mycobacterium
TDGLSAQAA

SEQ ID NO: 995840 - protein, 8 aa, Mycobacterium
TDGNFDKA

SEQ ID NO: 995841 - protein, 14 aa, Mycobacterium
TDGNGVADRVVCAG

SEQ ID NO: 995842 - protein, 13 aa, Mycobacterium
TDGPDNAPSDRTF

SEQ ID NO: 995843 - protein, 12 aa, Mycobacterium
TDGPGPEGTDVP

SEQ ID NO: 995844 - protein, 9 aa, Mycobacterium
TDGPMPQTR

SEQ ID NO: 995845 - protein, 11 aa, Mycobacterium
TDGQEQRAQGA

SEQ ID NO: 995846 - protein, 9 aa, Mycobacterium
TDGQPRTLD

SEQ ID NO: 995847 - protein, 5 aa, Mycobacterium
TDGRG

SEQ ID NO: 995848 - protein, 7 aa, Mycobacterium
TDGRKRR

SEQ ID NO: 995849 - protein, 14 aa, Mycobacterium
TDGRYRTQAAQQVP

SEQ ID NO: 995850 - protein, 4 aa, Mycobacterium
TDGS

SEQ ID NO: 995851 - protein, 9 aa, Mycobacterium
TDGSDDRRN

SEQ ID NO: 995852 - protein, 7 aa, Mycobacterium
TDGSDDW

SEQ ID NO: 995853 - protein, 7 aa, Mycobacterium
TDGSRRT

SEQ ID NO: 995854 - protein, 4 aa, Mycobacterium
TDHY

SEQ ID NO: 995855 - protein, 4 aa, Mycobacterium
TDIA

SEQ ID NO: 995856 - protein, 8 aa, Mycobacterium
TDIKTGRP

SEQ ID NO: 995857 - protein, 7 aa, Mycobacterium
TDIRDAQ

SEQ ID NO: 995858 - protein, 12 aa, Mycobacterium
TDKVDTEIPSPV

SEQ ID NO: 995859 - protein, 4 aa, Mycobacterium
TDLA

SEQ ID NO: 995860 - protein, 17 aa, Mycobacterium
TDLGPGYSSDTIHDHLV

SEQ ID NO: 995861 - protein, 6 aa, Mycobacterium
TDLPAG

SEQ ID NO: 995862 - protein, 7 aa, Mycobacterium
TDLPSNA

SEQ ID NO: 995863 - protein, 12 aa, Mycobacterium
TDLQEKAEEYRT

SEQ ID NO: 995864 - protein, 7 aa, Mycobacterium
TDNDAIG

SEQ ID NO: 995865 - protein, 6 aa, Mycobacterium
TDNETA

SEQ ID NO: 995866 - protein, 20 aa, Mycobacterium
TDNGSISKIEAGAVGRPYPG

SEQ ID NO: 995867 - protein, 9 aa, Mycobacterium
TDNPDSIVD

SEQ ID NO: 995868 - protein, 8 aa, Mycobacterium
TDNTPDIP

SEQ ID NO: 995869 - protein, 7 aa, Mycobacterium
TDPDDCT

SEQ ID NO: 995870 - protein, 10 aa, Mycobacterium
TDPDKGANGI

SEQ ID NO: 995871 - protein, 17 aa, Mycobacterium
TDPDSPKHKGIILTFLS

SEQ ID NO: 995872 - protein, 8 aa, Mycobacterium
TDPHNSER

SEQ ID NO: 995873 - protein, 21 aa, Mycobacterium
TDPNWQGGDYYETGRAPENGL

SEQ ID NO: 995874 - protein, 13 aa, Mycobacterium
TDPNYGSKLTNES

SEQ ID NO: 995875 - protein, 5 aa, Mycobacterium
TDPQT

SEQ ID NO: 995876 - protein, 7 aa, Mycobacterium
TDPSTEV

SEQ ID NO: 995877 - protein, 8 aa, Mycobacterium
TDPTSGTR

SEQ ID NO: 995878 - protein, 5 aa, Mycobacterium
TDPVA

SEQ ID NO: 995879 - protein, 13 aa, Mycobacterium
TDPVSSDQEVRAE

SEQ ID NO: 995880 - protein, 13 aa, Mycobacterium
TDQATAPAGPAVS

SEQ ID NO: 995881 - protein, 5 aa, Mycobacterium
TDQDV

SEQ ID NO: 995882 - protein, 13 aa, Mycobacterium
TDQNITSKLVSRR

SEQ ID NO: 995883 - protein, 8 aa, Mycobacterium
TDQPYPRG

SEQ ID NO: 995884 - protein, 32 aa, Mycobacterium
TDQRQIRNAEPSSSLPTKDKQRAQPPHQVDFD

SEQ ID NO: 995885 - protein, 16 aa, Mycobacterium
TDRGNVARGADFDTSV

SEQ ID NO: 995886 - protein, 9 aa, Mycobacterium
TDRSPVGGD

SEQ ID NO: 995887 - protein, 6 aa, Mycobacterium
TDRTSV

SEQ ID NO: 995888 - protein, 8 aa, Mycobacterium
TDSDKHAS

SEQ ID NO: 995889 - protein, 7 aa, Mycobacterium
TDSDNDL

SEQ ID NO: 995890 - protein, 7 aa, Mycobacterium
TDSEAAN

SEQ ID NO: 995891 - protein, 4 aa, Mycobacterium
TDSK

SEQ ID NO: 995892 - protein, 4 aa, Mycobacterium
TDSN

SEQ ID NO: 995893 - protein, 17 aa, Mycobacterium
TDSPVGYAGVDGDEQWA

SEQ ID NO: 995894 - protein, 6 aa, Mycobacterium
TDTASV

SEQ ID NO: 995895 - protein, 4 aa, Mycobacterium
TDTD

SEQ ID NO: 995896 - protein, 20 aa, Mycobacterium
TDTIPETEGAEKGSEYNKIR

SEQ ID NO: 995897 - protein, 9 aa, Mycobacterium
TDTPEHRAA

SEQ ID NO: 995898 - protein, 5 aa, Mycobacterium
TDTSL

SEQ ID NO: 995899 - protein, 22 aa, Mycobacterium
TDTSLRGTSGLSTRNRLTTKHP

SEQ ID NO: 995900 - protein, 9 aa, Mycobacterium
TDTTAAQRA

SEQ ID NO: 995901 - protein, 6 aa, Mycobacterium
TDWPRY

SEQ ID NO: 995902 - protein, 4 aa, Mycobacterium
TDYQ

SEQ ID NO: 995903 - protein, 19 aa, Mycobacterium
TEAASVRSGSESKPACAPQ

SEQ ID NO: 995904 - protein, 10 aa, Mycobacterium
TEAENIDPQQ

SEQ ID NO: 995905 - protein, 5 aa, Mycobacterium
TEARL

SEQ ID NO: 995906 - protein, 7 aa, Mycobacterium
TEARTAD

SEQ ID NO: 995907 - protein, 9 aa, Mycobacterium
TEATDETVT

SEQ ID NO: 995908 - protein, 9 aa, Mycobacterium
TEATEDCPR

SEQ ID NO: 995909 - protein, 10 aa, Mycobacterium
TEAVDPAKIE

SEQ ID NO: 995910 - protein, 8 aa, Mycobacterium
TECRGSGS

SEQ ID NO: 995911 - protein, 7 aa, Mycobacterium
TEDARVG

SEQ ID NO: 995912 - protein, 8 aa, Mycobacterium
TEDATSAM

SEQ ID NO: 995913 - protein, 13 aa, Mycobacterium
TEDEAPNTRGGMD

SEQ ID NO: 995914 - protein, 9 aa, Mycobacterium
TEDGNRATA

SEQ ID NO: 995915 - protein, 6 aa, Mycobacterium
TEDKYG

SEQ ID NO: 995916 - protein, 10 aa, Mycobacterium
TEDNLYQTSK

SEQ ID NO: 995917 - protein, 6 aa, Mycobacterium
TEDNMS

SEQ ID NO: 995918 - protein, 17 aa, Mycobacterium
TEDPSPGVDGQRFSHTP

SEQ ID NO: 995919 - protein, 8 aa, Mycobacterium
TEDTVPGN

SEQ ID NO: 995920 - protein, 5 aa, Mycobacterium
TEDVK

SEQ ID NO: 995921 - protein, 4 aa, Mycobacterium
TEEA

SEQ ID NO: 995922 - protein, 5 aa, Mycobacterium
TEEDI

SEQ ID NO: 995923 - protein, 7 aa, Mycobacterium
TEEGGGL

SEQ ID NO: 995924 - protein, 6 aa, Mycobacterium
TEENTE

SEQ ID NO: 995925 - protein, 4 aa, Mycobacterium
TEEQ

SEQ ID NO: 995926 - protein, 5 aa, Mycobacterium
TEEQV

SEQ ID NO: 995927 - protein, 4 aa, Mycobacterium
TEET

SEQ ID NO: 995928 - protein, 13 aa, Mycobacterium
TEETGAQISIEDD

SEQ ID NO: 995929 - protein, 13 aa, Mycobacterium
TEEVTEIKNGQRR

SEQ ID NO: 995930 - protein, 4 aa, Mycobacterium
TEFA

SEQ ID NO: 995931 - protein, 6 aa, Mycobacterium
TEFDGD

SEQ ID NO: 995932 - protein, 7 aa, Mycobacterium
TEGEPGD

SEQ ID NO: 995933 - protein, 6 aa, Mycobacterium
TEGERQ

SEQ ID NO: 995934 - protein, 4 aa, Mycobacterium
TEGG

SEQ ID NO: 995935 - protein, 14 aa, Mycobacterium
TEGGPVSNNKGMSL

SEQ ID NO: 995936 - protein, 5 aa, Mycobacterium
TEGTR

SEQ ID NO: 995937 - protein, 8 aa, Mycobacterium
TEHQPSRA

SEQ ID NO: 995938 - protein, 16 aa, Mycobacterium
TEIENSDSDYDREKLQ

SEQ ID NO: 995939 - protein, 7 aa, Mycobacterium
TEIQGTK

SEQ ID NO: 995940 - protein, 5 aa, Mycobacterium
TEKQK

SEQ ID NO: 995941 - protein, 4 aa, Mycobacterium
TELA

SEQ ID NO: 995942 - protein, 8 aa, Mycobacterium
TELPPPVH

SEQ ID NO: 995943 - protein, 5 aa, Mycobacterium
TENNI

SEQ ID NO: 995944 - protein, 8 aa, Mycobacterium
TENPCQPR

SEQ ID NO: 995945 - protein, 9 aa, Mycobacterium
TEPDPTPLH

SEQ ID NO: 995946 - protein, 6 aa, Mycobacterium
TEPEEE

SEQ ID NO: 995947 - protein, 6 aa, Mycobacterium
TEPEKV

SEQ ID NO: 995948 - protein, 16 aa, Mycobacterium
TEPGVKTRNLRRDPRA

SEQ ID NO: 995949 - protein, 6 aa, Mycobacterium
TEPWRG

SEQ ID NO: 995950 - protein, 5 aa, Mycobacterium
TEQGE

SEQ ID NO: 995951 - protein, 14 aa, Mycobacterium
TEQHPLATKDNDGR

SEQ ID NO: 995952 - protein, 5 aa, Mycobacterium
TEQQA

SEQ ID NO: 995953 - protein, 10 aa, Mycobacterium
TEQQARDGGY

SEQ ID NO: 995954 - protein, 13 aa, Mycobacterium
TERAEAKQISSES

SEQ ID NO: 995955 - protein, 16 aa, Mycobacterium
TERPGLTVGLEPLLNL

SEQ ID NO: 995956 - protein, 10 aa, Mycobacterium
TERPGSSDYV

SEQ ID NO: 995957 - protein, 13 aa, Mycobacterium
TERSVAATKSYTA

SEQ ID NO: 995958 - protein, 24 aa, Mycobacterium
TESQSATKAQLDGRPASNAHAQAA

SEQ ID NO: 995959 - protein, 4 aa, Mycobacterium
TESR

SEQ ID NO: 995960 - protein, 7 aa, Mycobacterium
TETEPSM

SEQ ID NO: 995961 - protein, 6 aa, Mycobacterium
TETERV

SEQ ID NO: 995962 - protein, 8 aa, Mycobacterium
TETQQPEQ

SEQ ID NO: 995963 - protein, 8 aa, Mycobacterium
TETTADFD

SEQ ID NO: 995964 - protein, 9 aa, Mycobacterium
TEVGGAASH

SEQ ID NO: 995965 - protein, 4 aa, Mycobacterium
TEWP

SEQ ID NO: 995966 - protein, 4 aa, Mycobacterium
TEYR

SEQ ID NO: 995967 - protein, 9 aa, Mycobacterium
TEYTPGQQV

SEQ ID NO: 995968 - protein, 11 aa, Mycobacterium
TFAQDGVGELR

SEQ ID NO: 995969 - protein, 15 aa, Mycobacterium
TFDAEGARKKLPSVQ

SEQ ID NO: 995970 - protein, 5 aa, Mycobacterium
TFPDV

SEQ ID NO: 995971 - protein, 5 aa, Mycobacterium
TFPDY

SEQ ID NO: 995972 - protein, 4 aa, Mycobacterium
TFPL

SEQ ID NO: 995973 - protein, 7 aa, Mycobacterium
TFPPSPM

SEQ ID NO: 995974 - protein, 9 aa, Mycobacterium
TFSAGGMPD

SEQ ID NO: 995975 - protein, 13 aa, Mycobacterium
TFTDSDGNTIDTS

SEQ ID NO: 995976 - protein, 13 aa, Mycobacterium
TFTPTTQDEVEDA

SEQ ID NO: 995977 - protein, 10 aa, Mycobacterium
TGAADGREAR

SEQ ID NO: 995978 - protein, 16 aa, Mycobacterium
TGAAPSAAGPRAKRAL

SEQ ID NO: 995979 - protein, 4 aa, Mycobacterium
TGAD

SEQ ID NO: 995980 - protein, 5 aa, Mycobacterium
TGADW

SEQ ID NO: 995981 - protein, 9 aa, Mycobacterium
TGAEEADLS

SEQ ID NO: 995982 - protein, 8 aa, Mycobacterium
TGAERVNA

SEQ ID NO: 995983 - protein, 5 aa, Mycobacterium
TGAGR

SEQ ID NO: 995984 - protein, 9 aa, Mycobacterium
TGAGSGIGQ

SEQ ID NO: 995985 - protein, 4 aa, Mycobacterium
TGAM

SEQ ID NO: 995986 - protein, 7 aa, Mycobacterium
TGANQTM

SEQ ID NO: 995987 - protein, 7 aa, Mycobacterium
TGAQLSS

SEQ ID NO: 995988 - protein, 7 aa, Mycobacterium
TGARDAV

SEQ ID NO: 995989 - protein, 13 aa, Mycobacterium
TGARSIKWYISSR

SEQ ID NO: 995990 - protein, 10 aa, Mycobacterium
TGASKGSIAA

SEQ ID NO: 995991 - protein, 10 aa, Mycobacterium
TGASQNIGEA

SEQ ID NO: 995992 - protein, 8 aa, Mycobacterium
TGASTASG

SEQ ID NO: 995993 - protein, 6 aa, Mycobacterium
TGATPV

SEQ ID NO: 995994 - protein, 5 aa, Mycobacterium
TGCGK

SEQ ID NO: 995995 - protein, 23 aa, Mycobacterium
TGDAAKTNARSTVDRYEHSSDPN

SEQ ID NO: 995996 - protein, 12 aa, Mycobacterium
TGDDLSAARSQA

SEQ ID NO: 995997 - protein, 8 aa, Mycobacterium
TGDDRDLD

SEQ ID NO: 995998 - protein, 4 aa, Mycobacterium
TGDE

SEQ ID NO: 995999 - protein, 4 aa, Mycobacterium
TGDG

SEQ ID NO: 996000 - protein, 8 aa, Mycobacterium
TGDGAARV

SEQ ID NO: 996001 - protein, 28 aa, Mycobacterium
TGDGANRRVAEAADLGERHTLTGQPLPP

SEQ ID NO: 996002 - protein, 8 aa, Mycobacterium
TGDQLQGI

SEQ ID NO: 996003 - protein, 6 aa, Mycobacterium
TGDQQR

SEQ ID NO: 996004 - protein, 9 aa, Mycobacterium
TGDRSGDQL

SEQ ID NO: 996005 - protein, 11 aa, Mycobacterium
TGDRTKSNATE

SEQ ID NO: 996006 - protein, 6 aa, Mycobacterium
TGDSVT

SEQ ID NO: 996007 - protein, 4 aa, Mycobacterium
TGDY

SEQ ID NO: 996008 - protein, 5 aa, Mycobacterium
TGEAL

SEQ ID NO: 996009 - protein, 5 aa, Mycobacterium
TGEEF

SEQ ID NO: 996010 - protein, 20 aa, Mycobacterium
TGEGRKDARTARRTGRARDG

SEQ ID NO: 996011 - protein, 13 aa, Mycobacterium
TGELAGPDFGSPQ

SEQ ID NO: 996012 - protein, 8 aa, Mycobacterium
TGENPSLK

SEQ ID NO: 996013 - protein, 6 aa, Mycobacterium
TGENVP

SEQ ID NO: 996014 - protein, 13 aa, Mycobacterium
TGEQVKSGGSQRA

SEQ ID NO: 996015 - protein, 4 aa, Mycobacterium
TGES

SEQ ID NO: 996016 - protein, 7 aa, Mycobacterium
TGETTTG

SEQ ID NO: 996017 - protein, 9 aa, Mycobacterium
TGGALPRTR

SEQ ID NO: 996018 - protein, 18 aa, Mycobacterium
TGGARKVPKVAADATQLP

SEQ ID NO: 996019 - protein, 6 aa, Mycobacterium
TGGCPE

SEQ ID NO: 996020 - protein, 4 aa, Mycobacterium
TGGD

SEQ ID NO: 996021 - protein, 8 aa, Mycobacterium
TGGERGEI

SEQ ID NO: 996022 - protein, 8 aa, Mycobacterium
TGGGPTEG

SEQ ID NO: 996023 - protein, 7 aa, Mycobacterium
TGGKHRS

SEQ ID NO: 996024 - protein, 4 aa, Mycobacterium
TGGM

SEQ ID NO: 996025 - protein, 25 aa, Mycobacterium
TGGPGAGVGSGVGSDIPAVSPAGVR

SEQ ID NO: 996026 - protein, 9 aa, Mycobacterium
TGGPGLRPA

SEQ ID NO: 996027 - protein, 5 aa, Mycobacterium
TGGRS

SEQ ID NO: 996028 - protein, 28 aa, Mycobacterium
TGGTADAPKQGETSTTSERLAAKQSWPT

SEQ ID NO: 996029 - protein, 7 aa, Mycobacterium
TGGTGKD

SEQ ID NO: 996030 - protein, 6 aa, Mycobacterium
TGGVPS

SEQ ID NO: 996031 - protein, 7 aa, Mycobacterium
TGGVTGR

SEQ ID NO: 996032 - protein, 5 aa, Mycobacterium
TGGVV

SEQ ID NO: 996033 - protein, 10 aa, Mycobacterium
TGGWEPDAKG

SEQ ID NO: 996034 - protein, 6 aa, Mycobacterium
TGIAPG

SEQ ID NO: 996035 - protein, 11 aa, Mycobacterium
TGIDPGALTND

SEQ ID NO: 996036 - protein, 10 aa, Mycobacterium
TGIETSDRQL

SEQ ID NO: 996037 - protein, 8 aa, Mycobacterium
TGKAGTFN

SEQ ID NO: 996038 - protein, 17 aa, Mycobacterium
TGKAHGAALGEDEVAAT

SEQ ID NO: 996039 - protein, 9 aa, Mycobacterium
TGKNPKAKR

SEQ ID NO: 996040 - protein, 16 aa, Mycobacterium
TGKPAALDRDEPRRVA

SEQ ID NO: 996041 - protein, 18 aa, Mycobacterium
TGKPRSPSAKLGKSTVSI

SEQ ID NO: 996042 - protein, 10 aa, Mycobacterium
TGKPTPTAYA

SEQ ID NO: 996043 - protein, 20 aa, Mycobacterium
TGKSSSASRAIDTESNLGQY

SEQ ID NO: 996044 - protein, 8 aa, Mycobacterium
TGLAEEND

SEQ ID NO: 996045 - protein, 4 aa, Mycobacterium
TGLP

SEQ ID NO: 996046 - protein, 5 aa, Mycobacterium
TGLPS

SEQ ID NO: 996047 - protein, 4 aa, Mycobacterium
TGML

SEQ ID NO: 996048 - protein, 8 aa, Mycobacterium
TGNESPAE

SEQ ID NO: 996049 - protein, 5 aa, Mycobacterium
TGNIG

SEQ ID NO: 996050 - protein, 11 aa, Mycobacterium
TGNKASEVGHA

SEQ ID NO: 996051 - protein, 8 aa, Mycobacterium
TGNPKNIK

SEQ ID NO: 996052 - protein, 11 aa, Mycobacterium
TGNYNSKTARL

SEQ ID NO: 996053 - protein, 5 aa, Mycobacterium
TGPAA

SEQ ID NO: 996054 - protein, 6 aa, Mycobacterium
TGPAAM

SEQ ID NO: 996055 - protein, 11 aa, Mycobacterium
TGPAARAKVRG

SEQ ID NO: 996056 - protein, 6 aa, Mycobacterium
TGPAEL

SEQ ID NO: 996057 - protein, 8 aa, Mycobacterium
TGPAGQAL

SEQ ID NO: 996058 - protein, 6 aa, Mycobacterium
TGPALN

SEQ ID NO: 996059 - protein, 5 aa, Mycobacterium
TGPAM

SEQ ID NO: 996060 - protein, 9 aa, Mycobacterium
TGPKDHASS

SEQ ID NO: 996061 - protein, 5 aa, Mycobacterium
TGPLM

SEQ ID NO: 996062 - protein, 10 aa, Mycobacterium
TGPPTGSRRD

SEQ ID NO: 996063 - protein, 5 aa, Mycobacterium
TGPRR

SEQ ID NO: 996064 - protein, 7 aa, Mycobacterium
TGPSDDG

SEQ ID NO: 996065 - protein, 8 aa, Mycobacterium
TGPTPGHL

SEQ ID NO: 996066 - protein, 9 aa, Mycobacterium
TGPVGTGAR

SEQ ID NO: 996067 - protein, 7 aa, Mycobacterium
TGPVPGA

SEQ ID NO: 996068 - protein, 8 aa, Mycobacterium
TGQDSGVW

SEQ ID NO: 996069 - protein, 13 aa, Mycobacterium
TGQEESRKDGIET

SEQ ID NO: 996070 - protein, 120 aa, Mycobacterium
TGQPVKRTATKTPATPAKRSTTKAANGSAPTKRATSTASRATKSTTPPKASGASDAAKKARTSVKSVDTKAPSAQDHTTKASAAKDTLNDPEATLNTLDSDATADDLDAEPDLDVEPSED

SEQ ID NO: 996071 - protein, 11 aa, Mycobacterium
TGQSGVPGSRL

SEQ ID NO: 996072 - protein, 14 aa, Mycobacterium
TGRAEYQPITDSEA

SEQ ID NO: 996073 - protein, 8 aa, Mycobacterium
TGRANPGM

SEQ ID NO: 996074 - protein, 4 aa, Mycobacterium
TGRD

SEQ ID NO: 996075 - protein, 14 aa, Mycobacterium
TGRDDTAVLVILTV

SEQ ID NO: 996076 - protein, 7 aa, Mycobacterium
TGRDGVA

SEQ ID NO: 996077 - protein, 13 aa, Mycobacterium
TGRNGAGKSTTLQ

SEQ ID NO: 996078 - protein, 8 aa, Mycobacterium
TGRPGAVQ

SEQ ID NO: 996079 - protein, 7 aa, Mycobacterium
TGRPQRL

SEQ ID NO: 996080 - protein, 10 aa, Mycobacterium
TGRQAVNDGY

SEQ ID NO: 996081 - protein, 4 aa, Mycobacterium
TGRY

SEQ ID NO: 996082 - protein, 6 aa, Mycobacterium
TGSADL

SEQ ID NO: 996083 - protein, 19 aa, Mycobacterium
TGSANSYTAAEAANTNPLQ

SEQ ID NO: 996084 - protein, 11 aa, Mycobacterium
TGSAPTSPELK

SEQ ID NO: 996085 - protein, 7 aa, Mycobacterium
TGSDPVR

SEQ ID NO: 996086 - protein, 14 aa, Mycobacterium
TGSDVYPVVPRPTP

SEQ ID NO: 996087 - protein, 6 aa, Mycobacterium
TGSEAA

SEQ ID NO: 996088 - protein, 5 aa, Mycobacterium
TGSGA

SEQ ID NO: 996089 - protein, 5 aa, Mycobacterium
TGSGH

SEQ ID NO: 996090 - protein, 14 aa, Mycobacterium
TGSGTNNDAAQRIS

SEQ ID NO: 996091 - protein, 19 aa, Mycobacterium
TGSMSAAKAAGKVRTEGKD

SEQ ID NO: 996092 - protein, 4 aa, Mycobacterium
TGSP

SEQ ID NO: 996093 - protein, 10 aa, Mycobacterium
TGSPAGPATL

SEQ ID NO: 996094 - protein, 7 aa, Mycobacterium
TGSRISE

SEQ ID NO: 996095 - protein, 11 aa, Mycobacterium
TGSRTANAGPV

SEQ ID NO: 996096 - protein, 4 aa, Mycobacterium
TGSS

SEQ ID NO: 996097 - protein, 11 aa, Mycobacterium
TGSSGKTSTKD

SEQ ID NO: 996098 - protein, 15 aa, Mycobacterium
TGSSGSTPVTVSRLG

SEQ ID NO: 996099 - protein, 30 aa, Mycobacterium
TGTAELTGPVRAGGAISENATDTPRRRRRD

SEQ ID NO: 996100 - protein, 6 aa, Mycobacterium
TGTEFD

SEQ ID NO: 996101 - protein, 7 aa, Mycobacterium
TGTPKTG

SEQ ID NO: 996102 - protein, 9 aa, Mycobacterium
TGTQGEPMS

SEQ ID NO: 996103 - protein, 11 aa, Mycobacterium
TGTSGKTTTTY

SEQ ID NO: 996104 - protein, 7 aa, Mycobacterium
TGTTTDT

SEQ ID NO: 996105 - protein, 6 aa, Mycobacterium
TGTVNG

SEQ ID NO: 996106 - protein, 10 aa, Mycobacterium
TGVENDEAYD

SEQ ID NO: 996107 - protein, 8 aa, Mycobacterium
TGVGGRIR

SEQ ID NO: 996108 - protein, 9 aa, Mycobacterium
TGVGKTELA

SEQ ID NO: 996109 - protein, 4 aa, Mycobacterium
TGVP

SEQ ID NO: 996110 - protein, 6 aa, Mycobacterium
TGVSRA

SEQ ID NO: 996111 - protein, 15 aa, Mycobacterium
TGVTDGNGNEPPRTA

SEQ ID NO: 996112 - protein, 5 aa, Mycobacterium
TGVVP

SEQ ID NO: 996113 - protein, 8 aa, Mycobacterium
TGYGTPSS

SEQ ID NO: 996114 - protein, 4 aa, Mycobacterium
TGYH

SEQ ID NO: 996115 - protein, 9 aa, Mycobacterium
TGYPDVPTS

SEQ ID NO: 996116 - protein, 4 aa, Mycobacterium
TGYS

SEQ ID NO: 996117 - protein, 9 aa, Mycobacterium
TGYSELNDP

SEQ ID NO: 996118 - protein, 5 aa, Mycobacterium
TGYTT

SEQ ID NO: 996119 - protein, 4 aa, Mycobacterium
THAR

SEQ ID NO: 996120 - protein, 12 aa, Mycobacterium
THASTTGSQLEV

SEQ ID NO: 996121 - protein, 4 aa, Mycobacterium
THDF

SEQ ID NO: 996122 - protein, 5 aa, Mycobacterium
THDRR

SEQ ID NO: 996123 - protein, 7 aa, Mycobacterium
THEQGAS

SEQ ID NO: 996124 - protein, 11 aa, Mycobacterium
THGTGTPLGDP

SEQ ID NO: 996125 - protein, 7 aa, Mycobacterium
THHDSRV

SEQ ID NO: 996126 - protein, 5 aa, Mycobacterium
THKDG

SEQ ID NO: 996127 - protein, 27 aa, Mycobacterium
THPESKVSAALKDPSYRLTTTTAEQIA

SEQ ID NO: 996128 - protein, 6 aa, Mycobacterium
THQVTT

SEQ ID NO: 996129 - protein, 5 aa, Mycobacterium
THRVR

SEQ ID NO: 996130 - protein, 8 aa, Mycobacterium
THSDHNDP

SEQ ID NO: 996131 - protein, 10 aa, Mycobacterium
THSPDRPPNL

SEQ ID NO: 996132 - protein, 9 aa, Mycobacterium
THSQTSGWS

SEQ ID NO: 996133 - protein, 16 aa, Mycobacterium
TIDAQEHAKREVGASI

SEQ ID NO: 996134 - protein, 13 aa, Mycobacterium
TIDSGPDFVSGET

SEQ ID NO: 996135 - protein, 4 aa, Mycobacterium
TIEG

SEQ ID NO: 996136 - protein, 13 aa, Mycobacterium
TIGGGQNGLGDNG

SEQ ID NO: 996137 - protein, 9 aa, Mycobacterium
TIGNSSPRV

SEQ ID NO: 996138 - protein, 10 aa, Mycobacterium
TIGRNSSEDT

SEQ ID NO: 996139 - protein, 4 aa, Mycobacterium
TIGT

SEQ ID NO: 996140 - protein, 17 aa, Mycobacterium
TINGEKVPNADAEGLSH

SEQ ID NO: 996141 - protein, 6 aa, Mycobacterium
TIPDKG

SEQ ID NO: 996142 - protein, 4 aa, Mycobacterium
TIPG

SEQ ID NO: 996143 - protein, 7 aa, Mycobacterium
TIPKPTV

SEQ ID NO: 996144 - protein, 13 aa, Mycobacterium
TIPRTSSGKIGRR

SEQ ID NO: 996145 - protein, 10 aa, Mycobacterium
TIQPTDTAGD

SEQ ID NO: 996146 - protein, 10 aa, Mycobacterium
TISPPPRRCA

SEQ ID NO: 996147 - protein, 23 aa, Mycobacterium
TISSKSSTKTYARSIPTTHWNEP

SEQ ID NO: 996148 - protein, 14 aa, Mycobacterium
TITPGSASQISDGA

SEQ ID NO: 996149 - protein, 11 aa, Mycobacterium
TITSPGGTTAA

SEQ ID NO: 996150 - protein, 9 aa, Mycobacterium
TKAALKDSA

SEQ ID NO: 996151 - protein, 6 aa, Mycobacterium
TKAERQ

SEQ ID NO: 996152 - protein, 9 aa, Mycobacterium
TKAFTAPPL

SEQ ID NO: 996153 - protein, 10 aa, Mycobacterium
TKAPEGAPDT

SEQ ID NO: 996154 - protein, 10 aa, Mycobacterium
TKASRVPSSQ

SEQ ID NO: 996155 - protein, 8 aa, Mycobacterium
TKATQSAI

SEQ ID NO: 996156 - protein, 7 aa, Mycobacterium
TKCSDSQ

SEQ ID NO: 996157 - protein, 4 aa, Mycobacterium
TKDF

SEQ ID NO: 996158 - protein, 7 aa, Mycobacterium
TKDKNIG

SEQ ID NO: 996159 - protein, 8 aa, Mycobacterium
TKDPEKFV

SEQ ID NO: 996160 - protein, 10 aa, Mycobacterium
TKDPKTGRTS

SEQ ID NO: 996161 - protein, 6 aa, Mycobacterium
TKETPA

SEQ ID NO: 996162 - protein, 7 aa, Mycobacterium
TKFPTSG

SEQ ID NO: 996163 - protein, 7 aa, Mycobacterium
TKGDGTL

SEQ ID NO: 996164 - protein, 5 aa, Mycobacterium
TKGEY

SEQ ID NO: 996165 - protein, 18 aa, Mycobacterium
TKGKTAVTARLSPEAAQG

SEQ ID NO: 996166 - protein, 8 aa, Mycobacterium
TKLADVDA

SEQ ID NO: 996167 - protein, 5 aa, Mycobacterium
TKLSQ

SEQ ID NO: 996168 - protein, 10 aa, Mycobacterium
TKNDNPAGAC

SEQ ID NO: 996169 - protein, 8 aa, Mycobacterium
TKNRQKNP

SEQ ID NO: 996170 - protein, 5 aa, Mycobacterium
TKPNI

SEQ ID NO: 996171 - protein, 16 aa, Mycobacterium
TKPRKSSMGTPNSGGG

SEQ ID NO: 996172 - protein, 9 aa, Mycobacterium
TKQEKQLAR

SEQ ID NO: 996173 - protein, 8 aa, Mycobacterium
TKRATTSW

SEQ ID NO: 996174 - protein, 10 aa, Mycobacterium
TKRGARKSYT

SEQ ID NO: 996175 - protein, 6 aa, Mycobacterium
TKRPNT

SEQ ID NO: 996176 - protein, 15 aa, Mycobacterium
TKRQQRQARGQSEVP

SEQ ID NO: 996177 - protein, 16 aa, Mycobacterium
TKSSITPRDALASAGK

SEQ ID NO: 996178 - protein, 7 aa, Mycobacterium
TKSTRSS

SEQ ID NO: 996179 - protein, 7 aa, Mycobacterium
TKSWQDA

SEQ ID NO: 996180 - protein, 4 aa, Mycobacterium
TKTA

SEQ ID NO: 996181 - protein, 17 aa, Mycobacterium
TKVEDEPDDTEQLVIVS

SEQ ID NO: 996182 - protein, 9 aa, Mycobacterium
TKVTTEEDA

SEQ ID NO: 996183 - protein, 6 aa, Mycobacterium
TLAGRE

SEQ ID NO: 996184 - protein, 8 aa, Mycobacterium
TLAGTQRN

SEQ ID NO: 996185 - protein, 23 aa, Mycobacterium
TLAKADVATERPGSTNTDAAGTV

SEQ ID NO: 996186 - protein, 13 aa, Mycobacterium
TLAPEKEGDADIR

SEQ ID NO: 996187 - protein, 4 aa, Mycobacterium
TLAS

SEQ ID NO: 996188 - protein, 6 aa, Mycobacterium
TLDDNG

SEQ ID NO: 996189 - protein, 4 aa, Mycobacterium
TLDE

SEQ ID NO: 996190 - protein, 4 aa, Mycobacterium
TLDR

SEQ ID NO: 996191 - protein, 6 aa, Mycobacterium
TLEENQ

SEQ ID NO: 996192 - protein, 14 aa, Mycobacterium
TLGASSNDLSTKGL

SEQ ID NO: 996193 - protein, 13 aa, Mycobacterium
TLGDQSLHDRDGF

SEQ ID NO: 996194 - protein, 8 aa, Mycobacterium
TLGGGRSG

SEQ ID NO: 996195 - protein, 16 aa, Mycobacterium
TLGNERVSLGGSDSFY

SEQ ID NO: 996196 - protein, 9 aa, Mycobacterium
TLGPAATLA

SEQ ID NO: 996197 - protein, 8 aa, Mycobacterium
TLGPKGRN

SEQ ID NO: 996198 - protein, 12 aa, Mycobacterium
TLGTGAASGIGQ

SEQ ID NO: 996199 - protein, 7 aa, Mycobacterium
TLGTTSR

SEQ ID NO: 996200 - protein, 23 aa, Mycobacterium
TLHPGEPGLCSQPNSGHGELGSP

SEQ ID NO: 996201 - protein, 8 aa, Mycobacterium
TLHTNRGD

SEQ ID NO: 996202 - protein, 7 aa, Mycobacterium
TLPAQYA

SEQ ID NO: 996203 - protein, 17 aa, Mycobacterium
TLPASEVPTTVVLTIRS

SEQ ID NO: 996204 - protein, 5 aa, Mycobacterium
TLPDD

SEQ ID NO: 996205 - protein, 14 aa, Mycobacterium
TLPEGSADNSGDVE

SEQ ID NO: 996206 - protein, 16 aa, Mycobacterium
TLPEREVRTATVKGTV

SEQ ID NO: 996207 - protein, 22 aa, Mycobacterium
TLPGAASAGVSPPPDAAPPGGL

SEQ ID NO: 996208 - protein, 11 aa, Mycobacterium
TLPPSSWGSGK

SEQ ID NO: 996209 - protein, 5 aa, Mycobacterium
TLPQE

SEQ ID NO: 996210 - protein, 9 aa, Mycobacterium
TLPRGGADV

SEQ ID NO: 996211 - protein, 7 aa, Mycobacterium
TLPRPES

SEQ ID NO: 996212 - protein, 10 aa, Mycobacterium
TLQSAKDEAM

SEQ ID NO: 996213 - protein, 9 aa, Mycobacterium
TLRADEQRH

SEQ ID NO: 996214 - protein, 16 aa, Mycobacterium
TLRTTNSSTYRDAVIV

SEQ ID NO: 996215 - protein, 8 aa, Mycobacterium
TLSDHEAA

SEQ ID NO: 996216 - protein, 8 aa, Mycobacterium
TLSEGERK

SEQ ID NO: 996217 - protein, 6 aa, Mycobacterium
TLSGPQ

SEQ ID NO: 996218 - protein, 4 aa, Mycobacterium
TLSR

SEQ ID NO: 996219 - protein, 5 aa, Mycobacterium
TLSRP

SEQ ID NO: 996220 - protein, 5 aa, Mycobacterium
TLSSH

SEQ ID NO: 996221 - protein, 6 aa, Mycobacterium
TLSTST

SEQ ID NO: 996222 - protein, 9 aa, Mycobacterium
TLTASQRDE

SEQ ID NO: 996223 - protein, 7 aa, Mycobacterium
TLTGAQT

SEQ ID NO: 996224 - protein, 15 aa, Mycobacterium
TLTPPHDGHELNALF

SEQ ID NO: 996225 - protein, 10 aa, Mycobacterium
TLVGEKPTYD

SEQ ID NO: 996226 - protein, 12 aa, Mycobacterium
TLVNKSKDLTLD

SEQ ID NO: 996227 - protein, 6 aa, Mycobacterium
TMAGTH

SEQ ID NO: 996228 - protein, 6 aa, Mycobacterium
TMASAA

SEQ ID NO: 996229 - protein, 12 aa, Mycobacterium
TMASSAATVSAP

SEQ ID NO: 996230 - protein, 8 aa, Mycobacterium
TMDSPDFA

SEQ ID NO: 996231 - protein, 12 aa, Mycobacterium
TMGTRGNSTGPH

SEQ ID NO: 996232 - protein, 15 aa, Mycobacterium
TMNDGEGSGVAPTDA

SEQ ID NO: 996233 - protein, 10 aa, Mycobacterium
TMPAPDGTQT

SEQ ID NO: 996234 - protein, 5 aa, Mycobacterium
TMPEH

SEQ ID NO: 996235 - protein, 4 aa, Mycobacterium
TMTR

SEQ ID NO: 996236 - protein, 14 aa, Mycobacterium
TMVGAAGKRLASTI

SEQ ID NO: 996237 - protein, 12 aa, Mycobacterium
TNADSASPGVSD

SEQ ID NO: 996238 - protein, 6 aa, Mycobacterium
TNAGAV

SEQ ID NO: 996239 - protein, 8 aa, Mycobacterium
TNAGKSSV

SEQ ID NO: 996240 - protein, 6 aa, Mycobacterium
TNANTV

SEQ ID NO: 996241 - protein, 9 aa, Mycobacterium
TNAQGGSSI

SEQ ID NO: 996242 - protein, 7 aa, Mycobacterium
TNAQRTL

SEQ ID NO: 996243 - protein, 6 aa, Mycobacterium
TNARRA

SEQ ID NO: 996244 - protein, 6 aa, Mycobacterium
TNATAA

SEQ ID NO: 996245 - protein, 7 aa, Mycobacterium
TNDDPAL

SEQ ID NO: 996246 - protein, 7 aa, Mycobacterium
TNDEELD

SEQ ID NO: 996247 - protein, 8 aa, Mycobacterium
TNEGLRSR

SEQ ID NO: 996248 - protein, 14 aa, Mycobacterium
TNGHVAKTPGFDSR

SEQ ID NO: 996249 - protein, 5 aa, Mycobacterium
TNGLH

SEQ ID NO: 996250 - protein, 9 aa, Mycobacterium
TNGSQIPRE

SEQ ID NO: 996251 - protein, 21 aa, Mycobacterium
TNGTDKSRGQFNGRITGAQTG

SEQ ID NO: 996252 - protein, 4 aa, Mycobacterium
TNHL

SEQ ID NO: 996253 - protein, 6 aa, Mycobacterium
TNLSAK

SEQ ID NO: 996254 - protein, 11 aa, Mycobacterium
TNLSPPKRSRA

SEQ ID NO: 996255 - protein, 4 aa, Mycobacterium
TNNL

SEQ ID NO: 996256 - protein, 8 aa, Mycobacterium
TNPAKSVS

SEQ ID NO: 996257 - protein, 6 aa, Mycobacterium
TNPAWP

SEQ ID NO: 996258 - protein, 5 aa, Mycobacterium
TNPEG

SEQ ID NO: 996259 - protein, 13 aa, Mycobacterium
TNPERLEEGIGRG

SEQ ID NO: 996260 - protein, 8 aa, Mycobacterium
TNPGQGVP

SEQ ID NO: 996261 - protein, 6 aa, Mycobacterium
TNPRDR

SEQ ID NO: 996262 - protein, 5 aa, Mycobacterium
TNPRS

SEQ ID NO: 996263 - protein, 12 aa, Mycobacterium
TNQPPGVIVLVT

SEQ ID NO: 996264 - protein, 6 aa, Mycobacterium
TNQRET

SEQ ID NO: 996265 - protein, 8 aa, Mycobacterium
TNRHGTRT

SEQ ID NO: 996266 - protein, 4 aa, Mycobacterium
TNRL

SEQ ID NO: 996267 - protein, 9 aa, Mycobacterium
TNRNHGKPT

SEQ ID NO: 996268 - protein, 8 aa, Mycobacterium
TNRPNPAL

SEQ ID NO: 996269 - protein, 20 aa, Mycobacterium
TNRSGSAVTKSTPPATEATD

SEQ ID NO: 996270 - protein, 6 aa, Mycobacterium
TNRSPR

SEQ ID NO: 996271 - protein, 5 aa, Mycobacterium
TNSPV

SEQ ID NO: 996272 - protein, 4 aa, Mycobacterium
TNTF

SEQ ID NO: 996273 - protein, 15 aa, Mycobacterium
TNTGRGETPLQLAGE

SEQ ID NO: 996274 - protein, 6 aa, Mycobacterium
TNTVDG

SEQ ID NO: 996275 - protein, 4 aa, Mycobacterium
TPAA

SEQ ID NO: 996276 - protein, 5 aa, Mycobacterium
TPAAL

SEQ ID NO: 996277 - protein, 11 aa, Mycobacterium
TPAAPSVSFGD

SEQ ID NO: 996278 - protein, 6 aa, Mycobacterium
TPAGGL

SEQ ID NO: 996279 - protein, 17 aa, Mycobacterium
TPARRADQVVRLCVVVI

SEQ ID NO: 996280 - protein, 16 aa, Mycobacterium
TPASGESFAGLVNPRR

SEQ ID NO: 996281 - protein, 9 aa, Mycobacterium
TPASGSQPK

SEQ ID NO: 996282 - protein, 9 aa, Mycobacterium
TPATDARGR

SEQ ID NO: 996283 - protein, 7 aa, Mycobacterium
TPDDDDA

SEQ ID NO: 996284 - protein, 6 aa, Mycobacterium
TPDDNQ

SEQ ID NO: 996285 - protein, 13 aa, Mycobacterium
TPDEAAAAAAAEF

SEQ ID NO: 996286 - protein, 16 aa, Mycobacterium
TPDEAAALSDELKGVT

SEQ ID NO: 996287 - protein, 14 aa, Mycobacterium
TPDEAPFQECDLKE

SEQ ID NO: 996288 - protein, 6 aa, Mycobacterium
TPDERR

SEQ ID NO: 996289 - protein, 15 aa, Mycobacterium
TPDGHATNPPARYTE

SEQ ID NO: 996290 - protein, 6 aa, Mycobacterium
TPDSSR

SEQ ID NO: 996291 - protein, 6 aa, Mycobacterium
TPEAPA

SEQ ID NO: 996292 - protein, 4 aa, Mycobacterium
TPEE

SEQ ID NO: 996293 - protein, 7 aa, Mycobacterium
TPEEVEN

SEQ ID NO: 996294 - protein, 5 aa, Mycobacterium
TPEGN

SEQ ID NO: 996295 - protein, 4 aa, Mycobacterium
TPEQ

SEQ ID NO: 996296 - protein, 5 aa, Mycobacterium
TPEQT

SEQ ID NO: 996297 - protein, 4 aa, Mycobacterium
TPEV

SEQ ID NO: 996298 - protein, 14 aa, Mycobacterium
TPEYPLEQADQALT

SEQ ID NO: 996299 - protein, 5 aa, Mycobacterium
TPFGL

SEQ ID NO: 996300 - protein, 6 aa, Mycobacterium
TPFQHP

SEQ ID NO: 996301 - protein, 13 aa, Mycobacterium
TPGAEPRAPGGYG

SEQ ID NO: 996302 - protein, 6 aa, Mycobacterium
TPGCTK

SEQ ID NO: 996303 - protein, 15 aa, Mycobacterium
TPGDNPKLRTEKIEQ

SEQ ID NO: 996304 - protein, 5 aa, Mycobacterium
TPGGQ

SEQ ID NO: 996305 - protein, 6 aa, Mycobacterium
TPGKDA

SEQ ID NO: 996306 - protein, 15 aa, Mycobacterium
TPGMPKRKAVARRQA

SEQ ID NO: 996307 - protein, 9 aa, Mycobacterium
TPGPPIATT

SEQ ID NO: 996308 - protein, 6 aa, Mycobacterium
TPGSAD

SEQ ID NO: 996309 - protein, 4 aa, Mycobacterium
TPGT

SEQ ID NO: 996310 - protein, 19 aa, Mycobacterium
TPGTDGTASVSGLGLGSTE

SEQ ID NO: 996311 - protein, 22 aa, Mycobacterium
TPGYAPTESAATAPAHGAYRGG

SEQ ID NO: 996312 - protein, 7 aa, Mycobacterium
TPGYQAP

SEQ ID NO: 996313 - protein, 6 aa, Mycobacterium
TPHDVG

SEQ ID NO: 996314 - protein, 6 aa, Mycobacterium
TPHEEA

SEQ ID NO: 996315 - protein, 4 aa, Mycobacterium
TPID

SEQ ID NO: 996316 - protein, 6 aa, Mycobacterium
TPIGHA

SEQ ID NO: 996317 - protein, 5 aa, Mycobacterium
TPKVE

SEQ ID NO: 996318 - protein, 9 aa, Mycobacterium
TPLPTPTGW

SEQ ID NO: 996319 - protein, 7 aa, Mycobacterium
TPMDESP

SEQ ID NO: 996320 - protein, 8 aa, Mycobacterium
TPPGTEAV

SEQ ID NO: 996321 - protein, 7 aa, Mycobacterium
TPPGTVG

SEQ ID NO: 996322 - protein, 6 aa, Mycobacterium
TPPKRE

SEQ ID NO: 996323 - protein, 7 aa, Mycobacterium
TPPSRNA

SEQ ID NO: 996324 - protein, 8 aa, Mycobacterium
TPPVGDDH

SEQ ID NO: 996325 - protein, 6 aa, Mycobacterium
TPPVPK

SEQ ID NO: 996326 - protein, 15 aa, Mycobacterium
TPQAPGPAALGQPPL

SEQ ID NO: 996327 - protein, 10 aa, Mycobacterium
TPQERADPKI

SEQ ID NO: 996328 - protein, 8 aa, Mycobacterium
TPQERADR

SEQ ID NO: 996329 - protein, 8 aa, Mycobacterium
TPQPATPL

SEQ ID NO: 996330 - protein, 7 aa, Mycobacterium
TPQQSGQ

SEQ ID NO: 996331 - protein, 8 aa, Mycobacterium
TPQSRERY

SEQ ID NO: 996332 - protein, 8 aa, Mycobacterium
TPQSVNSL

SEQ ID NO: 996333 - protein, 6 aa, Mycobacterium
TPQSYL

SEQ ID NO: 996334 - protein, 6 aa, Mycobacterium
TPRAED

SEQ ID NO: 996335 - protein, 5 aa, Mycobacterium
TPRGL

SEQ ID NO: 996336 - protein, 15 aa, Mycobacterium
TPRIYDRQSGEWKDG

SEQ ID NO: 996337 - protein, 5 aa, Mycobacterium
TPRLA

SEQ ID NO: 996338 - protein, 5 aa, Mycobacterium
TPRLD

SEQ ID NO: 996339 - protein, 9 aa, Mycobacterium
TPRQGTSNA

SEQ ID NO: 996340 - protein, 9 aa, Mycobacterium
TPRQQPVDG

SEQ ID NO: 996341 - protein, 10 aa, Mycobacterium
TPRRGIGDRA

SEQ ID NO: 996342 - protein, 5 aa, Mycobacterium
TPSEV

SEQ ID NO: 996343 - protein, 7 aa, Mycobacterium
TPSNPMQ

SEQ ID NO: 996344 - protein, 8 aa, Mycobacterium
TPSQRYQE

SEQ ID NO: 996345 - protein, 8 aa, Mycobacterium
TPSRERVE

SEQ ID NO: 996346 - protein, 27 aa, Mycobacterium
TPSRPGPAETNRRQALTPPCSGCGSSL

SEQ ID NO: 996347 - protein, 14 aa, Mycobacterium
TPSTDLADATDAEL

SEQ ID NO: 996348 - protein, 6 aa, Mycobacterium
TPTAST

SEQ ID NO: 996349 - protein, 6 aa, Mycobacterium
TPTEGR

SEQ ID NO: 996350 - protein, 4 aa, Mycobacterium
TPTN

SEQ ID NO: 996351 - protein, 4 aa, Mycobacterium
TPTP

SEQ ID NO: 996352 - protein, 18 aa, Mycobacterium
TPTPPAWPSTPVSTLSKS

SEQ ID NO: 996353 - protein, 7 aa, Mycobacterium
TPTRTSA

SEQ ID NO: 996354 - protein, 4 aa, Mycobacterium
TPTT

SEQ ID NO: 996355 - protein, 6 aa, Mycobacterium
TPTTQI

SEQ ID NO: 996356 - protein, 11 aa, Mycobacterium
TPVAGKDAITQ

SEQ ID NO: 996357 - protein, 5 aa, Mycobacterium
TPVNG

SEQ ID NO: 996358 - protein, 13 aa, Mycobacterium
TPVNKDRVYSPLS

SEQ ID NO: 996359 - protein, 10 aa, Mycobacterium
TPVPPEPAEI

SEQ ID NO: 996360 - protein, 31 aa, Mycobacterium
TPWNNATSNRSTTGYEGTASTAAAGPTHSKT

SEQ ID NO: 996361 - protein, 6 aa, Mycobacterium
TPYPAA

SEQ ID NO: 996362 - protein, 11 aa, Mycobacterium
TPYQPEISQGR

SEQ ID NO: 996363 - protein, 6 aa, Mycobacterium
TQAAAR

SEQ ID NO: 996364 - protein, 8 aa, Mycobacterium
TQAAGAAP

SEQ ID NO: 996365 - protein, 7 aa, Mycobacterium
TQAENEG

SEQ ID NO: 996366 - protein, 9 aa, Mycobacterium
TQAGKPGAY

SEQ ID NO: 996367 - protein, 9 aa, Mycobacterium
TQATVPAGT

SEQ ID NO: 996368 - protein, 19 aa, Mycobacterium
TQCTGRRGCHEESTAPGAF

SEQ ID NO: 996369 - protein, 8 aa, Mycobacterium
TQDAREFA

SEQ ID NO: 996370 - protein, 9 aa, Mycobacterium
TQDEAQEAV

SEQ ID NO: 996371 - protein, 4 aa, Mycobacterium
TQDN

SEQ ID NO: 996372 - protein, 7 aa, Mycobacterium
TQDPRSW

SEQ ID NO: 996373 - protein, 18 aa, Mycobacterium
TQDQNLQDGPHSDLRRAR

SEQ ID NO: 996374 - protein, 4 aa, Mycobacterium
TQEK

SEQ ID NO: 996375 - protein, 5 aa, Mycobacterium
TQEQV

SEQ ID NO: 996376 - protein, 33 aa, Mycobacterium
TQFADRSATPPTVSTDGAVAPSTAITIALARFL

SEQ ID NO: 996377 - protein, 7 aa, Mycobacterium
TQFRDDH

SEQ ID NO: 996378 - protein, 7 aa, Mycobacterium
TQGADVP

SEQ ID NO: 996379 - protein, 5 aa, Mycobacterium
TQGHQ

SEQ ID NO: 996380 - protein, 10 aa, Mycobacterium
TQGPTGPISE

SEQ ID NO: 996381 - protein, 9 aa, Mycobacterium
TQGRGIGEA

SEQ ID NO: 996382 - protein, 12 aa, Mycobacterium
TQGSGENDYERM

SEQ ID NO: 996383 - protein, 25 aa, Mycobacterium
TQGTDQWIGSGKAQGGMASSRSQLG

SEQ ID NO: 996384 - protein, 7 aa, Mycobacterium
TQGWQPD

SEQ ID NO: 996385 - protein, 6 aa, Mycobacterium
TQIDPK

SEQ ID NO: 996386 - protein, 9 aa, Mycobacterium
TQIGRRARA

SEQ ID NO: 996387 - protein, 11 aa, Mycobacterium
TQINGVARDSA

SEQ ID NO: 996388 - protein, 9 aa, Mycobacterium
TQKAAEETL

SEQ ID NO: 996389 - protein, 5 aa, Mycobacterium
TQLPT

SEQ ID NO: 996390 - protein, 6 aa, Mycobacterium
TQLQND

SEQ ID NO: 996391 - protein, 12 aa, Mycobacterium
TQLTPRERRRRP

SEQ ID NO: 996392 - protein, 4 aa, Mycobacterium
TQNP

SEQ ID NO: 996393 - protein, 7 aa, Mycobacterium
TQNRDAI

SEQ ID NO: 996394 - protein, 6 aa, Mycobacterium
TQNTSS

SEQ ID NO: 996395 - protein, 17 aa, Mycobacterium
TQPASLAEIDSGKTLYD

SEQ ID NO: 996396 - protein, 9 aa, Mycobacterium
TQPDRRARA

SEQ ID NO: 996397 - protein, 6 aa, Mycobacterium
TQPDRV

SEQ ID NO: 996398 - protein, 16 aa, Mycobacterium
TQPHTSSGRVPTEKGY

SEQ ID NO: 996399 - protein, 4 aa, Mycobacterium
TQPN

SEQ ID NO: 996400 - protein, 4 aa, Mycobacterium
TQPY

SEQ ID NO: 996401 - protein, 5 aa, Mycobacterium
TQQIR

SEQ ID NO: 996402 - protein, 5 aa, Mycobacterium
TQQQL

SEQ ID NO: 996403 - protein, 4 aa, Mycobacterium
TQQY

SEQ ID NO: 996404 - protein, 4 aa, Mycobacterium
TQRA

SEQ ID NO: 996405 - protein, 6 aa, Mycobacterium
TQRAEW

SEQ ID NO: 996406 - protein, 8 aa, Mycobacterium
TQRRPDLD

SEQ ID NO: 996407 - protein, 8 aa, Mycobacterium
TQSFRSKR

SEQ ID NO: 996408 - protein, 6 aa, Mycobacterium
TQSGLP

SEQ ID NO: 996409 - protein, 5 aa, Mycobacterium
TQSPY

SEQ ID NO: 996410 - protein, 4 aa, Mycobacterium
TQTI

SEQ ID NO: 996411 - protein, 5 aa, Mycobacterium
TQTRL

SEQ ID NO: 996412 - protein, 6 aa, Mycobacterium
TQTSDA

SEQ ID NO: 996413 - protein, 20 aa, Mycobacterium
TQTSQEDTCGRGVGQSGAMY

SEQ ID NO: 996414 - protein, 5 aa, Mycobacterium
TQVNL

SEQ ID NO: 996415 - protein, 9 aa, Mycobacterium
TQVTPATAH

SEQ ID NO: 996416 - protein, 7 aa, Mycobacterium
TQYPDDP

SEQ ID NO: 996417 - protein, 21 aa, Mycobacterium
TRAGARQPKSPFGRGERGPTC

SEQ ID NO: 996418 - protein, 7 aa, Mycobacterium
TRAGIDP

SEQ ID NO: 996419 - protein, 9 aa, Mycobacterium
TRAKPPEPL

SEQ ID NO: 996420 - protein, 14 aa, Mycobacterium
TRAPTSAATSGIAS

SEQ ID NO: 996421 - protein, 15 aa, Mycobacterium
TRAQPGRDDKIVVSW

SEQ ID NO: 996422 - protein, 4 aa, Mycobacterium
TRAR

SEQ ID NO: 996423 - protein, 10 aa, Mycobacterium
TRASYERRTE

SEQ ID NO: 996424 - protein, 10 aa, Mycobacterium
TRAYTSQKDS

SEQ ID NO: 996425 - protein, 8 aa, Mycobacterium
TRDFSNDA

SEQ ID NO: 996426 - protein, 8 aa, Mycobacterium
TRDGEQDR

SEQ ID NO: 996427 - protein, 6 aa, Mycobacterium
TRDHPG

SEQ ID NO: 996428 - protein, 8 aa, Mycobacterium
TRDLTDDQ

SEQ ID NO: 996429 - protein, 25 aa, Mycobacterium
TRDPRSTERKKYGLKKARKAPQYSK

SEQ ID NO: 996430 - protein, 6 aa, Mycobacterium
TRDSLR

SEQ ID NO: 996431 - protein, 5 aa, Mycobacterium
TREAI

SEQ ID NO: 996432 - protein, 5 aa, Mycobacterium
TREAT

SEQ ID NO: 996433 - protein, 11 aa, Mycobacterium
TREPQAAPQPL

SEQ ID NO: 996434 - protein, 5 aa, Mycobacterium
TRERT

SEQ ID NO: 996435 - protein, 20 aa, Mycobacterium
TRGDDGPGGPVDAEAPTPRL

SEQ ID NO: 996436 - protein, 9 aa, Mycobacterium
TRGGRGYVT

SEQ ID NO: 996437 - protein, 11 aa, Mycobacterium
TRGKPSPEQLN

SEQ ID NO: 996438 - protein, 6 aa, Mycobacterium
TRGQQI

SEQ ID NO: 996439 - protein, 13 aa, Mycobacterium
TRGTGVSSDVETT

SEQ ID NO: 996440 - protein, 7 aa, Mycobacterium
TRGYAYD

SEQ ID NO: 996441 - protein, 7 aa, Mycobacterium
TRHPEQL

SEQ ID NO: 996442 - protein, 4 aa, Mycobacterium
TRHS

SEQ ID NO: 996443 - protein, 18 aa, Mycobacterium
TRHSNNSANSRKNGHGQG

SEQ ID NO: 996444 - protein, 12 aa, Mycobacterium
TRIGEKKPATEA

SEQ ID NO: 996445 - protein, 19 aa, Mycobacterium
TRKGVEDAGGMYESHPAET

SEQ ID NO: 996446 - protein, 14 aa, Mycobacterium
TRKPRRWISRRGMG

SEQ ID NO: 996447 - protein, 17 aa, Mycobacterium
TRLGNTLAEKGLNPQQQ

SEQ ID NO: 996448 - protein, 13 aa, Mycobacterium
TRLPGDMNSPEET

SEQ ID NO: 996449 - protein, 6 aa, Mycobacterium
TRLTTG

SEQ ID NO: 996450 - protein, 5 aa, Mycobacterium
TRMGS

SEQ ID NO: 996451 - protein, 13 aa, Mycobacterium
TRMPAGPAKLAIK

SEQ ID NO: 996452 - protein, 9 aa, Mycobacterium
TRNAKGKFA

SEQ ID NO: 996453 - protein, 5 aa, Mycobacterium
TRNGR

SEQ ID NO: 996454 - protein, 14 aa, Mycobacterium
TRNSRADRLANEAM

SEQ ID NO: 996455 - protein, 8 aa, Mycobacterium
TRPAQDSN

SEQ ID NO: 996456 - protein, 12 aa, Mycobacterium
TRPARNIGPGTT

SEQ ID NO: 996457 - protein, 6 aa, Mycobacterium
TRPDET

SEQ ID NO: 996458 - protein, 8 aa, Mycobacterium
TRPDGTEI

SEQ ID NO: 996459 - protein, 7 aa, Mycobacterium
TRPDRGL

SEQ ID NO: 996460 - protein, 16 aa, Mycobacterium
TRPLTSEPGATWASSG

SEQ ID NO: 996461 - protein, 12 aa, Mycobacterium
TRPNPDDPTGLS

SEQ ID NO: 996462 - protein, 5 aa, Mycobacterium
TRPRR

SEQ ID NO: 996463 - protein, 13 aa, Mycobacterium
TRPRYQVTETPQV

SEQ ID NO: 996464 - protein, 20 aa, Mycobacterium
TRPSPASRRMKDGSSDHCPG

SEQ ID NO: 996465 - protein, 7 aa, Mycobacterium
TRPTQDI

SEQ ID NO: 996466 - protein, 7 aa, Mycobacterium
TRQPRTR

SEQ ID NO: 996467 - protein, 13 aa, Mycobacterium
TRRFKPDNTAVSH

SEQ ID NO: 996468 - protein, 10 aa, Mycobacterium
TRRGGGAALP

SEQ ID NO: 996469 - protein, 6 aa, Mycobacterium
TRRPQS

SEQ ID NO: 996470 - protein, 7 aa, Mycobacterium
TRRPYPP

SEQ ID NO: 996471 - protein, 5 aa, Mycobacterium
TRRVG

SEQ ID NO: 996472 - protein, 6 aa, Mycobacterium
TRRVGL

SEQ ID NO: 996473 - protein, 5 aa, Mycobacterium
TRSCS

SEQ ID NO: 996474 - protein, 8 aa, Mycobacterium
TRSEIKNV

SEQ ID NO: 996475 - protein, 9 aa, Mycobacterium
TRSGPDSVE

SEQ ID NO: 996476 - protein, 6 aa, Mycobacterium
TRSSWG

SEQ ID NO: 996477 - protein, 13 aa, Mycobacterium
TRSTSHPEWNPPT

SEQ ID NO: 996478 - protein, 5 aa, Mycobacterium
TRTDR

SEQ ID NO: 996479 - protein, 4 aa, Mycobacterium
TRTG

SEQ ID NO: 996480 - protein, 11 aa, Mycobacterium
TRTPGDPNALY

SEQ ID NO: 996481 - protein, 5 aa, Mycobacterium
TRTRE

SEQ ID NO: 996482 - protein, 8 aa, Mycobacterium
TRTSQPAL

SEQ ID NO: 996483 - protein, 13 aa, Mycobacterium
TRTTDGRFALTGE

SEQ ID NO: 996484 - protein, 6 aa, Mycobacterium
TRVDPD

SEQ ID NO: 996485 - protein, 8 aa, Mycobacterium
TRVGAEDS

SEQ ID NO: 996486 - protein, 10 aa, Mycobacterium
TRVVTDTSQV

SEQ ID NO: 996487 - protein, 5 aa, Mycobacterium
TRYDE

SEQ ID NO: 996488 - protein, 6 aa, Mycobacterium
TRYPID

SEQ ID NO: 996489 - protein, 6 aa, Mycobacterium
TRYSSA

SEQ ID NO: 996490 - protein, 6 aa, Mycobacterium
TSAAEP

SEQ ID NO: 996491 - protein, 9 aa, Mycobacterium
TSADGTRQR

SEQ ID NO: 996492 - protein, 9 aa, Mycobacterium
TSAGAAARI

SEQ ID NO: 996493 - protein, 5 aa, Mycobacterium
TSAGV

SEQ ID NO: 996494 - protein, 5 aa, Mycobacterium
TSAID

SEQ ID NO: 996495 - protein, 5 aa, Mycobacterium
TSATG

SEQ ID NO: 996496 - protein, 7 aa, Mycobacterium
TSATGLS

SEQ ID NO: 996497 - protein, 8 aa, Mycobacterium
TSAVGDSE

SEQ ID NO: 996498 - protein, 5 aa, Mycobacterium
TSAVQ

SEQ ID NO: 996499 - protein, 12 aa, Mycobacterium
TSAVYGSGSRDP

SEQ ID NO: 996500 - protein, 23 aa, Mycobacterium
TSDEVRDGAGSPADSSKGNKCTA

SEQ ID NO: 996501 - protein, 10 aa, Mycobacterium
TSDGPTATVP

SEQ ID NO: 996502 - protein, 7 aa, Mycobacterium
TSDPQEL

SEQ ID NO: 996503 - protein, 10 aa, Mycobacterium
TSDRDVARTH

SEQ ID NO: 996504 - protein, 7 aa, Mycobacterium
TSDRPNL

SEQ ID NO: 996505 - protein, 9 aa, Mycobacterium
TSDRQVRPV

SEQ ID NO: 996506 - protein, 6 aa, Mycobacterium
TSDVDQ

SEQ ID NO: 996507 - protein, 8 aa, Mycobacterium
TSEAAERQ

SEQ ID NO: 996508 - protein, 10 aa, Mycobacterium
TSELASAGDV

SEQ ID NO: 996509 - protein, 5 aa, Mycobacterium
TSELK

SEQ ID NO: 996510 - protein, 4 aa, Mycobacterium
TSEN

SEQ ID NO: 996511 - protein, 6 aa, Mycobacterium
TSENEC

SEQ ID NO: 996512 - protein, 5 aa, Mycobacterium
TSENV

SEQ ID NO: 996513 - protein, 4 aa, Mycobacterium
TSEQ

SEQ ID NO: 996514 - protein, 6 aa, Mycobacterium
TSETPT

SEQ ID NO: 996515 - protein, 5 aa, Mycobacterium
TSGAH

SEQ ID NO: 996516 - protein, 8 aa, Mycobacterium
TSGATTGA

SEQ ID NO: 996517 - protein, 6 aa, Mycobacterium
TSGDQL

SEQ ID NO: 996518 - protein, 8 aa, Mycobacterium
TSGDSDDL

SEQ ID NO: 996519 - protein, 10 aa, Mycobacterium
TSGEAGRQLG

SEQ ID NO: 996520 - protein, 7 aa, Mycobacterium
TSGEQRL

SEQ ID NO: 996521 - protein, 8 aa, Mycobacterium
TSGEQRSS

SEQ ID NO: 996522 - protein, 10 aa, Mycobacterium
TSGGIGLPSG

SEQ ID NO: 996523 - protein, 9 aa, Mycobacterium
TSGGTRESI

SEQ ID NO: 996524 - protein, 9 aa, Mycobacterium
TSGKGEELY

SEQ ID NO: 996525 - protein, 14 aa, Mycobacterium
TSGLRGPVRGGPDA

SEQ ID NO: 996526 - protein, 19 aa, Mycobacterium
TSGPASAPWEAARPTGRRG

SEQ ID NO: 996527 - protein, 8 aa, Mycobacterium
TSGQPDPD

SEQ ID NO: 996528 - protein, 4 aa, Mycobacterium
TSGR

SEQ ID NO: 996529 - protein, 10 aa, Mycobacterium
TSGSTRAPAG

SEQ ID NO: 996530 - protein, 10 aa, Mycobacterium
TSGSTRIPSG

SEQ ID NO: 996531 - protein, 8 aa, Mycobacterium
TSGSTRLP

SEQ ID NO: 996532 - protein, 6 aa, Mycobacterium
TSGTID

SEQ ID NO: 996533 - protein, 9 aa, Mycobacterium
TSGVADSTQ

SEQ ID NO: 996534 - protein, 9 aa, Mycobacterium
TSGVGQASN

SEQ ID NO: 996535 - protein, 5 aa, Mycobacterium
TSIQP

SEQ ID NO: 996536 - protein, 9 aa, Mycobacterium
TSKHAGQDA

SEQ ID NO: 996537 - protein, 8 aa, Mycobacterium
TSLAGGTP

SEQ ID NO: 996538 - protein, 13 aa, Mycobacterium
TSLANGPFPQADP

SEQ ID NO: 996539 - protein, 20 aa, Mycobacterium
TSLSDEPKPPSQKQPKLLPP

SEQ ID NO: 996540 - protein, 8 aa, Mycobacterium
TSLTGDEA

SEQ ID NO: 996541 - protein, 8 aa, Mycobacterium
TSLTPDRV

SEQ ID NO: 996542 - protein, 9 aa, Mycobacterium
TSLTTPGAT

SEQ ID NO: 996543 - protein, 9 aa, Mycobacterium
TSNDDDTLR

SEQ ID NO: 996544 - protein, 13 aa, Mycobacterium
TSNLEGATVQRAT

SEQ ID NO: 996545 - protein, 8 aa, Mycobacterium
TSPAGARY

SEQ ID NO: 996546 - protein, 11 aa, Mycobacterium
TSPAPEQPAAT

SEQ ID NO: 996547 - protein, 10 aa, Mycobacterium
TSPATSGGGY

SEQ ID NO: 996548 - protein, 5 aa, Mycobacterium
TSPAV

SEQ ID NO: 996549 - protein, 6 aa, Mycobacterium
TSPDAT

SEQ ID NO: 996550 - protein, 5 aa, Mycobacterium
TSPGL

SEQ ID NO: 996551 - protein, 7 aa, Mycobacterium
TSPHPAE

SEQ ID NO: 996552 - protein, 16 aa, Mycobacterium
TSPHSRNRSLGERLGR

SEQ ID NO: 996553 - protein, 18 aa, Mycobacterium
TSPKPEFEDSIESDPGSV

SEQ ID NO: 996554 - protein, 7 aa, Mycobacterium
TSPLGKN

SEQ ID NO: 996555 - protein, 8 aa, Mycobacterium
TSPLHGDE

SEQ ID NO: 996556 - protein, 4 aa, Mycobacterium
TSPN

SEQ ID NO: 996557 - protein, 7 aa, Mycobacterium
TSPNREL

SEQ ID NO: 996558 - protein, 6 aa, Mycobacterium
TSPQHA

SEQ ID NO: 996559 - protein, 7 aa, Mycobacterium
TSPVPQR

SEQ ID NO: 996560 - protein, 6 aa, Mycobacterium
TSRGAQ

SEQ ID NO: 996561 - protein, 7 aa, Mycobacterium
TSRKGDR

SEQ ID NO: 996562 - protein, 13 aa, Mycobacterium
TSRKLDKAASKGV

SEQ ID NO: 996563 - protein, 5 aa, Mycobacterium
TSRRG

SEQ ID NO: 996564 - protein, 9 aa, Mycobacterium
TSRSGQPAE

SEQ ID NO: 996565 - protein, 8 aa, Mycobacterium
TSRVNGRS

SEQ ID NO: 996566 - protein, 6 aa, Mycobacterium
TSRVNR

SEQ ID NO: 996567 - protein, 6 aa, Mycobacterium
TSSAEQ

SEQ ID NO: 996568 - protein, 8 aa, Mycobacterium
TSSAKRPY

SEQ ID NO: 996569 - protein, 24 aa, Mycobacterium
TSSGIPPAPPPPPEGGPPMPPSVG

SEQ ID NO: 996570 - protein, 5 aa, Mycobacterium
TSSGL

SEQ ID NO: 996571 - protein, 10 aa, Mycobacterium
TSSGRVEVSD

SEQ ID NO: 996572 - protein, 4 aa, Mycobacterium
TSSI

SEQ ID NO: 996573 - protein, 20 aa, Mycobacterium
TSSNPTAGGAALGSGIGPTR

SEQ ID NO: 996574 - protein, 14 aa, Mycobacterium
TSSPVAADSRGLGT

SEQ ID NO: 996575 - protein, 6 aa, Mycobacterium
TSSSLA

SEQ ID NO: 996576 - protein, 10 aa, Mycobacterium
TSSSWGSKSP

SEQ ID NO: 996577 - protein, 12 aa, Mycobacterium
TSSVRSATERET

SEQ ID NO: 996578 - protein, 5 aa, Mycobacterium
TSSYG

SEQ ID NO: 996579 - protein, 8 aa, Mycobacterium
TSTADANI

SEQ ID NO: 996580 - protein, 6 aa, Mycobacterium
TSTDER

SEQ ID NO: 996581 - protein, 4 aa, Mycobacterium
TSTE

SEQ ID NO: 996582 - protein, 12 aa, Mycobacterium
TSTFGTKGRQSL

SEQ ID NO: 996583 - protein, 10 aa, Mycobacterium
TSTGPDHDKE

SEQ ID NO: 996584 - protein, 5 aa, Mycobacterium
TSTLE

SEQ ID NO: 996585 - protein, 11 aa, Mycobacterium
TSTPKKPNSAL

SEQ ID NO: 996586 - protein, 8 aa, Mycobacterium
TSTPVGNG

SEQ ID NO: 996587 - protein, 7 aa, Mycobacterium
TSTTNGT

SEQ ID NO: 996588 - protein, 9 aa, Mycobacterium
TSVDAARQA

SEQ ID NO: 996589 - protein, 7 aa, Mycobacterium
TSVERSE

SEQ ID NO: 996590 - protein, 4 aa, Mycobacterium
TSVG

SEQ ID NO: 996591 - protein, 6 aa, Mycobacterium
TSVGTT

SEQ ID NO: 996592 - protein, 6 aa, Mycobacterium
TSVTPH

SEQ ID NO: 996593 - protein, 8 aa, Mycobacterium
TSVTSDAH

SEQ ID NO: 996594 - protein, 7 aa, Mycobacterium
TSYAGQL

SEQ ID NO: 996595 - protein, 8 aa, Mycobacterium
TSYGKHRT

SEQ ID NO: 996596 - protein, 4 aa, Mycobacterium
TTAD

SEQ ID NO: 996597 - protein, 11 aa, Mycobacterium
TTAEEDATGSV

SEQ ID NO: 996598 - protein, 7 aa, Mycobacterium
TTAEEQQ

SEQ ID NO: 996599 - protein, 5 aa, Mycobacterium
TTAEV

SEQ ID NO: 996600 - protein, 4 aa, Mycobacterium
TTAG

SEQ ID NO: 996601 - protein, 9 aa, Mycobacterium
TTAGRAAQT

SEQ ID NO: 996602 - protein, 10 aa, Mycobacterium
TTAGSDAKRQ

SEQ ID NO: 996603 - protein, 5 aa, Mycobacterium
TTAGV

SEQ ID NO: 996604 - protein, 10 aa, Mycobacterium
TTAHKSAPGI

SEQ ID NO: 996605 - protein, 8 aa, Mycobacterium
TTAPQDVR

SEQ ID NO: 996606 - protein, 9 aa, Mycobacterium
TTARPGAQR

SEQ ID NO: 996607 - protein, 10 aa, Mycobacterium
TTARRKPPFG

SEQ ID NO: 996608 - protein, 10 aa, Mycobacterium
TTASKNPKEQ

SEQ ID NO: 996609 - protein, 22 aa, Mycobacterium
TTCSPSATDDGSYESKDANGNV

SEQ ID NO: 996610 - protein, 10 aa, Mycobacterium
TTDARPDLAR

SEQ ID NO: 996611 - protein, 7 aa, Mycobacterium
TTDDGTG

SEQ ID NO: 996612 - protein, 8 aa, Mycobacterium
TTDDPPHP

SEQ ID NO: 996613 - protein, 15 aa, Mycobacterium
TTDGPDGRGQEGVHT

SEQ ID NO: 996614 - protein, 10 aa, Mycobacterium
TTDPASLDEA

SEQ ID NO: 996615 - protein, 16 aa, Mycobacterium
TTDPSESLSHLAAGAM

SEQ ID NO: 996616 - protein, 5 aa, Mycobacterium
TTEEQ

SEQ ID NO: 996617 - protein, 5 aa, Mycobacterium
TTEIE

SEQ ID NO: 996618 - protein, 6 aa, Mycobacterium
TTESIA

SEQ ID NO: 996619 - protein, 13 aa, Mycobacterium
TTETVGNGHGLAS

SEQ ID NO: 996620 - protein, 6 aa, Mycobacterium
TTFTKR

SEQ ID NO: 996621 - protein, 10 aa, Mycobacterium
TTGGNRHGES

SEQ ID NO: 996622 - protein, 6 aa, Mycobacterium
TTGGSV

SEQ ID NO: 996623 - protein, 13 aa, Mycobacterium
TTGGVADGRREIT

SEQ ID NO: 996624 - protein, 8 aa, Mycobacterium
TTGMSDEE

SEQ ID NO: 996625 - protein, 5 aa, Mycobacterium
TTGPL

SEQ ID NO: 996626 - protein, 5 aa, Mycobacterium
TTGTI

SEQ ID NO: 996627 - protein, 23 aa, Mycobacterium
TTGTKVNTPEGKSVKARALSGGS

SEQ ID NO: 996628 - protein, 6 aa, Mycobacterium
TTHPVG

SEQ ID NO: 996629 - protein, 8 aa, Mycobacterium
TTIDQPDH

SEQ ID NO: 996630 - protein, 8 aa, Mycobacterium
TTKDGLGT

SEQ ID NO: 996631 - protein, 5 aa, Mycobacterium
TTKGR

SEQ ID NO: 996632 - protein, 17 aa, Mycobacterium
TTKKVKAHDENSVAGIG

SEQ ID NO: 996633 - protein, 13 aa, Mycobacterium
TTKPVDPGKVGLD

SEQ ID NO: 996634 - protein, 6 aa, Mycobacterium
TTLPNE

SEQ ID NO: 996635 - protein, 7 aa, Mycobacterium
TTLQAGK

SEQ ID NO: 996636 - protein, 11 aa, Mycobacterium
TTNEDTTVPVG

SEQ ID NO: 996637 - protein, 6 aa, Mycobacterium
TTNRGR

SEQ ID NO: 996638 - protein, 15 aa, Mycobacterium
TTNTGDPETTRGEAE

SEQ ID NO: 996639 - protein, 4 aa, Mycobacterium
TTPA

SEQ ID NO: 996640 - protein, 14 aa, Mycobacterium
TTPDATTSTDERIA

SEQ ID NO: 996641 - protein, 14 aa, Mycobacterium
TTPEFTDRQQRTLA

SEQ ID NO: 996642 - protein, 5 aa, Mycobacterium
TTPET

SEQ ID NO: 996643 - protein, 4 aa, Mycobacterium
TTPG

SEQ ID NO: 996644 - protein, 12 aa, Mycobacterium
TTPNDADAEAAG

SEQ ID NO: 996645 - protein, 28 aa, Mycobacterium
TTPSKPALLRPTSNDDVHPTHDGPFPAL

SEQ ID NO: 996646 - protein, 6 aa, Mycobacterium
TTQATT

SEQ ID NO: 996647 - protein, 5 aa, Mycobacterium
TTQQR

SEQ ID NO: 996648 - protein, 10 aa, Mycobacterium
TTRAASADNT

SEQ ID NO: 996649 - protein, 6 aa, Mycobacterium
TTRADG

SEQ ID NO: 996650 - protein, 5 aa, Mycobacterium
TTRET

SEQ ID NO: 996651 - protein, 4 aa, Mycobacterium
TTRG

SEQ ID NO: 996652 - protein, 10 aa, Mycobacterium
TTRGQADAAR

SEQ ID NO: 996653 - protein, 11 aa, Mycobacterium
TTRHKGGGHKR

SEQ ID NO: 996654 - protein, 18 aa, Mycobacterium
TTRRARRTNPIAEIMRDD

SEQ ID NO: 996655 - protein, 5 aa, Mycobacterium
TTRSP

SEQ ID NO: 996656 - protein, 6 aa, Mycobacterium
TTRTAD

SEQ ID NO: 996657 - protein, 11 aa, Mycobacterium
TTRVGSGPFPT

SEQ ID NO: 996658 - protein, 12 aa, Mycobacterium
TTSAKASAASLD

SEQ ID NO: 996659 - protein, 9 aa, Mycobacterium
TTSGTFSPT

SEQ ID NO: 996660 - protein, 11 aa, Mycobacterium
TTSGTTGVPKG

SEQ ID NO: 996661 - protein, 13 aa, Mycobacterium
TTSNALRVYKLGS

SEQ ID NO: 996662 - protein, 4 aa, Mycobacterium
TTSS

SEQ ID NO: 996663 - protein, 13 aa, Mycobacterium
TTSTPCIASKKRD

SEQ ID NO: 996664 - protein, 6 aa, Mycobacterium
TTSVAA

SEQ ID NO: 996665 - protein, 12 aa, Mycobacterium
TTTADPSTNASL

SEQ ID NO: 996666 - protein, 12 aa, Mycobacterium
TTTARPLSGAPR

SEQ ID NO: 996667 - protein, 6 aa, Mycobacterium
TTTDQH

SEQ ID NO: 996668 - protein, 9 aa, Mycobacterium
TTTDSAEGV

SEQ ID NO: 996669 - protein, 4 aa, Mycobacterium
TTTG

SEQ ID NO: 996670 - protein, 15 aa, Mycobacterium
TTTPNGEVASPMPDW

SEQ ID NO: 996671 - protein, 4 aa, Mycobacterium
TTVD

SEQ ID NO: 996672 - protein, 20 aa, Mycobacterium
TTVDGGSSPLWSAASRSPPN

SEQ ID NO: 996673 - protein, 5 aa, Mycobacterium
TTVGQ

SEQ ID NO: 996674 - protein, 8 aa, Mycobacterium
TTVGRGGV

SEQ ID NO: 996675 - protein, 12 aa, Mycobacterium
TTVNSRGAKTTT

SEQ ID NO: 996676 - protein, 5 aa, Mycobacterium
TTVPQ

SEQ ID NO: 996677 - protein, 7 aa, Mycobacterium
TTVSPGR

SEQ ID NO: 996678 - protein, 15 aa, Mycobacterium
TTVSRPQERAAQRRL

SEQ ID NO: 996679 - protein, 16 aa, Mycobacterium
TTYPARQGHPFNNAIN

SEQ ID NO: 996680 - protein, 8 aa, Mycobacterium
TTYSPLSA

SEQ ID NO: 996681 - protein, 8 aa, Mycobacterium
TTYTYADT

SEQ ID NO: 996682 - protein, 13 aa, Mycobacterium
TVAQSGRSGGRPA

SEQ ID NO: 996683 - protein, 13 aa, Mycobacterium
TVARTKTSEYGRT

SEQ ID NO: 996684 - protein, 8 aa, Mycobacterium
TVASGSTV

SEQ ID NO: 996685 - protein, 8 aa, Mycobacterium
TVDGQPVD

SEQ ID NO: 996686 - protein, 5 aa, Mycobacterium
TVDPD

SEQ ID NO: 996687 - protein, 5 aa, Mycobacterium
TVEDE

SEQ ID NO: 996688 - protein, 6 aa, Mycobacterium
TVEDEA

SEQ ID NO: 996689 - protein, 10 aa, Mycobacterium
TVEPASGNLT

SEQ ID NO: 996690 - protein, 7 aa, Mycobacterium
TVESAGT

SEQ ID NO: 996691 - protein, 7 aa, Mycobacterium
TVGDRPI

SEQ ID NO: 996692 - protein, 18 aa, Mycobacterium
TVGGKTIVGPSLSSGQLT

SEQ ID NO: 996693 - protein, 6 aa, Mycobacterium
TVGPGL

SEQ ID NO: 996694 - protein, 5 aa, Mycobacterium
TVGPS

SEQ ID NO: 996695 - protein, 7 aa, Mycobacterium
TVGRRKE

SEQ ID NO: 996696 - protein, 4 aa, Mycobacterium
TVGT

SEQ ID NO: 996697 - protein, 15 aa, Mycobacterium
TVKPEARAAKDLENF

SEQ ID NO: 996698 - protein, 9 aa, Mycobacterium
TVKSGATVD

SEQ ID NO: 996699 - protein, 17 aa, Mycobacterium
TVPGADPSITRTDEATA

SEQ ID NO: 996700 - protein, 9 aa, Mycobacterium
TVPGGPSLP

SEQ ID NO: 996701 - protein, 13 aa, Mycobacterium
TVPTAEVARDRRP

SEQ ID NO: 996702 - protein, 5 aa, Mycobacterium
TVPVS

SEQ ID NO: 996703 - protein, 15 aa, Mycobacterium
TVQASEPLTGAQETL

SEQ ID NO: 996704 - protein, 9 aa, Mycobacterium
TVQQSNEKI

SEQ ID NO: 996705 - protein, 4 aa, Mycobacterium
TVRP

SEQ ID NO: 996706 - protein, 9 aa, Mycobacterium
TVSASGVRH

SEQ ID NO: 996707 - protein, 4 aa, Mycobacterium
TVSD

SEQ ID NO: 996708 - protein, 7 aa, Mycobacterium
TVSKVSE

SEQ ID NO: 996709 - protein, 8 aa, Mycobacterium
TVSNAEEF

SEQ ID NO: 996710 - protein, 7 aa, Mycobacterium
TVSNDTG

SEQ ID NO: 996711 - protein, 16 aa, Mycobacterium
TVSNEQGGIPPGWPCG

SEQ ID NO: 996712 - protein, 18 aa, Mycobacterium
TVSPHHRQAKVSEQPSLA

SEQ ID NO: 996713 - protein, 5 aa, Mycobacterium
TVSRS

SEQ ID NO: 996714 - protein, 12 aa, Mycobacterium
TVSSGEQPQKSK

SEQ ID NO: 996715 - protein, 5 aa, Mycobacterium
TVSYT

SEQ ID NO: 996716 - protein, 5 aa, Mycobacterium
TVTGA

SEQ ID NO: 996717 - protein, 7 aa, Mycobacterium
TVTGEDV

SEQ ID NO: 996718 - protein, 6 aa, Mycobacterium
TVTTAD

SEQ ID NO: 996719 - protein, 9 aa, Mycobacterium
TWEPKTDKV

SEQ ID NO: 996720 - protein, 8 aa, Mycobacterium
TWQGRSAA

SEQ ID NO: 996721 - protein, 4 aa, Mycobacterium
TWRP

SEQ ID NO: 996722 - protein, 22 aa, Mycobacterium
TWTPDTTSHPHDTRPPRSQYTK

SEQ ID NO: 996723 - protein, 6 aa, Mycobacterium
TYEPSV

SEQ ID NO: 996724 - protein, 8 aa, Mycobacterium
TYGDGGNA

SEQ ID NO: 996725 - protein, 8 aa, Mycobacterium
TYGRGESA

SEQ ID NO: 996726 - protein, 5 aa, Mycobacterium
TYGRH

SEQ ID NO: 996727 - protein, 9 aa, Mycobacterium
TYGTYDDSA

SEQ ID NO: 996728 - protein, 11 aa, Mycobacterium
TYNANPDSMRA

SEQ ID NO: 996729 - protein, 7 aa, Mycobacterium
TYNGRSG

SEQ ID NO: 996730 - protein, 5 aa, Mycobacterium
TYPGT

SEQ ID NO: 996731 - protein, 5 aa, Mycobacterium
TYPNQ

SEQ ID NO: 996732 - protein, 10 aa, Mycobacterium
TYPQDGPDQM

SEQ ID NO: 996733 - protein, 4 aa, Mycobacterium
TYPY

SEQ ID NO: 996734 - protein, 28 aa, Mycobacterium
TYQQNSPAGRRTRVSRKANRADQPLRRV

SEQ ID NO: 996735 - protein, 12 aa, Mycobacterium
TYRAGGPDDIDS

SEQ ID NO: 996736 - protein, 29 aa, Mycobacterium
TYRTASVATSACGNRASTRSICTGTDVPP

SEQ ID NO: 996737 - protein, 7 aa, Mycobacterium
TYSEDGD

SEQ ID NO: 996738 - protein, 6 aa, Mycobacterium
TYSPDE

SEQ ID NO: 996739 - protein, 9 aa, Mycobacterium
TYSSRASHA

SEQ ID NO: 996740 - protein, 5 aa, Mycobacterium
TYYGP

SEQ ID NO: 996741 - protein, 4 aa, Mycobacterium
VAAG

SEQ ID NO: 996742 - protein, 7 aa, Mycobacterium
VAAGGAA

SEQ ID NO: 996743 - protein, 4 aa, Mycobacterium
VAAH

SEQ ID NO: 996744 - protein, 6 aa, Mycobacterium
VAAPDR

SEQ ID NO: 996745 - protein, 5 aa, Mycobacterium
VAAQE

SEQ ID NO: 996746 - protein, 12 aa, Mycobacterium
VAARANSYAPYS

SEQ ID NO: 996747 - protein, 13 aa, Mycobacterium
VAARRDAAIHDTG

SEQ ID NO: 996748 - protein, 7 aa, Mycobacterium
VAARSRR

SEQ ID NO: 996749 - protein, 15 aa, Mycobacterium
VAASAQGMLSSTGRC

SEQ ID NO: 996750 - protein, 6 aa, Mycobacterium
VAATSG

SEQ ID NO: 996751 - protein, 11 aa, Mycobacterium
VADAEGIPYDD

SEQ ID NO: 996752 - protein, 9 aa, Mycobacterium
VADAPATNA

SEQ ID NO: 996753 - protein, 12 aa, Mycobacterium
VADDDHRPHNMN

SEQ ID NO: 996754 - protein, 9 aa, Mycobacterium
VADDDRSSA

SEQ ID NO: 996755 - protein, 8 aa, Mycobacterium
VADETPRI

SEQ ID NO: 996756 - protein, 16 aa, Mycobacterium
VADNREAAHAGLLAFI

SEQ ID NO: 996757 - protein, 7 aa, Mycobacterium
VADPVKV

SEQ ID NO: 996758 - protein, 6 aa, Mycobacterium
VADRKP

SEQ ID NO: 996759 - protein, 6 aa, Mycobacterium
VADSGK

SEQ ID NO: 996760 - protein, 13 aa, Mycobacterium
VAEAKTALGGTDI

SEQ ID NO: 996761 - protein, 12 aa, Mycobacterium
VAEFGQDDGLPK

SEQ ID NO: 996762 - protein, 10 aa, Mycobacterium
VAEGDPKFSG

SEQ ID NO: 996763 - protein, 24 aa, Mycobacterium
VAEGGSEAEDKFAEASAAIARLVR

SEQ ID NO: 996764 - protein, 9 aa, Mycobacterium
VAEHESGVA

SEQ ID NO: 996765 - protein, 7 aa, Mycobacterium
VAENSGA

SEQ ID NO: 996766 - protein, 6 aa, Mycobacterium
VAENST

SEQ ID NO: 996767 - protein, 6 aa, Mycobacterium
VAEPAE

SEQ ID NO: 996768 - protein, 9 aa, Mycobacterium
VAEPIDGPW

SEQ ID NO: 996769 - protein, 7 aa, Mycobacterium
VAERAGS

SEQ ID NO: 996770 - protein, 11 aa, Mycobacterium
VAESGEPAAGR

SEQ ID NO: 996771 - protein, 7 aa, Mycobacterium
VAETDEA

SEQ ID NO: 996772 - protein, 7 aa, Mycobacterium
VAGDRGV

SEQ ID NO: 996773 - protein, 4 aa, Mycobacterium
VAGG

SEQ ID NO: 996774 - protein, 13 aa, Mycobacterium
VAGGMAGGSADAA

SEQ ID NO: 996775 - protein, 15 aa, Mycobacterium
VAGGSGTGGPAFNEA

SEQ ID NO: 996776 - protein, 4 aa, Mycobacterium
VAGI

SEQ ID NO: 996777 - protein, 30 aa, Mycobacterium
VAGKNRRAAEVAGKNRRAAEVAGKNHRRVA

SEQ ID NO: 996778 - protein, 13 aa, Mycobacterium
VAGNSATKHPDAV

SEQ ID NO: 996779 - protein, 17 aa, Mycobacterium
VAGPDSTLQSQPANAIK

SEQ ID NO: 996780 - protein, 8 aa, Mycobacterium
VAGPPGST

SEQ ID NO: 996781 - protein, 8 aa, Mycobacterium
VAGPTDLT

SEQ ID NO: 996782 - protein, 5 aa, Mycobacterium
VAGQD

SEQ ID NO: 996783 - protein, 10 aa, Mycobacterium
VAGQPTMRGS

SEQ ID NO: 996784 - protein, 7 aa, Mycobacterium
VAGSPEH

SEQ ID NO: 996785 - protein, 7 aa, Mycobacterium
VAISGDK

SEQ ID NO: 996786 - protein, 11 aa, Mycobacterium
VAKEADLQSYE

SEQ ID NO: 996787 - protein, 6 aa, Mycobacterium
VAKSGF

SEQ ID NO: 996788 - protein, 4 aa, Mycobacterium
VANA

SEQ ID NO: 996789 - protein, 7 aa, Mycobacterium
VANDSAE

SEQ ID NO: 996790 - protein, 8 aa, Mycobacterium
VANEIEKK

SEQ ID NO: 996791 - protein, 7 aa, Mycobacterium
VANKIGT

SEQ ID NO: 996792 - protein, 13 aa, Mycobacterium
VANLSSDTDDLAR

SEQ ID NO: 996793 - protein, 4 aa, Mycobacterium
VANQ

SEQ ID NO: 996794 - protein, 10 aa, Mycobacterium
VANRSEPDRI

SEQ ID NO: 996795 - protein, 12 aa, Mycobacterium
VAPAANPEALDR

SEQ ID NO: 996796 - protein, 7 aa, Mycobacterium
VAPDETT

SEQ ID NO: 996797 - protein, 21 aa, Mycobacterium
VAPDSAKQHRPHRGPDRRQLR

SEQ ID NO: 996798 - protein, 5 aa, Mycobacterium
VAPED

SEQ ID NO: 996799 - protein, 6 aa, Mycobacterium
VAPEGL

SEQ ID NO: 996800 - protein, 6 aa, Mycobacterium
VAPGPF

SEQ ID NO: 996801 - protein, 15 aa, Mycobacterium
VAPIGPAGAVTVPDG

SEQ ID NO: 996802 - protein, 16 aa, Mycobacterium
VAPPASETNNNGDFSR

SEQ ID NO: 996803 - protein, 9 aa, Mycobacterium
VAPPKPSKL

SEQ ID NO: 996804 - protein, 8 aa, Mycobacterium
VAPSGTRN

SEQ ID NO: 996805 - protein, 7 aa, Mycobacterium
VAPSPQA

SEQ ID NO: 996806 - protein, 5 aa, Mycobacterium
VAPTC

SEQ ID NO: 996807 - protein, 11 aa, Mycobacterium
VAPTPLSTSTA

SEQ ID NO: 996808 - protein, 37 aa, Mycobacterium
VAQQSAQHADARQQSRELAPRRGAAGSAMQQLHNTTG

SEQ ID NO: 996809 - protein, 6 aa, Mycobacterium
VARGST

SEQ ID NO: 996810 - protein, 7 aa, Mycobacterium
VASDGSV

SEQ ID NO: 996811 - protein, 14 aa, Mycobacterium
VASESRVSHRGAVH

SEQ ID NO: 996812 - protein, 4 aa, Mycobacterium
VASG

SEQ ID NO: 996813 - protein, 7 aa, Mycobacterium
VASGATE

SEQ ID NO: 996814 - protein, 8 aa, Mycobacterium
VASGTKPV

SEQ ID NO: 996815 - protein, 11 aa, Mycobacterium
VASNGKSHDVD

SEQ ID NO: 996816 - protein, 6 aa, Mycobacterium
VASPSA

SEQ ID NO: 996817 - protein, 7 aa, Mycobacterium
VASSGVA

SEQ ID NO: 996818 - protein, 6 aa, Mycobacterium
VATDED

SEQ ID NO: 996819 - protein, 9 aa, Mycobacterium
VATDRRCGP

SEQ ID NO: 996820 - protein, 8 aa, Mycobacterium
VATGYQGA

SEQ ID NO: 996821 - protein, 17 aa, Mycobacterium
VATKTNDVAGDGTTTAT

SEQ ID NO: 996822 - protein, 5 aa, Mycobacterium
VATPD

SEQ ID NO: 996823 - protein, 7 aa, Mycobacterium
VATPDQM

SEQ ID NO: 996824 - protein, 19 aa, Mycobacterium
VATPKRTPVSQDSDNAGLS

SEQ ID NO: 996825 - protein, 12 aa, Mycobacterium
VATQPDRHAPPD

SEQ ID NO: 996826 - protein, 8 aa, Mycobacterium
VDADGGLV

SEQ ID NO: 996827 - protein, 4 aa, Mycobacterium
VDAP

SEQ ID NO: 996828 - protein, 6 aa, Mycobacterium
VDAPGV

SEQ ID NO: 996829 - protein, 15 aa, Mycobacterium
VDCRGPHDSEPEPGL

SEQ ID NO: 996830 - protein, 14 aa, Mycobacterium
VDDDSGETDEDQKL

SEQ ID NO: 996831 - protein, 5 aa, Mycobacterium
VDDEK

SEQ ID NO: 996832 - protein, 6 aa, Mycobacterium
VDDGAT

SEQ ID NO: 996833 - protein, 8 aa, Mycobacterium
VDDGPTAI

SEQ ID NO: 996834 - protein, 7 aa, Mycobacterium
VDDGRRA

SEQ ID NO: 996835 - protein, 4 aa, Mycobacterium
VDDN

SEQ ID NO: 996836 - protein, 16 aa, Mycobacterium
VDDPDSARPVPGATEA

SEQ ID NO: 996837 - protein, 10 aa, Mycobacterium
VDDPHISRDR

SEQ ID NO: 996838 - protein, 9 aa, Mycobacterium
VDDPRGLGG

SEQ ID NO: 996839 - protein, 4 aa, Mycobacterium
VDDT

SEQ ID NO: 996840 - protein, 9 aa, Mycobacterium
VDEAPQGTS

SEQ ID NO: 996841 - protein, 9 aa, Mycobacterium
VDEPDHRAE

SEQ ID NO: 996842 - protein, 7 aa, Mycobacterium
VDEPNAR

SEQ ID NO: 996843 - protein, 18 aa, Mycobacterium
VDEQHDAVATARARLADS

SEQ ID NO: 996844 - protein, 13 aa, Mycobacterium
VDESESAESFELP

SEQ ID NO: 996845 - protein, 5 aa, Mycobacterium
VDETE

SEQ ID NO: 996846 - protein, 19 aa, Mycobacterium
VDGDPTKGNVFIGSLLAAC

SEQ ID NO: 996847 - protein, 26 aa, Mycobacterium
VDGDTGAYRPAAEDRPESGVYSSPAE

SEQ ID NO: 996848 - protein, 6 aa, Mycobacterium
VDGGQV

SEQ ID NO: 996849 - protein, 7 aa, Mycobacterium
VDGHDEH

SEQ ID NO: 996850 - protein, 11 aa, Mycobacterium
VDGKKREDGVR

SEQ ID NO: 996851 - protein, 6 aa, Mycobacterium
VDGPLT

SEQ ID NO: 996852 - protein, 5 aa, Mycobacterium
VDGRR

SEQ ID NO: 996853 - protein, 5 aa, Mycobacterium
VDGRT

SEQ ID NO: 996854 - protein, 12 aa, Mycobacterium
VDGSSLHNQHSK

SEQ ID NO: 996855 - protein, 7 aa, Mycobacterium
VDGTGEV

SEQ ID NO: 996856 - protein, 5 aa, Mycobacterium
VDGYG

SEQ ID NO: 996857 - protein, 21 aa, Mycobacterium
VDHATGKVNAPPQVVRRDSDD

SEQ ID NO: 996858 - protein, 8 aa, Mycobacterium
VDITTSSE

SEQ ID NO: 996859 - protein, 7 aa, Mycobacterium
VDKFTGD

SEQ ID NO: 996860 - protein, 16 aa, Mycobacterium
VDKPAKTEEHDHHGHA

SEQ ID NO: 996861 - protein, 7 aa, Mycobacterium
VDKRLTE

SEQ ID NO: 996862 - protein, 4 aa, Mycobacterium
VDLQ

SEQ ID NO: 996863 - protein, 15 aa, Mycobacterium
VDNGALTDVVVHPLE

SEQ ID NO: 996864 - protein, 12 aa, Mycobacterium
VDNGDTGYPYGT

SEQ ID NO: 996865 - protein, 15 aa, Mycobacterium
VDNPAMAADPKSLAG

SEQ ID NO: 996866 - protein, 4 aa, Mycobacterium
VDPA

SEQ ID NO: 996867 - protein, 12 aa, Mycobacterium
VDPASAAEHDLV

SEQ ID NO: 996868 - protein, 20 aa, Mycobacterium
VDPASGEEITAQNGRYGPYL

SEQ ID NO: 996869 - protein, 23 aa, Mycobacterium
VDPATYGQRPHPSTDEPRTTRDS

SEQ ID NO: 996870 - protein, 4 aa, Mycobacterium
VDPD

SEQ ID NO: 996871 - protein, 18 aa, Mycobacterium
VDPEAPLVTPEQKIVTLL

SEQ ID NO: 996872 - protein, 8 aa, Mycobacterium
VDPEFGTG

SEQ ID NO: 996873 - protein, 8 aa, Mycobacterium
VDPERDRE

SEQ ID NO: 996874 - protein, 8 aa, Mycobacterium
VDPETGHE

SEQ ID NO: 996875 - protein, 8 aa, Mycobacterium
VDPGGGIR

SEQ ID NO: 996876 - protein, 12 aa, Mycobacterium
VDPGTSSNAGNV

SEQ ID NO: 996877 - protein, 4 aa, Mycobacterium
VDPQ

SEQ ID NO: 996878 - protein, 4 aa, Mycobacterium
VDPR

SEQ ID NO: 996879 - protein, 6 aa, Mycobacterium
VDQEQL

SEQ ID NO: 996880 - protein, 4 aa, Mycobacterium
VDQQ

SEQ ID NO: 996881 - protein, 4 aa, Mycobacterium
VDRA

SEQ ID NO: 996882 - protein, 6 aa, Mycobacterium
VDREGI

SEQ ID NO: 996883 - protein, 4 aa, Mycobacterium
VDRP

SEQ ID NO: 996884 - protein, 10 aa, Mycobacterium
VDRPTSQRFT

SEQ ID NO: 996885 - protein, 10 aa, Mycobacterium
VDRTRRYAPH

SEQ ID NO: 996886 - protein, 15 aa, Mycobacterium
VDSDGATDQFAYELL

SEQ ID NO: 996887 - protein, 9 aa, Mycobacterium
VDSDGTPAY

SEQ ID NO: 996888 - protein, 7 aa, Mycobacterium
VDSDSPA

SEQ ID NO: 996889 - protein, 9 aa, Mycobacterium
VDSRVGDDI

SEQ ID NO: 996890 - protein, 10 aa, Mycobacterium
VDSSDYPSLR

SEQ ID NO: 996891 - protein, 8 aa, Mycobacterium
VDSSGDGG

SEQ ID NO: 996892 - protein, 23 aa, Mycobacterium
VDSTAKTEQGELGDNVTPHKEDG

SEQ ID NO: 996893 - protein, 10 aa, Mycobacterium
VDSVTRREAT

SEQ ID NO: 996894 - protein, 12 aa, Mycobacterium
VDTATVDRRDTT

SEQ ID NO: 996895 - protein, 6 aa, Mycobacterium
VDTDEI

SEQ ID NO: 996896 - protein, 8 aa, Mycobacterium
VDTDGGSG

SEQ ID NO: 996897 - protein, 5 aa, Mycobacterium
VDTGG

SEQ ID NO: 996898 - protein, 8 aa, Mycobacterium
VDTNPEMA

SEQ ID NO: 996899 - protein, 7 aa, Mycobacterium
VDTPAEV

SEQ ID NO: 996900 - protein, 18 aa, Mycobacterium
VDTPEAAERHRLERRFEK

SEQ ID NO: 996901 - protein, 8 aa, Mycobacterium
VDTTGAGD

SEQ ID NO: 996902 - protein, 19 aa, Mycobacterium
VDVSPEERRRIAETGFYAY

SEQ ID NO: 996903 - protein, 6 aa, Mycobacterium
VDYSGR

SEQ ID NO: 996904 - protein, 7 aa, Mycobacterium
VEAAEAS

SEQ ID NO: 996905 - protein, 22 aa, Mycobacterium
VEAASPDSCTTTRISAGTPGLD

SEQ ID NO: 996906 - protein, 12 aa, Mycobacterium
VEAFPPQDYTLA

SEQ ID NO: 996907 - protein, 8 aa, Mycobacterium
VEAGARDA

SEQ ID NO: 996908 - protein, 6 aa, Mycobacterium
VEAGSV

SEQ ID NO: 996909 - protein, 14 aa, Mycobacterium
VEAKEGIETTETGE

SEQ ID NO: 996910 - protein, 16 aa, Mycobacterium
VEAQPPDTVRGIRSHP

SEQ ID NO: 996911 - protein, 10 aa, Mycobacterium
VEASEACRPH

SEQ ID NO: 996912 - protein, 8 aa, Mycobacterium
VEATGDCS

SEQ ID NO: 996913 - protein, 13 aa, Mycobacterium
VECGGRKEDREPD

SEQ ID NO: 996914 - protein, 12 aa, Mycobacterium
VEDAETADPTGL

SEQ ID NO: 996915 - protein, 4 aa, Mycobacterium
VEDD

SEQ ID NO: 996916 - protein, 11 aa, Mycobacterium
VEDNPLRGAPH

SEQ ID NO: 996917 - protein, 7 aa, Mycobacterium
VEDTGYT

SEQ ID NO: 996918 - protein, 8 aa, Mycobacterium
VEEGKRTR

SEQ ID NO: 996919 - protein, 6 aa, Mycobacterium
VEERKA

SEQ ID NO: 996920 - protein, 6 aa, Mycobacterium
VEESKS

SEQ ID NO: 996921 - protein, 9 aa, Mycobacterium
VEESSTLDT

SEQ ID NO: 996922 - protein, 10 aa, Mycobacterium
VEETNQATIA

SEQ ID NO: 996923 - protein, 8 aa, Mycobacterium
VEGDAGPD

SEQ ID NO: 996924 - protein, 6 aa, Mycobacterium
VEGEAL

SEQ ID NO: 996925 - protein, 7 aa, Mycobacterium
VEGGENV

SEQ ID NO: 996926 - protein, 6 aa, Mycobacterium
VEGNRA

SEQ ID NO: 996927 - protein, 5 aa, Mycobacterium
VEGPI

SEQ ID NO: 996928 - protein, 7 aa, Mycobacterium
VEGSGGY

SEQ ID NO: 996929 - protein, 16 aa, Mycobacterium
VEGSYPDSNASISSVA

SEQ ID NO: 996930 - protein, 4 aa, Mycobacterium
VEGT

SEQ ID NO: 996931 - protein, 9 aa, Mycobacterium
VEGTGAYGA

SEQ ID NO: 996932 - protein, 13 aa, Mycobacterium
VEGVGSGPEGNVT

SEQ ID NO: 996933 - protein, 10 aa, Mycobacterium
VEGVGSPTMT

SEQ ID NO: 996934 - protein, 7 aa, Mycobacterium
VEGVGVD

SEQ ID NO: 996935 - protein, 8 aa, Mycobacterium
VEHTHRGH

SEQ ID NO: 996936 - protein, 9 aa, Mycobacterium
VEKGLASKP

SEQ ID NO: 996937 - protein, 6 aa, Mycobacterium
VELGNT

SEQ ID NO: 996938 - protein, 6 aa, Mycobacterium
VENSPG

SEQ ID NO: 996939 - protein, 6 aa, Mycobacterium
VEPAGA

SEQ ID NO: 996940 - protein, 26 aa, Mycobacterium
VEPAGGGADVEAAANRVASALSDAGY

SEQ ID NO: 996941 - protein, 4 aa, Mycobacterium
VEPD

SEQ ID NO: 996942 - protein, 7 aa, Mycobacterium
VEPDGTR

SEQ ID NO: 996943 - protein, 5 aa, Mycobacterium
VEPET

SEQ ID NO: 996944 - protein, 15 aa, Mycobacterium
VEPPEAAEPHTRPPI

SEQ ID NO: 996945 - protein, 6 aa, Mycobacterium
VEPSAV

SEQ ID NO: 996946 - protein, 11 aa, Mycobacterium
VEPTSRKLKAS

SEQ ID NO: 996947 - protein, 18 aa, Mycobacterium
VEQCAPRGEGYGVGDNHR

SEQ ID NO: 996948 - protein, 4 aa, Mycobacterium
VEQD

SEQ ID NO: 996949 - protein, 7 aa, Mycobacterium
VEQGDSH

SEQ ID NO: 996950 - protein, 4 aa, Mycobacterium
VERD

SEQ ID NO: 996951 - protein, 8 aa, Mycobacterium
VERNPNPH

SEQ ID NO: 996952 - protein, 7 aa, Mycobacterium
VERPGRK

SEQ ID NO: 996953 - protein, 14 aa, Mycobacterium
VERPRNPEHGDYSS

SEQ ID NO: 996954 - protein, 4 aa, Mycobacterium
VERR

SEQ ID NO: 996955 - protein, 13 aa, Mycobacterium
VERSTTEEATAGD

SEQ ID NO: 996956 - protein, 15 aa, Mycobacterium
VESGGSELADELEQN

SEQ ID NO: 996957 - protein, 7 aa, Mycobacterium
VESTPGV

SEQ ID NO: 996958 - protein, 4 aa, Mycobacterium
VETG

SEQ ID NO: 996959 - protein, 9 aa, Mycobacterium
VETGDERTV

SEQ ID NO: 996960 - protein, 7 aa, Mycobacterium
VETGDPE

SEQ ID NO: 996961 - protein, 10 aa, Mycobacterium
VETGSRTLKD

SEQ ID NO: 996962 - protein, 12 aa, Mycobacterium
VETKNVKPTVAE

SEQ ID NO: 996963 - protein, 11 aa, Mycobacterium
VETPDASSHTA

SEQ ID NO: 996964 - protein, 8 aa, Mycobacterium
VETPGQAA

SEQ ID NO: 996965 - protein, 8 aa, Mycobacterium
VETRRERH

SEQ ID NO: 996966 - protein, 7 aa, Mycobacterium
VETSPAG

SEQ ID NO: 996967 - protein, 9 aa, Mycobacterium
VETTPLTRQ

SEQ ID NO: 996968 - protein, 12 aa, Mycobacterium
VEVEGDPESQQA

SEQ ID NO: 996969 - protein, 11 aa, Mycobacterium
VEVGGSSGGAV

SEQ ID NO: 996970 - protein, 7 aa, Mycobacterium
VEYEQDR

SEQ ID NO: 996971 - protein, 4 aa, Mycobacterium
VEYT

SEQ ID NO: 996972 - protein, 5 aa, Mycobacterium
VGADD

SEQ ID NO: 996973 - protein, 6 aa, Mycobacterium
VGAEPG

SEQ ID NO: 996974 - protein, 6 aa, Mycobacterium
VGANPL

SEQ ID NO: 996975 - protein, 4 aa, Mycobacterium
VGAP

SEQ ID NO: 996976 - protein, 12 aa, Mycobacterium
VGAPETRANSAP

SEQ ID NO: 996977 - protein, 7 aa, Mycobacterium
VGAPGDA

SEQ ID NO: 996978 - protein, 22 aa, Mycobacterium
VGAQGGHPEALGGLGGAAPGQL

SEQ ID NO: 996979 - protein, 22 aa, Mycobacterium
VGAVTPKPSINASRSATSAELT

SEQ ID NO: 996980 - protein, 10 aa, Mycobacterium
VGDASQPSEA

SEQ ID NO: 996981 - protein, 8 aa, Mycobacterium
VGDGSSYV

SEQ ID NO: 996982 - protein, 10 aa, Mycobacterium
VGDGTGPDVR

SEQ ID NO: 996983 - protein, 12 aa, Mycobacterium
VGDPATQAHGVN

SEQ ID NO: 996984 - protein, 16 aa, Mycobacterium
VGDPRLPQMPATAEQI

SEQ ID NO: 996985 - protein, 34 aa, Mycobacterium
VGDPTDPDTDVGPLATESGRAQVEQQVDAAAAAG

SEQ ID NO: 996986 - protein, 12 aa, Mycobacterium
VGDRLSGVFVTH

SEQ ID NO: 996987 - protein, 9 aa, Mycobacterium
VGDRTPEQT

SEQ ID NO: 996988 - protein, 11 aa, Mycobacterium
VGDSRDEQRDA

SEQ ID NO: 996989 - protein, 15 aa, Mycobacterium
VGDWSTRGKRGAYND

SEQ ID NO: 996990 - protein, 14 aa, Mycobacterium
VGEAPKQSGVALPG

SEQ ID NO: 996991 - protein, 5 aa, Mycobacterium
VGEDG

SEQ ID NO: 996992 - protein, 22 aa, Mycobacterium
VGEGRGSARCASPCDGYDAGPG

SEQ ID NO: 996993 - protein, 5 aa, Mycobacterium
VGEHD

SEQ ID NO: 996994 - protein, 18 aa, Mycobacterium
VGEISPDDTLVSTGLWPG

SEQ ID NO: 996995 - protein, 6 aa, Mycobacterium
VGEPTV

SEQ ID NO: 996996 - protein, 19 aa, Mycobacterium
VGEQAGQVETVKRSEAGMV

SEQ ID NO: 996997 - protein, 7 aa, Mycobacterium
VGERPSL

SEQ ID NO: 996998 - protein, 9 aa, Mycobacterium
VGESGAGVA

SEQ ID NO: 996999 - protein, 6 aa, Mycobacterium
VGETGV

SEQ ID NO: 997000 - protein, 9 aa, Mycobacterium
VGFTPDPSV

SEQ ID NO: 997001 - protein, 5 aa, Mycobacterium
VGGDG

SEQ ID NO: 997002 - protein, 6 aa, Mycobacterium
VGGDRD

SEQ ID NO: 997003 - protein, 10 aa, Mycobacterium
VGGDRTGSEI

SEQ ID NO: 997004 - protein, 25 aa, Mycobacterium
VGGEDESNESGTELTGKIDEPLEEQ

SEQ ID NO: 997005 - protein, 15 aa, Mycobacterium
VGGEHRRSVAIRSAI

SEQ ID NO: 997006 - protein, 8 aa, Mycobacterium
VGGESARS

SEQ ID NO: 997007 - protein, 10 aa, Mycobacterium
VGGESRADGP

SEQ ID NO: 997008 - protein, 7 aa, Mycobacterium
VGGFSEG

SEQ ID NO: 997009 - protein, 9 aa, Mycobacterium
VGGGDSAAA

SEQ ID NO: 997010 - protein, 7 aa, Mycobacterium
VGGITET

SEQ ID NO: 997011 - protein, 14 aa, Mycobacterium
VGGKTGINTEAGKN

SEQ ID NO: 997012 - protein, 31 aa, Mycobacterium
VGGPRSDAALAASSGRTATTKAMGKGSTQHQ

SEQ ID NO: 997013 - protein, 7 aa, Mycobacterium
VGGPYSE

SEQ ID NO: 997014 - protein, 5 aa, Mycobacterium
VGGRQ

SEQ ID NO: 997015 - protein, 14 aa, Mycobacterium
VGGRSGKAECDSAL

SEQ ID NO: 997016 - protein, 4 aa, Mycobacterium
VGGS

SEQ ID NO: 997017 - protein, 4 aa, Mycobacterium
VGGT

SEQ ID NO: 997018 - protein, 6 aa, Mycobacterium
VGGTIG

SEQ ID NO: 997019 - protein, 6 aa, Mycobacterium
VGGYTP

SEQ ID NO: 997020 - protein, 7 aa, Mycobacterium
VGHDTEA

SEQ ID NO: 997021 - protein, 7 aa, Mycobacterium
VGHTKRE

SEQ ID NO: 997022 - protein, 5 aa, Mycobacterium
VGKSE

SEQ ID NO: 997023 - protein, 7 aa, Mycobacterium
VGKTISG

SEQ ID NO: 997024 - protein, 18 aa, Mycobacterium
VGKTPSETAVLVREILCT

SEQ ID NO: 997025 - protein, 6 aa, Mycobacterium
VGLTSN

SEQ ID NO: 997026 - protein, 10 aa, Mycobacterium
VGNADDLTQE

SEQ ID NO: 997027 - protein, 5 aa, Mycobacterium
VGNPD

SEQ ID NO: 997028 - protein, 12 aa, Mycobacterium
VGNPPRLAEPGP

SEQ ID NO: 997029 - protein, 5 aa, Mycobacterium
VGPDA

SEQ ID NO: 997030 - protein, 14 aa, Mycobacterium
VGPEDYADIPPTRF

SEQ ID NO: 997031 - protein, 8 aa, Mycobacterium
VGPEPDSG

SEQ ID NO: 997032 - protein, 7 aa, Mycobacterium
VGPGRDQ

SEQ ID NO: 997033 - protein, 13 aa, Mycobacterium
VGPGRGSAAGSLA

SEQ ID NO: 997034 - protein, 8 aa, Mycobacterium
VGPHGSVR

SEQ ID NO: 997035 - protein, 4 aa, Mycobacterium
VGPR

SEQ ID NO: 997036 - protein, 7 aa, Mycobacterium
VGPSAEP

SEQ ID NO: 997037 - protein, 9 aa, Mycobacterium
VGPSTPLDV

SEQ ID NO: 997038 - protein, 22 aa, Mycobacterium
VGPTQRQQDQHRGSVDDVDCGL

SEQ ID NO: 997039 - protein, 22 aa, Mycobacterium
VGPVGASGLTVGTAADGNAVRG

SEQ ID NO: 997040 - protein, 6 aa, Mycobacterium
VGPYGA

SEQ ID NO: 997041 - protein, 8 aa, Mycobacterium
VGQPHSSQ

SEQ ID NO: 997042 - protein, 9 aa, Mycobacterium
VGQPQTSSG

SEQ ID NO: 997043 - protein, 14 aa, Mycobacterium
VGQRRLGSCDWARA

SEQ ID NO: 997044 - protein, 13 aa, Mycobacterium
VGQRSGVPGRRHL

SEQ ID NO: 997045 - protein, 6 aa, Mycobacterium
VGQSTG

SEQ ID NO: 997046 - protein, 30 aa, Mycobacterium
VGRDSTRGLGAGADPEVGRKAAEDAKDEIE

SEQ ID NO: 997047 - protein, 4 aa, Mycobacterium
VGRG

SEQ ID NO: 997048 - protein, 18 aa, Mycobacterium
VGRGARDGREAGNGVEVP

SEQ ID NO: 997049 - protein, 18 aa, Mycobacterium
VGRGDGRLGQGGIPTDRV

SEQ ID NO: 997050 - protein, 9 aa, Mycobacterium
VGRGRPAKH

SEQ ID NO: 997051 - protein, 5 aa, Mycobacterium
VGRKT

SEQ ID NO: 997052 - protein, 10 aa, Mycobacterium
VGRPRRAGVS

SEQ ID NO: 997053 - protein, 7 aa, Mycobacterium
VGRQPRV

SEQ ID NO: 997054 - protein, 6 aa, Mycobacterium
VGSAGK

SEQ ID NO: 997055 - protein, 32 aa, Mycobacterium
VGSARTGPSSGQVSCGGKPTLKASGSTAQANA

SEQ ID NO: 997056 - protein, 9 aa, Mycobacterium
VGSEEEAPL

SEQ ID NO: 997057 - protein, 9 aa, Mycobacterium
VGSEQAYAK

SEQ ID NO: 997058 - protein, 6 aa, Mycobacterium
VGSETL

SEQ ID NO: 997059 - protein, 5 aa, Mycobacterium
VGSGG

SEQ ID NO: 997060 - protein, 10 aa, Mycobacterium
VGSGSRRLEP

SEQ ID NO: 997061 - protein, 8 aa, Mycobacterium
VGSMNNPE

SEQ ID NO: 997062 - protein, 13 aa, Mycobacterium
VGSPGQGAYAAAN

SEQ ID NO: 997063 - protein, 8 aa, Mycobacterium
VGSSEVKA

SEQ ID NO: 997064 - protein, 14 aa, Mycobacterium
VGSSGQGNYAATNS

SEQ ID NO: 997065 - protein, 5 aa, Mycobacterium
VGSSR

SEQ ID NO: 997066 - protein, 6 aa, Mycobacterium
VGSTAQ

SEQ ID NO: 997067 - protein, 12 aa, Mycobacterium
VGTDGDDAGARN

SEQ ID NO: 997068 - protein, 8 aa, Mycobacterium
VGTDSHTT

SEQ ID NO: 997069 - protein, 6 aa, Mycobacterium
VGTEAH

SEQ ID NO: 997070 - protein, 7 aa, Mycobacterium
VGTEPGA

SEQ ID NO: 997071 - protein, 8 aa, Mycobacterium
VGTGAQVS

SEQ ID NO: 997072 - protein, 11 aa, Mycobacterium
VGTGRPGRNSI

SEQ ID NO: 997073 - protein, 4 aa, Mycobacterium
VGTN

SEQ ID NO: 997074 - protein, 13 aa, Mycobacterium
VGTNPTFSGRTRT

SEQ ID NO: 997075 - protein, 5 aa, Mycobacterium
VGTQF

SEQ ID NO: 997076 - protein, 5 aa, Mycobacterium
VGTTL

SEQ ID NO: 997077 - protein, 5 aa, Mycobacterium
VGVGK

SEQ ID NO: 997078 - protein, 11 aa, Mycobacterium
VGVGPGSTCTT

SEQ ID NO: 997079 - protein, 6 aa, Mycobacterium
VGVPTE

SEQ ID NO: 997080 - protein, 11 aa, Mycobacterium
VGVQGDNRSYG

SEQ ID NO: 997081 - protein, 5 aa, Mycobacterium
VGVRP

SEQ ID NO: 997082 - protein, 17 aa, Mycobacterium
VGYSGSVSSGCVRDLHH

SEQ ID NO: 997083 - protein, 16 aa, Mycobacterium
VHGTNSGVLRYGIFHM

SEQ ID NO: 997084 - protein, 7 aa, Mycobacterium
VHKPRPN

SEQ ID NO: 997085 - protein, 7 aa, Mycobacterium
VHPDDKR

SEQ ID NO: 997086 - protein, 6 aa, Mycobacterium
VHPGEE

SEQ ID NO: 997087 - protein, 8 aa, Mycobacterium
VHSETAID

SEQ ID NO: 997088 - protein, 19 aa, Mycobacterium
VHSPAVGGQRFAERWIRVP

SEQ ID NO: 997089 - protein, 17 aa, Mycobacterium
VHTPPHANIKTSRNAVP

SEQ ID NO: 997090 - protein, 10 aa, Mycobacterium
VIDPDDGSLA

SEQ ID NO: 997091 - protein, 7 aa, Mycobacterium
VIGPKGK

SEQ ID NO: 997092 - protein, 13 aa, Mycobacterium
VIRPGTDAHHTTR

SEQ ID NO: 997093 - protein, 12 aa, Mycobacterium
VKAGPGQGVDVD

SEQ ID NO: 997094 - protein, 12 aa, Mycobacterium
VKDGGTADGEAG

SEQ ID NO: 997095 - protein, 8 aa, Mycobacterium
VKDTAEAD

SEQ ID NO: 997096 - protein, 7 aa, Mycobacterium
VKEVTGN

SEQ ID NO: 997097 - protein, 7 aa, Mycobacterium
VKGDPTK

SEQ ID NO: 997098 - protein, 5 aa, Mycobacterium
VKGGH

SEQ ID NO: 997099 - protein, 24 aa, Mycobacterium
VKGHSSSSGAKLTNEAVRIPDTAV

SEQ ID NO: 997100 - protein, 8 aa, Mycobacterium
VKGSQLGL

SEQ ID NO: 997101 - protein, 16 aa, Mycobacterium
VKHSPDELAQSGQFVQ

SEQ ID NO: 997102 - protein, 8 aa, Mycobacterium
VKIPDEDL

SEQ ID NO: 997103 - protein, 21 aa, Mycobacterium
VKNAQEAHEAIRPAGETFATP

SEQ ID NO: 997104 - protein, 11 aa, Mycobacterium
VKNGASSEQAR

SEQ ID NO: 997105 - protein, 6 aa, Mycobacterium
VKPPRT

SEQ ID NO: 997106 - protein, 13 aa, Mycobacterium
VKPTSVPAFRPGA

SEQ ID NO: 997107 - protein, 8 aa, Mycobacterium
VKPTYGTV

SEQ ID NO: 997108 - protein, 6 aa, Mycobacterium
VKQDEV

SEQ ID NO: 997109 - protein, 9 aa, Mycobacterium
VKQGLAQTV

SEQ ID NO: 997110 - protein, 17 aa, Mycobacterium
VKQPKTAPLAGNSIATD

SEQ ID NO: 997111 - protein, 6 aa, Mycobacterium
VKRAET

SEQ ID NO: 997112 - protein, 12 aa, Mycobacterium
VKSPTDLDKLAN

SEQ ID NO: 997113 - protein, 12 aa, Mycobacterium
VKTPDGKVDGTI

SEQ ID NO: 997114 - protein, 5 aa, Mycobacterium
VKVEE

SEQ ID NO: 997115 - protein, 10 aa, Mycobacterium
VLGSNTSTLP

SEQ ID NO: 997116 - protein, 8 aa, Mycobacterium
VLPPPKYS

SEQ ID NO: 997117 - protein, 16 aa, Mycobacterium
VLPPPPTSARIPLPGG

SEQ ID NO: 997118 - protein, 7 aa, Mycobacterium
VLPPPTG

SEQ ID NO: 997119 - protein, 4 aa, Mycobacterium
VLTP

SEQ ID NO: 997120 - protein, 15 aa, Mycobacterium
VMPGPNRDRAIPWPA

SEQ ID NO: 997121 - protein, 14 aa, Mycobacterium
VNAAEEDGGSTSIA

SEQ ID NO: 997122 - protein, 12 aa, Mycobacterium
VNADSNLETSVF

SEQ ID NO: 997123 - protein, 6 aa, Mycobacterium
VNATAR

SEQ ID NO: 997124 - protein, 8 aa, Mycobacterium
VNDDQGIR

SEQ ID NO: 997125 - protein, 5 aa, Mycobacterium
VNEAA

SEQ ID NO: 997126 - protein, 12 aa, Mycobacterium
VNEEPVKKFLIF

SEQ ID NO: 997127 - protein, 13 aa, Mycobacterium
VNEGFSGGEKKRH

SEQ ID NO: 997128 - protein, 6 aa, Mycobacterium
VNEQTT

SEQ ID NO: 997129 - protein, 5 aa, Mycobacterium
VNESS

SEQ ID NO: 997130 - protein, 17 aa, Mycobacterium
VNGDIPQGQRERTTIAR

SEQ ID NO: 997131 - protein, 6 aa, Mycobacterium
VNGEQL

SEQ ID NO: 997132 - protein, 11 aa, Mycobacterium
VNGEVKQHSRT

SEQ ID NO: 997133 - protein, 5 aa, Mycobacterium
VNGGT

SEQ ID NO: 997134 - protein, 8 aa, Mycobacterium
VNGRGGPQ

SEQ ID NO: 997135 - protein, 5 aa, Mycobacterium
VNGTA

SEQ ID NO: 997136 - protein, 14 aa, Mycobacterium
VNMSQSSNDTFPTA

SEQ ID NO: 997137 - protein, 5 aa, Mycobacterium
VNNAE

SEQ ID NO: 997138 - protein, 6 aa, Mycobacterium
VNNDAA

SEQ ID NO: 997139 - protein, 6 aa, Mycobacterium
VNPALG

SEQ ID NO: 997140 - protein, 5 aa, Mycobacterium
VNPGL

SEQ ID NO: 997141 - protein, 6 aa, Mycobacterium
VNPGNI

SEQ ID NO: 997142 - protein, 6 aa, Mycobacterium
VNPPGS

SEQ ID NO: 997143 - protein, 9 aa, Mycobacterium
VNPSGTRKD

SEQ ID NO: 997144 - protein, 7 aa, Mycobacterium
VNPSRIA

SEQ ID NO: 997145 - protein, 22 aa, Mycobacterium
VNQPTKSGNHRSQQTQAGQLQL

SEQ ID NO: 997146 - protein, 7 aa, Mycobacterium
VNREPVD

SEQ ID NO: 997147 - protein, 10 aa, Mycobacterium
VNRPDGLRSS

SEQ ID NO: 997148 - protein, 8 aa, Mycobacterium
VNRSFEST

SEQ ID NO: 997149 - protein, 10 aa, Mycobacterium
VNRYADSEHG

SEQ ID NO: 997150 - protein, 7 aa, Mycobacterium
VNSPARL

SEQ ID NO: 997151 - protein, 10 aa, Mycobacterium
VNSSEFPTSR

SEQ ID NO: 997152 - protein, 12 aa, Mycobacterium
VNSSQGGGSKDT

SEQ ID NO: 997153 - protein, 11 aa, Mycobacterium
VNTAAQKVRSG

SEQ ID NO: 997154 - protein, 6 aa, Mycobacterium
VNTPPS

SEQ ID NO: 997155 - protein, 7 aa, Mycobacterium
VNTPSGA

SEQ ID NO: 997156 - protein, 12 aa, Mycobacterium
VNVRPDGEALIL

SEQ ID NO: 997157 - protein, 5 aa, Mycobacterium
VPAAA

SEQ ID NO: 997158 - protein, 8 aa, Mycobacterium
VPADSVGS

SEQ ID NO: 997159 - protein, 5 aa, Mycobacterium
VPAGR

SEQ ID NO: 997160 - protein, 22 aa, Mycobacterium
VPAGSTAAAAVSEAGLPTHGAP

SEQ ID NO: 997161 - protein, 7 aa, Mycobacterium
VPAGTGV

SEQ ID NO: 997162 - protein, 9 aa, Mycobacterium
VPAKKATKV

SEQ ID NO: 997163 - protein, 17 aa, Mycobacterium
VPAPAENATKITARAPA

SEQ ID NO: 997164 - protein, 5 aa, Mycobacterium
VPAPP

SEQ ID NO: 997165 - protein, 14 aa, Mycobacterium
VPAPQSVSTPMYVR

SEQ ID NO: 997166 - protein, 6 aa, Mycobacterium
VPAQEV

SEQ ID NO: 997167 - protein, 8 aa, Mycobacterium
VPATKGNI

SEQ ID NO: 997168 - protein, 4 aa, Mycobacterium
VPDA

SEQ ID NO: 997169 - protein, 5 aa, Mycobacterium
VPDAR

SEQ ID NO: 997170 - protein, 4 aa, Mycobacterium
VPDE

SEQ ID NO: 997171 - protein, 15 aa, Mycobacterium
VPDMDAENDLPERNG

SEQ ID NO: 997172 - protein, 11 aa, Mycobacterium
VPDPGGAAFYG

SEQ ID NO: 997173 - protein, 7 aa, Mycobacterium
VPDPGTL

SEQ ID NO: 997174 - protein, 7 aa, Mycobacterium
VPDPNVP

SEQ ID NO: 997175 - protein, 15 aa, Mycobacterium
VPDPRHEGASAANHR

SEQ ID NO: 997176 - protein, 18 aa, Mycobacterium
VPDQPDGPLDRTDPAQRA

SEQ ID NO: 997177 - protein, 7 aa, Mycobacterium
VPDRNTE

SEQ ID NO: 997178 - protein, 10 aa, Mycobacterium
VPDSDNTAYD

SEQ ID NO: 997179 - protein, 7 aa, Mycobacterium
VPDSQRL

SEQ ID NO: 997180 - protein, 9 aa, Mycobacterium
VPDTGPDGL

SEQ ID NO: 997181 - protein, 5 aa, Mycobacterium
VPDYQ

SEQ ID NO: 997182 - protein, 4 aa, Mycobacterium
VPEE

SEQ ID NO: 997183 - protein, 7 aa, Mycobacterium
VPEPGSV

SEQ ID NO: 997184 - protein, 4 aa, Mycobacterium
VPEQ

SEQ ID NO: 997185 - protein, 5 aa, Mycobacterium
VPEQA

SEQ ID NO: 997186 - protein, 7 aa, Mycobacterium
VPEQSQV

SEQ ID NO: 997187 - protein, 4 aa, Mycobacterium
VPFP

SEQ ID NO: 997188 - protein, 22 aa, Mycobacterium
VPFPTGPRPDVTRADDHAYAQQ

SEQ ID NO: 997189 - protein, 4 aa, Mycobacterium
VPGA

SEQ ID NO: 997190 - protein, 5 aa, Mycobacterium
VPGAC

SEQ ID NO: 997191 - protein, 19 aa, Mycobacterium
VPGALNDDSRPRKLRPGDS

SEQ ID NO: 997192 - protein, 8 aa, Mycobacterium
VPGGITTN

SEQ ID NO: 997193 - protein, 10 aa, Mycobacterium
VPGGTAPGQA

SEQ ID NO: 997194 - protein, 7 aa, Mycobacterium
VPGNNAD

SEQ ID NO: 997195 - protein, 4 aa, Mycobacterium
VPGP

SEQ ID NO: 997196 - protein, 5 aa, Mycobacterium
VPGPH

SEQ ID NO: 997197 - protein, 5 aa, Mycobacterium
VPGPQ

SEQ ID NO: 997198 - protein, 6 aa, Mycobacterium
VPGRTG

SEQ ID NO: 997199 - protein, 6 aa, Mycobacterium
VPGSAS

SEQ ID NO: 997200 - protein, 8 aa, Mycobacterium
VPGSGLRG

SEQ ID NO: 997201 - protein, 7 aa, Mycobacterium
VPGSVVE

SEQ ID NO: 997202 - protein, 12 aa, Mycobacterium
VPGYTRYPPQPK

SEQ ID NO: 997203 - protein, 4 aa, Mycobacterium
VPHQ

SEQ ID NO: 997204 - protein, 7 aa, Mycobacterium
VPISEAT

SEQ ID NO: 997205 - protein, 9 aa, Mycobacterium
VPKGTSDGR

SEQ ID NO: 997206 - protein, 21 aa, Mycobacterium
VPKTSASTGPRVSIQFRPRNV

SEQ ID NO: 997207 - protein, 15 aa, Mycobacterium
VPLPDQLSDEPPVPF

SEQ ID NO: 997208 - protein, 21 aa, Mycobacterium
VPLTPGEYTQLTGRAGRRGID

SEQ ID NO: 997209 - protein, 7 aa, Mycobacterium
VPMADDK

SEQ ID NO: 997210 - protein, 6 aa, Mycobacterium
VPNDGG

SEQ ID NO: 997211 - protein, 7 aa, Mycobacterium
VPNDGQG

SEQ ID NO: 997212 - protein, 10 aa, Mycobacterium
VPNDPRPPMV

SEQ ID NO: 997213 - protein, 4 aa, Mycobacterium
VPNT

SEQ ID NO: 997214 - protein, 5 aa, Mycobacterium
VPPEQ

SEQ ID NO: 997215 - protein, 5 aa, Mycobacterium
VPPGD

SEQ ID NO: 997216 - protein, 8 aa, Mycobacterium
VPPGDGPW

SEQ ID NO: 997217 - protein, 9 aa, Mycobacterium
VPPGPEPWP

SEQ ID NO: 997218 - protein, 8 aa, Mycobacterium
VPPGPGEI

SEQ ID NO: 997219 - protein, 11 aa, Mycobacterium
VPPPGPSTREI

SEQ ID NO: 997220 - protein, 5 aa, Mycobacterium
VPPRP

SEQ ID NO: 997221 - protein, 8 aa, Mycobacterium
VPPRTVAH

SEQ ID NO: 997222 - protein, 6 aa, Mycobacterium
VPPSMP

SEQ ID NO: 997223 - protein, 7 aa, Mycobacterium
VPPSQAK

SEQ ID NO: 997224 - protein, 8 aa, Mycobacterium
VPPTSKTG

SEQ ID NO: 997225 - protein, 4 aa, Mycobacterium
VPPY

SEQ ID NO: 997226 - protein, 4 aa, Mycobacterium
VPQG

SEQ ID NO: 997227 - protein, 10 aa, Mycobacterium
VPQGGVTDER

SEQ ID NO: 997228 - protein, 8 aa, Mycobacterium
VPQPFTSP

SEQ ID NO: 997229 - protein, 5 aa, Mycobacterium
VPREP

SEQ ID NO: 997230 - protein, 18 aa, Mycobacterium
VPRQNGGDLRYAHGLQTT

SEQ ID NO: 997231 - protein, 5 aa, Mycobacterium
VPRQR

SEQ ID NO: 997232 - protein, 10 aa, Mycobacterium
VPRRAKDMTP

SEQ ID NO: 997233 - protein, 24 aa, Mycobacterium
VPRRGDKRALAETVQRNAKEELQQ

SEQ ID NO: 997234 - protein, 7 aa, Mycobacterium
VPRSDAT

SEQ ID NO: 997235 - protein, 16 aa, Mycobacterium
VPRTPENSLNILYSAL

SEQ ID NO: 997236 - protein, 10 aa, Mycobacterium
VPSDEQVEPM

SEQ ID NO: 997237 - protein, 12 aa, Mycobacterium
VPSPLSALVAGR

SEQ ID NO: 997238 - protein, 7 aa, Mycobacterium
VPSPTAA

SEQ ID NO: 997239 - protein, 4 aa, Mycobacterium
VPSR

SEQ ID NO: 997240 - protein, 8 aa, Mycobacterium
VPSSGPAI

SEQ ID NO: 997241 - protein, 7 aa, Mycobacterium
VPSTPSN

SEQ ID NO: 997242 - protein, 15 aa, Mycobacterium
VPSWSTTRPGGDCSG

SEQ ID NO: 997243 - protein, 4 aa, Mycobacterium
VPTA

SEQ ID NO: 997244 - protein, 8 aa, Mycobacterium
VPTAANAG

SEQ ID NO: 997245 - protein, 9 aa, Mycobacterium
VPTASTTAS

SEQ ID NO: 997246 - protein, 12 aa, Mycobacterium
VPTDASSLGALS

SEQ ID NO: 997247 - protein, 6 aa, Mycobacterium
VPTEPR

SEQ ID NO: 997248 - protein, 8 aa, Mycobacterium
VPTGAGLS

SEQ ID NO: 997249 - protein, 6 aa, Mycobacterium
VPTPDD

SEQ ID NO: 997250 - protein, 11 aa, Mycobacterium
VPTPDRLEHDA

SEQ ID NO: 997251 - protein, 17 aa, Mycobacterium
VPTQPAGQDCAPSATAR

SEQ ID NO: 997252 - protein, 11 aa, Mycobacterium
VPTQVGSTLAP

SEQ ID NO: 997253 - protein, 5 aa, Mycobacterium
VPTRA

SEQ ID NO: 997254 - protein, 8 aa, Mycobacterium
VPTSEIAT

SEQ ID NO: 997255 - protein, 4 aa, Mycobacterium
VPTT

SEQ ID NO: 997256 - protein, 7 aa, Mycobacterium
VPVAPEA

SEQ ID NO: 997257 - protein, 11 aa, Mycobacterium
VPVKDSDKDSL

SEQ ID NO: 997258 - protein, 4 aa, Mycobacterium
VPVP

SEQ ID NO: 997259 - protein, 8 aa, Mycobacterium
VPVPGTSM

SEQ ID NO: 997260 - protein, 9 aa, Mycobacterium
VPWSNPRMN

SEQ ID NO: 997261 - protein, 4 aa, Mycobacterium
VPYS

SEQ ID NO: 997262 - protein, 7 aa, Mycobacterium
VQAGYEG

SEQ ID NO: 997263 - protein, 5 aa, Mycobacterium
VQAPE

SEQ ID NO: 997264 - protein, 9 aa, Mycobacterium
VQAPHGGES

SEQ ID NO: 997265 - protein, 8 aa, Mycobacterium
VQDAGGDV

SEQ ID NO: 997266 - protein, 16 aa, Mycobacterium
VQDWPGQRPAELAYRR

SEQ ID NO: 997267 - protein, 14 aa, Mycobacterium
VQEATDTNAELSKA

SEQ ID NO: 997268 - protein, 6 aa, Mycobacterium
VQEDRP

SEQ ID NO: 997269 - protein, 14 aa, Mycobacterium
VQGPEAGHLLALAG

SEQ ID NO: 997270 - protein, 6 aa, Mycobacterium
VQGQPH

SEQ ID NO: 997271 - protein, 5 aa, Mycobacterium
VQGRG

SEQ ID NO: 997272 - protein, 4 aa, Mycobacterium
VQGS

SEQ ID NO: 997273 - protein, 10 aa, Mycobacterium
VQHEDAAGQQ

SEQ ID NO: 997274 - protein, 8 aa, Mycobacterium
VQKAGAGG

SEQ ID NO: 997275 - protein, 12 aa, Mycobacterium
VQKASSADSEVS

SEQ ID NO: 997276 - protein, 37 aa, Mycobacterium
VQPEGDRDQWASPPFEPTERDGRIYGRGSADDKAGIA

SEQ ID NO: 997277 - protein, 20 aa, Mycobacterium
VQPELRKGRYPDRKTARRVS

SEQ ID NO: 997278 - protein, 6 aa, Mycobacterium
VQPGDE

SEQ ID NO: 997279 - protein, 10 aa, Mycobacterium
VQPGSKYTSL

SEQ ID NO: 997280 - protein, 9 aa, Mycobacterium
VQPGTKGLS

SEQ ID NO: 997281 - protein, 11 aa, Mycobacterium
VQPHSGAQANA

SEQ ID NO: 997282 - protein, 7 aa, Mycobacterium
VQPPELE

SEQ ID NO: 997283 - protein, 17 aa, Mycobacterium
VQPTEEARASAYTIPSY

SEQ ID NO: 997284 - protein, 17 aa, Mycobacterium
VQQPDKQQPQTDHSRSE

SEQ ID NO: 997285 - protein, 8 aa, Mycobacterium
VQQRKARQ

SEQ ID NO: 997286 - protein, 10 aa, Mycobacterium
VQQRNTGTPQ

SEQ ID NO: 997287 - protein, 6 aa, Mycobacterium
VQREAG

SEQ ID NO: 997288 - protein, 17 aa, Mycobacterium
VQREPSARASAADVDAA

SEQ ID NO: 997289 - protein, 13 aa, Mycobacterium
VQSGDAANLEQAG

SEQ ID NO: 997290 - protein, 7 aa, Mycobacterium
VQSGPGP

SEQ ID NO: 997291 - protein, 4 aa, Mycobacterium
VQSY

SEQ ID NO: 997292 - protein, 5 aa, Mycobacterium
VQTAR

SEQ ID NO: 997293 - protein, 12 aa, Mycobacterium
VQTGTQIGDDDL

SEQ ID NO: 997294 - protein, 9 aa, Mycobacterium
VRAAEQLGA

SEQ ID NO: 997295 - protein, 7 aa, Mycobacterium
VRADSVP

SEQ ID NO: 997296 - protein, 10 aa, Mycobacterium
VRAGTEGDNR

SEQ ID NO: 997297 - protein, 9 aa, Mycobacterium
VRAKDQRAV

SEQ ID NO: 997298 - protein, 6 aa, Mycobacterium
VRANTV

SEQ ID NO: 997299 - protein, 9 aa, Mycobacterium
VRAQASAAI

SEQ ID NO: 997300 - protein, 4 aa, Mycobacterium
VRDG

SEQ ID NO: 997301 - protein, 5 aa, Mycobacterium
VRDGG

SEQ ID NO: 997302 - protein, 4 aa, Mycobacterium
VRDK

SEQ ID NO: 997303 - protein, 10 aa, Mycobacterium
VRDPSPCASN

SEQ ID NO: 997304 - protein, 10 aa, Mycobacterium
VREAGNSDDV

SEQ ID NO: 997305 - protein, 8 aa, Mycobacterium
VREARDQI

SEQ ID NO: 997306 - protein, 41 aa, Mycobacterium
VREGPGGEHGSYGNGARASLGGFADPQLQSAGAHATVPSGG

SEQ ID NO: 997307 - protein, 14 aa, Mycobacterium
VREQADAQVKCRPP

SEQ ID NO: 997308 - protein, 5 aa, Mycobacterium
VREQR

SEQ ID NO: 997309 - protein, 4 aa, Mycobacterium
VRGD

SEQ ID NO: 997310 - protein, 6 aa, Mycobacterium
VRGDTT

SEQ ID NO: 997311 - protein, 5 aa, Mycobacterium
VRGEG

SEQ ID NO: 997312 - protein, 14 aa, Mycobacterium
VRGEGGRLLNGENE

SEQ ID NO: 997313 - protein, 10 aa, Mycobacterium
VRGGAGPSYE

SEQ ID NO: 997314 - protein, 7 aa, Mycobacterium
VRGPGAA

SEQ ID NO: 997315 - protein, 12 aa, Mycobacterium
VRGQGTPGAPTV

SEQ ID NO: 997316 - protein, 4 aa, Mycobacterium
VRIG

SEQ ID NO: 997317 - protein, 8 aa, Mycobacterium
VRLGGPRL

SEQ ID NO: 997318 - protein, 8 aa, Mycobacterium
VRLPSSAR

SEQ ID NO: 997319 - protein, 25 aa, Mycobacterium
VRNAGESGWSDLQAQDRAEQFQTRA

SEQ ID NO: 997320 - protein, 8 aa, Mycobacterium
VRNNGPEL

SEQ ID NO: 997321 - protein, 8 aa, Mycobacterium
VRNTPGVT

SEQ ID NO: 997322 - protein, 8 aa, Mycobacterium
VRPANVAS

SEQ ID NO: 997323 - protein, 9 aa, Mycobacterium
VRPGDGPVF

SEQ ID NO: 997324 - protein, 10 aa, Mycobacterium
VRPGDLGPGD

SEQ ID NO: 997325 - protein, 5 aa, Mycobacterium
VRPGE

SEQ ID NO: 997326 - protein, 15 aa, Mycobacterium
VRPHEPAYDPEPDSY

SEQ ID NO: 997327 - protein, 5 aa, Mycobacterium
VRPHS

SEQ ID NO: 997328 - protein, 6 aa, Mycobacterium
VRPLPR

SEQ ID NO: 997329 - protein, 7 aa, Mycobacterium
VRPPADI

SEQ ID NO: 997330 - protein, 13 aa, Mycobacterium
VRPPTPGRRLPKS

SEQ ID NO: 997331 - protein, 5 aa, Mycobacterium
VRPSY

SEQ ID NO: 997332 - protein, 16 aa, Mycobacterium
VRPTRRSCLPRAHGQP

SEQ ID NO: 997333 - protein, 26 aa, Mycobacterium
VRPTTKYETKAQHAGNVVTELIWKKR

SEQ ID NO: 997334 - protein, 7 aa, Mycobacterium
VRPVPTG

SEQ ID NO: 997335 - protein, 10 aa, Mycobacterium
VRQPGKTGEE

SEQ ID NO: 997336 - protein, 24 aa, Mycobacterium
VRQSPGSATNARALPSQQTTSYTF

SEQ ID NO: 997337 - protein, 7 aa, Mycobacterium
VRREGAS

SEQ ID NO: 997338 - protein, 5 aa, Mycobacterium
VRRER

SEQ ID NO: 997339 - protein, 4 aa, Mycobacterium
VRRK

SEQ ID NO: 997340 - protein, 9 aa, Mycobacterium
VRRPPRGSY

SEQ ID NO: 997341 - protein, 8 aa, Mycobacterium
VRRSNGSV

SEQ ID NO: 997342 - protein, 16 aa, Mycobacterium
VRRSRAGVADPNRPTG

SEQ ID NO: 997343 - protein, 8 aa, Mycobacterium
VRSAADAL

SEQ ID NO: 997344 - protein, 11 aa, Mycobacterium
VRSAGKGSEIT

SEQ ID NO: 997345 - protein, 7 aa, Mycobacterium
VRSATLN

SEQ ID NO: 997346 - protein, 10 aa, Mycobacterium
VRSDGEKGCL

SEQ ID NO: 997347 - protein, 11 aa, Mycobacterium
VRSGEKPGHQA

SEQ ID NO: 997348 - protein, 6 aa, Mycobacterium
VRSGHV

SEQ ID NO: 997349 - protein, 7 aa, Mycobacterium
VRSNATR

SEQ ID NO: 997350 - protein, 8 aa, Mycobacterium
VRSPAAEH

SEQ ID NO: 997351 - protein, 10 aa, Mycobacterium
VRSPTRPQPH

SEQ ID NO: 997352 - protein, 14 aa, Mycobacterium
VRSSTGSSRRFRCL

SEQ ID NO: 997353 - protein, 7 aa, Mycobacterium
VRSTPID

SEQ ID NO: 997354 - protein, 12 aa, Mycobacterium
VRTDPDAPKHAG

SEQ ID NO: 997355 - protein, 9 aa, Mycobacterium
VRTPKPGHR

SEQ ID NO: 997356 - protein, 5 aa, Mycobacterium
VRTPV

SEQ ID NO: 997357 - protein, 5 aa, Mycobacterium
VRTRG

SEQ ID NO: 997358 - protein, 7 aa, Mycobacterium
VRTTGDT

SEQ ID NO: 997359 - protein, 10 aa, Mycobacterium
VSADEKESEL

SEQ ID NO: 997360 - protein, 8 aa, Mycobacterium
VSADPSDE

SEQ ID NO: 997361 - protein, 8 aa, Mycobacterium
VSAEGNGN

SEQ ID NO: 997362 - protein, 8 aa, Mycobacterium
VSAEGTRE

SEQ ID NO: 997363 - protein, 8 aa, Mycobacterium
VSAEPKVK

SEQ ID NO: 997364 - protein, 8 aa, Mycobacterium
VSAERAAE

SEQ ID NO: 997365 - protein, 5 aa, Mycobacterium
VSALG

SEQ ID NO: 997366 - protein, 7 aa, Mycobacterium
VSAQGSP

SEQ ID NO: 997367 - protein, 9 aa, Mycobacterium
VSARPSDSV

SEQ ID NO: 997368 - protein, 6 aa, Mycobacterium
VSATAH

SEQ ID NO: 997369 - protein, 4 aa, Mycobacterium
VSAW

SEQ ID NO: 997370 - protein, 6 aa, Mycobacterium
VSDDER

SEQ ID NO: 997371 - protein, 8 aa, Mycobacterium
VSDGHTRR

SEQ ID NO: 997372 - protein, 6 aa, Mycobacterium
VSDQTH

SEQ ID NO: 997373 - protein, 11 aa, Mycobacterium
VSDRDAADALR

SEQ ID NO: 997374 - protein, 8 aa, Mycobacterium
VSDSATSI

SEQ ID NO: 997375 - protein, 14 aa, Mycobacterium
VSDSEWDREKLQER

SEQ ID NO: 997376 - protein, 8 aa, Mycobacterium
VSDSLTRK

SEQ ID NO: 997377 - protein, 11 aa, Mycobacterium
VSDSPRQYTRK

SEQ ID NO: 997378 - protein, 6 aa, Mycobacterium
VSDTRC

SEQ ID NO: 997379 - protein, 10 aa, Mycobacterium
VSEAKYAAKK

SEQ ID NO: 997380 - protein, 5 aa, Mycobacterium
VSEDE

SEQ ID NO: 997381 - protein, 7 aa, Mycobacterium
VSEHTAR

SEQ ID NO: 997382 - protein, 14 aa, Mycobacterium
VSESDTVAHPDPST

SEQ ID NO: 997383 - protein, 6 aa, Mycobacterium
VSGAPD

SEQ ID NO: 997384 - protein, 9 aa, Mycobacterium
VSGAPRPTA

SEQ ID NO: 997385 - protein, 5 aa, Mycobacterium
VSGDL

SEQ ID NO: 997386 - protein, 6 aa, Mycobacterium
VSGDNV

SEQ ID NO: 997387 - protein, 20 aa, Mycobacterium
VSGNSQAAGTRAVTTGTPHP

SEQ ID NO: 997388 - protein, 15 aa, Mycobacterium
VSGRASTGLTLMLSY

SEQ ID NO: 997389 - protein, 13 aa, Mycobacterium
VSGSGLAEQLIPR

SEQ ID NO: 997390 - protein, 7 aa, Mycobacterium
VSGSGPT

SEQ ID NO: 997391 - protein, 19 aa, Mycobacterium
VSGSSGTAAVKKDALEAAG

SEQ ID NO: 997392 - protein, 17 aa, Mycobacterium
VSGSVTSNLVRAGRASW

SEQ ID NO: 997393 - protein, 7 aa, Mycobacterium
VSGVGES

SEQ ID NO: 997394 - protein, 6 aa, Mycobacterium
VSHPET

SEQ ID NO: 997395 - protein, 14 aa, Mycobacterium
VSHRNTGKACNETI

SEQ ID NO: 997396 - protein, 10 aa, Mycobacterium
VSKDDEESGM

SEQ ID NO: 997397 - protein, 14 aa, Mycobacterium
VSKDWDTDATKGIP

SEQ ID NO: 997398 - protein, 6 aa, Mycobacterium
VSLRDG

SEQ ID NO: 997399 - protein, 5 aa, Mycobacterium
VSMPN

SEQ ID NO: 997400 - protein, 15 aa, Mycobacterium
VSNEDQPETSGDPRV

SEQ ID NO: 997401 - protein, 16 aa, Mycobacterium
VSNEPVGSTNISVGAK

SEQ ID NO: 997402 - protein, 11 aa, Mycobacterium
VSPAGPHTGPL

SEQ ID NO: 997403 - protein, 17 aa, Mycobacterium
VSPAGSSVGKGESLRDT

SEQ ID NO: 997404 - protein, 5 aa, Mycobacterium
VSPAL

SEQ ID NO: 997405 - protein, 8 aa, Mycobacterium
VSPEQASL

SEQ ID NO: 997406 - protein, 10 aa, Mycobacterium
VSPGPAEPLR

SEQ ID NO: 997407 - protein, 5 aa, Mycobacterium
VSPHP

SEQ ID NO: 997408 - protein, 9 aa, Mycobacterium
VSPKDDGSV

SEQ ID NO: 997409 - protein, 6 aa, Mycobacterium
VSPPIP

SEQ ID NO: 997410 - protein, 9 aa, Mycobacterium
VSPPVAASG

SEQ ID NO: 997411 - protein, 6 aa, Mycobacterium
VSPQNA

SEQ ID NO: 997412 - protein, 7 aa, Mycobacterium
VSPQRNI

SEQ ID NO: 997413 - protein, 13 aa, Mycobacterium
VSPSSMNDNRGPR

SEQ ID NO: 997414 - protein, 5 aa, Mycobacterium
VSPTD

SEQ ID NO: 997415 - protein, 11 aa, Mycobacterium
VSPTPPDDSDF

SEQ ID NO: 997416 - protein, 9 aa, Mycobacterium
VSPVNDGRG

SEQ ID NO: 997417 - protein, 6 aa, Mycobacterium
VSQDID

SEQ ID NO: 997418 - protein, 7 aa, Mycobacterium
VSQPYAI

SEQ ID NO: 997419 - protein, 4 aa, Mycobacterium
VSRE

SEQ ID NO: 997420 - protein, 6 aa, Mycobacterium
VSRGSG

SEQ ID NO: 997421 - protein, 10 aa, Mycobacterium
VSRGTGGEVQ

SEQ ID NO: 997422 - protein, 9 aa, Mycobacterium
VSRQGQRDA

SEQ ID NO: 997423 - protein, 8 aa, Mycobacterium
VSRSSAQG

SEQ ID NO: 997424 - protein, 11 aa, Mycobacterium
VSSCPESGSTF

SEQ ID NO: 997425 - protein, 11 aa, Mycobacterium
VSSDASPEEIK

SEQ ID NO: 997426 - protein, 16 aa, Mycobacterium
VSSDEKDDVTGRRAPQ

SEQ ID NO: 997427 - protein, 7 aa, Mycobacterium
VSSEGHT

SEQ ID NO: 997428 - protein, 4 aa, Mycobacterium
VSSN

SEQ ID NO: 997429 - protein, 6 aa, Mycobacterium
VSSPAT

SEQ ID NO: 997430 - protein, 15 aa, Mycobacterium
VSSPERNYRDTSHKP

SEQ ID NO: 997431 - protein, 24 aa, Mycobacterium
VSSPPVELPPGNPTADTPSPTQRL

SEQ ID NO: 997432 - protein, 13 aa, Mycobacterium
VSSPSSKETREAE

SEQ ID NO: 997433 - protein, 8 aa, Mycobacterium
VSSRDEQI

SEQ ID NO: 997434 - protein, 11 aa, Mycobacterium
VSSRRGKPTIP

SEQ ID NO: 997435 - protein, 10 aa, Mycobacterium
VSTDPGAPLP

SEQ ID NO: 997436 - protein, 6 aa, Mycobacterium
VSTEVA

SEQ ID NO: 997437 - protein, 12 aa, Mycobacterium
VSTGRLASLVWM

SEQ ID NO: 997438 - protein, 13 aa, Mycobacterium
VSTGSTAKAIADQ

SEQ ID NO: 997439 - protein, 10 aa, Mycobacterium
VSTTMGPGIP

SEQ ID NO: 997440 - protein, 4 aa, Mycobacterium
VSTV

SEQ ID NO: 997441 - protein, 10 aa, Mycobacterium
VSVEDKNGNL

SEQ ID NO: 997442 - protein, 12 aa, Mycobacterium
VTAAGGALEQGP

SEQ ID NO: 997443 - protein, 11 aa, Mycobacterium
VTADAGHGDSI

SEQ ID NO: 997444 - protein, 10 aa, Mycobacterium
VTAEERQALR

SEQ ID NO: 997445 - protein, 8 aa, Mycobacterium
VTAGSEEK

SEQ ID NO: 997446 - protein, 6 aa, Mycobacterium
VTAPTV

SEQ ID NO: 997447 - protein, 18 aa, Mycobacterium
VTDDNGRVAAKDTGVREE

SEQ ID NO: 997448 - protein, 6 aa, Mycobacterium
VTDGDR

SEQ ID NO: 997449 - protein, 9 aa, Mycobacterium
VTDPDSQKV

SEQ ID NO: 997450 - protein, 6 aa, Mycobacterium
VTDPHS

SEQ ID NO: 997451 - protein, 4 aa, Mycobacterium
VTDT

SEQ ID NO: 997452 - protein, 6 aa, Mycobacterium
VTDTGI

SEQ ID NO: 997453 - protein, 10 aa, Mycobacterium
VTDTGNSISV

SEQ ID NO: 997454 - protein, 10 aa, Mycobacterium
VTDTGVAPGL

SEQ ID NO: 997455 - protein, 7 aa, Mycobacterium
VTEMAPP

SEQ ID NO: 997456 - protein, 12 aa, Mycobacterium
VTENSPLVPVKS

SEQ ID NO: 997457 - protein, 7 aa, Mycobacterium
VTEPNAV

SEQ ID NO: 997458 - protein, 7 aa, Mycobacterium
VTESGKP

SEQ ID NO: 997459 - protein, 12 aa, Mycobacterium
VTESQGRVHTSA

SEQ ID NO: 997460 - protein, 17 aa, Mycobacterium
VTETALKKRKESVEDAV

SEQ ID NO: 997461 - protein, 5 aa, Mycobacterium
VTETL

SEQ ID NO: 997462 - protein, 14 aa, Mycobacterium
VTEYDRRSWGSGGA

SEQ ID NO: 997463 - protein, 5 aa, Mycobacterium
VTGED

SEQ ID NO: 997464 - protein, 5 aa, Mycobacterium
VTGEQ

SEQ ID NO: 997465 - protein, 4 aa, Mycobacterium
VTGG

SEQ ID NO: 997466 - protein, 10 aa, Mycobacterium
VTGGSPHAIR

SEQ ID NO: 997467 - protein, 9 aa, Mycobacterium
VTGNPANTN

SEQ ID NO: 997468 - protein, 8 aa, Mycobacterium
VTGPDEYT

SEQ ID NO: 997469 - protein, 8 aa, Mycobacterium
VTGPDKGA

SEQ ID NO: 997470 - protein, 18 aa, Mycobacterium
VTGPDKQPKSKDADATEN

SEQ ID NO: 997471 - protein, 4 aa, Mycobacterium
VTGR

SEQ ID NO: 997472 - protein, 16 aa, Mycobacterium
VTGRVDSNLPDPQSPL

SEQ ID NO: 997473 - protein, 20 aa, Mycobacterium
VTGSGRVGIGPAGDEPGFQL

SEQ ID NO: 997474 - protein, 10 aa, Mycobacterium
VTGTEESRRF

SEQ ID NO: 997475 - protein, 14 aa, Mycobacterium
VTGTTVAAASSIEA

SEQ ID NO: 997476 - protein, 10 aa, Mycobacterium
VTHVDPKDRD

SEQ ID NO: 997477 - protein, 13 aa, Mycobacterium
VTIGAGDRSTADE

SEQ ID NO: 997478 - protein, 17 aa, Mycobacterium
VTKANTAEPAAAQRATS

SEQ ID NO: 997479 - protein, 8 aa, Mycobacterium
VTKARYGE

SEQ ID NO: 997480 - protein, 7 aa, Mycobacterium
VTKPYSA

SEQ ID NO: 997481 - protein, 4 aa, Mycobacterium
VTKS

SEQ ID NO: 997482 - protein, 14 aa, Mycobacterium
VTKSPVDHMLMLAC

SEQ ID NO: 997483 - protein, 4 aa, Mycobacterium
VTLT

SEQ ID NO: 997484 - protein, 6 aa, Mycobacterium
VTNASR

SEQ ID NO: 997485 - protein, 10 aa, Mycobacterium
VTNPKGEFIP

SEQ ID NO: 997486 - protein, 10 aa, Mycobacterium
VTNVKTERRQ

SEQ ID NO: 997487 - protein, 7 aa, Mycobacterium
VTPAQYP

SEQ ID NO: 997488 - protein, 4 aa, Mycobacterium
VTPD

SEQ ID NO: 997489 - protein, 13 aa, Mycobacterium
VTPEATAPADRGA

SEQ ID NO: 997490 - protein, 10 aa, Mycobacterium
VTPELEAEGW

SEQ ID NO: 997491 - protein, 13 aa, Mycobacterium
VTPERGVIALPNS

SEQ ID NO: 997492 - protein, 27 aa, Mycobacterium
VTPFDSSGSPNPKAAPTASDQGAGTLG

SEQ ID NO: 997493 - protein, 13 aa, Mycobacterium
VTPKGETELTPEE

SEQ ID NO: 997494 - protein, 8 aa, Mycobacterium
VTPPSLGR

SEQ ID NO: 997495 - protein, 7 aa, Mycobacterium
VTPPSWR

SEQ ID NO: 997496 - protein, 11 aa, Mycobacterium
VTPQRSASGYR

SEQ ID NO: 997497 - protein, 4 aa, Mycobacterium
VTPR

SEQ ID NO: 997498 - protein, 7 aa, Mycobacterium
VTPSEIA

SEQ ID NO: 997499 - protein, 5 aa, Mycobacterium
VTPTL

SEQ ID NO: 997500 - protein, 6 aa, Mycobacterium
VTQYDP

SEQ ID NO: 997501 - protein, 5 aa, Mycobacterium
VTREN

SEQ ID NO: 997502 - protein, 7 aa, Mycobacterium
VTRNGEH

SEQ ID NO: 997503 - protein, 6 aa, Mycobacterium
VTRPGG

SEQ ID NO: 997504 - protein, 6 aa, Mycobacterium
VTRQPG

SEQ ID NO: 997505 - protein, 8 aa, Mycobacterium
VTRTEGRK

SEQ ID NO: 997506 - protein, 10 aa, Mycobacterium
VTSAVSKSHR

SEQ ID NO: 997507 - protein, 6 aa, Mycobacterium
VTSIEA

SEQ ID NO: 997508 - protein, 10 aa, Mycobacterium
VTSRGYPPSI

SEQ ID NO: 997509 - protein, 10 aa, Mycobacterium
VTTADGSRAA

SEQ ID NO: 997510 - protein, 5 aa, Mycobacterium
VTTAN

SEQ ID NO: 997511 - protein, 13 aa, Mycobacterium
VTTDAASSFTDEH

SEQ ID NO: 997512 - protein, 8 aa, Mycobacterium
VTTDFTGD

SEQ ID NO: 997513 - protein, 20 aa, Mycobacterium
VTTDHISPASTIKPGTPAAQ

SEQ ID NO: 997514 - protein, 11 aa, Mycobacterium
VTTGDPGPIIP

SEQ ID NO: 997515 - protein, 10 aa, Mycobacterium
VTTGTESETM

SEQ ID NO: 997516 - protein, 4 aa, Mycobacterium
VTTT

SEQ ID NO: 997517 - protein, 7 aa, Mycobacterium
VTTTDGD

SEQ ID NO: 997518 - protein, 10 aa, Mycobacterium
VTVDSSQSSS

SEQ ID NO: 997519 - protein, 8 aa, Mycobacterium
VVDPGDIE

SEQ ID NO: 997520 - protein, 5 aa, Mycobacterium
VVGPT

SEQ ID NO: 997521 - protein, 4 aa, Mycobacterium
VVND

SEQ ID NO: 997522 - protein, 6 aa, Mycobacterium
VVNPET

SEQ ID NO: 997523 - protein, 4 aa, Mycobacterium
VVPE

SEQ ID NO: 997524 - protein, 21 aa, Mycobacterium
VVPGGTYLDPEAAAAVISQAR

SEQ ID NO: 997525 - protein, 13 aa, Mycobacterium
VVQRQSVKEPLQT

SEQ ID NO: 997526 - protein, 6 aa, Mycobacterium
VVSGGT

SEQ ID NO: 997527 - protein, 10 aa, Mycobacterium
VVTEDDDAAL

SEQ ID NO: 997528 - protein, 5 aa, Mycobacterium
VVTGG

SEQ ID NO: 997529 - protein, 6 aa, Mycobacterium
VWGPPV

SEQ ID NO: 997530 - protein, 11 aa, Mycobacterium
VYGAADPSAAV

SEQ ID NO: 997531 - protein, 11 aa, Mycobacterium
VYGEGRRALAD

SEQ ID NO: 997532 - protein, 12 aa, Mycobacterium
VYGPRQDPYGEA

SEQ ID NO: 997533 - protein, 5 aa, Mycobacterium
WANAT

SEQ ID NO: 997534 - protein, 11 aa, Mycobacterium
WAPHSGESRVD

SEQ ID NO: 997535 - protein, 5 aa, Mycobacterium
WAQRG

SEQ ID NO: 997536 - protein, 4 aa, Mycobacterium
WATS

SEQ ID NO: 997537 - protein, 7 aa, Mycobacterium
WDDPRGV

SEQ ID NO: 997538 - protein, 9 aa, Mycobacterium
WDGEGPGED

SEQ ID NO: 997539 - protein, 4 aa, Mycobacterium
WDGP

SEQ ID NO: 997540 - protein, 7 aa, Mycobacterium
WDGSAAE

SEQ ID NO: 997541 - protein, 6 aa, Mycobacterium
WDNTTD

SEQ ID NO: 997542 - protein, 22 aa, Mycobacterium
WDPAGVAGERSVDRPVGRVREQ

SEQ ID NO: 997543 - protein, 9 aa, Mycobacterium
WDPHRAGDD

SEQ ID NO: 997544 - protein, 9 aa, Mycobacterium
WEPGSDPAM

SEQ ID NO: 997545 - protein, 8 aa, Mycobacterium
WEPSTEGD

SEQ ID NO: 997546 - protein, 11 aa, Mycobacterium
WEQSAAQRAEL

SEQ ID NO: 997547 - protein, 14 aa, Mycobacterium
WGDGPHDSAVAQRL

SEQ ID NO: 997548 - protein, 17 aa, Mycobacterium
WGDPSQKADDVSAGGAY

SEQ ID NO: 997549 - protein, 15 aa, Mycobacterium
WGDTRISGQDLLTTL

SEQ ID NO: 997550 - protein, 7 aa, Mycobacterium
WGEADDG

SEQ ID NO: 997551 - protein, 4 aa, Mycobacterium
WGHD

SEQ ID NO: 997552 - protein, 11 aa, Mycobacterium
WGPPNDPAWQR

SEQ ID NO: 997553 - protein, 11 aa, Mycobacterium
WGSTTPGHPEF

SEQ ID NO: 997554 - protein, 12 aa, Mycobacterium
WGTTRQAGDCGL

SEQ ID NO: 997555 - protein, 12 aa, Mycobacterium
WKDQSANGRLRR

SEQ ID NO: 997556 - protein, 12 aa, Mycobacterium
WNDASDAASGAL

SEQ ID NO: 997557 - protein, 9 aa, Mycobacterium
WNDNGAPMR

SEQ ID NO: 997558 - protein, 14 aa, Mycobacterium
WNGTDERVDQAYDD

SEQ ID NO: 997559 - protein, 11 aa, Mycobacterium
WNRGSESAPTG

SEQ ID NO: 997560 - protein, 8 aa, Mycobacterium
WPDGGDGQ

SEQ ID NO: 997561 - protein, 5 aa, Mycobacterium
WPDHP

SEQ ID NO: 997562 - protein, 16 aa, Mycobacterium
WPDNEELAEQLNGNTR

SEQ ID NO: 997563 - protein, 15 aa, Mycobacterium
WPGPSFPSTSSAVPR

SEQ ID NO: 997564 - protein, 5 aa, Mycobacterium
WPPAL

SEQ ID NO: 997565 - protein, 10 aa, Mycobacterium
WPPDPTSTLT

SEQ ID NO: 997566 - protein, 9 aa, Mycobacterium
WPRAAEESI

SEQ ID NO: 997567 - protein, 14 aa, Mycobacterium
WPRTTSCSNPPFSG

SEQ ID NO: 997568 - protein, 4 aa, Mycobacterium
WPRY

SEQ ID NO: 997569 - protein, 11 aa, Mycobacterium
WPTESTPAALD

SEQ ID NO: 997570 - protein, 32 aa, Mycobacterium
WPTRAGDARCARGGANYSANHKAVPSTEQQVI

SEQ ID NO: 997571 - protein, 8 aa, Mycobacterium
WPTSSGDY

SEQ ID NO: 997572 - protein, 12 aa, Mycobacterium
WQKPDESERTFG

SEQ ID NO: 997573 - protein, 10 aa, Mycobacterium
WQQPEANEET

SEQ ID NO: 997574 - protein, 12 aa, Mycobacterium
WQRNPKQLGRLG

SEQ ID NO: 997575 - protein, 14 aa, Mycobacterium
WQTTNASKADFDGF

SEQ ID NO: 997576 - protein, 11 aa, Mycobacterium
WRGQTEEEDQL

SEQ ID NO: 997577 - protein, 16 aa, Mycobacterium
WRNPRRRAGRGSGVRP

SEQ ID NO: 997578 - protein, 11 aa, Mycobacterium
WRPDGTHGDTG

SEQ ID NO: 997579 - protein, 12 aa, Mycobacterium
WRRGAAQGHSGT

SEQ ID NO: 997580 - protein, 21 aa, Mycobacterium
WSDGAIPAASVSDQPASAGVD

SEQ ID NO: 997581 - protein, 9 aa, Mycobacterium
WSGAPRPVQ

SEQ ID NO: 997582 - protein, 4 aa, Mycobacterium
WSGG

SEQ ID NO: 997583 - protein, 7 aa, Mycobacterium
WSGLPNR

SEQ ID NO: 997584 - protein, 12 aa, Mycobacterium
WSGSYGDDAGNT

SEQ ID NO: 997585 - protein, 7 aa, Mycobacterium
WSPLSKG

SEQ ID NO: 997586 - protein, 4 aa, Mycobacterium
WSRP

SEQ ID NO: 997587 - protein, 10 aa, Mycobacterium
WTDEHGTRPL

SEQ ID NO: 997588 - protein, 7 aa, Mycobacterium
WTGAGGV

SEQ ID NO: 997589 - protein, 21 aa, Mycobacterium
WTGSYGHDPCRPTMQSEAMIM

SEQ ID NO: 997590 - protein, 18 aa, Mycobacterium
WTTASQPVTAATRALSPA

SEQ ID NO: 997591 - protein, 11 aa, Mycobacterium
YAADDNQRGGT

SEQ ID NO: 997592 - protein, 4 aa, Mycobacterium
YAAG

SEQ ID NO: 997593 - protein, 14 aa, Mycobacterium
YAAKSEGCRNSQAG

SEQ ID NO: 997594 - protein, 4 aa, Mycobacterium
YAAN

SEQ ID NO: 997595 - protein, 7 aa, Mycobacterium
YAAREAE

SEQ ID NO: 997596 - protein, 9 aa, Mycobacterium
YAATDADDP

SEQ ID NO: 997597 - protein, 5 aa, Mycobacterium
YAATK

SEQ ID NO: 997598 - protein, 7 aa, Mycobacterium
YAATTYQ

SEQ ID NO: 997599 - protein, 5 aa, Mycobacterium
YADEG

SEQ ID NO: 997600 - protein, 9 aa, Mycobacterium
YADGRLSKK

SEQ ID NO: 997601 - protein, 5 aa, Mycobacterium
YADNG

SEQ ID NO: 997602 - protein, 19 aa, Mycobacterium
YAEADPTADVEGHDAAAKA

SEQ ID NO: 997603 - protein, 9 aa, Mycobacterium
YAEGLPGRR

SEQ ID NO: 997604 - protein, 9 aa, Mycobacterium
YAEHESKPF

SEQ ID NO: 997605 - protein, 8 aa, Mycobacterium
YAEHRAQQ

SEQ ID NO: 997606 - protein, 7 aa, Mycobacterium
YAEPQIA

SEQ ID NO: 997607 - protein, 8 aa, Mycobacterium
YAERNPPV

SEQ ID NO: 997608 - protein, 14 aa, Mycobacterium
YAGGAEEVEGVPPQ

SEQ ID NO: 997609 - protein, 17 aa, Mycobacterium
YAGKTETPAAHSNSRYC

SEQ ID NO: 997610 - protein, 17 aa, Mycobacterium
YAGPDFADGTSVTTEVA

SEQ ID NO: 997611 - protein, 11 aa, Mycobacterium
YAGTARTDVGV

SEQ ID NO: 997612 - protein, 11 aa, Mycobacterium
YAKPRSADTDA

SEQ ID NO: 997613 - protein, 7 aa, Mycobacterium
YANKARL

SEQ ID NO: 997614 - protein, 6 aa, Mycobacterium
YAPDAE

SEQ ID NO: 997615 - protein, 6 aa, Mycobacterium
YAPDRD

SEQ ID NO: 997616 - protein, 4 aa, Mycobacterium
YAPG

SEQ ID NO: 997617 - protein, 9 aa, Mycobacterium
YAPKSALGH

SEQ ID NO: 997618 - protein, 4 aa, Mycobacterium
YAPP

SEQ ID NO: 997619 - protein, 16 aa, Mycobacterium
YAQRGRGNRKRPTTGW

SEQ ID NO: 997620 - protein, 7 aa, Mycobacterium
YARGGSA

SEQ ID NO: 997621 - protein, 6 aa, Mycobacterium
YARTLG

SEQ ID NO: 997622 - protein, 12 aa, Mycobacterium
YASGSSDVACST

SEQ ID NO: 997623 - protein, 8 aa, Mycobacterium
YATRAREV

SEQ ID NO: 997624 - protein, 12 aa, Mycobacterium
YAWGGAAPGGFD

SEQ ID NO: 997625 - protein, 6 aa, Mycobacterium
YCGAPD

SEQ ID NO: 997626 - protein, 4 aa, Mycobacterium
YDAE

SEQ ID NO: 997627 - protein, 8 aa, Mycobacterium
YDAPLESD

SEQ ID NO: 997628 - protein, 4 aa, Mycobacterium
YDAS

SEQ ID NO: 997629 - protein, 4 aa, Mycobacterium
YDAT

SEQ ID NO: 997630 - protein, 7 aa, Mycobacterium
YDATLAS

SEQ ID NO: 997631 - protein, 16 aa, Mycobacterium
YDDEPRLSTAHHRHWW

SEQ ID NO: 997632 - protein, 9 aa, Mycobacterium
YDDGGDGGI

SEQ ID NO: 997633 - protein, 4 aa, Mycobacterium
YDDR

SEQ ID NO: 997634 - protein, 5 aa, Mycobacterium
YDEFD

SEQ ID NO: 997635 - protein, 10 aa, Mycobacterium
YDENGGYPHP

SEQ ID NO: 997636 - protein, 12 aa, Mycobacterium
YDLSRGRIVYRY

SEQ ID NO: 997637 - protein, 9 aa, Mycobacterium
YDPDPEQAL

SEQ ID NO: 997638 - protein, 5 aa, Mycobacterium
YDPDS

SEQ ID NO: 997639 - protein, 12 aa, Mycobacterium
YDPEPGVPGRSV

SEQ ID NO: 997640 - protein, 15 aa, Mycobacterium
YDQPGRQHRSGGQDM

SEQ ID NO: 997641 - protein, 10 aa, Mycobacterium
YDQVSRNPEV

SEQ ID NO: 997642 - protein, 5 aa, Mycobacterium
YDRTQ

SEQ ID NO: 997643 - protein, 12 aa, Mycobacterium
YDSDPRKNTGAR

SEQ ID NO: 997644 - protein, 4 aa, Mycobacterium
YDSP

SEQ ID NO: 997645 - protein, 12 aa, Mycobacterium
YDSSDKGFDGAS

SEQ ID NO: 997646 - protein, 4 aa, Mycobacterium
YDTA

SEQ ID NO: 997647 - protein, 30 aa, Mycobacterium
YDTPPPPIEKGSEFSQDADPRYTDIGGGPL

SEQ ID NO: 997648 - protein, 4 aa, Mycobacterium
YEAG

SEQ ID NO: 997649 - protein, 7 aa, Mycobacterium
YEDEGMA

SEQ ID NO: 997650 - protein, 10 aa, Mycobacterium
YEDGDGPESR

SEQ ID NO: 997651 - protein, 4 aa, Mycobacterium
YEDR

SEQ ID NO: 997652 - protein, 4 aa, Mycobacterium
YEDV

SEQ ID NO: 997653 - protein, 10 aa, Mycobacterium
YEEAGEQEAQ

SEQ ID NO: 997654 - protein, 9 aa, Mycobacterium
YEEGERVRR

SEQ ID NO: 997655 - protein, 6 aa, Mycobacterium
YEGAAS

SEQ ID NO: 997656 - protein, 12 aa, Mycobacterium
YEGPLRDATAGR

SEQ ID NO: 997657 - protein, 12 aa, Mycobacterium
YEGQSAVKAAKT

SEQ ID NO: 997658 - protein, 11 aa, Mycobacterium
YENQRDTSLAD

SEQ ID NO: 997659 - protein, 7 aa, Mycobacterium
YERESTE

SEQ ID NO: 997660 - protein, 8 aa, Mycobacterium
YERGKRKR

SEQ ID NO: 997661 - protein, 6 aa, Mycobacterium
YERPKA

SEQ ID NO: 997662 - protein, 4 aa, Mycobacterium
YFPK

SEQ ID NO: 997663 - protein, 5 aa, Mycobacterium
YFTGT

SEQ ID NO: 997664 - protein, 18 aa, Mycobacterium
YGASGDQSRGVVDGKPAD

SEQ ID NO: 997665 - protein, 11 aa, Mycobacterium
YGDLKKDTAEA

SEQ ID NO: 997666 - protein, 13 aa, Mycobacterium
YGEDQGDEDELQV

SEQ ID NO: 997667 - protein, 9 aa, Mycobacterium
YGETKPPEL

SEQ ID NO: 997668 - protein, 10 aa, Mycobacterium
YGETRSYGEI

SEQ ID NO: 997669 - protein, 16 aa, Mycobacterium
YGGGRTAPDLQAGGYV

SEQ ID NO: 997670 - protein, 10 aa, Mycobacterium
YGGHDAAAPK

SEQ ID NO: 997671 - protein, 5 aa, Mycobacterium
YGGRR

SEQ ID NO: 997672 - protein, 10 aa, Mycobacterium
YGGTEIKYNG

SEQ ID NO: 997673 - protein, 4 aa, Mycobacterium
YGGV

SEQ ID NO: 997674 - protein, 12 aa, Mycobacterium
YGGVPDGPWPDA

SEQ ID NO: 997675 - protein, 9 aa, Mycobacterium
YGIEPDSSR

SEQ ID NO: 997676 - protein, 8 aa, Mycobacterium
YGKATSEA

SEQ ID NO: 997677 - protein, 13 aa, Mycobacterium
YGKPQSVANARQQ

SEQ ID NO: 997678 - protein, 5 aa, Mycobacterium
YGNPT

SEQ ID NO: 997679 - protein, 12 aa, Mycobacterium
YGNTASTKSSIT

SEQ ID NO: 997680 - protein, 10 aa, Mycobacterium
YGPDDSDDME

SEQ ID NO: 997681 - protein, 5 aa, Mycobacterium
YGPGG

SEQ ID NO: 997682 - protein, 6 aa, Mycobacterium
YGPHPA

SEQ ID NO: 997683 - protein, 5 aa, Mycobacterium
YGPSR

SEQ ID NO: 997684 - protein, 5 aa, Mycobacterium
YGPTI

SEQ ID NO: 997685 - protein, 13 aa, Mycobacterium
YGQDRGSAGAAGK

SEQ ID NO: 997686 - protein, 10 aa, Mycobacterium
YGQERDSDET

SEQ ID NO: 997687 - protein, 10 aa, Mycobacterium
YGQGRPADQP

SEQ ID NO: 997688 - protein, 4 aa, Mycobacterium
YGQQ

SEQ ID NO: 997689 - protein, 8 aa, Mycobacterium
YGQVGDGR

SEQ ID NO: 997690 - protein, 12 aa, Mycobacterium
YGRDPENLRRQR

SEQ ID NO: 997691 - protein, 21 aa, Mycobacterium
YGSGIGHSKKEAEQKAASAAW

SEQ ID NO: 997692 - protein, 8 aa, Mycobacterium
YGSPDASA

SEQ ID NO: 997693 - protein, 9 aa, Mycobacterium
YGSSMSSSG

SEQ ID NO: 997694 - protein, 6 aa, Mycobacterium
YGSTEA

SEQ ID NO: 997695 - protein, 4 aa, Mycobacterium
YGTA

SEQ ID NO: 997696 - protein, 10 aa, Mycobacterium
YGTGTAYRSS

SEQ ID NO: 997697 - protein, 6 aa, Mycobacterium
YGTIDG

SEQ ID NO: 997698 - protein, 7 aa, Mycobacterium
YGTPKSP

SEQ ID NO: 997699 - protein, 9 aa, Mycobacterium
YGTSSPSGY

SEQ ID NO: 997700 - protein, 10 aa, Mycobacterium
YGTTQVSERH

SEQ ID NO: 997701 - protein, 8 aa, Mycobacterium
YGTTTRGV

SEQ ID NO: 997702 - protein, 7 aa, Mycobacterium
YGVTPKG

SEQ ID NO: 997703 - protein, 6 aa, Mycobacterium
YHEQEA

SEQ ID NO: 997704 - protein, 8 aa, Mycobacterium
YHPHGDAS

SEQ ID NO: 997705 - protein, 8 aa, Mycobacterium
YHTPAETN

SEQ ID NO: 997706 - protein, 5 aa, Mycobacterium
YIGGH

SEQ ID NO: 997707 - protein, 10 aa, Mycobacterium
YKANRSSIPA

SEQ ID NO: 997708 - protein, 4 aa, Mycobacterium
YKSS

SEQ ID NO: 997709 - protein, 6 aa, Mycobacterium
YLDDDE

SEQ ID NO: 997710 - protein, 9 aa, Mycobacterium
YLPPGTEPV

SEQ ID NO: 997711 - protein, 22 aa, Mycobacterium
YLTSSAATAVGATAVGPSLPAL

SEQ ID NO: 997712 - protein, 10 aa, Mycobacterium
YNASGDPAVD

SEQ ID NO: 997713 - protein, 24 aa, Mycobacterium
YNGGECGKVTSGAVRQAQGDCHDQ

SEQ ID NO: 997714 - protein, 9 aa, Mycobacterium
YNIGGTHRH

SEQ ID NO: 997715 - protein, 12 aa, Mycobacterium
YNPAPDVPGTCN

SEQ ID NO: 997716 - protein, 5 aa, Mycobacterium
YNPAR

SEQ ID NO: 997717 - protein, 4 aa, Mycobacterium
YNRD

SEQ ID NO: 997718 - protein, 6 aa, Mycobacterium
YNTGTR

SEQ ID NO: 997719 - protein, 4 aa, Mycobacterium
YPAD

SEQ ID NO: 997720 - protein, 14 aa, Mycobacterium
YPANTRGKEIGDGR

SEQ ID NO: 997721 - protein, 4 aa, Mycobacterium
YPAR

SEQ ID NO: 997722 - protein, 9 aa, Mycobacterium
YPATAPPGV

SEQ ID NO: 997723 - protein, 7 aa, Mycobacterium
YPATGYS

SEQ ID NO: 997724 - protein, 7 aa, Mycobacterium
YPDAQVG

SEQ ID NO: 997725 - protein, 4 aa, Mycobacterium
YPDE

SEQ ID NO: 997726 - protein, 16 aa, Mycobacterium
YPDGASSVRLVNQTGY

SEQ ID NO: 997727 - protein, 13 aa, Mycobacterium
YPDLATDSATDDI

SEQ ID NO: 997728 - protein, 20 aa, Mycobacterium
YPDPAADKQPNRIPEAAGGW

SEQ ID NO: 997729 - protein, 9 aa, Mycobacterium
YPDPGTGCE

SEQ ID NO: 997730 - protein, 5 aa, Mycobacterium
YPDRD

SEQ ID NO: 997731 - protein, 21 aa, Mycobacterium
YPDSPSRISDLDEEMVYASPR

SEQ ID NO: 997732 - protein, 4 aa, Mycobacterium
YPET

SEQ ID NO: 997733 - protein, 5 aa, Mycobacterium
YPFEE

SEQ ID NO: 997734 - protein, 8 aa, Mycobacterium
YPGAEHAT

SEQ ID NO: 997735 - protein, 9 aa, Mycobacterium
YPGSDVEER

SEQ ID NO: 997736 - protein, 12 aa, Mycobacterium
YPIPGNDDAIRS

SEQ ID NO: 997737 - protein, 7 aa, Mycobacterium
YPNPDGL

SEQ ID NO: 997738 - protein, 4 aa, Mycobacterium
YPPC

SEQ ID NO: 997739 - protein, 8 aa, Mycobacterium
YPPDDELA

SEQ ID NO: 997740 - protein, 5 aa, Mycobacterium
YPPEP

SEQ ID NO: 997741 - protein, 12 aa, Mycobacterium
YPPTPTHSDNKV

SEQ ID NO: 997742 - protein, 8 aa, Mycobacterium
YPRNTENL

SEQ ID NO: 997743 - protein, 4 aa, Mycobacterium
YPRP

SEQ ID NO: 997744 - protein, 5 aa, Mycobacterium
YPSER

SEQ ID NO: 997745 - protein, 6 aa, Mycobacterium
YPSGDG

SEQ ID NO: 997746 - protein, 5 aa, Mycobacterium
YPSHS

SEQ ID NO: 997747 - protein, 8 aa, Mycobacterium
YPSPEEER

SEQ ID NO: 997748 - protein, 4 aa, Mycobacterium
YPTD

SEQ ID NO: 997749 - protein, 9 aa, Mycobacterium
YPTVQQPNS

SEQ ID NO: 997750 - protein, 6 aa, Mycobacterium
YPVTRP

SEQ ID NO: 997751 - protein, 4 aa, Mycobacterium
YQAD

SEQ ID NO: 997752 - protein, 6 aa, Mycobacterium
YQDTNH

SEQ ID NO: 997753 - protein, 4 aa, Mycobacterium
YQGG

SEQ ID NO: 997754 - protein, 17 aa, Mycobacterium
YQPCAKSSSGPMQLVGP

SEQ ID NO: 997755 - protein, 6 aa, Mycobacterium
YQPWPE

SEQ ID NO: 997756 - protein, 7 aa, Mycobacterium
YQRNGER

SEQ ID NO: 997757 - protein, 10 aa, Mycobacterium
YQRYESSGEI

SEQ ID NO: 997758 - protein, 9 aa, Mycobacterium
YQSRQDPAV

SEQ ID NO: 997759 - protein, 6 aa, Mycobacterium
YQTEKR

SEQ ID NO: 997760 - protein, 8 aa, Mycobacterium
YQTPDPEI

SEQ ID NO: 997761 - protein, 7 aa, Mycobacterium
YRASPDS

SEQ ID NO: 997762 - protein, 6 aa, Mycobacterium
YRDEAA

SEQ ID NO: 997763 - protein, 14 aa, Mycobacterium
YRDHPGRCIAPTVQ

SEQ ID NO: 997764 - protein, 6 aa, Mycobacterium
YRDSRI

SEQ ID NO: 997765 - protein, 15 aa, Mycobacterium
YRDTGTASTPDSHHP

SEQ ID NO: 997766 - protein, 26 aa, Mycobacterium
YRGENRTNAVASSDRIASGIGIGLRP

SEQ ID NO: 997767 - protein, 5 aa, Mycobacterium
YRGKR

SEQ ID NO: 997768 - protein, 24 aa, Mycobacterium
YRGRQASDLRTSTSPSCRTSVPAP

SEQ ID NO: 997769 - protein, 7 aa, Mycobacterium
YRPDGAR

SEQ ID NO: 997770 - protein, 10 aa, Mycobacterium
YRPGGLTSGP

SEQ ID NO: 997771 - protein, 4 aa, Mycobacterium
YRPS

SEQ ID NO: 997772 - protein, 10 aa, Mycobacterium
YRPSRAEPYT

SEQ ID NO: 997773 - protein, 9 aa, Mycobacterium
YRQGHSPNL

SEQ ID NO: 997774 - protein, 7 aa, Mycobacterium
YRREGKR

SEQ ID NO: 997775 - protein, 11 aa, Mycobacterium
YRRESESMARP

SEQ ID NO: 997776 - protein, 6 aa, Mycobacterium
YRRGAR

SEQ ID NO: 997777 - protein, 7 aa, Mycobacterium
YRRPDSI

SEQ ID NO: 997778 - protein, 6 aa, Mycobacterium
YRRSEN

SEQ ID NO: 997779 - protein, 12 aa, Mycobacterium
YRSDGFKRLDVT

SEQ ID NO: 997780 - protein, 9 aa, Mycobacterium
YRTDNGEEF

SEQ ID NO: 997781 - protein, 5 aa, Mycobacterium
YRTET

SEQ ID NO: 997782 - protein, 8 aa, Mycobacterium
YRTSGDSP

SEQ ID NO: 997783 - protein, 9 aa, Mycobacterium
YSAESEAGR

SEQ ID NO: 997784 - protein, 18 aa, Mycobacterium
YSARPRSGSAGSSTSAEV

SEQ ID NO: 997785 - protein, 10 aa, Mycobacterium
YSDEPAEAAA

SEQ ID NO: 997786 - protein, 10 aa, Mycobacterium
YSDPSACPGL

SEQ ID NO: 997787 - protein, 9 aa, Mycobacterium
YSDSERDGL

SEQ ID NO: 997788 - protein, 6 aa, Mycobacterium
YSDTGL

SEQ ID NO: 997789 - protein, 4 aa, Mycobacterium
YSEQ

SEQ ID NO: 997790 - protein, 9 aa, Mycobacterium
YSETNTGTD

SEQ ID NO: 997791 - protein, 11 aa, Mycobacterium
YSGPAGTGQQA

SEQ ID NO: 997792 - protein, 18 aa, Mycobacterium
YSGRGATDLDVVVEITRL

SEQ ID NO: 997793 - protein, 9 aa, Mycobacterium
YSGTGNGHS

SEQ ID NO: 997794 - protein, 16 aa, Mycobacterium
YSKEARREFDNWCRVA

SEQ ID NO: 997795 - protein, 8 aa, Mycobacterium
YSKPPQTG

SEQ ID NO: 997796 - protein, 10 aa, Mycobacterium
YSKSKGQPLL

SEQ ID NO: 997797 - protein, 11 aa, Mycobacterium
YSLGTAEDLTA

SEQ ID NO: 997798 - protein, 9 aa, Mycobacterium
YSPATSTVI

SEQ ID NO: 997799 - protein, 6 aa, Mycobacterium
YSPGPH

SEQ ID NO: 997800 - protein, 17 aa, Mycobacterium
YSPLQGAHSVSAPPTRR

SEQ ID NO: 997801 - protein, 6 aa, Mycobacterium
YSPRSV

SEQ ID NO: 997802 - protein, 7 aa, Mycobacterium
YSPTSSM

SEQ ID NO: 997803 - protein, 12 aa, Mycobacterium
YSPYENVEAKQY

SEQ ID NO: 997804 - protein, 6 aa, Mycobacterium
YSQAQK

SEQ ID NO: 997805 - protein, 13 aa, Mycobacterium
YSQPRSGEGGKSG

SEQ ID NO: 997806 - protein, 14 aa, Mycobacterium
YSQSEVTDSFVQFL

SEQ ID NO: 997807 - protein, 7 aa, Mycobacterium
YSQTDLA

SEQ ID NO: 997808 - protein, 11 aa, Mycobacterium
YSRADKAGAIK

SEQ ID NO: 997809 - protein, 9 aa, Mycobacterium
YSRGDQSHG

SEQ ID NO: 997810 - protein, 7 aa, Mycobacterium
YSRGSRA

SEQ ID NO: 997811 - protein, 19 aa, Mycobacterium
YSRPEGNWTPNIHSGQENL

SEQ ID NO: 997812 - protein, 8 aa, Mycobacterium
YSSLPEDQ

SEQ ID NO: 997813 - protein, 9 aa, Mycobacterium
YSSPHDQIT

SEQ ID NO: 997814 - protein, 17 aa, Mycobacterium
YSTDLTAQSGEGKLDPV

SEQ ID NO: 997815 - protein, 12 aa, Mycobacterium
YSTTGDTTWENA

SEQ ID NO: 997816 - protein, 13 aa, Mycobacterium
YSYTDDPTINWNT

SEQ ID NO: 997817 - protein, 4 aa, Mycobacterium
YTAG

SEQ ID NO: 997818 - protein, 42 aa, Mycobacterium
YTANGSGAGVSEFNGNQTDFGGSDSPLSRKEYAAAEQRCGSQ

SEQ ID NO: 997819 - protein, 10 aa, Mycobacterium
YTAQESTKAL

SEQ ID NO: 997820 - protein, 6 aa, Mycobacterium
YTATGI

SEQ ID NO: 997821 - protein, 12 aa, Mycobacterium
YTDVANGDPPVL

SEQ ID NO: 997822 - protein, 10 aa, Mycobacterium
YTGPEQTPNV

SEQ ID NO: 997823 - protein, 10 aa, Mycobacterium
YTGQATDAGA

SEQ ID NO: 997824 - protein, 5 aa, Mycobacterium
YTLAG

SEQ ID NO: 997825 - protein, 13 aa, Mycobacterium
YTPDDKDQLDPAA

SEQ ID NO: 997826 - protein, 19 aa, Mycobacterium
YTPTLQGDTTLGDFAERPR

SEQ ID NO: 997827 - protein, 5 aa, Mycobacterium
YTRPH

SEQ ID NO: 997828 - protein, 12 aa, Mycobacterium
YTRSVSRARIDL

SEQ ID NO: 997829 - protein, 6 aa, Mycobacterium
YTRTAE

SEQ ID NO: 997830 - protein, 12 aa, Mycobacterium
YTSGTTGKPKAA

SEQ ID NO: 997831 - protein, 7 aa, Mycobacterium
YTTEGQS

SEQ ID NO: 997832 - protein, 20 aa, Mycobacterium
YTTHSTTSAATQCIAATNTT

SEQ ID NO: 997833 - protein, 15 aa, Mycobacterium
YVATDATAASTYTTG

SEQ ID NO: 997834 - protein, 21 aa, Mycobacterium
YVENKTKSEASLMELTNSIDR

SEQ ID NO: 997835 - protein, 6 aa, Mycobacterium
YVESVN

SEQ ID NO: 997836 - protein, 20 aa, Mycobacterium
YVPASRGRRSSQLSGDDREQ

SEQ ID NO: 997837 - protein, 15 aa, Mycobacterium
YVPKDDDERNEKQAR

SEQ ID NO: 997838 - protein, 11 aa, Mycobacterium
YWRGNQKNASL

SEQ ID NO: 997839 - protein, 10 aa, Mycobacterium
YYATADPDTF

SEQ ID NO: 997840 - protein, 16 aa, Mycobacterium
YYPASGADAYLMRREA

SEQ ID NO: 997841 - protein, 6 aa, Mycobacterium
YYSGDD

SEQ ID NO: 997842 - protein, 7 aa, Mycobacterium
YYTARGP

SEQ ID NO: 997843 - protein, 10 aa, Mycobacterium
AAAAADIPTA

SEQ ID NO: 997844 - protein, 6 aa, Mycobacterium
AAAAAE

SEQ ID NO: 997845 - protein, 9 aa, Mycobacterium
AAAAAGAPV

SEQ ID NO: 997846 - protein, 9 aa, Mycobacterium
AAAAAGEPL

SEQ ID NO: 997847 - protein, 15 aa, Mycobacterium
AAAAAGGGTPQETKV

SEQ ID NO: 997848 - protein, 8 aa, Mycobacterium
AAAAALPD

SEQ ID NO: 997849 - protein, 9 aa, Mycobacterium
AAAAAPPPL

SEQ ID NO: 997850 - protein, 10 aa, Mycobacterium
AAAAAPVPIP

SEQ ID NO: 997851 - protein, 26 aa, Mycobacterium
AAAAAQEGGAGRKNAAAREEAPSRLR

SEQ ID NO: 997852 - protein, 17 aa, Mycobacterium
AAAAAQVGKRAAEPADD

SEQ ID NO: 997853 - protein, 26 aa, Mycobacterium
AAAAARSAISGTSDAAAASARAESAA

SEQ ID NO: 997854 - protein, 5 aa, Mycobacterium
AAAAD

SEQ ID NO: 997855 - protein, 8 aa, Mycobacterium
AAAADEVS

SEQ ID NO: 997856 - protein, 10 aa, Mycobacterium
AAAADEVSAA

SEQ ID NO: 997857 - protein, 8 aa, Mycobacterium
AAAADSEE

SEQ ID NO: 997858 - protein, 8 aa, Mycobacterium
AAAADTLR

SEQ ID NO: 997859 - protein, 9 aa, Mycobacterium
AAAAEHERE

SEQ ID NO: 997860 - protein, 7 aa, Mycobacterium
AAAAENP

SEQ ID NO: 997861 - protein, 6 aa, Mycobacterium
AAAAER

SEQ ID NO: 997862 - protein, 8 aa, Mycobacterium
AAAAESRR

SEQ ID NO: 997863 - protein, 18 aa, Mycobacterium
AAAAETSAVGEGQDPAAL

SEQ ID NO: 997864 - protein, 5 aa, Mycobacterium
AAAAG

SEQ ID NO: 997865 - protein, 6 aa, Mycobacterium
AAAAGA

SEQ ID NO: 997866 - protein, 7 aa, Mycobacterium
AAAAGDA

SEQ ID NO: 997867 - protein, 9 aa, Mycobacterium
AAAAGDEVS

SEQ ID NO: 997868 - protein, 14 aa, Mycobacterium
AAAAGISTSPGGVD

SEQ ID NO: 997869 - protein, 10 aa, Mycobacterium
AAAAGRAVSD

SEQ ID NO: 997870 - protein, 12 aa, Mycobacterium
AAAANQPAYGAA

SEQ ID NO: 997871 - protein, 16 aa, Mycobacterium
AAAAPSAAAAAASTAV

SEQ ID NO: 997872 - protein, 9 aa, Mycobacterium
AAAAPVAAA

SEQ ID NO: 997873 - protein, 9 aa, Mycobacterium
AAAAQVEDR

SEQ ID NO: 997874 - protein, 6 aa, Mycobacterium
AAAARL

SEQ ID NO: 997875 - protein, 8 aa, Mycobacterium
AAAARREY

SEQ ID NO: 997876 - protein, 11 aa, Mycobacterium
AAAARRSRAEL

SEQ ID NO: 997877 - protein, 9 aa, Mycobacterium
AAAASPTTA

SEQ ID NO: 997878 - protein, 9 aa, Mycobacterium
AAAATDGEW

SEQ ID NO: 997879 - protein, 9 aa, Mycobacterium
AAAATEQAG

SEQ ID NO: 997880 - protein, 9 aa, Mycobacterium
AAAATGTHD

SEQ ID NO: 997881 - protein, 11 aa, Mycobacterium
AAAATPTTGAL

SEQ ID NO: 997882 - protein, 12 aa, Mycobacterium
AAAATSDAYDDA

SEQ ID NO: 997883 - protein, 7 aa, Mycobacterium
AAAAVDA

SEQ ID NO: 997884 - protein, 5 aa, Mycobacterium
AAAAY

SEQ ID NO: 997885 - protein, 8 aa, Mycobacterium
AAADDIER

SEQ ID NO: 997886 - protein, 12 aa, Mycobacterium
AAADDPTKDRHT

SEQ ID NO: 997887 - protein, 7 aa, Mycobacterium
AAADEIS

SEQ ID NO: 997888 - protein, 7 aa, Mycobacterium
AAADEQL

SEQ ID NO: 997889 - protein, 7 aa, Mycobacterium
AAADEVS

SEQ ID NO: 997890 - protein, 6 aa, Mycobacterium
AAADGA

SEQ ID NO: 997891 - protein, 10 aa, Mycobacterium
AAADGTGWGE

SEQ ID NO: 997892 - protein, 11 aa, Mycobacterium
AAADGVSPPTA

SEQ ID NO: 997893 - protein, 14 aa, Mycobacterium
AAADIAATQDSQGA

SEQ ID NO: 997894 - protein, 26 aa, Mycobacterium
AAADPMAAAGASGGHGGPGGVGGVGG

SEQ ID NO: 997895 - protein, 8 aa, Mycobacterium
AAADPQEN

SEQ ID NO: 997896 - protein, 9 aa, Mycobacterium
AAADRPDVQ

SEQ ID NO: 997897 - protein, 7 aa, Mycobacterium
AAADSRT

SEQ ID NO: 997898 - protein, 8 aa, Mycobacterium
AAADSTDD

SEQ ID NO: 997899 - protein, 5 aa, Mycobacterium
AAADT

SEQ ID NO: 997900 - protein, 7 aa, Mycobacterium
AAADTGA

SEQ ID NO: 997901 - protein, 5 aa, Mycobacterium
AAADV

SEQ ID NO: 997902 - protein, 16 aa, Mycobacterium
AAAEAELSTRPAEQQR

SEQ ID NO: 997903 - protein, 6 aa, Mycobacterium
AAAEAG

SEQ ID NO: 997904 - protein, 12 aa, Mycobacterium
AAAEASARSVDQ

SEQ ID NO: 997905 - protein, 5 aa, Mycobacterium
AAAED

SEQ ID NO: 997906 - protein, 9 aa, Mycobacterium
AAAEDEVSA

SEQ ID NO: 997907 - protein, 7 aa, Mycobacterium
AAAEGRL

SEQ ID NO: 997908 - protein, 6 aa, Mycobacterium
AAAEKE

SEQ ID NO: 997909 - protein, 12 aa, Mycobacterium
AAAEPVSRTLIM

SEQ ID NO: 997910 - protein, 7 aa, Mycobacterium
AAAEPYD

SEQ ID NO: 997911 - protein, 5 aa, Mycobacterium
AAAER

SEQ ID NO: 997912 - protein, 8 aa, Mycobacterium
AAAESARA

SEQ ID NO: 997913 - protein, 6 aa, Mycobacterium
AAAESQ

SEQ ID NO: 997914 - protein, 6 aa, Mycobacterium
AAAEVR

SEQ ID NO: 997915 - protein, 6 aa, Mycobacterium
AAAEVS

SEQ ID NO: 997916 - protein, 5 aa, Mycobacterium
AAAGA

SEQ ID NO: 997917 - protein, 13 aa, Mycobacterium
AAAGAAEHSSTLS

SEQ ID NO: 997918 - protein, 6 aa, Mycobacterium
AAAGAG

SEQ ID NO: 997919 - protein, 13 aa, Mycobacterium
AAAGAGPLRGNAR

SEQ ID NO: 997920 - protein, 12 aa, Mycobacterium
AAAGAPPAGGGR

SEQ ID NO: 997921 - protein, 9 aa, Mycobacterium
AAAGDEVSA

SEQ ID NO: 997922 - protein, 12 aa, Mycobacterium
AAAGDYGQPGTH

SEQ ID NO: 997923 - protein, 20 aa, Mycobacterium
AAAGEIPTAASREIERGNAD

SEQ ID NO: 997924 - protein, 9 aa, Mycobacterium
AAAGETIGQ

SEQ ID NO: 997925 - protein, 7 aa, Mycobacterium
AAAGGAA

SEQ ID NO: 997926 - protein, 6 aa, Mycobacterium
AAAGGR

SEQ ID NO: 997927 - protein, 11 aa, Mycobacterium
AAAGGRGGLGN

SEQ ID NO: 997928 - protein, 10 aa, Mycobacterium
AAAGGTTSLA

SEQ ID NO: 997929 - protein, 23 aa, Mycobacterium
AAAGMTAPAARREKTRAPHDPDL

SEQ ID NO: 997930 - protein, 13 aa, Mycobacterium
AAAGNSRRGTPPM

SEQ ID NO: 997931 - protein, 5 aa, Mycobacterium
AAAGQ

SEQ ID NO: 997932 - protein, 8 aa, Mycobacterium
AAAGRAGG

SEQ ID NO: 997933 - protein, 13 aa, Mycobacterium
AAAGRDYPSHGDA

SEQ ID NO: 997934 - protein, 8 aa, Mycobacterium
AAAGRPAG

SEQ ID NO: 997935 - protein, 8 aa, Mycobacterium
AAAGRSRA

SEQ ID NO: 997936 - protein, 14 aa, Mycobacterium
AAAGSGAGTENYPA

SEQ ID NO: 997937 - protein, 6 aa, Mycobacterium
AAAGSS

SEQ ID NO: 997938 - protein, 6 aa, Mycobacterium
AAAGTA

SEQ ID NO: 997939 - protein, 7 aa, Mycobacterium
AAAGTKL

SEQ ID NO: 997940 - protein, 7 aa, Mycobacterium
AAAGTKQ

SEQ ID NO: 997941 - protein, 7 aa, Mycobacterium
AAAGTPL

SEQ ID NO: 997942 - protein, 14 aa, Mycobacterium
AAAGTSAQTPDARV

SEQ ID NO: 997943 - protein, 6 aa, Mycobacterium
AAAGVD

SEQ ID NO: 997944 - protein, 6 aa, Mycobacterium
AAAGVS

SEQ ID NO: 997945 - protein, 5 aa, Mycobacterium
AAAGW

SEQ ID NO: 997946 - protein, 8 aa, Mycobacterium
AAAHPGQP

SEQ ID NO: 997947 - protein, 4 aa, Mycobacterium
AAAK

SEQ ID NO: 997948 - protein, 12 aa, Mycobacterium
AAAKAAGKVRME

SEQ ID NO: 997949 - protein, 16 aa, Mycobacterium
AAAKAKSLLDQEGRDD

SEQ ID NO: 997950 - protein, 9 aa, Mycobacterium
AAAKGAAAT

SEQ ID NO: 997951 - protein, 6 aa, Mycobacterium
AAAKGK

SEQ ID NO: 997952 - protein, 119 aa, Mycobacterium
AAAKKAAKKAPAKKAATKTAAKKAATKAPAKKAATKAPAKKAATKARAKKAATKAPAKKAATKVTKAPAKKVTKATVKKTAAKAPVRKGATKAPAKKAAAKRPATKAPAKKATSTRRGR

SEQ ID NO: 997953 - protein, 6 aa, Mycobacterium
AAAKKD

SEQ ID NO: 997954 - protein, 6 aa, Mycobacterium
AAAKLG

SEQ ID NO: 997955 - protein, 14 aa, Mycobacterium
AAAKNRVDGKPEEL

SEQ ID NO: 997956 - protein, 14 aa, Mycobacterium
AAAKPGSAMTPLPG

SEQ ID NO: 997957 - protein, 4 aa, Mycobacterium
AAAL

SEQ ID NO: 997958 - protein, 8 aa, Mycobacterium
AAALAGSR

SEQ ID NO: 997959 - protein, 5 aa, Mycobacterium
AAALP

SEQ ID NO: 997960 - protein, 6 aa, Mycobacterium
AAALSP

SEQ ID NO: 997961 - protein, 9 aa, Mycobacterium
AAALTESRT

SEQ ID NO: 997962 - protein, 13 aa, Mycobacterium
AAANAQNNNGLDP

SEQ ID NO: 997963 - protein, 7 aa, Mycobacterium
AAANDAK

SEQ ID NO: 997964 - protein, 16 aa, Mycobacterium
AAANESATQVRAAGAA

SEQ ID NO: 997965 - protein, 8 aa, Mycobacterium
AAANGGSC

SEQ ID NO: 997966 - protein, 8 aa, Mycobacterium
AAANPAGF

SEQ ID NO: 997967 - protein, 7 aa, Mycobacterium
AAANPEA

SEQ ID NO: 997968 - protein, 15 aa, Mycobacterium
AAANPGSTMTPLPSI

SEQ ID NO: 997969 - protein, 9 aa, Mycobacterium
AAANQRADA

SEQ ID NO: 997970 - protein, 12 aa, Mycobacterium
AAANTAAIGPTT

SEQ ID NO: 997971 - protein, 5 aa, Mycobacterium
AAAPA

SEQ ID NO: 997972 - protein, 7 aa, Mycobacterium
AAAPASA

SEQ ID NO: 997973 - protein, 15 aa, Mycobacterium
AAAPAWGKAAPAERA

SEQ ID NO: 997974 - protein, 9 aa, Mycobacterium
AAAPDGLQD

SEQ ID NO: 997975 - protein, 6 aa, Mycobacterium
AAAPDL

SEQ ID NO: 997976 - protein, 7 aa, Mycobacterium
AAAPDPE

SEQ ID NO: 997977 - protein, 7 aa, Mycobacterium
AAAPETH

SEQ ID NO: 997978 - protein, 6 aa, Mycobacterium
AAAPGG

SEQ ID NO: 997979 - protein, 8 aa, Mycobacterium
AAAPGRAA

SEQ ID NO: 997980 - protein, 6 aa, Mycobacterium
AAAPGS

SEQ ID NO: 997981 - protein, 11 aa, Mycobacterium
AAAPLPTADPD

SEQ ID NO: 997982 - protein, 8 aa, Mycobacterium
AAAPMGIP

SEQ ID NO: 997983 - protein, 7 aa, Mycobacterium
AAAPPHR

SEQ ID NO: 997984 - protein, 7 aa, Mycobacterium
AAAPQGR

SEQ ID NO: 997985 - protein, 8 aa, Mycobacterium
AAAPSGLT

SEQ ID NO: 997986 - protein, 10 aa, Mycobacterium
AAAPTAAPGT

SEQ ID NO: 997987 - protein, 12 aa, Mycobacterium
AAAPTAGLPGEA

SEQ ID NO: 997988 - protein, 6 aa, Mycobacterium
AAAPTT

SEQ ID NO: 997989 - protein, 7 aa, Mycobacterium
AAAPTTS

SEQ ID NO: 997990 - protein, 5 aa, Mycobacterium
AAAPY

SEQ ID NO: 997991 - protein, 11 aa, Mycobacterium
AAAQAKRAVEQ

SEQ ID NO: 997992 - protein, 6 aa, Mycobacterium
AAAQGR

SEQ ID NO: 997993 - protein, 8 aa, Mycobacterium
AAAQHGRA

SEQ ID NO: 997994 - protein, 8 aa, Mycobacterium
AAAQPGEP

SEQ ID NO: 997995 - protein, 7 aa, Mycobacterium
AAAQREG

SEQ ID NO: 997996 - protein, 8 aa, Mycobacterium
AAAQSADI

SEQ ID NO: 997997 - protein, 11 aa, Mycobacterium
AAAQSEATGAG

SEQ ID NO: 997998 - protein, 9 aa, Mycobacterium
AAAQSTDFT

SEQ ID NO: 997999 - protein, 10 aa, Mycobacterium
AAAQTSSGVG

SEQ ID NO: 998000 - protein, 6 aa, Mycobacterium
AAARAA

SEQ ID NO: 998001 - protein, 7 aa, Mycobacterium
AAARAVD

SEQ ID NO: 998002 - protein, 5 aa, Mycobacterium
AAARD

SEQ ID NO: 998003 - protein, 6 aa, Mycobacterium
AAARGA

SEQ ID NO: 998004 - protein, 7 aa, Mycobacterium
AAARGLT

SEQ ID NO: 998005 - protein, 7 aa, Mycobacterium
AAARGTA

SEQ ID NO: 998006 - protein, 9 aa, Mycobacterium
AAARKDSKL

SEQ ID NO: 998007 - protein, 12 aa, Mycobacterium
AAARLSDTKDPN

SEQ ID NO: 998008 - protein, 7 aa, Mycobacterium
AAARRAL

SEQ ID NO: 998009 - protein, 14 aa, Mycobacterium
AAARRTGGHPAKRT

SEQ ID NO: 998010 - protein, 16 aa, Mycobacterium
AAARTQARIDSGQQPV

SEQ ID NO: 998011 - protein, 4 aa, Mycobacterium
AAAS

SEQ ID NO: 998012 - protein, 7 aa, Mycobacterium
AAASAGS

SEQ ID NO: 998013 - protein, 14 aa, Mycobacterium
AAASDAGRDPMSIT

SEQ ID NO: 998014 - protein, 11 aa, Mycobacterium
AAASGAGPQSL

SEQ ID NO: 998015 - protein, 11 aa, Mycobacterium
AAASGNDPRDS

SEQ ID NO: 998016 - protein, 11 aa, Mycobacterium
AAASRSARAKL

SEQ ID NO: 998017 - protein, 11 aa, Mycobacterium
AAASSGDTLGE

SEQ ID NO: 998018 - protein, 12 aa, Mycobacterium
AAASSPAAVGGA

SEQ ID NO: 998019 - protein, 9 aa, Mycobacterium
AAASSSCAG

SEQ ID NO: 998020 - protein, 10 aa, Mycobacterium
AAASSSPLEQ

SEQ ID NO: 998021 - protein, 9 aa, Mycobacterium
AAASTLQGI

SEQ ID NO: 998022 - protein, 6 aa, Mycobacterium
AAASTT

SEQ ID NO: 998023 - protein, 10 aa, Mycobacterium
AAATAGPRDV

SEQ ID NO: 998024 - protein, 10 aa, Mycobacterium
AAATASGAWA

SEQ ID NO: 998025 - protein, 7 aa, Mycobacterium
AAATDSR

SEQ ID NO: 998026 - protein, 7 aa, Mycobacterium
AAATEEI

SEQ ID NO: 998027 - protein, 16 aa, Mycobacterium
AAATEQSASKARIAAS

SEQ ID NO: 998028 - protein, 27 aa, Mycobacterium
AAATGAASTGVALGPTAAEQQRGLTAG

SEQ ID NO: 998029 - protein, 8 aa, Mycobacterium
AAATGGRG

SEQ ID NO: 998030 - protein, 12 aa, Mycobacterium
AAATGKRSQCFG

SEQ ID NO: 998031 - protein, 6 aa, Mycobacterium
AAATGT

SEQ ID NO: 998032 - protein, 7 aa, Mycobacterium
AAATGYG

SEQ ID NO: 998033 - protein, 7 aa, Mycobacterium
AAATNSL

SEQ ID NO: 998034 - protein, 7 aa, Mycobacterium
AAATPAR

SEQ ID NO: 998035 - protein, 21 aa, Mycobacterium
AAATQRPDRLPGVGSSSHIPT

SEQ ID NO: 998036 - protein, 10 aa, Mycobacterium
AAATQVGGDG

SEQ ID NO: 998037 - protein, 6 aa, Mycobacterium
AAATRH

SEQ ID NO: 998038 - protein, 7 aa, Mycobacterium
AAATRNA

SEQ ID NO: 998039 - protein, 5 aa, Mycobacterium
AAATS

SEQ ID NO: 998040 - protein, 10 aa, Mycobacterium
AAATSGTGEI

SEQ ID NO: 998041 - protein, 8 aa, Mycobacterium
AAAVAPTT

SEQ ID NO: 998042 - protein, 13 aa, Mycobacterium
AAAVEGPSAAIDR

SEQ ID NO: 998043 - protein, 5 aa, Mycobacterium
AAAVR

SEQ ID NO: 998044 - protein, 6 aa, Mycobacterium
AAAYQT

SEQ ID NO: 998045 - protein, 17 aa, Mycobacterium
AACTGGAPTTAPAHSTQ

SEQ ID NO: 998046 - protein, 13 aa, Mycobacterium
AACTPTDAPADVE

SEQ ID NO: 998047 - protein, 11 aa, Mycobacterium
AADAAAALTDA

SEQ ID NO: 998048 - protein, 7 aa, Mycobacterium
AADAARK

SEQ ID NO: 998049 - protein, 8 aa, Mycobacterium
AADAESDH

SEQ ID NO: 998050 - protein, 9 aa, Mycobacterium
AADAGDATI

SEQ ID NO: 998051 - protein, 8 aa, Mycobacterium
AADAGTAV

SEQ ID NO: 998052 - protein, 6 aa, Mycobacterium
AADALS

SEQ ID NO: 998053 - protein, 7 aa, Mycobacterium
AADAPGL

SEQ ID NO: 998054 - protein, 8 aa, Mycobacterium
AADAPVSA

SEQ ID NO: 998055 - protein, 13 aa, Mycobacterium
AADARGHLTKDGV

SEQ ID NO: 998056 - protein, 12 aa, Mycobacterium
AADDDSATGGPD

SEQ ID NO: 998057 - protein, 7 aa, Mycobacterium
AADDGVG

SEQ ID NO: 998058 - protein, 11 aa, Mycobacterium
AADDPAQDTLE

SEQ ID NO: 998059 - protein, 19 aa, Mycobacterium
AADDPREAAAKLKSELLAA

SEQ ID NO: 998060 - protein, 9 aa, Mycobacterium
AADDPSSAG

SEQ ID NO: 998061 - protein, 8 aa, Mycobacterium
AADDRRDV

SEQ ID NO: 998062 - protein, 10 aa, Mycobacterium
AADEARRTEL

SEQ ID NO: 998063 - protein, 7 aa, Mycobacterium
AADEVST

SEQ ID NO: 998064 - protein, 6 aa, Mycobacterium
AADFGP

SEQ ID NO: 998065 - protein, 7 aa, Mycobacterium
AADGADT

SEQ ID NO: 998066 - protein, 7 aa, Mycobacterium
AADGAGM

SEQ ID NO: 998067 - protein, 7 aa, Mycobacterium
AADGDAR

SEQ ID NO: 998068 - protein, 9 aa, Mycobacterium
AADGEGGYI

SEQ ID NO: 998069 - protein, 12 aa, Mycobacterium
AADGSDSNSGAR

SEQ ID NO: 998070 - protein, 6 aa, Mycobacterium
AADGSI

SEQ ID NO: 998071 - protein, 15 aa, Mycobacterium
AADGSLETLFSAPVS

SEQ ID NO: 998072 - protein, 6 aa, Mycobacterium
AADGTA

SEQ ID NO: 998073 - protein, 8 aa, Mycobacterium
AADGTRQR

SEQ ID NO: 998074 - protein, 19 aa, Mycobacterium
AADHDITTGTPLRRRRQSS

SEQ ID NO: 998075 - protein, 7 aa, Mycobacterium
AADHGAS

SEQ ID NO: 998076 - protein, 4 aa, Mycobacterium
AADI

SEQ ID NO: 998077 - protein, 7 aa, Mycobacterium
AADIPPG

SEQ ID NO: 998078 - protein, 7 aa, Mycobacterium
AADKGAR

SEQ ID NO: 998079 - protein, 29 aa, Mycobacterium
AADLDTGSASVSAANPGPAGAEPETEAFD

SEQ ID NO: 998080 - protein, 8 aa, Mycobacterium
AADLGQND

SEQ ID NO: 998081 - protein, 6 aa, Mycobacterium
AADPAL

SEQ ID NO: 998082 - protein, 7 aa, Mycobacterium
AADPDAP

SEQ ID NO: 998083 - protein, 11 aa, Mycobacterium
AADPDDWNPPQ

SEQ ID NO: 998084 - protein, 9 aa, Mycobacterium
AADPGPAAR

SEQ ID NO: 998085 - protein, 6 aa, Mycobacterium
AADPLD

SEQ ID NO: 998086 - protein, 16 aa, Mycobacterium
AADPLGAGGAGSLPGM

SEQ ID NO: 998087 - protein, 5 aa, Mycobacterium
AADPN

SEQ ID NO: 998088 - protein, 9 aa, Mycobacterium
AADPPDWAG

SEQ ID NO: 998089 - protein, 10 aa, Mycobacterium
AADPPPQTVA

SEQ ID NO: 998090 - protein, 12 aa, Mycobacterium
AADPSLRERQPY

SEQ ID NO: 998091 - protein, 37 aa, Mycobacterium; identical to SEQ ID NO: 409694

SEQ ID NO: 998092 - protein, 4 aa, Mycobacterium
AADQ

SEQ ID NO: 998093 - protein, 6 aa, Mycobacterium
AADQAV

SEQ ID NO: 998094 - protein, 6 aa, Mycobacterium
AADQQA

SEQ ID NO: 998095 - protein, 9 aa, Mycobacterium
AADRAEAPL

SEQ ID NO: 998096 - protein, 11 aa, Mycobacterium
AADRAGRDPAS

SEQ ID NO: 998097 - protein, 9 aa, Mycobacterium
AADRGDGHQ

SEQ ID NO: 998098 - protein, 7 aa, Mycobacterium
AADRSGA

SEQ ID NO: 998099 - protein, 8 aa, Mycobacterium
AADSAERS

SEQ ID NO: 998100 - protein, 18 aa, Mycobacterium
AADSEGVTDAEDRVDELA

SEQ ID NO: 998101 - protein, 5 aa, Mycobacterium
AADSG

SEQ ID NO: 998102 - protein, 8 aa, Mycobacterium
AADSGADP

SEQ ID NO: 998103 - protein, 11 aa, Mycobacterium
AADSIGETDEY

SEQ ID NO: 998104 - protein, 9 aa, Mycobacterium
AADSPNSPH

SEQ ID NO: 998105 - protein, 8 aa, Mycobacterium
AADSQAAT

SEQ ID NO: 998106 - protein, 5 aa, Mycobacterium
AADSS

SEQ ID NO: 998107 - protein, 8 aa, Mycobacterium
AADSSDEI

SEQ ID NO: 998108 - protein, 8 aa, Mycobacterium
AADSSLEQ

SEQ ID NO: 998109 - protein, 11 aa, Mycobacterium
AADTGLPDSSA

SEQ ID NO: 998110 - protein, 7 aa, Mycobacterium
AADTKKT

SEQ ID NO: 998111 - protein, 5 aa, Mycobacterium
AADVD

SEQ ID NO: 998112 - protein, 6 aa, Mycobacterium
AADWTT

SEQ ID NO: 998113 - protein, 6 aa, Mycobacterium
AAEAAR

SEQ ID NO: 998114 - protein, 6 aa, Mycobacterium
AAEADQ

SEQ ID NO: 998115 - protein, 6 aa, Mycobacterium
AAEALD

SEQ ID NO: 998116 - protein, 21 aa, Mycobacterium
AAEALGASATYTPQQAAAAGV

SEQ ID NO: 998117 - protein, 6 aa, Mycobacterium
AAEAQY

SEQ ID NO: 998118 - protein, 7 aa, Mycobacterium
AAEARAG

SEQ ID NO: 998119 - protein, 16 aa, Mycobacterium
AAEARGQQVDEAADAA

SEQ ID NO: 998120 - protein, 9 aa, Mycobacterium
AAEARRRDP

SEQ ID NO: 998121 - protein, 10 aa, Mycobacterium
AAEASDELSS

SEQ ID NO: 998122 - protein, 17 aa, Mycobacterium
AAEATSRGLATLRKVLH

SEQ ID NO: 998123 - protein, 96 aa, Mycobacterium
AAEDADVDVDATATEAEESGDESPEPAADSEEPEADESAPEDSAEDTSSGESDTQSELEQSQTIEQGSDQTSAGDGEGPPPSAAVDGDTGPTRQGW

SEQ ID NO: 998124 - protein, 8 aa, Mycobacterium
AAEEERAR

SEQ ID NO: 998125 - protein, 5 aa, Mycobacterium
AAEGA

SEQ ID NO: 998126 - protein, 15 aa, Mycobacterium
AAEGAQRKAAGDKRS

SEQ ID NO: 998127 - protein, 5 aa, Mycobacterium
AAEGF

SEQ ID NO: 998128 - protein, 8 aa, Mycobacterium
AAEGGGNI

SEQ ID NO: 998129 - protein, 49 aa, Mycobacterium; identical to SEQ ID NO: 409981

SEQ ID NO: 998130 - protein, 5 aa, Mycobacterium
AAEGR

SEQ ID NO: 998131 - protein, 7 aa, Mycobacterium
AAEGRGD

SEQ ID NO: 998132 - protein, 16 aa, Mycobacterium
AAEGRTQDLGYPAAGS

SEQ ID NO: 998133 - protein, 6 aa, Mycobacterium
AAEGTL

SEQ ID NO: 998134 - protein, 7 aa, Mycobacterium
AAEHPDK

SEQ ID NO: 998135 - protein, 33 aa, Mycobacterium
AAEKKKERPEAKPAAAQASAPASPSKAAVPAAA

SEQ ID NO: 998136 - protein, 5 aa, Mycobacterium
AAELA

SEQ ID NO: 998137 - protein, 15 aa, Mycobacterium
AAELSKTRAKAAKRL

SEQ ID NO: 998138 - protein, 13 aa, Mycobacterium
AAELTGPEGPRPV

SEQ ID NO: 998139 - protein, 10 aa, Mycobacterium
AAENRNAGLT

SEQ ID NO: 998140 - protein, 7 aa, Mycobacterium
AAENYDR

SEQ ID NO: 998141 - protein, 22 aa, Mycobacterium
AAEPAATPTPAKAAAPAADPVA

SEQ ID NO: 998142 - protein, 8 aa, Mycobacterium
AAEPATDR

SEQ ID NO: 998143 - protein, 6 aa, Mycobacterium
AAEPAV

SEQ ID NO: 998144 - protein, 12 aa, Mycobacterium
AAEPDGLPLDPA

SEQ ID NO: 998145 - protein, 12 aa, Mycobacterium
AAEPDLSSEKIG

SEQ ID NO: 998146 - protein, 7 aa, Mycobacterium
AAEPDRV

SEQ ID NO: 998147 - protein, 12 aa, Mycobacterium
AAEPGGKEYGVP

SEQ ID NO: 998148 - protein, 8 aa, Mycobacterium
AAEPSGFD

SEQ ID NO: 998149 - protein, 7 aa, Mycobacterium
AAEPSPL

SEQ ID NO: 998150 - protein, 4 aa, Mycobacterium
AAEQ

SEQ ID NO: 998151 - protein, 7 aa, Mycobacterium
AAEQADA

SEQ ID NO: 998152 - protein, 13 aa, Mycobacterium
AAEQAGQPLPSRD

SEQ ID NO: 998153 - protein, 13 aa, Mycobacterium
AAEQEERDEDEKV

SEQ ID NO: 998154 - protein, 7 aa, Mycobacterium
AAEQGNS

SEQ ID NO: 998155 - protein, 13 aa, Mycobacterium
AAEQRAETTGASV

SEQ ID NO: 998156 - protein, 7 aa, Mycobacterium
AAEQRHE

SEQ ID NO: 998157 - protein, 21 aa, Mycobacterium
AAEQTTTQAEAHRQAMASTPG

SEQ ID NO: 998158 - protein, 9 aa, Mycobacterium
AAERASGHL

SEQ ID NO: 998159 - protein, 5 aa, Mycobacterium
AAERE

SEQ ID NO: 998160 - protein, 12 aa, Mycobacterium
AAERGGPAGLGS

SEQ ID NO: 998161 - protein, 5 aa, Mycobacterium
AAERL

SEQ ID NO: 998162 - protein, 10 aa, Mycobacterium
AAERQQRSAA

SEQ ID NO: 998163 - protein, 11 aa, Mycobacterium
AAERQVRKAQR

SEQ ID NO: 998164 - protein, 11 aa, Mycobacterium
AAERRDRPGDD

SEQ ID NO: 998165 - protein, 17 aa, Mycobacterium
AAERSSGFDPRAGWAGN

SEQ ID NO: 998166 - protein, 17 aa, Mycobacterium
AAERVKSTAYVTHTFFT

SEQ ID NO: 998167 - protein, 8 aa, Mycobacterium
AAESAGAE

SEQ ID NO: 998168 - protein, 8 aa, Mycobacterium
AAESFSAQ

SEQ ID NO: 998169 - protein, 8 aa, Mycobacterium
AAESGGAA

SEQ ID NO: 998170 - protein, 51 aa, Mycobacterium
AAESGGGDAPSQPEPEAEPAAAAQPEPEAEPEPQPEAKPQSGGSSTAGGDV

SEQ ID NO: 998171 - protein, 16 aa, Mycobacterium
AAESSGPWNNAGTGHS

SEQ ID NO: 998172 - protein, 4 aa, Mycobacterium
AAET

SEQ ID NO: 998173 - protein, 7 aa, Mycobacterium
AAETPLT

SEQ ID NO: 998174 - protein, 14 aa, Mycobacterium
AAETRVRGEPDEPA

SEQ ID NO: 998175 - protein, 10 aa, Mycobacterium
AAETTGTSPL

SEQ ID NO: 998176 - protein, 4 aa, Mycobacterium
AAEV

SEQ ID NO: 998177 - protein, 10 aa, Mycobacterium
AAEVGNAAPL

SEQ ID NO: 998178 - protein, 16 aa, Mycobacterium
AAEVGPRRALSGQPVG

SEQ ID NO: 998179 - protein, 7 aa, Mycobacterium
AAEVRSR

SEQ ID NO: 998180 - protein, 7 aa, Mycobacterium
AAEWGTP

SEQ ID NO: 998181 - protein, 6 aa, Mycobacterium
AAFGAK

SEQ ID NO: 998182 - protein, 7 aa, Mycobacterium
AAFGANE

SEQ ID NO: 998183 - protein, 9 aa, Mycobacterium
AAFGEDPGT

SEQ ID NO: 998184 - protein, 5 aa, Mycobacterium
AAFGG

SEQ ID NO: 998185 - protein, 18 aa, Mycobacterium
AAFPGGASDPGDDGPVAT

SEQ ID NO: 998186 - protein, 8 aa, Mycobacterium
AAGAAGFE

SEQ ID NO: 998187 - protein, 26 aa, Mycobacterium
AAGAAGSSGAAGVSGAAGEAGSCGGV

SEQ ID NO: 998188 - protein, 33 aa, Mycobacterium
AAGAAKAHAPRVNDRRVDAQAKYPAAPRQRKGA

SEQ ID NO: 998189 - protein, 14 aa, Mycobacterium
AAGAALPVSGTSEG

SEQ ID NO: 998190 - protein, 6 aa, Mycobacterium
AAGADI

SEQ ID NO: 998191 - protein, 16 aa, Mycobacterium
AAGAGAARTTLARRTS

SEQ ID NO: 998192 - protein, 17 aa, Mycobacterium
AAGAGGGAAVTAQPTQA

SEQ ID NO: 998193 - protein, 8 aa, Mycobacterium
AAGAGSAA

SEQ ID NO: 998194 - protein, 10 aa, Mycobacterium
AAGAGSRRDT

SEQ ID NO: 998195 - protein, 16 aa, Mycobacterium
AAGAGVTAGPEDDPEQ

SEQ ID NO: 998196 - protein, 8 aa, Mycobacterium
AAGALSGV

SEQ ID NO: 998197 - protein, 8 aa, Mycobacterium
AAGAPGLD

SEQ ID NO: 998198 - protein, 6 aa, Mycobacterium
AAGAQG

SEQ ID NO: 998199 - protein, 6 aa, Mycobacterium
AAGASA

SEQ ID NO: 998200 - protein, 6 aa, Mycobacterium
AAGASS

SEQ ID NO: 998201 - protein, 9 aa, Mycobacterium
AAGATGSIA

SEQ ID NO: 998202 - protein, 7 aa, Mycobacterium
AAGATGV

SEQ ID NO: 998203 - protein, 12 aa, Mycobacterium
AAGATQRTSHGA

SEQ ID NO: 998204 - protein, 16 aa, Mycobacterium
AAGAYETASAATVPPP

SEQ ID NO: 998205 - protein, 10 aa, Mycobacterium
AAGDAGAHYP

SEQ ID NO: 998206 - protein, 8 aa, Mycobacterium
AAGDDGAR

SEQ ID NO: 998207 - protein, 6 aa, Mycobacterium
AAGDEA

SEQ ID NO: 998208 - protein, 9 aa, Mycobacterium
AAGDLPDGS

SEQ ID NO: 998209 - protein, 6 aa, Mycobacterium
AAGDPA

SEQ ID NO: 998210 - protein, 6 aa, Mycobacterium
AAGDPE

SEQ ID NO: 998211 - protein, 6 aa, Mycobacterium
AAGDPH

SEQ ID NO: 998212 - protein, 7 aa, Mycobacterium
AAGDQSI

SEQ ID NO: 998213 - protein, 16 aa, Mycobacterium
AAGDRGCGGRAPRQRR

SEQ ID NO: 998214 - protein, 7 aa, Mycobacterium
AAGEEGS

SEQ ID NO: 998215 - protein, 14 aa, Mycobacterium
AAGEGDGRAWLLAR

SEQ ID NO: 998216 - protein, 22 aa, Mycobacterium
AAGEGGYARELTDEERAQQQKA

SEQ ID NO: 998217 - protein, 7 aa, Mycobacterium
AAGEGPA

SEQ ID NO: 998218 - protein, 6 aa, Mycobacterium
AAGELG

SEQ ID NO: 998219 - protein, 5 aa, Mycobacterium
AAGEM

SEQ ID NO: 998220 - protein, 11 aa, Mycobacterium
AAGEPDPRSVQ

SEQ ID NO: 998221 - protein, 6 aa, Mycobacterium
AAGEPR

SEQ ID NO: 998222 - protein, 13 aa, Mycobacterium
AAGEPRRAAPPRR

SEQ ID NO: 998223 - protein, 7 aa, Mycobacterium
AAGERER

SEQ ID NO: 998224 - protein, 8 aa, Mycobacterium
AAGERPAE

SEQ ID NO: 998225 - protein, 7 aa, Mycobacterium
AAGESHA

SEQ ID NO: 998226 - protein, 29 aa, Mycobacterium
AAGESRDPLPTAVSPTANGICSSGSTGVP

SEQ ID NO: 998227 - protein, 12 aa, Mycobacterium
AAGFGQSSTTPT

SEQ ID NO: 998228 - protein, 28 aa, Mycobacterium
AAGFTDGATGAGGDGGQGGTAASGPGEA

SEQ ID NO: 998229 - protein, 12 aa, Mycobacterium
AAGGAAADAIAG

SEQ ID NO: 998230 - protein, 12 aa, Mycobacterium
AAGGAQGSSAAC

SEQ ID NO: 998231 - protein, 5 aa, Mycobacterium
AAGGD

SEQ ID NO: 998232 - protein, 12 aa, Mycobacterium
AAGGDSVDSAML

SEQ ID NO: 998233 - protein, 13 aa, Mycobacterium
AAGGERPFFQLLY

SEQ ID NO: 998234 - protein, 8 aa, Mycobacterium
AAGGGAAV

SEQ ID NO: 998235 - protein, 9 aa, Mycobacterium
AAGGGPFAA

SEQ ID NO: 998236 - protein, 8 aa, Mycobacterium
AAGGGSRK

SEQ ID NO: 998237 - protein, 6 aa, Mycobacterium
AAGGGV

SEQ ID NO: 998238 - protein, 5 aa, Mycobacterium
AAGGH

SEQ ID NO: 998239 - protein, 7 aa, Mycobacterium
AAGGIGT

SEQ ID NO: 998240 - protein, 9 aa, Mycobacterium
AAGGKGGDA

SEQ ID NO: 998241 - protein, 8 aa, Mycobacterium
AAGGPAVA

SEQ ID NO: 998242 - protein, 10 aa, Mycobacterium
AAGGPELDRE

SEQ ID NO: 998243 - protein, 9 aa, Mycobacterium
AAGGPGCPT

SEQ ID NO: 998244 - protein, 8 aa, Mycobacterium
AAGGPTVE

SEQ ID NO: 998245 - protein, 7 aa, Mycobacterium
AAGGQVR

SEQ ID NO: 998246 - protein, 7 aa, Mycobacterium
AAGGRAL

SEQ ID NO: 998247 - protein, 11 aa, Mycobacterium
AAGGSSYTGVS

SEQ ID NO: 998248 - protein, 9 aa, Mycobacterium
AAGGTVTTL

SEQ ID NO: 998249 - protein, 7 aa, Mycobacterium
AAGHDAE

SEQ ID NO: 998250 - protein, 9 aa, Mycobacterium
AAGHSADQA

SEQ ID NO: 998251 - protein, 7 aa, Mycobacterium
AAGISGP

SEQ ID NO: 998252 - protein, 5 aa, Mycobacterium
AAGKG

SEQ ID NO: 998253 - protein, 5 aa, Mycobacterium
AAGKT

SEQ ID NO: 998254 - protein, 9 aa, Mycobacterium
AAGLDLGGR

SEQ ID NO: 998255 - protein, 8 aa, Mycobacterium
AAGLGPTT

SEQ ID NO: 998256 - protein, 16 aa, Mycobacterium
AAGLPSAIDGPTIGSN

SEQ ID NO: 998257 - protein, 7 aa, Mycobacterium
AAGLQSY

SEQ ID NO: 998258 - protein, 9 aa, Mycobacterium
AAGNDYQRG

SEQ ID NO: 998259 - protein, 17 aa, Mycobacterium
AAGNPLTAGSARSVDPA

SEQ ID NO: 998260 - protein, 6 aa, Mycobacterium
AAGNSS

SEQ ID NO: 998261 - protein, 7 aa, Mycobacterium
AAGPDLS

SEQ ID NO: 998262 - protein, 13 aa, Mycobacterium
AAGPGNRRDTRTL

SEQ ID NO: 998263 - protein, 8 aa, Mycobacterium
AAGPGSID

SEQ ID NO: 998264 - protein, 5 aa, Mycobacterium
AAGPL

SEQ ID NO: 998265 - protein, 7 aa, Mycobacterium
AAGPNNL

SEQ ID NO: 998266 - protein, 12 aa, Mycobacterium
AAGPPRPGEGSL

SEQ ID NO: 998267 - protein, 5 aa, Mycobacterium
AAGPT

SEQ ID NO: 998268 - protein, 11 aa, Mycobacterium
AAGPVGSNGQA

SEQ ID NO: 998269 - protein, 4 aa, Mycobacterium
AAGQ

SEQ ID NO: 998270 - protein, 26 aa, Mycobacterium
AAGQADPGDTASDPGGGSGAPRGVGG

SEQ ID NO: 998271 - protein, 11 aa, Mycobacterium
AAGQGRSDDVA

SEQ ID NO: 998272 - protein, 6 aa, Mycobacterium
AAGQPG

SEQ ID NO: 998273 - protein, 7 aa, Mycobacterium
AAGQPQL

SEQ ID NO: 998274 - protein, 5 aa, Mycobacterium
AAGQR

SEQ ID NO: 998275 - protein, 5 aa, Mycobacterium
AAGRA

SEQ ID NO: 998276 - protein, 13 aa, Mycobacterium
AAGRANVGAPPPI

SEQ ID NO: 998277 - protein, 10 aa, Mycobacterium
AAGRASKDVD

SEQ ID NO: 998278 - protein, 19 aa, Mycobacterium
AAGRAVSAEPGAGAAGGIG

SEQ ID NO: 998279 - protein, 10 aa, Mycobacterium
AAGRDAGAEV

SEQ ID NO: 998280 - protein, 7 aa, Mycobacterium
AAGRDAV

SEQ ID NO: 998281 - protein, 9 aa, Mycobacterium
AAGRDGAPQ

SEQ ID NO: 998282 - protein, 12 aa, Mycobacterium
AAGRGRRLRRHR

SEQ ID NO: 998283 - protein, 11 aa, Mycobacterium
AAGRNTAVAEQ

SEQ ID NO: 998284 - protein, 7 aa, Mycobacterium
AAGRSAD

SEQ ID NO: 998285 - protein, 9 aa, Mycobacterium
AAGRSPEAI

SEQ ID NO: 998286 - protein, 13 aa, Mycobacterium
AAGRTDAGVHATG

SEQ ID NO: 998287 - protein, 7 aa, Mycobacterium
AAGRTGR

SEQ ID NO: 998288 - protein, 7 aa, Mycobacterium
AAGRTPV

SEQ ID NO: 998289 - protein, 4 aa, Mycobacterium
AAGS

SEQ ID NO: 998290 - protein, 16 aa, Mycobacterium
AAGSAAPAVADLPGRA

SEQ ID NO: 998291 - protein, 10 aa, Mycobacterium
AAGSAEAGRC

SEQ ID NO: 998292 - protein, 16 aa, Mycobacterium
AAGSAPGVEAQRDDKG

SEQ ID NO: 998293 - protein, 44 aa, Mycobacterium
AAGSGGAGGVDGDGSQGGDGGNGGAGGFGQNGGPGGRGGGGGHS

SEQ ID NO: 998294 - protein, 10 aa, Mycobacterium
AAGSGNASIT

SEQ ID NO: 998295 - protein, 9 aa, Mycobacterium
AAGSGQRLA

SEQ ID NO: 998296 - protein, 8 aa, Mycobacterium
AAGSPELY

SEQ ID NO: 998297 - protein, 13 aa, Mycobacterium
AAGSSRDDPQPAI

SEQ ID NO: 998298 - protein, 21 aa, Mycobacterium
AAGSSYAGAEAASAAPLQQTQ

SEQ ID NO: 998299 - protein, 13 aa, Mycobacterium
AAGSVGDCDYPGD

SEQ ID NO: 998300 - protein, 12 aa, Mycobacterium
AAGSYGRTEAAG

SEQ ID NO: 998301 - protein, 6 aa, Mycobacterium
AAGTAR

SEQ ID NO: 998302 - protein, 13 aa, Mycobacterium
AAGTASPGADPAV

SEQ ID NO: 998303 - protein, 15 aa, Mycobacterium
AAGTDYADLTGEPPF

SEQ ID NO: 998304 - protein, 12 aa, Mycobacterium
AAGTGDARKIRA

SEQ ID NO: 998305 - protein, 8 aa, Mycobacterium
AAGTHSGA

SEQ ID NO: 998306 - protein, 8 aa, Mycobacterium
AAGTNQAT

SEQ ID NO: 998307 - protein, 6 aa, Mycobacterium
AAGTPV

SEQ ID NO: 998308 - protein, 7 aa, Mycobacterium
AAGTQQG

SEQ ID NO: 998309 - protein, 7 aa, Mycobacterium
AAGTSVP

SEQ ID NO: 998310 - protein, 44 aa, Mycobacterium
AAGVATDMPTRVTPSVGSAGAAAPDSPAVPPAAPAAREGPAARR

SEQ ID NO: 998311 - protein, 6 aa, Mycobacterium
AAGVDA

SEQ ID NO: 998312 - protein, 10 aa, Mycobacterium
AAGVGGTGGI

SEQ ID NO: 998313 - protein, 9 aa, Mycobacterium
AAGVGPGDA

SEQ ID NO: 998314 - protein, 7 aa, Mycobacterium
AAGVGPS

SEQ ID NO: 998315 - protein, 5 aa, Mycobacterium
AAGVS

SEQ ID NO: 998316 - protein, 6 aa, Mycobacterium
AAGVSH

SEQ ID NO: 998317 - protein, 5 aa, Mycobacterium
AAGVT

SEQ ID NO: 998318 - protein, 4 aa, Mycobacterium
AAGY

SEQ ID NO: 998319 - protein, 6 aa, Mycobacterium
AAGYGT

SEQ ID NO: 998320 - protein, 9 aa, Mycobacterium
AAHAAGQDT

SEQ ID NO: 998321 - protein, 4 aa, Mycobacterium
AAHG

SEQ ID NO: 998322 - protein, 9 aa, Mycobacterium
AAHGANRTG

SEQ ID NO: 998323 - protein, 13 aa, Mycobacterium
AAHGRAGDDGLGN

SEQ ID NO: 998324 - protein, 7 aa, Mycobacterium
AAHNRAT

SEQ ID NO: 998325 - protein, 5 aa, Mycobacterium
AAHPD

SEQ ID NO: 998326 - protein, 8 aa, Mycobacterium
AAHPGRPE

SEQ ID NO: 998327 - protein, 7 aa, Mycobacterium
AAHPSAS

SEQ ID NO: 998328 - protein, 15 aa, Mycobacterium
AAHPTTGDSSLPDDR

SEQ ID NO: 998329 - protein, 11 aa, Mycobacterium
AAHSGDKEKAA

SEQ ID NO: 998330 - protein, 7 aa, Mycobacterium
AAHTTAH

SEQ ID NO: 998331 - protein, 19 aa, Mycobacterium
AAIDTSRRPGRPRAAPPVR

SEQ ID NO: 998332 - protein, 8 aa, Mycobacterium
AAINNRNI

SEQ ID NO: 998333 - protein, 11 aa, Mycobacterium
AAINPGNSGGA

SEQ ID NO: 998334 - protein, 4 aa, Mycobacterium
AAIQ

SEQ ID NO: 998335 - protein, 9 aa, Mycobacterium
AAKAERERT

SEQ ID NO: 998336 - protein, 6 aa, Mycobacterium
AAKAGA

SEQ ID NO: 998337 - protein, 10 aa, Mycobacterium
AAKAGASGDL

SEQ ID NO: 998338 - protein, 10 aa, Mycobacterium
AAKAGGGSIN

SEQ ID NO: 998339 - protein, 13 aa, Mycobacterium
AAKALSDTVTPSG

SEQ ID NO: 998340 - protein, 7 aa, Mycobacterium
AAKATAE

SEQ ID NO: 998341 - protein, 6 aa, Mycobacterium
AAKDQA

SEQ ID NO: 998342 - protein, 4 aa, Mycobacterium
AAKE

SEQ ID NO: 998343 - protein, 6 aa, Mycobacterium
AAKERK

SEQ ID NO: 998344 - protein, 10 aa, Mycobacterium
AAKGAGASAR

SEQ ID NO: 998345 - protein, 12 aa, Mycobacterium
AAKGAGAYAGPR

SEQ ID NO: 998346 - protein, 10 aa, Mycobacterium
AAKKDGDTLG

SEQ ID NO: 998347 - protein, 9 aa, Mycobacterium
AAKNDSTLR

SEQ ID NO: 998348 - protein, 9 aa, Mycobacterium
AAKPDDDTL

SEQ ID NO: 998349 - protein, 8 aa, Mycobacterium
AAKPGSPV

SEQ ID NO: 998350 - protein, 11 aa, Mycobacterium
AAKPPSATQGT

SEQ ID NO: 998351 - protein, 8 aa, Mycobacterium
AAKQQNLA

SEQ ID NO: 998352 - protein, 10 aa, Mycobacterium
AAKQRLTDSV

SEQ ID NO: 998353 - protein, 9 aa, Mycobacterium
AAKQTFADT

SEQ ID NO: 998354 - protein, 11 aa, Mycobacterium
AAKQTREVSPR

SEQ ID NO: 998355 - protein, 9 aa, Mycobacterium
AAKRRNTVD

SEQ ID NO: 998356 - protein, 9 aa, Mycobacterium
AAKSERAWS

SEQ ID NO: 998357 - protein, 8 aa, Mycobacterium
AAKSETLT

SEQ ID NO: 998358 - protein, 12 aa, Mycobacterium
AAKSSAQQGDPL

SEQ ID NO: 998359 - protein, 7 aa, Mycobacterium
AAKTPAV

SEQ ID NO: 998360 - protein, 9 aa, Mycobacterium
AAKTTDDTV

SEQ ID NO: 998361 - protein, 4 aa, Mycobacterium
AALA

SEQ ID NO: 998362 - protein, 8 aa, Mycobacterium
AALAPTTG

SEQ ID NO: 998363 - protein, 31 aa, Mycobacterium
AALATTPSTPVPPTAPAACPGIPGPQDLPAK

SEQ ID NO: 998364 - protein, 11 aa, Mycobacterium
AALDDASHDER

SEQ ID NO: 998365 - protein, 21 aa, Mycobacterium
AALDGSRRAGARCGEGFMPAQ

SEQ ID NO: 998366 - protein, 11 aa, Mycobacterium
AALDSGATAPL

SEQ ID NO: 998367 - protein, 8 aa, Mycobacterium
AALGDEEV

SEQ ID NO: 998368 - protein, 5 aa, Mycobacterium
AALGG

SEQ ID NO: 998369 - protein, 14 aa, Mycobacterium
AALGGNQRARERHV

SEQ ID NO: 998370 - protein, 6 aa, Mycobacterium
AALPAA

SEQ ID NO: 998371 - protein, 8 aa, Mycobacterium
AALPPPGI

SEQ ID NO: 998372 - protein, 6 aa, Mycobacterium
AALPPS

SEQ ID NO: 998373 - protein, 8 aa, Mycobacterium
AALPRRGG

SEQ ID NO: 998374 - protein, 10 aa, Mycobacterium
AALQTPDARV

SEQ ID NO: 998375 - protein, 6 aa, Mycobacterium
AALSAG

SEQ ID NO: 998376 - protein, 5 aa, Mycobacterium
AALSE

SEQ ID NO: 998377 - protein, 7 aa, Mycobacterium
AALSPAG

SEQ ID NO: 998378 - protein, 19 aa, Mycobacterium
AALTAGGAVSASGADSTGA

SEQ ID NO: 998379 - protein, 12 aa, Mycobacterium
AAMDNARDAAQV

SEQ ID NO: 998380 - protein, 5 aa, Mycobacterium
AAMPA

SEQ ID NO: 998381 - protein, 6 aa, Mycobacterium
AAMTGS

SEQ ID NO: 998382 - protein, 9 aa, Mycobacterium
AANAAAAAL

SEQ ID NO: 998383 - protein, 7 aa, Mycobacterium
AANAAEG

SEQ ID NO: 998384 - protein, 8 aa, Mycobacterium
AANDAQTA

SEQ ID NO: 998385 - protein, 8 aa, Mycobacterium
AANDEGTY

SEQ ID NO: 998386 - protein, 6 aa, Mycobacterium
AANEAE

SEQ ID NO: 998387 - protein, 7 aa, Mycobacterium
AANEEAA

SEQ ID NO: 998388 - protein, 6 aa, Mycobacterium
AANNLP

SEQ ID NO: 998389 - protein, 6 aa, Mycobacterium
AANNNL

SEQ ID NO: 998390 - protein, 10 aa, Mycobacterium
AANPALSDDP

SEQ ID NO: 998391 - protein, 7 aa, Mycobacterium
AANPDAP

SEQ ID NO: 998392 - protein, 6 aa, Mycobacterium
AANPDR

SEQ ID NO: 998393 - protein, 7 aa, Mycobacterium
AANPEVA

SEQ ID NO: 998394 - protein, 7 aa, Mycobacterium
AANPLAT

SEQ ID NO: 998395 - protein, 5 aa, Mycobacterium
AANPN

SEQ ID NO: 998396 - protein, 5 aa, Mycobacterium
AANPP

SEQ ID NO: 998397 - protein, 23 aa, Mycobacterium
AANPRPNGPRTHERVDANDGLLP

SEQ ID NO: 998398 - protein, 7 aa, Mycobacterium
AANRDPD

SEQ ID NO: 998399 - protein, 10 aa, Mycobacterium
AANRDPRRFE

SEQ ID NO: 998400 - protein, 7 aa, Mycobacterium
AANSQVA

SEQ ID NO: 998401 - protein, 5 aa, Mycobacterium
AANSR

SEQ ID NO: 998402 - protein, 7 aa, Mycobacterium
AANTAKG

SEQ ID NO: 998403 - protein, 9 aa, Mycobacterium
AANTDDGRS

SEQ ID NO: 998404 - protein, 26 aa, Mycobacterium
AANTPRTNVGGEHPDINTADNGAHDP

SEQ ID NO: 998405 - protein, 5 aa, Mycobacterium
AANTY

SEQ ID NO: 998406 - protein, 7 aa, Mycobacterium
AAPAAAL

SEQ ID NO: 998407 - protein, 7 aa, Mycobacterium
AAPAAEA

SEQ ID NO: 998408 - protein, 23 aa, Mycobacterium
AAPAAGAASTTGPAFDADGAAAA

SEQ ID NO: 998409 - protein, 9 aa, Mycobacterium
AAPAALAAS

SEQ ID NO: 998410 - protein, 21 aa, Mycobacterium
AAPAAPARSVNPVAPAGRRGC

SEQ ID NO: 998411 - protein, 14 aa, Mycobacterium
AAPAATSPRPGPVN

SEQ ID NO: 998412 - protein, 12 aa, Mycobacterium
AAPAATSSMPDP

SEQ ID NO: 998413 - protein, 8 aa, Mycobacterium
AAPADDGL

SEQ ID NO: 998414 - protein, 6 aa, Mycobacterium
AAPAEN

SEQ ID NO: 998415 - protein, 26 aa, Mycobacterium
AAPALTSGTTALDGSGWAVPQGSGVV

SEQ ID NO: 998416 - protein, 6 aa, Mycobacterium
AAPAPD

SEQ ID NO: 998417 - protein, 7 aa, Mycobacterium
AAPAQRA

SEQ ID NO: 998418 - protein, 10 aa, Mycobacterium
AAPATPAKKN

SEQ ID NO: 998419 - protein, 7 aa, Mycobacterium
AAPAYAE

SEQ ID NO: 998420 - protein, 18 aa, Mycobacterium
AAPCPEPNFPGVPQAELG

SEQ ID NO: 998421 - protein, 7 aa, Mycobacterium
AAPDDVD

SEQ ID NO: 998422 - protein, 8 aa, Mycobacterium
AAPDGRTV

SEQ ID NO: 998423 - protein, 5 aa, Mycobacterium
AAPDL

SEQ ID NO: 998424 - protein, 5 aa, Mycobacterium
AAPDQ

SEQ ID NO: 998425 - protein, 7 aa, Mycobacterium
AAPDTGN

SEQ ID NO: 998426 - protein, 9 aa, Mycobacterium
AAPDYGRDE

SEQ ID NO: 998427 - protein, 9 aa, Mycobacterium
AAPEESAAS

SEQ ID NO: 998428 - protein, 8 aa, Mycobacterium
AAPEPPRV

SEQ ID NO: 998429 - protein, 8 aa, Mycobacterium
AAPEPRTK

SEQ ID NO: 998430 - protein, 6 aa, Mycobacterium
AAPERA

SEQ ID NO: 998431 - protein, 8 aa, Mycobacterium
AAPESDRD

SEQ ID NO: 998432 - protein, 10 aa, Mycobacterium
AAPESGEQEL

SEQ ID NO: 998433 - protein, 4 aa, Mycobacterium
AAPG

SEQ ID NO: 998434 - protein, 5 aa, Mycobacterium
AAPGA

SEQ ID NO: 998435 - protein, 7 aa, Mycobacterium
AAPGAMA

SEQ ID NO: 998436 - protein, 9 aa, Mycobacterium
AAPGDGGKI

SEQ ID NO: 998437 - protein, 9 aa, Mycobacterium
AAPGNVPSL

SEQ ID NO: 998438 - protein, 5 aa, Mycobacterium
AAPGP

SEQ ID NO: 998439 - protein, 16 aa, Mycobacterium
AAPGPDGRPRAVARAS

SEQ ID NO: 998440 - protein, 6 aa, Mycobacterium
AAPGQV

SEQ ID NO: 998441 - protein, 6 aa, Mycobacterium
AAPGRI

SEQ ID NO: 998442 - protein, 13 aa, Mycobacterium
AAPHGRNEGSRCA

SEQ ID NO: 998443 - protein, 6 aa, Mycobacterium
AAPHQP

SEQ ID NO: 998444 - protein, 7 aa, Mycobacterium
AAPIPKE

SEQ ID NO: 998445 - protein, 7 aa, Mycobacterium
AAPKSAG

SEQ ID NO: 998446 - protein, 7 aa, Mycobacterium
AAPKYAA

SEQ ID NO: 998447 - protein, 4 aa, Mycobacterium
AAPL

SEQ ID NO: 998448 - protein, 8 aa, Mycobacterium
AAPLPDAR

SEQ ID NO: 998449 - protein, 10 aa, Mycobacterium
AAPLPPGKGP

SEQ ID NO: 998450 - protein, 5 aa, Mycobacterium
AAPNQ

SEQ ID NO: 998451 - protein, 9 aa, Mycobacterium
AAPPADQIA

SEQ ID NO: 998452 - protein, 8 aa, Mycobacterium
AAPPAELS

SEQ ID NO: 998453 - protein, 8 aa, Mycobacterium
AAPPAGHG

SEQ ID NO: 998454 - protein, 8 aa, Mycobacterium
AAPPDDHG

SEQ ID NO: 998455 - protein, 7 aa, Mycobacterium
AAPPDPL

SEQ ID NO: 998456 - protein, 7 aa, Mycobacterium
AAPPMPP

SEQ ID NO: 998457 - protein, 8 aa, Mycobacterium
AAPPNAAD

SEQ ID NO: 998458 - protein, 9 aa, Mycobacterium
AAPPPAATR

SEQ ID NO: 998459 - protein, 9 aa, Mycobacterium
AAPPPGDRR

SEQ ID NO: 998460 - protein, 11 aa, Mycobacterium
AAPPPQPSAAQ

SEQ ID NO: 998461 - protein, 6 aa, Mycobacterium
AAPPTA

SEQ ID NO: 998462 - protein, 9 aa, Mycobacterium
AAPPTGCGY

SEQ ID NO: 998463 - protein, 10 aa, Mycobacterium
AAPQGEDEGD

SEQ ID NO: 998464 - protein, 13 aa, Mycobacterium
AAPQQHRVFRWRR

SEQ ID NO: 998465 - protein, 4 aa, Mycobacterium
AAPR

SEQ ID NO: 998466 - protein, 5 aa, Mycobacterium
AAPRG

SEQ ID NO: 998467 - protein, 18 aa, Mycobacterium
AAPRGALAGAPRSPGPRY

SEQ ID NO: 998468 - protein, 11 aa, Mycobacterium
AAPSARGHQKD

SEQ ID NO: 998469 - protein, 5 aa, Mycobacterium
AAPSD

SEQ ID NO: 998470 - protein, 7 aa, Mycobacterium
AAPSESY

SEQ ID NO: 998471 - protein, 14 aa, Mycobacterium
AAPSTGPGAGPPNH

SEQ ID NO: 998472 - protein, 4 aa, Mycobacterium
AAPT

SEQ ID NO: 998473 - protein, 6 aa, Mycobacterium
AAPTAG

SEQ ID NO: 998474 - protein, 7 aa, Mycobacterium
AAPTDTA

SEQ ID NO: 998475 - protein, 6 aa, Mycobacterium
AAPTGY

SEQ ID NO: 998476 - protein, 7 aa, Mycobacterium
AAPTQSI

SEQ ID NO: 998477 - protein, 10 aa, Mycobacterium
AAPVQSATEY

SEQ ID NO: 998478 - protein, 6 aa, Mycobacterium
AAPYGI

SEQ ID NO: 998479 - protein, 5 aa, Mycobacterium
AAQAA

SEQ ID NO: 998480 - protein, 14 aa, Mycobacterium
AAQAAGTAGRASAA

SEQ ID NO: 998481 - protein, 19 aa, Mycobacterium
AAQAATRAATNATDGPASE

SEQ ID NO: 998482 - protein, 8 aa, Mycobacterium
AAQAERAA

SEQ ID NO: 998483 - protein, 10 aa, Mycobacterium
AAQAGQAATQ

SEQ ID NO: 998484 - protein, 7 aa, Mycobacterium
AAQAKQP

SEQ ID NO: 998485 - protein, 10 aa, Mycobacterium
AAQARNDGVS

SEQ ID NO: 998486 - protein, 8 aa, Mycobacterium
AAQATTLG

SEQ ID NO: 998487 - protein, 9 aa, Mycobacterium
AAQDPRGLG

SEQ ID NO: 998488 - protein, 12 aa, Mycobacterium
AAQEELRRAGEA

SEQ ID NO: 998489 - protein, 7 aa, Mycobacterium
AAQEEQN

SEQ ID NO: 998490 - protein, 11 aa, Mycobacterium
AAQGDNSYFPQ

SEQ ID NO: 998491 - protein, 7 aa, Mycobacterium
AAQGEKR

SEQ ID NO: 998492 - protein, 8 aa, Mycobacterium
AAQGEPGV

SEQ ID NO: 998493 - protein, 7 aa, Mycobacterium
AAQGPRR

SEQ ID NO: 998494 - protein, 13 aa, Mycobacterium
AAQGQPDGPGADL

SEQ ID NO: 998495 - protein, 13 aa, Mycobacterium
AAQITGGPNAPVI

SEQ ID NO: 998496 - protein, 6 aa, Mycobacterium
AAQLDG

SEQ ID NO: 998497 - protein, 5 aa, Mycobacterium
AAQLG

SEQ ID NO: 998498 - protein, 5 aa, Mycobacterium
AAQMD

SEQ ID NO: 998499 - protein, 6 aa, Mycobacterium
AAQPAD

SEQ ID NO: 998500 - protein, 7 aa, Mycobacterium
AAQPAMS

SEQ ID NO: 998501 - protein, 9 aa, Mycobacterium
AAQPEHQSA

SEQ ID NO: 998502 - protein, 6 aa, Mycobacterium
AAQPEW

SEQ ID NO: 998503 - protein, 11 aa, Mycobacterium
AAQPIPDDADF

SEQ ID NO: 998504 - protein, 5 aa, Mycobacterium
AAQPL

SEQ ID NO: 998505 - protein, 23 aa, Mycobacterium
AAQPPPTRTAPWAERAARAATAP

SEQ ID NO: 998506 - protein, 7 aa, Mycobacterium
AAQQSVD

SEQ ID NO: 998507 - protein, 5 aa, Mycobacterium
AAQRG

SEQ ID NO: 998508 - protein, 12 aa, Mycobacterium
AAQRGGVPGLRR

SEQ ID NO: 998509 - protein, 9 aa, Mycobacterium
AAQRGRADE

SEQ ID NO: 998510 - protein, 6 aa, Mycobacterium
AAQRPV

SEQ ID NO: 998511 - protein, 10 aa, Mycobacterium
AAQRYSGTAD

SEQ ID NO: 998512 - protein, 10 aa, Mycobacterium
AAQSATITDR

SEQ ID NO: 998513 - protein, 5 aa, Mycobacterium
AAQSD

SEQ ID NO: 998514 - protein, 9 aa, Mycobacterium
AAQSGWQGA

SEQ ID NO: 998515 - protein, 6 aa, Mycobacterium
AAQSID

SEQ ID NO: 998516 - protein, 6 aa, Mycobacterium
AAQSPT

SEQ ID NO: 998517 - protein, 16 aa, Mycobacterium
AAQSYRSTNPTEAIAQ

SEQ ID NO: 998518 - protein, 5 aa, Mycobacterium
AAQTG

SEQ ID NO: 998519 - protein, 7 aa, Mycobacterium
AAQTMQQ

SEQ ID NO: 998520 - protein, 13 aa, Mycobacterium
AAQTPGSLHEGGE

SEQ ID NO: 998521 - protein, 8 aa, Mycobacterium
AAQTVRTG

SEQ ID NO: 998522 - protein, 28 aa, Mycobacterium
AAQVPGGPGGPAGSDRAPAPTAAPRAEQ

SEQ ID NO: 998523 - protein, 4 aa, Mycobacterium
AARA

SEQ ID NO: 998524 - protein, 6 aa, Mycobacterium
AARAAG

SEQ ID NO: 998525 - protein, 12 aa, Mycobacterium
AARAAGAAGQAK

SEQ ID NO: 998526 - protein, 14 aa, Mycobacterium
AARAAGAGGQAQAV

SEQ ID NO: 998527 - protein, 13 aa, Mycobacterium
AARAASSGGGLRQ

SEQ ID NO: 998528 - protein, 10 aa, Mycobacterium
AARAATTGPI

SEQ ID NO: 998529 - protein, 7 aa, Mycobacterium
AARAKYG

SEQ ID NO: 998530 - protein, 7 aa, Mycobacterium
AARAPER

SEQ ID NO: 998531 - protein, 10 aa, Mycobacterium
AARARDEGLI

SEQ ID NO: 998532 - protein, 6 aa, Mycobacterium
AARARG

SEQ ID NO: 998533 - protein, 7 aa, Mycobacterium
AARARSS

SEQ ID NO: 998534 - protein, 9 aa, Mycobacterium
AARASESGQ

SEQ ID NO: 998535 - protein, 8 aa, Mycobacterium
AARATELA

SEQ ID NO: 998536 - protein, 6 aa, Mycobacterium
AARATG

SEQ ID NO: 998537 - protein, 6 aa, Mycobacterium
AARATT

SEQ ID NO: 998538 - protein, 8 aa, Mycobacterium
AARDAEGV

SEQ ID NO: 998539 - protein, 9 aa, Mycobacterium
AARDDGGAI

SEQ ID NO: 998540 - protein, 9 aa, Mycobacterium
AARDDSAAR

SEQ ID NO: 998541 - protein, 19 aa, Mycobacterium
AARDPEGAGAVATDRSAEP

SEQ ID NO: 998542 - protein, 7 aa, Mycobacterium
AARDRAI

SEQ ID NO: 998543 - protein, 10 aa, Mycobacterium
AARDTFNRRR

SEQ ID NO: 998544 - protein, 5 aa, Mycobacterium
AARDV

SEQ ID NO: 998545 - protein, 8 aa, Mycobacterium
AAREASAT

SEQ ID NO: 998546 - protein, 11 aa, Mycobacterium
AAREDVERTGA

SEQ ID NO: 998547 - protein, 6 aa, Mycobacterium
AAREEL

SEQ ID NO: 998548 - protein, 13 aa, Mycobacterium
AARENAKSAREVT

SEQ ID NO: 998549 - protein, 5 aa, Mycobacterium
AAREP

SEQ ID NO: 998550 - protein, 16 aa, Mycobacterium
AAREPGGSAAACGGQP

SEQ ID NO: 998551 - protein, 8 aa, Mycobacterium
AARETDQG

SEQ ID NO: 998552 - protein, 13 aa, Mycobacterium
AARETFKRRRGSH

SEQ ID NO: 998553 - protein, 7 aa, Mycobacterium
AARETLD

SEQ ID NO: 998554 - protein, 9 aa, Mycobacterium
AARGAIDRG

SEQ ID NO: 998555 - protein, 9 aa, Mycobacterium
AARGDGGAA

SEQ ID NO: 998556 - protein, 7 aa, Mycobacterium
AARGEVR

SEQ ID NO: 998557 - protein, 5 aa, Mycobacterium
AARGL

SEQ ID NO: 998558 - protein, 6 aa, Mycobacterium
AARGPL

SEQ ID NO: 998559 - protein, 8 aa, Mycobacterium
AARGQGRA

SEQ ID NO: 998560 - protein, 7 aa, Mycobacterium
AARGQVR

SEQ ID NO: 998561 - protein, 9 aa, Mycobacterium
AARGVGKGV

SEQ ID NO: 998562 - protein, 5 aa, Mycobacterium
AARHP

SEQ ID NO: 998563 - protein, 14 aa, Mycobacterium
AARITAGKQCEDQR

SEQ ID NO: 998564 - protein, 7 aa, Mycobacterium
AARKAGH

SEQ ID NO: 998565 - protein, 7 aa, Mycobacterium
AARKNGL

SEQ ID NO: 998566 - protein, 12 aa, Mycobacterium
AARKPGSSRPTF

SEQ ID NO: 998567 - protein, 7 aa, Mycobacterium
AARLARD

SEQ ID NO: 998568 - protein, 12 aa, Mycobacterium
AARNETAGRREE

SEQ ID NO: 998569 - protein, 7 aa, Mycobacterium
AARNPSR

SEQ ID NO: 998570 - protein, 8 aa, Mycobacterium
AARNQGGD

SEQ ID NO: 998571 - protein, 5 aa, Mycobacterium
AARNR

SEQ ID NO: 998572 - protein, 5 aa, Mycobacterium
AARNS

SEQ ID NO: 998573 - protein, 16 aa, Mycobacterium
AARPGAPAVGVLYHRW

SEQ ID NO: 998574 - protein, 6 aa, Mycobacterium
AARPPA

SEQ ID NO: 998575 - protein, 9 aa, Mycobacterium
AARPQYTDP

SEQ ID NO: 998576 - protein, 12 aa, Mycobacterium
AARPWADRRPPV

SEQ ID NO: 998577 - protein, 5 aa, Mycobacterium
AARQA

SEQ ID NO: 998578 - protein, 10 aa, Mycobacterium
AARQAADKVA

SEQ ID NO: 998579 - protein, 12 aa, Mycobacterium
AARQRDPARPTT

SEQ ID NO: 998580 - protein, 4 aa, Mycobacterium
AARR

SEQ ID NO: 998581 - protein, 5 aa, Mycobacterium
AARRL

SEQ ID NO: 998582 - protein, 8 aa, Mycobacterium
AARRNGAR

SEQ ID NO: 998583 - protein, 12 aa, Mycobacterium
AARRQTVRPSLD

SEQ ID NO: 998584 - protein, 10 aa, Mycobacterium
AARRTGTTAT

SEQ ID NO: 998585 - protein, 4 aa, Mycobacterium
AARS

SEQ ID NO: 998586 - protein, 82 aa, Mycobacterium
AARSAPGAGGRGNPPAPAPSQPSEPLREQDKATEHASAGPAGAAAGPRAGAAAPVGQKPSSAPIRPAAATTRAAAKTGPTIG

SEQ ID NO: 998587 - protein, 8 aa, Mycobacterium
AARSARQD

SEQ ID NO: 998588 - protein, 6 aa, Mycobacterium
AARSDT

SEQ ID NO: 998589 - protein, 11 aa, Mycobacterium
AARSGRTPDRR

SEQ ID NO: 998590 - protein, 10 aa, Mycobacterium
AARSSPAGPL

SEQ ID NO: 998591 - protein, 4 aa, Mycobacterium
AART

SEQ ID NO: 998592 - protein, 16 aa, Mycobacterium
AARTAARLGETRAHGD

SEQ ID NO: 998593 - protein, 8 aa, Mycobacterium
AARTAEQL

SEQ ID NO: 998594 - protein, 11 aa, Mycobacterium
AARTGNDRHAP

SEQ ID NO: 998595 - protein, 11 aa, Mycobacterium
AARTGPNLAER

SEQ ID NO: 998596 - protein, 5 aa, Mycobacterium
AARTR

SEQ ID NO: 998597 - protein, 54 aa, Mycobacterium
AARVPRAAPEALAETAAPRLETSTPPVPPPRDKRVGTAAPAPTRRESAATAATA

SEQ ID NO: 998598 - protein, 13 aa, Mycobacterium
AARVQPGTALQGN

SEQ ID NO: 998599 - protein, 10 aa, Mycobacterium
AARYGQPGKT

SEQ ID NO: 998600 - protein, 18 aa, Mycobacterium
AARYTASQLGYGGAPQPQ

SEQ ID NO: 998601 - protein, 23 aa, Mycobacterium
AASAAVAGPTTGVTAAAADEVSG

SEQ ID NO: 998602 - protein, 8 aa, Mycobacterium
AASAEPVR

SEQ ID NO: 998603 - protein, 9 aa, Mycobacterium
AASAGLTTS

SEQ ID NO: 998604 - protein, 9 aa, Mycobacterium
AASAGNAQL

SEQ ID NO: 998605 - protein, 14 aa, Mycobacterium
AASAPVGLGSAEAA

SEQ ID NO: 998606 - protein, 14 aa, Mycobacterium
AASAQGAADPPPVP

SEQ ID NO: 998607 - protein, 8 aa, Mycobacterium
AASARENA

SEQ ID NO: 998608 - protein, 8 aa, Mycobacterium
AASASTQL

SEQ ID NO: 998609 - protein, 6 aa, Mycobacterium
AASAWS

SEQ ID NO: 998610 - protein, 4 aa, Mycobacterium
AASD

SEQ ID NO: 998611 - protein, 9 aa, Mycobacterium
AASDATGRA

SEQ ID NO: 998612 - protein, 9 aa, Mycobacterium
AASDEGELD

SEQ ID NO: 998613 - protein, 16 aa, Mycobacterium
AASDPTGANFNLSSLR

SEQ ID NO: 998614 - protein, 16 aa, Mycobacterium
AASDRALAGRPVPSTS

SEQ ID NO: 998615 - protein, 8 aa, Mycobacterium
AASEAGVE

SEQ ID NO: 998616 - protein, 13 aa, Mycobacterium
AASEETLGPDATR

SEQ ID NO: 998617 - protein, 9 aa, Mycobacterium
AASEGPPHV

SEQ ID NO: 998618 - protein, 13 aa, Mycobacterium
AASEVGPRAYRAA

SEQ ID NO: 998619 - protein, 6 aa, Mycobacterium
AASFQT

SEQ ID NO: 998620 - protein, 19 aa, Mycobacterium
AASGAPVRPSRGLLAAILG

SEQ ID NO: 998621 - protein, 6 aa, Mycobacterium
AASGDM

SEQ ID NO: 998622 - protein, 19 aa, Mycobacterium
AASGKQGMGSNRDGAAGAD

SEQ ID NO: 998623 - protein, 8 aa, Mycobacterium
AASGQSEL

SEQ ID NO: 998624 - protein, 5 aa, Mycobacterium
AASGR

SEQ ID NO: 998625 - protein, 11 aa, Mycobacterium
AASGRQPPDGD

SEQ ID NO: 998626 - protein, 12 aa, Mycobacterium
AASGSAGDVGAH

SEQ ID NO: 998627 - protein, 8 aa, Mycobacterium
AASGSARG

SEQ ID NO: 998628 - protein, 76 aa, Mycobacterium
AASGTDGLSGPAAQTGGAGADGNPGQQGGTGGTGGTGGISTSPNQAGGGGIGGTGGIGAPGGAGGHGGGGGAGGRG

SEQ ID NO: 998629 - protein, 10 aa, Mycobacterium
AASGTPEVGR

SEQ ID NO: 998630 - protein, 15 aa, Mycobacterium
AASHDKAARATKDGL

SEQ ID NO: 998631 - protein, 4 aa, Mycobacterium
AASK

SEQ ID NO: 998632 - protein, 8 aa, Mycobacterium
AASKGGVQ

SEQ ID NO: 998633 - protein, 4 aa, Mycobacterium
AASL

SEQ ID NO: 998634 - protein, 7 aa, Mycobacterium
AASLAGK

SEQ ID NO: 998635 - protein, 10 aa, Mycobacterium
AASLDRLSGG

SEQ ID NO: 998636 - protein, 7 aa, Mycobacterium
AASLTRR

SEQ ID NO: 998637 - protein, 4 aa, Mycobacterium
AASN

SEQ ID NO: 998638 - protein, 18 aa, Mycobacterium
AASNEAVASRKKDPRLHN

SEQ ID NO: 998639 - protein, 10 aa, Mycobacterium
AASNGRRPGS

SEQ ID NO: 998640 - protein, 9 aa, Mycobacterium
AASNGYAGP

SEQ ID NO: 998641 - protein, 5 aa, Mycobacterium
AASNR

SEQ ID NO: 998642 - protein, 10 aa, Mycobacterium
AASPANTASF

SEQ ID NO: 998643 - protein, 10 aa, Mycobacterium
AASPASPESL

SEQ ID NO: 998644 - protein, 17 aa, Mycobacterium
AASPVLSGGQKGPHPIQ

SEQ ID NO: 998645 - protein, 12 aa, Mycobacterium
AASQEAQRRGLS

SEQ ID NO: 998646 - protein, 4 aa, Mycobacterium
AASR

SEQ ID NO: 998647 - protein, 16 aa, Mycobacterium
AASRASTDGQPPELNQ

SEQ ID NO: 998648 - protein, 6 aa, Mycobacterium
AASRDH

SEQ ID NO: 998649 - protein, 13 aa, Mycobacterium
AASREAESAFGDP

SEQ ID NO: 998650 - protein, 15 aa, Mycobacterium
AASREVTRGGTPISL

SEQ ID NO: 998651 - protein, 8 aa, Mycobacterium
AASRYAAS

SEQ ID NO: 998652 - protein, 11 aa, Mycobacterium
AASSAAAPRSF

SEQ ID NO: 998653 - protein, 7 aa, Mycobacterium
AASSDDI

SEQ ID NO: 998654 - protein, 10 aa, Mycobacterium
AASSGGISTT

SEQ ID NO: 998655 - protein, 8 aa, Mycobacterium
AASSPEKL

SEQ ID NO: 998656 - protein, 9 aa, Mycobacterium
AASSPFGGE

SEQ ID NO: 998657 - protein, 21 aa, Mycobacterium
AASSSPALSRSESRDGTGAAL

SEQ ID NO: 998658 - protein, 9 aa, Mycobacterium
AASSSVTEA

SEQ ID NO: 998659 - protein, 46 aa, Mycobacterium
AASSTSGSLQPLSTPQQTTNPGGLAAQSAAVSQAAASAAATDGTTS

SEQ ID NO: 998660 - protein, 4 aa, Mycobacterium
AAST

SEQ ID NO: 998661 - protein, 5 aa, Mycobacterium
AASTF

SEQ ID NO: 998662 - protein, 6 aa, Mycobacterium
AASTGA

SEQ ID NO: 998663 - protein, 15 aa, Mycobacterium
AASTRAAAAATQAKA

SEQ ID NO: 998664 - protein, 6 aa, Mycobacterium
AASTRL

SEQ ID NO: 998665 - protein, 7 aa, Mycobacterium
AASTTAV

SEQ ID NO: 998666 - protein, 6 aa, Mycobacterium
AASTTF

SEQ ID NO: 998667 - protein, 13 aa, Mycobacterium
AASTTRAFSSSPV

SEQ ID NO: 998668 - protein, 7 aa, Mycobacterium
AASVASA

SEQ ID NO: 998669 - protein, 9 aa, Mycobacterium
AASYTTTDL

SEQ ID NO: 998670 - protein, 16 aa, Mycobacterium
AATAAEHEAAAGAYTS

SEQ ID NO: 998671 - protein, 10 aa, Mycobacterium
AATAAPAGIS

SEQ ID NO: 998672 - protein, 10 aa, Mycobacterium
AATADAPNAL

SEQ ID NO: 998673 - protein, 5 aa, Mycobacterium
AATAE

SEQ ID NO: 998674 - protein, 10 aa, Mycobacterium
AATAEAKRQN

SEQ ID NO: 998675 - protein, 6 aa, Mycobacterium
AATAEF

SEQ ID NO: 998676 - protein, 9 aa, Mycobacterium
AATAERDAE

SEQ ID NO: 998677 - protein, 9 aa, Mycobacterium
AATAGGSNA

SEQ ID NO: 998678 - protein, 8 aa, Mycobacterium
AATAGGYS

SEQ ID NO: 998679 - protein, 8 aa, Mycobacterium
AATAGRDH

SEQ ID NO: 998680 - protein, 8 aa, Mycobacterium
AATAPASS

SEQ ID NO: 998681 - protein, 15 aa, Mycobacterium
AATAPGTADKIVVTF

SEQ ID NO: 998682 - protein, 10 aa, Mycobacterium
AATAPPATYP

SEQ ID NO: 998683 - protein, 5 aa, Mycobacterium
AATAQ

SEQ ID NO: 998684 - protein, 7 aa, Mycobacterium
AATARSE

SEQ ID NO: 998685 - protein, 7 aa, Mycobacterium
AATATHG

SEQ ID NO: 998686 - protein, 12 aa, Mycobacterium
AATATSAGALPA

SEQ ID NO: 998687 - protein, 7 aa, Mycobacterium
AATDDPI

SEQ ID NO: 998688 - protein, 6 aa, Mycobacterium
AATDDS

SEQ ID NO: 998689 - protein, 7 aa, Mycobacterium
AATDETL

SEQ ID NO: 998690 - protein, 11 aa, Mycobacterium
AATDPAGKPAE

SEQ ID NO: 998691 - protein, 5 aa, Mycobacterium
AATDR

SEQ ID NO: 998692 - protein, 8 aa, Mycobacterium
AATDRPDR

SEQ ID NO: 998693 - protein, 4 aa, Mycobacterium
AATE

SEQ ID NO: 998694 - protein, 16 aa, Mycobacterium
AATEERYSDGSGTGSI

SEQ ID NO: 998695 - protein, 5 aa, Mycobacterium
AATEQ

SEQ ID NO: 998696 - protein, 17 aa, Mycobacterium
AATETELKKRKESVEDA

SEQ ID NO: 998697 - protein, 11 aa, Mycobacterium
AATGADPVFPG

SEQ ID NO: 998698 - protein, 8 aa, Mycobacterium
AATGATPV

SEQ ID NO: 998699 - protein, 14 aa, Mycobacterium
AATGAVQVSSQAKA

SEQ ID NO: 998700 - protein, 5 aa, Mycobacterium
AATGD

SEQ ID NO: 998701 - protein, 11 aa, Mycobacterium
AATGEPGCATN

SEQ ID NO: 998702 - protein, 5 aa, Mycobacterium
AATGG

SEQ ID NO: 998703 - protein, 29 aa, Mycobacterium
AATGGDGGDSGGGGAGGNGGAGGAGGHGS

SEQ ID NO: 998704 - protein, 7 aa, Mycobacterium
AATGGRG

SEQ ID NO: 998705 - protein, 6 aa, Mycobacterium
AATGKP

SEQ ID NO: 998706 - protein, 11 aa, Mycobacterium
AATGLDTAAQT

SEQ ID NO: 998707 - protein, 10 aa, Mycobacterium
AATGPARQDG

SEQ ID NO: 998708 - protein, 10 aa, Mycobacterium
AATGSSGPGL

SEQ ID NO: 998709 - protein, 19 aa, Mycobacterium
AATGSVRGPAFRSSYGSST

SEQ ID NO: 998710 - protein, 8 aa, Mycobacterium
AATGTDTF

SEQ ID NO: 998711 - protein, 6 aa, Mycobacterium
AATGTG

SEQ ID NO: 998712 - protein, 4 aa, Mycobacterium
AATI

SEQ ID NO: 998713 - protein, 13 aa, Mycobacterium
AATKAAAERGLGN

SEQ ID NO: 998714 - protein, 16 aa, Mycobacterium
AATKAKSLLDQEGRDD

SEQ ID NO: 998715 - protein, 20 aa, Mycobacterium
AATKKPPGDSFKDGSYDPSR

SEQ ID NO: 998716 - protein, 11 aa, Mycobacterium
AATKSGANAIH

SEQ ID NO: 998717 - protein, 11 aa, Mycobacterium
AATLSGGEAQR

SEQ ID NO: 998718 - protein, 9 aa, Mycobacterium
AATNHNTRH

SEQ ID NO: 998719 - protein, 6 aa, Mycobacterium
AATNTV

SEQ ID NO: 998720 - protein, 5 aa, Mycobacterium
AATPA

SEQ ID NO: 998721 - protein, 7 aa, Mycobacterium
AATPAAS

SEQ ID NO: 998722 - protein, 8 aa, Mycobacterium
AATPARAY

SEQ ID NO: 998723 - protein, 8 aa, Mycobacterium
AATPNADR

SEQ ID NO: 998724 - protein, 17 aa, Mycobacterium
AATPPPATVGAPETVPD

SEQ ID NO: 998725 - protein, 19 aa, Mycobacterium
AATPTDAAKKAVPDTAAEQ

SEQ ID NO: 998726 - protein, 6 aa, Mycobacterium
AATPTI

SEQ ID NO: 998727 - protein, 16 aa, Mycobacterium
AATPTTHGQRGAAPGS

SEQ ID NO: 998728 - protein, 37 aa, Mycobacterium
AATQHEQGQQGQQEPDQPVPRRGAEGSAMQQLRSTTG

SEQ ID NO: 998729 - protein, 9 aa, Mycobacterium
AATQRGDYR

SEQ ID NO: 998730 - protein, 4 aa, Mycobacterium
AATR

SEQ ID NO: 998731 - protein, 8 aa, Mycobacterium
AATRGGQR

SEQ ID NO: 998732 - protein, 7 aa, Mycobacterium
AATRGGW

SEQ ID NO: 998733 - protein, 19 aa, Mycobacterium
AATRQGRGWPTDPQLGESV

SEQ ID NO: 998734 - protein, 9 aa, Mycobacterium
AATRQRAQE

SEQ ID NO: 998735 - protein, 4 aa, Mycobacterium
AATS

SEQ ID NO: 998736 - protein, 6 aa, Mycobacterium
AATSAS

SEQ ID NO: 998737 - protein, 14 aa, Mycobacterium
AATSNTLPEQLGEG

SEQ ID NO: 998738 - protein, 8 aa, Mycobacterium
AATSSELP

SEQ ID NO: 998739 - protein, 13 aa, Mycobacterium
AATSYASAEATNV

SEQ ID NO: 998740 - protein, 5 aa, Mycobacterium
AATTA

SEQ ID NO: 998741 - protein, 12 aa, Mycobacterium
AATTAAAAQTTS

SEQ ID NO: 998742 - protein, 12 aa, Mycobacterium
AATTDGVNAAQG

SEQ ID NO: 998743 - protein, 7 aa, Mycobacterium
AATTDSV

SEQ ID NO: 998744 - protein, 5 aa, Mycobacterium
AATTI

SEQ ID NO: 998745 - protein, 11 aa, Mycobacterium
AATTSEYAARG

SEQ ID NO: 998746 - protein, 7 aa, Mycobacterium
AATTTVY

SEQ ID NO: 998747 - protein, 6 aa, Mycobacterium
AATVAE

SEQ ID NO: 998748 - protein, 7 aa, Mycobacterium
AATVPKG

SEQ ID NO: 998749 - protein, 5 aa, Mycobacterium
AATVS

SEQ ID NO: 998750 - protein, 14 aa, Mycobacterium
AATVTDTDGNTIDT

SEQ ID NO: 998751 - protein, 5 aa, Mycobacterium
AAVDA

SEQ ID NO: 998752 - protein, 17 aa, Mycobacterium
AAVDGNNATSWAPNGTA

SEQ ID NO: 998753 - protein, 13 aa, Mycobacterium
AAVEKAAKDGGHE

SEQ ID NO: 998754 - protein, 9 aa, Mycobacterium
AAVGDAELG

SEQ ID NO: 998755 - protein, 6 aa, Mycobacterium
AAVGGE

SEQ ID NO: 998756 - protein, 14 aa, Mycobacterium
AAVGQAIDSAAAGQ

SEQ ID NO: 998757 - protein, 13 aa, Mycobacterium
AAVPAEAQQPPGI

SEQ ID NO: 998758 - protein, 6 aa, Mycobacterium
AAVPTT

SEQ ID NO: 998759 - protein, 11 aa, Mycobacterium
AAVRGDPARQV

SEQ ID NO: 998760 - protein, 5 aa, Mycobacterium
AAVSD

SEQ ID NO: 998761 - protein, 6 aa, Mycobacterium
AAVSDI

SEQ ID NO: 998762 - protein, 9 aa, Mycobacterium
AAVSGRPEA

SEQ ID NO: 998763 - protein, 8 aa, Mycobacterium
AAVSPDDV

SEQ ID NO: 998764 - protein, 4 aa, Mycobacterium
AAVT

SEQ ID NO: 998765 - protein, 14 aa, Mycobacterium
AAVTGNGTADKAQV

SEQ ID NO: 998766 - protein, 4 aa, Mycobacterium
AAVY

SEQ ID NO: 998767 - protein, 8 aa, Mycobacterium
AAWPGTDR

SEQ ID NO: 998768 - protein, 12 aa, Mycobacterium
AAYAGAEATAKQ

SEQ ID NO: 998769 - protein, 8 aa, Mycobacterium
AAYAQADN

SEQ ID NO: 998770 - protein, 13 aa, Mycobacterium
AAYERGRPSYPPE

SEQ ID NO: 998771 - protein, 9 aa, Mycobacterium
AAYGNEAAV

SEQ ID NO: 998772 - protein, 11 aa, Mycobacterium
AAYGQPPPVRR

SEQ ID NO: 998773 - protein, 5 aa, Mycobacterium
ACAGP

SEQ ID NO: 998774 - protein, 5 aa, Mycobacterium
ACAPG

SEQ ID NO: 998775 - protein, 6 aa, Mycobacterium
ACGEKG

SEQ ID NO: 998776 - protein, 11 aa, Mycobacterium
ACGEPAHDPDF

SEQ ID NO: 998777 - protein, 7 aa, Mycobacterium
ACGSPRN

SEQ ID NO: 998778 - protein, 5 aa, Mycobacterium
ACPGQ

SEQ ID NO: 998779 - protein, 12 aa, Mycobacterium
ACPKKTEISERV

SEQ ID NO: 998780 - protein, 8 aa, Mycobacterium
ACSRQGLE

SEQ ID NO: 998781 - protein, 4 aa, Mycobacterium
ACSS

SEQ ID NO: 998782 - protein, 5 aa, Mycobacterium
ACSSS

SEQ ID NO: 998783 - protein, 4 aa, Mycobacterium
ACST

SEQ ID NO: 998784 - protein, 7 aa, Mycobacterium
ACTAEAD

SEQ ID NO: 998785 - protein, 35 aa, Mycobacterium
ACTPRDAAAQPGGHSAARTGMGPYARTTGCAQGGG

SEQ ID NO: 998786 - protein, 13 aa, Mycobacterium
ACTTEDRAPRNDV

SEQ ID NO: 998787 - protein, 4 aa, Mycobacterium
ADAA

SEQ ID NO: 998788 - protein, 17 aa, Mycobacterium
ADAAAADRRRAAGDAAP

SEQ ID NO: 998789 - protein, 8 aa, Mycobacterium
ADAAAGDE

SEQ ID NO: 998790 - protein, 15 aa, Mycobacterium
ADAAAGSNQPTYSRQ

SEQ ID NO: 998791 - protein, 12 aa, Mycobacterium
ADAAAQAERAGG

SEQ ID NO: 998792 - protein, 13 aa, Mycobacterium
ADAADGPDAVSPN

SEQ ID NO: 998793 - protein, 19 aa, Mycobacterium
ADAAEDALRTTGSGALGGA

SEQ ID NO: 998794 - protein, 7 aa, Mycobacterium
ADAAEGV

SEQ ID NO: 998795 - protein, 5 aa, Mycobacterium
ADAAG

SEQ ID NO: 998796 - protein, 13 aa, Mycobacterium
ADAAGRDKVAERL

SEQ ID NO: 998797 - protein, 6 aa, Mycobacterium
ADAAPI

SEQ ID NO: 998798 - protein, 10 aa, Mycobacterium
ADAAQREPGR

SEQ ID NO: 998799 - protein, 5 aa, Mycobacterium
ADAAS

SEQ ID NO: 998800 - protein, 13 aa, Mycobacterium
ADAATDALTPGPV

SEQ ID NO: 998801 - protein, 5 aa, Mycobacterium
ADADD

SEQ ID NO: 998802 - protein, 13 aa, Mycobacterium
ADADDDHSDHDMG

SEQ ID NO: 998803 - protein, 11 aa, Mycobacterium
ADADGAGGNRF

SEQ ID NO: 998804 - protein, 9 aa, Mycobacterium
ADADGRPDL

SEQ ID NO: 998805 - protein, 6 aa, Mycobacterium
ADADQA

SEQ ID NO: 998806 - protein, 7 aa, Mycobacterium
ADADRDA

SEQ ID NO: 998807 - protein, 6 aa, Mycobacterium
ADADSL

SEQ ID NO: 998808 - protein, 11 aa, Mycobacterium
ADADTAPARQA

SEQ ID NO: 998809 - protein, 4 aa, Mycobacterium
ADAE

SEQ ID NO: 998810 - protein, 7 aa, Mycobacterium
ADAEAEH

SEQ ID NO: 998811 - protein, 8 aa, Mycobacterium
ADAERGLG

SEQ ID NO: 998812 - protein, 9 aa, Mycobacterium
ADAFDGSSG

SEQ ID NO: 998813 - protein, 4 aa, Mycobacterium
ADAG

SEQ ID NO: 998814 - protein, 5 aa, Mycobacterium
ADAGA

SEQ ID NO: 998815 - protein, 7 aa, Mycobacterium
ADAGDAG

SEQ ID NO: 998816 - protein, 5 aa, Mycobacterium
ADAGF

SEQ ID NO: 998817 - protein, 14 aa, Mycobacterium
ADAGRVRTLGDTGT

SEQ ID NO: 998818 - protein, 7 aa, Mycobacterium
ADAGRVS

SEQ ID NO: 998819 - protein, 8 aa, Mycobacterium
ADAGTQSR

SEQ ID NO: 998820 - protein, 8 aa, Mycobacterium
ADAGTRSQ

SEQ ID NO: 998821 - protein, 13 aa, Mycobacterium
ADAGVEAPAGGAA

SEQ ID NO: 998822 - protein, 6 aa, Mycobacterium
ADAGVS

SEQ ID NO: 998823 - protein, 5 aa, Mycobacterium
ADALA

SEQ ID NO: 998824 - protein, 6 aa, Mycobacterium
ADALGG

SEQ ID NO: 998825 - protein, 7 aa, Mycobacterium
ADANTNA

SEQ ID NO: 998826 - protein, 18 aa, Mycobacterium
ADAPAADPPTQRRPSQRR

SEQ ID NO: 998827 - protein, 8 aa, Mycobacterium
ADAPDTRR

SEQ ID NO: 998828 - protein, 9 aa, Mycobacterium
ADAPNGRAA

SEQ ID NO: 998829 - protein, 8 aa, Mycobacterium
ADAPQVAS

SEQ ID NO: 998830 - protein, 23 aa, Mycobacterium
ADAPRVERGTERYRIGADGQTVF

SEQ ID NO: 998831 - protein, 4 aa, Mycobacterium
ADAQ

SEQ ID NO: 998832 - protein, 7 aa, Mycobacterium
ADAQPRE

SEQ ID NO: 998833 - protein, 8 aa, Mycobacterium
ADAQRPPL

SEQ ID NO: 998834 - protein, 8 aa, Mycobacterium
ADAQTRSV

SEQ ID NO: 998835 - protein, 9 aa, Mycobacterium
ADARHPPEV

SEQ ID NO: 998836 - protein, 5 aa, Mycobacterium
ADARR

SEQ ID NO: 998837 - protein, 16 aa, Mycobacterium
ADARREKESAIDAQDF

SEQ ID NO: 998838 - protein, 7 aa, Mycobacterium
ADARSRW

SEQ ID NO: 998839 - protein, 4 aa, Mycobacterium
ADAS

SEQ ID NO: 998840 - protein, 9 aa, Mycobacterium
ADASHPATT

SEQ ID NO: 998841 - protein, 8 aa, Mycobacterium
ADASNLAD

SEQ ID NO: 998842 - protein, 7 aa, Mycobacterium
ADASPDG

SEQ ID NO: 998843 - protein, 5 aa, Mycobacterium
ADASQ

SEQ ID NO: 998844 - protein, 6 aa, Mycobacterium
ADASTV

SEQ ID NO: 998845 - protein, 4 aa, Mycobacterium
ADAT

SEQ ID NO: 998846 - protein, 8 aa, Mycobacterium
ADATDAEL

SEQ ID NO: 998847 - protein, 8 aa, Mycobacterium
ADATDEAA

SEQ ID NO: 998848 - protein, 9 aa, Mycobacterium
ADATGAGHI

SEQ ID NO: 998849 - protein, 17 aa, Mycobacterium
ADATGGNGIVDIQPPFF

SEQ ID NO: 998850 - protein, 21 aa, Mycobacterium
ADAVDGAAAPLAGTTSQPALS

SEQ ID NO: 998851 - protein, 12 aa, Mycobacterium
ADCRGPNPRELA

SEQ ID NO: 998852 - protein, 9 aa, Mycobacterium
ADDAANYGG

SEQ ID NO: 998853 - protein, 9 aa, Mycobacterium
ADDAATALT

SEQ ID NO: 998854 - protein, 8 aa, Mycobacterium
ADDDAADF

SEQ ID NO: 998855 - protein, 7 aa, Mycobacterium
ADDDEDA

SEQ ID NO: 998856 - protein, 8 aa, Mycobacterium
ADDEQTIH

SEQ ID NO: 998857 - protein, 8 aa, Mycobacterium
ADDGAAAG

SEQ ID NO: 998858 - protein, 10 aa, Mycobacterium
ADDGDSYDLE

SEQ ID NO: 998859 - protein, 7 aa, Mycobacterium
ADDGKTL

SEQ ID NO: 998860 - protein, 6 aa, Mycobacterium
ADDGRI

SEQ ID NO: 998861 - protein, 7 aa, Mycobacterium
ADDGRRR

SEQ ID NO: 998862 - protein, 15 aa, Mycobacterium
ADDKQAYSDFVTAER

SEQ ID NO: 998863 - protein, 4 aa, Mycobacterium
ADDL

SEQ ID NO: 998864 - protein, 6 aa, Mycobacterium
ADDLAA

SEQ ID NO: 998865 - protein, 9 aa, Mycobacterium
ADDNDLDEG

SEQ ID NO: 998866 - protein, 9 aa, Mycobacterium
ADDPAAQVT

SEQ ID NO: 998867 - protein, 8 aa, Mycobacterium
ADDPAARR

SEQ ID NO: 998868 - protein, 7 aa, Mycobacterium
ADDPAHA

SEQ ID NO: 998869 - protein, 7 aa, Mycobacterium
ADDPDSY

SEQ ID NO: 998870 - protein, 7 aa, Mycobacterium
ADDPGTI

SEQ ID NO: 998871 - protein, 12 aa, Mycobacterium
ADDPKRARRESR

SEQ ID NO: 998872 - protein, 5 aa, Mycobacterium
ADDPQ

SEQ ID NO: 998873 - protein, 7 aa, Mycobacterium
ADDPRRR

SEQ ID NO: 998874 - protein, 7 aa, Mycobacterium
ADDPRTV

SEQ ID NO: 998875 - protein, 8 aa, Mycobacterium
ADDPTSGV

SEQ ID NO: 998876 - protein, 6 aa, Mycobacterium
ADDPTT

SEQ ID NO: 998877 - protein, 8 aa, Mycobacterium
ADDRGDPV

SEQ ID NO: 998878 - protein, 7 aa, Mycobacterium
ADDRPGA

SEQ ID NO: 998879 - protein, 9 aa, Mycobacterium
ADDSGRTGR

SEQ ID NO: 998880 - protein, 5 aa, Mycobacterium
ADDSR

SEQ ID NO: 998881 - protein, 4 aa, Mycobacterium
ADDT

SEQ ID NO: 998882 - protein, 32 aa, Mycobacterium; identical to SEQ ID NO: 414819

SEQ ID NO: 998883 - protein, 5 aa, Mycobacterium
ADDYQ

SEQ ID NO: 998884 - protein, 8 aa, Mycobacterium
ADEAISAT

SEQ ID NO: 998885 - protein, 10 aa, Mycobacterium
ADEATASATV

SEQ ID NO: 998886 - protein, 7 aa, Mycobacterium
ADEDAAR

SEQ ID NO: 998887 - protein, 7 aa, Mycobacterium
ADEDDAA

SEQ ID NO: 998888 - protein, 10 aa, Mycobacterium
ADEDGNRFSD

SEQ ID NO: 998889 - protein, 7 aa, Mycobacterium
ADEEAAH

SEQ ID NO: 998890 - protein, 8 aa, Mycobacterium
ADEEARAA

SEQ ID NO: 998891 - protein, 7 aa, Mycobacterium
ADEERGW

SEQ ID NO: 998892 - protein, 8 aa, Mycobacterium
ADEFAAEP

SEQ ID NO: 998893 - protein, 12 aa, Mycobacterium
ADEFSTPEKPRY

SEQ ID NO: 998894 - protein, 4 aa, Mycobacterium
ADEG

SEQ ID NO: 998895 - protein, 16 aa, Mycobacterium
ADEGPTAKRIRPRAQG

SEQ ID NO: 998896 - protein, 16 aa, Mycobacterium
ADEGQGPAGRTPDLPG

SEQ ID NO: 998897 - protein, 6 aa, Mycobacterium
ADEGRR

SEQ ID NO: 998898 - protein, 8 aa, Mycobacterium
ADEKESEL

SEQ ID NO: 998899 - protein, 5 aa, Mycobacterium
ADEKW

SEQ ID NO: 998900 - protein, 4 aa, Mycobacterium
ADEL

SEQ ID NO: 998901 - protein, 7 aa, Mycobacterium
ADELRSH

SEQ ID NO: 998902 - protein, 5 aa, Mycobacterium
ADENL

SEQ ID NO: 998903 - protein, 6 aa, Mycobacterium
ADEPLE

SEQ ID NO: 998904 - protein, 11 aa, Mycobacterium
ADEPPDGPQPL

SEQ ID NO: 998905 - protein, 7 aa, Mycobacterium
ADESDGS

SEQ ID NO: 998906 - protein, 5 aa, Mycobacterium
ADESI

SEQ ID NO: 998907 - protein, 6 aa, Mycobacterium
ADESTT

SEQ ID NO: 998908 - protein, 43 aa, Mycobacterium
ADETAAKARAAQAEAEVKAAEAARLQERAAQHQSEAEATRTQL

SEQ ID NO: 998909 - protein, 8 aa, Mycobacterium
ADEVGGTW

SEQ ID NO: 998910 - protein, 6 aa, Mycobacterium
ADEVPD

SEQ ID NO: 998911 - protein, 6 aa, Mycobacterium
ADEVSA

SEQ ID NO: 998912 - protein, 6 aa, Mycobacterium
ADFGAR

SEQ ID NO: 998913 - protein, 6 aa, Mycobacterium
ADFGGS

SEQ ID NO: 998914 - protein, 6 aa, Mycobacterium
ADFPNN

SEQ ID NO: 998915 - protein, 4 aa, Mycobacterium
ADFR

SEQ ID NO: 998916 - protein, 6 aa, Mycobacterium
ADFSQS

SEQ ID NO: 998917 - protein, 7 aa, Mycobacterium
ADGAARR

SEQ ID NO: 998918 - protein, 8 aa, Mycobacterium
ADGAASYD

SEQ ID NO: 998919 - protein, 6 aa, Mycobacterium
ADGAEY

SEQ ID NO: 998920 - protein, 5 aa, Mycobacterium
ADGAL

SEQ ID NO: 998921 - protein, 7 aa, Mycobacterium
ADGALND

SEQ ID NO: 998922 - protein, 72 aa, Mycobacterium
ADGANGNGGAGGAGGNPGAPGNGGTGGVGPDAATSGGMGGTGGDPGAVGGRGNSGAAGGAGAVAGASGAAGT

SEQ ID NO: 998923 - protein, 5 aa, Mycobacterium
ADGAT

SEQ ID NO: 998924 - protein, 9 aa, Mycobacterium
ADGATGRYT

SEQ ID NO: 998925 - protein, 4 aa, Mycobacterium
ADGD

SEQ ID NO: 998926 - protein, 6 aa, Mycobacterium
ADGDED

SEQ ID NO: 998927 - protein, 5 aa, Mycobacterium
ADGDG

SEQ ID NO: 998928 - protein, 13 aa, Mycobacterium
ADGDPLSGTYQRT

SEQ ID NO: 998929 - protein, 7 aa, Mycobacterium
ADGDPQL

SEQ ID NO: 998930 - protein, 14 aa, Mycobacterium
ADGDQDGGQDTVDA

SEQ ID NO: 998931 - protein, 32 aa, Mycobacterium; identical to SEQ ID NO: 415189

SEQ ID NO: 998932 - protein, 7 aa, Mycobacterium
ADGEEHT

SEQ ID NO: 998933 - protein, 6 aa, Mycobacterium
ADGEHL

SEQ ID NO: 998934 - protein, 7 aa, Mycobacterium
ADGEPRW

SEQ ID NO: 998935 - protein, 16 aa, Mycobacterium
ADGEPTDEHRYSRDLP

SEQ ID NO: 998936 - protein, 9 aa, Mycobacterium
ADGEPTEDQ

SEQ ID NO: 998937 - protein, 4 aa, Mycobacterium
ADGG

SEQ ID NO: 998938 - protein, 44 aa, Mycobacterium
ADGGAGGSGGHGGHGGKGGAEGSGFGSGGSGGDGGVAAMGGSGG

SEQ ID NO: 998939 - protein, 7 aa, Mycobacterium
ADGGARV

SEQ ID NO: 998940 - protein, 19 aa, Mycobacterium
ADGGDRNAGQRWPNPRPSI

SEQ ID NO: 998941 - protein, 8 aa, Mycobacterium
ADGGGGSI

SEQ ID NO: 998942 - protein, 6 aa, Mycobacterium
ADGGPL

SEQ ID NO: 998943 - protein, 22 aa, Mycobacterium
ADGGRRRRRRPRRRRRRRRDRR

SEQ ID NO: 998944 - protein, 7 aa, Mycobacterium
ADGGSAR

SEQ ID NO: 998945 - protein, 6 aa, Mycobacterium
ADGGTE

SEQ ID NO: 998946 - protein, 9 aa, Mycobacterium
ADGGTRTAA

SEQ ID NO: 998947 - protein, 6 aa, Mycobacterium
ADGKAA

SEQ ID NO: 998948 - protein, 6 aa, Mycobacterium
ADGLSQ

SEQ ID NO: 998949 - protein, 7 aa, Mycobacterium
ADGNGRD

SEQ ID NO: 998950 - protein, 8 aa, Mycobacterium
ADGNPSWG

SEQ ID NO: 998951 - protein, 9 aa, Mycobacterium
ADGNPVGEA

SEQ ID NO: 998952 - protein, 17 aa, Mycobacterium
ADGNRVDVGANGPSGGQ

SEQ ID NO: 998953 - protein, 6 aa, Mycobacterium
ADGNVT

SEQ ID NO: 998954 - protein, 6 aa, Mycobacterium
ADGPAL

SEQ ID NO: 998955 - protein, 7 aa, Mycobacterium
ADGPDNA

SEQ ID NO: 998956 - protein, 13 aa, Mycobacterium
ADGPGGEKNWSGE

SEQ ID NO: 998957 - protein, 13 aa, Mycobacterium
ADGPGQAATVPDI

SEQ ID NO: 998958 - protein, 7 aa, Mycobacterium
ADGPSTR

SEQ ID NO: 998959 - protein, 8 aa, Mycobacterium
ADGPTEAH

SEQ ID NO: 998960 - protein, 7 aa, Mycobacterium
ADGQAFR

SEQ ID NO: 998961 - protein, 6 aa, Mycobacterium
ADGQLP

SEQ ID NO: 998962 - protein, 8 aa, Mycobacterium
ADGQPGEV

SEQ ID NO: 998963 - protein, 4 aa, Mycobacterium
ADGR

SEQ ID NO: 998964 - protein, 8 aa, Mycobacterium
ADGRLDEA

SEQ ID NO: 998965 - protein, 6 aa, Mycobacterium
ADGRPC

SEQ ID NO: 998966 - protein, 6 aa, Mycobacterium
ADGRPG

SEQ ID NO: 998967 - protein, 14 aa, Mycobacterium
ADGSEVATSPLATE

SEQ ID NO: 998968 - protein, 8 aa, Mycobacterium
ADGSGAMA

SEQ ID NO: 998969 - protein, 8 aa, Mycobacterium
ADGSPDTV

SEQ ID NO: 998970 - protein, 8 aa, Mycobacterium
ADGSPERD

SEQ ID NO: 998971 - protein, 8 aa, Mycobacterium
ADGSRPRD

SEQ ID NO: 998972 - protein, 11 aa, Mycobacterium
ADGSVSPATGT

SEQ ID NO: 998973 - protein, 7 aa, Mycobacterium
ADGTALS

SEQ ID NO: 998974 - protein, 13 aa, Mycobacterium
ADGTANELKHRAG

SEQ ID NO: 998975 - protein, 117 aa, Mycobacterium
ADGTEGVGGAGGEGGSGGVAGDGGKGADAAAFSGAAGGNGGHGGDNGAGGAGGTGGAGSTDGAHGADGFSPITGGNGGDGGSGGSGFQGVKGGAGGVGGDGGLYGNGGTGGTGGIGF

SEQ ID NO: 998976 - protein, 11 aa, Mycobacterium
ADGTGESTGVT

SEQ ID NO: 998977 - protein, 14 aa, Mycobacterium
ADGTKFGKSTGGGS

SEQ ID NO: 998978 - protein, 5 aa, Mycobacterium
ADGTL

SEQ ID NO: 998979 - protein, 7 aa, Mycobacterium
ADGTPLG

SEQ ID NO: 998980 - protein, 18 aa, Mycobacterium
ADGTPLTKAQLGDPAAFT

SEQ ID NO: 998981 - protein, 7 aa, Mycobacterium
ADGTTAV

SEQ ID NO: 998982 - protein, 14 aa, Mycobacterium
ADGVADPERRDDLE

SEQ ID NO: 998983 - protein, 9 aa, Mycobacterium
ADGVRAGRA

SEQ ID NO: 998984 - protein, 16 aa, Mycobacterium
ADGWQQETYPSLDPQG

SEQ ID NO: 998985 - protein, 8 aa, Mycobacterium
ADHDDTTR

SEQ ID NO: 998986 - protein, 12 aa, Mycobacterium
ADHDEKRLTSCG

SEQ ID NO: 998987 - protein, 6 aa, Mycobacterium
ADHPAG

SEQ ID NO: 998988 - protein, 10 aa, Mycobacterium
ADHPARSEQD

SEQ ID NO: 998989 - protein, 7 aa, Mycobacterium
ADHPDNP

SEQ ID NO: 998990 - protein, 9 aa, Mycobacterium
ADHSSKADF

SEQ ID NO: 998991 - protein, 7 aa, Mycobacterium
ADHTGAN

SEQ ID NO: 998992 - protein, 6 aa, Mycobacterium
ADHTYG

SEQ ID NO: 998993 - protein, 6 aa, Mycobacterium
ADIERN

SEQ ID NO: 998994 - protein, 11 aa, Mycobacterium
ADIGDDSNIGA

SEQ ID NO: 998995 - protein, 6 aa, Mycobacterium
ADIGGI

SEQ ID NO: 998996 - protein, 5 aa, Mycobacterium
ADIKG

SEQ ID NO: 998997 - protein, 11 aa, Mycobacterium
ADIPRGPTGKV

SEQ ID NO: 998998 - protein, 11 aa, Mycobacterium
ADISGAANIGT

SEQ ID NO: 998999 - protein, 9 aa, Mycobacterium
ADISTATLN

SEQ ID NO: 999000 - protein, 5 aa, Mycobacterium
ADKAG

SEQ ID NO: 999001 - protein, 14 aa, Mycobacterium
ADKAGARDRADDLA

SEQ ID NO: 999002 - protein, 5 aa, Mycobacterium
ADKAV

SEQ ID NO: 999003 - protein, 7 aa, Mycobacterium
ADKKKAI

SEQ ID NO: 999004 - protein, 7 aa, Mycobacterium
ADKLSPP

SEQ ID NO: 999005 - protein, 4 aa, Mycobacterium
ADKP

SEQ ID NO: 999006 - protein, 14 aa, Mycobacterium
ADKPAGSSRQARVN

SEQ ID NO: 999007 - protein, 7 aa, Mycobacterium
ADKPDSH

SEQ ID NO: 999008 - protein, 22 aa, Mycobacterium
ADKPEKAAAPAGDPTGGMGGMD

SEQ ID NO: 999009 - protein, 10 aa, Mycobacterium
ADKVRGGYYT

SEQ ID NO: 999010 - protein, 13 aa, Mycobacterium
ADLADPQERTKLT

SEQ ID NO: 999011 - protein, 21 aa, Mycobacterium
ADLAGSNNTTIKGADSFGPPA

SEQ ID NO: 999012 - protein, 6 aa, Mycobacterium
ADLEGI

SEQ ID NO: 999013 - protein, 12 aa, Mycobacterium
ADLEQRARRGGR

SEQ ID NO: 999014 - protein, 12 aa, Mycobacterium
ADLGAADTTPDN

SEQ ID NO: 999015 - protein, 10 aa, Mycobacterium
ADLNGKSSRA

SEQ ID NO: 999016 - protein, 24 aa, Mycobacterium
ADLPDGAQPQPYEPGDKTAPQGVY

SEQ ID NO: 999017 - protein, 21 aa, Mycobacterium
ADLPGAAVSPRRGGNCNPAPS

SEQ ID NO: 999018 - protein, 24 aa, Mycobacterium
ADLQGIGSSVNAANAAAAISTTEL

SEQ ID NO: 999019 - protein, 5 aa, Mycobacterium
ADLRV

SEQ ID NO: 999020 - protein, 7 aa, Mycobacterium
ADLSGEE

SEQ ID NO: 999021 - protein, 16 aa, Mycobacterium
ADLSTPLKRSQDQPEH

SEQ ID NO: 999022 - protein, 17 aa, Mycobacterium
ADLSTPMQDSVRNPEYP

SEQ ID NO: 999023 - protein, 7 aa, Mycobacterium
ADLTNRS

SEQ ID NO: 999024 - protein, 6 aa, Mycobacterium
ADMKSG

SEQ ID NO: 999025 - protein, 4 aa, Mycobacterium
ADMN

SEQ ID NO: 999026 - protein, 6 aa, Mycobacterium
ADMSTL

SEQ ID NO: 999027 - protein, 6 aa, Mycobacterium
ADMTSG

SEQ ID NO: 999028 - protein, 12 aa, Mycobacterium
ADNAPGACPASR

SEQ ID NO: 999029 - protein, 7 aa, Mycobacterium
ADNASAA

SEQ ID NO: 999030 - protein, 4 aa, Mycobacterium
ADND

SEQ ID NO: 999031 - protein, 10 aa, Mycobacterium
ADNDQKPCGH

SEQ ID NO: 999032 - protein, 20 aa, Mycobacterium
ADNDRSGVAGYASVDPLNPI

SEQ ID NO: 999033 - protein, 6 aa, Mycobacterium
ADNIAE

SEQ ID NO: 999034 - protein, 16 aa, Mycobacterium
ADNPDQVGVNETGARF

SEQ ID NO: 999035 - protein, 7 aa, Mycobacterium
ADNPERA

SEQ ID NO: 999036 - protein, 8 aa, Mycobacterium
ADNPTVTS

SEQ ID NO: 999037 - protein, 10 aa, Mycobacterium
ADPAADHAQR

SEQ ID NO: 999038 - protein, 6 aa, Mycobacterium
ADPAER

SEQ ID NO: 999039 - protein, 7 aa, Mycobacterium
ADPAGIN

SEQ ID NO: 999040 - protein, 10 aa, Mycobacterium
ADPAGNGQKH

SEQ ID NO: 999041 - protein, 7 aa, Mycobacterium
ADPAKVT

SEQ ID NO: 999042 - protein, 8 aa, Mycobacterium
ADPANPYG

SEQ ID NO: 999043 - protein, 24 aa, Mycobacterium
ADPANTAPVQTPAAPGWTGRRDTA

SEQ ID NO: 999044 - protein, 6 aa, Mycobacterium
ADPARF

SEQ ID NO: 999045 - protein, 6 aa, Mycobacterium
ADPASA

SEQ ID NO: 999046 - protein, 6 aa, Mycobacterium
ADPATA

SEQ ID NO: 999047 - protein, 25 aa, Mycobacterium
ADPAVTARRGATAEVDARSYARPDP

SEQ ID NO: 999048 - protein, 4 aa, Mycobacterium
ADPD

SEQ ID NO: 999049 - protein, 7 aa, Mycobacterium
ADPDGGL

SEQ ID NO: 999050 - protein, 5 aa, Mycobacterium
ADPDL

SEQ ID NO: 999051 - protein, 6 aa, Mycobacterium
ADPDRG

SEQ ID NO: 999052 - protein, 6 aa, Mycobacterium
ADPDRP

SEQ ID NO: 999053 - protein, 8 aa, Mycobacterium
ADPDTARA

SEQ ID NO: 999054 - protein, 5 aa, Mycobacterium
ADPEA

SEQ ID NO: 999055 - protein, 5 aa, Mycobacterium
ADPEF

SEQ ID NO: 999056 - protein, 9 aa, Mycobacterium
ADPEGVSAL

SEQ ID NO: 999057 - protein, 5 aa, Mycobacterium
ADPEH

SEQ ID NO: 999058 - protein, 9 aa, Mycobacterium
ADPEQATSD

SEQ ID NO: 999059 - protein, 7 aa, Mycobacterium
ADPERDG

SEQ ID NO: 999060 - protein, 7 aa, Mycobacterium
ADPERSV

SEQ ID NO: 999061 - protein, 8 aa, Mycobacterium
ADPESGSA

SEQ ID NO: 999062 - protein, 7 aa, Mycobacterium
ADPETPP

SEQ ID NO: 999063 - protein, 9 aa, Mycobacterium
ADPGAGSQI

SEQ ID NO: 999064 - protein, 8 aa, Mycobacterium
ADPGAWPG

SEQ ID NO: 999065 - protein, 5 aa, Mycobacterium
ADPGG

SEQ ID NO: 999066 - protein, 6 aa, Mycobacterium
ADPGHS

SEQ ID NO: 999067 - protein, 5 aa, Mycobacterium
ADPKL

SEQ ID NO: 999068 - protein, 9 aa, Mycobacterium
ADPKTQTMG

SEQ ID NO: 999069 - protein, 7 aa, Mycobacterium
ADPKTYE

SEQ ID NO: 999070 - protein, 8 aa, Mycobacterium
ADPKVTAN

SEQ ID NO: 999071 - protein, 5 aa, Mycobacterium
ADPLG

SEQ ID NO: 999072 - protein, 8 aa, Mycobacterium
ADPLGGAS

SEQ ID NO: 999073 - protein, 6 aa, Mycobacterium
ADPMAK

SEQ ID NO: 999074 - protein, 11 aa, Mycobacterium
ADPMHTSGART

SEQ ID NO: 999075 - protein, 7 aa, Mycobacterium
ADPNGLN

SEQ ID NO: 999076 - protein, 6 aa, Mycobacterium
ADPNSP

SEQ ID NO: 999077 - protein, 7 aa, Mycobacterium
ADPNTVG

SEQ ID NO: 999078 - protein, 20 aa, Mycobacterium
ADPNWRNGDYHETGCRPEAG

SEQ ID NO: 999079 - protein, 7 aa, Mycobacterium
ADPPACR

SEQ ID NO: 999080 - protein, 6 aa, Mycobacterium
ADPPHL

SEQ ID NO: 999081 - protein, 6 aa, Mycobacterium
ADPPMP

SEQ ID NO: 999082 - protein, 8 aa, Mycobacterium
ADPPMTKD

SEQ ID NO: 999083 - protein, 17 aa, Mycobacterium
ADPPPATGEHNETLLGE

SEQ ID NO: 999084 - protein, 19 aa, Mycobacterium
ADPPPGGRASATSTTSAAS

SEQ ID NO: 999085 - protein, 8 aa, Mycobacterium
ADPPPGLP

SEQ ID NO: 999086 - protein, 14 aa, Mycobacterium
ADPPRRASVNELGG

SEQ ID NO: 999087 - protein, 5 aa, Mycobacterium
ADPQA

SEQ ID NO: 999088 - protein, 6 aa, Mycobacterium
ADPQQW

SEQ ID NO: 999089 - protein, 6 aa, Mycobacterium
ADPQVR

SEQ ID NO: 999090 - protein, 6 aa, Mycobacterium
ADPQYV

SEQ ID NO: 999091 - protein, 4 aa, Mycobacterium
ADPR

SEQ ID NO: 999092 - protein, 8 aa, Mycobacterium
ADPRAADG

SEQ ID NO: 999093 - protein, 13 aa, Mycobacterium
ADPRGAMRRSGAL

SEQ ID NO: 999094 - protein, 6 aa, Mycobacterium
ADPRKF

SEQ ID NO: 999095 - protein, 13 aa, Mycobacterium
ADPRTREQRRADA

SEQ ID NO: 999096 - protein, 13 aa, Mycobacterium
ADPRTRKQRRADA

SEQ ID NO: 999097 - protein, 6 aa, Mycobacterium
ADPRWG

SEQ ID NO: 999098 - protein, 4 aa, Mycobacterium
ADPS

SEQ ID NO: 999099 - protein, 18 aa, Mycobacterium
ADPSARLQASREANTQMK

SEQ ID NO: 999100 - protein, 6 aa, Mycobacterium
ADPSGR

SEQ ID NO: 999101 - protein, 10 aa, Mycobacterium
ADPSIEDGRE

SEQ ID NO: 999102 - protein, 11 aa, Mycobacterium
ADPSIPRSGSA

SEQ ID NO: 999103 - protein, 7 aa, Mycobacterium
ADPSQQL

SEQ ID NO: 999104 - protein, 8 aa, Mycobacterium
ADPSREAP

SEQ ID NO: 999105 - protein, 10 aa, Mycobacterium
ADPSRSAGNI

SEQ ID NO: 999106 - protein, 9 aa, Mycobacterium
ADPSWPEQA

SEQ ID NO: 999107 - protein, 34 aa, Mycobacterium
ADPTASASTAATPAGGASMAPAAAGTRITVPGAG

SEQ ID NO: 999108 - protein, 8 aa, Mycobacterium
ADPTHSGY

SEQ ID NO: 999109 - protein, 7 aa, Mycobacterium
ADPTPQL

SEQ ID NO: 999110 - protein, 7 aa, Mycobacterium
ADPTSDI

SEQ ID NO: 999111 - protein, 15 aa, Mycobacterium
ADQARAAAAGDDEAM

SEQ ID NO: 999112 - protein, 7 aa, Mycobacterium
ADQASTQ

SEQ ID NO: 999113 - protein, 11 aa, Mycobacterium
ADQAYAAREAE

SEQ ID NO: 999114 - protein, 10 aa, Mycobacterium
ADQEGKPLSA

SEQ ID NO: 999115 - protein, 9 aa, Mycobacterium
ADQGGALGG

SEQ ID NO: 999116 - protein, 4 aa, Mycobacterium
ADQI

SEQ ID NO: 999117 - protein, 10 aa, Mycobacterium
ADQKTISESH

SEQ ID NO: 999118 - protein, 11 aa, Mycobacterium
ADQLGAATPCS

SEQ ID NO: 999119 - protein, 6 aa, Mycobacterium
ADQPGC

SEQ ID NO: 999120 - protein, 14 aa, Mycobacterium
ADQPITEAIPDSPA

SEQ ID NO: 999121 - protein, 6 aa, Mycobacterium
ADQPNA

SEQ ID NO: 999122 - protein, 7 aa, Mycobacterium
ADQPVTA

SEQ ID NO: 999123 - protein, 17 aa, Mycobacterium
ADQRAPQQRLGGRIYQV

SEQ ID NO: 999124 - protein, 14 aa, Mycobacterium
ADQRRGETATHYAQ

SEQ ID NO: 999125 - protein, 8 aa, Mycobacterium
ADQSLSSQ

SEQ ID NO: 999126 - protein, 33 aa, Mycobacterium; identical to SEQ ID NO: 416514

SEQ ID NO: 999127 - protein, 4 aa, Mycobacterium
ADQT

SEQ ID NO: 999128 - protein, 12 aa, Mycobacterium
ADQTRKTEQQLA

SEQ ID NO: 999129 - protein, 8 aa, Mycobacterium
ADQVPSQL

SEQ ID NO: 999130 - protein, 4 aa, Mycobacterium
ADRA

SEQ ID NO: 999131 - protein, 6 aa, Mycobacterium
ADRADH

SEQ ID NO: 999132 - protein, 15 aa, Mycobacterium
ADRAPLRGWLRGVHR

SEQ ID NO: 999133 - protein, 5 aa, Mycobacterium
ADRAT

SEQ ID NO: 999134 - protein, 7 aa, Mycobacterium
ADRAVGE

SEQ ID NO: 999135 - protein, 4 aa, Mycobacterium
ADRD

SEQ ID NO: 999136 - protein, 6 aa, Mycobacterium
ADRDEA

SEQ ID NO: 999137 - protein, 6 aa, Mycobacterium
ADRDGV

SEQ ID NO: 999138 - protein, 11 aa, Mycobacterium
ADRDRTNVHGS

SEQ ID NO: 999139 - protein, 9 aa, Mycobacterium
ADREQAQRL

SEQ ID NO: 999140 - protein, 6 aa, Mycobacterium
ADRGGT

SEQ ID NO: 999141 - protein, 5 aa, Mycobacterium
ADRNA

SEQ ID NO: 999142 - protein, 9 aa, Mycobacterium
ADRNFARTA

SEQ ID NO: 999143 - protein, 8 aa, Mycobacterium
ADRNPPVF

SEQ ID NO: 999144 - protein, 7 aa, Mycobacterium
ADRPALA

SEQ ID NO: 999145 - protein, 4 aa, Mycobacterium
ADRQ

SEQ ID NO: 999146 - protein, 5 aa, Mycobacterium
ADRQA

SEQ ID NO: 999147 - protein, 5 aa, Mycobacterium
ADRRT

SEQ ID NO: 999148 - protein, 9 aa, Mycobacterium
ADRSARPVR

SEQ ID NO: 999149 - protein, 9 aa, Mycobacterium
ADRSDPKLT

SEQ ID NO: 999150 - protein, 12 aa, Mycobacterium
ADRSEPGRPGVL

SEQ ID NO: 999151 - protein, 8 aa, Mycobacterium
ADRSGAPT

SEQ ID NO: 999152 - protein, 7 aa, Mycobacterium
ADRSGKL

SEQ ID NO: 999153 - protein, 5 aa, Mycobacterium
ADRSS

SEQ ID NO: 999154 - protein, 16 aa, Mycobacterium
ADRSSLRQLHAAIKAA

SEQ ID NO: 999155 - protein, 6 aa, Mycobacterium
ADRTDD

SEQ ID NO: 999156 - protein, 40 aa, Mycobacterium; identical to SEQ ID NO: 416757

SEQ ID NO: 999157 - protein, 10 aa, Mycobacterium
ADRVGAEQTV

SEQ ID NO: 999158 - protein, 8 aa, Mycobacterium
ADRVSGQL

SEQ ID NO: 999159 - protein, 6 aa, Mycobacterium
ADRYQA

SEQ ID NO: 999160 - protein, 9 aa, Mycobacterium
ADSADPSAQ

SEQ ID NO: 999161 - protein, 8 aa, Mycobacterium
ADSANEEL

SEQ ID NO: 999162 - protein, 16 aa, Mycobacterium
ADSAPTTRPLIIDRIS

SEQ ID NO: 999163 - protein, 13 aa, Mycobacterium
ADSAYPGAPNGRV

SEQ ID NO: 999164 - protein, 4 aa, Mycobacterium
ADSD

SEQ ID NO: 999165 - protein, 5 aa, Mycobacterium
ADSDD

SEQ ID NO: 999166 - protein, 6 aa, Mycobacterium
ADSDVA

SEQ ID NO: 999167 - protein, 7 aa, Mycobacterium
ADSDVAS

SEQ ID NO: 999168 - protein, 5 aa, Mycobacterium
ADSEQ

SEQ ID NO: 999169 - protein, 7 aa, Mycobacterium
ADSERGW

SEQ ID NO: 999170 - protein, 5 aa, Mycobacterium
ADSGI

SEQ ID NO: 999171 - protein, 14 aa, Mycobacterium
ADSLPPEDDPAFTD

SEQ ID NO: 999172 - protein, 12 aa, Mycobacterium
ADSLRKDSAEVS

SEQ ID NO: 999173 - protein, 4 aa, Mycobacterium
ADSP

SEQ ID NO: 999174 - protein, 8 aa, Mycobacterium
ADSPAAVD

SEQ ID NO: 999175 - protein, 9 aa, Mycobacterium
ADSPDQTCG

SEQ ID NO: 999176 - protein, 14 aa, Mycobacterium
ADSPGVTIAPREDT

SEQ ID NO: 999177 - protein, 5 aa, Mycobacterium
ADSPI

SEQ ID NO: 999178 - protein, 6 aa, Mycobacterium
ADSPRL

SEQ ID NO: 999179 - protein, 11 aa, Mycobacterium
ADSPSKDDEAF

SEQ ID NO: 999180 - protein, 6 aa, Mycobacterium
ADSQTR

SEQ ID NO: 999181 - protein, 4 aa, Mycobacterium
ADSR

SEQ ID NO: 999182 - protein, 10 aa, Mycobacterium
ADSRDAAEQA

SEQ ID NO: 999183 - protein, 6 aa, Mycobacterium
ADSRDV

SEQ ID NO: 999184 - protein, 12 aa, Mycobacterium
ADSRPNDSADAA

SEQ ID NO: 999185 - protein, 10 aa, Mycobacterium
ADSRQAGIDD

SEQ ID NO: 999186 - protein, 5 aa, Mycobacterium
ADSRV

SEQ ID NO: 999187 - protein, 19 aa, Mycobacterium
ADSTDLADSGAPHRPRDPE

SEQ ID NO: 999188 - protein, 12 aa, Mycobacterium
ADSTPPADWDRP

SEQ ID NO: 999189 - protein, 8 aa, Mycobacterium
ADSTRTFE

SEQ ID NO: 999190 - protein, 8 aa, Mycobacterium
ADSVQKQA

SEQ ID NO: 999191 - protein, 6 aa, Mycobacterium
ADSVTS

SEQ ID NO: 999192 - protein, 8 aa, Mycobacterium
ADTAESYS

SEQ ID NO: 999193 - protein, 9 aa, Mycobacterium
ADTAGDRAF

SEQ ID NO: 999194 - protein, 9 aa, Mycobacterium
ADTAGKPSL

SEQ ID NO: 999195 - protein, 8 aa, Mycobacterium
ADTAQMDT

SEQ ID NO: 999196 - protein, 5 aa, Mycobacterium
ADTAR

SEQ ID NO: 999197 - protein, 14 aa, Mycobacterium
ADTDVPDGFPAATA

SEQ ID NO: 999198 - protein, 4 aa, Mycobacterium
ADTE

SEQ ID NO: 999199 - protein, 11 aa, Mycobacterium
ADTEQQRNAAL

SEQ ID NO: 999200 - protein, 9 aa, Mycobacterium
ADTETPPGG

SEQ ID NO: 999201 - protein, 8 aa, Mycobacterium
ADTFAGPS

SEQ ID NO: 999202 - protein, 7 aa, Mycobacterium
ADTGARG

SEQ ID NO: 999203 - protein, 6 aa, Mycobacterium
ADTGDV

SEQ ID NO: 999204 - protein, 8 aa, Mycobacterium
ADTGEAAA

SEQ ID NO: 999205 - protein, 5 aa, Mycobacterium
ADTGL

SEQ ID NO: 999206 - protein, 7 aa, Mycobacterium
ADTGVFP

SEQ ID NO: 999207 - protein, 5 aa, Mycobacterium
ADTLA

SEQ ID NO: 999208 - protein, 7 aa, Mycobacterium
ADTNTTA

SEQ ID NO: 999209 - protein, 5 aa, Mycobacterium
ADTPA

SEQ ID NO: 999210 - protein, 7 aa, Mycobacterium
ADTPADF

SEQ ID NO: 999211 - protein, 7 aa, Mycobacterium
ADTPFPQ

SEQ ID NO: 999212 - protein, 10 aa, Mycobacterium
ADTPGVATSL

SEQ ID NO: 999213 - protein, 4 aa, Mycobacterium
ADTQ

SEQ ID NO: 999214 - protein, 4 aa, Mycobacterium
ADTR

SEQ ID NO: 999215 - protein, 12 aa, Mycobacterium
ADTRCETGAPAG

SEQ ID NO: 999216 - protein, 7 aa, Mycobacterium
ADTREEA

SEQ ID NO: 999217 - protein, 9 aa, Mycobacterium
ADTSRGTVG

SEQ ID NO: 999218 - protein, 5 aa, Mycobacterium
ADTSV

SEQ ID NO: 999219 - protein, 8 aa, Mycobacterium
ADTTGDLD

SEQ ID NO: 999220 - protein, 7 aa, Mycobacterium
ADTTPKG

SEQ ID NO: 999221 - protein, 4 aa, Mycobacterium
ADTV

SEQ ID NO: 999222 - protein, 5 aa, Mycobacterium
ADTVG

SEQ ID NO: 999223 - protein, 4 aa, Mycobacterium
ADTY

SEQ ID NO: 999224 - protein, 19 aa, Mycobacterium
ADVAAADAARAAAESDDQQ

SEQ ID NO: 999225 - protein, 6 aa, Mycobacterium
ADVAPE

SEQ ID NO: 999226 - protein, 12 aa, Mycobacterium
ADVDENSRFPQE

SEQ ID NO: 999227 - protein, 6 aa, Mycobacterium
ADVGSR

SEQ ID NO: 999228 - protein, 4 aa, Mycobacterium
ADVH

SEQ ID NO: 999229 - protein, 7 aa, Mycobacterium
ADVPVGS

SEQ ID NO: 999230 - protein, 7 aa, Mycobacterium
ADVRDRE

SEQ ID NO: 999231 - protein, 7 aa, Mycobacterium
ADVRDSA

SEQ ID NO: 999232 - protein, 8 aa, Mycobacterium
ADVRPGDD

SEQ ID NO: 999233 - protein, 6 aa, Mycobacterium
ADVRSG

SEQ ID NO: 999234 - protein, 28 aa, Mycobacterium
ADWDPAGAADDDLSGIGADAKPPAIDPT

SEQ ID NO: 999235 - protein, 17 aa, Mycobacterium
ADWGRSDPLKTAKTAQA

SEQ ID NO: 999236 - protein, 4 aa, Mycobacterium
ADWS

SEQ ID NO: 999237 - protein, 7 aa, Mycobacterium
ADYASGF

SEQ ID NO: 999238 - protein, 9 aa, Mycobacterium
ADYEAANAA

SEQ ID NO: 999239 - protein, 8 aa, Mycobacterium
ADYGGDPD

SEQ ID NO: 999240 - protein, 11 aa, Mycobacterium
ADYPYTPDGSR

SEQ ID NO: 999241 - protein, 6 aa, Mycobacterium
AEAAAG

SEQ ID NO: 999242 - protein, 8 aa, Mycobacterium
AEAAASHN

SEQ ID NO: 999243 - protein, 12 aa, Mycobacterium
AEAADNLSAQAY

SEQ ID NO: 999244 - protein, 9 aa, Mycobacterium
AEAADRRRT

SEQ ID NO: 999245 - protein, 7 aa, Mycobacterium
AEAADTA

SEQ ID NO: 999246 - protein, 10 aa, Mycobacterium
AEAAEKTAKQ

SEQ ID NO: 999247 - protein, 9 aa, Mycobacterium
AEAAGAAAL

SEQ ID NO: 999248 - protein, 32 aa, Mycobacterium
AEAAGHGDNGGGSSSSSSSEKSAGGSLASDAQ

SEQ ID NO: 999249 - protein, 8 aa, Mycobacterium
AEAAGRKV

SEQ ID NO: 999250 - protein, 5 aa, Mycobacterium
AEAAK

SEQ ID NO: 999251 - protein, 10 aa, Mycobacterium
AEAAKYQPKP

SEQ ID NO: 999252 - protein, 5 aa, Mycobacterium
AEAAN

SEQ ID NO: 999253 - protein, 7 aa, Mycobacterium
AEAAPAP

SEQ ID NO: 999254 - protein, 5 aa, Mycobacterium
AEAAT

SEQ ID NO: 999255 - protein, 9 aa, Mycobacterium
AEAATASNA

SEQ ID NO: 999256 - protein, 15 aa, Mycobacterium
AEAAVGAGQELTPTL

SEQ ID NO: 999257 - protein, 4 aa, Mycobacterium
AEAD

SEQ ID NO: 999258 - protein, 5 aa, Mycobacterium
AEADA

SEQ ID NO: 999259 - protein, 10 aa, Mycobacterium
AEADPTADVE

SEQ ID NO: 999260 - protein, 8 aa, Mycobacterium
AEADQDDM

SEQ ID NO: 999261 - protein, 7 aa, Mycobacterium
AEADQTA

SEQ ID NO: 999262 - protein, 10 aa, Mycobacterium
AEADSGAALR

SEQ ID NO: 999263 - protein, 8 aa, Mycobacterium
AEADVKDR

SEQ ID NO: 999264 - protein, 62 aa, Mycobacterium
AEAEEAEEGEDEPKEAEEVAEAEGSEAEDKTAQAIDGGQTGVDEAGEADAEPDDDSTAAEPE

SEQ ID NO: 999265 - protein, 10 aa, Mycobacterium
AEAEPLPVPS

SEQ ID NO: 999266 - protein, 6 aa, Mycobacterium
AEAEPT

SEQ ID NO: 999267 - protein, 10 aa, Mycobacterium
AEAERDGASG

SEQ ID NO: 999268 - protein, 12 aa, Mycobacterium
AEAGASAAASVA

SEQ ID NO: 999269 - protein, 7 aa, Mycobacterium
AEAGELR

SEQ ID NO: 999270 - protein, 6 aa, Mycobacterium
AEAGKD

SEQ ID NO: 999271 - protein, 10 aa, Mycobacterium
AEAGKSVARD

SEQ ID NO: 999272 - protein, 6 aa, Mycobacterium
AEAGMT

SEQ ID NO: 999273 - protein, 7 aa, Mycobacterium
AEAGPVS

SEQ ID NO: 999274 - protein, 11 aa, Mycobacterium
AEAGRPPGAIH

SEQ ID NO: 999275 - protein, 8 aa, Mycobacterium
AEAGRSAA

SEQ ID NO: 999276 - protein, 7 aa, Mycobacterium
AEAGTDT

SEQ ID NO: 999277 - protein, 8 aa, Mycobacterium
AEAGVGKG

SEQ ID NO: 999278 - protein, 9 aa, Mycobacterium
AEAGYPPSR

SEQ ID NO: 999279 - protein, 4 aa, Mycobacterium
AEAH

SEQ ID NO: 999280 - protein, 4 aa, Mycobacterium
AEAI

SEQ ID NO: 999281 - protein, 5 aa, Mycobacterium
AEAID

SEQ ID NO: 999282 - protein, 4 aa, Mycobacterium
AEAK

SEQ ID NO: 999283 - protein, 4 aa, Mycobacterium
AEAL

SEQ ID NO: 999284 - protein, 18 aa, Mycobacterium
AEANSSRRQLMLSLVRKT

SEQ ID NO: 999285 - protein, 4 aa, Mycobacterium
AEAP

SEQ ID NO: 999286 - protein, 8 aa, Mycobacterium
AEAPAAVD

SEQ ID NO: 999287 - protein, 6 aa, Mycobacterium
AEAPNA

SEQ ID NO: 999288 - protein, 12 aa, Mycobacterium
AEAPRLPAANTQ

SEQ ID NO: 999289 - protein, 6 aa, Mycobacterium
AEAPVD

SEQ ID NO: 999290 - protein, 10 aa, Mycobacterium
AEAQKGAAGR

SEQ ID NO: 999291 - protein, 6 aa, Mycobacterium
AEAQRC

SEQ ID NO: 999292 - protein, 12 aa, Mycobacterium
AEAQRSGKSALA

SEQ ID NO: 999293 - protein, 8 aa, Mycobacterium
AEARTEEN

SEQ ID NO: 999294 - protein, 12 aa, Mycobacterium
AEASGALRPGGT

SEQ ID NO: 999295 - protein, 10 aa, Mycobacterium
AEATASIQGT

SEQ ID NO: 999296 - protein, 8 aa, Mycobacterium
AEATENGC

SEQ ID NO: 999297 - protein, 11 aa, Mycobacterium
AEATGAPTAAH

SEQ ID NO: 999298 - protein, 8 aa, Mycobacterium
AEATGSFN

SEQ ID NO: 999299 - protein, 5 aa, Mycobacterium
AEATQ

SEQ ID NO: 999300 - protein, 8 aa, Mycobacterium
AEATRNPA

SEQ ID NO: 999301 - protein, 12 aa, Mycobacterium
AEATSQTPSQWG

SEQ ID NO: 999302 - protein, 17 aa, Mycobacterium
AEATSVRSAPASKSAKH

SEQ ID NO: 999303 - protein, 6 aa, Mycobacterium
AEAVEN

SEQ ID NO: 999304 - protein, 12 aa, Mycobacterium
AEAVQRARESVD

SEQ ID NO: 999305 - protein, 4 aa, Mycobacterium
AECP

SEQ ID NO: 999306 - protein, 5 aa, Mycobacterium
AEDAE

SEQ ID NO: 999307 - protein, 9 aa, Mycobacterium
AEDAGGELR

SEQ ID NO: 999308 - protein, 16 aa, Mycobacterium
AEDDDVNRYRASKQAD

SEQ ID NO: 999309 - protein, 7 aa, Mycobacterium
AEDDPTK

SEQ ID NO: 999310 - protein, 5 aa, Mycobacterium
AEDDY

SEQ ID NO: 999311 - protein, 5 aa, Mycobacterium
AEDEQ

SEQ ID NO: 999312 - protein, 6 aa, Mycobacterium
AEDEVS

SEQ ID NO: 999313 - protein, 10 aa, Mycobacterium
AEDGTDERAA

SEQ ID NO: 999314 - protein, 6 aa, Mycobacterium
AEDGTR

SEQ ID NO: 999315 - protein, 9 aa, Mycobacterium
AEDHSEIDS

SEQ ID NO: 999316 - protein, 7 aa, Mycobacterium
AEDPARG

SEQ ID NO: 999317 - protein, 14 aa, Mycobacterium
AEDPAWAQNDPTVN

SEQ ID NO: 999318 - protein, 5 aa, Mycobacterium
AEDPD

SEQ ID NO: 999319 - protein, 16 aa, Mycobacterium
AEDPDEDDSSPRSNYA

SEQ ID NO: 999320 - protein, 10 aa, Mycobacterium
AEDPNRKPEF

SEQ ID NO: 999321 - protein, 8 aa, Mycobacterium
AEDPPARA

SEQ ID NO: 999322 - protein, 6 aa, Mycobacterium
AEDPRA

SEQ ID NO: 999323 - protein, 7 aa, Mycobacterium
AEDQQRQ

SEQ ID NO: 999324 - protein, 6 aa, Mycobacterium
AEDRVT

SEQ ID NO: 999325 - protein, 4 aa, Mycobacterium
AEDT

SEQ ID NO: 999326 - protein, 4 aa, Mycobacterium
AEEA

SEQ ID NO: 999327 - protein, 7 aa, Mycobacterium
AEEAARE

SEQ ID NO: 999328 - protein, 22 aa, Mycobacterium
AEEAYQKARRTADDIAAQRQQW

SEQ ID NO: 999329 - protein, 5 aa, Mycobacterium
AEEDD

SEQ ID NO: 999330 - protein, 11 aa, Mycobacterium
AEEDGGTTSID

SEQ ID NO: 999331 - protein, 5 aa, Mycobacterium
AEEDV

SEQ ID NO: 999332 - protein, 11 aa, Mycobacterium
AEEGGSVDRAE

SEQ ID NO: 999333 - protein, 17 aa, Mycobacterium
AEEGRKDDIAFLREKLN

SEQ ID NO: 999334 - protein, 12 aa, Mycobacterium
AEEIAAEGTPAA

SEQ ID NO: 999335 - protein, 8 aa, Mycobacterium
AEELAKTD

SEQ ID NO: 999336 - protein, 12 aa, Mycobacterium
AEELGADPHLTS

SEQ ID NO: 999337 - protein, 5 aa, Mycobacterium
AEEMS

SEQ ID NO: 999338 - protein, 6 aa, Mycobacterium
AEENRH

SEQ ID NO: 999339 - protein, 9 aa, Mycobacterium
AEENRHSTA

SEQ ID NO: 999340 - protein, 11 aa, Mycobacterium
AEEPAGTRARE

SEQ ID NO: 999341 - protein, 13 aa, Mycobacterium
AEEQRKPGLPAAR

SEQ ID NO: 999342 - protein, 16 aa, Mycobacterium
AEERGYTATKHQREVG

SEQ ID NO: 999343 - protein, 5 aa, Mycobacterium
AEETA

SEQ ID NO: 999344 - protein, 14 aa, Mycobacterium
AEETAAAVGSTTGA

SEQ ID NO: 999345 - protein, 4 aa, Mycobacterium
AEEV

SEQ ID NO: 999346 - protein, 8 aa, Mycobacterium
AEEYGSHD

SEQ ID NO: 999347 - protein, 4 aa, Mycobacterium
AEFA

SEQ ID NO: 999348 - protein, 15 aa, Mycobacterium
AEFEPKAQRPTPGSA

SEQ ID NO: 999349 - protein, 5 aa, Mycobacterium
AEFPD

SEQ ID NO: 999350 - protein, 4 aa, Mycobacterium
AEGA

SEQ ID NO: 999351 - protein, 7 aa, Mycobacterium
AEGAKQA

SEQ ID NO: 999352 - protein, 7 aa, Mycobacterium
AEGANAY

SEQ ID NO: 999353 - protein, 7 aa, Mycobacterium
AEGARLD

SEQ ID NO: 999354 - protein, 6 aa, Mycobacterium
AEGDRY

SEQ ID NO: 999355 - protein, 7 aa, Mycobacterium
AEGEDGT

SEQ ID NO: 999356 - protein, 9 aa, Mycobacterium
AEGGPDHRG

SEQ ID NO: 999357 - protein, 5 aa, Mycobacterium
AEGGR

SEQ ID NO: 999358 - protein, 23 aa, Mycobacterium
AEGGTDADGKLAEASAAIARLVR

SEQ ID NO: 999359 - protein, 14 aa, Mycobacterium
AEGIGAEIGSAAAA

SEQ ID NO: 999360 - protein, 8 aa, Mycobacterium
AEGIPYDD

SEQ ID NO: 999361 - protein, 12 aa, Mycobacterium
AEGKATELANRE

SEQ ID NO: 999362 - protein, 5 aa, Mycobacterium
AEGKL

SEQ ID NO: 999363 - protein, 7 aa, Mycobacterium
AEGKNAL

SEQ ID NO: 999364 - protein, 7 aa, Mycobacterium
AEGLNAD

SEQ ID NO: 999365 - protein, 8 aa, Mycobacterium
AEGLPGRR

SEQ ID NO: 999366 - protein, 13 aa, Mycobacterium
AEGLRETQKTGES

SEQ ID NO: 999367 - protein, 8 aa, Mycobacterium
AEGNEEQR

SEQ ID NO: 999368 - protein, 8 aa, Mycobacterium
AEGNHLGP

SEQ ID NO: 999369 - protein, 19 aa, Mycobacterium
AEGPLPPDAVRCPPISFLC

SEQ ID NO: 999370 - protein, 5 aa, Mycobacterium
AEGPV

SEQ ID NO: 999371 - protein, 4 aa, Mycobacterium
AEGR

SEQ ID NO: 999372 - protein, 7 aa, Mycobacterium
AEGRASA

SEQ ID NO: 999373 - protein, 5 aa, Mycobacterium
AEGRD

SEQ ID NO: 999374 - protein, 5 aa, Mycobacterium
AEGRS

SEQ ID NO: 999375 - protein, 14 aa, Mycobacterium
AEGSAGEGGEVSPK

SEQ ID NO: 999376 - protein, 4 aa, Mycobacterium
AEGT

SEQ ID NO: 999377 - protein, 6 aa, Mycobacterium
AEGTGS

SEQ ID NO: 999378 - protein, 17 aa, Mycobacterium
AEGTPLPADERRPGQSV

SEQ ID NO: 999379 - protein, 5 aa, Mycobacterium
AEGTV

SEQ ID NO: 999380 - protein, 7 aa, Mycobacterium
AEGTVAG

SEQ ID NO: 999381 - protein, 4 aa, Mycobacterium
AEGV

SEQ ID NO: 999382 - protein, 7 aa, Mycobacterium
AEGVNPA

SEQ ID NO: 999383 - protein, 12 aa, Mycobacterium
AEGYADAAKRAA

SEQ ID NO: 999384 - protein, 8 aa, Mycobacterium
AEGYPGRR

SEQ ID NO: 999385 - protein, 5 aa, Mycobacterium
AEHAG

SEQ ID NO: 999386 - protein, 11 aa, Mycobacterium
AEHEAAAGAYA

SEQ ID NO: 999387 - protein, 9 aa, Mycobacterium
AEHGAEPAC

SEQ ID NO: 999388 - protein, 5 aa, Mycobacterium
AEHPD

SEQ ID NO: 999389 - protein, 8 aa, Mycobacterium
AEHPRLGP

SEQ ID NO: 999390 - protein, 24 aa, Mycobacterium
AEHTADRAESAGWTSPLRSAGPWA

SEQ ID NO: 999391 - protein, 10 aa, Mycobacterium
AEIEASAPTI

SEQ ID NO: 999392 - protein, 4 aa, Mycobacterium
AEIP

SEQ ID NO: 999393 - protein, 4 aa, Mycobacterium
AEKA

SEQ ID NO: 999394 - protein, 8 aa, Mycobacterium
AEKDSNGY

SEQ ID NO: 999395 - protein, 7 aa, Mycobacterium
AEKELER

SEQ ID NO: 999396 - protein, 6 aa, Mycobacterium
AEKGGY

SEQ ID NO: 999397 - protein, 4 aa, Mycobacterium
AEKH

SEQ ID NO: 999398 - protein, 6 aa, Mycobacterium
AEKITS

SEQ ID NO: 999399 - protein, 8 aa, Mycobacterium
AEKNTEEM

SEQ ID NO: 999400 - protein, 5 aa, Mycobacterium
AEKQV

SEQ ID NO: 999401 - protein, 6 aa, Mycobacterium
AEKTGR

SEQ ID NO: 999402 - protein, 13 aa, Mycobacterium
AEKVDRSNPYTPL

SEQ ID NO: 999403 - protein, 6 aa, Mycobacterium
AEKYGG

SEQ ID NO: 999404 - protein, 6 aa, Mycobacterium
AEKYTQ

SEQ ID NO: 999405 - protein, 4 aa, Mycobacterium
AELD

SEQ ID NO: 999406 - protein, 7 aa, Mycobacterium
AELDEET

SEQ ID NO: 999407 - protein, 6 aa, Mycobacterium
AELDEG

SEQ ID NO: 999408 - protein, 4 aa, Mycobacterium
AELG

SEQ ID NO: 999409 - protein, 6 aa, Mycobacterium
AELGRG

SEQ ID NO: 999410 - protein, 9 aa, Mycobacterium
AELGTAAES

SEQ ID NO: 999411 - protein, 5 aa, Mycobacterium
AELPA

SEQ ID NO: 999412 - protein, 15 aa, Mycobacterium
AELPRTSSATGPTLA

SEQ ID NO: 999413 - protein, 4 aa, Mycobacterium
AELQ

SEQ ID NO: 999414 - protein, 8 aa, Mycobacterium
AELSGSAA

SEQ ID NO: 999415 - protein, 22 aa, Mycobacterium
AEMTDADEGDGEPAEPASDDLD

SEQ ID NO: 999416 - protein, 19 aa, Mycobacterium
AENADQTGGGRRTYPGSKA

SEQ ID NO: 999417 - protein, 10 aa, Mycobacterium
AENAEPAEPA

SEQ ID NO: 999418 - protein, 16 aa, Mycobacterium
AENATGSGPLRPQGAD

SEQ ID NO: 999419 - protein, 6 aa, Mycobacterium
AENDDL

SEQ ID NO: 999420 - protein, 16 aa, Mycobacterium
AENERTYGEFSTREGE

SEQ ID NO: 999421 - protein, 9 aa, Mycobacterium
AENGADSDP

SEQ ID NO: 999422 - protein, 5 aa, Mycobacterium
AENGQ

SEQ ID NO: 999423 - protein, 7 aa, Mycobacterium
AENKAAA

SEQ ID NO: 999424 - protein, 16 aa, Mycobacterium
AENMPAQRRRAAHSAI

SEQ ID NO: 999425 - protein, 4 aa, Mycobacterium
AENP

SEQ ID NO: 999426 - protein, 8 aa, Mycobacterium
AENPDQRD

SEQ ID NO: 999427 - protein, 9 aa, Mycobacterium
AENPPKKYQ

SEQ ID NO: 999428 - protein, 6 aa, Mycobacterium
AENPRD

SEQ ID NO: 999429 - protein, 6 aa, Mycobacterium
AENQGV

SEQ ID NO: 999430 - protein, 4 aa, Mycobacterium
AENR

SEQ ID NO: 999431 - protein, 4 aa, Mycobacterium
AENS

SEQ ID NO: 999432 - protein, 5 aa, Mycobacterium
AENSG

SEQ ID NO: 999433 - protein, 7 aa, Mycobacterium
AENSTTV

SEQ ID NO: 999434 - protein, 6 aa, Mycobacterium
AENTDG

SEQ ID NO: 999435 - protein, 4 aa, Mycobacterium
AEPA

SEQ ID NO: 999436 - protein, 11 aa, Mycobacterium
AEPAEPEPNTL

SEQ ID NO: 999437 - protein, 11 aa, Mycobacterium
AEPAKRKPGYA

SEQ ID NO: 999438 - protein, 9 aa, Mycobacterium
AEPAPGTAN

SEQ ID NO: 999439 - protein, 15 aa, Mycobacterium
AEPAPHDESSPSGAD

SEQ ID NO: 999440 - protein, 17 aa, Mycobacterium
AEPAPPEPAAEPAPRTY

SEQ ID NO: 999441 - protein, 5 aa, Mycobacterium
AEPAT

SEQ ID NO: 999442 - protein, 9 aa, Mycobacterium
AEPDAEAPH

SEQ ID NO: 999443 - protein, 8 aa, Mycobacterium
AEPDAKTL

SEQ ID NO: 999444 - protein, 10 aa, Mycobacterium
AEPDASGPRV

SEQ ID NO: 999445 - protein, 8 aa, Mycobacterium
AEPDGAQA

SEQ ID NO: 999446 - protein, 8 aa, Mycobacterium
AEPDQEPK

SEQ ID NO: 999447 - protein, 5 aa, Mycobacterium
AEPDV

SEQ ID NO: 999448 - protein, 6 aa, Mycobacterium
AEPDVD

SEQ ID NO: 999449 - protein, 15 aa, Mycobacterium
AEPEAVAAEAREAAE

SEQ ID NO: 999450 - protein, 6 aa, Mycobacterium
AEPEHQ

SEQ ID NO: 999451 - protein, 10 aa, Mycobacterium
AEPERQHPRP

SEQ ID NO: 999452 - protein, 7 aa, Mycobacterium
AEPETAD

SEQ ID NO: 999453 - protein, 6 aa, Mycobacterium
AEPFPD

SEQ ID NO: 999454 - protein, 6 aa, Mycobacterium
AEPGHH

SEQ ID NO: 999455 - protein, 9 aa, Mycobacterium
AEPGLPPRS

SEQ ID NO: 999456 - protein, 6 aa, Mycobacterium
AEPGSA

SEQ ID NO: 999457 - protein, 7 aa, Mycobacterium
AEPGSYD

SEQ ID NO: 999458 - protein, 6 aa, Mycobacterium
AEPGTA

SEQ ID NO: 999459 - protein, 4 aa, Mycobacterium
AEPH

SEQ ID NO: 999460 - protein, 7 aa, Mycobacterium
AEPIDPA

SEQ ID NO: 999461 - protein, 6 aa, Mycobacterium
AEPIRA

SEQ ID NO: 999462 - protein, 21 aa, Mycobacterium
AEPLDETTSRGQYTTGWQGGE

SEQ ID NO: 999463 - protein, 7 aa, Mycobacterium
AEPPESA

SEQ ID NO: 999464 - protein, 7 aa, Mycobacterium
AEPPGSS

SEQ ID NO: 999465 - protein, 9 aa, Mycobacterium
AEPPPAHGH

SEQ ID NO: 999466 - protein, 10 aa, Mycobacterium
AEPPSAALNP

SEQ ID NO: 999467 - protein, 4 aa, Mycobacterium
AEPQ

SEQ ID NO: 999468 - protein, 5 aa, Mycobacterium
AEPQM

SEQ ID NO: 999469 - protein, 10 aa, Mycobacterium
AEPRGGQGPW

SEQ ID NO: 999470 - protein, 9 aa, Mycobacterium
AEPRNEHKR

SEQ ID NO: 999471 - protein, 9 aa, Mycobacterium
AEPRYTPSA

SEQ ID NO: 999472 - protein, 9 aa, Mycobacterium
AEPSADDTA

SEQ ID NO: 999473 - protein, 10 aa, Mycobacterium
AEPSASLSEV

SEQ ID NO: 999474 - protein, 9 aa, Mycobacterium
AEPSGTGIR

SEQ ID NO: 999475 - protein, 13 aa, Mycobacterium
AEPSLSGPGRDEL

SEQ ID NO: 999476 - protein, 15 aa, Mycobacterium
AEPTAPAAPSGGNPL

SEQ ID NO: 999477 - protein, 6 aa, Mycobacterium
AEPTQM

SEQ ID NO: 999478 - protein, 8 aa, Mycobacterium
AEPVEPSD

SEQ ID NO: 999479 - protein, 8 aa, Mycobacterium
AEPVKSAN

SEQ ID NO: 999480 - protein, 9 aa, Mycobacterium
AEPVSGADT

SEQ ID NO: 999481 - protein, 7 aa, Mycobacterium
AEQAAAA

SEQ ID NO: 999482 - protein, 8 aa, Mycobacterium
AEQAAESE

SEQ ID NO: 999483 - protein, 17 aa, Mycobacterium
AEQASQVETVKRSEAGM

SEQ ID NO: 999484 - protein, 6 aa, Mycobacterium
AEQATW

SEQ ID NO: 999485 - protein, 15 aa, Mycobacterium
AEQDPRKSFPAPTEL

SEQ ID NO: 999486 - protein, 15 aa, Mycobacterium
AEQEGDASNSPFKSL

SEQ ID NO: 999487 - protein, 5 aa, Mycobacterium
AEQFA

SEQ ID NO: 999488 - protein, 7 aa, Mycobacterium
AEQGADT

SEQ ID NO: 999489 - protein, 8 aa, Mycobacterium
AEQGIPAS

SEQ ID NO: 999490 - protein, 10 aa, Mycobacterium
AEQGKSDWAA

SEQ ID NO: 999491 - protein, 10 aa, Mycobacterium
AEQGRDPAGF

SEQ ID NO: 999492 - protein, 7 aa, Mycobacterium
AEQHGRR

SEQ ID NO: 999493 - protein, 8 aa, Mycobacterium
AEQKARNV

SEQ ID NO: 999494 - protein, 9 aa, Mycobacterium
AEQKSAPTT

SEQ ID NO: 999495 - protein, 6 aa, Mycobacterium
AEQLPF

SEQ ID NO: 999496 - protein, 26 aa, Mycobacterium
AEQPATSAPYTAPRPAPARAAERNAD

SEQ ID NO: 999497 - protein, 7 aa, Mycobacterium
AEQPDLQ

SEQ ID NO: 999498 - protein, 8 aa, Mycobacterium
AEQPGFRG

SEQ ID NO: 999499 - protein, 7 aa, Mycobacterium
AEQPTAV

SEQ ID NO: 999500 - protein, 15 aa, Mycobacterium
AEQQRRSYTAKLKAA

SEQ ID NO: 999501 - protein, 9 aa, Mycobacterium
AEQRAQATQ

SEQ ID NO: 999502 - protein, 12 aa, Mycobacterium
AEQRGHTPRSRR

SEQ ID NO: 999503 - protein, 9 aa, Mycobacterium
AEQRRDETA

SEQ ID NO: 999504 - protein, 8 aa, Mycobacterium
AEQRSTVT

SEQ ID NO: 999505 - protein, 14 aa, Mycobacterium
AEQTARQAAAAAGA

SEQ ID NO: 999506 - protein, 8 aa, Mycobacterium
AEQTDDAE

SEQ ID NO: 999507 - protein, 9 aa, Mycobacterium
AEQTPAPGE

SEQ ID NO: 999508 - protein, 6 aa, Mycobacterium
AEQTQW

SEQ ID NO: 999509 - protein, 11 aa, Mycobacterium
AEQTSELDDAR

SEQ ID NO: 999510 - protein, 6 aa, Mycobacterium
AEQVTT

SEQ ID NO: 999511 - protein, 5 aa, Mycobacterium
AERAA

SEQ ID NO: 999512 - protein, 10 aa, Mycobacterium
AERAARRRGR

SEQ ID NO: 999513 - protein, 10 aa, Mycobacterium
AERADITSGV

SEQ ID NO: 999514 - protein, 9 aa, Mycobacterium
AERAERIDT

SEQ ID NO: 999515 - protein, 8 aa, Mycobacterium
AERAGSDR

SEQ ID NO: 999516 - protein, 9 aa, Mycobacterium
AERARDLQQ

SEQ ID NO: 999517 - protein, 12 aa, Mycobacterium
AERARPHTGRTV

SEQ ID NO: 999518 - protein, 6 aa, Mycobacterium
AERDGG

SEQ ID NO: 999519 - protein, 9 aa, Mycobacterium
AERDGGRKV

SEQ ID NO: 999520 - protein, 5 aa, Mycobacterium
AERDI

SEQ ID NO: 999521 - protein, 5 aa, Mycobacterium
AERDQ

SEQ ID NO: 999522 - protein, 6 aa, Mycobacterium
AEREAR

SEQ ID NO: 999523 - protein, 13 aa, Mycobacterium
AEREASDDVEDAE

SEQ ID NO: 999524 - protein, 5 aa, Mycobacterium
AEREK

SEQ ID NO: 999525 - protein, 10 aa, Mycobacterium
AERERGAAPV

SEQ ID NO: 999526 - protein, 13 aa, Mycobacterium
AERERPKLGGEER

SEQ ID NO: 999527 - protein, 8 aa, Mycobacterium
AERETPKS

SEQ ID NO: 999528 - protein, 4 aa, Mycobacterium
AERG

SEQ ID NO: 999529 - protein, 12 aa, Mycobacterium
AERGEHELKGVP

SEQ ID NO: 999530 - protein, 6 aa, Mycobacterium
AERGFA

SEQ ID NO: 999531 - protein, 7 aa, Mycobacterium
AERGLPN

SEQ ID NO: 999532 - protein, 7 aa, Mycobacterium
AERGQGE

SEQ ID NO: 999533 - protein, 8 aa, Mycobacterium
AERGRTGL

SEQ ID NO: 999534 - protein, 15 aa, Mycobacterium
AERKGVPRAKLTGTI

SEQ ID NO: 999535 - protein, 4 aa, Mycobacterium
AERL

SEQ ID NO: 999536 - protein, 7 aa, Mycobacterium
AERLTEE

SEQ ID NO: 999537 - protein, 6 aa, Mycobacterium
AERNGA

SEQ ID NO: 999538 - protein, 11 aa, Mycobacterium
AERNSSEDAEA

SEQ ID NO: 999539 - protein, 4 aa, Mycobacterium
AERP

SEQ ID NO: 999540 - protein, 5 aa, Mycobacterium
AERPR

SEQ ID NO: 999541 - protein, 19 aa, Mycobacterium
AERQISCGGRGDDTTMSPD

SEQ ID NO: 999542 - protein, 19 aa, Mycobacterium
AERRGELPSNAVSGGPLPE

SEQ ID NO: 999543 - protein, 7 aa, Mycobacterium
AERRGEP

SEQ ID NO: 999544 - protein, 4 aa, Mycobacterium
AERS

SEQ ID NO: 999545 - protein, 7 aa, Mycobacterium
AERSGDD

SEQ ID NO: 999546 - protein, 10 aa, Mycobacterium
AERSGHTPQV

SEQ ID NO: 999547 - protein, 6 aa, Mycobacterium
AERSPT

SEQ ID NO: 999548 - protein, 18 aa, Mycobacterium
AERTADAHDAATSCPVKS

SEQ ID NO: 999549 - protein, 11 aa, Mycobacterium
AERTGDAPPRL

SEQ ID NO: 999550 - protein, 7 aa, Mycobacterium
AERTGEG

SEQ ID NO: 999551 - protein, 12 aa, Mycobacterium
AERTGTDPENDM

SEQ ID NO: 999552 - protein, 6 aa, Mycobacterium
AERTKR

SEQ ID NO: 999553 - protein, 11 aa, Mycobacterium
AERTKTLRDAG

SEQ ID NO: 999554 - protein, 4 aa, Mycobacterium
AESA

SEQ ID NO: 999555 - protein, 16 aa, Mycobacterium
AESANKVAQTNDPTAH

SEQ ID NO: 999556 - protein, 15 aa, Mycobacterium
AESAPSGSAAERARG

SEQ ID NO: 999557 - protein, 5 aa, Mycobacterium
AESDG

SEQ ID NO: 999558 - protein, 9 aa, Mycobacterium
AESDKPIST

SEQ ID NO: 999559 - protein, 11 aa, Mycobacterium
AESEAKAGGKC

SEQ ID NO: 999560 - protein, 24 aa, Mycobacterium
AESELNPVRGGRARSRGRNGQGVA

SEQ ID NO: 999561 - protein, 5 aa, Mycobacterium
AESEP

SEQ ID NO: 999562 - protein, 16 aa, Mycobacterium
AESERAACPNGEDNRL

SEQ ID NO: 999563 - protein, 18 aa, Mycobacterium
AESESDADVGDRANNPVR

SEQ ID NO: 999564 - protein, 15 aa, Mycobacterium
AESGAQSDDPAEPAR

SEQ ID NO: 999565 - protein, 5 aa, Mycobacterium
AESGD

SEQ ID NO: 999566 - protein, 7 aa, Mycobacterium
AESGDDA

SEQ ID NO: 999567 - protein, 10 aa, Mycobacterium
AESGEPAAGR

SEQ ID NO: 999568 - protein, 6 aa, Mycobacterium
AESGHE

SEQ ID NO: 999569 - protein, 5 aa, Mycobacterium
AESGK

SEQ ID NO: 999570 - protein, 7 aa, Mycobacterium
AESGLPD

SEQ ID NO: 999571 - protein, 10 aa, Mycobacterium
AESGTAVSEG

SEQ ID NO: 999572 - protein, 20 aa, Mycobacterium
AESGVTGGRGGSGSVGGGAG

SEQ ID NO: 999573 - protein, 17 aa, Mycobacterium
AESGWDRGGDQPPPPLP

SEQ ID NO: 999574 - protein, 5 aa, Mycobacterium
AESMA

SEQ ID NO: 999575 - protein, 15 aa, Mycobacterium
AESNPDDEVDETTTK

SEQ ID NO: 999576 - protein, 7 aa, Mycobacterium
AESPTGM

SEQ ID NO: 999577 - protein, 5 aa, Mycobacterium
AESQA

SEQ ID NO: 999578 - protein, 13 aa, Mycobacterium
AESQTGERAPKHR

SEQ ID NO: 999579 - protein, 9 aa, Mycobacterium
AESRATLGR

SEQ ID NO: 999580 - protein, 8 aa, Mycobacterium
AESRPTVP

SEQ ID NO: 999581 - protein, 6 aa, Mycobacterium
AESRQG

SEQ ID NO: 999582 - protein, 9 aa, Mycobacterium
AESRQTRDR

SEQ ID NO: 999583 - protein, 8 aa, Mycobacterium
AESSPSIV

SEQ ID NO: 999584 - protein, 6 aa, Mycobacterium
AESTAW

SEQ ID NO: 999585 - protein, 5 aa, Mycobacterium
AESTG

SEQ ID NO: 999586 - protein, 12 aa, Mycobacterium
AESTGVKASTDL

SEQ ID NO: 999587 - protein, 7 aa, Mycobacterium
AESYSGE

SEQ ID NO: 999588 - protein, 6 aa, Mycobacterium
AETAAE

SEQ ID NO: 999589 - protein, 27 aa, Mycobacterium
AETARHQGTQLADTARARVEAPVRGRR

SEQ ID NO: 999590 - protein, 8 aa, Mycobacterium
AETATYSL

SEQ ID NO: 999591 - protein, 9 aa, Mycobacterium
AETDANPLD

SEQ ID NO: 999592 - protein, 6 aa, Mycobacterium
AETDDA

SEQ ID NO: 999593 - protein, 5 aa, Mycobacterium
AETDE

SEQ ID NO: 999594 - protein, 5 aa, Mycobacterium
AETDP

SEQ ID NO: 999595 - protein, 6 aa, Mycobacterium
AETDSG

SEQ ID NO: 999596 - protein, 4 aa, Mycobacterium
AETE

SEQ ID NO: 999597 - protein, 12 aa, Mycobacterium
AETETTKPSPFA

SEQ ID NO: 999598 - protein, 8 aa, Mycobacterium
AETGDANG

SEQ ID NO: 999599 - protein, 12 aa, Mycobacterium
AETGESERRRTL

SEQ ID NO: 999600 - protein, 5 aa, Mycobacterium
AETGH

SEQ ID NO: 999601 - protein, 7 aa, Mycobacterium
AETGTVR

SEQ ID NO: 999602 - protein, 6 aa, Mycobacterium
AETGVT

SEQ ID NO: 999603 - protein, 6 aa, Mycobacterium
AETNGS

SEQ ID NO: 999604 - protein, 16 aa, Mycobacterium
AETPAPRSHDSDDHAV

SEQ ID NO: 999605 - protein, 8 aa, Mycobacterium
AETPDPTF

SEQ ID NO: 999606 - protein, 8 aa, Mycobacterium
AETPPALP

SEQ ID NO: 999607 - protein, 4 aa, Mycobacterium
AETR

SEQ ID NO: 999608 - protein, 19 aa, Mycobacterium
AETRARRRNDQNVASGLAD

SEQ ID NO: 999609 - protein, 11 aa, Mycobacterium
AETRSRRPPTS

SEQ ID NO: 999610 - protein, 9 aa, Mycobacterium
AETSEEAHK

SEQ ID NO: 999611 - protein, 18 aa, Mycobacterium
AETSGAAAKPSGAGGGDC

SEQ ID NO: 999612 - protein, 22 aa, Mycobacterium
AETSGGLPGFGDPLDGKTLSGA

SEQ ID NO: 999613 - protein, 9 aa, Mycobacterium
AETSPGPSY

SEQ ID NO: 999614 - protein, 7 aa, Mycobacterium
AETTGSQ

SEQ ID NO: 999615 - protein, 8 aa, Mycobacterium
AETVPPDE

SEQ ID NO: 999616 - protein, 10 aa, Mycobacterium
AEVDNDYQPT

SEQ ID NO: 999617 - protein, 5 aa, Mycobacterium
AEVDP

SEQ ID NO: 999618 - protein, 7 aa, Mycobacterium
AEVGRGG

SEQ ID NO: 999619 - protein, 7 aa, Mycobacterium
AEVPATA

SEQ ID NO: 999620 - protein, 15 aa, Mycobacterium
AEVPDAPGEPAEPES

SEQ ID NO: 999621 - protein, 11 aa, Mycobacterium
AEVQKAERAKL

SEQ ID NO: 999622 - protein, 6 aa, Mycobacterium
AEVRDD

SEQ ID NO: 999623 - protein, 4 aa, Mycobacterium
AEVT

SEQ ID NO: 999624 - protein, 18 aa, Mycobacterium
AEVTAGETFGEVESTKSV

SEQ ID NO: 999625 - protein, 6 aa, Mycobacterium
AEVTGA

SEQ ID NO: 999626 - protein, 7 aa, Mycobacterium
AEWNDDD

SEQ ID NO: 999627 - protein, 9 aa, Mycobacterium
AEYDGDQHR

SEQ ID NO: 999628 - protein, 10 aa, Mycobacterium
AEYEQSDDYR

SEQ ID NO: 999629 - protein, 5 aa, Mycobacterium
AEYHP

SEQ ID NO: 999630 - protein, 5 aa, Mycobacterium
AFAAG

SEQ ID NO: 999631 - protein, 25 aa, Mycobacterium
AFDSGGGGGGGGNGGNGGAGGASGA

SEQ ID NO: 999632 - protein, 6 aa, Mycobacterium
AFEGPR

SEQ ID NO: 999633 - protein, 12 aa, Mycobacterium
AFERDDPRGGEA

SEQ ID NO: 999634 - protein, 5 aa, Mycobacterium
AFGIS

SEQ ID NO: 999635 - protein, 6 aa, Mycobacterium
AFGPRA

SEQ ID NO: 999636 - protein, 5 aa, Mycobacterium
AFGSP

SEQ ID NO: 999637 - protein, 12 aa, Mycobacterium
AFKSERDNEAAL

SEQ ID NO: 999638 - protein, 9 aa, Mycobacterium
AFPAPPPRE

SEQ ID NO: 999639 - protein, 19 aa, Mycobacterium
AFPDQDQDQDQDQDQDQDH

SEQ ID NO: 999640 - protein, 7 aa, Mycobacterium
AFSPGDT

SEQ ID NO: 999641 - protein, 4 aa, Mycobacterium
AGAA

SEQ ID NO: 999642 - protein, 9 aa, Mycobacterium
AGAAAAAAH

SEQ ID NO: 999643 - protein, 11 aa, Mycobacterium
AGAAAAAQDTA

SEQ ID NO: 999644 - protein, 12 aa, Mycobacterium
AGAAAAARAAAA

SEQ ID NO: 999645 - protein, 17 aa, Mycobacterium
AGAAAPGAFDGAADYAA

SEQ ID NO: 999646 - protein, 12 aa, Mycobacterium
AGAADGTTWSEG

SEQ ID NO: 999647 - protein, 7 aa, Mycobacterium
AGAAEAA

SEQ ID NO: 999648 - protein, 7 aa, Mycobacterium
AGAAEAQ

SEQ ID NO: 999649 - protein, 21 aa, Mycobacterium
AGAAGTGCVETSGISADATVS

SEQ ID NO: 999650 - protein, 6 aa, Mycobacterium
AGAAMA

SEQ ID NO: 999651 - protein, 42 aa, Mycobacterium
AGAAPGAAMGSGGAGMAPMGAPGAGQAPGQTGKGKRAEPGDE

SEQ ID NO: 999652 - protein, 8 aa, Mycobacterium
AGAASADM

SEQ ID NO: 999653 - protein, 9 aa, Mycobacterium
AGAASAKLA

SEQ ID NO: 999654 - protein, 12 aa, Mycobacterium
AGADATDAEEGT

SEQ ID NO: 999655 - protein, 8 aa, Mycobacterium
AGADGSAV

SEQ ID NO: 999656 - protein, 5 aa, Mycobacterium
AGADP

SEQ ID NO: 999657 - protein, 8 aa, Mycobacterium
AGADPARP

SEQ ID NO: 999658 - protein, 9 aa, Mycobacterium
AGADPDDYT

SEQ ID NO: 999659 - protein, 6 aa, Mycobacterium
AGADRS

SEQ ID NO: 999660 - protein, 6 aa, Mycobacterium
AGADSL

SEQ ID NO: 999661 - protein, 8 aa, Mycobacterium
AGADSTEL

SEQ ID NO: 999662 - protein, 14 aa, Mycobacterium
AGADTQALDRARQQ

SEQ ID NO: 999663 - protein, 15 aa, Mycobacterium
AGAEAVSDGFAGGAD

SEQ ID NO: 999664 - protein, 6 aa, Mycobacterium
AGAEDA

SEQ ID NO: 999665 - protein, 7 aa, Mycobacterium
AGAEGTV

SEQ ID NO: 999666 - protein, 14 aa, Mycobacterium
AGAENPDPGPDSSE

SEQ ID NO: 999667 - protein, 8 aa, Mycobacterium
AGAEPGGA

SEQ ID NO: 999668 - protein, 6 aa, Mycobacterium
AGAEPQ

SEQ ID NO: 999669 - protein, 12 aa, Mycobacterium
AGAERALEQAAA

SEQ ID NO: 999670 - protein, 23 aa, Mycobacterium
AGAERGRELASTAAEKSAPYAEA

SEQ ID NO: 999671 - protein, 5 aa, Mycobacterium
AGAGA

SEQ ID NO: 999672 - protein, 11 aa, Mycobacterium
AGAGAGGGMPG

SEQ ID NO: 999673 - protein, 14 aa, Mycobacterium
AGAGAPSSDFEGPA

SEQ ID NO: 999674 - protein, 9 aa, Mycobacterium
AGAGATIGP

SEQ ID NO: 999675 - protein, 18 aa, Mycobacterium
AGAGAYAGAEAVNASPLQ

SEQ ID NO: 999676 - protein, 8 aa, Mycobacterium
AGAGDPAT

SEQ ID NO: 999677 - protein, 31 aa, Mycobacterium
AGAGGAGGAGGSSSGGNANGGAGGAGGAGAL

SEQ ID NO: 999678 - protein, 23 aa, Mycobacterium
AGAGGAGGEGTAAGGDGGNGGNG

SEQ ID NO: 999679 - protein, 24 aa, Mycobacterium
AGAGGAGGSANSVTGGAGGTGGAA

SEQ ID NO: 999680 - protein, 20 aa, Mycobacterium
AGAGGPGGSGGAGTYISPSG

SEQ ID NO: 999681 - protein, 35 aa, Mycobacterium
AGAGGQGGLGGDGNYAGQGSYGGVGGAGGAGGAAG

SEQ ID NO: 999682 - protein, 19 aa, Mycobacterium
AGAGGQGGNAAPGAYSDNL

SEQ ID NO: 999683 - protein, 16 aa, Mycobacterium
AGAGGSSGFGNNGSGL

SEQ ID NO: 999684 - protein, 9 aa, Mycobacterium
AGAGGTSWS

SEQ ID NO: 999685 - protein, 18 aa, Mycobacterium
AGAGGYSAVEAANTSLQQ

SEQ ID NO: 999686 - protein, 5 aa, Mycobacterium
AGAGI

SEQ ID NO: 999687 - protein, 8 aa, Mycobacterium
AGAGIGRA

SEQ ID NO: 999688 - protein, 9 aa, Mycobacterium
AGAGKTETM

SEQ ID NO: 999689 - protein, 7 aa, Mycobacterium
AGAGPAQ

SEQ ID NO: 999690 - protein, 7 aa, Mycobacterium
AGAGQAS

SEQ ID NO: 999691 - protein, 16 aa, Mycobacterium
AGAGQGPRGAASIGRG

SEQ ID NO: 999692 - protein, 25 aa, Mycobacterium
AGAGRQGGEKDQECRASAAVSHGYR

SEQ ID NO: 999693 - protein, 8 aa, Mycobacterium
AGAGSGAL

SEQ ID NO: 999694 - protein, 16 aa, Mycobacterium
AGAGSYATAEASNVAQ

SEQ ID NO: 999695 - protein, 13 aa, Mycobacterium
AGAGSYSSAEAAA

SEQ ID NO: 999696 - protein, 5 aa, Mycobacterium
AGAGV

SEQ ID NO: 999697 - protein, 10 aa, Mycobacterium
AGAHAATAGV

SEQ ID NO: 999698 - protein, 13 aa, Mycobacterium
AGALQRDGVTPGD

SEQ ID NO: 999699 - protein, 7 aa, Mycobacterium
AGANGNL

SEQ ID NO: 999700 - protein, 7 aa, Mycobacterium
AGANPLG

SEQ ID NO: 999701 - protein, 10 aa, Mycobacterium
AGANVSPAEV

SEQ ID NO: 999702 - protein, 15 aa, Mycobacterium
AGAPAFGAGPQGWDG

SEQ ID NO: 999703 - protein, 7 aa, Mycobacterium
AGAPELT

SEQ ID NO: 999704 - protein, 7 aa, Mycobacterium
AGAPGLD

SEQ ID NO: 999705 - protein, 13 aa, Mycobacterium
AGAPGRASANGTS

SEQ ID NO: 999706 - protein, 13 aa, Mycobacterium
AGAPGTGQNGGAG

SEQ ID NO: 999707 - protein, 6 aa, Mycobacterium
AGAPLT

SEQ ID NO: 999708 - protein, 13 aa, Mycobacterium
AGAPNYRPTGSPD

SEQ ID NO: 999709 - protein, 8 aa, Mycobacterium
AGAPPDEF

SEQ ID NO: 999710 - protein, 10 aa, Mycobacterium
AGAPQEVKHT

SEQ ID NO: 999711 - protein, 6 aa, Mycobacterium
AGAPSG

SEQ ID NO: 999712 - protein, 7 aa, Mycobacterium
AGAPSIV

SEQ ID NO: 999713 - protein, 11 aa, Mycobacterium
AGAPVAPGAEG

SEQ ID NO: 999714 - protein, 15 aa, Mycobacterium
AGAQEALAIANSVPR

SEQ ID NO: 999715 - protein, 10 aa, Mycobacterium
AGAQLPPRDL

SEQ ID NO: 999716 - protein, 10 aa, Mycobacterium
AGAQSAGAAR

SEQ ID NO: 999717 - protein, 17 aa, Mycobacterium
AGAQSYEAAEAANVIAA

SEQ ID NO: 999718 - protein, 19 aa, Mycobacterium
AGAQSYVGAEAANATPLQT

SEQ ID NO: 999719 - protein, 6 aa, Mycobacterium
AGAQTR

SEQ ID NO: 999720 - protein, 15 aa, Mycobacterium
AGAQVHGTASPGKHQ

SEQ ID NO: 999721 - protein, 10 aa, Mycobacterium
AGARAAGLTP

SEQ ID NO: 999722 - protein, 11 aa, Mycobacterium
AGARARARDPA

SEQ ID NO: 999723 - protein, 5 aa, Mycobacterium
AGARD

SEQ ID NO: 999724 - protein, 11 aa, Mycobacterium
AGARGGGGDYQ

SEQ ID NO: 999725 - protein, 6 aa, Mycobacterium
AGARGR

SEQ ID NO: 999726 - protein, 9 aa, Mycobacterium
AGARGTGKC

SEQ ID NO: 999727 - protein, 24 aa, Mycobacterium
AGARRREEYVGRGSPSRSYSTRAT

SEQ ID NO: 999728 - protein, 10 aa, Mycobacterium
AGARTPTRLQ

SEQ ID NO: 999729 - protein, 4 aa, Mycobacterium
AGAS

SEQ ID NO: 999730 - protein, 7 aa, Mycobacterium
AGASAGD

SEQ ID NO: 999731 - protein, 20 aa, Mycobacterium
AGASAYTGAEATNASPLQTV

SEQ ID NO: 999732 - protein, 17 aa, Mycobacterium
AGASAYTQAEAASASPL

SEQ ID NO: 999733 - protein, 10 aa, Mycobacterium
AGASGASGKK

SEQ ID NO: 999734 - protein, 16 aa, Mycobacterium
AGASGPEWTLYAWEPD

SEQ ID NO: 999735 - protein, 9 aa, Mycobacterium
AGASSGSLA

SEQ ID NO: 999736 - protein, 11 aa, Mycobacterium
AGASSSGSAVA

SEQ ID NO: 999737 - protein, 8 aa, Mycobacterium
AGASTGGF

SEQ ID NO: 999738 - protein, 4 aa, Mycobacterium
AGAT

SEQ ID NO: 999739 - protein, 22 aa, Mycobacterium
AGATAATSITSVRPAGADEVST

SEQ ID NO: 999740 - protein, 6 aa, Mycobacterium
AGATAQ

SEQ ID NO: 999741 - protein, 10 aa, Mycobacterium
AGATGDERSF

SEQ ID NO: 999742 - protein, 13 aa, Mycobacterium
AGATGTDAAAAER

SEQ ID NO: 999743 - protein, 5 aa, Mycobacterium
AGATN

SEQ ID NO: 999744 - protein, 8 aa, Mycobacterium
AGATNETL

SEQ ID NO: 999745 - protein, 12 aa, Mycobacterium
AGATPTPRLLAG

SEQ ID NO: 999746 - protein, 9 aa, Mycobacterium
AGATTPDAF

SEQ ID NO: 999747 - protein, 5 aa, Mycobacterium
AGATV

SEQ ID NO: 999748 - protein, 5 aa, Mycobacterium
AGAVG

SEQ ID NO: 999749 - protein, 5 aa, Mycobacterium
AGAVP

SEQ ID NO: 999750 - protein, 8 aa, Mycobacterium
AGAVPGPF

SEQ ID NO: 999751 - protein, 17 aa, Mycobacterium
AGAYSGAEAANASPLQT

SEQ ID NO: 999752 - protein, 8 aa, Mycobacterium
AGCGDGTY

SEQ ID NO: 999753 - protein, 5 aa, Mycobacterium
AGDAA

SEQ ID NO: 999754 - protein, 9 aa, Mycobacterium
AGDAASDAV

SEQ ID NO: 999755 - protein, 14 aa, Mycobacterium
AGDAASGNRTAEQT

SEQ ID NO: 999756 - protein, 11 aa, Mycobacterium
AGDADAVAERR

SEQ ID NO: 999757 - protein, 9 aa, Mycobacterium
AGDADEATL

SEQ ID NO: 999758 - protein, 5 aa, Mycobacterium
AGDAE

SEQ ID NO: 999759 - protein, 12 aa, Mycobacterium
AGDAESAPAAPW

SEQ ID NO: 999760 - protein, 80 aa, Mycobacterium
AGDAFGGAAGKGGTGVVGGNGGSGGAAYNYGTGNATGAGGSSGSGGAASVPNSASTATATSGSGGAGGDGTDGGNGGSGG

SEQ ID NO: 999761 - protein, 7 aa, Mycobacterium
AGDARRA

SEQ ID NO: 999762 - protein, 4 aa, Mycobacterium
AGDD

SEQ ID NO: 999763 - protein, 9 aa, Mycobacterium
AGDDDTARV

SEQ ID NO: 999764 - protein, 21 aa, Mycobacterium
AGDDGSGGTAIGNGGDGGANI

SEQ ID NO: 999765 - protein, 9 aa, Mycobacterium
AGDDPEVNE

SEQ ID NO: 999766 - protein, 8 aa, Mycobacterium
AGDDPQRV

SEQ ID NO: 999767 - protein, 6 aa, Mycobacterium
AGDDTF

SEQ ID NO: 999768 - protein, 4 aa, Mycobacterium
AGDE

SEQ ID NO: 999769 - protein, 5 aa, Mycobacterium
AGDED

SEQ ID NO: 999770 - protein, 6 aa, Mycobacterium
AGDEIK

SEQ ID NO: 999771 - protein, 6 aa, Mycobacterium
AGDEIS

SEQ ID NO: 999772 - protein, 5 aa, Mycobacterium
AGDER

SEQ ID NO: 999773 - protein, 6 aa, Mycobacterium
AGDERS

SEQ ID NO: 999774 - protein, 7 aa, Mycobacterium
AGDEVSA

SEQ ID NO: 999775 - protein, 5 aa, Mycobacterium
AGDFQ

SEQ ID NO: 999776 - protein, 5 aa, Mycobacterium
AGDGD

SEQ ID NO: 999777 - protein, 7 aa, Mycobacterium
AGDGDVA

SEQ ID NO: 999778 - protein, 11 aa, Mycobacterium
AGDGEATTSSA

SEQ ID NO: 999779 - protein, 13 aa, Mycobacterium
AGDGGAGGHGGHG

SEQ ID NO: 999780 - protein, 18 aa, Mycobacterium
AGDGPSRTMAKPQRDAGD

SEQ ID NO: 999781 - protein, 10 aa, Mycobacterium
AGDGPVVPGT

SEQ ID NO: 999782 - protein, 6 aa, Mycobacterium
AGDGQA

SEQ ID NO: 999783 - protein, 10 aa, Mycobacterium
AGDGVETGRH

SEQ ID NO: 999784 - protein, 5 aa, Mycobacterium
AGDGY

SEQ ID NO: 999785 - protein, 5 aa, Mycobacterium
AGDHA

SEQ ID NO: 999786 - protein, 10 aa, Mycobacterium
AGDHAGRDAE

SEQ ID NO: 999787 - protein, 11 aa, Mycobacterium
AGDHPQSGPKF

SEQ ID NO: 999788 - protein, 8 aa, Mycobacterium
AGDKASLS

SEQ ID NO: 999789 - protein, 4 aa, Mycobacterium
AGDL

SEQ ID NO: 999790 - protein, 6 aa, Mycobacterium
AGDLER

SEQ ID NO: 999791 - protein, 11 aa, Mycobacterium
AGDLPEGIEGG

SEQ ID NO: 999792 - protein, 13 aa, Mycobacterium
AGDLQAPGADIDA

SEQ ID NO: 999793 - protein, 5 aa, Mycobacterium
AGDMN

SEQ ID NO: 999794 - protein, 6 aa, Mycobacterium
AGDNKF

SEQ ID NO: 999795 - protein, 4 aa, Mycobacterium
AGDP

SEQ ID NO: 999796 - protein, 10 aa, Mycobacterium
AGDPDGGAAT

SEQ ID NO: 999797 - protein, 6 aa, Mycobacterium
AGDPDY

SEQ ID NO: 999798 - protein, 8 aa, Mycobacterium
AGDPEGGA

SEQ ID NO: 999799 - protein, 9 aa, Mycobacterium
AGDPEGGAA

SEQ ID NO: 999800 - protein, 7 aa, Mycobacterium
AGDPEQL

SEQ ID NO: 999801 - protein, 10 aa, Mycobacterium
AGDPETAAAA

SEQ ID NO: 999802 - protein, 7 aa, Mycobacterium
AGDPHPQ

SEQ ID NO: 999803 - protein, 8 aa, Mycobacterium
AGDPPPFD

SEQ ID NO: 999804 - protein, 18 aa, Mycobacterium
AGDQTSPGVEISGDPQAL

SEQ ID NO: 999805 - protein, 6 aa, Mycobacterium
AGDQVG

SEQ ID NO: 999806 - protein, 6 aa, Mycobacterium
AGDQVS

SEQ ID NO: 999807 - protein, 7 aa, Mycobacterium
AGDQVSA

SEQ ID NO: 999808 - protein, 6 aa, Mycobacterium
AGDRGV

SEQ ID NO: 999809 - protein, 9 aa, Mycobacterium
AGDSAGGTI

SEQ ID NO: 999810 - protein, 6 aa, Mycobacterium
AGDSGM

SEQ ID NO: 999811 - protein, 7 aa, Mycobacterium
AGDSNDL

SEQ ID NO: 999812 - protein, 10 aa, Mycobacterium
AGDSNSDATF

SEQ ID NO: 999813 - protein, 9 aa, Mycobacterium
AGDSPLAAD

SEQ ID NO: 999814 - protein, 13 aa, Mycobacterium
AGDSYAITEASNA

SEQ ID NO: 999815 - protein, 10 aa, Mycobacterium
AGDTDEQARD

SEQ ID NO: 999816 - protein, 15 aa, Mycobacterium
AGDTEADREQAAAGT

SEQ ID NO: 999817 - protein, 7 aa, Mycobacterium
AGDTGGL

SEQ ID NO: 999818 - protein, 5 aa, Mycobacterium
AGDTM

SEQ ID NO: 999819 - protein, 11 aa, Mycobacterium
AGDTSGGRTPS

SEQ ID NO: 999820 - protein, 4 aa, Mycobacterium
AGDY

SEQ ID NO: 999821 - protein, 5 aa, Mycobacterium
AGEAA

SEQ ID NO: 999822 - protein, 8 aa, Mycobacterium
AGEAARQR

SEQ ID NO: 999823 - protein, 5 aa, Mycobacterium
AGEDA

SEQ ID NO: 999824 - protein, 12 aa, Mycobacterium
AGEDLDAYPRTL

SEQ ID NO: 999825 - protein, 12 aa, Mycobacterium
AGEGAASADPVA

SEQ ID NO: 999826 - protein, 6 aa, Mycobacterium
AGEGDA

SEQ ID NO: 999827 - protein, 11 aa, Mycobacterium
AGEGDGGDGGN

SEQ ID NO: 999828 - protein, 9 aa, Mycobacterium
AGEGEPDQV

SEQ ID NO: 999829 - protein, 10 aa, Mycobacterium
AGEGESTTDL

SEQ ID NO: 999830 - protein, 6 aa, Mycobacterium
AGEGPV

SEQ ID NO: 999831 - protein, 16 aa, Mycobacterium
AGEGSAISDSDFKAAG

SEQ ID NO: 999832 - protein, 10 aa, Mycobacterium
AGEKAKDDPF

SEQ ID NO: 999833 - protein, 5 aa, Mycobacterium
AGEKQ

SEQ ID NO: 999834 - protein, 4 aa, Mycobacterium
AGEL

SEQ ID NO: 999835 - protein, 6 aa, Mycobacterium
AGELAS

SEQ ID NO: 999836 - protein, 6 aa, Mycobacterium
AGENDL

SEQ ID NO: 999837 - protein, 7 aa, Mycobacterium
AGEPATG

SEQ ID NO: 999838 - protein, 8 aa, Mycobacterium
AGEPDGKE

SEQ ID NO: 999839 - protein, 10 aa, Mycobacterium
AGEPIGPKAL

SEQ ID NO: 999840 - protein, 13 aa, Mycobacterium
AGEPLDDEDFRPR

SEQ ID NO: 999841 - protein, 11 aa, Mycobacterium
AGEPPRDSSLT

SEQ ID NO: 999842 - protein, 16 aa, Mycobacterium
AGEPQASGKTYKVTGD

SEQ ID NO: 999843 - protein, 16 aa, Mycobacterium
AGEPTAVASAPQGLRA

SEQ ID NO: 999844 - protein, 5 aa, Mycobacterium
AGEPW

SEQ ID NO: 999845 - protein, 4 aa, Mycobacterium
AGEQ

SEQ ID NO: 999846 - protein, 9 aa, Mycobacterium
AGEQDAKSI

SEQ ID NO: 999847 - protein, 5 aa, Mycobacterium
AGEQR

SEQ ID NO: 999848 - protein, 7 aa, Mycobacterium
AGERDSV

SEQ ID NO: 999849 - protein, 10 aa, Mycobacterium
AGERERAQAA

SEQ ID NO: 999850 - protein, 8 aa, Mycobacterium
AGERGSAG

SEQ ID NO: 999851 - protein, 13 aa, Mycobacterium
AGERGSPDTWRDP

SEQ ID NO: 999852 - protein, 17 aa, Mycobacterium
AGERKTSALADSSDTQR

SEQ ID NO: 999853 - protein, 7 aa, Mycobacterium
AGERLPS

SEQ ID NO: 999854 - protein, 8 aa, Mycobacterium
AGERSGRE

SEQ ID NO: 999855 - protein, 8 aa, Mycobacterium
AGERSVGR

SEQ ID NO: 999856 - protein, 7 aa, Mycobacterium
AGETLDE

SEQ ID NO: 999857 - protein, 8 aa, Mycobacterium
AGEVREGL

SEQ ID NO: 999858 - protein, 4 aa, Mycobacterium
AGEY

SEQ ID NO: 999859 - protein, 4 aa, Mycobacterium
AGFA

SEQ ID NO: 999860 - protein, 11 aa, Mycobacterium
AGFDPQRSSAW

SEQ ID NO: 999861 - protein, 8 aa, Mycobacterium
AGFGGGGV

SEQ ID NO: 999862 - protein, 6 aa, Mycobacterium
AGFGTS

SEQ ID NO: 999863 - protein, 6 aa, Mycobacterium
AGFPGF

SEQ ID NO: 999864 - protein, 10 aa, Mycobacterium
AGFSGKAQIG

SEQ ID NO: 999865 - protein, 4 aa, Mycobacterium
AGGA

SEQ ID NO: 999866 - protein, 8 aa, Mycobacterium
AGGADPQA

SEQ ID NO: 999867 - protein, 13 aa, Mycobacterium
AGGAGGAAGNAGL

SEQ ID NO: 999868 - protein, 31 aa, Mycobacterium
AGGAGGAAGTGGAGISGYPNGFGGSRGHRRQ

SEQ ID NO: 999869 - protein, 34 aa, Mycobacterium
AGGAGGADGAGGLGGNGGDATGFGMTGGDGAMGG

SEQ ID NO: 999870 - protein, 105 aa, Mycobacterium
AGGAGGAGGAGATPGGAGGVGGSGGAGGLGGTGSAGAGLGATGGDGGAGGVGGQAGAGGAGGAVTGSINPLGNAGAHGANGTGGVGGTGGVGGAGGTGIAGTGDL

SEQ ID NO: 999871 - protein, 13 aa, Mycobacterium
AGGAGGAGGDSGL

SEQ ID NO: 999872 - protein, 72 aa, Mycobacterium
AGGAGGAGGSATTPGGAGGAGGTGGANGLIGGGNGGVGGAGGAGAAGGAGAVGSTAQAGGTGGDGGAGGANR

SEQ ID NO: 999873 - protein, 22 aa, Mycobacterium
AGGAGGEGGGGQSGGAGGAGGV

SEQ ID NO: 999874 - protein, 46 aa, Mycobacterium
AGGAGGTGDFNGSGGHGGTGGLVTGSDGADGTESFDGGNGGSGGFA

SEQ ID NO: 999875 - protein, 31 aa, Mycobacterium; identical to SEQ ID NO: 421463

SEQ ID NO: 999876 - protein, 21 aa, Mycobacterium
AGGAGGTGGVGASGGTGGAGG

SEQ ID NO: 999877 - protein, 11 aa, Mycobacterium
AGGAGGVGGTG

SEQ ID NO: 999878 - protein, 7 aa, Mycobacterium
AGGATEH

SEQ ID NO: 999879 - protein, 6 aa, Mycobacterium
AGGATV

SEQ ID NO: 999880 - protein, 6 aa, Mycobacterium
AGGAVT

SEQ ID NO: 999881 - protein, 16 aa, Mycobacterium
AGGAYAGAEAANVSPL

SEQ ID NO: 999882 - protein, 12 aa, Mycobacterium
AGGDALRQRTGA

SEQ ID NO: 999883 - protein, 7 aa, Mycobacterium
AGGDEIS

SEQ ID NO: 999884 - protein, 8 aa, Mycobacterium
AGGDEVSE

SEQ ID NO: 999885 - protein, 8 aa, Mycobacterium
AGGDEVST

SEQ ID NO: 999886 - protein, 6 aa, Mycobacterium
AGGDPA

SEQ ID NO: 999887 - protein, 9 aa, Mycobacterium
AGGDPLGTP

SEQ ID NO: 999888 - protein, 57 aa, Mycobacterium
AGGDSGAGGDSVGGADGGDGGNGGKAGLVGQGGDGGAGGNNNSGFGTGGSGGKGGDA

SEQ ID NO: 999889 - protein, 15 aa, Mycobacterium
AGGDTAIDDLDGSDP

SEQ ID NO: 999890 - protein, 4 aa, Mycobacterium
AGGE

SEQ ID NO: 999891 - protein, 9 aa, Mycobacterium
AGGEDVSPQ

SEQ ID NO: 999892 - protein, 13 aa, Mycobacterium
AGGEGDAQTGTNI

SEQ ID NO: 999893 - protein, 8 aa, Mycobacterium
AGGEGPAT

SEQ ID NO: 999894 - protein, 7 aa, Mycobacterium
AGGEGTL

SEQ ID NO: 999895 - protein, 11 aa, Mycobacterium
AGGEKGKPRYD

SEQ ID NO: 999896 - protein, 8 aa, Mycobacterium
AGGELASE

SEQ ID NO: 999897 - protein, 10 aa, Mycobacterium
AGGELGAGSS

SEQ ID NO: 999898 - protein, 7 aa, Mycobacterium
AGGELSP

SEQ ID NO: 999899 - protein, 15 aa, Mycobacterium
AGGEPMYQRPPDRRF

SEQ ID NO: 999900 - protein, 4 aa, Mycobacterium
AGGF

SEQ ID NO: 999901 - protein, 23 aa, Mycobacterium
AGGFGGASGFGTGGVGGVGGAGG

SEQ ID NO: 999902 - protein, 6 aa, Mycobacterium
AGGGAA

SEQ ID NO: 999903 - protein, 13 aa, Mycobacterium
AGGGAAPYPDPDD

SEQ ID NO: 999904 - protein, 14 aa, Mycobacterium
AGGGGAGGNGGAAG

SEQ ID NO: 999905 - protein, 7 aa, Mycobacterium
AGGGGFG

SEQ ID NO: 999906 - protein, 10 aa, Mycobacterium
AGGGGNGGNA

SEQ ID NO: 999907 - protein, 73 aa, Mycobacterium
AGGGGTGGSGGDAGWLGSGGAGGAGGISVNGDAGAGGAGGTSGQLLGDGGAGGAGGEAELAAGGAGGSGGVGG

SEQ ID NO: 999908 - protein, 5 aa, Mycobacterium
AGGGH

SEQ ID NO: 999909 - protein, 27 aa, Mycobacterium
AGGGHGGTGGFGAGGTGGDGGAGGNAG

SEQ ID NO: 999910 - protein, 36 aa, Mycobacterium
AGGGHGGTGGYGGGAGGAGATGGGNTGGIGGDGGSA

SEQ ID NO: 999911 - protein, 18 aa, Mycobacterium
AGGGIAKRTLTKSGPHDL

SEQ ID NO: 999912 - protein, 7 aa, Mycobacterium
AGGGIGR

SEQ ID NO: 999913 - protein, 6 aa, Mycobacterium
AGGGLD

SEQ ID NO: 999914 - protein, 7 aa, Mycobacterium
AGGGLGR

SEQ ID NO: 999915 - protein, 11 aa, Mycobacterium
AGGGPGAGQLQ

SEQ ID NO: 999916 - protein, 7 aa, Mycobacterium
AGGGPWA

SEQ ID NO: 999917 - protein, 39 aa, Mycobacterium
AGGGQSGPVNAGPPVRETAPAAPEPEAAAPAPGEVEAPV

SEQ ID NO: 999918 - protein, 6 aa, Mycobacterium
AGGGSA

SEQ ID NO: 999919 - protein, 9 aa, Mycobacterium
AGGGSPRDT

SEQ ID NO: 999920 - protein, 13 aa, Mycobacterium
AGGGVIDEPATAE

SEQ ID NO: 999921 - protein, 7 aa, Mycobacterium
AGGGVRA

SEQ ID NO: 999922 - protein, 6 aa, Mycobacterium
AGGHGN

SEQ ID NO: 999923 - protein, 7 aa, Mycobacterium
AGGIGTS

SEQ ID NO: 999924 - protein, 7 aa, Mycobacterium
AGGITQN

SEQ ID NO: 999925 - protein, 9 aa, Mycobacterium
AGGKSTPDM

SEQ ID NO: 999926 - protein, 26 aa, Mycobacterium
AGGLGGAGGYGPGGVGGTGGAGGAGG

SEQ ID NO: 999927 - protein, 16 aa, Mycobacterium
AGGLPEYQPPGGPPVG

SEQ ID NO: 999928 - protein, 14 aa, Mycobacterium
AGGLRADGLKPGDR

SEQ ID NO: 999929 - protein, 7 aa, Mycobacterium
AGGLRPD

SEQ ID NO: 999930 - protein, 4 aa, Mycobacterium
AGGM

SEQ ID NO: 999931 - protein, 12 aa, Mycobacterium
AGGNARDGKAGD

SEQ ID NO: 999932 - protein, 34 aa, Mycobacterium
AGGNGGNGGPGTAKGDPGSGGAGGLLGVDGLNGL

SEQ ID NO: 999933 - protein, 33 aa, Mycobacterium; identical to SEQ ID NO: 421725

SEQ ID NO: 999934 - protein, 9 aa, Mycobacterium
AGGNGGTGG

SEQ ID NO: 999935 - protein, 9 aa, Mycobacterium
AGGNRSGLP

SEQ ID NO: 999936 - protein, 10 aa, Mycobacterium
AGGPDKIKTG

SEQ ID NO: 999937 - protein, 15 aa, Mycobacterium
AGGPGGAAAGAGPRY

SEQ ID NO: 999938 - protein, 8 aa, Mycobacterium
AGGPSDAL

SEQ ID NO: 999939 - protein, 7 aa, Mycobacterium
AGGPTLP

SEQ ID NO: 999940 - protein, 12 aa, Mycobacterium
AGGQASKDLVAD

SEQ ID NO: 999941 - protein, 7 aa, Mycobacterium
AGGQDPV

SEQ ID NO: 999942 - protein, 13 aa, Mycobacterium
AGGQGGQVAEEPQ

SEQ ID NO: 999943 - protein, 4 aa, Mycobacterium
AGGR

SEQ ID NO: 999944 - protein, 6 aa, Mycobacterium
AGGRNA

SEQ ID NO: 999945 - protein, 12 aa, Mycobacterium
AGGRRLDQTAEG

SEQ ID NO: 999946 - protein, 5 aa, Mycobacterium
AGGRT

SEQ ID NO: 999947 - protein, 27 aa, Mycobacterium
AGGSDGGAGGTGVNHEGGAGGAGGAGG

SEQ ID NO: 999948 - protein, 15 aa, Mycobacterium
AGGSEQDRADAHRRA

SEQ ID NO: 999949 - protein, 157 aa, Mycobacterium
AGGSGGSGGIGATGTGSGGAAGNGGIGGNGGAGGAPGAAGLAGTGGQAGNEGVGGNGAQGGHGGTGGTGSIGAAGGNGGQGGSGGAAGSGGGTAGNGGAGGLGGTGGVGGGGGDGGAGALAGTGGSGGTGGASGAGGSGGGGGLSAAARAVQTAAPA

SEQ ID NO: 999950 - protein, 7 aa, Mycobacterium
AGGSNLD

SEQ ID NO: 999951 - protein, 8 aa, Mycobacterium
AGGSPLPS

SEQ ID NO: 999952 - protein, 8 aa, Mycobacterium
AGGSQSIT

SEQ ID NO: 999953 - protein, 11 aa, Mycobacterium
AGGSSESGSQM

SEQ ID NO: 999954 - protein, 5 aa, Mycobacterium
AGGST

SEQ ID NO: 999955 - protein, 6 aa, Mycobacterium
AGGSTV

SEQ ID NO: 999956 - protein, 16 aa, Mycobacterium
AGGTDPVEKATPGTIR

SEQ ID NO: 999957 - protein, 5 aa, Mycobacterium
AGGTE

SEQ ID NO: 999958 - protein, 6 aa, Mycobacterium
AGGTEE

SEQ ID NO: 999959 - protein, 6 aa, Mycobacterium
AGGTGD

SEQ ID NO: 999960 - protein, 47 aa, Mycobacterium
AGGTGGNGGAGGDGGAGGVGGDGGAGGVGGVGGDGGAGGVGGVGGDG

SEQ ID NO: 999961 - protein, 90 aa, Mycobacterium
AGGTGVDLGGGGGDGQTGGPGTLGGNGGNGGTASMGGSGGGGSGGDGGGGGGAGGNGAIGGFSGGNGGAGGSGGSGGGAGGNGGDGGNAT

SEQ ID NO: 999962 - protein, 8 aa, Mycobacterium
AGGTREPI

SEQ ID NO: 999963 - protein, 10 aa, Mycobacterium
AGGTSEVTRN

SEQ ID NO: 999964 - protein, 14 aa, Mycobacterium
AGGVDTTSDPPIGL

SEQ ID NO: 999965 - protein, 5 aa, Mycobacterium
AGGVG

SEQ ID NO: 999966 - protein, 6 aa, Mycobacterium
AGGVGA

SEQ ID NO: 999967 - protein, 21 aa, Mycobacterium
AGGVGGISGNDTGGVGGMGGT

SEQ ID NO: 999968 - protein, 7 aa, Mycobacterium
AGGVGGN

SEQ ID NO: 999969 - protein, 7 aa, Mycobacterium
AGGVGTA

SEQ ID NO: 999970 - protein, 5 aa, Mycobacterium
AGGVP

SEQ ID NO: 999971 - protein, 6 aa, Mycobacterium
AGGWTR

SEQ ID NO: 999972 - protein, 11 aa, Mycobacterium
AGGYAKRTGIE

SEQ ID NO: 999973 - protein, 48 aa, Mycobacterium; identical to SEQ ID NO: 894506

SEQ ID NO: 999974 - protein, 7 aa, Mycobacterium
AGGYSKK

SEQ ID NO: 999975 - protein, 29 aa, Mycobacterium
AGHAGAGGGGGVGGSGGVGDVDSTGSGVG

SEQ ID NO: 999976 - protein, 13 aa, Mycobacterium
AGHDGAPLPIEDG

SEQ ID NO: 999977 - protein, 19 aa, Mycobacterium
AGHGGDGGAGGHGGQGGLG

SEQ ID NO: 999978 - protein, 9 aa, Mycobacterium
AGHGPNEAA

SEQ ID NO: 999979 - protein, 6 aa, Mycobacterium
AGHRCD

SEQ ID NO: 999980 - protein, 13 aa, Mycobacterium
AGHRDALPDHGAD

SEQ ID NO: 999981 - protein, 10 aa, Mycobacterium
AGHREQARAR

SEQ ID NO: 999982 - protein, 8 aa, Mycobacterium
AGHSDGDV

SEQ ID NO: 999983 - protein, 6 aa, Mycobacterium
AGHSRE

SEQ ID NO: 999984 - protein, 8 aa, Mycobacterium
AGHSTAQI

SEQ ID NO: 999985 - protein, 13 aa, Mycobacterium
AGHTAAGDDNDAF

SEQ ID NO: 999986 - protein, 11 aa, Mycobacterium
AGIANSGNATF

SEQ ID NO: 999987 - protein, 13 aa, Mycobacterium
AGIDPKALRGSAT

SEQ ID NO: 999988 - protein, 5 aa, Mycobacterium
AGIEV

SEQ ID NO: 999989 - protein, 13 aa, Mycobacterium
AGIEVTDTVNGPQ

SEQ ID NO: 999990 - protein, 8 aa, Mycobacterium
AGIGPGAA

SEQ ID NO: 999991 - protein, 6 aa, Mycobacterium
AGIGST

SEQ ID NO: 999992 - protein, 9 aa, Mycobacterium
AGINNDRAA

SEQ ID NO: 999993 - protein, 7 aa, Mycobacterium
AGIPDGA

SEQ ID NO: 999994 - protein, 8 aa, Mycobacterium
AGIPPTRT

SEQ ID NO: 999995 - protein, 6 aa, Mycobacterium
AGIPQR

SEQ ID NO: 999996 - protein, 5 aa, Mycobacterium
AGIPS

SEQ ID NO: 999997 - protein, 13 aa, Mycobacterium
AGIPSQAPASRPH

SEQ ID NO: 999998 - protein, 10 aa, Mycobacterium
AGIQRAKRTR

SEQ ID NO: 999999 - protein, 6 aa, Mycobacterium
AGISNR

SEQ ID NO: 1000000 - protein, 16 aa, Mycobacterium
AGISPESRASTGGEEA

SEQ ID NO: 1000001 - protein, 12 aa, Mycobacterium
AGISPQTIRGTQ

SEQ ID NO: 1000002 - protein, 23 aa, Mycobacterium
AGISTDSGIPDYRGPDSPPSNPM

SEQ ID NO: 1000003 - protein, 6 aa, Mycobacterium
AGITPP

SEQ ID NO: 1000004 - protein, 7 aa, Mycobacterium
AGKAGLV

SEQ ID NO: 1000005 - protein, 5 aa, Mycobacterium
AGKEA

SEQ ID NO: 1000006 - protein, 9 aa, Mycobacterium
AGKEGGDRW

SEQ ID NO: 1000007 - protein, 9 aa, Mycobacterium
AGKETVTTL

SEQ ID NO: 1000008 - protein, 9 aa, Mycobacterium
AGKFEQASQ

SEQ ID NO: 1000009 - protein, 12 aa, Mycobacterium
AGKGSAEPRNSR

SEQ ID NO: 1000010 - protein, 5 aa, Mycobacterium
AGKLE

SEQ ID NO: 1000011 - protein, 10 aa, Mycobacterium
AGKPLASSNR

SEQ ID NO: 1000012 - protein, 12 aa, Mycobacterium
AGKPLDDDDRRP

SEQ ID NO: 1000013 - protein, 11 aa, Mycobacterium
AGKQGLSGGNE

SEQ ID NO: 1000014 - protein, 8 aa, Mycobacterium
AGKSALSA

SEQ ID NO: 1000015 - protein, 20 aa, Mycobacterium
AGKSKYVDNGWPTTDPDDHA

SEQ ID NO: 1000016 - protein, 7 aa, Mycobacterium
AGKSLRR

SEQ ID NO: 1000017 - protein, 4 aa, Mycobacterium
AGKV

SEQ ID NO: 1000018 - protein, 6 aa, Mycobacterium
AGKYGV

SEQ ID NO: 1000019 - protein, 6 aa, Mycobacterium
AGLAEG

SEQ ID NO: 1000020 - protein, 7 aa, Mycobacterium
AGLAPLP

SEQ ID NO: 1000021 - protein, 6 aa, Mycobacterium
AGLDEE

SEQ ID NO: 1000022 - protein, 5 aa, Mycobacterium
AGLDG

SEQ ID NO: 1000023 - protein, 8 aa, Mycobacterium
AGLDGAKE

SEQ ID NO: 1000024 - protein, 10 aa, Mycobacterium
AGLDSADDRF

SEQ ID NO: 1000025 - protein, 10 aa, Mycobacterium
AGLDSDSQAR

SEQ ID NO: 1000026 - protein, 20 aa, Mycobacterium
AGLDSRSGPAATSEGTSADL

SEQ ID NO: 1000027 - protein, 7 aa, Mycobacterium
AGLDSTA

SEQ ID NO: 1000028 - protein, 24 aa, Mycobacterium
AGLGAAPTSPPPVAPPTSDMTGGV

SEQ ID NO: 1000029 - protein, 13 aa, Mycobacterium
AGLGGNGGAGGSV

SEQ ID NO: 1000030 - protein, 6 aa, Mycobacterium
AGLGNY

SEQ ID NO: 1000031 - protein, 7 aa, Mycobacterium
AGLGPAA

SEQ ID NO: 1000032 - protein, 12 aa, Mycobacterium
AGLGREVSAADT

SEQ ID NO: 1000033 - protein, 13 aa, Mycobacterium
AGLHPSSTATTVR

SEQ ID NO: 1000034 - protein, 14 aa, Mycobacterium
AGLKARDYPVNFDV

SEQ ID NO: 1000035 - protein, 14 aa, Mycobacterium
AGLKATPGNGHYAA

SEQ ID NO: 1000036 - protein, 6 aa, Mycobacterium
AGLPAD

SEQ ID NO: 1000037 - protein, 6 aa, Mycobacterium
AGLPEE

SEQ ID NO: 1000038 - protein, 13 aa, Mycobacterium
AGLPEPAKPGEQR

SEQ ID NO: 1000039 - protein, 13 aa, Mycobacterium
AGLPGAASEWPNY

SEQ ID NO: 1000040 - protein, 20 aa, Mycobacterium
AGLPGQAWQGSAAMQGSGVV

SEQ ID NO: 1000041 - protein, 15 aa, Mycobacterium
AGLPGTKKGCDQGAC

SEQ ID NO: 1000042 - protein, 9 aa, Mycobacterium
AGLPKPGRQ

SEQ ID NO: 1000043 - protein, 5 aa, Mycobacterium
AGLPP

SEQ ID NO: 1000044 - protein, 38 aa, Mycobacterium; identical to SEQ ID NO: 422351

SEQ ID NO: 1000045 - protein, 18 aa, Mycobacterium
AGLPTSDEDKGAQATAAA

SEQ ID NO: 1000046 - protein, 6 aa, Mycobacterium
AGLQPE

SEQ ID NO: 1000047 - protein, 9 aa, Mycobacterium
AGLQSNPGI

SEQ ID NO: 1000048 - protein, 10 aa, Mycobacterium
AGLRSDSRTT

SEQ ID NO: 1000049 - protein, 4 aa, Mycobacterium
AGLS

SEQ ID NO: 1000050 - protein, 12 aa, Mycobacterium
AGLSRQGRRGPI

SEQ ID NO: 1000051 - protein, 22 aa, Mycobacterium
AGLSTGLGDEGGFAPDVASTTA

SEQ ID NO: 1000052 - protein, 6 aa, Mycobacterium
AGLTEK

SEQ ID NO: 1000053 - protein, 11 aa, Mycobacterium
AGLTGSAKPDV

SEQ ID NO: 1000054 - protein, 5 aa, Mycobacterium
AGLTN

SEQ ID NO: 1000055 - protein, 6 aa, Mycobacterium
AGLTPQ

SEQ ID NO: 1000056 - protein, 8 aa, Mycobacterium
AGLTVDEG

SEQ ID NO: 1000057 - protein, 15 aa, Mycobacterium
AGMAPKAKSGYPATP

SEQ ID NO: 1000058 - protein, 6 aa, Mycobacterium
AGMDKE

SEQ ID NO: 1000059 - protein, 8 aa, Mycobacterium
AGMDTGGV

SEQ ID NO: 1000060 - protein, 6 aa, Mycobacterium
AGMQTS

SEQ ID NO: 1000061 - protein, 4 aa, Mycobacterium
AGMT

SEQ ID NO: 1000062 - protein, 8 aa, Mycobacterium
AGNAERRQ

SEQ ID NO: 1000063 - protein, 6 aa, Mycobacterium
AGNDDA

SEQ ID NO: 1000064 - protein, 9 aa, Mycobacterium
AGNDPSHPG

SEQ ID NO: 1000065 - protein, 10 aa, Mycobacterium
AGNEVTASYS

SEQ ID NO: 1000066 - protein, 74 aa, Mycobacterium; identical to SEQ ID NO: 894595

SEQ ID NO: 1000067 - protein, 5 aa, Mycobacterium
AGNGG

SEQ ID NO: 1000068 - protein, 15 aa, Mycobacterium
AGNGGAGGTGGDAGM

SEQ ID NO: 1000069 - protein, 13 aa, Mycobacterium
AGNGGDGGAGGRG

SEQ ID NO: 1000070 - protein, 30 aa, Mycobacterium
AGNGGDGGQGGEADRTGGVGGMGGAGGAAG

SEQ ID NO: 1000071 - protein, 10 aa, Mycobacterium
AGNGGDGGTG

SEQ ID NO: 1000072 - protein, 20 aa, Mycobacterium
AGNGGDSGSGGGSDETQTGV

SEQ ID NO: 1000073 - protein, 9 aa, Mycobacterium
AGNGGKGGN

SEQ ID NO: 1000074 - protein, 12 aa, Mycobacterium
AGNGGNGGYGPT

SEQ ID NO: 1000075 - protein, 9 aa, Mycobacterium
AGNGGNGVS

SEQ ID NO: 1000076 - protein, 10 aa, Mycobacterium
AGNGMAGHTA

SEQ ID NO: 1000077 - protein, 7 aa, Mycobacterium
AGNLGGP

SEQ ID NO: 1000078 - protein, 12 aa, Mycobacterium
AGNMSKRQSATG

SEQ ID NO: 1000079 - protein, 14 aa, Mycobacterium
AGNNSGTADDGRIS

SEQ ID NO: 1000080 - protein, 5 aa, Mycobacterium
AGNNY

SEQ ID NO: 1000081 - protein, 5 aa, Mycobacterium
AGNPF

SEQ ID NO: 1000082 - protein, 7 aa, Mycobacterium
AGNPPEI

SEQ ID NO: 1000083 - protein, 6 aa, Mycobacterium
AGNPPY

SEQ ID NO: 1000084 - protein, 10 aa, Mycobacterium
AGNRGPAAVP

SEQ ID NO: 1000085 - protein, 8 aa, Mycobacterium
AGNSAAMA

SEQ ID NO: 1000086 - protein, 21 aa, Mycobacterium
AGNSAGTAGPDGGSDTGAVAP

SEQ ID NO: 1000087 - protein, 9 aa, Mycobacterium
AGNSPSFQE

SEQ ID NO: 1000088 - protein, 7 aa, Mycobacterium
AGPADGP

SEQ ID NO: 1000089 - protein, 7 aa, Mycobacterium
AGPAEPA

SEQ ID NO: 1000090 - protein, 68 aa, Mycobacterium
AGPAERADPAPPPADPGEPAAPPRSCSAQAGSAAAAATAAGPAGPADRGRDVRQRRGRRRRRRPGLRR

SEQ ID NO: 1000091 - protein, 7 aa, Mycobacterium
AGPAGLA

SEQ ID NO: 1000092 - protein, 9 aa, Mycobacterium
AGPAGRTEV

SEQ ID NO: 1000093 - protein, 12 aa, Mycobacterium
AGPAHAGGPGSF

SEQ ID NO: 1000094 - protein, 15 aa, Mycobacterium
AGPALSADAEQGGLA

SEQ ID NO: 1000095 - protein, 6 aa, Mycobacterium
AGPALV

SEQ ID NO: 1000096 - protein, 5 aa, Mycobacterium
AGPAN

SEQ ID NO: 1000097 - protein, 16 aa, Mycobacterium
AGPAPEDFGAYRTYCG

SEQ ID NO: 1000098 - protein, 9 aa, Mycobacterium
AGPAPVTNA

SEQ ID NO: 1000099 - protein, 8 aa, Mycobacterium
AGPAQASI

SEQ ID NO: 1000100 - protein, 10 aa, Mycobacterium
AGPATGSSAH

SEQ ID NO: 1000101 - protein, 8 aa, Mycobacterium
AGPAVPAG

SEQ ID NO: 1000102 - protein, 5 aa, Mycobacterium
AGPAW

SEQ ID NO: 1000103 - protein, 8 aa, Mycobacterium
AGPDGATI

SEQ ID NO: 1000104 - protein, 17 aa, Mycobacterium
AGPDGAVRPPDGRETAT

SEQ ID NO: 1000105 - protein, 7 aa, Mycobacterium
AGPDGPR

SEQ ID NO: 1000106 - protein, 6 aa, Mycobacterium
AGPDGR

SEQ ID NO: 1000107 - protein, 11 aa, Mycobacterium
AGPDPQTASNP

SEQ ID NO: 1000108 - protein, 7 aa, Mycobacterium
AGPDRAE

SEQ ID NO: 1000109 - protein, 9 aa, Mycobacterium
AGPDTSATY

SEQ ID NO: 1000110 - protein, 7 aa, Mycobacterium
AGPEAAA

SEQ ID NO: 1000111 - protein, 9 aa, Mycobacterium
AGPEAQEEL

SEQ ID NO: 1000112 - protein, 12 aa, Mycobacterium
AGPEDAGQSFDT

SEQ ID NO: 1000113 - protein, 7 aa, Mycobacterium
AGPEDVA

SEQ ID NO: 1000114 - protein, 7 aa, Mycobacterium
AGPEYGG

SEQ ID NO: 1000115 - protein, 4 aa, Mycobacterium
AGPF

SEQ ID NO: 1000116 - protein, 7 aa, Mycobacterium
AGPFGED

SEQ ID NO: 1000117 - protein, 8 aa, Mycobacterium
AGPGAHGY

SEQ ID NO: 1000118 - protein, 12 aa, Mycobacterium
AGPGAPNQPDDH

SEQ ID NO: 1000119 - protein, 7 aa, Mycobacterium
AGPGDSI

SEQ ID NO: 1000120 - protein, 16 aa, Mycobacterium
AGPGFGNSSTSPSSGF

SEQ ID NO: 1000121 - protein, 5 aa, Mycobacterium
AGPGG

SEQ ID NO: 1000122 - protein, 6 aa, Mycobacterium
AGPGGL

SEQ ID NO: 1000123 - protein, 6 aa, Mycobacterium
AGPGKR

SEQ ID NO: 1000124 - protein, 11 aa, Mycobacterium
AGPGPDTGRNG

SEQ ID NO: 1000125 - protein, 10 aa, Mycobacterium
AGPGPGPIVG

SEQ ID NO: 1000126 - protein, 6 aa, Mycobacterium
AGPGQR

SEQ ID NO: 1000127 - protein, 8 aa, Mycobacterium
AGPGTNGS

SEQ ID NO: 1000128 - protein, 5 aa, Mycobacterium
AGPHD

SEQ ID NO: 1000129 - protein, 6 aa, Mycobacterium
AGPHPF

SEQ ID NO: 1000130 - protein, 4 aa, Mycobacterium
AGPI

SEQ ID NO: 1000131 - protein, 11 aa, Mycobacterium
AGPIDAPDPKV

SEQ ID NO: 1000132 - protein, 5 aa, Mycobacterium
AGPIG

SEQ ID NO: 1000133 - protein, 8 aa, Mycobacterium
AGPIGDDD

SEQ ID NO: 1000134 - protein, 6 aa, Mycobacterium
AGPKKI

SEQ ID NO: 1000135 - protein, 10 aa, Mycobacterium
AGPLGAQAAN

SEQ ID NO: 1000136 - protein, 9 aa, Mycobacterium
AGPMNRPPE

SEQ ID NO: 1000137 - protein, 4 aa, Mycobacterium
AGPN

SEQ ID NO: 1000138 - protein, 11 aa, Mycobacterium
AGPNNAALSAA

SEQ ID NO: 1000139 - protein, 13 aa, Mycobacterium
AGPNSAIPHHRPT

SEQ ID NO: 1000140 - protein, 7 aa, Mycobacterium
AGPPESV

SEQ ID NO: 1000141 - protein, 8 aa, Mycobacterium
AGPPEVAT

SEQ ID NO: 1000142 - protein, 9 aa, Mycobacterium
AGPPGAGTR

SEQ ID NO: 1000143 - protein, 10 aa, Mycobacterium
AGPPGQHAGA

SEQ ID NO: 1000144 - protein, 10 aa, Mycobacterium
AGPQGSDRPH

SEQ ID NO: 1000145 - protein, 8 aa, Mycobacterium
AGPQSGWA

SEQ ID NO: 1000146 - protein, 7 aa, Mycobacterium
AGPRLGK

SEQ ID NO: 1000147 - protein, 8 aa, Mycobacterium
AGPRPGAR

SEQ ID NO: 1000148 - protein, 6 aa, Mycobacterium
AGPRPV

SEQ ID NO: 1000149 - protein, 29 aa, Mycobacterium
AGPRSDAALQASSGRTATTKAMGKGSTQH

SEQ ID NO: 1000150 - protein, 4 aa, Mycobacterium
AGPS

SEQ ID NO: 1000151 - protein, 5 aa, Mycobacterium
AGPSA

SEQ ID NO: 1000152 - protein, 6 aa, Mycobacterium
AGPSAL

SEQ ID NO: 1000153 - protein, 6 aa, Mycobacterium
AGPSCD

SEQ ID NO: 1000154 - protein, 8 aa, Mycobacterium
AGPSEDIR

SEQ ID NO: 1000155 - protein, 7 aa, Mycobacterium
AGPSISE

SEQ ID NO: 1000156 - protein, 6 aa, Mycobacterium
AGPSTR

SEQ ID NO: 1000157 - protein, 8 aa, Mycobacterium
AGPSWAGD

SEQ ID NO: 1000158 - protein, 13 aa, Mycobacterium
AGPTAGSLPLQPS

SEQ ID NO: 1000159 - protein, 7 aa, Mycobacterium
AGPTAGY

SEQ ID NO: 1000160 - protein, 6 aa, Mycobacterium
AGPTEF

SEQ ID NO: 1000161 - protein, 9 aa, Mycobacterium
AGPTESLNA

SEQ ID NO: 1000162 - protein, 4 aa, Mycobacterium
AGPV

SEQ ID NO: 1000163 - protein, 6 aa, Mycobacterium
AGPVGT

SEQ ID NO: 1000164 - protein, 11 aa, Mycobacterium
AGPVTAPGATH

SEQ ID NO: 1000165 - protein, 10 aa, Mycobacterium
AGPWQGPSAA

SEQ ID NO: 1000166 - protein, 9 aa, Mycobacterium
AGPYETTLA

SEQ ID NO: 1000167 - protein, 6 aa, Mycobacterium
AGPYTH

SEQ ID NO: 1000168 - protein, 11 aa, Mycobacterium
AGQAEKEVGDQ

SEQ ID NO: 1000169 - protein, 11 aa, Mycobacterium
AGQAEQAAAQA

SEQ ID NO: 1000170 - protein, 11 aa, Mycobacterium
AGQATTGGPRV

SEQ ID NO: 1000171 - protein, 6 aa, Mycobacterium
AGQDEL

SEQ ID NO: 1000172 - protein, 7 aa, Mycobacterium
AGQDNGA

SEQ ID NO: 1000173 - protein, 7 aa, Mycobacterium
AGQECQQ

SEQ ID NO: 1000174 - protein, 6 aa, Mycobacterium
AGQEVN

SEQ ID NO: 1000175 - protein, 10 aa, Mycobacterium
AGQGAGEYPT

SEQ ID NO: 1000176 - protein, 10 aa, Mycobacterium
AGQGQPERRV

SEQ ID NO: 1000177 - protein, 11 aa, Mycobacterium
AGQHNDANRAV

SEQ ID NO: 1000178 - protein, 5 aa, Mycobacterium
AGQKG

SEQ ID NO: 1000179 - protein, 7 aa, Mycobacterium
AGQKVGS

SEQ ID NO: 1000180 - protein, 6 aa, Mycobacterium
AGQLEN

SEQ ID NO: 1000181 - protein, 8 aa, Mycobacterium
AGQNHGPA

SEQ ID NO: 1000182 - protein, 7 aa, Mycobacterium
AGQNTDD

SEQ ID NO: 1000183 - protein, 8 aa, Mycobacterium
AGQPGPGV

SEQ ID NO: 1000184 - protein, 8 aa, Mycobacterium
AGQPNGAA

SEQ ID NO: 1000185 - protein, 14 aa, Mycobacterium
AGQPSVGAPEPIRA

SEQ ID NO: 1000186 - protein, 10 aa, Mycobacterium
AGQPTSTNPI

SEQ ID NO: 1000187 - protein, 6 aa, Mycobacterium
AGQQAG

SEQ ID NO: 1000188 - protein, 13 aa, Mycobacterium
AGQQIADAEVDAG

SEQ ID NO: 1000189 - protein, 6 aa, Mycobacterium
AGQQTV

SEQ ID NO: 1000190 - protein, 7 aa, Mycobacterium
AGQRDGL

SEQ ID NO: 1000191 - protein, 11 aa, Mycobacterium
AGQSDGGPSVI

SEQ ID NO: 1000192 - protein, 11 aa, Mycobacterium
AGQTGSSNEEV

SEQ ID NO: 1000193 - protein, 6 aa, Mycobacterium
AGQTPD

SEQ ID NO: 1000194 - protein, 20 aa, Mycobacterium
AGQWNNAARSDAFDRSAELE

SEQ ID NO: 1000195 - protein, 6 aa, Mycobacterium
AGRAAK

SEQ ID NO: 1000196 - protein, 10 aa, Mycobacterium
AGRAAPGLDE

SEQ ID NO: 1000197 - protein, 10 aa, Mycobacterium
AGRADKPDFT

SEQ ID NO: 1000198 - protein, 5 aa, Mycobacterium
AGRAG

SEQ ID NO: 1000199 - protein, 8 aa, Mycobacterium
AGRAGSIA

SEQ ID NO: 1000200 - protein, 10 aa, Mycobacterium
AGRAKRDPAL

SEQ ID NO: 1000201 - protein, 5 aa, Mycobacterium
AGRAM

SEQ ID NO: 1000202 - protein, 17 aa, Mycobacterium
AGRANKARLNRSPVRST

SEQ ID NO: 1000203 - protein, 7 aa, Mycobacterium
AGRAPQL

SEQ ID NO: 1000204 - protein, 8 aa, Mycobacterium
AGRAPSTE

SEQ ID NO: 1000205 - protein, 7 aa, Mycobacterium
AGRARGV

SEQ ID NO: 1000206 - protein, 15 aa, Mycobacterium
AGRARLNASSDNVRD

SEQ ID NO: 1000207 - protein, 6 aa, Mycobacterium
AGRCRA

SEQ ID NO: 1000208 - protein, 6 aa, Mycobacterium
AGRDDP

SEQ ID NO: 1000209 - protein, 7 aa, Mycobacterium
AGRDDPG

SEQ ID NO: 1000210 - protein, 6 aa, Mycobacterium
AGRDDT

SEQ ID NO: 1000211 - protein, 6 aa, Mycobacterium
AGRDQA

SEQ ID NO: 1000212 - protein, 10 aa, Mycobacterium
AGRDYSDVPP

SEQ ID NO: 1000213 - protein, 8 aa, Mycobacterium
AGREHSGI

SEQ ID NO: 1000214 - protein, 16 aa, Mycobacterium
AGRETAPEPVITGPST

SEQ ID NO: 1000215 - protein, 6 aa, Mycobacterium
AGRGAD

SEQ ID NO: 1000216 - protein, 8 aa, Mycobacterium
AGRGATRG

SEQ ID NO: 1000217 - protein, 6 aa, Mycobacterium
AGRGDD

SEQ ID NO: 1000218 - protein, 7 aa, Mycobacterium
AGRGDRA

SEQ ID NO: 1000219 - protein, 21 aa, Mycobacterium
AGRGFSSGADHKSAGAVPNVG

SEQ ID NO: 1000220 - protein, 6 aa, Mycobacterium
AGRGKA

SEQ ID NO: 1000221 - protein, 6 aa, Mycobacterium
AGRGNE

SEQ ID NO: 1000222 - protein, 6 aa, Mycobacterium
AGRGTR

SEQ ID NO: 1000223 - protein, 7 aa, Mycobacterium
AGRGTTG

SEQ ID NO: 1000224 - protein, 4 aa, Mycobacterium
AGRH

SEQ ID NO: 1000225 - protein, 33 aa, Mycobacterium
AGRHAGSSPLAGAGATQEDEPPHATKSAASAER

SEQ ID NO: 1000226 - protein, 6 aa, Mycobacterium
AGRKGY

SEQ ID NO: 1000227 - protein, 9 aa, Mycobacterium
AGRNHPSVE

SEQ ID NO: 1000228 - protein, 9 aa, Mycobacterium
AGRNPKLGY

SEQ ID NO: 1000229 - protein, 5 aa, Mycobacterium
AGRPA

SEQ ID NO: 1000230 - protein, 8 aa, Mycobacterium
AGRPDIKS

SEQ ID NO: 1000231 - protein, 8 aa, Mycobacterium
AGRPGRNL

SEQ ID NO: 1000232 - protein, 9 aa, Mycobacterium
AGRPPATTG

SEQ ID NO: 1000233 - protein, 19 aa, Mycobacterium
AGRPPRCRPTGAGRHRHGR

SEQ ID NO: 1000234 - protein, 30 aa, Mycobacterium
AGRPRERAPVARRRPDRSPPTRIHRSGVGR

SEQ ID NO: 1000235 - protein, 20 aa, Mycobacterium
AGRPSGSSDACRRRERRRRR

SEQ ID NO: 1000236 - protein, 8 aa, Mycobacterium
AGRPSPLY

SEQ ID NO: 1000237 - protein, 7 aa, Mycobacterium
AGRPTPE

SEQ ID NO: 1000238 - protein, 9 aa, Mycobacterium
AGRPTRANF

SEQ ID NO: 1000239 - protein, 28 aa, Mycobacterium
AGRQAGDTVTYSTPRGPSQVELLSIKLP

SEQ ID NO: 1000240 - protein, 5 aa, Mycobacterium
AGRQG

SEQ ID NO: 1000241 - protein, 12 aa, Mycobacterium
AGRQRWRAQKPK

SEQ ID NO: 1000242 - protein, 10 aa, Mycobacterium
AGRRDRADEV

SEQ ID NO: 1000243 - protein, 23 aa, Mycobacterium
AGRRDSSSSGSSMAQALRDAGFG

SEQ ID NO: 1000244 - protein, 6 aa, Mycobacterium
AGRRGA

SEQ ID NO: 1000245 - protein, 7 aa, Mycobacterium
AGRRPTA

SEQ ID NO: 1000246 - protein, 26 aa, Mycobacterium
AGRRRKVRDPVAARKPRRWTARRGVG

SEQ ID NO: 1000247 - protein, 13 aa, Mycobacterium
AGRRTEPHERPGP

SEQ ID NO: 1000248 - protein, 12 aa, Mycobacterium
AGRSANGPAASR

SEQ ID NO: 1000249 - protein, 6 aa, Mycobacterium
AGRSDN

SEQ ID NO: 1000250 - protein, 9 aa, Mycobacterium
AGRSGGTNI

SEQ ID NO: 1000251 - protein, 10 aa, Mycobacterium
AGRSGRRGQG

SEQ ID NO: 1000252 - protein, 6 aa, Mycobacterium
AGRSNA

SEQ ID NO: 1000253 - protein, 8 aa, Mycobacterium
AGRSPEDF

SEQ ID NO: 1000254 - protein, 10 aa, Mycobacterium
AGRSRPGARV

SEQ ID NO: 1000255 - protein, 10 aa, Mycobacterium
AGRSTAESNV

SEQ ID NO: 1000256 - protein, 6 aa, Mycobacterium
AGRSTD

SEQ ID NO: 1000257 - protein, 13 aa, Mycobacterium
AGRSTGPTEGPAI

SEQ ID NO: 1000258 - protein, 9 aa, Mycobacterium
AGRSTRPAT

SEQ ID NO: 1000259 - protein, 13 aa, Mycobacterium
AGRSTTEADTAFE

SEQ ID NO: 1000260 - protein, 5 aa, Mycobacterium
AGRSV

SEQ ID NO: 1000261 - protein, 7 aa, Mycobacterium
AGRTAAE

SEQ ID NO: 1000262 - protein, 11 aa, Mycobacterium
AGRTAPAGPKE

SEQ ID NO: 1000263 - protein, 15 aa, Mycobacterium
AGRTDVGGLGQAGAA

SEQ ID NO: 1000264 - protein, 7 aa, Mycobacterium
AGRTEAP

SEQ ID NO: 1000265 - protein, 5 aa, Mycobacterium
AGRTR

SEQ ID NO: 1000266 - protein, 7 aa, Mycobacterium
AGRTSAP

SEQ ID NO: 1000267 - protein, 17 aa, Mycobacterium
AGRYATAEAAAASPLQT

SEQ ID NO: 1000268 - protein, 7 aa, Mycobacterium
AGRYSDP

SEQ ID NO: 1000269 - protein, 27 aa, Mycobacterium
AGSAALTGEPGGPPTLPGYSSADNSTG

SEQ ID NO: 1000270 - protein, 10 aa, Mycobacterium
AGSAAPGKAR

SEQ ID NO: 1000271 - protein, 9 aa, Mycobacterium
AGSADTHDD

SEQ ID NO: 1000272 - protein, 5 aa, Mycobacterium
AGSAE

SEQ ID NO: 1000273 - protein, 10 aa, Mycobacterium
AGSAEVDEYG

SEQ ID NO: 1000274 - protein, 29 aa, Mycobacterium
AGSAPRSADPEIDAANATALAGSAKNQHE

SEQ ID NO: 1000275 - protein, 5 aa, Mycobacterium
AGSAV

SEQ ID NO: 1000276 - protein, 18 aa, Mycobacterium
AGSDEQFRTAAGGGTASQ

SEQ ID NO: 1000277 - protein, 9 aa, Mycobacterium
AGSDGSNAG

SEQ ID NO: 1000278 - protein, 5 aa, Mycobacterium
AGSDL

SEQ ID NO: 1000279 - protein, 13 aa, Mycobacterium
AGSDPRRDGQAAA

SEQ ID NO: 1000280 - protein, 11 aa, Mycobacterium
AGSDRKTQRSV

SEQ ID NO: 1000281 - protein, 14 aa, Mycobacterium
AGSEGHRADLARLT

SEQ ID NO: 1000282 - protein, 13 aa, Mycobacterium
AGSEHGSAKTAAE

SEQ ID NO: 1000283 - protein, 6 aa, Mycobacterium
AGSEPM

SEQ ID NO: 1000284 - protein, 12 aa, Mycobacterium
AGSGCQRSAELA

SEQ ID NO: 1000285 - protein, 22 aa, Mycobacterium
AGSGGFGGSSTKTAGDGGTGGN

SEQ ID NO: 1000286 - protein, 24 aa, Mycobacterium
AGSGGGDPRPGSYPAQMLVDWVRV

SEQ ID NO: 1000287 - protein, 30 aa, Mycobacterium; identical to SEQ ID NO: 423714

SEQ ID NO: 1000288 - protein, 15 aa, Mycobacterium
AGSGGVVGQPGEGLQ

SEQ ID NO: 1000289 - protein, 7 aa, Mycobacterium
AGSGIGQ

SEQ ID NO: 1000290 - protein, 7 aa, Mycobacterium
AGSGKLA

SEQ ID NO: 1000291 - protein, 7 aa, Mycobacterium
AGSGKTA

SEQ ID NO: 1000292 - protein, 7 aa, Mycobacterium
AGSGMQA

SEQ ID NO: 1000293 - protein, 17 aa, Mycobacterium
AGSGNISLPAAKSGATV

SEQ ID NO: 1000294 - protein, 6 aa, Mycobacterium
AGSGNV

SEQ ID NO: 1000295 - protein, 14 aa, Mycobacterium
AGSGPGDDRVGATR

SEQ ID NO: 1000296 - protein, 6 aa, Mycobacterium
AGSGPM

SEQ ID NO: 1000297 - protein, 9 aa, Mycobacterium
AGSGRPERK

SEQ ID NO: 1000298 - protein, 8 aa, Mycobacterium
AGSGTATV

SEQ ID NO: 1000299 - protein, 7 aa, Mycobacterium
AGSGTPL

SEQ ID NO: 1000300 - protein, 8 aa, Mycobacterium
AGSIAENN

SEQ ID NO: 1000301 - protein, 9 aa, Mycobacterium
AGSISGSDG

SEQ ID NO: 1000302 - protein, 8 aa, Mycobacterium
AGSLQEVG

SEQ ID NO: 1000303 - protein, 10 aa, Mycobacterium
AGSLTEPGVG

SEQ ID NO: 1000304 - protein, 4 aa, Mycobacterium
AGSP

SEQ ID NO: 1000305 - protein, 7 aa, Mycobacterium
AGSPEAD

SEQ ID NO: 1000306 - protein, 8 aa, Mycobacterium
AGSPEQKK

SEQ ID NO: 1000307 - protein, 8 aa, Mycobacterium
AGSPFDAS

SEQ ID NO: 1000308 - protein, 13 aa, Mycobacterium
AGSPGAPETRAAS

SEQ ID NO: 1000309 - protein, 7 aa, Mycobacterium
AGSPGYD

SEQ ID NO: 1000310 - protein, 6 aa, Mycobacterium
AGSPLR

SEQ ID NO: 1000311 - protein, 7 aa, Mycobacterium
AGSPPAC

SEQ ID NO: 1000312 - protein, 8 aa, Mycobacterium
AGSPPEFA

SEQ ID NO: 1000313 - protein, 8 aa, Mycobacterium
AGSRPDKV

SEQ ID NO: 1000314 - protein, 8 aa, Mycobacterium
AGSRTGRV

SEQ ID NO: 1000315 - protein, 7 aa, Mycobacterium
AGSRVSA

SEQ ID NO: 1000316 - protein, 9 aa, Mycobacterium
AGSSAAATR

SEQ ID NO: 1000317 - protein, 8 aa, Mycobacterium
AGSSAGAA

SEQ ID NO: 1000318 - protein, 9 aa, Mycobacterium
AGSSAGATL

SEQ ID NO: 1000319 - protein, 6 aa, Mycobacterium
AGSSAR

SEQ ID NO: 1000320 - protein, 7 aa, Mycobacterium
AGSSARW

SEQ ID NO: 1000321 - protein, 10 aa, Mycobacterium
AGSSASATKI

SEQ ID NO: 1000322 - protein, 16 aa, Mycobacterium
AGSSAVGSRYQSPAWS

SEQ ID NO: 1000323 - protein, 9 aa, Mycobacterium
AGSSEAAQA

SEQ ID NO: 1000324 - protein, 10 aa, Mycobacterium
AGSSGAAGAL

SEQ ID NO: 1000325 - protein, 7 aa, Mycobacterium
AGSSQIQ

SEQ ID NO: 1000326 - protein, 10 aa, Mycobacterium
AGSSRDKTAR

SEQ ID NO: 1000327 - protein, 14 aa, Mycobacterium
AGSSRSTELPRLQP

SEQ ID NO: 1000328 - protein, 9 aa, Mycobacterium
AGSSTTADF

SEQ ID NO: 1000329 - protein, 10 aa, Mycobacterium
AGSSTVPGVG

SEQ ID NO: 1000330 - protein, 11 aa, Mycobacterium
AGSSVGDAPWD

SEQ ID NO: 1000331 - protein, 15 aa, Mycobacterium
AGSTAALAAAPRGMP

SEQ ID NO: 1000332 - protein, 13 aa, Mycobacterium
AGSTPDSNGVSRR

SEQ ID NO: 1000333 - protein, 7 aa, Mycobacterium
AGSTPML

SEQ ID NO: 1000334 - protein, 20 aa, Mycobacterium
AGSTSGGEDPRDWAPDAWEM

SEQ ID NO: 1000335 - protein, 8 aa, Mycobacterium
AGSTSSGL

SEQ ID NO: 1000336 - protein, 10 aa, Mycobacterium
AGSVDDGKST

SEQ ID NO: 1000337 - protein, 7 aa, Mycobacterium
AGSVSER

SEQ ID NO: 1000338 - protein, 10 aa, Mycobacterium
AGTAGTAGTM

SEQ ID NO: 1000339 - protein, 7 aa, Mycobacterium
AGTAGTL

SEQ ID NO: 1000340 - protein, 6 aa, Mycobacterium
AGTAHA

SEQ ID NO: 1000341 - protein, 8 aa, Mycobacterium
AGTALRDG

SEQ ID NO: 1000342 - protein, 36 aa, Mycobacterium
AGTALTARTARTACTAATANGAITTGDTSGAPDSVA

SEQ ID NO: 1000343 - protein, 12 aa, Mycobacterium
AGTAPPGGAAGP

SEQ ID NO: 1000344 - protein, 25 aa, Mycobacterium
AGTARPSSDRCAGELRQSAARGKRA

SEQ ID NO: 1000345 - protein, 14 aa, Mycobacterium
AGTDEQHPDSQGRI

SEQ ID NO: 1000346 - protein, 8 aa, Mycobacterium
AGTDEVSA

SEQ ID NO: 1000347 - protein, 19 aa, Mycobacterium
AGTDGQPVGPDGRVQSPWR

SEQ ID NO: 1000348 - protein, 10 aa, Mycobacterium
AGTEGANSSF

SEQ ID NO: 1000349 - protein, 5 aa, Mycobacterium
AGTEK

SEQ ID NO: 1000350 - protein, 5 aa, Mycobacterium
AGTEN

SEQ ID NO: 1000351 - protein, 7 aa, Mycobacterium
AGTESEV

SEQ ID NO: 1000352 - protein, 8 aa, Mycobacterium
AGTGDAAA

SEQ ID NO: 1000353 - protein, 10 aa, Mycobacterium
AGTGGAGGLP

SEQ ID NO: 1000354 - protein, 10 aa, Mycobacterium
AGTGGDGGHA

SEQ ID NO: 1000355 - protein, 47 aa, Mycobacterium
AGTGGNGGAGGTDAYSRGGAGGAGGTGGTGGTDMSDSGGTGGAGGNA

SEQ ID NO: 1000356 - protein, 10 aa, Mycobacterium
AGTGGTSATI

SEQ ID NO: 1000357 - protein, 8 aa, Mycobacterium
AGTGGVSE

SEQ ID NO: 1000358 - protein, 6 aa, Mycobacterium
AGTGHT

SEQ ID NO: 1000359 - protein, 5 aa, Mycobacterium
AGTGI

SEQ ID NO: 1000360 - protein, 7 aa, Mycobacterium
AGTGKLT

SEQ ID NO: 1000361 - protein, 12 aa, Mycobacterium
AGTGKSSVSRGL

SEQ ID NO: 1000362 - protein, 9 aa, Mycobacterium
AGTGKTRTI

SEQ ID NO: 1000363 - protein, 8 aa, Mycobacterium
AGTGNDHA

SEQ ID NO: 1000364 - protein, 20 aa, Mycobacterium
AGTGNSPVSDGADARVTRGS

SEQ ID NO: 1000365 - protein, 8 aa, Mycobacterium
AGTGPLAG

SEQ ID NO: 1000366 - protein, 8 aa, Mycobacterium
AGTGTGKS

SEQ ID NO: 1000367 - protein, 11 aa, Mycobacterium
AGTGTGTGAEV

SEQ ID NO: 1000368 - protein, 12 aa, Mycobacterium
AGTHRTISPDQT

SEQ ID NO: 1000369 - protein, 6 aa, Mycobacterium
AGTKER

SEQ ID NO: 1000370 - protein, 8 aa, Mycobacterium
AGTNPAYG

SEQ ID NO: 1000371 - protein, 7 aa, Mycobacterium
AGTNPTL

SEQ ID NO: 1000372 - protein, 9 aa, Mycobacterium
AGTPADDLE

SEQ ID NO: 1000373 - protein, 9 aa, Mycobacterium
AGTPDDVTR

SEQ ID NO: 1000374 - protein, 7 aa, Mycobacterium
AGTPDEV

SEQ ID NO: 1000375 - protein, 14 aa, Mycobacterium
AGTPDSKVGTNSQV

SEQ ID NO: 1000376 - protein, 5 aa, Mycobacterium
AGTPF

SEQ ID NO: 1000377 - protein, 7 aa, Mycobacterium
AGTPGKR

SEQ ID NO: 1000378 - protein, 6 aa, Mycobacterium
AGTPMT

SEQ ID NO: 1000379 - protein, 6 aa, Mycobacterium
AGTPRV

SEQ ID NO: 1000380 - protein, 10 aa, Mycobacterium
AGTPVTPAQL

SEQ ID NO: 1000381 - protein, 13 aa, Mycobacterium
AGTQGNQLSSDQI

SEQ ID NO: 1000382 - protein, 8 aa, Mycobacterium
AGTQQGIV

SEQ ID NO: 1000383 - protein, 5 aa, Mycobacterium
AGTRI

SEQ ID NO: 1000384 - protein, 8 aa, Mycobacterium
AGTSDRRA

SEQ ID NO: 1000385 - protein, 11 aa, Mycobacterium
AGTSFATPDKL

SEQ ID NO: 1000386 - protein, 8 aa, Mycobacterium
AGTSGAPW

SEQ ID NO: 1000387 - protein, 12 aa, Mycobacterium
AGTSGSHQRIGP

SEQ ID NO: 1000388 - protein, 8 aa, Mycobacterium
AGTSPRRA

SEQ ID NO: 1000389 - protein, 8 aa, Mycobacterium
AGTSRGGC

SEQ ID NO: 1000390 - protein, 4 aa, Mycobacterium
AGTT

SEQ ID NO: 1000391 - protein, 11 aa, Mycobacterium
AGTTDEGEAWR

SEQ ID NO: 1000392 - protein, 13 aa, Mycobacterium
AGTTPGSKVHEAP

SEQ ID NO: 1000393 - protein, 8 aa, Mycobacterium
AGTTRQAY

SEQ ID NO: 1000394 - protein, 16 aa, Mycobacterium
AGTVEAVGPGVTNVEP

SEQ ID NO: 1000395 - protein, 6 aa, Mycobacterium
AGTVKP

SEQ ID NO: 1000396 - protein, 10 aa, Mycobacterium
AGTVRRGAEA

SEQ ID NO: 1000397 - protein, 51 aa, Mycobacterium
AGTYAAAETANSSAAAGTLNPLTTPAQIANPAGLASQAAAVSQAAAATTVE

SEQ ID NO: 1000398 - protein, 9 aa, Mycobacterium
AGVAARDGH

SEQ ID NO: 1000399 - protein, 10 aa, Mycobacterium
AGVAGADPAG

SEQ ID NO: 1000400 - protein, 7 aa, Mycobacterium
AGVDAAS

SEQ ID NO: 1000401 - protein, 20 aa, Mycobacterium
AGVDGAGGRALPDWSPAGSL

SEQ ID NO: 1000402 - protein, 10 aa, Mycobacterium
AGVDGQSRSV

SEQ ID NO: 1000403 - protein, 11 aa, Mycobacterium
AGVDGSNVDRS

SEQ ID NO: 1000404 - protein, 6 aa, Mycobacterium
AGVDKT

SEQ ID NO: 1000405 - protein, 7 aa, Mycobacterium
AGVDPNQ

SEQ ID NO: 1000406 - protein, 5 aa, Mycobacterium
AGVEP

SEQ ID NO: 1000407 - protein, 9 aa, Mycobacterium
AGVEPDPRR

SEQ ID NO: 1000408 - protein, 6 aa, Mycobacterium
AGVEPR

SEQ ID NO: 1000409 - protein, 6 aa, Mycobacterium
AGVGAR

SEQ ID NO: 1000410 - protein, 5 aa, Mycobacterium
AGVGD

SEQ ID NO: 1000411 - protein, 6 aa, Mycobacterium
AGVGGT

SEQ ID NO: 1000412 - protein, 9 aa, Mycobacterium
AGVGTQIAD

SEQ ID NO: 1000413 - protein, 5 aa, Mycobacterium
AGVHA

SEQ ID NO: 1000414 - protein, 12 aa, Mycobacterium
AGVIGTPERARA

SEQ ID NO: 1000415 - protein, 7 aa, Mycobacterium
AGVKPDE

SEQ ID NO: 1000416 - protein, 10 aa, Mycobacterium
AGVNGSGKQV

SEQ ID NO: 1000417 - protein, 4 aa, Mycobacterium
AGVP

SEQ ID NO: 1000418 - protein, 37 aa, Mycobacterium; identical to SEQ ID NO: 424428

SEQ ID NO: 1000419 - protein, 10 aa, Mycobacterium
AGVPSTQALS

SEQ ID NO: 1000420 - protein, 7 aa, Mycobacterium
AGVPTGS

SEQ ID NO: 1000421 - protein, 5 aa, Mycobacterium
AGVPV

SEQ ID NO: 1000422 - protein, 4 aa, Mycobacterium
AGVR

SEQ ID NO: 1000423 - protein, 5 aa, Mycobacterium
AGVRE

SEQ ID NO: 1000424 - protein, 11 aa, Mycobacterium
AGVSGADPVGW

SEQ ID NO: 1000425 - protein, 9 aa, Mycobacterium
AGVSNDTPL

SEQ ID NO: 1000426 - protein, 5 aa, Mycobacterium
AGVST

SEQ ID NO: 1000427 - protein, 9 aa, Mycobacterium
AGVTGPDAE

SEQ ID NO: 1000428 - protein, 11 aa, Mycobacterium
AGVTPRPGKGP

SEQ ID NO: 1000429 - protein, 6 aa, Mycobacterium
AGVTQR

SEQ ID NO: 1000430 - protein, 6 aa, Mycobacterium
AGVTSL

SEQ ID NO: 1000431 - protein, 9 aa, Mycobacterium
AGVTTYSTD

SEQ ID NO: 1000432 - protein, 10 aa, Mycobacterium
AGWAGYGRGG

SEQ ID NO: 1000433 - protein, 8 aa, Mycobacterium
AGWEPPNR

SEQ ID NO: 1000434 - protein, 18 aa, Mycobacterium
AGWSSAPRSRYTKKEMAD

SEQ ID NO: 1000435 - protein, 5 aa, Mycobacterium
AGYDD

SEQ ID NO: 1000436 - protein, 11 aa, Mycobacterium
AGYEDALTGEG

SEQ ID NO: 1000437 - protein, 9 aa, Mycobacterium
AGYESRHRP

SEQ ID NO: 1000438 - protein, 9 aa, Mycobacterium
AGYPDTGSE

SEQ ID NO: 1000439 - protein, 9 aa, Mycobacterium
AGYQRSAAA

SEQ ID NO: 1000440 - protein, 4 aa, Mycobacterium
AGYS

SEQ ID NO: 1000441 - protein, 9 aa, Mycobacterium
AGYSEETTQ

SEQ ID NO: 1000442 - protein, 5 aa, Mycobacterium
AGYTA

SEQ ID NO: 1000443 - protein, 6 aa, Mycobacterium
AGYTDA

SEQ ID NO: 1000444 - protein, 8 aa, Mycobacterium
AGYTDQDD

SEQ ID NO: 1000445 - protein, 12 aa, Mycobacterium
AHAAAHACARVA

SEQ ID NO: 1000446 - protein, 9 aa, Mycobacterium
AHADAADGY

SEQ ID NO: 1000447 - protein, 16 aa, Mycobacterium
AHADGRVSKPVRVRSD

SEQ ID NO: 1000448 - protein, 5 aa, Mycobacterium
AHAEA

SEQ ID NO: 1000449 - protein, 11 aa, Mycobacterium
AHAEQAAAQAE

SEQ ID NO: 1000450 - protein, 9 aa, Mycobacterium
AHAESDRLR

SEQ ID NO: 1000451 - protein, 7 aa, Mycobacterium
AHAGQLD

SEQ ID NO: 1000452 - protein, 9 aa, Mycobacterium
AHAKTDEDK

SEQ ID NO: 1000453 - protein, 7 aa, Mycobacterium
AHANGAR

SEQ ID NO: 1000454 - protein, 11 aa, Mycobacterium
AHAQGLNGDQL

SEQ ID NO: 1000455 - protein, 11 aa, Mycobacterium
AHARANDAALR

SEQ ID NO: 1000456 - protein, 8 aa, Mycobacterium
AHATTADH

SEQ ID NO: 1000457 - protein, 6 aa, Mycobacterium
AHDAAR

SEQ ID NO: 1000458 - protein, 9 aa, Mycobacterium
AHDADEAIS

SEQ ID NO: 1000459 - protein, 6 aa, Mycobacterium
AHDDRQ

SEQ ID NO: 1000460 - protein, 17 aa, Mycobacterium
AHDEAARTLAAKTGDRF

SEQ ID NO: 1000461 - protein, 7 aa, Mycobacterium
AHDGDAD

SEQ ID NO: 1000462 - protein, 13 aa, Mycobacterium
AHDHRAAGGLPSG

SEQ ID NO: 1000463 - protein, 6 aa, Mycobacterium
AHDPAL

SEQ ID NO: 1000464 - protein, 4 aa, Mycobacterium
AHEA

SEQ ID NO: 1000465 - protein, 7 aa, Mycobacterium
AHEEGGE

SEQ ID NO: 1000466 - protein, 7 aa, Mycobacterium
AHEETGL

SEQ ID NO: 1000467 - protein, 15 aa, Mycobacterium
AHEKQKNKHGGKNAD

SEQ ID NO: 1000468 - protein, 31 aa, Mycobacterium
AHGDGGDGGAGGNAGIYGGNGGAGGTGGVGV

SEQ ID NO: 1000469 - protein, 49 aa, Mycobacterium
AHGGGGTGGSGGAGGAAGDGGDGATGVSGGGREFRRQRGQSGRRRSRRH

SEQ ID NO: 1000470 - protein, 8 aa, Mycobacterium
AHGMDSAT

SEQ ID NO: 1000471 - protein, 4 aa, Mycobacterium
AHGP

SEQ ID NO: 1000472 - protein, 5 aa, Mycobacterium
AHGQA

SEQ ID NO: 1000473 - protein, 6 aa, Mycobacterium
AHHRVD

SEQ ID NO: 1000474 - protein, 7 aa, Mycobacterium
AHHTNAT

SEQ ID NO: 1000475 - protein, 6 aa, Mycobacterium
AHLGPN

SEQ ID NO: 1000476 - protein, 6 aa, Mycobacterium
AHNPPR

SEQ ID NO: 1000477 - protein, 7 aa, Mycobacterium
AHNPPRW

SEQ ID NO: 1000478 - protein, 13 aa, Mycobacterium
AHPAAGAALDGSH

SEQ ID NO: 1000479 - protein, 19 aa, Mycobacterium
AHPATSNGTATSAAIRIPS

SEQ ID NO: 1000480 - protein, 5 aa, Mycobacterium
AHPDA

SEQ ID NO: 1000481 - protein, 6 aa, Mycobacterium
AHPDAT

SEQ ID NO: 1000482 - protein, 5 aa, Mycobacterium
AHPDR

SEQ ID NO: 1000483 - protein, 6 aa, Mycobacterium
AHPELA

SEQ ID NO: 1000484 - protein, 13 aa, Mycobacterium
AHPELKSRPTRPH

SEQ ID NO: 1000485 - protein, 11 aa, Mycobacterium
AHPGDSNTELA

SEQ ID NO: 1000486 - protein, 7 aa, Mycobacterium
AHPGLTK

SEQ ID NO: 1000487 - protein, 6 aa, Mycobacterium
AHPGRQ

SEQ ID NO: 1000488 - protein, 6 aa, Mycobacterium
AHPGTT

SEQ ID NO: 1000489 - protein, 13 aa, Mycobacterium
AHPLSDQQARDQV

SEQ ID NO: 1000490 - protein, 7 aa, Mycobacterium
AHPLSTA

SEQ ID NO: 1000491 - protein, 10 aa, Mycobacterium
AHPPTSVDET

SEQ ID NO: 1000492 - protein, 6 aa, Mycobacterium
AHPPYP

SEQ ID NO: 1000493 - protein, 10 aa, Mycobacterium
AHPQPGNPAP

SEQ ID NO: 1000494 - protein, 9 aa, Mycobacterium
AHPSAEQAV

SEQ ID NO: 1000495 - protein, 7 aa, Mycobacterium
AHPSAGQ

SEQ ID NO: 1000496 - protein, 19 aa, Mycobacterium
AHPVNTGKPEFARGPRAAR

SEQ ID NO: 1000497 - protein, 11 aa, Mycobacterium
AHQAAKPNPII

SEQ ID NO: 1000498 - protein, 8 aa, Mycobacterium
AHQAGATA

SEQ ID NO: 1000499 - protein, 6 aa, Mycobacterium
AHQQNT

SEQ ID NO: 1000500 - protein, 7 aa, Mycobacterium
AHRAAGR

SEQ ID NO: 1000501 - protein, 5 aa, Mycobacterium
AHRDG

SEQ ID NO: 1000502 - protein, 7 aa, Mycobacterium
AHRGPRL

SEQ ID NO: 1000503 - protein, 13 aa, Mycobacterium
AHRGTGPATAPAR

SEQ ID NO: 1000504 - protein, 14 aa, Mycobacterium
AHRPRVTVNGDPQT

SEQ ID NO: 1000505 - protein, 5 aa, Mycobacterium
AHRPV

SEQ ID NO: 1000506 - protein, 7 aa, Mycobacterium
AHRQGAA

SEQ ID NO: 1000507 - protein, 5 aa, Mycobacterium
AHRSD

SEQ ID NO: 1000508 - protein, 6 aa, Mycobacterium
AHRTGA

SEQ ID NO: 1000509 - protein, 7 aa, Mycobacterium
AHSAEKP

SEQ ID NO: 1000510 - protein, 8 aa, Mycobacterium
AHSAPEEY

SEQ ID NO: 1000511 - protein, 7 aa, Mycobacterium
AHSGSWP

SEQ ID NO: 1000512 - protein, 4 aa, Mycobacterium
AHSP

SEQ ID NO: 1000513 - protein, 7 aa, Mycobacterium
AHSVDSS

SEQ ID NO: 1000514 - protein, 8 aa, Mycobacterium
AHSVSESR

SEQ ID NO: 1000515 - protein, 14 aa, Mycobacterium
AHTAGTSGVGGNGG

SEQ ID NO: 1000516 - protein, 7 aa, Mycobacterium
AHTPLDG

SEQ ID NO: 1000517 - protein, 15 aa, Mycobacterium
AHTQSGVRVANPRDD

SEQ ID NO: 1000518 - protein, 5 aa, Mycobacterium
AHTRK

SEQ ID NO: 1000519 - protein, 13 aa, Mycobacterium
AHTYPDGARTQAE

SEQ ID NO: 1000520 - protein, 10 aa, Mycobacterium
AHYPEESPLR

SEQ ID NO: 1000521 - protein, 5 aa, Mycobacterium
AIAAG

SEQ ID NO: 1000522 - protein, 16 aa, Mycobacterium
AIADGDTVTILPAVAG

SEQ ID NO: 1000523 - protein, 6 aa, Mycobacterium
AIADGK

SEQ ID NO: 1000524 - protein, 6 aa, Mycobacterium
AIAEAE

SEQ ID NO: 1000525 - protein, 8 aa, Mycobacterium
AIAGDERR

SEQ ID NO: 1000526 - protein, 9 aa, Mycobacterium
AIANGSEPW

SEQ ID NO: 1000527 - protein, 11 aa, Mycobacterium
AIANRTDGFSG

SEQ ID NO: 1000528 - protein, 9 aa, Mycobacterium
AIANSDGSV

SEQ ID NO: 1000529 - protein, 4 aa, Mycobacterium
AIAP

SEQ ID NO: 1000530 - protein, 18 aa, Mycobacterium
AIAPGASAYDNGHAASDI

SEQ ID NO: 1000531 - protein, 8 aa, Mycobacterium
AIATTEAE

SEQ ID NO: 1000532 - protein, 4 aa, Mycobacterium
AIDD

SEQ ID NO: 1000533 - protein, 6 aa, Mycobacterium
AIDEQS

SEQ ID NO: 1000534 - protein, 12 aa, Mycobacterium
AIDETERRRAKQ

SEQ ID NO: 1000535 - protein, 9 aa, Mycobacterium
AIDGPGGSI

SEQ ID NO: 1000536 - protein, 18 aa, Mycobacterium
AIDPKAAAKELGPDAGPV

SEQ ID NO: 1000537 - protein, 6 aa, Mycobacterium
AIDSTN

SEQ ID NO: 1000538 - protein, 9 aa, Mycobacterium
AIDSTSGKL

SEQ ID NO: 1000539 - protein, 10 aa, Mycobacterium
AIEKTADGYR

SEQ ID NO: 1000540 - protein, 6 aa, Mycobacterium
AIENDG

SEQ ID NO: 1000541 - protein, 9 aa, Mycobacterium
AIEQQAGRS

SEQ ID NO: 1000542 - protein, 19 aa, Mycobacterium
AIGDGNTEVTADAGGLGGN

SEQ ID NO: 1000543 - protein, 16 aa, Mycobacterium
AIGGGNTVAASSTGLT

SEQ ID NO: 1000544 - protein, 5 aa, Mycobacterium
AIGGP

SEQ ID NO: 1000545 - protein, 4 aa, Mycobacterium
AIGP

SEQ ID NO: 1000546 - protein, 6 aa, Mycobacterium
AIGRES

SEQ ID NO: 1000547 - protein, 5 aa, Mycobacterium
AIGSA

SEQ ID NO: 1000548 - protein, 21 aa, Mycobacterium
AIGSGNSQVSAEAGGAGGNIA

SEQ ID NO: 1000549 - protein, 5 aa, Mycobacterium
AIGSH

SEQ ID NO: 1000550 - protein, 6 aa, Mycobacterium
AIGSST

SEQ ID NO: 1000551 - protein, 4 aa, Mycobacterium
AIKG

SEQ ID NO: 1000552 - protein, 21 aa, Mycobacterium
AINNDGSAKMGYAAPNPAAQA

SEQ ID NO: 1000553 - protein, 4 aa, Mycobacterium
AINP

SEQ ID NO: 1000554 - protein, 20 aa, Mycobacterium
AINQDGASNGLTAPSGPAQQ

SEQ ID NO: 1000555 - protein, 21 aa, Mycobacterium
AINQDGRSNGMTAPNAAAQRD

SEQ ID NO: 1000556 - protein, 15 aa, Mycobacterium
AIPAATAGAWVAASN

SEQ ID NO: 1000557 - protein, 5 aa, Mycobacterium
AIPAD

SEQ ID NO: 1000558 - protein, 6 aa, Mycobacterium
AIPAGE

SEQ ID NO: 1000559 - protein, 5 aa, Mycobacterium
AIPDA

SEQ ID NO: 1000560 - protein, 5 aa, Mycobacterium
AIPDD

SEQ ID NO: 1000561 - protein, 6 aa, Mycobacterium
AIPDGS

SEQ ID NO: 1000562 - protein, 16 aa, Mycobacterium
AIPGDAPAIGDHRPLT

SEQ ID NO: 1000563 - protein, 9 aa, Mycobacterium
AIPGELDDA

SEQ ID NO: 1000564 - protein, 7 aa, Mycobacterium
AIPGGGR

SEQ ID NO: 1000565 - protein, 11 aa, Mycobacterium
AIPKTSSGKIQ

SEQ ID NO: 1000566 - protein, 10 aa, Mycobacterium
AIPNNGDHVE

SEQ ID NO: 1000567 - protein, 9 aa, Mycobacterium
AIPRDASRM

SEQ ID NO: 1000568 - protein, 5 aa, Mycobacterium
AIPVR

SEQ ID NO: 1000569 - protein, 10 aa, Mycobacterium
AIRRRRSCPE

SEQ ID NO: 1000570 - protein, 9 aa, Mycobacterium
AISAGDQSI

SEQ ID NO: 1000571 - protein, 11 aa, Mycobacterium
AISGSAQAQRW

SEQ ID NO: 1000572 - protein, 8 aa, Mycobacterium
AISKPGRT

SEQ ID NO: 1000573 - protein, 6 aa, Mycobacterium
AISPGA

SEQ ID NO: 1000574 - protein, 20 aa, Mycobacterium
AISPSSSLRRAPKDNTLPRE

SEQ ID NO: 1000575 - protein, 11 aa, Mycobacterium
AISRPGDFSSN

SEQ ID NO: 1000576 - protein, 10 aa, Mycobacterium
AISSGRSGTI

SEQ ID NO: 1000577 - protein, 15 aa, Mycobacterium
AISTNQRGAKSGGIV

SEQ ID NO: 1000578 - protein, 5 aa, Mycobacterium
AISTT

SEQ ID NO: 1000579 - protein, 12 aa, Mycobacterium
AITGRTAGPAVA

SEQ ID NO: 1000580 - protein, 9 aa, Mycobacterium
AITGSESDQ

SEQ ID NO: 1000581 - protein, 6 aa, Mycobacterium
AIYPPG

SEQ ID NO: 1000582 - protein, 4 aa, Mycobacterium
AKAA

SEQ ID NO: 1000583 - protein, 17 aa, Mycobacterium
AKAAAAPATPAAAPTLS

SEQ ID NO: 1000584 - protein, 6 aa, Mycobacterium
AKAADI

SEQ ID NO: 1000585 - protein, 8 aa, Mycobacterium
AKAAGAAG

SEQ ID NO: 1000586 - protein, 15 aa, Mycobacterium
AKAATSSASAAAHAE

SEQ ID NO: 1000587 - protein, 14 aa, Mycobacterium
AKADPSAGKKTLKA

SEQ ID NO: 1000588 - protein, 6 aa, Mycobacterium
AKAEAE

SEQ ID NO: 1000589 - protein, 7 aa, Mycobacterium
AKAGGIS

SEQ ID NO: 1000590 - protein, 8 aa, Mycobacterium
AKAGLDGF

SEQ ID NO: 1000591 - protein, 6 aa, Mycobacterium
AKAGRS

SEQ ID NO: 1000592 - protein, 4 aa, Mycobacterium
AKAI

SEQ ID NO: 1000593 - protein, 6 aa, Mycobacterium
AKAIGS

SEQ ID NO: 1000594 - protein, 10 aa, Mycobacterium
AKAKGHLDAG

SEQ ID NO: 1000595 - protein, 12 aa, Mycobacterium
AKALSSPSSLSP

SEQ ID NO: 1000596 - protein, 9 aa, Mycobacterium
AKANTGDGI

SEQ ID NO: 1000597 - protein, 5 aa, Mycobacterium
AKANV

SEQ ID NO: 1000598 - protein, 7 aa, Mycobacterium
AKAPEGS

SEQ ID NO: 1000599 - protein, 11 aa, Mycobacterium
AKARERGYQPV

SEQ ID NO: 1000600 - protein, 8 aa, Mycobacterium
AKARGAMT

SEQ ID NO: 1000601 - protein, 5 aa, Mycobacterium
AKASE

SEQ ID NO: 1000602 - protein, 18 aa, Mycobacterium
AKASFEDGSWSRATPQER

SEQ ID NO: 1000603 - protein, 6 aa, Mycobacterium
AKASGV

SEQ ID NO: 1000604 - protein, 15 aa, Mycobacterium
AKASPAGACEKVSGL

SEQ ID NO: 1000605 - protein, 8 aa, Mycobacterium
AKATDTSI

SEQ ID NO: 1000606 - protein, 8 aa, Mycobacterium
AKATGASI

SEQ ID NO: 1000607 - protein, 6 aa, Mycobacterium
AKATRE

SEQ ID NO: 1000608 - protein, 9 aa, Mycobacterium
AKATRKLDD

SEQ ID NO: 1000609 - protein, 6 aa, Mycobacterium
AKAVAD

SEQ ID NO: 1000610 - protein, 12 aa, Mycobacterium
AKAVERVRDVLI

SEQ ID NO: 1000611 - protein, 14 aa, Mycobacterium
AKAYASAEAASAAA

SEQ ID NO: 1000612 - protein, 8 aa, Mycobacterium
AKAYEEVD

SEQ ID NO: 1000613 - protein, 7 aa, Mycobacterium
AKAYGPD

SEQ ID NO: 1000614 - protein, 6 aa, Mycobacterium
AKAYSA

SEQ ID NO: 1000615 - protein, 8 aa, Mycobacterium
AKDAAESA

SEQ ID NO: 1000616 - protein, 5 aa, Mycobacterium
AKDAP

SEQ ID NO: 1000617 - protein, 21 aa, Mycobacterium
AKDGAGAGTIPDPFGGPGRAP

SEQ ID NO: 1000618 - protein, 8 aa, Mycobacterium
AKDGSPKI

SEQ ID NO: 1000619 - protein, 7 aa, Mycobacterium
AKDPAIR

SEQ ID NO: 1000620 - protein, 7 aa, Mycobacterium
AKDPHSV

SEQ ID NO: 1000621 - protein, 9 aa, Mycobacterium
AKDSRTTAE

SEQ ID NO: 1000622 - protein, 4 aa, Mycobacterium
AKDT

SEQ ID NO: 1000623 - protein, 14 aa, Mycobacterium
AKDVGKRAERATAE

SEQ ID NO: 1000624 - protein, 10 aa, Mycobacterium
AKEAANDDSR

SEQ ID NO: 1000625 - protein, 7 aa, Mycobacterium
AKEAKEL

SEQ ID NO: 1000626 - protein, 7 aa, Mycobacterium
AKENSYA

SEQ ID NO: 1000627 - protein, 22 aa, Mycobacterium
AKEPGGEKAAAKRDKKGIPSAR

SEQ ID NO: 1000628 - protein, 6 aa, Mycobacterium
AKEQKA

SEQ ID NO: 1000629 - protein, 6 aa, Mycobacterium
AKEQQL

SEQ ID NO: 1000630 - protein, 8 aa, Mycobacterium
AKERMEGQ

SEQ ID NO: 1000631 - protein, 11 aa, Mycobacterium
AKEVETKEQIA

SEQ ID NO: 1000632 - protein, 9 aa, Mycobacterium
AKEVSATEL

SEQ ID NO: 1000633 - protein, 7 aa, Mycobacterium
AKFGQPE

SEQ ID NO: 1000634 - protein, 14 aa, Mycobacterium
AKFSPAREALDNPN

SEQ ID NO: 1000635 - protein, 13 aa, Mycobacterium
AKGAAKAGRSPAD

SEQ ID NO: 1000636 - protein, 14 aa, Mycobacterium
AKGAPRERIQHDPL

SEQ ID NO: 1000637 - protein, 7 aa, Mycobacterium
AKGATLA

SEQ ID NO: 1000638 - protein, 9 aa, Mycobacterium
AKGDPTTFP

SEQ ID NO: 1000639 - protein, 14 aa, Mycobacterium
AKGEPTPDDGYAGS

SEQ ID NO: 1000640 - protein, 22 aa, Mycobacterium
AKGFRGAQTVENSGHSVQSDQP

SEQ ID NO: 1000641 - protein, 21 aa, Mycobacterium
AKGGPGGAPGCGSLPDATKNL

SEQ ID NO: 1000642 - protein, 7 aa, Mycobacterium
AKGGTSF

SEQ ID NO: 1000643 - protein, 5 aa, Mycobacterium
AKGKA

SEQ ID NO: 1000644 - protein, 5 aa, Mycobacterium
AKGLS

SEQ ID NO: 1000645 - protein, 4 aa, Mycobacterium
AKGM

SEQ ID NO: 1000646 - protein, 5 aa, Mycobacterium
AKGPA

SEQ ID NO: 1000647 - protein, 10 aa, Mycobacterium
AKGPGVNPFG

SEQ ID NO: 1000648 - protein, 6 aa, Mycobacterium
AKGRDA

SEQ ID NO: 1000649 - protein, 9 aa, Mycobacterium
AKGSFAERE

SEQ ID NO: 1000650 - protein, 4 aa, Mycobacterium
AKGV

SEQ ID NO: 1000651 - protein, 7 aa, Mycobacterium
AKGVDQD

SEQ ID NO: 1000652 - protein, 14 aa, Mycobacterium
AKGYRNPVQPDPFA

SEQ ID NO: 1000653 - protein, 5 aa, Mycobacterium
AKHAR

SEQ ID NO: 1000654 - protein, 11 aa, Mycobacterium
AKHGQPPPNGL

SEQ ID NO: 1000655 - protein, 9 aa, Mycobacterium
AKHKGEEAR

SEQ ID NO: 1000656 - protein, 6 aa, Mycobacterium
AKIATD

SEQ ID NO: 1000657 - protein, 4 aa, Mycobacterium
AKIG

SEQ ID NO: 1000658 - protein, 10 aa, Mycobacterium
AKIGPDKDIP

SEQ ID NO: 1000659 - protein, 10 aa, Mycobacterium
AKIGRDNDIP

SEQ ID NO: 1000660 - protein, 7 aa, Mycobacterium
AKIGYPP

SEQ ID NO: 1000661 - protein, 7 aa, Mycobacterium
AKKEEAI

SEQ ID NO: 1000662 - protein, 7 aa, Mycobacterium
AKKGGQH

SEQ ID NO: 1000663 - protein, 4 aa, Mycobacterium
AKKL

SEQ ID NO: 1000664 - protein, 6 aa, Mycobacterium
AKKNAI

SEQ ID NO: 1000665 - protein, 6 aa, Mycobacterium
AKLADA

SEQ ID NO: 1000666 - protein, 21 aa, Mycobacterium
AKLAKAAAKAPSSPAESAAVD

SEQ ID NO: 1000667 - protein, 6 aa, Mycobacterium
AKLGED

SEQ ID NO: 1000668 - protein, 7 aa, Mycobacterium
AKLQPMS

SEQ ID NO: 1000669 - protein, 27 aa, Mycobacterium
AKLRTASSAYQGVDEQAGESLDKQIIE

SEQ ID NO: 1000670 - protein, 24 aa, Mycobacterium
AKLSAKNEARRIKSAQKATDKALK

SEQ ID NO: 1000671 - protein, 11 aa, Mycobacterium
AKLSNADRDRA

SEQ ID NO: 1000672 - protein, 19 aa, Mycobacterium
AKLSPTSTVRGWESMPAVF

SEQ ID NO: 1000673 - protein, 6 aa, Mycobacterium
AKLTNT

SEQ ID NO: 1000674 - protein, 7 aa, Mycobacterium
AKLTPAD

SEQ ID NO: 1000675 - protein, 6 aa, Mycobacterium
AKMPAD

SEQ ID NO: 1000676 - protein, 4 aa, Mycobacterium
AKNA

SEQ ID NO: 1000677 - protein, 6 aa, Mycobacterium
AKNGLG

SEQ ID NO: 1000678 - protein, 16 aa, Mycobacterium
AKNGVGTGISASDRAT

SEQ ID NO: 1000679 - protein, 6 aa, Mycobacterium
AKNPNM

SEQ ID NO: 1000680 - protein, 8 aa, Mycobacterium
AKNPSDDL

SEQ ID NO: 1000681 - protein, 9 aa, Mycobacterium
AKNRGGTPD

SEQ ID NO: 1000682 - protein, 14 aa, Mycobacterium
AKNTDTREHDIADS

SEQ ID NO: 1000683 - protein, 11 aa, Mycobacterium
AKPAAQQPSWP

SEQ ID NO: 1000684 - protein, 23 aa, Mycobacterium
AKPAGEADPYRDRGSVDEPSDAG

SEQ ID NO: 1000685 - protein, 5 aa, Mycobacterium
AKPAQ

SEQ ID NO: 1000686 - protein, 7 aa, Mycobacterium
AKPATIS

SEQ ID NO: 1000687 - protein, 26 aa, Mycobacterium
AKPAVGEDPRSGRWRGRTKTECGLHA

SEQ ID NO: 1000688 - protein, 10 aa, Mycobacterium
AKPDEPFQPY

SEQ ID NO: 1000689 - protein, 16 aa, Mycobacterium
AKPGEPSWPTPWGRGR

SEQ ID NO: 1000690 - protein, 12 aa, Mycobacterium
AKPGGDGVTPID

SEQ ID NO: 1000691 - protein, 16 aa, Mycobacterium
AKPGGGPGGGLSPKTT

SEQ ID NO: 1000692 - protein, 18 aa, Mycobacterium
AKPGPHVHEPASAATVQP

SEQ ID NO: 1000693 - protein, 14 aa, Mycobacterium
AKPGPQGAPEGKGP

SEQ ID NO: 1000694 - protein, 12 aa, Mycobacterium
AKPGRMAGPDPG

SEQ ID NO: 1000695 - protein, 6 aa, Mycobacterium
AKPKIA

SEQ ID NO: 1000696 - protein, 13 aa, Mycobacterium
AKPKPAIDAGRST

SEQ ID NO: 1000697 - protein, 8 aa, Mycobacterium
AKPKSTRR

SEQ ID NO: 1000698 - protein, 16 aa, Mycobacterium
AKPLAAKGDCTYNGEA

SEQ ID NO: 1000699 - protein, 7 aa, Mycobacterium
AKPLSDG

SEQ ID NO: 1000700 - protein, 8 aa, Mycobacterium
AKPPDQGD

SEQ ID NO: 1000701 - protein, 11 aa, Mycobacterium
AKPPGLPDTSD

SEQ ID NO: 1000702 - protein, 10 aa, Mycobacterium
AKPPPSGSPG

SEQ ID NO: 1000703 - protein, 9 aa, Mycobacterium
AKPPSGPLS

SEQ ID NO: 1000704 - protein, 6 aa, Mycobacterium
AKPTSN

SEQ ID NO: 1000705 - protein, 5 aa, Mycobacterium
AKQAL

SEQ ID NO: 1000706 - protein, 8 aa, Mycobacterium
AKQGTNIE

SEQ ID NO: 1000707 - protein, 4 aa, Mycobacterium
AKQH

SEQ ID NO: 1000708 - protein, 7 aa, Mycobacterium
AKQIPAD

SEQ ID NO: 1000709 - protein, 18 aa, Mycobacterium
AKQISSRAAMSQTVKTSP

SEQ ID NO: 1000710 - protein, 7 aa, Mycobacterium
AKQPSPE

SEQ ID NO: 1000711 - protein, 4 aa, Mycobacterium
AKQQ

SEQ ID NO: 1000712 - protein, 5 aa, Mycobacterium
AKQRR

SEQ ID NO: 1000713 - protein, 6 aa, Mycobacterium
AKQRTQ

SEQ ID NO: 1000714 - protein, 10 aa, Mycobacterium
AKQTAKSGAT

SEQ ID NO: 1000715 - protein, 4 aa, Mycobacterium
AKRA

SEQ ID NO: 1000716 - protein, 8 aa, Mycobacterium
AKRAQPRA

SEQ ID NO: 1000717 - protein, 7 aa, Mycobacterium
AKRAVDA

SEQ ID NO: 1000718 - protein, 9 aa, Mycobacterium
AKRDPRDQA

SEQ ID NO: 1000719 - protein, 16 aa, Mycobacterium
AKREYEASMSRAKSEC

SEQ ID NO: 1000720 - protein, 4 aa, Mycobacterium
AKRI

SEQ ID NO: 1000721 - protein, 20 aa, Mycobacterium
AKRPPQFTGEQAAASTYPRG

SEQ ID NO: 1000722 - protein, 8 aa, Mycobacterium
AKRRPLDE

SEQ ID NO: 1000723 - protein, 7 aa, Mycobacterium
AKRTPGA

SEQ ID NO: 1000724 - protein, 8 aa, Mycobacterium
AKSAARAY

SEQ ID NO: 1000725 - protein, 10 aa, Mycobacterium
AKSDEHDAAA

SEQ ID NO: 1000726 - protein, 7 aa, Mycobacterium
AKSDQLA

SEQ ID NO: 1000727 - protein, 4 aa, Mycobacterium
AKSE

SEQ ID NO: 1000728 - protein, 7 aa, Mycobacterium
AKSEIGN

SEQ ID NO: 1000729 - protein, 8 aa, Mycobacterium
AKSGKTTI

SEQ ID NO: 1000730 - protein, 7 aa, Mycobacterium
AKSGQPV

SEQ ID NO: 1000731 - protein, 8 aa, Mycobacterium
AKSGTAEL

SEQ ID NO: 1000732 - protein, 12 aa, Mycobacterium
AKSGTCPGHDGR

SEQ ID NO: 1000733 - protein, 7 aa, Mycobacterium
AKSNADE

SEQ ID NO: 1000734 - protein, 6 aa, Mycobacterium
AKSPCG

SEQ ID NO: 1000735 - protein, 6 aa, Mycobacterium
AKSPHW

SEQ ID NO: 1000736 - protein, 8 aa, Mycobacterium
AKSPLPGW

SEQ ID NO: 1000737 - protein, 14 aa, Mycobacterium
AKSQTAAYGSLPAA

SEQ ID NO: 1000738 - protein, 4 aa, Mycobacterium
AKSR

SEQ ID NO: 1000739 - protein, 9 aa, Mycobacterium
AKSSDAGFT

SEQ ID NO: 1000740 - protein, 9 aa, Mycobacterium
AKTAPKDAG

SEQ ID NO: 1000741 - protein, 39 aa, Mycobacterium
AKTARQAPTPTAAPGAAAARRAPEVRPDDGRAPRRARGK

SEQ ID NO: 1000742 - protein, 13 aa, Mycobacterium
AKTEPVGPNAEER

SEQ ID NO: 1000743 - protein, 19 aa, Mycobacterium
AKTGQARTTSLTSARDGDS

SEQ ID NO: 1000744 - protein, 6 aa, Mycobacterium
AKTGSL

SEQ ID NO: 1000745 - protein, 6 aa, Mycobacterium
AKTGVA

SEQ ID NO: 1000746 - protein, 15 aa, Mycobacterium
AKTIGGPDGQQDKEY

SEQ ID NO: 1000747 - protein, 7 aa, Mycobacterium
AKTPDAR

SEQ ID NO: 1000748 - protein, 5 aa, Mycobacterium
AKTPE

SEQ ID NO: 1000749 - protein, 10 aa, Mycobacterium
AKTPKQKRDR

SEQ ID NO: 1000750 - protein, 14 aa, Mycobacterium
AKTPVSKDDAQQNA

SEQ ID NO: 1000751 - protein, 5 aa, Mycobacterium
AKTQG

SEQ ID NO: 1000752 - protein, 11 aa, Mycobacterium
AKTRHNEVAPG

SEQ ID NO: 1000753 - protein, 9 aa, Mycobacterium
AKTRQDQTV

SEQ ID NO: 1000754 - protein, 22 aa, Mycobacterium
AKTRRSRSCPTGSTSPTSRSHS

SEQ ID NO: 1000755 - protein, 4 aa, Mycobacterium
AKTV

SEQ ID NO: 1000756 - protein, 4 aa, Mycobacterium
AKVA

SEQ ID NO: 1000757 - protein, 6 aa, Mycobacterium
AKVAAT

SEQ ID NO: 1000758 - protein, 20 aa, Mycobacterium
AKVEGIPDTESAVTPDLLED

SEQ ID NO: 1000759 - protein, 8 aa, Mycobacterium
AKVGQSGE

SEQ ID NO: 1000760 - protein, 7 aa, Mycobacterium
AKVRPSE

SEQ ID NO: 1000761 - protein, 9 aa, Mycobacterium
AKVTSEGER

SEQ ID NO: 1000762 - protein, 6 aa, Mycobacterium
AKYPDR

SEQ ID NO: 1000763 - protein, 6 aa, Mycobacterium
AKYPDT

SEQ ID NO: 1000764 - protein, 12 aa, Mycobacterium
ALAAPGPKRQAT

SEQ ID NO: 1000765 - protein, 5 aa, Mycobacterium
ALADG

SEQ ID NO: 1000766 - protein, 7 aa, Mycobacterium
ALADGEE

SEQ ID NO: 1000767 - protein, 5 aa, Mycobacterium
ALADQ

SEQ ID NO: 1000768 - protein, 21 aa, Mycobacterium
ALAEAAARARQDALTKPRGAL

SEQ ID NO: 1000769 - protein, 15 aa, Mycobacterium
ALAEESRESGWNKPS

SEQ ID NO: 1000770 - protein, 17 aa, Mycobacterium
ALAGGTGGTGGDGGHGA

SEQ ID NO: 1000771 - protein, 8 aa, Mycobacterium
ALAGPGGV

SEQ ID NO: 1000772 - protein, 20 aa, Mycobacterium
ALAGRAQGRREASAVAAFLG

SEQ ID NO: 1000773 - protein, 8 aa, Mycobacterium
ALAGSSGT

SEQ ID NO: 1000774 - protein, 14 aa, Mycobacterium
ALANGDAPEPPLRT

SEQ ID NO: 1000775 - protein, 6 aa, Mycobacterium
ALAPAA

SEQ ID NO: 1000776 - protein, 4 aa, Mycobacterium
ALDD

SEQ ID NO: 1000777 - protein, 19 aa, Mycobacterium
ALDEARQAEEQIARGNHRG

SEQ ID NO: 1000778 - protein, 9 aa, Mycobacterium
ALDEDDADK

SEQ ID NO: 1000779 - protein, 8 aa, Mycobacterium
ALDEDSPH

SEQ ID NO: 1000780 - protein, 9 aa, Mycobacterium
ALDEGASVD

SEQ ID NO: 1000781 - protein, 8 aa, Mycobacterium
ALDEPGSG

SEQ ID NO: 1000782 - protein, 12 aa, Mycobacterium
ALDGPSGPTADF

SEQ ID NO: 1000783 - protein, 6 aa, Mycobacterium
ALDPDQ

SEQ ID NO: 1000784 - protein, 14 aa, Mycobacterium
ALDPGPDGAPTSAS

SEQ ID NO: 1000785 - protein, 14 aa, Mycobacterium
ALDPTGYLNPAVLF

SEQ ID NO: 1000786 - protein, 9 aa, Mycobacterium
ALDSAGGDG

SEQ ID NO: 1000787 - protein, 8 aa, Mycobacterium
ALDSGKPV

SEQ ID NO: 1000788 - protein, 9 aa, Mycobacterium
ALDSPDSPR

SEQ ID NO: 1000789 - protein, 5 aa, Mycobacterium
ALEAA

SEQ ID NO: 1000790 - protein, 5 aa, Mycobacterium
ALEAQ

SEQ ID NO: 1000791 - protein, 4 aa, Mycobacterium
ALED

SEQ ID NO: 1000792 - protein, 12 aa, Mycobacterium
ALEEGSGSPGEV

SEQ ID NO: 1000793 - protein, 7 aa, Mycobacterium
ALEGDPK

SEQ ID NO: 1000794 - protein, 30 aa, Mycobacterium; identical to SEQ ID NO: 426843

SEQ ID NO: 1000795 - protein, 8 aa, Mycobacterium
ALEPGNPE

SEQ ID NO: 1000796 - protein, 6 aa, Mycobacterium
ALEPTL

SEQ ID NO: 1000797 - protein, 7 aa, Mycobacterium
ALEQGKG

SEQ ID NO: 1000798 - protein, 10 aa, Mycobacterium
ALESSDDATL

SEQ ID NO: 1000799 - protein, 7 aa, Mycobacterium
ALGAGDA

SEQ ID NO: 1000800 - protein, 5 aa, Mycobacterium
ALGEG

SEQ ID NO: 1000801 - protein, 5 aa, Mycobacterium
ALGEP

SEQ ID NO: 1000802 - protein, 6 aa, Mycobacterium
ALGGAQ

SEQ ID NO: 1000803 - protein, 7 aa, Mycobacterium
ALGGDGK

SEQ ID NO: 1000804 - protein, 7 aa, Mycobacterium
ALGGDPQ

SEQ ID NO: 1000805 - protein, 20 aa, Mycobacterium
ALGGQDNTVSAQAGAGGANI

SEQ ID NO: 1000806 - protein, 21 aa, Mycobacterium
ALGGQGNTVSAESGGAGANIA

SEQ ID NO: 1000807 - protein, 20 aa, Mycobacterium
ALGGQNNTVSAETGTGGANI

SEQ ID NO: 1000808 - protein, 6 aa, Mycobacterium
ALGGRQ

SEQ ID NO: 1000809 - protein, 6 aa, Mycobacterium
ALGKGA

SEQ ID NO: 1000810 - protein, 5 aa, Mycobacterium
ALGPR

SEQ ID NO: 1000811 - protein, 8 aa, Mycobacterium
ALGPSAAE

SEQ ID NO: 1000812 - protein, 7 aa, Mycobacterium
ALGPSIE

SEQ ID NO: 1000813 - protein, 17 aa, Mycobacterium
ALGPTEPPDPETAAAVK

SEQ ID NO: 1000814 - protein, 8 aa, Mycobacterium
ALGQASGP

SEQ ID NO: 1000815 - protein, 8 aa, Mycobacterium
ALGQGTAA

SEQ ID NO: 1000816 - protein, 6 aa, Mycobacterium
ALGRGK

SEQ ID NO: 1000817 - protein, 18 aa, Mycobacterium
ALGSHKPAVYAPKSALGH

SEQ ID NO: 1000818 - protein, 9 aa, Mycobacterium
ALGSQGGAV

SEQ ID NO: 1000819 - protein, 10 aa, Mycobacterium
ALGSSDVDRD

SEQ ID NO: 1000820 - protein, 17 aa, Mycobacterium
ALGSYAEPGWASETGWP

SEQ ID NO: 1000821 - protein, 16 aa, Mycobacterium
ALGTGQAGAGRRNGQA

SEQ ID NO: 1000822 - protein, 7 aa, Mycobacterium
ALGTTSD

SEQ ID NO: 1000823 - protein, 10 aa, Mycobacterium
ALGVSQSTLS

SEQ ID NO: 1000824 - protein, 6 aa, Mycobacterium
ALKETS

SEQ ID NO: 1000825 - protein, 5 aa, Mycobacterium
ALNEV

SEQ ID NO: 1000826 - protein, 8 aa, Mycobacterium
ALNGSKNI

SEQ ID NO: 1000827 - protein, 8 aa, Mycobacterium
ALNGTKNI

SEQ ID NO: 1000828 - protein, 8 aa, Mycobacterium
ALNNSGTT

SEQ ID NO: 1000829 - protein, 8 aa, Mycobacterium
ALNPAKPL

SEQ ID NO: 1000830 - protein, 13 aa, Mycobacterium
ALNPGTVDAQGVA

SEQ ID NO: 1000831 - protein, 9 aa, Mycobacterium
ALNTAEPAD

SEQ ID NO: 1000832 - protein, 10 aa, Mycobacterium
ALPADTPDHS

SEQ ID NO: 1000833 - protein, 7 aa, Mycobacterium
ALPAPGR

SEQ ID NO: 1000834 - protein, 6 aa, Mycobacterium
ALPAPR

SEQ ID NO: 1000835 - protein, 23 aa, Mycobacterium
ALPAPREPQARTGPSAPAAGDTV

SEQ ID NO: 1000836 - protein, 9 aa, Mycobacterium
ALPAPTPIA

SEQ ID NO: 1000837 - protein, 10 aa, Mycobacterium
ALPDEDVTDL

SEQ ID NO: 1000838 - protein, 7 aa, Mycobacterium
ALPEGGA

SEQ ID NO: 1000839 - protein, 6 aa, Mycobacterium
ALPERV

SEQ ID NO: 1000840 - protein, 30 aa, Mycobacterium
ALPGAGTATAPEASAAMPGVPGVPAPRAYA

SEQ ID NO: 1000841 - protein, 7 aa, Mycobacterium
ALPGDPT

SEQ ID NO: 1000842 - protein, 5 aa, Mycobacterium
ALPGK

SEQ ID NO: 1000843 - protein, 5 aa, Mycobacterium
ALPGL

SEQ ID NO: 1000844 - protein, 9 aa, Mycobacterium
ALPGPGDEA

SEQ ID NO: 1000845 - protein, 15 aa, Mycobacterium
ALPGSRTTSAAGTAA

SEQ ID NO: 1000846 - protein, 7 aa, Mycobacterium
ALPGVSG

SEQ ID NO: 1000847 - protein, 5 aa, Mycobacterium
ALPKG

SEQ ID NO: 1000848 - protein, 18 aa, Mycobacterium
ALPKTAATTGALGGSGWT

SEQ ID NO: 1000849 - protein, 7 aa, Mycobacterium
ALPNPTD

SEQ ID NO: 1000850 - protein, 6 aa, Mycobacterium
ALPPES

SEQ ID NO: 1000851 - protein, 19 aa, Mycobacterium
ALPPGIGKPGPHGHGTGQY

SEQ ID NO: 1000852 - protein, 7 aa, Mycobacterium
ALPPGTD

SEQ ID NO: 1000853 - protein, 6 aa, Mycobacterium
ALPPNT

SEQ ID NO: 1000854 - protein, 6 aa, Mycobacterium
ALPPRQ

SEQ ID NO: 1000855 - protein, 7 aa, Mycobacterium
ALPPTEP

SEQ ID NO: 1000856 - protein, 6 aa, Mycobacterium
ALPRQP

SEQ ID NO: 1000857 - protein, 15 aa, Mycobacterium
ALPRYKDGTVDEQIE

SEQ ID NO: 1000858 - protein, 11 aa, Mycobacterium
ALPSASGANPM

SEQ ID NO: 1000859 - protein, 16 aa, Mycobacterium
ALPSEKEIARRSEAGI

SEQ ID NO: 1000860 - protein, 7 aa, Mycobacterium
ALPSGSS

SEQ ID NO: 1000861 - protein, 8 aa, Mycobacterium
ALPSPGRV

SEQ ID NO: 1000862 - protein, 10 aa, Mycobacterium
ALPSPGSDEQ

SEQ ID NO: 1000863 - protein, 6 aa, Mycobacterium
ALPSTS

SEQ ID NO: 1000864 - protein, 7 aa, Mycobacterium
ALPTPAA

SEQ ID NO: 1000865 - protein, 5 aa, Mycobacterium
ALPTY

SEQ ID NO: 1000866 - protein, 11 aa, Mycobacterium
ALQAQGPPSIP

SEQ ID NO: 1000867 - protein, 15 aa, Mycobacterium
ALQDSGRLSADADAL

SEQ ID NO: 1000868 - protein, 8 aa, Mycobacterium
ALQDSTPS

SEQ ID NO: 1000869 - protein, 9 aa, Mycobacterium
ALQESRDRV

SEQ ID NO: 1000870 - protein, 8 aa, Mycobacterium
ALQGNTPV

SEQ ID NO: 1000871 - protein, 4 aa, Mycobacterium
ALQP

SEQ ID NO: 1000872 - protein, 5 aa, Mycobacterium
ALQSA

SEQ ID NO: 1000873 - protein, 16 aa, Mycobacterium
ALQTGKPQNEIKQTGR

SEQ ID NO: 1000874 - protein, 23 aa, Mycobacterium
ALRAGTPEPAADLDPATPLPAYL

SEQ ID NO: 1000875 - protein, 9 aa, Mycobacterium
ALRDAGGSV

SEQ ID NO: 1000876 - protein, 10 aa, Mycobacterium
ALRERAADEG

SEQ ID NO: 1000877 - protein, 18 aa, Mycobacterium
ALRGARASSVLDGGPTRL

SEQ ID NO: 1000878 - protein, 17 aa, Mycobacterium
ALRGSEDSKDENHNGAN

SEQ ID NO: 1000879 - protein, 4 aa, Mycobacterium
ALRP

SEQ ID NO: 1000880 - protein, 6 aa, Mycobacterium
ALRPGY

SEQ ID NO: 1000881 - protein, 6 aa, Mycobacterium
ALRPQG

SEQ ID NO: 1000882 - protein, 4 aa, Mycobacterium
ALRS

SEQ ID NO: 1000883 - protein, 7 aa, Mycobacterium
ALSADGR

SEQ ID NO: 1000884 - protein, 7 aa, Mycobacterium
ALSASPV

SEQ ID NO: 1000885 - protein, 7 aa, Mycobacterium
ALSAYSA

SEQ ID NO: 1000886 - protein, 6 aa, Mycobacterium
ALSEQA

SEQ ID NO: 1000887 - protein, 8 aa, Mycobacterium
ALSGAASA

SEQ ID NO: 1000888 - protein, 17 aa, Mycobacterium
ALSGDGPINGVTEEELR

SEQ ID NO: 1000889 - protein, 6 aa, Mycobacterium
ALSGEA

SEQ ID NO: 1000890 - protein, 7 aa, Mycobacterium
ALSGGRA

SEQ ID NO: 1000891 - protein, 11 aa, Mycobacterium
ALSGKGGTYNI

SEQ ID NO: 1000892 - protein, 7 aa, Mycobacterium
ALSGSGP

SEQ ID NO: 1000893 - protein, 7 aa, Mycobacterium
ALSGSVS

SEQ ID NO: 1000894 - protein, 6 aa, Mycobacterium
ALSPDM

SEQ ID NO: 1000895 - protein, 7 aa, Mycobacterium
ALSPETG

SEQ ID NO: 1000896 - protein, 8 aa, Mycobacterium
ALSPTGNC

SEQ ID NO: 1000897 - protein, 8 aa, Mycobacterium
ALSPTGRC

SEQ ID NO: 1000898 - protein, 11 aa, Mycobacterium
ALSRQPRDASA

SEQ ID NO: 1000899 - protein, 11 aa, Mycobacterium
ALSRSSGAGST

SEQ ID NO: 1000900 - protein, 8 aa, Mycobacterium
ALSSPSSM

SEQ ID NO: 1000901 - protein, 8 aa, Mycobacterium
ALSSTPAG

SEQ ID NO: 1000902 - protein, 13 aa, Mycobacterium
ALSTANAAAAAPT

SEQ ID NO: 1000903 - protein, 5 aa, Mycobacterium
ALTAA

SEQ ID NO: 1000904 - protein, 5 aa, Mycobacterium
ALTDG

SEQ ID NO: 1000905 - protein, 4 aa, Mycobacterium
ALTE

SEQ ID NO: 1000906 - protein, 6 aa, Mycobacterium
ALTEAE

SEQ ID NO: 1000907 - protein, 7 aa, Mycobacterium
ALTGSDI

SEQ ID NO: 1000908 - protein, 5 aa, Mycobacterium
ALTPD

SEQ ID NO: 1000909 - protein, 8 aa, Mycobacterium
ALTPPPTP

SEQ ID NO: 1000910 - protein, 8 aa, Mycobacterium
ALTTRTQE

SEQ ID NO: 1000911 - protein, 14 aa, Mycobacterium
AMADASADRASQIR

SEQ ID NO: 1000912 - protein, 7 aa, Mycobacterium
AMADGPD

SEQ ID NO: 1000913 - protein, 6 aa, Mycobacterium
AMANPA

SEQ ID NO: 1000914 - protein, 14 aa, Mycobacterium
AMDRRGTRTKTEQL

SEQ ID NO: 1000915 - protein, 4 aa, Mycobacterium
AMEP

SEQ ID NO: 1000916 - protein, 10 aa, Mycobacterium
AMGEAPDSRV

SEQ ID NO: 1000917 - protein, 5 aa, Mycobacterium
AMGGP

SEQ ID NO: 1000918 - protein, 4 aa, Mycobacterium
AMGT

SEQ ID NO: 1000919 - protein, 8 aa, Mycobacterium
AMNTAGED

SEQ ID NO: 1000920 - protein, 6 aa, Mycobacterium
AMPDKE

SEQ ID NO: 1000921 - protein, 5 aa, Mycobacterium
AMPGS

SEQ ID NO: 1000922 - protein, 12 aa, Mycobacterium
AMPTITSGNTNA

SEQ ID NO: 1000923 - protein, 9 aa, Mycobacterium
AMPTPAKPH

SEQ ID NO: 1000924 - protein, 13 aa, Mycobacterium
AMREDAAQSPGWD

SEQ ID NO: 1000925 - protein, 5 aa, Mycobacterium
AMRPG

SEQ ID NO: 1000926 - protein, 4 aa, Mycobacterium
AMRQ

SEQ ID NO: 1000927 - protein, 5 aa, Mycobacterium
AMSAE

SEQ ID NO: 1000928 - protein, 6 aa, Mycobacterium
AMSGLG

SEQ ID NO: 1000929 - protein, 11 aa, Mycobacterium
AMSNGQPESRF

SEQ ID NO: 1000930 - protein, 8 aa, Mycobacterium
AMTATATE

SEQ ID NO: 1000931 - protein, 4 aa, Mycobacterium
AMTD

SEQ ID NO: 1000932 - protein, 12 aa, Mycobacterium
AMTSGQSSGPVN

SEQ ID NO: 1000933 - protein, 8 aa, Mycobacterium
AMTTGEQL

SEQ ID NO: 1000934 - protein, 4 aa, Mycobacterium
AMTY

SEQ ID NO: 1000935 - protein, 20 aa, Mycobacterium
ANAAAAGATTSVTAAAGDEV

SEQ ID NO: 1000936 - protein, 19 aa, Mycobacterium
ANAAAGATTSVTAAAGDEV

SEQ ID NO: 1000937 - protein, 12 aa, Mycobacterium
ANAAEPETEPGA

SEQ ID NO: 1000938 - protein, 5 aa, Mycobacterium
ANAAG

SEQ ID NO: 1000939 - protein, 8 aa, Mycobacterium
ANAAPSAH

SEQ ID NO: 1000940 - protein, 11 aa, Mycobacterium
ANAAQGTSSRG

SEQ ID NO: 1000941 - protein, 9 aa, Mycobacterium
ANAARGAEI

SEQ ID NO: 1000942 - protein, 36 aa, Mycobacterium
ANAASTLAANAQSLANSDVQAAQRAYTRPGGSNTGA

SEQ ID NO: 1000943 - protein, 4 aa, Mycobacterium
ANAD

SEQ ID NO: 1000944 - protein, 9 aa, Mycobacterium
ANADEATRR

SEQ ID NO: 1000945 - protein, 7 aa, Mycobacterium
ANADEAV

SEQ ID NO: 1000946 - protein, 8 aa, Mycobacterium
ANADPATV

SEQ ID NO: 1000947 - protein, 7 aa, Mycobacterium
ANAEATR

SEQ ID NO: 1000948 - protein, 6 aa, Mycobacterium
ANAGTV

SEQ ID NO: 1000949 - protein, 6 aa, Mycobacterium
ANAKAR

SEQ ID NO: 1000950 - protein, 8 aa, Mycobacterium
ANAPDDAP

SEQ ID NO: 1000951 - protein, 5 aa, Mycobacterium
ANAPG

SEQ ID NO: 1000952 - protein, 5 aa, Mycobacterium
ANAPS

SEQ ID NO: 1000953 - protein, 7 aa, Mycobacterium
ANAQNAC

SEQ ID NO: 1000954 - protein, 6 aa, Mycobacterium
ANARGK

SEQ ID NO: 1000955 - protein, 10 aa, Mycobacterium
ANASIPTPQP

SEQ ID NO: 1000956 - protein, 6 aa, Mycobacterium
ANASLD

SEQ ID NO: 1000957 - protein, 11 aa, Mycobacterium
ANATAKVSQTS

SEQ ID NO: 1000958 - protein, 8 aa, Mycobacterium
ANATPEAA

SEQ ID NO: 1000959 - protein, 6 aa, Mycobacterium
ANAVAG

SEQ ID NO: 1000960 - protein, 5 aa, Mycobacterium
ANDAR

SEQ ID NO: 1000961 - protein, 33 aa, Mycobacterium
ANDASIGRQVPTGRGGTKDCQASGTSSNSGYPE

SEQ ID NO: 1000962 - protein, 19 aa, Mycobacterium
ANDGPQHSEASAEEMGSQK

SEQ ID NO: 1000963 - protein, 6 aa, Mycobacterium
ANDPER

SEQ ID NO: 1000964 - protein, 7 aa, Mycobacterium
ANDPTSV

SEQ ID NO: 1000965 - protein, 4 aa, Mycobacterium
ANDR

SEQ ID NO: 1000966 - protein, 9 aa, Mycobacterium
ANEADDGAK

SEQ ID NO: 1000967 - protein, 7 aa, Mycobacterium
ANEAGIG

SEQ ID NO: 1000968 - protein, 20 aa, Mycobacterium
ANEHPTDDSRNPGLAHGSQR

SEQ ID NO: 1000969 - protein, 7 aa, Mycobacterium
ANEPELA

SEQ ID NO: 1000970 - protein, 4 aa, Mycobacterium
ANER

SEQ ID NO: 1000971 - protein, 7 aa, Mycobacterium
ANERAEV

SEQ ID NO: 1000972 - protein, 6 aa, Mycobacterium
ANERTL

SEQ ID NO: 1000973 - protein, 5 aa, Mycobacterium
ANESI

SEQ ID NO: 1000974 - protein, 7 aa, Mycobacterium
ANEVATE

SEQ ID NO: 1000975 - protein, 14 aa, Mycobacterium
ANEYSGQRKPPAVP

SEQ ID NO: 1000976 - protein, 5 aa, Mycobacterium
ANGAG

SEQ ID NO: 1000977 - protein, 4 aa, Mycobacterium
ANGC

SEQ ID NO: 1000978 - protein, 7 aa, Mycobacterium
ANGDGNQ

SEQ ID NO: 1000979 - protein, 5 aa, Mycobacterium
ANGDP

SEQ ID NO: 1000980 - protein, 16 aa, Mycobacterium
ANGDSQAVAAPPVSAP

SEQ ID NO: 1000981 - protein, 5 aa, Mycobacterium
ANGET

SEQ ID NO: 1000982 - protein, 13 aa, Mycobacterium
ANGGAVDERGTAV

SEQ ID NO: 1000983 - protein, 6 aa, Mycobacterium
ANGGWS

SEQ ID NO: 1000984 - protein, 8 aa, Mycobacterium
ANGKLDRR

SEQ ID NO: 1000985 - protein, 4 aa, Mycobacterium
ANGL

SEQ ID NO: 1000986 - protein, 5 aa, Mycobacterium
ANGLG

SEQ ID NO: 1000987 - protein, 7 aa, Mycobacterium
ANGNTTI

SEQ ID NO: 1000988 - protein, 7 aa, Mycobacterium
ANGRFDR

SEQ ID NO: 1000989 - protein, 6 aa, Mycobacterium
ANGRNP

SEQ ID NO: 1000990 - protein, 8 aa, Mycobacterium
ANGRPEIT

SEQ ID NO: 1000991 - protein, 6 aa, Mycobacterium
ANGSNE

SEQ ID NO: 1000992 - protein, 22 aa, Mycobacterium
ANGTRCETAPGASDADRIEEAR

SEQ ID NO: 1000993 - protein, 12 aa, Mycobacterium
ANGYQAKPKLPG

SEQ ID NO: 1000994 - protein, 6 aa, Mycobacterium
ANHADG

SEQ ID NO: 1000995 - protein, 4 aa, Mycobacterium
ANHD

SEQ ID NO: 1000996 - protein, 8 aa, Mycobacterium
ANHGGSEH

SEQ ID NO: 1000997 - protein, 8 aa, Mycobacterium
ANHGSKGL

SEQ ID NO: 1000998 - protein, 11 aa, Mycobacterium
ANIDPEPGPEY

SEQ ID NO: 1000999 - protein, 10 aa, Mycobacterium
ANISTGGTAV

SEQ ID NO: 1001000 - protein, 7 aa, Mycobacterium
ANKARPI

SEQ ID NO: 1001001 - protein, 9 aa, Mycobacterium
ANKLGPGEA

SEQ ID NO: 1001002 - protein, 11 aa, Mycobacterium
ANKNAGEGTRF

SEQ ID NO: 1001003 - protein, 17 aa, Mycobacterium
ANKPGGPHKPPKPEAAI

SEQ ID NO: 1001004 - protein, 7 aa, Mycobacterium
ANLDEHG

SEQ ID NO: 1001005 - protein, 5 aa, Mycobacterium
ANLET

SEQ ID NO: 1001006 - protein, 10 aa, Mycobacterium
ANLGDAAGTY

SEQ ID NO: 1001007 - protein, 7 aa, Mycobacterium
ANLGGYN

SEQ ID NO: 1001008 - protein, 6 aa, Mycobacterium
ANLRGK

SEQ ID NO: 1001009 - protein, 9 aa, Mycobacterium
ANLSGGERR

SEQ ID NO: 1001010 - protein, 7 aa, Mycobacterium
ANLTRNA

SEQ ID NO: 1001011 - protein, 9 aa, Mycobacterium
ANNDAGALA

SEQ ID NO: 1001012 - protein, 18 aa, Mycobacterium
ANNDGIVSPDNIDDAALS

SEQ ID NO: 1001013 - protein, 10 aa, Mycobacterium
ANNEPEDDER

SEQ ID NO: 1001014 - protein, 6 aa, Mycobacterium
ANNPRG

SEQ ID NO: 1001015 - protein, 16 aa, Mycobacterium
ANNYEQQEQASQQILS

SEQ ID NO: 1001016 - protein, 4 aa, Mycobacterium
ANPA

SEQ ID NO: 1001017 - protein, 7 aa, Mycobacterium
ANPAEDA

SEQ ID NO: 1001018 - protein, 9 aa, Mycobacterium
ANPAEDAVS

SEQ ID NO: 1001019 - protein, 15 aa, Mycobacterium
ANPAKAERYGQAGRQ

SEQ ID NO: 1001020 - protein, 19 aa, Mycobacterium
ANPATGGTAGGRQPTGPDG

SEQ ID NO: 1001021 - protein, 8 aa, Mycobacterium
ANPAVPQD

SEQ ID NO: 1001022 - protein, 13 aa, Mycobacterium
ANPDDLARTDIAD

SEQ ID NO: 1001023 - protein, 6 aa, Mycobacterium
ANPDGD

SEQ ID NO: 1001024 - protein, 7 aa, Mycobacterium
ANPDMEA

SEQ ID NO: 1001025 - protein, 9 aa, Mycobacterium
ANPDRGTLS

SEQ ID NO: 1001026 - protein, 13 aa, Mycobacterium
ANPDSHEQPWDKK

SEQ ID NO: 1001027 - protein, 7 aa, Mycobacterium
ANPDVKA

SEQ ID NO: 1001028 - protein, 9 aa, Mycobacterium
ANPEDYTNR

SEQ ID NO: 1001029 - protein, 41 aa, Mycobacterium
ANPGAAGQDVTTPTIPPPTPSPGATGRKAPRAAPSKTAALA

SEQ ID NO: 1001030 - protein, 7 aa, Mycobacterium
ANPGIPA

SEQ ID NO: 1001031 - protein, 6 aa, Mycobacterium
ANPGLG

SEQ ID NO: 1001032 - protein, 9 aa, Mycobacterium
ANPGPVDVE

SEQ ID NO: 1001033 - protein, 7 aa, Mycobacterium
ANPGRRG

SEQ ID NO: 1001034 - protein, 7 aa, Mycobacterium
ANPLTGR

SEQ ID NO: 1001035 - protein, 9 aa, Mycobacterium
ANPNSVEAK

SEQ ID NO: 1001036 - protein, 6 aa, Mycobacterium
ANPNVG

SEQ ID NO: 1001037 - protein, 16 aa, Mycobacterium
ANPPNEQQPRPAVPEQ

SEQ ID NO: 1001038 - protein, 10 aa, Mycobacterium
ANPPTDKRDR

SEQ ID NO: 1001039 - protein, 6 aa, Mycobacterium
ANPPTF

SEQ ID NO: 1001040 - protein, 21 aa, Mycobacterium
ANPPWAGTPALPPSTSPASSI

SEQ ID NO: 1001041 - protein, 8 aa, Mycobacterium
ANPQEVTR

SEQ ID NO: 1001042 - protein, 4 aa, Mycobacterium
ANPR

SEQ ID NO: 1001043 - protein, 7 aa, Mycobacterium
ANPRRQL

SEQ ID NO: 1001044 - protein, 6 aa, Mycobacterium
ANPSHL

SEQ ID NO: 1001045 - protein, 8 aa, Mycobacterium
ANPSTQLR

SEQ ID NO: 1001046 - protein, 7 aa, Mycobacterium
ANPYPTY

SEQ ID NO: 1001047 - protein, 14 aa, Mycobacterium
ANQELSQAKNAVQQ

SEQ ID NO: 1001048 - protein, 6 aa, Mycobacterium
ANQGAG

SEQ ID NO: 1001049 - protein, 13 aa, Mycobacterium
ANQHPRSFPNDPV

SEQ ID NO: 1001050 - protein, 13 aa, Mycobacterium
ANQINDSRYNPDY

SEQ ID NO: 1001051 - protein, 7 aa, Mycobacterium
ANQNGKR

SEQ ID NO: 1001052 - protein, 10 aa, Mycobacterium
ANQPPNPGEH

SEQ ID NO: 1001053 - protein, 5 aa, Mycobacterium
ANQPY

SEQ ID NO: 1001054 - protein, 23 aa, Mycobacterium
ANQTAVQAETAAQAYEQAAAKMT

SEQ ID NO: 1001055 - protein, 9 aa, Mycobacterium
ANQVRPENR

SEQ ID NO: 1001056 - protein, 5 aa, Mycobacterium
ANRAA

SEQ ID NO: 1001057 - protein, 18 aa, Mycobacterium
ANRAGSGCLDTTDAGLTG

SEQ ID NO: 1001058 - protein, 14 aa, Mycobacterium
ANRAPPEQLTDAYA

SEQ ID NO: 1001059 - protein, 12 aa, Mycobacterium
ANRAPSAANNQP

SEQ ID NO: 1001060 - protein, 11 aa, Mycobacterium
ANRAPSVGNAQ

SEQ ID NO: 1001061 - protein, 4 aa, Mycobacterium
ANRD

SEQ ID NO: 1001062 - protein, 6 aa, Mycobacterium
ANRDEE

SEQ ID NO: 1001063 - protein, 11 aa, Mycobacterium
ANRDEREYPDP

SEQ ID NO: 1001064 - protein, 14 aa, Mycobacterium
ANRDERQYGPDAGE

SEQ ID NO: 1001065 - protein, 12 aa, Mycobacterium
ANRDESRWPDPN

SEQ ID NO: 1001066 - protein, 7 aa, Mycobacterium
ANRDPAV

SEQ ID NO: 1001067 - protein, 12 aa, Mycobacterium
ANRDPAVFPDPG

SEQ ID NO: 1001068 - protein, 5 aa, Mycobacterium
ANRER

SEQ ID NO: 1001069 - protein, 8 aa, Mycobacterium
ANRGTGFG

SEQ ID NO: 1001070 - protein, 8 aa, Mycobacterium
ANRNPLTR

SEQ ID NO: 1001071 - protein, 10 aa, Mycobacterium
ANRPGPDGEV

SEQ ID NO: 1001072 - protein, 4 aa, Mycobacterium
ANRS

SEQ ID NO: 1001073 - protein, 16 aa, Mycobacterium
ANRSDASTSTPPRRKP

SEQ ID NO: 1001074 - protein, 4 aa, Mycobacterium
ANRT

SEQ ID NO: 1001075 - protein, 7 aa, Mycobacterium
ANRTLSS

SEQ ID NO: 1001076 - protein, 6 aa, Mycobacterium
ANRTTH

SEQ ID NO: 1001077 - protein, 6 aa, Mycobacterium
ANSASA

SEQ ID NO: 1001078 - protein, 8 aa, Mycobacterium
ANSATGSR

SEQ ID NO: 1001079 - protein, 6 aa, Mycobacterium
ANSDDR

SEQ ID NO: 1001080 - protein, 25 aa, Mycobacterium
ANSGKPPDRPPPRPKPQPNPARPAW

SEQ ID NO: 1001081 - protein, 7 aa, Mycobacterium
ANSGLGA

SEQ ID NO: 1001082 - protein, 26 aa, Mycobacterium
ANSHGQKVQAAGKNMAQTDSAVGSSW

SEQ ID NO: 1001083 - protein, 4 aa, Mycobacterium
ANSI

SEQ ID NO: 1001084 - protein, 13 aa, Mycobacterium
ANSKCTGTADGAA

SEQ ID NO: 1001085 - protein, 9 aa, Mycobacterium
ANSLGNHVS

SEQ ID NO: 1001086 - protein, 4 aa, Mycobacterium
ANSP

SEQ ID NO: 1001087 - protein, 8 aa, Mycobacterium
ANSPIDAQ

SEQ ID NO: 1001088 - protein, 6 aa, Mycobacterium
ANSSIS

SEQ ID NO: 1001089 - protein, 5 aa, Mycobacterium
ANSSV

SEQ ID NO: 1001090 - protein, 22 aa, Mycobacterium
ANSTPYQPDPTRAHTPASNYGA

SEQ ID NO: 1001091 - protein, 14 aa, Mycobacterium
ANSYASAEATNAAD

SEQ ID NO: 1001092 - protein, 4 aa, Mycobacterium
ANTA

SEQ ID NO: 1001093 - protein, 12 aa, Mycobacterium
ANTAKPRRAPTG

SEQ ID NO: 1001094 - protein, 7 aa, Mycobacterium
ANTASCK

SEQ ID NO: 1001095 - protein, 5 aa, Mycobacterium
ANTCR

SEQ ID NO: 1001096 - protein, 8 aa, Mycobacterium
ANTGRSYG

SEQ ID NO: 1001097 - protein, 33 aa, Mycobacterium
ANTGVANAGSYNTGNLNAGDINTGSFNTGVGNT

SEQ ID NO: 1001098 - protein, 29 aa, Mycobacterium
ANTGWGNAGAYNSGGFNAGAYNTGSFNPG

SEQ ID NO: 1001099 - protein, 5 aa, Mycobacterium
ANTPE

SEQ ID NO: 1001100 - protein, 6 aa, Mycobacterium
ANTTRD

SEQ ID NO: 1001101 - protein, 4 aa, Mycobacterium
ANTY

SEQ ID NO: 1001102 - protein, 6 aa, Mycobacterium
ANVDTG

SEQ ID NO: 1001103 - protein, 6 aa, Mycobacterium
ANVQDG

SEQ ID NO: 1001104 - protein, 6 aa, Mycobacterium
ANVRTR

SEQ ID NO: 1001105 - protein, 11 aa, Mycobacterium
ANVSGQPPAVD

SEQ ID NO: 1001106 - protein, 5 aa, Mycobacterium
ANVSK

SEQ ID NO: 1001107 - protein, 5 aa, Mycobacterium
ANVTS

SEQ ID NO: 1001108 - protein, 4 aa, Mycobacterium
ANYA

SEQ ID NO: 1001109 - protein, 5 aa, Mycobacterium
ANYGK

SEQ ID NO: 1001110 - protein, 10 aa, Mycobacterium
ANYGPGHVPN

SEQ ID NO: 1001111 - protein, 22 aa, Mycobacterium
APAAAGAATADVSVSGPKFTAP

SEQ ID NO: 1001112 - protein, 44 aa, Mycobacterium
APAAATSAPAPDPEPAFAASPAVPAGIAPAPGAGLELPTDAGDF

SEQ ID NO: 1001113 - protein, 11 aa, Mycobacterium
APAAQPAETTA

SEQ ID NO: 1001114 - protein, 8 aa, Mycobacterium
APAAQRVR

SEQ ID NO: 1001115 - protein, 22 aa, Mycobacterium
APAAQSRRKTIATAEDGTEYQA

SEQ ID NO: 1001116 - protein, 8 aa, Mycobacterium
APAAQTGP

SEQ ID NO: 1001117 - protein, 11 aa, Mycobacterium
APADEEARDQL

SEQ ID NO: 1001118 - protein, 8 aa, Mycobacterium
APADEVAA

SEQ ID NO: 1001119 - protein, 6 aa, Mycobacterium
APADRP

SEQ ID NO: 1001120 - protein, 9 aa, Mycobacterium
APADTGPGS

SEQ ID NO: 1001121 - protein, 6 aa, Mycobacterium
APADWQ

SEQ ID NO: 1001122 - protein, 7 aa, Mycobacterium
APAEGTC

SEQ ID NO: 1001123 - protein, 7 aa, Mycobacterium
APAEHSS

SEQ ID NO: 1001124 - protein, 5 aa, Mycobacterium
APAER

SEQ ID NO: 1001125 - protein, 14 aa, Mycobacterium
APAEVRSSGWSTDP

SEQ ID NO: 1001126 - protein, 18 aa, Mycobacterium
APAGAAALSGPAIDGTGK

SEQ ID NO: 1001127 - protein, 6 aa, Mycobacterium
APAGAH

SEQ ID NO: 1001128 - protein, 7 aa, Mycobacterium
APAGAQI

SEQ ID NO: 1001129 - protein, 10 aa, Mycobacterium
APAGGESSTV

SEQ ID NO: 1001130 - protein, 10 aa, Mycobacterium
APAGGGPGPH

SEQ ID NO: 1001131 - protein, 7 aa, Mycobacterium
APAHTPV

SEQ ID NO: 1001132 - protein, 4 aa, Mycobacterium
APAI

SEQ ID NO: 1001133 - protein, 6 aa, Mycobacterium
APAIAQ

SEQ ID NO: 1001134 - protein, 12 aa, Mycobacterium
APAISPRSTPLT

SEQ ID NO: 1001135 - protein, 7 aa, Mycobacterium
APAKASA

SEQ ID NO: 1001136 - protein, 10 aa, Mycobacterium
APAKDDPRLV

SEQ ID NO: 1001137 - protein, 13 aa, Mycobacterium
APAKVKGPIAGTG

SEQ ID NO: 1001138 - protein, 5 aa, Mycobacterium
APALA

SEQ ID NO: 1001139 - protein, 6 aa, Mycobacterium
APALDN

SEQ ID NO: 1001140 - protein, 13 aa, Mycobacterium
APALSAQAGADAQ

SEQ ID NO: 1001141 - protein, 8 aa, Mycobacterium
APALSEKD

SEQ ID NO: 1001142 - protein, 7 aa, Mycobacterium
APANGPA

SEQ ID NO: 1001143 - protein, 4 aa, Mycobacterium
APAP

SEQ ID NO: 1001144 - protein, 8 aa, Mycobacterium
APAPAELP

SEQ ID NO: 1001145 - protein, 8 aa, Mycobacterium
APAPDGTE

SEQ ID NO: 1001146 - protein, 6 aa, Mycobacterium
APAPLG

SEQ ID NO: 1001147 - protein, 10 aa, Mycobacterium
APAPPAPPLP

SEQ ID NO: 1001148 - protein, 7 aa, Mycobacterium
APAPPPL

SEQ ID NO: 1001149 - protein, 6 aa, Mycobacterium
APAPRF

SEQ ID NO: 1001150 - protein, 8 aa, Mycobacterium
APAPVSDI

SEQ ID NO: 1001151 - protein, 5 aa, Mycobacterium
APARA

SEQ ID NO: 1001152 - protein, 9 aa, Mycobacterium
APARATASA

SEQ ID NO: 1001153 - protein, 8 aa, Mycobacterium
APARGAPV

SEQ ID NO: 1001154 - protein, 6 aa, Mycobacterium
APARGQ

SEQ ID NO: 1001155 - protein, 7 aa, Mycobacterium
APARQGC

SEQ ID NO: 1001156 - protein, 12 aa, Mycobacterium
APARRGRHKNIP

SEQ ID NO: 1001157 - protein, 8 aa, Mycobacterium
APASDSAG

SEQ ID NO: 1001158 - protein, 11 aa, Mycobacterium
APASYGAGGLG

SEQ ID NO: 1001159 - protein, 8 aa, Mycobacterium
APATADLD

SEQ ID NO: 1001160 - protein, 7 aa, Mycobacterium
APATDPD

SEQ ID NO: 1001161 - protein, 10 aa, Mycobacterium
APATKSTAAT

SEQ ID NO: 1001162 - protein, 14 aa, Mycobacterium
APATPGPAAGPGGL

SEQ ID NO: 1001163 - protein, 31 aa, Mycobacterium
APATPTSSRRPHQRLPPSRTPLGRPGGTGLT

SEQ ID NO: 1001164 - protein, 7 aa, Mycobacterium
APATREP

SEQ ID NO: 1001165 - protein, 8 aa, Mycobacterium
APAVEEQD

SEQ ID NO: 1001166 - protein, 20 aa, Mycobacterium
APCAESADPAAPPDGAEVCK

SEQ ID NO: 1001167 - protein, 13 aa, Mycobacterium
APCSSRRSPTHAW

SEQ ID NO: 1001168 - protein, 9 aa, Mycobacterium
APDAADPTV

SEQ ID NO: 1001169 - protein, 6 aa, Mycobacterium
APDAAK

SEQ ID NO: 1001170 - protein, 8 aa, Mycobacterium
APDAARAI

SEQ ID NO: 1001171 - protein, 5 aa, Mycobacterium
APDAE

SEQ ID NO: 1001172 - protein, 5 aa, Mycobacterium
APDAS

SEQ ID NO: 1001173 - protein, 13 aa, Mycobacterium
APDASVSQVGDAV

SEQ ID NO: 1001174 - protein, 4 aa, Mycobacterium
APDD

SEQ ID NO: 1001175 - protein, 6 aa, Mycobacterium
APDDEL

SEQ ID NO: 1001176 - protein, 65 aa, Mycobacterium
APDDVPPVPPSPPAPSPPAPPSLPQPPTRGPVPPVPPAPPWVPGPPIPPVPPLPPKGFVSPWPPL

SEQ ID NO: 1001177 - protein, 8 aa, Mycobacterium
APDEKWGE

SEQ ID NO: 1001178 - protein, 7 aa, Mycobacterium
APDETTY

SEQ ID NO: 1001179 - protein, 5 aa, Mycobacterium
APDEV

SEQ ID NO: 1001180 - protein, 6 aa, Mycobacterium
APDFPT

SEQ ID NO: 1001181 - protein, 7 aa, Mycobacterium
APDGCGG

SEQ ID NO: 1001182 - protein, 11 aa, Mycobacterium
APDGRQHRQPS

SEQ ID NO: 1001183 - protein, 12 aa, Mycobacterium
APDGTHHQNEAA

SEQ ID NO: 1001184 - protein, 6 aa, Mycobacterium
APDHPE

SEQ ID NO: 1001185 - protein, 9 aa, Mycobacterium
APDHQNTKR

SEQ ID NO: 1001186 - protein, 7 aa, Mycobacterium
APDLTER

SEQ ID NO: 1001187 - protein, 15 aa, Mycobacterium
APDPAPVPRDAAPAV

SEQ ID NO: 1001188 - protein, 12 aa, Mycobacterium
APDPKDLDERTE

SEQ ID NO: 1001189 - protein, 6 aa, Mycobacterium
APDPRR

SEQ ID NO: 1001190 - protein, 9 aa, Mycobacterium
APDPRRDPV

SEQ ID NO: 1001191 - protein, 20 aa, Mycobacterium
APDPVVSTTTPEDVDAAAAG

SEQ ID NO: 1001192 - protein, 10 aa, Mycobacterium
APDQLEHDAD

SEQ ID NO: 1001193 - protein, 9 aa, Mycobacterium
APDRGCGDS

SEQ ID NO: 1001194 - protein, 9 aa, Mycobacterium
APDRGSSAN

SEQ ID NO: 1001195 - protein, 12 aa, Mycobacterium
APDRRVGPPAQR

SEQ ID NO: 1001196 - protein, 8 aa, Mycobacterium
APDSRLDS

SEQ ID NO: 1001197 - protein, 4 aa, Mycobacterium
APDT

SEQ ID NO: 1001198 - protein, 6 aa, Mycobacterium
APDTLD

SEQ ID NO: 1001199 - protein, 8 aa, Mycobacterium
APDTPEIA

SEQ ID NO: 1001200 - protein, 7 aa, Mycobacterium
APDTPWQ

SEQ ID NO: 1001201 - protein, 16 aa, Mycobacterium
APDTVTNSDGTTDAPN

SEQ ID NO: 1001202 - protein, 7 aa, Mycobacterium
APDVSAE

SEQ ID NO: 1001203 - protein, 4 aa, Mycobacterium
APEA

SEQ ID NO: 1001204 - protein, 6 aa, Mycobacterium
APEAAS

SEQ ID NO: 1001205 - protein, 15 aa, Mycobacterium
APEAAVTAGAAQQSA

SEQ ID NO: 1001206 - protein, 6 aa, Mycobacterium
APEARR

SEQ ID NO: 1001207 - protein, 8 aa, Mycobacterium
APEAVREP

SEQ ID NO: 1001208 - protein, 6 aa, Mycobacterium
APEDMG

SEQ ID NO: 1001209 - protein, 11 aa, Mycobacterium
APEDPKTLNSN

SEQ ID NO: 1001210 - protein, 6 aa, Mycobacterium
APEEND

SEQ ID NO: 1001211 - protein, 8 aa, Mycobacterium
APEEPIES

SEQ ID NO: 1001212 - protein, 4 aa, Mycobacterium
APEF

SEQ ID NO: 1001213 - protein, 12 aa, Mycobacterium
APEGAPTGGDPL

SEQ ID NO: 1001214 - protein, 6 aa, Mycobacterium
APEGTM

SEQ ID NO: 1001215 - protein, 8 aa, Mycobacterium
APEIESQV

SEQ ID NO: 1001216 - protein, 4 aa, Mycobacterium
APEL

SEQ ID NO: 1001217 - protein, 5 aa, Mycobacterium
APELQ

SEQ ID NO: 1001218 - protein, 5 aa, Mycobacterium
APELS

SEQ ID NO: 1001219 - protein, 11 aa, Mycobacterium
APELSAPTNGE

SEQ ID NO: 1001220 - protein, 8 aa, Mycobacterium
APEPADGE

SEQ ID NO: 1001221 - protein, 8 aa, Mycobacterium
APEPELTG

SEQ ID NO: 1001222 - protein, 11 aa, Mycobacterium
APEPGDPQHTL

SEQ ID NO: 1001223 - protein, 7 aa, Mycobacterium
APEPGLA

SEQ ID NO: 1001224 - protein, 21 aa, Mycobacterium
APEPSTGAEAAVSRTVRGSLE

SEQ ID NO: 1001225 - protein, 8 aa, Mycobacterium
APEPTARP

SEQ ID NO: 1001226 - protein, 6 aa, Mycobacterium
APEPVP

SEQ ID NO: 1001227 - protein, 8 aa, Mycobacterium
APEQGVEE

SEQ ID NO: 1001228 - protein, 13 aa, Mycobacterium
APEQRADYERRAD

SEQ ID NO: 1001229 - protein, 6 aa, Mycobacterium
APEQRE

SEQ ID NO: 1001230 - protein, 4 aa, Mycobacterium
APER

SEQ ID NO: 1001231 - protein, 7 aa, Mycobacterium
APERTAE

SEQ ID NO: 1001232 - protein, 4 aa, Mycobacterium
APES

SEQ ID NO: 1001233 - protein, 4 aa, Mycobacterium
APEV

SEQ ID NO: 1001234 - protein, 15 aa, Mycobacterium
APEYAEGDTRGERMG

SEQ ID NO: 1001235 - protein, 8 aa, Mycobacterium
APFTGGGY

SEQ ID NO: 1001236 - protein, 6 aa, Mycobacterium
APGAAW

SEQ ID NO: 1001237 - protein, 16 aa, Mycobacterium
APGAELPRIDPDARRR

SEQ ID NO: 1001238 - protein, 7 aa, Mycobacterium
APGAESQ

SEQ ID NO: 1001239 - protein, 8 aa, Mycobacterium
APGAKTDT

SEQ ID NO: 1001240 - protein, 9 aa, Mycobacterium
APGASAPSH

SEQ ID NO: 1001241 - protein, 8 aa, Mycobacterium
APGASGAV

SEQ ID NO: 1001242 - protein, 10 aa, Mycobacterium
APGATGNIAT

SEQ ID NO: 1001243 - protein, 16 aa, Mycobacterium
APGAVAPAPLGPQTRG

SEQ ID NO: 1001244 - protein, 8 aa, Mycobacterium
APGAVGAA

SEQ ID NO: 1001245 - protein, 17 aa, Mycobacterium
APGDATTVRQSAESTLR

SEQ ID NO: 1001246 - protein, 5 aa, Mycobacterium
APGDG

SEQ ID NO: 1001247 - protein, 5 aa, Mycobacterium
APGEI

SEQ ID NO: 1001248 - protein, 6 aa, Mycobacterium
APGEPA

SEQ ID NO: 1001249 - protein, 13 aa, Mycobacterium
APGEPAIPTQTIS

SEQ ID NO: 1001250 - protein, 7 aa, Mycobacterium
APGERID

SEQ ID NO: 1001251 - protein, 6 aa, Mycobacterium
APGESA

SEQ ID NO: 1001252 - protein, 7 aa, Mycobacterium
APGFGDR

SEQ ID NO: 1001253 - protein, 14 aa, Mycobacterium
APGFGNSTTTASSG

SEQ ID NO: 1001254 - protein, 4 aa, Mycobacterium
APGG

SEQ ID NO: 1001255 - protein, 5 aa, Mycobacterium
APGGA

SEQ ID NO: 1001256 - protein, 6 aa, Mycobacterium
APGGAV

SEQ ID NO: 1001257 - protein, 8 aa, Mycobacterium
APGGDAAA

SEQ ID NO: 1001258 - protein, 8 aa, Mycobacterium
APGGGDGV

SEQ ID NO: 1001259 - protein, 5 aa, Mycobacterium
APGHA

SEQ ID NO: 1001260 - protein, 6 aa, Mycobacterium
APGIES

SEQ ID NO: 1001261 - protein, 4 aa, Mycobacterium
APGL

SEQ ID NO: 1001262 - protein, 8 aa, Mycobacterium
APGMPTDG

SEQ ID NO: 1001263 - protein, 8 aa, Mycobacterium
APGNPKHV

SEQ ID NO: 1001264 - protein, 6 aa, Mycobacterium
APGPEV

SEQ ID NO: 1001265 - protein, 5 aa, Mycobacterium
APGPI

SEQ ID NO: 1001266 - protein, 4 aa, Mycobacterium
APGQ

SEQ ID NO: 1001267 - protein, 7 aa, Mycobacterium
APGQPAG

SEQ ID NO: 1001268 - protein, 8 aa, Mycobacterium
APGQRDES

SEQ ID NO: 1001269 - protein, 11 aa, Mycobacterium
APGQVGSSAMP

SEQ ID NO: 1001270 - protein, 7 aa, Mycobacterium
APGRDDV

SEQ ID NO: 1001271 - protein, 6 aa, Mycobacterium
APGRDN

SEQ ID NO: 1001272 - protein, 26 aa, Mycobacterium
APGRGAPGRGACGRGMGRSTGCAEEN

SEQ ID NO: 1001273 - protein, 6 aa, Mycobacterium
APGRME

SEQ ID NO: 1001274 - protein, 9 aa, Mycobacterium
APGRPQAPN

SEQ ID NO: 1001275 - protein, 5 aa, Mycobacterium
APGSA

SEQ ID NO: 1001276 - protein, 15 aa, Mycobacterium
APGSGLDDRRQLQEP

SEQ ID NO: 1001277 - protein, 8 aa, Mycobacterium
APGSGQTV

SEQ ID NO: 1001278 - protein, 13 aa, Mycobacterium
APGSKPIDLFGAP

SEQ ID NO: 1001279 - protein, 8 aa, Mycobacterium
APGTAAPL

SEQ ID NO: 1001280 - protein, 8 aa, Mycobacterium
APGTGLRD

SEQ ID NO: 1001281 - protein, 8 aa, Mycobacterium
APGTIDTP

SEQ ID NO: 1001282 - protein, 8 aa, Mycobacterium
APGTKPRW

SEQ ID NO: 1001283 - protein, 8 aa, Mycobacterium
APGTPTTD

SEQ ID NO: 1001284 - protein, 5 aa, Mycobacterium
APGVA

SEQ ID NO: 1001285 - protein, 7 aa, Mycobacterium
APGVESR

SEQ ID NO: 1001286 - protein, 7 aa, Mycobacterium
APGVRGG

SEQ ID NO: 1001287 - protein, 6 aa, Mycobacterium
APHNAA

SEQ ID NO: 1001288 - protein, 18 aa, Mycobacterium
APHPASAVPGPSGEEERE

SEQ ID NO: 1001289 - protein, 5 aa, Mycobacterium
APHRE

SEQ ID NO: 1001290 - protein, 4 aa, Mycobacterium
APHS

SEQ ID NO: 1001291 - protein, 8 aa, Mycobacterium
APHSGAAT

SEQ ID NO: 1001292 - protein, 10 aa, Mycobacterium
APHSPERSRL

SEQ ID NO: 1001293 - protein, 16 aa, Mycobacterium
APHVATPTPAHTPPVE

SEQ ID NO: 1001294 - protein, 7 aa, Mycobacterium
APIDKTR

SEQ ID NO: 1001295 - protein, 5 aa, Mycobacterium
APIES

SEQ ID NO: 1001296 - protein, 4 aa, Mycobacterium
APIG

SEQ ID NO: 1001297 - protein, 7 aa, Mycobacterium
APIPASA

SEQ ID NO: 1001298 - protein, 11 aa, Mycobacterium
APIPSAEPRRR

SEQ ID NO: 1001299 - protein, 7 aa, Mycobacterium
APIQGSA

SEQ ID NO: 1001300 - protein, 4 aa, Mycobacterium
APIT

SEQ ID NO: 1001301 - protein, 4 aa, Mycobacterium
APKA

SEQ ID NO: 1001302 - protein, 5 aa, Mycobacterium
APKAL

SEQ ID NO: 1001303 - protein, 10 aa, Mycobacterium
APKGSGTDVT

SEQ ID NO: 1001304 - protein, 5 aa, Mycobacterium
APKNA

SEQ ID NO: 1001305 - protein, 17 aa, Mycobacterium
APKPELEDRIESDPGSV

SEQ ID NO: 1001306 - protein, 16 aa, Mycobacterium
APKPGTGPSAATRERG

SEQ ID NO: 1001307 - protein, 4 aa, Mycobacterium
APKR

SEQ ID NO: 1001308 - protein, 14 aa, Mycobacterium
APKRYKELSETVSE

SEQ ID NO: 1001309 - protein, 8 aa, Mycobacterium
APKSAGAL

SEQ ID NO: 1001310 - protein, 8 aa, Mycobacterium
APKSALGH

SEQ ID NO: 1001311 - protein, 8 aa, Mycobacterium
APKTSVRS

SEQ ID NO: 1001312 - protein, 4 aa, Mycobacterium
APKY

SEQ ID NO: 1001313 - protein, 4 aa, Mycobacterium
APLA

SEQ ID NO: 1001314 - protein, 6 aa, Mycobacterium
APLANV

SEQ ID NO: 1001315 - protein, 13 aa, Mycobacterium
APLAPDDADAFTE

SEQ ID NO: 1001316 - protein, 10 aa, Mycobacterium
APLDEASRNR

SEQ ID NO: 1001317 - protein, 6 aa, Mycobacterium
APLDRT

SEQ ID NO: 1001318 - protein, 32 aa, Mycobacterium
APLETAEREVTAGRAGLAARPPLITAKPAKLA

SEQ ID NO: 1001319 - protein, 12 aa, Mycobacterium
APLGGASDERVG

SEQ ID NO: 1001320 - protein, 11 aa, Mycobacterium
APLGKKQDSMK

SEQ ID NO: 1001321 - protein, 9 aa, Mycobacterium
APLPAEGET

SEQ ID NO: 1001322 - protein, 14 aa, Mycobacterium
APLPAQQGPARAPS

SEQ ID NO: 1001323 - protein, 6 aa, Mycobacterium
APLPCT

SEQ ID NO: 1001324 - protein, 11 aa, Mycobacterium
APLPELPQRPI

SEQ ID NO: 1001325 - protein, 11 aa, Mycobacterium
APLPGQAAYGA

SEQ ID NO: 1001326 - protein, 21 aa, Mycobacterium
APLPPLPPAPPPPPLPPAPPP

SEQ ID NO: 1001327 - protein, 6 aa, Mycobacterium
APLPPT

SEQ ID NO: 1001328 - protein, 7 aa, Mycobacterium
APLPTGA

SEQ ID NO: 1001329 - protein, 5 aa, Mycobacterium
APLQP

SEQ ID NO: 1001330 - protein, 4 aa, Mycobacterium
APLR

SEQ ID NO: 1001331 - protein, 4 aa, Mycobacterium
APLS

SEQ ID NO: 1001332 - protein, 6 aa, Mycobacterium
APLSDD

SEQ ID NO: 1001333 - protein, 12 aa, Mycobacterium
APLSTSSLAAGN

SEQ ID NO: 1001334 - protein, 14 aa, Mycobacterium
APLVPGTPDPVKNA

SEQ ID NO: 1001335 - protein, 4 aa, Mycobacterium
APMP

SEQ ID NO: 1001336 - protein, 7 aa, Mycobacterium
APMPNSL

SEQ ID NO: 1001337 - protein, 13 aa, Mycobacterium
APMPTAESAPVPS

SEQ ID NO: 1001338 - protein, 10 aa, Mycobacterium
APMQSGDDGW

SEQ ID NO: 1001339 - protein, 5 aa, Mycobacterium
APMTQ

SEQ ID NO: 1001340 - protein, 11 aa, Mycobacterium
APNDPAEPDYS

SEQ ID NO: 1001341 - protein, 8 aa, Mycobacterium
APNEGPLR

SEQ ID NO: 1001342 - protein, 4 aa, Mycobacterium
APNG

SEQ ID NO: 1001343 - protein, 6 aa, Mycobacterium
APNGFS

SEQ ID NO: 1001344 - protein, 7 aa, Mycobacterium
APNGGAQ

SEQ ID NO: 1001345 - protein, 6 aa, Mycobacterium
APNLTA

SEQ ID NO: 1001346 - protein, 8 aa, Mycobacterium
APNPAAQQ

SEQ ID NO: 1001347 - protein, 7 aa, Mycobacterium
APNPGHQ

SEQ ID NO: 1001348 - protein, 19 aa, Mycobacterium
APNPHATAEEVEAARHDSK

SEQ ID NO: 1001349 - protein, 5 aa, Mycobacterium
APNPR

SEQ ID NO: 1001350 - protein, 5 aa, Mycobacterium
APNQA

SEQ ID NO: 1001351 - protein, 13 aa, Mycobacterium
APNSSGKDVDDAF

SEQ ID NO: 1001352 - protein, 8 aa, Mycobacterium
APNTGGES

SEQ ID NO: 1001353 - protein, 13 aa, Mycobacterium
APNTGNAIRTAAA

SEQ ID NO: 1001354 - protein, 8 aa, Mycobacterium
APNTGSLR

SEQ ID NO: 1001355 - protein, 5 aa, Mycobacterium
APNVA

SEQ ID NO: 1001356 - protein, 26 aa, Mycobacterium
APPAAPLAATGAAGAPSPGGGSIIAG

SEQ ID NO: 1001357 - protein, 16 aa, Mycobacterium
APPAGGPARMGPAIDS

SEQ ID NO: 1001358 - protein, 9 aa, Mycobacterium
APPAGKSLD

SEQ ID NO: 1001359 - protein, 9 aa, Mycobacterium
APPAGPAAD

SEQ ID NO: 1001360 - protein, 14 aa, Mycobacterium
APPANAPTPAERKT

SEQ ID NO: 1001361 - protein, 49 aa, Mycobacterium
APPAPPSPPEPARPNSHPGLPPSPPAPPAPPAVPTPPAPPPPPCPKSSA

SEQ ID NO: 1001362 - protein, 6 aa, Mycobacterium
APPARA

SEQ ID NO: 1001363 - protein, 6 aa, Mycobacterium
APPDDA

SEQ ID NO: 1001364 - protein, 15 aa, Mycobacterium
APPDGQTKQSEPADV

SEQ ID NO: 1001365 - protein, 5 aa, Mycobacterium
APPDL

SEQ ID NO: 1001366 - protein, 8 aa, Mycobacterium
APPDVVGG

SEQ ID NO: 1001367 - protein, 4 aa, Mycobacterium
APPE

SEQ ID NO: 1001368 - protein, 9 aa, Mycobacterium
APPEASAAG

SEQ ID NO: 1001369 - protein, 5 aa, Mycobacterium
APPEI

SEQ ID NO: 1001370 - protein, 12 aa, Mycobacterium
APPEYGGAGGTL

SEQ ID NO: 1001371 - protein, 4 aa, Mycobacterium
APPG

SEQ ID NO: 1001372 - protein, 6 aa, Mycobacterium
APPGIR

SEQ ID NO: 1001373 - protein, 5 aa, Mycobacterium
APPGP

SEQ ID NO: 1001374 - protein, 7 aa, Mycobacterium
APPGSFN

SEQ ID NO: 1001375 - protein, 8 aa, Mycobacterium
APPGTVGS

SEQ ID NO: 1001376 - protein, 6 aa, Mycobacterium
APPGYV

SEQ ID NO: 1001377 - protein, 5 aa, Mycobacterium
APPHG

SEQ ID NO: 1001378 - protein, 8 aa, Mycobacterium
APPIPLGP

SEQ ID NO: 1001379 - protein, 8 aa, Mycobacterium
APPKCGTT

SEQ ID NO: 1001380 - protein, 4 aa, Mycobacterium
APPL

SEQ ID NO: 1001381 - protein, 5 aa, Mycobacterium
APPLE

SEQ ID NO: 1001382 - protein, 14 aa, Mycobacterium
APPPADDDDDSVAA

SEQ ID NO: 1001383 - protein, 6 aa, Mycobacterium
APPPDV

SEQ ID NO: 1001384 - protein, 5 aa, Mycobacterium
APPPE

SEQ ID NO: 1001385 - protein, 5 aa, Mycobacterium
APPPF

SEQ ID NO: 1001386 - protein, 8 aa, Mycobacterium
APPPIRPY

SEQ ID NO: 1001387 - protein, 5 aa, Mycobacterium
APPPQ

SEQ ID NO: 1001388 - protein, 6 aa, Mycobacterium
APPRAG

SEQ ID NO: 1001389 - protein, 5 aa, Mycobacterium
APPRI

SEQ ID NO: 1001390 - protein, 9 aa, Mycobacterium
APPRSPAQM

SEQ ID NO: 1001391 - protein, 15 aa, Mycobacterium
APPSADEVGKLRSGQ

SEQ ID NO: 1001392 - protein, 6 aa, Mycobacterium
APPSDI

SEQ ID NO: 1001393 - protein, 8 aa, Mycobacterium
APPSDRRG

SEQ ID NO: 1001394 - protein, 19 aa, Mycobacterium
APPSESPPGCGTTKRPART

SEQ ID NO: 1001395 - protein, 21 aa, Mycobacterium
APPSPPAPPCPPVPPAPPLPP

SEQ ID NO: 1001396 - protein, 21 aa, Mycobacterium
APPSSTTSGVVTTQTASCTDA

SEQ ID NO: 1001397 - protein, 7 aa, Mycobacterium
APPSVAS

SEQ ID NO: 1001398 - protein, 4 aa, Mycobacterium
APPT

SEQ ID NO: 1001399 - protein, 8 aa, Mycobacterium
APPTAMTT

SEQ ID NO: 1001400 - protein, 5 aa, Mycobacterium
APPTE

SEQ ID NO: 1001401 - protein, 6 aa, Mycobacterium
APPTVN

SEQ ID NO: 1001402 - protein, 6 aa, Mycobacterium
APPVEE

SEQ ID NO: 1001403 - protein, 4 aa, Mycobacterium
APPW

SEQ ID NO: 1001404 - protein, 8 aa, Mycobacterium
APQAVGYP

SEQ ID NO: 1001405 - protein, 9 aa, Mycobacterium
APQDKGPWG

SEQ ID NO: 1001406 - protein, 6 aa, Mycobacterium
APQDMD

SEQ ID NO: 1001407 - protein, 8 aa, Mycobacterium
APQEITDD

SEQ ID NO: 1001408 - protein, 6 aa, Mycobacterium
APQGEL

SEQ ID NO: 1001409 - protein, 8 aa, Mycobacterium
APQGSATQ

SEQ ID NO: 1001410 - protein, 19 aa, Mycobacterium
APQIGNTGWNDEDGESRGD

SEQ ID NO: 1001411 - protein, 11 aa, Mycobacterium
APQPVRNAEYT

SEQ ID NO: 1001412 - protein, 11 aa, Mycobacterium
APQRVAPDPAR

SEQ ID NO: 1001413 - protein, 7 aa, Mycobacterium
APQSGSI

SEQ ID NO: 1001414 - protein, 10 aa, Mycobacterium
APQSVGAALG

SEQ ID NO: 1001415 - protein, 19 aa, Mycobacterium
APQTRADPGPAKNRRNRGP

SEQ ID NO: 1001416 - protein, 5 aa, Mycobacterium
APQVH

SEQ ID NO: 1001417 - protein, 9 aa, Mycobacterium
APRAADDGF

SEQ ID NO: 1001418 - protein, 7 aa, Mycobacterium
APRAELP

SEQ ID NO: 1001419 - protein, 7 aa, Mycobacterium
APRATSV

SEQ ID NO: 1001420 - protein, 8 aa, Mycobacterium
APRDVGEV

SEQ ID NO: 1001421 - protein, 4 aa, Mycobacterium
APRE

SEQ ID NO: 1001422 - protein, 8 aa, Mycobacterium
APRGDRDA

SEQ ID NO: 1001423 - protein, 11 aa, Mycobacterium
APRGDSPSRRL

SEQ ID NO: 1001424 - protein, 12 aa, Mycobacterium
APRGKAKSVDGG

SEQ ID NO: 1001425 - protein, 7 aa, Mycobacterium
APRGPVT

SEQ ID NO: 1001426 - protein, 6 aa, Mycobacterium
APRKAV

SEQ ID NO: 1001427 - protein, 10 aa, Mycobacterium
APRKRTSPDM

SEQ ID NO: 1001428 - protein, 7 aa, Mycobacterium
APRLDNQ

SEQ ID NO: 1001429 - protein, 10 aa, Mycobacterium
APRLPDGTPF

SEQ ID NO: 1001430 - protein, 5 aa, Mycobacterium
APRNP

SEQ ID NO: 1001431 - protein, 7 aa, Mycobacterium
APRPARR

SEQ ID NO: 1001432 - protein, 7 aa, Mycobacterium
APRPDGA

SEQ ID NO: 1001433 - protein, 6 aa, Mycobacterium
APRPGE

SEQ ID NO: 1001434 - protein, 34 aa, Mycobacterium
APRPGPSRSSRGCTDSGTRMGESSMSARPRACVA

SEQ ID NO: 1001435 - protein, 11 aa, Mycobacterium
APRPGSRPSLA

SEQ ID NO: 1001436 - protein, 18 aa, Mycobacterium
APRPSSAPCGPGAPDTAF

SEQ ID NO: 1001437 - protein, 8 aa, Mycobacterium
APRPTTPF

SEQ ID NO: 1001438 - protein, 11 aa, Mycobacterium
APRQLPAPEAV

SEQ ID NO: 1001439 - protein, 5 aa, Mycobacterium
APRQV

SEQ ID NO: 1001440 - protein, 14 aa, Mycobacterium
APRRQPPKTVPPLR

SEQ ID NO: 1001441 - protein, 6 aa, Mycobacterium
APRRSG

SEQ ID NO: 1001442 - protein, 5 aa, Mycobacterium
APRRV

SEQ ID NO: 1001443 - protein, 4 aa, Mycobacterium
APRS

SEQ ID NO: 1001444 - protein, 12 aa, Mycobacterium
APRSADAGQLRE

SEQ ID NO: 1001445 - protein, 7 aa, Mycobacterium
APRSNFG

SEQ ID NO: 1001446 - protein, 7 aa, Mycobacterium
APRSPAD

SEQ ID NO: 1001447 - protein, 5 aa, Mycobacterium
APRTA

SEQ ID NO: 1001448 - protein, 5 aa, Mycobacterium
APRTL

SEQ ID NO: 1001449 - protein, 5 aa, Mycobacterium
APRVS

SEQ ID NO: 1001450 - protein, 4 aa, Mycobacterium
APRY

SEQ ID NO: 1001451 - protein, 4 aa, Mycobacterium
APSA

SEQ ID NO: 1001452 - protein, 7 aa, Mycobacterium
APSAGAI

SEQ ID NO: 1001453 - protein, 8 aa, Mycobacterium
APSAPGSI

SEQ ID NO: 1001454 - protein, 9 aa, Mycobacterium
APSARAPRR

SEQ ID NO: 1001455 - protein, 7 aa, Mycobacterium
APSDDDL

SEQ ID NO: 1001456 - protein, 4 aa, Mycobacterium
APSE

SEQ ID NO: 1001457 - protein, 4 aa, Mycobacterium
APSF

SEQ ID NO: 1001458 - protein, 8 aa, Mycobacterium
APSFRSTA

SEQ ID NO: 1001459 - protein, 11 aa, Mycobacterium
APSGGGTDVTE

SEQ ID NO: 1001460 - protein, 7 aa, Mycobacterium
APSGGRV

SEQ ID NO: 1001461 - protein, 14 aa, Mycobacterium
APSGLDAARAKPGN

SEQ ID NO: 1001462 - protein, 8 aa, Mycobacterium
APSGLTAE

SEQ ID NO: 1001463 - protein, 16 aa, Mycobacterium
APSGNRRMSANPHANG

SEQ ID NO: 1001464 - protein, 6 aa, Mycobacterium
APSGSW

SEQ ID NO: 1001465 - protein, 5 aa, Mycobacterium
APSGT

SEQ ID NO: 1001466 - protein, 10 aa, Mycobacterium
APSKPIPTPG

SEQ ID NO: 1001467 - protein, 5 aa, Mycobacterium
APSLA

SEQ ID NO: 1001468 - protein, 5 aa, Mycobacterium
APSMA

SEQ ID NO: 1001469 - protein, 9 aa, Mycobacterium
APSNAAPVH

SEQ ID NO: 1001470 - protein, 5 aa, Mycobacterium
APSNI

SEQ ID NO: 1001471 - protein, 17 aa, Mycobacterium
APSNKAARSASLNGEAA

SEQ ID NO: 1001472 - protein, 5 aa, Mycobacterium
APSNL

SEQ ID NO: 1001473 - protein, 13 aa, Mycobacterium
APSPALQGQRGEQ

SEQ ID NO: 1001474 - protein, 8 aa, Mycobacterium
APSPAPSV

SEQ ID NO: 1001475 - protein, 7 aa, Mycobacterium
APSPPAR

SEQ ID NO: 1001476 - protein, 12 aa, Mycobacterium
APSPSVRSRRRP

SEQ ID NO: 1001477 - protein, 5 aa, Mycobacterium
APSQM

SEQ ID NO: 1001478 - protein, 9 aa, Mycobacterium
APSRSPLGS

SEQ ID NO: 1001479 - protein, 9 aa, Mycobacterium
APSSFVPPT

SEQ ID NO: 1001480 - protein, 6 aa, Mycobacterium
APSTAQ

SEQ ID NO: 1001481 - protein, 5 aa, Mycobacterium
APSTE

SEQ ID NO: 1001482 - protein, 12 aa, Mycobacterium
APSTVPPAPPYY

SEQ ID NO: 1001483 - protein, 4 aa, Mycobacterium
APSV

SEQ ID NO: 1001484 - protein, 4 aa, Mycobacterium
APTA

SEQ ID NO: 1001485 - protein, 32 aa, Mycobacterium
APTAEDLEQAGGEESAESAAAEGEGGQPEAES

SEQ ID NO: 1001486 - protein, 14 aa, Mycobacterium
APTAPMGPSPYLPT

SEQ ID NO: 1001487 - protein, 5 aa, Mycobacterium
APTAS

SEQ ID NO: 1001488 - protein, 8 aa, Mycobacterium
APTASAEE

SEQ ID NO: 1001489 - protein, 10 aa, Mycobacterium
APTDALRRGG

SEQ ID NO: 1001490 - protein, 6 aa, Mycobacterium
APTDED

SEQ ID NO: 1001491 - protein, 30 aa, Mycobacterium; identical to SEQ ID NO: 896028

SEQ ID NO: 1001492 - protein, 12 aa, Mycobacterium
APTDSAEQEAQI

SEQ ID NO: 1001493 - protein, 5 aa, Mycobacterium
APTDT

SEQ ID NO: 1001494 - protein, 10 aa, Mycobacterium
APTDYDTPAK

SEQ ID NO: 1001495 - protein, 5 aa, Mycobacterium
APTEA

SEQ ID NO: 1001496 - protein, 8 aa, Mycobacterium
APTEGSPA

SEQ ID NO: 1001497 - protein, 5 aa, Mycobacterium
APTGA

SEQ ID NO: 1001498 - protein, 6 aa, Mycobacterium
APTGAI

SEQ ID NO: 1001499 - protein, 15 aa, Mycobacterium
APTGGAATAAASGSL

SEQ ID NO: 1001500 - protein, 8 aa, Mycobacterium
APTGKAAA

SEQ ID NO: 1001501 - protein, 13 aa, Mycobacterium
APTGSVDPAGLGL

SEQ ID NO: 1001502 - protein, 7 aa, Mycobacterium
APTKAAI

SEQ ID NO: 1001503 - protein, 11 aa, Mycobacterium
APTKQSSVPRR

SEQ ID NO: 1001504 - protein, 4 aa, Mycobacterium
APTL

SEQ ID NO: 1001505 - protein, 10 aa, Mycobacterium
APTLSPRRTT

SEQ ID NO: 1001506 - protein, 6 aa, Mycobacterium
APTPAP

SEQ ID NO: 1001507 - protein, 12 aa, Mycobacterium
APTPAPAELGPG

SEQ ID NO: 1001508 - protein, 8 aa, Mycobacterium
APTPAQAS

SEQ ID NO: 1001509 - protein, 7 aa, Mycobacterium
APTPGRR

SEQ ID NO: 1001510 - protein, 8 aa, Mycobacterium
APTPPAVV

SEQ ID NO: 1001511 - protein, 19 aa, Mycobacterium
APTPSSGSPEPAGRPQHGA

SEQ ID NO: 1001512 - protein, 8 aa, Mycobacterium
APTPTDAA

SEQ ID NO: 1001513 - protein, 5 aa, Mycobacterium
APTQA

SEQ ID NO: 1001514 - protein, 9 aa, Mycobacterium
APTQPEEAD

SEQ ID NO: 1001515 - protein, 5 aa, Mycobacterium
APTQR

SEQ ID NO: 1001516 - protein, 6 aa, Mycobacterium
APTREN

SEQ ID NO: 1001517 - protein, 17 aa, Mycobacterium
APTRRAAARRRGGDPIT

SEQ ID NO: 1001518 - protein, 11 aa, Mycobacterium
APTSLSADGFD

SEQ ID NO: 1001519 - protein, 16 aa, Mycobacterium
APTSTVRGWERLRVLV

SEQ ID NO: 1001520 - protein, 11 aa, Mycobacterium
APTTGWAGSED

SEQ ID NO: 1001521 - protein, 4 aa, Mycobacterium
APTV

SEQ ID NO: 1001522 - protein, 13 aa, Mycobacterium
APTWDAGDPRTYS

SEQ ID NO: 1001523 - protein, 9 aa, Mycobacterium
APVAGERNP

SEQ ID NO: 1001524 - protein, 8 aa, Mycobacterium
APVANGAN

SEQ ID NO: 1001525 - protein, 7 aa, Mycobacterium
APVDEPL

SEQ ID NO: 1001526 - protein, 8 aa, Mycobacterium
APVDPDHR

SEQ ID NO: 1001527 - protein, 6 aa, Mycobacterium
APVDRR

SEQ ID NO: 1001528 - protein, 10 aa, Mycobacterium
APVGAGGQEF

SEQ ID NO: 1001529 - protein, 16 aa, Mycobacterium
APVGGGAVGAGGPVAA

SEQ ID NO: 1001530 - protein, 4 aa, Mycobacterium
APVI

SEQ ID NO: 1001531 - protein, 10 aa, Mycobacterium
APVNRERAEA

SEQ ID NO: 1001532 - protein, 7 aa, Mycobacterium
APVPAGA

SEQ ID NO: 1001533 - protein, 16 aa, Mycobacterium
APVPERDDGGYTPGLP

SEQ ID NO: 1001534 - protein, 16 aa, Mycobacterium
APVPGVPRNRSLGHRS

SEQ ID NO: 1001535 - protein, 10 aa, Mycobacterium
APVPGYRGSR

SEQ ID NO: 1001536 - protein, 8 aa, Mycobacterium
APVPVPAA

SEQ ID NO: 1001537 - protein, 5 aa, Mycobacterium
APVSA

SEQ ID NO: 1001538 - protein, 25 aa, Mycobacterium
APVTPPGAPILSGTPTSGSGTARPG

SEQ ID NO: 1001539 - protein, 10 aa, Mycobacterium
APVTTTAGSI

SEQ ID NO: 1001540 - protein, 5 aa, Mycobacterium
APWRS

SEQ ID NO: 1001541 - protein, 12 aa, Mycobacterium
APYDPGLTPTQA

SEQ ID NO: 1001542 - protein, 8 aa, Mycobacterium
APYETTNR

SEQ ID NO: 1001543 - protein, 19 aa, Mycobacterium
APYGPGSARADADGTGPQG

SEQ ID NO: 1001544 - protein, 11 aa, Mycobacterium
APYGRGASPAE

SEQ ID NO: 1001545 - protein, 10 aa, Mycobacterium
APYGVEPQQA

SEQ ID NO: 1001546 - protein, 11 aa, Mycobacterium
AQAAALTSGDV

SEQ ID NO: 1001547 - protein, 10 aa, Mycobacterium
AQAAASAAAY

SEQ ID NO: 1001548 - protein, 10 aa, Mycobacterium
AQAADGYEAM

SEQ ID NO: 1001549 - protein, 5 aa, Mycobacterium
AQAAG

SEQ ID NO: 1001550 - protein, 6 aa, Mycobacterium
AQAAGG

SEQ ID NO: 1001551 - protein, 5 aa, Mycobacterium
AQAAI

SEQ ID NO: 1001552 - protein, 11 aa, Mycobacterium
AQAAQRLGEDS

SEQ ID NO: 1001553 - protein, 9 aa, Mycobacterium
AQAARNESI

SEQ ID NO: 1001554 - protein, 20 aa, Mycobacterium
AQAATTATNVGDVRTGMSSD

SEQ ID NO: 1001555 - protein, 7 aa, Mycobacterium
AQAEERH

SEQ ID NO: 1001556 - protein, 8 aa, Mycobacterium
AQAEKEGL

SEQ ID NO: 1001557 - protein, 5 aa, Mycobacterium
AQAEN

SEQ ID NO: 1001558 - protein, 6 aa, Mycobacterium
AQAEPS

SEQ ID NO: 1001559 - protein, 6 aa, Mycobacterium
AQAERA

SEQ ID NO: 1001560 - protein, 18 aa, Mycobacterium
AQAERSRQPITPLTPSYP

SEQ ID NO: 1001561 - protein, 10 aa, Mycobacterium
AQAESLTGAE

SEQ ID NO: 1001562 - protein, 4 aa, Mycobacterium
AQAG

SEQ ID NO: 1001563 - protein, 10 aa, Mycobacterium
AQAGADEAGA

SEQ ID NO: 1001564 - protein, 8 aa, Mycobacterium
AQAGVSRP

SEQ ID NO: 1001565 - protein, 6 aa, Mycobacterium
AQAHDT

SEQ ID NO: 1001566 - protein, 13 aa, Mycobacterium
AQAKRRDSEVDRA

SEQ ID NO: 1001567 - protein, 16 aa, Mycobacterium
AQAPAGDRDGRQSSAR

SEQ ID NO: 1001568 - protein, 5 aa, Mycobacterium
AQAPD

SEQ ID NO: 1001569 - protein, 8 aa, Mycobacterium
AQAPEAAG

SEQ ID NO: 1001570 - protein, 24 aa, Mycobacterium
AQAQANQLSAEAEQESQRKQAEFA

SEQ ID NO: 1001571 - protein, 7 aa, Mycobacterium
AQAQGIP

SEQ ID NO: 1001572 - protein, 14 aa, Mycobacterium
AQAQVAQAARRADG

SEQ ID NO: 1001573 - protein, 10 aa, Mycobacterium
AQARNAAAQR

SEQ ID NO: 1001574 - protein, 7 aa, Mycobacterium
AQARRGD

SEQ ID NO: 1001575 - protein, 28 aa, Mycobacterium
AQARSESQLRQAQEKADALQADAERKHS

SEQ ID NO: 1001576 - protein, 4 aa, Mycobacterium
AQAS

SEQ ID NO: 1001577 - protein, 17 aa, Mycobacterium
AQASADDDAKKEAVSET

SEQ ID NO: 1001578 - protein, 9 aa, Mycobacterium
AQASAGAGN

SEQ ID NO: 1001579 - protein, 10 aa, Mycobacterium
AQASELGDIP

SEQ ID NO: 1001580 - protein, 5 aa, Mycobacterium
AQASG

SEQ ID NO: 1001581 - protein, 9 aa, Mycobacterium
AQATGDTPV

SEQ ID NO: 1001582 - protein, 7 aa, Mycobacterium
AQATGSG

SEQ ID NO: 1001583 - protein, 16 aa, Mycobacterium
AQATPNGAAGGYGGNA

SEQ ID NO: 1001584 - protein, 4 aa, Mycobacterium
AQAV

SEQ ID NO: 1001585 - protein, 6 aa, Mycobacterium
AQDAVS

SEQ ID NO: 1001586 - protein, 7 aa, Mycobacterium
AQDDTVR

SEQ ID NO: 1001587 - protein, 6 aa, Mycobacterium
AQDDYN

SEQ ID NO: 1001588 - protein, 6 aa, Mycobacterium
AQDEVS

SEQ ID NO: 1001589 - protein, 4 aa, Mycobacterium
AQDG

SEQ ID NO: 1001590 - protein, 7 aa, Mycobacterium
AQDGGAD

SEQ ID NO: 1001591 - protein, 9 aa, Mycobacterium
AQDGLASTD

SEQ ID NO: 1001592 - protein, 14 aa, Mycobacterium
AQDISDSDLSGRYE

SEQ ID NO: 1001593 - protein, 24 aa, Mycobacterium
AQDISDSDLSGRYETACDPRLNTQ

SEQ ID NO: 1001594 - protein, 10 aa, Mycobacterium
AQDLGGGEIR

SEQ ID NO: 1001595 - protein, 6 aa, Mycobacterium
AQDPAA

SEQ ID NO: 1001596 - protein, 7 aa, Mycobacterium
AQDTSEL

SEQ ID NO: 1001597 - protein, 9 aa, Mycobacterium
AQEATQGMT

SEQ ID NO: 1001598 - protein, 6 aa, Mycobacterium
AQEEHD

SEQ ID NO: 1001599 - protein, 7 aa, Mycobacterium
AQEGRSH

SEQ ID NO: 1001600 - protein, 12 aa, Mycobacterium
AQEGSLSQIDQD

SEQ ID NO: 1001601 - protein, 14 aa, Mycobacterium
AQEPDYEAALAAVG

SEQ ID NO: 1001602 - protein, 6 aa, Mycobacterium
AQEQRD

SEQ ID NO: 1001603 - protein, 4 aa, Mycobacterium
AQER

SEQ ID NO: 1001604 - protein, 25 aa, Mycobacterium
AQERTAAAAAGAEEWHDPRADGNLP

SEQ ID NO: 1001605 - protein, 9 aa, Mycobacterium
AQESSRGAI

SEQ ID NO: 1001606 - protein, 4 aa, Mycobacterium
AQGA

SEQ ID NO: 1001607 - protein, 8 aa, Mycobacterium
AQGEAAAP

SEQ ID NO: 1001608 - protein, 8 aa, Mycobacterium
AQGEAKAI

SEQ ID NO: 1001609 - protein, 7 aa, Mycobacterium
AQGEARI

SEQ ID NO: 1001610 - protein, 5 aa, Mycobacterium
AQGGG

SEQ ID NO: 1001611 - protein, 10 aa, Mycobacterium
AQGGSGSITA

SEQ ID NO: 1001612 - protein, 9 aa, Mycobacterium
AQGGSLSGT

SEQ ID NO: 1001613 - protein, 5 aa, Mycobacterium
AQGHL

SEQ ID NO: 1001614 - protein, 4 aa, Mycobacterium
AQGI

SEQ ID NO: 1001615 - protein, 7 aa, Mycobacterium
AQGIGQA

SEQ ID NO: 1001616 - protein, 5 aa, Mycobacterium
AQGIR

SEQ ID NO: 1001617 - protein, 31 aa, Mycobacterium; identical to SEQ ID NO: 431768

SEQ ID NO: 1001618 - protein, 8 aa, Mycobacterium
AQGPGGIA

SEQ ID NO: 1001619 - protein, 10 aa, Mycobacterium
AQGPTATPCG

SEQ ID NO: 1001620 - protein, 10 aa, Mycobacterium
AQGRASPVDQ

SEQ ID NO: 1001621 - protein, 12 aa, Mycobacterium
AQGSDAEPTPDE

SEQ ID NO: 1001622 - protein, 11 aa, Mycobacterium
AQGSFDSGRDL

SEQ ID NO: 1001623 - protein, 14 aa, Mycobacterium
AQGTGSVRAGDPRK

SEQ ID NO: 1001624 - protein, 19 aa, Mycobacterium
AQGVTGTAGDGGTGGDGGL

SEQ ID NO: 1001625 - protein, 14 aa, Mycobacterium
AQGWPEDGIAPGTR

SEQ ID NO: 1001626 - protein, 5 aa, Mycobacterium
AQGYS

SEQ ID NO: 1001627 - protein, 12 aa, Mycobacterium
AQHPASENTVTG

SEQ ID NO: 1001628 - protein, 6 aa, Mycobacterium
AQHPGY

SEQ ID NO: 1001629 - protein, 4 aa, Mycobacterium
AQID

SEQ ID NO: 1001630 - protein, 6 aa, Mycobacterium
AQIPDE

SEQ ID NO: 1001631 - protein, 12 aa, Mycobacterium
AQIPPPDERRGY

SEQ ID NO: 1001632 - protein, 9 aa, Mycobacterium
AQIRPSTGP

SEQ ID NO: 1001633 - protein, 15 aa, Mycobacterium
AQKAGREALSAGAEL

SEQ ID NO: 1001634 - protein, 7 aa, Mycobacterium
AQKPHDG

SEQ ID NO: 1001635 - protein, 6 aa, Mycobacterium
AQLAGK

SEQ ID NO: 1001636 - protein, 4 aa, Mycobacterium
AQLD

SEQ ID NO: 1001637 - protein, 4 aa, Mycobacterium
AQLG

SEQ ID NO: 1001638 - protein, 6 aa, Mycobacterium
AQLGDS

SEQ ID NO: 1001639 - protein, 9 aa, Mycobacterium
AQLGSGNPA

SEQ ID NO: 1001640 - protein, 8 aa, Mycobacterium
AQLGTSGA

SEQ ID NO: 1001641 - protein, 7 aa, Mycobacterium
AQLPGGR

SEQ ID NO: 1001642 - protein, 6 aa, Mycobacterium
AQLQQG

SEQ ID NO: 1001643 - protein, 8 aa, Mycobacterium
AQNADKVE

SEQ ID NO: 1001644 - protein, 6 aa, Mycobacterium
AQNATK

SEQ ID NO: 1001645 - protein, 8 aa, Mycobacterium
AQNGADRL

SEQ ID NO: 1001646 - protein, 4 aa, Mycobacterium
AQNH

SEQ ID NO: 1001647 - protein, 5 aa, Mycobacterium
AQPAE

SEQ ID NO: 1001648 - protein, 7 aa, Mycobacterium
AQPATDV

SEQ ID NO: 1001649 - protein, 6 aa, Mycobacterium
AQPDSI

SEQ ID NO: 1001650 - protein, 4 aa, Mycobacterium
AQPE

SEQ ID NO: 1001651 - protein, 10 aa, Mycobacterium
AQPEPSSESR

SEQ ID NO: 1001652 - protein, 4 aa, Mycobacterium
AQPG

SEQ ID NO: 1001653 - protein, 6 aa, Mycobacterium
AQPGAG

SEQ ID NO: 1001654 - protein, 14 aa, Mycobacterium
AQPIAEGDRANPAH

SEQ ID NO: 1001655 - protein, 8 aa, Mycobacterium
AQPLDGPW

SEQ ID NO: 1001656 - protein, 21 aa, Mycobacterium
AQPPKPKPERSPLNASAPTEV

SEQ ID NO: 1001657 - protein, 13 aa, Mycobacterium
AQPQPAGDRKAER

SEQ ID NO: 1001658 - protein, 11 aa, Mycobacterium
AQPRSVDPTVA

SEQ ID NO: 1001659 - protein, 8 aa, Mycobacterium
AQPSAELQ

SEQ ID NO: 1001660 - protein, 6 aa, Mycobacterium
AQPTEP

SEQ ID NO: 1001661 - protein, 17 aa, Mycobacterium
AQPVPTSGQRVQAGQPW

SEQ ID NO: 1001662 - protein, 6 aa, Mycobacterium
AQQAAG

SEQ ID NO: 1001663 - protein, 4 aa, Mycobacterium
AQQG

SEQ ID NO: 1001664 - protein, 7 aa, Mycobacterium
AQQGNPT

SEQ ID NO: 1001665 - protein, 21 aa, Mycobacterium
AQQGPGTAPEPAEDGPVLQPE

SEQ ID NO: 1001666 - protein, 4 aa, Mycobacterium
AQQI

SEQ ID NO: 1001667 - protein, 9 aa, Mycobacterium
AQQIGTPQE

SEQ ID NO: 1001668 - protein, 6 aa, Mycobacterium
AQQLDD

SEQ ID NO: 1001669 - protein, 9 aa, Mycobacterium
AQQLSPADE

SEQ ID NO: 1001670 - protein, 8 aa, Mycobacterium
AQQPNGYT

SEQ ID NO: 1001671 - protein, 12 aa, Mycobacterium
AQQPPKKHGNIP

SEQ ID NO: 1001672 - protein, 9 aa, Mycobacterium
AQRAAAEGE

SEQ ID NO: 1001673 - protein, 15 aa, Mycobacterium
AQRADRVAPDADAGE

SEQ ID NO: 1001674 - protein, 14 aa, Mycobacterium
AQRAENEYVGAPTG

SEQ ID NO: 1001675 - protein, 9 aa, Mycobacterium
AQRAREGEV

SEQ ID NO: 1001676 - protein, 6 aa, Mycobacterium
AQRARG

SEQ ID NO: 1001677 - protein, 10 aa, Mycobacterium
AQRASEAEHP

SEQ ID NO: 1001678 - protein, 8 aa, Mycobacterium
AQRASREI

SEQ ID NO: 1001679 - protein, 8 aa, Mycobacterium
AQRCPDRP

SEQ ID NO: 1001680 - protein, 6 aa, Mycobacterium
AQRDPS

SEQ ID NO: 1001681 - protein, 4 aa, Mycobacterium
AQRG

SEQ ID NO: 1001682 - protein, 5 aa, Mycobacterium
AQRGA

SEQ ID NO: 1001683 - protein, 6 aa, Mycobacterium
AQRGSY

SEQ ID NO: 1001684 - protein, 7 aa, Mycobacterium
AQRIPTD

SEQ ID NO: 1001685 - protein, 8 aa, Mycobacterium
AQRKKPWQ

SEQ ID NO: 1001686 - protein, 12 aa, Mycobacterium
AQRLPAEGPAVK

SEQ ID NO: 1001687 - protein, 9 aa, Mycobacterium
AQRLSSQPR

SEQ ID NO: 1001688 - protein, 8 aa, Mycobacterium
AQRNSRGK

SEQ ID NO: 1001689 - protein, 9 aa, Mycobacterium
AQRPDRADT

SEQ ID NO: 1001690 - protein, 12 aa, Mycobacterium
AQRQATKDAGQI

SEQ ID NO: 1001691 - protein, 5 aa, Mycobacterium
AQRQL

SEQ ID NO: 1001692 - protein, 7 aa, Mycobacterium
AQRQPDE

SEQ ID NO: 1001693 - protein, 7 aa, Mycobacterium
AQRRAAA

SEQ ID NO: 1001694 - protein, 5 aa, Mycobacterium
AQRRK

SEQ ID NO: 1001695 - protein, 7 aa, Mycobacterium
AQRRPEA

SEQ ID NO: 1001696 - protein, 12 aa, Mycobacterium
AQRSAKAGWPAG

SEQ ID NO: 1001697 - protein, 8 aa, Mycobacterium
AQRSLREA

SEQ ID NO: 1001698 - protein, 8 aa, Mycobacterium
AQRSRVED

SEQ ID NO: 1001699 - protein, 6 aa, Mycobacterium
AQRSTL

SEQ ID NO: 1001700 - protein, 8 aa, Mycobacterium
AQRSVSSA

SEQ ID NO: 1001701 - protein, 9 aa, Mycobacterium
AQRSYSEPH

SEQ ID NO: 1001702 - protein, 16 aa, Mycobacterium
AQRTAEAQAKAKANEI

SEQ ID NO: 1001703 - protein, 5 aa, Mycobacterium
AQRTP

SEQ ID NO: 1001704 - protein, 9 aa, Mycobacterium
AQRVSGADH

SEQ ID NO: 1001705 - protein, 5 aa, Mycobacterium
AQSAA

SEQ ID NO: 1001706 - protein, 10 aa, Mycobacterium
AQSDAKQKFA

SEQ ID NO: 1001707 - protein, 17 aa, Mycobacterium
AQSDKPLNIPGENLPGS

SEQ ID NO: 1001708 - protein, 6 aa, Mycobacterium
AQSERA

SEQ ID NO: 1001709 - protein, 13 aa, Mycobacterium
AQSESAASQAGAV

SEQ ID NO: 1001710 - protein, 7 aa, Mycobacterium
AQSETTG

SEQ ID NO: 1001711 - protein, 16 aa, Mycobacterium
AQSFTGAANADATGSF

SEQ ID NO: 1001712 - protein, 14 aa, Mycobacterium
AQSGARANPIIAPA

SEQ ID NO: 1001713 - protein, 16 aa, Mycobacterium
AQSGMPSQAATFVVSQ

SEQ ID NO: 1001714 - protein, 8 aa, Mycobacterium
AQSGNATL

SEQ ID NO: 1001715 - protein, 8 aa, Mycobacterium
AQSGNELT

SEQ ID NO: 1001716 - protein, 6 aa, Mycobacterium
AQSGNV

SEQ ID NO: 1001717 - protein, 12 aa, Mycobacterium
AQSGQPEEPQAT

SEQ ID NO: 1001718 - protein, 5 aa, Mycobacterium
AQSGY

SEQ ID NO: 1001719 - protein, 17 aa, Mycobacterium
AQSLRNAAKAYEVDEES

SEQ ID NO: 1001720 - protein, 9 aa, Mycobacterium
AQSNRTATQ

SEQ ID NO: 1001721 - protein, 10 aa, Mycobacterium
AQSPDIAQGV

SEQ ID NO: 1001722 - protein, 4 aa, Mycobacterium
AQSQ

SEQ ID NO: 1001723 - protein, 9 aa, Mycobacterium
AQSQADAEG

SEQ ID NO: 1001724 - protein, 7 aa, Mycobacterium
AQSQQRE

SEQ ID NO: 1001725 - protein, 7 aa, Mycobacterium
AQSRSHR

SEQ ID NO: 1001726 - protein, 12 aa, Mycobacterium
AQSTDKRVNLTT

SEQ ID NO: 1001727 - protein, 7 aa, Mycobacterium
AQTAKEA

SEQ ID NO: 1001728 - protein, 8 aa, Mycobacterium
AQTDEDKR

SEQ ID NO: 1001729 - protein, 8 aa, Mycobacterium
AQTDGATV

SEQ ID NO: 1001730 - protein, 5 aa, Mycobacterium
AQTDP

SEQ ID NO: 1001731 - protein, 7 aa, Mycobacterium
AQTENPG

SEQ ID NO: 1001732 - protein, 10 aa, Mycobacterium
AQTESEQMKE

SEQ ID NO: 1001733 - protein, 12 aa, Mycobacterium
AQTGANLAGGIG

SEQ ID NO: 1001734 - protein, 7 aa, Mycobacterium
AQTGDSW

SEQ ID NO: 1001735 - protein, 6 aa, Mycobacterium
AQTGTR

SEQ ID NO: 1001736 - protein, 22 aa, Mycobacterium
AQTGVRVSDGSTNVVPEGTEEQ

SEQ ID NO: 1001737 - protein, 5 aa, Mycobacterium
AQTNN

SEQ ID NO: 1001738 - protein, 8 aa, Mycobacterium
AQTPGEVE

SEQ ID NO: 1001739 - protein, 8 aa, Mycobacterium
AQTPIERK

SEQ ID NO: 1001740 - protein, 5 aa, Mycobacterium
AQTPV

SEQ ID NO: 1001741 - protein, 16 aa, Mycobacterium
AQTQQRIAGYLERLRR

SEQ ID NO: 1001742 - protein, 4 aa, Mycobacterium
AQTT

SEQ ID NO: 1001743 - protein, 5 aa, Mycobacterium
AQTTG

SEQ ID NO: 1001744 - protein, 8 aa, Mycobacterium
AQVSAAAT

SEQ ID NO: 1001745 - protein, 4 aa, Mycobacterium
AQWN

SEQ ID NO: 1001746 - protein, 4 aa, Mycobacterium
AQWP

SEQ ID NO: 1001747 - protein, 5 aa, Mycobacterium
AQWSR

SEQ ID NO: 1001748 - protein, 4 aa, Mycobacterium
AQWT

SEQ ID NO: 1001749 - protein, 4 aa, Mycobacterium
AQYD

SEQ ID NO: 1001750 - protein, 6 aa, Mycobacterium
AQYRAA

SEQ ID NO: 1001751 - protein, 46 aa, Mycobacterium; identical to SEQ ID NO: 432704

SEQ ID NO: 1001752 - protein, 20 aa, Mycobacterium
ARAAARYGADTCARGDEDAA

SEQ ID NO: 1001753 - protein, 6 aa, Mycobacterium
ARAAEQ

SEQ ID NO: 1001754 - protein, 10 aa, Mycobacterium
ARAAETRSQH

SEQ ID NO: 1001755 - protein, 15 aa, Mycobacterium
ARAAGSGTVTRGRKK

SEQ ID NO: 1001756 - protein, 14 aa, Mycobacterium
ARAAHESLTGRAGS

SEQ ID NO: 1001757 - protein, 6 aa, Mycobacterium
ARAALT

SEQ ID NO: 1001758 - protein, 9 aa, Mycobacterium
ARAANGDTY

SEQ ID NO: 1001759 - protein, 10 aa, Mycobacterium
ARAASDYNNG

SEQ ID NO: 1001760 - protein, 6 aa, Mycobacterium
ARADAA

SEQ ID NO: 1001761 - protein, 14 aa, Mycobacterium
ARADANRVRSGADR

SEQ ID NO: 1001762 - protein, 10 aa, Mycobacterium
ARAEAATQAV

SEQ ID NO: 1001763 - protein, 10 aa, Mycobacterium
ARAEARAAAE

SEQ ID NO: 1001764 - protein, 13 aa, Mycobacterium
ARAEKRPAVFTDD

SEQ ID NO: 1001765 - protein, 18 aa, Mycobacterium
ARAELADREHRAAEADRA

SEQ ID NO: 1001766 - protein, 6 aa, Mycobacterium
ARAERD

SEQ ID NO: 1001767 - protein, 25 aa, Mycobacterium
ARAERDAIAEASTADAARRNGADPL

SEQ ID NO: 1001768 - protein, 9 aa, Mycobacterium
ARAERGESN

SEQ ID NO: 1001769 - protein, 19 aa, Mycobacterium
ARAERRAIPSKGLTGTGYD

SEQ ID NO: 1001770 - protein, 8 aa, Mycobacterium
ARAETAQQ

SEQ ID NO: 1001771 - protein, 10 aa, Mycobacterium
ARAETDEGHE

SEQ ID NO: 1001772 - protein, 4 aa, Mycobacterium
ARAG

SEQ ID NO: 1001773 - protein, 7 aa, Mycobacterium
ARAGAAG

SEQ ID NO: 1001774 - protein, 10 aa, Mycobacterium
ARAGAPPRRS

SEQ ID NO: 1001775 - protein, 10 aa, Mycobacterium
ARAGDVSAQA

SEQ ID NO: 1001776 - protein, 5 aa, Mycobacterium
ARAGE

SEQ ID NO: 1001777 - protein, 5 aa, Mycobacterium
ARAGP

SEQ ID NO: 1001778 - protein, 7 aa, Mycobacterium
ARAGQAL

SEQ ID NO: 1001779 - protein, 10 aa, Mycobacterium
ARAKATVGEI

SEQ ID NO: 1001780 - protein, 9 aa, Mycobacterium
ARAKEQDAE

SEQ ID NO: 1001781 - protein, 5 aa, Mycobacterium
ARAKM

SEQ ID NO: 1001782 - protein, 9 aa, Mycobacterium
ARAKPRPHR

SEQ ID NO: 1001783 - protein, 7 aa, Mycobacterium
ARAKSDR

SEQ ID NO: 1001784 - protein, 12 aa, Mycobacterium
ARANGGEPDAGR

SEQ ID NO: 1001785 - protein, 8 aa, Mycobacterium
ARANRTPI

SEQ ID NO: 1001786 - protein, 26 aa, Mycobacterium
ARAPDSGVKPGQRRPKRHSDVTEPER

SEQ ID NO: 1001787 - protein, 6 aa, Mycobacterium
ARAPRV

SEQ ID NO: 1001788 - protein, 9 aa, Mycobacterium
ARAQQTRAE

SEQ ID NO: 1001789 - protein, 10 aa, Mycobacterium
ARAQRPGTYY

SEQ ID NO: 1001790 - protein, 13 aa, Mycobacterium
ARAQTGKAAPYRR

SEQ ID NO: 1001791 - protein, 10 aa, Mycobacterium
ARARRGDGPT

SEQ ID NO: 1001792 - protein, 14 aa, Mycobacterium
ARARRRKHQPVDST

SEQ ID NO: 1001793 - protein, 17 aa, Mycobacterium
ARARSGNLKPDELSGGT

SEQ ID NO: 1001794 - protein, 4 aa, Mycobacterium
ARAS

SEQ ID NO: 1001795 - protein, 11 aa, Mycobacterium
ARAYPRSDRGA

SEQ ID NO: 1001796 - protein, 4 aa, Mycobacterium
ARDA

SEQ ID NO: 1001797 - protein, 7 aa, Mycobacterium
ARDAATG

SEQ ID NO: 1001798 - protein, 5 aa, Mycobacterium
ARDAG

SEQ ID NO: 1001799 - protein, 6 aa, Mycobacterium
ARDATA

SEQ ID NO: 1001800 - protein, 7 aa, Mycobacterium
ARDAVDS

SEQ ID NO: 1001801 - protein, 7 aa, Mycobacterium
ARDCPPR

SEQ ID NO: 1001802 - protein, 9 aa, Mycobacterium
ARDGARAQA

SEQ ID NO: 1001803 - protein, 11 aa, Mycobacterium
ARDGDSDARLR

SEQ ID NO: 1001804 - protein, 10 aa, Mycobacterium
ARDGKLTAED

SEQ ID NO: 1001805 - protein, 12 aa, Mycobacterium
ARDHPKPSPEPV

SEQ ID NO: 1001806 - protein, 5 aa, Mycobacterium
ARDHR

SEQ ID NO: 1001807 - protein, 7 aa, Mycobacterium
ARDKAAS

SEQ ID NO: 1001808 - protein, 5 aa, Mycobacterium
ARDLN

SEQ ID NO: 1001809 - protein, 7 aa, Mycobacterium
ARDLTSD

SEQ ID NO: 1001810 - protein, 9 aa, Mycobacterium
ARDNSEARA

SEQ ID NO: 1001811 - protein, 14 aa, Mycobacterium
ARDPADRPDSAAAF

SEQ ID NO: 1001812 - protein, 7 aa, Mycobacterium
ARDPETL

SEQ ID NO: 1001813 - protein, 7 aa, Mycobacterium
ARDPGKL

SEQ ID NO: 1001814 - protein, 9 aa, Mycobacterium
ARDSGGPAP

SEQ ID NO: 1001815 - protein, 9 aa, Mycobacterium
ARDSSDPRP

SEQ ID NO: 1001816 - protein, 7 aa, Mycobacterium
ARDTDDR

SEQ ID NO: 1001817 - protein, 6 aa, Mycobacterium
ARDTEI

SEQ ID NO: 1001818 - protein, 5 aa, Mycobacterium
ARDTG

SEQ ID NO: 1001819 - protein, 4 aa, Mycobacterium
AREA

SEQ ID NO: 1001820 - protein, 8 aa, Mycobacterium
AREAEAAG

SEQ ID NO: 1001821 - protein, 12 aa, Mycobacterium
AREAGRAAARES

SEQ ID NO: 1001822 - protein, 14 aa, Mycobacterium
AREATLREQEEQHR

SEQ ID NO: 1001823 - protein, 8 aa, Mycobacterium
AREDGQLP

SEQ ID NO: 1001824 - protein, 8 aa, Mycobacterium
AREEAEVA

SEQ ID NO: 1001825 - protein, 10 aa, Mycobacterium
AREELGDPTA

SEQ ID NO: 1001826 - protein, 7 aa, Mycobacterium
AREGGLS

SEQ ID NO: 1001827 - protein, 6 aa, Mycobacterium
AREGQP

SEQ ID NO: 1001828 - protein, 4 aa, Mycobacterium
AREL

SEQ ID NO: 1001829 - protein, 13 aa, Mycobacterium
ARELAGDDTLRPR

SEQ ID NO: 1001830 - protein, 5 aa, Mycobacterium
AREPD

SEQ ID NO: 1001831 - protein, 6 aa, Mycobacterium
AREPDR

SEQ ID NO: 1001832 - protein, 6 aa, Mycobacterium
AREQTY

SEQ ID NO: 1001833 - protein, 15 aa, Mycobacterium
ARERTKPDPAVRAAT

SEQ ID NO: 1001834 - protein, 17 aa, Mycobacterium
ARERYGSTERSPRARKA

SEQ ID NO: 1001835 - protein, 18 aa, Mycobacterium
ARESATVGGMASTNAGGL

SEQ ID NO: 1001836 - protein, 9 aa, Mycobacterium
ARESGPGLG

SEQ ID NO: 1001837 - protein, 11 aa, Mycobacterium
ARESGTNALND

SEQ ID NO: 1001838 - protein, 5 aa, Mycobacterium
ARESR

SEQ ID NO: 1001839 - protein, 5 aa, Mycobacterium
ARETL

SEQ ID NO: 1001840 - protein, 8 aa, Mycobacterium
ARETTKGM

SEQ ID NO: 1001841 - protein, 7 aa, Mycobacterium
AREVRDT

SEQ ID NO: 1001842 - protein, 12 aa, Mycobacterium
ARFRPGPGPRTI

SEQ ID NO: 1001843 - protein, 9 aa, Mycobacterium
ARGADISEA

SEQ ID NO: 1001844 - protein, 8 aa, Mycobacterium
ARGADPGE

SEQ ID NO: 1001845 - protein, 17 aa, Mycobacterium
ARGAELGDVATDEVPIG

SEQ ID NO: 1001846 - protein, 10 aa, Mycobacterium
ARGAHGGDAL

SEQ ID NO: 1001847 - protein, 7 aa, Mycobacterium
ARGAQGE

SEQ ID NO: 1001848 - protein, 5 aa, Mycobacterium
ARGDL

SEQ ID NO: 1001849 - protein, 4 aa, Mycobacterium
ARGE

SEQ ID NO: 1001850 - protein, 28 aa, Mycobacterium
ARGEGGFGGDRGPSGGGAADAAPQRAPD

SEQ ID NO: 1001851 - protein, 8 aa, Mycobacterium
ARGEPGAG

SEQ ID NO: 1001852 - protein, 6 aa, Mycobacterium
ARGETV

SEQ ID NO: 1001853 - protein, 5 aa, Mycobacterium
ARGFG

SEQ ID NO: 1001854 - protein, 10 aa, Mycobacterium
ARGGAAGPPM

SEQ ID NO: 1001855 - protein, 7 aa, Mycobacterium
ARGGELT

SEQ ID NO: 1001856 - protein, 4 aa, Mycobacterium
ARGH

SEQ ID NO: 1001857 - protein, 6 aa, Mycobacterium
ARGIGA

SEQ ID NO: 1001858 - protein, 6 aa, Mycobacterium
ARGIGQ

SEQ ID NO: 1001859 - protein, 8 aa, Mycobacterium
ARGKAKDV

SEQ ID NO: 1001860 - protein, 8 aa, Mycobacterium
ARGKRTDE

SEQ ID NO: 1001861 - protein, 4 aa, Mycobacterium
ARGP

SEQ ID NO: 1001862 - protein, 5 aa, Mycobacterium
ARGPS

SEQ ID NO: 1001863 - protein, 9 aa, Mycobacterium
ARGQRAASS

SEQ ID NO: 1001864 - protein, 4 aa, Mycobacterium
ARGR

SEQ ID NO: 1001865 - protein, 7 aa, Mycobacterium
ARGRGPV

SEQ ID NO: 1001866 - protein, 9 aa, Mycobacterium
ARGRPRSAA

SEQ ID NO: 1001867 - protein, 8 aa, Mycobacterium
ARGSAASL

SEQ ID NO: 1001868 - protein, 10 aa, Mycobacterium
ARGSGASWTD

SEQ ID NO: 1001869 - protein, 10 aa, Mycobacterium
ARGSSSSTRW

SEQ ID NO: 1001870 - protein, 13 aa, Mycobacterium
ARGTKYPDEVERE

SEQ ID NO: 1001871 - protein, 4 aa, Mycobacterium
ARGV

SEQ ID NO: 1001872 - protein, 6 aa, Mycobacterium
ARGVTP

SEQ ID NO: 1001873 - protein, 4 aa, Mycobacterium
ARHD

SEQ ID NO: 1001874 - protein, 28 aa, Mycobacterium
ARHDASDSDAPRPAVEKAGAPTDELDPE

SEQ ID NO: 1001875 - protein, 8 aa, Mycobacterium
ARHGATAA

SEQ ID NO: 1001876 - protein, 9 aa, Mycobacterium
ARHGGPEQL

SEQ ID NO: 1001877 - protein, 9 aa, Mycobacterium
ARHGTSPEP

SEQ ID NO: 1001878 - protein, 19 aa, Mycobacterium
ARHTGKDPSVIRKDTDRDK

SEQ ID NO: 1001879 - protein, 13 aa, Mycobacterium
ARIGQSSQPHAAV

SEQ ID NO: 1001880 - protein, 10 aa, Mycobacterium
ARIPDGADPL

SEQ ID NO: 1001881 - protein, 20 aa, Mycobacterium
ARIPGGSGLPGGLDAGGSAL

SEQ ID NO: 1001882 - protein, 14 aa, Mycobacterium
ARISRSDSRVTHDR

SEQ ID NO: 1001883 - protein, 16 aa, Mycobacterium
ARKAGTTVTHEDKGGR

SEQ ID NO: 1001884 - protein, 9 aa, Mycobacterium
ARKDGAEAR

SEQ ID NO: 1001885 - protein, 9 aa, Mycobacterium
ARKDGYTST

SEQ ID NO: 1001886 - protein, 13 aa, Mycobacterium
ARKDTEVAGTAIK

SEQ ID NO: 1001887 - protein, 14 aa, Mycobacterium
ARKDYNSFGSRRGN

SEQ ID NO: 1001888 - protein, 10 aa, Mycobacterium
ARKEAVGPQT

SEQ ID NO: 1001889 - protein, 9 aa, Mycobacterium
ARKGDSDQL

SEQ ID NO: 1001890 - protein, 7 aa, Mycobacterium
ARKQPGA

SEQ ID NO: 1001891 - protein, 9 aa, Mycobacterium
ARKRSMSEA

SEQ ID NO: 1001892 - protein, 8 aa, Mycobacterium
ARKSGADL

SEQ ID NO: 1001893 - protein, 5 aa, Mycobacterium
ARKTG

SEQ ID NO: 1001894 - protein, 9 aa, Mycobacterium
ARKTQDGRI

SEQ ID NO: 1001895 - protein, 5 aa, Mycobacterium
ARLAE

SEQ ID NO: 1001896 - protein, 4 aa, Mycobacterium
ARLG

SEQ ID NO: 1001897 - protein, 14 aa, Mycobacterium
ARLGPRPVHQTHTG

SEQ ID NO: 1001898 - protein, 13 aa, Mycobacterium
ARLTSKTGLTSNA

SEQ ID NO: 1001899 - protein, 4 aa, Mycobacterium
ARMA

SEQ ID NO: 1001900 - protein, 13 aa, Mycobacterium
ARNATAAEGLDSD

SEQ ID NO: 1001901 - protein, 8 aa, Mycobacterium
ARNDPRVN

SEQ ID NO: 1001902 - protein, 6 aa, Mycobacterium
ARNGHP

SEQ ID NO: 1001903 - protein, 6 aa, Mycobacterium
ARNGVG

SEQ ID NO: 1001904 - protein, 16 aa, Mycobacterium
ARNHDLTESELAEAER

SEQ ID NO: 1001905 - protein, 8 aa, Mycobacterium
ARNKSGNA

SEQ ID NO: 1001906 - protein, 8 aa, Mycobacterium
ARNPERID

SEQ ID NO: 1001907 - protein, 9 aa, Mycobacterium
ARNPEVADQ

SEQ ID NO: 1001908 - protein, 5 aa, Mycobacterium
ARNQF

SEQ ID NO: 1001909 - protein, 6 aa, Mycobacterium
ARNSQT

SEQ ID NO: 1001910 - protein, 13 aa, Mycobacterium
ARNTAADSGIDNP

SEQ ID NO: 1001911 - protein, 14 aa, Mycobacterium
ARNVGGKGRQDVGD

SEQ ID NO: 1001912 - protein, 5 aa, Mycobacterium
ARNVS

SEQ ID NO: 1001913 - protein, 4 aa, Mycobacterium
ARPA

SEQ ID NO: 1001914 - protein, 30 aa, Mycobacterium
ARPAAKASQEPAAPAQAMSGAQRRAAEKEL

SEQ ID NO: 1001915 - protein, 8 aa, Mycobacterium
ARPAGLPP

SEQ ID NO: 1001916 - protein, 8 aa, Mycobacterium
ARPAGVSE

SEQ ID NO: 1001917 - protein, 16 aa, Mycobacterium
ARPAPVATAGTPGCSS

SEQ ID NO: 1001918 - protein, 24 aa, Mycobacterium
ARPARPPRGTGGKRTARNGGRTAS

SEQ ID NO: 1001919 - protein, 8 aa, Mycobacterium
ARPATGSD

SEQ ID NO: 1001920 - protein, 10 aa, Mycobacterium
ARPDASEAQM

SEQ ID NO: 1001921 - protein, 4 aa, Mycobacterium
ARPE

SEQ ID NO: 1001922 - protein, 5 aa, Mycobacterium
ARPER

SEQ ID NO: 1001923 - protein, 13 aa, Mycobacterium
ARPESLPIDGQPD

SEQ ID NO: 1001924 - protein, 4 aa, Mycobacterium
ARPF

SEQ ID NO: 1001925 - protein, 5 aa, Mycobacterium
ARPGD

SEQ ID NO: 1001926 - protein, 6 aa, Mycobacterium
ARPGER

SEQ ID NO: 1001927 - protein, 7 aa, Mycobacterium
ARPGGEC

SEQ ID NO: 1001928 - protein, 11 aa, Mycobacterium
ARPGTPLHDPG

SEQ ID NO: 1001929 - protein, 6 aa, Mycobacterium
ARPGTR

SEQ ID NO: 1001930 - protein, 12 aa, Mycobacterium
ARPHNSSELDEA

SEQ ID NO: 1001931 - protein, 4 aa, Mycobacterium
ARPI

SEQ ID NO: 1001932 - protein, 5 aa, Mycobacterium
ARPIG

SEQ ID NO: 1001933 - protein, 5 aa, Mycobacterium
ARPIS

SEQ ID NO: 1001934 - protein, 14 aa, Mycobacterium
ARPPGTTITEQQPT

SEQ ID NO: 1001935 - protein, 5 aa, Mycobacterium
ARPPR

SEQ ID NO: 1001936 - protein, 6 aa, Mycobacterium
ARPQTV

SEQ ID NO: 1001937 - protein, 6 aa, Mycobacterium
ARPTST

SEQ ID NO: 1001938 - protein, 4 aa, Mycobacterium
ARPV

SEQ ID NO: 1001939 - protein, 5 aa, Mycobacterium
ARPVG

SEQ ID NO: 1001940 - protein, 7 aa, Mycobacterium
ARPVTDA

SEQ ID NO: 1001941 - protein, 4 aa, Mycobacterium
ARQA

SEQ ID NO: 1001942 - protein, 11 aa, Mycobacterium
ARQARSQHRKP

SEQ ID NO: 1001943 - protein, 6 aa, Mycobacterium
ARQDSA

SEQ ID NO: 1001944 - protein, 12 aa, Mycobacterium
ARQGDPAPGGVG

SEQ ID NO: 1001945 - protein, 7 aa, Mycobacterium
ARQHSER

SEQ ID NO: 1001946 - protein, 11 aa, Mycobacterium
ARQKAKEMGVD

SEQ ID NO: 1001947 - protein, 6 aa, Mycobacterium
ARQPKF

SEQ ID NO: 1001948 - protein, 17 aa, Mycobacterium
ARQQARTTQYADVSSSG

SEQ ID NO: 1001949 - protein, 4 aa, Mycobacterium
ARQR

SEQ ID NO: 1001950 - protein, 6 aa, Mycobacterium
ARQRRL

SEQ ID NO: 1001951 - protein, 8 aa, Mycobacterium
ARQSPGDS

SEQ ID NO: 1001952 - protein, 10 aa, Mycobacterium
ARQTAGRYRN

SEQ ID NO: 1001953 - protein, 7 aa, Mycobacterium
ARQTPQQ

SEQ ID NO: 1001954 - protein, 11 aa, Mycobacterium
ARQVGTKHDAT

SEQ ID NO: 1001955 - protein, 11 aa, Mycobacterium
ARRAAGPDAPE

SEQ ID NO: 1001956 - protein, 9 aa, Mycobacterium
ARRAEPTDD

SEQ ID NO: 1001957 - protein, 7 aa, Mycobacterium
ARRAQTI

SEQ ID NO: 1001958 - protein, 6 aa, Mycobacterium
ARRASE

SEQ ID NO: 1001959 - protein, 12 aa, Mycobacterium
ARRATPTTHFHG

SEQ ID NO: 1001960 - protein, 8 aa, Mycobacterium
ARRDETTR

SEQ ID NO: 1001961 - protein, 16 aa, Mycobacterium
ARRDGATRVEVTEEAN

SEQ ID NO: 1001962 - protein, 10 aa, Mycobacterium
ARREAASAFG

SEQ ID NO: 1001963 - protein, 5 aa, Mycobacterium
ARREP

SEQ ID NO: 1001964 - protein, 8 aa, Mycobacterium
ARRERGDL

SEQ ID NO: 1001965 - protein, 10 aa, Mycobacterium
ARRETTRSAA

SEQ ID NO: 1001966 - protein, 6 aa, Mycobacterium
ARRGDE

SEQ ID NO: 1001967 - protein, 7 aa, Mycobacterium
ARRGEEL

SEQ ID NO: 1001968 - protein, 12 aa, Mycobacterium
ARRGEGSVAGTL

SEQ ID NO: 1001969 - protein, 9 aa, Mycobacterium
ARRGGGSDK

SEQ ID NO: 1001970 - protein, 8 aa, Mycobacterium
ARRGLTPG

SEQ ID NO: 1001971 - protein, 8 aa, Mycobacterium
ARRGSAGR

SEQ ID NO: 1001972 - protein, 12 aa, Mycobacterium
ARRGSGSASRSV

SEQ ID NO: 1001973 - protein, 11 aa, Mycobacterium
ARRGSVTDLSP

SEQ ID NO: 1001974 - protein, 5 aa, Mycobacterium
ARRHD

SEQ ID NO: 1001975 - protein, 6 aa, Mycobacterium
ARRHPN

SEQ ID NO: 1001976 - protein, 7 aa, Mycobacterium
ARRKNTA

SEQ ID NO: 1001977 - protein, 4 aa, Mycobacterium
ARRN

SEQ ID NO: 1001978 - protein, 5 aa, Mycobacterium
ARRNS

SEQ ID NO: 1001979 - protein, 7 aa, Mycobacterium
ARRPAAE

SEQ ID NO: 1001980 - protein, 9 aa, Mycobacterium
ARRRAGDEA

SEQ ID NO: 1001981 - protein, 19 aa, Mycobacterium
ARRRAPDATEEPDRTALGG

SEQ ID NO: 1001982 - protein, 5 aa, Mycobacterium
ARRRG

SEQ ID NO: 1001983 - protein, 16 aa, Mycobacterium
ARRRGELAEQADTAGA

SEQ ID NO: 1001984 - protein, 13 aa, Mycobacterium
ARRRRGSAPPGPL

SEQ ID NO: 1001985 - protein, 12 aa, Mycobacterium
ARRRVDESEGLA

SEQ ID NO: 1001986 - protein, 5 aa, Mycobacterium
ARRSA

SEQ ID NO: 1001987 - protein, 10 aa, Mycobacterium
ARRSGDAGAL

SEQ ID NO: 1001988 - protein, 19 aa, Mycobacterium
ARRSKGRRRFSPADYQPGL

SEQ ID NO: 1001989 - protein, 7 aa, Mycobacterium
ARRSTWD

SEQ ID NO: 1001990 - protein, 15 aa, Mycobacterium
ARRVPGHVKGDGRHT

SEQ ID NO: 1001991 - protein, 14 aa, Mycobacterium
ARSAAVARGTGATR

SEQ ID NO: 1001992 - protein, 7 aa, Mycobacterium
ARSAGDV

SEQ ID NO: 1001993 - protein, 10 aa, Mycobacterium
ARSAKRAVKS

SEQ ID NO: 1001994 - protein, 12 aa, Mycobacterium
ARSDNGPGGESV

SEQ ID NO: 1001995 - protein, 7 aa, Mycobacterium
ARSESEG

SEQ ID NO: 1001996 - protein, 11 aa, Mycobacterium
ARSGDKGGSAN

SEQ ID NO: 1001997 - protein, 7 aa, Mycobacterium
ARSGDPD

SEQ ID NO: 1001998 - protein, 5 aa, Mycobacterium
ARSGI

SEQ ID NO: 1001999 - protein, 9 aa, Mycobacterium
ARSGKTKLS

SEQ ID NO: 1002000 - protein, 15 aa, Mycobacterium
ARSGSLGKPKSEPVE

SEQ ID NO: 1002001 - protein, 8 aa, Mycobacterium
ARSKGWQD

SEQ ID NO: 1002002 - protein, 5 aa, Mycobacterium
ARSKL

SEQ ID NO: 1002003 - protein, 11 aa, Mycobacterium
ARSKPFTQRTR

SEQ ID NO: 1002004 - protein, 6 aa, Mycobacterium
ARSPIP

SEQ ID NO: 1002005 - protein, 11 aa, Mycobacterium
ARSPRKRGGVA

SEQ ID NO: 1002006 - protein, 4 aa, Mycobacterium
ARSQ

SEQ ID NO: 1002007 - protein, 8 aa, Mycobacterium
ARSQGRKL

SEQ ID NO: 1002008 - protein, 15 aa, Mycobacterium
ARSQRNDSEKPAKSI

SEQ ID NO: 1002009 - protein, 6 aa, Mycobacterium
ARSRPR

SEQ ID NO: 1002010 - protein, 5 aa, Mycobacterium
ARSRS

SEQ ID NO: 1002011 - protein, 14 aa, Mycobacterium
ARSSDSMEISCRTA

SEQ ID NO: 1002012 - protein, 18 aa, Mycobacterium
ARSTSMPAPVPATAARRG

SEQ ID NO: 1002013 - protein, 8 aa, Mycobacterium
ARSTTGAA

SEQ ID NO: 1002014 - protein, 15 aa, Mycobacterium
ARSVEGAGPGPEGNV

SEQ ID NO: 1002015 - protein, 5 aa, Mycobacterium
ARSVS

SEQ ID NO: 1002016 - protein, 5 aa, Mycobacterium
ARTAE

SEQ ID NO: 1002017 - protein, 8 aa, Mycobacterium
ARTAGSGE

SEQ ID NO: 1002018 - protein, 6 aa, Mycobacterium
ARTALD

SEQ ID NO: 1002019 - protein, 28 aa, Mycobacterium
ARTARAGGGVAGAADAAGAANSDTKQRC

SEQ ID NO: 1002020 - protein, 12 aa, Mycobacterium
ARTASSGAGRGW

SEQ ID NO: 1002021 - protein, 5 aa, Mycobacterium
ARTEE

SEQ ID NO: 1002022 - protein, 13 aa, Mycobacterium
ARTEHSDPHPVRD

SEQ ID NO: 1002023 - protein, 7 aa, Mycobacterium
ARTERGE

SEQ ID NO: 1002024 - protein, 8 aa, Mycobacterium
ARTGGDIK

SEQ ID NO: 1002025 - protein, 5 aa, Mycobacterium
ARTGR

SEQ ID NO: 1002026 - protein, 9 aa, Mycobacterium
ARTGRPGQR

SEQ ID NO: 1002027 - protein, 12 aa, Mycobacterium
ARTGRTSSLQPR

SEQ ID NO: 1002028 - protein, 8 aa, Mycobacterium
ARTGVDPV

SEQ ID NO: 1002029 - protein, 4 aa, Mycobacterium
ARTH

SEQ ID NO: 1002030 - protein, 14 aa, Mycobacterium
ARTKETDLSVPTRR

SEQ ID NO: 1002031 - protein, 4 aa, Mycobacterium
ARTL

SEQ ID NO: 1002032 - protein, 13 aa, Mycobacterium
ARTPEATAITDGD

SEQ ID NO: 1002033 - protein, 6 aa, Mycobacterium
ARTPED

SEQ ID NO: 1002034 - protein, 8 aa, Mycobacterium
ARTPEETA

SEQ ID NO: 1002035 - protein, 6 aa, Mycobacterium
ARTPTA

SEQ ID NO: 1002036 - protein, 9 aa, Mycobacterium
ARTRAADYP

SEQ ID NO: 1002037 - protein, 6 aa, Mycobacterium
ARTREQ

SEQ ID NO: 1002038 - protein, 7 aa, Mycobacterium
ARTRSPI

SEQ ID NO: 1002039 - protein, 8 aa, Mycobacterium
ARTSGAIE

SEQ ID NO: 1002040 - protein, 8 aa, Mycobacterium
ARTSPERA

SEQ ID NO: 1002041 - protein, 4 aa, Mycobacterium
ARTT

SEQ ID NO: 1002042 - protein, 11 aa, Mycobacterium
ARTTEEDRSRT

SEQ ID NO: 1002043 - protein, 14 aa, Mycobacterium
ARTTERRTKQATER

SEQ ID NO: 1002044 - protein, 54 aa, Mycobacterium
ARTTGATSTTGAKQPRAPTSPASTPVKGPDAPGTTSTTATDQPSPSPTSPTHGT

SEQ ID NO: 1002045 - protein, 9 aa, Mycobacterium
ARTTGRAAE

SEQ ID NO: 1002046 - protein, 5 aa, Mycobacterium
ARTTQ

SEQ ID NO: 1002047 - protein, 12 aa, Mycobacterium
ARTTTDSAFDRA

SEQ ID NO: 1002048 - protein, 7 aa, Mycobacterium
ARTTTPH

SEQ ID NO: 1002049 - protein, 6 aa, Mycobacterium
ARVDPE

SEQ ID NO: 1002050 - protein, 6 aa, Mycobacterium
ARVPLQ

SEQ ID NO: 1002051 - protein, 6 aa, Mycobacterium
ARVSDQ

SEQ ID NO: 1002052 - protein, 6 aa, Mycobacterium
ARWRAG

SEQ ID NO: 1002053 - protein, 13 aa, Mycobacterium
ARWRGRPKNQDAY

SEQ ID NO: 1002054 - protein, 8 aa, Mycobacterium
ARYGGQQA

SEQ ID NO: 1002055 - protein, 7 aa, Mycobacterium
ARYNGHR

SEQ ID NO: 1002056 - protein, 11 aa, Mycobacterium
ARYPGDGPGVQ

SEQ ID NO: 1002057 - protein, 12 aa, Mycobacterium
ARYRNDPQRTAE

SEQ ID NO: 1002058 - protein, 7 aa, Mycobacterium
ASAAAAL

SEQ ID NO: 1002059 - protein, 13 aa, Mycobacterium
ASAAADTPPLALT

SEQ ID NO: 1002060 - protein, 17 aa, Mycobacterium
ASAAAVAATPHTNHAPP

SEQ ID NO: 1002061 - protein, 9 aa, Mycobacterium
ASAADSITS

SEQ ID NO: 1002062 - protein, 7 aa, Mycobacterium
ASAADVR

SEQ ID NO: 1002063 - protein, 8 aa, Mycobacterium
ASAAGPDL

SEQ ID NO: 1002064 - protein, 9 aa, Mycobacterium
ASAANAAAA

SEQ ID NO: 1002065 - protein, 11 aa, Mycobacterium
ASADASTANAT

SEQ ID NO: 1002066 - protein, 11 aa, Mycobacterium
ASADEAARALQ

SEQ ID NO: 1002067 - protein, 28 aa, Mycobacterium
ASADPGLRSTRTEIGATPANNASKTGKN

SEQ ID NO: 1002068 - protein, 12 aa, Mycobacterium
ASADPQGRPWSE

SEQ ID NO: 1002069 - protein, 6 aa, Mycobacterium
ASADQV

SEQ ID NO: 1002070 - protein, 11 aa, Mycobacterium
ASAEAANASQN

SEQ ID NO: 1002071 - protein, 9 aa, Mycobacterium
ASAEAANVS

SEQ ID NO: 1002072 - protein, 19 aa, Mycobacterium
ASAEFDKEAADLNDEKLRK

SEQ ID NO: 1002073 - protein, 10 aa, Mycobacterium
ASAEPNAAAR

SEQ ID NO: 1002074 - protein, 6 aa, Mycobacterium
ASAGGE

SEQ ID NO: 1002075 - protein, 6 aa, Mycobacterium
ASAGLS

SEQ ID NO: 1002076 - protein, 27 aa, Mycobacterium
ASAGNPPGSRGEDGNAGIVGAGGLLIG

SEQ ID NO: 1002077 - protein, 8 aa, Mycobacterium
ASAGPGNF

SEQ ID NO: 1002078 - protein, 9 aa, Mycobacterium
ASAGQETGT

SEQ ID NO: 1002079 - protein, 8 aa, Mycobacterium
ASAGRSSL

SEQ ID NO: 1002080 - protein, 8 aa, Mycobacterium
ASAGTGKT

SEQ ID NO: 1002081 - protein, 17 aa, Mycobacterium
ASAGTVDTLRTDTGESV

SEQ ID NO: 1002082 - protein, 25 aa, Mycobacterium
ASAGTYGATENLNSAAAASPLDGIT

SEQ ID NO: 1002083 - protein, 7 aa, Mycobacterium
ASAGYGA

SEQ ID NO: 1002084 - protein, 18 aa, Mycobacterium
ASAKAGLSALARTATDRS

SEQ ID NO: 1002085 - protein, 7 aa, Mycobacterium
ASANDVY

SEQ ID NO: 1002086 - protein, 4 aa, Mycobacterium
ASAP

SEQ ID NO: 1002087 - protein, 16 aa, Mycobacterium
ASAPEARAEILEPVPL

SEQ ID NO: 1002088 - protein, 10 aa, Mycobacterium
ASAPGGDSYA

SEQ ID NO: 1002089 - protein, 5 aa, Mycobacterium
ASAPK

SEQ ID NO: 1002090 - protein, 14 aa, Mycobacterium
ASAPYDGPPPQPED

SEQ ID NO: 1002091 - protein, 7 aa, Mycobacterium
ASAQTFR

SEQ ID NO: 1002092 - protein, 9 aa, Mycobacterium
ASARETAAR

SEQ ID NO: 1002093 - protein, 10 aa, Mycobacterium
ASARETAARV

SEQ ID NO: 1002094 - protein, 13 aa, Mycobacterium
ASARETAARVAAG

SEQ ID NO: 1002095 - protein, 10 aa, Mycobacterium
ASARGSRELA

SEQ ID NO: 1002096 - protein, 5 aa, Mycobacterium
ASARS

SEQ ID NO: 1002097 - protein, 4 aa, Mycobacterium
ASAS

SEQ ID NO: 1002098 - protein, 10 aa, Mycobacterium
ASASAARRAG

SEQ ID NO: 1002099 - protein, 8 aa, Mycobacterium
ASASDASK

SEQ ID NO: 1002100 - protein, 17 aa, Mycobacterium
ASASGYSAAEAANTGPL

SEQ ID NO: 1002101 - protein, 6 aa, Mycobacterium
ASASST

SEQ ID NO: 1002102 - protein, 6 aa, Mycobacterium
ASASTD

SEQ ID NO: 1002103 - protein, 8 aa, Mycobacterium
ASASYDPA

SEQ ID NO: 1002104 - protein, 7 aa, Mycobacterium
ASATDVS

SEQ ID NO: 1002105 - protein, 12 aa, Mycobacterium
ASATHSAHGTSA

SEQ ID NO: 1002106 - protein, 8 aa, Mycobacterium
ASATNLPR

SEQ ID NO: 1002107 - protein, 9 aa, Mycobacterium
ASATNTARS

SEQ ID NO: 1002108 - protein, 7 aa, Mycobacterium
ASATTSA

SEQ ID NO: 1002109 - protein, 4 aa, Mycobacterium
ASAV

SEQ ID NO: 1002110 - protein, 6 aa, Mycobacterium
ASAVTS

SEQ ID NO: 1002111 - protein, 6 aa, Mycobacterium
ASCERA

SEQ ID NO: 1002112 - protein, 7 aa, Mycobacterium
ASDAAQQ

SEQ ID NO: 1002113 - protein, 5 aa, Mycobacterium
ASDAD

SEQ ID NO: 1002114 - protein, 6 aa, Mycobacterium
ASDADG

SEQ ID NO: 1002115 - protein, 5 aa, Mycobacterium
ASDAL

SEQ ID NO: 1002116 - protein, 9 aa, Mycobacterium
ASDARDSLP

SEQ ID NO: 1002117 - protein, 8 aa, Mycobacterium
ASDASVRH

SEQ ID NO: 1002118 - protein, 7 aa, Mycobacterium
ASDCTDS

SEQ ID NO: 1002119 - protein, 8 aa, Mycobacterium
ASDDGDLQ

SEQ ID NO: 1002120 - protein, 5 aa, Mycobacterium
ASDDI

SEQ ID NO: 1002121 - protein, 9 aa, Mycobacterium
ASDDTDYGK

SEQ ID NO: 1002122 - protein, 17 aa, Mycobacterium
ASDGASDGASGADNRAQ

SEQ ID NO: 1002123 - protein, 40 aa, Mycobacterium; identical to SEQ ID NO: 896655

SEQ ID NO: 1002124 - protein, 9 aa, Mycobacterium
ASDGGGSIR

SEQ ID NO: 1002125 - protein, 6 aa, Mycobacterium
ASDGIE

SEQ ID NO: 1002126 - protein, 5 aa, Mycobacterium
ASDGS

SEQ ID NO: 1002127 - protein, 10 aa, Mycobacterium
ASDMGPGTYT

SEQ ID NO: 1002128 - protein, 6 aa, Mycobacterium
ASDPAL

SEQ ID NO: 1002129 - protein, 9 aa, Mycobacterium
ASDPGTGVG

SEQ ID NO: 1002130 - protein, 11 aa, Mycobacterium
ASDPLAPYDDR

SEQ ID NO: 1002131 - protein, 15 aa, Mycobacterium
ASDPLRSSARNRGDA

SEQ ID NO: 1002132 - protein, 6 aa, Mycobacterium
ASDPRF

SEQ ID NO: 1002133 - protein, 8 aa, Mycobacterium
ASDPRSAG

SEQ ID NO: 1002134 - protein, 22 aa, Mycobacterium
ASDPVYAPNSYGGPQADPARAA

SEQ ID NO: 1002135 - protein, 7 aa, Mycobacterium
ASDRPAE

SEQ ID NO: 1002136 - protein, 8 aa, Mycobacterium
ASDRPDEL

SEQ ID NO: 1002137 - protein, 9 aa, Mycobacterium
ASDRRKANK

SEQ ID NO: 1002138 - protein, 6 aa, Mycobacterium
ASDRRR

SEQ ID NO: 1002139 - protein, 7 aa, Mycobacterium
ASDTDTE

SEQ ID NO: 1002140 - protein, 6 aa, Mycobacterium
ASDTGT

SEQ ID NO: 1002141 - protein, 13 aa, Mycobacterium
ASDYMRSASAEDR

SEQ ID NO: 1002142 - protein, 31 aa, Mycobacterium
ASEAAARQLASRARKAVAAAPPPQPDPTHDE

SEQ ID NO: 1002143 - protein, 6 aa, Mycobacterium
ASEAGC

SEQ ID NO: 1002144 - protein, 5 aa, Mycobacterium
ASEDG

SEQ ID NO: 1002145 - protein, 16 aa, Mycobacterium
ASEGEYKTDAAKAFGE

SEQ ID NO: 1002146 - protein, 11 aa, Mycobacterium
ASEIAPSQADL

SEQ ID NO: 1002147 - protein, 6 aa, Mycobacterium
ASEKAA

SEQ ID NO: 1002148 - protein, 24 aa, Mycobacterium
ASELAGVGSTLSTATTAAAAQTTG

SEQ ID NO: 1002149 - protein, 20 aa, Mycobacterium
ASELASRQRAMKSATDNADD

SEQ ID NO: 1002150 - protein, 8 aa, Mycobacterium
ASEPAQKR

SEQ ID NO: 1002151 - protein, 7 aa, Mycobacterium
ASEPGIG

SEQ ID NO: 1002152 - protein, 6 aa, Mycobacterium
ASEPRW

SEQ ID NO: 1002153 - protein, 6 aa, Mycobacterium
ASEQER

SEQ ID NO: 1002154 - protein, 6 aa, Mycobacterium
ASEQLA

SEQ ID NO: 1002155 - protein, 9 aa, Mycobacterium
ASEQRGGRY

SEQ ID NO: 1002156 - protein, 8 aa, Mycobacterium
ASEQTTSL

SEQ ID NO: 1002157 - protein, 9 aa, Mycobacterium
ASERSTGLR

SEQ ID NO: 1002158 - protein, 7 aa, Mycobacterium
ASESEPY

SEQ ID NO: 1002159 - protein, 6 aa, Mycobacterium
ASEVKR

SEQ ID NO: 1002160 - protein, 8 aa, Mycobacterium
ASEYEING

SEQ ID NO: 1002161 - protein, 5 aa, Mycobacterium
ASFST

SEQ ID NO: 1002162 - protein, 12 aa, Mycobacterium
ASGAAALARTNA

SEQ ID NO: 1002163 - protein, 15 aa, Mycobacterium
ASGAASAVGATAVGP

SEQ ID NO: 1002164 - protein, 20 aa, Mycobacterium
ASGAGGAGGIGGLAGPTDNG

SEQ ID NO: 1002165 - protein, 6 aa, Mycobacterium
ASGAGV

SEQ ID NO: 1002166 - protein, 10 aa, Mycobacterium
ASGAKRGFGI

SEQ ID NO: 1002167 - protein, 5 aa, Mycobacterium
ASGAP

SEQ ID NO: 1002168 - protein, 5 aa, Mycobacterium
ASGAS

SEQ ID NO: 1002169 - protein, 14 aa, Mycobacterium
ASGAWQGPAATAMT

SEQ ID NO: 1002170 - protein, 12 aa, Mycobacterium
ASGAWQGPASAA

SEQ ID NO: 1002171 - protein, 18 aa, Mycobacterium
ASGDGGAGGAGGAGGAGG

SEQ ID NO: 1002172 - protein, 9 aa, Mycobacterium
ASGEDPQRL

SEQ ID NO: 1002173 - protein, 8 aa, Mycobacterium
ASGEETRQ

SEQ ID NO: 1002174 - protein, 6 aa, Mycobacterium
ASGEGA

SEQ ID NO: 1002175 - protein, 6 aa, Mycobacterium
ASGEGI

SEQ ID NO: 1002176 - protein, 20 aa, Mycobacterium
ASGEGSAKPEGVSEDSREWA

SEQ ID NO: 1002177 - protein, 6 aa, Mycobacterium
ASGEPD

SEQ ID NO: 1002178 - protein, 7 aa, Mycobacterium
ASGEPGV

SEQ ID NO: 1002179 - protein, 7 aa, Mycobacterium
ASGFGND

SEQ ID NO: 1002180 - protein, 8 aa, Mycobacterium
ASGGDSGA

SEQ ID NO: 1002181 - protein, 31 aa, Mycobacterium
ASGGGDAENGSGSVPYVPQPAAESTGAAARP

SEQ ID NO: 1002182 - protein, 7 aa, Mycobacterium
ASGGGRR

SEQ ID NO: 1002183 - protein, 5 aa, Mycobacterium
ASGGL

SEQ ID NO: 1002184 - protein, 6 aa, Mycobacterium
ASGGQT

SEQ ID NO: 1002185 - protein, 8 aa, Mycobacterium
ASGGSVGY

SEQ ID NO: 1002186 - protein, 7 aa, Mycobacterium
ASGHPDV

SEQ ID NO: 1002187 - protein, 5 aa, Mycobacterium
ASGHR

SEQ ID NO: 1002188 - protein, 10 aa, Mycobacterium
ASGHRERGVK

SEQ ID NO: 1002189 - protein, 4 aa, Mycobacterium
ASGI

SEQ ID NO: 1002190 - protein, 9 aa, Mycobacterium
ASGIPKADG

SEQ ID NO: 1002191 - protein, 9 aa, Mycobacterium
ASGIPPANY

SEQ ID NO: 1002192 - protein, 4 aa, Mycobacterium
ASGL

SEQ ID NO: 1002193 - protein, 8 aa, Mycobacterium
ASGLTGGA

SEQ ID NO: 1002194 - protein, 8 aa, Mycobacterium
ASGMGRAT

SEQ ID NO: 1002195 - protein, 17 aa, Mycobacterium
ASGNAEGDLHKPAPLTA

SEQ ID NO: 1002196 - protein, 12 aa, Mycobacterium
ASGPAERADPCR

SEQ ID NO: 1002197 - protein, 6 aa, Mycobacterium
ASGPGE

SEQ ID NO: 1002198 - protein, 6 aa, Mycobacterium
ASGPQV

SEQ ID NO: 1002199 - protein, 6 aa, Mycobacterium
ASGPRV

SEQ ID NO: 1002200 - protein, 11 aa, Mycobacterium
ASGPVPPVEPQ

SEQ ID NO: 1002201 - protein, 7 aa, Mycobacterium
ASGPVYD

SEQ ID NO: 1002202 - protein, 8 aa, Mycobacterium
ASGQERRT

SEQ ID NO: 1002203 - protein, 20 aa, Mycobacterium
ASGRLTGSDAGAGRLPEAEE

SEQ ID NO: 1002204 - protein, 11 aa, Mycobacterium
ASGRRDNAQRL

SEQ ID NO: 1002205 - protein, 8 aa, Mycobacterium
ASGRRRTQ

SEQ ID NO: 1002206 - protein, 12 aa, Mycobacterium
ASGRTDDDGRIK

SEQ ID NO: 1002207 - protein, 7 aa, Mycobacterium
ASGRTRN

SEQ ID NO: 1002208 - protein, 13 aa, Mycobacterium
ASGSADAFGGVTT

SEQ ID NO: 1002209 - protein, 15 aa, Mycobacterium
ASGSARRDSDADQQH

SEQ ID NO: 1002210 - protein, 7 aa, Mycobacterium
ASGSEAI

SEQ ID NO: 1002211 - protein, 11 aa, Mycobacterium
ASGSGAAAAPG

SEQ ID NO: 1002212 - protein, 11 aa, Mycobacterium
ASGSPDQDPLP

SEQ ID NO: 1002213 - protein, 8 aa, Mycobacterium
ASGTPDEV

SEQ ID NO: 1002214 - protein, 8 aa, Mycobacterium
ASGTSAQE

SEQ ID NO: 1002215 - protein, 7 aa, Mycobacterium
ASGTVNG

SEQ ID NO: 1002216 - protein, 9 aa, Mycobacterium
ASGVDRARR

SEQ ID NO: 1002217 - protein, 9 aa, Mycobacterium
ASGVTDAQG

SEQ ID NO: 1002218 - protein, 4 aa, Mycobacterium
ASGY

SEQ ID NO: 1002219 - protein, 7 aa, Mycobacterium
ASHAGGE

SEQ ID NO: 1002220 - protein, 11 aa, Mycobacterium
ASHDTADVEPT

SEQ ID NO: 1002221 - protein, 6 aa, Mycobacterium
ASHEES

SEQ ID NO: 1002222 - protein, 20 aa, Mycobacterium
ASHGGGEYAPSAQLASREEQ

SEQ ID NO: 1002223 - protein, 12 aa, Mycobacterium
ASHGGVDDTREL

SEQ ID NO: 1002224 - protein, 9 aa, Mycobacterium
ASHNPDPVP

SEQ ID NO: 1002225 - protein, 8 aa, Mycobacterium
ASHPAPDW

SEQ ID NO: 1002226 - protein, 10 aa, Mycobacterium
ASHPFGQAPA

SEQ ID NO: 1002227 - protein, 9 aa, Mycobacterium
ASHPRDARL

SEQ ID NO: 1002228 - protein, 5 aa, Mycobacterium
ASHQY

SEQ ID NO: 1002229 - protein, 6 aa, Mycobacterium
ASHSRA

SEQ ID NO: 1002230 - protein, 9 aa, Mycobacterium
ASIGGQTVE

SEQ ID NO: 1002231 - protein, 14 aa, Mycobacterium
ASIPGSTSGSDFNS

SEQ ID NO: 1002232 - protein, 7 aa, Mycobacterium
ASISGAE

SEQ ID NO: 1002233 - protein, 14 aa, Mycobacterium
ASITDGQPLATPQV

SEQ ID NO: 1002234 - protein, 8 aa, Mycobacterium
ASKAADVD

SEQ ID NO: 1002235 - protein, 7 aa, Mycobacterium
ASKAELA

SEQ ID NO: 1002236 - protein, 11 aa, Mycobacterium
ASKANADPRSV

SEQ ID NO: 1002237 - protein, 9 aa, Mycobacterium
ASKEPEPTA

SEQ ID NO: 1002238 - protein, 9 aa, Mycobacterium
ASKGDTADG

SEQ ID NO: 1002239 - protein, 7 aa, Mycobacterium
ASKGKWD

SEQ ID NO: 1002240 - protein, 10 aa, Mycobacterium
ASKGYRGQRS

SEQ ID NO: 1002241 - protein, 31 aa, Mycobacterium
ASKQEASSPGDAQTATEPAAGTGPDADRAAG

SEQ ID NO: 1002242 - protein, 6 aa, Mycobacterium
ASKYGL

SEQ ID NO: 1002243 - protein, 7 aa, Mycobacterium
ASLADRE

SEQ ID NO: 1002244 - protein, 9 aa, Mycobacterium
ASLDAPPAD

SEQ ID NO: 1002245 - protein, 24 aa, Mycobacterium
ASLDDSGHAGGTACPNARPVTGPT

SEQ ID NO: 1002246 - protein, 7 aa, Mycobacterium
ASLDTDP

SEQ ID NO: 1002247 - protein, 8 aa, Mycobacterium
ASLGRKVR

SEQ ID NO: 1002248 - protein, 7 aa, Mycobacterium
ASLRDRE

SEQ ID NO: 1002249 - protein, 5 aa, Mycobacterium
ASLSD

SEQ ID NO: 1002250 - protein, 7 aa, Mycobacterium
ASLSDDE

SEQ ID NO: 1002251 - protein, 8 aa, Mycobacterium
ASLSGDEA

SEQ ID NO: 1002252 - protein, 7 aa, Mycobacterium
ASLSPDE

SEQ ID NO: 1002253 - protein, 8 aa, Mycobacterium
ASLTEEGL

SEQ ID NO: 1002254 - protein, 8 aa, Mycobacterium
ASLTPQQA

SEQ ID NO: 1002255 - protein, 4 aa, Mycobacterium
ASND

SEQ ID NO: 1002256 - protein, 8 aa, Mycobacterium
ASNEPVRV

SEQ ID NO: 1002257 - protein, 9 aa, Mycobacterium
ASNERPARA

SEQ ID NO: 1002258 - protein, 13 aa, Mycobacterium
ASNGGISRGVPTG

SEQ ID NO: 1002259 - protein, 4 aa, Mycobacterium
ASNL

SEQ ID NO: 1002260 - protein, 6 aa, Mycobacterium
ASNPRF

SEQ ID NO: 1002261 - protein, 5 aa, Mycobacterium
ASNTN

SEQ ID NO: 1002262 - protein, 9 aa, Mycobacterium
ASNTPVQQA

SEQ ID NO: 1002263 - protein, 7 aa, Mycobacterium
ASNTSSI

SEQ ID NO: 1002264 - protein, 13 aa, Mycobacterium
ASPAGVPGLRGSE

SEQ ID NO: 1002265 - protein, 6 aa, Mycobacterium
ASPALQ

SEQ ID NO: 1002266 - protein, 6 aa, Mycobacterium
ASPDAD

SEQ ID NO: 1002267 - protein, 5 aa, Mycobacterium
ASPEP

SEQ ID NO: 1002268 - protein, 7 aa, Mycobacterium
ASPERRK

SEQ ID NO: 1002269 - protein, 10 aa, Mycobacterium
ASPESDNNKP

SEQ ID NO: 1002270 - protein, 11 aa, Mycobacterium
ASPESGPGDPV

SEQ ID NO: 1002271 - protein, 6 aa, Mycobacterium
ASPGFR

SEQ ID NO: 1002272 - protein, 8 aa, Mycobacterium
ASPGLSSA

SEQ ID NO: 1002273 - protein, 5 aa, Mycobacterium
ASPGY

SEQ ID NO: 1002274 - protein, 4 aa, Mycobacterium
ASPI

SEQ ID NO: 1002275 - protein, 5 aa, Mycobacterium
ASPLD

SEQ ID NO: 1002276 - protein, 10 aa, Mycobacterium
ASPLGTAESG

SEQ ID NO: 1002277 - protein, 10 aa, Mycobacterium
ASPLPGPSGN

SEQ ID NO: 1002278 - protein, 9 aa, Mycobacterium
ASPNGARRA

SEQ ID NO: 1002279 - protein, 7 aa, Mycobacterium
ASPNPAE

SEQ ID NO: 1002280 - protein, 9 aa, Mycobacterium
ASPNSGTPG

SEQ ID NO: 1002281 - protein, 7 aa, Mycobacterium
ASPNSRL

SEQ ID NO: 1002282 - protein, 11 aa, Mycobacterium
ASPPHTPDQPT

SEQ ID NO: 1002283 - protein, 16 aa, Mycobacterium
ASPQSDTTAEAPGEAE

SEQ ID NO: 1002284 - protein, 4 aa, Mycobacterium
ASPR

SEQ ID NO: 1002285 - protein, 6 aa, Mycobacterium
ASPRAS

SEQ ID NO: 1002286 - protein, 8 aa, Mycobacterium
ASPRDEPR

SEQ ID NO: 1002287 - protein, 5 aa, Mycobacterium
ASPRI

SEQ ID NO: 1002288 - protein, 7 aa, Mycobacterium
ASPSAEA

SEQ ID NO: 1002289 - protein, 5 aa, Mycobacterium
ASPSL

SEQ ID NO: 1002290 - protein, 12 aa, Mycobacterium
ASPSSGGTRMQE

SEQ ID NO: 1002291 - protein, 9 aa, Mycobacterium
ASPTEGVPR

SEQ ID NO: 1002292 - protein, 8 aa, Mycobacterium
ASPTGARL

SEQ ID NO: 1002293 - protein, 15 aa, Mycobacterium
ASPTPNSTASVSTGP

SEQ ID NO: 1002294 - protein, 16 aa, Mycobacterium
ASPTQQDTPHAKPEDV

SEQ ID NO: 1002295 - protein, 12 aa, Mycobacterium
ASPTSALTAATS

SEQ ID NO: 1002296 - protein, 29 aa, Mycobacterium
ASPTSPTAAPQRRPSAGPAGLPSCTGTAS

SEQ ID NO: 1002297 - protein, 9 aa, Mycobacterium
ASQAAPGLE

SEQ ID NO: 1002298 - protein, 6 aa, Mycobacterium
ASQALP

SEQ ID NO: 1002299 - protein, 8 aa, Mycobacterium
ASQANQAG

SEQ ID NO: 1002300 - protein, 8 aa, Mycobacterium
ASQEAKPD

SEQ ID NO: 1002301 - protein, 6 aa, Mycobacterium
ASQELR

SEQ ID NO: 1002302 - protein, 10 aa, Mycobacterium
ASQGSSPDQY

SEQ ID NO: 1002303 - protein, 4 aa, Mycobacterium
ASQM

SEQ ID NO: 1002304 - protein, 8 aa, Mycobacterium
ASQPAEPD

SEQ ID NO: 1002305 - protein, 9 aa, Mycobacterium
ASQPEREFE

SEQ ID NO: 1002306 - protein, 5 aa, Mycobacterium
ASQRA

SEQ ID NO: 1002307 - protein, 7 aa, Mycobacterium
ASQRRTL

SEQ ID NO: 1002308 - protein, 5 aa, Mycobacterium
ASRAV

SEQ ID NO: 1002309 - protein, 4 aa, Mycobacterium
ASRD

SEQ ID NO: 1002310 - protein, 6 aa, Mycobacterium
ASRDGL

SEQ ID NO: 1002311 - protein, 13 aa, Mycobacterium
ASRDNAAKALRSG

SEQ ID NO: 1002312 - protein, 6 aa, Mycobacterium
ASRELP

SEQ ID NO: 1002313 - protein, 16 aa, Mycobacterium
ASRERSQLAPYESGQS

SEQ ID NO: 1002314 - protein, 4 aa, Mycobacterium
ASRG

SEQ ID NO: 1002315 - protein, 7 aa, Mycobacterium
ASRGEPH

SEQ ID NO: 1002316 - protein, 7 aa, Mycobacterium
ASRGEQQ

SEQ ID NO: 1002317 - protein, 6 aa, Mycobacterium
ASRGNW

SEQ ID NO: 1002318 - protein, 24 aa, Mycobacterium
ASRGSRIANSSSGAGSKDTWIFTD

SEQ ID NO: 1002319 - protein, 5 aa, Mycobacterium
ASRIT

SEQ ID NO: 1002320 - protein, 9 aa, Mycobacterium
ASRKGVTDA

SEQ ID NO: 1002321 - protein, 5 aa, Mycobacterium
ASRKL

SEQ ID NO: 1002322 - protein, 6 aa, Mycobacterium
ASRLET

SEQ ID NO: 1002323 - protein, 5 aa, Mycobacterium
ASRND

SEQ ID NO: 1002324 - protein, 9 aa, Mycobacterium
ASRPARPGH

SEQ ID NO: 1002325 - protein, 20 aa, Mycobacterium
ASRPGKDRASATDTVQRSHA

SEQ ID NO: 1002326 - protein, 6 aa, Mycobacterium
ASRPWA

SEQ ID NO: 1002327 - protein, 7 aa, Mycobacterium
ASRQGAQ

SEQ ID NO: 1002328 - protein, 16 aa, Mycobacterium
ASRQKARAARRLGFEV

SEQ ID NO: 1002329 - protein, 11 aa, Mycobacterium
ASRRARREGKV

SEQ ID NO: 1002330 - protein, 5 aa, Mycobacterium
ASRRG

SEQ ID NO: 1002331 - protein, 7 aa, Mycobacterium
ASRSCGD

SEQ ID NO: 1002332 - protein, 12 aa, Mycobacterium
ASRSQPGENRHS

SEQ ID NO: 1002333 - protein, 12 aa, Mycobacterium
ASRSQSAQRGAV

SEQ ID NO: 1002334 - protein, 6 aa, Mycobacterium
ASRTPV

SEQ ID NO: 1002335 - protein, 16 aa, Mycobacterium
ASRTSYEKIVDAIKAF

SEQ ID NO: 1002336 - protein, 9 aa, Mycobacterium
ASSAAGREA

SEQ ID NO: 1002337 - protein, 10 aa, Mycobacterium
ASSAATDHDR

SEQ ID NO: 1002338 - protein, 9 aa, Mycobacterium
ASSAFGGPC

SEQ ID NO: 1002339 - protein, 7 aa, Mycobacterium
ASSALRG

SEQ ID NO: 1002340 - protein, 7 aa, Mycobacterium
ASSAPDW

SEQ ID NO: 1002341 - protein, 11 aa, Mycobacterium
ASSAPRAPGRA

SEQ ID NO: 1002342 - protein, 9 aa, Mycobacterium
ASSAQSVEI

SEQ ID NO: 1002343 - protein, 8 aa, Mycobacterium
ASSATATR

SEQ ID NO: 1002344 - protein, 4 aa, Mycobacterium
ASSC

SEQ ID NO: 1002345 - protein, 8 aa, Mycobacterium
ASSDPDGI

SEQ ID NO: 1002346 - protein, 8 aa, Mycobacterium
ASSDPSGL

SEQ ID NO: 1002347 - protein, 6 aa, Mycobacterium
ASSDTV

SEQ ID NO: 1002348 - protein, 16 aa, Mycobacterium
ASSFTTGSILRADGGI

SEQ ID NO: 1002349 - protein, 5 aa, Mycobacterium
ASSGC

SEQ ID NO: 1002350 - protein, 20 aa, Mycobacterium
ASSGGDPDHRPPPGIPSVFP

SEQ ID NO: 1002351 - protein, 6 aa, Mycobacterium
ASSGIG

SEQ ID NO: 1002352 - protein, 9 aa, Mycobacterium
ASSGIGEAA

SEQ ID NO: 1002353 - protein, 18 aa, Mycobacterium
ASSGKPDPYEAGTWGPES

SEQ ID NO: 1002354 - protein, 9 aa, Mycobacterium
ASSGRDEAY

SEQ ID NO: 1002355 - protein, 6 aa, Mycobacterium
ASSGYK

SEQ ID NO: 1002356 - protein, 9 aa, Mycobacterium
ASSIDDTAA

SEQ ID NO: 1002357 - protein, 7 aa, Mycobacterium
ASSIETD

SEQ ID NO: 1002358 - protein, 10 aa, Mycobacterium
ASSIKAPINP

SEQ ID NO: 1002359 - protein, 12 aa, Mycobacterium
ASSKNGLISTPA

SEQ ID NO: 1002360 - protein, 4 aa, Mycobacterium
ASSL

SEQ ID NO: 1002361 - protein, 5 aa, Mycobacterium
ASSLT

SEQ ID NO: 1002362 - protein, 5 aa, Mycobacterium
ASSNS

SEQ ID NO: 1002363 - protein, 13 aa, Mycobacterium
ASSNTSASAPSGL

SEQ ID NO: 1002364 - protein, 5 aa, Mycobacterium
ASSPA

SEQ ID NO: 1002365 - protein, 9 aa, Mycobacterium
ASSPRQYTR

SEQ ID NO: 1002366 - protein, 17 aa, Mycobacterium
ASSPTLVTTQSPGAESG

SEQ ID NO: 1002367 - protein, 9 aa, Mycobacterium
ASSRARDFG

SEQ ID NO: 1002368 - protein, 6 aa, Mycobacterium
ASSRDE

SEQ ID NO: 1002369 - protein, 6 aa, Mycobacterium
ASSRDF

SEQ ID NO: 1002370 - protein, 7 aa, Mycobacterium
ASSRVSP

SEQ ID NO: 1002371 - protein, 8 aa, Mycobacterium
ASSSGRAT

SEQ ID NO: 1002372 - protein, 8 aa, Mycobacterium
ASSSHEGP

SEQ ID NO: 1002373 - protein, 7 aa, Mycobacterium
ASSSRIT

SEQ ID NO: 1002374 - protein, 22 aa, Mycobacterium
ASSSSEAEHGDGEVEESGEELT

SEQ ID NO: 1002375 - protein, 13 aa, Mycobacterium
ASSTASLRRDERD

SEQ ID NO: 1002376 - protein, 17 aa, Mycobacterium
ASSTGISRKLPDTERQR

SEQ ID NO: 1002377 - protein, 9 aa, Mycobacterium
ASSTRRGRP

SEQ ID NO: 1002378 - protein, 4 aa, Mycobacterium
ASSV

SEQ ID NO: 1002379 - protein, 10 aa, Mycobacterium
ASSVNGDAVT

SEQ ID NO: 1002380 - protein, 7 aa, Mycobacterium
ASSYMTG

SEQ ID NO: 1002381 - protein, 21 aa, Mycobacterium
ASTAAASQTAQTVAAAEDEVS

SEQ ID NO: 1002382 - protein, 15 aa, Mycobacterium
ASTAEAQDRAGTDVA

SEQ ID NO: 1002383 - protein, 7 aa, Mycobacterium
ASTAGAQ

SEQ ID NO: 1002384 - protein, 11 aa, Mycobacterium
ASTAPEDKAWT

SEQ ID NO: 1002385 - protein, 8 aa, Mycobacterium
ASTAVGGA

SEQ ID NO: 1002386 - protein, 11 aa, Mycobacterium
ASTDKARASID

SEQ ID NO: 1002387 - protein, 9 aa, Mycobacterium
ASTEKVAQV

SEQ ID NO: 1002388 - protein, 6 aa, Mycobacterium
ASTEVF

SEQ ID NO: 1002389 - protein, 11 aa, Mycobacterium
ASTEVRGDSTD

SEQ ID NO: 1002390 - protein, 15 aa, Mycobacterium
ASTFGSSSGGAVANS

SEQ ID NO: 1002391 - protein, 5 aa, Mycobacterium
ASTGG

SEQ ID NO: 1002392 - protein, 8 aa, Mycobacterium
ASTGGGAA

SEQ ID NO: 1002393 - protein, 10 aa, Mycobacterium
ASTGGNTSVD

SEQ ID NO: 1002394 - protein, 6 aa, Mycobacterium
ASTGQP

SEQ ID NO: 1002395 - protein, 6 aa, Mycobacterium
ASTGSD

SEQ ID NO: 1002396 - protein, 11 aa, Mycobacterium
ASTGTQRHRTG

SEQ ID NO: 1002397 - protein, 8 aa, Mycobacterium
ASTHESNT

SEQ ID NO: 1002398 - protein, 4 aa, Mycobacterium
ASTL

SEQ ID NO: 1002399 - protein, 6 aa, Mycobacterium
ASTNTR

SEQ ID NO: 1002400 - protein, 19 aa, Mycobacterium
ASTPCRGRHDHAGGAGVGR

SEQ ID NO: 1002401 - protein, 8 aa, Mycobacterium
ASTPGCTK

SEQ ID NO: 1002402 - protein, 8 aa, Mycobacterium
ASTPGQRV

SEQ ID NO: 1002403 - protein, 15 aa, Mycobacterium
ASTQAAGAASQAKAV

SEQ ID NO: 1002404 - protein, 16 aa, Mycobacterium
ASTQDPDDRDREGRAH

SEQ ID NO: 1002405 - protein, 5 aa, Mycobacterium
ASTRM

SEQ ID NO: 1002406 - protein, 6 aa, Mycobacterium
ASTRYD

SEQ ID NO: 1002407 - protein, 20 aa, Mycobacterium
ASTTDTGDRDDLKPGVAERS

SEQ ID NO: 1002408 - protein, 9 aa, Mycobacterium
ASTTVTSGS

SEQ ID NO: 1002409 - protein, 5 aa, Mycobacterium
ASTVT

SEQ ID NO: 1002410 - protein, 9 aa, Mycobacterium
ASVAAARDS

SEQ ID NO: 1002411 - protein, 15 aa, Mycobacterium
ASVAEQAGIQARAAA

SEQ ID NO: 1002412 - protein, 4 aa, Mycobacterium
ASVD

SEQ ID NO: 1002413 - protein, 10 aa, Mycobacterium
ASVEATAQQD

SEQ ID NO: 1002414 - protein, 13 aa, Mycobacterium
ASVEGAGTAPGVL

SEQ ID NO: 1002415 - protein, 9 aa, Mycobacterium
ASVGPDGLG

SEQ ID NO: 1002416 - protein, 4 aa, Mycobacterium
ASVP

SEQ ID NO: 1002417 - protein, 16 aa, Mycobacterium
ASVPGPGETPPAPDTS

SEQ ID NO: 1002418 - protein, 10 aa, Mycobacterium
ASVPPGVPAA

SEQ ID NO: 1002419 - protein, 12 aa, Mycobacterium
ASVSDPKAAPPT

SEQ ID NO: 1002420 - protein, 15 aa, Mycobacterium
ASVSGNGGIDPNEAA

SEQ ID NO: 1002421 - protein, 11 aa, Mycobacterium
ASWAPAEGEPL

SEQ ID NO: 1002422 - protein, 22 aa, Mycobacterium
ASWSDGAEPAMVPPAQPAPVTG

SEQ ID NO: 1002423 - protein, 8 aa, Mycobacterium
ASWTEPKG

SEQ ID NO: 1002424 - protein, 9 aa, Mycobacterium
ASYAEGAAE

SEQ ID NO: 1002425 - protein, 13 aa, Mycobacterium
ASYAPRSGGSAAL

SEQ ID NO: 1002426 - protein, 26 aa, Mycobacterium
ASYGGGLPPTPLPAPPEVRPMPDEPA

SEQ ID NO: 1002427 - protein, 9 aa, Mycobacterium
ASYGKNGAN

SEQ ID NO: 1002428 - protein, 7 aa, Mycobacterium
ASYGSTV

SEQ ID NO: 1002429 - protein, 4 aa, Mycobacterium
ASYI

SEQ ID NO: 1002430 - protein, 7 aa, Mycobacterium
ASYPEEA

SEQ ID NO: 1002431 - protein, 8 aa, Mycobacterium
ASYRSAEQ

SEQ ID NO: 1002432 - protein, 6 aa, Mycobacterium
ASYTDL

SEQ ID NO: 1002433 - protein, 5 aa, Mycobacterium
ATAAA

SEQ ID NO: 1002434 - protein, 6 aa, Mycobacterium
ATAAAA

SEQ ID NO: 1002435 - protein, 36 aa, Mycobacterium
ATAAAAGGARGSRSDAARGPRGESPSDRARGRNAPR

SEQ ID NO: 1002436 - protein, 19 aa, Mycobacterium
ATAAAPAEGAVATETTPTE

SEQ ID NO: 1002437 - protein, 12 aa, Mycobacterium
ATAADGTTSEHD

SEQ ID NO: 1002438 - protein, 8 aa, Mycobacterium
ATAAHSPD

SEQ ID NO: 1002439 - protein, 10 aa, Mycobacterium
ATAAIGRSGV

SEQ ID NO: 1002440 - protein, 15 aa, Mycobacterium
ATAAQAGQVSAQANG

SEQ ID NO: 1002441 - protein, 8 aa, Mycobacterium
ATAAQSDL

SEQ ID NO: 1002442 - protein, 17 aa, Mycobacterium
ATAASGAQAAAVTGTDQ

SEQ ID NO: 1002443 - protein, 7 aa, Mycobacterium
ATAATPV

SEQ ID NO: 1002444 - protein, 9 aa, Mycobacterium
ATADDATHQ

SEQ ID NO: 1002445 - protein, 5 aa, Mycobacterium
ATADG

SEQ ID NO: 1002446 - protein, 21 aa, Mycobacterium
ATADGAPPLTEAELEKLFLAL

SEQ ID NO: 1002447 - protein, 9 aa, Mycobacterium
ATADLDPGQ

SEQ ID NO: 1002448 - protein, 11 aa, Mycobacterium
ATADLDSDVPD

SEQ ID NO: 1002449 - protein, 11 aa, Mycobacterium
ATADTASRALG

SEQ ID NO: 1002450 - protein, 6 aa, Mycobacterium
ATADTD

SEQ ID NO: 1002451 - protein, 8 aa, Mycobacterium
ATAEAIDG

SEQ ID NO: 1002452 - protein, 12 aa, Mycobacterium
ATAEATNASPLQ

SEQ ID NO: 1002453 - protein, 7 aa, Mycobacterium
ATAEDAV

SEQ ID NO: 1002454 - protein, 5 aa, Mycobacterium
ATAEP

SEQ ID NO: 1002455 - protein, 7 aa, Mycobacterium
ATAEPGS

SEQ ID NO: 1002456 - protein, 15 aa, Mycobacterium
ATAERRAEVGDTADY

SEQ ID NO: 1002457 - protein, 4 aa, Mycobacterium
ATAG

SEQ ID NO: 1002458 - protein, 21 aa, Mycobacterium
ATAGGNDNGVGASGVGVGGNI

SEQ ID NO: 1002459 - protein, 20 aa, Mycobacterium
ATAGGSGNTTVAAEASGAEN

SEQ ID NO: 1002460 - protein, 7 aa, Mycobacterium
ATAGPGL

SEQ ID NO: 1002461 - protein, 8 aa, Mycobacterium
ATAGPTAV

SEQ ID NO: 1002462 - protein, 12 aa, Mycobacterium
ATAGQSKPGKTE

SEQ ID NO: 1002463 - protein, 15 aa, Mycobacterium
ATAGTTIGTGVASGN

SEQ ID NO: 1002464 - protein, 5 aa, Mycobacterium
ATAHA

SEQ ID NO: 1002465 - protein, 6 aa, Mycobacterium
ATAHTR

SEQ ID NO: 1002466 - protein, 10 aa, Mycobacterium
ATAKPDRWRR

SEQ ID NO: 1002467 - protein, 9 aa, Mycobacterium
ATAKSKSAL

SEQ ID NO: 1002468 - protein, 10 aa, Mycobacterium
ATALSGGEPQ

SEQ ID NO: 1002469 - protein, 8 aa, Mycobacterium
ATANAGGL

SEQ ID NO: 1002470 - protein, 5 aa, Mycobacterium
ATAPK

SEQ ID NO: 1002471 - protein, 11 aa, Mycobacterium
ATAPPIAENPD

SEQ ID NO: 1002472 - protein, 7 aa, Mycobacterium
ATAPPWT

SEQ ID NO: 1002473 - protein, 16 aa, Mycobacterium
ATAPQGASTATAPKSL

SEQ ID NO: 1002474 - protein, 7 aa, Mycobacterium
ATAPRTG

SEQ ID NO: 1002475 - protein, 6 aa, Mycobacterium
ATAPTT

SEQ ID NO: 1002476 - protein, 7 aa, Mycobacterium
ATAQGEC

SEQ ID NO: 1002477 - protein, 9 aa, Mycobacterium
ATAQRDPTT

SEQ ID NO: 1002478 - protein, 7 aa, Mycobacterium
ATAQRPD

SEQ ID NO: 1002479 - protein, 16 aa, Mycobacterium
ATARGVTGHPAPSEAE

SEQ ID NO: 1002480 - protein, 25 aa, Mycobacterium
ATARPAATEGITPCAPGSATNAAGT

SEQ ID NO: 1002481 - protein, 5 aa, Mycobacterium
ATART

SEQ ID NO: 1002482 - protein, 18 aa, Mycobacterium
ATASGLARTTVADSGGSQ

SEQ ID NO: 1002483 - protein, 8 aa, Mycobacterium
ATASGRRF

SEQ ID NO: 1002484 - protein, 18 aa, Mycobacterium
ATASGSSVLAGRKNKGAL

SEQ ID NO: 1002485 - protein, 12 aa, Mycobacterium
ATASNATDTDMG

SEQ ID NO: 1002486 - protein, 8 aa, Mycobacterium
ATASNPAF

SEQ ID NO: 1002487 - protein, 4 aa, Mycobacterium
ATAT

SEQ ID NO: 1002488 - protein, 6 aa, Mycobacterium
ATATEI

SEQ ID NO: 1002489 - protein, 8 aa, Mycobacterium
ATATGHEE

SEQ ID NO: 1002490 - protein, 6 aa, Mycobacterium
ATATGL

SEQ ID NO: 1002491 - protein, 7 aa, Mycobacterium
ATATPQV

SEQ ID NO: 1002492 - protein, 5 aa, Mycobacterium
ATATR

SEQ ID NO: 1002493 - protein, 16 aa, Mycobacterium
ATATRRVNTIAELART

SEQ ID NO: 1002494 - protein, 5 aa, Mycobacterium
ATATS

SEQ ID NO: 1002495 - protein, 8 aa, Mycobacterium
ATATVTAP

SEQ ID NO: 1002496 - protein, 12 aa, Mycobacterium
ATATVTGTAQRP

SEQ ID NO: 1002497 - protein, 5 aa, Mycobacterium
ATAVA

SEQ ID NO: 1002498 - protein, 6 aa, Mycobacterium
ATAVAG

SEQ ID NO: 1002499 - protein, 13 aa, Mycobacterium
ATCSGADKPRYGN

SEQ ID NO: 1002500 - protein, 7 aa, Mycobacterium
ATDAEMA

SEQ ID NO: 1002501 - protein, 7 aa, Mycobacterium
ATDAETT

SEQ ID NO: 1002502 - protein, 17 aa, Mycobacterium
ATDARRHTRAETPFYSG

SEQ ID NO: 1002503 - protein, 13 aa, Mycobacterium
ATDASVRPSEAEL

SEQ ID NO: 1002504 - protein, 10 aa, Mycobacterium
ATDAYPSRTD

SEQ ID NO: 1002505 - protein, 4 aa, Mycobacterium
ATDD

SEQ ID NO: 1002506 - protein, 9 aa, Mycobacterium
ATDDPRGLT

SEQ ID NO: 1002507 - protein, 7 aa, Mycobacterium
ATDEPDR

SEQ ID NO: 1002508 - protein, 6 aa, Mycobacterium
ATDEQL

SEQ ID NO: 1002509 - protein, 4 aa, Mycobacterium
ATDG

SEQ ID NO: 1002510 - protein, 7 aa, Mycobacterium
ATDGARR

SEQ ID NO: 1002511 - protein, 6 aa, Mycobacterium
ATDGDL

SEQ ID NO: 1002512 - protein, 7 aa, Mycobacterium
ATDGGLE

SEQ ID NO: 1002513 - protein, 5 aa, Mycobacterium
ATDGH

SEQ ID NO: 1002514 - protein, 11 aa, Mycobacterium
ATDGIDSGSPL

SEQ ID NO: 1002515 - protein, 11 aa, Mycobacterium
ATDGPARGESY

SEQ ID NO: 1002516 - protein, 12 aa, Mycobacterium
ATDKAVRGDQTE

SEQ ID NO: 1002517 - protein, 10 aa, Mycobacterium
ATDKGTPGAK

SEQ ID NO: 1002518 - protein, 21 aa, Mycobacterium
ATDNPAPTAPAAQPATAGPAV

SEQ ID NO: 1002519 - protein, 6 aa, Mycobacterium
ATDNPI

SEQ ID NO: 1002520 - protein, 10 aa, Mycobacterium
ATDPGAAAQF

SEQ ID NO: 1002521 - protein, 10 aa, Mycobacterium
ATDPMTGRRR

SEQ ID NO: 1002522 - protein, 8 aa, Mycobacterium
ATDQHDGV

SEQ ID NO: 1002523 - protein, 13 aa, Mycobacterium
ATDQHLTKTGTAV

SEQ ID NO: 1002524 - protein, 10 aa, Mycobacterium
ATDQPRRAGV

SEQ ID NO: 1002525 - protein, 5 aa, Mycobacterium
ATDRP

SEQ ID NO: 1002526 - protein, 8 aa, Mycobacterium
ATDRTAAV

SEQ ID NO: 1002527 - protein, 17 aa, Mycobacterium
ATDTTDTADADTDECGS

SEQ ID NO: 1002528 - protein, 4 aa, Mycobacterium
ATDY

SEQ ID NO: 1002529 - protein, 9 aa, Mycobacterium
ATEAARPDA

SEQ ID NO: 1002530 - protein, 11 aa, Mycobacterium
ATEDPADIGGP

SEQ ID NO: 1002531 - protein, 11 aa, Mycobacterium
ATEEDRIGSRR

SEQ ID NO: 1002532 - protein, 10 aa, Mycobacterium
ATEEPTGEDD

SEQ ID NO: 1002533 - protein, 6 aa, Mycobacterium
ATEETF

SEQ ID NO: 1002534 - protein, 7 aa, Mycobacterium
ATEGADG

SEQ ID NO: 1002535 - protein, 9 aa, Mycobacterium
ATEGPSSVE

SEQ ID NO: 1002536 - protein, 7 aa, Mycobacterium
ATEGRTA

SEQ ID NO: 1002537 - protein, 7 aa, Mycobacterium
ATEISDR

SEQ ID NO: 1002538 - protein, 12 aa, Mycobacterium
ATEITRERGPAL

SEQ ID NO: 1002539 - protein, 5 aa, Mycobacterium
ATEPG

SEQ ID NO: 1002540 - protein, 19 aa, Mycobacterium
ATEPLTKTTITRRDPGPHD

SEQ ID NO: 1002541 - protein, 6 aa, Mycobacterium
ATEPSI

SEQ ID NO: 1002542 - protein, 7 aa, Mycobacterium
ATEPTGM

SEQ ID NO: 1002543 - protein, 8 aa, Mycobacterium
ATEPTNAL

SEQ ID NO: 1002544 - protein, 6 aa, Mycobacterium
ATERGD

SEQ ID NO: 1002545 - protein, 9 aa, Mycobacterium
ATESAEPAI

SEQ ID NO: 1002546 - protein, 5 aa, Mycobacterium
ATETL

SEQ ID NO: 1002547 - protein, 17 aa, Mycobacterium
ATETLDEEHADSETAAL

SEQ ID NO: 1002548 - protein, 6 aa, Mycobacterium
ATETTF

SEQ ID NO: 1002549 - protein, 4 aa, Mycobacterium
ATFA

SEQ ID NO: 1002550 - protein, 12 aa, Mycobacterium
ATFASGGGGHDA

SEQ ID NO: 1002551 - protein, 9 aa, Mycobacterium
ATGADTVKG

SEQ ID NO: 1002552 - protein, 9 aa, Mycobacterium
ATGATSVPT

SEQ ID NO: 1002553 - protein, 4 aa, Mycobacterium
ATGC

SEQ ID NO: 1002554 - protein, 4 aa, Mycobacterium
ATGD

SEQ ID NO: 1002555 - protein, 19 aa, Mycobacterium
ATGDAYRQTTYREVGQRAA

SEQ ID NO: 1002556 - protein, 11 aa, Mycobacterium
ATGDDADADRH

SEQ ID NO: 1002557 - protein, 5 aa, Mycobacterium
ATGDE

SEQ ID NO: 1002558 - protein, 12 aa, Mycobacterium
ATGDGARRSKTE

SEQ ID NO: 1002559 - protein, 10 aa, Mycobacterium
ATGDKAAMPS

SEQ ID NO: 1002560 - protein, 5 aa, Mycobacterium
ATGDP

SEQ ID NO: 1002561 - protein, 6 aa, Mycobacterium
ATGDPE

SEQ ID NO: 1002562 - protein, 6 aa, Mycobacterium
ATGDPV

SEQ ID NO: 1002563 - protein, 10 aa, Mycobacterium
ATGDRTKNNA

SEQ ID NO: 1002564 - protein, 9 aa, Mycobacterium
ATGDTTKLA

SEQ ID NO: 1002565 - protein, 7 aa, Mycobacterium
ATGEDAR

SEQ ID NO: 1002566 - protein, 7 aa, Mycobacterium
ATGEDKA

SEQ ID NO: 1002567 - protein, 10 aa, Mycobacterium
ATGEGKTLAG

SEQ ID NO: 1002568 - protein, 7 aa, Mycobacterium
ATGEGRG

SEQ ID NO: 1002569 - protein, 5 aa, Mycobacterium
ATGEP

SEQ ID NO: 1002570 - protein, 11 aa, Mycobacterium
ATGEPAAGSRV

SEQ ID NO: 1002571 - protein, 7 aa, Mycobacterium
ATGEPTV

SEQ ID NO: 1002572 - protein, 5 aa, Mycobacterium
ATGEV

SEQ ID NO: 1002573 - protein, 102 aa, Mycobacterium
ATGGAGGDGGSGGTGRGGTGGGGTGGGGTGGGGGVGINNGSGEAIGGAPGAGGTGAVGGDGGQGGAAYSYGTGDATGSAGAAGTAGTTGVGGTGGAGGAAYT

SEQ ID NO: 1002574 - protein, 9 aa, Mycobacterium
ATGGDNPHK

SEQ ID NO: 1002575 - protein, 19 aa, Mycobacterium
ATGGGNNNDGGRGAGGASI

SEQ ID NO: 1002576 - protein, 12 aa, Mycobacterium
ATGGHTLPASTA

SEQ ID NO: 1002577 - protein, 5 aa, Mycobacterium
ATGGP

SEQ ID NO: 1002578 - protein, 9 aa, Mycobacterium
ATGGPSAIR

SEQ ID NO: 1002579 - protein, 7 aa, Mycobacterium
ATGGREH

SEQ ID NO: 1002580 - protein, 6 aa, Mycobacterium
ATGGRI

SEQ ID NO: 1002581 - protein, 7 aa, Mycobacterium
ATGHDAV

SEQ ID NO: 1002582 - protein, 6 aa, Mycobacterium
ATGHNS

SEQ ID NO: 1002583 - protein, 4 aa, Mycobacterium
ATGI

SEQ ID NO: 1002584 - protein, 6 aa, Mycobacterium
ATGKGA

SEQ ID NO: 1002585 - protein, 16 aa, Mycobacterium
ATGMIGDPRDIGERTL

SEQ ID NO: 1002586 - protein, 7 aa, Mycobacterium
ATGNGHP

SEQ ID NO: 1002587 - protein, 7 aa, Mycobacterium
ATGNSAS

SEQ ID NO: 1002588 - protein, 8 aa, Mycobacterium
ATGPAEVE

SEQ ID NO: 1002589 - protein, 6 aa, Mycobacterium
ATGPAL

SEQ ID NO: 1002590 - protein, 8 aa, Mycobacterium
ATGPEDVG

SEQ ID NO: 1002591 - protein, 13 aa, Mycobacterium
ATGPNTGESLSDQ

SEQ ID NO: 1002592 - protein, 9 aa, Mycobacterium
ATGQGAAAL

SEQ ID NO: 1002593 - protein, 5 aa, Mycobacterium
ATGQL

SEQ ID NO: 1002594 - protein, 5 aa, Mycobacterium
ATGQR

SEQ ID NO: 1002595 - protein, 11 aa, Mycobacterium
ATGQRPADTAL

SEQ ID NO: 1002596 - protein, 13 aa, Mycobacterium
ATGQRQAKDPAAF

SEQ ID NO: 1002597 - protein, 6 aa, Mycobacterium
ATGRAG

SEQ ID NO: 1002598 - protein, 6 aa, Mycobacterium
ATGRDV

SEQ ID NO: 1002599 - protein, 5 aa, Mycobacterium
ATGRG

SEQ ID NO: 1002600 - protein, 12 aa, Mycobacterium
ATGRLSSTEPNL

SEQ ID NO: 1002601 - protein, 5 aa, Mycobacterium
ATGRR

SEQ ID NO: 1002602 - protein, 16 aa, Mycobacterium
ATGSHTAHATTYTPRT

SEQ ID NO: 1002603 - protein, 13 aa, Mycobacterium
ATGSLSYSPGDPL

SEQ ID NO: 1002604 - protein, 14 aa, Mycobacterium
ATGSSTRLVPGTSL

SEQ ID NO: 1002605 - protein, 7 aa, Mycobacterium
ATGTDPE

SEQ ID NO: 1002606 - protein, 7 aa, Mycobacterium
ATGTRGI

SEQ ID NO: 1002607 - protein, 13 aa, Mycobacterium
ATGVKDRAATNAE

SEQ ID NO: 1002608 - protein, 7 aa, Mycobacterium
ATGVPRA

SEQ ID NO: 1002609 - protein, 15 aa, Mycobacterium
ATGVRRPPRFVPTLS

SEQ ID NO: 1002610 - protein, 15 aa, Mycobacterium
ATHEVQAAGASPEIA

SEQ ID NO: 1002611 - protein, 7 aa, Mycobacterium
ATHGRRT

SEQ ID NO: 1002612 - protein, 8 aa, Mycobacterium
ATHPGVNI

SEQ ID NO: 1002613 - protein, 6 aa, Mycobacterium
ATHSPR

SEQ ID NO: 1002614 - protein, 21 aa, Mycobacterium
ATHTRSDRESVKGRVGGRTQE

SEQ ID NO: 1002615 - protein, 21 aa, Mycobacterium
ATHTRSERESVKGRLSGRTQE

SEQ ID NO: 1002616 - protein, 6 aa, Mycobacterium
ATIDNA

SEQ ID NO: 1002617 - protein, 7 aa, Mycobacterium
ATIGPAD

SEQ ID NO: 1002618 - protein, 18 aa, Mycobacterium
ATIGPSDTLTADSARDSI

SEQ ID NO: 1002619 - protein, 4 aa, Mycobacterium
ATIP

SEQ ID NO: 1002620 - protein, 5 aa, Mycobacterium
ATITL

SEQ ID NO: 1002621 - protein, 11 aa, Mycobacterium
ATKAADDAQRQ

SEQ ID NO: 1002622 - protein, 13 aa, Mycobacterium
ATKAARAEIATRT

SEQ ID NO: 1002623 - protein, 5 aa, Mycobacterium
ATKAD

SEQ ID NO: 1002624 - protein, 11 aa, Mycobacterium
ATKAELGDHDE

SEQ ID NO: 1002625 - protein, 27 aa, Mycobacterium
ATKATVSISQPVAAARSVTAQVPGSAD

SEQ ID NO: 1002626 - protein, 4 aa, Mycobacterium
ATKD

SEQ ID NO: 1002627 - protein, 9 aa, Mycobacterium
ATKDGADPI

SEQ ID NO: 1002628 - protein, 4 aa, Mycobacterium
ATKH

SEQ ID NO: 1002629 - protein, 7 aa, Mycobacterium
ATKNPRR

SEQ ID NO: 1002630 - protein, 7 aa, Mycobacterium
ATKPDRL

SEQ ID NO: 1002631 - protein, 5 aa, Mycobacterium
ATKQE

SEQ ID NO: 1002632 - protein, 7 aa, Mycobacterium
ATKRAGE

SEQ ID NO: 1002633 - protein, 14 aa, Mycobacterium
ATKTETTLSAPVTK

SEQ ID NO: 1002634 - protein, 16 aa, Mycobacterium
ATKTNDVAGDGTTTAT

SEQ ID NO: 1002635 - protein, 6 aa, Mycobacterium
ATKTQH

SEQ ID NO: 1002636 - protein, 21 aa, Mycobacterium
ATKTTDPAGTGRGGPGTVAVR

SEQ ID NO: 1002637 - protein, 15 aa, Mycobacterium
ATLAENGVTPAAERR

SEQ ID NO: 1002638 - protein, 12 aa, Mycobacterium
ATLAPGNGDLTG

SEQ ID NO: 1002639 - protein, 8 aa, Mycobacterium
ATLDTNGH

SEQ ID NO: 1002640 - protein, 8 aa, Mycobacterium
ATLEDPVG

SEQ ID NO: 1002641 - protein, 9 aa, Mycobacterium
ATLEGRARQ

SEQ ID NO: 1002642 - protein, 7 aa, Mycobacterium
ATLGNND

SEQ ID NO: 1002643 - protein, 4 aa, Mycobacterium
ATLP

SEQ ID NO: 1002644 - protein, 10 aa, Mycobacterium
ATLPEDRSRE

SEQ ID NO: 1002645 - protein, 7 aa, Mycobacterium
ATLRPET

SEQ ID NO: 1002646 - protein, 6 aa, Mycobacterium
ATLSRE

SEQ ID NO: 1002647 - protein, 7 aa, Mycobacterium
ATMSAPG

SEQ ID NO: 1002648 - protein, 10 aa, Mycobacterium
ATNAEGANMD

SEQ ID NO: 1002649 - protein, 8 aa, Mycobacterium
ATNAIAGS

SEQ ID NO: 1002650 - protein, 5 aa, Mycobacterium
ATNAV

SEQ ID NO: 1002651 - protein, 13 aa, Mycobacterium
ATNAVEKASDIVE

SEQ ID NO: 1002652 - protein, 5 aa, Mycobacterium
ATNEG

SEQ ID NO: 1002653 - protein, 7 aa, Mycobacterium
ATNEPKP

SEQ ID NO: 1002654 - protein, 17 aa, Mycobacterium
ATNGAQALDRARETRPD

SEQ ID NO: 1002655 - protein, 7 aa, Mycobacterium
ATNGQQV

SEQ ID NO: 1002656 - protein, 25 aa, Mycobacterium
ATNLAGVGSTISTANATAAGPTAAA

SEQ ID NO: 1002657 - protein, 6 aa, Mycobacterium
ATNNVA

SEQ ID NO: 1002658 - protein, 8 aa, Mycobacterium
ATNRAPGW

SEQ ID NO: 1002659 - protein, 7 aa, Mycobacterium
ATNRDAA

SEQ ID NO: 1002660 - protein, 7 aa, Mycobacterium
ATNTAVT

SEQ ID NO: 1002661 - protein, 62 aa, Mycobacterium
ATNTQTGLASDTCRTTGSKTRLTGDTGLAGDTGLASDARLTGKTGLTGNARLTGKTGLTSKT

SEQ ID NO: 1002662 - protein, 14 aa, Mycobacterium
ATPAAADRCDGGPG

SEQ ID NO: 1002663 - protein, 6 aa, Mycobacterium
ATPAAG

SEQ ID NO: 1002664 - protein, 20 aa, Mycobacterium
ATPAARPRPSDGWWRWMPAC

SEQ ID NO: 1002665 - protein, 21 aa, Mycobacterium
ATPADLRAAPDTAGRPAEGTE

SEQ ID NO: 1002666 - protein, 5 aa, Mycobacterium
ATPAE

SEQ ID NO: 1002667 - protein, 6 aa, Mycobacterium
ATPAEV

SEQ ID NO: 1002668 - protein, 14 aa, Mycobacterium
ATPAGRAALTEDRR

SEQ ID NO: 1002669 - protein, 9 aa, Mycobacterium
ATPAGRAHP

SEQ ID NO: 1002670 - protein, 5 aa, Mycobacterium
ATPAH

SEQ ID NO: 1002671 - protein, 7 aa, Mycobacterium
ATPAPTR

SEQ ID NO: 1002672 - protein, 10 aa, Mycobacterium
ATPDASQQKD

SEQ ID NO: 1002673 - protein, 6 aa, Mycobacterium
ATPDAT

SEQ ID NO: 1002674 - protein, 7 aa, Mycobacterium
ATPDFTA

SEQ ID NO: 1002675 - protein, 13 aa, Mycobacterium
ATPDGAPGNDDLG

SEQ ID NO: 1002676 - protein, 9 aa, Mycobacterium
ATPDKRTTT

SEQ ID NO: 1002677 - protein, 15 aa, Mycobacterium
ATPDPCSAGASTQAE

SEQ ID NO: 1002678 - protein, 7 aa, Mycobacterium
ATPDTTN

SEQ ID NO: 1002679 - protein, 5 aa, Mycobacterium
ATPEV

SEQ ID NO: 1002680 - protein, 5 aa, Mycobacterium
ATPGG

SEQ ID NO: 1002681 - protein, 18 aa, Mycobacterium
ATPGGKPMYTPKCRNVTD

SEQ ID NO: 1002682 - protein, 15 aa, Mycobacterium
ATPGHPNQVGPRKRP

SEQ ID NO: 1002683 - protein, 18 aa, Mycobacterium
ATPGNQARHTPRCRSMAD

SEQ ID NO: 1002684 - protein, 14 aa, Mycobacterium
ATPGPYELSQSGGE

SEQ ID NO: 1002685 - protein, 7 aa, Mycobacterium
ATPGSAA

SEQ ID NO: 1002686 - protein, 8 aa, Mycobacterium
ATPGSGKT

SEQ ID NO: 1002687 - protein, 12 aa, Mycobacterium
ATPKASRTTPEA

SEQ ID NO: 1002688 - protein, 6 aa, Mycobacterium
ATPLEQ

SEQ ID NO: 1002689 - protein, 9 aa, Mycobacterium
ATPLRSGDQ

SEQ ID NO: 1002690 - protein, 20 aa, Mycobacterium
ATPLTTLPTDEVPASGIPGM

SEQ ID NO: 1002691 - protein, 9 aa, Mycobacterium
ATPNAPITR

SEQ ID NO: 1002692 - protein, 10 aa, Mycobacterium
ATPPDHDRDG

SEQ ID NO: 1002693 - protein, 9 aa, Mycobacterium
ATPPGPGAH

SEQ ID NO: 1002694 - protein, 17 aa, Mycobacterium
ATPPLTVGDTTTSPRLQ

SEQ ID NO: 1002695 - protein, 12 aa, Mycobacterium
ATPPNPATDQPR

SEQ ID NO: 1002696 - protein, 29 aa, Mycobacterium
ATPPPQPLAPRVDPNAAPEAARVNPAPPL

SEQ ID NO: 1002697 - protein, 39 aa, Mycobacterium
ATPPPTNNAPLTSSEPPSPSPAPRSHQRQPTKPQNPQVN

SEQ ID NO: 1002698 - protein, 5 aa, Mycobacterium
ATPPR

SEQ ID NO: 1002699 - protein, 15 aa, Mycobacterium
ATPPTHRATFVEHSA

SEQ ID NO: 1002700 - protein, 11 aa, Mycobacterium
ATPQPATPSAV

SEQ ID NO: 1002701 - protein, 8 aa, Mycobacterium
ATPRPRSE

SEQ ID NO: 1002702 - protein, 5 aa, Mycobacterium
ATPRQ

SEQ ID NO: 1002703 - protein, 27 aa, Mycobacterium
ATPSFRSSRPATRPPAQRWRGPPTPCS

SEQ ID NO: 1002704 - protein, 7 aa, Mycobacterium
ATPSGGQ

SEQ ID NO: 1002705 - protein, 6 aa, Mycobacterium
ATPSTL

SEQ ID NO: 1002706 - protein, 6 aa, Mycobacterium
ATPVGD

SEQ ID NO: 1002707 - protein, 9 aa, Mycobacterium
ATPVSGKDA

SEQ ID NO: 1002708 - protein, 22 aa, Mycobacterium
ATPVSVGPDRTGLVAPSPLCPE

SEQ ID NO: 1002709 - protein, 7 aa, Mycobacterium
ATPVTPT

SEQ ID NO: 1002710 - protein, 25 aa, Mycobacterium
ATQADAAAAGAPGGQPGGAEPGADD

SEQ ID NO: 1002711 - protein, 9 aa, Mycobacterium
ATQADLSGK

SEQ ID NO: 1002712 - protein, 9 aa, Mycobacterium
ATQAELESR

SEQ ID NO: 1002713 - protein, 13 aa, Mycobacterium
ATQDATSDATDIT

SEQ ID NO: 1002714 - protein, 9 aa, Mycobacterium
ATQDQPDGL

SEQ ID NO: 1002715 - protein, 8 aa, Mycobacterium
ATQDSMET

SEQ ID NO: 1002716 - protein, 7 aa, Mycobacterium
ATQESEM

SEQ ID NO: 1002717 - protein, 6 aa, Mycobacterium
ATQEST

SEQ ID NO: 1002718 - protein, 5 aa, Mycobacterium
ATQHR

SEQ ID NO: 1002719 - protein, 4 aa, Mycobacterium
ATQM

SEQ ID NO: 1002720 - protein, 8 aa, Mycobacterium
ATQNPAKL

SEQ ID NO: 1002721 - protein, 6 aa, Mycobacterium
ATQNPF

SEQ ID NO: 1002722 - protein, 9 aa, Mycobacterium
ATQPNYPAE

SEQ ID NO: 1002723 - protein, 10 aa, Mycobacterium
ATQPSDAFRA

SEQ ID NO: 1002724 - protein, 4 aa, Mycobacterium
ATQQ

SEQ ID NO: 1002725 - protein, 14 aa, Mycobacterium
ATQQRRAKRAEREL

SEQ ID NO: 1002726 - protein, 7 aa, Mycobacterium
ATQTGAA

SEQ ID NO: 1002727 - protein, 7 aa, Mycobacterium
ATQYPNR

SEQ ID NO: 1002728 - protein, 7 aa, Mycobacterium
ATRAEDG

SEQ ID NO: 1002729 - protein, 7 aa, Mycobacterium
ATRAENP

SEQ ID NO: 1002730 - protein, 9 aa, Mycobacterium
ATRALTDEG

SEQ ID NO: 1002731 - protein, 4 aa, Mycobacterium
ATRD

SEQ ID NO: 1002732 - protein, 6 aa, Mycobacterium
ATRDGD

SEQ ID NO: 1002733 - protein, 8 aa, Mycobacterium
ATRDTSPV

SEQ ID NO: 1002734 - protein, 8 aa, Mycobacterium
ATRETEAV

SEQ ID NO: 1002735 - protein, 13 aa, Mycobacterium
ATRGAAPQGSGVV

SEQ ID NO: 1002736 - protein, 6 aa, Mycobacterium
ATRGAE

SEQ ID NO: 1002737 - protein, 7 aa, Mycobacterium
ATRGGVG

SEQ ID NO: 1002738 - protein, 8 aa, Mycobacterium
ATRGNERL

SEQ ID NO: 1002739 - protein, 8 aa, Mycobacterium
ATRGPGVG

SEQ ID NO: 1002740 - protein, 12 aa, Mycobacterium
ATRGPIRNIVLS

SEQ ID NO: 1002741 - protein, 9 aa, Mycobacterium
ATRGQADAA

SEQ ID NO: 1002742 - protein, 5 aa, Mycobacterium
ATRIP

SEQ ID NO: 1002743 - protein, 6 aa, Mycobacterium
ATRLPS

SEQ ID NO: 1002744 - protein, 6 aa, Mycobacterium
ATRNHP

SEQ ID NO: 1002745 - protein, 17 aa, Mycobacterium
ATRPRRSWNADQTTDYS

SEQ ID NO: 1002746 - protein, 10 aa, Mycobacterium
ATRQRFERES

SEQ ID NO: 1002747 - protein, 7 aa, Mycobacterium
ATRQTLT

SEQ ID NO: 1002748 - protein, 37 aa, Mycobacterium
ATRRDAPAATSRARWPPPRGLPTGNPSRRWSWRGWDA

SEQ ID NO: 1002749 - protein, 9 aa, Mycobacterium
ATRRDVAGT

SEQ ID NO: 1002750 - protein, 8 aa, Mycobacterium
ATRRGRPP

SEQ ID NO: 1002751 - protein, 28 aa, Mycobacterium
ATRRNTELEGTRSTAATRADQDDYARGK

SEQ ID NO: 1002752 - protein, 23 aa, Mycobacterium
ATRSNGAATAEREADPPQERDGT

SEQ ID NO: 1002753 - protein, 9 aa, Mycobacterium
ATRSNGETV

SEQ ID NO: 1002754 - protein, 7 aa, Mycobacterium
ATRSQGR

SEQ ID NO: 1002755 - protein, 14 aa, Mycobacterium
ATRSSGQDSAGYGR

SEQ ID NO: 1002756 - protein, 8 aa, Mycobacterium
ATRSSPAL

SEQ ID NO: 1002757 - protein, 8 aa, Mycobacterium
ATRSSPDE

SEQ ID NO: 1002758 - protein, 5 aa, Mycobacterium
ATRTD

SEQ ID NO: 1002759 - protein, 11 aa, Mycobacterium
ATRTIGVTPGS

SEQ ID NO: 1002760 - protein, 5 aa, Mycobacterium
ATRTL

SEQ ID NO: 1002761 - protein, 19 aa, Mycobacterium
ATRVSNKAFQSKYKAAGGY

SEQ ID NO: 1002762 - protein, 10 aa, Mycobacterium
ATRVTTDEEI

SEQ ID NO: 1002763 - protein, 17 aa, Mycobacterium
ATSAKGSTTEDPGPDLA

SEQ ID NO: 1002764 - protein, 20 aa, Mycobacterium
ATSAPGNNSIRPKEKAPLAE

SEQ ID NO: 1002765 - protein, 10 aa, Mycobacterium
ATSAPPGPKV

SEQ ID NO: 1002766 - protein, 5 aa, Mycobacterium
ATSAR

SEQ ID NO: 1002767 - protein, 5 aa, Mycobacterium
ATSAT

SEQ ID NO: 1002768 - protein, 8 aa, Mycobacterium
ATSAVRPG

SEQ ID NO: 1002769 - protein, 23 aa, Mycobacterium
ATSCGSAGGCGSADGAGSSAGDP

SEQ ID NO: 1002770 - protein, 8 aa, Mycobacterium
ATSDGPRR

SEQ ID NO: 1002771 - protein, 7 aa, Mycobacterium
ATSDGQD

SEQ ID NO: 1002772 - protein, 8 aa, Mycobacterium
ATSDPDTF

SEQ ID NO: 1002773 - protein, 9 aa, Mycobacterium
ATSEDGTSI

SEQ ID NO: 1002774 - protein, 13 aa, Mycobacterium
ATSEDVVTSAQSA

SEQ ID NO: 1002775 - protein, 4 aa, Mycobacterium
ATSG

SEQ ID NO: 1002776 - protein, 8 aa, Mycobacterium
ATSGNTGI

SEQ ID NO: 1002777 - protein, 9 aa, Mycobacterium
ATSGRGADS

SEQ ID NO: 1002778 - protein, 4 aa, Mycobacterium
ATSH

SEQ ID NO: 1002779 - protein, 9 aa, Mycobacterium
ATSHGGGQL

SEQ ID NO: 1002780 - protein, 4 aa, Mycobacterium
ATSP

SEQ ID NO: 1002781 - protein, 11 aa, Mycobacterium
ATSPEELGNME

SEQ ID NO: 1002782 - protein, 5 aa, Mycobacterium
ATSPP

SEQ ID NO: 1002783 - protein, 5 aa, Mycobacterium
ATSQG

SEQ ID NO: 1002784 - protein, 9 aa, Mycobacterium
ATSREGKAQ

SEQ ID NO: 1002785 - protein, 18 aa, Mycobacterium
ATSSGSYAATEAANAAAA

SEQ ID NO: 1002786 - protein, 8 aa, Mycobacterium
ATSSTQPI

SEQ ID NO: 1002787 - protein, 5 aa, Mycobacterium
ATSTV

SEQ ID NO: 1002788 - protein, 5 aa, Mycobacterium
ATTAA

SEQ ID NO: 1002789 - protein, 7 aa, Mycobacterium
ATTAELD

SEQ ID NO: 1002790 - protein, 12 aa, Mycobacterium
ATTAELDSTGRA

SEQ ID NO: 1002791 - protein, 13 aa, Mycobacterium
ATTAEQSATTGHA

SEQ ID NO: 1002792 - protein, 5 aa, Mycobacterium
ATTAM

SEQ ID NO: 1002793 - protein, 7 aa, Mycobacterium
ATTAPTE

SEQ ID NO: 1002794 - protein, 4 aa, Mycobacterium
ATTD

SEQ ID NO: 1002795 - protein, 8 aa, Mycobacterium
ATTDFSEA

SEQ ID NO: 1002796 - protein, 11 aa, Mycobacterium
ATTDSPGATAA

SEQ ID NO: 1002797 - protein, 10 aa, Mycobacterium
ATTDTLPSEL

SEQ ID NO: 1002798 - protein, 7 aa, Mycobacterium
ATTEQDP

SEQ ID NO: 1002799 - protein, 10 aa, Mycobacterium
ATTETGDQRP

SEQ ID NO: 1002800 - protein, 6 aa, Mycobacterium
ATTGTR

SEQ ID NO: 1002801 - protein, 11 aa, Mycobacterium
ATTHGTFTSEY

SEQ ID NO: 1002802 - protein, 10 aa, Mycobacterium
ATTLDQPDLQ

SEQ ID NO: 1002803 - protein, 12 aa, Mycobacterium
ATTNPEGSTGDG

SEQ ID NO: 1002804 - protein, 9 aa, Mycobacterium
ATTPATEAE

SEQ ID NO: 1002805 - protein, 7 aa, Mycobacterium
ATTPDLP

SEQ ID NO: 1002806 - protein, 7 aa, Mycobacterium
ATTPGKV

SEQ ID NO: 1002807 - protein, 9 aa, Mycobacterium
ATTPRRRAD

SEQ ID NO: 1002808 - protein, 12 aa, Mycobacterium
ATTRAAAGPGPL

SEQ ID NO: 1002809 - protein, 12 aa, Mycobacterium
ATTRAPRPGEVD

SEQ ID NO: 1002810 - protein, 7 aa, Mycobacterium
ATTRNGR

SEQ ID NO: 1002811 - protein, 8 aa, Mycobacterium
ATTRPKSA

SEQ ID NO: 1002812 - protein, 5 aa, Mycobacterium
ATTRY

SEQ ID NO: 1002813 - protein, 11 aa, Mycobacterium
ATTSAAPTAAS

SEQ ID NO: 1002814 - protein, 10 aa, Mycobacterium
ATTSPQQTRT

SEQ ID NO: 1002815 - protein, 7 aa, Mycobacterium
ATTSPSV

SEQ ID NO: 1002816 - protein, 8 aa, Mycobacterium
ATTSRAHT

SEQ ID NO: 1002817 - protein, 22 aa, Mycobacterium
ATTSTDGSDRPTEPVVIESITI

SEQ ID NO: 1002818 - protein, 7 aa, Mycobacterium
ATTTDGL

SEQ ID NO: 1002819 - protein, 9 aa, Mycobacterium
ATTTRVGGP

SEQ ID NO: 1002820 - protein, 5 aa, Mycobacterium
ATTVS

SEQ ID NO: 1002821 - protein, 4 aa, Mycobacterium
ATTY

SEQ ID NO: 1002822 - protein, 7 aa, Mycobacterium
ATVASGT

SEQ ID NO: 1002823 - protein, 6 aa, Mycobacterium
ATVDPS

SEQ ID NO: 1002824 - protein, 5 aa, Mycobacterium
ATVDQ

SEQ ID NO: 1002825 - protein, 7 aa, Mycobacterium
ATVEGGA

SEQ ID NO: 1002826 - protein, 6 aa, Mycobacterium
ATVGTA

SEQ ID NO: 1002827 - protein, 9 aa, Mycobacterium
ATVKGGTYY

SEQ ID NO: 1002828 - protein, 4 aa, Mycobacterium
ATVP

SEQ ID NO: 1002829 - protein, 13 aa, Mycobacterium
ATVPAERAAAAQR

SEQ ID NO: 1002830 - protein, 7 aa, Mycobacterium
ATVPGAS

SEQ ID NO: 1002831 - protein, 9 aa, Mycobacterium
ATVRSDAGE

SEQ ID NO: 1002832 - protein, 8 aa, Mycobacterium
ATVSATAS

SEQ ID NO: 1002833 - protein, 4 aa, Mycobacterium
ATWT

SEQ ID NO: 1002834 - protein, 6 aa, Mycobacterium
ATYAAT

SEQ ID NO: 1002835 - protein, 5 aa, Mycobacterium
ATYDQ

SEQ ID NO: 1002836 - protein, 10 aa, Mycobacterium
ATYPDGSTPE

SEQ ID NO: 1002837 - protein, 7 aa, Mycobacterium
AVAAQKD

SEQ ID NO: 1002838 - protein, 9 aa, Mycobacterium
AVAARGGNG

SEQ ID NO: 1002839 - protein, 26 aa, Mycobacterium
AVAARSASPIPVKSPAAAANASGAAV

SEQ ID NO: 1002840 - protein, 11 aa, Mycobacterium
AVADTAQTARG

SEQ ID NO: 1002841 - protein, 9 aa, Mycobacterium
AVAESHPDG

SEQ ID NO: 1002842 - protein, 11 aa, Mycobacterium
AVAGDVAGATE

SEQ ID NO: 1002843 - protein, 8 aa, Mycobacterium
AVAGNPGL

SEQ ID NO: 1002844 - protein, 13 aa, Mycobacterium
AVAGPTPDESQGE

SEQ ID NO: 1002845 - protein, 21 aa, Mycobacterium
AVAGRDPSLPRPPRGEAPDRN

SEQ ID NO: 1002846 - protein, 10 aa, Mycobacterium
AVAGTTNTLG

SEQ ID NO: 1002847 - protein, 10 aa, Mycobacterium
AVANNTARQL

SEQ ID NO: 1002848 - protein, 7 aa, Mycobacterium
AVAPEGG

SEQ ID NO: 1002849 - protein, 9 aa, Mycobacterium
AVAPGDGSQ

SEQ ID NO: 1002850 - protein, 10 aa, Mycobacterium
AVAPGVTTDE

SEQ ID NO: 1002851 - protein, 12 aa, Mycobacterium
AVAPKDKGSARD

SEQ ID NO: 1002852 - protein, 6 aa, Mycobacterium
AVAPPE

SEQ ID NO: 1002853 - protein, 8 aa, Mycobacterium
AVAPSGQP

SEQ ID NO: 1002854 - protein, 7 aa, Mycobacterium
AVAREDS

SEQ ID NO: 1002855 - protein, 10 aa, Mycobacterium
AVASEGVPGG

SEQ ID NO: 1002856 - protein, 31 aa, Mycobacterium; identical to SEQ ID NO: 440267

SEQ ID NO: 1002857 - protein, 10 aa, Mycobacterium
AVASTGLAKT

SEQ ID NO: 1002858 - protein, 9 aa, Mycobacterium
AVDADDKAL

SEQ ID NO: 1002859 - protein, 13 aa, Mycobacterium
AVDADGRARPNYK

SEQ ID NO: 1002860 - protein, 14 aa, Mycobacterium
AVDDPATIATDPYG

SEQ ID NO: 1002861 - protein, 15 aa, Mycobacterium
AVDEPAPLESPAAAA

SEQ ID NO: 1002862 - protein, 9 aa, Mycobacterium
AVDEPDDAT

SEQ ID NO: 1002863 - protein, 17 aa, Mycobacterium
AVDGAEALRSATETRPD

SEQ ID NO: 1002864 - protein, 9 aa, Mycobacterium
AVDPPGDAR

SEQ ID NO: 1002865 - protein, 13 aa, Mycobacterium
AVDPSGPDRQVDV

SEQ ID NO: 1002866 - protein, 4 aa, Mycobacterium
AVDR

SEQ ID NO: 1002867 - protein, 20 aa, Mycobacterium
AVEGKTYTITGQAQGADMKN

SEQ ID NO: 1002868 - protein, 5 aa, Mycobacterium
AVEGR

SEQ ID NO: 1002869 - protein, 17 aa, Mycobacterium
AVEPDPRVSGVPSTKGV

SEQ ID NO: 1002870 - protein, 12 aa, Mycobacterium
AVEPGQPLDQQE

SEQ ID NO: 1002871 - protein, 8 aa, Mycobacterium
AVEPSSHR

SEQ ID NO: 1002872 - protein, 7 aa, Mycobacterium
AVEPTDA

SEQ ID NO: 1002873 - protein, 7 aa, Mycobacterium
AVEPTPL

SEQ ID NO: 1002874 - protein, 4 aa, Mycobacterium
AVER

SEQ ID NO: 1002875 - protein, 10 aa, Mycobacterium
AVESARERLA

SEQ ID NO: 1002876 - protein, 9 aa, Mycobacterium
AVESERTEQ

SEQ ID NO: 1002877 - protein, 10 aa, Mycobacterium
AVESGAQSLG

SEQ ID NO: 1002878 - protein, 9 aa, Mycobacterium
AVETAGANP

SEQ ID NO: 1002879 - protein, 11 aa, Mycobacterium
AVETSKPEPLI

SEQ ID NO: 1002880 - protein, 8 aa, Mycobacterium
AVGAAAGA

SEQ ID NO: 1002881 - protein, 5 aa, Mycobacterium
AVGAD

SEQ ID NO: 1002882 - protein, 18 aa, Mycobacterium
AVGADNAVSATASGAGGN

SEQ ID NO: 1002883 - protein, 9 aa, Mycobacterium
AVGAGDTEA

SEQ ID NO: 1002884 - protein, 4 aa, Mycobacterium
AVGD

SEQ ID NO: 1002885 - protein, 16 aa, Mycobacterium
AVGDAQIATQPGTFSL

SEQ ID NO: 1002886 - protein, 17 aa, Mycobacterium
AVGDGNTGIAARGHQAG

SEQ ID NO: 1002887 - protein, 7 aa, Mycobacterium
AVGESGR

SEQ ID NO: 1002888 - protein, 6 aa, Mycobacterium
AVGGAA

SEQ ID NO: 1002889 - protein, 15 aa, Mycobacterium
AVGGTHGRLPDSDEE

SEQ ID NO: 1002890 - protein, 13 aa, Mycobacterium
AVGHDGKAVPVTG

SEQ ID NO: 1002891 - protein, 9 aa, Mycobacterium
AVGKRGGAL

SEQ ID NO: 1002892 - protein, 5 aa, Mycobacterium
AVGPN

SEQ ID NO: 1002893 - protein, 13 aa, Mycobacterium
AVGPQGTARSARD

SEQ ID NO: 1002894 - protein, 6 aa, Mycobacterium
AVGPTT

SEQ ID NO: 1002895 - protein, 4 aa, Mycobacterium
AVGQ

SEQ ID NO: 1002896 - protein, 11 aa, Mycobacterium
AVGQGRVERTQ

SEQ ID NO: 1002897 - protein, 6 aa, Mycobacterium
AVGRDV

SEQ ID NO: 1002898 - protein, 7 aa, Mycobacterium
AVGRPYP

SEQ ID NO: 1002899 - protein, 8 aa, Mycobacterium
AVGSAEHD

SEQ ID NO: 1002900 - protein, 5 aa, Mycobacterium
AVGTT

SEQ ID NO: 1002901 - protein, 7 aa, Mycobacterium
AVKGGWA

SEQ ID NO: 1002902 - protein, 8 aa, Mycobacterium
AVKPGTAK

SEQ ID NO: 1002903 - protein, 4 aa, Mycobacterium
AVLP

SEQ ID NO: 1002904 - protein, 6 aa, Mycobacterium
AVNDND

SEQ ID NO: 1002905 - protein, 20 aa, Mycobacterium
AVNDTGGSLAGAGGDPAPAH

SEQ ID NO: 1002906 - protein, 6 aa, Mycobacterium
AVNEGM

SEQ ID NO: 1002907 - protein, 7 aa, Mycobacterium
AVNGPNQ

SEQ ID NO: 1002908 - protein, 21 aa, Mycobacterium
AVNQDGASNGLATPDGPSQQR

SEQ ID NO: 1002909 - protein, 20 aa, Mycobacterium
AVNQDGASSGVTVPNGPAQQ

SEQ ID NO: 1002910 - protein, 21 aa, Mycobacterium
AVNQDGASSGVTVPNGPAQQE

SEQ ID NO: 1002911 - protein, 18 aa, Mycobacterium
AVNQDGRSNGITAPNTAA

SEQ ID NO: 1002912 - protein, 10 aa, Mycobacterium
AVNRGNATQA

SEQ ID NO: 1002913 - protein, 9 aa, Mycobacterium
AVNRPTPDR

SEQ ID NO: 1002914 - protein, 7 aa, Mycobacterium
AVNTARQ

SEQ ID NO: 1002915 - protein, 8 aa, Mycobacterium
AVPADAAG

SEQ ID NO: 1002916 - protein, 6 aa, Mycobacterium
AVPAGP

SEQ ID NO: 1002917 - protein, 5 aa, Mycobacterium
AVPAP

SEQ ID NO: 1002918 - protein, 8 aa, Mycobacterium
AVPATDDH

SEQ ID NO: 1002919 - protein, 6 aa, Mycobacterium
AVPDDA

SEQ ID NO: 1002920 - protein, 14 aa, Mycobacterium
AVPDDPAARERRRR

SEQ ID NO: 1002921 - protein, 5 aa, Mycobacterium
AVPDG

SEQ ID NO: 1002922 - protein, 12 aa, Mycobacterium
AVPEAPDGPGWR

SEQ ID NO: 1002923 - protein, 9 aa, Mycobacterium
AVPGEPQSL

SEQ ID NO: 1002924 - protein, 6 aa, Mycobacterium
AVPGPL

SEQ ID NO: 1002925 - protein, 4 aa, Mycobacterium
AVPH

SEQ ID NO: 1002926 - protein, 11 aa, Mycobacterium
AVPHPGDPPIQ

SEQ ID NO: 1002927 - protein, 11 aa, Mycobacterium
AVPKDGPSAGV

SEQ ID NO: 1002928 - protein, 8 aa, Mycobacterium
AVPKPMAP

SEQ ID NO: 1002929 - protein, 4 aa, Mycobacterium
AVPP

SEQ ID NO: 1002930 - protein, 7 aa, Mycobacterium
AVPPAQV

SEQ ID NO: 1002931 - protein, 11 aa, Mycobacterium
AVPPDDPGAQL

SEQ ID NO: 1002932 - protein, 8 aa, Mycobacterium
AVPPPSVP

SEQ ID NO: 1002933 - protein, 5 aa, Mycobacterium
AVPQG

SEQ ID NO: 1002934 - protein, 14 aa, Mycobacterium
AVPRDAEAGESAAG

SEQ ID NO: 1002935 - protein, 12 aa, Mycobacterium
AVPSGASTGEHE

SEQ ID NO: 1002936 - protein, 8 aa, Mycobacterium
AVPSNTQV

SEQ ID NO: 1002937 - protein, 5 aa, Mycobacterium
AVPSR

SEQ ID NO: 1002938 - protein, 7 aa, Mycobacterium
AVPSRDI

SEQ ID NO: 1002939 - protein, 6 aa, Mycobacterium
AVPSSE

SEQ ID NO: 1002940 - protein, 19 aa, Mycobacterium
AVPTADDGSLSIGSLKGTS

SEQ ID NO: 1002941 - protein, 8 aa, Mycobacterium
AVPTPGSL

SEQ ID NO: 1002942 - protein, 8 aa, Mycobacterium
AVPTQDPL

SEQ ID NO: 1002943 - protein, 15 aa, Mycobacterium
AVQAADGHNLSRPSW

SEQ ID NO: 1002944 - protein, 7 aa, Mycobacterium
AVQGPNA

SEQ ID NO: 1002945 - protein, 16 aa, Mycobacterium
AVQPDQRPSIGCGIKW

SEQ ID NO: 1002946 - protein, 5 aa, Mycobacterium
AVQPG

SEQ ID NO: 1002947 - protein, 11 aa, Mycobacterium
AVQPQPSRQAQ

SEQ ID NO: 1002948 - protein, 8 aa, Mycobacterium
AVRAGADG

SEQ ID NO: 1002949 - protein, 5 aa, Mycobacterium
AVRDR

SEQ ID NO: 1002950 - protein, 4 aa, Mycobacterium
AVRE

SEQ ID NO: 1002951 - protein, 8 aa, Mycobacterium
AVREDDDT

SEQ ID NO: 1002952 - protein, 5 aa, Mycobacterium
AVRGE

SEQ ID NO: 1002953 - protein, 5 aa, Mycobacterium
AVRKN

SEQ ID NO: 1002954 - protein, 4 aa, Mycobacterium
AVRP

SEQ ID NO: 1002955 - protein, 7 aa, Mycobacterium
AVRQGDP

SEQ ID NO: 1002956 - protein, 11 aa, Mycobacterium
AVRQGDPLDTE

SEQ ID NO: 1002957 - protein, 12 aa, Mycobacterium
AVRQGSAPGSDY

SEQ ID NO: 1002958 - protein, 7 aa, Mycobacterium
AVRRDPG

SEQ ID NO: 1002959 - protein, 12 aa, Mycobacterium
AVRRSRRDAADR

SEQ ID NO: 1002960 - protein, 6 aa, Mycobacterium
AVSDGT

SEQ ID NO: 1002961 - protein, 4 aa, Mycobacterium
AVSE

SEQ ID NO: 1002962 - protein, 8 aa, Mycobacterium
AVSGLTGK

SEQ ID NO: 1002963 - protein, 8 aa, Mycobacterium
AVSGPKTL

SEQ ID NO: 1002964 - protein, 9 aa, Mycobacterium
AVSPEKAAE

SEQ ID NO: 1002965 - protein, 7 aa, Mycobacterium
AVSPTTA

SEQ ID NO: 1002966 - protein, 21 aa, Mycobacterium
AVSPYGSGALAGSSLGLDPDA

SEQ ID NO: 1002967 - protein, 6 aa, Mycobacterium
AVSRQT

SEQ ID NO: 1002968 - protein, 10 aa, Mycobacterium
AVSSGDNSNI

SEQ ID NO: 1002969 - protein, 15 aa, Mycobacterium
AVSTECRDDRSQEFP

SEQ ID NO: 1002970 - protein, 16 aa, Mycobacterium
AVSTSTADNPNALNTR

SEQ ID NO: 1002971 - protein, 10 aa, Mycobacterium
AVTAAGGSRC

SEQ ID NO: 1002972 - protein, 8 aa, Mycobacterium
AVTAAPDG

SEQ ID NO: 1002973 - protein, 8 aa, Mycobacterium
AVTADSSV

SEQ ID NO: 1002974 - protein, 28 aa, Mycobacterium
AVTATSAAEISETPTGAAATPATTTRAA

SEQ ID NO: 1002975 - protein, 7 aa, Mycobacterium
AVTDSGV

SEQ ID NO: 1002976 - protein, 11 aa, Mycobacterium
AVTEATAGSGF

SEQ ID NO: 1002977 - protein, 6 aa, Mycobacterium
AVTEGK

SEQ ID NO: 1002978 - protein, 6 aa, Mycobacterium
AVTGKG

SEQ ID NO: 1002979 - protein, 16 aa, Mycobacterium
AVTGKKAAGAASASVA

SEQ ID NO: 1002980 - protein, 4 aa, Mycobacterium
AVTP

SEQ ID NO: 1002981 - protein, 6 aa, Mycobacterium
AVTPKT

SEQ ID NO: 1002982 - protein, 8 aa, Mycobacterium
AVTPNGDV

SEQ ID NO: 1002983 - protein, 11 aa, Mycobacterium
AVTSATGPLAA

SEQ ID NO: 1002984 - protein, 8 aa, Mycobacterium
AVTSDADA

SEQ ID NO: 1002985 - protein, 8 aa, Mycobacterium
AVVPPGGY

SEQ ID NO: 1002986 - protein, 12 aa, Mycobacterium
AWEGGSPPAALQ

SEQ ID NO: 1002987 - protein, 6 aa, Mycobacterium
AWGAGA

SEQ ID NO: 1002988 - protein, 15 aa, Mycobacterium
AWGTPEVHRRRVLEA

SEQ ID NO: 1002989 - protein, 9 aa, Mycobacterium
AWPGGRAGR

SEQ ID NO: 1002990 - protein, 6 aa, Mycobacterium
AWPPAG

SEQ ID NO: 1002991 - protein, 6 aa, Mycobacterium
AWPPTS

SEQ ID NO: 1002992 - protein, 10 aa, Mycobacterium
AWPSPPLPPL

SEQ ID NO: 1002993 - protein, 9 aa, Mycobacterium
AWQGDTGVT

SEQ ID NO: 1002994 - protein, 9 aa, Mycobacterium
AWQGPSAAS

SEQ ID NO: 1002995 - protein, 4 aa, Mycobacterium
AWRP

SEQ ID NO: 1002996 - protein, 5 aa, Mycobacterium
AWSND

SEQ ID NO: 1002997 - protein, 4 aa, Mycobacterium
AWTG

SEQ ID NO: 1002998 - protein, 10 aa, Mycobacterium
AWTQDEAEQR

SEQ ID NO: 1002999 - protein, 4 aa, Mycobacterium
AYAD

SEQ ID NO: 1003000 - protein, 8 aa, Mycobacterium
AYADDGAV

SEQ ID NO: 1003001 - protein, 5 aa, Mycobacterium
AYAGA

SEQ ID NO: 1003002 - protein, 15 aa, Mycobacterium
AYAGAADGTAFSEGA

SEQ ID NO: 1003003 - protein, 6 aa, Mycobacterium
AYAGGG

SEQ ID NO: 1003004 - protein, 21 aa, Mycobacterium
AYAKASSRDTVRSRSFTGKPA

SEQ ID NO: 1003005 - protein, 5 aa, Mycobacterium
AYAPY

SEQ ID NO: 1003006 - protein, 10 aa, Mycobacterium
AYAQGDDDEL

SEQ ID NO: 1003007 - protein, 18 aa, Mycobacterium
AYDDPDDLSARTSMSNAA

SEQ ID NO: 1003008 - protein, 6 aa, Mycobacterium
AYDQDN

SEQ ID NO: 1003009 - protein, 5 aa, Mycobacterium
AYDSP

SEQ ID NO: 1003010 - protein, 5 aa, Mycobacterium
AYEEN

SEQ ID NO: 1003011 - protein, 8 aa, Mycobacterium
AYEGPPGH

SEQ ID NO: 1003012 - protein, 11 aa, Mycobacterium
AYENSPSYHGD

SEQ ID NO: 1003013 - protein, 7 aa, Mycobacterium
AYEPETS

SEQ ID NO: 1003014 - protein, 5 aa, Mycobacterium
AYEPQ

SEQ ID NO: 1003015 - protein, 10 aa, Mycobacterium
AYGAQKAGID

SEQ ID NO: 1003016 - protein, 14 aa, Mycobacterium
AYGDDAANEITAVL

SEQ ID NO: 1003017 - protein, 5 aa, Mycobacterium
AYGEA

SEQ ID NO: 1003018 - protein, 6 aa, Mycobacterium
AYGGNP

SEQ ID NO: 1003019 - protein, 29 aa, Mycobacterium
AYGGTPPPYPGWPDRPPAEAVSCSAIEPT

SEQ ID NO: 1003020 - protein, 6 aa, Mycobacterium
AYGIDG

SEQ ID NO: 1003021 - protein, 6 aa, Mycobacterium
AYGNHT

SEQ ID NO: 1003022 - protein, 7 aa, Mycobacterium
AYGPTRN

SEQ ID NO: 1003023 - protein, 4 aa, Mycobacterium
AYGQ

SEQ ID NO: 1003024 - protein, 5 aa, Mycobacterium
AYGQS

SEQ ID NO: 1003025 - protein, 6 aa, Mycobacterium
AYGQTE

SEQ ID NO: 1003026 - protein, 8 aa, Mycobacterium
AYGREGEH

SEQ ID NO: 1003027 - protein, 9 aa, Mycobacterium
AYGSDAQKK

SEQ ID NO: 1003028 - protein, 7 aa, Mycobacterium
AYKPGNV

SEQ ID NO: 1003029 - protein, 4 aa, Mycobacterium
AYLP

SEQ ID NO: 1003030 - protein, 13 aa, Mycobacterium
AYNEANGIDPQPL

SEQ ID NO: 1003031 - protein, 20 aa, Mycobacterium
AYPADTAAAGAEPAPPPSIE

SEQ ID NO: 1003032 - protein, 9 aa, Mycobacterium
AYPAGSAGR

SEQ ID NO: 1003033 - protein, 10 aa, Mycobacterium
AYPAKKREPL

SEQ ID NO: 1003034 - protein, 5 aa, Mycobacterium
AYPER

SEQ ID NO: 1003035 - protein, 6 aa, Mycobacterium
AYPPRL

SEQ ID NO: 1003036 - protein, 9 aa, Mycobacterium
AYPPRSDGT

SEQ ID NO: 1003037 - protein, 8 aa, Mycobacterium
AYPSGSEH

SEQ ID NO: 1003038 - protein, 13 aa, Mycobacterium
AYQAASAQAQSLG

SEQ ID NO: 1003039 - protein, 6 aa, Mycobacterium
AYQGKG

SEQ ID NO: 1003040 - protein, 4 aa, Mycobacterium
AYQP

SEQ ID NO: 1003041 - protein, 13 aa, Mycobacterium
AYQQSRRINAASG

SEQ ID NO: 1003042 - protein, 5 aa, Mycobacterium
AYQTL

SEQ ID NO: 1003043 - protein, 14 aa, Mycobacterium
AYRAKTRVRATPRR

SEQ ID NO: 1003044 - protein, 16 aa, Mycobacterium
AYRDPAASEPQRIAIT

SEQ ID NO: 1003045 - protein, 5 aa, Mycobacterium
AYRRD

SEQ ID NO: 1003046 - protein, 7 aa, Mycobacterium
AYRSTYA

SEQ ID NO: 1003047 - protein, 12 aa, Mycobacterium
AYSAGAARATVA

SEQ ID NO: 1003048 - protein, 8 aa, Mycobacterium
AYSASPRS

SEQ ID NO: 1003049 - protein, 16 aa, Mycobacterium
AYSNADGARQVAEGQV

SEQ ID NO: 1003050 - protein, 24 aa, Mycobacterium
AYSNETPNFNNSNGQPLSDHSPPA

SEQ ID NO: 1003051 - protein, 8 aa, Mycobacterium
AYSPGSRG

SEQ ID NO: 1003052 - protein, 4 aa, Mycobacterium
AYSS

SEQ ID NO: 1003053 - protein, 12 aa, Mycobacterium
AYTAAEAASVNP

SEQ ID NO: 1003054 - protein, 13 aa, Mycobacterium
AYTGAEAANASPL

SEQ ID NO: 1003055 - protein, 6 aa, Mycobacterium
AYTGNP

SEQ ID NO: 1003056 - protein, 10 aa, Mycobacterium
AYTSADPVSG

SEQ ID NO: 1003057 - protein, 5 aa, Mycobacterium
AYTSG

SEQ ID NO: 1003058 - protein, 6 aa, Mycobacterium
CAAPAG

SEQ ID NO: 1003059 - protein, 5 aa, Mycobacterium
CADEE

SEQ ID NO: 1003060 - protein, 4 aa, Mycobacterium
CADN

SEQ ID NO: 1003061 - protein, 7 aa, Mycobacterium
CADPDVQ

SEQ ID NO: 1003062 - protein, 8 aa, Mycobacterium
CAEARSKD

SEQ ID NO: 1003063 - protein, 12 aa, Mycobacterium
CAGATGAAHNGF

SEQ ID NO: 1003064 - protein, 12 aa, Mycobacterium
CAGGAGGNGGRG

SEQ ID NO: 1003065 - protein, 17 aa, Mycobacterium
CAGGPGARGYERSAAGR

SEQ ID NO: 1003066 - protein, 33 aa, Mycobacterium
CAHPGAAGAPVDRQRRQRGPGDRPERRRRWAVV

SEQ ID NO: 1003067 - protein, 19 aa, Mycobacterium
CAPPPPSPGVPPVPPAPPA

SEQ ID NO: 1003068 - protein, 23 aa, Mycobacterium
CAQPAFDQRETATYAATRQCNSP

SEQ ID NO: 1003069 - protein, 10 aa, Mycobacterium
CAQRTDHRRG

SEQ ID NO: 1003070 - protein, 6 aa, Mycobacterium
CARSGR

SEQ ID NO: 1003071 - protein, 7 aa, Mycobacterium
CARSPRH

SEQ ID NO: 1003072 - protein, 12 aa, Mycobacterium
CASGSQALQSAR

SEQ ID NO: 1003073 - protein, 6 aa, Mycobacterium
CASGSV

SEQ ID NO: 1003074 - protein, 10 aa, Mycobacterium
CASGTSAQGF

SEQ ID NO: 1003075 - protein, 7 aa, Mycobacterium
CATGATA

SEQ ID NO: 1003076 - protein, 15 aa, Mycobacterium
CATGNHGALPAPYAT

SEQ ID NO: 1003077 - protein, 5 aa, Mycobacterium
CCDGS

SEQ ID NO: 1003078 - protein, 35 aa, Mycobacterium
CCGPGPSNSPTPTPPSRPPSASAPWTAVTSKSRYL

SEQ ID NO: 1003079 - protein, 7 aa, Mycobacterium
CDAAGRD

SEQ ID NO: 1003080 - protein, 8 aa, Mycobacterium
CDAGQTRK

SEQ ID NO: 1003081 - protein, 7 aa, Mycobacterium
CDDTRDS

SEQ ID NO: 1003082 - protein, 7 aa, Mycobacterium
CDEANSA

SEQ ID NO: 1003083 - protein, 6 aa, Mycobacterium
CDETGV

SEQ ID NO: 1003084 - protein, 4 aa, Mycobacterium
CDGA

SEQ ID NO: 1003085 - protein, 8 aa, Mycobacterium
CDGGAGAN

SEQ ID NO: 1003086 - protein, 8 aa, Mycobacterium
CDGTRSSE

SEQ ID NO: 1003087 - protein, 20 aa, Mycobacterium
CDKRGAQALAPTRAAQDRFN

SEQ ID NO: 1003088 - protein, 17 aa, Mycobacterium
CDPDGRSTTRPSASSRA

SEQ ID NO: 1003089 - protein, 8 aa, Mycobacterium
CDRSSGQL

SEQ ID NO: 1003090 - protein, 23 aa, Mycobacterium
CDSRGTDHRRDPARQRGARRPVV

SEQ ID NO: 1003091 - protein, 19 aa, Mycobacterium
CDTGSPASPDYGPTGNAFS

SEQ ID NO: 1003092 - protein, 8 aa, Mycobacterium
CDTTTTTG

SEQ ID NO: 1003093 - protein, 13 aa, Mycobacterium
CDVQGGRAGQSAN

SEQ ID NO: 1003094 - protein, 13 aa, Mycobacterium
CEANSAGPTGGPV

SEQ ID NO: 1003095 - protein, 12 aa, Mycobacterium
CEEAGRDPSTLE

SEQ ID NO: 1003096 - protein, 4 aa, Mycobacterium
CEEL

SEQ ID NO: 1003097 - protein, 7 aa, Mycobacterium
CEETGQH

SEQ ID NO: 1003098 - protein, 7 aa, Mycobacterium
CEGGDLD

SEQ ID NO: 1003099 - protein, 4 aa, Mycobacterium
CEGP

SEQ ID NO: 1003100 - protein, 8 aa, Mycobacterium
CEKGGATF

SEQ ID NO: 1003101 - protein, 5 aa, Mycobacterium
CEPSR

SEQ ID NO: 1003102 - protein, 14 aa, Mycobacterium
CEQRSRAGLDDAEY

SEQ ID NO: 1003103 - protein, 10 aa, Mycobacterium
CERPTDPVAE

SEQ ID NO: 1003104 - protein, 10 aa, Mycobacterium
CERRDPKGLY

SEQ ID NO: 1003105 - protein, 6 aa, Mycobacterium
CESGGN

SEQ ID NO: 1003106 - protein, 5 aa, Mycobacterium
CESGT

SEQ ID NO: 1003107 - protein, 11 aa, Mycobacterium
CFGGSTALSGG

SEQ ID NO: 1003108 - protein, 7 aa, Mycobacterium
CFPPPPG

SEQ ID NO: 1003109 - protein, 36 aa, Mycobacterium
CGAAGAAEAAVAAGAAGSSGAAGVSGAAGEAGSCGD

SEQ ID NO: 1003110 - protein, 9 aa, Mycobacterium
CGAASKRPR

SEQ ID NO: 1003111 - protein, 10 aa, Mycobacterium
CGAGSDCGRC

SEQ ID NO: 1003112 - protein, 20 aa, Mycobacterium
CGAHSDTPAPAGTGSPMYEP

SEQ ID NO: 1003113 - protein, 7 aa, Mycobacterium
CGATGDR

SEQ ID NO: 1003114 - protein, 8 aa, Mycobacterium
CGDDPVRE

SEQ ID NO: 1003115 - protein, 6 aa, Mycobacterium
CGDQGD

SEQ ID NO: 1003116 - protein, 5 aa, Mycobacterium
CGEAE

SEQ ID NO: 1003117 - protein, 4 aa, Mycobacterium
CGGA

SEQ ID NO: 1003118 - protein, 11 aa, Mycobacterium
CGGDAGNAAPI

SEQ ID NO: 1003119 - protein, 10 aa, Mycobacterium
CGGESEDEFE

SEQ ID NO: 1003120 - protein, 14 aa, Mycobacterium
CGGPPIAAATRDQL

SEQ ID NO: 1003121 - protein, 6 aa, Mycobacterium
CGGPTK

SEQ ID NO: 1003122 - protein, 9 aa, Mycobacterium
CGGRGEVQT

SEQ ID NO: 1003123 - protein, 5 aa, Mycobacterium
CGHKA

SEQ ID NO: 1003124 - protein, 16 aa, Mycobacterium
CGKDAPAGEPLPTSSN

SEQ ID NO: 1003125 - protein, 7 aa, Mycobacterium
CGNEEAN

SEQ ID NO: 1003126 - protein, 15 aa, Mycobacterium
CGPDSRFARVTRLAG

SEQ ID NO: 1003127 - protein, 6 aa, Mycobacterium
CGPGRL

SEQ ID NO: 1003128 - protein, 14 aa, Mycobacterium
CGQQRTVAGYRVAS

SEQ ID NO: 1003129 - protein, 9 aa, Mycobacterium
CGRGTDELE

SEQ ID NO: 1003130 - protein, 15 aa, Mycobacterium
CGSAGGDAHAGHTET

SEQ ID NO: 1003131 - protein, 4 aa, Mycobacterium
CGSG

SEQ ID NO: 1003132 - protein, 7 aa, Mycobacterium
CGSGQQA

SEQ ID NO: 1003133 - protein, 22 aa, Mycobacterium
CGSPGRATTTGSPEPEPTPPSQ

SEQ ID NO: 1003134 - protein, 4 aa, Mycobacterium
CGSQ

SEQ ID NO: 1003135 - protein, 5 aa, Mycobacterium
CGSTG

SEQ ID NO: 1003136 - protein, 6 aa, Mycobacterium
CGTDAA

SEQ ID NO: 1003137 - protein, 10 aa, Mycobacterium
CGTDPQRVRP

SEQ ID NO: 1003138 - protein, 9 aa, Mycobacterium
CGTEPPTGF

SEQ ID NO: 1003139 - protein, 4 aa, Mycobacterium
CGTG

SEQ ID NO: 1003140 - protein, 9 aa, Mycobacterium
CGTGDPRAT

SEQ ID NO: 1003141 - protein, 7 aa, Mycobacterium
CGTPDAP

SEQ ID NO: 1003142 - protein, 20 aa, Mycobacterium
CHETPDESGQFSGHLNKGEL

SEQ ID NO: 1003143 - protein, 5 aa, Mycobacterium
CHGGP

SEQ ID NO: 1003144 - protein, 9 aa, Mycobacterium
CKPGDGLGI

SEQ ID NO: 1003145 - protein, 5 aa, Mycobacterium
CLDDP

SEQ ID NO: 1003146 - protein, 4 aa, Mycobacterium
CLPR

SEQ ID NO: 1003147 - protein, 16 aa, Mycobacterium
CMGDQGDHRIGQRGRR

SEQ ID NO: 1003148 - protein, 14 aa, Mycobacterium
CNAAAKPAHPSDDE

SEQ ID NO: 1003149 - protein, 39 aa, Mycobacterium
CNASATNRNSRGPSPSANKPRSSTDAPPASRHKIASGSG

SEQ ID NO: 1003150 - protein, 10 aa, Mycobacterium
CNDQGDPPYR

SEQ ID NO: 1003151 - protein, 31 aa, Mycobacterium
CNPDDETPRVKGEPTDEVTDKDLRSPAQRRH

SEQ ID NO: 1003152 - protein, 31 aa, Mycobacterium; identical to SEQ ID NO: 897843

SEQ ID NO: 1003153 - protein, 7 aa, Mycobacterium
CNPKSDI

SEQ ID NO: 1003154 - protein, 6 aa, Mycobacterium
CNPSRP

SEQ ID NO: 1003155 - protein, 9 aa, Mycobacterium
CNRRGPDAG

SEQ ID NO: 1003156 - protein, 5 aa, Mycobacterium
CNTAR

SEQ ID NO: 1003157 - protein, 12 aa, Mycobacterium
CPAGARPDEPYR

SEQ ID NO: 1003158 - protein, 4 aa, Mycobacterium
CPAT

SEQ ID NO: 1003159 - protein, 8 aa, Mycobacterium
CPDRTAGT

SEQ ID NO: 1003160 - protein, 15 aa, Mycobacterium
CPGGESVQQVTERAD

SEQ ID NO: 1003161 - protein, 14 aa, Mycobacterium
CPGGTGAAKFGGNY

SEQ ID NO: 1003162 - protein, 6 aa, Mycobacterium
CPGPEA

SEQ ID NO: 1003163 - protein, 5 aa, Mycobacterium
CPGQS

SEQ ID NO: 1003164 - protein, 5 aa, Mycobacterium
CPKDK

SEQ ID NO: 1003165 - protein, 5 aa, Mycobacterium
CPLND

SEQ ID NO: 1003166 - protein, 18 aa, Mycobacterium
CPNHGGDGTGDNTGSKNT

SEQ ID NO: 1003167 - protein, 9 aa, Mycobacterium
CPPDEVDPN

SEQ ID NO: 1003168 - protein, 12 aa, Mycobacterium
CPPDGASNRSPI

SEQ ID NO: 1003169 - protein, 4 aa, Mycobacterium
CPPE

SEQ ID NO: 1003170 - protein, 8 aa, Mycobacterium
CPPPEEPV

SEQ ID NO: 1003171 - protein, 5 aa, Mycobacterium
CPPRP

SEQ ID NO: 1003172 - protein, 4 aa, Mycobacterium
CPTK

SEQ ID NO: 1003173 - protein, 9 aa, Mycobacterium
CPVPAPETY

SEQ ID NO: 1003174 - protein, 8 aa, Mycobacterium
CQAASGSA

SEQ ID NO: 1003175 - protein, 11 aa, Mycobacterium
CQGEKAPEGLR

SEQ ID NO: 1003176 - protein, 9 aa, Mycobacterium
CQGEVGSAA

SEQ ID NO: 1003177 - protein, 9 aa, Mycobacterium
CQGRQVDDD

SEQ ID NO: 1003178 - protein, 4 aa, Mycobacterium
CQPP

SEQ ID NO: 1003179 - protein, 8 aa, Mycobacterium
CQPSAPGV

SEQ ID NO: 1003180 - protein, 6 aa, Mycobacterium
CQRSQD

SEQ ID NO: 1003181 - protein, 4 aa, Mycobacterium
CQTE

SEQ ID NO: 1003182 - protein, 11 aa, Mycobacterium
CQTRTVSDRSG

SEQ ID NO: 1003183 - protein, 7 aa, Mycobacterium
CQTSDPD

SEQ ID NO: 1003184 - protein, 6 aa, Mycobacterium
CRATEV

SEQ ID NO: 1003185 - protein, 7 aa, Mycobacterium
CRDRPQV

SEQ ID NO: 1003186 - protein, 5 aa, Mycobacterium
CRGKG

SEQ ID NO: 1003187 - protein, 28 aa, Mycobacterium
CRGQANGTSVNDGPSRDHGGSATAISTE

SEQ ID NO: 1003188 - protein, 18 aa, Mycobacterium
CRGSTGPSSLARDGKPWG

SEQ ID NO: 1003189 - protein, 18 aa, Mycobacterium
CRNNGHATAAPVAPLPSR

SEQ ID NO: 1003190 - protein, 12 aa, Mycobacterium
CRPDASPGSPEW

SEQ ID NO: 1003191 - protein, 8 aa, Mycobacterium
CRPESGTD

SEQ ID NO: 1003192 - protein, 7 aa, Mycobacterium
CRPQGDQ

SEQ ID NO: 1003193 - protein, 11 aa, Mycobacterium
CRPSSTPHNTT

SEQ ID NO: 1003194 - protein, 6 aa, Mycobacterium
CRRERR

SEQ ID NO: 1003195 - protein, 5 aa, Mycobacterium
CRRGD

SEQ ID NO: 1003196 - protein, 8 aa, Mycobacterium
CRSGGRIK

SEQ ID NO: 1003197 - protein, 9 aa, Mycobacterium
CRSTDPRKS

SEQ ID NO: 1003198 - protein, 18 aa, Mycobacterium
CSAAPRPAPRPSALSPTS

SEQ ID NO: 1003199 - protein, 4 aa, Mycobacterium
CSAN

SEQ ID NO: 1003200 - protein, 8 aa, Mycobacterium
CSAPDTGN
